United States Patent 11,332,783 (SAMPLE ANALYSIS, PRESENCE DETERMINATION OF A TARGET SEQUENCE) - sequence listing, part 12

SEQ ID NO: 232214 - DNA, 75 bp, Artificial Sequence
  Synthetic
tagtaataattggctttagtgttcttattattctgggtgccctaatttatctttgttggcatcgcaggtttcttt

SEQ ID NO: 232215 - DNA, 75 bp, Artificial Sequence
  Synthetic
tattattctgggtgccctaatttatctttgttggcatcgcaggtttctttatagatctaaatcagaaccttgtgt

SEQ ID NO: 232216 - DNA, 75 bp, Artificial Sequence
  Synthetic
tttgttttacagtatggtgacggttctcttcatctttttatgcctaccaattatttttgcctcttcaacttttgc

SEQ ID NO: 232217 - DNA, 75 bp, Artificial Sequence
  Synthetic
ctcttcatctttttatgcctaccaattatttttgcctcttcaacttttgcatccgtcagtcacatcaatcctgac

SEQ ID NO: 232218 - DNA, 75 bp, Artificial Sequence
  Synthetic
taatttttgcatttgtaactgctacctgcgtctgcagtcttattaccctgctaattacatccttgcaattttttg

SEQ ID NO: 232219 - DNA, 75 bp, Artificial Sequence
  Synthetic
ctgcgtctgcagtcttattaccctgctaattacatccttgcaattttttgattattactacgttcgatttgttta

SEQ ID NO: 232220 - DNA, 75 bp, Artificial Sequence
  Synthetic
aacccccaaattgcagcccttcttcagttgcaaccatgaagttaccgttagccttcctttttttctttgtgccaa

SEQ ID NO: 232221 - DNA, 75 bp, Artificial Sequence
  Synthetic
agttgcaaccatgaagttaccgttagccttcctttttttctttgtgccaattagggcaacaccttgtgaattgca

SEQ ID NO: 232222 - DNA, 75 bp, Artificial Sequence
  Synthetic
tacaccaaagaaacaagctacataggttggatttatggaataatgactggtttggtttttatttccagtgtaata

SEQ ID NO: 232223 - DNA, 75 bp, Artificial Sequence
  Synthetic
gttggatttatggaataatgactggtttggtttttatttccagtgtaatagctttacaaatgtatccgcgccttg

SEQ ID NO: 232224 - DNA, 75 bp, Artificial Sequence
  Synthetic
tgatcttcccgaataccctaatcctcaagttaatctaccacaaaatattgtgtttccagaacccccacgtcctcc

SEQ ID NO: 232225 - DNA, 75 bp, Artificial Sequence
  Synthetic
caagttaatctaccacaaaatattgtgtttccagaacccccacgtcctccttctgttgttagttactttaaactc

SEQ ID NO: 232226 - DNA, 75 bp, Artificial Sequence
  Synthetic
ttagaagtcgatggaagaattaccgaacaaagacttctcaccaatcgcgctaggcaacggcagcaggaacaaaaa

SEQ ID NO: 232227 - DNA, 75 bp, Artificial Sequence
  Synthetic
aacaaagacttctcaccaatcgcgctaggcaacggcagcaggaacaaaaacacaaagagcttcttgatttgcaaa

SEQ ID NO: 232228 - DNA, 75 bp, Artificial Sequence
  Synthetic
tttttgtttagtaaaacaagctacactcacttatgagttattatcaggcaaagaacaccagttaagctatgtgtt

SEQ ID NO: 232229 - DNA, 75 bp, Artificial Sequence
  Synthetic
ctcacttatgagttattatcaggcaaagaacaccagttaagctatgtgttgcccattcagcgccaaacctttact

SEQ ID NO: 232230 - DNA, 75 bp, Artificial Sequence
  Synthetic
aagtgtcccaacaagcaggagagcaagaaggctttattcgttgcctgtgtgataatcctgaatgtttgtacactt

SEQ ID NO: 232231 - DNA, 75 bp, Artificial Sequence
  Synthetic
agaaggctttattcgttgcctgtgtgataatcctgaatgtttgtacactttaataaaaacactgtgcggtttaag

SEQ ID NO: 232232 - DNA, 75 bp, Artificial Sequence
  Synthetic
aatcacttaccgaaaatctgaaaatatatcgtggtctccgtgtactcttataagttttccctcttcccaactgtc

SEQ ID NO: 232233 - DNA, 75 bp, Artificial Sequence
  Synthetic
atatcgtggtctccgtgtactcttataagttttccctcttcccaactgtcatacttgacagatttacaaatagca

SEQ ID NO: 232234 - DNA, 75 bp, Artificial Sequence
  Synthetic
tatcagattcttcctcccaacccctacccaccatcttcattttttgtagatgaagcgcagcagagtccagtatgc

SEQ ID NO: 232235 - DNA, 75 bp, Artificial Sequence
  Synthetic
acccaccatcttcattttttgtagatgaagcgcagcagagtccagtatgctgaagaaactgaagaaaatgatgac

SEQ ID NO: 232236 - DNA, 75 bp, Artificial Sequence
  Synthetic
cctctgatacaacaattgtgccatttattacgcccccttttaccacttccaatggccttcaagaaaaaccaccag

SEQ ID NO: 232237 - DNA, 75 bp, Artificial Sequence
  Synthetic
tattacgcccccttttaccacttccaatggccttcaagaaaaaccaccaggagtactagcgttgagctacaaaga

SEQ ID NO: 232238 - DNA, 75 bp, Artificial Sequence
  Synthetic
cttacacttaaattaggggatggaataaaacttaatgcacagggtcaacttacagctagtaacactgctaaggta

SEQ ID NO: 232239 - DNA, 75 bp, Artificial Sequence
  Synthetic
taaaacttaatgcacagggtcaacttacagctagtaacactgctaaggtactagagccccttaccaacaccacac

SEQ ID NO: 232240 - DNA, 75 bp, Artificial Sequence
  Synthetic
ccccctcgcagtacgggcaagtgcccttacattaattacaaaagcgcctttggttacagcggatgaaagcttaag

SEQ ID NO: 232241 - DNA, 75 bp, Artificial Sequence
  Synthetic
cttacattaattacaaaagcgcctttggttacagcggatgaaagcttaagcttagtaacaacgcctcccattaca

SEQ ID NO: 232242 - DNA, 75 bp, Artificial Sequence
  Synthetic
ctaccatagcccctcttagtttagatggaggtggaaatttaggtttggatttatctgctcccctggacgttagta

SEQ ID NO: 232243 - DNA, 75 bp, Artificial Sequence
  Synthetic
tggaggtggaaatttaggtttggatttatctgctcccctggacgttagtaacaacaatttgcatctcaccactga

SEQ ID NO: 232244 - DNA, 75 bp, Artificial Sequence
  Synthetic
ggtgccctaactgttgctactacggaaccccttggtgttcgtaacaacactctcaccttatctactatggaaccc

SEQ ID NO: 232245 - DNA, 75 bp, Artificial Sequence
  Synthetic
aaccccttggtgttcgtaacaacactctcaccttatctactatggaacccttaacagtaagcgctaatgggttag

SEQ ID NO: 232246 - DNA, 75 bp, Artificial Sequence
  Synthetic
ggtggccaatggttccttagccttggccgccgctgctcctcttaacaccacaggatccaccttaggtctttctgt

SEQ ID NO: 232247 - DNA, 75 bp, Artificial Sequence
  Synthetic
gccgccgctgctcctcttaacaccacaggatccaccttaggtctttctgttacaaatcctctcactatttcagga

SEQ ID NO: 232248 - DNA, 75 bp, Artificial Sequence
  Synthetic
atggtcttcaagtatcggggtctcaattagtagcaagaataggtgatggtttaaggtttgataatggaattataa

SEQ ID NO: 232249 - DNA, 75 bp, Artificial Sequence
  Synthetic
attagtagcaagaataggtgatggtttaaggtttgataatggaattataaaggtatatgccgccgggggaatgag

SEQ ID NO: 232250 - DNA, 75 bp, Artificial Sequence
  Synthetic
gatgtcgactacccatttaatgcaaccaccaacttgtctttaagaagaggtttggggctaatttataatcagtct

SEQ ID NO: 232251 - DNA, 75 bp, Artificial Sequence
  Synthetic
ccaccaacttgtctttaagaagaggtttggggctaatttataatcagtctacaaattggaacttaacaactgata

SEQ ID NO: 232252 - DNA, 75 bp, Artificial Sequence
  Synthetic
cattggaaatcagatagctattaatgccggacagggacttacatttaataatcaacaactacaggtaaaattggg

SEQ ID NO: 232253 - DNA, 75 bp, Artificial Sequence
  Synthetic
gccggacagggacttacatttaataatcaacaactacaggtaaaattgggagctggacttacttttgactcaaac

SEQ ID NO: 232254 - DNA, 75 bp, Artificial Sequence
  Synthetic
gcggcactgcctacgaccctcttacactgtggacaactcccgaccctcttccaaattgcagtcttcttgaagact

SEQ ID NO: 232255 - DNA, 75 bp, Artificial Sequence
  Synthetic
actgtggacaactcccgaccctcttccaaattgcagtcttcttgaagacttagatacaaagctaacattgtgttt

SEQ ID NO: 232256 - DNA, 75 bp, Artificial Sequence
  Synthetic
ggcgtggtaagctttgtgcccgttaaaggtgcgctactaaatttacaaaaccctaccagcattggacttcacatt

SEQ ID NO: 232257 - DNA, 75 bp, Artificial Sequence
  Synthetic
aaggtgcgctactaaatttacaaaaccctaccagcattggacttcacattctatttgaccaacatggtgtcttac

SEQ ID NO: 232258 - DNA, 75 bp, Artificial Sequence
  Synthetic
cccacaggcgtactggggatatagacagggacaatccatatcccctactcctgttaccaacgctctgaaatttat

SEQ ID NO: 232259 - DNA, 75 bp, Artificial Sequence
  Synthetic
cagggacaatccatatcccctactcctgttaccaacgctctgaaatttatgcctaactccagtgcataccccaga

SEQ ID NO: 232260 - DNA, 75 bp, Artificial Sequence
  Synthetic
aaacgtttacttctacatatatgcaaggcgacatcgctaaacccatgacaatgaaagtctcgtttaatgccgctt

SEQ ID NO: 232261 - DNA, 75 bp, Artificial Sequence
  Synthetic
aggcgacatcgctaaacccatgacaatgaaagtctcgtttaatgccgcttctactgttactggctactctttaag

SEQ ID NO: 232262 - DNA, 75 bp, Artificial Sequence
  Synthetic
taccgtaatcaagctttttcatgcccatcatgttcattttcttacctagcccaagaataaaaaaatactcacaaa

SEQ ID NO: 232263 - DNA, 75 bp, Artificial Sequence
  Synthetic
catcatgttcattttcttacctagcccaagaataaaaaaatactcacaaagaattattatcatattgtttattct

SEQ ID NO: 232264 - DNA, 75 bp, Artificial Sequence
  Synthetic
acttccgcctccttcccattttattttatacaccaccctttccccctttatagccgaaaacagctgcatgtgcat

SEQ ID NO: 232265 - DNA, 75 bp, Artificial Sequence
  Synthetic
ttatacaccaccctttccccctttatagccgaaaacagctgcatgtgcatgtttctacttaggttcttaggtgtc

SEQ ID NO: 232266 - DNA, 75 bp, Artificial Sequence
  Synthetic
caaagcgatgatcaatgatagaaacaaacccctcgcccacacagtcacttaggtaactttccccatccagtacca

SEQ ID NO: 232267 - DNA, 75 bp, Artificial Sequence
  Synthetic
aaacccctcgcccacacagtcacttaggtaactttccccatccagtaccaggtccatgttgacttcctacagaaa

SEQ ID NO: 232268 - DNA, 75 bp, Artificial Sequence
  Synthetic
agcccaaggattttcacgttgtccatattcttcaaacagcacaggtcggtggtgcataataataccctttagtaa

SEQ ID NO: 232269 - DNA, 75 bp, Artificial Sequence
  Synthetic
tattcttcaaacagcacaggtcggtggtgcataataataccctttagtaatcgctgacgctgaatttctactcgg

SEQ ID NO: 232270 - DNA, 75 bp, Artificial Sequence
  Synthetic
ttttcataatgatttgtaaagcttttatcattaataaacgggtgcgacgagcacagcagcgcacacgtatctcac

SEQ ID NO: 232271 - DNA, 75 bp, Artificial Sequence
  Synthetic
taataccagcatgttatttaaaaatccatagctaaatgcactgcatccaaaactcattttttctaacaccaatcc

SEQ ID NO: 232272 - DNA, 75 bp, Artificial Sequence
  Synthetic
ccatagctaaatgcactgcatccaaaactcattttttctaacaccaatccgacatgaccatcatacattatttta

SEQ ID NO: 232273 - DNA, 75 bp, Artificial Sequence
  Synthetic
cattttaaaccaccatgctaacaaagaaccggctgccttacactgtaatgaacctgggcgattacagtgacaatg

SEQ ID NO: 232274 - DNA, 75 bp, Artificial Sequence
  Synthetic
aataattgggttctctctacatctatggttgcacagcatatacacacgctcatgtacttctttaatataaacatt

SEQ ID NO: 232275 - DNA, 75 bp, Artificial Sequence
  Synthetic
atggcactggtagctcttgtaatacagtaaagcatacagatgaaggaatgccccttacctcactaacattatgta

SEQ ID NO: 232276 - DNA, 75 bp, Artificial Sequence
  Synthetic
ccccttacctcactaacattatgtaaggttaaactgttacactcagaaactgaagaattctcaggtccaaacaaa

SEQ ID NO: 232277 - DNA, 75 bp, Artificial Sequence
  Synthetic
gtggtaacgggtacttcccgtacggtgccaatctgtacggataccgtctgttgcgctgcattatacagcaaagac

SEQ ID NO: 232278 - DNA, 75 bp, Artificial Sequence
  Synthetic
tgccaatctgtacggataccgtctgttgcgctgcattatacagcaaagacttccgcgccttctcgtactttaaat

SEQ ID NO: 232279 - DNA, 75 bp, Artificial Sequence
  Synthetic
agcagcgcctcgtcttctttgtctgcgacgattttgctccgtagtaagggcgtaatataaccactctcgcaaaca

SEQ ID NO: 232280 - DNA, 75 bp, Artificial Sequence
  Synthetic
gttatcattaggcgatgtcctttaatgcgtagcagagtatccacacaggtcgcatgggctaaaccaagccatgct

SEQ ID NO: 232281 - DNA, 75 bp, Artificial Sequence
  Synthetic
gaaactcttctatcatcaaactgcctgactgaaccattcccaggtaattttcattcttccattgttgtattatgt

SEQ ID NO: 232282 - DNA, 75 bp, Artificial Sequence
  Synthetic
tccgtaaacactccggaaacaacacagagtaatgaacaagctgcctctgaaacatgctttaggttagcctgaaaa

SEQ ID NO: 232283 - DNA, 75 bp, Artificial Sequence
  Synthetic
agagtaatgaacaagctgcctctgaaacatgctttaggttagcctgaaaaataaaaatatgttaaagtaaagatg

SEQ ID NO: 232284 - DNA, 75 bp, Artificial Sequence
  Synthetic
ggataaagcgtttcagcgccaacaaaaacccctctggcgttcatgtcgctcaatgaaaataatgttcccaaatat

SEQ ID NO: 232285 - DNA, 75 bp, Artificial Sequence
  Synthetic
gcaaatataaaagcacaactccatgcggaggtataacaaaattcgcaggagaaaataacacataagcgttagaat

SEQ ID NO: 232286 - DNA, 75 bp, Artificial Sequence
  Synthetic
cggaggtataacaaaattcgcaggagaaaataacacataagcgttagaataaccttcttgttcaggcaacatagc

SEQ ID NO: 232287 - DNA, 75 bp, Artificial Sequence
  Synthetic
agagcctgtaaagcagccataatgccttaccagaaaaaacagtacaaatcccaggcacagcgaacacaatctgcc

SEQ ID NO: 232288 - DNA, 75 bp, Artificial Sequence
  Synthetic
aaatagtgacgtaaatgaccaaagttcacctacacaacacaaaaaacccccaaaagcccgcgaaaaaatacactt

SEQ ID NO: 232289 - DNA, 75 bp, Artificial Sequence
  Synthetic
ccaatcaaagtacatcgccacacccacttcattttaatattggctctagtccagtataaggtatatatttagata

SEQ ID NO: 232290 - DNA, 75 bp, Artificial Sequence
  Synthetic
taaagacttttttgtttttaggtcctgtttctgacaacgaaccggaaccggacagcactacggatgacaatgaga

SEQ ID NO: 232291 - DNA, 75 bp, Artificial Sequence
  Synthetic
atctacaaagcggtggtaagctcctgtattaatggtgtaactgcagttggtcattactgaccaattaacagtgtg

SEQ ID NO: 232292 - DNA, 75 bp, Artificial Sequence
  Synthetic
aggctgaggaaatgagagactgtagattcagggccggtcgcgagctgcgttgcggacttaatcgcgagcgactgc

SEQ ID NO: 232293 - DNA, 75 bp, Artificial Sequence
  Synthetic
agtggctgcggtcaattattccatgttaagtttgggaaagttctatgctcgcaagatatacaaaagtccatatgt

SEQ ID NO: 232294 - DNA, 75 bp, Artificial Sequence
  Synthetic
ttaagtttgggaaagttctatgctcgcaagatatacaaaagtccatatgttcccattgacaaggaagtaaagata

SEQ ID NO: 232295 - DNA, 75 bp, Artificial Sequence
  Synthetic
ctaacgggagccggaacagaggacgagtcctttttcgatatgggcgcagatctaaagtggcagccaagcgcccgc

SEQ ID NO: 232296 - DNA, 75 bp, Artificial Sequence
  Synthetic
tctaaagtggcagccaagcgcccgcgccctggaggcggctggccaggataatgatgatgatgatgacgaagacca

SEQ ID NO: 232297 - DNA, 75 bp, Artificial Sequence
  Synthetic
aaacatagtgttaactcccgtctgtatacgcctctatgttagcgccagaggaccaacgctcgaattgcagttatt

SEQ ID NO: 232298 - DNA, 75 bp, Artificial Sequence
  Synthetic
atggctagctcttactttgatattagaggggtgctggatcgcggtcccagttttaagccttattcgggtaccgcc

SEQ ID NO: 232299 - DNA, 75 bp, Artificial Sequence
  Synthetic
aaccgtggaattccagcataacaactcagggtttgtgggatacctgggtcctactatgcgcgagggacaagctta

SEQ ID NO: 232300 - DNA, 75 bp, Artificial Sequence
  Synthetic
ggttttgtgtctcgcgaccgcttatcatgcgctattgttaacactgccggtcgcgaaactgggggcgtacactgg

SEQ ID NO: 232301 - DNA, 75 bp, Artificial Sequence
  Synthetic
accctagaaaagtcaacacaaactgtacaaggaccgttttctgcagcgtgcggcctgttttgttgtatgttctta

SEQ ID NO: 232302 - DNA, 75 bp, Artificial Sequence
  Synthetic
ctcgagaatcgccatggttggtgggcagggctatgtttctatactgcaaacgtggatgccacttgaactctggaa

SEQ ID NO: 232303 - DNA, 75 bp, Artificial Sequence
  Synthetic
aaaacagcagcgggcgtcatcatttttaatttgaactacattacgcccccagcggttttgcactaccttggcttt

SEQ ID NO: 232304 - DNA, 75 bp, Artificial Sequence
  Synthetic
tttctttggaggcaaaggcacagcctccaggtcttcttcgctttctgattccaaaaagtaccgacccatttttgg

SEQ ID NO: 232305 - DNA, 75 bp, Artificial Sequence
  Synthetic
gattgctggccattatttaatcctaggcaaagaaacacatcatggatccgcagtcaaaggaaaacttaaccgccc

SEQ ID NO: 232306 - DNA, 75 bp, Artificial Sequence
  Synthetic
gatgtcttgcttaaacatttacagcgacaaagcattatcgttcgcgacgccgtagctgaccgctctttattgcca

SEQ ID NO: 232307 - DNA, 75 bp, Artificial Sequence
  Synthetic
ccggaatgggggtgtggcaacaatgcttggaagaaactaacctcagagaactcaacaaactgcttgacagagcgt

SEQ ID NO: 232308 - DNA, 75 bp, Artificial Sequence
  Synthetic
cggattccagcggagaaggattaatggagtgtcactgtcgctgcaatttatgcactcctcaccgttctctggtgt

SEQ ID NO: 232309 - DNA, 75 bp, Artificial Sequence
  Synthetic
ccaggttattggtacgtttgaaatgcaaggaccgcactctgatagcaatctcaccacaaacctgaggctgacacc

SEQ ID NO: 232310 - DNA, 75 bp, Artificial Sequence
  Synthetic
ggcatttacctctaataccttgcttctatatagtggtcttgtggctcttactctatttctaatttctaacttgtt

SEQ ID NO: 232311 - DNA, 75 bp, Artificial Sequence
  Synthetic
tgattttcttagtaataattgcatttagcgttctcattattattgcagccctcacttacctgtgctgtcacaaac

SEQ ID NO: 232312 - DNA, 75 bp, Artificial Sequence
  Synthetic
tacttcttacctcgcttcaattttttgattactactacgtgcgatacgtttaccgcagacatcaccctcgttatc

SEQ ID NO: 232313 - DNA, 75 bp, Artificial Sequence
  Synthetic
aagcttcacaattgggcttagccactgtagcacctctaagcttagacggagggggaaaccttggtttggatcttc

SEQ ID NO: 232314 - DNA, 75 bp, Artificial Sequence
  Synthetic
caactcgctaaccctatctgcttcagatccgttaactgtaaattccaatagtttaggattaaatattaccagtcc

SEQ ID NO: 232315 - DNA, 75 bp, Artificial Sequence
  Synthetic
gatggtttacgatttgataatggggttataaaagcatatgttgccgggggaatgagactctcagggggtaaaata

SEQ ID NO: 232316 - DNA, 75 bp, Artificial Sequence
  Synthetic
ttataaaagcatatgttgccgggggaatgagactctcagggggtaaaataattttagatgttaattatccctttg

SEQ ID NO: 232317 - DNA, 75 bp, Artificial Sequence
  Synthetic
aacgtttagtgggaaccaaatagctatcaacgcaggtccaggtctcacgtttaataaccgcaagcttcaggtaaa

SEQ ID NO: 232318 - DNA, 75 bp, Artificial Sequence
  Synthetic
cctatctaaatatataccttatactggactagagccaatattaaaatgaagtgggtggagagtgtaatttgattg

SEQ ID NO: 232319 - DNA, 75 bp, Artificial Sequence
  Synthetic
ggactagagccaatattaaaatgaagtgggtggagagtgtaatttgattggttgtaggtgtggctttgggtgtgc

SEQ ID NO: 232320 - DNA, 75 bp, Artificial Sequence
  Synthetic
gtgggtggagagtgtaatttgattggttgtaggtgtggctttgggtgtgcttgtaagtttgggcggaagccggaa

SEQ ID NO: 232321 - DNA, 75 bp, Artificial Sequence
  Synthetic
gcgccggatgtggcgttttcggcgccatttttatgcggaaatgatgttttttgggcgttgtttgtgaaaattgtc

SEQ ID NO: 232322 - DNA, 75 bp, Artificial Sequence
  Synthetic
catttttatgcggaaatgatgttttttgggcgttgtttgtgaaaattgtctgtttttggcgcgaaaactaaaata

SEQ ID NO: 232323 - DNA, 75 bp, Artificial Sequence
  Synthetic
ttttattataggcgcggaatatttaccgagggcagagtgaactctgagcctctacgtgtcggtttcggtacgtga

SEQ ID NO: 232324 - DNA, 75 bp, Artificial Sequence
  Synthetic
ccgagggcagagtgaactctgagcctctacgtgtcggtttcggtacgtgagcgttcgggaaactccacgttggcg

SEQ ID NO: 232325 - DNA, 75 bp, Artificial Sequence
  Synthetic
tcgctgggtatttaattccgccgcgatcgtcaagaggccactcttgagtgccagcgagaagagttttctctgcta

SEQ ID NO: 232326 - DNA, 75 bp, Artificial Sequence
  Synthetic
atcgtcaagaggccactcttgagtgccagcgagaagagttttctctgctacctccactcggcgccattatgagga

SEQ ID NO: 232327 - DNA, 75 bp, Artificial Sequence
  Synthetic
gtgtcaagaggctgatgacatattggaggacttggtggacaatttttttaacgaggtacccgacgatggggatga

SEQ ID NO: 232328 - DNA, 75 bp, Artificial Sequence
  Synthetic
gaggacttggtggacaatttttttaacgaggtacccgacgatggggatgatttctatattccttcccttcatgaa

SEQ ID NO: 232329 - DNA, 75 bp, Artificial Sequence
  Synthetic
ctggcgacgattgtgatgaacaggctgtgagtgaattttttcctgagtcgcttcttttagccgccagtgaggggc

SEQ ID NO: 232330 - DNA, 75 bp, Artificial Sequence
  Synthetic
tgtgagtgaattttttcctgagtcgcttcttttagccgccagtgaggggctgttgctcccagagcctccagtcct

SEQ ID NO: 232331 - DNA, 75 bp, Artificial Sequence
  Synthetic
ggtgaatatatgccccggctacagcctgaagatatggatttgttgtgttatgagacgggttttcctcttagtgac

SEQ ID NO: 232332 - DNA, 75 bp, Artificial Sequence
  Synthetic
ctgaagatatggatttgttgtgttatgagacgggttttcctcttagtgactctgaagatgagcaggatgtgcgcg

SEQ ID NO: 232333 - DNA, 75 bp, Artificial Sequence
  Synthetic
tatggttgctgttgctcatcatgaggagtttgagttagatcatccagaattgcctgggcacgactgtaagtcctg

SEQ ID NO: 232334 - DNA, 75 bp, Artificial Sequence
  Synthetic
gagtttgagttagatcatccagaattgcctgggcacgactgtaagtcctgtgaatatcatcggaatagtactggg

SEQ ID NO: 232335 - DNA, 75 bp, Artificial Sequence
  Synthetic
gttatctgcgagcatacagcatgtttatttacagtaagtgcctttggaacggggggtgggttagttaaaagtgca

SEQ ID NO: 232336 - DNA, 75 bp, Artificial Sequence
  Synthetic
tatttacagtaagtgcctttggaacggggggtgggttagttaaaagtgcactgaaagtaattttttttgttttac

SEQ ID NO: 232337 - DNA, 75 bp, Artificial Sequence
  Synthetic
gagtcagatgagtcccattataccatgaatagggacgagcgaccgtcgcccccaacactaggaaacgcagttcct

SEQ ID NO: 232338 - DNA, 75 bp, Artificial Sequence
  Synthetic
tgaatagggacgagcgaccgtcgcccccaacactaggaaacgcagttcctgaaggggtgttaaaacctgtaccgc

SEQ ID NO: 232339 - DNA, 75 bp, Artificial Sequence
  Synthetic
tgttgaaagcattttggatttgattcaagaggaagaaaatgaacaaacagagcctgttgatttgtcagtgaaacg

SEQ ID NO: 232340 - DNA, 75 bp, Artificial Sequence
  Synthetic
caagaggaagaaaatgaacaaacagagcctgttgatttgtcagtgaaacgccctagaagtgattagtggactttg

SEQ ID NO: 232341 - DNA, 75 bp, Artificial Sequence
  Synthetic
ggttcagccttctgagtcacgtacaataaaacagtagtttctgtcgagagtgttttattggtttcattgggcgtg

SEQ ID NO: 232342 - DNA, 75 bp, Artificial Sequence
  Synthetic
ataaaacagtagtttctgtcgagagtgttttattggtttcattgggcgtggttaacagggatataaaggtgggtt

SEQ ID NO: 232343 - DNA, 75 bp, Artificial Sequence
  Synthetic
agtaatggagttggaagctgtgctgcaaagttatcagagcattcgtcagctcttacagcatacctctagaaacac

SEQ ID NO: 232344 - DNA, 75 bp, Artificial Sequence
  Synthetic
caaagttatcagagcattcgtcagctcttacagcatacctctagaaacacctcaggtttttggagatatctgttt

SEQ ID NO: 232345 - DNA, 75 bp, Artificial Sequence
  Synthetic
atagggtaaaggaagactacaggaacgaatttgaaaacatactggctggctgtccagggcttttggcatccttag

SEQ ID NO: 232346 - DNA, 75 bp, Artificial Sequence
  Synthetic
cgaatttgaaaacatactggctggctgtccagggcttttggcatccttagatctttgtcaccactcgatttttca

SEQ ID NO: 232347 - DNA, 75 bp, Artificial Sequence
  Synthetic
attacatgacaatgcagctgtggagggcatggctcacgaggagggtttgcatttactcgctggcgcggcctttga

SEQ ID NO: 232348 - DNA, 75 bp, Artificial Sequence
  Synthetic
atttactcgctggcgcggcctttgaccatgccgcgactgccaacgttgcaggaggagccggaggagcgggaccct

SEQ ID NO: 232349 - DNA, 75 bp, Artificial Sequence
  Synthetic
acaggtgcaagaaggccatgcacttgaccctggcgaagggcccagctgtgcagctgttaacattaagcgggaaaa

SEQ ID NO: 232350 - DNA, 75 bp, Artificial Sequence
  Synthetic
gaccctggcgaagggcccagctgtgcagctgttaacattaagcgggaaaaggacagttccaaggaagcggttctt

SEQ ID NO: 232351 - DNA, 75 bp, Artificial Sequence
  Synthetic
ctcgcccgcgcctagaaactgtgtattggcaggaactgcaagatgagtttcagcaaggagatatgcatttacagt

SEQ ID NO: 232352 - DNA, 75 bp, Artificial Sequence
  Synthetic
ttggcaggaactgcaagatgagtttcagcaaggagatatgcatttacagtacaagtatagttttgagcaactaaa

SEQ ID NO: 232353 - DNA, 75 bp, Artificial Sequence
  Synthetic
gatattgaaagtgctattaaaacttttgcaaagttagctttacgccctgatcgcagctatagaattactaaaaca

SEQ ID NO: 232354 - DNA, 75 bp, Artificial Sequence
  Synthetic
ttgcaaagttagctttacgccctgatcgcagctatagaattactaaaacagtaactattgcctcatatgcttaca

SEQ ID NO: 232355 - DNA, 75 bp, Artificial Sequence
  Synthetic
ggtggatacaagtgacagggttgcttttaggtgtcgaacgcaaggcatgggtcccggggtagtggggttgggtgg

SEQ ID NO: 232356 - DNA, 75 bp, Artificial Sequence
  Synthetic
tttaggtgtcgaacgcaaggcatgggtcccggggtagtggggttgggtggtatcacgtttattaatgttagattt

SEQ ID NO: 232357 - DNA, 75 bp, Artificial Sequence
  Synthetic
tttagtaatacttgtgtggagtcttggatgaaggttgccgcaaggggctgtacgttttatggttgtaggaggggt

SEQ ID NO: 232358 - DNA, 75 bp, Artificial Sequence
  Synthetic
tgtccgatcaatctgcgcgccgttatgttacttgcgctgatggaaactgccacaccttgaaaactattcatgttg

SEQ ID NO: 232359 - DNA, 75 bp, Artificial Sequence
  Synthetic
cgctgttccatgcatttaggcttaaggcgtggcatgtttgtgccttttcaatgtaaccttagccatacaaatgta

SEQ ID NO: 232360 - DNA, 75 bp, Artificial Sequence
  Synthetic
gagtaagtttaaatggggtgtttgacctgtctatggaattgtataaggtgataagatatgatgatactcgtcacc

SEQ ID NO: 232361 - DNA, 75 bp, Artificial Sequence
  Synthetic
cctgtctatggaattgtataaggtgataagatatgatgatactcgtcaccgttgccgacagtgtgagtgtggcag

SEQ ID NO: 232362 - DNA, 75 bp, Artificial Sequence
  Synthetic
ttattgaatgtgacggaagagctgaggagtgaccaccttaccttatcttgtctgcgaactgactatgaatccagt

SEQ ID NO: 232363 - DNA, 75 bp, Artificial Sequence
  Synthetic
ggagtgaccaccttaccttatcttgtctgcgaactgactatgaatccagtgatgaagatggcaactgagggtaag

SEQ ID NO: 232364 - DNA, 75 bp, Artificial Sequence
  Synthetic
agaccgtaagggaaatttaagctattttgtcatttacagcaacatgaacggaactacccaagataacgctgtgct

SEQ ID NO: 232365 - DNA, 75 bp, Artificial Sequence
  Synthetic
tttgtcatttacagcaacatgaacggaactacccaagataacgctgtgctttttgacggaggggttttcagtcct

SEQ ID NO: 232366 - DNA, 75 bp, Artificial Sequence
  Synthetic
gggccggagtgcgtcagaatgtggtgggatctaccttggacggtcgacctgtggcgcctgcgaattcatcaacct

SEQ ID NO: 232367 - DNA, 75 bp, Artificial Sequence
  Synthetic
gggatctaccttggacggtcgacctgtggcgcctgcgaattcatcaaccttaacatatgccactgtgggaccttc

SEQ ID NO: 232368 - DNA, 75 bp, Artificial Sequence
  Synthetic
gcggcttctgcagccgcttccaccgctcgcagtatggcagccgatttcagtttctacagtcacttggcttcaaac

SEQ ID NO: 232369 - DNA, 75 bp, Artificial Sequence
  Synthetic
ctcgcagtatggcagccgatttcagtttctacagtcacttggcttcaaacgctgtaacgcgcaccgcggttcggg

SEQ ID NO: 232370 - DNA, 75 bp, Artificial Sequence
  Synthetic
taagctggagactttaaccgctcagctagaagatctatcgcagaaggttgaagaacttgctgatgcctctacccc

SEQ ID NO: 232371 - DNA, 75 bp, Artificial Sequence
  Synthetic
ctagaagatctatcgcagaaggttgaagaacttgctgatgcctctacccctaccctcccagcccaacctgtagcc

SEQ ID NO: 232372 - DNA, 75 bp, Artificial Sequence
  Synthetic
aaactgtgttagaatctttattgcttgttttttcttacatagtaggctctggtccacctttccctgtcattaata

SEQ ID NO: 232373 - DNA, 75 bp, Artificial Sequence
  Synthetic
acacgatgaatgtgctccagtattttataaagatgcgattgtatattaagatacattggcataagaccgtctttg

SEQ ID NO: 232374 - DNA, 75 bp, Artificial Sequence
  Synthetic
aagttctttagtgtaggtgtttataaggcgattgagctgggtggggtgcatgcgtggagacatgatatgcatttt

SEQ ID NO: 232375 - DNA, 75 bp, Artificial Sequence
  Synthetic
catggaagaacttagaaacagctttgtgactgcccaaattttccatgcactcgtccattattatggcaatgggcc

SEQ ID NO: 232376 - DNA, 75 bp, Artificial Sequence
  Synthetic
ttgtggtccagagttaggtcatcgtaggacagcttaacaaatttagggcgcagtgtccccgactggggtattata

SEQ ID NO: 232377 - DNA, 75 bp, Artificial Sequence
  Synthetic
ttccttcacaaatctgcatttcccaagctttaatttcagatggggggatcatatcaacctggggagcaataaaga

SEQ ID NO: 232378 - DNA, 75 bp, Artificial Sequence
  Synthetic
agctttaatttcagatggggggatcatatcaacctggggagcaataaagaaaacagtttctggagcaggtgtaac

SEQ ID NO: 232379 - DNA, 75 bp, Artificial Sequence
  Synthetic
aatagctgagatttaccacaaccagtaggtccataaataaccccaataactggttgtaagtgatagtttaacgag

SEQ ID NO: 232380 - DNA, 75 bp, Artificial Sequence
  Synthetic
taggtccataaataaccccaataactggttgtaagtgatagtttaacgaggtgcagctgccgtcttcgcgaagaa

SEQ ID NO: 232381 - DNA, 75 bp, Artificial Sequence
  Synthetic
tcggacgcatgtgttttgcttggctagttctcccaaaagacgctccccgcccagcgacagcaactcctgcaaaga

SEQ ID NO: 232382 - DNA, 75 bp, Artificial Sequence
  Synthetic
tttaaaatttttaagaggttttaagccatcagccataggcatgtgatctagggtttgctttagtagctgtagccg

SEQ ID NO: 232383 - DNA, 75 bp, Artificial Sequence
  Synthetic
ctcgttgcgggggttgggttggctgttgctgtaagggatgagtcgatgagcgtccagatgggccagagttttgtc

SEQ ID NO: 232384 - DNA, 75 bp, Artificial Sequence
  Synthetic
agggttgtttccgttactgtaaatggatgcgctcctggttgtgcgctggccagtgtgcgctttagactcaggcgg

SEQ ID NO: 232385 - DNA, 75 bp, Artificial Sequence
  Synthetic
cctgtgcttcggcaaggtagcattttaacatgagatcataagagagagcctctgcagcatgccctttagctcgta

SEQ ID NO: 232386 - DNA, 75 bp, Artificial Sequence
  Synthetic
gccgcagaagttacaaacagtttcacattcaactgaccaggtcagctcaggacaagatggatcaaaaacaagttt

SEQ ID NO: 232387 - DNA, 75 bp, Artificial Sequence
  Synthetic
ttacctcgcgactccataaggcggcgtcctttctctgtcacaaaaaggctgtctgtgtctccgtacacggattta

SEQ ID NO: 232388 - DNA, 75 bp, Artificial Sequence
  Synthetic
gtcctttctctgtcacaaaaaggctgtctgtgtctccgtacacggatttaagaggcctgtctttcaggggtattc

SEQ ID NO: 232389 - DNA, 75 bp, Artificial Sequence
  Synthetic
gtgtgtaagcacatgtccccttcttcagcgtccagaaatgtgattggcttgtaggtataggtcacgtgacttgag

SEQ ID NO: 232390 - DNA, 75 bp, Artificial Sequence
  Synthetic
gttcaaaagcaggcatcacatctgtactcaaggtgtcagtttctataaatgatgaggatttgatgtttaaacgtc

SEQ ID NO: 232391 - DNA, 75 bp, Artificial Sequence
  Synthetic
gttcctttgcggcaatattaagttgcacatattcacgcgccagacatttccaggtaggaaagatggtggtgcgct

SEQ ID NO: 232392 - DNA, 75 bp, Artificial Sequence
  Synthetic
cacatattcacgcgccagacatttccaggtaggaaagatggtggtgcgctcgtcaggtaggaggcgcaatcgcca

SEQ ID NO: 232393 - DNA, 75 bp, Artificial Sequence
  Synthetic
tctacactagtaatcacttcaccccgcaagcgctcattggtccacactaggcgaccgccctttcgtgaacaaaaa

SEQ ID NO: 232394 - DNA, 75 bp, Artificial Sequence
  Synthetic
ggtgggagaacatccagctgattttcatccggaggatcagcatctacagtaaaaatgcctggacagagattttta

SEQ ID NO: 232395 - DNA, 75 bp, Artificial Sequence
  Synthetic
atgggttctttcaatactcctatgtaggtaggatagcacctgccgccgcggatgctggcgcgaacgtagtcatat

SEQ ID NO: 232396 - DNA, 75 bp, Artificial Sequence
  Synthetic
gatgctggcgcgaacgtagtcatataattcatgtgatggcgccaggatgttgtgtccaaggtttgtgcgctgtgg

SEQ ID NO: 232397 - DNA, 75 bp, Artificial Sequence
  Synthetic
aaatggtaggtcgctgaaatacattaaagtgtgccgcatgaaggcccacggagtcagtaataaagtgggcatatg

SEQ ID NO: 232398 - DNA, 75 bp, Artificial Sequence
  Synthetic
ggctgtgacaaggacgtccagggcgcaatagtttaatgtttccttaataaggttgtaatttttttctccctttgt

SEQ ID NO: 232399 - DNA, 75 bp, Artificial Sequence
  Synthetic
caatagtttaatgtttccttaataaggttgtaatttttttctccctttgttttccatagtttttggtttaggagg

SEQ ID NO: 232400 - DNA, 75 bp, Artificial Sequence
  Synthetic
cttccaggggaaaaccatctgcatttgcacggtaagaaccaagcatataaaactcattcacagccttgtaggggc

SEQ ID NO: 232401 - DNA, 75 bp, Artificial Sequence
  Synthetic
tgcacggtaagaaccaagcatataaaactcattcacagccttgtaggggcaacatcctttttctacaggcagggc

SEQ ID NO: 232402 - DNA, 75 bp, Artificial Sequence
  Synthetic
gatgtatgagtaagagcaaaggtgtctctgaccattactttaaaatactgatatttaaagtcttggtcgttacac

SEQ ID NO: 232403 - DNA, 75 bp, Artificial Sequence
  Synthetic
ctctgaccattactttaaaatactgatatttaaagtcttggtcgttacaccctccttgttcccacagtgaaaagt

SEQ ID NO: 232404 - DNA, 75 bp, Artificial Sequence
  Synthetic
catcaaatccattaatgttgtgtcctactatgtataactccacaaaccttggctgacccttgattgcaggggctt

SEQ ID NO: 232405 - DNA, 75 bp, Artificial Sequence
  Synthetic
tactatgtataactccacaaaccttggctgacccttgattgcaggggcttttttaagatcttcgtaggcaaggtc

SEQ ID NO: 232406 - DNA, 75 bp, Artificial Sequence
  Synthetic
tgttgagcccattgaggcaagtgtggatttttttgtaaaaaagatgtccaaagatcactggctaaggaggtttgc

SEQ ID NO: 232407 - DNA, 75 bp, Artificial Sequence
  Synthetic
gatttttttgtaaaaaagatgtccaaagatcactggctaaggaggtttgcaagcggtgtctgtaggttcgaaact

SEQ ID NO: 232408 - DNA, 75 bp, Artificial Sequence
  Synthetic
ggttatgcaatgaaaagtagtggggtctttttcccactggttccatccaagttccaaggcaagttgtaacccccg

SEQ ID NO: 232409 - DNA, 75 bp, Artificial Sequence
  Synthetic
tctttttcccactggttccatccaagttccaaggcaagttgtaacccccgatttacaagacggccatccccagat

SEQ ID NO: 232410 - DNA, 75 bp, Artificial Sequence
  Synthetic
gcgacctcgcgccagaaagcagatgggaaaatcgatgccttcttttggcggttgccgttcgtcctctttctcttc

SEQ ID NO: 232411 - DNA, 75 bp, Artificial Sequence
  Synthetic
ggaaaatcgatgccttcttttggcggttgccgttcgtcctctttctcttcttctgcattgccactaccgcttgga

SEQ ID NO: 232412 - DNA, 75 bp, Artificial Sequence
  Synthetic
taacggtgccccgagagccgcacgtccagatctcagcacgagtggggcggagacgggaaatcagggcgcgcagct

SEQ ID NO: 232413 - DNA, 75 bp, Artificial Sequence
  Synthetic
ccagatctcagcacgagtggggcggagacgggaaatcagggcgcgcagcttggtgctgtccatggtatcgccaag

SEQ ID NO: 232414 - DNA, 75 bp, Artificial Sequence
  Synthetic
gctttcaagttaacttcgcacaggcgggtaagagcaggctgaaggtgtaggtgatacttgatttctaggggagtg

SEQ ID NO: 232415 - DNA, 75 bp, Artificial Sequence
  Synthetic
gggtaagagcaggctgaaggtgtaggtgatacttgatttctaggggagtgccggtggcagaattaattgcatgca

SEQ ID NO: 232416 - DNA, 75 bp, Artificial Sequence
  Synthetic
cactgttccacggtgaactttttctatgggtttgtttaaaatcggcggcgtggccgtgctcccggaggaagaggt

SEQ ID NO: 232417 - DNA, 75 bp, Artificial Sequence
  Synthetic
gaaggggtacgtcggcttgtcgctctggcaggggaaggtgctgagcgcgaagttgactggcacgggcaactaccc

SEQ ID NO: 232418 - DNA, 75 bp, Artificial Sequence
  Synthetic
aatttcttcgtcctggaggtcgccatgacccgcccgttcaatggtggcggcaagatcgttagatatgcgacccat

SEQ ID NO: 232419 - DNA, 75 bp, Artificial Sequence
  Synthetic
atttcgttccagacgcggctgtacactacccctccctcgctgtctcgggcgcgcatcaccacttgtgccaggttt

SEQ ID NO: 232420 - DNA, 75 bp, Artificial Sequence
  Synthetic
ctacccctccctcgctgtctcgggcgcgcatcaccacttgtgccaggtttagttctacaagccgtgcaaacacgc

SEQ ID NO: 232421 - DNA, 75 bp, Artificial Sequence
  Synthetic
gtagttcaaggtggtggcgatgtgttccgaaacgaagaaataaagaatccagcggcgcagcgtcagctcattgat

SEQ ID NO: 232422 - DNA, 75 bp, Artificial Sequence
  Synthetic
tccgaaacgaagaaataaagaatccagcggcgcagcgtcagctcattgatgtctcctaaggcttcaagacggtcc

SEQ ID NO: 232423 - DNA, 75 bp, Artificial Sequence
  Synthetic
agctgaaaaactgggagttgcgagccgccaccgttaactcctgttccagaagacgaatgagctcagctactgttt

SEQ ID NO: 232424 - DNA, 75 bp, Artificial Sequence
  Synthetic
cgccaccgttaactcctgttccagaagacgaatgagctcagctactgtttcgcgaacttcccgctcaaaggcccc

SEQ ID NO: 232425 - DNA, 75 bp, Artificial Sequence
  Synthetic
atttccattatttcttcttcttcgggcggcggtgggggcgcacgtctccgccggcgacgtattggcaaccggtcc

SEQ ID NO: 232426 - DNA, 75 bp, Artificial Sequence
  Synthetic
gcggcggtgggggcgcacgtctccgccggcgacgtattggcaaccggtccacaaatctctcaatgatttcaccgc

SEQ ID NO: 232427 - DNA, 75 bp, Artificial Sequence
  Synthetic
agctcgaccgttttcgcgggggcgtaactcgaatactccacctctaagtcctgttccactcaaattgggaatgaa

SEQ ID NO: 232428 - DNA, 75 bp, Artificial Sequence
  Synthetic
agcattggaaggggtgttgggtagcgacacagcacttactatgcattttattatttgttgcgtaggaactccgcg

SEQ ID NO: 232429 - DNA, 75 bp, Artificial Sequence
  Synthetic
aggcatctagccaatcgcagtcacaaggtaggctgagttttgtttgactcaaagaatcagaatggtctccaatgc

SEQ ID NO: 232430 - DNA, 75 bp, Artificial Sequence
  Synthetic
cgacttaagacgacggatggttgtaagaagcaccgcatctttgggaccggcttgttggatccgcagacggtcagc

SEQ ID NO: 232431 - DNA, 75 bp, Artificial Sequence
  Synthetic
agaagcaccgcatctttgggaccggcttgttggatccgcagacggtcagccattccccacacttcactctgacac

SEQ ID NO: 232432 - DNA, 75 bp, Artificial Sequence
  Synthetic
gcatcaacctctccacatctacctcacgctgtccgcggtcggccatacgcgtgcttccatatccttgtaacggtt

SEQ ID NO: 232433 - DNA, 75 bp, Artificial Sequence
  Synthetic
acgctgtccgcggtcggccatacgcgtgcttccatatccttgtaacggttgcaacaaagcgagatctgccaccac

SEQ ID NO: 232434 - DNA, 75 bp, Artificial Sequence
  Synthetic
atttgagctagggtggtggcaaagtcatccatgtccacaaaccggtgatatgctcccgtatttatagtgtagctg

SEQ ID NO: 232435 - DNA, 75 bp, Artificial Sequence
  Synthetic
catccatgtccacaaaccggtgatatgctcccgtatttatagtgtagctgcagtttgtcattaccgaccagttaa

SEQ ID NO: 232436 - DNA, 75 bp, Artificial Sequence
  Synthetic
ttctgtgtagcgtaagcgcgagtacgcacgagagtcgaacacatagtcattgcaaacacggactagatactggta

SEQ ID NO: 232437 - DNA, 75 bp, Artificial Sequence
  Synthetic
gcacgagagtcgaacacatagtcattgcaaacacggactagatactggtagcctacaagaaaatgaggaggaggt

SEQ ID NO: 232438 - DNA, 75 bp, Artificial Sequence
  Synthetic
tggccggagcgcccggagcaaggtcttctagcataaggcggtggtattcatatatgtatcgagacatccatgtga

SEQ ID NO: 232439 - DNA, 75 bp, Artificial Sequence
  Synthetic
agcaaactcgcgagctctgttccaaatgttgcgcagaggtaaaaagcgttgcattgtagccatagtttgaccggt

SEQ ID NO: 232440 - DNA, 75 bp, Artificial Sequence
  Synthetic
atgttgcgcagaggtaaaaagcgttgcattgtagccatagtttgaccggtcagacgagcgcaatcttgaatgctc

SEQ ID NO: 232441 - DNA, 75 bp, Artificial Sequence
  Synthetic
taagcgactcccttccgtggcttggtggaaaagtcacaagggtaccatagcgaggaaccccggttcgaaaccggc

SEQ ID NO: 232442 - DNA, 75 bp, Artificial Sequence
  Synthetic
agacccccagacacggagaggagtcctttttttttgatttttcttagatgcatcccgtcctgcgacaaatgcgac

SEQ ID NO: 232443 - DNA, 75 bp, Artificial Sequence
  Synthetic
ctttttttttgatttttcttagatgcatcccgtcctgcgacaaatgcgacctcagcccagggtaactacggcctc

SEQ ID NO: 232444 - DNA, 75 bp, Artificial Sequence
  Synthetic
ggcgaacaggaggagcctcagccttccacgttggagttagaagaaggagaaggcatagcccgattgggcgcccat

SEQ ID NO: 232445 - DNA, 75 bp, Artificial Sequence
  Synthetic
gtttgtgcctcgtcaaaacatgtttcgagacaacagcggggaggaagctgaggaaatgagagactgcaggttcag

SEQ ID NO: 232446 - DNA, 75 bp, Artificial Sequence
  Synthetic
tttaatcgcgagcgcctgctgcgcgaggaagactttgagccagacgagcattcgggcattagtccagcacgagcc

SEQ ID NO: 232447 - DNA, 75 bp, Artificial Sequence
  Synthetic
cagcgtatgaacaaactgttacagaggaacgtaattttcaaaaaagttttaataatcatgtgcgcacactaatag

SEQ ID NO: 232448 - DNA, 75 bp, Artificial Sequence
  Synthetic
acatagctgaaccacagggtcgttggctacttgatttaattaacattctgcagagcattgtagtgcaggaacgca

SEQ ID NO: 232449 - DNA, 75 bp, Artificial Sequence
  Synthetic
tgcggttaattactccatgttaagtctggggaagttttacgctcgcaagatctataaaagtccgtatgttcccat

SEQ ID NO: 232450 - DNA, 75 bp, Artificial Sequence
  Synthetic
ctggggaagttttacgctcgcaagatctataaaagtccgtatgttcccattgacaaggaagtaaagatagacagt

SEQ ID NO: 232451 - DNA, 75 bp, Artificial Sequence
  Synthetic
tactaacattaagcgatgatcttggagtataccgcaatgacagaatccacaaagcagtgagtgccagtcgccgca

SEQ ID NO: 232452 - DNA, 75 bp, Artificial Sequence
  Synthetic
agtataccgcaatgacagaatccacaaagcagtgagtgccagtcgccgcagggagctgagcgacaaggagcttat

SEQ ID NO: 232453 - DNA, 75 bp, Artificial Sequence
  Synthetic
ggagcaggaacagaggacgagtcgttttttgatatgggagcagacctccggtggcagccaagcgctcgcgctctg

SEQ ID NO: 232454 - DNA, 75 bp, Artificial Sequence
  Synthetic
tttttgatatgggagcagacctccggtggcagccaagcgctcgcgctctggaggcagccggagcgacatccgctg

SEQ ID NO: 232455 - DNA, 75 bp, Artificial Sequence
  Synthetic
tgaccagtacgaggactgatgggtcgtaccttttgttagatgcagcgaccggcgatcatcgcggatggggctcct

SEQ ID NO: 232456 - DNA, 75 bp, Artificial Sequence
  Synthetic
gtaccttttgttagatgcagcgaccggcgatcatcgcggatggggctcctaacctggatcccgcggtcatggcag

SEQ ID NO: 232457 - DNA, 75 bp, Artificial Sequence
  Synthetic
tacagcttcagatgactggacagcggccatggaccgtattatggctttaacagcgcgcagtcctgaggcttttcg

SEQ ID NO: 232458 - DNA, 75 bp, Artificial Sequence
  Synthetic
gccatggaccgtattatggctttaacagcgcgcagtcctgaggcttttcgccagcagccacaagccaaccgcttt

SEQ ID NO: 232459 - DNA, 75 bp, Artificial Sequence
  Synthetic
cttctcgtactaaccctacgcatgaaaaagtgttaaccattgtgaatgctttgttggatagcaaagctatccgca

SEQ ID NO: 232460 - DNA, 75 bp, Artificial Sequence
  Synthetic
aaaagtgttaaccattgtgaatgctttgttggatagcaaagctatccgcaaagatgaggcgggtttgatatacaa

SEQ ID NO: 232461 - DNA, 75 bp, Artificial Sequence
  Synthetic
tacaatagtactaatgttcaggcgaatttagaccggatggggactgatgtaaaggaggcactggcgcaaagagag

SEQ ID NO: 232462 - DNA, 75 bp, Artificial Sequence
  Synthetic
atttagaccggatggggactgatgtaaaggaggcactggcgcaaagagagcgctttcatcgcgatggtaatcttg

SEQ ID NO: 232463 - DNA, 75 bp, Artificial Sequence
  Synthetic
tttgagtactctaccagccaatgttccacgcggtcaagaggattacacaaacttcattagcgcattgcgcctaat

SEQ ID NO: 232464 - DNA, 75 bp, Artificial Sequence
  Synthetic
ccacgcggtcaagaggattacacaaacttcattagcgcattgcgcctaatggtcaccgaagttcctcagagcgaa

SEQ ID NO: 232465 - DNA, 75 bp, Artificial Sequence
  Synthetic
tttttcagacttccaggcagggtttgcaaactgttaatttaacccaggcttttaaaaatttgcaaggcttgtggg

SEQ ID NO: 232466 - DNA, 75 bp, Artificial Sequence
  Synthetic
gcaaactgttaatttaacccaggcttttaaaaatttgcaaggcttgtggggggtccgtgctcctgtgggcgaccg

SEQ ID NO: 232467 - DNA, 75 bp, Artificial Sequence
  Synthetic
ccaaactcccgcttattgctgttgctaattgcccccttcaccaacagcagtagtttaagtcgagattcatacctg

SEQ ID NO: 232468 - DNA, 75 bp, Artificial Sequence
  Synthetic
taattgcccccttcaccaacagcagtagtttaagtcgagattcatacctgggtcacttagttactttgtaccgcg

SEQ ID NO: 232469 - DNA, 75 bp, Artificial Sequence
  Synthetic
tgaacagacttatcaagaaataaccagtgttagccgagcgctgggccaggaagatactggcagtttggaggcaac

SEQ ID NO: 232470 - DNA, 75 bp, Artificial Sequence
  Synthetic
agtgttagccgagcgctgggccaggaagatactggcagtttggaggcaacactaaactttctcctaaccaaccgc

SEQ ID NO: 232471 - DNA, 75 bp, Artificial Sequence
  Synthetic
gtttgaatgcagaagaagagcgcatattacgctatgtacagcagtcggtaagcttgtatcttatgcgagagggcg

SEQ ID NO: 232472 - DNA, 75 bp, Artificial Sequence
  Synthetic
attacgctatgtacagcagtcggtaagcttgtatcttatgcgagagggcgccacgcccagcgctgctttagatat

SEQ ID NO: 232473 - DNA, 75 bp, Artificial Sequence
  Synthetic
ttctatgcttccaatcgagcattcattaatcgccttatggattaccttcaccgagcggcggccgtgaacggggag

SEQ ID NO: 232474 - DNA, 75 bp, Artificial Sequence
  Synthetic
ttaatcgccttatggattaccttcaccgagcggcggccgtgaacggggagtacttcaccaatgctattctaaatc

SEQ ID NO: 232475 - DNA, 75 bp, Artificial Sequence
  Synthetic
ttacactggcgagtttgatctaccagaaggaaatgatggctttttgtgggatgatgttacagacagtttgtttag

SEQ ID NO: 232476 - DNA, 75 bp, Artificial Sequence
  Synthetic
gaaggaaatgatggctttttgtgggatgatgttacagacagtttgtttagtcccgcagctattggtcatcatggc

SEQ ID NO: 232477 - DNA, 75 bp, Artificial Sequence
  Synthetic
cgctacttggttctcgctcaagttctccatttcctagcttaacaagtattaacagcggacgggacacccgaccgc

SEQ ID NO: 232478 - DNA, 75 bp, Artificial Sequence
  Synthetic
tccatttcctagcttaacaagtattaacagcggacgggacacccgaccgcgactgataggggaaagtgagtacct

SEQ ID NO: 232479 - DNA, 75 bp, Artificial Sequence
  Synthetic
cgggacaaaaactttcctaacaacggtatagagagtctggtagacaaaatgtcccgttggaaaacatacgcgcag

SEQ ID NO: 232480 - DNA, 75 bp, Artificial Sequence
  Synthetic
gtatagagagtctggtagacaaaatgtcccgttggaaaacatacgcgcaggaacgccgagaatgggaggagagac

SEQ ID NO: 232481 - DNA, 75 bp, Artificial Sequence
  Synthetic
gcaacggtggcagcgccgcagaaaagggacatatgcaatggaacaaggaagcgacgattcggccgacgatagtag

SEQ ID NO: 232482 - DNA, 75 bp, Artificial Sequence
  Synthetic
gggacatatgcaatggaacaaggaagcgacgattcggccgacgatagtagtgtgttggatttaggtggtacaggg

SEQ ID NO: 232483 - DNA, 75 bp, Artificial Sequence
  Synthetic
agggccacataggtcctttgtactaaaaaatatacatataaaaaaagcatacttactaaggccatggcgaccagc

SEQ ID NO: 232484 - DNA, 75 bp, Artificial Sequence
  Synthetic
aaaaatatacatataaaaaaagcatacttactaaggccatggcgaccagcgttcgtcttattgtcttcttccgtt

SEQ ID NO: 232485 - DNA, 75 bp, Artificial Sequence
  Synthetic
ctccagccagtggctttcgctgaggcaccacctccctcttatgaaaccgtgatggcagcagcagcagcccagcct

SEQ ID NO: 232486 - DNA, 75 bp, Artificial Sequence
  Synthetic
gatggcagcagcagcagcccagccttctacactggaagcaccctacgtgcctccccgctacttgggtcctacgga

SEQ ID NO: 232487 - DNA, 75 bp, Artificial Sequence
  Synthetic
taactactgtggtgcagaataacgactacccccctattgaggctggcacgcaaactattaactttgatgagcggt

SEQ ID NO: 232488 - DNA, 75 bp, Artificial Sequence
  Synthetic
aatactgcataccaacatgccaaatataaacgatttcatgtttacaaccaaatttagagctaaggttatggtcgc

SEQ ID NO: 232489 - DNA, 75 bp, Artificial Sequence
  Synthetic
ataaacgatttcatgtttacaaccaaatttagagctaaggttatggtcgctagggaaaaaaatgaagaagatccg

SEQ ID NO: 232490 - DNA, 75 bp, Artificial Sequence
  Synthetic
ggacagaatttgtgttgcctgagggtaactattctgaaaccatgaccattgatttaatgaataatgccattattg

SEQ ID NO: 232491 - DNA, 75 bp, Artificial Sequence
  Synthetic
taactattctgaaaccatgaccattgatttaatgaataatgccattattgagcactatttgctagtaggaagaca

SEQ ID NO: 232492 - DNA, 75 bp, Artificial Sequence
  Synthetic
ggagttaagtttgacacaagaaacttccgccttgggtgggaccccgagactaaactcattatgccgggtgtttac

SEQ ID NO: 232493 - DNA, 75 bp, Artificial Sequence
  Synthetic
tccgccttgggtgggaccccgagactaaactcattatgccgggtgtttacacaaatgaggcgtttcacccagaca

SEQ ID NO: 232494 - DNA, 75 bp, Artificial Sequence
  Synthetic
tgactttacagagagtagattaagcaacgtccttggcatcaggaagcgtcaacctttccaggaaggatttattat

SEQ ID NO: 232495 - DNA, 75 bp, Artificial Sequence
  Synthetic
aacattccggccctcctggatgtaaaaaagtacgaagacagcctgaagaatgagagcgtcgtaagaggagacaat

SEQ ID NO: 232496 - DNA, 75 bp, Artificial Sequence
  Synthetic
caattgaaccagtggcagcggatcccaaagggcgcagttacaacttgcttccagacaaaaaaaatactgagtatc

SEQ ID NO: 232497 - DNA, 75 bp, Artificial Sequence
  Synthetic
agttcagcgagtcaccatcactgacgcccgccgccggacctgtccctacgtttacaaagcactgggcatagtttc

SEQ ID NO: 232498 - DNA, 75 bp, Artificial Sequence
  Synthetic
attttgatttcgccaagtaataacacagggtggggcttgggctccactcgaatgtatggaggcgccaaaacaagg

SEQ ID NO: 232499 - DNA, 75 bp, Artificial Sequence
  Synthetic
cagggtggggcttgggctccactcgaatgtatggaggcgccaaaacaaggtccagccaacatccagtgcgcgtgc

SEQ ID NO: 232500 - DNA, 75 bp, Artificial Sequence
  Synthetic
agcacatactcgaggacgcacggggcgcaccactgtagacgatgttattgattctgtggtggccgatgcgcgcaa

SEQ ID NO: 232501 - DNA, 75 bp, Artificial Sequence
  Synthetic
cgcaccactgtagacgatgttattgattctgtggtggccgatgcgcgcaaataccgcgggcccgctgactccgcc

SEQ ID NO: 232502 - DNA, 75 bp, Artificial Sequence
  Synthetic
acgaggtggtggccaacgctcgagattatgctaggcgccgcagacgtcttcgccgccgccgtagaccaaccgctg

SEQ ID NO: 232503 - DNA, 75 bp, Artificial Sequence
  Synthetic
ttatgctaggcgccgcagacgtcttcgccgccgccgtagaccaaccgctgctatgcgcgccgccagggctttggt

SEQ ID NO: 232504 - DNA, 75 bp, Artificial Sequence
  Synthetic
cgagctatgctgcgggcggcaagacgggcggcaacacctactggtcgagcacgcaggcgggccgcagctgcggcg

SEQ ID NO: 232505 - DNA, 75 bp, Artificial Sequence
  Synthetic
ctcctcggcgaggaaatgtatactgggtgcgtgactcagtaaccgggacccgcgtgccagttcgtacgcgtccac

SEQ ID NO: 232506 - DNA, 75 bp, Artificial Sequence
  Synthetic
ggtgcgtgactcagtaaccgggacccgcgtgccagttcgtacgcgtccacctcacccttagaagacaaagagtga

SEQ ID NO: 232507 - DNA, 75 bp, Artificial Sequence
  Synthetic
agagctgctgcaggccatagcgcctgaaatatatggcccatcggataaccttatcaagcgcgaaatcaagcatgt

SEQ ID NO: 232508 - DNA, 75 bp, Artificial Sequence
  Synthetic
gaagttgccgcggcgttagcggacggcgtcgagtttgtgcgctcatttgcacccagacgtagggtacagtggaag

SEQ ID NO: 232509 - DNA, 75 bp, Artificial Sequence
  Synthetic
gcgtcgagtttgtgcgctcatttgcacccagacgtagggtacagtggaaggggcggcgagtaaagcgcattttgc

SEQ ID NO: 232510 - DNA, 75 bp, Artificial Sequence
  Synthetic
tcccggagagcgaacggtcatgcgaccgctaaagcgcgagtacgacgaagtgtatgctgacgatgacattctgga

SEQ ID NO: 232511 - DNA, 75 bp, Artificial Sequence
  Synthetic
ccgctaaagcgcgagtacgacgaagtgtatgctgacgatgacattctggaacaagcggcacagcagactggggaa

SEQ ID NO: 232512 - DNA, 75 bp, Artificial Sequence
  Synthetic
atggagacaaaattgccattcctttggacgagggcaatccaacacccagtttaaaggccgtcactttacagcaag

SEQ ID NO: 232513 - DNA, 75 bp, Artificial Sequence
  Synthetic
ggacgagggcaatccaacacccagtttaaaggccgtcactttacagcaagtattgccagtgcttgggccttcgga

SEQ ID NO: 232514 - DNA, 75 bp, Artificial Sequence
  Synthetic
gccgtggacgaattgcagcccaccatgcaactgatggtgcctaagaaacaaaaactagaggatgtactagagcac

SEQ ID NO: 232515 - DNA, 75 bp, Artificial Sequence
  Synthetic
tgcaactgatggtgcctaagaaacaaaaactagaggatgtactagagcacatgaaagtggatcctagcgtacagc

SEQ ID NO: 232516 - DNA, 75 bp, Artificial Sequence
  Synthetic
aaaagtagctccaggtttaggagttcaaacagtggacattcaaattcctgtgcaaaccgcgtccggggaacctat

SEQ ID NO: 232517 - DNA, 75 bp, Artificial Sequence
  Synthetic
caaacagtggacattcaaattcctgtgcaaaccgcgtccggggaacctatggaaacccaaacttcaccaataaaa

SEQ ID NO: 232518 - DNA, 75 bp, Artificial Sequence
  Synthetic
cagactcttactacctgccagcgctttctaaaaagcgtcactacagacaaacaagtgcgcttttaccaaactacg

SEQ ID NO: 232519 - DNA, 75 bp, Artificial Sequence
  Synthetic
acctgggtatcacgggtcaacttttaagcgccgagctgcgcgccctagccgcaagcgaggcccatcacgccgcag

SEQ ID NO: 232520 - DNA, 75 bp, Artificial Sequence
  Synthetic
ccagctgcagtgcgccgcgttgtacgaagggggcgcacactggttcttccatccgtgcgttaccaccctagcatt

SEQ ID NO: 232521 - DNA, 75 bp, Artificial Sequence
  Synthetic
gcgtagcatgcgcagacgcatgaagggcggggttttgcccctcctaattcctcttattgctgcggccattggggc

SEQ ID NO: 232522 - DNA, 75 bp, Artificial Sequence
  Synthetic
ttgcaggcttctcgaaaaaattaaacaataaagacttccaacttattactggtactatgactgttttatgcagac

SEQ ID NO: 232523 - DNA, 75 bp, Artificial Sequence
  Synthetic
gagcggtcttaaaaattttggctccacaattaagtcatatggcaccaaagcgtggaacagccaaaccggccagat

SEQ ID NO: 232524 - DNA, 75 bp, Artificial Sequence
  Synthetic
agaggaaaagctaccacctttagaaacggtgcccggatccgttccatctaaaggagaaaagcggccacggccgga

SEQ ID NO: 232525 - DNA, 75 bp, Artificial Sequence
  Synthetic
acggtgcccggatccgttccatctaaaggagaaaagcggccacggccggatgcagaggaaaccctagtgacgcac

SEQ ID NO: 232526 - DNA, 75 bp, Artificial Sequence
  Synthetic
aagcagtaaaacagggagccacacttacgcccaccacgtaccccatgacaaaaccgattttacccatggctacta

SEQ ID NO: 232527 - DNA, 75 bp, Artificial Sequence
  Synthetic
tacgcccaccacgtaccccatgacaaaaccgattttacccatggctactagggtgtatggaaaaaatgaacatga

SEQ ID NO: 232528 - DNA, 75 bp, Artificial Sequence
  Synthetic
ctgccagaacccaccattgcggagccagtggtttccacaccaccagttacaacagtgacgcgtccagaagtacgg

SEQ ID NO: 232529 - DNA, 75 bp, Artificial Sequence
  Synthetic
cagtggtttccacaccaccagttacaacagtgacgcgtccagaagtacggccagtggctgtggccagcctacgaa

SEQ ID NO: 232530 - DNA, 75 bp, Artificial Sequence
  Synthetic
cacgctgaacagcattgtggggctgggagtaaaatctctcaaacgccgtcgctgctactaaaaaaaacagagtgt

SEQ ID NO: 232531 - DNA, 75 bp, Artificial Sequence
  Synthetic
taacatcccatctgtgtatacgcctcctatgtcagcgccagaggaccaacgcgcgaatcgcagttaccaccgctt

SEQ ID NO: 232532 - DNA, 75 bp, Artificial Sequence
  Synthetic
gccgcagtggtcttacatgcatatcgccggtcaggatgcctcggagtacctgagtcccgggctggtgcaattcgc

SEQ ID NO: 232533 - DNA, 75 bp, Artificial Sequence
  Synthetic
gccggtcaggatgcctcggagtacctgagtcccgggctggtgcaattcgcccgcgccacggacacctacttcacc

SEQ ID NO: 232534 - DNA, 75 bp, Artificial Sequence
  Synthetic
ctgtggctcccacccatgacgttaccaccgatcgctctcagcggctgacgctgcgttttgtgcccgtggatcggg

SEQ ID NO: 232535 - DNA, 75 bp, Artificial Sequence
  Synthetic
caccgatcgctctcagcggctgacgctgcgttttgtgcccgtggatcgggaagatactgcttattcatacaaggc

SEQ ID NO: 232536 - DNA, 75 bp, Artificial Sequence
  Synthetic
aaccgcgtacttgacatggctagttcttactttgacataagaggggtactagaccgcggtccaagtttcaagcca

SEQ ID NO: 232537 - DNA, 75 bp, Artificial Sequence
  Synthetic
cttactttgacataagaggggtactagaccgcggtccaagtttcaagccatattctggaacggcctacaactctt

SEQ ID NO: 232538 - DNA, 75 bp, Artificial Sequence
  Synthetic
tagccagtggctgactactaacaatggcaacaaaacccacacttttgctcaagcgccttacatagggaactccat

SEQ ID NO: 232539 - DNA, 75 bp, Artificial Sequence
  Synthetic
ggcaacaaaacccacacttttgctcaagcgccttacatagggaactccatcactaaagatggcattcaagttgga

SEQ ID NO: 232540 - DNA, 75 bp, Artificial Sequence
  Synthetic
cagtatatgctgacaagacctatcagcccgaacctcaagtaggcgagagtcaatggaacacgccattggctaaca

SEQ ID NO: 232541 - DNA, 75 bp, Artificial Sequence
  Synthetic
gcccgaacctcaagtaggcgagagtcaatggaacacgccattggctaacaacacgaaagcagcaggaagggtgct

SEQ ID NO: 232542 - DNA, 75 bp, Artificial Sequence
  Synthetic
tgctatgggtcttacgcccgagccacaaatgaaaaaggaggtcaatcaaaaaataacgaaggggtggaaatgcaa

SEQ ID NO: 232543 - DNA, 75 bp, Artificial Sequence
  Synthetic
caaatgaaaaaggaggtcaatcaaaaaataacgaaggggtggaaatgcaattttttgcatccagtgctaacgaca

SEQ ID NO: 232544 - DNA, 75 bp, Artificial Sequence
  Synthetic
gtacagtgaggacgtaaacctggaagcccctgacacacacattgtttacaagccagctgtaaccgcggacactgt

SEQ ID NO: 232545 - DNA, 75 bp, Artificial Sequence
  Synthetic
gcccctgacacacacattgtttacaagccagctgtaaccgcggacactgtcagttcagaactgctactaggtcaa

SEQ ID NO: 232546 - DNA, 75 bp, Artificial Sequence
  Synthetic
acattggcttcagagacaacttcatagggctgatgtactacaacagcactggaaacatgggagtgcttgctggac

SEQ ID NO: 232547 - DNA, 75 bp, Artificial Sequence
  Synthetic
ggacctgcaagacagaaacacagagctgtcctaccaacttatgctggacgctttaggcgaccgaagtcgctattt

SEQ ID NO: 232548 - DNA, 75 bp, Artificial Sequence
  Synthetic
agctacgatcctgatgtgcgaatcattgaaaatcatggggtggaagacgaacttcccaattactgctttccacta

SEQ ID NO: 232549 - DNA, 75 bp, Artificial Sequence
  Synthetic
ttgaaaatcatggggtggaagacgaacttcccaattactgctttccactaggggctgtgggcattgcgaattcct

SEQ ID NO: 232550 - DNA, 75 bp, Artificial Sequence
  Synthetic
caataatggctgggtaaaagatgacagcgcagcagataacaatgacatagctacaggtaatatcttcgccatgga

SEQ ID NO: 232551 - DNA, 75 bp, Artificial Sequence
  Synthetic
agcgcagcagataacaatgacatagctacaggtaatatcttcgccatggaaattaacttgcaggctaatttgtgg

SEQ ID NO: 232552 - DNA, 75 bp, Artificial Sequence
  Synthetic
gcttatacttacctgacagcttaaagtacactcccgggaacataaagctgcctgataataaaaacacctacgagt

SEQ ID NO: 232553 - DNA, 75 bp, Artificial Sequence
  Synthetic
gtacactcccgggaacataaagctgcctgataataaaaacacctacgagtacatcaatggccgtgttacagcccc

SEQ ID NO: 232554 - DNA, 75 bp, Artificial Sequence
  Synthetic
atcggggctcgttggtcgccagatgttatggataacatgaatccttttaaccaccaccgaaacgcagggctccgt

SEQ ID NO: 232555 - DNA, 75 bp, Artificial Sequence
  Synthetic
gcaggtttgtgccttttcacattcaagtgccgcaaaaattttttgccataagaaacttgttgctgttacctggtt

SEQ ID NO: 232556 - DNA, 75 bp, Artificial Sequence
  Synthetic
ccaccctagaagctatgttgagaaatgacaccaacgaccagtcatttaatgactacctctgcgccgcaaacatgc

SEQ ID NO: 232557 - DNA, 75 bp, Artificial Sequence
  Synthetic
cagtgtgcccatttctataccttcccgaaattgggcggcatttaggggatggagttttactcgcttgaaaactaa

SEQ ID NO: 232558 - DNA, 75 bp, Artificial Sequence
  Synthetic
cgaaattgggcggcatttaggggatggagttttactcgcttgaaaactaaggaaacaccttcattgggctcgggc

SEQ ID NO: 232559 - DNA, 75 bp, Artificial Sequence
  Synthetic
gaaccattccctacttggacggtaccttttaccttaatcatactttcaaaaaggtgtcaatcatgtttgactcct

SEQ ID NO: 232560 - DNA, 75 bp, Artificial Sequence
  Synthetic
cttttaccttaatcatactttcaaaaaggtgtcaatcatgtttgactcctctgtaagctggccgggaaatgatcg

SEQ ID NO: 232561 - DNA, 75 bp, Artificial Sequence
  Synthetic
attaagcgttccgtggatggcgaagggtacaacgtggctcaatgcaacatgactaaggactggtttcttatccaa

SEQ ID NO: 232562 - DNA, 75 bp, Artificial Sequence
  Synthetic
ggtacaacgtggctcaatgcaacatgactaaggactggtttcttatccaaatgcttagtcactacaacattgggt

SEQ ID NO: 232563 - DNA, 75 bp, Artificial Sequence
  Synthetic
ctataaggaccgaatgtattcttttttcagaaactttcagcctatgagtagacaggttgttgacactactgaata

SEQ ID NO: 232564 - DNA, 75 bp, Artificial Sequence
  Synthetic
ttcagaaactttcagcctatgagtagacaggttgttgacactactgaatacaaagactacaaaaaagtaacagta

SEQ ID NO: 232565 - DNA, 75 bp, Artificial Sequence
  Synthetic
tcgtaggatacttgggccccaccatgcgggaaggtcaggcttatccggccaactatccctaccccctcattggaa

SEQ ID NO: 232566 - DNA, 75 bp, Artificial Sequence
  Synthetic
gaaaaaatttctgtgcgatcgtgtaatgtggcgcatcccattttcaagcaactttatgtctatgggagcgctcac

SEQ ID NO: 232567 - DNA, 75 bp, Artificial Sequence
  Synthetic
ttatgggttcaagcgagcaggagctcacggccattgttcgagacctaggttgcggtccctatttcatgggtacat

SEQ ID NO: 232568 - DNA, 75 bp, Artificial Sequence
  Synthetic
attgttaacactgctggtcgcgaaactgggggcgtccattggcttgcttttggatggaatcccaaatctcatact

SEQ ID NO: 232569 - DNA, 75 bp, Artificial Sequence
  Synthetic
tttctgaccagcggctaagacaaatctaccactttgagtacgagggattgctgcgccgcagtgcactggcggcca

SEQ ID NO: 232570 - DNA, 75 bp, Artificial Sequence
  Synthetic
aaagtcgactcaaagcgttcaagggcctttttctgaggcatgtggccttttttgctgtatgtttttacatgcttt

SEQ ID NO: 232571 - DNA, 75 bp, Artificial Sequence
  Synthetic
ttactggggtgcctaattgtatgctacaaagtcctcaggtagtgggcacattgcgacgcaaccaggatgaattgt

SEQ ID NO: 232572 - DNA, 75 bp, Artificial Sequence
  Synthetic
ttactttcgccacaaccgcgagcgcatagaaaaagctacatcttttactaaaatgcaaaatggactcaaataaac

SEQ ID NO: 232573 - DNA, 75 bp, Artificial Sequence
  Synthetic
atagaaaaagctacatcttttactaaaatgcaaaatggactcaaataaacatgtacacaatgcattaataaaaac

SEQ ID NO: 232574 - DNA, 75 bp, Artificial Sequence
  Synthetic
agcttgtttgttttattaaaaatcaaacggttcttcgcgagagtcgccatggttggtgggcagggatatgttcct

SEQ ID NO: 232575 - DNA, 75 bp, Artificial Sequence
  Synthetic
aacggttcttcgcgagagtcgccatggttggtgggcagggatatgttcctgtactgcaaacgcggatgccacttg

SEQ ID NO: 232576 - DNA, 75 bp, Artificial Sequence
  Synthetic
gtgggccttcaaaattttctccccacagctggcgcacaagctgcaaggcgcccataacatcaggagcggatatct

SEQ ID NO: 232577 - DNA, 75 bp, Artificial Sequence
  Synthetic
cagctggcgcacaagctgcaaggcgcccataacatcaggagcggatatcttgaagtcgcaattggggccggcatt

SEQ ID NO: 232578 - DNA, 75 bp, Artificial Sequence
  Synthetic
tttgcgcactgaaaaaccagcaggcaaggatagtgaatgctggctaacgcccctgggtcagtcacttcgccagtg

SEQ ID NO: 232579 - DNA, 75 bp, Artificial Sequence
  Synthetic
aaggatagtgaatgctggctaacgcccctgggtcagtcacttcgccagtgtcaatgttttccacattgctgaggt

SEQ ID NO: 232580 - DNA, 75 bp, Artificial Sequence
  Synthetic
tcgccccatccgcggtagaccatcctgcttgctcaaacactcgcagcgcactggcataagaatacgtttttgccc

SEQ ID NO: 232581 - DNA, 75 bp, Artificial Sequence
  Synthetic
tgcttgctcaaacactcgcagcgcactggcataagaatacgtttttgcccctgtcgcatgtgagggtagtcggcc

SEQ ID NO: 232582 - DNA, 75 bp, Artificial Sequence
  Synthetic
aagccatttgggccttcgacccttcagaataaaacaagccacaggactttccggaaaaagagttgcttccgcaac

SEQ ID NO: 232583 - DNA, 75 bp, Artificial Sequence
  Synthetic
agaataaaacaagccacaggactttccggaaaaagagttgcttccgcaaccaacatcatgaaaacagcagcgggc

SEQ ID NO: 232584 - DNA, 75 bp, Artificial Sequence
  Synthetic
ttgcgcccccaacggttttgcaccaccttagctttagacgggttttctttcaacgcccgttgcccattttcactg

SEQ ID NO: 232585 - DNA, 75 bp, Artificial Sequence
  Synthetic
ccttagctttagacgggttttctttcaacgcccgttgcccattttcactggttacatccatttctactaggtgct

SEQ ID NO: 232586 - DNA, 75 bp, Artificial Sequence
  Synthetic
caaacacctaagctctccctcccgctcagtgcactgatgctcccacacacagcaaccagtgggttcccaggtttt

SEQ ID NO: 232587 - DNA, 75 bp, Artificial Sequence
  Synthetic
tcagtgcactgatgctcccacacacagcaaccagtgggttcccaggttttatgttgcacgccggcatatgcttgc

SEQ ID NO: 232588 - DNA, 75 bp, Artificial Sequence
  Synthetic
ttagctcctgaaacgttttttgggatgagaaagttagctgcaatccgcgcttttcttcgccgagccatgttgcgc

SEQ ID NO: 232589 - DNA, 75 bp, Artificial Sequence
  Synthetic
tgagaaagttagctgcaatccgcgcttttcttcgccgagccatgttgcgcatatttttttgtatatgtcactctg

SEQ ID NO: 232590 - DNA, 75 bp, Artificial Sequence
  Synthetic
cgctcgtcatgatccacatggtacttctccatcagcatagccatggcttccatacccttttcccaagccgttact

SEQ ID NO: 232591 - DNA, 75 bp, Artificial Sequence
  Synthetic
tctccatcagcatagccatggcttccatacccttttcccaagccgttactaggggctcgctcgcaggattgcgga

SEQ ID NO: 232592 - DNA, 75 bp, Artificial Sequence
  Synthetic
ctgcattgcggccttcgcggggtttcgttggttgacctccattttttgacaagactgcgaaccgtctgcatgatg

SEQ ID NO: 232593 - DNA, 75 bp, Artificial Sequence
  Synthetic
cgttggttgacctccattttttgacaagactgcgaaccgtctgcatgatgtataatgcgaacagggggcatgctg

SEQ ID NO: 232594 - DNA, 75 bp, Artificial Sequence
  Synthetic
ttggcgattccactactccttcctcttcttcgctgtctaaaacaatctctggcgacaaaggaagaggctttgcgg

SEQ ID NO: 232595 - DNA, 75 bp, Artificial Sequence
  Synthetic
acttcatgctctttcttttcggaggcaaaggcgcaggagcttctatgtcttcctcgctttcggaatccaaaaagt

SEQ ID NO: 232596 - DNA, 75 bp, Artificial Sequence
  Synthetic
gaaagtttaaccaccccaagcgctcccgccatctgcactactgctgtcatggaaaaggaaaacagcctacccata

SEQ ID NO: 232597 - DNA, 75 bp, Artificial Sequence
  Synthetic
ccgccatctgcactactgctgtcatggaaaaggaaaacagcctacccatatcccaagacgcgccggtggagcagg

SEQ ID NO: 232598 - DNA, 75 bp, Artificial Sequence
  Synthetic
ggagtggcatcaaccaggctctcttctaatccaaaagcaaccaaatgacgaacaggcagaaagcgatgagcaaaa

SEQ ID NO: 232599 - DNA, 75 bp, Artificial Sequence
  Synthetic
ctaatccaaaagcaaccaaatgacgaacaggcagaaagcgatgagcaaaatgctgggctcgaaaatcatgaccac

SEQ ID NO: 232600 - DNA, 75 bp, Artificial Sequence
  Synthetic
agcatgtgcagcgacaaaccactattgtacgcgacgctgtagccgaccgcttgtccttacctatttcagtttcag

SEQ ID NO: 232601 - DNA, 75 bp, Artificial Sequence
  Synthetic
ttgtccttacctatttcagtttcagagttaagtagcgtgtacgagcgcaatttgttttccccacgtgtgcctcct

SEQ ID NO: 232602 - DNA, 75 bp, Artificial Sequence
  Synthetic
cttgcaacgtatcatatttttttcaaaaatcacaagatacccgtgtcctgccgagccaaccgcacccgcgcagat

SEQ ID NO: 232603 - DNA, 75 bp, Artificial Sequence
  Synthetic
ctaccatacctggtattgtatccttagaggaggtgcccagaatttttgaaggattgggacgtgatgaaaagcgag

SEQ ID NO: 232604 - DNA, 75 bp, Artificial Sequence
  Synthetic
agaggaggtgcccagaatttttgaaggattgggacgtgatgaaaagcgagcggcaaacaccctgcaaaaacaaaa

SEQ ID NO: 232605 - DNA, 75 bp, Artificial Sequence
  Synthetic
gcactggtagagcttgaaggggacaacgctcgcttggcagtactgaagcgaaacgttgaagtgactcactttgcc

SEQ ID NO: 232606 - DNA, 75 bp, Artificial Sequence
  Synthetic
acgctcgcttggcagtactgaagcgaaacgttgaagtgactcactttgcctatccggcgctgaatctcccaccaa

SEQ ID NO: 232607 - DNA, 75 bp, Artificial Sequence
  Synthetic
agtattaattaagcgcgccaacccaattggtgaagaagcaaacttgcaagatgctgagataacggacgatggaaa

SEQ ID NO: 232608 - DNA, 75 bp, Artificial Sequence
  Synthetic
attggtgaagaagcaaacttgcaagatgctgagataacggacgatggaaaaccagctgtaagcgacgaacagctg

SEQ ID NO: 232609 - DNA, 75 bp, Artificial Sequence
  Synthetic
acaaggaactagaacatcggcgcaaattaatgatgggcgctgtactagtaactacagaactcgagtgcatgcatc

SEQ ID NO: 232610 - DNA, 75 bp, Artificial Sequence
  Synthetic
attaatgatgggcgctgtactagtaactacagaactcgagtgcatgcatcgctttttttctaacaccaccacatt

SEQ ID NO: 232611 - DNA, 75 bp, Artificial Sequence
  Synthetic
tacaccttccgccatggctatgtgcgccaagcttgtaaagtgtccaatgtggaactaagcaaccttgtttcttac

SEQ ID NO: 232612 - DNA, 75 bp, Artificial Sequence
  Synthetic
gccaagcttgtaaagtgtccaatgtggaactaagcaaccttgtttcttacatgggcatcttgcatgaaaaccgtc

SEQ ID NO: 232613 - DNA, 75 bp, Artificial Sequence
  Synthetic
ccttcgcgatgaagcacgcagagactacgtgcgcgattgcatttatctttttctattgcacacctggcaaaccgg

SEQ ID NO: 232614 - DNA, 75 bp, Artificial Sequence
  Synthetic
tacgtgcgcgattgcatttatctttttctattgcacacctggcaaaccggaatgggggtctggcagcagtgcttg

SEQ ID NO: 232615 - DNA, 75 bp, Artificial Sequence
  Synthetic
ataaactcctcgacaagtcgctgagatctctttggacaggctttgatgaaagaacagtagctgccaacctcgctg

SEQ ID NO: 232616 - DNA, 75 bp, Artificial Sequence
  Synthetic
atctctttggacaggctttgatgaaagaacagtagctgccaacctcgctgacataatttttccagaaaggctaat

SEQ ID NO: 232617 - DNA, 75 bp, Artificial Sequence
  Synthetic
gatttcatgagccaaagcatgctgcacaattttcgctctttcattttggagcgatctggcatgcttcctagcatg

SEQ ID NO: 232618 - DNA, 75 bp, Artificial Sequence
  Synthetic
acaattttcgctctttcattttggagcgatctggcatgcttcctagcatgtgttgcgcgctgccttcagattttg

SEQ ID NO: 232619 - DNA, 75 bp, Artificial Sequence
  Synthetic
tcctcccctatggagtcattgctatctactaaaactggccaactacctagcttatcactcagaccttatgacaga

SEQ ID NO: 232620 - DNA, 75 bp, Artificial Sequence
  Synthetic
ctactaaaactggccaactacctagcttatcactcagaccttatgacagattccagcggcgagggtctaatggag

SEQ ID NO: 232621 - DNA, 75 bp, Artificial Sequence
  Synthetic
ccccccaccgttctttggtttgtaacacagaactactgagtgaaagtcaagttataggaacctctgaaatgcagg

SEQ ID NO: 232622 - DNA, 75 bp, Artificial Sequence
  Synthetic
cacagaactactgagtgaaagtcaagttataggaacctctgaaatgcaggggccgcagtctgacaacaactccac

SEQ ID NO: 232623 - DNA, 75 bp, Artificial Sequence
  Synthetic
ctgtggacttcagcgtacctgcgtaaattcgagcccaaagattaccacgcccatactatacatttctacgaagac

SEQ ID NO: 232624 - DNA, 75 bp, Artificial Sequence
  Synthetic
aattcgagcccaaagattaccacgcccatactatacatttctacgaagaccaatccagaccccccaaggctccgt

SEQ ID NO: 232625 - DNA, 75 bp, Artificial Sequence
  Synthetic
ctaccacgtactcttcacatccacagcatgcccccgaaagccgccaaacaggctattgctctacaacgttcaaag

SEQ ID NO: 232626 - DNA, 75 bp, Artificial Sequence
  Synthetic
gcatgcccccgaaagccgccaaacaggctattgctctacaacgttcaaagaaacaacagcaacagcaggaaatct

SEQ ID NO: 232627 - DNA, 75 bp, Artificial Sequence
  Synthetic
tgggaggaggaggaggaatacaacagcctagaagaggaggaggaaggtaccgaggacggagcgaccgccgcaaaa

SEQ ID NO: 232628 - DNA, 75 bp, Artificial Sequence
  Synthetic
catcgaacctcacagtgagcaaatctcagaaagccagccgtagatgggacaacactgaagcaagcatcgcaccct

SEQ ID NO: 232629 - DNA, 75 bp, Artificial Sequence
  Synthetic
tcagaaagccagccgtagatgggacaacactgaagcaagcatcgcaccctcaaactggggtaagaaccgcaagca

SEQ ID NO: 232630 - DNA, 75 bp, Artificial Sequence
  Synthetic
cgggctcacaaaagtaacattgtaacctgcctgcaacactgcggggggaatatctcattcgcaaggagatatctg

SEQ ID NO: 232631 - DNA, 75 bp, Artificial Sequence
  Synthetic
cctgcctgcaacactgcggggggaatatctcattcgcaaggagatatctgctattccatgatggagtggcaattc

SEQ ID NO: 232632 - DNA, 75 bp, Artificial Sequence
  Synthetic
taatctttacagccccttcgaagcgcccgacaaagaaccgaccagcggcaaccaagcggtccattagaaaaagaa

SEQ ID NO: 232633 - DNA, 75 bp, Artificial Sequence
  Synthetic
gctctgttcaataaatactgcgctctctcgcttaaagagtaaaaaaagcccgcgcgcggaccttacaggcgggaa

SEQ ID NO: 232634 - DNA, 75 bp, Artificial Sequence
  Synthetic
ccggccctcacatgatttccagggtaaacgggattcgcgcccagcgtaaccaaatgctgctaaagcaagcggctc

SEQ ID NO: 232635 - DNA, 75 bp, Artificial Sequence
  Synthetic
gcgcacgtcacagtttcaggtgtaaaggtcgcaccgggccctaccccagtgcaggtataaatcgagtactcatca

SEQ ID NO: 232636 - DNA, 75 bp, Artificial Sequence
  Synthetic
aggtcgcaccgggccctaccccagtgcaggtataaatcgagtactcatcagagggaaaggtatacagctcaacga

SEQ ID NO: 232637 - DNA, 75 bp, Artificial Sequence
  Synthetic
ctcaaaccagacggagtgtttcagcttggagggtccggccgctcctcctttaccacccgccaagcctacctgacg

SEQ ID NO: 232638 - DNA, 75 bp, Artificial Sequence
  Synthetic
ttggagggtccggccgctcctcctttaccacccgccaagcctacctgacgctgcagagctcatcatccgctccga

SEQ ID NO: 232639 - DNA, 75 bp, Artificial Sequence
  Synthetic
atttgtggaggagtttactccatccgtttacttcaatcccttttcgggttctccgggccactaccccgacgcctt

SEQ ID NO: 232640 - DNA, 75 bp, Artificial Sequence
  Synthetic
gtttacttcaatcccttttcgggttctccgggccactaccccgacgccttcatacctaacttcgacgcagtgagt

SEQ ID NO: 232641 - DNA, 75 bp, Artificial Sequence
  Synthetic
gtctaatggagcagctgacacagcgcggctgcgacatttagatcattgtcgccaacttcgctgctttgctcgaga

SEQ ID NO: 232642 - DNA, 75 bp, Artificial Sequence
  Synthetic
cggctgcgacatttagatcattgtcgccaacttcgctgctttgctcgagacgtgtgtgcttttgcttactttgag

SEQ ID NO: 232643 - DNA, 75 bp, Artificial Sequence
  Synthetic
ctgctcacggcgtcacagtaacagttgaaaaaggaattgatacccaccttatcaaatttttcaccaaacgtccac

SEQ ID NO: 232644 - DNA, 75 bp, Artificial Sequence
  Synthetic
tgaaaaaggaattgatacccaccttatcaaatttttcaccaaacgtccacttttggtggaaaaagatcaagggaa

SEQ ID NO: 232645 - DNA, 75 bp, Artificial Sequence
  Synthetic
tgttcaattcccggattacatgaagatttttgttgtcatttgtgtgctgaatttaataaattgtagtggcgcttt

SEQ ID NO: 232646 - DNA, 75 bp, Artificial Sequence
  Synthetic
atttttgttgtcatttgtgtgctgaatttaataaattgtagtggcgctttgtcacctgaagaagaacctaactgt

SEQ ID NO: 232647 - DNA, 75 bp, Artificial Sequence
  Synthetic
ttacactttcaaccgctcacattacccttaactgcaagtttttttctacacaactcacttggacctttaatggaa

SEQ ID NO: 232648 - DNA, 75 bp, Artificial Sequence
  Synthetic
ccttaactgcaagtttttttctacacaactcacttggacctttaatggaaaagacgttgccgcagcaaatttaaa

SEQ ID NO: 232649 - DNA, 75 bp, Artificial Sequence
  Synthetic
accttacattcgcctattcacctgggatactaccgctgcgctgctccaccttgtgtgcaagcgttttttcttgct

SEQ ID NO: 232650 - DNA, 75 bp, Artificial Sequence
  Synthetic
gatactaccgctgcgctgctccaccttgtgtgcaagcgttttttcttgctccagttatcgacactcgtcctgctg

SEQ ID NO: 232651 - DNA, 75 bp, Artificial Sequence
  Synthetic
aatcaccaagttgatctctactgctactaccaaaggtacagaagaaattatatacttttcaaactttacaagtca

SEQ ID NO: 232652 - DNA, 75 bp, Artificial Sequence
  Synthetic
actaccaaaggtacagaagaaattatatacttttcaaactttacaagtcatttacttttaaattgctcgtgctct

SEQ ID NO: 232653 - DNA, 75 bp, Artificial Sequence
  Synthetic
acaacaccctttgcaaagcttttttccaaggaaaaactctgtattcggctaaacttggactgtgtaacagcagca

SEQ ID NO: 232654 - DNA, 75 bp, Artificial Sequence
  Synthetic
ccaaggaaaaactctgtattcggctaaacttggactgtgtaacagcagcactccttctcacctcactctgttccc

SEQ ID NO: 232655 - DNA, 75 bp, Artificial Sequence
  Synthetic
tgcctgggagcaggcggtcctccttgtcagcagcactggaaactagtttttctcccaacactggtttcaccctcc

SEQ ID NO: 232656 - DNA, 75 bp, Artificial Sequence
  Synthetic
gtcagcagcactggaaactagtttttctcccaacactggtttcaccctcctttgctattgattctacttcccccc

SEQ ID NO: 232657 - DNA, 75 bp, Artificial Sequence
  Synthetic
cggcggtcttgcagcttttattttatttttactttccaatttattcttagtgcatttttattaattatgctttgc

SEQ ID NO: 232658 - DNA, 75 bp, Artificial Sequence
  Synthetic
tttttactttccaatttattcttagtgcatttttattaattatgctttgcattttaattttgtcctcttttttaa

SEQ ID NO: 232659 - DNA, 75 bp, Artificial Sequence
  Synthetic
cgagaatccactaaaggttgtggttgaagctggccataatgtcacacttcctcatttgctgcctggatttaacaa

SEQ ID NO: 232660 - DNA, 75 bp, Artificial Sequence
  Synthetic
gaagctggccataatgtcacacttcctcatttgctgcctggatttaacaaaactggtcatgtcacttggttaata

SEQ ID NO: 232661 - DNA, 75 bp, Artificial Sequence
  Synthetic
ctccagacaactttatttttagcggccaaaagctctgtcagttcaccagcagaaccatgatgtggtcttatccac

SEQ ID NO: 232662 - DNA, 75 bp, Artificial Sequence
  Synthetic
ccaaaagctctgtcagttcaccagcagaaccatgatgtggtcttatccacaattaatttttaactgtgacaatta

SEQ ID NO: 232663 - DNA, 75 bp, Artificial Sequence
  Synthetic
atagaaaactccgcaatttacaatgtaaaaaacacagttgaagcaactgaaaggaatatatactaccagttaaca

SEQ ID NO: 232664 - DNA, 75 bp, Artificial Sequence
  Synthetic
taaaaaacacagttgaagcaactgaaaggaatatatactaccagttaacagtaatacaaattgatccacccaact

SEQ ID NO: 232665 - DNA, 75 bp, Artificial Sequence
  Synthetic
agaagcttattgtcacattacaattgattgcactaactctcgttatcctaacaaggttatcttcaacaatgttac

SEQ ID NO: 232666 - DNA, 75 bp, Artificial Sequence
  Synthetic
gattgcactaactctcgttatcctaacaaggttatcttcaacaatgttactcgagcctactatggatatggtaac

SEQ ID NO: 232667 - DNA, 75 bp, Artificial Sequence
  Synthetic
ttacaaccagctttaatgtttcaggtgttactaaaagctttaatcatacctatccttttagtgagctatgtgctt

SEQ ID NO: 232668 - DNA, 75 bp, Artificial Sequence
  Synthetic
tgttactaaaagctttaatcatacctatccttttagtgagctatgtgcttacccttcttccaaaaatttctacaa

SEQ ID NO: 232669 - DNA, 75 bp, Artificial Sequence
  Synthetic
gtttttctagtaataattggctccagcgttcttattattttaggcgccctaatttatctgtactggcatcgaaaa

SEQ ID NO: 232670 - DNA, 75 bp, Artificial Sequence
  Synthetic
gcgttcttattattttaggcgccctaatttatctgtactggcatcgaaaatttctttgtagatttaaatcagaac

SEQ ID NO: 232671 - DNA, 75 bp, Artificial Sequence
  Synthetic
gttttttgttttttttttacagtatggtgacggttcttttcatctttttatgcctgccaattatttttgcctcct

SEQ ID NO: 232672 - DNA, 75 bp, Artificial Sequence
  Synthetic
ggtgacggttcttttcatctttttatgcctgccaattatttttgcctcctcaacttttgcagccgttagtcacat

SEQ ID NO: 232673 - DNA, 75 bp, Artificial Sequence
  Synthetic
acagtgtatcttatttttacatttgtaactgctacctgcgtctgcagtctcattaccctgctaattacctccctg

SEQ ID NO: 232674 - DNA, 75 bp, Artificial Sequence
  Synthetic
taactgctacctgcgtctgcagtctcattaccctgctaattacctccctgcagttttttgattattactacgttc

SEQ ID NO: 232675 - DNA, 75 bp, Artificial Sequence
  Synthetic
gcattatcaaaatccccaaattgcagccctccttcaattgcaaccatgaagttaccgttagttctacttttctct

SEQ ID NO: 232676 - DNA, 75 bp, Artificial Sequence
  Synthetic
gccctccttcaattgcaaccatgaagttaccgttagttctacttttctctgtgccaatttgggctacaccttgtg

SEQ ID NO: 232677 - DNA, 75 bp, Artificial Sequence
  Synthetic
ggattgctacacgaaagaaacaagctacataggttggatttatggaattatgactggcttagtgtttctgtccag

SEQ ID NO: 232678 - DNA, 75 bp, Artificial Sequence
  Synthetic
tacataggttggatttatggaattatgactggcttagtgtttctgtccagtgtgatagctctacaattgtatgcg

SEQ ID NO: 232679 - DNA, 75 bp, Artificial Sequence
  Synthetic
acactgatgatcttcccgaatacccaagtccccaaattaatttaccccaaaatattgtgtttccagaacccccgc

SEQ ID NO: 232680 - DNA, 75 bp, Artificial Sequence
  Synthetic
aagtccccaaattaatttaccccaaaatattgtgtttccagaacccccgcgtcctccttctgttgttagttactt

SEQ ID NO: 232681 - DNA, 75 bp, Artificial Sequence
  Synthetic
agctgatttagaaattgatggaagaatcaccgaacacaagctcctcaccgatcgcgctaggcgacgccagcagga

SEQ ID NO: 232682 - DNA, 75 bp, Artificial Sequence
  Synthetic
atcaccgaacacaagctcctcaccgatcgcgctaggcgacgccagcaggaacaaaaaaataaagagcttcttgat

SEQ ID NO: 232683 - DNA, 75 bp, Artificial Sequence
  Synthetic
aaggactcttttgcctggtaaagcaatctacccttacttatgagttattaccaggcaaagaacatcagctcagct

SEQ ID NO: 232684 - DNA, 75 bp, Artificial Sequence
  Synthetic
acatgttgcccatacagcgccaaacctttactgcaatggtgggttctgtacctattaaagtgtcccaacaagcag

SEQ ID NO: 232685 - DNA, 75 bp, Artificial Sequence
  Synthetic
aactgtcatacctaacagacttacaaacagcaaacttcctccaaaccttaaatggaatgtcagattcttcctccc

SEQ ID NO: 232686 - DNA, 75 bp, Artificial Sequence
  Synthetic
aacagcaaacttcctccaaaccttaaatggaatgtcagattcttcctcccaatccctacccatcatcttcatctt

SEQ ID NO: 232687 - DNA, 75 bp, Artificial Sequence
  Synthetic
agtatgctgaagaaaaagaagaaaatgatgacttcaaccccgtttaccctttcgacccctctgacacaacagttg

SEQ ID NO: 232688 - DNA, 75 bp, Artificial Sequence
  Synthetic
tgatgacttcaaccccgtttaccctttcgacccctctgacacaacagttgtaccctttgttacacccccttttac

SEQ ID NO: 232689 - DNA, 75 bp, Artificial Sequence
  Synthetic
ccaccaggagtactggcacttaactacaaagaccccattgttaccgaaaatggaacccttacactcaaattaggg

SEQ ID NO: 232690 - DNA, 75 bp, Artificial Sequence
  Synthetic
acaaagaccccattgttaccgaaaatggaacccttacactcaaattaggggatggaataaaacttaatgcccagg

SEQ ID NO: 232691 - DNA, 75 bp, Artificial Sequence
  Synthetic
taaagtactagagccccttaccaacaccacacaaggccttacactttcttggagcgcccccctcgcagtaaaggc

SEQ ID NO: 232692 - DNA, 75 bp, Artificial Sequence
  Synthetic
accacacaaggccttacactttcttggagcgcccccctcgcagtaaaggctagcgcccttacattaaacacaaaa

SEQ ID NO: 232693 - DNA, 75 bp, Artificial Sequence
  Synthetic
gcttaagcttagtaactgcccctcccatcacaatagagtcttctcgtttgggattagccaccatagcccctctaa

SEQ ID NO: 232694 - DNA, 75 bp, Artificial Sequence
  Synthetic
catcacaatagagtcttctcgtttgggattagccaccatagcccctctaagtttagatggaggtggaaacctagg

SEQ ID NO: 232695 - DNA, 75 bp, Artificial Sequence
  Synthetic
gttagtaacaacaatctgcatcttaccactgaagctcccttagttataaattctagcagtgccttaactgtcgct

SEQ ID NO: 232696 - DNA, 75 bp, Artificial Sequence
  Synthetic
ccactgaagctcccttagttataaattctagcagtgccttaactgtcgctactgcagaacctataagtgttcgca

SEQ ID NO: 232697 - DNA, 75 bp, Artificial Sequence
  Synthetic
ggatccgttaatagtaggcaccaatgggttaggagtaagcgtcgccagtccaatcacagtggccaatggttcctt

SEQ ID NO: 232698 - DNA, 75 bp, Artificial Sequence
  Synthetic
gggttaggagtaagcgtcgccagtccaatcacagtggccaatggttccttagccttgtccgccactgctcccctt

SEQ ID NO: 232699 - DNA, 75 bp, Artificial Sequence
  Synthetic
tttctgtcgccaatcctcttactgtttcaggaaatgccctcactgtttccactggcaatggtcttcaagtatcgg

SEQ ID NO: 232700 - DNA, 75 bp, Artificial Sequence
  Synthetic
ttcaggaaatgccctcactgtttccactggcaatggtcttcaagtatcggggtctcaattagtagccagaatagg

SEQ ID NO: 232701 - DNA, 75 bp, Artificial Sequence
  Synthetic
gtcatgaaagtatacgtagccgggggaatgagaacttcgggtggtagaataattttagatgtggcctatccgttt

SEQ ID NO: 232702 - DNA, 75 bp, Artificial Sequence
  Synthetic
gaatgagaacttcgggtggtagaataattttagatgtggcctatccgtttgatgcgggcacaaacttgtccttaa

SEQ ID NO: 232703 - DNA, 75 bp, Artificial Sequence
  Synthetic
tgaatctacaaattggaacttaacaactgatattagtactgaaaaaggcttaatgttcagtggaaatcaaatagc

SEQ ID NO: 232704 - DNA, 75 bp, Artificial Sequence
  Synthetic
actgatattagtactgaaaaaggcttaatgttcagtggaaatcaaatagctattaatgcaggtcaggggcttaca

SEQ ID NO: 232705 - DNA, 75 bp, Artificial Sequence
  Synthetic
aattgggcgccggacttacttttgactcaaacaatagcattgccttaggcaacagcagcagcgctgcatatgacc

SEQ ID NO: 232706 - DNA, 75 bp, Artificial Sequence
  Synthetic
ctcaaacaatagcattgccttaggcaacagcagcagcgctgcatatgaccctcttacgctgtggacaactcccga

SEQ ID NO: 232707 - DNA, 75 bp, Artificial Sequence
  Synthetic
gaagacttagatacaaagctgacattgtgtttaagtaaaaatggcgccattgtaaatggcgtggtaagcttagtg

SEQ ID NO: 232708 - DNA, 75 bp, Artificial Sequence
  Synthetic
tgtgtttaagtaaaaatggcgccattgtaaatggcgtggtaagcttagtgccagttaaaggttcactactaaatt

SEQ ID NO: 232709 - DNA, 75 bp, Artificial Sequence
  Synthetic
tcacattttgtttaacgaacaaggtgttccacagacaggaacaccatcagctatagccccacaggcgtattgggg

SEQ ID NO: 232710 - DNA, 75 bp, Artificial Sequence
  Synthetic
gttccacagacaggaacaccatcagctatagccccacaggcgtattggggatacagacaggggcaatctatatct

SEQ ID NO: 232711 - DNA, 75 bp, Artificial Sequence
  Synthetic
gatttatgcctaactccagtgcctaccccagaaccaacggaagtgaagcaaaaagccaaatgtttacttccacct

SEQ ID NO: 232712 - DNA, 75 bp, Artificial Sequence
  Synthetic
ccccagaaccaacggaagtgaagcaaaaagccaaatgtttacttccacctacatgcagggtgataccgctaaacc

SEQ ID NO: 232713 - DNA, 75 bp, Artificial Sequence
  Synthetic
gccacttctactgttactggatactctttgagctttacatggacaggtatctcaaactacagtaatcaggctttt

SEQ ID NO: 232714 - DNA, 75 bp, Artificial Sequence
  Synthetic
ctttgagctttacatggacaggtatctcaaactacagtaatcaggctttttcatgcccatcatgttcattttctt

SEQ ID NO: 232715 - DNA, 75 bp, Artificial Sequence
  Synthetic
ctcaagaattgttattatatcttgtttatttgtttttacacaatgcgcgttgttaaacttcctccgccttcccat

SEQ ID NO: 232716 - DNA, 75 bp, Artificial Sequence
  Synthetic
ttatttgtttttacacaatgcgcgttgttaaacttcctccgccttcccattttaccctgtacacctccctttccc

SEQ ID NO: 232717 - DNA, 75 bp, Artificial Sequence
  Synthetic
ctgcatgtttctacttaaatttttaggtgtcaaagtccaaacagtttccttccgagcaaagcgatgatcagtgat

SEQ ID NO: 232718 - DNA, 75 bp, Artificial Sequence
  Synthetic
ggtgtcaaagtccaaacagtttccttccgagcaaagcgatgatcagtgatagaaacaaacccctcgcccacacag

SEQ ID NO: 232719 - DNA, 75 bp, Artificial Sequence
  Synthetic
gtaccaggtccatgttcacttcctacagaaacaaaaaaacagtcagtgtccatcggcagcccaagggttttcgcg

SEQ ID NO: 232720 - DNA, 75 bp, Artificial Sequence
  Synthetic
cagaaacaaaaaaacagtcagtgtccatcggcagcccaagggttttcgcgttgtccatattcttcaaacagcaca

SEQ ID NO: 232721 - DNA, 75 bp, Artificial Sequence
  Synthetic
ttagtaaacgctgacgctgaatttctactcggctatgtttcaaagaacgtgaagtacctttggtaataatttgca

SEQ ID NO: 232722 - DNA, 75 bp, Artificial Sequence
  Synthetic
tactcggctatgtttcaaagaacgtgaagtacctttggtaataatttgcacagcttttatcattagtaaacgggt

SEQ ID NO: 232723 - DNA, 75 bp, Artificial Sequence
  Synthetic
atctcacttaaatccttacaataactacagcataataccagcatgttatttaaaaatccataactaaatgcgctc

SEQ ID NO: 232724 - DNA, 75 bp, Artificial Sequence
  Synthetic
taaaaatccataactaaatgcgctccacccaaaactcattctttctaacaccaatccaacatgcccatcatacat

SEQ ID NO: 232725 - DNA, 75 bp, Artificial Sequence
  Synthetic
cctctaacaaaaatgcttcccatgtacagcacctcttttggcataaaccgattcactacttctctataccaaaag

SEQ ID NO: 232726 - DNA, 75 bp, Artificial Sequence
  Synthetic
acaccaccattttaaaccaccatgctagcaaaggaccggctgccttacactgtaatgaaccaggtcgattacagt

SEQ ID NO: 232727 - DNA, 75 bp, Artificial Sequence
  Synthetic
gtaatacagtaaagcatacagatgaaggaatgccccttacctcactaacattatgtaaggttaaactgttacatt

SEQ ID NO: 232728 - DNA, 75 bp, Artificial Sequence
  Synthetic
aggaatgccccttacctcactaacattatgtaaggttaaactgttacattcaaaaactgaagaattttcaggccc

SEQ ID NO: 232729 - DNA, 75 bp, Artificial Sequence
  Synthetic
tcacaaggtggtaacgggtacttcccgtatggtgccaatctgtatggataccgtctgttgcgctgcatgatacag

SEQ ID NO: 232730 - DNA, 75 bp, Artificial Sequence
  Synthetic
cgtatggtgccaatctgtatggataccgtctgttgcgctgcatgatacagtaaagacttccgcgccttttcgtac

SEQ ID NO: 232731 - DNA, 75 bp, Artificial Sequence
  Synthetic
cactgcatgcaacacctcgtcttctttggctgcgacgattgtgctccgtagtaagggcgtaatgcaaccactctc

SEQ ID NO: 232732 - DNA, 75 bp, Artificial Sequence
  Synthetic
ttggctgcgacgattgtgctccgtagtaagggcgtaatgcaaccactctcgcaaacacagcaaaattctttcagc

SEQ ID NO: 232733 - DNA, 75 bp, Artificial Sequence
  Synthetic
tctctaatgcgtcgcaaagtatccacacaggttgcatgggctaaacccaaccatgctatgcaagcagccgtgtcc

SEQ ID NO: 232734 - DNA, 75 bp, Artificial Sequence
  Synthetic
cacaggttgcatgggctaaacccaaccatgctatgcaagcagccgtgtcccggcttacgggaggaggaggaatgc

SEQ ID NO: 232735 - DNA, 75 bp, Artificial Sequence
  Synthetic
aaaaactcttaatccagacggtcagcaagaatttgaatgcgtaaatctcgcaggtggcagcgatcgcctccgctg

SEQ ID NO: 232736 - DNA, 75 bp, Artificial Sequence
  Synthetic
caaattgtaagcgattttccaaatgttcaacaacagcatctaaaagagccacagctctaatttccacaaacaaaa

SEQ ID NO: 232737 - DNA, 75 bp, Artificial Sequence
  Synthetic
ctcttctatcatcaaactgcctgactgaaccattcccaagtaattttcattcttccactgttgtattatttgaac

SEQ ID NO: 232738 - DNA, 75 bp, Artificial Sequence
  Synthetic
tgaaccattcccaagtaattttcattcttccactgttgtattatttgaacacactgattctgcaggtttaaacca

SEQ ID NO: 232739 - DNA, 75 bp, Artificial Sequence
  Synthetic
caccctccaccgccatccgcaggcagtacttcatatcggctgaaaaaagtctggatcctcaaacacctgtagcaa

SEQ ID NO: 232740 - DNA, 75 bp, Artificial Sequence
  Synthetic
gtacttcatatcggctgaaaaaagtctggatcctcaaacacctgtagcaaattcagtagatttaaattaggctcc

SEQ ID NO: 232741 - DNA, 75 bp, Artificial Sequence
  Synthetic
ttaatgccagttgtatacactcatacaaatcagaagccagcagcaaagaaagttcccctccaggtgtaagttccg

SEQ ID NO: 232742 - DNA, 75 bp, Artificial Sequence
  Synthetic
caaatcagaagccagcagcaaagaaagttcccctccaggtgtaagttccgaagtgcccacggagcatacaacttg

SEQ ID NO: 232743 - DNA, 75 bp, Artificial Sequence
  Synthetic
taggaggagttaaataatgcattacaagcagccaaaactcaggtagcacttctttaagaaacgccaccacctcaa

SEQ ID NO: 232744 - DNA, 75 bp, Artificial Sequence
  Synthetic
taaagactctggaaacaacacagaataatgaacaagcggcctctgaaacatgctttatgtagcctgaaaaaatat

SEQ ID NO: 232745 - DNA, 75 bp, Artificial Sequence
  Synthetic
taatgaacaagcggcctctgaaacatgctttatgtagcctgaaaaaatataaaacagaggttaaagtaaagatgc

SEQ ID NO: 232746 - DNA, 75 bp, Artificial Sequence
  Synthetic
ctctctaaaagcaaacgcgccaccggctgctttgcgcgaacgtcgcaaaatacgtccgaatgattaaacagcaaa

SEQ ID NO: 232747 - DNA, 75 bp, Artificial Sequence
  Synthetic
gctgctttgcgcgaacgtcgcaaaatacgtccgaatgattaaacagcaaaacagaaagttccactcttgaaccag

SEQ ID NO: 232748 - DNA, 75 bp, Artificial Sequence
  Synthetic
aaaccctctggcattcatatcgctcaaagaaaacaaagttcccacataaccagggggaatagtaactgctatgtg

SEQ ID NO: 232749 - DNA, 75 bp, Artificial Sequence
  Synthetic
aaagaaaacaaagttcccacataaccagggggaatagtaactgctatgtgcaaatatagtagcacaaccccgcgt

SEQ ID NO: 232750 - DNA, 75 bp, Artificial Sequence
  Synthetic
aaaataaaacataagcattagaatagccttcttgttcaggcaacatagccccaggtccctcaaaatacacataaa

SEQ ID NO: 232751 - DNA, 75 bp, Artificial Sequence
  Synthetic
gccttcttgttcaggcaacatagccccaggtccctcaaaatacacataaacagcctccaaaacagccataacaca

SEQ ID NO: 232752 - DNA, 75 bp, Artificial Sequence
  Synthetic
cagagccagtgacagcagacaaacagtctgccacaagcgctcctttaatactgaaaaatagtgacgtaaatgccc

SEQ ID NO: 232753 - DNA, 75 bp, Artificial Sequence
  Synthetic
gtctgccacaagcgctcctttaatactgaaaaatagtgacgtaaatgcccaaagtccaggtgcacaagtccaaaa

SEQ ID NO: 232754 - DNA, 75 bp, Artificial Sequence
  Synthetic
aatttcacttccgcatatgagttcgcgcgctacaatactcccacagtgcgtcacatccggcgcgcccggctccca

SEQ ID NO: 232755 - DNA, 75 bp, Artificial Sequence
  Synthetic
cgcgctacaatactcccacagtgcgtcacatccggcgcgcccggctcccacgccacgcccaacttccggcttccg

SEQ ID NO: 232756 - DNA, 75 bp, Artificial Sequence
  Synthetic
ccacacctacaaccaatcaaattacactctccacccacttcattttaatattggctctagtccagtataaggtat

SEQ ID NO: 232757 - DNA, 75 bp, Artificial Sequence
  Synthetic
aatgcgcactgcagtccgaggagacattttaactgttatgcttgcaaagcttgagaccttaactgctcagctaga

SEQ ID NO: 232758 - DNA, 75 bp, Artificial Sequence
  Synthetic
ttgagaccttaactgctcagctagaggagctgtcgcacaaggtcgaagaattagctgatgctaccactcccaccc

SEQ ID NO: 232759 - DNA, 75 bp, Artificial Sequence
  Synthetic
tgaccacttcgccgcgcaagctctcattagtccaggctaaacgaccgccttttcgagagcaaaaaggaggaagaa

SEQ ID NO: 232760 - DNA, 75 bp, Artificial Sequence
  Synthetic
atcagcatccacagtaaaaataccaggacataaaattttatcaaaataatcaattttggaagtatgattttcaag

SEQ ID NO: 232761 - DNA, 75 bp, Artificial Sequence
  Synthetic
ggacataaaattttatcaaaataatcaattttggaagtatgattttcaagtgccacctgccattgccgtacggct

SEQ ID NO: 232762 - DNA, 75 bp, Artificial Sequence
  Synthetic
cggtgagcaacacgcctgcttaaaagcgacggcgcgcaggaactgggacttccgcttctgcgggggcatgaggca

SEQ ID NO: 232763 - DNA, 75 bp, Artificial Sequence
  Synthetic
tagtggaaggtgctgagcccgtagttgactggcatgggcgacgacccgacgattgatgttctgaatttgtcgacg

SEQ ID NO: 232764 - DNA, 75 bp, Artificial Sequence
  Synthetic
gattgatgttctgaatttgtcgacgttgtgtaaacaccaccggtcccgttgttttgaacctgaaagaaagttcaa

SEQ ID NO: 232765 - DNA, 75 bp, Artificial Sequence
  Synthetic
caatttctgccattagttgatcaatttcttcctcttggagatctccatgacccgctcgttcaatggtagctgcaa

SEQ ID NO: 232766 - DNA, 75 bp, Artificial Sequence
  Synthetic
ttcttcctcttggagatctccatgacccgctcgttcaatggtagctgcaaggtcattagagatgcgtcccataag

SEQ ID NO: 232767 - DNA, 75 bp, Artificial Sequence
  Synthetic
ggcggcggcgcatagtttccgtcactgctcgaccattttcacgtgggcgaagctcgaaaagtccaccccttagtt

SEQ ID NO: 232768 - DNA, 75 bp, Artificial Sequence
  Synthetic
ctagggtaggaaatgcgttgcgaggtgtgtttggtagcgacacagcgcttactatgcattttatgatttgctgcg

SEQ ID NO: 232769 - DNA, 75 bp, Artificial Sequence
  Synthetic
cgtttgtgcctcggcaaaatatgtttcgagataacagcgggcaggaggctgaggaaatgagagactgtagattca

SEQ ID NO: 232770 - DNA, 75 bp, Artificial Sequence
  Synthetic
taatgcatctttgggactttgtggaagcgtatgtgcataatccagcaagcaaacctttgaccgcccagctcttct

SEQ ID NO: 232771 - DNA, 75 bp, Artificial Sequence
  Synthetic
tgcacagcctgcaaagggcgctaactggagccggaacagaggatgaggccttttttgatatgggcgcagatctaa

SEQ ID NO: 232772 - DNA, 75 bp, Artificial Sequence
  Synthetic
tggaagcagtagtgccgtctcgaactaatcccacccacgagaaagtgctaaccatagtgaacgctctgttggaca

SEQ ID NO: 232773 - DNA, 75 bp, Artificial Sequence
  Synthetic
taatcccacccacgagaaagtgctaaccatagtgaacgctctgttggacagcaaagctattcgtaaagatgaggc

SEQ ID NO: 232774 - DNA, 75 bp, Artificial Sequence
  Synthetic
cttgcgcaacgagagcgatttcatcgcgacggcaatcttggctccctggttgcgctaaatgcttttttaagcact

SEQ ID NO: 232775 - DNA, 75 bp, Artificial Sequence
  Synthetic
aagaagattatacaaactttataagcgctttgcgcctgatggttactgaagttccacaaagcgaagtgtatcagt

SEQ ID NO: 232776 - DNA, 75 bp, Artificial Sequence
  Synthetic
ttccaggcaggggttgcaaaccgtaaatttaagccaggcttttaagaatttgcaaggcctgtggggggtacgcgc

SEQ ID NO: 232777 - DNA, 75 bp, Artificial Sequence
  Synthetic
tccagtctgttaacgccaaattctcggttattattgttgttaatcgctccttttaccaacagcgatagtttaagt

SEQ ID NO: 232778 - DNA, 75 bp, Artificial Sequence
  Synthetic
cttccgcactggaagctccctacgtgcctccccgctatttggctcctacggagggaagaaatagcatccgttatt

SEQ ID NO: 232779 - DNA, 75 bp, Artificial Sequence
  Synthetic
gcctccccgctatttggctcctacggagggaagaaatagcatccgttattcagagttgtcacctttatacgatac

SEQ ID NO: 232780 - DNA, 75 bp, Artificial Sequence
  Synthetic
attccacttattgccgcggccatcggagccgtacccggaattgcttcagttgccttgcaggcttctcgaaaaaat

SEQ ID NO: 232781 - DNA, 75 bp, Artificial Sequence
  Synthetic
atcggcaccagccagctgaacgggggcgccttcaattggaacagtatctggagcggtcttaaaaattttggttcc

SEQ ID NO: 232782 - DNA, 75 bp, Artificial Sequence
  Synthetic
acccgcgatccgctaattggcaaagcaccctaaacagcattgtgggactgggagtaaagtctttaaaacgcagac

SEQ ID NO: 232783 - DNA, 75 bp, Artificial Sequence
  Synthetic
gtgctggatcgcggtcccagttttaagccttattcgggtaccgcctataactcactggcgccaaaaggcgcccct

SEQ ID NO: 232784 - DNA, 75 bp, Artificial Sequence
  Synthetic
ataaggtgaacacttttgggcaggctccgtatcttagtgactctattactgccgatggtattaaagttggaacag

SEQ ID NO: 232785 - DNA, 75 bp, Artificial Sequence
  Synthetic
tccgtatcttagtgactctattactgccgatggtattaaagttggaacagataccgcccaagcaggggcggcggt

SEQ ID NO: 232786 - DNA, 75 bp, Artificial Sequence
  Synthetic
gagccgcaggtaggggcaagtgaatggaataccagtattacaaacgttaaagcagggggtagggcattaaaacaa

SEQ ID NO: 232787 - DNA, 75 bp, Artificial Sequence
  Synthetic
ggaataccagtattacaaacgttaaagcagggggtagggcattaaaacaaacgactgccatgcagccgtgctacg

SEQ ID NO: 232788 - DNA, 75 bp, Artificial Sequence
  Synthetic
aaaagggggacaaaccaaggacaataacgtagaacttcggttttttgacacagccaacaatgcagccactcctca

SEQ ID NO: 232789 - DNA, 75 bp, Artificial Sequence
  Synthetic
aacgtagaacttcggttttttgacacagccaacaatgcagccactcctcaagttgtgttttacactgaagatgta

SEQ ID NO: 232790 - DNA, 75 bp, Artificial Sequence
  Synthetic
ttgtgtttaagccggctgttcctaatggaacaattgcgtccgagtccttgttgggacagcaagcagcgccaaata

SEQ ID NO: 232791 - DNA, 75 bp, Artificial Sequence
  Synthetic
tggaacaattgcgtccgagtccttgttgggacagcaagcagcgccaaatagagcaaattacattgcattcagaga

SEQ ID NO: 232792 - DNA, 75 bp, Artificial Sequence
  Synthetic
aacagcacagggaacatgggtgtccttgccggacaagcttcacagctaaacgcagtagtggacttacaagacaga

SEQ ID NO: 232793 - DNA, 75 bp, Artificial Sequence
  Synthetic
ttgccggacaagcttcacagctaaacgcagtagtggacttacaagacagaaatacggagctgtcttaccagttaa

SEQ ID NO: 232794 - DNA, 75 bp, Artificial Sequence
  Synthetic
gcggtatttctcactgtggaattctgcagtggacagttacgaccctgatgttcgcatcattgagaatcatggggt

SEQ ID NO: 232795 - DNA, 75 bp, Artificial Sequence
  Synthetic
gcagtggacagttacgaccctgatgttcgcatcattgagaatcatggggttgaggatgaactcccaaattattgc

SEQ ID NO: 232796 - DNA, 75 bp, Artificial Sequence
  Synthetic
taaagagttacaaaggcattaagcaaaacaacggagggggcggtaactgggctgcggacgacactgttggcgaca

SEQ ID NO: 232797 - DNA, 75 bp, Artificial Sequence
  Synthetic
gctgcggacgacactgttggcgacaaaaacgatataggcattggtaacattgccgctatggaaattaacttgcag

SEQ ID NO: 232798 - DNA, 75 bp, Artificial Sequence
  Synthetic
acaactcagggtttgtgggatacctgggtcctactatgcgcgagggacaagcttatcctgcgaactatccctatc

SEQ ID NO: 232799 - DNA, 75 bp, Artificial Sequence
  Synthetic
gatccatttggattttctgatcagcggctcaaacaaatctatcagtttgagtacgaaagtctgttgcgtcgtagt

SEQ ID NO: 232800 - DNA, 75 bp, Artificial Sequence
  Synthetic
gttcctcgcgagaatcaccatggttggtgggcagggctatgtttctatactgcaaacgcggatgccacttgaact

SEQ ID NO: 232801 - DNA, 75 bp, Artificial Sequence
  Synthetic
ggtgggcagggctatgtttctatactgcaaacgcggatgccacttgaactctggaataacaagccgaggaagcgg

SEQ ID NO: 232802 - DNA, 75 bp, Artificial Sequence
  Synthetic
tttttggaaagactgagaaccgtctgcatgatgcataatgcgaacagggggcatgctgaaacccatgactcctaa

SEQ ID NO: 232803 - DNA, 75 bp, Artificial Sequence
  Synthetic
acagcctccaggtcttcttcgctttctgagtccaaaaagtaccgacccatttttggaggcggcggctgagtgttg

SEQ ID NO: 232804 - DNA, 75 bp, Artificial Sequence
  Synthetic
ccccgaggaattggaaggctctcttctaatccaagagcaaccaaataaggaacaggcagaaagcaatgagcaaaa

SEQ ID NO: 232805 - DNA, 75 bp, Artificial Sequence
  Synthetic
agagaactcaacaaactgcttgacagagcgttgaaatcactatggacaggtttcgacgaaagaacggtagcggca

SEQ ID NO: 232806 - DNA, 75 bp, Artificial Sequence
  Synthetic
aacagaggctttcacctctaataccctgcttctatatagtggtcttgtggctcttactttatttctaatttctaa

SEQ ID NO: 232807 - DNA, 75 bp, Artificial Sequence
  Synthetic
caactcagtgtatccaaacaaagttcagtttaataatgttagtcgattctattatggatacgccaagggaggccc

SEQ ID NO: 232808 - DNA, 75 bp, Artificial Sequence
  Synthetic
acacggtaattttcttagtaataattgcatttagcgttctcattattatagcggccctcacttacctgtgctgtc

SEQ ID NO: 232809 - DNA, 75 bp, Artificial Sequence
  Synthetic
tgcatttagcgttctcattattatagcggccctcacttacctgtgctgtcacaaacagacttaaatcttgctttt

SEQ ID NO: 232810 - DNA, 75 bp, Artificial Sequence
  Synthetic
tgattactactacgtgcgatacgtttaccgcagacatcaccctcgctatcaaaacccccaaattgcagctcttct

SEQ ID NO: 232811 - DNA, 75 bp, Artificial Sequence
  Synthetic
gtctggatcttcaaacacctgcagtaaattcagtagatttacattaggctccacaccttgctctcgcagctgaca

SEQ ID NO: 232812 - DNA, 75 bp, Artificial Sequence
  Synthetic
cactaagctccattcttgagcctggataaagcgtttcagcgccaacaaaaacccctctggcgttcatgccgctca

SEQ ID NO: 232813 - DNA, 75 bp, Artificial Sequence
  Synthetic
gtgcacacttttaatactgaaaaacagtgacgtaaatgaccaaagttcacctgcgcaacaaaaaaccccgaaaca

SEQ ID NO: 232814 - DNA, 75 bp, Artificial Sequence
  Synthetic
catcatcaataatataccttatagatggaatggtgccaatatgcaaatgaggtaatttaaaaaagtgcgcgctgt

SEQ ID NO: 232815 - DNA, 75 bp, Artificial Sequence
  Synthetic
gctctgacgggggcagggaccgatggggagaactactttgacatgggggcagacttgcaatggcaacctagccgc

SEQ ID NO: 232816 - DNA, 75 bp, Artificial Sequence
  Synthetic
tggacaggcgcaaaaccaagcgccaactgtgtaattaaagagggagaagattccccagactgtaagctcacttta

SEQ ID NO: 232817 - DNA, 75 bp, Artificial Sequence
  Synthetic
gaggtgacgtaacttttgtgggaggagttatgttgcaagttatcgcggtaaaggtgacgtaaaatgaggtgtggt

SEQ ID NO: 232818 - DNA, 75 bp, Artificial Sequence
  Synthetic
taccaagctgtcacacttgcttaccagcacaacaactctggctttgtgggttaccatgcacccactctccgtcag

SEQ ID NO: 232819 - DNA, 75 bp, Artificial Sequence
  Synthetic
agttatgttgcaagttatcgcggtaaaggtgacgtaaaatgaggtgtggtttaaacacggaagtagacagttttc

SEQ ID NO: 232820 - DNA, 75 bp, Artificial Sequence
  Synthetic
aaggtgacgtaaaatgaggtgtggtttaaacacggaagtagacagttttcccacgcttactgacaggatatgagg

SEQ ID NO: 232821 - DNA, 75 bp, Artificial Sequence
  Synthetic
tagttttgggcggatgcaagttaaaattctccattttggcgcgaaaactgaatgaggaagtgaatttctgagtca

SEQ ID NO: 232822 - DNA, 75 bp, Artificial Sequence
  Synthetic
gcgagaagagttttctcctccgcgccgcaagtcagttctgcgctttgaaaatgagacacctgcgtttcctgccac

SEQ ID NO: 232823 - DNA, 75 bp, Artificial Sequence
  Synthetic
tcctcagcacccagcctgccaacgtgccccgcggccagcaagactatacaaactttctaagtgcactgagactca

SEQ ID NO: 232824 - DNA, 75 bp, Artificial Sequence
  Synthetic
aaccccaccatgaagttgctgactggggtgcccaacagcatgctccaatcaccccaagtccagcccaccctgcgc

SEQ ID NO: 232825 - DNA, 75 bp, Artificial Sequence
  Synthetic
gacaaagaggctgtccgtgtccccgtagaccgactttatgggcctgtcctcgagcggagtgcctcggtcctcttc

SEQ ID NO: 232826 - DNA, 75 bp, Artificial Sequence
  Synthetic
ggagtgcacgcccccgtaggagatcgcgcgaccgtgtctagcttgctgacccccaactcccgcctactgctgctg

SEQ ID NO: 232827 - DNA, 75 bp, Artificial Sequence
  Synthetic
atatgcaataataagtcatgtaaaaaccgtgttcaataaacagcactttatttttacatgcactgaggctctggt

SEQ ID NO: 232828 - DNA, 75 bp, Artificial Sequence
  Synthetic
atatgagaatgcactgccactttatttacagtaagtgtatttaagtgaaatttaaaggaatagtgtagctgttta

SEQ ID NO: 232829 - DNA, 75 bp, Artificial Sequence
  Synthetic
gcctaagcctgggaaacgccctgctgtggataagcttgaggacttgttggagggtggggatggacctttggacct

SEQ ID NO: 232830 - DNA, 75 bp, Artificial Sequence
  Synthetic
cagcagcagcggggacctccagcagaaaaccagcagcagcagttagaaaatccagtgcagcaggaggaggactga

SEQ ID NO: 232831 - DNA, 75 bp, Artificial Sequence
  Synthetic
tgagtgccctgcagctgtgtttatttaatgtgacgtcatgtaataaaattatgtcagctgctgagtgttttatta

SEQ ID NO: 232832 - DNA, 75 bp, Artificial Sequence
  Synthetic
atggaggtttgggctatcttggaagacctcagacagactaggctactgctagaaaacgcctcggacggagtctct

SEQ ID NO: 232833 - DNA, 75 bp, Artificial Sequence
  Synthetic
cactcttccgtgtcgctgtccgggtcgaggggtgctgccgctgcggtgcccgaggctgcaagtcctttccctagc

SEQ ID NO: 232834 - DNA, 75 bp, Artificial Sequence
  Synthetic
gtgatctagctaggctagtgtttaggataaaacaggactacagggaagaatttgaaaagttattggacgacagtc

SEQ ID NO: 232835 - DNA, 75 bp, Artificial Sequence
  Synthetic
gggtcatcaggctcattttaaggagaaggttttatcagttttagatttttctactcctggtagaactgctgctgc

SEQ ID NO: 232836 - DNA, 75 bp, Artificial Sequence
  Synthetic
ggtaatttaaaaaagtgcgcgctgtgtggtgattggctgcggggtgaacggctaaaatgggtgggacgatgctgg

SEQ ID NO: 232837 - DNA, 75 bp, Artificial Sequence
  Synthetic
acagacagaggggtcttgtatgggacgatgaggactcggccgatgacagcagcgtgttggacttgggtgggagag

SEQ ID NO: 232838 - DNA, 75 bp, Artificial Sequence
  Synthetic
gagggggcaacccgttcgctcatctgcgcccgcactttgggcgcatgttgtaaaagtgaaagtaaaataaaaagg

SEQ ID NO: 232839 - DNA, 75 bp, Artificial Sequence
  Synthetic
cgtgctaggcggagcggtggtgtatccggagggtcctcctccttcgtacgagagcgtgatgcagcagcaggcggc

SEQ ID NO: 232840 - DNA, 75 bp, Artificial Sequence
  Synthetic
aacctgacgagttccgtcaagaggccactcttgagtgccagcgagaagagttttctcctccgcgccgcgagtcag

SEQ ID NO: 232841 - DNA, 75 bp, Artificial Sequence
  Synthetic
tgcgattcctgccacaggaaattatatccagtgagaccgggatcgaaatactggaatttgtggtaaataccctga

SEQ ID NO: 232842 - DNA, 75 bp, Artificial Sequence
  Synthetic
cattcgttactcggagctggcaccccagtacgataccaccaggttgtatctggtggacaacaagtcggcggacat

SEQ ID NO: 232843 - DNA, 75 bp, Artificial Sequence
  Synthetic
gattggacataaaccctcctcctgagacccttgataccccaggggtggttgtggaaagcggcagaggtgggaaaa

SEQ ID NO: 232844 - DNA, 75 bp, Artificial Sequence
  Synthetic
agaaatgcatgctacatatcagggaatggggcagaggttataatagatacacaagataaagcagcttttagatgt

SEQ ID NO: 232845 - DNA, 75 bp, Artificial Sequence
  Synthetic
cgcacaaagcacaagctctaaagaagctctaaagacactctccaacctctccacaatatatacacaagccctaaa

SEQ ID NO: 232846 - DNA, 75 bp, Artificial Sequence
  Synthetic
atgttcagcaacaagttcaaggctcgggtgatggtgtctagaaaggctcctgaaggtgttacagtagctgataat

SEQ ID NO: 232847 - DNA, 75 bp, Artificial Sequence
  Synthetic
ttcctctttctcacggtacgtgatatcccactaacttgcaacgtcattttcccacggtcgcaccgccccttttag

SEQ ID NO: 232848 - DNA, 75 bp, Artificial Sequence
  Synthetic
ctaacactaagctgattctacatggttgtagcttttttgggtttaataatacgtgtgtagaagcttgggggcaag

SEQ ID NO: 232849 - DNA, 75 bp, Artificial Sequence
  Synthetic
tttacaacaccagccagaccctccgttccagccagaagaaccagacccttcctctgatccaggactctaattcta

SEQ ID NO: 232850 - DNA, 75 bp, Artificial Sequence
  Synthetic
aacaagcgtaacttcctctttctcacggtacgtcacatccgattaacttgcaacgtcattttcccacggccgcgc

SEQ ID NO: 232851 - DNA, 75 bp, Artificial Sequence
  Synthetic
agtgacattggtgtcaagtttgacaccaggaacttcagactgggctgggaccccaaaactaagttgattatgcca

SEQ ID NO: 232852 - DNA, 75 bp, Artificial Sequence
  Synthetic
ccaggaacttcagactgggctgggaccccaaaactaagttgattatgccaggggtctatacttatgaagccttcc

SEQ ID NO: 232853 - DNA, 75 bp, Artificial Sequence
  Synthetic
gctaaaaggggcggcgcggccgtgggaaaatgatgttttttgggggtggagttttttttgcaagttgtcgcggga

SEQ ID NO: 232854 - DNA, 75 bp, Artificial Sequence
  Synthetic
tcgccgactacctcaccgggcttggctcagaggacgtgctcctcaagcatctagcaaggcagtccatcatagtca

SEQ ID NO: 232855 - DNA, 75 bp, Artificial Sequence
  Synthetic
ctgcggggtggactttactgagagtcgccttagcaacttgcttggcatcaggaagagacacccattccaggaggg

SEQ ID NO: 232856 - DNA, 75 bp, Artificial Sequence
  Synthetic
cgccttagcaacttgcttggcatcaggaagagacacccattccaggagggtttcaaaatattgtatgaggatcta

SEQ ID NO: 232857 - DNA, 75 bp, Artificial Sequence
  Synthetic
agaggccttatcagatgctgacctgcgctggtggacattgcaatattcttgctaccgtgcatatcgtttcacatg

SEQ ID NO: 232858 - DNA, 75 bp, Artificial Sequence
  Synthetic
gtgttgctggtttaagaaatgggggtcgtactagtatcgcttgctttactttcgcttttgggtctgggctctgct

SEQ ID NO: 232859 - DNA, 75 bp, Artificial Sequence
  Synthetic
gtatggtgaacatcaatcatgatccctagaaatttcttcttcaccatactcatctgtgctttcaatgtctgtgct

SEQ ID NO: 232860 - DNA, 75 bp, Artificial Sequence
  Synthetic
tggacgtagaagcatatgaaaaaagtaagaaagaacaagaagctaaaacagaagctgctaaagctgctgctgttg

SEQ ID NO: 232861 - DNA, 75 bp, Artificial Sequence
  Synthetic
cccacttgagtttcatggcgaggtcataggcgatgttgacgagccgctggtctccagagagtttcatgaccagca

SEQ ID NO: 232862 - DNA, 75 bp, Artificial Sequence
  Synthetic
agccgcgcctacgagctcaacctcttttcgcctcgggtgccccccaagcggcagccaaacggcacctgcgagccc

SEQ ID NO: 232863 - DNA, 75 bp, Artificial Sequence
  Synthetic
tgtttatgccttaccagtgtaacatgaatcatgtgaaggtgatgttggaaccagatgccttttccagagtgagct

SEQ ID NO: 232864 - DNA, 75 bp, Artificial Sequence
  Synthetic
taagaaagaacaagaagctaaaacagaagctgctaaagctgctgctgttgctaaagccaacatagttgccagcga

SEQ ID NO: 232865 - DNA, 75 bp, Artificial Sequence
  Synthetic
gaagtcagaggagacaactatactgcctcagctgttgcgactgaagaatcactattggctgctgtggctgaaaac

SEQ ID NO: 232866 - DNA, 75 bp, Artificial Sequence
  Synthetic
cctcagctgttgcgactgaagaatcactattggctgctgtggctgaaaacgaaactacagaaacaaaactcacta

SEQ ID NO: 232867 - DNA, 75 bp, Artificial Sequence
  Synthetic
cacgcaagaaatggcctgtatttgaacataatgtgattaccaagtgcaccatgcacataggtggtcgcaggggaa

SEQ ID NO: 232868 - DNA, 75 bp, Artificial Sequence
  Synthetic
gagtagaagctataatgtcttggacgataaaatcaacacagcatatcgcagttggtacttgtcatacaactatgg

SEQ ID NO: 232869 - DNA, 75 bp, Artificial Sequence
  Synthetic
gataaaatcaacacagcatatcgcagttggtacttgtcatacaactatggagaccctgaaaaaggagtccgttcc

SEQ ID NO: 232870 - DNA, 75 bp, Artificial Sequence
  Synthetic
gtagagtatgaaaatgagccacaaccttcactgccccctgccattagttacttcaacctaaccggcggagatgac

SEQ ID NO: 232871 - DNA, 75 bp, Artificial Sequence
  Synthetic
ccagtggacagaacaggggcattaagagggagaggaatcctagtgggaataattcaagaaccgagttggctttaa

SEQ ID NO: 232872 - DNA, 75 bp, Artificial Sequence
  Synthetic
tcacatgcggggcggaacaggtctactggtcgctcccagacatgatgcaggaccccgttacctttcgctccacga

SEQ ID NO: 232873 - DNA, 75 bp, Artificial Sequence
  Synthetic
gagttcgtcagaatgtcatgggatctactgtggatgggagacccgtccagcccgccaattcctcaacgctgacct

SEQ ID NO: 232874 - DNA, 75 bp, Artificial Sequence
  Synthetic
cgtgcccttgtttttccttttgggcggcggtggctctgttgcttcttgcatgtttagaagcggtgtcgagggcgc

SEQ ID NO: 232875 - DNA, 75 bp, Artificial Sequence
  Synthetic
tggagatactaagggttgcatccactgttcctgtgattccaccgagtgcatctacacactgctgaagaccctctg

SEQ ID NO: 232876 - DNA, 75 bp, Artificial Sequence
  Synthetic
tgtaaaggtgggattgaatgtttagatacatgggcattagtccgtctcgggggtggagatagctccattgaagag

SEQ ID NO: 232877 - DNA, 75 bp, Artificial Sequence
  Synthetic
agtgcatggtgttgcacaatatcttttaggagcagactaattgcaacggggaggcccttagtgtaggtgtttaca

SEQ ID NO: 232878 - DNA, 75 bp, Artificial Sequence
  Synthetic
gagctctcagcctgcgtcatcacccagggggcaattctggcccaattgcaagccatccaaaaatcccgccaagaa

SEQ ID NO: 232879 - DNA, 75 bp, Artificial Sequence
  Synthetic
ttccctcacatatttgcatttcccaggctttcagttcagagggggggatcatgtccacctgcggggctataaaaa

SEQ ID NO: 232880 - DNA, 75 bp, Artificial Sequence
  Synthetic
ccgctgctctggtgcggagagtgtatcgcgatggccgcgcggatcccctgacgttgccgcgcgtacgctaccatc

SEQ ID NO: 232881 - DNA, 75 bp, Artificial Sequence
  Synthetic
ggggggccacttcgttcatcatttgccttacatggatattttcccgcaccaagtccgttaggaggcgctctcccc

SEQ ID NO: 232882 - DNA, 75 bp, Artificial Sequence
  Synthetic
tgcattactaccgtcacctccacagcccctactgcagccagcaagccccggcaacctcggcagaaaaagacagca

SEQ ID NO: 232883 - DNA, 75 bp, Artificial Sequence
  Synthetic
actcaggcaaccctcataacctccccatttaccttttcctatattacagaagatgactgacaacaaaaataaagt

SEQ ID NO: 232884 - DNA, 75 bp, Artificial Sequence
  Synthetic
tctgggagtacaaaccgtggacatcaagattcccaccgagtctatggaagtccagactgaacctgcaaagccccc

SEQ ID NO: 232885 - DNA, 75 bp, Artificial Sequence
  Synthetic
tttaaacatttggataccattagagatagacatagttttagattccacattccaaacagtttcagagcgagccaa

SEQ ID NO: 232886 - DNA, 75 bp, Artificial Sequence
  Synthetic
tccaaacagtttcagagcgagccaatctggggtcagtgatacataaaaatgcatcgggatagtcttttaaagcgc

SEQ ID NO: 232887 - DNA, 75 bp, Artificial Sequence
  Synthetic
cgggtgtcaaagatgtaatcgttacaggtgcgcaccaggtactggtagccgatgagaaagtgcggcggcggctgg

SEQ ID NO: 232888 - DNA, 75 bp, Artificial Sequence
  Synthetic
tcgccgtcgccgccgcaccaccagcaaactgactcctgccgctctggtgcggagggtgtatcgcgatggccgcgc

SEQ ID NO: 232889 - DNA, 75 bp, Artificial Sequence
  Synthetic
gaactcgcgtacgcggttccagatgttgcgcagcggcatgaagtagttcatggtaggcacggtttggcccgtgag

SEQ ID NO: 232890 - DNA, 75 bp, Artificial Sequence
  Synthetic
cctgctgctataaaaaagacgaacataaaggtgatccattacttagatttgatatttaatttgttcttttttttt

SEQ ID NO: 232891 - DNA, 75 bp, Artificial Sequence
  Synthetic
aataaaatagaatggactctgacgctcctggtcctgtgactatgtttttgtagagatggaagacatcaatttttc

SEQ ID NO: 232892 - DNA, 75 bp, Artificial Sequence
  Synthetic
atcaagtgtttttatttcatttttcgcgcacggtatgccctagaccaccgatctcgatcattgagaactcggtgg

SEQ ID NO: 232893 - DNA, 75 bp, Artificial Sequence
  Synthetic
agaacttccaacagaaggtggtcgatgggatcgcctctggcatcaatggggtggtggatctggccaaccaggccg

SEQ ID NO: 232894 - DNA, 75 bp, Artificial Sequence
  Synthetic
acaatcttcttgttgtccagcttggtggcaaatgatccatagagggcattggatagaagcttggcgatggagcgc

SEQ ID NO: 232895 - DNA, 75 bp, Artificial Sequence
  Synthetic
ctcccctggaaaagcggggagacaagcgcccgcgtcccgatatggaggagacgctggtgacgcgcggagacgagc

SEQ ID NO: 232896 - DNA, 75 bp, Artificial Sequence
  Synthetic
ggattgcatgaaagcctttgctgtcttatttgtgctgagtttaataaaaactgagttaagaccctcctacggact

SEQ ID NO: 232897 - DNA, 75 bp, Artificial Sequence
  Synthetic
ttatttgtgctgagtttaataaaaactgagttaagaccctcctacggactaccgcttcttcaaccaggactttac

SEQ ID NO: 232898 - DNA, 75 bp, Artificial Sequence
  Synthetic
acatccacactggtggccacctcgcctcggaggggctcattggtccagcagagtcgacctccttttcttgaacag

SEQ ID NO: 232899 - DNA, 75 bp, Artificial Sequence
  Synthetic
cccctgacatgaggcagcttcttgagttcttcaaaagtgaggtctgtagggtcagtgagagcatagtgttcgagg

SEQ ID NO: 232900 - DNA, 75 bp, Artificial Sequence
  Synthetic
tcctctgatccaggactctaactctaccttcccagcaccatcccctactaaccttcccgaaactaacaacctcgg

SEQ ID NO: 232901 - DNA, 75 bp, Artificial Sequence
  Synthetic
gctcatcaggggggtccgcatctatggtaaatattcccggtagcaaatctttgtcaaaatagctaatggtggcgg

SEQ ID NO: 232902 - DNA, 75 bp, Artificial Sequence
  Synthetic
ggtctggaccgaagacgggtgctgcgtgatgatgattttgaagtcgatgaagtgacaggaataagtcctgctagg

SEQ ID NO: 232903 - DNA, 75 bp, Artificial Sequence
  Synthetic
gctattaattaaatatggagtagcgcttaacttgcttgtctgtgtgtatgtgtcatcaccacgccgccgcagcag

SEQ ID NO: 232904 - DNA, 75 bp, Artificial Sequence
  Synthetic
accctactagtcgtgcttgctttactttcgcttttgggactgggctctgctaatctcattcctcctgatcacgat

SEQ ID NO: 232905 - DNA, 75 bp, Artificial Sequence
  Synthetic
actgcacactcacctttgcacctgaaacaagccgctactgcggagtagttattaggtgcggactggaatgcaggc

SEQ ID NO: 232906 - DNA, 75 bp, Artificial Sequence
  Synthetic
accaagtactaactgtaaaattcaagaagatgcagatgccctagactgcaagctaactctagtccttgtaaaaaa

SEQ ID NO: 232907 - DNA, 75 bp, Artificial Sequence
  Synthetic
aaaatgggcatgaggtaagcctacagagtcccttatgaagtgggcatatgactcttgcagcttggctaccagctc

SEQ ID NO: 232908 - DNA, 75 bp, Artificial Sequence
  Synthetic
aacaagccgctactgcggagtagttattaggtgcggactggaatgcaggcccattgaaattacacacaataacaa

SEQ ID NO: 232909 - DNA, 75 bp, Artificial Sequence
  Synthetic
ctacacgctggctgtgggcgacaacagagtgctggatatggcaagcaccttctttgacatccgtggggtgcttga

SEQ ID NO: 232910 - DNA, 75 bp, Artificial Sequence
  Synthetic
tctggcacagcttacaactcgctggcacctaaaggcgcccctaacacatgtcagtggaagtatgaaagcacaacc

SEQ ID NO: 232911 - DNA, 75 bp, Artificial Sequence
  Synthetic
catcactgctatcgtgtgtgtgtgcatacacttgcttatagtcattcgccccagaaacagcaatgaggaaaaaga

SEQ ID NO: 232912 - DNA, 75 bp, Artificial Sequence
  Synthetic
cacctaaaggcgcccctaacacatgtcagtggaagtatgaaagcacaaccactgaagaagacaaggaagaggagg

SEQ ID NO: 232913 - DNA, 75 bp, Artificial Sequence
  Synthetic
atacacttgcttatagtcattcgccccagaaacagcaatgaggaaaaagagaaaatgccctaacttttttcacaa

SEQ ID NO: 232914 - DNA, 75 bp, Artificial Sequence
  Synthetic
gatgttactgtaatactcaacagacgtatgaccgctgctggaatggcttatgcaatgaactttacgtggcttctt

SEQ ID NO: 232915 - DNA, 75 bp, Artificial Sequence
  Synthetic
gcaaacaaaagaaatgactgctacttttggaaatgcccctatgaagggacttgacatagataaagaaggcttaca

SEQ ID NO: 232916 - DNA, 75 bp, Artificial Sequence
  Synthetic
ttttttcttcttactattgttgctgttatttccgcacaaacaatagtagatgttccacttggttctaactacaca

SEQ ID NO: 232917 - DNA, 75 bp, Artificial Sequence
  Synthetic
tttggaaatgcccctatgaagggacttgacatagataaagaaggcttacaaataggagaggacgatagcaaggct

SEQ ID NO: 232918 - DNA, 75 bp, Artificial Sequence
  Synthetic
ttatttccgcacaaacaatagtagatgttccacttggttctaactacacactaataggtcctacaatccattcag

SEQ ID NO: 232919 - DNA, 75 bp, Artificial Sequence
  Synthetic
acaaactattccaaccagaacctcaagtgggcgatgaacaatggcaggataccactggtaatactgaacagtatg

SEQ ID NO: 232920 - DNA, 75 bp, Artificial Sequence
  Synthetic
tgaagactactataatgtattttgtgatggggatgatgacattcaagtaacctgtaacaaacagaatcttacact

SEQ ID NO: 232921 - DNA, 75 bp, Artificial Sequence
  Synthetic
agtgggcgatgaacaatggcaggataccactggtaatactgaacagtatggtggaagagctcttaaacctgaaac

SEQ ID NO: 232922 - DNA, 75 bp, Artificial Sequence
  Synthetic
gaggttccaaaaatctttgagggtctgggaagtgatgagactcgggccgcaaatgctctgcaacagggagagaat

SEQ ID NO: 232923 - DNA, 75 bp, Artificial Sequence
  Synthetic
gatggggatgatgacattcaagtaacctgtaacaaacagaatcttacactcattaatgttaccaaaagttacaat

SEQ ID NO: 232924 - DNA, 75 bp, Artificial Sequence
  Synthetic
tttgccagacccacaaatgaaaaaggcggacaggcaaaaccaaaaccaacgactgcagagcagggacaaaataag

SEQ ID NO: 232925 - DNA, 75 bp, Artificial Sequence
  Synthetic
ctggcagtgaatttaaaaattacctggtacgaacaattccacccattacaaacattaaaatagagaaactccaaa

SEQ ID NO: 232926 - DNA, 75 bp, Artificial Sequence
  Synthetic
gcggacaggcaaaaccaaaaccaacgactgcagagcagggacaaaataagatagagtatgatattgatttggcct

SEQ ID NO: 232927 - DNA, 75 bp, Artificial Sequence
  Synthetic
tcgagggcccattcgtgcaggtgagggttcgctttgagaaaggaggaccagaggtccactgctagtgctgtttgt

SEQ ID NO: 232928 - DNA, 75 bp, Artificial Sequence
  Synthetic
ggtacgaacaattccacccattacaaacattaaaatagagaaactccaaatggatagtgacattttaagtaatct

SEQ ID NO: 232929 - DNA, 75 bp, Artificial Sequence
  Synthetic
cagtctctcgaagcatgattctaatagccctcaacattaacatcctggtacgatgcgcacagcaacgcatcctga

SEQ ID NO: 232930 - DNA, 75 bp, Artificial Sequence
  Synthetic
caactttgatccagaaatcgttatgtacaccgaaaatgtaaatctggaaacaccagacactcatattgtttacaa

SEQ ID NO: 232931 - DNA, 75 bp, Artificial Sequence
  Synthetic
gaacaaaacattccaagttcaatgattgcaattattgcggcggtggcagtgggaatggcaatcataataacatgt

SEQ ID NO: 232932 - DNA, 75 bp, Artificial Sequence
  Synthetic
tacaccgaaaatgtaaatctggaaacaccagacactcatattgtttacaaagcgggtacagatgattccagttcc

SEQ ID NO: 232933 - DNA, 75 bp, Artificial Sequence
  Synthetic
caacagcagcaacgtgcagaccaacctggaccggatggtgaccgatgtgcgcgaggccgtgtctcagcgcgagcg

SEQ ID NO: 232934 - DNA, 75 bp, Artificial Sequence
  Synthetic
tgcccaacagacccaattacattgggtttagagacaactttatcgggctaatgtactataacagtactggcaata

SEQ ID NO: 232935 - DNA, 75 bp, Artificial Sequence
  Synthetic
ttcactactaaattatgatttttaacttcttattttaacagacaatgattttcattacagttcttcttgccatct

SEQ ID NO: 232936 - DNA, 75 bp, Artificial Sequence
  Synthetic
agtttcatgaccagcatgaaggggattagctgcttgccaaaggaccccatccaggtgtaggtttccacatcgtag

SEQ ID NO: 232937 - DNA, 75 bp, Artificial Sequence
  Synthetic
gtttagagacaactttatcgggctaatgtactataacagtactggcaatatgggagtactggctggtcaagcatc

SEQ ID NO: 232938 - DNA, 75 bp, Artificial Sequence
  Synthetic
ttgcaattattgcggcggtggcagtgggaatggcaatcataataacatgtatgattgtttatgcttgctgctaca

SEQ ID NO: 232939 - DNA, 75 bp, Artificial Sequence
  Synthetic
caggacagaaacacagagctgtcctatcagcttatgcttgattctctgggagacagaaccaggtattttagcatg

SEQ ID NO: 232940 - DNA, 75 bp, Artificial Sequence
  Synthetic
ggttccacatacacactaaaaggcccagaaggtcataatggtgttatttggtggaaactatttgatgatggaggg

SEQ ID NO: 232941 - DNA, 75 bp, Artificial Sequence
  Synthetic
gatctcctgccaccagttggaggaatggctgttgatgtgatggaagtagaactccctgcgacgcgccgagcattc

SEQ ID NO: 232942 - DNA, 75 bp, Artificial Sequence
  Synthetic
gtaccagtccgggccagactactttttccagaccagcagacagggcttgcagacagtaaacctgagccaggcttt

SEQ ID NO: 232943 - DNA, 75 bp, Artificial Sequence
  Synthetic
cacgcgacctcgttgtaatggagctgcttcctgacattctcgtattttgcatggcagaacctagccttggcacaa

SEQ ID NO: 232944 - DNA, 75 bp, Artificial Sequence
  Synthetic
cagccaatcaccacacagcgcgcacttttttaaattacctcatttgcatattggcaccattccatctataaggta

SEQ ID NO: 232945 - DNA, 75 bp, Artificial Sequence
  Synthetic
tcatggtgtggaagatgaactacctaactactgtttcccattgaatggtgttggttttacaagttcctttcaagg

SEQ ID NO: 232946 - DNA, 75 bp, Artificial Sequence
  Synthetic
cctaactattattaatgtcacaaaacacgacaatggctactattatgggaccaattatattacaagtttagatta

SEQ ID NO: 232947 - DNA, 75 bp, Artificial Sequence
  Synthetic
atcagcttatgcttgattctctgggagacagaaccaggtattttagcatgtggaatcaggcagtggacagctacg

SEQ ID NO: 232948 - DNA, 75 bp, Artificial Sequence
  Synthetic
aactactgtttcccattgaatggtgttggttttacaagttcctttcaaggtgtcaaagttaaaaccaatgggaat

SEQ ID NO: 232949 - DNA, 75 bp, Artificial Sequence
  Synthetic
atggcaacgtcaacacttccaatgagattgccaagggcaacccctttgctatggaaatcaacatccaagctaacc

SEQ ID NO: 232950 - DNA, 75 bp, Artificial Sequence
  Synthetic
ctttctctagcagcagcgctaaaaacacaatcaaaattaatacaactgctataaaaatgctccaaaaaatggctt

SEQ ID NO: 232951 - DNA, 75 bp, Artificial Sequence
  Synthetic
cggcacgggcaaacacgttccggggatctgacacatcatagttatgctcctgagacaggtcatcataagccattt

SEQ ID NO: 232952 - DNA, 75 bp, Artificial Sequence
  Synthetic
gccatagggcaaactcaggtagatgagcaaacctatcaagaaattacccaagtgagccgcgctctgggtcgggag

SEQ ID NO: 232953 - DNA, 75 bp, Artificial Sequence
  Synthetic
gattgccaagggcaacccctttgctatggaaatcaacatccaagctaacctttggaggagtttcctttattctaa

SEQ ID NO: 232954 - DNA, 75 bp, Artificial Sequence
  Synthetic
tacaagtacactccagccaatgtaactcttcctactaacaccaacacttatgaatacatgaatgggcgagtggtg

SEQ ID NO: 232955 - DNA, 75 bp, Artificial Sequence
  Synthetic
ataattgtagcggcggtagtggggctggcaattattatttcttgcataatttattatgcctgctgctatagaaaa

SEQ ID NO: 232956 - DNA, 75 bp, Artificial Sequence
  Synthetic
ctcttcctactaacaccaacacttatgaatacatgaatgggcgagtggtggccccatccttggtagattcataca

SEQ ID NO: 232957 - DNA, 75 bp, Artificial Sequence
  Synthetic
gcagaagatccctcctcagtatgcgcttaccgcggaggaggaacggatcctgagatacgtgcagcagagcgtggg

SEQ ID NO: 232958 - DNA, 75 bp, Artificial Sequence
  Synthetic
cacaatcaaaattaatacaactgctataaaaatgctccaaaaaatggcttctaattataccccacccgctaccaa

SEQ ID NO: 232959 - DNA, 75 bp, Artificial Sequence
  Synthetic
ggaccccatggacaatgtaaatccatttaatcaccaccgcaatgctggcctgcgctacaggtccatgcttctggg

SEQ ID NO: 232960 - DNA, 75 bp, Artificial Sequence
  Synthetic
accatgaaattcctatgtgtattagctttttcagtttttagcttttgcacatccacccccatcaccattgtcaat

SEQ ID NO: 232961 - DNA, 75 bp, Artificial Sequence
  Synthetic
tgcgctacaggtccatgcttctgggcaatggtcgctatgtgcccttccacatccaagtgcctcagaaatttttcg

SEQ ID NO: 232962 - DNA, 75 bp, Artificial Sequence
  Synthetic
tggcaattattatttcttgcataatttattatgcctgctgctatagaaaaataaaaggagaccccctactaagct

SEQ ID NO: 232963 - DNA, 75 bp, Artificial Sequence
  Synthetic
gcggtgtcgagggcgcgcaccgggcggctcgggacccggcggcatggctggcagtggtacgtcggcgccgcgtgc

SEQ ID NO: 232964 - DNA, 75 bp, Artificial Sequence
  Synthetic
tggatcctacacctatgagtggaacttcagaaaggatgtgaacatggtcctacagagttcccttggcaacgacct

SEQ ID NO: 232965 - DNA, 75 bp, Artificial Sequence
  Synthetic
atactacaaattacacatctacctcctatgcaaccatacatacccagcttattcctttttccacaattaaagcca

SEQ ID NO: 232966 - DNA, 75 bp, Artificial Sequence
  Synthetic
ttcagaaaggatgtgaacatggtcctacagagttcccttggcaacgaccttcgggttgatggagccagcatcagt

SEQ ID NO: 232967 - DNA, 75 bp, Artificial Sequence
  Synthetic
agaagacttgcatgcgcgacgacgcggcggttgacatcctggatctgacgcctctgggtgaaagctaccggcccc

SEQ ID NO: 232968 - DNA, 75 bp, Artificial Sequence
  Synthetic
attggaataactattctagctgttcttctttattttatattctgccgccaaatacccaatgttcataaaaaacca

SEQ ID NO: 232969 - DNA, 75 bp, Artificial Sequence
  Synthetic
cctttttccccatggcccacaatactgcttccactcttgaagccatgctgcgcaatgacaccaatgaccagtcct

SEQ ID NO: 232970 - DNA, 75 bp, Artificial Sequence
  Synthetic
cccagatgcatccagtgctgcgacagatgcgcccccagcaacaggtcccttctcagcagcaacagccacaaaagg

SEQ ID NO: 232971 - DNA, 75 bp, Artificial Sequence
  Synthetic
tgcttccactcttgaagccatgctgcgcaatgacaccaatgaccagtccttcaacgactacctctctgcagccaa

SEQ ID NO: 232972 - DNA, 75 bp, Artificial Sequence
  Synthetic
gcaaccaacatccccatctccattccctctcgcaactgggctgcattcaggggctggtcattcaccagacttaaa

SEQ ID NO: 232973 - DNA, 75 bp, Artificial Sequence
  Synthetic
cctctcgcaactgggctgcattcaggggctggtcattcaccagacttaaaaccaaagagacaccctctttggggt

SEQ ID NO: 232974 - DNA, 75 bp, Artificial Sequence
  Synthetic
ttctggttctattccctatctggatggtaccttctatctaaatcatacttttaagaaggtttccatcatgtttga

SEQ ID NO: 232975 - DNA, 75 bp, Artificial Sequence
  Synthetic
ggtaccttctatctaaatcatacttttaagaaggtttccatcatgtttgactcctcagtcagctggccaggcaat

SEQ ID NO: 232976 - DNA, 75 bp, Artificial Sequence
  Synthetic
ttgaaatcaaacgcactgtggatggggaagggtacaatgtggctcaatgcaatatgaccaaagactggtttctgg

SEQ ID NO: 232977 - DNA, 75 bp, Artificial Sequence
  Synthetic
ccgtgaaggaggagcgcaacttccaaaaatctttcaacaaccatgtgcgcaccctgatcgcccgcgaggaagtga

SEQ ID NO: 232978 - DNA, 75 bp, Artificial Sequence
  Synthetic
cagtcattctaattctgctgctaccctgcgttgccttagctcccacaaccactcgcactccacctgaacaactta

SEQ ID NO: 232979 - DNA, 75 bp, Artificial Sequence
  Synthetic
ggaagggtacaatgtggctcaatgcaatatgaccaaagactggtttctggttcagatgcttgccaactacaacat

SEQ ID NO: 232980 - DNA, 75 bp, Artificial Sequence
  Synthetic
cccccgcgtcgggcgcctgatgtaagaaaccgaaaataaatactcaccaaggccatggcgaccagcgtgcgttcg

SEQ ID NO: 232981 - DNA, 75 bp, Artificial Sequence
  Synthetic
gaaggatacaaggaccgtatgtattcattcttcagaaacttccagcccatgagcaggcaggtggttgatcaggtt

SEQ ID NO: 232982 - DNA, 75 bp, Artificial Sequence
  Synthetic
ggacacggtcaactcctcttccaaaagacggacgagttcggcgatggtggtgcgcacctcgcgctcgaaagcccc

SEQ ID NO: 232983 - DNA, 75 bp, Artificial Sequence
  Synthetic
agagtttcctggatgatgtcataacgcggttggcttttcttttcccacagctcgcggttgagaaggtattcttcg

SEQ ID NO: 232984 - DNA, 75 bp, Artificial Sequence
  Synthetic
tagtgattgttggaataattaacatactctcatgtaccttattctcattcctaatataccccatatttagttttg

SEQ ID NO: 232985 - DNA, 75 bp, Artificial Sequence
  Synthetic
tggatttgtgggttaccttgctcctaccattcgtcaaggacaaccataccctgccaactacccatatccactcat

SEQ ID NO: 232986 - DNA, 75 bp, Artificial Sequence
  Synthetic
cattcttcagaaacttccagcccatgagcaggcaggtggttgatcaggttaactacaaagagtatcaagccgtca

SEQ ID NO: 232987 - DNA, 75 bp, Artificial Sequence
  Synthetic
aacgcggcgacgccggcggcgcacgggcagacggtcgatgaatctttcaatgacctctccgcggcggcggcgcat

SEQ ID NO: 232988 - DNA, 75 bp, Artificial Sequence
  Synthetic
accattcgtcaaggacaaccataccctgccaactacccatatccactcattggcgaaagtgcagttaccagcgtt

SEQ ID NO: 232989 - DNA, 75 bp, Artificial Sequence
  Synthetic
gccattagctacttcaacctaaccggtggagatgactgatcagctcaacgcctccactgctgccgtggatctgct

SEQ ID NO: 232990 - DNA, 75 bp, Artificial Sequence
  Synthetic
ctgacgtgaggtagcttattgagctcatcaaaggttaggtctgtagggtcagataaggcgtagtgttcgagagcc

SEQ ID NO: 232991 - DNA, 75 bp, Artificial Sequence
  Synthetic
cagcgtctcgcccaactacgcatacgtcagcaacaggaacgtgccgccaaggagctcaggaatgccatcgagatt

SEQ ID NO: 232992 - DNA, 75 bp, Artificial Sequence
  Synthetic
gtcagcaacaggaacgtgccgccaaggagctcaggaatgccatcgagattcaccagtgtaaaaaaggaatcttct

SEQ ID NO: 232993 - DNA, 75 bp, Artificial Sequence
  Synthetic
acgggatctgaaaacctttcgacgaaagcgtctaaccagtcgcaatcgcaaggtaggctgagcactgtttcttgc

SEQ ID NO: 232994 - DNA, 75 bp, Artificial Sequence
  Synthetic
ttttcccacggccgcgccgccccttttagccgttaaccccacagccaattaccacacagcccacactttttaaaa

SEQ ID NO: 232995 - DNA, 75 bp, Artificial Sequence
  Synthetic
tttttgtgcataatgtactacgcctgctgctatagaaaacatgaacaaaaaggtgatgcattactaaattttgat

SEQ ID NO: 232996 - DNA, 75 bp, Artificial Sequence
  Synthetic
ctacgagatcactgctaatgaccaccgtctgtcatatgagcttgttcagcagcgacagaaattcacttgcatggt

SEQ ID NO: 232997 - DNA, 75 bp, Artificial Sequence
  Synthetic
cggggatctctctttcttctccttcctcctcttgggagggtaagacgatgctgctggtgatgaaattaaaatagg

SEQ ID NO: 232998 - DNA, 75 bp, Artificial Sequence
  Synthetic
caccgttctcagctggtaacgccaccacataagaagcctcttgcttcttgcaagcagcagcaacagccatggcct

SEQ ID NO: 232999 - DNA, 75 bp, Artificial Sequence
  Synthetic
gcaagagcttagggccatcgctagagatcttggctgcggaccctatttcctgggaacctttgacaagcgcttccc

SEQ ID NO: 233000 - DNA, 75 bp, Artificial Sequence
  Synthetic
gatcttggctgcggaccctatttcctgggaacctttgacaagcgcttcccggggttcatggcccccgacaagctc

SEQ ID NO: 233001 - DNA, 75 bp, Artificial Sequence
  Synthetic
gcttgttggatgcgcaggcgatgggccattccccaagcattatcctgacatctggccagatctttatagtagtct

SEQ ID NO: 233002 - DNA, 75 bp, Artificial Sequence
  Synthetic
aattatcaataaagatcacttacttgaaatcagcaataaggtttctgtcaaaattttctcccagcagcacctcac

SEQ ID NO: 233003 - DNA, 75 bp, Artificial Sequence
  Synthetic
ctccacactttgaaagggatgtcaaattttatttcctcttctttgcccacaatcttcatttctttatccccagat

SEQ ID NO: 233004 - DNA, 75 bp, Artificial Sequence
  Synthetic
acgtgccccgtggtcagcaagactatacaaactttttgagtgcattgagactcatggtatctgaggtgccccaga

SEQ ID NO: 233005 - DNA, 75 bp, Artificial Sequence
  Synthetic
tccttcaacccggtgtacccctatgaagacgagagcagctcacaacacccatttataaaccccggcttcatttcc

SEQ ID NO: 233006 - DNA, 75 bp, Artificial Sequence
  Synthetic
aagacgagagcagctcacaacacccatttataaaccccggcttcatttcccctgatggctttacacaaagcccag

SEQ ID NO: 233007 - DNA, 75 bp, Artificial Sequence
  Synthetic
tcgttgcaggtgcgcaccaggtactggtagccgatgagaaagtgtggcggtggctggcggtacaggggccatcgc

SEQ ID NO: 233008 - DNA, 75 bp, Artificial Sequence
  Synthetic
ttcccctcttactaccaccagtggcgctctagacattaaagtgggaagagggcttaaagtagatagcactgatgg

SEQ ID NO: 233009 - DNA, 75 bp, Artificial Sequence
  Synthetic
gtggggagtgcacgccccagtaggagatcgcgcgaccgtgtctagcttgctgactcccaactcccgcctgctgct

SEQ ID NO: 233010 - DNA, 75 bp, Artificial Sequence
  Synthetic
gatcgcgcgaccgtgtctagcttgctgactcccaactcccgcctgctgctgctgctggtatcccccttcactgac

SEQ ID NO: 233011 - DNA, 75 bp, Artificial Sequence
  Synthetic
ggtcttccagcatgaggcggtggtagccgtagatgtacctggacatccaggtgataccggaggcggtggtggatg

SEQ ID NO: 233012 - DNA, 75 bp, Artificial Sequence
  Synthetic
gctctagacattaaagtgggaagagggcttaaagtagatagcactgatggttccctggaagaaaatatagacatt

SEQ ID NO: 233013 - DNA, 75 bp, Artificial Sequence
  Synthetic
actcagtaggattagcatttggcgacggtctagaaacaaaagaaaacaagctttatgtaaaacttggagatggac

SEQ ID NO: 233014 - DNA, 75 bp, Artificial Sequence
  Synthetic
ccagatgttgcgcagcggcatgaagtagttcatggtaggcacggtctggccagtaaggcgcgcgcagtcattgac

SEQ ID NO: 233015 - DNA, 75 bp, Artificial Sequence
  Synthetic
ggttctggcgggaatcagagtgacccgcgggcagggatacgttgcggaactggaacctgttctgccacttgaact

SEQ ID NO: 233016 - DNA, 75 bp, Artificial Sequence
  Synthetic
cggtctagaaacaaaagaaaacaagctttatgtaaaacttggagatggacttaaatttagctctggcagtatata

SEQ ID NO: 233017 - DNA, 75 bp, Artificial Sequence
  Synthetic
tggacaggagtcaatccaagtgctaactgtataattacagacaatggagaaaccaatgacagcaagcttacccta

SEQ ID NO: 233018 - DNA, 75 bp, Artificial Sequence
  Synthetic
actgtataattacagacaatggagaaaccaatgacagcaagcttaccctaatacttgttaagtcaggtggattaa

SEQ ID NO: 233019 - DNA, 75 bp, Artificial Sequence
  Synthetic
ggccggagccgcggctaacgtggtattggctatcccgtctcgacccagccgacgaatatccagggtacggagtag

SEQ ID NO: 233020 - DNA, 75 bp, Artificial Sequence
  Synthetic
tgactcagacacagtcaataaattaaccacagaaaaaagtgctcaaattaccgttgacatatactttgataatca

SEQ ID NO: 233021 - DNA, 75 bp, Artificial Sequence
  Synthetic
accacagaaaaaagtgctcaaattaccgttgacatatactttgataatcaaggaaaagttcttactgaactatcg

SEQ ID NO: 233022 - DNA, 75 bp, Artificial Sequence
  Synthetic
agggcgcgcaccgggcggcaggggcggctcgggacccggcggcatggctggcagtggtacgtcggcgccgcgcgc

SEQ ID NO: 233023 - DNA, 75 bp, Artificial Sequence
  Synthetic
aatttggtcaaaacatggcttctagcgaagtatcaaactgcaaaggctttatgccaagcttaaatgcatacccat

SEQ ID NO: 233024 - DNA, 75 bp, Artificial Sequence
  Synthetic
cgaagtatcaaactgcaaaggctttatgccaagcttaaatgcatacccattcagaaatccaactaaacctaccaa

SEQ ID NO: 233025 - DNA, 75 bp, Artificial Sequence
  Synthetic
aatggggatcagcatcatcctggcctggtcgggggttattcctggatacaccgccttcataaaggcttcgtactg

SEQ ID NO: 233026 - DNA, 75 bp, Artificial Sequence
  Synthetic
tcttgctgaccaaccggtcgcagaagatccctcctcagtatgcgcttaccgcggaggaggaacggatcctgagat

SEQ ID NO: 233027 - DNA, 75 bp, Artificial Sequence
  Synthetic
ataacttactatcaagccacagatggtaatctctatgagctaaaaactactattactctaaaccacagtgtcatt

SEQ ID NO: 233028 - DNA, 75 bp, Artificial Sequence
  Synthetic
agttctctatgtgcatatgcaatgcacatttcatggtcatgggacaccgtaacagagccagagacaacacccact

SEQ ID NO: 233029 - DNA, 75 bp, Artificial Sequence
  Synthetic
tttcctatatcagagaagatgactgacaacaaaaaataaagttcaaaattttttattgaaaatcagtttacagga

SEQ ID NO: 233030 - DNA, 75 bp, Artificial Sequence
  Synthetic
ggacagcccgcctatgatctggacttggaagagggcgagggattggcgcgcctgggggctccatcgcccgagcgg

SEQ ID NO: 233031 - DNA, 75 bp, Artificial Sequence
  Synthetic
ggccgatgctcgtaattatactcctactgcacctacatctactgtggatgcagttattgacagcgtagtggctga

SEQ ID NO: 233032 - DNA, 75 bp, Artificial Sequence
  Synthetic
cacggtgctcctcgttcacatactggtggcagatacgcctgtactgctcgtgctgctctggcatcagcttgaaag

SEQ ID NO: 233033 - DNA, 75 bp, Artificial Sequence
  Synthetic
ccaaaaatcttttaacaaccatgtgcgcaccctgatcgcccgcgaggaagtgaccctgggtctgatgcacctgtg

SEQ ID NO: 233034 - DNA, 75 bp, Artificial Sequence
  Synthetic
gtacctctccatcagtacggccattacttccatgcccttctcccaggcagagaccaagggcaggctcatgggatt

SEQ ID NO: 233035 - DNA, 75 bp, Artificial Sequence
  Synthetic
tgaccctgggtctgatgcacctgtgggacctgatggaggctatcacccagaaccccactagcaaacccctgacag

SEQ ID NO: 233036 - DNA, 75 bp, Artificial Sequence
  Synthetic
aaccccactagcaaacccctgacagctcagctgtttctggtggttcaacatagcagggacaacgaggcattcagg

SEQ ID NO: 233037 - DNA, 75 bp, Artificial Sequence
  Synthetic
cacagcaccgcattctaatctcacttaggtcactgcagtaggtacagcacatcacaataatgttgttcaacaggc

SEQ ID NO: 233038 - DNA, 75 bp, Artificial Sequence
  Synthetic
taggtcactgcagtaggtacagcacatcacaataatgttgttcaacaggccataattaaaggcgctccagccaaa

SEQ ID NO: 233039 - DNA, 75 bp, Artificial Sequence
  Synthetic
gatggcaatgatggtctggtggagtttgtacgcgagttcgccccaaggcggcgtgtgcagtggcgtggacgcaaa

SEQ ID NO: 233040 - DNA, 75 bp, Artificial Sequence
  Synthetic
gaacacactgcccacatacatgatctccttgggcatgtgcagattcacaatttctcggtaccatggacagcgctg

SEQ ID NO: 233041 - DNA, 75 bp, Artificial Sequence
  Synthetic
tttctcggtaccatggacagcgctggtttatcatgcagccctgaataactttcctgaaccaaatggccagcactg

SEQ ID NO: 233042 - DNA, 75 bp, Artificial Sequence
  Synthetic
accctgctgattacaatgacaatggagaacccacttctctcgcccatgaaccacttgggaataaaatatatctat

SEQ ID NO: 233043 - DNA, 75 bp, Artificial Sequence
  Synthetic
gatggggagaactactttgacatgggagcggacttgcaatggcaacccagtcgcagggccatggaggctgcaggg

SEQ ID NO: 233044 - DNA, 75 bp, Artificial Sequence
  Synthetic
atacatctcctcatcacccttaactcttcaggggttaaaaccatatcccagggaataggaagctcttgcaaaaca

SEQ ID NO: 233045 - DNA, 75 bp, Artificial Sequence
  Synthetic
cttcaggggttaaaaccatatcccagggaataggaagctcttgcaaaacagtgaaaccggcagaacaaggaagac

SEQ ID NO: 233046 - DNA, 75 bp, Artificial Sequence
  Synthetic
ggtcagggtattacaatctggcaacagcgggtggtcctcggtcatagaagccctggtctcattttcctcacagcg

SEQ ID NO: 233047 - DNA, 75 bp, Artificial Sequence
  Synthetic
agcgggtggtcctcggtcatagaagccctggtctcattttcctcacagcgtggtaaaggggccctcatgcgagga

SEQ ID NO: 233048 - DNA, 75 bp, Artificial Sequence
  Synthetic
cgcacgatgtcgagcgtgcacgcgacctcgttgtaatggaggctcttcctgacattctcgtattttgcagcgcaa

SEQ ID NO: 233049 - DNA, 75 bp, Artificial Sequence
  Synthetic
ctccagctgctgtcaacaccactcgaagatcccggcgaaagtacggtccagcaagtttgctgatgccaaattatg

SEQ ID NO: 233050 - DNA, 75 bp, Artificial Sequence
  Synthetic
agcagatggcgatcaccaggaggctgggctcggggatcatgtcgccgaatacctcaccgggcttggcggggagga

SEQ ID NO: 233051 - DNA, 75 bp, Artificial Sequence
  Synthetic
ctcttcgccttctatctcgtcgcctagcgcgttcagtgtggtaattgaagtacagccattcccgcagattggtca

SEQ ID NO: 233052 - DNA, 75 bp, Artificial Sequence
  Synthetic
cgtgctcctcaaacatctagcaaggcagtcgatcatagttaaagacgcactgctcgaccgcaccgaagtgcccat

SEQ ID NO: 233053 - DNA, 75 bp, Artificial Sequence
  Synthetic
catccgtcccgatgaggccgggctggtatacaatgctctcttggagcgcgtggcccgttacaacagcagcaacgt

SEQ ID NO: 233054 - DNA, 75 bp, Artificial Sequence
  Synthetic
gaaaactccatcatatctgatcgctctaataaaatcattcacggtagacaatgcaattcccaaccaagcaatgca

SEQ ID NO: 233055 - DNA, 75 bp, Artificial Sequence
  Synthetic
cagtgtggaagagctcagccgcgcctacgagctcaacctgttctcgcctcgggtgccccccaagcgtcagccaaa

SEQ ID NO: 233056 - DNA, 75 bp, Artificial Sequence
  Synthetic
agagttaaagatccaacctttagaaaaagacagcaagaatagaagctacaatgtcttggaagacaaaatcaacac

SEQ ID NO: 233057 - DNA, 75 bp, Artificial Sequence
  Synthetic
attagcttgagtttcgatcaggggtgggggaggaagagatggaagaaccataattaatttttattccaaacggtc

SEQ ID NO: 233058 - DNA, 75 bp, Artificial Sequence
  Synthetic
ctcaacttctatccggcctttgctgtcccagaagtgcttgctacctaccacatctttttcaagaaccaaaagatt

SEQ ID NO: 233059 - DNA, 75 bp, Artificial Sequence
  Synthetic
tttttttttttgccgctcagatgcatcccgtgctgcgacagatgcgtccccaacaacagcccccctcgcagcagc

SEQ ID NO: 233060 - DNA, 75 bp, Artificial Sequence
  Synthetic
agagcgaggtgtaccagtccgggccagattacttcttccagaccagcagacagggcttgcagacagtgaacctga

SEQ ID NO: 233061 - DNA, 75 bp, Artificial Sequence
  Synthetic
cccgcgccgatgccctgctcaacttgggaccgggcgctcgcttacctgatatagcttccttggaagaggttccaa

SEQ ID NO: 233062 - DNA, 75 bp, Artificial Sequence
  Synthetic
tgcccgtcttctcaaagagtttctacaatgagcaagccgtgtactctcagcagctccgacagtccacctcgctca

SEQ ID NO: 233063 - DNA, 75 bp, Artificial Sequence
  Synthetic
attcctgtaccattcccaggtaattttcatctttccagccttgtattattcgtgttaattcttgttgtaaatcca

SEQ ID NO: 233064 - DNA, 75 bp, Artificial Sequence
  Synthetic
gtatcgcgaggccataggacagagccaggtggacgaacagacctatcaagaaatcacccaagtgagccgcgccct

SEQ ID NO: 233065 - DNA, 75 bp, Artificial Sequence
  Synthetic
tctaagttcaagttgtaaatactctttcatatcatcgccaaactgcttggccataggtccgccaggaataagagc

SEQ ID NO: 233066 - DNA, 75 bp, Artificial Sequence
  Synthetic
cctgaacccacactggctgcccccacctggtttctacactggcgagtacgacatgcccgaccccaatgacgggtt

SEQ ID NO: 233067 - DNA, 75 bp, Artificial Sequence
  Synthetic
cagtttggaagaaggaagggggcgatacaaggcactcttccgtgtcgctgtccagaacggctggtgctgccgcga

SEQ ID NO: 233068 - DNA, 75 bp, Artificial Sequence
  Synthetic
ccgtgcccgaagctgcaagtcctttccctagcttgcccttttcactaaacagcgttcgcagcagtgaactgggga

SEQ ID NO: 233069 - DNA, 75 bp, Artificial Sequence
  Synthetic
agcatacaatccagaagtgttagtatcagttaaagaaaaaaatcggccaatatagcatctaggaacaattatgct

SEQ ID NO: 233070 - DNA, 75 bp, Artificial Sequence
  Synthetic
agcgttcgcagcagtgaactggggagaataacccgcccgcgcttgatgggcgaggatgagtacttgaatgactct

SEQ ID NO: 233071 - DNA, 75 bp, Artificial Sequence
  Synthetic
tcagttaaagaaaaaaatcggccaatatagcatctaggaacaattatgctcaatctcaaatgcagcaaagcgaca

SEQ ID NO: 233072 - DNA, 75 bp, Artificial Sequence
  Synthetic
caggcgcataaaaataatacatattcccctcttgcacaggcagtgtagctcccggcccctccaaaaacacataca

SEQ ID NO: 233073 - DNA, 75 bp, Artificial Sequence
  Synthetic
cccggcccctccaaaaacacatacaaagcttcagcagccatagcttaccgcgcaagtcaggcagagcagacagat

SEQ ID NO: 233074 - DNA, 75 bp, Artificial Sequence
  Synthetic
ccaggtcatcgcgcctgaaatctacggtccgccgatgaaggatgaaaaaaagccccgcaaaatcaagcgggtcaa

SEQ ID NO: 233075 - DNA, 75 bp, Artificial Sequence
  Synthetic
cgccacgacaggcagatgggtcttgtgtgggacgatgaggactctgccgatgatagcagcgtgttggacttgggt

SEQ ID NO: 233076 - DNA, 75 bp, Artificial Sequence
  Synthetic
tgtgggacgatgaggactctgccgatgatagcagcgtgttggacttgggtggaagaggagggggcaacccgttcg

SEQ ID NO: 233077 - DNA, 75 bp, Artificial Sequence
  Synthetic
acccttacactgacgtaattgggcaaagtctaaaaaatcccgccaaaaaccagcacacgcccagaaactatgtca

SEQ ID NO: 233078 - DNA, 75 bp, Artificial Sequence
  Synthetic
catgttgtaaaagtgaaagtaaaataaaaagacaactcaccaaggccatggcgaccgagcgtgcgttcgttcttt

SEQ ID NO: 233079 - DNA, 75 bp, Artificial Sequence
  Synthetic
cctctttcccacgtgtcgtcactgccgggtatcttgcaacgtcaccaccccgcgccggcccgccccctttgaccg

SEQ ID NO: 233080 - DNA, 75 bp, Artificial Sequence
  Synthetic
atcagtccggacctgactacttctttcagactagcagacagggcttgcagacggtaaatctgagccaagctttta

SEQ ID NO: 233081 - DNA, 75 bp, Artificial Sequence
  Synthetic
aggagacgagccgtgctaggcggagcggtggtgtatccggagggtcctcctccttcttacgagagcgtgatgcag

SEQ ID NO: 233082 - DNA, 75 bp, Artificial Sequence
  Synthetic
tccttcttacgagagcgtgatgcagcaacaggcggcgatgctacagcccccactggaggctcccttcgtaccccc

SEQ ID NO: 233083 - DNA, 75 bp, Artificial Sequence
  Synthetic
aaaaaggggaacggggtctacctcgacccccagaccggtgaggagctcaacacaaggttccctcaggatgtccca

SEQ ID NO: 233084 - DNA, 75 bp, Artificial Sequence
  Synthetic
tggcccctaagggcgctcccaatacatctcagtggattgctgaaggcgtaaaaaaagaaaatggggaatctgacg

SEQ ID NO: 233085 - DNA, 75 bp, Artificial Sequence
  Synthetic
atgcagctaatggtgcccaagcgccagagattagaagacgtactggagaaaatgaaagtggatgccgatatccag

SEQ ID NO: 233086 - DNA, 75 bp, Artificial Sequence
  Synthetic
gcggacattgcctccctgaactatcagaacgaccacagcaacttcctgaccacggtggtgcagaacaatgacttt

SEQ ID NO: 233087 - DNA, 75 bp, Artificial Sequence
  Synthetic
ggaagacgaggaggcagaggaggtggaagaagcaaccgccgccaaacagttgtcctcggcagcggagacaagcaa

SEQ ID NO: 233088 - DNA, 75 bp, Artificial Sequence
  Synthetic
ggggcggcgcggccgtgggaaaatgacgttttatgggggtggagtttttttgcaagttgtcgcgggaaatgttac

SEQ ID NO: 233089 - DNA, 75 bp, Artificial Sequence
  Synthetic
gcagtttggaagccaccctgaacttcttgctaaccaaccggtcgcagaagatccctcctcagtatgcgcttaccg

SEQ ID NO: 233090 - DNA, 75 bp, Artificial Sequence
  Synthetic
gaacaatgccatcattgacaactacctggaaattggcagacaaaatggagtgctggaaagtgacattggtgttaa

SEQ ID NO: 233091 - DNA, 75 bp, Artificial Sequence
  Synthetic
cgagtacgacatgcccgaccccaatgacgggttcctgtgggacgatgtggacagcagcatattctccccgcctcc

SEQ ID NO: 233092 - DNA, 75 bp, Artificial Sequence
  Synthetic
ggcattccatcctgacattgttttgctgcctggttgcggggtagactttactgaaagccgacttagcaacttgct

SEQ ID NO: 233093 - DNA, 75 bp, Artificial Sequence
  Synthetic
caacaatctatgcccaacagacccaactacattggctttagagataactttattggacttatgtactacaacagt

SEQ ID NO: 233094 - DNA, 75 bp, Artificial Sequence
  Synthetic
acagcagcatattctccccgcctcccggttatacagtttggaagaaggaagggggcgatagaagacactcttccg

SEQ ID NO: 233095 - DNA, 75 bp, Artificial Sequence
  Synthetic
tggcatcaggaaaagacatccattccaggagggtttcaaaatcatgtatgaagatcttgaagggggtaatattcc

SEQ ID NO: 233096 - DNA, 75 bp, Artificial Sequence
  Synthetic
tacccatcatcgccgcggcgatcggggcgataccaggcatagcttccgtggcggttcaggcctcgcagcgccact

SEQ ID NO: 233097 - DNA, 75 bp, Artificial Sequence
  Synthetic
gatagctatgatcctgatgtgcgcattattgaaaatcatggggtggaagatgagcttcccaactactgctttcca

SEQ ID NO: 233098 - DNA, 75 bp, Artificial Sequence
  Synthetic
gaccaacttcagcgcactctcgaggacgccgaggctctcttcaacaagtactgcgcgctgactcttaaagagtag

SEQ ID NO: 233099 - DNA, 75 bp, Artificial Sequence
  Synthetic
aaagcggtacaggtgtaagaaaattacctgatttgagttccgtggactgtgatttgcactgctatgaagacgggt

SEQ ID NO: 233100 - DNA, 75 bp, Artificial Sequence
  Synthetic
acgccgaggctctcttcaacaagtactgcgcgctgactcttaaagagtagcccgcgcccgcgctcgctcgaaaaa

SEQ ID NO: 233101 - DNA, 75 bp, Artificial Sequence
  Synthetic
gcaagagtagaagctacaatgtcttggaagacaaaatcaacacggcctaccgcagctggtacctgtcctacaatt

SEQ ID NO: 233102 - DNA, 75 bp, Artificial Sequence
  Synthetic
ggaagacaaaatcaacacggcctaccgcagctggtacctgtcctacaattacggtaaccctgagaaaggaataag

SEQ ID NO: 233103 - DNA, 75 bp, Artificial Sequence
  Synthetic
gtcttggacactgcttaccacttcagatgtcacctgtggggcagagcaggtctactggtcgctccctgacatgat

SEQ ID NO: 233104 - DNA, 75 bp, Artificial Sequence
  Synthetic
gaaacagataaacagccgcctggatccgccgcccgcaactcctggtgaaatggaagtggaggaagagcttcctcc

SEQ ID NO: 233105 - DNA, 75 bp, Artificial Sequence
  Synthetic
gcaagacccagtcaccttccgctccacaagacaagtcaacaactacccagtggtgggtgcagagcttatgcccgt

SEQ ID NO: 233106 - DNA, 75 bp, Artificial Sequence
  Synthetic
taatgatatacgagcttaccgaaaccagttactcctagaacagtcagctctcaccaccacaccccgccaacacct

SEQ ID NO: 233107 - DNA, 75 bp, Artificial Sequence
  Synthetic
gcaacttttcggtcactatgactattgacttgatgaacaatgccatcatagacaactacttaaaagttggcagac

SEQ ID NO: 233108 - DNA, 75 bp, Artificial Sequence
  Synthetic
ctaccataaaaacctatgggaacaaagcttggaacagcagcacagggcaggcactgagaaataagcttaaagagc

SEQ ID NO: 233109 - DNA, 75 bp, Artificial Sequence
  Synthetic
gtacagcccgtcgccgtagccagaccgcgtcctgggggcacaccgcgcccgaaagcaaactggcagagtactctg

SEQ ID NO: 233110 - DNA, 75 bp, Artificial Sequence
  Synthetic
ccccgctcgggcggcatcgggactctccagtttgtggaggagtttactccctctgtctacttcaaccccttctcc

SEQ ID NO: 233111 - DNA, 75 bp, Artificial Sequence
  Synthetic
tctcgcaactgggccgccttcagaggctggtccttcaccagactcaaaaccaaggagactccctctttgggatca

SEQ ID NO: 233112 - DNA, 75 bp, Artificial Sequence
  Synthetic
cgaccaggtggtcgccgatgctcgtaattatactcctactgcgcctacatctactgtggatgcagttattgacag

SEQ ID NO: 233113 - DNA, 75 bp, Artificial Sequence
  Synthetic
tcttacaaagttcgctacacgctggctgtaggggacaacagagtactggatatggccagcacgttctttgacatc

SEQ ID NO: 233114 - DNA, 75 bp, Artificial Sequence
  Synthetic
ctcggaccacggtcgatgatgtgatcgaccaggtggtcgccgatgctcgtaattatactcctactgcgcctacat

SEQ ID NO: 233115 - DNA, 75 bp, Artificial Sequence
  Synthetic
gcttcaaaccctactccgggaccgcctacaacagcctggctcccaagggagcgcccaacacctgccagtggaagg

SEQ ID NO: 233116 - DNA, 75 bp, Artificial Sequence
  Synthetic
ctacaacagcctggctcccaagggagcgcccaacacctgccagtggaaggattctgacagcaaaatgcatacctt

SEQ ID NO: 233117 - DNA, 75 bp, Artificial Sequence
  Synthetic
actgggaaaaagatagaagctgatgggctgcctattggaatagattcaacttctggaactgacacagtaatttat

SEQ ID NO: 233118 - DNA, 75 bp, Artificial Sequence
  Synthetic
ggctgcctattggaatagattcaacttctggaactgacacagtaatttatgctgataaaactttccaaccagaac

SEQ ID NO: 233119 - DNA, 75 bp, Artificial Sequence
  Synthetic
tgacgccaatggcgcagaggaaaaatatggaggcagagctctgaaggacactacaaagatgaaaccctgctatgg

SEQ ID NO: 233120 - DNA, 75 bp, Artificial Sequence
  Synthetic
ctaccggccagcgcgtgcccgtgcgcacccgcccccctcgcacttagaagatactgagcagtctccgatgttgtg

SEQ ID NO: 233121 - DNA, 75 bp, Artificial Sequence
  Synthetic
tatggaggcagagctctgaaggacactacaaagatgaaaccctgctatggttctttcgccaagcctaccaacaaa

SEQ ID NO: 233122 - DNA, 75 bp, Artificial Sequence
  Synthetic
caaatacaaggaagagatgctccaggtcatcgcgcctgaaatctacggtccaccggtgaaggatgaaaaaaagcc

SEQ ID NO: 233123 - DNA, 75 bp, Artificial Sequence
  Synthetic
agaagaatcggaccccacgcgacggtaggtgttcctcttcgggggcagaggtggaggcgactgagatgggctgcg

SEQ ID NO: 233124 - DNA, 75 bp, Artificial Sequence
  Synthetic
attcagaaaccgccgccaccactcctaactatgatatagatctggctttctttgacaacaaaaatattgctgcta

SEQ ID NO: 233125 - DNA, 75 bp, Artificial Sequence
  Synthetic
taactatgatatagatctggctttctttgacaacaaaaatattgctgctaactacgatccagatattgtaatgta

SEQ ID NO: 233126 - DNA, 75 bp, Artificial Sequence
  Synthetic
atgggctggtggagtttgtgcgcgagttcgccccaagacggcgcgtgcagtggcgcgggcgcaaagtgcgtcaag

SEQ ID NO: 233127 - DNA, 75 bp, Artificial Sequence
  Synthetic
accatgtggcgcatcccattctctagcaacttcatgtccatgggtgcccttacagacctgggacagaacttgctg

SEQ ID NO: 233128 - DNA, 75 bp, Artificial Sequence
  Synthetic
ccagatactcatattgtatacaaacctggaacagaggacaccagctctgaatccaatttgggtcaacaagccatg

SEQ ID NO: 233129 - DNA, 75 bp, Artificial Sequence
  Synthetic
ctggaacagaggacaccagctctgaatccaatttgggtcaacaagccatgcctaacagacccaactacattggct

SEQ ID NO: 233130 - DNA, 75 bp, Artificial Sequence
  Synthetic
tagcgctaaacgctttcctcagcacccagcccgccaacgtgccccgtggtcagcaagactatacaaactttttga

SEQ ID NO: 233131 - DNA, 75 bp, Artificial Sequence
  Synthetic
gtactacaacagcactggcaatatgggggtgctggccggtcaggcctctcagctgaatgctgtggttgacttgca

SEQ ID NO: 233132 - DNA, 75 bp, Artificial Sequence
  Synthetic
ggggtgctggccggtcaggcctctcagctgaatgctgtggttgacttgcaagacagaaacactgaactgtcctac

SEQ ID NO: 233133 - DNA, 75 bp, Artificial Sequence
  Synthetic
ttgcacctgaaacaagtcgctactgtggagttcttattaggtgcggacgggaatgcaggcccattgagattacac

SEQ ID NO: 233134 - DNA, 75 bp, Artificial Sequence
  Synthetic
acagaacccggtatttcagtatgtggaatcaggcagtggacagctatgatcctgatgtgcgtattattgaaaacc

SEQ ID NO: 233135 - DNA, 75 bp, Artificial Sequence
  Synthetic
gaatcaggcagtggacagctatgatcctgatgtgcgtattattgaaaaccatggtgtggaggacgaattgccaaa

SEQ ID NO: 233136 - DNA, 75 bp, Artificial Sequence
  Synthetic
ggatttacagacacttaccaaggtgttaaagttaaaacagatgcagttgctggaaccagtggaacacagtgggac

SEQ ID NO: 233137 - DNA, 75 bp, Artificial Sequence
  Synthetic
agctaatggtgcccaagcgccagaggctagaagacgtactggagaaaatgaaagtggatcccgatatccagcctg

SEQ ID NO: 233138 - DNA, 75 bp, Artificial Sequence
  Synthetic
gctgaaatgtgcgatatggtcatgttcatgagcagacagtatgacctatggcctcccagcaaggagaacattgtg

SEQ ID NO: 233139 - DNA, 75 bp, Artificial Sequence
  Synthetic
agtggcgccaggtttgggagtacaaaccttcgacatcaagattcccaccgagtccatggaagtgcagaccgaacc

SEQ ID NO: 233140 - DNA, 75 bp, Artificial Sequence
  Synthetic
ctaatgaaatccatggaggcaatccttttgccatggaaatcaacatccaagccaatctatggcgaagtttccttt

SEQ ID NO: 233141 - DNA, 75 bp, Artificial Sequence
  Synthetic
gcaatctggaagccaccctgaacttcttgctgaccaaccggtcgcagaagatcccgccccagtacgcgctgagcg

SEQ ID NO: 233142 - DNA, 75 bp, Artificial Sequence
  Synthetic
aacagatttaccagtttgagtacgaggggctcctgcgccgcagtgcccttgctaccaaagaccgctgcatcaccc

SEQ ID NO: 233143 - DNA, 75 bp, Artificial Sequence
  Synthetic
gaggtgcaaacggaaccctggacgcccgcgcccgttgtcgcccccagcaccactcgaagatcacgacgaaagtac

SEQ ID NO: 233144 - DNA, 75 bp, Artificial Sequence
  Synthetic
gtacatgtatcatcactgctatcatgtgtgtatgcatacacttgcttatagccattcgccccagaaacagcaatg

SEQ ID NO: 233145 - DNA, 75 bp, Artificial Sequence
  Synthetic
gtgtgtatgcatacacttgcttatagccattcgccccagaaacagcaatgaggaaaaagagaagatgccttgatc

SEQ ID NO: 233146 - DNA, 75 bp, Artificial Sequence
  Synthetic
gtttacagcatgacttctgttacggttcttactattgctagctttgctattgtaacacatggaatggaacacatt

SEQ ID NO: 233147 - DNA, 75 bp, Artificial Sequence
  Synthetic
tcccactccgggttacagaggcactcgctactatcgaaaccggagcaacacctctcgccgccgcaaaccacctgc

SEQ ID NO: 233148 - DNA, 75 bp, Artificial Sequence
  Synthetic
ttcttactattgctagctttgctattgtaacacatggaatggaacacattacccttagtgtttatactggcgata

SEQ ID NO: 233149 - DNA, 75 bp, Artificial Sequence
  Synthetic
cctcctacctgtctcatggtactggtatgaaaatcatgaaaacattgttagactttgtgaggggatgaaacacaa

SEQ ID NO: 233150 - DNA, 75 bp, Artificial Sequence
  Synthetic
tgtcgctgtccggaacggctggtgctgccgcgaccgtgcccgaagctgcaagtcctttccctagcttgccctttt

SEQ ID NO: 233151 - DNA, 75 bp, Artificial Sequence
  Synthetic
tatgaaaatcatgaaaacattgttagactttgtgaggggatgaaacacaacaacattcagactattcaatatgat

SEQ ID NO: 233152 - DNA, 75 bp, Artificial Sequence
  Synthetic
ttaacataactaaaagatatgctggtttttactatggaactgactatattgatcaaagagacaaatactatacta

SEQ ID NO: 233153 - DNA, 75 bp, Artificial Sequence
  Synthetic
tttttactatggaactgactatattgatcaaagagacaaatactatactattcaagtactaaatccaacaactaa

SEQ ID NO: 233154 - DNA, 75 bp, Artificial Sequence
  Synthetic
aataatgcaatggctcatttcctattgcaacatgcttttaatacttctaactctaccatctcccctactcttcca

SEQ ID NO: 233155 - DNA, 75 bp, Artificial Sequence
  Synthetic
tgcaacatgcttttaatacttctaactctaccatctcccctactcttccaaatgaaaacaacattcctaattcca

SEQ ID NO: 233156 - DNA, 75 bp, Artificial Sequence
  Synthetic
agcaggtcaggagcagagatcttgaaatcacagttggggccggcattctggacacgggagttgcggtacactggg

SEQ ID NO: 233157 - DNA, 75 bp, Artificial Sequence
  Synthetic
acgagcttgttgttgatttaaaatcaagtgtttttatttcatttttcgcgcacggtatgccctggaccaccgatc

SEQ ID NO: 233158 - DNA, 75 bp, Artificial Sequence
  Synthetic
tgtgggcatggcaattattgtaatcagcatgattacctatgcttgctgctatagaaaattacagcataacaaact

SEQ ID NO: 233159 - DNA, 75 bp, Artificial Sequence
  Synthetic
agcatgattacctatgcttgctgctatagaaaattacagcataacaaactagacccactactaagctttgatgtt

SEQ ID NO: 233160 - DNA, 75 bp, Artificial Sequence
  Synthetic
gctccgcgacacggcacgaggccgtacatgggcacctggagcgacatcggcacgagccaactgaacgggggcgcc

SEQ ID NO: 233161 - DNA, 75 bp, Artificial Sequence
  Synthetic
tcataggccttttagtttttatttcctttaaacttacactagcggcaaacaaatacgaaaccatcacagtagttg

SEQ ID NO: 233162 - DNA, 75 bp, Artificial Sequence
  Synthetic
ctttaaacttacactagcggcaaacaaatacgaaaccatcacagtagttgagggcacaccaaacttaactttaaa

SEQ ID NO: 233163 - DNA, 75 bp, Artificial Sequence
  Synthetic
tggggatcagcatcatcctggcttggtcgggggttatccctgggtacacggccttcatgaaggcttcgtactgct

SEQ ID NO: 233164 - DNA, 75 bp, Artificial Sequence
  Synthetic
aaaagaatcaccgttaatataacatgggaaactgaggtaaatacaccaagacaagatgtatgtaaattaaattta

SEQ ID NO: 233165 - DNA, 75 bp, Artificial Sequence
  Synthetic
gggaaactgaggtaaatacaccaagacaagatgtatgtaaattaaatttaacaaagtacaaatgtgatgggtatg

SEQ ID NO: 233166 - DNA, 75 bp, Artificial Sequence
  Synthetic
acagataaacagccgcctggacccgccgcccgcaacccctggtgaaatggaagtggaggaagaacttcctccgct

SEQ ID NO: 233167 - DNA, 75 bp, Artificial Sequence
  Synthetic
aaatgattctaaattctactttggagaaagtattactgtactaacactaggcgcagcaaaaggctccataacaca

SEQ ID NO: 233168 - DNA, 75 bp, Artificial Sequence
  Synthetic
gaaagtattactgtactaacactaggcgcagcaaaaggctccataacacatcactatgctgtttataatgttaaa

SEQ ID NO: 233169 - DNA, 75 bp, Artificial Sequence
  Synthetic
ccgcccgcaacccctggtgaaatggaagtggaggaagaacttcctccgctggaaaagcggggcgacaagcgtccg

SEQ ID NO: 233170 - DNA, 75 bp, Artificial Sequence
  Synthetic
caactaagcttaaggttgcttatttattgaaaccaacagaaatcactaccaatgagcagactactgagaaccaca

SEQ ID NO: 233171 - DNA, 75 bp, Artificial Sequence
  Synthetic
atacgaggaggcagtaaagctcggaatgcccactaccaggcctgtagctcacatggctaccggggtgatgaaacc

SEQ ID NO: 233172 - DNA, 75 bp, Artificial Sequence
  Synthetic
attgaaaccaacagaaatcactaccaatgagcagactactgagaaccacacaccagctacctcaactgtcctaac

SEQ ID NO: 233173 - DNA, 75 bp, Artificial Sequence
  Synthetic
cccattccaactactatcttatctgaaaatttacctactcctttaaaaagatttgatgctttcatgaaactagaa

SEQ ID NO: 233174 - DNA, 75 bp, Artificial Sequence
  Synthetic
ctgcggcacctgttcccaaacctgtcgctaccagaaagcccaccgccgtacagcccgtcgccgtagccagaccgc

SEQ ID NO: 233175 - DNA, 75 bp, Artificial Sequence
  Synthetic
aaaatttacctactcctttaaaaagatttgatgctttcatgaaactagaaattacttttttaattgctgtgggaa

SEQ ID NO: 233176 - DNA, 75 bp, Artificial Sequence
  Synthetic
ctgtatcttctgccgccgtatacccaatgttccaagacgacctgtatatagacctattataggcgagccccaaca

SEQ ID NO: 233177 - DNA, 75 bp, Artificial Sequence
  Synthetic
aatgttccaagacgacctgtatatagacctattataggcgagccccaacaacttcaggtagaagggggtctaaga

SEQ ID NO: 233178 - DNA, 75 bp, Artificial Sequence
  Synthetic
tgcacatcgccggacaggatgcttcggagtacctgagtccgggtctggtgcagttcgcccgtgcaacagacacct

SEQ ID NO: 233179 - DNA, 75 bp, Artificial Sequence
  Synthetic
cctggttattaattttttccaacttgtagactggatctttgtgcgaatagcctacctaaggcaccatcccgaata

SEQ ID NO: 233180 - DNA, 75 bp, Artificial Sequence
  Synthetic
gtttcaagcagcagaggagagggaagagacggaagaatcatgttaatttttattccaaacgatctcgcagtactt

SEQ ID NO: 233181 - DNA, 75 bp, Artificial Sequence
  Synthetic
gcggttctgggtgatcttggctctgtctgggttctccttcatagcgcgctgcccgttctcgctcgccacatccat

SEQ ID NO: 233182 - DNA, 75 bp, Artificial Sequence
  Synthetic
ctcaggcttatttaaaaccatgcaggctatactgccggtgattctgcttctattgctcccctgcgttgccttgac

SEQ ID NO: 233183 - DNA, 75 bp, Artificial Sequence
  Synthetic
gctatactgccggtgattctgcttctattgctcccctgcgttgccttgacccccgttagcactcgcaccccacct

SEQ ID NO: 233184 - DNA, 75 bp, Artificial Sequence
  Synthetic
aacagccatggtcattccttgattgctatcgcgaaaaatctgattttcccccacactggataatgattgttggaa

SEQ ID NO: 233185 - DNA, 75 bp, Artificial Sequence
  Synthetic
tggcggtcgcttgactgatttcctccgcggctggccattgtgttctcctaggcagagaaacaacagacatggaaa

SEQ ID NO: 233186 - DNA, 75 bp, Artificial Sequence
  Synthetic
taatcaatataatctcatgcactctattctcattcctaatataccccatatttaattttgggtggaatgctccca

SEQ ID NO: 233187 - DNA, 75 bp, Artificial Sequence
  Synthetic
agaggaacacattccactacagaacatgcaacagccaatagatctaatagattatgaaaatgagccacagcctcc

SEQ ID NO: 233188 - DNA, 75 bp, Artificial Sequence
  Synthetic
atgcaacagccaatagatctaatagattatgaaaatgagccacagcctccactgctccctgccattagctacttc

SEQ ID NO: 233189 - DNA, 75 bp, Artificial Sequence
  Synthetic
catatcagccagagcctcaagttggagaagaatcatggactgatactgatgtaacaaatgaaaagtttggtggaa

SEQ ID NO: 233190 - DNA, 75 bp, Artificial Sequence
  Synthetic
ccgctcaccgcctccactgctgccgatgaacttcttgacatggacggacgtgcctcagaacagcgactcgtccaa

SEQ ID NO: 233191 - DNA, 75 bp, Artificial Sequence
  Synthetic
gcacgagccaactgaacgggggcgccttcaattggagcagtctctggagcgggcttaagaattttgggtccacgc

SEQ ID NO: 233192 - DNA, 75 bp, Artificial Sequence
  Synthetic
atgaacttcttgacatggacggacgtgcctcagaacagcgactcgtccaactacgcatccgccagcagcaggaac

SEQ ID NO: 233193 - DNA, 75 bp, Artificial Sequence
  Synthetic
tattgtgattcaccagtgcaaaaaaggcatattctgcttggtaaaacaatccaagatctcctacgagatcaccgc

SEQ ID NO: 233194 - DNA, 75 bp, Artificial Sequence
  Synthetic
ttttcgatggtagagatgctgttgcaggagctttagcgcctgaaattgtgctttatacggaaaatgtaaatttgg

SEQ ID NO: 233195 - DNA, 75 bp, Artificial Sequence
  Synthetic
tactgaacatcgcctctcctacgagctcggtccgcagcgtcagaaatttacctgcatggtgggaatcaaccctat

SEQ ID NO: 233196 - DNA, 75 bp, Artificial Sequence
  Synthetic
actaagggttgcatccactgttcctgtgattccactgagtgcatctacactctactgaaaaccctctgcggcctt

SEQ ID NO: 233197 - DNA, 75 bp, Artificial Sequence
  Synthetic
atgtactacaacagtactggaaatatgggagttttggctggccaagcatcacaactgaatgcagtggttgacttg

SEQ ID NO: 233198 - DNA, 75 bp, Artificial Sequence
  Synthetic
cgtgctcctcaaacatctagcaaggcagtcgatcatagttaaagacgcactactcgacctcaccgaagtgcccat

SEQ ID NO: 233199 - DNA, 75 bp, Artificial Sequence
  Synthetic
caggacagaaatactgaactgtcatatcagcttttgcttgattctctgggagacagaaccagatacttcagcatg

SEQ ID NO: 233200 - DNA, 75 bp, Artificial Sequence
  Synthetic
cccaattaaaaattatcaataaaaatcacttacttgaaatcagcaataaggtctctgtcaaaacttcctgccagc

SEQ ID NO: 233201 - DNA, 75 bp, Artificial Sequence
  Synthetic
tcacttacttgaaatcagcaataaggtctctgtcaaaacttcctgccagcagcacctcgctcccctcttcccaac

SEQ ID NO: 233202 - DNA, 75 bp, Artificial Sequence
  Synthetic
gccacctaccacatcttttttaagaaccaaaagattccagtctcctgccgcgccaaccgcacccgagccgatgcc

SEQ ID NO: 233203 - DNA, 75 bp, Artificial Sequence
  Synthetic
atcccgatgttcgcattattgaaaatcatggcatcgaggatgaactgcctaattactgttttcctctggatggca

SEQ ID NO: 233204 - DNA, 75 bp, Artificial Sequence
  Synthetic
ggcatatttcctccacactttgaaagggatgtcaaattttagttcctcttctctgcctacaatcttcatttcttt

SEQ ID NO: 233205 - DNA, 75 bp, Artificial Sequence
  Synthetic
gggatgtcaaattttagttcctcttctctgcctacaatcttcatttctttattcctcagatgtccaagcgtgctc

SEQ ID NO: 233206 - DNA, 75 bp, Artificial Sequence
  Synthetic
gaaaccccacagtggcgcccacccacgatgtgaccaccgaccgtagccagcgactgatgctgcgcttcgtgcccg

SEQ ID NO: 233207 - DNA, 75 bp, Artificial Sequence
  Synthetic
ttacccttatgaagatgaagtcagctcacaacacccatttataaaccctggctttatttcccccgatggttttgc

SEQ ID NO: 233208 - DNA, 75 bp, Artificial Sequence
  Synthetic
tcacaacacccatttataaaccctggctttatttcccccgatggttttgcgcaaggcccagatggagttctaact

SEQ ID NO: 233209 - DNA, 75 bp, Artificial Sequence
  Synthetic
acctgggacagaacctgctctatgccaactcggcccatgcgctggacatgacttttgaggtggatcccatggatg

SEQ ID NO: 233210 - DNA, 75 bp, Artificial Sequence
  Synthetic
ccaccggcggacccctccaacttaaagttggaaacagtcttacagtagatactatcgatggatctttggaagaaa

SEQ ID NO: 233211 - DNA, 75 bp, Artificial Sequence
  Synthetic
agttggaaacagtcttacagtagatactatcgatggatctttggaagaaaatataaatgccacagcaccactcac

SEQ ID NO: 233212 - DNA, 75 bp, Artificial Sequence
  Synthetic
gggagatgggttggaaacaaaggaagataaactatgtttatcgctgggagatgggttggaaacaaaggaagataa

SEQ ID NO: 233213 - DNA, 75 bp, Artificial Sequence
  Synthetic
atgggttggaaacaaaggaagataaactatgtaccaaactaggaaatggccttgtgtttgactcttctagtgcta

SEQ ID NO: 233214 - DNA, 75 bp, Artificial Sequence
  Synthetic
gtaatgtatgcagaaaatgtggacctggaatctccagatactcatgttgtgtacaaacctggagtttcagatgct

SEQ ID NO: 233215 - DNA, 75 bp, Artificial Sequence
  Synthetic
gatgtgaacatggtcctgcaaagttcccttggaaatgacctcagaacagatggtgctaccataagtttcaccagc

SEQ ID NO: 233216 - DNA, 75 bp, Artificial Sequence
  Synthetic
tgtgtaattaaagacggagaagagtccccagactgtaagctcactttagtcctagtgaaaaatggaggactggta

SEQ ID NO: 233217 - DNA, 75 bp, Artificial Sequence
  Synthetic
ccttgaagccatgctgcgcaacgataccaatgatcagtcatttaacgactacctctctgcagctaacatgcttta

SEQ ID NO: 233218 - DNA, 75 bp, Artificial Sequence
  Synthetic
actcagaatatgctaacaccttgtttaaagaaaaacaagctacaatcgatgtaaaccttgcatttgataatacag

SEQ ID NO: 233219 - DNA, 75 bp, Artificial Sequence
  Synthetic
agcgtctcagttgaatgcagtggttgacttgcaggacagaaacacagaactgtcttaccaactcttgcttgactc

SEQ ID NO: 233220 - DNA, 75 bp, Artificial Sequence
  Synthetic
taaagaaaaacaagctacaatcgatgtaaaccttgcatttgataatacaggccaaattatcacttacctatcatc

SEQ ID NO: 233221 - DNA, 75 bp, Artificial Sequence
  Synthetic
cataaccaaaacatggctactggaactataaccagcgccaaaggcttcatgcctagcaccaccgcctatcctttt

SEQ ID NO: 233222 - DNA, 75 bp, Artificial Sequence
  Synthetic
ctataaccagcgccaaaggcttcatgcctagcaccaccgcctatccttttatgagccacggcactgactccctaa

SEQ ID NO: 233223 - DNA, 75 bp, Artificial Sequence
  Synthetic
ttattacaaatccaccaatggaactctctatccactaaaagttactatcacactaaacagacgtatgtcagctgc

SEQ ID NO: 233224 - DNA, 75 bp, Artificial Sequence
  Synthetic
ctctatccactaaaagttactatcacactaaacagacgtatgtcagctgccggaatggcctatgctgtaaacttt

SEQ ID NO: 233225 - DNA, 75 bp, Artificial Sequence
  Synthetic
ccccggaaactacacaagttaccctcattacctcccccttctttttttcttatatcagagaagatgactgacaaa

SEQ ID NO: 233226 - DNA, 75 bp, Artificial Sequence
  Synthetic
ttgccaactacaacattggctaccagggcttttacatccctgagggatacaaggatcgcatgtactcttttttca

SEQ ID NO: 233227 - DNA, 75 bp, Artificial Sequence
  Synthetic
tatatcagagaagatgactgacaaaataaagttcaacttttttattaaatcagtttacaggattcgagtcgttat

SEQ ID NO: 233228 - DNA, 75 bp, Artificial Sequence
  Synthetic
gaaacttccagcctatgagcaggcaggtggttgatgaggttaattacactgactacaaagccgtcaccttaccat

SEQ ID NO: 233229 - DNA, 75 bp, Artificial Sequence
  Synthetic
aacaatctggctatggaaattaatatccaagctaatctttggagaagttttctgtactccaatgtggctttgtac

SEQ ID NO: 233230 - DNA, 75 bp, Artificial Sequence
  Synthetic
tgatgtcttgtaaagggacatgcttggtcttcctgggcttctttttggggggtattggcggagggctgctgctcc

SEQ ID NO: 233231 - DNA, 75 bp, Artificial Sequence
  Synthetic
gtggtttcacagtccagttgctgaggctgcggttccggagtctggatcagagtcatctggaagaagaacgatggg

SEQ ID NO: 233232 - DNA, 75 bp, Artificial Sequence
  Synthetic
actcagcccatgcgctggacatgacttttgaggtggatcccatggatgagcccaccctgctttatcttcttttcg

SEQ ID NO: 233233 - DNA, 75 bp, Artificial Sequence
  Synthetic
agcagtcgctgtctgcgccgctccgtgcgactgctgctgatgggatcggggtccacagtctctcgaagcatgatt

SEQ ID NO: 233234 - DNA, 75 bp, Artificial Sequence
  Synthetic
agtttcgctcaccagtaccacctggctctcggtagaagaaccggaccccacacggcggtaggtgttcctcttcgg

SEQ ID NO: 233235 - DNA, 75 bp, Artificial Sequence
  Synthetic
aagtcttcgacgtggtcagagtgcaccagccacaccgcggcgtcatcgaggccgtctacctgcgcacaccgttct

SEQ ID NO: 233236 - DNA, 75 bp, Artificial Sequence
  Synthetic
cggccggcaacgccaccacataagaagcctcttgcttcttgcaagcagcagctgcagccatgacatgcgggtccg

SEQ ID NO: 233237 - DNA, 75 bp, Artificial Sequence
  Synthetic
acccagagcgtgcagggcccgcgctcagccgcctgtggacttttttgctgtatgttccttcatgcctttgtgcac

SEQ ID NO: 233238 - DNA, 75 bp, Artificial Sequence
  Synthetic
ggaaaccccaccatgaagttgctgactggggtgtccaacagcatgctccaatcaccccaagtccagcccaccttg

SEQ ID NO: 233239 - DNA, 75 bp, Artificial Sequence
  Synthetic
tggtaattatagtacaaccattcccgtagattggtcaaaagatcttcagcctcagttgtcataaaaactccatca

SEQ ID NO: 233240 - DNA, 75 bp, Artificial Sequence
  Synthetic
aaatgccttaacctttttactcataccttttctttacagcatggcttctgttacagctctaattattgccagcat

SEQ ID NO: 233241 - DNA, 75 bp, Artificial Sequence
  Synthetic
ccctgctttatcttcttttcgaagtcttcgacgtcgtccgagtgcaccagccccaccgcggcgtcattgaggccg

SEQ ID NO: 233242 - DNA, 75 bp, Artificial Sequence
  Synthetic
atccaaaaacaaaagaacagcaaaagcaggagcattttctaattcctcaatcatcatattacattcctgtaccat

SEQ ID NO: 233243 - DNA, 75 bp, Artificial Sequence
  Synthetic
ctggtaaatccaatccacacatgagaaatagctcccggagggcgccctccaccggcaatcttaagcacaccctca

SEQ ID NO: 233244 - DNA, 75 bp, Artificial Sequence
  Synthetic
ttcacacagcagcgggcatcgttgttggccaactggaccacatttctgccccagcggttctgggtgatcttggct

SEQ ID NO: 233245 - DNA, 75 bp, Artificial Sequence
  Synthetic
accggcaatcttaagcacaccctcatagtgagaaaatatcgtgctcctctgtcacctgcagcaaattgagaatgg

SEQ ID NO: 233246 - DNA, 75 bp, Artificial Sequence
  Synthetic
aattgcctccagcaaaagtgaggttgcaataagcatactgagaacctccagtgatatcatccagtgtactggaaa

SEQ ID NO: 233247 - DNA, 75 bp, Artificial Sequence
  Synthetic
cggtgcactcccaattattgtgggcgatctcggaataataatgtaccaatccctgcatgaatcttcccatcattg

SEQ ID NO: 233248 - DNA, 75 bp, Artificial Sequence
  Synthetic
agatgaacatttaaagcctgtgggatgcagatgcaataagttatcgcgctgcgttccaacattgttagtatggtt

SEQ ID NO: 233249 - DNA, 75 bp, Artificial Sequence
  Synthetic
acatgaacatgcaaatctggaagatcctgaggtatgatgatacaagatcgagggtgcgcgcatgcgaatgcggag

SEQ ID NO: 233250 - DNA, 75 bp, Artificial Sequence
  Synthetic
aaaattacatcacgctatactggcgaacgggtggataaatcactctctccaacaccaggcaggctacagggtctc

SEQ ID NO: 233251 - DNA, 75 bp, Artificial Sequence
  Synthetic
acgcttgccagcacggtcgggtcactgatggtagtcacatccaagtcttcagcattggccatcccaaagggggtc

SEQ ID NO: 233252 - DNA, 75 bp, Artificial Sequence
  Synthetic
aacaccaggcaggctacagggtctccagcgcgaccctcgtaaaacctgtctgtatgattaaaaagcatcaccgaa

SEQ ID NO: 233253 - DNA, 75 bp, Artificial Sequence
  Synthetic
cttctcttgccatccttctcaatgatgcgcaccggggggtagctgaagcccacggccaccaactgagcctgttct

SEQ ID NO: 233254 - DNA, 75 bp, Artificial Sequence
  Synthetic
gaacgattatgctcaatctcaaatgcagcaaagcgacacctcgcggatgcaaagtaaaatccacaggagcataaa

SEQ ID NO: 233255 - DNA, 75 bp, Artificial Sequence
  Synthetic
aggcagcctagctcccggcccctccaaaatcacatacaaagcttcagcagccatagcttaccgcgcaaatcaggc

SEQ ID NO: 233256 - DNA, 75 bp, Artificial Sequence
  Synthetic
caatatatagagaacccatacactgacgtaattgggcaaagtctaaaaaatcccgccaaaaaaccagcacacgcc

SEQ ID NO: 233257 - DNA, 75 bp, Artificial Sequence
  Synthetic
gacccagaaaactgcacacttacttttgcacccgacacaagccgtctctgtggagttcttattaagtgcggatgg

SEQ ID NO: 233258 - DNA, 75 bp, Artificial Sequence
  Synthetic
cggaagagattgaggcagatgtcgagcaggacccgggctatgtgacgccggcggagcacgaggaggagctgaaac

SEQ ID NO: 233259 - DNA, 75 bp, Artificial Sequence
  Synthetic
ttatgagcagacagtatgacctatggcctcccagcaaagagaacattgtggcattttccattgcttattgcttgg

SEQ ID NO: 233260 - DNA, 75 bp, Artificial Sequence
  Synthetic
gcggagcacgaggaggagctgaaacgctttctagacagagaggatgacgaccgcccagagcatcaagcagatggc

SEQ ID NO: 233261 - DNA, 75 bp, Artificial Sequence
  Synthetic
tacagagttcccttggtaacgacctacgggtagatggcgccagcatcagtttcacgagcatcaacctctatgcta

SEQ ID NO: 233262 - DNA, 75 bp, Artificial Sequence
  Synthetic
ccttggtggggaggacgtgctcctcaaacatctagcaaggcagtcgatcatagttaaagacgcattgctcaatct

SEQ ID NO: 233263 - DNA, 75 bp, Artificial Sequence
  Synthetic
gcagtatcgtggtcacccattttgcctaccccgctgttaacctgccccccaaagttatgagcgctgtcatggacc

SEQ ID NO: 233264 - DNA, 75 bp, Artificial Sequence
  Synthetic
acagactaggcaactgctagaaaacgcctcggacggagtctctagtctttggagattctggttcggtggtgatct

SEQ ID NO: 233265 - DNA, 75 bp, Artificial Sequence
  Synthetic
caggctcattttaaggagaaggttttatcagttttagatttttctacccctggtagaactgctgctgctgtagca

SEQ ID NO: 233266 - DNA, 75 bp, Artificial Sequence
  Synthetic
aacaactttcgctctttcatcctggaacgctccggtatcctgcctgccacctgctgtgcgctgccctccgacttt

SEQ ID NO: 233267 - DNA, 75 bp, Artificial Sequence
  Synthetic
atgtgagcggagacggcctgctggaatgccactgccgctgcaatctttgcacaccccaccgctcccttgcctgca

SEQ ID NO: 233268 - DNA, 75 bp, Artificial Sequence
  Synthetic
acaccccaccgctcccttgcctgcaacccccagttgctgagcgagacccagattatcggcaccttcgagttgcag

SEQ ID NO: 233269 - DNA, 75 bp, Artificial Sequence
  Synthetic
gacaccggggctgtggacctccgcctacctgcgcaagtttcaccccgaggactaccatccctatgagatcaggtt

SEQ ID NO: 233270 - DNA, 75 bp, Artificial Sequence
  Synthetic
tggctttaagtttaatgagtcgcagccgccctgaaactatctggtggcatgaggttcagagcgagggcagggatg

SEQ ID NO: 233271 - DNA, 75 bp, Artificial Sequence
  Synthetic
acggggtctaccttgaccctcagaccggtgaggagcttaacacaagattcccccaggatgtcccatcgccgagga

SEQ ID NO: 233272 - DNA, 75 bp, Artificial Sequence
  Synthetic
gaatggggcagaggttataatagatacaccagataaaacagcttttaggtgttgtatgatgggtatgtggccagg

SEQ ID NO: 233273 - DNA, 75 bp, Artificial Sequence
  Synthetic
gttgtatgatgggtatgtggccaggggtggctggtatggaggcagtaacacttatgaatattaggtttaggggag

SEQ ID NO: 233274 - DNA, 75 bp, Artificial Sequence
  Synthetic
aggaggtggacagcctggaggaagacagtttggaggaggaagacgaggaggcagaggaggtggaagaagcaaccg

SEQ ID NO: 233275 - DNA, 75 bp, Artificial Sequence
  Synthetic
ccgccaaacagttgtcatcggcggcggagacaagcaagtccccagacagcagcacggctaccatctccgctccgg

SEQ ID NO: 233276 - DNA, 75 bp, Artificial Sequence
  Synthetic
tatgcatgctggattgcactatcaggcagaaccaagagtcagttgtctgtgaagaaatgcatgtttgagagatgt

SEQ ID NO: 233277 - DNA, 75 bp, Artificial Sequence
  Synthetic
cagtagatgggacgagaccgggcgattcccaaacccgaccaccgcttccaagaccggtaagaaggagcgacaggg

SEQ ID NO: 233278 - DNA, 75 bp, Artificial Sequence
  Synthetic
cagttagaaaatccacaacaagtgcagcaggaggaggactgaggatcacagcgaacgagccagcgcagaccagag

SEQ ID NO: 233279 - DNA, 75 bp, Artificial Sequence
  Synthetic
aatgtttatgccttaccagtgtaacatgaatcatgtgaaggtgatgttggaaccagatgccttttccagaatgag

SEQ ID NO: 233280 - DNA, 75 bp, Artificial Sequence
  Synthetic
caccagaagttgtttgtatcacaagagcgaagaccaacttcagcgcactcttgaggacgccgaggctctcttcaa

SEQ ID NO: 233281 - DNA, 75 bp, Artificial Sequence
  Synthetic
ggtaaggtgggcagattgggtaaattctgtttgtttctgtcttgcagctgccatgagtggaagcgcttcttttga

SEQ ID NO: 233282 - DNA, 75 bp, Artificial Sequence
  Synthetic
catttgcttcctatgcactttttgccttcgttacttgcatctgcgtgtgtagcatagtctgcctggttattaatt

SEQ ID NO: 233283 - DNA, 75 bp, Artificial Sequence
  Synthetic
tgatagatataaatccatcggaacagtctttcaaggtggtttcacagtccaactgctgcggctgcggttccggag

SEQ ID NO: 233284 - DNA, 75 bp, Artificial Sequence
  Synthetic
gtctttcaaggtggtttcacagtccaactgctgcggctgcggttccggagtttggattagagtcatctggaagaa

SEQ ID NO: 233285 - DNA, 75 bp, Artificial Sequence
  Synthetic
ccgctcccaccaccgtactacttcctcgagacgcccaggccgaagttcagatgactaacgcaggtgtacagctgg

SEQ ID NO: 233286 - DNA, 75 bp, Artificial Sequence
  Synthetic
tcgagacgcccaggccgaagttcagatgactaacgcaggtgtacagctggcgggcggttccgccctatgtcgtca

SEQ ID NO: 233287 - DNA, 75 bp, Artificial Sequence
  Synthetic
ctgtctcagcaggtggcccagttgcgcgagcaaactgagtctgctgttgccacagcaaagtctaaataaagattc

SEQ ID NO: 233288 - DNA, 75 bp, Artificial Sequence
  Synthetic
caacgtcgcccccggtcctctaaaatacacatacaaagcctcatcagccatggcttaccagacaaagtacagcgg

SEQ ID NO: 233289 - DNA, 75 bp, Artificial Sequence
  Synthetic
tgcggattaccatcgaagggggaatagactctcgcctgcatcgcatcttctcccagcggcccgtgctgattgaac

SEQ ID NO: 233290 - DNA, 75 bp, Artificial Sequence
  Synthetic
acgtcacatccgattaacttgcaacgtcattttcccacggcctcaccgccccttttagccgttcaccccgcagcc

SEQ ID NO: 233291 - DNA, 75 bp, Artificial Sequence
  Synthetic
atcgaacaaagtctaaaaaaaaatcccgccaaaaccagcacacgcccagaaactgtgtcatccactaaaaaaaat

SEQ ID NO: 233292 - DNA, 75 bp, Artificial Sequence
  Synthetic
ggattggccagcgggttcaacggtcaaaaggggcgggccggcgcggggaggtgacgtatttcgtgtgggaggagt

SEQ ID NO: 233293 - DNA, 75 bp, Artificial Sequence
  Synthetic
cacaaaattcgagtagttattttgcctcccccttcccatttaacagaatacaccaatctctccccacgcacagct

SEQ ID NO: 233294 - DNA, 75 bp, Artificial Sequence
  Synthetic
aacaccaaccagatcttccagaagacccagacccttcctcctttgatccaggactctaactttaccttgccagca

SEQ ID NO: 233295 - DNA, 75 bp, Artificial Sequence
  Synthetic
cgccccgtgaccgttgaaccccaagccaatccccttccgctctccattttcaaaccacctcatttacatattggc

SEQ ID NO: 233296 - DNA, 75 bp, Artificial Sequence
  Synthetic
attcttgtttttaccataacctactacgcctgctgctatagaaaagacaaacataaaggtgatccattacttaga

SEQ ID NO: 233297 - DNA, 75 bp, Artificial Sequence
  Synthetic
tctgccaatactaccactcccaaaaccggaggtgagctccgcggtcttcctactgacgacccctgggtggtagcg

SEQ ID NO: 233298 - DNA, 75 bp, Artificial Sequence
  Synthetic
ccggaggtgagctccgcggtcttcctactgacgacccctgggtggtagcgggttttgtaacgttaggagtagttg

SEQ ID NO: 233299 - DNA, 75 bp, Artificial Sequence
  Synthetic
ggcttacaactctctggctcctaaaggcgctccaaatgcatctcaatggattgcaaaaggcgtaccaactgcagc

SEQ ID NO: 233300 - DNA, 75 bp, Artificial Sequence
  Synthetic
tgcttttgtcacttgcatctgcgtatgtagcatagtctgcctggttattaattttttccaacttctagactggat

SEQ ID NO: 233301 - DNA, 75 bp, Artificial Sequence
  Synthetic
catgaaacagaggagaaaactgctacttacacttttgccaatgctcctgtaaaagccgaggctcaaattacaaaa

SEQ ID NO: 233302 - DNA, 75 bp, Artificial Sequence
  Synthetic
cttacacttttgccaatgctcctgtaaaagccgaggctcaaattacaaaagagggcttaccaataggtttggaga

SEQ ID NO: 233303 - DNA, 75 bp, Artificial Sequence
  Synthetic
cgcccctgcatgaccatcataccaaagtttaatataaattaaatgtcgttccctcaaaaacacactacccacata

SEQ ID NO: 233304 - DNA, 75 bp, Artificial Sequence
  Synthetic
taccttatccaccacatgggagccaggagttcccgagtggtatactgtctctgtccgaggtcctgacggttccat

SEQ ID NO: 233305 - DNA, 75 bp, Artificial Sequence
  Synthetic
ggagttcccgagtggtatactgtctctgtccgaggtcctgacggttccatccgcattagtaacaacactttcatt

SEQ ID NO: 233306 - DNA, 75 bp, Artificial Sequence
  Synthetic
cttggactgacctagacggaaaaaccgaagagtatggaggcagggctctaaagcctactactaacatgaaaccct

SEQ ID NO: 233307 - DNA, 75 bp, Artificial Sequence
  Synthetic
atttttataggtcctgtgtcagatgctgatgaatcgccttctcctgattcaactacctcacctcctgaaattcag

SEQ ID NO: 233308 - DNA, 75 bp, Artificial Sequence
  Synthetic
taatttaaaaggtggtcaggcaaaaccgaaaaactcggaaccgtcgagtgaaaaaattgaatatgatattgacat

SEQ ID NO: 233309 - DNA, 75 bp, Artificial Sequence
  Synthetic
cgtagttgagcgcctcggccgcgtggcctttggcgcggagcttacctttggaagttttctggcaggcggggcagt

SEQ ID NO: 233310 - DNA, 75 bp, Artificial Sequence
  Synthetic
ttaccttaggacataatcacactcttgtagggcccccaattacttcagaggttatttggaccaaacttggaagtg

SEQ ID NO: 233311 - DNA, 75 bp, Artificial Sequence
  Synthetic
gttatttggaccaaacttggaagtgttgattattttgatataatttgcaacaaaactaaaccaatatttgtaatc

SEQ ID NO: 233312 - DNA, 75 bp, Artificial Sequence
  Synthetic
ttaatgttagcaaaatttataacggttactattatggttatgacagatccagtagtcaatataaaaattacttag

SEQ ID NO: 233313 - DNA, 75 bp, Artificial Sequence
  Synthetic
ttatgatcctgatgtacgtgttattgaaaatcatggtgtggaagatgaacttcccaactattgttttccactgga

SEQ ID NO: 233314 - DNA, 75 bp, Artificial Sequence
  Synthetic
ttcgcataactcagcccaaattaacagtgccaactatgacaataattaaaatggctaataaagcattagaaaatt

SEQ ID NO: 233315 - DNA, 75 bp, Artificial Sequence
  Synthetic
cggcataggtgttccaacaaccagttacaaatcaatagttccaaatggagaagataataataattggaaagaacc

SEQ ID NO: 233316 - DNA, 75 bp, Artificial Sequence
  Synthetic
atggctaataaagcattagaaaattttacatcaccaacaacgcccaatgaaaaaaacattccaaattcaatgatt

SEQ ID NO: 233317 - DNA, 75 bp, Artificial Sequence
  Synthetic
tatacagatgatttccactacaatttttatcattattagccttgcagctgtaacttatggccgttcacacctaac

SEQ ID NO: 233318 - DNA, 75 bp, Artificial Sequence
  Synthetic
gggtaggtattccctctcgaaggcgggcataacctctgcactcaggttgtcagtttctaggaacgaggaggattt

SEQ ID NO: 233319 - DNA, 75 bp, Artificial Sequence
  Synthetic
tgtacctgttggctcaacatgtacactacaaggaccccaagaaggctatgtcacttggtggagaatatatgataa

SEQ ID NO: 233320 - DNA, 75 bp, Artificial Sequence
  Synthetic
tggagggttcgctagaccatgtgatcagcctggtacaaaattttcatgcaacggaagagacttgaccattattaa

SEQ ID NO: 233321 - DNA, 75 bp, Artificial Sequence
  Synthetic
tattatggaaccaactataaaaatagtttagattacaacattattgtagtgccagccaccacgtctgctccccgc

SEQ ID NO: 233322 - DNA, 75 bp, Artificial Sequence
  Synthetic
aaaatcgctttaagtaattccacagccgctcccaatacaattcctaaatcaacaattggcatcattactgccgtg

SEQ ID NO: 233323 - DNA, 75 bp, Artificial Sequence
  Synthetic
gcatactgaatgaaggtgaagcaagggtccgccactgcgctgctacagaaactggctgcttcattctaataaagg

SEQ ID NO: 233324 - DNA, 75 bp, Artificial Sequence
  Synthetic
ctttttgccttcgttacttgcatctgcgtgtgtagcatagtctgcctggttattaattttttccaactggtagac

SEQ ID NO: 233325 - DNA, 75 bp, Artificial Sequence
  Synthetic
ctaccagtcattttaattctgctactaccctgcattgccctagcttccaccgccactcgcgctacacctgaacaa

SEQ ID NO: 233326 - DNA, 75 bp, Artificial Sequence
  Synthetic
catggtcatttcttgattgctaccatgaaaaatctgattttcccacatactggatagtgattgttggaataatta

SEQ ID NO: 233327 - DNA, 75 bp, Artificial Sequence
  Synthetic
ccctgccattagttacttcaacctaaccggcggagatgactgacccaatcgccacatcatccaccgctgccaagg

SEQ ID NO: 233328 - DNA, 75 bp, Artificial Sequence
  Synthetic
ctcagaacagcgactcatccaactacgcattcgtcagcagcaggaacgagcagtaaaagagctaagggatgccat

SEQ ID NO: 233329 - DNA, 75 bp, Artificial Sequence
  Synthetic
cgcattcgtcagcagcaggaacgagcagtaaaagagctaagggatgccattgggattcaccagtgcaaaaaaggc

SEQ ID NO: 233330 - DNA, 75 bp, Artificial Sequence
  Synthetic
aaatctcctacgagatcaccgctactgaccatcgtctctcatacgagctcggtccgcagcgacaaaaattcacct

SEQ ID NO: 233331 - DNA, 75 bp, Artificial Sequence
  Synthetic
ctattatggaagcatcgttgccaattccagttcctctaataacccttcgaccctggctgaggacaagctacttgt

SEQ ID NO: 233332 - DNA, 75 bp, Artificial Sequence
  Synthetic
attccaccgagtgcatctacacactgctgaagaccctctgcggccttcgagacctcctacccatgaactaatcat

SEQ ID NO: 233333 - DNA, 75 bp, Artificial Sequence
  Synthetic
ggagggtggcatactttctccacactttgaaagggatgtcaaattttatttcctcttctttgcccacaatcttca

SEQ ID NO: 233334 - DNA, 75 bp, Artificial Sequence
  Synthetic
tcctcttctttgcccacaatcttcatttctttatccccagatggccaagcgagctcggctaagcacttccttcaa

SEQ ID NO: 233335 - DNA, 75 bp, Artificial Sequence
  Synthetic
agcaacttacaacacccatttataaatcctggtttcatttcccctgacgggttcacacaaagtccaaacggggtt

SEQ ID NO: 233336 - DNA, 75 bp, Artificial Sequence
  Synthetic
atcctggtttcatttcccctgacgggttcacacaaagtccaaacggggttttaagtcttaaatgtgttaatccac

SEQ ID NO: 233337 - DNA, 75 bp, Artificial Sequence
  Synthetic
atgttatctgcatcggcctggccatcttctgtctcgatggtggtcatgctgacgagcccccgcgggaggcaagtc

SEQ ID NO: 233338 - DNA, 75 bp, Artificial Sequence
  Synthetic
acttaaagtgggaagtggtcttacagtagacactactgatggatccttagaagaaaacatcaaagttaacacccc

SEQ ID NO: 233339 - DNA, 75 bp, Artificial Sequence
  Synthetic
cctaacaaagtcaaaccattctataaatttaccaataggaaacggtttgcaaatagaacaaaacaaactttgcag

SEQ ID NO: 233340 - DNA, 75 bp, Artificial Sequence
  Synthetic
gactcttccaattctattgcactcaaaaataacactttatggacaggtccaaaaccagaagccaactgcataatt

SEQ ID NO: 233341 - DNA, 75 bp, Artificial Sequence
  Synthetic
aaaataacactttatggacaggtccaaaaccagaagccaactgcataattgaatacgggaaagaaaacccagata

SEQ ID NO: 233342 - DNA, 75 bp, Artificial Sequence
  Synthetic
aaatggaggaattgttaatggatatgtaacgctaatgggagcctcagactatgttaacaccttatttaaaaacaa

SEQ ID NO: 233343 - DNA, 75 bp, Artificial Sequence
  Synthetic
aaatgtctccattaatgtagaattatactttgatgccactggtcatatattaccagacttatcttctcttaaaac

SEQ ID NO: 233344 - DNA, 75 bp, Artificial Sequence
  Synthetic
cacagtgtcctgaagcatgattttaatagcccttaacattaactttctggtgcgatgcgcgcagcaacgcattct

SEQ ID NO: 233345 - DNA, 75 bp, Artificial Sequence
  Synthetic
accactcactttagtgcaagaggttttatgccaagtactacagcgtatccatttgtccttcctaatgcgggaaca

SEQ ID NO: 233346 - DNA, 75 bp, Artificial Sequence
  Synthetic
ttatgccaagtactacagcgtatccatttgtccttcctaatgcgggaacagataatgaaaattatatttttggtc

SEQ ID NO: 233347 - DNA, 75 bp, Artificial Sequence
  Synthetic
tgccctttttccgttggaagttactgttacgcttaataaacgcctgccagatagtcgcacatcctatgttatgac

SEQ ID NO: 233348 - DNA, 75 bp, Artificial Sequence
  Synthetic
cctccgcgatacctggcacctacggagggcagaaacagcattcgttactcggaactggcacctcagtacgatacc

SEQ ID NO: 233349 - DNA, 75 bp, Artificial Sequence
  Synthetic
agcagtttaccatgagttcgtagttgagcgcctcggccgcgtggcctttggcgcggagcttacctttggaagttt

SEQ ID NO: 233350 - DNA, 75 bp, Artificial Sequence
  Synthetic
cgagtagttattttgcctcccccttcccatttaacagaatacaccaatctctccccacgcacagctttaaacatt

SEQ ID NO: 233351 - DNA, 75 bp, Artificial Sequence
  Synthetic
aggactttttgaagctcttaacttgggccatcaggctcattttaaggagaaggttttatcagttttagatttttc

SEQ ID NO: 233352 - DNA, 75 bp, Artificial Sequence
  Synthetic
ttcagagcgagccaatctggggtcagtgatacataaaaatgcatcgggatagtcttttaaagcgctttcacagtc

SEQ ID NO: 233353 - DNA, 75 bp, Artificial Sequence
  Synthetic
tatcacaatattgtttaataaaccataattaaaagcgctccagccaaaactcatatctgatataatcgcccctgc

SEQ ID NO: 233354 - DNA, 75 bp, Artificial Sequence
  Synthetic
gacgatgctgctggtgatgaaattaaaataggcagttctgagacggcggatggtggcgaggagcaccaggtcttt

SEQ ID NO: 233355 - DNA, 75 bp, Artificial Sequence
  Synthetic
tgtctgtaccatggacaacgttggttaatcatgcaacccaatataaccttccggaaccacactgccaacaccgct

SEQ ID NO: 233356 - DNA, 75 bp, Artificial Sequence
  Synthetic
tgcaacgtcattttcccacggccgcgccgccccttttagccgttaaccccacagccaatcaccacacaccccgca

SEQ ID NO: 233357 - DNA, 75 bp, Artificial Sequence
  Synthetic
cccccagccatgcattgaagtgaaccctgctgattacaatgacaatgaagaacccaattctctcgaccatgaatc

SEQ ID NO: 233358 - DNA, 75 bp, Artificial Sequence
  Synthetic
gtagtcttgcatgagtcgctccacgggcacttcttcttcgcccgctctgccatgcatgcgcgtgagcccgaaccc

SEQ ID NO: 233359 - DNA, 75 bp, Artificial Sequence
  Synthetic
aaagctggcagaacaaggaagaccacgaacacaacttacactatgcatagtcatagtatcacaatctggcaacag

SEQ ID NO: 233360 - DNA, 75 bp, Artificial Sequence
  Synthetic
tgcttcctgacattctcgtattttgtatagcaaaacgcggccctggcacaacacactcttcttcgtcttctatcc

SEQ ID NO: 233361 - DNA, 75 bp, Artificial Sequence
  Synthetic
ggcatggggtgggtgagtgcagaggcatacatgccacagatgtcatagacatagaggggctcttcgaggatgcca

SEQ ID NO: 233362 - DNA, 75 bp, Artificial Sequence
  Synthetic
tactcctactgcgcctacatctactgtggatgcagttattgacagtgtggtggcagacgcccgcgcctatgctcg

SEQ ID NO: 233363 - DNA, 75 bp, Artificial Sequence
  Synthetic
agccaaagcgcggctcgtattggccggtttccgcgacaagcgaggtttggcagccccgtcatttccaagaccccg

SEQ ID NO: 233364 - DNA, 75 bp, Artificial Sequence
  Synthetic
ggtagcatatgcaaatcccaaccaagcaatgcaactggattgcgtttcaagcagcagaggagagggaagagacgg

SEQ ID NO: 233365 - DNA, 75 bp, Artificial Sequence
  Synthetic
aacgatctcgcagtacttcaaattgtagatcgcgcagatggcatctatcgcccccactgtgttggtgaaaaagca

SEQ ID NO: 233366 - DNA, 75 bp, Artificial Sequence
  Synthetic
tagatcgcgcagatggcatctatcgcccccactgtgttggtgaaaaagcacagctaaatcaaaagaaatgcgatt

SEQ ID NO: 233367 - DNA, 75 bp, Artificial Sequence
  Synthetic
cccctatttgattttggctggaacgctcccaatgcacatgatcatccccaagacccagaggaacacattccccta

SEQ ID NO: 233368 - DNA, 75 bp, Artificial Sequence
  Synthetic
atgatgtcataacctagttggttttttttttcccacagctcgcggttgagaaggtattcttcgcgatccttccag

SEQ ID NO: 233369 - DNA, 75 bp, Artificial Sequence
  Synthetic
ggtcccggagggcgccctccaccaccattcttaaacacaccctcataatgacaaaatatcttgctcctgtgtcac

SEQ ID NO: 233370 - DNA, 75 bp, Artificial Sequence
  Synthetic
ataggtaccaccacaccacttgttaagactgggcactctataggtttatccctaggagccggattgggaacagat

SEQ ID NO: 233371 - DNA, 75 bp, Artificial Sequence
  Synthetic
caacgtcgcccccggtccctctaaatacacatacaaagcctcattagccatggcttaccaggcaaagtacagcca

SEQ ID NO: 233372 - DNA, 75 bp, Artificial Sequence
  Synthetic
acgatacgtcacatccgattaacttacaacgtcattttcccacggtcacaccgccccgtttagccgttcaccccg

SEQ ID NO: 233373 - DNA, 75 bp, Artificial Sequence
  Synthetic
gtaatttaaaaaagcgcgcgctgtgtggtgattggctgtggggtgaacggctaaaatgggcggggcggccgtggg

SEQ ID NO: 233374 - DNA, 75 bp, Artificial Sequence
  Synthetic
ggtacctggcgcctacggaagggagaaacagcattcgttactcggagctgtcgcccctgtacgataccaccaagt

SEQ ID NO: 233375 - DNA, 75 bp, Artificial Sequence
  Synthetic
tggtgattggctgtggggtgaacggctaaaatgggcggggcggccgtgggaaaatgacgtgacttatgtgggagg

SEQ ID NO: 233376 - DNA, 75 bp, Artificial Sequence
  Synthetic
agctatgttgcaagttattgcggtaaatgtgacgtaaaacgaggtgtggtttgaacacggaagtagacagttttc

SEQ ID NO: 233377 - DNA, 75 bp, Artificial Sequence
  Synthetic
gaccgtttacgtggaggtttcgattaccgtgtttttcacctaaatttccgcgtacggtgtcaaagtcctgtgttt

SEQ ID NO: 233378 - DNA, 75 bp, Artificial Sequence
  Synthetic
agcagctgaaatggacttgcgttgttatgaagagggttttcctccgagtgatgatgaagatggggaaactgagca

SEQ ID NO: 233379 - DNA, 75 bp, Artificial Sequence
  Synthetic
gcggcaggtcccgcaggcgcgcggccacggcggcagcagcggccattgccaacatggcccaaccgcgaagaggca

SEQ ID NO: 233380 - DNA, 75 bp, Artificial Sequence
  Synthetic
ggcagacggtcgatgaatctttcaatgacctctccgcggcggcggcgcatggtctcggtgacggcgcggccgttc

SEQ ID NO: 233381 - DNA, 75 bp, Artificial Sequence
  Synthetic
gccgccgcagcagaggagaaaggaagaggtcgcgcgccgaggctgagttgctttcaagatggccaccccatcgat

SEQ ID NO: 233382 - DNA, 75 bp, Artificial Sequence
  Synthetic
taggatcttgggggctgcgagcgggacgacccgtagacgccagcgccatgacagacagaggggtcttgtgtggga

SEQ ID NO: 233383 - DNA, 75 bp, Artificial Sequence
  Synthetic
gggtgatggtgtcacgcaagaaacctgaaggctatacaggggataaaaatgatacaagtcaggatattctggagt

SEQ ID NO: 233384 - DNA, 75 bp, Artificial Sequence
  Synthetic
gacatcggtgtcaagtttgataccaggaacttcaggctgggctgggaccccataactaaacttgttatgccagga

SEQ ID NO: 233385 - DNA, 75 bp, Artificial Sequence
  Synthetic
ggaacttcaggctgggctgggaccccataactaaacttgttatgccaggagtctacacttatgaagccttccatc

SEQ ID NO: 233386 - DNA, 75 bp, Artificial Sequence
  Synthetic
tggggtggactttactgagagccgccttagcaacttgcttggtattaggaagagacacccattccaggaaggttt

SEQ ID NO: 233387 - DNA, 75 bp, Artificial Sequence
  Synthetic
cttagcaacttgcttggtattaggaagagacacccattccaggaaggttttaaaattatgtatgaggatcttgag

SEQ ID NO: 233388 - DNA, 75 bp, Artificial Sequence
  Synthetic
tccttttcctagtctacccttttctctacacagtgtacgtagcagcgaagtgggtagaataagtcgcccgagttt

SEQ ID NO: 233389 - DNA, 75 bp, Artificial Sequence
  Synthetic
gtatccggtgcacttgggaaatttatcatgcagcttagagggaaaagcatgaaaaaatttggagacgcctttgtg

SEQ ID NO: 233390 - DNA, 75 bp, Artificial Sequence
  Synthetic
atgtagatgcctatgaaaaaagcaaaaaggaaaacacagacaccaccaccactaccactgttactactactgaag

SEQ ID NO: 233391 - DNA, 75 bp, Artificial Sequence
  Synthetic
aaaggaaaacacagacaccaccaccactaccactgttactactactgaagtagcaactgttgcaagacacgttgc

SEQ ID NO: 233392 - DNA, 75 bp, Artificial Sequence
  Synthetic
gttgttgcagtggatcctattgttgaagagaacaataatactgttagaggagataatatccatactgccaatgag

SEQ ID NO: 233393 - DNA, 75 bp, Artificial Sequence
  Synthetic
ttggtttaaaaaatggggcccatactagtcttgcttgttttactttcgcttttggaaccgggttctgccaattac

SEQ ID NO: 233394 - DNA, 75 bp, Artificial Sequence
  Synthetic
atgcttgtgcttgtacagacggccgcagtactcgcagcgattcacgggatgcacctcatgaatgagttgtacctg

SEQ ID NO: 233395 - DNA, 75 bp, Artificial Sequence
  Synthetic
catacaactatggcgaccctgaaaaaggagtccgctcctggacgctgctcaccacttcagatgtcacctgcggag

SEQ ID NO: 233396 - DNA, 75 bp, Artificial Sequence
  Synthetic
accacttcagatgtcacctgcggagcggagcaagtatattggtcgctccctgacatgatgcaggaccccgtcacc

SEQ ID NO: 233397 - DNA, 75 bp, Artificial Sequence
  Synthetic
catgcccgtcttctcaaagagtttctacaacgagcaagccgtgtactcccagcagctccgccagaccacctcgct

SEQ ID NO: 233398 - DNA, 75 bp, Artificial Sequence
  Synthetic
atgcatgctggattgcaacatcaggtagggtcaagagtcagttgtctgtgaagaaatgcatgtttgagagatgta

SEQ ID NO: 233399 - DNA, 75 bp, Artificial Sequence
  Synthetic
cttcaggggctggtccttcaccagactcaaaaccaaggagactccatctcttggatcagggttcgatccctactt

SEQ ID NO: 233400 - DNA, 75 bp, Artificial Sequence
  Synthetic
ctgcagagccagccgtccggcattaactcctcggacgattggacccaggccatgcaacgcatcatggcgctgacg

SEQ ID NO: 233401 - DNA, 75 bp, Artificial Sequence
  Synthetic
caatgcaacatgaccaaagactggttcctggttcagatgcttgccaactacaacattggctaccagggcttttac

SEQ ID NO: 233402 - DNA, 75 bp, Artificial Sequence
  Synthetic
tggtaaggtggacagattgggtaaattttgttaatttctgtcttgcagctgccatgagtggaagcgcttcttttg

SEQ ID NO: 233403 - DNA, 75 bp, Artificial Sequence
  Synthetic
cgaccgtgtctagcttgctgacccccaactcccgcctactgctgctgctggttgcccccttcactgatagcggta

SEQ ID NO: 233404 - DNA, 75 bp, Artificial Sequence
  Synthetic
gcagaagatccctcctcagtatgcgcttaccgcggaggaggagcggatcctgagatatgtccagcagagcgtggg

SEQ ID NO: 233405 - DNA, 75 bp, Artificial Sequence
  Synthetic
tgggataacagcgcccccctctgatgcttgctcgcacatagtcatagagttcatgtgagggggcgagaagacccg

SEQ ID NO: 233406 - DNA, 75 bp, Artificial Sequence
  Synthetic
ccttatgcttactagtatagcaactctgacttctgctcgctcacacctcactgtaactataggctcaaactgcac

SEQ ID NO: 233407 - DNA, 75 bp, Artificial Sequence
  Synthetic
cccaagggatagaagctcctggagcgaggagaagtttttcagcggcttcagcccgtcagccatgggcattttgga

SEQ ID NO: 233408 - DNA, 75 bp, Artificial Sequence
  Synthetic
gaggagaagtttttcagcggcttcagcccgtcagccatgggcattttggaaagagtctgttgcaagagctcgagc

SEQ ID NO: 233409 - DNA, 75 bp, Artificial Sequence
  Synthetic
tcctggagtagggaatcagacgatgggcgtccagcgctgccagggtccgatccttccatggtcgcagcgtccgag

SEQ ID NO: 233410 - DNA, 75 bp, Artificial Sequence
  Synthetic
cagcccgtcgccgtagccagaccgcgtcctgggggcactccgcgcccgaatgcaaactggcagagtactctgaac

SEQ ID NO: 233411 - DNA, 75 bp, Artificial Sequence
  Synthetic
ctgagttgctttcaagatggccaccccatcgatgctgccccagtgggcatacatgcacatcgccggacaggatgc

SEQ ID NO: 233412 - DNA, 75 bp, Artificial Sequence
  Synthetic
gagtggtttgagttcactttaccagaaggcaacttctcagccaccatgaccatcgacctgatgaacaatgccatc

SEQ ID NO: 233413 - DNA, 75 bp, Artificial Sequence
  Synthetic
aggctgtccgtgtccccgtagaccgactttatgggcctgtcctcgagcggagtgcctcggtcctcttcgtagagg

SEQ ID NO: 233414 - DNA, 75 bp, Artificial Sequence
  Synthetic
cacgatgtgaccaccgaccgaagccagcggctgatgctgcgctttgtgcccgttgatcgggaggacaatacttac

SEQ ID NO: 233415 - DNA, 75 bp, Artificial Sequence
  Synthetic
gtttcaaaccctactctgggacagcatacaattccctggcccctaagggagctcctaatactagtcagtggatag

SEQ ID NO: 233416 - DNA, 75 bp, Artificial Sequence
  Synthetic
atatcccaaggaataggaagctcttgcagaacagtaaagctggcagaacaaggaagaccacgaacacaacttaca

SEQ ID NO: 233417 - DNA, 75 bp, Artificial Sequence
  Synthetic
agaatcatggactgataccgatggaacaaatgaaaagtttggcggtagagcgcttaaacccgctaccaacatgaa

SEQ ID NO: 233418 - DNA, 75 bp, Artificial Sequence
  Synthetic
ggtagcaaatgatccatagagggcattggatagaagcttggcgatggagcgcatggtttggttcttttccttgtc

SEQ ID NO: 233419 - DNA, 75 bp, Artificial Sequence
  Synthetic
cctacaaacataaaaggtggtcaagctaaaaatagaaaagtaaagccgacaaccgagggaggggttgaaactgag

SEQ ID NO: 233420 - DNA, 75 bp, Artificial Sequence
  Synthetic
ctaaaaatagaaaagtaaagccgacaaccgagggaggggttgaaactgaggaaccggatattgatatggaatttt

SEQ ID NO: 233421 - DNA, 75 bp, Artificial Sequence
  Synthetic
agctttatcgcctgaaattgtgctttacacagaaaatgtaaatttggaaactccagacacccatgtggtatacaa

SEQ ID NO: 233422 - DNA, 75 bp, Artificial Sequence
  Synthetic
gttcaagtacagccacactcttaagttggtcaaaagaatgctggcttcagttgtaatcaaaactccatcgcatct

SEQ ID NO: 233423 - DNA, 75 bp, Artificial Sequence
  Synthetic
tacacagaaaatgtaaatttggaaactccagacacccatgtggtatacaaaccaggaacttcagatgataactct

SEQ ID NO: 233424 - DNA, 75 bp, Artificial Sequence
  Synthetic
tgcccaacagacccaattacattggcttcagagacaactttgttggactcttgtactacaacagcactggcaaca

SEQ ID NO: 233425 - DNA, 75 bp, Artificial Sequence
  Synthetic
cttcagagacaactttgttggactcttgtactacaacagcactggcaacatgggagtgttggcaggtcaagcatc

SEQ ID NO: 233426 - DNA, 75 bp, Artificial Sequence
  Synthetic
caggacagaaacactgaactgtcctatcagcttttgcttgattctcttggggacagaaccagatacttcagcatg

SEQ ID NO: 233427 - DNA, 75 bp, Artificial Sequence
  Synthetic
atcagcttttgcttgattctcttggggacagaaccagatacttcagcatgtggaatcaggccgtggatagttatg

SEQ ID NO: 233428 - DNA, 75 bp, Artificial Sequence
  Synthetic
ggatatgcaataagtcatgtaaaaccgtgttcaataaacagcactttatttttacatgcactgaggctctggttt

SEQ ID NO: 233429 - DNA, 75 bp, Artificial Sequence
  Synthetic
acccgggcccagattggtgcggttgggtttttccgccctgtaaacgatctggcgaaagatggcatgggaatttga

SEQ ID NO: 233430 - DNA, 75 bp, Artificial Sequence
  Synthetic
attattcgtgtcagttcttgtggtaaatccaatccacacattacaaacaggtcccggagggcgccctccaccacc

SEQ ID NO: 233431 - DNA, 75 bp, Artificial Sequence
  Synthetic
tcatggtatcgaggatgaactacccaactactgttttcctctggatggcataggaccagggaactcatatcaagg

SEQ ID NO: 233432 - DNA, 75 bp, Artificial Sequence
  Synthetic
taggaccagggaactcatatcaaggcatcaaggctaaaaacggtgataataatggatgggaaaaagatactaatg

SEQ ID NO: 233433 - DNA, 75 bp, Artificial Sequence
  Synthetic
gttggactgtttctgatgcaggagggggcgacacctaccgccgcgctggacatgacagctcgaaacatggagccc

SEQ ID NO: 233434 - DNA, 75 bp, Artificial Sequence
  Synthetic
aatatccaggctaacctttggagaagttttctgtactccaacgtggctttgtaccttccagacgcttacaagtac

SEQ ID NO: 233435 - DNA, 75 bp, Artificial Sequence
  Synthetic
ccaataccaacacctatgaatacatgaacgggcgagtggtggcaccatctttggttgattcgtacatcaacattg

SEQ ID NO: 233436 - DNA, 75 bp, Artificial Sequence
  Synthetic
ggtattcttcgcgatccttccagtactcttcgaggggaaacccgtctttttctgcacggtaagagcccaacatgt

SEQ ID NO: 233437 - DNA, 75 bp, Artificial Sequence
  Synthetic
gtccacccgcttcttgtaggcggggttgggcaaagcgaaagtaacatcattgaagaggatcttgccggccctggg

SEQ ID NO: 233438 - DNA, 75 bp, Artificial Sequence
  Synthetic
cttcaccagactcaaaacaaaggaaacaccctctttgggatcaggctttgatccctactttgtttactctggctc

SEQ ID NO: 233439 - DNA, 75 bp, Artificial Sequence
  Synthetic
atgttgacgagccgctggtctccagagagtttcatgaccagcatgaaggggattagctgcttgccaaaggacccc

SEQ ID NO: 233440 - DNA, 75 bp, Artificial Sequence
  Synthetic
actgcgtcaccagggaaaagtacagtttcacttccgcaatcccaacaagcgtcacttcctctttctcacggtacg

SEQ ID NO: 233441 - DNA, 75 bp, Artificial Sequence
  Synthetic
ctaactccaaatgagtttgaaatcaagcgcactgtggatggagaagggtacaatgtggctcaatgcaacatgacc

SEQ ID NO: 233442 - DNA, 75 bp, Artificial Sequence
  Synthetic
tccagtcccaaggatgaggcggtgtccatacccttggatcatggaaatcccaccccaagtctaaaaccagtcacc

SEQ ID NO: 233443 - DNA, 75 bp, Artificial Sequence
  Synthetic
gggcttctacatcccagaggggtacaaggatcgcatgtactccttcttcagaaacttccagcccatgagcagaca

SEQ ID NO: 233444 - DNA, 75 bp, Artificial Sequence
  Synthetic
aaggatcgcatgtactccttcttcagaaacttccagcccatgagcagacaggtggttgatgaggtgaactacacc

SEQ ID NO: 233445 - DNA, 75 bp, Artificial Sequence
  Synthetic
cgcagtactcgcagcgattcacgggatgcacctcatgaatgagttgtacctgacttcctttgacgagaaatttca

SEQ ID NO: 233446 - DNA, 75 bp, Artificial Sequence
  Synthetic
cgcagctaacgtggtactggcactcccgtctcgacccaggcctgcacaaaacctccaggatacggaggcgggtcg

SEQ ID NO: 233447 - DNA, 75 bp, Artificial Sequence
  Synthetic
tgctgttaagagtgttacccagaaaaagttcctgtgcgacaggaccatgtggcgcatccccttctccagcaactt

SEQ ID NO: 233448 - DNA, 75 bp, Artificial Sequence
  Synthetic
cagggtcctgagacgctgcggagtcaggttagtaggcagtgtcaggagattgacttgcatgatcttttcgagggc

SEQ ID NO: 233449 - DNA, 75 bp, Artificial Sequence
  Synthetic
aagcttcttgcttcttgcaagcagctgccatggcctgtgggtccggcaacggatccagcgagcaagagctcaggg

SEQ ID NO: 233450 - DNA, 75 bp, Artificial Sequence
  Synthetic
tgccatggcctgtgggtccggcaacggatccagcgagcaagagctcagggccattgctagagacctgggctgcgg

SEQ ID NO: 233451 - DNA, 75 bp, Artificial Sequence
  Synthetic
ggatccagcgagcaagagctcagggccattgctagagacctgggctgcggaccctatttcctgggaacctttgat

SEQ ID NO: 233452 - DNA, 75 bp, Artificial Sequence
  Synthetic
gcggcaggggcggctcgggacccggcggcatggctggcagtggtacgtcggcgccgcgcgcgggtaggttctggt

SEQ ID NO: 233453 - DNA, 75 bp, Artificial Sequence
  Synthetic
taacacggccggtcgcgagacggggggtgagcactggctggcttttggttggaatccgcgctccaacacctgcta

SEQ ID NO: 233454 - DNA, 75 bp, Artificial Sequence
  Synthetic
tggatctgacgcctctgggtgaaagctaccggccccgtgagcttgaacctgaaagagagttcaacagaatcaatc

SEQ ID NO: 233455 - DNA, 75 bp, Artificial Sequence
  Synthetic
taaggatttcttgcacgtcgccagagttatcctggtaggcgatctcggccatgaactgctggatctcttcctctt

SEQ ID NO: 233456 - DNA, 75 bp, Artificial Sequence
  Synthetic
gggtgcttgatagaggtcctagcttcaagccatattccggcacagcttacaattcactggctcctaagggcgcgc

SEQ ID NO: 233457 - DNA, 75 bp, Artificial Sequence
  Synthetic
ctaaactcccactcatcttactttcgttctcaccgcgcgcgcatcgaaaaggccaccgcgtttaatcgaatggat

SEQ ID NO: 233458 - DNA, 75 bp, Artificial Sequence
  Synthetic
gataaacagccgcctggacccgccgcccgcagcccctggcgaaatggaagtggaggaagagctccctcccctgga

SEQ ID NO: 233459 - DNA, 75 bp, Artificial Sequence
  Synthetic
tgttcaaataaacagcactttattttttacatgcactgtggctctgggttgctcattcattcatcattcactcag

SEQ ID NO: 233460 - DNA, 75 bp, Artificial Sequence
  Synthetic
caattctctagaaacttttacatctcccaccacacccgacgaaaaaaacatcccagattcaatgattgcaattgt

SEQ ID NO: 233461 - DNA, 75 bp, Artificial Sequence
  Synthetic
tcgcaatcgcaaggtaggctgagcactgtttcttgcgggcgggggcggctagacgctcggtcggggttctctctt

SEQ ID NO: 233462 - DNA, 75 bp, Artificial Sequence
  Synthetic
gaaccccaccgtggcccccacccacgatgtgaccaccgaccgaagccagcggctgatgctgcgctttgtgcccgt

SEQ ID NO: 233463 - DNA, 75 bp, Artificial Sequence
  Synthetic
caacggtgtggaagcagctgatgacaatgcaaaagctacttacacttttggcaatgctccagtgaaagcggagga

SEQ ID NO: 233464 - DNA, 75 bp, Artificial Sequence
  Synthetic
tgggcgacaacagagtgctagatatggccagcaccttctttgacatcagaggggtgcttgatagaggtcccagct

SEQ ID NO: 233465 - DNA, 75 bp, Artificial Sequence
  Synthetic
caactccctggctcctaagggagctcccaaccctagccagtggctagaatctactacagctgatgaaactaccac

SEQ ID NO: 233466 - DNA, 75 bp, Artificial Sequence
  Synthetic
cccaaccctagccagtggctagaatctactacagctgatgaaactaccactactactacacatacgtttggtatg

SEQ ID NO: 233467 - DNA, 75 bp, Artificial Sequence
  Synthetic
caggtccgctacaaccctttcggcgaggatggcttgctgcacctgggtgagggtggcttggaagtcgtcaaagtc

SEQ ID NO: 233468 - DNA, 75 bp, Artificial Sequence
  Synthetic
ccaaagacggtttacaaattggaaaagaagtaactgccactggcgatgaaaaaccaatttatgcagataaaaaat

SEQ ID NO: 233469 - DNA, 75 bp, Artificial Sequence
  Synthetic
agcgggatgccacggtgctcctcgttcacatactggtggcagatacgcctgtactgctcgtgctgctcgggcatc

SEQ ID NO: 233470 - DNA, 75 bp, Artificial Sequence
  Synthetic
tgccactgccgctgcaatctttgcacaccccaccgctccctcgcctgcaacccccagttgctgagcgagacccag

SEQ ID NO: 233471 - DNA, 75 bp, Artificial Sequence
  Synthetic
agaagtaactgccactggcgatgaaaaaccaatttatgcagataaaaaatttcaaccagaaccccaagtagggga

SEQ ID NO: 233472 - DNA, 75 bp, Artificial Sequence
  Synthetic
acaaatgaaaaatttggaggcagaactcttaaaagtgctaccaatatgaaaccatgttatggatcgttcgctaga

SEQ ID NO: 233473 - DNA, 75 bp, Artificial Sequence
  Synthetic
ctcttaaaagtgctaccaatatgaaaccatgttatggatcgttcgctagacccacaaacaaggaaggaggtcagg

SEQ ID NO: 233474 - DNA, 75 bp, Artificial Sequence
  Synthetic
tgaagaggggggagctgaaactgaagagccagatattgatatggtgttttatgatgatagacaagctgccgatcc

SEQ ID NO: 233475 - DNA, 75 bp, Artificial Sequence
  Synthetic
gagccagatattgatatggtgttttatgatgatagacaagctgccgatcctgctttggcgcctgaagttgttctt

SEQ ID NO: 233476 - DNA, 75 bp, Artificial Sequence
  Synthetic
cgcctgaaatctacggtccgccggtgaaggatgaaaaaaagccccgcaaaatcaagcgggtcaaaaaggacaaaa

SEQ ID NO: 233477 - DNA, 75 bp, Artificial Sequence
  Synthetic
ctcctgacacccatattgtatacaagccgggtacttcagatgtcagttcacatgaaaatttgggacagcaagcta

SEQ ID NO: 233478 - DNA, 75 bp, Artificial Sequence
  Synthetic
gccgggtacttcagatgtcagttcacatgaaaatttgggacagcaagctatgcctaacagacccaattacattgg

SEQ ID NO: 233479 - DNA, 75 bp, Artificial Sequence
  Synthetic
ggcaaaaacgaaagcggtcagcggctcgtctccgtggcctggaggctaagcgaacgggttgggctgcgcgtgtac

SEQ ID NO: 233480 - DNA, 75 bp, Artificial Sequence
  Synthetic
atgtactacaatagtactggcaacatgggtgtgttggcagggcaggcatcacagctaaatgcagtagttgacttg

SEQ ID NO: 233481 - DNA, 75 bp, Artificial Sequence
  Synthetic
tgggtgtgttggcagggcaggcatcacagctaaatgcagtagttgacttgcaagatagaaacactgagctatcgt

SEQ ID NO: 233482 - DNA, 75 bp, Artificial Sequence
  Synthetic
tgacagaactcgatatttcagcatgtggaatcaggctgtggatagttatgaccccgatgtgcgcattattgaaaa

SEQ ID NO: 233483 - DNA, 75 bp, Artificial Sequence
  Synthetic
tggaatcaggctgtggatagttatgaccccgatgtgcgcattattgaaaatcatggcatagaggatgaattgcca

SEQ ID NO: 233484 - DNA, 75 bp, Artificial Sequence
  Synthetic
gcaacatccaatagcgctaatagattacgaaagtgaaccacaacccccactactccctgctattagttacttcaa

SEQ ID NO: 233485 - DNA, 75 bp, Artificial Sequence
  Synthetic
ttgggcctggcaagtcctatcaaggaattaaagagaaaactggcgaagacaaaaaatgggaaaaagacggtactc

SEQ ID NO: 233486 - DNA, 75 bp, Artificial Sequence
  Synthetic
aattaaagagaaaactggcgaagacaaaaaatgggaaaaagacggtactcaggccaattccaatgaaatagccat

SEQ ID NO: 233487 - DNA, 75 bp, Artificial Sequence
  Synthetic
cgggagcgagccctcttttttttttttgttttttgttgcccagatgcatcccgtgctgcgacagatgcgccccca

SEQ ID NO: 233488 - DNA, 75 bp, Artificial Sequence
  Synthetic
ccgtgctgcgacagatgcgcccccagcaacagcccccttctcagcagcagctacaacgacagccacaaaaggctc

SEQ ID NO: 233489 - DNA, 75 bp, Artificial Sequence
  Synthetic
ttggttgattcatacatcaacattggtgccaggtggtctcttgacccaatggacaatgtgaaccccttcaatcac

SEQ ID NO: 233490 - DNA, 75 bp, Artificial Sequence
  Synthetic
actttctcagcaggtggccgagttgcgagtacaaactgagtctgctgtcggcacggcaaagtctaaataaaaaaa

SEQ ID NO: 233491 - DNA, 75 bp, Artificial Sequence
  Synthetic
gatccatgcttctgggcaatggtcgctatgtgcctttccacatccaagtgcctcaaaaattctttgctatcaaaa

SEQ ID NO: 233492 - DNA, 75 bp, Artificial Sequence
  Synthetic
ccatggctcacaacactgcttccacccttgaagccatgctgcgcaatgacaccaatgaccagtcattcaatgact

SEQ ID NO: 233493 - DNA, 75 bp, Artificial Sequence
  Synthetic
gcagtgatgagactcgggccgcaaatgctctgcaacagggagagaatggcatggatgaacatcacagcgctctgg

SEQ ID NO: 233494 - DNA, 75 bp, Artificial Sequence
  Synthetic
cagctggccaggcaatgacagattgctaactccaaatgagttcgaaatcaagcgcactgtggatggagaagggta

SEQ ID NO: 233495 - DNA, 75 bp, Artificial Sequence
  Synthetic
cgcaagatctacaagaccccctacgtacccatagacaaggaggtaaagatagatgggttttacatgcgcatgact

SEQ ID NO: 233496 - DNA, 75 bp, Artificial Sequence
  Synthetic
aaggatcgcatgtattccttcttcagaaacttccagcccatgagcagacaggtggttgatgaagttaattacaag

SEQ ID NO: 233497 - DNA, 75 bp, Artificial Sequence
  Synthetic
accaacacaacaactctggctttgtgggttaccttgcgcccactatgaggcagggagaaccttaccccgctaact

SEQ ID NO: 233498 - DNA, 75 bp, Artificial Sequence
  Synthetic
attaactcctcggacgattggacccaggccatgcaacgcataatggcgctgacgacccgcaaccccgaagccttt

SEQ ID NO: 233499 - DNA, 75 bp, Artificial Sequence
  Synthetic
tccagaaagcaacatagctacgctgaccacatccccctttttcttttcttacattacagaagacgacaactaaaa

SEQ ID NO: 233500 - DNA, 75 bp, Artificial Sequence
  Synthetic
catcgcctctcttacgagcttggcccccaacgacaaaaatttacctgcatggtgggaatcaaccccatagttatc

SEQ ID NO: 233501 - DNA, 75 bp, Artificial Sequence
  Synthetic
ccccgttcagcggcatactttctccatactttaaaggggatgtcaaattttagctcctctcctgtacccacaatc

SEQ ID NO: 233502 - DNA, 75 bp, Artificial Sequence
  Synthetic
ctatggagccactgctacctgttccgcctggccaactacctctcctaccactcggatgtgatcgaggatgtgagc

SEQ ID NO: 233503 - DNA, 75 bp, Artificial Sequence
  Synthetic
cccagaccgtgcagggcccgcgctccgcagcctgtggacttttttgctgcatgttcctccacgcttttgtgcatt

SEQ ID NO: 233504 - DNA, 75 bp, Artificial Sequence
  Synthetic
caacctggaccggatggtgaccgatgtgcgcgaggccgtgtctcagcgcgagcggttccagcgcgacgccaactt

SEQ ID NO: 233505 - DNA, 75 bp, Artificial Sequence
  Synthetic
cctttttcctcataccttttctttacagcatggcttctgttacagctctaattattgccagcattgtcactgtcg

SEQ ID NO: 233506 - DNA, 75 bp, Artificial Sequence
  Synthetic
gcaaagtacagccaacgcgcaaagcacaagctctaaagaagctctaaaacactctccaacctctccacaatatat

SEQ ID NO: 233507 - DNA, 75 bp, Artificial Sequence
  Synthetic
ttctacactggcgagtacgacatgcccgaccccaatgacgggttcctgtgggacgatgtggacagcagcatattc

SEQ ID NO: 233508 - DNA, 75 bp, Artificial Sequence
  Synthetic
gatacaagtcctggcgggggcataagaatgccatcatctcctgcttgcatgaatgcgggggcaacatatccttca

SEQ ID NO: 233509 - DNA, 75 bp, Artificial Sequence
  Synthetic
tctcacggaactacttagttttcccacggtatttaacaggaaatgaggtagttttggccggatgcaagtgaaaat

SEQ ID NO: 233510 - DNA, 75 bp, Artificial Sequence
  Synthetic
atttgccatggaaattaaccttcaagccaatctatggcgaagtttcctttattccaatgtggctctgtatctccc

SEQ ID NO: 233511 - DNA, 75 bp, Artificial Sequence
  Synthetic
ttctcccaggctcctacacttatgagtggaacttcaggaaggatgtgaacatggtgctacagagttccctcggta

SEQ ID NO: 233512 - DNA, 75 bp, Artificial Sequence
  Synthetic
gagggtcattcttgtcaatcttctcaacacttctcttgccatccttctcagtgatgcgcacgggtgggtagctga

SEQ ID NO: 233513 - DNA, 75 bp, Artificial Sequence
  Synthetic
actttgacgagcggtcgcgatggggcggtcagctgaagaccatcatgcacaccaacatgcccaacgtgaacgagt

SEQ ID NO: 233514 - DNA, 75 bp, Artificial Sequence
  Synthetic
cttcctctgatccaggactctaattctacctccccagcaccttttcctactaaccttcccgttactaacaacctc

SEQ ID NO: 233515 - DNA, 75 bp, Artificial Sequence
  Synthetic
cgccatcacacctcgcccccagcagcgacgaggaggagagcttaaccaccccaccacccagtcccgccaccacca

SEQ ID NO: 233516 - DNA, 75 bp, Artificial Sequence
  Synthetic
gtttgactcttcagtaagctggcctggtaatgacagattgctaactccaaatgagttcgaaatcaagcgcacagt

SEQ ID NO: 233517 - DNA, 75 bp, Artificial Sequence
  Synthetic
ttattaggtgcggatttgaatgcaggcccattgagattacacacaataacaaaacttggaacaataccttattca

SEQ ID NO: 233518 - DNA, 75 bp, Artificial Sequence
  Synthetic
caaccacactggctgttgcagaggaaactagtgaagatgataatataactagaggagatacttatataactgaaa

SEQ ID NO: 233519 - DNA, 75 bp, Artificial Sequence
  Synthetic
acgtggtcagagtgcatcagccacatcgcggcatcatcgagacagtctacctgcgtacaccgttctcggccggta

SEQ ID NO: 233520 - DNA, 75 bp, Artificial Sequence
  Synthetic
agacagtatgacctatggcctcccagcaaagagaacattgtggcattctccattgcttattgcttctgtacttgc

SEQ ID NO: 233521 - DNA, 75 bp, Artificial Sequence
  Synthetic
aactagtgaagatgataatataactagaggagatacttatataactgaaaaacaaaaacgtgaagctgcagctgc

SEQ ID NO: 233522 - DNA, 75 bp, Artificial Sequence
  Synthetic
gcaaagagaacattgtggcattctccattgcttattgcttctgtacttgccttatcactgctactttgtgtattt

SEQ ID NO: 233523 - DNA, 75 bp, Artificial Sequence
  Synthetic
cccaaaaaacagcaacgaggaaaaagaaaaagtgccttaatcttttcctcaccttttttgtttacagcatggctt

SEQ ID NO: 233524 - DNA, 75 bp, Artificial Sequence
  Synthetic
gaaaaagtgccttaatcttttcctcaccttttttgtttacagcatggcttctgttgctgttctaatctttataat

SEQ ID NO: 233525 - DNA, 75 bp, Artificial Sequence
  Synthetic
gacgtgacttatgtgggaggagctatgttgcaagttattgcggtaaatgtgacgtaaaacgaggtgtggtttgaa

SEQ ID NO: 233526 - DNA, 75 bp, Artificial Sequence
  Synthetic
aaatttaatgatcaaatagtccatgtaggttccaaccatacactgcgtggaccaataggcaattcagaagtaacc

SEQ ID NO: 233527 - DNA, 75 bp, Artificial Sequence
  Synthetic
taggttccaaccatacactgcgtggaccaataggcaattcagaagtaacctggtactggtattatgcagatgata

SEQ ID NO: 233528 - DNA, 75 bp, Artificial Sequence
  Synthetic
cattaatttacataacattcttacaaaaactcttaatagtaagactattaaatataactgtactgattatgattt

SEQ ID NO: 233529 - DNA, 75 bp, Artificial Sequence
  Synthetic
aaaactcttaatagtaagactattaaatataactgtactgattatgatttaattctagttaatgtcactacaaac

SEQ ID NO: 233530 - DNA, 75 bp, Artificial Sequence
  Synthetic
atccgcccgccggcgcccacaattaccaccgtcagtgaaaacgttcctgctctcacagatcacgggaccctgccg

SEQ ID NO: 233531 - DNA, 75 bp, Artificial Sequence
  Synthetic
attttgaaaatgttgcatattataatattctagtaaagtttagacctacaacaactaaaacgtctagcagcagta

SEQ ID NO: 233532 - DNA, 75 bp, Artificial Sequence
  Synthetic
tattctagtaaagtttagacctacaacaactaaaacgtctagcagcagtactataaccagcaccacgcttccaat

SEQ ID NO: 233533 - DNA, 75 bp, Artificial Sequence
  Synthetic
aaaatagaaaataccaccaatagcaattacactctattcaacgatcaaaatgttcaagggtcattaactacaatt

SEQ ID NO: 233534 - DNA, 75 bp, Artificial Sequence
  Synthetic
attacactctattcaacgatcaaaatgttcaagggtcattaactacaattatcattctactaattgtggggttaa

SEQ ID NO: 233535 - DNA, 75 bp, Artificial Sequence
  Synthetic
cacagcccacacttttaaaatcacctcatttacatattggcaccattccatctataaggtatattattgatgatg

SEQ ID NO: 233536 - DNA, 75 bp, Artificial Sequence
  Synthetic
ctatacctgccgctacagaaaactacacaataaagtagacccctattagattccatacttagacatctaactttt

SEQ ID NO: 233537 - DNA, 75 bp, Artificial Sequence
  Synthetic
cacaataaagtagacccctattagattccatacttagacatctaactttttttaaaacactttattttcagccat

SEQ ID NO: 233538 - DNA, 75 bp, Artificial Sequence
  Synthetic
ctatctatataatataccttatagatggaatggtgccaatatgtaaatgaggtaatttaaaaaagtgcgcgctgt

SEQ ID NO: 233539 - DNA, 75 bp, Artificial Sequence
  Synthetic
atcactgccattactactgtacaggggttcacaaacatcaaaaaaacaatacatgtgggatccagttctacacta

SEQ ID NO: 233540 - DNA, 75 bp, Artificial Sequence
  Synthetic
ggttcacaaacatcaaaaaaacaatacatgtgggatccagttctacactagaaggttaccaatcccaatcacgtg

SEQ ID NO: 233541 - DNA, 75 bp, Artificial Sequence
  Synthetic
tcagccagctattacactttgcaaaggatctcaggaaaccacaatacgcacaatcaaatacaaatgcaataacaa

SEQ ID NO: 233542 - DNA, 75 bp, Artificial Sequence
  Synthetic
catgagccagagcatgcttaacaactttcgctctttcatcctggaacgctccggtatcctgcccgccacctgctg

SEQ ID NO: 233543 - DNA, 75 bp, Artificial Sequence
  Synthetic
gaagcttggttaccagttcggcggtgacaagtacgtccagggcgcagtagtcaagtgtttcttgaatgatgtcat

SEQ ID NO: 233544 - DNA, 75 bp, Artificial Sequence
  Synthetic
ggatctcaggaaaccacaatacgcacaatcaaatacaaatgcaataacaataatttaaccctaattgatgttaca

SEQ ID NO: 233545 - DNA, 75 bp, Artificial Sequence
  Synthetic
gaacaaattttaacataggacaagacacatactataccattacagtaattaactctactactcctgtaacaacta

SEQ ID NO: 233546 - DNA, 75 bp, Artificial Sequence
  Synthetic
gcccaaccgcgaagaggcaatgtgtactgggtgcgtgatgccactaccggccagcgcgtgcccgtgcgcacccgc

SEQ ID NO: 233547 - DNA, 75 bp, Artificial Sequence
  Synthetic
cacatactataccattacagtaattaactctactactcctgtaacaactaccataaaacctacaaaaactaaaag

SEQ ID NO: 233548 - DNA, 75 bp, Artificial Sequence
  Synthetic
agcaagcccacctcaatctatacaacttcacttttgcaactacttcaaaaggctaacgttacagacaattatact

SEQ ID NO: 233549 - DNA, 75 bp, Artificial Sequence
  Synthetic
cttcacttttgcaactacttcaaaaggctaacgttacagacaattatactattaaccccactcttcctagcgaag

SEQ ID NO: 233550 - DNA, 75 bp, Artificial Sequence
  Synthetic
tattgctgctgtggtagcgggaatgctaattataattctatgtatgatttattatgcttgctgctatagaaaata

SEQ ID NO: 233551 - DNA, 75 bp, Artificial Sequence
  Synthetic
ctaattataattctatgtatgatttattatgcttgctgctatagaaaatatgaacatgaacaaaaaatagaccca

SEQ ID NO: 233552 - DNA, 75 bp, Artificial Sequence
  Synthetic
ggtggagtttgtgcgcgagttcgccccaagacggcgcgtgcagtggcgcgggcgcaaagtgcgtcaagtgctcag

SEQ ID NO: 233553 - DNA, 75 bp, Artificial Sequence
  Synthetic
ttttagagcaccatgaaaggtccagttatcctattgtttatttccactttttggtgttgtgatactttttcaatt

SEQ ID NO: 233554 - DNA, 75 bp, Artificial Sequence
  Synthetic
ttatcctattgtttatttccactttttggtgttgtgatactttttcaattaccaccaatgtgcagactactttaa

SEQ ID NO: 233555 - DNA, 75 bp, Artificial Sequence
  Synthetic
aaggtctccatcatgtttgactcctcagtcagctggcctggcaatgacaggctgttgagtccaaatgagtttgaa

SEQ ID NO: 233556 - DNA, 75 bp, Artificial Sequence
  Synthetic
acaactttcacctcaatctgaagatgacataaaactacaaatcactatccttattgtaattggtttaattatcct

SEQ ID NO: 233557 - DNA, 75 bp, Artificial Sequence
  Synthetic
gacataaaactacaaatcactatccttattgtaattggtttaattatccttgctgttctcctttactttatcttt

SEQ ID NO: 233558 - DNA, 75 bp, Artificial Sequence
  Synthetic
ggagtagctgacctgtttcctgaactgcgacgggtgcttactaggtctacgaccagtggacagaacaggggcatt

SEQ ID NO: 233559 - DNA, 75 bp, Artificial Sequence
  Synthetic
agaaacctaccagacgtcccatctatcgatcaataatcagcaaaccccacatggctctaaatgaaatttaatctt

SEQ ID NO: 233560 - DNA, 75 bp, Artificial Sequence
  Synthetic
gaggtggaagaagcaaccgccgccaaacagttgtcctcggcagcggagacaagcaaggtcccagacagcagcagc

SEQ ID NO: 233561 - DNA, 75 bp, Artificial Sequence
  Synthetic
tcgatcaataatcagcaaaccccacatggctctaaatgaaatttaatctttctcttcacagtatggtgatcaact

SEQ ID NO: 233562 - DNA, 75 bp, Artificial Sequence
  Synthetic
ccatacttatctgcgctttcaatgtctgtgctacattcgccacagtcgccaatgtgacaccagattgtatagggg

SEQ ID NO: 233563 - DNA, 75 bp, Artificial Sequence
  Synthetic
cttcattacctgcatctgcgtttgtagcatagtctgcctggttatcaacttctttcaactagtagactgggtttt

SEQ ID NO: 233564 - DNA, 75 bp, Artificial Sequence
  Synthetic
ttgcagcaattcttaggctcatttaaaaccatgcaaactctgctactgcttctgctagttatacacccatgtgcc

SEQ ID NO: 233565 - DNA, 75 bp, Artificial Sequence
  Synthetic
gagtcggttagctcttcgcttggtctgcgaccagacggagtcttccagatcgccggctgtgggagatcttccttc

SEQ ID NO: 233566 - DNA, 75 bp, Artificial Sequence
  Synthetic
gctaccgaggaagaaactcgcgccgtagaaggatgttggggcgagggatgcgccgccacagacgaaggcgcgcta

SEQ ID NO: 233567 - DNA, 75 bp, Artificial Sequence
  Synthetic
ctcgtcatgagtaaagaaattcccacgccttacatgtggagctatcagccccaaatgggactggcagcaggcgcc

SEQ ID NO: 233568 - DNA, 75 bp, Artificial Sequence
  Synthetic
ctttgcggccttcgagaccttctgcccatgaactaatcaaccccgcccttcccttaccaattacaaaaagccaat

SEQ ID NO: 233569 - DNA, 75 bp, Artificial Sequence
  Synthetic
gagctcttcgcttggtctgcgaccagacggagtcttccaaattgccggctgtgggagatcttccttcactcctcg

SEQ ID NO: 233570 - DNA, 75 bp, Artificial Sequence
  Synthetic
gagctcgactaagcagctccttcaatccggtctacccctatgaagacgaaagcaccacacatccctttataaacc

SEQ ID NO: 233571 - DNA, 75 bp, Artificial Sequence
  Synthetic
tgcacaaagtccagatggggttctcacacttaaatgtatatccccacttaatactacaggcggatcattacaact

SEQ ID NO: 233572 - DNA, 75 bp, Artificial Sequence
  Synthetic
acacttaaatgtatatccccacttaatactacaggcggatcattacaacttaaagtgggaggagggctaaaagtg

SEQ ID NO: 233573 - DNA, 75 bp, Artificial Sequence
  Synthetic
tcgccgtagccagaccgcgtcctgggggcacaccgcgcccgaaagcaaactggcaaagtactctgaacagcatcg

SEQ ID NO: 233574 - DNA, 75 bp, Artificial Sequence
  Synthetic
aaaacataaatacaacagctccacttactaaaactaaccattctatcagtatgttggtaggaaatggcttacata

SEQ ID NO: 233575 - DNA, 75 bp, Artificial Sequence
  Synthetic
tactaaaactaaccattctatcagtatgttggtaggaaatggcttacatactgaagaaaacaaactatgtgcaaa

SEQ ID NO: 233576 - DNA, 75 bp, Artificial Sequence
  Synthetic
tcaggtagtatttgtatagatcacaatacaaacacactatggacaggagttcccactgaggccaattgtcatatg

SEQ ID NO: 233577 - DNA, 75 bp, Artificial Sequence
  Synthetic
atacaaacacactatggacaggagttcccactgaggccaattgtcatatgctagagtacacagatgacaaagact

SEQ ID NO: 233578 - DNA, 75 bp, Artificial Sequence
  Synthetic
acccggtgcactcccaattattgtgggcgatctcagaataataatgtaccaatccctgcatgaatcttcccatca

SEQ ID NO: 233579 - DNA, 75 bp, Artificial Sequence
  Synthetic
aaatggagctatggtaaacggatatgtatctcttatgggtgccactgacgaatttaatgctataaccacagttaa

SEQ ID NO: 233580 - DNA, 75 bp, Artificial Sequence
  Synthetic
gtatctcttatgggtgccactgacgaatttaatgctataaccacagttaaaattgctcaacttactgctgatata

SEQ ID NO: 233581 - DNA, 75 bp, Artificial Sequence
  Synthetic
gcaggatccagacgcctcggacgagggcaagccggtagtcagtgacgagcagctatctcgctggctgggtaccaa

SEQ ID NO: 233582 - DNA, 75 bp, Artificial Sequence
  Synthetic
ttactgatatatcagcccttaaaacagaattaaaatataagtctggacaaaatatggcaacaggtgaaccatcaa

SEQ ID NO: 233583 - DNA, 75 bp, Artificial Sequence
  Synthetic
agaattaaaatataagtctggacaaaatatggcaacaggtgaaccatcaaacagcaagagcttcatgccaagcct

SEQ ID NO: 233584 - DNA, 75 bp, Artificial Sequence
  Synthetic
actattaaaccagttagaggtaatgaggactacatatatggcaccacttattttagatccagcgatgatgctctc

SEQ ID NO: 233585 - DNA, 75 bp, Artificial Sequence
  Synthetic
cgcttttgggtctgggctctactacgctaagaaatcagcctttgctattagatcccaatgatgttgatccatgtc

SEQ ID NO: 233586 - DNA, 75 bp, Artificial Sequence
  Synthetic
aggactacatatatggcaccacttattttagatccagcgatgatgctctcttaccactagatacatatgttatgc

SEQ ID NO: 233587 - DNA, 75 bp, Artificial Sequence
  Synthetic
tggactttgatccagagaactgcacactcacttttgcacctgaaacaagtcgcttctgtggagttgttattaggt

SEQ ID NO: 233588 - DNA, 75 bp, Artificial Sequence
  Synthetic
atgtgcatatgcaatgcactttatgtggtcatggaatacttccattaaaccagaagaaacagccactacctttat

SEQ ID NO: 233589 - DNA, 75 bp, Artificial Sequence
  Synthetic
aaccgaaggagatgttgaagctgaggagccagatattgatatggaattttttgatggtagagaagctgctgacgc

SEQ ID NO: 233590 - DNA, 75 bp, Artificial Sequence
  Synthetic
gacctatggcctcccagcaaagagaacattgtggcattctccattgcttattgcttgggtacatgcatcatcact

SEQ ID NO: 233591 - DNA, 75 bp, Artificial Sequence
  Synthetic
tgcttatagccattcgcccaaaaaacaatcaagaaaaagagaaaatgccctgattataaatttctatttacagaa

SEQ ID NO: 233592 - DNA, 75 bp, Artificial Sequence
  Synthetic
tgattataaatttctatttacagaaaatgacctctgtttcagctctcatatttgctactattatggctgttcaag

SEQ ID NO: 233593 - DNA, 75 bp, Artificial Sequence
  Synthetic
tattaatgttcatcctggaactaatcataccttggtggttcctaataactattcaaatattgaatggcaatggtt

SEQ ID NO: 233594 - DNA, 75 bp, Artificial Sequence
  Synthetic
cataccttggtggttcctaataactattcaaatattgaatggcaatggttcacaaacaacgtatggtatgaacca

SEQ ID NO: 233595 - DNA, 75 bp, Artificial Sequence
  Synthetic
caacttttcggtcactatgactattgacttgatgaataatgccatcatagacaattacttgaaagtgggcagaca

SEQ ID NO: 233596 - DNA, 75 bp, Artificial Sequence
  Synthetic
gacttgatgaataatgccatcatagacaattacttgaaagtgggcagacagaatggagtaatggaaagtgacatt

SEQ ID NO: 233597 - DNA, 75 bp, Artificial Sequence
  Synthetic
gcaatcataatttaactttaatcaatgtcagcacaatacacaaaggatactattatagatatgacaaccacagca

SEQ ID NO: 233598 - DNA, 75 bp, Artificial Sequence
  Synthetic
tgtcagcacaatacacaaaggatactattatagatatgacaaccacagcattgatcctacaatatatctagtacg

SEQ ID NO: 233599 - DNA, 75 bp, Artificial Sequence
  Synthetic
gaccagggaacaaatatcaaggcattaaacctagagacactgcatgggaaaaagatactaaagtttctacagcta

SEQ ID NO: 233600 - DNA, 75 bp, Artificial Sequence
  Synthetic
cccaaagctttctctagaactacaatacaaaactttaaaacagcaattttacttaattttaaaaccaaaaatatt

SEQ ID NO: 233601 - DNA, 75 bp, Artificial Sequence
  Synthetic
gtcatcacccagggggcaattctggcccaattgcaagccatccaaaaatcccgccaagaatttctgctgaaaaag

SEQ ID NO: 233602 - DNA, 75 bp, Artificial Sequence
  Synthetic
ccactgaaaaaaatacacctaattcaatatttgaaatcatcattgcactgttagcagtaggcataacaatcatac

SEQ ID NO: 233603 - DNA, 75 bp, Artificial Sequence
  Synthetic
ttataaaaaaattcaccacaaaaaagaaccactactaagcttttaatttcttttttatacagccatgattttctt

SEQ ID NO: 233604 - DNA, 75 bp, Artificial Sequence
  Synthetic
gaaccactactaagcttttaatttcttttttatacagccatgattttcttcgcaactcttattactattggcatt

SEQ ID NO: 233605 - DNA, 75 bp, Artificial Sequence
  Synthetic
tacatcaacattggcgccaggtggtctcttgacccaatggacaatgtgaatccatttaaccaccaccgcaatgct

SEQ ID NO: 233606 - DNA, 75 bp, Artificial Sequence
  Synthetic
gtaatggagctgcttcctgacattctcgtattttgcatggcagaacctagccttggcacaacacacttctcttcg

SEQ ID NO: 233607 - DNA, 75 bp, Artificial Sequence
  Synthetic
gatatgtaggcaataatattaccctattaggtcccccaacaggaacaatccctacctggtacaaaatatatgaaa

SEQ ID NO: 233608 - DNA, 75 bp, Artificial Sequence
  Synthetic
attaggtcccccaacaggaacaatccctacctggtacaaaatatatgaaagagggtggtggattagaccctgcga

SEQ ID NO: 233609 - DNA, 75 bp, Artificial Sequence
  Synthetic
ggtagagacataaccatcaccaatcttaataaaaacgataatggctactatttttgcaataactatggaggtggt

SEQ ID NO: 233610 - DNA, 75 bp, Artificial Sequence
  Synthetic
ttaataaaaacgataatggctactatttttgcaataactatggaggtggtaaaaagtcttacacacttgaagtaa

SEQ ID NO: 233611 - DNA, 75 bp, Artificial Sequence
  Synthetic
cctatgcactttttgccttcgttacttgcatctgcgtgtgtagcatagtctgcctggttattaattttttccaac

SEQ ID NO: 233612 - DNA, 75 bp, Artificial Sequence
  Synthetic
taccactttctccagcagcacgtctagaaacacacatgaggcagcttatgccagagcaatgcttcaaaaaattaa

SEQ ID NO: 233613 - DNA, 75 bp, Artificial Sequence
  Synthetic
agaaacacacatgaggcagcttatgccagagcaatgcttcaaaaaattaatgaaacaataaattctacaatctct

SEQ ID NO: 233614 - DNA, 75 bp, Artificial Sequence
  Synthetic
caatgattggcattattgtagccgtggcagttggaatggcaatcataataatttgtatgatcgtctatgcttgct

SEQ ID NO: 233615 - DNA, 75 bp, Artificial Sequence
  Synthetic
ggcagttggaatggcaatcataataatttgtatgatcgtctatgcttgctgctatagaaagtttcaagatgaaaa

SEQ ID NO: 233616 - DNA, 75 bp, Artificial Sequence
  Synthetic
ccctccaccggcaatcttaagcataccctcatagtgacaaaatatcgtgctcctctgtcacctgcagcaaattga

SEQ ID NO: 233617 - DNA, 75 bp, Artificial Sequence
  Synthetic
atttaatttctttatagaaacatgaaaggagtaggtatcctagttctttcaactttaatctactcagtgatccct

SEQ ID NO: 233618 - DNA, 75 bp, Artificial Sequence
  Synthetic
aaggagtaggtatcctagttctttcaactttaatctactcagtgatccctatcagcatcaatgtgcagactactt

SEQ ID NO: 233619 - DNA, 75 bp, Artificial Sequence
  Synthetic
gaggttgcaatatgcatactgagaacctccagtgatatcatccagtgtactggaaagataatcaggcagagcttc

SEQ ID NO: 233620 - DNA, 75 bp, Artificial Sequence
  Synthetic
tacctcacatacacctcccccgctttctacccaccctcaatccaaagatgccatacaactacaactcaccatcct

SEQ ID NO: 233621 - DNA, 75 bp, Artificial Sequence
  Synthetic
ccatacaactacaactcaccatccttattgtgattgggttaactatccttgctgttatcctttactttatctttt

SEQ ID NO: 233622 - DNA, 75 bp, Artificial Sequence
  Synthetic
gtacctcgcgctctactatgttgtctgcatcggcatgaccatcttctgtctcgatggtggtcatgctgacgagcc

SEQ ID NO: 233623 - DNA, 75 bp, Artificial Sequence
  Synthetic
cactctctccaacaccaggcaggctacagggtctccagcgcgaccctcgtaaaacctgtcagtatgattaaaaag

SEQ ID NO: 233624 - DNA, 75 bp, Artificial Sequence
  Synthetic
tgttacccaaaaaaagttcctgtgcgacaggaccatgtggcgcataccgttctccagcaacttcatgtccatggg

SEQ ID NO: 233625 - DNA, 75 bp, Artificial Sequence
  Synthetic
tctaagaaaatgtaaatttcaagaaccatggaaattccttgattgctatcatgaaacatctgatttccccacata

SEQ ID NO: 233626 - DNA, 75 bp, Artificial Sequence
  Synthetic
cgttccgtgaatgacgtcagttcccctttcccacgagccgtcacttccggtcatcttgcaacgtcacctccccgc

SEQ ID NO: 233627 - DNA, 75 bp, Artificial Sequence
  Synthetic
gagtttactccctctgtctacttcaaccccttctccggctctcctggccagtacccggacgagttcataccgaac

SEQ ID NO: 233628 - DNA, 75 bp, Artificial Sequence
  Synthetic
acggagttcttactttaaaatgtttaaccccactaacaaccacaggcgggtctctacagttaaaagtgggagggg

SEQ ID NO: 233629 - DNA, 75 bp, Artificial Sequence
  Synthetic
tggaatggtgccaatatgcaaatgaggtaatttaaaaaagtgcgcgctgtgtggtgattggctgtggggtgaacg

SEQ ID NO: 233630 - DNA, 75 bp, Artificial Sequence
  Synthetic
gccggacgcgagacggggggagagcactggctggcttttggttggaacccgcgctccaacacctgctaccttttt

SEQ ID NO: 233631 - DNA, 75 bp, Artificial Sequence
  Synthetic
accgctaacgaccaccgcctctcatatgagcttggcccgcagcgtcagaaattcacttgcatggtgggaatcaac

SEQ ID NO: 233632 - DNA, 75 bp, Artificial Sequence
  Synthetic
ttcctgtgaatccaccgagtgcatctacaccctgctgaagaccctctgcggccttcgagacctcctacccatgaa

SEQ ID NO: 233633 - DNA, 75 bp, Artificial Sequence
  Synthetic
ctaatcaacaacccctaccctcttcccattaaaatccaattaataaaattcacttacttaaaatcagaaacaaag

SEQ ID NO: 233634 - DNA, 75 bp, Artificial Sequence
  Synthetic
ctggtactctaagcctcggcgggtggcatacttcctccacactttgaaagggatgtcaaattttagttcttcttt

SEQ ID NO: 233635 - DNA, 75 bp, Artificial Sequence
  Synthetic
gacgcctctgggtgaaagctaccggccccgtgagcttgaacctgaaagagagttcaacagaatcaatctcggtat

SEQ ID NO: 233636 - DNA, 75 bp, Artificial Sequence
  Synthetic
agcaaactatgtgccaaattaggagaggaacttacctttgattcttccaatgccattacaataaaaaataacact

SEQ ID NO: 233637 - DNA, 75 bp, Artificial Sequence
  Synthetic
caggacttgctggaaaattgattagtagcacagttggcatcatttacacagcagcgggcatcgttgttggccaac

SEQ ID NO: 233638 - DNA, 75 bp, Artificial Sequence
  Synthetic
agatgccctagactgcaagctaactctagtccttgtaaaaaatggaggactagtaaatgcatatgtgtcattaat

SEQ ID NO: 233639 - DNA, 75 bp, Artificial Sequence
  Synthetic
ctattcactaaaaagactgcatcaatcagcgtagaacttgcctttgatagctccggtcaaatacttactagccta

SEQ ID NO: 233640 - DNA, 75 bp, Artificial Sequence
  Synthetic
tcttctctaaaaactagcctcaactttaaacacaaccaagacatggccactgaaactatcagtgccaaaggcttc

SEQ ID NO: 233641 - DNA, 75 bp, Artificial Sequence
  Synthetic
ttaacacccaggctacttcttctagagacaatgaagattacatttttggtaaatgttactacagagcctcatatg

SEQ ID NO: 233642 - DNA, 75 bp, Artificial Sequence
  Synthetic
attgggaatggcactaataataatatgcatgttcctatatgcttgttgctataaaaagtttcaacataaacagga

SEQ ID NO: 233643 - DNA, 75 bp, Artificial Sequence
  Synthetic
ttcttcttgggagggatcgggggaggactgttgctccgttccggagacagggatgaccgcgaagtttcgcttacc

SEQ ID NO: 233644 - DNA, 75 bp, Artificial Sequence
  Synthetic
ccctattctggtacggcttacaactctctggctcctaaaggcgctccaaatgcatctcagtggttggataaggga

SEQ ID NO: 233645 - DNA, 75 bp, Artificial Sequence
  Synthetic
tcacagcagtaggtacaacacaacaccacaatattgtttaacaggccataattaaaggcgctccagccaaaactc

SEQ ID NO: 233646 - DNA, 75 bp, Artificial Sequence
  Synthetic
cggcgccctgcatgtcggccaggtagcagtttaccatgagttcgtagttgagcgcctcggccgcgtggcctttgg

SEQ ID NO: 233647 - DNA, 75 bp, Artificial Sequence
  Synthetic
cccaggagatgcaggcgcaggataatgtgaaagcggaagagattgaggcagatgtcgagcaggacccgggctatg

SEQ ID NO: 233648 - DNA, 75 bp, Artificial Sequence
  Synthetic
gatgtcgagcaggacccgggctatgtgacaccggcggagcacgaggaggagctgaaacgttttctagacagagag

SEQ ID NO: 233649 - DNA, 75 bp, Artificial Sequence
  Synthetic
tgacaccggcggagcacgaggaggagctgaaacgttttctagacagagaggatgacgaccgcccagagcatcaag

SEQ ID NO: 233650 - DNA, 75 bp, Artificial Sequence
  Synthetic
gatgacgaccgcccagagcatcaagcagatggcgatcaccaggaggctggcatcggggatcaagttgccgactac

SEQ ID NO: 233651 - DNA, 75 bp, Artificial Sequence
  Synthetic
aggcgttgttgaatatcaccgagcctgatgggagatggctgtatgatttgattaacattctgcaaagcattatag

SEQ ID NO: 233652 - DNA, 75 bp, Artificial Sequence
  Synthetic
gcgcgtgtccaggccagcacaaaggaggccacgtgggaggggtagcggtcgttgtcaaccagggggtccaccttc

SEQ ID NO: 233653 - DNA, 75 bp, Artificial Sequence
  Synthetic
ttcctatgcactttttgcctttgttacttgcatctgcgtgtgtagcatagtctgcctggttattaattttttcca

SEQ ID NO: 233654 - DNA, 75 bp, Artificial Sequence
  Synthetic
ctctgcactcaggttgtcagtttctaggaacgaggaggatttgatattgacagtaccagcagagatgcctttcat

SEQ ID NO: 233655 - DNA, 75 bp, Artificial Sequence
  Synthetic
gcgccctccaccggcattcttaagcacaccctcatagtgaaaaaatatcgtgctcctctgtcacctgcagcaaat

SEQ ID NO: 233656 - DNA, 75 bp, Artificial Sequence
  Synthetic
gcccgttgaccgggaagacaatacctactcttacaaagttcgctacacgctggctgtaggcgacaacagagtgct

SEQ ID NO: 233657 - DNA, 75 bp, Artificial Sequence
  Synthetic
tgcgcaatatatagagaacccttacactgacgtaattggacaaagtctaaaaaatcccgccaaaaaccagcacac

SEQ ID NO: 233658 - DNA, 75 bp, Artificial Sequence
  Synthetic
tgatagttcaagtacagccacactcttaagttggtcaaaagaatgctggcttcagttgtaatcaaaactccatca

SEQ ID NO: 233659 - DNA, 75 bp, Artificial Sequence
  Synthetic
aaataattttcacttcctcgttccgtgaatgacgtcagttcccctttcccacgagccgtcacttccgggcatctt

SEQ ID NO: 233660 - DNA, 75 bp, Artificial Sequence
  Synthetic
gcagctgacgcccccagaggatatggaggaagactgggacagtcaggcagaggaggagatggaagattgggacag

SEQ ID NO: 233661 - DNA, 75 bp, Artificial Sequence
  Synthetic
tggccaatccccttccgccctccattttcaaaagctcatttgcatgttggcaccgttccatttataaggtatatt

SEQ ID NO: 233662 - DNA, 75 bp, Artificial Sequence
  Synthetic
cggcccaacagtagatgggacgagaccgggcgattcccaaacccgaccaccgcttccaagaccggtaagaaggag

SEQ ID NO: 233663 - DNA, 75 bp, Artificial Sequence
  Synthetic
caatatcttgcattactaccgtcacctccacagcccctactgcagtcagcaagtcccggcaaccccgacagaaaa

SEQ ID NO: 233664 - DNA, 75 bp, Artificial Sequence
  Synthetic
cacgccttacatgtggagctatcagccccaaatggggttggcagcaggcgcctcccaggactactccacccgcat

SEQ ID NO: 233665 - DNA, 75 bp, Artificial Sequence
  Synthetic
attggcccgccgccctggtgtaccaggaaactcccgctcccaccaccgtactacttcctcgagacgcccaggccg

SEQ ID NO: 233666 - DNA, 75 bp, Artificial Sequence
  Synthetic
ggaaatgacctcagaacagatggtgctaccataagtttcaccagcatcaacctctatgccaccttcttccccatg

SEQ ID NO: 233667 - DNA, 75 bp, Artificial Sequence
  Synthetic
taaaacgcctggtgatcagaggccgaggtatccagctcaacgacgagtcggttagctcttcgcttggtctgcgac

SEQ ID NO: 233668 - DNA, 75 bp, Artificial Sequence
  Synthetic
gttagctcttcgcttggtctgcgaccagacggagtcttccagatcgccggctgtgggagatcttccttcacccct

SEQ ID NO: 233669 - DNA, 75 bp, Artificial Sequence
  Synthetic
gatgatagcaagtttctgagcaattgagatttgccacatccggtggggccataaatgattccgattacaggttgc

SEQ ID NO: 233670 - DNA, 75 bp, Artificial Sequence
  Synthetic
aacttcgacgcaatcagcgagtcagtggatggctatgattgatgtctaatggtggcgcggctgagctagctcgac

SEQ ID NO: 233671 - DNA, 75 bp, Artificial Sequence
  Synthetic
caaccgtggtcatttcttgcttgctatcgagaaaaatcagaaattcccccaaatttaataatgattgctggaata

SEQ ID NO: 233672 - DNA, 75 bp, Artificial Sequence
  Synthetic
ctggccagtgcagcctctgggagtagcagggatactgagacacccaccgaccatgccagcggttctgcaggagga

SEQ ID NO: 233673 - DNA, 75 bp, Artificial Sequence
  Synthetic
actcaccacctccaattccgccgaggatctgctcgatatggacggccgcgtctcagaacagcgactcgcccaact

SEQ ID NO: 233674 - DNA, 75 bp, Artificial Sequence
  Synthetic
tgcatggtgggaatcaaccccatagttatcacccagcaaagtggagatactaagggttgcattcactgctcctgc

SEQ ID NO: 233675 - DNA, 75 bp, Artificial Sequence
  Synthetic
aaagagctctgacgggggctggaaccgagggggagaactactttgacatgggagcggacttgcagtggcagccca

SEQ ID NO: 233676 - DNA, 75 bp, Artificial Sequence
  Synthetic
gggctcctgcgtcgcagtgcccttgctaccaaagaccgctgcatcaccctggaaaagtccacccaaagcgtgcag

SEQ ID NO: 233677 - DNA, 75 bp, Artificial Sequence
  Synthetic
tattagtcgtgcttgctttactttcgcttttgggtctgggctctgctaatctcaatcctcttgatcacgatccat

SEQ ID NO: 233678 - DNA, 75 bp, Artificial Sequence
  Synthetic
gcagcttttagatgttgtatgatgggtatgtggccaggggttgtcggcatggaagcagtaacacttatgaatatt

SEQ ID NO: 233679 - DNA, 75 bp, Artificial Sequence
  Synthetic
gtggacattcggatgagaggccttatcagatgctgacctgcgctggtggacattgcaatattcttgctaccgtgc

SEQ ID NO: 233680 - DNA, 75 bp, Artificial Sequence
  Synthetic
cacagacacctacttcaatctggggaacaagtttaggaaccccaccgtggcgcccacccatgatgtgaccaccga

SEQ ID NO: 233681 - DNA, 75 bp, Artificial Sequence
  Synthetic
accctagtcacctccccatttaccttttactacatcagagaagacgactgacaaataaagtttaacttgtttatt

SEQ ID NO: 233682 - DNA, 75 bp, Artificial Sequence
  Synthetic
tcccaccatgggcaggagttcgtcagaatgtcatgggatctactgtggatgggagacccgtccagcccgccaatt

SEQ ID NO: 233683 - DNA, 75 bp, Artificial Sequence
  Synthetic
tttggctaggggggttcaacggtcaaagggggcgggccggcgcgggtaggtgacgtgatttgtgtgggaggagtt

SEQ ID NO: 233684 - DNA, 75 bp, Artificial Sequence
  Synthetic
catcatcaataatataccttataaatggaacggtgccaacatgcaaatgagcttttgaaaatggagggcggaagg

SEQ ID NO: 233685 - DNA, 75 bp, Artificial Sequence
  Synthetic
ttgtagtgccagccaccacttctgctccccgcaaaaccactttctctagcagcagtgccaaagcaagcacaattc

SEQ ID NO: 233686 - DNA, 75 bp, Artificial Sequence
  Synthetic
ctgattctatgctgttagctgccgatgaaggattggacataaaccctcctccggagacccttgataccccaggag

SEQ ID NO: 233687 - DNA, 75 bp, Artificial Sequence
  Synthetic
tatgttgcaagttctcgcggtaaatgtgacgtaaaacgaggtgtggtttgaacacggaagtggacagttttcccg

SEQ ID NO: 233688 - DNA, 75 bp, Artificial Sequence
  Synthetic
aaaaggggcgggccggcgcggggaggtgacgtgtttagtgtgggaggagttatgttgcaagttctcgcggtaaat

SEQ ID NO: 233689 - DNA, 75 bp, Artificial Sequence
  Synthetic
tatacacaagccctaaactgacgtaatgggagtaaagtgtaaaaaatcccgccaaacccaacacacaccccgaaa

SEQ ID NO: 233690 - DNA, 75 bp, Artificial Sequence
  Synthetic
aaaaggtgatgcattactaaattttgacatttaattttttatagaattatgatattgtttcaatcaaataccact

SEQ ID NO: 233691 - DNA, 75 bp, Artificial Sequence
  Synthetic
gatggctggcagagcccattccgcgttcgggggtgtgctcccggtggcggtcgcttgactgatttcctccgcggc

SEQ ID NO: 233692 - DNA, 75 bp, Artificial Sequence
  Synthetic
agtcagatctccactttgaaaaatgagacacctgcgattcctgcctcaggaaatctccatcgagaccgggaatga

SEQ ID NO: 233693 - DNA, 75 bp, Artificial Sequence
  Synthetic
ctataccctacctggatggtaccttctaccttaaccacactttcaagaaagtgtctatcatgtttgactcttcag

SEQ ID NO: 233694 - DNA, 75 bp, Artificial Sequence
  Synthetic
gcttcatgaactgtatgatttagaggtagacgggccggaggatcctaacgaggaagctgtgaatggtttttttag

SEQ ID NO: 233695 - DNA, 75 bp, Artificial Sequence
  Synthetic
cggagaccctcgataccccaggggtgattgtggagagcggcagaggtgggaaaacattgcctgaacttggtgctg

SEQ ID NO: 233696 - DNA, 75 bp, Artificial Sequence
  Synthetic
gaagaggaggaaaatgtgcagtcgatccagaccgcagcgggtgagggaatgaaagctgccaatgatggttttaag

SEQ ID NO: 233697 - DNA, 75 bp, Artificial Sequence
  Synthetic
ttggactgcccggagctgcctggacatggctgtaagtcttgtgaatttcacaggaatagtactggactaaaagaa

SEQ ID NO: 233698 - DNA, 75 bp, Artificial Sequence
  Synthetic
gaacgcactgccattttatttacagtaagtgtgtctaacttaaatttaaagggacagtgtagcagtttagtgtct

SEQ ID NO: 233699 - DNA, 75 bp, Artificial Sequence
  Synthetic
aattttgggtggaattctcccaatgcactgggttacccacaagaaccagatgaacatatcccactacaacacata

SEQ ID NO: 233700 - DNA, 75 bp, Artificial Sequence
  Synthetic
tgaacatatcccactacaacacatacaacaaccactagcactggtagagtatgaaaatgagccacaaccttcact

SEQ ID NO: 233701 - DNA, 75 bp, Artificial Sequence
  Synthetic
ctaaccggcggagatgactgaaatactcaccacctccaattccgccgaggatctgcttgatatggacggccgcgt

SEQ ID NO: 233702 - DNA, 75 bp, Artificial Sequence
  Synthetic
ggcggagctcgaggacgagagcgcgcaggccggagctgtccagggtcctgagacgctgcggagtcaggttagtag

SEQ ID NO: 233703 - DNA, 75 bp, Artificial Sequence
  Synthetic
cctgcacctgtgtttatttaatgtgacgtcagtatttatgtgagagtaccatgtaataaaattatgtcagctgct

SEQ ID NO: 233704 - DNA, 75 bp, Artificial Sequence
  Synthetic
aaggggtgcattcactgctcttgcgattccatcgagtgcacctacaccctgctaaagaccctatgcggcctaaga

SEQ ID NO: 233705 - DNA, 75 bp, Artificial Sequence
  Synthetic
ctagacaactgctagaaaacgcctcggacggagtctctagtctttggagattctggttcggtggtgatctagcta

SEQ ID NO: 233706 - DNA, 75 bp, Artificial Sequence
  Synthetic
tcatgtctttcttcccagatgaccaagagagtccggctcagtgattccttcaaccctgtctacccctatgaagat

SEQ ID NO: 233707 - DNA, 75 bp, Artificial Sequence
  Synthetic
caaccctgtctacccctatgaagatgaaagcacctcccaacacccctttataaacccagggtttatttccccaaa

SEQ ID NO: 233708 - DNA, 75 bp, Artificial Sequence
  Synthetic
atgccagcggttttggaggaggagcagcaggaggacaacccgagagccggcctggaccctccggtggaggaggcg

SEQ ID NO: 233709 - DNA, 75 bp, Artificial Sequence
  Synthetic
ggctgtagtgctagtaactgtggagctggagtgtctgcgccgctttttcaccgaccctgagaccctgcgcaagct

SEQ ID NO: 233710 - DNA, 75 bp, Artificial Sequence
  Synthetic
cctggaccctccggtggaggaggcggaggagtagctgacctgtttcctgaactgcgacgggtgcttactaggtct

SEQ ID NO: 233711 - DNA, 75 bp, Artificial Sequence
  Synthetic
tgaaagaaaacataagtgccaccacaccactcgttaagactggtcactctataggtttgtcgctaggacccggat

SEQ ID NO: 233712 - DNA, 75 bp, Artificial Sequence
  Synthetic
actgcgacgggtgcttactaggtctacgtccagtggacaggacaggggcattaagagggagaggaatgctagtgg

SEQ ID NO: 233713 - DNA, 75 bp, Artificial Sequence
  Synthetic
aatgcccaccactagaccgatagcccctatggctaccggggtgatgaaaccttctcagttgcatcgacccgtcac

SEQ ID NO: 233714 - DNA, 75 bp, Artificial Sequence
  Synthetic
ttaagtttaatgagtcgcagccgccctgaaactatctggtggcatgaggttcagagcgagggcagggatgaagtt

SEQ ID NO: 233715 - DNA, 75 bp, Artificial Sequence
  Synthetic
ctaatgattgcaaattaattctaacactagttaaaactggagccctcgtcactgcatttgtttatgttataggag

SEQ ID NO: 233716 - DNA, 75 bp, Artificial Sequence
  Synthetic
actagttaaaactggagccctcgtcactgcatttgtttatgttataggagtatctaacgattttaatatgctaac

SEQ ID NO: 233717 - DNA, 75 bp, Artificial Sequence
  Synthetic
agataaaacagcttttaggtgttgcatgatgggtatgtggccaggggtggctggcatggaggcggtgacccttat

SEQ ID NO: 233718 - DNA, 75 bp, Artificial Sequence
  Synthetic
tcagggcaaaacatggctactggtgcccttactaatgctaaaggtttcatgcccagcacaactgcctatcctttc

SEQ ID NO: 233719 - DNA, 75 bp, Artificial Sequence
  Synthetic
tataatgggattgtctttatggctaacactaagctgattctgcatggttgtagcttttttgggtttaataatact

SEQ ID NO: 233720 - DNA, 75 bp, Artificial Sequence
  Synthetic
actacatttacggaacttgttactacacagctagtgatcacactgcttttcccattgacatatctgtcatgctta

SEQ ID NO: 233721 - DNA, 75 bp, Artificial Sequence
  Synthetic
taaagtttaacttgtttatttaaaatcaattcataaaattcgagtagttattttgcctcccccttcccatttaac

SEQ ID NO: 233722 - DNA, 75 bp, Artificial Sequence
  Synthetic
atgatctgtggaccctcggatgagaggccttatcagatgctgacctgtgctggaggacattgcaatatgctggct

SEQ ID NO: 233723 - DNA, 75 bp, Artificial Sequence
  Synthetic
taatgtgatgaccaagtgcaccatgcacataggtggtcgcaggggaatgtttatgccttaccagtgtaacatgaa

SEQ ID NO: 233724 - DNA, 75 bp, Artificial Sequence
  Synthetic
cggtcatctggaagaagaacgatgggaatcataatccgaaaacggaatcgggcgattgtgtctcatcaaacccac

SEQ ID NO: 233725 - DNA, 75 bp, Artificial Sequence
  Synthetic
gaatcataatccgaaaacggaatcgggcgattgtgtctcatcaaacccacaagcagccgctgtctgcgtcgctcc

SEQ ID NO: 233726 - DNA, 75 bp, Artificial Sequence
  Synthetic
acggaagacctgagacccgatcatttggtgcttgcctgcactggagcggagttcggttctagtggggaagaaact

SEQ ID NO: 233727 - DNA, 75 bp, Artificial Sequence
  Synthetic
ggcgaacacgttccgggggtctgacacatcatagttatgctcctgagtcaggtcatcataagccattttaataaa

SEQ ID NO: 233728 - DNA, 75 bp, Artificial Sequence
  Synthetic
tagctcttcgcttggtctgcgaccagacggagttttccagatcgccggctgtgggagatcttccttcactcctcg

SEQ ID NO: 233729 - DNA, 75 bp, Artificial Sequence
  Synthetic
agcaaactgagtctgctgttgccacagcaaagtctaaataaagattcccaaatcaataaataaaggagatccttg

SEQ ID NO: 233730 - DNA, 75 bp, Artificial Sequence
  Synthetic
ttgtcataatggagttgcttcctgacattctcgtattttgtatagcaaaacgcggccctggcacaacacactctt

SEQ ID NO: 233731 - DNA, 75 bp, Artificial Sequence
  Synthetic
tgtgttccgtctgataattcaagtacagccacactcttaagttggtcaaaagaatgctggcttcagttgtaatta

SEQ ID NO: 233732 - DNA, 75 bp, Artificial Sequence
  Synthetic
gcggctaacgtggtattggctatcccgtctcgacccagccgacgaatatccagggtacggagtagagtcgttttt

SEQ ID NO: 233733 - DNA, 75 bp, Artificial Sequence
  Synthetic
cattcagaaccctactagcaaacctctgaccgcacagctgtttctggtggtgcaacacagcagagacaatgaggc

SEQ ID NO: 233734 - DNA, 75 bp, Artificial Sequence
  Synthetic
tccctctttggggtctggatttgacccctactttgtctattctggttctattccctacctggatggtaccttcta

SEQ ID NO: 233735 - DNA, 75 bp, Artificial Sequence
  Synthetic
gggaaaagcatgaaaaaatttggagacgcctttgtgtccgcccagattctccatgcactcatccataatgatagc

SEQ ID NO: 233736 - DNA, 75 bp, Artificial Sequence
  Synthetic
aataccaaaagaaggagcattttctaactcctcaaacatcatattacattcctgcaccattcccagataattttc

SEQ ID NO: 233737 - DNA, 75 bp, Artificial Sequence
  Synthetic
tgtgttctatggcatctcgatccagcagacctcctcgtttcgcgggttgggacgactcctggagtatggtatcag

SEQ ID NO: 233738 - DNA, 75 bp, Artificial Sequence
  Synthetic
agtctttccatcacaagacaagccacagggtctccagctctaccctcgtaaaacctgtcatcgtgattaaacaac

SEQ ID NO: 233739 - DNA, 75 bp, Artificial Sequence
  Synthetic
ctactttgacatgggagcggacttgcaatggcaacccagtcgcagggccatggaggctgcagggtgtgagcttcc

SEQ ID NO: 233740 - DNA, 75 bp, Artificial Sequence
  Synthetic
tccagcactacttttaaacggtcctatgatgaggtgtacggggatgacgatattcttgagcaggcggcagaccgc

SEQ ID NO: 233741 - DNA, 75 bp, Artificial Sequence
  Synthetic
acttcctctttctcacgatacgtcacatccgattaacttacaacgtcattttcccacggacgccccgcccatttt

SEQ ID NO: 233742 - DNA, 75 bp, Artificial Sequence
  Synthetic
gtctttgtctgcacggtaagagcccagcatgtagaactgattgactgccttgtagggacagcatcccttctccac

SEQ ID NO: 233743 - DNA, 75 bp, Artificial Sequence
  Synthetic
tttctaggaacgaggaggatttgatattgacagtgccagccgagatgcctttcataagactctcgtccatttggt

SEQ ID NO: 233744 - DNA, 75 bp, Artificial Sequence
  Synthetic
cagcttggtggcaaaggatccatagagggcattggataagagcttggctatggagcgcatggtttggttcttttc

SEQ ID NO: 233745 - DNA, 75 bp, Artificial Sequence
  Synthetic
atgttgagctggacatactcgcgcgccagacacttccattcagggaagatggttgtcagttcatctggcacgatt

SEQ ID NO: 233746 - DNA, 75 bp, Artificial Sequence
  Synthetic
gggtgatcagatccacactggtggtcacttcgcctctgaggggctcgttggtccagcagagtcggcccccttttc

SEQ ID NO: 233747 - DNA, 75 bp, Artificial Sequence
  Synthetic
gggcggtcagctgaagaccatcatgcacaccaacatgcccaacgtgaacgagtacatgttcagcaacaagttcaa

SEQ ID NO: 233748 - DNA, 75 bp, Artificial Sequence
  Synthetic
tagcatgagttcatcaggggggtctgcatccatagtgaagattcctgggagcagatccttgtcaaaatagctgat

SEQ ID NO: 233749 - DNA, 75 bp, Artificial Sequence
  Synthetic
gattcggccgatgatagcagcgtattggacttgggtgggagaggaaggggcaacccgtttgctcatttgcgccct

SEQ ID NO: 233750 - DNA, 75 bp, Artificial Sequence
  Synthetic
ccaaagcgcggctcgtattggccggtttccgcaacaagcaaggtttggcagccccgtcatttccaagaccccgcc

SEQ ID NO: 233751 - DNA, 75 bp, Artificial Sequence
  Synthetic
atttgaagagatggtgggtctctgaaagatgttaaaatgggcatgaggtagacctacagagtccctgatgaagtg

SEQ ID NO: 233752 - DNA, 75 bp, Artificial Sequence
  Synthetic
gacctacagagtccctgatgaagtgggcatatgactcttgcagcttggccaccagctctgcagtgacaaggacat

SEQ ID NO: 233753 - DNA, 75 bp, Artificial Sequence
  Synthetic
agacaagtcaacaactacccagtggtgggtgcagagcttatgcccgtcttctcaaagagtttctacaatgagcaa

SEQ ID NO: 233754 - DNA, 75 bp, Artificial Sequence
  Synthetic
ggttattgatcacctgagcggctaggacgatctcatcaaagccattgatgttgtgccccacaatgtaaagttcta

SEQ ID NO: 233755 - DNA, 75 bp, Artificial Sequence
  Synthetic
ttgtgccccacaatgtaaagttctatgaatcgcggggtgcccctgacatgaggcagcttcttgagttcttcaaaa

SEQ ID NO: 233756 - DNA, 75 bp, Artificial Sequence
  Synthetic
ttttgccgcaacatccgttccgactaaagaatcattattggatgatgtgtctcaaaatatagagttaaaactcac

SEQ ID NO: 233757 - DNA, 75 bp, Artificial Sequence
  Synthetic
caggtgagggtttgcattgaggaaggaggaccagagatccactgccagtgctgtttgtaactggtcccgatactg

SEQ ID NO: 233758 - DNA, 75 bp, Artificial Sequence
  Synthetic
gcccgttgaccgggaggacaatacatactcttacaaagtgcggtacaccctcgccgtgggcgacaacagagtgct

SEQ ID NO: 233759 - DNA, 75 bp, Artificial Sequence
  Synthetic
cttccactaacatctcttcttcctcttcaggcgggggtggaggaggagggggaacgcggcgacgccggcggcgca

SEQ ID NO: 233760 - DNA, 75 bp, Artificial Sequence
  Synthetic
tgtgcgaggatgagagccgatcgggaagaactggatctcctgccaccagttggaggaatggctgttgatgtgatg

SEQ ID NO: 233761 - DNA, 75 bp, Artificial Sequence
  Synthetic
cgaaactaagttgattatgccaggagtctacacttatgaggcattccatcctgacattgttttgctgcctggttg

SEQ ID NO: 233762 - DNA, 75 bp, Artificial Sequence
  Synthetic
cacgggatgcacctcatgaatgagttgtacctggcttcctttgacgagaaatttcagtgggaagttgaggcctgg

SEQ ID NO: 233763 - DNA, 75 bp, Artificial Sequence
  Synthetic
tggtaactctcatgcaaatttgggtcaacaagccatgcctaacagacccaattacattggcttcagggataactt

SEQ ID NO: 233764 - DNA, 75 bp, Artificial Sequence
  Synthetic
gaggtggctctgttgcttcttgcatgttcagaagcggtggcgagggcgcgcgccgggcggtaggggcggctctgg

SEQ ID NO: 233765 - DNA, 75 bp, Artificial Sequence
  Synthetic
cgcgagtaggcgcgggtgtcaaagatgtaatcgttgcaggtgcgcaccaggtactggtagccgatgagaaagtgt

SEQ ID NO: 233766 - DNA, 75 bp, Artificial Sequence
  Synthetic
cgccgggcggtaggggcggctctggccccggcggcatggcaggcagaggcacgtcggcgccgcgcgcgggtaggt

SEQ ID NO: 233767 - DNA, 75 bp, Artificial Sequence
  Synthetic
ggcgaggtcttccagcatgaggcggtggtagccgtagatgtacctggacatccaggtgataccggaggcggtggt

SEQ ID NO: 233768 - DNA, 75 bp, Artificial Sequence
  Synthetic
cggttccagatgttgcgcagcggcatgaagtagttcatggtaggcacggtctggccagtgaggcgcgcgcagtca

SEQ ID NO: 233769 - DNA, 75 bp, Artificial Sequence
  Synthetic
agaatgcattcatgcccgcctcgttccagacgcggctgtagaccacggccccctcgggatctcttgcgcgcatga

SEQ ID NO: 233770 - DNA, 75 bp, Artificial Sequence
  Synthetic
cgcgtcaagctttagaacgctcagttctcggggccgggagtggctcgcgcccgtagtctggagaatcaatcgcca

SEQ ID NO: 233771 - DNA, 75 bp, Artificial Sequence
  Synthetic
cctttcattaacaaactgctggactacctgcacagggcggccgccatgaactctgattatttcaccaatgctatc

SEQ ID NO: 233772 - DNA, 75 bp, Artificial Sequence
  Synthetic
ctcttcttcctcttcaggcgggggcggaggaggagggggcacgcggcgacgccggcggcgcacgggcagacggtc

SEQ ID NO: 233773 - DNA, 75 bp, Artificial Sequence
  Synthetic
aaacctttcgacgaaagcgtctaaccagtcgcaatcgcaaggtaggctgagcactgtttcttgcgggcgggggtt

SEQ ID NO: 233774 - DNA, 75 bp, Artificial Sequence
  Synthetic
aactacttagtgttcccacggtatttaacaggaaatgaggtagttttggccggatgcaagtaaaaattgttcatt

SEQ ID NO: 233775 - DNA, 75 bp, Artificial Sequence
  Synthetic
tttcgattaccgtgttttttacctaaatttccgcgtaccgtgtgaaagtcttctgtttttacgtaggtgtcagct

SEQ ID NO: 233776 - DNA, 75 bp, Artificial Sequence
  Synthetic
ggtttgtgtcaagaggccactcttgagtgccagcgagaagagttttctcctctgcgccggcagtttaatattaaa

SEQ ID NO: 233777 - DNA, 75 bp, Artificial Sequence
  Synthetic
atgagcggctcgcctccgtggcctggaggaacgtgaacgggttgggtcgcggtgtaccccggttcgagacacaag

SEQ ID NO: 233778 - DNA, 75 bp, Artificial Sequence
  Synthetic
ctggacgggtgccagtgccgcgtcaagctttagaacgctcagttcacggggccgggagtggctcgcgcccgtagt

SEQ ID NO: 233779 - DNA, 75 bp, Artificial Sequence
  Synthetic
cagatgcgcccccagcaacaggccccttctcagcaacagcagcagccacaaaaggctcttcctgctcctgctcct

SEQ ID NO: 233780 - DNA, 75 bp, Artificial Sequence
  Synthetic
gtgccccagcagaacctgttcagggacaggagcggcgaggagcccgaggagatgcgagcctctcgctttaacgcg

SEQ ID NO: 233781 - DNA, 75 bp, Artificial Sequence
  Synthetic
aaaccctattctggtacggcttacaactccctggctcctaaaggcgctccaaatgcatctcagtggttggataag

SEQ ID NO: 233782 - DNA, 75 bp, Artificial Sequence
  Synthetic
gggatcagccccgctagggcacatgtggccgcggccaacctcgtctcggcctacgagcagaccgtgaaggaggag

SEQ ID NO: 233783 - DNA, 75 bp, Artificial Sequence
  Synthetic
accatgtgcgcaccctgatcgcccgcgaggaagtgaccctgggtctgatgcacctgtgggacctgatggaagcta

SEQ ID NO: 233784 - DNA, 75 bp, Artificial Sequence
  Synthetic
ataagctttatcagccagaacctcaagtgggagacgaaacttggactgacctagacggaaaaaccgaagagtatg

SEQ ID NO: 233785 - DNA, 75 bp, Artificial Sequence
  Synthetic
gcagcagtgaactggggagaataacccgcccgcgcttgatgggcgaggatgagtacttgaacgactctttgctga

SEQ ID NO: 233786 - DNA, 75 bp, Artificial Sequence
  Synthetic
gtgcaacatagcagggacaatgaggcattcagggaggcgctgctgaacatcaccgagcccgaggggagatggttg

SEQ ID NO: 233787 - DNA, 75 bp, Artificial Sequence
  Synthetic
cattcagggaggcgctgctgaacatcaccgagcccgaggggagatggttgtatgatctgatcaatatcctgcaaa

SEQ ID NO: 233788 - DNA, 75 bp, Artificial Sequence
  Synthetic
gtattatagtacaggaacgtagcctgggtctggctgagaaagtggcagccatcaactactcggtcttgagcctgg

SEQ ID NO: 233789 - DNA, 75 bp, Artificial Sequence
  Synthetic
atcaactactcggtcttgagcctgggcaagtactacgctcgcaagatctacaagaccccctacgtgcccatagac

SEQ ID NO: 233790 - DNA, 75 bp, Artificial Sequence
  Synthetic
agggtcattcttgtcgatcttctcaacacttctcttgccatccttctcaatgatgcgcaccggggggtagctgaa

SEQ ID NO: 233791 - DNA, 75 bp, Artificial Sequence
  Synthetic
agcttgcaaagagctctgacgggggcagggaccgagggggagaactactttgacatgggagcggacttgcaatgg

SEQ ID NO: 233792 - DNA, 75 bp, Artificial Sequence
  Synthetic
tacctggatggcaccttctaccttaaccacactttcaagaaggtctccatcatgtttgactcctcagtcagctgg

SEQ ID NO: 233793 - DNA, 75 bp, Artificial Sequence
  Synthetic
gtgcgcgctgtgtggtgattggctgtggggtgaacggctaaaatgggcggggcggccgtgggaaaatgacgtgac

SEQ ID NO: 233794 - DNA, 75 bp, Artificial Sequence
  Synthetic
ggcggccgtgggaaaatgacgtgacttatgtgggaggagctatgttgcaagttattgcggtaaatgtgacgtaaa

SEQ ID NO: 233795 - DNA, 75 bp, Artificial Sequence
  Synthetic
caggatatgaggtagttttgggcggatgcaagtaaaaattctccattttcgcgcgaaaactgaatgaggaagtga

SEQ ID NO: 233796 - DNA, 75 bp, Artificial Sequence
  Synthetic
cccgctcatcggaactactgccgttaagagtgttacccagaaaaagttcctgtgcgacaggaccatgtggcgcat

SEQ ID NO: 233797 - DNA, 75 bp, Artificial Sequence
  Synthetic
tgtgcgacaggaccatgtggcgcattcccttctccagcaacttcatgtccatgggggcccttaccgacctgggac

SEQ ID NO: 233798 - DNA, 75 bp, Artificial Sequence
  Synthetic
gcattccatcctgacattgtattgctgcctggttgtggggtagactttactgagagccgccttagtaacttgctt

SEQ ID NO: 233799 - DNA, 75 bp, Artificial Sequence
  Synthetic
tgcctggttgtggggtagactttactgagagccgccttagtaacttgcttggaatcaggaagagacacccattcc

SEQ ID NO: 233800 - DNA, 75 bp, Artificial Sequence
  Synthetic
ggatctcgagggaggtaacatccccgccctactggatgtagacgcctatgaaaaaagcaagaaagaacaagaagc

SEQ ID NO: 233801 - DNA, 75 bp, Artificial Sequence
  Synthetic
gccctactggatgtagacgcctatgaaaaaagcaagaaagaacaagaagccaaaacagaagccgctaaagccgct

SEQ ID NO: 233802 - DNA, 75 bp, Artificial Sequence
  Synthetic
ccagcgatcccgtaagggtggctaatgccgaagaagttagaggagataactatactgcctcagctgttgcaactg

SEQ ID NO: 233803 - DNA, 75 bp, Artificial Sequence
  Synthetic
tgaaaccgaaactacagagacaaaactcactattcaacctttggaaaaagatagtaagagtagaagctataatgt

SEQ ID NO: 233804 - DNA, 75 bp, Artificial Sequence
  Synthetic
agagccaggtggacgagcagacctaccaagaaatcacccaagtgagccgcgccctgggtcaggaagacacgggca

SEQ ID NO: 233805 - DNA, 75 bp, Artificial Sequence
  Synthetic
agcccaatgcaacatgaccaaagactggttcttggtacagatgctcgccaactacaacatcggctatcagggctt

SEQ ID NO: 233806 - DNA, 75 bp, Artificial Sequence
  Synthetic
ccgcgctggacatgacagcgcgaaacatggagcccagcatgtatgccagtaaccggcctttcattaacaaactgc

SEQ ID NO: 233807 - DNA, 75 bp, Artificial Sequence
  Synthetic
ggtggctttttgccagctcttatacccatcatcgccgcagcgatcggggcgataccaggcatagcttccgtggcg

SEQ ID NO: 233808 - DNA, 75 bp, Artificial Sequence
  Synthetic
ttttttgtaggtcctgtgtctgatgatgagtcaccttctcctgattcaactacctcacctcctgaaattcaggcg

SEQ ID NO: 233809 - DNA, 75 bp, Artificial Sequence
  Synthetic
ttataacacttggaagaaggaagggggcgatagaagacactcttccgtgtcgctgtccgggtcgaggggtgctgc

SEQ ID NO: 233810 - DNA, 75 bp, Artificial Sequence
  Synthetic
tgacgccagacgccgcacctgtccctacgtttacaaggccctgggcatagtcgcgccgcgcgtcctttcaagccg

SEQ ID NO: 233811 - DNA, 75 bp, Artificial Sequence
  Synthetic
cctttccctagcctgcccttttctctgaacagcgtgcgcagcagtgaactggggagaataacccgcccgcgcttg

SEQ ID NO: 233812 - DNA, 75 bp, Artificial Sequence
  Synthetic
tgaacagcgtgcgcagcagtgaactggggagaataacccgcccgcgcttgatgggcgaggatgagtacttgaacg

SEQ ID NO: 233813 - DNA, 75 bp, Artificial Sequence
  Synthetic
gccatggcgacgagcgtgcgttcgttcttttctgttatctatgtctagtatgatgaggcgagccgtgctaggcgg

SEQ ID NO: 233814 - DNA, 75 bp, Artificial Sequence
  Synthetic
cccccgcggtacctggcgcctacagaggggagaaacagcattcgttactcggagctggcaccccagtacgatacc

SEQ ID NO: 233815 - DNA, 75 bp, Artificial Sequence
  Synthetic
ccagcctgtacctttccattagcacagccatcacttccatgcccttctcccaggcagataccaggggcagactca

SEQ ID NO: 233816 - DNA, 75 bp, Artificial Sequence
  Synthetic
gaagaagatggcgatgatgggctggtggagtttgtgcgcgagttcgccccaaggcggcgcgtgcagtggcgcggg

SEQ ID NO: 233817 - DNA, 75 bp, Artificial Sequence
  Synthetic
gacaatgcccggcttgcagtgctcaagcgcagtatcgtggtcacccattttgcctaccccgctgttaacctgccc

SEQ ID NO: 233818 - DNA, 75 bp, Artificial Sequence
  Synthetic
aagttcaaggcgcgggtgatggtgtccagaaaggctcctgaaggtgttacagtagatgacacctatgatcataag

SEQ ID NO: 233819 - DNA, 75 bp, Artificial Sequence
  Synthetic
ttgagttcactctgccagaaggcaacttctcagccaccatgaccatcgacctgatgaacaatgccatcattgaca

SEQ ID NO: 233820 - DNA, 75 bp, Artificial Sequence
  Synthetic
aagtgctgcccgtacctccgcggagaggtgtaaaacgcgagggtgaggagctgtatcccaccatgcagctgatgg

SEQ ID NO: 233821 - DNA, 75 bp, Artificial Sequence
  Synthetic
ggcttggctgggaccccgaaactaagttaattatgcctggggtttacacctatgaggccttccatcctgacattg

SEQ ID NO: 233822 - DNA, 75 bp, Artificial Sequence
  Synthetic
gttaattatgcctggggtttacacctatgaggccttccatcctgacattgtgctactgcctggttgcggggtgga

SEQ ID NO: 233823 - DNA, 75 bp, Artificial Sequence
  Synthetic
ttgcttggaatcaggaagagacacccattccaggaaggctttcagatactgtatgaagatctcgaagggggtaat

SEQ ID NO: 233824 - DNA, 75 bp, Artificial Sequence
  Synthetic
ctcagccgcctccattgaggtgcaaacggatccctggatgcccgcacccgttgccgcccccagcaccacacgaag

SEQ ID NO: 233825 - DNA, 75 bp, Artificial Sequence
  Synthetic
tgcaggcaccactactgaagggacaacaactgtcgctgttgctaatgcactaacgacagctaaagcggcagcaaa

SEQ ID NO: 233826 - DNA, 75 bp, Artificial Sequence
  Synthetic
acaactgtcgctgttgctaatgcactaacgacagctaaagcggcagcaaatgtgacagtagatgttattactgaa

SEQ ID NO: 233827 - DNA, 75 bp, Artificial Sequence
  Synthetic
tcagcgaccctgtaagggtgggtaatgccgaagaagtcagaggagacaactatacagcttcatctgttgcaactg

SEQ ID NO: 233828 - DNA, 75 bp, Artificial Sequence
  Synthetic
ataattacctatctgctaatgacatgaaagactctagtgaaacaactgtggagccggcagttcctattgtagtac

SEQ ID NO: 233829 - DNA, 75 bp, Artificial Sequence
  Synthetic
gccgcgcctacgagctgaacctcttttcgcctcaggtaccccccaagcggcagccaaacggcacctgcgaggcca

SEQ ID NO: 233830 - DNA, 75 bp, Artificial Sequence
  Synthetic
cgaaaccaaaacaccaaccatccagccgctaaaaaaagatagcaaaagtaggagttataatgtcttggaagatga

SEQ ID NO: 233831 - DNA, 75 bp, Artificial Sequence
  Synthetic
cgcgcgcgctaccatccaagcatcaccacttaatgactgttgccgctgcctccttgcagatatggccctcacttg

SEQ ID NO: 233832 - DNA, 75 bp, Artificial Sequence
  Synthetic
agtcaacacagcctatcgcagttggtacttgtcctacaactatggcgaccctgaaaaaggagtccgctcctggac

SEQ ID NO: 233833 - DNA, 75 bp, Artificial Sequence
  Synthetic
cgtcaccttccgctctacgagacaagtcagcaactaccccgtggtgggtgcagagctcatgcccgtcttctcaaa

SEQ ID NO: 233834 - DNA, 75 bp, Artificial Sequence
  Synthetic
tttggctcgaccataaaaacctatgggaacaaagcttggaacagcagcacagggcaggctctgagaaataagctt

SEQ ID NO: 233835 - DNA, 75 bp, Artificial Sequence
  Synthetic
tacttcgaactccccgaggagcaccctcagggtccggcccacggagtgcggattaccatcgaagggggaatagac

SEQ ID NO: 233836 - DNA, 75 bp, Artificial Sequence
  Synthetic
caatgtgttgaccaagtgtaccatgcatgcaggtgggcgtagaggaatgtttatgccttaccagtgtaacatgaa

SEQ ID NO: 233837 - DNA, 75 bp, Artificial Sequence
  Synthetic
tgctgcacctgcatctactgtggatgcagttattgacagcgtggtggctgacgctcgcgactatgctcgcaggaa

SEQ ID NO: 233838 - DNA, 75 bp, Artificial Sequence
  Synthetic
ccgcaggcgcgcggccacggcggcagcagcggccattgccaacatggcccaaccgcgaagaggcaatgtgtactg

SEQ ID NO: 233839 - DNA, 75 bp, Artificial Sequence
  Synthetic
acaaagcacaagctctaaagtcactcaccaacctgtccacagtatatatacacaagccctaaactgacgtaatgg

SEQ ID NO: 233840 - DNA, 75 bp, Artificial Sequence
  Synthetic
agaagatggcgatgatgggctggtggagtttgtgcgcgagttcgctccaaggcggcgcgtgcagtggcgcgggcg

SEQ ID NO: 233841 - DNA, 75 bp, Artificial Sequence
  Synthetic
gggtagcggtcgttgtcaaccagggggtccaccttctctacggtatgtaaacacatgtccccctcctccacatcc

SEQ ID NO: 233842 - DNA, 75 bp, Artificial Sequence
  Synthetic
tggcacagcttacaactcactggctcctaagggagctcctaatcccagccaatggctagaacaaacgacagagga

SEQ ID NO: 233843 - DNA, 75 bp, Artificial Sequence
  Synthetic
cctaagggagctcctaatcccagccaatggctagaacaaacgacagaggaagaaggcgatccaactaacactaca

SEQ ID NO: 233844 - DNA, 75 bp, Artificial Sequence
  Synthetic
aaggagaaaccatcaccaaagaaggtctgcaaattggaaaagaagtaaccactactggagataaaccaatttatg

SEQ ID NO: 233845 - DNA, 75 bp, Artificial Sequence
  Synthetic
tctgcaaattggaaaagaagtaaccactactggagataaaccaatttatgcagataaaacctttcagccagaacc

SEQ ID NO: 233846 - DNA, 75 bp, Artificial Sequence
  Synthetic
gtgctgcccgtgcctccacggagaggtgtcaagcgagagggcgaggatctgtatcccaccatgcaattgatggtg

SEQ ID NO: 233847 - DNA, 75 bp, Artificial Sequence
  Synthetic
gtgtcaagcgagagggcgaggatctgtatcccaccatgcaattgatggtgcccaagcgccagaagctggaggacg

SEQ ID NO: 233848 - DNA, 75 bp, Artificial Sequence
  Synthetic
gtatcccaccatgcaattgatggtgcccaagcgccagaagctggaggacgtgctggagaaaatgaaagtggatcc

SEQ ID NO: 233849 - DNA, 75 bp, Artificial Sequence
  Synthetic
gatactgacgggacaaatgaaaagtttggcggtagaactcttaaaagtgctactaatatgaaaccatgctatggg

SEQ ID NO: 233850 - DNA, 75 bp, Artificial Sequence
  Synthetic
ttggcggtagaactcttaaaagtgctactaatatgaaaccatgctatgggtcttttgctagacccacaaacaaac

SEQ ID NO: 233851 - DNA, 75 bp, Artificial Sequence
  Synthetic
agacccatcaagcaggtggcgcccggtctgggagtacaaaccgtggacatcaagattcccaccgagtccatggaa

SEQ ID NO: 233852 - DNA, 75 bp, Artificial Sequence
  Synthetic
caagattcccaccgagtccatggaagtccagactgaacctgcaaagcctacagccacctccattgaggtgcagac

SEQ ID NO: 233853 - DNA, 75 bp, Artificial Sequence
  Synthetic
agtagctgcagttgatggaggggaggaaaccgaagaaccagacattgacatggtgttttatgatgatagaggtgc

SEQ ID NO: 233854 - DNA, 75 bp, Artificial Sequence
  Synthetic
gaaaccgaagaaccagacattgacatggtgttttatgatgatagaggtgctacagaagctatgatggctcctgaa

SEQ ID NO: 233855 - DNA, 75 bp, Artificial Sequence
  Synthetic
atttggaaacaccagacacccatgtggtgtacaaaccaggaacctctgatattaattctcatgaaaatttgggtc

SEQ ID NO: 233856 - DNA, 75 bp, Artificial Sequence
  Synthetic
ggtgtacaaaccaggaacctctgatattaattctcatgaaaatttgggtcagcaggctatgccaaacaggcccaa

SEQ ID NO: 233857 - DNA, 75 bp, Artificial Sequence
  Synthetic
cgggttaccgaggcactcgctactaccgcagccggagcaccacttcccgccgtcgcaaaacacctgcaagccgca

SEQ ID NO: 233858 - DNA, 75 bp, Artificial Sequence
  Synthetic
cagcaaactgactcccgccgctctggtgcggagggtgtatcgcgatggccgcgcagagcccctgatgctgccgcg

SEQ ID NO: 233859 - DNA, 75 bp, Artificial Sequence
  Synthetic
ttccctgggtgacagaacacgatattttagcatgtggaatcaggctgtggatagctatgaccctgatgtacgcat

SEQ ID NO: 233860 - DNA, 75 bp, Artificial Sequence
  Synthetic
tttagcatgtggaatcaggctgtggatagctatgaccctgatgtacgcattattgaaaatcatggtatagaggat

SEQ ID NO: 233861 - DNA, 75 bp, Artificial Sequence
  Synthetic
ttgatggaataggaccaggtaaaacataccaaggtattaaggcaaaacaagatgaggataacaaatgggaacaag

SEQ ID NO: 233862 - DNA, 75 bp, Artificial Sequence
  Synthetic
aggatgttggggcgcgggatgcgtcgccacaggcggcggcgcgctatcagcaagaggctggggggtggctttctg

SEQ ID NO: 233863 - DNA, 75 bp, Artificial Sequence
  Synthetic
ataccaaggtattaaggcaaaacaagatgaggataacaaatgggaacaagacaaaacctatgccacctctaatga

SEQ ID NO: 233864 - DNA, 75 bp, Artificial Sequence
  Synthetic
accgctttgattcccatcatcgccgcggcgattggggcagtaccaggcatagcttccgtggcggttcaggcctcg

SEQ ID NO: 233865 - DNA, 75 bp, Artificial Sequence
  Synthetic
atggaaattaatatccaggctaatctttggagaagttttctgtactccaacgtggccttataccttccagatgct

SEQ ID NO: 233866 - DNA, 75 bp, Artificial Sequence
  Synthetic
aatcaggactttacaacaccaaccagatcttccagaagacccagacccttcctcctttgatccaggactctaact

SEQ ID NO: 233867 - DNA, 75 bp, Artificial Sequence
  Synthetic
gttaggagtagttgcgggtgggcttgtgctgatcctttgctacctatacacaccttgctgtgcatatttagtcat

SEQ ID NO: 233868 - DNA, 75 bp, Artificial Sequence
  Synthetic
cctctcgcaactgggccgccttcaggggctggtcattcaccagactcaaaaccaaggagactccctctttgggat

SEQ ID NO: 233869 - DNA, 75 bp, Artificial Sequence
  Synthetic
ttctggttctattccctacctggatggtaccttctaccttaaccacacttttaagaaggtctccatcatgtttga

SEQ ID NO: 233870 - DNA, 75 bp, Artificial Sequence
  Synthetic
gtagcgcttaacttgcttgtctgtgtgtatgtgtcatcaccacgccgccgcagcagcagaggagaaaggaagagg

SEQ ID NO: 233871 - DNA, 75 bp, Artificial Sequence
  Synthetic
ccccagtgggcatacatgcacatcgccggacaggatgcttcggagtacctgagtccgggtctggtgcagttcgcc

SEQ ID NO: 233872 - DNA, 75 bp, Artificial Sequence
  Synthetic
gcgcaatgttttgcattactaccgtcacctccacagcccctactatagccagcaaatcccggcagtctcgacaga

SEQ ID NO: 233873 - DNA, 75 bp, Artificial Sequence
  Synthetic
agcttcaagccatactctggcactgcttacaactcattggcccctaagggcgctcccaatacatctcagtggatt

SEQ ID NO: 233874 - DNA, 75 bp, Artificial Sequence
  Synthetic
acagagtgctggatatggccagcaccttctttgacattcggggcgtgcttgacagaggtcctagcttcaagccat

SEQ ID NO: 233875 - DNA, 75 bp, Artificial Sequence
  Synthetic
actctggcacagcttacaactccctagcacctaagggagcccccaatacatctcagtggcttgccgaagggacaa

SEQ ID NO: 233876 - DNA, 75 bp, Artificial Sequence
  Synthetic
agcacctaagggagcccccaatacatctcagtggcttgccgaagggacaaataatgctgcagagggggaggctga

SEQ ID NO: 233877 - DNA, 75 bp, Artificial Sequence
  Synthetic
gaagaaacaaaaatggctacatacacttttggcaatgctccagtaaaagctgacgctgaaattacaaaggaaggg

SEQ ID NO: 233878 - DNA, 75 bp, Artificial Sequence
  Synthetic
cttttggcaatgctccagtaaaagctgacgctgaaattacaaaggaagggttggcagtaggagtagagctattag

SEQ ID NO: 233879 - DNA, 75 bp, Artificial Sequence
  Synthetic
ccccgttctcagctggtaacgccaccacataagaagcctcttgcttcttacaagcagcagctgcagcaatggcct

SEQ ID NO: 233880 - DNA, 75 bp, Artificial Sequence
  Synthetic
gcaagagctcagggccattgctggagatctgggctgtggaccctatttcctgggaacctttgacaagcgcttccc

SEQ ID NO: 233881 - DNA, 75 bp, Artificial Sequence
  Synthetic
tgcagataaactgtatcaacctgaaccccaagttggagaggaaacttggactgatacagacgggacaaatgaaca

SEQ ID NO: 233882 - DNA, 75 bp, Artificial Sequence
  Synthetic
ccccaagttggagaggaaacttggactgatacagacgggacaaatgaacagtatggaggcagggctttaaagcct

SEQ ID NO: 233883 - DNA, 75 bp, Artificial Sequence
  Synthetic
gatcttttgccaggccaaccaatactaaaggcggtcaggcaaaactaaaaaacccagacgaaaaagacataacca

SEQ ID NO: 233884 - DNA, 75 bp, Artificial Sequence
  Synthetic
taaaggcggtcaggcaaaactaaaaaacccagacgaaaaagacataaccaaaattgaatatgatgttgagatgga

SEQ ID NO: 233885 - DNA, 75 bp, Artificial Sequence
  Synthetic
aatggcagtccaaaaattgtgatgtatgcagaaaatgtaaatctagaaactccagacactcacgtggtgtacaag

SEQ ID NO: 233886 - DNA, 75 bp, Artificial Sequence
  Synthetic
atgcagaaaatgtaaatctagaaactccagacactcacgtggtgtacaagcctggaacttcagatgatagttctc

SEQ ID NO: 233887 - DNA, 75 bp, Artificial Sequence
  Synthetic
gcccaatagacctaactacattggcttcagagacaacttcattggtctcgcatactataacagtactggcaatat

SEQ ID NO: 233888 - DNA, 75 bp, Artificial Sequence
  Synthetic
ttcagagacaacttcattggtctcgcatactataacagtactggcaatatgggagtactggctgggcaggcatca

SEQ ID NO: 233889 - DNA, 75 bp, Artificial Sequence
  Synthetic
aagacagaaacaccgaattgtcataccaactactgcttgactctttgggcgacagaaccaggtactttagcatgt

SEQ ID NO: 233890 - DNA, 75 bp, Artificial Sequence
  Synthetic
ccaactactgcttgactctttgggcgacagaaccaggtactttagcatgtggaaccaggccgtggatagctatga

SEQ ID NO: 233891 - DNA, 75 bp, Artificial Sequence
  Synthetic
gaaggtattcttcgcgatccttccagtactcttctagcggaaacccgtctttgtctgcacggtaagatcctagca

SEQ ID NO: 233892 - DNA, 75 bp, Artificial Sequence
  Synthetic
catggtgtggaagacgaacttcccaattattgctttccactgaatggcgttggttcggaaacagaaagatacaaa

SEQ ID NO: 233893 - DNA, 75 bp, Artificial Sequence
  Synthetic
attattgctttccactgaatggcgttggttcggaaacagaaagatacaaagaaatgcaagctaaaaatgggaatg

SEQ ID NO: 233894 - DNA, 75 bp, Artificial Sequence
  Synthetic
tactggaacaagtgagattgctaaaggcaatccctatgctatggaaattaatcttcaggctaacctttggagaag

SEQ ID NO: 233895 - DNA, 75 bp, Artificial Sequence
  Synthetic
ggcaatccctatgctatggaaattaatcttcaggctaacctttggagaagttttctttattctaatgttgctttg

SEQ ID NO: 233896 - DNA, 75 bp, Artificial Sequence
  Synthetic
cacaggctccctgttcccagagttggaagtctacccgtttcttgtaggcggggttgggcaaagcgaaagtaacat

SEQ ID NO: 233897 - DNA, 75 bp, Artificial Sequence
  Synthetic
ctccagctaatatcactctcccttccaacactaacacttatgactacctgaacgggcgggtggttcccccctccc

SEQ ID NO: 233898 - DNA, 75 bp, Artificial Sequence
  Synthetic
caacactaacacttatgactacctgaacgggcgggtggttcccccctccctagtggatacatatataaacattgg

SEQ ID NO: 233899 - DNA, 75 bp, Artificial Sequence
  Synthetic
gacaatgtcaacccattcaaccaccaccgcaacgctggattgcgctaccggtccatgcttttgggcaatggtcgc

SEQ ID NO: 233900 - DNA, 75 bp, Artificial Sequence
  Synthetic
accgcaacgctggattgcgctaccggtccatgcttttgggcaatggtcgctatgtgcctttccacatccaagtgc

SEQ ID NO: 233901 - DNA, 75 bp, Artificial Sequence
  Synthetic
cctgctgcttctccctggttcctacacctatgagtggaacttcagaaaggacgtgaacatggttttgcagagttc

SEQ ID NO: 233902 - DNA, 75 bp, Artificial Sequence
  Synthetic
acgtgaacatggttttgcagagttcacttggcaacgacctccgggtcgacggtgccagcatcagttttaccagca

SEQ ID NO: 233903 - DNA, 75 bp, Artificial Sequence
  Synthetic
cctctctgcggctaacatgctctaccccattccagcaaatgccaccaacattcccatctccattccctctcgcaa

SEQ ID NO: 233904 - DNA, 75 bp, Artificial Sequence
  Synthetic
cccatccaggtgtaagtttccacatcgtaggtcaggaagagtctttctgtgcgaggatgagagccgatcgggaaa

SEQ ID NO: 233905 - DNA, 75 bp, Artificial Sequence
  Synthetic
tacctctccattagcacagccatcacttccatgcccttctcccaggcagataccaggggcaggctcatgggattc

SEQ ID NO: 233906 - DNA, 75 bp, Artificial Sequence
  Synthetic
gcgcactgtggatggggaagggtacaatgtggctcaatgcaacatgaccaaggactggttcctggttcagatgct

SEQ ID NO: 233907 - DNA, 75 bp, Artificial Sequence
  Synthetic
ggtatgggtgtgtggcaacagtgtttggaagagcagaacctgaaagagctgaacaagctcttgcagagatccctc

SEQ ID NO: 233908 - DNA, 75 bp, Artificial Sequence
  Synthetic
aatgtggctcaatgcaacatgaccaaggactggttcctggttcagatgctggccaactacaacattggctaccag

SEQ ID NO: 233909 - DNA, 75 bp, Artificial Sequence
  Synthetic
aggatcgcatgtattccttctttagaaacttccagcccatgagcagacaggtggttgatgaggttaactacactg

SEQ ID NO: 233910 - DNA, 75 bp, Artificial Sequence
  Synthetic
ccagcacaacaattctggttttgtgggttacatggctcctacaatgcgccagggacaagcttatccagctaacta

SEQ ID NO: 233911 - DNA, 75 bp, Artificial Sequence
  Synthetic
ggttacatggctcctacaatgcgccagggacaagcttatccagctaactacccctacccacttattggaaccact

SEQ ID NO: 233912 - DNA, 75 bp, Artificial Sequence
  Synthetic
tttgaggtggatcccatggatgagcccaccctgctttatcttcttttcgaagttttcgacgtggtcagagtgcac

SEQ ID NO: 233913 - DNA, 75 bp, Artificial Sequence
  Synthetic
ttaaccaccccaccacccagtcccgccaccaccacctctaccctcgatgatgaggaggaggtcgacgcaccccag

SEQ ID NO: 233914 - DNA, 75 bp, Artificial Sequence
  Synthetic
taacttgaatggtagatttatatttttacttgcaatttttttgtaggtcctgtgtctgatgatgagtcaccttct

SEQ ID NO: 233915 - DNA, 75 bp, Artificial Sequence
  Synthetic
ccgtcatttccaagaccccgccagccgacttcaccagtttacgggagcgtagtcccttttttttttttgtttttt

SEQ ID NO: 233916 - DNA, 75 bp, Artificial Sequence
  Synthetic
ccagaggagatgcgagcatctcgatttaacgcgggtcgcgagctgcgccacggtctggatcgaagacggctgctg

SEQ ID NO: 233917 - DNA, 75 bp, Artificial Sequence
  Synthetic
gtgccaatatgcaaatgaggtaatttaaaaaagtgcgcgctgtgtggtgattggctgtggggtgaacggctaaaa

SEQ ID NO: 233918 - DNA, 75 bp, Artificial Sequence
  Synthetic
ccttgcttcttgcaagcagtagctgcagcatggcctgcgggtccggcaacggatccagtgagcaagagctcaggg

SEQ ID NO: 233919 - DNA, 75 bp, Artificial Sequence
  Synthetic
cagcatggcctgcgggtccggcaacggatccagtgagcaagagctcagggccatcgctagagatttgggctgcgg

SEQ ID NO: 233920 - DNA, 75 bp, Artificial Sequence
  Synthetic
gccatgaactgctcgatttcttcctcctgaagatctccgcgacccgctctctcgacggtggccgcgaggtcattg

SEQ ID NO: 233921 - DNA, 75 bp, Artificial Sequence
  Synthetic
aagcgattcccggggttcatggctcccgacaagctcgcctgtgccattgtcaatacggccggtcgcgagacgggg

SEQ ID NO: 233922 - DNA, 75 bp, Artificial Sequence
  Synthetic
ccgacaagctcgcctgtgccattgtcaatacggccggtcgcgagacggggggtgaacattggctggcttttggtt

SEQ ID NO: 233923 - DNA, 75 bp, Artificial Sequence
  Synthetic
gtcttgccacaactttctggtcagttgcagggcgccaagcaggtcaggagcagagatcttgaaatcacagttggg

SEQ ID NO: 233924 - DNA, 75 bp, Artificial Sequence
  Synthetic
cctttttgatccttttggcttctcggacgagcgccttaagcaaatctaccagttcgaatatgaggggctcctgcg

SEQ ID NO: 233925 - DNA, 75 bp, Artificial Sequence
  Synthetic
cctacgagctcaacctgttctcacctcggatgccccccaagcggcagccaaacggcacctgcgagcccaaccctc

SEQ ID NO: 233926 - DNA, 75 bp, Artificial Sequence
  Synthetic
gaggaggtggacagcctggaggaagacagtttggaggaggaagacgaggaggcagaggaggtggaagaagcaacc

SEQ ID NO: 233927 - DNA, 75 bp, Artificial Sequence
  Synthetic
ggcccgaccgccccatggacggaaaccccaccatgaagttgctaactggggtacccaacagcatgcttcaatcac

SEQ ID NO: 233928 - DNA, 75 bp, Artificial Sequence
  Synthetic
atatagcttccttggaagaggttccaaagatcttcgaaggtctgggtagtgatgagactcgggccgcaaatgctc

SEQ ID NO: 233929 - DNA, 75 bp, Artificial Sequence
  Synthetic
caaccaggaggcgctctaccgcttcctcaacacccactcatcttactttcgttctcaccgcgcgcgcatcgaaaa

SEQ ID NO: 233930 - DNA, 75 bp, Artificial Sequence
  Synthetic
gatgagactcgggccgcaaatgctctgcaacagggagagaatggcatggatgaacaccacagcgctctggtggaa

SEQ ID NO: 233931 - DNA, 75 bp, Artificial Sequence
  Synthetic
gaagaggaaaacaatactactacttacacttttggcaatgctcccgtaaaagctgaagctgaaattacaaaagaa

SEQ ID NO: 233932 - DNA, 75 bp, Artificial Sequence
  Synthetic
ctccaacattgttagttttgaattagtctgcaaaataaaagaaacaagcgtcatatcatagtagcctgtcgaaca

SEQ ID NO: 233933 - DNA, 75 bp, Artificial Sequence
  Synthetic
cagtgctcaagcgcactatccaggtcacccattttgcataccccgctgttaacctgccccccaaagtcatgagcg

SEQ ID NO: 233934 - DNA, 75 bp, Artificial Sequence
  Synthetic
gaagtcgaaggggttctggcgggaatcagcgtgacccgcgggcagggatacgttgcggaactggaacctgttctg

SEQ ID NO: 233935 - DNA, 75 bp, Artificial Sequence
  Synthetic
cagaacatgcaggatccagacgcctcggacgagggcaagccggtggttagtgacgagcagctatctcgctggctg

SEQ ID NO: 233936 - DNA, 75 bp, Artificial Sequence
  Synthetic
tgtcttgccacagctttctggtcagttgcagagcgccgagcaggtcaggagcagagatcttgaaatcacagttgg

SEQ ID NO: 233937 - DNA, 75 bp, Artificial Sequence
  Synthetic
gcagagatcttgaaatcacagttggggccagcattctgggcacgggagttgcggtacactgggttgcagcactgg

SEQ ID NO: 233938 - DNA, 75 bp, Artificial Sequence
  Synthetic
gatggtagtcacatccaagtcttcagcattggccattccaaagggggtcatcttacaggtctgcctgcccatcac

SEQ ID NO: 233939 - DNA, 75 bp, Artificial Sequence
  Synthetic
catcccacaggacttgctggaaaattgattagtagcacagttggcatcattcacacagcagcgggcatcgttgtt

SEQ ID NO: 233940 - DNA, 75 bp, Artificial Sequence
  Synthetic
atggtgtaagcacagttggccatgactgaccagttaactgtttggtgaccagggcgcacgagctcggtgtattta

SEQ ID NO: 233941 - DNA, 75 bp, Artificial Sequence
  Synthetic
ggccagctggaccacattcctgccccagcggttctgggtgatcttggctcggtctgggttctccttcatcgcgcg

SEQ ID NO: 233942 - DNA, 75 bp, Artificial Sequence
  Synthetic
tcaccgctactgaccatcgcctctcttacgaacttggcccccaacgacaaaaatttacctgcatggtgggaatca

SEQ ID NO: 233943 - DNA, 75 bp, Artificial Sequence
  Synthetic
accccgaaactaagttgattatgccaggagtctacacttatgaggcattccatcctgacattgtattgctgcctg

SEQ ID NO: 233944 - DNA, 75 bp, Artificial Sequence
  Synthetic
cgagaccctgcgcaagctagaggagaacctgcactacaccttcagacatggcttcgtgcggcaggcatgcaagat

SEQ ID NO: 233945 - DNA, 75 bp, Artificial Sequence
  Synthetic
tgaagggggtaatattcctgcccttttggatgtcactgcctatgaggaaagcaaaaaggataccactactgaaac

SEQ ID NO: 233946 - DNA, 75 bp, Artificial Sequence
  Synthetic
cttctcttgccatccttctcagtgatgcgcacgggtgggtagctgaagcccacggccaccagctccgcctgttct

SEQ ID NO: 233947 - DNA, 75 bp, Artificial Sequence
  Synthetic
tggaacggtgccaacatgcaaatgagcttttgaaaatggagggcggaaggggattggctagtgggttcaacggtc

SEQ ID NO: 233948 - DNA, 75 bp, Artificial Sequence
  Synthetic
tttatttccccaaatggcttcacacaaagcccagacggagttcttactttaaaatgtttaaccccactaacaacc

SEQ ID NO: 233949 - DNA, 75 bp, Artificial Sequence
  Synthetic
gattctatgctgctagctgccgatgaaggattggacataaaccctcctcctgagacccttgttaccccaggggtg

SEQ ID NO: 233950 - DNA, 75 bp, Artificial Sequence
  Synthetic
cagaggtggaggcgactgcgatgggctgcggtccggcctgggaggcggatggctggcagagcctcttccgcgttc

SEQ ID NO: 233951 - DNA, 75 bp, Artificial Sequence
  Synthetic
ccattgtgttctcctaggcagagaaacaacagacatggagactcagccatcgctgccaacaccgctgcaagcgcc

SEQ ID NO: 233952 - DNA, 75 bp, Artificial Sequence
  Synthetic
aaagctgccagcgatgtttttaagttggactgtccggagctgcctggacatggctgtaagtcttgtgaatttcac

SEQ ID NO: 233953 - DNA, 75 bp, Artificial Sequence
  Synthetic
gtcgacgcaccccaggagatgcaggttatggaggatgagaaagcggaagagattgaggcagatgtcgagcaggac

SEQ ID NO: 233954 - DNA, 75 bp, Artificial Sequence
  Synthetic
gagcagcaagcagatggcgatcaccaggaggctgggctcggggatcatgtcgccgaatacctcaccgggcttggc

SEQ ID NO: 233955 - DNA, 75 bp, Artificial Sequence
  Synthetic
gccgaggaagcaagaagctgaaggtgcagctgtcgcccccagaggatatggaggaagactgggacagtcaggcag

SEQ ID NO: 233956 - DNA, 75 bp, Artificial Sequence
  Synthetic
tgcttgtgatttttataggtcctgtgtctgatgctgatgaatcgccttctcctgattcaactacctcacctcctg

SEQ ID NO: 233957 - DNA, 75 bp, Artificial Sequence
  Synthetic
tgggtggggacttggatatataagtaggagcagatctgtgtggttagctcacagcaacctgctgccatccatgga

SEQ ID NO: 233958 - DNA, 75 bp, Artificial Sequence
  Synthetic
cagcaaaacggcacctgcgagcccaaccctcgcctcaacttctatccggcctttgctgtcccagaagtgcttgct

SEQ ID NO: 233959 - DNA, 75 bp, Artificial Sequence
  Synthetic
acttggaagagaggcgcaagcttatgatggctgtagtgctagtcactgtggagctggagtgtctccgccgctttt

SEQ ID NO: 233960 - DNA, 75 bp, Artificial Sequence
  Synthetic
aggtcagtgtaagaggctgtagtttttatgcatgctggattgcactatcaggcaggaccaaaagtcagttgtctg

SEQ ID NO: 233961 - DNA, 75 bp, Artificial Sequence
  Synthetic
aggggaggcccgccgcgactacatccgcgactgtgtctacctctacctctgccatacctggcagactggcatggg

SEQ ID NO: 233962 - DNA, 75 bp, Artificial Sequence
  Synthetic
gtggacaggttttgacgagcgcaccgtcgcctcagacctggcagacatcatcttccccgagcgtctcagggttac

SEQ ID NO: 233963 - DNA, 75 bp, Artificial Sequence
  Synthetic
tgtgcaactatggaagatcctgagatatgatgagaccaaatcgagggtgcgcgcatgcgaatgcgggggcaagca

SEQ ID NO: 233964 - DNA, 75 bp, Artificial Sequence
  Synthetic
ggtcatgtttatgagcagacagtatgacctatggcctcccagaaaggagaacattgtggctttctccattgctta

SEQ ID NO: 233965 - DNA, 75 bp, Artificial Sequence
  Synthetic
ggctctgaatgaaatctaagatcttttttttttctcttacagtatggtgaacatcaatcatgatccctagaaatt

SEQ ID NO: 233966 - DNA, 75 bp, Artificial Sequence
  Synthetic
agaaggatgttggggcgagggatgcgccgccacagacgaaggcgcgctatcagcagacgattagggggtggcttt

SEQ ID NO: 233967 - DNA, 75 bp, Artificial Sequence
  Synthetic
gctatcatgtgtgtgtgcatacacttgcttatagccattcgcccaaaaaacaaagagaaggagaaaatgccctga

SEQ ID NO: 233968 - DNA, 75 bp, Artificial Sequence
  Synthetic
tgcttatagccattcgcccaaaaaacaaagagaaggagaaaatgccctgattataaatttctatttacagacaat

SEQ ID NO: 233969 - DNA, 75 bp, Artificial Sequence
  Synthetic
gagctcaacacaaggttccctcaggatgtcccagcgccgaggaagcaagaagttgaaggtgcagctgccgccccc

SEQ ID NO: 233970 - DNA, 75 bp, Artificial Sequence
  Synthetic
actactattatggttattcatggacagacacttattaatgttcaccctggaactaatcataccttagtggttcct

SEQ ID NO: 233971 - DNA, 75 bp, Artificial Sequence
  Synthetic
agacacttattaatgttcaccctggaactaatcataccttagtggttcctaaaaactattcaaatattgaatggc

SEQ ID NO: 233972 - DNA, 75 bp, Artificial Sequence
  Synthetic
tgaaccatgtgaacattacaatttatttatttgcaatcataatttaactttaattaatgttagtacattacacaa

SEQ ID NO: 233973 - DNA, 75 bp, Artificial Sequence
  Synthetic
tttatttgcaatcataatttaactttaattaatgttagtacattacacaaaggctattattatagatatgacaat

SEQ ID NO: 233974 - DNA, 75 bp, Artificial Sequence
  Synthetic
gcagcacggctacaatctccgctccgggtcggggggcccagcggcgtcccaacagtagatgggacgagaccgggc

SEQ ID NO: 233975 - DNA, 75 bp, Artificial Sequence
  Synthetic
tagtacgtgtaaataccaagggacattctataaccaaagctttctctaatataagtacaatacaaaattttaaag

SEQ ID NO: 233976 - DNA, 75 bp, Artificial Sequence
  Synthetic
ttctataaccaaagctttctctaatataagtacaatacaaaattttaaagcagctttactatttaaaacagaaaa

SEQ ID NO: 233977 - DNA, 75 bp, Artificial Sequence
  Synthetic
actcccactgaaaaaaatattcctaattcaatatctggaataattgcactgttaacagtgggcatagtaatcata

SEQ ID NO: 233978 - DNA, 75 bp, Artificial Sequence
  Synthetic
ggatatgtaggcaataatattaccctattaggtccatcaacaggaacaatccctacttggtacaaaatatatgaa

SEQ ID NO: 233979 - DNA, 75 bp, Artificial Sequence
  Synthetic
tattaggtccatcaacaggaacaatccctacttggtacaaaatatatgaaagagggtggtggattagaccatgcg

SEQ ID NO: 233980 - DNA, 75 bp, Artificial Sequence
  Synthetic
agtgcagcaggaggaggactgaggatcacagcgaacgagccagcgcagacccgagagctgagaaacaggatcttt

SEQ ID NO: 233981 - DNA, 75 bp, Artificial Sequence
  Synthetic
cacaagagacttaaccatcactaatcttaatacaaacgataatggctactatttttgcaataactacggaggtgg

SEQ ID NO: 233982 - DNA, 75 bp, Artificial Sequence
  Synthetic
cttaatacaaacgataatggctactatttttgcaataactacggaggtggtaaaaagtcttacacagttgaagta

SEQ ID NO: 233983 - DNA, 75 bp, Artificial Sequence
  Synthetic
caagctctaaagtcactctccaacctctccacaatatatatacacaagccctaaactgacgtaatgggagtaaag

SEQ ID NO: 233984 - DNA, 75 bp, Artificial Sequence
  Synthetic
aaattaccactttctccagcagcatgactagaactacctcgcatgaggctgcttatgctagagcaatgcttcaaa

SEQ ID NO: 233985 - DNA, 75 bp, Artificial Sequence
  Synthetic
gactagaactacctcgcatgaggctgcttatgctagagcaatgcttcaaaaaattaacacaacaaattctacaat

SEQ ID NO: 233986 - DNA, 75 bp, Artificial Sequence
  Synthetic
aaatcaacgattggcattattgtagccgtagcaatcggaatgataatcataataatttgtatgatcgtctatgct

SEQ ID NO: 233987 - DNA, 75 bp, Artificial Sequence
  Synthetic
ccgtagcaatcggaatgataatcataataatttgtatgatcgtctatgcttgctgctatagaaagtttcaacatg

SEQ ID NO: 233988 - DNA, 75 bp, Artificial Sequence
  Synthetic
gggtgaaattatatgcattttggactggatcttgaggttggcaatgttgccgcctagatcccgtctcgggttcat

SEQ ID NO: 233989 - DNA, 75 bp, Artificial Sequence
  Synthetic
ctttgatatttaatttttttatagaatcatgagaggagtaggtattctagttctttcaactttaatttgctcagc

SEQ ID NO: 233990 - DNA, 75 bp, Artificial Sequence
  Synthetic
actactttaaatgaaactgaaagccattcaactacctcacatatccctacaaatagcaccataatcaaatcaaac

SEQ ID NO: 233991 - DNA, 75 bp, Artificial Sequence
  Synthetic
attcaactacctcacatatccctacaaatagcaccataatcaaatcaaacactcactccaacagtgctgtgcaac

SEQ ID NO: 233992 - DNA, 75 bp, Artificial Sequence
  Synthetic
acgtcccatctatcgatcaataatcagcaaaccccacacagctctaaatgaaatttaacctttcttttcacagta

SEQ ID NO: 233993 - DNA, 75 bp, Artificial Sequence
  Synthetic
gaaattttttcttcaccatactcatctgcctactcaatatctgcgctacacttgctgcggtcactagcgtctcac

SEQ ID NO: 233994 - DNA, 75 bp, Artificial Sequence
  Synthetic
cttgctgcggtcactagcgtctcaccagactgcataggaccattcgccacctacttgctttttgcattaatcacc

SEQ ID NO: 233995 - DNA, 75 bp, Artificial Sequence
  Synthetic
tggctatgattgatgtctggtggcgcggctgagttagctcgactgcgacatctagaccactgccgccgctttcgc

SEQ ID NO: 233996 - DNA, 75 bp, Artificial Sequence
  Synthetic
tgtatatgtgtgagcagcacagtctgtctggttattaattttttccaactcatagactggatttttgtacgcgtt

SEQ ID NO: 233997 - DNA, 75 bp, Artificial Sequence
  Synthetic
ctgctactaccttgtgtcactatagccaccacacctaccctaaaccccaatcttaaaaaatgtaaatttcaagaa

SEQ ID NO: 233998 - DNA, 75 bp, Artificial Sequence
  Synthetic
cgcgaccagggaactacaacagtctccatctactgcatctgtaaccaccccggattgcatgaaagcctttgctgt

SEQ ID NO: 233999 - DNA, 75 bp, Artificial Sequence
  Synthetic
ccatctactgcatctgtaaccaccccggattgcatgaaagcctttgctgtcttatttgtgctgagtttaataaaa

SEQ ID NO: 234000 - DNA, 75 bp, Artificial Sequence
  Synthetic
atgaaacaattgattttccaccctattggataacaatcattggaatccttaatgtagtatgttgcaccatatttg

SEQ ID NO: 234001 - DNA, 75 bp, Artificial Sequence
  Synthetic
ttggataacaatcattggaatccttaatgtagtatgttgcaccatatttgcattccttgtatatcccatgtttga

SEQ ID NO: 234002 - DNA, 75 bp, Artificial Sequence
  Synthetic
accactagcactagtagaatatgaaaatgaaccacagtcctcgctgctccctgctattagttacttcaacctaac

SEQ ID NO: 234003 - DNA, 75 bp, Artificial Sequence
  Synthetic
cccgatactaacaacctcggagctcagctgcaacaccgcttctccagaagcctcctttctgccaatactactact

SEQ ID NO: 234004 - DNA, 75 bp, Artificial Sequence
  Synthetic
ttgaaaagttattggacgacagtccaggactttttgaagctcttaacttgggccaccaggctcattttaaggaga

SEQ ID NO: 234005 - DNA, 75 bp, Artificial Sequence
  Synthetic
cacatccactgctgccgaggagctgctcgacatggacggccgtgcctcagaacagcgacttgcccaactgcgcat

SEQ ID NO: 234006 - DNA, 75 bp, Artificial Sequence
  Synthetic
ctcgacatggacggccgtgcctcagaacagcgacttgcccaactgcgcatccgtcagcagcaggaacgtgccgcc

SEQ ID NO: 234007 - DNA, 75 bp, Artificial Sequence
  Synthetic
ggattcgggggagtatgcatccgcaccgcaggaggcgcagacggtttcgcactccacgagccaggtcagatccgg

SEQ ID NO: 234008 - DNA, 75 bp, Artificial Sequence
  Synthetic
ttcaccagtgcaaaaaaggaatcttctgtttggtgaatcaagccaagatctcatacgagatcactgctactgacc

SEQ ID NO: 234009 - DNA, 75 bp, Artificial Sequence
  Synthetic
tgttggtttaagaaatgggggtcgtactagtcgcgcttgctttactttcgcttttgggtctgggctctactacgc

SEQ ID NO: 234010 - DNA, 75 bp, Artificial Sequence
  Synthetic
ataggctctcctacgagcttggtccgcagcgtcagaaatttacctgcatggtgggaatcaaccccatagtcatca

SEQ ID NO: 234011 - DNA, 75 bp, Artificial Sequence
  Synthetic
cttttgggtctgggctctactacgctagcgaatcagcctttactattagatcctgataatgttgatccatgccta

SEQ ID NO: 234012 - DNA, 75 bp, Artificial Sequence
  Synthetic
ttacttttgcacctgaaacaagtcgctactgtggagttcttattaggtgcggacgggaatgcaggcccattgaga

SEQ ID NO: 234013 - DNA, 75 bp, Artificial Sequence
  Synthetic
ctactgtggagttcttattaggtgcggacgggaatgcaggcccattgagattacacacaataacaaaacttggaa

SEQ ID NO: 234014 - DNA, 75 bp, Artificial Sequence
  Synthetic
actgagtgcatctacaccctactgaaaaccctctgcggccttcgagacctcctacccatgaactaatcaatgccc

SEQ ID NO: 234015 - DNA, 75 bp, Artificial Sequence
  Synthetic
tcatgttcatgagcagacagtataacctatggcctcccagcgaggaaaacattgtggcattctccattgcttatt

SEQ ID NO: 234016 - DNA, 75 bp, Artificial Sequence
  Synthetic
tatcttgtgtgcgtgcttgcatttgcttattgctattcgctccagaaacaatgaggaaaaagaaaaaatgcctta

SEQ ID NO: 234017 - DNA, 75 bp, Artificial Sequence
  Synthetic
cttattgctattcgctccagaaacaatgaggaaaaagaaaaaatgccttaacctttttcctcataccttttttac

SEQ ID NO: 234018 - DNA, 75 bp, Artificial Sequence
  Synthetic
ctttgccaaacctactactgtgaaaggcggtcaggcaaaaccaaaaacaacggagcagccaaatcagaaagtcga

SEQ ID NO: 234019 - DNA, 75 bp, Artificial Sequence
  Synthetic
ttactattattaccggctttactactgccgtgcatggaatgaaaaatgttaaactaactgtctatactaacacca

SEQ ID NO: 234020 - DNA, 75 bp, Artificial Sequence
  Synthetic
atgtgtttcccctcttactaccactagtggagctctggacattaaagtaggagggggacttaaggtggatagcac

SEQ ID NO: 234021 - DNA, 75 bp, Artificial Sequence
  Synthetic
taagtcctaaaattgtcatgtatgcagaaaatgtaaatttggaaactccagacactcatgtagtgtacaaacctg

SEQ ID NO: 234022 - DNA, 75 bp, Artificial Sequence
  Synthetic
tgccgtgcatggaatgaaaaatgttaaactaactgtctatactaacaccaaccaaacactggaggggcctaaagg

SEQ ID NO: 234023 - DNA, 75 bp, Artificial Sequence
  Synthetic
agtggagctctggacattaaagtaggagggggacttaaggtggatagcactgatggttccttggaagaaaacata

SEQ ID NO: 234024 - DNA, 75 bp, Artificial Sequence
  Synthetic
aattttggcgatctgtctgtatggttgtgcgatggaacaaccattaataagaccattgatttaattaaatacagt

SEQ ID NO: 234025 - DNA, 75 bp, Artificial Sequence
  Synthetic
tgtgcgatggaacaaccattaataagaccattgatttaattaaatacagttgcgattcagatttaacactaatca

SEQ ID NO: 234026 - DNA, 75 bp, Artificial Sequence
  Synthetic
agcaaactatgtgtcaaattaggagagggacttacctttgactcttccaacgccattacaataaaaaataacact

SEQ ID NO: 234027 - DNA, 75 bp, Artificial Sequence
  Synthetic
ctattatggaactgacataaatgatgtaaacttctacaacatttatgtatcagacccaacaaccattccaactaa

SEQ ID NO: 234028 - DNA, 75 bp, Artificial Sequence
  Synthetic
gtaaacttctacaacatttatgtatcagacccaacaaccattccaactaaaccctccacacacactaaaacttac

SEQ ID NO: 234029 - DNA, 75 bp, Artificial Sequence
  Synthetic
agatgcactagactgcaagctaactctagtccttgtaaaaaacgggggactagtaaatgcatatgtgtcattaat

SEQ ID NO: 234030 - DNA, 75 bp, Artificial Sequence
  Synthetic
tcaatgagttacaatttctaaaagctaacataacatacaattctaccatctcgcctactattcccaatgaaacaa

SEQ ID NO: 234031 - DNA, 75 bp, Artificial Sequence
  Synthetic
taacataacatacaattctaccatctcgcctactattcccaatgaaacaaatattcctaattcaatgattggaat

SEQ ID NO: 234032 - DNA, 75 bp, Artificial Sequence
  Synthetic
ttgtttactaaaaagactgcgtcactcagcgtagaacttgcatttgatagctccggtcaaatccttactagcctg

SEQ ID NO: 234033 - DNA, 75 bp, Artificial Sequence
  Synthetic
gttccaacaaccagttacaaatcaatagtttcaaatggagacaatgcacctaattggaaggaacctgaagtaaat

SEQ ID NO: 234034 - DNA, 75 bp, Artificial Sequence
  Synthetic
gcgatcataataatatgtatgatcgtttatgcttgctgctataaaaaacttcaagaagaaaaattagatccacta

SEQ ID NO: 234035 - DNA, 75 bp, Artificial Sequence
  Synthetic
tcttctcttaaaactaaccttaactttaaacataaccaagacatggccgctgggactattaatgccaaaggattc

SEQ ID NO: 234036 - DNA, 75 bp, Artificial Sequence
  Synthetic
tttatgcttgctgctataaaaaacttcaagaagaaaaattagatccactactaagctttgatttttaaatttttt

SEQ ID NO: 234037 - DNA, 75 bp, Artificial Sequence
  Synthetic
tttagcttttatttccatttttggtttctcacttggaggtaaaatacataagaatgttaccgtgttagagggcgc

SEQ ID NO: 234038 - DNA, 75 bp, Artificial Sequence
  Synthetic
ttctcacttggaggtaaaatacataagaatgttaccgtgttagagggcgctccaaatataacactccaaggagtt

SEQ ID NO: 234039 - DNA, 75 bp, Artificial Sequence
  Synthetic
gctgctggtatggcttatgcaatgaactttacgtggcttcttgacgcggcggatgccccagaaaacacccaaacc

SEQ ID NO: 234040 - DNA, 75 bp, Artificial Sequence
  Synthetic
gcactattaacataacttgggaaactgtaataaatggaagcagaccaaatgtatgtgctttaaatttaacaaaat

SEQ ID NO: 234041 - DNA, 75 bp, Artificial Sequence
  Synthetic
tgtaataaatggaagcagaccaaatgtatgtgctttaaatttaacaaaattcaaatgtgagggttttgatcttac

SEQ ID NO: 234042 - DNA, 75 bp, Artificial Sequence
  Synthetic
tttggattccatttgagatagtcatggatttagattctacattccacacagtttcagagctagctaatcttggat

SEQ ID NO: 234043 - DNA, 75 bp, Artificial Sequence
  Synthetic
tccaaaaattattttggtgaaagtataactgtcttaacttctggttatcaaaaaaattatataacccacaattat

SEQ ID NO: 234044 - DNA, 75 bp, Artificial Sequence
  Synthetic
taactgtcttaacttctggttatcaaaaaaattatataacccacaattatgcagtttatcatgttattgttatat

SEQ ID NO: 234045 - DNA, 75 bp, Artificial Sequence
  Synthetic
cacacaagtaactacagctcattctaacacttacacccatgtaaaggtattaaaagaaacatacagtactaccaa

SEQ ID NO: 234046 - DNA, 75 bp, Artificial Sequence
  Synthetic
aacacttacacccatgtaaaggtattaaaagaaacatacagtactaccaatgtgcagactactataatcacaaaa

SEQ ID NO: 234047 - DNA, 75 bp, Artificial Sequence
  Synthetic
cctgttcccagagttggaagtccacccgcttcttgtaggcggggttgggcaaagcgaaagtaacatcattgaaga

SEQ ID NO: 234048 - DNA, 75 bp, Artificial Sequence
  Synthetic
ctttacacaaatcagcactttcatgcgccccaacgctcaccactttgcatgctactaaaccttttactaatatat

SEQ ID NO: 234049 - DNA, 75 bp, Artificial Sequence
  Synthetic
aaaaaaaaaatacaatggactctgacactcctggtcctgtgactatgttttcttagagatggaagacatcaattt

SEQ ID NO: 234050 - DNA, 75 bp, Artificial Sequence
  Synthetic
tctctcggtaccatggacagcgctggttaatcatgcagccctgaataactttcctgaaccagatggctagcactg

SEQ ID NO: 234051 - DNA, 75 bp, Artificial Sequence
  Synthetic
cgccccaacgctcaccactttgcatgctactaaaccttttactaatatatctactcccttaaaacaatttgatcg

SEQ ID NO: 234052 - DNA, 75 bp, Artificial Sequence
  Synthetic
cttattgtcataggaataattatcattgcaatcttgctttactacatattctgtcgccaaatccccaatgctcaa

SEQ ID NO: 234053 - DNA, 75 bp, Artificial Sequence
  Synthetic
ttgcaatcttgctttactacatattctgtcgccaaatccccaatgctcaaagacgacctatatatagacctatca

SEQ ID NO: 234054 - DNA, 75 bp, Artificial Sequence
  Synthetic
ggagggaggcttaagaaatcttctgttctcttttacagtatggtgatcaacaatcatgatccctagaaatttcct

SEQ ID NO: 234055 - DNA, 75 bp, Artificial Sequence
  Synthetic
aaacattcaaaacctctgggatgcaaatgcaataggttaccgcgctgcgctccaacattgttagttttgaattag

SEQ ID NO: 234056 - DNA, 75 bp, Artificial Sequence
  Synthetic
ttctcttttacagtatggtgatcaacaatcatgatccctagaaatttcctcttcaccatactcatctgtgctttt

SEQ ID NO: 234057 - DNA, 75 bp, Artificial Sequence
  Synthetic
ttgccaatgtcactccagactgtataggagcatttgcctcctatgtgcttttcgcatttattacctgcatctgtg

SEQ ID NO: 234058 - DNA, 75 bp, Artificial Sequence
  Synthetic
ttcgcatttattacctgcatctgtgtttgtagcatagtttgcctggttattaatttctttcaacttgtagactgg

SEQ ID NO: 234059 - DNA, 75 bp, Artificial Sequence
  Synthetic
ggcatcaccctgaataccgcaaccaaaatgttgcagcaattcttaggctcatttaaaaccatgcaaactctgcta

SEQ ID NO: 234060 - DNA, 75 bp, Artificial Sequence
  Synthetic
aaatttcaagaaccatggaaattccttgaatgctatcatgaaacatctgatttccccacatactggattacaatc

SEQ ID NO: 234061 - DNA, 75 bp, Artificial Sequence
  Synthetic
ccacttatttgattttggatggaatgccctcaatgcactcacttacccacaagaaccagaggaacatataccact

SEQ ID NO: 234062 - DNA, 75 bp, Artificial Sequence
  Synthetic
aagaaccagaggaacatataccactacaaaacatgcaaccactagcactagtagaatatgaaaatgaaccacagc

SEQ ID NO: 234063 - DNA, 75 bp, Artificial Sequence
  Synthetic
acaaaacatgcaaccactagcactagtagaatatgaaaatgaaccacagcccccgatgctccctgctattagtta

SEQ ID NO: 234064 - DNA, 75 bp, Artificial Sequence
  Synthetic
tcctcgttccgtgagtgacgtcagttcctctttcccacgtgtcgtcactgccgggtatcttgcaacgtcacctcc

SEQ ID NO: 234065 - DNA, 75 bp, Artificial Sequence
  Synthetic
tgacccactcgccgcctccgctgctgaggaactacttgatatggatggccgtgcctccgaacagcgactcgccca

SEQ ID NO: 234066 - DNA, 75 bp, Artificial Sequence
  Synthetic
gtgcctccgaacagcgactcgcccacctacgcattcgccagcagcaggaacgtgcagtcaaggagctcagggatg

SEQ ID NO: 234067 - DNA, 75 bp, Artificial Sequence
  Synthetic
aggcatattctgcttggtaaaacaagccaagatctcatacgagatcaccgctaacgaccaccgcctctcatatga

SEQ ID NO: 234068 - DNA, 75 bp, Artificial Sequence
  Synthetic
gtggtaattggctgtggggttaacggctaaaaggggcggcgcggccgtgggaaaatgacgttttttgggggtgga

SEQ ID NO: 234069 - DNA, 75 bp, Artificial Sequence
  Synthetic
ctaacgaccaccgcctctcatatgagcttggcctgcagcgtcagaaattcacctgcatggttggaatcaatccca

SEQ ID NO: 234070 - DNA, 75 bp, Artificial Sequence
  Synthetic
gaaaatgacgttttttgggggtggagtgtttttgcaagttgtcgcggtaaatgtgacgtaaacaaaggctttttt

SEQ ID NO: 234071 - DNA, 75 bp, Artificial Sequence
  Synthetic
ttcaaaccctattctggtacggcttacaactctctggctcctaaaggcgctccaaatacatctcagtggattgca

SEQ ID NO: 234072 - DNA, 75 bp, Artificial Sequence
  Synthetic
taccaagggttgtatccattgttcctgtgaatccaccgagtgcatctacaccctgctgaagaccctctgcggcct

SEQ ID NO: 234073 - DNA, 75 bp, Artificial Sequence
  Synthetic
tcgagacctactacccatgaactaatcaataaccccctacccctttccatcaaacccaaaaaacaattaataaaa

SEQ ID NO: 234074 - DNA, 75 bp, Artificial Sequence
  Synthetic
tgaggaagtggttttctgaataatgcggtatttatggcagggtggagtatttgttcagggccaggtagactttga

SEQ ID NO: 234075 - DNA, 75 bp, Artificial Sequence
  Synthetic
ttgttcagggccaggtagactttgacccattacgtggaggtttcgattaccgcggaggtttcgattaccgtgttt

SEQ ID NO: 234076 - DNA, 75 bp, Artificial Sequence
  Synthetic
tgaaagtcttctgtttttacgtaggtgtcagctgatcgctacggtatttatacctcagggtttgtgtcaagaggc

SEQ ID NO: 234077 - DNA, 75 bp, Artificial Sequence
  Synthetic
atattaaaaaaatgagacacttgcgatttctgcctcaggaaataatttctgctgagactggaaacgaaatactgg

SEQ ID NO: 234078 - DNA, 75 bp, Artificial Sequence
  Synthetic
cacaacacccatttataaaccctggcttcatttcccctaatgggtttacacaaagtccagacggagctcttacac

SEQ ID NO: 234079 - DNA, 75 bp, Artificial Sequence
  Synthetic
tacccctatgaagacgaaagcagctcacaacacccatttataaaccctggcttcatttcccctaatgggtttaca

SEQ ID NO: 234080 - DNA, 75 bp, Artificial Sequence
  Synthetic
agacgatccggagccacctgtgcagctttttgagcctcctacgcttcaggaactgtatgatttagaggtagaggg

SEQ ID NO: 234081 - DNA, 75 bp, Artificial Sequence
  Synthetic
caccagtggcgccctggacattaaagtaggaggggggcttaaggtagactccactgatgggtccttagaagaaaa

SEQ ID NO: 234082 - DNA, 75 bp, Artificial Sequence
  Synthetic
cagtctatgcccaacagacccaactacattggcttcagagataactttattggacttatgtactataacagtact

SEQ ID NO: 234083 - DNA, 75 bp, Artificial Sequence
  Synthetic
aactgtatgatttagaggtagagggatcggaggattctaatgaggaagctgtgaatggcttttttaccgattcta

SEQ ID NO: 234084 - DNA, 75 bp, Artificial Sequence
  Synthetic
aaatctaatcattccataggattagcagtgggaaatggattacaaacaaatgaaagcaaactatgtgccaaatta

SEQ ID NO: 234085 - DNA, 75 bp, Artificial Sequence
  Synthetic
agaattagatccgcctttggacactttcgatactccaggggtgattgtggaaagcggtacaggtgtaagaaaatt

SEQ ID NO: 234086 - DNA, 75 bp, Artificial Sequence
  Synthetic
cagtgggaaatggattacaaacaaatgaaagcaaactatgtgccaaattaggagatggacttatttttgactctt

SEQ ID NO: 234087 - DNA, 75 bp, Artificial Sequence
  Synthetic
cttcttattttaacagacaatgattttcattacagttcttcttgccatctttaacttactatcagcctctcatgg

SEQ ID NO: 234088 - DNA, 75 bp, Artificial Sequence
  Synthetic
cactttatggacaggagcaaaaccagaagctaattgcataattgagtatggaaaagaaagcacagacagcaagct

SEQ ID NO: 234089 - DNA, 75 bp, Artificial Sequence
  Synthetic
ttcctttgagtgatgaggaggaccgtgaaaaggagcagtttatgcagactgcagcgggtgagggagtgaaggctg

SEQ ID NO: 234090 - DNA, 75 bp, Artificial Sequence
  Synthetic
gaagctaattgcataattgagtatggaaaagaaagcacagacagcaagcttactctagttcttgtaaaaaatgga

SEQ ID NO: 234091 - DNA, 75 bp, Artificial Sequence
  Synthetic
cccggagcttcctggacatggctgtaagtcttgtgaatttcacaggaaaaatactggagtaaaggaactgttatg

SEQ ID NO: 234092 - DNA, 75 bp, Artificial Sequence
  Synthetic
taatgggagcctcggactatgttaatacattatttacaaacaagtatgcctccattaatgtagaactatactttg

SEQ ID NO: 234093 - DNA, 75 bp, Artificial Sequence
  Synthetic
tacattatttacaaacaagtatgcctccattaatgtagaactatactttgacgccaatggtcacctcctaacaga

SEQ ID NO: 234094 - DNA, 75 bp, Artificial Sequence
  Synthetic
tgccactttatttacagtaagtgtgtttaagttaaaatttaaaggaatatgctgtttttcacatgtatattgagt

SEQ ID NO: 234095 - DNA, 75 bp, Artificial Sequence
  Synthetic
caactaaaatcccaaaccactgagtctagtacaaaaggttttatgcccagtactatagcatatccatttgtcctt

SEQ ID NO: 234096 - DNA, 75 bp, Artificial Sequence
  Synthetic
ctagtacaaaaggttttatgcccagtactatagcatatccatttgtccttcctaatgctggaagagataatgaag

SEQ ID NO: 234097 - DNA, 75 bp, Artificial Sequence
  Synthetic
gtcctgtgtctgatgctgatgagtcaccatctcctgattctactacctcacctcctgagattcaagcacctgttc

SEQ ID NO: 234098 - DNA, 75 bp, Artificial Sequence
  Synthetic
accatctcctgattctactacctcacctcctgagattcaagcacctgttcctgtggacgtgcacaagcccattcc

SEQ ID NO: 234099 - DNA, 75 bp, Artificial Sequence
  Synthetic
caaagcaagtagtgatggaaccctttttccactggaagttactgttatgcttaataaacgcctgccagatagtag

SEQ ID NO: 234100 - DNA, 75 bp, Artificial Sequence
  Synthetic
tttccactggaagttactgttatgcttaataaacgcctgccagatagtaggacatcctatgttatgaccttctct

SEQ ID NO: 234101 - DNA, 75 bp, Artificial Sequence
  Synthetic
ccagcagtggaaaaacttgaggacttgttacagggtggggacggacctttggacttgagtacacggaaacggcca

SEQ ID NO: 234102 - DNA, 75 bp, Artificial Sequence
  Synthetic
cagaaaccactcaagccaccctcattacctcccccttctttttttcttacattagagaagatgactgacaacaaa

SEQ ID NO: 234103 - DNA, 75 bp, Artificial Sequence
  Synthetic
attagagaagatgactgacaacaaaaaaataaagttcaacttttttattgaacaatcagtttacaggattcgagt

SEQ ID NO: 234104 - DNA, 75 bp, Artificial Sequence
  Synthetic
cagaaggtcataatggtgttatttggtggaaactatttgatgatggagggtttgttagtccctgcagcacatcta

SEQ ID NO: 234105 - DNA, 75 bp, Artificial Sequence
  Synthetic
tggaatgggctattatggaagcatcgttgccaattccagttcctctaataacccttcaaccctggctgaggacaa

SEQ ID NO: 234106 - DNA, 75 bp, Artificial Sequence
  Synthetic
gactaggcaactgttagagaacgcttcggacggagtctccggtttttggagattctggttcgctagtgaattagc

SEQ ID NO: 234107 - DNA, 75 bp, Artificial Sequence
  Synthetic
tagggtagtttttaggataaaacaggactataaagaagaatttgaaaagttgttggtagattgcccaggactttt

SEQ ID NO: 234108 - DNA, 75 bp, Artificial Sequence
  Synthetic
gctgtggctgcggctccggagtctggatcagagtcatctggaagaagaacgatgggagtcataatccgagaacgg

SEQ ID NO: 234109 - DNA, 75 bp, Artificial Sequence
  Synthetic
gttcactttaaagaaaaagttttatcagttttagacttttcgaccccaggtagaactgctgctgctgtggctttt

SEQ ID NO: 234110 - DNA, 75 bp, Artificial Sequence
  Synthetic
tagaactgctgctgctgtggcttttcttacttttatattagataaatggatcccgcagactcatttcagcagggg

SEQ ID NO: 234111 - DNA, 75 bp, Artificial Sequence
  Synthetic
atacgttttggatttcgtagccacagcattgtggagaacatggaaggttcgcaagatgaggacaatcttaggtta

SEQ ID NO: 234112 - DNA, 75 bp, Artificial Sequence
  Synthetic
gcattgtggagaacatggaaggttcgcaagatgaggacaatcttaggttactggccagtgcagcctttgggtgta

SEQ ID NO: 234113 - DNA, 75 bp, Artificial Sequence
  Synthetic
caatgttgtttaacaggccataattaaaggcgctccagccaaaactcatttcaggaataatttgcccagcgtggc

SEQ ID NO: 234114 - DNA, 75 bp, Artificial Sequence
  Synthetic
tcatgccagcggttctggaggaggaacagcaagaggacaacccgagagccggcctggaccctccagtggaggagg

SEQ ID NO: 234115 - DNA, 75 bp, Artificial Sequence
  Synthetic
catcgtaccaaatcctgatgtaaatcaaatggcgccccctccagaacacactgcccacatacatgatctccttag

SEQ ID NO: 234116 - DNA, 75 bp, Artificial Sequence
  Synthetic
acagcaagaggacaacccgagagccggcctggaccctccagtggaggaggcggagtagctgacttgtctcctgaa

SEQ ID NO: 234117 - DNA, 75 bp, Artificial Sequence
  Synthetic
cacgacaatggctactattatgggaccaattatattacaagtttagattacaccattactgtcatatcgcctact

SEQ ID NO: 234118 - DNA, 75 bp, Artificial Sequence
  Synthetic
cgtccactggacgggataggggcgttaaaagggagagggcatctagtggtactgatgctagatctgagttggctt

SEQ ID NO: 234119 - DNA, 75 bp, Artificial Sequence
  Synthetic
accaaatggccagcactgcgcccccagcaatacattgaagagaaccctgtcgattacagtgacaatggagaaccc

SEQ ID NO: 234120 - DNA, 75 bp, Artificial Sequence
  Synthetic
tgaaaccatttggtggcatgaggtccagaaagagggaagggatgaagtttctgtattgcaggagaaatattcact

SEQ ID NO: 234121 - DNA, 75 bp, Artificial Sequence
  Synthetic
acttttctcgcccatggattacttgggaataaaatatatctattgtggcacaacacagacataaatgcatacatc

SEQ ID NO: 234122 - DNA, 75 bp, Artificial Sequence
  Synthetic
ctgtattgcaggagaaatattcactggaacaggtgaaaacatgttggttggagcctgaggatgattgggaggtgg

SEQ ID NO: 234123 - DNA, 75 bp, Artificial Sequence
  Synthetic
cagaaagagggaagggatgaagtttctgtattgcaggagaaatattcactggaacaggtgaaaacatgttggttg

SEQ ID NO: 234124 - DNA, 75 bp, Artificial Sequence
  Synthetic
tacttgaagtcgatgtcatcacaggccccctgttcccagagttggaagtccacccgcttcttgtaggcggggttg

SEQ ID NO: 234125 - DNA, 75 bp, Artificial Sequence
  Synthetic
ataggaaacaacctggctatggaaattaatatccaagctaacctttggagaagttttctgtactccaatgtggct

SEQ ID NO: 234126 - DNA, 75 bp, Artificial Sequence
  Synthetic
tttgaggcctgataaacagtataagattactagacggattaatatccggaatgcttgttacatatctggaaatgg

SEQ ID NO: 234127 - DNA, 75 bp, Artificial Sequence
  Synthetic
atgcttgttacatatctggaaatggggctgaggtggtaatagatactccagacaagacagttattagatgctgca

SEQ ID NO: 234128 - DNA, 75 bp, Artificial Sequence
  Synthetic
gctcctcagtcatagaagctctggtttcactttcctcacagcgtggtaaaggggccctcagttgaggttccctgg

SEQ ID NO: 234129 - DNA, 75 bp, Artificial Sequence
  Synthetic
tgatggatatgtggcctggagtagtcggtatggaagcagtaacttttgtaaatgttaagtttaggggagatggtt

SEQ ID NO: 234130 - DNA, 75 bp, Artificial Sequence
  Synthetic
cggtatggaagcagtaacttttgtaaatgttaagtttaggggagatggttataatggaatagtgtttatggccaa

SEQ ID NO: 234131 - DNA, 75 bp, Artificial Sequence
  Synthetic
ttcactttcctcacagcgtggtaaaggggccctcagttgaggttccctggtgtaaggatggtgtctggcgcacga

SEQ ID NO: 234132 - DNA, 75 bp, Artificial Sequence
  Synthetic
tcgcaagatctacaagaccccctacgtgcccatagacaaggaggtgaagatagatgggttttacatgcgcatgac

SEQ ID NO: 234133 - DNA, 75 bp, Artificial Sequence
  Synthetic
tcgtattttgcaaagcagaacctagtcttggcacagcacacgtcccgtcgcctcctgtcccgccgcctagcacgt

SEQ ID NO: 234134 - DNA, 75 bp, Artificial Sequence
  Synthetic
gttcgctttgaggaaggaggaccagaggtccactgccagtgctgtttgtaactggtcccggtactgacgaaaatg

SEQ ID NO: 234135 - DNA, 75 bp, Artificial Sequence
  Synthetic
attcccgtagattggtcaaaagatcttcagcctcagttgtcataaaaactccatcatatcttactgctctgataa

SEQ ID NO: 234136 - DNA, 75 bp, Artificial Sequence
  Synthetic
atgcatattccaaagatgtaacctgggcattcttaatgaaggcgaagcaagggtccgccactgcgcttctacaga

SEQ ID NO: 234137 - DNA, 75 bp, Artificial Sequence
  Synthetic
ggcattcttaatgaaggcgaagcaagggtccgccactgcgcttctacagatactggatgttttattttaattaag

SEQ ID NO: 234138 - DNA, 75 bp, Artificial Sequence
  Synthetic
gcccagccaggcaatgcaattagcttgtgtttcaaccaaaggagggggaggaagacatggaagaaccataattaa

SEQ ID NO: 234139 - DNA, 75 bp, Artificial Sequence
  Synthetic
tgtgtttcaaccaaaggagggggaggaagacatggaagaaccataattaatttttatgccagacgatcccgcagt

SEQ ID NO: 234140 - DNA, 75 bp, Artificial Sequence
  Synthetic
caaaaaatggcctgtttttgatcacaatgtgttgaccaagtgtaccatgcatgcaggtgggcgtagaggaatgtt

SEQ ID NO: 234141 - DNA, 75 bp, Artificial Sequence
  Synthetic
ctgaagatctgagaccggatcatttggttattgcccgcactggagcagagttcggatccagtggagaagaaactg

SEQ ID NO: 234142 - DNA, 75 bp, Artificial Sequence
  Synthetic
actggctctaagttcttctctaagttccagttgtaaaaactcttgcatatcatcgccaaactgcttagccatagg

SEQ ID NO: 234143 - DNA, 75 bp, Artificial Sequence
  Synthetic
tccagttgtaaaaactcttgcatatcatcgccaaactgcttagccataggtcctccaggaataagagcgggggac

SEQ ID NO: 234144 - DNA, 75 bp, Artificial Sequence
  Synthetic
cttcttttaatgggggagtcttcagcccttatctgacagggcgtctcccatcctgggcaggagttcgtcagaatg

SEQ ID NO: 234145 - DNA, 75 bp, Artificial Sequence
  Synthetic
acccgtccaacccgccaattcttcaacgctgacctatgctactttaagttcttcacctttggacccagctgcagc

SEQ ID NO: 234146 - DNA, 75 bp, Artificial Sequence
  Synthetic
aacactgtgcttggaatgggttactatggaagcatcctggctaattccacttcctctaataacccttctaccctg

SEQ ID NO: 234147 - DNA, 75 bp, Artificial Sequence
  Synthetic
cgcgctgcgctccaacattgttagtatggttagtctgtaaaaacaaaaaaacaaaaaattacatcacgctgtgct

SEQ ID NO: 234148 - DNA, 75 bp, Artificial Sequence
  Synthetic
ttcctctaataacccttctaccctgactcaggacaagttacttgtccttttggcccagctggaggctttgaccca

SEQ ID NO: 234149 - DNA, 75 bp, Artificial Sequence
  Synthetic
gtggccgagttgcgagtacaaactgagtctgctgttggcacggcaaagtctaaataaaaaaattccagaatcaat

SEQ ID NO: 234150 - DNA, 75 bp, Artificial Sequence
  Synthetic
agcgagccaatctggggtcagtgatagataaaaatccatcgggatagtcttttaaagcgctttcacagtccaact

SEQ ID NO: 234151 - DNA, 75 bp, Artificial Sequence
  Synthetic
tatattatttgcgatgaagcatacaaaccagaagtgttagtatcagttaaagaaaaaaatcggccaagatagcat

SEQ ID NO: 234152 - DNA, 75 bp, Artificial Sequence
  Synthetic
ataaaggtgggattgaatgtttagatacatgggcattaggccgtctttggggtggagatagctccattgaaggga

SEQ ID NO: 234153 - DNA, 75 bp, Artificial Sequence
  Synthetic
tacatgggcattaggccgtctttggggtggagatagctccattgaagggattcatgctccggggtagtgttgtaa

SEQ ID NO: 234154 - DNA, 75 bp, Artificial Sequence
  Synthetic
gcacaggcagtctagctcccggtccctccaaaatcacatataaagcttcagcagccatagcttaccgcgcaaatc

SEQ ID NO: 234155 - DNA, 75 bp, Artificial Sequence
  Synthetic
cgaggttgagctccacgtggcgggtgaagaccgcatagttgcataggcgctggaaaaggtagttgagtgtggtgg

SEQ ID NO: 234156 - DNA, 75 bp, Artificial Sequence
  Synthetic
aaagctcctgaaggtgttatagtaaatgacacctatgatcataaagaggatatcttaaagtatgagtggtttgag

SEQ ID NO: 234157 - DNA, 75 bp, Artificial Sequence
  Synthetic
gtgcatggtgttgcacaatatcttttagaagtaggctgattgccacagataagcccttggtgtaggtgtttacaa

SEQ ID NO: 234158 - DNA, 75 bp, Artificial Sequence
  Synthetic
atgtatgccagtaaccggcctttcatcaacaaactgctggactacctgcacagggcagccgctatgaactctgat

SEQ ID NO: 234159 - DNA, 75 bp, Artificial Sequence
  Synthetic
tgcgcaatatatagagaacccttacactgacgtaattgggcaaagtctaaaaaatcccgccaaaaaaaacagcac

SEQ ID NO: 234160 - DNA, 75 bp, Artificial Sequence
  Synthetic
cccactggctgcccccgcctggattttacacgggcgagtatgacatgcccgaccccaatgacgggtttctgtggg

SEQ ID NO: 234161 - DNA, 75 bp, Artificial Sequence
  Synthetic
tcggggtgaaattatgtgcattttggattggatttttaagttggcaatattgccgccaagatctcgtcttgggtt

SEQ ID NO: 234162 - DNA, 75 bp, Artificial Sequence
  Synthetic
gtgtatccggtacatttaggaaatttatcgtgcagcttggatggaaaagcgtggaaaaatttggagacacccttg

SEQ ID NO: 234163 - DNA, 75 bp, Artificial Sequence
  Synthetic
tatcgtgcagcttggatggaaaagcgtggaaaaatttggagacacccttgtgtcctccgagattttccatgcact

SEQ ID NO: 234164 - DNA, 75 bp, Artificial Sequence
  Synthetic
catcatcaataatataccttatagatggaatggtgccaatatgtaaatgaggtggtttgaaaatggagagcggaa

SEQ ID NO: 234165 - DNA, 75 bp, Artificial Sequence
  Synthetic
gtgggcagcagcgcgggcaaacacgttccgtgggtctgacacatcatagttatgttcctgagttaaatcatcata

SEQ ID NO: 234166 - DNA, 75 bp, Artificial Sequence
  Synthetic
tggaatggtgccaatatgtaaatgaggtggtttgaaaatggagagcggaaggggattggcttggggttcaacggt

SEQ ID NO: 234167 - DNA, 75 bp, Artificial Sequence
  Synthetic
ggtggtttgaaaatggagagcggaaggggattggcttggggttcaacggtcacggggcggcgcgggaaggtgacg

SEQ ID NO: 234168 - DNA, 75 bp, Artificial Sequence
  Synthetic
agagtacccgattggggtatgaatgttccttcgggccccggagcatagttcccctcacagatttgcatttcccaa

SEQ ID NO: 234169 - DNA, 75 bp, Artificial Sequence
  Synthetic
ttccttcgggccccggagcatagttcccctcacagatttgcatttcccaagctttcagttccgagggtggaatca

SEQ ID NO: 234170 - DNA, 75 bp, Artificial Sequence
  Synthetic
agctgtcgcggtatttctgacgtaaacgaggtggagtttaaacacggaagtacacagtttcccgcgcttattgac

SEQ ID NO: 234171 - DNA, 75 bp, Artificial Sequence
  Synthetic
gatgttggggcgcggaatgcgacgccacaggcggcggcgcgctatcagcaagaggctggggggtggctttctgcc

SEQ ID NO: 234172 - DNA, 75 bp, Artificial Sequence
  Synthetic
cgacccgtagacgccagcgccatgacagacagaggggtcttgtgtgggacgatgaggactcggccgatgacagca

SEQ ID NO: 234173 - DNA, 75 bp, Artificial Sequence
  Synthetic
aggaaatgaggtagttttgggcggatgcaagtgaaaattcctcattttcgcgcgaaaactgaatgaggaagtgaa

SEQ ID NO: 234174 - DNA, 75 bp, Artificial Sequence
  Synthetic
ggttgcagttggtagtttagggaacggcaactgccgtcttctcgaagcaagggggccacctcgttcatcatttcc

SEQ ID NO: 234175 - DNA, 75 bp, Artificial Sequence
  Synthetic
cacggagtgcggattaccatcgaagggggaatagactctcgcctgcatcgaatcttctcccagcgacccgtgctg

SEQ ID NO: 234176 - DNA, 75 bp, Artificial Sequence
  Synthetic
ggcaactgccgtcttctcgaagcaagggggccacctcgttcatcatttcccttacatgcatattttcccgcacca

SEQ ID NO: 234177 - DNA, 75 bp, Artificial Sequence
  Synthetic
aggtttcgattaccgtgtttttcacctaaatttccgcgtacggtgtcaaagtcctgtgtttttacgtaggtgtca

SEQ ID NO: 234178 - DNA, 75 bp, Artificial Sequence
  Synthetic
tagtgatagaagttcttgtagtgaggaaaagtttttcagcggttttagaccgtcagccatgggcattttggagag

SEQ ID NO: 234179 - DNA, 75 bp, Artificial Sequence
  Synthetic
atgtttagtaacaagttcaaggcgcgggtgatggtgtctagagaggcctcaaaaattgaatcagagaaagatgac

SEQ ID NO: 234180 - DNA, 75 bp, Artificial Sequence
  Synthetic
ttgagtgccagcgagaagagttttctcctccgcgctgcgagtcagatctccacttcgaaaatgagacacctgcgt

SEQ ID NO: 234181 - DNA, 75 bp, Artificial Sequence
  Synthetic
agtctgttgcaaaagttctagtctgttccacagttcagtgatgtgttctatggcatctcgatccagcagacctcc

SEQ ID NO: 234182 - DNA, 75 bp, Artificial Sequence
  Synthetic
tggcatctcgatccagcagacctcctcgtttcgcgggtttggacggctcctggagtagggtatgagacgatgggc

SEQ ID NO: 234183 - DNA, 75 bp, Artificial Sequence
  Synthetic
ctgaaactgggaatgaaatactgcagtttgtggtaaatactctgatgggagacgatccagagccgcctgagccat

SEQ ID NO: 234184 - DNA, 75 bp, Artificial Sequence
  Synthetic
tcgtttcgcgggtttggacggctcctggagtagggtatgagacgatgggcgtccagcgctgccagggttcggtcc

SEQ ID NO: 234185 - DNA, 75 bp, Artificial Sequence
  Synthetic
atcgacctgatgaacaatgccatcattgacaactacctggaaattggcagacagaatggagtgctggaaagtgac

SEQ ID NO: 234186 - DNA, 75 bp, Artificial Sequence
  Synthetic
gtttgtggtaaatactctgatgggagacgatccagagccgcctgagccatcttttgatcctcctacgcttcatga

SEQ ID NO: 234187 - DNA, 75 bp, Artificial Sequence
  Synthetic
gggttgtttccgtcacagtgaaggggtgtgcgcctgcttgggcgcttgccagggtgcgcttcagactcatcctgc

SEQ ID NO: 234188 - DNA, 75 bp, Artificial Sequence
  Synthetic
ccggaggaccctaatgaggacgacgtgaatgggttttttactgattctatgttattagctgctaatgagggagtg

SEQ ID NO: 234189 - DNA, 75 bp, Artificial Sequence
  Synthetic
tgaatgggttttttactgattctatgttattagctgctaatgagggagtggatttagacccaccttctggaactc

SEQ ID NO: 234190 - DNA, 75 bp, Artificial Sequence
  Synthetic
aactaagttaatcatgcctggggtctacacctatgaggcattccatcctgacattgtgcttctgcctggttgcgg

SEQ ID NO: 234191 - DNA, 75 bp, Artificial Sequence
  Synthetic
aagcgacataaatgggaaaaatttacctgatttgggtgctgctgaattggacttgcactgctatgaagagggttt

SEQ ID NO: 234192 - DNA, 75 bp, Artificial Sequence
  Synthetic
cctgatttgggtgctgctgaattggacttgcactgctatgaagagggttttcctccgagtgatgatgaagatgtg

SEQ ID NO: 234193 - DNA, 75 bp, Artificial Sequence
  Synthetic
agcaacttgcttggaatcaggaagagacacccattccaggaaggctttcagatactgtatgaagatctcgaaggg

SEQ ID NO: 234194 - DNA, 75 bp, Artificial Sequence
  Synthetic
gatactgtatgaagatctcgaagggggtaatatcccagcccttctggatgtagaaacctatgaaaaaagcaaaaa

SEQ ID NO: 234195 - DNA, 75 bp, Artificial Sequence
  Synthetic
ctgtagcccccatggctaccggggtaatgaaaccttctcagtcacaccgacccgctaccttggacttgcctcccc

SEQ ID NO: 234196 - DNA, 75 bp, Artificial Sequence
  Synthetic
cagcgggtgagggagtgaaagcagccagtgatggttttaagttggactgcccgatgctgcctggacatggctgta

SEQ ID NO: 234197 - DNA, 75 bp, Artificial Sequence
  Synthetic
cagtgatggttttaagttggactgcccgatgctgcctggacatggctgtaagtcttgtgaatttcacaggaaaaa

SEQ ID NO: 234198 - DNA, 75 bp, Artificial Sequence
  Synthetic
tctcgggccgtgagtggctcgcgcccgtagtctggagaatcagtcgccagggttgcgttgcggtatgccccggtt

SEQ ID NO: 234199 - DNA, 75 bp, Artificial Sequence
  Synthetic
gcctgtcgctaccccgaagcccaccaccgtacagcccgtcgccgtagccagaccgcgtcctgggggcactccacg

SEQ ID NO: 234200 - DNA, 75 bp, Artificial Sequence
  Synthetic
tttaccatgagttcgtagttgagcgcctcggctgcgtggcccttggcgcggagcttacctttggaagttttcttg

SEQ ID NO: 234201 - DNA, 75 bp, Artificial Sequence
  Synthetic
tcgctttgttatatgagagcgcattgccactttatttacagtaagtgtgtttaagttaaatttaaaggaacagta

SEQ ID NO: 234202 - DNA, 75 bp, Artificial Sequence
  Synthetic
attaaggcagaaaatgacaatgtgcccagaggcgataattaccaatctgctaatgccatgaaagcatctgatgaa

SEQ ID NO: 234203 - DNA, 75 bp, Artificial Sequence
  Synthetic
gcctcggtcttcttcgtataggaactctgaccactctgatacaaaggcgcgcgtccaggccagcacaaaggaggc

SEQ ID NO: 234204 - DNA, 75 bp, Artificial Sequence
  Synthetic
tctgaccactctgatacaaaggcgcgcgtccaggccagcacaaaggaggctatgtgggaggggtagcgatcgttg

SEQ ID NO: 234205 - DNA, 75 bp, Artificial Sequence
  Synthetic
ctggtgtagtaactgaaactgaaaccaaatcaccaaccattcagccgctggaaaaagatagcaagagtaggagtt

SEQ ID NO: 234206 - DNA, 75 bp, Artificial Sequence
  Synthetic
cttttaaattaatatggagtagcgcttaacttgcctgtctgtgtgtatgtgtcatcatcacgccgccgccgcagc

SEQ ID NO: 234207 - DNA, 75 bp, Artificial Sequence
  Synthetic
ccgtccctgcaaatgtatgcaagcccattcctgtgaagcttaagcctgggaaacgccctgctgtggataaacttg

SEQ ID NO: 234208 - DNA, 75 bp, Artificial Sequence
  Synthetic
aagtatgcaaacacatgtcactctcttcaacatccaggaatgtgattggcttgtaggtgtatttcacgtgacctg

SEQ ID NO: 234209 - DNA, 75 bp, Artificial Sequence
  Synthetic
acctttggacttgtgtacccggaaaataccaaggcaatgagtgccccgcacctgtgtttatttaatgacgtcact

SEQ ID NO: 234210 - DNA, 75 bp, Artificial Sequence
  Synthetic
cctgtgtttatttaatgacgtcactatttatgtgagagtgccatgtaataaaattatgtcagctgctgagtgttt

SEQ ID NO: 234211 - DNA, 75 bp, Artificial Sequence
  Synthetic
gcactcaggttgtcagtttctaagaacgaggaggatttgatattgacagtgccgcttgagatgcctttcatgagg

SEQ ID NO: 234212 - DNA, 75 bp, Artificial Sequence
  Synthetic
ctgcggctgcagccgtcagcggcgcgggacagcccgcctatgatctggacttggaagagggcgagggattggcgc

SEQ ID NO: 234213 - DNA, 75 bp, Artificial Sequence
  Synthetic
caatttttttattgtcaagtttggtggcaaatgatccatacagggcgttggataaaagtttggcaatggatcgca

SEQ ID NO: 234214 - DNA, 75 bp, Artificial Sequence
  Synthetic
ggcaaatgatccatacagggcgttggataaaagtttggcaatggatcgcatggtttggttcttttccttgtccgc

SEQ ID NO: 234215 - DNA, 75 bp, Artificial Sequence
  Synthetic
ctgctagaaaacgcctcggacggagtctctggtctttggagattctggttcggtggtgatctggctagactagtc

SEQ ID NO: 234216 - DNA, 75 bp, Artificial Sequence
  Synthetic
tggacatactcgcgtgccaggcacttccattcggggaagatagttgtcaattcatctggcacaattctcacttgc

SEQ ID NO: 234217 - DNA, 75 bp, Artificial Sequence
  Synthetic
aatccacactggtggccacctcgcctcgaaggggttcgttggtccagcagagcctacctcctttcctagaacaga

SEQ ID NO: 234218 - DNA, 75 bp, Artificial Sequence
  Synthetic
agcctacctcctttcctagaacagaaaggtggaagtgggtctagcataagttcatcgggagggtctgcatccatg

SEQ ID NO: 234219 - DNA, 75 bp, Artificial Sequence
  Synthetic
aaggtggaagtgggtctagcataagttcatcgggagggtctgcatccatggtaaagattccaggaagtaaatcct

SEQ ID NO: 234220 - DNA, 75 bp, Artificial Sequence
  Synthetic
gacaatcttagattactggccagtacagcctctgggcgtagcagggatcctgagacacccaccgaccatgccagc

SEQ ID NO: 234221 - DNA, 75 bp, Artificial Sequence
  Synthetic
gtcatctaaggccatttgccattctcgagctgccagtgcgcgctcatatgggttaaggggactgccccagggcat

SEQ ID NO: 234222 - DNA, 75 bp, Artificial Sequence
  Synthetic
cgagctgccagtgcgcgctcatatgggttaaggggactgccccagggcatgggatgggtgagtgcagaggcatac

SEQ ID NO: 234223 - DNA, 75 bp, Artificial Sequence
  Synthetic
tgggatcctcaaagatgcctatgtaggttggatagcatcgcccccctctgatacttgctcgcacatagtcatata

SEQ ID NO: 234224 - DNA, 75 bp, Artificial Sequence
  Synthetic
ggttggatagcatcgcccccctctgatacttgctcgcacatagtcatatagttcatgtgacggcgctagcagccc

SEQ ID NO: 234225 - DNA, 75 bp, Artificial Sequence
  Synthetic
agtagttttgggcggatgcaagtaaaaattctccattttcgcgcgaaaactgaatgagaatatgaatttctgagt

SEQ ID NO: 234226 - DNA, 75 bp, Artificial Sequence
  Synthetic
gaaaggaatcctagtggaactaatcccagatctgagttggctttaagtttgatgagtcgcagacgtcctgaaact

SEQ ID NO: 234227 - DNA, 75 bp, Artificial Sequence
  Synthetic
ccagatctgagttggctttaagtttgatgagtcgcagacgtcctgaaactatatggtggcatgaggttcagaatg

SEQ ID NO: 234228 - DNA, 75 bp, Artificial Sequence
  Synthetic
ttttctgttctgtagacaatctggcgaaagatggcgtgagaattggaagagatggtgggtctttgaaaaatgttg

SEQ ID NO: 234229 - DNA, 75 bp, Artificial Sequence
  Synthetic
gaaagatggcgtgagaattggaagagatggtgggtctttgaaaaatgttgaagtgggcatgaggtagacctacag

SEQ ID NO: 234230 - DNA, 75 bp, Artificial Sequence
  Synthetic
aaattctccattttcgcgcgaaaactgaatgagaatatgaatttctgagtcatttcgcggttatgacagggtgga

SEQ ID NO: 234231 - DNA, 75 bp, Artificial Sequence
  Synthetic
gcaagagaaatattctctagaacaggtgaaaacatgttggttggagcctgaggatgattgggaggttgccattag

SEQ ID NO: 234232 - DNA, 75 bp, Artificial Sequence
  Synthetic
gtgaaaacatgttggttggagcctgaggatgattgggaggttgccattaggaattatgccaagatagctttgagg

SEQ ID NO: 234233 - DNA, 75 bp, Artificial Sequence
  Synthetic
aacggattaatattagaaatgcatgttatatatcagggaatggggctgaggtagtgatagacactcaagacagaa

SEQ ID NO: 234234 - DNA, 75 bp, Artificial Sequence
  Synthetic
ttatatatcagggaatggggctgaggtagtgatagacactcaagacagaacagtttttagatgctgcatgatggg

SEQ ID NO: 234235 - DNA, 75 bp, Artificial Sequence
  Synthetic
gaggcagtaacccttatgaatgtaaagtttagaggggatgggtataatggtgtggtttttatggctaatactaaa

SEQ ID NO: 234236 - DNA, 75 bp, Artificial Sequence
  Synthetic
agtttagaggggatgggtataatggtgtggtttttatggctaatactaaattgattttgcatggttgtagctttt

SEQ ID NO: 234237 - DNA, 75 bp, Artificial Sequence
  Synthetic
agcttgggggcaggtgagtgtaagaggctgtagtttctatgcatgctggattgcaacatcaggcaggaccaagag

SEQ ID NO: 234238 - DNA, 75 bp, Artificial Sequence
  Synthetic
ggctgtagtttctatgcatgctggattgcaacatcaggcaggaccaagagtcaattgtctgtaaagaaatgtatg

SEQ ID NO: 234239 - DNA, 75 bp, Artificial Sequence
  Synthetic
tgaatgaaggagaagccagagtcagccactgtgcttcttccgaaactggctgtttcatattgataaagggaaatg

SEQ ID NO: 234240 - DNA, 75 bp, Artificial Sequence
  Synthetic
acaatgtataattctatgaaacgcggcgtgcctctgacgtgaggtagcttattgagctcatcaaaggttaggtct

SEQ ID NO: 234241 - DNA, 75 bp, Artificial Sequence
  Synthetic
atttgcatgtaggaatgatgaccaaagatccaccgccagtgctgtttgtaactggtcccgatactgacgaaaatg

SEQ ID NO: 234242 - DNA, 75 bp, Artificial Sequence
  Synthetic
tgaccaaatgcactatgcacgtaggtggtcgcagaggaatgttaatgccataccagtgtaacatgaataatgtga

SEQ ID NO: 234243 - DNA, 75 bp, Artificial Sequence
  Synthetic
agatccaccgccagtgctgtttgtaactggtcccgatactgacgaaaatgctggccaattgccattttttctgga

SEQ ID NO: 234244 - DNA, 75 bp, Artificial Sequence
  Synthetic
tggtcgcagaggaatgttaatgccataccagtgtaacatgaataatgtgaaagtgatgttggagccagatgcatt

SEQ ID NO: 234245 - DNA, 75 bp, Artificial Sequence
  Synthetic
cttgttgccatcgatcccacttaagtttaatggctagatcgtgggccatgttgacgagacgctcttctcctgaga

SEQ ID NO: 234246 - DNA, 75 bp, Artificial Sequence
  Synthetic
tttgacatgaatctgcaaatatggaagatcctgagatatgatgacacgaagtcgagggtacgcgcatgcgagtgc

SEQ ID NO: 234247 - DNA, 75 bp, Artificial Sequence
  Synthetic
tttaatggctagatcgtgggccatgttgacgagacgctcttctcctgagagtttcatgaccagcatgaaaggaac

SEQ ID NO: 234248 - DNA, 75 bp, Artificial Sequence
  Synthetic
agatcctgagatatgatgacacgaagtcgagggtacgcgcatgcgagtgcgggggcaaacatgccaggttccagc

SEQ ID NO: 234249 - DNA, 75 bp, Artificial Sequence
  Synthetic
actaaggccagatcatttggtgattgcctgcactggagcggagttcggttctagtggtgaagaaactgactaaag

SEQ ID NO: 234250 - DNA, 75 bp, Artificial Sequence
  Synthetic
atttcctgccaccagttggaggattggctgttgatgtgatggaagtagaagtttctgcggcgcgccgagcattcg

SEQ ID NO: 234251 - DNA, 75 bp, Artificial Sequence
  Synthetic
ggactctaatgtgaataagatggacagattgggtaaatttttgttttttctgtcttgcagctgtcatgagtggaa

SEQ ID NO: 234252 - DNA, 75 bp, Artificial Sequence
  Synthetic
agattgggtaaatttttgttttttctgtcttgcagctgtcatgagtggaagcgcttcttttgaggggggagtctt

SEQ ID NO: 234253 - DNA, 75 bp, Artificial Sequence
  Synthetic
ctgttgccgctgcctccttgcagatatggccctcacttgccgccttcgcgtccccattactggctaccgaggaag

SEQ ID NO: 234254 - DNA, 75 bp, Artificial Sequence
  Synthetic
agtagtcgcagcgttgcacgggttgtatctcgtgaatgagctgtacctggcttcccttgacgagaaatttcagtg

SEQ ID NO: 234255 - DNA, 75 bp, Artificial Sequence
  Synthetic
tatctcgtgaatgagctgtacctggcttcccttgacgagaaatttcagtgggaagccgaggcctggcgattgtat

SEQ ID NO: 234256 - DNA, 75 bp, Artificial Sequence
  Synthetic
cgggaggcaagtccagacctcggcgcgggaggggcggagctgaaggacgagagcgcgcaggctggagctgtccag

SEQ ID NO: 234257 - DNA, 75 bp, Artificial Sequence
  Synthetic
atggaagcatcgttgccaataccagttcctcaaataacccttcgaccctggctgaggacaagctacttgttcttt

SEQ ID NO: 234258 - DNA, 75 bp, Artificial Sequence
  Synthetic
ttagtaggtagggacagaagattaacttgcataatcttttccagggcgtgcgggaggtttagatggtacttgatt

SEQ ID NO: 234259 - DNA, 75 bp, Artificial Sequence
  Synthetic
gtggcccagctgcgcgagcaaactgagtctgctgttgccacagcaaagtctaaataaagattaatcaataaataa

SEQ ID NO: 234260 - DNA, 75 bp, Artificial Sequence
  Synthetic
gcagcggttgttccggacccgggggcatggctggtagtggcacgtcggcgccgcgcacgggcaggttctggtact

SEQ ID NO: 234261 - DNA, 75 bp, Artificial Sequence
  Synthetic
ccgcgcacgggcaggttctggtactgcgctctgagaagacttgcgtgcgccaccacgcgtcgattgacgtcttgt

SEQ ID NO: 234262 - DNA, 75 bp, Artificial Sequence
  Synthetic
cattaggccgtctcgagggtggagatagctccattgaagagcctcgtgttccggggtagtgttataaatcaccca

SEQ ID NO: 234263 - DNA, 75 bp, Artificial Sequence
  Synthetic
gctcccatggccaccggggtaatgaaaccttctcagtcgcatcggcccgccaccttggacttgcctcctgcccct

SEQ ID NO: 234264 - DNA, 75 bp, Artificial Sequence
  Synthetic
tgttgcacaatatctttaaggagcaggctgattgcaactgggagccccttggtgtatgtgtttacaaatctgttg

SEQ ID NO: 234265 - DNA, 75 bp, Artificial Sequence
  Synthetic
gatctccgcgacccgctctctcgacggtggccgcgaggtcattggagatacggcccatgagttgggagaatgcat

SEQ ID NO: 234266 - DNA, 75 bp, Artificial Sequence
  Synthetic
cgaatgcaaactggcagagtactctgaacagcatcgtgggtctgggcgtgcagagtgtaaagcgccgtcgctgct

SEQ ID NO: 234267 - DNA, 75 bp, Artificial Sequence
  Synthetic
gctgtaaaccacggccccctcggagtctcttgcgcgcatcaccacctgagcgaggttaagctccacgtgtctggt

SEQ ID NO: 234268 - DNA, 75 bp, Artificial Sequence
  Synthetic
cgaggttaagctccacgtgtctggtgaagaccgcatagttgcataggcgctgaaaaaggtagttgagtgtggtgg

SEQ ID NO: 234269 - DNA, 75 bp, Artificial Sequence
  Synthetic
agcgctccatggcctcgtagaagtccacggcaaaattaaaaaactgggagtttcgcgcggacacggtcaattcct

SEQ ID NO: 234270 - DNA, 75 bp, Artificial Sequence
  Synthetic
taaaaccgtgttcaataaaaagcactttatttttacatgcactaaggctctggttttttgctcattcgttttcat

SEQ ID NO: 234271 - DNA, 75 bp, Artificial Sequence
  Synthetic
tatggtggcccgtacttcgcgttcaaaggctcccggcatctcttcttcctcttctatctcttcttccactaacat

SEQ ID NO: 234272 - DNA, 75 bp, Artificial Sequence
  Synthetic
tgcggggctataaaaaataccgtttctggggctggggtgattaactgtgatgatagcaaattccttagcagctgt

SEQ ID NO: 234273 - DNA, 75 bp, Artificial Sequence
  Synthetic
gaaaccttctcagtcacatcgacccgccaccttggacttgcctcctccccctgcttctgcggcgcctgttcccaa

SEQ ID NO: 234274 - DNA, 75 bp, Artificial Sequence
  Synthetic
gccaccttggacttgcctcctccccctgcttctgcggcgcctgttcccaaacctgtcgctaccagaaagcccacc

SEQ ID NO: 234275 - DNA, 75 bp, Artificial Sequence
  Synthetic
catccggggggtgctggacagaggtcccagtttcaagccatactctggcacagcttacaactcactagctcctaa

SEQ ID NO: 234276 - DNA, 75 bp, Artificial Sequence
  Synthetic
aaaaacaccgccgcgcatctccttaaagtggtgactgggaggttctccgtttgggagggaaagggcgctgattat

SEQ ID NO: 234277 - DNA, 75 bp, Artificial Sequence
  Synthetic
aagtggtgactgggaggttctccgtttgggagggaaagggcgctgattatacattttattaattggcccgtaggg

SEQ ID NO: 234278 - DNA, 75 bp, Artificial Sequence
  Synthetic
aagtacaaaacacttgctaacacagaaacagaagaagaggaggaggaggacaaacaggcagatgaacaagaatac

SEQ ID NO: 234279 - DNA, 75 bp, Artificial Sequence
  Synthetic
atgggcattttggagagagtctgttgcaagagctcgagccgatcccaaagctcggttatgtgttctatggcatct

SEQ ID NO: 234280 - DNA, 75 bp, Artificial Sequence
  Synthetic
aaacagaagaagaggaggaggaggacaaacaggcagatgaacaagaatacgttgaaaagacttctacatttggaa

SEQ ID NO: 234281 - DNA, 75 bp, Artificial Sequence
  Synthetic
caagatccacgggatctgaaaacctttcaacgaaagcgtctaaccagtcacagtcacaaggtaggctgagtacgg

SEQ ID NO: 234282 - DNA, 75 bp, Artificial Sequence
  Synthetic
agatgcagatggcttgcagataggtgtggacatacaagatgaaactaaaccagtctacgctaacaagctttatga

SEQ ID NO: 234283 - DNA, 75 bp, Artificial Sequence
  Synthetic
caagtcttcagcattggccattccaaagggggtcatcttacaggtctgcctgcccatcacgggagcgcagcctgg

SEQ ID NO: 234284 - DNA, 75 bp, Artificial Sequence
  Synthetic
gtggacatacaagatgaaactaaaccagtctacgctaacaagctttatgaaccagaaccccaagtgggagatgga

SEQ ID NO: 234285 - DNA, 75 bp, Artificial Sequence
  Synthetic
ctgagcagtatggaggccgtgctcttaagcctgacacaaaaatgaaaccttgctatggatcgtttgctagaccta

SEQ ID NO: 234286 - DNA, 75 bp, Artificial Sequence
  Synthetic
taagcctgacacaaaaatgaaaccttgctatggatcgtttgctagacctacaaatgaaaaaggaggacaatctaa

SEQ ID NO: 234287 - DNA, 75 bp, Artificial Sequence
  Synthetic
tcttcatctcgggaaggtaagacgatgctgctggtgatgaaattaaagtaggcagttctaagacggcggatggtg

SEQ ID NO: 234288 - DNA, 75 bp, Artificial Sequence
  Synthetic
aaagtagtggaagagccagatattgatatggctttctttgatggaagagatgccaaaaaaccagatccagaaatt

SEQ ID NO: 234289 - DNA, 75 bp, Artificial Sequence
  Synthetic
atatggctttctttgatggaagagatgccaaaaaaccagatccagaaattgttctgtatactgaaaatgttaact

SEQ ID NO: 234290 - DNA, 75 bp, Artificial Sequence
  Synthetic
atacgtgtgagtccaaacccgcgcattggttggaccagtgccaagtcagctacgactctttcggcgaggatggct

SEQ ID NO: 234291 - DNA, 75 bp, Artificial Sequence
  Synthetic
agcttgggtgcgaggaagattgattcgggggagtatgcatctgcgccgcaggaggcgcagacagtttcgcattcc

SEQ ID NO: 234292 - DNA, 75 bp, Artificial Sequence
  Synthetic
tacgactctttcggcgaggatggcttgctgtacttgggtgagggtggcttgaaagtcatcaaaatccacgaagcg

SEQ ID NO: 234293 - DNA, 75 bp, Artificial Sequence
  Synthetic
ttacaaagccggcacagatgattccagctcatctattaatttgggccaacagtctatgcccaatagacccaacta

SEQ ID NO: 234294 - DNA, 75 bp, Artificial Sequence
  Synthetic
agctcatctattaatttgggccaacagtctatgcccaatagacccaactatattggcttcagagacaacttcatt

SEQ ID NO: 234295 - DNA, 75 bp, Artificial Sequence
  Synthetic
gcaatatgggagtgttggccggacaagcatctcagctaaatgcagtggttgacttgcaggacagaaacacagagc

SEQ ID NO: 234296 - DNA, 75 bp, Artificial Sequence
  Synthetic
agcatctcagctaaatgcagtggttgacttgcaggacagaaacacagagctgtcttaccagcttttgcttgattc

SEQ ID NO: 234297 - DNA, 75 bp, Artificial Sequence
  Synthetic
cacgagctcggtgtatttaaggcgcgaataggcgcgggtgtcaaagatgtaatcgttgcaggtgcgcaccagata

SEQ ID NO: 234298 - DNA, 75 bp, Artificial Sequence
  Synthetic
ctgtcctcgagcggagtgcctcggtcctcttcgtataggaatcccgaccactctgatacaaaggcgcgtgtccag

SEQ ID NO: 234299 - DNA, 75 bp, Artificial Sequence
  Synthetic
agcatgtggaatcaggcagtggacagctatgaccctgatgtccgtattattgaaaaccatggtgtggaagacgaa

SEQ ID NO: 234300 - DNA, 75 bp, Artificial Sequence
  Synthetic
ggtggttggcggtagagaggccattgttctgtagctggagcgccgggggcgaggtcttccaacataaggcggtga

SEQ ID NO: 234301 - DNA, 75 bp, Artificial Sequence
  Synthetic
gaaaggaataaggtcctggacactgctcaccacttcggatgtcacctgtggagccgagcaggtctactggtcgct

SEQ ID NO: 234302 - DNA, 75 bp, Artificial Sequence
  Synthetic
gttctgtagctggagcgccgggggcgaggtcttccaacataaggcggtgatagccgtaaatgtacctggacatcc

SEQ ID NO: 234303 - DNA, 75 bp, Artificial Sequence
  Synthetic
gctatgaccctgatgtccgtattattgaaaaccatggtgtggaagacgaacttcccaattactgtttcccattgg

SEQ ID NO: 234304 - DNA, 75 bp, Artificial Sequence
  Synthetic
caaaggcgtcgtagtagatcaagctgcagcagcaggaactgcaactacttggaaagatgataccactgcaaatga

SEQ ID NO: 234305 - DNA, 75 bp, Artificial Sequence
  Synthetic
agcccgaggaaactcgcgtacgcggttccaaatgttgcgtagcggcatgaagtagttcattgtaggcacggtttg

SEQ ID NO: 234306 - DNA, 75 bp, Artificial Sequence
  Synthetic
ttccaaatgttgcgtagcggcatgaagtagttcattgtaggcacggtttgaccagtgaggcgcgcgcagtcattg

SEQ ID NO: 234307 - DNA, 75 bp, Artificial Sequence
  Synthetic
gtatgccacgtgaccgggagtcccagccgggggggtataaaagggggcgggtctctgtttgtcctcactgtcttc

SEQ ID NO: 234308 - DNA, 75 bp, Artificial Sequence
  Synthetic
gcagcagcaggaactgcaactacttggaaagatgataccactgcaaatgaatacaatgaaattgctaagggtaat

SEQ ID NO: 234309 - DNA, 75 bp, Artificial Sequence
  Synthetic
aagctaacttatggagaagttttctttactccaatgtagctttgtaccttccggatgcttacaaatacactccgg

SEQ ID NO: 234310 - DNA, 75 bp, Artificial Sequence
  Synthetic
aaagcgttcagcgactcgactctgtagcctggaggaacgtgaacgggttgggtcgcggtgtaccccggttcaaga

SEQ ID NO: 234311 - DNA, 75 bp, Artificial Sequence
  Synthetic
tggctgatgtcttgcagagggacatgcttggtcttcctgggcttcttcttgggagggatcgggggaggactgttg

SEQ ID NO: 234312 - DNA, 75 bp, Artificial Sequence
  Synthetic
agcctggaggaacgtgaacgggttgggtcgcggtgtaccccggttcaagacttgtactcgagccggccggagccg

SEQ ID NO: 234313 - DNA, 75 bp, Artificial Sequence
  Synthetic
ttactccaatgtagctttgtaccttccggatgcttacaaatacactccggctaatgtcactctccctactaacac

SEQ ID NO: 234314 - DNA, 75 bp, Artificial Sequence
  Synthetic
agggtagtgtcgccatctttggtggacgcttatgtaaacattggcgcaagatggtctttggatcctatggacaat

SEQ ID NO: 234315 - DNA, 75 bp, Artificial Sequence
  Synthetic
gtctcgacccagcctacaaaaatccaggatacggaatcgagtcgttttgctggttgctgaatggcagggaagtga

SEQ ID NO: 234316 - DNA, 75 bp, Artificial Sequence
  Synthetic
catttggtcagaaaagacaatctttttgttgtccaacttggtagcaaaggatccatatagggcattggataggag

SEQ ID NO: 234317 - DNA, 75 bp, Artificial Sequence
  Synthetic
cccattttagccgttcaccccacagccaatcaccacacagcgcgcacttttttaaattacctcatttgcatattg

SEQ ID NO: 234318 - DNA, 75 bp, Artificial Sequence
  Synthetic
ttgttgtccaacttggtagcaaaggatccatatagggcattggataggagcttggctatggagcgcatggtttga

SEQ ID NO: 234319 - DNA, 75 bp, Artificial Sequence
  Synthetic
gcttctgggcaacggtcgctatgtgcccttccacatccaagtgcctcagaaattttttgctgtgaaaaacctgct

SEQ ID NO: 234320 - DNA, 75 bp, Artificial Sequence
  Synthetic
tggcggcgatgttcagctggacatattcgcgcgccaggcacttccattcagggaagatggttgtcagttcatccg

SEQ ID NO: 234321 - DNA, 75 bp, Artificial Sequence
  Synthetic
cagcagcagcaaccacaaaaggctgtccctgcaactactgcaactgccgccgtgagcggtgcgggacagcccgcc

SEQ ID NO: 234322 - DNA, 75 bp, Artificial Sequence
  Synthetic
tccctgcaactactgcaactgccgccgtgagcggtgcgggacagcccgcctatgatctggacttggaagagggcg

SEQ ID NO: 234323 - DNA, 75 bp, Artificial Sequence
  Synthetic
ttcgcgcgccaggcacttccattcagggaagatggttgtcagttcatccggcacaattctgacttgccagcccct

SEQ ID NO: 234324 - DNA, 75 bp, Artificial Sequence
  Synthetic
acgcttatgtaaacattggcgcaagatggtctttggatcctatggacaatgttaacccctttaatcatcaccgca

SEQ ID NO: 234325 - DNA, 75 bp, Artificial Sequence
  Synthetic
ctggtggccacctctcctcgaagaggttcgttggtccagcagagccgacccccctttctcgaacagaaagggggt

SEQ ID NO: 234326 - DNA, 75 bp, Artificial Sequence
  Synthetic
ctcgcccgagcggcatccgcgagttcaactgaaaaaagattctcgcgaggcgtatgtgccccaacagaacctatt

SEQ ID NO: 234327 - DNA, 75 bp, Artificial Sequence
  Synthetic
gttcgttggtccagcagagccgacccccctttctcgaacagaaagggggtagagggtctagcatgagctcatcag

SEQ ID NO: 234328 - DNA, 75 bp, Artificial Sequence
  Synthetic
tagagacagaagcggcgaggagccagaggagatgcgagcttcccgctttaacgcgggtcgtgagctgcgtcacgg

SEQ ID NO: 234329 - DNA, 75 bp, Artificial Sequence
  Synthetic
tcctggaagtaggtccttgtcaaaatagctgatgggggtgggatcatctaaagccatctgccattctcgagctgc

SEQ ID NO: 234330 - DNA, 75 bp, Artificial Sequence
  Synthetic
acgcgggtcgtgagctgcgtcacggtttggaccgaagacgagtgttgcgggacgaggatttcgaagttgatgaag

SEQ ID NO: 234331 - DNA, 75 bp, Artificial Sequence
  Synthetic
tagctgatgggggtgggatcatctaaagccatctgccattctcgagctgctagcgcgcgctcatatgggttcagt

SEQ ID NO: 234332 - DNA, 75 bp, Artificial Sequence
  Synthetic
tttccattccctctcgcaactgggctgccttcaggggctggtccttcaccagactcaaaaccaaggagactccct

SEQ ID NO: 234333 - DNA, 75 bp, Artificial Sequence
  Synthetic
gccatgctgcgcaatgacaccaatgaccagtcattcaatgactacctctctgcagctaacatgctctacccaatt

SEQ ID NO: 234334 - DNA, 75 bp, Artificial Sequence
  Synthetic
acacgtggctgcagccaaccttgtatcggcttacgagcagacagtaaaggaagagcgtaacttccaaaagtcttt

SEQ ID NO: 234335 - DNA, 75 bp, Artificial Sequence
  Synthetic
tgagcgcagaggcatacatgccacagatgtcatagacataaaggggctcttctagtatgccgatgtatgtgggat

SEQ ID NO: 234336 - DNA, 75 bp, Artificial Sequence
  Synthetic
gatgtcatagacataaaggggctcttctagtatgccgatgtatgtgggataacatcgcccccctctgatgcttgc

SEQ ID NO: 234337 - DNA, 75 bp, Artificial Sequence
  Synthetic
gcccgcgaagaagttacccttggtttgatgcatttgtgggatttgatggaagctatcattcagaaccctactagc

SEQ ID NO: 234338 - DNA, 75 bp, Artificial Sequence
  Synthetic
gatggggcaaggagacccgggcccagattagtgcggttgggcttctctgccctgtagacaatttggcgaaagatg

SEQ ID NO: 234339 - DNA, 75 bp, Artificial Sequence
  Synthetic
gattagtgcggttgggcttctctgccctgtagacaatttggcgaaagatggcatgggaattagaagagatagttg

SEQ ID NO: 234340 - DNA, 75 bp, Artificial Sequence
  Synthetic
caggtcattatccagcctgtacctctccattagcacagccatcacttccatgcccttctcccaggcagataccag

SEQ ID NO: 234341 - DNA, 75 bp, Artificial Sequence
  Synthetic
aaacctctgaccgcacagctgtttctggtggtgcaacacagcagagacaacgaggctttcagagaggcgctgctc

SEQ ID NO: 234342 - DNA, 75 bp, Artificial Sequence
  Synthetic
atggggtaaacctacagaatccctgatgaagtgggcatatgattcttgcaacttggccactagctctgcggtgac

SEQ ID NO: 234343 - DNA, 75 bp, Artificial Sequence
  Synthetic
tacatcccagaggggtacaaggatcgcatgtactccttcttcagaaacttccagcccatgagtaggcaggtggtt

SEQ ID NO: 234344 - DNA, 75 bp, Artificial Sequence
  Synthetic
agtttgtgcgcgagttcgcgccaagacggcgcgtgcagtggcgcggtcgaaaagtacgccaagtgcttagacccg

SEQ ID NO: 234345 - DNA, 75 bp, Artificial Sequence
  Synthetic
tttgggaaaatattacgctcgcaagatctacaagactccatacgttcccatagacaaggaggtgaagatagatgg

SEQ ID NO: 234346 - DNA, 75 bp, Artificial Sequence
  Synthetic
caacaactctggatttgtgggttacctcgctccaaccattcgtcagggtcaagcttatccagctaactacccata

SEQ ID NO: 234347 - DNA, 75 bp, Artificial Sequence
  Synthetic
agagctggacaagctcttgcagagatccctcaaagccctgtggacaggttttgacgagcgcaccgtcgcctcgga

SEQ ID NO: 234348 - DNA, 75 bp, Artificial Sequence
  Synthetic
gttctacatgcgcatgacgctcaaggtcttgaccctgagcgatgatcttggggtgtaccgcaatgacagaatgca

SEQ ID NO: 234349 - DNA, 75 bp, Artificial Sequence
  Synthetic
tctccacagggagagagtatgcttgagcggctttgcgcagtgaggtatgagtaagggcgaaggtgtccctgacca

SEQ ID NO: 234350 - DNA, 75 bp, Artificial Sequence
  Synthetic
cgcgagttaagcgacagggaactgatgcacagtttgcaaagagctctgactggagctggaacagagggtgagaat

SEQ ID NO: 234351 - DNA, 75 bp, Artificial Sequence
  Synthetic
ctcaaaccagtcaccctgcagcaagtgctgcccgtacctgcgagcagaggcgtaaagcgcgagggtgaggaccta

SEQ ID NO: 234352 - DNA, 75 bp, Artificial Sequence
  Synthetic
agtggcagcctagtcgcagggctctaagcgccgcgacggcaggatgtgagcttccttacatagaagaggcggatg

SEQ ID NO: 234353 - DNA, 75 bp, Artificial Sequence
  Synthetic
aagcgccgcgacggcaggatgtgagcttccttacatagaagaggcggatgaaggcgaggaggaagagggcgagta

SEQ ID NO: 234354 - DNA, 75 bp, Artificial Sequence
  Synthetic
aaggcgaggaggaagagggcgagtacttggaagactgatggcgcaacccgtgttttttgctagatggaacagcaa

SEQ ID NO: 234355 - DNA, 75 bp, Artificial Sequence
  Synthetic
ctctgctcgattattgatcacttgcgcagctaggacgatctcgtcaaagccgttaatgttgtgccccactatgta

SEQ ID NO: 234356 - DNA, 75 bp, Artificial Sequence
  Synthetic
gcagctaggacgatctcgtcaaagccgttaatgttgtgccccactatgtacatttctatgaatcgtggggagcct

SEQ ID NO: 234357 - DNA, 75 bp, Artificial Sequence
  Synthetic
taactcctcggacgattggacccaggccatgcaacgtatcatggcgttgacgactcgcaaccccgaagcctttag

SEQ ID NO: 234358 - DNA, 75 bp, Artificial Sequence
  Synthetic
cttcgaaggtgaggtctgtagggtcagagagagcgtagtgttcgagggcccattcgtgcaggtgagggtttgcat

SEQ ID NO: 234359 - DNA, 75 bp, Artificial Sequence
  Synthetic
gaaccctggatgcccgcgcccgttgccgcccccagcaccactagaagatcacgtcgaaagtatggcccagcaagt

SEQ ID NO: 234360 - DNA, 75 bp, Artificial Sequence
  Synthetic
tcggccatcatggaagctgtagtgccttcccgctctaatcccactcatgagaaggtcctggccattgtgaacgcg

SEQ ID NO: 234361 - DNA, 75 bp, Artificial Sequence
  Synthetic
cttcccgctctaatcccactcatgagaaggtcctggccattgtgaacgcgttggtggagaacaaagctattcgtc

SEQ ID NO: 234362 - DNA, 75 bp, Artificial Sequence
  Synthetic
gtagaatgttttggggtcctgctgccaatgatcccacttgagtttcatggcgagatcgtaggcgatgttgacgag

SEQ ID NO: 234363 - DNA, 75 bp, Artificial Sequence
  Synthetic
atccttttggcttctcggatgagcgcctcaagcaaatctaccagtttgagtatgaggggctcctgcgccgcagcg

SEQ ID NO: 234364 - DNA, 75 bp, Artificial Sequence
  Synthetic
gttcgctagtggcgttaaatgcttttttgagtactcagcctgctaatgtgccgcgtggtcaacaggattatacta

SEQ ID NO: 234365 - DNA, 75 bp, Artificial Sequence
  Synthetic
tttgagtactcagcctgctaatgtgccgcgtggtcaacaggattatactaactttttgagtgcgttgagactgat

SEQ ID NO: 234366 - DNA, 75 bp, Artificial Sequence
  Synthetic
ccactcatcttactttcgttctcaccgcgcgcgcatcgaaaaggctaccgcgtttgaccgtatggatatgcaata

SEQ ID NO: 234367 - DNA, 75 bp, Artificial Sequence
  Synthetic
tggtagctcctttcaccgacagcggcagcatcgaccgtaattcctatttgggttacctactaaacctgtatcgcg

SEQ ID NO: 234368 - DNA, 75 bp, Artificial Sequence
  Synthetic
ggttacctactaaacctgtatcgcgaagccatagggcaaagccaggtggacgagcagacctatcaagaaattacc

SEQ ID NO: 234369 - DNA, 75 bp, Artificial Sequence
  Synthetic
caagtcagtcgcgctttgggtcaggaagacactggcagtttggaagccactctgaacttcttgcttaccaatcgg

SEQ ID NO: 234370 - DNA, 75 bp, Artificial Sequence
  Synthetic
aggccggagctgtccagggtcctgagtcgctgcggagtcaggttagtagggaggctctggagattgacttgcaag

SEQ ID NO: 234371 - DNA, 75 bp, Artificial Sequence
  Synthetic
tctgaacttcttgcttaccaatcggtctcagaagatccctcctcaatatgctcttactgcggaggaggagaggat

SEQ ID NO: 234372 - DNA, 75 bp, Artificial Sequence
  Synthetic
taagatggtacttgatctctactggtccgttggtggagatgtcgatggcttgcagggttccatgtcccttgggcg

SEQ ID NO: 234373 - DNA, 75 bp, Artificial Sequence
  Synthetic
ttttggcgggagtggtggtggctctgttgcttcttgcatgttcagaatcggtggcgagggcgagcgccgggcggt

SEQ ID NO: 234374 - DNA, 75 bp, Artificial Sequence
  Synthetic
atgtatgccagtaaccggcctttcattaacaaactgctagactacttgcacagagctgccgctatgaactctgat

SEQ ID NO: 234375 - DNA, 75 bp, Artificial Sequence
  Synthetic
gtcgatggtatcgcctctggtattaacggcgtagtggatctagccaaccaggctgtgcagaaacagataaacagc

SEQ ID NO: 234376 - DNA, 75 bp, Artificial Sequence
  Synthetic
cgcactggctgcccccacctggtttctacacgggcgaatatgacatgcccgaccctaatgacgggtttctgtggg

SEQ ID NO: 234377 - DNA, 75 bp, Artificial Sequence
  Synthetic
acctctttttgatcatcgcacgtggaaaaaggaaggcggcgatagaatgcattcttctgcatcgctgtccggggt

SEQ ID NO: 234378 - DNA, 75 bp, Artificial Sequence
  Synthetic
accggcgagagaaaaaaatttcccaaacaatggaatagaaagtttggtggataagatgagtagatggaagactta

SEQ ID NO: 234379 - DNA, 75 bp, Artificial Sequence
  Synthetic
tgtagaccacggccccttcgggatctcttgcgcgcatgaccacctgggcaaggttgagctccacgtggcgcgtga

SEQ ID NO: 234380 - DNA, 75 bp, Artificial Sequence
  Synthetic
tgctcaggatcacagagacgagcctgggatcatggggactacaagtagagcgagccgtagacgccagcgtcatga

SEQ ID NO: 234381 - DNA, 75 bp, Artificial Sequence
  Synthetic
aggttgagctccacgtggcgcgtgaagaccgcatagttgcagaggcgctggtataggtagttgagtgtggtggcg

SEQ ID NO: 234382 - DNA, 75 bp, Artificial Sequence
  Synthetic
taagaatgcgccaaaccctgcaggaatcttcccatcatcgcagtcagggtcttcatgctggtaaaggtcagcgga

SEQ ID NO: 234383 - DNA, 75 bp, Artificial Sequence
  Synthetic
tggtggcgcgcacttcgcgctcgaaggcccccgggatttcttcctcctcttctaactcttcttccactaacatct

SEQ ID NO: 234384 - DNA, 75 bp, Artificial Sequence
  Synthetic
ggacagattgggtaaattttgttaatttctgtcttgcagctgccatgagtggaagcgcttcttttgaggggggag

SEQ ID NO: 234385 - DNA, 75 bp, Artificial Sequence
  Synthetic
gataccaccaggttgtatctggtggacaacaagtcggcggacattgcttctctgaactatcagaatgaccacagc

SEQ ID NO: 234386 - DNA, 75 bp, Artificial Sequence
  Synthetic
ctccctgaagtggtgacttgggggctctccgttgggcagtgaaagggcgctgattatgcactttatcaattgtcc

SEQ ID NO: 234387 - DNA, 75 bp, Artificial Sequence
  Synthetic
acaatgactttacccctacggaagccagtacccagaccattaactttgatgaacgatcgcggtggggcggtcagc

SEQ ID NO: 234388 - DNA, 75 bp, Artificial Sequence
  Synthetic
cagtacccagaccattaactttgatgaacgatcgcggtggggcggtcagctaaagaccatcatgcatactaacat

SEQ ID NO: 234389 - DNA, 75 bp, Artificial Sequence
  Synthetic
gtctaccttgaccctcagaccggtgaggagctcaacacaaggttcccccaggatgtcccatcgccgaggaagcaa

SEQ ID NO: 234390 - DNA, 75 bp, Artificial Sequence
  Synthetic
gctccacgggcacttcttcttcgcccgctctgccatgcatgcgcgtgagcccaaacccacgcatgggctggacaa

SEQ ID NO: 234391 - DNA, 75 bp, Artificial Sequence
  Synthetic
aaccaagttgattatgcctggagtgtatacgtatgaagcctttcatcctgacattgtcttactgcctggctgtgg

SEQ ID NO: 234392 - DNA, 75 bp, Artificial Sequence
  Synthetic
tgcgaggatggcttgctgcacctgagtgagggtggcttggaagtcgtcgaagtccacaaaacgatggtaggcccc

SEQ ID NO: 234393 - DNA, 75 bp, Artificial Sequence
  Synthetic
agtggactttaccgaaagtcgtttgagcaaccttcttggtatcagaaaaaaacagccatttcaagagggttttaa

SEQ ID NO: 234394 - DNA, 75 bp, Artificial Sequence
  Synthetic
ggtaatattccggccctcttggatgtagatgcctatgagaacagtaagaaagaacaaaaagccaaaatagaagct

SEQ ID NO: 234395 - DNA, 75 bp, Artificial Sequence
  Synthetic
gctgcggaagctaaggcaaacatagttgccagcgactctacaagggttgctaacgctggagaggtcagaggagac

SEQ ID NO: 234396 - DNA, 75 bp, Artificial Sequence
  Synthetic
ctgcagaatcattattggccgatgtatctggaggaacggacgtgaaactcactattcaacctgtagaaaaagata

SEQ ID NO: 234397 - DNA, 75 bp, Artificial Sequence
  Synthetic
ggaagataaaatcaacacagcctatcgcagttggtacctttcgtacaattatggcgatcccgaaaaaggagtgcg

SEQ ID NO: 234398 - DNA, 75 bp, Artificial Sequence
  Synthetic
atggcgatcccgaaaaaggagtgcgttcctggacattgctcaccacctcagatgtcacctgcggagcagagcagg

SEQ ID NO: 234399 - DNA, 75 bp, Artificial Sequence
  Synthetic
aagaccagaacatgcaggatccagacgcctcggacgagggcaagccggtggttagtgacgagcagctgtctcgct

SEQ ID NO: 234400 - DNA, 75 bp, Artificial Sequence
  Synthetic
gcaggatcctgtcactttccgctccactagacaagtcagcaactaccctgtggtgggtgcagagcttatgcccgt

SEQ ID NO: 234401 - DNA, 75 bp, Artificial Sequence
  Synthetic
cttctcaaagagcttctacaacgaacaagctgtgtactcccagcagctccgccagtccacctcgcttacgcacgt

SEQ ID NO: 234402 - DNA, 75 bp, Artificial Sequence
  Synthetic
acatgcccttggctctaagttcttctctaagttctagttgtaaatactctctcatattatcaccaaactgcttag

SEQ ID NO: 234403 - DNA, 75 bp, Artificial Sequence
  Synthetic
cgccagacgccgcacctgtccctacgtgtacaaggcactgggcatagtcgcaccgcgcgtcctttcaagccgcac

SEQ ID NO: 234404 - DNA, 75 bp, Artificial Sequence
  Synthetic
ctcgcccagtaataacaccggttggggtctgcgcgctccaagcaagatgtacggaggcgcacgcaaacgttctac

SEQ ID NO: 234405 - DNA, 75 bp, Artificial Sequence
  Synthetic
cagcgaaggcgaggggtcttctccggggcagagtctgaaactgaccccggggctgtggacctccgcctacctgcg

SEQ ID NO: 234406 - DNA, 75 bp, Artificial Sequence
  Synthetic
cggcgcgggacagcccgcctatgatctggacttggaagagggcgagggactggcgcgcctgggtgcaccatcgcc

SEQ ID NO: 234407 - DNA, 75 bp, Artificial Sequence
  Synthetic
cattttcgcgctccatggggtgccctcaagggccgcactcgcgttcgaaccaccgtcgatgatgtaatcgatgag

SEQ ID NO: 234408 - DNA, 75 bp, Artificial Sequence
  Synthetic
ggtcgcagcgtccgagtcagggttgtttccgtcacggtgaatgggtgcgcgcctggttgggcgcttgcgagggtg

SEQ ID NO: 234409 - DNA, 75 bp, Artificial Sequence
  Synthetic
ggatgcagttattgacagtgtagtggctgacgctcgcaactatgctcgacgtaagagccggcgaaggcgcattgc

SEQ ID NO: 234410 - DNA, 75 bp, Artificial Sequence
  Synthetic
cgcttcagactcatcctgctggtcgagaaccgctgccgatcggcgccctgcatgtcggccaggtagcagtttacc

SEQ ID NO: 234411 - DNA, 75 bp, Artificial Sequence
  Synthetic
atgcgagccgcaagagctctgctacgaagagctagacgcgtgggacgaagagccatgcttagggcggccagacgt

SEQ ID NO: 234412 - DNA, 75 bp, Artificial Sequence
  Synthetic
gaaggatgaaaaaaaaccccgcaaaatcaagcgggctaaaaaggacaaaaaagaagaggaagatggcgatgatgg

SEQ ID NO: 234413 - DNA, 75 bp, Artificial Sequence
  Synthetic
atcaagcgggctaaaaaggacaaaaaagaagaggaagatggcgatgatgggctggcggagtttgtgcgcgagttt

SEQ ID NO: 234414 - DNA, 75 bp, Artificial Sequence
  Synthetic
gtggacgcaaagttcgacatttgttgagacctggaacttcggtggtctttacacccggcgagcgttcaagcgcta

SEQ ID NO: 234415 - DNA, 75 bp, Artificial Sequence
  Synthetic
gctagctcgactgcgacacctagaccactgccgccgctttcgctgcttcgcccgggaactcaccgagttcatcta

SEQ ID NO: 234416 - DNA, 75 bp, Artificial Sequence
  Synthetic
gtacggggatgatgatattcttgagcaggcggctgaccgattaggcgagtttgcttatggcaagcgtagtagaat

SEQ ID NO: 234417 - DNA, 75 bp, Artificial Sequence
  Synthetic
atacccttggatcatggaaatcccacccctagtcttaaaccggtcactttgcagcaagtgttacccgtaactccg

SEQ ID NO: 234418 - DNA, 75 bp, Artificial Sequence
  Synthetic
gcagcaagtgttacccgtaactccgcgaacaggtgttaaacgcgaaggtgaagatttgtatcccactatgcaact

SEQ ID NO: 234419 - DNA, 75 bp, Artificial Sequence
  Synthetic
tgaatgggtttttcagcgattctatgctattagctgctagtgaaggagtggacttagacccaccttctgagaccc

SEQ ID NO: 234420 - DNA, 75 bp, Artificial Sequence
  Synthetic
ggactactccacccgcatgaattggctcagcgccggcccctcgatgatctcacgggttaatgatatacgagctta

SEQ ID NO: 234421 - DNA, 75 bp, Artificial Sequence
  Synthetic
gaggacgttttggagaaagtaaaagtggatccagatattcaacctgaggttaaagtgagacccattaagcaggta

SEQ ID NO: 234422 - DNA, 75 bp, Artificial Sequence
  Synthetic
tggatccagatattcaacctgaggttaaagtgagacccattaagcaggtagcgcctggtctgggagtacaaactg

SEQ ID NO: 234423 - DNA, 75 bp, Artificial Sequence
  Synthetic
tatggaagtgcaaactgaacccgcaaagcctactgccacctccactgaagtgcaaacggatccatggatgccgat

SEQ ID NO: 234424 - DNA, 75 bp, Artificial Sequence
  Synthetic
gcctattacaactgacgccgccggtcccactcgaagatcccgacgaaagtacggtccagcaagtctgttgatgcc

SEQ ID NO: 234425 - DNA, 75 bp, Artificial Sequence
  Synthetic
acggtccagcaagtctgttgatgcccaactatgttgtacacccatctattattcctactcctggttaccgaggca

SEQ ID NO: 234426 - DNA, 75 bp, Artificial Sequence
  Synthetic
tcgctttgctatatgagaacgcactgccattttatttacagtaagtgtgtctaacttaaatttaaagggacagtg

SEQ ID NO: 234427 - DNA, 75 bp, Artificial Sequence
  Synthetic
caactatgttgtacacccatctattattcctactcctggttaccgaggcactcgctactatcgcagccgaaacag

SEQ ID NO: 234428 - DNA, 75 bp, Artificial Sequence
  Synthetic
ccggtgcactcccaattattgtgggcgatctcagaataagaatgcaccaatccctgcatgaatcttcccatcatc

SEQ ID NO: 234429 - DNA, 75 bp, Artificial Sequence
  Synthetic
cctgcaaatcgcagtcgtcgccgtagacgcacaagcaaaccgactcccggcgccctggtgcggcaagtgtaccgc

SEQ ID NO: 234430 - DNA, 75 bp, Artificial Sequence
  Synthetic
gacgcacaagcaaaccgactcccggcgccctggtgcggcaagtgtaccgcaatagtagtgcggaacctttgacac

SEQ ID NO: 234431 - DNA, 75 bp, Artificial Sequence
  Synthetic
tatcatcacttaatcaatgttgccgctgcctccttgcagatatggccctcacttgtcgccttcgcgttcccatca

SEQ ID NO: 234432 - DNA, 75 bp, Artificial Sequence
  Synthetic
ctgcctccttgcagatatggccctcacttgtcgccttcgcgttcccatcactggttaccgaggaagaaattcgcg

SEQ ID NO: 234433 - DNA, 75 bp, Artificial Sequence
  Synthetic
acttgcttgagggtggggatggacctttggacttgagtacccggaaactgccaaggcaatgagtgccctgcacct

SEQ ID NO: 234434 - DNA, 75 bp, Artificial Sequence
  Synthetic
ggaatgcgacgctacaggcgacggcgtgctatccgcaagcaattgcggggtggttttttgccagccttaattcca

SEQ ID NO: 234435 - DNA, 75 bp, Artificial Sequence
  Synthetic
attatcgctgctgcaattggcgcgataccaggcatagcttccgtggcggttcaggcctcgcaacgacattgacat

SEQ ID NO: 234436 - DNA, 75 bp, Artificial Sequence
  Synthetic
tatataagtaggagcagacctgtgtggttagctcacagcagcttgctgccatccatggaggtttgggctatcttg

SEQ ID NO: 234437 - DNA, 75 bp, Artificial Sequence
  Synthetic
cgaggaggagagcttaaccaccccaccacccagtcccgctaccaccacctctaccctcgatgatgaggaggaggt

SEQ ID NO: 234438 - DNA, 75 bp, Artificial Sequence
  Synthetic
gatagcttccggcatcaatggagtggtagatttggctaatcaggctgtgcagaaaaagataaacagtcgtttgga

SEQ ID NO: 234439 - DNA, 75 bp, Artificial Sequence
  Synthetic
gtagatttggctaatcaggctgtgcagaaaaagataaacagtcgtttggacccgccgccagcaaccccaggtgaa

SEQ ID NO: 234440 - DNA, 75 bp, Artificial Sequence
  Synthetic
cgccagaaaaacaaggcgacaagcgtccgcgtcccgatttggaagagacgctggtgacgcgcgtagatgaaccgc

SEQ ID NO: 234441 - DNA, 75 bp, Artificial Sequence
  Synthetic
tggaatggtgccaatatgtaaatgaggtgattttaaaaagtgtgggccgtgtggtgattggctgtggggttaacg

SEQ ID NO: 234442 - DNA, 75 bp, Artificial Sequence
  Synthetic
agatcctcagtggtatactgtctctgtccggggtcctgacggttccgtccgcatggctaataacactttcatttt

SEQ ID NO: 234443 - DNA, 75 bp, Artificial Sequence
  Synthetic
cactttggatttgccccctccccctgctgctactgctgtacccgcttctaagcctgtcgctgccccgaaaccagt

SEQ ID NO: 234444 - DNA, 75 bp, Artificial Sequence
  Synthetic
agcctgtcgctgccccgaaaccagtcgccgtagccaggtcacgtcccgggggcgctcctcgtccaaatgcgcact

SEQ ID NO: 234445 - DNA, 75 bp, Artificial Sequence
  Synthetic
cgccgtagccaggtcacgtcccgggggcgctcctcgtccaaatgcgcactggcaaaatactctgaacagcattgt

SEQ ID NO: 234446 - DNA, 75 bp, Artificial Sequence
  Synthetic
cgccgtcgctgcttttaattaaatatggagtagcgcttaacttgcctatctgtgtatatgtgtcattacacgccg

SEQ ID NO: 234447 - DNA, 75 bp, Artificial Sequence
  Synthetic
tggagtagcgcttaacttgcctatctgtgtatatgtgtcattacacgccgtcacagcagcagaggaaaaaaggaa

SEQ ID NO: 234448 - DNA, 75 bp, Artificial Sequence
  Synthetic
tgtgtgtatgcatacacgtgcttatagccattcgccccagaaacagcaatgaggaaaaagaaaaaatgccataac

SEQ ID NO: 234449 - DNA, 75 bp, Artificial Sequence
  Synthetic
ttataatagatacaccagataaaacagcttttaggtgttgcatgatgggtatgtggccaggggtggctggcatgg

SEQ ID NO: 234450 - DNA, 75 bp, Artificial Sequence
  Synthetic
gcttcagctctttttattcttgctatcattactgttatttccgcacagacaatagtagatatacccattggttct

SEQ ID NO: 234451 - DNA, 75 bp, Artificial Sequence
  Synthetic
tcattactgttatttccgcacagacaatagtagatatacccattggttctaactacaccctaataggacctacaa

SEQ ID NO: 234452 - DNA, 75 bp, Artificial Sequence
  Synthetic
cgcccgcgccacagacacctacttcaatctgggaaataagtttagaaatcccaccgtagcgccgacccacgatgt

SEQ ID NO: 234453 - DNA, 75 bp, Artificial Sequence
  Synthetic
gcttagtactgaagattattataatgtattttgtgatggagatgatgacattcaagtaacctgtgacaaacaaaa

SEQ ID NO: 234454 - DNA, 75 bp, Artificial Sequence
  Synthetic
attgtctttatggctaacactaagctgattctgcatggttgtagcttttttgggtttaataatacttgtgtggaa

SEQ ID NO: 234455 - DNA, 75 bp, Artificial Sequence
  Synthetic
gtattttgtgatggagatgatgacattcaagtaacctgtgacaaacaaaatcttacactcattaatgttacccag

SEQ ID NO: 234456 - DNA, 75 bp, Artificial Sequence
  Synthetic
atgatagatatagcagtgaatttaaaaattacatggtacgaataatccagcccataaatgcaaacactaaaatgg

SEQ ID NO: 234457 - DNA, 75 bp, Artificial Sequence
  Synthetic
agtgcggtacacactggccgtgggcgacaacagagtgctggatatggccagcacgttctttgacattaggggcgt

SEQ ID NO: 234458 - DNA, 75 bp, Artificial Sequence
  Synthetic
aaattacatggtacgaataatccagcccataaatgcaaacactaaaatggaaaaactccacatgaataacacctt

SEQ ID NO: 234459 - DNA, 75 bp, Artificial Sequence
  Synthetic
ccatctgaacaaaatattccaaattcaatgattgcaataattgtggcggtggcggtgggaatggcaatcataata

SEQ ID NO: 234460 - DNA, 75 bp, Artificial Sequence
  Synthetic
caatgattgcaataattgtggcggtggcggtgggaatggcaatcataatagcatgtatgcttatttatgcttgct

SEQ ID NO: 234461 - DNA, 75 bp, Artificial Sequence
  Synthetic
aaagctgaagctgaaattacaaaagaaggactcccaataggtttgaaagtttcagatgaagaaagtaaaccgatt

SEQ ID NO: 234462 - DNA, 75 bp, Artificial Sequence
  Synthetic
acaagatccactacttaattatgatttttaattttttattttttatacagacatgatttacacagttcttaccat

SEQ ID NO: 234463 - DNA, 75 bp, Artificial Sequence
  Synthetic
ttttaattttttattttttatacagacatgatttacacagttcttaccatctttagcttaatttctgcctcttat

SEQ ID NO: 234464 - DNA, 75 bp, Artificial Sequence
  Synthetic
ctggatccaaatacacactaaaaggaccagatggtcacaatggtgttatttggtggaggatatttgacgatggag

SEQ ID NO: 234465 - DNA, 75 bp, Artificial Sequence
  Synthetic
accagatggtcacaatggtgttatttggtggaggatatttgacgatggagggtttgttaacccctgtagcacatc

SEQ ID NO: 234466 - DNA, 75 bp, Artificial Sequence
  Synthetic
cgcctctgggtgaaagctaccggccccgtgagcttgaacctgaaagagagttcaacagaatcaatctcggtatcg

SEQ ID NO: 234467 - DNA, 75 bp, Artificial Sequence
  Synthetic
gtgaaaggcggtcaggcaaaaccaaaaacaacggagcagccaaatcagaaagtcgaatatgatattgacatggag

SEQ ID NO: 234468 - DNA, 75 bp, Artificial Sequence
  Synthetic
gacctaactattattaatgccacaaaaagtgataatggctattactatggaactaactatattactagcttagac

SEQ ID NO: 234469 - DNA, 75 bp, Artificial Sequence
  Synthetic
aaagtgataatggctattactatggaactaactatattactagcttagactacaccattactgtcatatctccca

SEQ ID NO: 234470 - DNA, 75 bp, Artificial Sequence
  Synthetic
agtgaaggcgaggggtcttctccggggcagagtctgaaactgacaccggggctgtggacctccgcctacctgcgc

SEQ ID NO: 234471 - DNA, 75 bp, Artificial Sequence
  Synthetic
aactttctctagcagcagtactataaccacaaccaaaattaaaacaacttctaatattgaacacgtgcaaaaaat

SEQ ID NO: 234472 - DNA, 75 bp, Artificial Sequence
  Synthetic
accacaaccaaaattaaaacaacttctaatattgaacacgtgcaaaaaatggcttctaattctaccttacccgct

SEQ ID NO: 234473 - DNA, 75 bp, Artificial Sequence
  Synthetic
ttggaataattgtagcagcaatagtgggtttgtcaatcattatttcttgcataatttactatgcctgctgctata

SEQ ID NO: 234474 - DNA, 75 bp, Artificial Sequence
  Synthetic
gggtttgtcaatcattatttcttgcataatttactatgcctgctgctatagaaaaatagaaaaaggagaccccct

SEQ ID NO: 234475 - DNA, 75 bp, Artificial Sequence
  Synthetic
tcaacgctgacctatgccactttgagctcttcacccttggatgcagctgcagccgctgccgcctctgctgccgcc

SEQ ID NO: 234476 - DNA, 75 bp, Artificial Sequence
  Synthetic
tgttggatgtagaagcctatgagaacagtaagaaagaacaagaagccaaaacagaagccgctaaagctgctgcta

SEQ ID NO: 234477 - DNA, 75 bp, Artificial Sequence
  Synthetic
tatagcactatgaaacacctatgtattttagctatttcaatttttagtttttgctcatctacccccatcgccact

SEQ ID NO: 234478 - DNA, 75 bp, Artificial Sequence
  Synthetic
accgaaactacagagacaaaactcactattaaacctgtagaaaaagacagcaagagtagaagttacaatgtcttg

SEQ ID NO: 234479 - DNA, 75 bp, Artificial Sequence
  Synthetic
atgttaacactacaaattacacatctacctcatatgtaactatctcttctacccagcctattgctttctccacaa

SEQ ID NO: 234480 - DNA, 75 bp, Artificial Sequence
  Synthetic
tgcactacaactagaaatcactatcctaattgtaattggaataactattctagctgttcttctttattttatctt

SEQ ID NO: 234481 - DNA, 75 bp, Artificial Sequence
  Synthetic
caccccgtccaatgtcactcttccagaaaacaaaaacacctacgactacatgaacgggcgggtggtgccgccatc

SEQ ID NO: 234482 - DNA, 75 bp, Artificial Sequence
  Synthetic
attgtcctatgattagtaaacctcacttggccttaaatgaaatctaaggtctattctttttctttttacagtatg

SEQ ID NO: 234483 - DNA, 75 bp, Artificial Sequence
  Synthetic
ggcgccaggtggtctctggatgctatggacaatgtcaacccattcaaccaccaccgtaacgctggcttgcgttac

SEQ ID NO: 234484 - DNA, 75 bp, Artificial Sequence
  Synthetic
aatttcttcttcaccatactcatctgtgctttcaatgtctgtgctaccttcacagcagtagccactgcaacccca

SEQ ID NO: 234485 - DNA, 75 bp, Artificial Sequence
  Synthetic
ggatgtgaacatggtgctacagagttcccttggtaacgacctacgggtagatggcgccagcatcagtttcacgag

SEQ ID NO: 234486 - DNA, 75 bp, Artificial Sequence
  Synthetic
cgcaatcaaaatgttgcggcacttctcaggcttatctaaaaccatgcaggctatactaccagtcattctgattct

SEQ ID NO: 234487 - DNA, 75 bp, Artificial Sequence
  Synthetic
tcaggcttatctaaaaccatgcaggctatactaccagtcattctgattctgctgctcccctgtgttgccttagct

SEQ ID NO: 234488 - DNA, 75 bp, Artificial Sequence
  Synthetic
cccatggctcacaacaccgcttccacccttgaagccatgctgcggaatgacaccaatgatcagtcattcaacgac

SEQ ID NO: 234489 - DNA, 75 bp, Artificial Sequence
  Synthetic
cccttgaagccatgctgcggaatgacaccaatgatcagtcattcaacgactacctatctgcagctaacatgctct

SEQ ID NO: 234490 - DNA, 75 bp, Artificial Sequence
  Synthetic
aacaacttagaaaatgcaaatttcaacagccatggtcattccttgattgctaccaagaaaaatctgattttccca

SEQ ID NO: 234491 - DNA, 75 bp, Artificial Sequence
  Synthetic
tattcccatttccattccttctcgcaactgggcggctttcagaggctggtcatttaccagactcaaaaccaaaga

SEQ ID NO: 234492 - DNA, 75 bp, Artificial Sequence
  Synthetic
agggtatttaaacctgacgagttccgtcaagaggccactctttgagtgccagcgagaagagttttctcctccgcg

SEQ ID NO: 234493 - DNA, 75 bp, Artificial Sequence
  Synthetic
ttaattttgggtggaatgttcccaatgcacttgctcacccacaaaatccagaggaacacattccactacagaaca

SEQ ID NO: 234494 - DNA, 75 bp, Artificial Sequence
  Synthetic
aatgagacacctgcgtttcctgccacaggagattatctccagtgagaccgggatcgaaatactggagtttgtggt

SEQ ID NO: 234495 - DNA, 75 bp, Artificial Sequence
  Synthetic
tgagctggcctggaaatgacaggttactatctcccaacgaatttgaaataaagcgcactgtggatggcgaaggct

SEQ ID NO: 234496 - DNA, 75 bp, Artificial Sequence
  Synthetic
ttatgaaaatgagccacagcctccactactccctgccattagctacttcaacctaaccggtggagatgactgacc

SEQ ID NO: 234497 - DNA, 75 bp, Artificial Sequence
  Synthetic
gggaccgtaaatgaccccgattacgggttgcagatggtagtttagggagcggcagctgccgtcctcccggagcag

SEQ ID NO: 234498 - DNA, 75 bp, Artificial Sequence
  Synthetic
gtttccatcatgtttgactcttcagtgagctggcctggaaatgacaggttactatctcccaacgaatttgaaata

SEQ ID NO: 234499 - DNA, 75 bp, Artificial Sequence
  Synthetic
ctcgccaactacaacatcggctatcagggcttctacattccagaaggatacaaagatcgcatgtattcatttttc

SEQ ID NO: 234500 - DNA, 75 bp, Artificial Sequence
  Synthetic
tacgcattcgccagcagcaggaacgtgccgccaaggagctcagggatgctattgagattcaccagtgcaaaaaag

SEQ ID NO: 234501 - DNA, 75 bp, Artificial Sequence
  Synthetic
agggcttctacattccagaaggatacaaagatcgcatgtattcatttttcagaaacttccagcccatgagcaggc

SEQ ID NO: 234502 - DNA, 75 bp, Artificial Sequence
  Synthetic
agacttcaaggccgtcgccataccctaccaacacaacaactctggctttgtgggttacatggctccgaccatgcg

SEQ ID NO: 234503 - DNA, 75 bp, Artificial Sequence
  Synthetic
taccaacacaacaactctggctttgtgggttacatggctccgaccatgcgccaaggtcaaccctatcccgctaac

SEQ ID NO: 234504 - DNA, 75 bp, Artificial Sequence
  Synthetic
ctgccgtaaatagtgttacgcagaaaaagttcttgtgtgacagaaccatgtggcgcataccgttctcgagcaact

SEQ ID NO: 234505 - DNA, 75 bp, Artificial Sequence
  Synthetic
tcctagaaatttcttcttcaccatactcatctgtgctttcaatgtctgtgctactttcacagcagtagccactgc

SEQ ID NO: 234506 - DNA, 75 bp, Artificial Sequence
  Synthetic
agccaattaataaaaatcacttacttaaaatcagaaataaggtttttgtctgcgttgttttcaagcagcacctca

SEQ ID NO: 234507 - DNA, 75 bp, Artificial Sequence
  Synthetic
ttacttgcatctgcgtgtgtagcatagtctgcctggttattaattttttccaactggtagactggatctttgtgc

SEQ ID NO: 234508 - DNA, 75 bp, Artificial Sequence
  Synthetic
atcagccacatcgcggcatcatcgagacagtctacctgcgtacaccgttctcggccggtaacgctaccacgtaaa

SEQ ID NO: 234509 - DNA, 75 bp, Artificial Sequence
  Synthetic
gcactcgctactaccgcagccggagcagcacttcccgccgtcgccgcaaaacacctgcaagtcgtagtcaccgtc

SEQ ID NO: 234510 - DNA, 75 bp, Artificial Sequence
  Synthetic
agcagctgcaaccatggcctgcggatcccaaaacggctccagcgagcaagagctcagagccattgtccaagacct

SEQ ID NO: 234511 - DNA, 75 bp, Artificial Sequence
  Synthetic
tcccaaaacggctccagcgagcaagagctcagagccattgtccaagacctgggttgcggaccctattttttggga

SEQ ID NO: 234512 - DNA, 75 bp, Artificial Sequence
  Synthetic
cctttataaaccctggtttcatttcctcaaatggatttacacaaagcccagatggggttcttacacttaaatgct

SEQ ID NO: 234513 - DNA, 75 bp, Artificial Sequence
  Synthetic
tgattgctaccatgaaaaatctgattttcccacatactggatagtgattgttggaataattaacatactttcatg

SEQ ID NO: 234514 - DNA, 75 bp, Artificial Sequence
  Synthetic
tcatggcccccgataagctcgcctgtgccattgtaaacacggccggacgtgagacggggggagagcactggttgg

SEQ ID NO: 234515 - DNA, 75 bp, Artificial Sequence
  Synthetic
tgccattgtaaacacggccggacgtgagacggggggagagcactggttggctttcggttggaacccacgttctaa

SEQ ID NO: 234516 - DNA, 75 bp, Artificial Sequence
  Synthetic
ctcccttcaacttaaagttggaggaggattatcagtggatgacactgacggttcattagaagaaaacataagcat

SEQ ID NO: 234517 - DNA, 75 bp, Artificial Sequence
  Synthetic
ggattatcagtggatgacactgacggttcattagaagaaaacataagcattacagcaccacttaataaaacaagt

SEQ ID NO: 234518 - DNA, 75 bp, Artificial Sequence
  Synthetic
ggattctcggatgatcgtcttaaacagatttaccagtttgaatatgagggtctcctgcgccgcagcgctcttgct

SEQ ID NO: 234519 - DNA, 75 bp, Artificial Sequence
  Synthetic
atgggttggaaacaaaaaacaaccaactatgtgctaagctgggagacggtcttacatttaatacaggcagcatat

SEQ ID NO: 234520 - DNA, 75 bp, Artificial Sequence
  Synthetic
tctcctgcgccgcagcgctcttgctaccaaggaccgctgtattacgctggaaaaatctacccagaccgtgcaggg

SEQ ID NO: 234521 - DNA, 75 bp, Artificial Sequence
  Synthetic
cggtatgtaaacacatgtccccctcctccacatccaagaatgtgattggcttgtaagtgtatgccacgtgaccag

SEQ ID NO: 234522 - DNA, 75 bp, Artificial Sequence
  Synthetic
actatgtgctaagctgggagacggtcttacatttaatacaggcagcatatgcatagatactgacattaatacatt

SEQ ID NO: 234523 - DNA, 75 bp, Artificial Sequence
  Synthetic
ttctgctgcatgttccttcatgcctttgtgcactggcctgaccgtcccatggacggaaaccccaccatgaaattg

SEQ ID NO: 234524 - DNA, 75 bp, Artificial Sequence
  Synthetic
aattgcttagtccttggaactgaatctaatgattgtaaacttacactggcacttgtaaagtcaggagccttagta

SEQ ID NO: 234525 - DNA, 75 bp, Artificial Sequence
  Synthetic
ggacggaaaccccaccatgaaattgctgactggagtgccaaacaacatgcttcattctcctaaagtccagcccac

SEQ ID NO: 234526 - DNA, 75 bp, Artificial Sequence
  Synthetic
ctaatgattgtaaacttacactggcacttgtaaagtcaggagccttagtaaatgcttacgtagcacttgttggag

SEQ ID NO: 234527 - DNA, 75 bp, Artificial Sequence
  Synthetic
cacagaaacaagtgctcaaataattgcagacatatattttgatgcgcaaggaaaacttcttcctgatttatcagc

SEQ ID NO: 234528 - DNA, 75 bp, Artificial Sequence
  Synthetic
gcagacatatattttgatgcgcaaggaaaacttcttcctgatttatcagcactcaaaacagagctaaaacacaaa

SEQ ID NO: 234529 - DNA, 75 bp, Artificial Sequence
  Synthetic
gagcgggcttaaaaattttggctctaccataaaaacctatgggaacaaagcttggaacagcagcacagggcaggc

SEQ ID NO: 234530 - DNA, 75 bp, Artificial Sequence
  Synthetic
cgtatggatgtgcaataatgactcatgtaaacaacgtgttgaataaacagcactttattttttacatgtatcaag

SEQ ID NO: 234531 - DNA, 75 bp, Artificial Sequence
  Synthetic
atcccaataactgtaaaagctttatgccaagtctaaatgcatatccactgcgccccaatggaggcaacggaaact

SEQ ID NO: 234532 - DNA, 75 bp, Artificial Sequence
  Synthetic
gccaagtctaaatgcatatccactgcgccccaatggaggcaacggaaactatatttatggaaccacctactacag

SEQ ID NO: 234533 - DNA, 75 bp, Artificial Sequence
  Synthetic
gctctggattacttatttatttacaagtcgaatgggttctgacgagaatcagaatgacccgcgggcagtgatacg

SEQ ID NO: 234534 - DNA, 75 bp, Artificial Sequence
  Synthetic
agaatgacccgcgggcagtgatacgttgcggaactgatacttgggttgccacttgaattcgggaatcaccaactt

SEQ ID NO: 234535 - DNA, 75 bp, Artificial Sequence
  Synthetic
aggtccgttgaaattacacataataacaaaacatggaacaataccttatccaccacatgggagccaggagttccc

SEQ ID NO: 234536 - DNA, 75 bp, Artificial Sequence
  Synthetic
cttaaaacctctgtaatgcttaactacaaaattaccagtggactatgtgcatatgccatgcattttcagtggtct

SEQ ID NO: 234537 - DNA, 75 bp, Artificial Sequence
  Synthetic
tcactccacagctttctggtcagctgcaaagctcccagcaggtcaggagccgaaatcttgaaatcacaattagga

SEQ ID NO: 234538 - DNA, 75 bp, Artificial Sequence
  Synthetic
gcaaagctcccagcaggtcaggagccgaaatcttgaaatcacaattaggaccagtgctctgagcgcgagagttgc

SEQ ID NO: 234539 - DNA, 75 bp, Artificial Sequence
  Synthetic
tggaatagtgggactaaaccagaagacactcccgccactttcattgcctccccctttgtcttttcctacattaga

SEQ ID NO: 234540 - DNA, 75 bp, Artificial Sequence
  Synthetic
caccatcagcgacggatgtctcacgcttgccagcacggtgggatctgcaatcatgcccacatccagatcttcagc

SEQ ID NO: 234541 - DNA, 75 bp, Artificial Sequence
  Synthetic
cttgccagcacggtgggatctgcaatcatgcccacatccagatcttcagcattggcaatgctgaacggggtcatc

SEQ ID NO: 234542 - DNA, 75 bp, Artificial Sequence
  Synthetic
gcacccaattaggcttgtggttgcaatcgcagtgcagggggattagtatcatcttggcctgatcctgtctgattc

SEQ ID NO: 234543 - DNA, 75 bp, Artificial Sequence
  Synthetic
ttcacagtccagttgctgtggctgcggctccggagtctggatcagagtcatctggaagaagaacgatgggagtca

SEQ ID NO: 234544 - DNA, 75 bp, Artificial Sequence
  Synthetic
atcatattgcttgaaagcctgctgggctttactaccctcggtatagaacatcccgcaggacctgctcgaaaactg

SEQ ID NO: 234545 - DNA, 75 bp, Artificial Sequence
  Synthetic
ttttaaattaaatatggagtagcgcttaacttgcctgtctgtgtgtatgtgtcatcatcacgccgccgcagcaac

SEQ ID NO: 234546 - DNA, 75 bp, Artificial Sequence
  Synthetic
catcatcaataatataccttatagatggaatggtgccaatatgtaaatgaggtgattttaaaaattgtggggtgt

SEQ ID NO: 234547 - DNA, 75 bp, Artificial Sequence
  Synthetic
acacagcagcgggcgtcattgttggctatttgcaccacacttctgccccagcggttttgggtgattttggttcgc

SEQ ID NO: 234548 - DNA, 75 bp, Artificial Sequence
  Synthetic
cagcaggcaccggaccccgcaatgcgggcggcgctgcagagccagccgtccggcattaactcctcggacgattgg

SEQ ID NO: 234549 - DNA, 75 bp, Artificial Sequence
  Synthetic
ctatttgcaccacacttctgccccagcggttttgggtgattttggttcgctcgggattctccttcaaggctcgtt

SEQ ID NO: 234550 - DNA, 75 bp, Artificial Sequence
  Synthetic
gaaaatgacgttttgtgggggtggagtttttttgcaagttgtcgcgggaaatgtgacgcataaaaaggctttttt

SEQ ID NO: 234551 - DNA, 75 bp, Artificial Sequence
  Synthetic
ctcgataatctgctccttctgaatcataatagtgccatgcaggcacttcagcttgccctcataatcattgcagcc

SEQ ID NO: 234552 - DNA, 75 bp, Artificial Sequence
  Synthetic
ataatagtgccatgcaggcacttcagcttgccctcataatcattgcagccatgaggccacaacgcacagcctgta

SEQ ID NO: 234553 - DNA, 75 bp, Artificial Sequence
  Synthetic
acggtatttaacaggaaatgaggtagttttgaccggatgcaagtgaaaattgctgatttgcgcgcgaaaactgaa

SEQ ID NO: 234554 - DNA, 75 bp, Artificial Sequence
  Synthetic
gagaaaaagaatgtatcattccctgcagaaatcttcccatcatcgtgctcagtgtcttgtgactagtgaaagtta

SEQ ID NO: 234555 - DNA, 75 bp, Artificial Sequence
  Synthetic
ccctccagaacacactgcccacatacatgatctccttaggcatatgcatattcacaatctctcggtaccatggac

SEQ ID NO: 234556 - DNA, 75 bp, Artificial Sequence
  Synthetic
cagaaatcttcccatcatcgtgctcagtgtcttgtgactagtgaaagttaactggacgcctcggtgctcctcgtt

SEQ ID NO: 234557 - DNA, 75 bp, Artificial Sequence
  Synthetic
cagtttaataataaaaaaatgagagatttgcgatttctgcctcaggaaataatttctgctgagactggaaatgaa

SEQ ID NO: 234558 - DNA, 75 bp, Artificial Sequence
  Synthetic
aatttctgctgagactggaaatgaaatactggagcttgtggtgcacgccctgatgggagacgatccggagccacc

SEQ ID NO: 234559 - DNA, 75 bp, Artificial Sequence
  Synthetic
gaaattgcgggtgatgcggaaaggctggggcacctctgcccggttattgatcacctgagcggctaggacgatctc

SEQ ID NO: 234560 - DNA, 75 bp, Artificial Sequence
  Synthetic
tttgccatccttctcaacgatgcgcacgggcgggtagctgaaacctactgctacaagctgcgcctcttctctttc

SEQ ID NO: 234561 - DNA, 75 bp, Artificial Sequence
  Synthetic
tatcccagggaataggaagctcttgcaaaacagtaaaggtggcagaacaaggcagaccgcgaacataacttacac

SEQ ID NO: 234562 - DNA, 75 bp, Artificial Sequence
  Synthetic
ggagacagggaggattgtgaagtttcgctcaccattaccaactgactgtcggtagaagaacctgaccccacacgg

SEQ ID NO: 234563 - DNA, 75 bp, Artificial Sequence
  Synthetic
atcgcgaggccatagggcagagccaggtggacgagcagacctatcaagaaatcacccaagtgagccgcgccctgg

SEQ ID NO: 234564 - DNA, 75 bp, Artificial Sequence
  Synthetic
gaaaaatatctatagtagcacaacaaagacataaatgcatgcatcttctcataatttttaactcctctggattta

SEQ ID NO: 234565 - DNA, 75 bp, Artificial Sequence
  Synthetic
cgacaggtgtttctcttcgggggcagaggtggaggcgattgcgaagggctgcggtccgacctggaaggcggatga

SEQ ID NO: 234566 - DNA, 75 bp, Artificial Sequence
  Synthetic
aggaccatgaaaaggagcagtctatgcagactgcagcgggtgagggagtgaaggctgccagtgttggttttcagt

SEQ ID NO: 234567 - DNA, 75 bp, Artificial Sequence
  Synthetic
gcaaacttcagtccaaaaattgtgatgtatgcagaaaatgtagacttggaaaccccagacactcacgtggtgtac

SEQ ID NO: 234568 - DNA, 75 bp, Artificial Sequence
  Synthetic
attgaagtacagccattcccgtagattggtcaaaagttcctcggcttcagttgtcataaaaactccatcatatct

SEQ ID NO: 234569 - DNA, 75 bp, Artificial Sequence
  Synthetic
attgtgttctcctaggcagagaaacaacagacatggaaactcagccattgctgtcaacatcgccacaagtgccat

SEQ ID NO: 234570 - DNA, 75 bp, Artificial Sequence
  Synthetic
aataccactaacactatcaatgtgcagactactttaaatcatgacatggaaaaccacactacctcctatgcatac

SEQ ID NO: 234571 - DNA, 75 bp, Artificial Sequence
  Synthetic
aaaggagcagagcttaaccattccaccgcccagtcctgccaccacctctaccctagaagataaggaggtcgacgc

SEQ ID NO: 234572 - DNA, 75 bp, Artificial Sequence
  Synthetic
ccgcccagtcctgccaccacctctaccctagaagataaggaggtcgacgcatctcatgacatgcagaataaaaaa

SEQ ID NO: 234573 - DNA, 75 bp, Artificial Sequence
  Synthetic
agcaagacccgggctatgtgacaccggtggaacacgaggaagagttgaaacgctttctagagagagaggatgaaa

SEQ ID NO: 234574 - DNA, 75 bp, Artificial Sequence
  Synthetic
ctatcaccaagatgctggaaatagggatcagaacaccgactacctcatagggcttgacggggaagacgcgctcct

SEQ ID NO: 234575 - DNA, 75 bp, Artificial Sequence
  Synthetic
gatcagaacaccgactacctcatagggcttgacggggaagacgcgctccttaaacatctagcaagacagtcactc

SEQ ID NO: 234576 - DNA, 75 bp, Artificial Sequence
  Synthetic
atccgtgtttacttaaggtgacgtcaatatttgtgtgagagtgcaatgtaataaaaatatgttaactgttcactg

SEQ ID NO: 234577 - DNA, 75 bp, Artificial Sequence
  Synthetic
acggccaagacaataagtgttccatatccgtgtttacttaaggtgacgtcaatatttgtgtgagagtgcaatgta

SEQ ID NO: 234578 - DNA, 75 bp, Artificial Sequence
  Synthetic
atagtcaaggatgcattattggacagaactgaagtgcccatcagtgtggaagagctcagccgcgcctacgagctt

SEQ ID NO: 234579 - DNA, 75 bp, Artificial Sequence
  Synthetic
ggaaatctctttgccatggaaattaacctccaagctaatctctggagaagttttctttattccaatgtggctctg

SEQ ID NO: 234580 - DNA, 75 bp, Artificial Sequence
  Synthetic
cattcttaagcacaccctcatagtgaaaaaatatcgtgctcctctgtcacctgcagcaaattaagaatggcaaca

SEQ ID NO: 234581 - DNA, 75 bp, Artificial Sequence
  Synthetic
ccaaacgccagccaaacggcacctgcgagccaaatcctcgcttaaacttttatccagcttttgctgtgccagaag

SEQ ID NO: 234582 - DNA, 75 bp, Artificial Sequence
  Synthetic
tactggctacttatcacatcttttttaaaaatcaaaaaattccagtctcctgccgcgctaatcgcacccgcgctg

SEQ ID NO: 234583 - DNA, 75 bp, Artificial Sequence
  Synthetic
catcatcaataatataccttatagatggaatggtgccaatatgtaaatgaggtgattttaaaaagtgtggatcgt

SEQ ID NO: 234584 - DNA, 75 bp, Artificial Sequence
  Synthetic
aacgaggtgtggtttgaacacggaagtagacagttttcccacgcttactgacaggatatgaggtagttttgggcg

SEQ ID NO: 234585 - DNA, 75 bp, Artificial Sequence
  Synthetic
gaaaatggcatggatgagcatcacagcgttctggtggaattggagggcgataatgccagactcgcagtactcaag

SEQ ID NO: 234586 - DNA, 75 bp, Artificial Sequence
  Synthetic
gagacgagccgtgctaggcggagcggtggtgtatccggagggtcctcctccttcttacgagagcgtgatgcagca

SEQ ID NO: 234587 - DNA, 75 bp, Artificial Sequence
  Synthetic
cataccccgctgtcaacctgccccctaaagtcatgacggcggtcatggaccagttactcattaagcgcgcaagtc

SEQ ID NO: 234588 - DNA, 75 bp, Artificial Sequence
  Synthetic
taaagtcatgacggcggtcatggaccagttactcattaagcgcgcaagtcccctttcagaagacatgcatgaccc

SEQ ID NO: 234589 - DNA, 75 bp, Artificial Sequence
  Synthetic
cttgaagccatgctgcgcaatgacaccaatgatcaatcattcaatgactacctttctgcagccaacatgctctac

SEQ ID NO: 234590 - DNA, 75 bp, Artificial Sequence
  Synthetic
gtggtcagtgatgagcagctaacccgatggctgggcaccgactctccccgggatttggaagagcgtcgcaagctt

SEQ ID NO: 234591 - DNA, 75 bp, Artificial Sequence
  Synthetic
gatggctgggcaccgactctccccgggatttggaagagcgtcgcaagcttatgatggccgtagtgctggttaccg

SEQ ID NO: 234592 - DNA, 75 bp, Artificial Sequence
  Synthetic
accacacagcgcgcacttttttaaatacctcatttgcatgttggcaccattccatctttaaggtatattattgat

SEQ ID NO: 234593 - DNA, 75 bp, Artificial Sequence
  Synthetic
ctttaccgattcagaaaccttgcgcaaactcgaagagaatctgcactacacttttagacacggctttgtgcggca

SEQ ID NO: 234594 - DNA, 75 bp, Artificial Sequence
  Synthetic
ctgtgtggtgattggctgcggggtgaacggctaaaaggggcgggcaatgctgggaggtgacgtaatttatgtggg

SEQ ID NO: 234595 - DNA, 75 bp, Artificial Sequence
  Synthetic
cttttagacacggctttgtgcggcaggcgtgcaagatatctaacgtggaactcaccaacctggtttcctacatgg

SEQ ID NO: 234596 - DNA, 75 bp, Artificial Sequence
  Synthetic
agctcccggcccctccaggatcacatacaaagcctcagcagccatagcttaccgcgcaaatcaggcacagcagtc

SEQ ID NO: 234597 - DNA, 75 bp, Artificial Sequence
  Synthetic
aggagttatgttgcaagttattgcggtaaaggtgacgtaaaacgaggtgtggtttggacacggaagtagacagtt

SEQ ID NO: 234598 - DNA, 75 bp, Artificial Sequence
  Synthetic
acaaagcgtgctgcacagcacccttaagggggaagcccgccgtgattacatccgcgattgtgtctatctctacct

SEQ ID NO: 234599 - DNA, 75 bp, Artificial Sequence
  Synthetic
aagggggaagcccgccgtgattacatccgcgattgtgtctatctctacctgtgccacacgtggcaaaccggcatg

SEQ ID NO: 234600 - DNA, 75 bp, Artificial Sequence
  Synthetic
cctccagaagacggatgagatcggcgatggtggcgcgcacctcgcgctcgaaggcccccgggatttcttcctcct

SEQ ID NO: 234601 - DNA, 75 bp, Artificial Sequence
  Synthetic
aacagaacttgaaagagcttaacaagctcttacagaaatctcttaaggttctgtggacagggttcgacgagcgca

SEQ ID NO: 234602 - DNA, 75 bp, Artificial Sequence
  Synthetic
agtatttgccgagggccgagtagactttgaccgtttacgtggaggtttcgattaccgtgtttttcacctaaattt

SEQ ID NO: 234603 - DNA, 75 bp, Artificial Sequence
  Synthetic
ctgtggacagggttcgacgagcgcaccgtcgcttccgacctggcagacctcatcttcccagagcgtcttagggtt

SEQ ID NO: 234604 - DNA, 75 bp, Artificial Sequence
  Synthetic
ttttcgctctttcatcctggaacgctccggtatcctgcccgccacctgctgcgcactgccctccgactttgtgcc

SEQ ID NO: 234605 - DNA, 75 bp, Artificial Sequence
  Synthetic
ttttggtttcaacaatacctgtgtagatgcctggggacaggttagtgtacggggatgtagtttctatgcgtgttg

SEQ ID NO: 234606 - DNA, 75 bp, Artificial Sequence
  Synthetic
taagtcttgtgaatttcacaggaataacactggaatgaaagaactattgtgctcgctttgctatatgagaatgca

SEQ ID NO: 234607 - DNA, 75 bp, Artificial Sequence
  Synthetic
ggggatgtagtttctatgcgtgttggattgccacagctggcagaaccaagagtcaattgtctctgaagaaatgca

SEQ ID NO: 234608 - DNA, 75 bp, Artificial Sequence
  Synthetic
agatgaaagcagctcacaacacccctttataaaccctggtttcatttcctcaaatggttttgcacaaagcccaga

SEQ ID NO: 234609 - DNA, 75 bp, Artificial Sequence
  Synthetic
ccaccggtccctagcttgcaacccccagttgatgagcgaaacccagataataggcacctttgaactgcaaggccc

SEQ ID NO: 234610 - DNA, 75 bp, Artificial Sequence
  Synthetic
cagttgatgagcgaaacccagataataggcacctttgaactgcaaggccccagcagccaaggcgatgggtcttct

SEQ ID NO: 234611 - DNA, 75 bp, Artificial Sequence
  Synthetic
tgcggtgcttccgatgagaggccttatcaaatgctcacttgtgccggtgggcattgtaatatgctggctactgtg

SEQ ID NO: 234612 - DNA, 75 bp, Artificial Sequence
  Synthetic
ggctggtaacgccaccacataagaaacctgcttcttgcaaggtgcagccatggcctgcgggtccggaaacggctc

SEQ ID NO: 234613 - DNA, 75 bp, Artificial Sequence
  Synthetic
cgggactgtggacctctgcctacttgcgcaagtttgccccggaagattaccacccctatgaaatcaagttctatg

SEQ ID NO: 234614 - DNA, 75 bp, Artificial Sequence
  Synthetic
gcgcaagtttgccccggaagattaccacccctatgaaatcaagttctatgaggaccaatcacagcctccaaaggc

SEQ ID NO: 234615 - DNA, 75 bp, Artificial Sequence
  Synthetic
cagcgagcaagagctcaaagccatcgtccgagaccttggctgtggaccctacttcctgggaacctttgacaaacg

SEQ ID NO: 234616 - DNA, 75 bp, Artificial Sequence
  Synthetic
aagccatccaaaaatcccgccaagaatttctactgaaaaagggtaagggggtctaccttgacccccagaccggcg

SEQ ID NO: 234617 - DNA, 75 bp, Artificial Sequence
  Synthetic
gaagatcctgaggtatgatgatacgagatcgagggtgcgcgcatgcgaatgcggaggcaagcatgccaggttcca

SEQ ID NO: 234618 - DNA, 75 bp, Artificial Sequence
  Synthetic
gcactggttggcttttggttggaacccgcgctccaacacatgctacctttttgatccgtttggattttcggatga

SEQ ID NO: 234619 - DNA, 75 bp, Artificial Sequence
  Synthetic
ggatgtcccaacgacgagaaagcaagaagttgaaggtgcagccgccgcccccagaagatatggaggaagattggg

SEQ ID NO: 234620 - DNA, 75 bp, Artificial Sequence
  Synthetic
gaagttgaaggtgcagccgccgcccccagaagatatggaggaagattgggacagtcaggcagaggaagcggagga

SEQ ID NO: 234621 - DNA, 75 bp, Artificial Sequence
  Synthetic
gaatacgaggggttactgcgccgcagcgcccttgctactaaggatcgctgcattaccttggaaaagtccacccaa

SEQ ID NO: 234622 - DNA, 75 bp, Artificial Sequence
  Synthetic
gcgcccttgctactaaggatcgctgcattaccttggaaaagtccacccaaaccgtgcagggtccgcgctccgccg

SEQ ID NO: 234623 - DNA, 75 bp, Artificial Sequence
  Synthetic
gaagacagtttggaggaggaaaacgaggaggcagaggaggtggaagaagtaaccgccggcaaacagttatccccg

SEQ ID NO: 234624 - DNA, 75 bp, Artificial Sequence
  Synthetic
ccatgacagacagaggggtcttgtgtgggacgatgaggattcggccgatgatagcagcgtgttggacttgggtgg

SEQ ID NO: 234625 - DNA, 75 bp, Artificial Sequence
  Synthetic
tctccatgcctttgtacactggccagaccgccccatggacggtaaccccaccatgaagttgcttacgggagtgcc

SEQ ID NO: 234626 - DNA, 75 bp, Artificial Sequence
  Synthetic
ggtgagtattgggaaaacttggggtggggttttcagatggacagattgagtaaaaatttgttttttctgtctttc

SEQ ID NO: 234627 - DNA, 75 bp, Artificial Sequence
  Synthetic
gtccagcgcgtgaccgttactgacgccagacgccgcacctgtccctacgtttacaaggccctgggcatagtcgcg

SEQ ID NO: 234628 - DNA, 75 bp, Artificial Sequence
  Synthetic
gaccgccccatggacggtaaccccaccatgaagttgcttacgggagtgcccaacagcatgctccagtcaccccaa

SEQ ID NO: 234629 - DNA, 75 bp, Artificial Sequence
  Synthetic
aaactcaccaaggccatggcgacgagcgtacgttcgttcttctttattatctgtgtctagtataatgaggcgagt

SEQ ID NO: 234630 - DNA, 75 bp, Artificial Sequence
  Synthetic
aggaggcgctctaccatttcctcaacacacattcatcttactttcgttctcaccgcgcacgtatcgaaagggcta

SEQ ID NO: 234631 - DNA, 75 bp, Artificial Sequence
  Synthetic
cacacattcatcttactttcgttctcaccgcgcacgtatcgaaagggctactgcgttcgatcgtatgggatatta

SEQ ID NO: 234632 - DNA, 75 bp, Artificial Sequence
  Synthetic
taaacaaaactttattttttacatgcactggtggtttctcattcatttattcactcagaagtcgaaggggttttg

SEQ ID NO: 234633 - DNA, 75 bp, Artificial Sequence
  Synthetic
cactggtggtttctcattcatttattcactcagaagtcgaaggggttttggcgggaatcagagtgacccgcgggc

SEQ ID NO: 234634 - DNA, 75 bp, Artificial Sequence
  Synthetic
tttacaagattcgagtagttattttgcccccctcttcccattttatagaatacacaattctctccccacgcacag

SEQ ID NO: 234635 - DNA, 75 bp, Artificial Sequence
  Synthetic
gagcctgccacttgaattcggggatcaccagcttgggaactggcaggtcaggcaggatgtcgctccacagcttcc

SEQ ID NO: 234636 - DNA, 75 bp, Artificial Sequence
  Synthetic
caccagcttgggaactggcaggtcaggcaggatgtcgctccacagcttcctggtcagttgcagggctcccaacag

SEQ ID NO: 234637 - DNA, 75 bp, Artificial Sequence
  Synthetic
acgagccagcgcaaacccgagagctaagaaatcggatctttccaaccctgtatgccatcttccagcagagtcggg

SEQ ID NO: 234638 - DNA, 75 bp, Artificial Sequence
  Synthetic
aagaaatcggatctttccaaccctgtatgccatcttccagcagagtcggggccaagagcaggaactgaaaataaa

SEQ ID NO: 234639 - DNA, 75 bp, Artificial Sequence
  Synthetic
caattgggacccgtgctctgagcgcgggagttgcgatacacagggttgcaacactggaacaccatcagcgacggg

SEQ ID NO: 234640 - DNA, 75 bp, Artificial Sequence
  Synthetic
gggagttgcgatacacagggttgcaacactggaacaccatcagcgacgggtatttcacactcgccagcacagtgg

SEQ ID NO: 234641 - DNA, 75 bp, Artificial Sequence
  Synthetic
tactaacatgccaaacgtgaacgagtatatgtttagtaacaagttcaaagcgcgtgtgatggtgtccagaaaacc

SEQ ID NO: 234642 - DNA, 75 bp, Artificial Sequence
  Synthetic
tatatgtttagtaacaagttcaaagcgcgtgtgatggtgtccagaaaacctcccgacggtgctgcagttggggat

SEQ ID NO: 234643 - DNA, 75 bp, Artificial Sequence
  Synthetic
gtcttcggcattggccatgctaaagggggtcatcttgcatgtctgtctgcccatagccggtacccagcctggctt

SEQ ID NO: 234644 - DNA, 75 bp, Artificial Sequence
  Synthetic
ggacgccgaggctctcttcaacaagtactgcgcgctgactcttaaagagtaggcagcgaccgcgcttattcaaaa

SEQ ID NO: 234645 - DNA, 75 bp, Artificial Sequence
  Synthetic
ggggtcatcttgcatgtctgtctgcccatagccggtacccagcctggcttgtggttgcaatcgcagcgcagaggg

SEQ ID NO: 234646 - DNA, 75 bp, Artificial Sequence
  Synthetic
atctcataccgggatacacagctttcatgaaagcttcatattgcttgaaagcctgttgggccttgctaccctcag

SEQ ID NO: 234647 - DNA, 75 bp, Artificial Sequence
  Synthetic
tacatgtggagttatcagccccaaatgggattggcggcaggcgcctcccaggactactccacccgcatgaattgg

SEQ ID NO: 234648 - DNA, 75 bp, Artificial Sequence
  Synthetic
agtgggtagacagaatggagtgcttgaaagtgacattggtgttaagttcgacaccaggaacttcaagctgggatg

SEQ ID NO: 234649 - DNA, 75 bp, Artificial Sequence
  Synthetic
catgaaagcttcatattgcttgaaagcctgttgggccttgctaccctcagtgtagaacatcccacaagacttgct

SEQ ID NO: 234650 - DNA, 75 bp, Artificial Sequence
  Synthetic
ctcgagttaatgatatacgcgcctaccgaaaccaaatacttttggaacagtcagctcttaccaccacgccccgcc

SEQ ID NO: 234651 - DNA, 75 bp, Artificial Sequence
  Synthetic
acaccaggaacttcaagctgggatgggatcccgaaaccaagttgatcatgcctggagtgtatacgtatgaagcct

SEQ ID NO: 234652 - DNA, 75 bp, Artificial Sequence
  Synthetic
gcatcattcacacaacagcgagcgtcgttgttggctatttgcaccacactcctgccccagcggttctgggtgatc

SEQ ID NO: 234653 - DNA, 75 bp, Artificial Sequence
  Synthetic
ccgaaaccaaatacttttggaacagtcagctcttaccaccacgccccgccaacaccttaatccccgaaattggcc

SEQ ID NO: 234654 - DNA, 75 bp, Artificial Sequence
  Synthetic
cgttgttggctatttgcaccacactcctgccccagcggttctgggtgatcttggttcgctcagggttctccttca

SEQ ID NO: 234655 - DNA, 75 bp, Artificial Sequence
  Synthetic
cccgctcccaccactgtattacttcctcgagacgcccaggccgaagtccaaatgactaatgcaggtgcgcagtta

SEQ ID NO: 234656 - DNA, 75 bp, Artificial Sequence
  Synthetic
cacatccatttctatgatatgttccttctgaatcatgatgttgccatgcaaacacttcagcttgccttcataatc

SEQ ID NO: 234657 - DNA, 75 bp, Artificial Sequence
  Synthetic
aatgactaatgcaggtgcgcagttagctggcggctccaccctatgtcgtcacaggcctcggcataatataaaacg

SEQ ID NO: 234658 - DNA, 75 bp, Artificial Sequence
  Synthetic
attacatccatgtgaccacagcgcgcatcccgtacactcccagttattgtgagcgatctcagaataggaatgcac

SEQ ID NO: 234659 - DNA, 75 bp, Artificial Sequence
  Synthetic
cagctcaacgacgagtcggtgagctctccgcttggtctacgaccagacggaatctttcaaattgccggctgcggg

SEQ ID NO: 234660 - DNA, 75 bp, Artificial Sequence
  Synthetic
atggttgagagggtcttgttactggtgaaagtcagcgggacgcctcgatgctcctcgttcacatactggtggcaa

SEQ ID NO: 234661 - DNA, 75 bp, Artificial Sequence
  Synthetic
agatcttccttcacccctcgtcagactgttttgactttggaaagttcgtcttcgcaaccccgctcgggcggaatc

SEQ ID NO: 234662 - DNA, 75 bp, Artificial Sequence
  Synthetic
tcacagatttgcatttcccaagctttcagttccgatggtggaatcatgtccacctggggggctatgaagaacacc

SEQ ID NO: 234663 - DNA, 75 bp, Artificial Sequence
  Synthetic
ggaatggggcagaggttataatagatacacaagataaaacagcttttagatgttgtatgatgggtatgtggccag

SEQ ID NO: 234664 - DNA, 75 bp, Artificial Sequence
  Synthetic
tgaaagtcagcgggacgcctcgatgctcctcgttcacatactggtggcaaattcgcttgtactgttcatgctgct

SEQ ID NO: 234665 - DNA, 75 bp, Artificial Sequence
  Synthetic
taggtcattctccagcctgtacttctccatcagcacagccattacttccatgcccttttcccaggcagaaaccag

SEQ ID NO: 234666 - DNA, 75 bp, Artificial Sequence
  Synthetic
agaccactgccgccgctttcgctgctttgcccgggaactcattgagttcatttacttcgaactccccaaggatca

SEQ ID NO: 234667 - DNA, 75 bp, Artificial Sequence
  Synthetic
tttgcccgggaactcattgagttcatttacttcgaactccccaaggatcaccctcaaggtccggcccacggagtg

SEQ ID NO: 234668 - DNA, 75 bp, Artificial Sequence
  Synthetic
actctcgcctgcatcgaattttctcccagcggcccgtgctgatcgagcgagaccagggaaacaccacggtttcca

SEQ ID NO: 234669 - DNA, 75 bp, Artificial Sequence
  Synthetic
ccagcggcccgtgctgatcgagcgagaccagggaaacaccacggtttccatctactgcatttgtaatcacccagg

SEQ ID NO: 234670 - DNA, 75 bp, Artificial Sequence
  Synthetic
atgtgtactgagtttaataaaaactgaattaagactctcctacggactgccgcttcttcaacccggattttacaa

SEQ ID NO: 234671 - DNA, 75 bp, Artificial Sequence
  Synthetic
gaattaagactctcctacggactgccgcttcttcaacccggattttacaaccagaagaacgaaacttttcctctc

SEQ ID NO: 234672 - DNA, 75 bp, Artificial Sequence
  Synthetic
ccagtaatatcatcaaagttgctggaaatataatcaggcagagtttcttgtaaaaattgaataaaagaaaaattt

SEQ ID NO: 234673 - DNA, 75 bp, Artificial Sequence
  Synthetic
ttcctactcacaaaccagaagctcaacgacaacaccgcttttccagaagcattttccctactaatactactttca

SEQ ID NO: 234674 - DNA, 75 bp, Artificial Sequence
  Synthetic
ccccacagaaaacccttgggtggaagcgggccttgtagtgctaggaattcttgcgggtgggcttgtgattattct

SEQ ID NO: 234675 - DNA, 75 bp, Artificial Sequence
  Synthetic
gcgggccttgtagtgctaggaattcttgcgggtgggcttgtgattattctttgctacctatacacaccttgcttc

SEQ ID NO: 234676 - DNA, 75 bp, Artificial Sequence
  Synthetic
ggaggaggaacaaagcttaaccgccccaccacccagtcccgccaccaccacctctaccctcgaggatgaggaggt

SEQ ID NO: 234677 - DNA, 75 bp, Artificial Sequence
  Synthetic
ccaccacccagtcccgccaccaccacctctaccctcgaggatgaggaggtcgacgcaccccaggagatacggacg

SEQ ID NO: 234678 - DNA, 75 bp, Artificial Sequence
  Synthetic
aagagattgaggcagatatcgagcaggacccaggctatgtgacaccggccgagcacgaggaagagctgagacgct

SEQ ID NO: 234679 - DNA, 75 bp, Artificial Sequence
  Synthetic
tttatttgatttttcgcgcgcggtatgccctggaccatcggtctcgatcattgagaactcggtggatcttttcca

SEQ ID NO: 234680 - DNA, 75 bp, Artificial Sequence
  Synthetic
ggacccaggctatgtgacaccggccgagcacgaggaagagctgagacgctttctagagaaagatgatgacaaccg

SEQ ID NO: 234681 - DNA, 75 bp, Artificial Sequence
  Synthetic
tggaagcgggttctgccaattacgatccatgtctagactttgacccagaaaactgcacacttacttttgcacccg

SEQ ID NO: 234682 - DNA, 75 bp, Artificial Sequence
  Synthetic
cagcagaatgttgggctcggggatcatgttgtcgactacctcaccggccttggtggggaggacgtgctcctcaaa

SEQ ID NO: 234683 - DNA, 75 bp, Artificial Sequence
  Synthetic
atgttgtcgactacctcaccggccttggtggggaggacgtgctcctcaaacacctagcaaggcagtcgatcataa

SEQ ID NO: 234684 - DNA, 75 bp, Artificial Sequence
  Synthetic
aacagtattctctatggcctcccagcaaggacaacattgtaacgttctccattgcttattgcttgtgcgcttgcc

SEQ ID NO: 234685 - DNA, 75 bp, Artificial Sequence
  Synthetic
caaggacaacattgtaacgttctccattgcttattgcttgtgcgcttgccttcttactgctttactgtgcgtatg

SEQ ID NO: 234686 - DNA, 75 bp, Artificial Sequence
  Synthetic
ccgcattcaccgtccccgaggtgctggctacctaccacatatttttcaaaaaccaaaaaattccaatttcctgcc

SEQ ID NO: 234687 - DNA, 75 bp, Artificial Sequence
  Synthetic
atcaaaaacgccaataacaaagaaaaaatgccttaacctctttctgtttacagacatggcttttcttacagctct

SEQ ID NO: 234688 - DNA, 75 bp, Artificial Sequence
  Synthetic
gcgccaaccgaactcgcgccgatgccctgctcaacttgggacctggcgcttgcttacctgatataacttccttgg

SEQ ID NO: 234689 - DNA, 75 bp, Artificial Sequence
  Synthetic
ccgagctggagcagacgctggtgacgcgcgcagacgagcccccttcatacgaggaggcagtaaagctcggaatgc

SEQ ID NO: 234690 - DNA, 75 bp, Artificial Sequence
  Synthetic
gctcacggacaaacagtcgtctctatccctctaggtcataattacactctcataggacccccaatcacttcagag

SEQ ID NO: 234691 - DNA, 75 bp, Artificial Sequence
  Synthetic
tgcaacatacaaaatcttacattaattaatgttagcaaagtttacagcggttactattatggttatgacagatac

SEQ ID NO: 234692 - DNA, 75 bp, Artificial Sequence
  Synthetic
ccccgctgtcaacctgcctcccaaagtcatgagcgctgtcatggatcagatactcattaaacgcgcaagtcccct

SEQ ID NO: 234693 - DNA, 75 bp, Artificial Sequence
  Synthetic
gcctcggatgagggcaagccagtggtcagtgatgaacagctatctcgctggctgggcaccaactccccacgagac

SEQ ID NO: 234694 - DNA, 75 bp, Artificial Sequence
  Synthetic
tcagtgatgaacagctatctcgctggctgggcaccaactccccacgagacttggaagagcggcgcaagctcatga

SEQ ID NO: 234695 - DNA, 75 bp, Artificial Sequence
  Synthetic
cgatccgatgacaattctctagaaacttttacatcttccaccacacctgacgaaaaaaatatcccagattcaatg

SEQ ID NO: 234696 - DNA, 75 bp, Artificial Sequence
  Synthetic
cttttacatcttccaccacacctgacgaaaaaaatatcccagattcaatgattgcaattatcgcagcggtggcag

SEQ ID NO: 234697 - DNA, 75 bp, Artificial Sequence
  Synthetic
gaagagggctttcctccgagtgatgatgaagatgaggaaaatgtgcagtcgatccagaccgcagcgggtgaggga

SEQ ID NO: 234698 - DNA, 75 bp, Artificial Sequence
  Synthetic
aatggagtgtcttcgccgcttcttcactgaccccgagacactgcgcaagctcgaggagaacctacactacacttt

SEQ ID NO: 234699 - DNA, 75 bp, Artificial Sequence
  Synthetic
actgaccccgagacactgcgcaagctcgaggagaacctacactacacttttagacatggatttgtgagacaggca

SEQ ID NO: 234700 - DNA, 75 bp, Artificial Sequence
  Synthetic
catgcttttatatgcttgtcgctacaaaaagtttcatcctaaaaaacaagatctcctactaaggcttaacattta

SEQ ID NO: 234701 - DNA, 75 bp, Artificial Sequence
  Synthetic
ccaacctggtttcctacatgggcattttgcatgaaaacagactcggacagagcgtgctgcacaccaccctgaagg

SEQ ID NO: 234702 - DNA, 75 bp, Artificial Sequence
  Synthetic
tttgcatgaaaacagactcggacagagcgtgctgcacaccaccctgaagggggaagcccgtcgcgactacatccg

SEQ ID NO: 234703 - DNA, 75 bp, Artificial Sequence
  Synthetic
catacctggcagactggtatgggtgtgtggcagcagtgtttggaagaacaaaacctgaaagaactagacaagctc

SEQ ID NO: 234704 - DNA, 75 bp, Artificial Sequence
  Synthetic
agaatatatgacaatggatggtttacaaaaccatgtgaccaacctggtagatttttctgcaacggcagagaccta

SEQ ID NO: 234705 - DNA, 75 bp, Artificial Sequence
  Synthetic
gttcactttaccagaaggcaacttctcagccaccatgaccatcgacctgatgaacaatgccatcattgacaacta

SEQ ID NO: 234706 - DNA, 75 bp, Artificial Sequence
  Synthetic
ggacgggttttgacgagcgcacagtcgcctctgatctggcagatctcatcttcccagagcgtctcaggactactc

SEQ ID NO: 234707 - DNA, 75 bp, Artificial Sequence
  Synthetic
acaaaggcttctattatggaaccgactataaaagtagtttagattataacattattgtactgccatccaccactc

SEQ ID NO: 234708 - DNA, 75 bp, Artificial Sequence
  Synthetic
tagcagcagtgccgctaacaatacaatttccaatccaacctttaccgcgcttttaaaacgcactgtgaataattc

SEQ ID NO: 234709 - DNA, 75 bp, Artificial Sequence
  Synthetic
cctggccaactacctatcataccactcggatgtgatcgaggatgtgagcggagatggcctgcttgagtgccactg

SEQ ID NO: 234710 - DNA, 75 bp, Artificial Sequence
  Synthetic
cccttctctacgggtagagagtatgcttgagcagcttttcgcagcgaagcgtgagtaagggcgaaggtgtctctg

SEQ ID NO: 234711 - DNA, 75 bp, Artificial Sequence
  Synthetic
atgcgtttcttacctttggtttccatgagttcgtgtccccgctgggtgacaaagaggctgtccgtgtccccgtag

SEQ ID NO: 234712 - DNA, 75 bp, Artificial Sequence
  Synthetic
gtgaacaccaatcatggtacctagaaatttcttcttcaccatactcatctgtgcttttaatgtttgcgctacttt

SEQ ID NO: 234713 - DNA, 75 bp, Artificial Sequence
  Synthetic
cgctccctcgtctgtaacccccagttgcttagcgaaacccaaattataggcaccttcgaattgcagggtcccagc

SEQ ID NO: 234714 - DNA, 75 bp, Artificial Sequence
  Synthetic
ttttcgatggtagagaagctgctgacgctttttcgcctgaaattgtgctttacacggaaaatgtcaatttggaaa

SEQ ID NO: 234715 - DNA, 75 bp, Artificial Sequence
  Synthetic
tgcttagcgaaacccaaattataggcaccttcgaattgcagggtcccagcagcgaaggcaaggggtcttctcctg

SEQ ID NO: 234716 - DNA, 75 bp, Artificial Sequence
  Synthetic
gactgtataggagcatttgcttcctatgcactgtttgcttttgtcacttgcatctgcgtatgtagcatagtctgc

SEQ ID NO: 234717 - DNA, 75 bp, Artificial Sequence
  Synthetic
actgccaatgagatgaaagcagcagctgatgatacaacagttgtagttgtgcctggcgctgtagtgactgaaact

SEQ ID NO: 234718 - DNA, 75 bp, Artificial Sequence
  Synthetic
cgcaaccaaaatatcgcggcacttcttagacttatctaaaaccatgcaggctatactaccaatatttttgcttct

SEQ ID NO: 234719 - DNA, 75 bp, Artificial Sequence
  Synthetic
gtctcagcgccgaggaaacaagaagttgaaagtgcagctgccgcccccagaggatatggaggaagactgggacag

SEQ ID NO: 234720 - DNA, 75 bp, Artificial Sequence
  Synthetic
aacaccttagaaaatgcaaattccaacaaccgtggtcatttcttgcttgctatcgagaaaaatctgaaattcccc

SEQ ID NO: 234721 - DNA, 75 bp, Artificial Sequence
  Synthetic
cctaaaattgtcatgtatgcagaaaatgtaggtttggaaacgccagacactcatgtagtgtacaaacctggaaca

SEQ ID NO: 234722 - DNA, 75 bp, Artificial Sequence
  Synthetic
ccagctacctatagtactccaccagaacaccttagaaaatgcaaattccaacaaccgtggtcatttcttgcttgc

SEQ ID NO: 234723 - DNA, 75 bp, Artificial Sequence
  Synthetic
tatcgagaaaaatctgaaattcccccaactttaataatgattgctggaataattaatgtaatctgttgcaccata

SEQ ID NO: 234724 - DNA, 75 bp, Artificial Sequence
  Synthetic
accatctccgttccgggtcggggggtccagcaccgtcccaacagtagatgggatgagaccgggcgactcccgaat

SEQ ID NO: 234725 - DNA, 75 bp, Artificial Sequence
  Synthetic
tgcaacaaccaatagcgctaatagaatacgaaagtgaaccacaacccccactactccctgctattagttacttca

SEQ ID NO: 234726 - DNA, 75 bp, Artificial Sequence
  Synthetic
agaaggagcggcagggatacaagtcctggcgggggcataagaacgctatcatatcctgcttgcatgaatgcgggg

SEQ ID NO: 234727 - DNA, 75 bp, Artificial Sequence
  Synthetic
tccgcgctccctggggcgccctcaagggccgtactcgcactcggaccaccgtcgatgatgtgatcgaccaggtgg

SEQ ID NO: 234728 - DNA, 75 bp, Artificial Sequence
  Synthetic
agaaaaccagcagcagttagaacacccacagcaggtgcaacaggaggaggactgagaatcacagcgaacgagcca

SEQ ID NO: 234729 - DNA, 75 bp, Artificial Sequence
  Synthetic
cgaatccattgagtgcacctacaccctgctgaagaccctatgcggactaagagacctgctacccatgaattaaaa

SEQ ID NO: 234730 - DNA, 75 bp, Artificial Sequence
  Synthetic
ggaaccacggtggtcttcacgcccggcgagcgctccagcactacttttaaacgctcctatgatgaggtgtacggg

SEQ ID NO: 234731 - DNA, 75 bp, Artificial Sequence
  Synthetic
tggaactttaggaaggatgtgaacatggttctacagagttccctcggtaacgacctgcgggtagatggcgccagc

SEQ ID NO: 234732 - DNA, 75 bp, Artificial Sequence
  Synthetic
tccctcgatgatctcacgggttaatgatatacgagcttatcgaaaccaattactcctagaacagtcagcacttac

SEQ ID NO: 234733 - DNA, 75 bp, Artificial Sequence
  Synthetic
agtactcttcgaggggaaacccgtctttttctgcacggtaagagcccaacatgtagaactgattgactgccttgt

SEQ ID NO: 234734 - DNA, 75 bp, Artificial Sequence
  Synthetic
ccccgtgagcttgaacctgaaagagagttcaacagaatcaatttcggtatcgttaacggcagcttgtctcagtat

SEQ ID NO: 234735 - DNA, 75 bp, Artificial Sequence
  Synthetic
ttaaccccgctaacaaccacaggcgggtctctacagctaaaagtgggagggggacttacagtagatgacactgat

SEQ ID NO: 234736 - DNA, 75 bp, Artificial Sequence
  Synthetic
acttacattcaattcaaacaacatttgcattgatgacaatattaacaccctgtggacaggaattaaccccaccga

SEQ ID NO: 234737 - DNA, 75 bp, Artificial Sequence
  Synthetic
gaaaggctgagggacctctgctcggttattgataacctgagcggccaagacgatctcatcaaagccattgatgtt

SEQ ID NO: 234738 - DNA, 75 bp, Artificial Sequence
  Synthetic
ttgccggctgcgggagatcttccttcactcctcgtcaggctgtactgactttggagagttcgtcatcgcagcccc

SEQ ID NO: 234739 - DNA, 75 bp, Artificial Sequence
  Synthetic
actggtgccattactaatgctaaaagtttcatgcccagcacaactgcttatcctttcaataataattctagagaa

SEQ ID NO: 234740 - DNA, 75 bp, Artificial Sequence
  Synthetic
gctcgactgcgacatctagaccactgccgccgctttcgctgctttgcccgagaactcaccgagttcatctacttc

SEQ ID NO: 234741 - DNA, 75 bp, Artificial Sequence
  Synthetic
gcggttgagaaggtattcttcgcgatccttccagtactcttcgaggggaaacccgtctttgtctgcacggtaaga

SEQ ID NO: 234742 - DNA, 75 bp, Artificial Sequence
  Synthetic
tgagtttaataaaaactgagttaagactctcctacggactaccaattcttcaactcggactttataacaatcaga

SEQ ID NO: 234743 - DNA, 75 bp, Artificial Sequence
  Synthetic
tctgcgaaacggcctgccagacttcatgagccagagcatgcttaacaactttcgctctttcatcctggaacgctc

SEQ ID NO: 234744 - DNA, 75 bp, Artificial Sequence
  Synthetic
aacccttcctctgatccaggaatctaattctacctccccagcaccacactttactagccttcccgaaactaacaa

SEQ ID NO: 234745 - DNA, 75 bp, Artificial Sequence
  Synthetic
aattctacctccccagcaccacactttactagccttcccgaaactaacaacctcggagctcaactgcaccacttt

SEQ ID NO: 234746 - DNA, 75 bp, Artificial Sequence
  Synthetic
tgtaggcggggttgggcaaagcgaaagtaacatcattgaagagaatcttgccggccctgggcatgaaattgcggg

SEQ ID NO: 234747 - DNA, 75 bp, Artificial Sequence
  Synthetic
ctaccactcccagaaccggaggtgagctccgtggtcttcctaataacaacccctgggtggtaactgggtttgtaa

SEQ ID NO: 234748 - DNA, 75 bp, Artificial Sequence
  Synthetic
gctccgtggtcttcctaataacaacccctgggtggtaactgggtttgtaacgctaggtgtagttgcgggtgggct

SEQ ID NO: 234749 - DNA, 75 bp, Artificial Sequence
  Synthetic
acaccttgctgtgcttatttagtaatcttgtgttgctggtttaagaaatgggggccctactagtcgcgcttgctt

SEQ ID NO: 234750 - DNA, 75 bp, Artificial Sequence
  Synthetic
tcttgtgttgctggtttaagaaatgggggccctactagtcgcgcttgctttactttcacttttggatctgggctc

SEQ ID NO: 234751 - DNA, 75 bp, Artificial Sequence
  Synthetic
tttgatccatgcctcaattttgatccagacaactgcacactcacttttgctccagaggctggccgctgtggagtt

SEQ ID NO: 234752 - DNA, 75 bp, Artificial Sequence
  Synthetic
cagacaactgcacactcacttttgctccagaggctggccgctgtggagttcttattaggtgcggacgggaatgca

SEQ ID NO: 234753 - DNA, 75 bp, Artificial Sequence
  Synthetic
ccatcttttctggggtgatacagtagaaggttttggggtcttgctgccagcgatcccacttgagtttcatggcaa

SEQ ID NO: 234754 - DNA, 75 bp, Artificial Sequence
  Synthetic
caaaatttggaacaataccttattcaccacatggcagccaggagaccctgagtggtatactgtctctgtccgtgg

SEQ ID NO: 234755 - DNA, 75 bp, Artificial Sequence
  Synthetic
accacatggcagccaggagaccctgagtggtatactgtctctgtccgtggtcctgacggttccatccgcactgct

SEQ ID NO: 234756 - DNA, 75 bp, Artificial Sequence
  Synthetic
tgtgcgatctgaccatgttcatgagcaaacagtataacctatggcctccaagcaaggagaacattgtggcattct

SEQ ID NO: 234757 - DNA, 75 bp, Artificial Sequence
  Synthetic
caaacagtataacctatggcctccaagcaaggagaacattgtggcattctccattgcttattgcttgtgtacgtg

SEQ ID NO: 234758 - DNA, 75 bp, Artificial Sequence
  Synthetic
tgcatacacttgcttatttgccaccgccacagaaacagcaatgaggaaaaagagaaaatgccttgagctttttct

SEQ ID NO: 234759 - DNA, 75 bp, Artificial Sequence
  Synthetic
gccatggcttcagttatagctctaattattgtcagcattctcactgccgcacagggacaaacaattgtctatatt

SEQ ID NO: 234760 - DNA, 75 bp, Artificial Sequence
  Synthetic
ttattgtcagcattctcactgccgcacagggacaaacaattgtctatattaccttaggtcataaccacactctta

SEQ ID NO: 234761 - DNA, 75 bp, Artificial Sequence
  Synthetic
acagggacaaacaattgtctatattaccttaggtcataaccacactcttataggaccccaaattagttcacaggt

SEQ ID NO: 234762 - DNA, 75 bp, Artificial Sequence
  Synthetic
gattattttgacataatctgcaacagaactaaaccaatatttgtaacctgtaacaaacaaaatctcaccttaatt

SEQ ID NO: 234763 - DNA, 75 bp, Artificial Sequence
  Synthetic
gaactaaaccaatatttgtaacctgtaacaaacaaaatctcaccttaattaatgttagcgaaatttacagcggtt

SEQ ID NO: 234764 - DNA, 75 bp, Artificial Sequence
  Synthetic
cagtgaatataaaaattacctagttcgcataactcaacccaaaaccacaaaaatgccaaataaggcaaaaattca

SEQ ID NO: 234765 - DNA, 75 bp, Artificial Sequence
  Synthetic
cgcataactcaacccaaaaccacaaaaatgccaaataaggcaaaaattcaaatggttagcgcattagaacatctt

SEQ ID NO: 234766 - DNA, 75 bp, Artificial Sequence
  Synthetic
gttcggcgatggtggtgcgcacctcgcgctcgaaagcccctgggatttcttcctcaatctcttcttcttccacta

SEQ ID NO: 234767 - DNA, 75 bp, Artificial Sequence
  Synthetic
gaaacattccaaattcaatgattgccattattgcggcggtggcagtgggaatggcactaataataatttgtatgt

SEQ ID NO: 234768 - DNA, 75 bp, Artificial Sequence
  Synthetic
cattattgcggcggtggcagtgggaatggcactaataataatttgtatgttcctatatgcttgttactgtagaaa

SEQ ID NO: 234769 - DNA, 75 bp, Artificial Sequence
  Synthetic
aatgcaactggattgcgtttcaagcaggagaggagagggaagagacggaagaagcatgttaatttttattccaaa

SEQ ID NO: 234770 - DNA, 75 bp, Artificial Sequence
  Synthetic
ctaaatttttgacatttaattttttatacagctatggtttccactacagccttttttgttattagtagccttgca

SEQ ID NO: 234771 - DNA, 75 bp, Artificial Sequence
  Synthetic
ctccctgaagtggtgactgggaggctctccgttgggcagggacaccgcgctgattatgcattttatcaattgccc

SEQ ID NO: 234772 - DNA, 75 bp, Artificial Sequence
  Synthetic
gctgtcacttatggtcgctcacacctcactgtaactgttggctcaacttgtacactacaaggaccccaagaaggg

SEQ ID NO: 234773 - DNA, 75 bp, Artificial Sequence
  Synthetic
caaagcctccacgcgcacatccaagaacaaaagaataccaaaagaaggagcattttctaactcctcaatcatcat

SEQ ID NO: 234774 - DNA, 75 bp, Artificial Sequence
  Synthetic
cagatcgccggctgtgggagatcttccttcactcctcgtcaggctgtgctgactttggagagttcgtcctcgcag

SEQ ID NO: 234775 - DNA, 75 bp, Artificial Sequence
  Synthetic
atagtggatggttcattaggccatgtgaccagcctggtaacaaatttttctgcaacgggagagacttgaccatta

SEQ ID NO: 234776 - DNA, 75 bp, Artificial Sequence
  Synthetic
tgaccagcctggtaacaaatttttctgcaacgggagagacttgaccattattaacatcacagtaaatgaccaggg

SEQ ID NO: 234777 - DNA, 75 bp, Artificial Sequence
  Synthetic
aataacttagattacaacattatcgtagtgccagccaccactccagctccccgcaaaaccactttctttagcagc

SEQ ID NO: 234778 - DNA, 75 bp, Artificial Sequence
  Synthetic
tcaccgaacccgaggggagatggttgtatgatcttatcaacattctacagagtatcatagtgcaggagcggagcc

SEQ ID NO: 234779 - DNA, 75 bp, Artificial Sequence
  Synthetic
agtgccagtatttctaaaacagcttctgcaagcttcaaaaaattcgctttacgtaattccacaacctcttccact

SEQ ID NO: 234780 - DNA, 75 bp, Artificial Sequence
  Synthetic
cctgaagtggtgactggggggctctccgttgggcagggacagggcgctgatgatgcattttatcaattgccccgt

SEQ ID NO: 234781 - DNA, 75 bp, Artificial Sequence
  Synthetic
taatcggcatcgctgctgccgcgatagtgggattaatgattataattctatgcataatctactacgcctgctgct

SEQ ID NO: 234782 - DNA, 75 bp, Artificial Sequence
  Synthetic
agagcaggacacgctacagtgcagtacaagcgcagacctccccaattggctccagcaaaaacaagattggaataa

SEQ ID NO: 234783 - DNA, 75 bp, Artificial Sequence
  Synthetic
tacatgcgcatgacgctgaaggtgttgaccctgagcgatgatcttggggtgtaccgcaatgacagaatgcatcgc

SEQ ID NO: 234784 - DNA, 75 bp, Artificial Sequence
  Synthetic
accacactacctcttatgagctcacaaacattactacccatcatcctaaatatgctatgcaactagaaatcacca

SEQ ID NO: 234785 - DNA, 75 bp, Artificial Sequence
  Synthetic
cctagctattattttctattttacactatgccgccaaatacctaatattcataaaaattctaaaagacgtcccat

SEQ ID NO: 234786 - DNA, 75 bp, Artificial Sequence
  Synthetic
gaccctcgtaaaacctgtcatcgtgattaaacaacagcaccgaaagttcctcgcggtgaccagcatgaataattc

SEQ ID NO: 234787 - DNA, 75 bp, Artificial Sequence
  Synthetic
gcgttacagatccatgcttctgggcaatggtcgctatgtgcctttccacatccaagtgcctcagaaattctttgc

SEQ ID NO: 234788 - DNA, 75 bp, Artificial Sequence
  Synthetic
ataaaaattctaaaagacgtcccatctattgccctgtgattagtcgaccccatatgactctaaatgaaatctaag

SEQ ID NO: 234789 - DNA, 75 bp, Artificial Sequence
  Synthetic
ttgatgaagcatacaatccaaacatgttagcatcagttaaagacaaaaaacagccaatatagcctctgggtataa

SEQ ID NO: 234790 - DNA, 75 bp, Artificial Sequence
  Synthetic
tctgtgcttttaatgtctgtgccaccttcacagcagtagccactgcaaccccagactgtataggagcatttgcct

SEQ ID NO: 234791 - DNA, 75 bp, Artificial Sequence
  Synthetic
ttgcacctgcgtgtgtagcgtagtctgcctggttattaattttttccaacttgtagactggatctttgtacgact

SEQ ID NO: 234792 - DNA, 75 bp, Artificial Sequence
  Synthetic
tgcctggttattaattttttccaacttgtagactggatctttgtacgacttgcctacctgcgtcaccatcccgaa

SEQ ID NO: 234793 - DNA, 75 bp, Artificial Sequence
  Synthetic
tacacatacaaagcctcatcagccatggcttaccagacaaagtacagcaggcacacaaagcacaagctctaaagt

SEQ ID NO: 234794 - DNA, 75 bp, Artificial Sequence
  Synthetic
ctcttagaacgcgtggctcgctacaacagtagcaatgtgcaaaccaatttggaccgtatgataacagatgtacgc

SEQ ID NO: 234795 - DNA, 75 bp, Artificial Sequence
  Synthetic
ttctcagacttatttaaaaccatgcaggctatactaccagtcattctgcttctgttgctcccctgcgatgcctta

SEQ ID NO: 234796 - DNA, 75 bp, Artificial Sequence
  Synthetic
acagtagcaatgtgcaaaccaatttggaccgtatgataacagatgtacgcgaagccgtgtctcagcgcgaaaggt

SEQ ID NO: 234797 - DNA, 75 bp, Artificial Sequence
  Synthetic
aggctatactaccagtcattctgcttctgttgctcccctgcgatgccttaacccccgtcgctaatcgtaccccac

SEQ ID NO: 234798 - DNA, 75 bp, Artificial Sequence
  Synthetic
tatacacaagccctaaactgacgtaatggggctaaagtacacaaaatcccgccaaacccaacacacaccccgaaa

SEQ ID NO: 234799 - DNA, 75 bp, Artificial Sequence
  Synthetic
ccaacaaccatggacattccttgattgctaccgagaaaaatctgatttccctacatactggattatgatcattgg

SEQ ID NO: 234800 - DNA, 75 bp, Artificial Sequence
  Synthetic
agtactcagcctgctaatgtgccgcgtggtcaacaggattatactaactttttaagtgctttgagactgatggta

SEQ ID NO: 234801 - DNA, 75 bp, Artificial Sequence
  Synthetic
tgctaccgagaaaaatctgatttccctacatactggattatgatcattggaattgtcaatctagtttcttgcaca

SEQ ID NO: 234802 - DNA, 75 bp, Artificial Sequence
  Synthetic
gcaactgaaaaaggactctcgcgaggcgtacgtgccccagcagaacctgttcagggacaggagcggcgaggagcc

SEQ ID NO: 234803 - DNA, 75 bp, Artificial Sequence
  Synthetic
tttttgattttggatggaatgcccccaatgcactcacttacccacaagaaccagaggaacatatcccactacaga

SEQ ID NO: 234804 - DNA, 75 bp, Artificial Sequence
  Synthetic
caatgcactcacttacccacaagaaccagaggaacatatcccactacagaacatgcaacagccaatagctataat

SEQ ID NO: 234805 - DNA, 75 bp, Artificial Sequence
  Synthetic
aaaaccttaaaggtttgtggggagtgcatgccccggtaggagaaagagcaaccgtgtctagcttgttaactccga

SEQ ID NO: 234806 - DNA, 75 bp, Artificial Sequence
  Synthetic
cgtggctaacgtggtattggcgatcccgtctcgacccagccgacgaatatccaggatacggagtcgagtcgtttt

SEQ ID NO: 234807 - DNA, 75 bp, Artificial Sequence
  Synthetic
aggcaggcataacctctgcactcaggttgtcagtttctaggaacgatgaggatttgatattgacagtgcctgctg

SEQ ID NO: 234808 - DNA, 75 bp, Artificial Sequence
  Synthetic
tcgctgcttcctgctattagttacttcaacctaaccggtggagatgactgacccactcgccgcctccactgctgc

SEQ ID NO: 234809 - DNA, 75 bp, Artificial Sequence
  Synthetic
tcaacctaaccggtggagatgactgacccactcgccgcctccactgctgccgaggaactacttgatatggacggc

SEQ ID NO: 234810 - DNA, 75 bp, Artificial Sequence
  Synthetic
cccagaaaaagttcctgtgcgacaggaccatgtggcgcatccccttctccagcaacttcatgtccatgggtgccc

SEQ ID NO: 234811 - DNA, 75 bp, Artificial Sequence
  Synthetic
gtcaagctttagaacgctcagttctcggggctgggagtggctcgcgcccgtagtctggagaatcaatcgccaggg

SEQ ID NO: 234812 - DNA, 75 bp, Artificial Sequence
  Synthetic
atgcatcccgtgctgcgacagatgcgcccccagcaacaggccccttctcagcaacagcagcagccacaaaaggct

SEQ ID NO: 234813 - DNA, 75 bp, Artificial Sequence
  Synthetic
aatactgaccatcgcctctcatacgagctcggaccgcagcggcaaaaattcacttgtatggtgggaatcaacccc

SEQ ID NO: 234814 - DNA, 75 bp, Artificial Sequence
  Synthetic
agctcggaccgcagcggcaaaaattcacttgtatggtgggaatcaaccccataatcatcacccagcaagctggag

SEQ ID NO: 234815 - DNA, 75 bp, Artificial Sequence
  Synthetic
agccaagatttcctacgagattaccaatactgaccatcgcctctcatacgagctcggaccgcagcggcaaaaatt

SEQ ID NO: 234816 - DNA, 75 bp, Artificial Sequence
  Synthetic
ctgcagttccaccgagtgcatctacaccctgctgaagaccctctgcggccttcgagacctcctacccatgaacta

SEQ ID NO: 234817 - DNA, 75 bp, Artificial Sequence
  Synthetic
tcttttcgaagtcttcgacgtggtcagagtgcaccagccacaccgcggcgtcatcgaggctgtctacctgcgtac

SEQ ID NO: 234818 - DNA, 75 bp, Artificial Sequence
  Synthetic
accctgctgaagaccctctgcggccttcgagacctcctacccatgaactaatcaacccagcccctcacttaccaa

SEQ ID NO: 234819 - DNA, 75 bp, Artificial Sequence
  Synthetic
gtgcagcctttcgatccacctacgctgcacgatctgtatgatttagaggtagacgggccggaggatcccaatgag

SEQ ID NO: 234820 - DNA, 75 bp, Artificial Sequence
  Synthetic
ccattgtcaacacggccggtcgcgagacggggggagagcactggctggcttttggttggaacccgcgctccaaca

SEQ ID NO: 234821 - DNA, 75 bp, Artificial Sequence
  Synthetic
cctgctacctttttgatccttttggcttctcggacgagcgcctcaagcaaatctaccagtttgagtatgaggggc

SEQ ID NO: 234822 - DNA, 75 bp, Artificial Sequence
  Synthetic
aaaattgcctgatctgggagcagctgaaatggacttgcgttgttatgaagagggttttcctccgagtgatgatga

SEQ ID NO: 234823 - DNA, 75 bp, Artificial Sequence
  Synthetic
gccagcggacccctccaacttaaagttggaagcagtcttacagtagatactatcgatgggtctttggaggaaaat

SEQ ID NO: 234824 - DNA, 75 bp, Artificial Sequence
  Synthetic
ttggaagcagtcttacagtagatactatcgatgggtctttggaggaaaatataactgccgcagcgccactcacta

SEQ ID NO: 234825 - DNA, 75 bp, Artificial Sequence
  Synthetic
aataggatctggcttgcaaacaaaggatgataaactttgtttatcgctgggagatgggttggtaacaaaggatga

SEQ ID NO: 234826 - DNA, 75 bp, Artificial Sequence
  Synthetic
gatgataaactttgtttatcgctgggagatgggttggtaacaaaggatgataaactatgtttatcgctgggagat

SEQ ID NO: 234827 - DNA, 75 bp, Artificial Sequence
  Synthetic
tatgtgccaaactaggacatggccttgtgtttgactcttccaatgctatcaccatagaaaacaacaccttgtgga

SEQ ID NO: 234828 - DNA, 75 bp, Artificial Sequence
  Synthetic
tgttctgccacttgaactcggggatcaccagcttgggaactgggatctcggggaaggtgtcttgccacagctttc

SEQ ID NO: 234829 - DNA, 75 bp, Artificial Sequence
  Synthetic
ccagactgtaagctcactttagttctagtgaagaatggaggactgataaatggatacataacattaatgggagcc

SEQ ID NO: 234830 - DNA, 75 bp, Artificial Sequence
  Synthetic
aaaacaaacaagttacaatcgatgtaaacctcgcatttgataatactggccaaattatcacttacctatcatccc

SEQ ID NO: 234831 - DNA, 75 bp, Artificial Sequence
  Synthetic
gggagttgcggtacactgggttgcagcactggaacaccatcagggcggggtgtctcacgctcgccagcacggtcg

SEQ ID NO: 234832 - DNA, 75 bp, Artificial Sequence
  Synthetic
caaattatcacttacctatcatcccttaaaagtaacctgaactttaaagacaaccaaaacatggctactggaacc

SEQ ID NO: 234833 - DNA, 75 bp, Artificial Sequence
  Synthetic
ataaccagtgccaaaggcttcatgcccagcaccaccgcctatccatttataacatacgccactcagtccctaaat

SEQ ID NO: 234834 - DNA, 75 bp, Artificial Sequence
  Synthetic
ccagcaccaccgcctatccatttataacatacgccactcagtccctaaatgaagattacatttatggagagtgtt

SEQ ID NO: 234835 - DNA, 75 bp, Artificial Sequence
  Synthetic
ctttccactaaaagttactgtcacactaaacagacgtatgtcagcttctggaatggcctatgctatgaatttttc

SEQ ID NO: 234836 - DNA, 75 bp, Artificial Sequence
  Synthetic
gtgtaccagtccggtccagactacttcttccagaccagcagacagggcttgcagacagtgaatctgagccaggct

SEQ ID NO: 234837 - DNA, 75 bp, Artificial Sequence
  Synthetic
cataagcaagatattctaaaatacgagtggttcgagtttactttgccagaaggcaacttttcggtcactatgact

SEQ ID NO: 234838 - DNA, 75 bp, Artificial Sequence
  Synthetic
atcgacttgatgaacaatgccatcatagacaattacttgaaagtgggcagacagaatggagtgttggaaagtgac

SEQ ID NO: 234839 - DNA, 75 bp, Artificial Sequence
  Synthetic
ccggaaactaccgaagtcactctcattacctccccattctttttttcttatatcagagaagatgactgacaacaa

SEQ ID NO: 234840 - DNA, 75 bp, Artificial Sequence
  Synthetic
acttcaagttgggatgggatccagaaactaagttgatcatgcctggggtttacacctatgaggccttccatcctg

SEQ ID NO: 234841 - DNA, 75 bp, Artificial Sequence
  Synthetic
tagcattgaccgcaactcctacttgggctacctgctgaacttgtatcgcgaggccatagggcagagccaggtgga

SEQ ID NO: 234842 - DNA, 75 bp, Artificial Sequence
  Synthetic
aactaagttgatcatgcctggggtttacacctatgaggccttccatcctgacatcgtattgctgcctggctgcgg

SEQ ID NO: 234843 - DNA, 75 bp, Artificial Sequence
  Synthetic
tccccacgcacagctttgaacatttgaattccattagagatagacatagttttagattccacattccacacagtt

SEQ ID NO: 234844 - DNA, 75 bp, Artificial Sequence
  Synthetic
agcaaccttcttggcattagaaagaaacacccattccaagagggttttaagatcttgtatgaggatttagaagga

SEQ ID NO: 234845 - DNA, 75 bp, Artificial Sequence
  Synthetic
gaattccattagagatagacatagttttagattccacattccacacagtttcagagcgggccaatcttggatcag

SEQ ID NO: 234846 - DNA, 75 bp, Artificial Sequence
  Synthetic
gatcttgtatgaggatttagaaggaggaaatattccagcccttttggatgtagatgcttatgagaacagcaagaa

SEQ ID NO: 234847 - DNA, 75 bp, Artificial Sequence
  Synthetic
agatcaaaaagccaaaatagaagctgctgcagaagctaaagcaaacatagttgccaacgatccggtaagggtggc

SEQ ID NO: 234848 - DNA, 75 bp, Artificial Sequence
  Synthetic
tttggattatagtcatctggaagaagaacgatgggagtcataatccgagaacgggatcgggcggttgtgtcttaa

SEQ ID NO: 234849 - DNA, 75 bp, Artificial Sequence
  Synthetic
tcaacaaactgctggactacctgcacagagcagccgctatgaactctgattatttcaccaatgctatcctcaacc

SEQ ID NO: 234850 - DNA, 75 bp, Artificial Sequence
  Synthetic
acgggatcgggcggttgtgtcttaaacctcgaagcagtcgctgtctgcgccgctccgtgcgactgctgctgatgg

SEQ ID NO: 234851 - DNA, 75 bp, Artificial Sequence
  Synthetic
ctaaagaatcattattggatgatgtgtctcaaaacatagagttaaaactcactattaagcctgtggaaaaagatg

SEQ ID NO: 234852 - DNA, 75 bp, Artificial Sequence
  Synthetic
actacagtaggtacaacacattaccacaatgttgtttaacaggccataattaaaggtgctccagccaaaactcat

SEQ ID NO: 234853 - DNA, 75 bp, Artificial Sequence
  Synthetic
ccgtgtctagcttgctgactcccaactcccgcctgctgctgctgctggtatcccccttcactgacagcggtagca

SEQ ID NO: 234854 - DNA, 75 bp, Artificial Sequence
  Synthetic
taaaggtgctccagccaaaactcatctcagggataatcatacccgcgtgaccatcgtaccagatcttaatgtaaa

SEQ ID NO: 234855 - DNA, 75 bp, Artificial Sequence
  Synthetic
cagcaatacattgaagagaaccaggctgtttacagtgacaatgaagaacccacttctctcgcccatggatcactt

SEQ ID NO: 234856 - DNA, 75 bp, Artificial Sequence
  Synthetic
cacttctctcgcccatggatcacttgagaatgaaatatatctatagtagcacaacacaaacataaatgcatgcat

SEQ ID NO: 234857 - DNA, 75 bp, Artificial Sequence
  Synthetic
cgcccgcactttgggcgcatgttgtaaaagtgaaagtaaaataaaaaaaggcaactcaccaaggccatggcgacg

SEQ ID NO: 234858 - DNA, 75 bp, Artificial Sequence
  Synthetic
gggttagaaacatatcccagggaatgggaagctcttgcaaaacagtaaagctggcagaacaaggaagaccgcgaa

SEQ ID NO: 234859 - DNA, 75 bp, Artificial Sequence
  Synthetic
caatgacgggttcctgtgggacgatgtggacagtagcatattttccccgcctccaggttatacggtttggaagaa

SEQ ID NO: 234860 - DNA, 75 bp, Artificial Sequence
  Synthetic
cctcggtacctggcacctacggaggggagaaacagcattcgttactcggagctggcaccattgtatgataccacc

SEQ ID NO: 234861 - DNA, 75 bp, Artificial Sequence
  Synthetic
tggtcttcagtcatagaagctctggtttcattttcctcacagcgtggtaaaggggccctcaaatgagggtccatg

SEQ ID NO: 234862 - DNA, 75 bp, Artificial Sequence
  Synthetic
tccgtatcgttgcccggaacggctggtgctgccgcggccgtgcccgaagctgcgagtcctttccctagcttgtcc

SEQ ID NO: 234863 - DNA, 75 bp, Artificial Sequence
  Synthetic
ttatgacagatacagtagtcaatatagaaattacttggttcgtgttacccagttgaaaaccacgaaaatgccaaa

SEQ ID NO: 234864 - DNA, 75 bp, Artificial Sequence
  Synthetic
ctcgtattttgcatgacagaacctagccttagcacaacacacttctcttcgccttctatcccgccgcctagcgcg

SEQ ID NO: 234865 - DNA, 75 bp, Artificial Sequence
  Synthetic
tggaatagagagcctggtggataagatgagtagatggaagacctatgcgcaggatcacagagacgagcccaggat

SEQ ID NO: 234866 - DNA, 75 bp, Artificial Sequence
  Synthetic
cattcccgtagattggtcaaaagttcctcagcttcagttgttatgaaaactccatcatatctgatcgctctgata

SEQ ID NO: 234867 - DNA, 75 bp, Artificial Sequence
  Synthetic
cctcagcttcagttgttatgaaaactccatcatatctgatcgctctgataaaatcattcactgtagaatgggcaa

SEQ ID NO: 234868 - DNA, 75 bp, Artificial Sequence
  Synthetic
ttgagtttcaaccaaaggagggggaggaagacatggaagaaccataattaattttttatgccagacgatctcgca

SEQ ID NO: 234869 - DNA, 75 bp, Artificial Sequence
  Synthetic
acagaggtcccagtttcaaaccctattctggtacggcttacaactccctggctcctaaaggcgctccaaatacat

SEQ ID NO: 234870 - DNA, 75 bp, Artificial Sequence
  Synthetic
ccgtttcggtcgcatgttgtaaaagtgaaagtaaaaataaaaaggcaactcaccaaggccatggcaaccgagcgt

SEQ ID NO: 234871 - DNA, 75 bp, Artificial Sequence
  Synthetic
atggcacctctcgcccccactgtgttgatgaaaaataacagctaagtcaaacacgatgcgattttcaagatgctc

SEQ ID NO: 234872 - DNA, 75 bp, Artificial Sequence
  Synthetic
tccttatgcttactagtctcgcaactctgacttctgctcgctcacacctcactgtaactataggctcaaactgca

SEQ ID NO: 234873 - DNA, 75 bp, Artificial Sequence
  Synthetic
acatcggtgtcaagtttgataccaggaacttcaggctgggctgggaccctgtaactaaacttgttatgccggggg

SEQ ID NO: 234874 - DNA, 75 bp, Artificial Sequence
  Synthetic
tgtaccattcccagataattttcatctttccagccttgaattaatcgtgtcatttcttcttgtaaatccaatcca

SEQ ID NO: 234875 - DNA, 75 bp, Artificial Sequence
  Synthetic
tgatattgttctactacctgactgtggggtggactttactgaaagccgccttagcaacttgcttggcatcaggaa

SEQ ID NO: 234876 - DNA, 75 bp, Artificial Sequence
  Synthetic
tacaacaatttccacttcaacaatcagcatcatcgctgcagtgacaattggaatatctattcttgtttttaccat

SEQ ID NO: 234877 - DNA, 75 bp, Artificial Sequence
  Synthetic
ggggtggactttactgaaagccgccttagcaacttgcttggcatcaggaagagacacccattccaggaaggcttc

SEQ ID NO: 234878 - DNA, 75 bp, Artificial Sequence
  Synthetic
ttagcaacttgcttggcatcaggaagagacacccattccaggaaggcttcaagataatgtatgaggatcttgaag

SEQ ID NO: 234879 - DNA, 75 bp, Artificial Sequence
  Synthetic
caccctcataatgacaaaatatcttgctcctgtgtcacctgcagcaaattgagaatggcaacatcaaacgacatg

SEQ ID NO: 234880 - DNA, 75 bp, Artificial Sequence
  Synthetic
tgtacaagcctatgaagagagcaaaaaggcaaatgcaggcaccaccaccactactactacaactgaagtgacaac

SEQ ID NO: 234881 - DNA, 75 bp, Artificial Sequence
  Synthetic
cgccaggcatgcaagatctccaacgtggagctcaccaacctggtctcctacatgggcattttgcatgagaaccgc

SEQ ID NO: 234882 - DNA, 75 bp, Artificial Sequence
  Synthetic
gttcaagttgtaaaaactccttcaaatcatcgccaaactgcttggccataggtccgccaggaataagagcggggg

SEQ ID NO: 234883 - DNA, 75 bp, Artificial Sequence
  Synthetic
atcatcgccaaactgcttggccataggtccgccaggaataagagcgggggacgctactgtacagaacaagcggag

SEQ ID NO: 234884 - DNA, 75 bp, Artificial Sequence
  Synthetic
aaggcaaatgcaggcaccaccaccactactactacaactgaagtgacaaccgtcgctgttgctaatgcactaact

SEQ ID NO: 234885 - DNA, 75 bp, Artificial Sequence
  Synthetic
taacagtagatgctattactgaagcaaacaataatgcaatcagaggagataattacctacctgctaatgccatga

SEQ ID NO: 234886 - DNA, 75 bp, Artificial Sequence
  Synthetic
aaacaaatgaatgtttatttgatttttcgcgcgcggtatgccctggaccatcggtctcgatcattgagaactcgg

SEQ ID NO: 234887 - DNA, 75 bp, Artificial Sequence
  Synthetic
gtgaggttacaataagcatactgagaacctccagtgatatcatccaatgtgctggaaacataatcaggcagagtt

SEQ ID NO: 234888 - DNA, 75 bp, Artificial Sequence
  Synthetic
gttcagcaacaagtttaaggcgagggtgatggtatctaggaaggctcctgaaggtgttacagtaaatgatcataa

SEQ ID NO: 234889 - DNA, 75 bp, Artificial Sequence
  Synthetic
aagaatctggggaaacaactgtggtgccggtaattcccatacctgaaactcaaactgaaactgaaactgaaacca

SEQ ID NO: 234890 - DNA, 75 bp, Artificial Sequence
  Synthetic
aacctccagtgatatcatccaatgtgctggaaacataatcaggcagagtttctcgtataaaattaataaaagaaa

SEQ ID NO: 234891 - DNA, 75 bp, Artificial Sequence
  Synthetic
ttctggaatacagatgcaataagttaccgcgctgcgctccaacattgttagtacgattagtctgtaaaaaaagca

SEQ ID NO: 234892 - DNA, 75 bp, Artificial Sequence
  Synthetic
gctccggggtagtgttataaatcacccagtcatagcaaggtcggagtgcatggtgttgcacaatatcttttagga

SEQ ID NO: 234893 - DNA, 75 bp, Artificial Sequence
  Synthetic
caaaaaattacatcatgctagcctggcgaacggatggataaatcactctctccaacaccaggcaggctacagggt

SEQ ID NO: 234894 - DNA, 75 bp, Artificial Sequence
  Synthetic
gaaagaggctgttgatgagcagcgaatattatttgcgatgaagcatacaatccagaagtgttagtatcagttaaa

SEQ ID NO: 234895 - DNA, 75 bp, Artificial Sequence
  Synthetic
actgactgccgcctgtgcgcaatatatagagaacctatacactgacgtaatcgaacaaagtctaaaaaaaaatcc

SEQ ID NO: 234896 - DNA, 75 bp, Artificial Sequence
  Synthetic
tcgaacaaagtctaaaaaaaaatcccgccaaaaaccagcacacgcccagaaactgtgtcatccactaaaaaaatt

SEQ ID NO: 234897 - DNA, 75 bp, Artificial Sequence
  Synthetic
aagacaaaatcaacacagcctaccgcagctggtacctgtcctacaattatggtaaccctgagaaaggaataaggt

SEQ ID NO: 234898 - DNA, 75 bp, Artificial Sequence
  Synthetic
cgttatgtgcctttccacatacaagtgcctcaaaaattcttcgctgttaaaaacctgctgcttctcccaggctcc

SEQ ID NO: 234899 - DNA, 75 bp, Artificial Sequence
  Synthetic
cacgtcctctttcccacgaatcgtcacttccggccatcttgtaacgtcaccttcccgcgccgccccgtgaccgtt

SEQ ID NO: 234900 - DNA, 75 bp, Artificial Sequence
  Synthetic
gaaccccaagccaatccccttccgctctccattttcaaaccacctcatttacatattggcaccattccatctata

SEQ ID NO: 234901 - DNA, 75 bp, Artificial Sequence
  Synthetic
catcatcaataatataccttatagatggaatggtgccaatatgtaaatgaggtgattttaaaaagtgtgggctgt

SEQ ID NO: 234902 - DNA, 75 bp, Artificial Sequence
  Synthetic
tttggctcaaccataaaaacatacgggaacaaagcttggaacagcagtacaggacaggcgcttagaaataaactt

SEQ ID NO: 234903 - DNA, 75 bp, Artificial Sequence
  Synthetic
gagctcggtgatgtgctctatggcatctcgatccagcagacctcctcgtttcgcgggttgggacggctcctggag

SEQ ID NO: 234904 - DNA, 75 bp, Artificial Sequence
  Synthetic
cggcccacggagtgcggattaccatcgaagggggaatagactctcgcctgcatcggatcttctgccagcgacccg

SEQ ID NO: 234905 - DNA, 75 bp, Artificial Sequence
  Synthetic
aggcggcagaccgccttggcgagtttgcttatggcaagcgcacaagatccagtcccaaagaggaggcggtgtcta

SEQ ID NO: 234906 - DNA, 75 bp, Artificial Sequence
  Synthetic
gaggtgcagacggatccttggatacccgcgcccgttgcaaccaccgccagtaccgcccgaagaccccggcgaaag

SEQ ID NO: 234907 - DNA, 75 bp, Artificial Sequence
  Synthetic
gcttacaactccctggctcctaaaggcgctccaaatgcatctcagtggttggataagggagttacaagcactggc

SEQ ID NO: 234908 - DNA, 75 bp, Artificial Sequence
  Synthetic
atggggaagaagccaaaaaagcaacatacacttttggtaatgctccagtaaaagccgaggctgaaatcacaaaag

SEQ ID NO: 234909 - DNA, 75 bp, Artificial Sequence
  Synthetic
ccaactatgctctgcacccatccattattccaactccgggttaccgaggcactcgctactaccgcagccggagca

SEQ ID NO: 234910 - DNA, 75 bp, Artificial Sequence
  Synthetic
atacacttttggtaatgctccagtaaaagccgaggctgaaatcacaaaagacggattgccggtgggcttggaagt

SEQ ID NO: 234911 - DNA, 75 bp, Artificial Sequence
  Synthetic
aacctcaagtgggagacgaaacttggactgacctagacggaaaaaccgaagagtatggagggagggttcttaaac

SEQ ID NO: 234912 - DNA, 75 bp, Artificial Sequence
  Synthetic
cggatcttttgctaaacctactaatattaaaggaggtcaggcaaaggtaaaaccaaaagaagacgatggcactaa

SEQ ID NO: 234913 - DNA, 75 bp, Artificial Sequence
  Synthetic
aaccaaaagaagacgatggcactaacaacatcgagtatgacattgacatgaacttctttgacttaagatcacaaa

SEQ ID NO: 234914 - DNA, 75 bp, Artificial Sequence
  Synthetic
ccccgggttacagaggcactcgctactatcgaagtcggagcaacacctcacgccgccgcaaactacctgcaagtc

SEQ ID NO: 234915 - DNA, 75 bp, Artificial Sequence
  Synthetic
ataacactttcatttttgctgaaatgtgcgatatggccatgttcatgagcagacagtatgacctatggcctccca

SEQ ID NO: 234916 - DNA, 75 bp, Artificial Sequence
  Synthetic
gcaaagagaacattgtggcattctccattgcttattgcttatgtacttgcattaccactgctatcatatgtgtgt

SEQ ID NO: 234917 - DNA, 75 bp, Artificial Sequence
  Synthetic
tgcgggtaatttactaactagcctgtcatccctaaaaactccacttaatcataaatcaggacaaaacatggctac

SEQ ID NO: 234918 - DNA, 75 bp, Artificial Sequence
  Synthetic
cttgcaggacagaaacacagaactgtcttaccaactcttgcttgactctctgggcgacagaaccagatactttag

SEQ ID NO: 234919 - DNA, 75 bp, Artificial Sequence
  Synthetic
ctccaaaaacagcaatgaggaaaaagagaaaatgccttgaccttttttcctcgttttctgttcacagctatgatt

SEQ ID NO: 234920 - DNA, 75 bp, Artificial Sequence
  Synthetic
gagaaaatgccttgaccttttttcctcgttttctgttcacagctatgatttttattacatccatctttattgtca

SEQ ID NO: 234921 - DNA, 75 bp, Artificial Sequence
  Synthetic
acaaataaatgcaggcgacaatttcacattagttgggcctaaaaaaccagttgtctcctggttctggactaaacc

SEQ ID NO: 234922 - DNA, 75 bp, Artificial Sequence
  Synthetic
acattagttgggcctaaaaaaccagttgtctcctggttctggactaaacctgatccatgggctaaaactgattac

SEQ ID NO: 234923 - DNA, 75 bp, Artificial Sequence
  Synthetic
ggtgtcggtccgcgaacagatagttacaaggagattaagccaaatggagaccaatctacttggacaaatgtagac

SEQ ID NO: 234924 - DNA, 75 bp, Artificial Sequence
  Synthetic
ttctgtataaatctaaccttacattcaattgcaataatcaaaacctaacactaatcaatgttactaaagattatg

SEQ ID NO: 234925 - DNA, 75 bp, Artificial Sequence
  Synthetic
caattgcaataatcaaaacctaacactaatcaatgttactaaagattatgaaggaacatactatggagatggaat

SEQ ID NO: 234926 - DNA, 75 bp, Artificial Sequence
  Synthetic
tatgaggaggcgataaagcttggaatgcccactaccaggcctatagctcccatggccaccggggtaatgaaacct

SEQ ID NO: 234927 - DNA, 75 bp, Artificial Sequence
  Synthetic
ccttctccactgggagagagtatgcttgggctgcattgcgcagcgaggtatgagtgagggcaaaagtgtccctga

SEQ ID NO: 234928 - DNA, 75 bp, Artificial Sequence
  Synthetic
ggtattaacggcgtagtggatctggccaaccaggctgtgcagaaacagataaacagccgcctggacccgccgccc

SEQ ID NO: 234929 - DNA, 75 bp, Artificial Sequence
  Synthetic
actcctaagagattcaaaagagctacaactaaagttacagatccacaaccaaaaatctctagcatcactactatc

SEQ ID NO: 234930 - DNA, 75 bp, Artificial Sequence
  Synthetic
caactaaagttacagatccacaaccaaaaatctctagcatcactactatctttactaacagtacatataccaatt

SEQ ID NO: 234931 - DNA, 75 bp, Artificial Sequence
  Synthetic
aaatattacaatcctgcctacaccaatcaatgaagaaattcctaaatcaatgattgggatcattgtggcggtggc

SEQ ID NO: 234932 - DNA, 75 bp, Artificial Sequence
  Synthetic
atcaatgaagaaattcctaaatcaatgattgggatcattgtggcggtggcagtgggaatgatcataatcataata

SEQ ID NO: 234933 - DNA, 75 bp, Artificial Sequence
  Synthetic
acagaaagttttattatgaagaaaaaggagaccccctactaaattttgacatttaattttttatagatgaaacaa

SEQ ID NO: 234934 - DNA, 75 bp, Artificial Sequence
  Synthetic
aggagaccccctactaaattttgacatttaattttttatagatgaaacaactaggtatcttgattatttactgca

SEQ ID NO: 234935 - DNA, 75 bp, Artificial Sequence
  Synthetic
aacaccaactagtaacaatgtgcagactactttaccagtcaccataaacaaaactacctcagtttttctaaataa

SEQ ID NO: 234936 - DNA, 75 bp, Artificial Sequence
  Synthetic
actactttaccagtcaccataaacaaaactacctcagtttttctaaataatacagactttaatactaactccaac

SEQ ID NO: 234937 - DNA, 75 bp, Artificial Sequence
  Synthetic
tcactgctcttattataattggattaataattctagcaatccttctatactttgtcttttgccgcaacatcccca

SEQ ID NO: 234938 - DNA, 75 bp, Artificial Sequence
  Synthetic
cgactgccatcttttctggggtgacgcaatagaaggtttgggggtcctgccgccagcgatcccacttgagtttca

SEQ ID NO: 234939 - DNA, 75 bp, Artificial Sequence
  Synthetic
tcctatttacaaccccatcttaagcgagccacaacttagacggtggagggaaatctaatacatctctcttttctt

SEQ ID NO: 234940 - DNA, 75 bp, Artificial Sequence
  Synthetic
ccccacagccaatcaccacacggcccacactttttaaaatcacctcatttacatattggcaccattccatctata

SEQ ID NO: 234941 - DNA, 75 bp, Artificial Sequence
  Synthetic
cttgggacagaacatgctctatgccaactcagctcatgctctggacatgacctttgaggtggatcccatggatga

SEQ ID NO: 234942 - DNA, 75 bp, Artificial Sequence
  Synthetic
atcacctgtatctgtgtgagtagcacagtctgtctggttattaattttttccaacttatagactggatttttgtg

SEQ ID NO: 234943 - DNA, 75 bp, Artificial Sequence
  Synthetic
cagaataccgcaaccatgatattgcggcactactcagacttctttaaaaccatacaggctttgctaccactgcta

SEQ ID NO: 234944 - DNA, 75 bp, Artificial Sequence
  Synthetic
actggctcctaagggcgcgcccaatacatctcagtggatagttacaacaaatgcggaccaaactaccaccaccac

SEQ ID NO: 234945 - DNA, 75 bp, Artificial Sequence
  Synthetic
ttgctgctactgccctgtgacactatagccaccacacctaccctaaacccaaatcttagaaaatgtaaattccaa

SEQ ID NO: 234946 - DNA, 75 bp, Artificial Sequence
  Synthetic
atgaagggagacaatattactaaagaaggtttacaaattgggaaagacattaccactaccgaaggagaagaaaag

SEQ ID NO: 234947 - DNA, 75 bp, Artificial Sequence
  Synthetic
tgattttgggtggaatgtccccaatgcactcactcacccacaagaaccacaggaacatatcccactacaaaacat

SEQ ID NO: 234948 - DNA, 75 bp, Artificial Sequence
  Synthetic
gggtccgttggtggagatgtcgatggcttgcagggttccgtgccccttgggcgctaccaccgtgcccttgttttt

SEQ ID NO: 234949 - DNA, 75 bp, Artificial Sequence
  Synthetic
ggttcagatggtacttgatctccacgggtccgttggtggagatgtcgatggcttgcagggttccgtgccccttgg

SEQ ID NO: 234950 - DNA, 75 bp, Artificial Sequence
  Synthetic
tcgagggcgcgcaccgggcggcaggggcggctcgggacccggcggcatggctggcagtggtacgtcggcgccgcg

SEQ ID NO: 234951 - DNA, 75 bp, Artificial Sequence
  Synthetic
ctacttgatatggacggccgtgcctccgaacagcgactcgcccaactacgcattcgccagcagcaggaacgtgcc

SEQ ID NO: 234952 - DNA, 75 bp, Artificial Sequence
  Synthetic
cattttctcaatacccattcgccttattttcgctctcatcgtacacacatcgaaagggccactgcgttcgaccgt

SEQ ID NO: 234953 - DNA, 75 bp, Artificial Sequence
  Synthetic
atcacaagcaggatattttggaatatgagtggtttgagtttactttgccagaaggcaacttttcagttactatga

SEQ ID NO: 234954 - DNA, 75 bp, Artificial Sequence
  Synthetic
catctccgctccgagtcgaggaacccggcggcgtcccagcagtagatgggacgagaccggacgcttcccgaaccc

SEQ ID NO: 234955 - DNA, 75 bp, Artificial Sequence
  Synthetic
tgagtggtttgagtttactttgccagaaggcaacttttcagttactatgaccattgatttgatgaacaatgccat

SEQ ID NO: 234956 - DNA, 75 bp, Artificial Sequence
  Synthetic
ttaatatccaggctaacctctggagaagttttctgtactccaacgtggctctgtaccttccagatgcttacaagt

SEQ ID NO: 234957 - DNA, 75 bp, Artificial Sequence
  Synthetic
aggcgtcctgaaactgtttggtggcatgaggttcagagtgagggcagggatgaagtttcaatattgcaggagaaa

SEQ ID NO: 234958 - DNA, 75 bp, Artificial Sequence
  Synthetic
cagctaatgaaatagccataggcaacaacctggctatggaaattaatattcaagctaacctttggagaaattttc

SEQ ID NO: 234959 - DNA, 75 bp, Artificial Sequence
  Synthetic
aacccggtctacccctatgaagatgaaaacagctcacaacacccctttataaaccccggtttcatttcccccaat

SEQ ID NO: 234960 - DNA, 75 bp, Artificial Sequence
  Synthetic
atgagtaaagaaattcccacgccttacatgtggagttatcaaccccaaatgggattggcggcaggcgcctcccag

SEQ ID NO: 234961 - DNA, 75 bp, Artificial Sequence
  Synthetic
ttctagctcttaaatgcgcagctccacttaccaccacaggtggttctcttcagcttaaagtgggtagggggctta

SEQ ID NO: 234962 - DNA, 75 bp, Artificial Sequence
  Synthetic
acttaccaccacaggtggttctcttcagcttaaagtgggtagggggcttacaattgacactactgacgggacatt

SEQ ID NO: 234963 - DNA, 75 bp, Artificial Sequence
  Synthetic
ccacttacaaaaactgcccactccataggtttatcattgggaaatgggttagaattaaaagacagcaaactatat

SEQ ID NO: 234964 - DNA, 75 bp, Artificial Sequence
  Synthetic
taggtttatcattgggaaatgggttagaattaaaagacagcaaactatatgttaaactaggagatggtctaaaat

SEQ ID NO: 234965 - DNA, 75 bp, Artificial Sequence
  Synthetic
ccatgacattaacactttatggaccggaatgaatccgtccattaactgtaacattatgcaacaagatgacaatga

SEQ ID NO: 234966 - DNA, 75 bp, Artificial Sequence
  Synthetic
ggaatgaatccgtccattaactgtaacattatgcaacaagatgacaatgacagcaagctaactctagtcttaact

SEQ ID NO: 234967 - DNA, 75 bp, Artificial Sequence
  Synthetic
gatgagaggccttatcagatgctgacctgtgctggaggacattgcaatatgctggctaccgtgcatattgtttct

SEQ ID NO: 234968 - DNA, 75 bp, Artificial Sequence
  Synthetic
atgtatcattggtaggggcatctgatattgtaaactcactatttaaacgggccactgcaaatatcacaataaggc

SEQ ID NO: 234969 - DNA, 75 bp, Artificial Sequence
  Synthetic
tattgtaaactcactatttaaacgggccactgcaaatatcacaataaggctaagctttgatgcctctggcaattt

SEQ ID NO: 234970 - DNA, 75 bp, Artificial Sequence
  Synthetic
accccactgaatcacagatatggcaatgacatggacactgacacattaactaatggcaagagttttatgcccagc

SEQ ID NO: 234971 - DNA, 75 bp, Artificial Sequence
  Synthetic
atgacatggacactgacacattaactaatggcaagagttttatgcccagcactacagcctatccctttaatgaca

SEQ ID NO: 234972 - DNA, 75 bp, Artificial Sequence
  Synthetic
aagcagacaccaggggcaagctaatcggattcttaacagtgcaggcagcagctcctttagccagagggtcatctt

SEQ ID NO: 234973 - DNA, 75 bp, Artificial Sequence
  Synthetic
ggggtctgcgcgctccaagcaagatgtacggaggcgcacgcaaacgttctacccaacatcccgtgcgtgttcgcg

SEQ ID NO: 234974 - DNA, 75 bp, Artificial Sequence
  Synthetic
atatggcacctgttattataaatcaactgaagacgcattgtacccgctagaagttgccgtcacacttaacagacg

SEQ ID NO: 234975 - DNA, 75 bp, Artificial Sequence
  Synthetic
actgaagacgcattgtacccgctagaagttgccgtcacacttaacagacggatgagcagtgctgccgtttcttat

SEQ ID NO: 234976 - DNA, 75 bp, Artificial Sequence
  Synthetic
gtgcaaacacaccccctgaaactaccatagcaacccttgttacctcccccttcactttttcctatattagagaaa

SEQ ID NO: 234977 - DNA, 75 bp, Artificial Sequence
  Synthetic
ggtggtaagccccggtgttgattgtgtaggagcagttggccatgactgaccagttgactgtctggtgccccggac

SEQ ID NO: 234978 - DNA, 75 bp, Artificial Sequence
  Synthetic
aactttttattgaaaaatcagtttacaggattcgagtagttattttgcctcccccttcccatttcatacgataca

SEQ ID NO: 234979 - DNA, 75 bp, Artificial Sequence
  Synthetic
aggctgtctacctgcgtaccccgttctcagctggtaacgccaccacataagaagcctcttgcttcttgcaagcag

SEQ ID NO: 234980 - DNA, 75 bp, Artificial Sequence
  Synthetic
ggcaacggatccagcgagcaagagcttagggccattgctagagatctgggctgcggaccatatttcctgggaacc

SEQ ID NO: 234981 - DNA, 75 bp, Artificial Sequence
  Synthetic
ttctcagatgagcgcctcaagcaaatttaccagtttgagtatgaggggctcctgcgccgtagcgccctagctacc

SEQ ID NO: 234982 - DNA, 75 bp, Artificial Sequence
  Synthetic
aaatcaaatgggttctggcgggagtcagagtggcccgcgggcagggatacgttgcggaactgtaacctgttctgc

SEQ ID NO: 234983 - DNA, 75 bp, Artificial Sequence
  Synthetic
tagaacgctcagttctcggggctgggagtggctcgcgcccgtagtctggagaatcaatcgccagggttgcgttgc

SEQ ID NO: 234984 - DNA, 75 bp, Artificial Sequence
  Synthetic
gaatcaatcgccagggttgcgttgcggtgtgccccggttcgagtcttagcgcgccggatcggccggtttccgcga

SEQ ID NO: 234985 - DNA, 75 bp, Artificial Sequence
  Synthetic
caagcgagggtttggcagccccgtcatttctaagaccccgccagccgacttctccagtttacgggagcgagccct

SEQ ID NO: 234986 - DNA, 75 bp, Artificial Sequence
  Synthetic
gagttgtcctggtaggcgatctcggccatgaactgctcgatctcttcctcttgaagatctccgcggcccgctctc

SEQ ID NO: 234987 - DNA, 75 bp, Artificial Sequence
  Synthetic
gctcgccacatccatctcgataatgtggtccttctggatcatgatagtgccatgcaggcatttcaccttgccttc

SEQ ID NO: 234988 - DNA, 75 bp, Artificial Sequence
  Synthetic
acgggtgctgcgtgatgatgattttgaagtcgatgaagtgacaggaataagtcctgctagggcacatgtggccgc

SEQ ID NO: 234989 - DNA, 75 bp, Artificial Sequence
  Synthetic
ttcaaaaatctttcaacaaccatgtgcgcaccctgattgcccgcgaggaagtgacactgggtctgatgcacctgt

SEQ ID NO: 234990 - DNA, 75 bp, Artificial Sequence
  Synthetic
gaaccccaccagcaaacctctaaccgctcagctgtttctggtggtgcaacatagtagagacaatgaggcatttag

SEQ ID NO: 234991 - DNA, 75 bp, Artificial Sequence
  Synthetic
gctcagctgtttctggtggtgcaacatagtagagacaatgaggcatttagggaggcgctgttgaacattactgag

SEQ ID NO: 234992 - DNA, 75 bp, Artificial Sequence
  Synthetic
ttatcaatattctgcaaagtataatagtgcaagaacgtagcctgggtctagctgagaaggtggctgctattaact

SEQ ID NO: 234993 - DNA, 75 bp, Artificial Sequence
  Synthetic
agtgcaagaacgtagcctgggtctagctgagaaggtggctgctattaactactcggtcttgagcctgggcaagca

SEQ ID NO: 234994 - DNA, 75 bp, Artificial Sequence
  Synthetic
ccatacgtacctatagacaaggaggtgaagatagatgggttttatatgcgcatgactctcaaggtgctgaccttg

SEQ ID NO: 234995 - DNA, 75 bp, Artificial Sequence
  Synthetic
tacctcaccgggcttgggggggaggacgtgctcctcaaacatctagcaaggcagtcgatcatagttaaagacgca

SEQ ID NO: 234996 - DNA, 75 bp, Artificial Sequence
  Synthetic
gtatgagcttccttacatagaagaggtggatgaaggccaggatgaggagggcgagtacctggaagactgatggcg

SEQ ID NO: 234997 - DNA, 75 bp, Artificial Sequence
  Synthetic
gtggatgaaggccaggatgaggagggcgagtacctggaagactgatggcgcgaccatccatatttttgctagatg

SEQ ID NO: 234998 - DNA, 75 bp, Artificial Sequence
  Synthetic
ctttagccagagggtcattcttgtcaatcttctcaacacttctcttgccatccttctcagtgatgcgcacgggtg

SEQ ID NO: 234999 - DNA, 75 bp, Artificial Sequence
  Synthetic
cacacacgagaaggtcctggccatcgtgaacgcgctggtggagaacaaagccatacgtcccgatgaggctgggct

SEQ ID NO: 235000 - DNA, 75 bp, Artificial Sequence
  Synthetic
tctgggaagtgatgagactcgggccgcaaatgctctgcaacagggagagaatggcatggatgaacatcacagcgc

SEQ ID NO: 235001 - DNA, 75 bp, Artificial Sequence
  Synthetic
taccacctggctctcggtagaagaaccggaccccacacggcggtaggtgttcctcttcgggggcagaggtggagg

SEQ ID NO: 235002 - DNA, 75 bp, Artificial Sequence
  Synthetic
gaacgccttcctcagcactcagcctgccaacgtgcctcgcggtcagcaagactacacaaactttctaagtgcatt

SEQ ID NO: 235003 - DNA, 75 bp, Artificial Sequence
  Synthetic
acagggcttgcagacagtaaacctgagccaggcttttaagaacctgaatggtctgtggggagtgcgcgccccagt

SEQ ID NO: 235004 - DNA, 75 bp, Artificial Sequence
  Synthetic
ttgctgacccctaactcccgcctactactgctcttggtagccccattcactgacagcggtagcatcgaccgtaat

SEQ ID NO: 235005 - DNA, 75 bp, Artificial Sequence
  Synthetic
actgcccagcctgtgcgcaatatatagagaacccttacactgacgtaattgggcaaagtctaaaaaatcccgcca

SEQ ID NO: 235006 - DNA, 75 bp, Artificial Sequence
  Synthetic
cacttcctcgttccgtatatgacgtcaattccgctttcccacgaatcgtcacttccggccatcttgcaacgtcac

SEQ ID NO: 235007 - DNA, 75 bp, Artificial Sequence
  Synthetic
ccaacagaaaaccagcagcggcagttagaaaatacacaacaagtgcagcaacaggaggattaaagattacagcca

SEQ ID NO: 235008 - DNA, 75 bp, Artificial Sequence
  Synthetic
gctcgatatgacagcccgaaacatggagcccagcatgtatgccagtaaccggccttttatcaataaactgctaga

SEQ ID NO: 235009 - DNA, 75 bp, Artificial Sequence
  Synthetic
aactctgattatttcaccaatgctatcctgaacccccattggctgcccccacctgggttctatacgggcgagtat

SEQ ID NO: 235010 - DNA, 75 bp, Artificial Sequence
  Synthetic
ttttatgggacgatgtggacagtagtgttttctccccgcctcctggttataacacttggaagaaggaaggtggcg

SEQ ID NO: 235011 - DNA, 75 bp, Artificial Sequence
  Synthetic
tgttttctccccgcctcctggttataacacttggaagaaggaaggtggcgatagaaggcactcttccgtgtcact

SEQ ID NO: 235012 - DNA, 75 bp, Artificial Sequence
  Synthetic
gcggttcccgaggccgcaagtcctttccctagtttgccattttcgctaaacagtgtacgcagcagtgagctggga

SEQ ID NO: 235013 - DNA, 75 bp, Artificial Sequence
  Synthetic
tccctagtttgccattttcgctaaacagtgtacgcagcagtgagctgggaagaataacccgtcctcgcttgatcg

SEQ ID NO: 235014 - DNA, 75 bp, Artificial Sequence
  Synthetic
cctgttgagacccgagagggagaagaatttccccaacaacgggatagaaagcttggttgacaaaatgaaccgctg

SEQ ID NO: 235015 - DNA, 75 bp, Artificial Sequence
  Synthetic
ctccacttaatcataaatcaggacaaaacatggctactggtgccattactaatgctaaaggtttcatgcccagca

SEQ ID NO: 235016 - DNA, 75 bp, Artificial Sequence
  Synthetic
gacgatccccgggcgctgggggatagccggggcagcgctacccgtaaacgccagtggcacgacaggcagcggggc

SEQ ID NO: 235017 - DNA, 75 bp, Artificial Sequence
  Synthetic
ccagtggcacgacaggcagcggggcctggtgtgggccgatgatgattccgccgacgacagcagcgtgttggactt

SEQ ID NO: 235018 - DNA, 75 bp, Artificial Sequence
  Synthetic
gatggtgaccgatgtgcgcgaggccgtgtctcagcgcgagcggttccagcgcgacgccaacttggggtcgttggt

SEQ ID NO: 235019 - DNA, 75 bp, Artificial Sequence
  Synthetic
ctcactgaactatcagaacgaccacagcaacttcctcaccacggtggtgcaaaacaatgactttacccccacgga

SEQ ID NO: 235020 - DNA, 75 bp, Artificial Sequence
  Synthetic
gactttgtgcctctcacctaccgcgagtgccccccgccgctatggagccactgctacctgttccgcctggccaac

SEQ ID NO: 235021 - DNA, 75 bp, Artificial Sequence
  Synthetic
aggtgtcacagtagatgacaattatgatcacaagcaggatattttggaatatgagtggtttgagtttactctacc

SEQ ID NO: 235022 - DNA, 75 bp, Artificial Sequence
  Synthetic
gatcacaagcaggatattttggaatatgagtggtttgagtttactctaccggaagggaacttctcagccacaatg

SEQ ID NO: 235023 - DNA, 75 bp, Artificial Sequence
  Synthetic
tcattgataattaccttgaagtgggcagacagaatggagtgttggagagtgacattggtgttaaatttgacacca

SEQ ID NO: 235024 - DNA, 75 bp, Artificial Sequence
  Synthetic
cagacagaatggagtgttggagagtgacattggtgttaaatttgacaccaggaactttagactgggttgggatcc

SEQ ID NO: 235025 - DNA, 75 bp, Artificial Sequence
  Synthetic
gaaaagaacttccccaacaatggaatagagagcctggtggataagatgagtagatggaagacctatgcgcaggat

SEQ ID NO: 235026 - DNA, 75 bp, Artificial Sequence
  Synthetic
gtttacacctatgaggcattccatcctgacattgtattgttgcctggttgcggagttgactttactgaaagtcgc

SEQ ID NO: 235027 - DNA, 75 bp, Artificial Sequence
  Synthetic
ctgacattgtattgttgcctggttgcggagttgactttactgaaagtcgccttagtaacttgcttggtatcagga

SEQ ID NO: 235028 - DNA, 75 bp, Artificial Sequence
  Synthetic
taagatcttgtatgaggatcttgaagggggtaatatcccggccctgttggatgtagaagcctatgagaacagtaa

SEQ ID NO: 235029 - DNA, 75 bp, Artificial Sequence
  Synthetic
tccctctaggacataattacactctcataggacccccaatcacttcagaggtcatctggaccaaactgggaagcg

SEQ ID NO: 235030 - DNA, 75 bp, Artificial Sequence
  Synthetic
gagttcttcaaaagtgagatctgtagggtcagtgagagcatagtgttcgagggcccattcgtgcaggtgagggtt

SEQ ID NO: 235031 - DNA, 75 bp, Artificial Sequence
  Synthetic
aagaagtcagaggagacaactatacagcttcatctgttgcaactgaagaatcgctattggctgctgtggccgaaa

SEQ ID NO: 235032 - DNA, 75 bp, Artificial Sequence
  Synthetic
aagataaagtgaatacagcctaccgcagctggtacctgtcctacaactatggtgaccctgaaaaaggagtccgtt

SEQ ID NO: 235033 - DNA, 75 bp, Artificial Sequence
  Synthetic
tgtcacctgtggagcagagcaggtgtactggtcgctcccagacatgatgcaggaccctgtcacattccgttccac

SEQ ID NO: 235034 - DNA, 75 bp, Artificial Sequence
  Synthetic
cacgtcgcccgagttgtcctggtaggcgatctcggccatgaactgctcgatttcttcctcctgaagatctccgcg

SEQ ID NO: 235035 - DNA, 75 bp, Artificial Sequence
  Synthetic
ttttaaaacgcactgtgaataattctacaacttcacatacaacaatttccacttcaacaatcagcattatcgctg

SEQ ID NO: 235036 - DNA, 75 bp, Artificial Sequence
  Synthetic
ccctgagaagacttgcatgcgcgacgacgcggcggttgacatcctggatctgacgcctctgggtgaaagctaccg

SEQ ID NO: 235037 - DNA, 75 bp, Artificial Sequence
  Synthetic
cttatctcacctagtaataacaccggttggggcctgcgcgcgccaagcaagatgtacggaggtgctcgcaaacgc

SEQ ID NO: 235038 - DNA, 75 bp, Artificial Sequence
  Synthetic
gttggggcctgcgcgcgccaagcaagatgtacggaggtgctcgcaaacgctctacacagcaccctgtgcgcgtgc

SEQ ID NO: 235039 - DNA, 75 bp, Artificial Sequence
  Synthetic
tctacacagcaccctgtgcgcgtgcgcgggcacttccgcgctccatggggcgccctcaagggtcgtacccgcact

SEQ ID NO: 235040 - DNA, 75 bp, Artificial Sequence
  Synthetic
atgatgaggtgtacggggatgacgatattcttgagcaggcggcagaccgccttgacgagtttgcttatggcaagc

SEQ ID NO: 235041 - DNA, 75 bp, Artificial Sequence
  Synthetic
ggcggtgtccattcccttggatcatggaaatcccacccccagcctcaaaccagtcaccctgcagcaagtgctgcc

SEQ ID NO: 235042 - DNA, 75 bp, Artificial Sequence
  Synthetic
aacaagcttggatctcatctgcaacaccgcctttcacgaagccttctttctgccaatactaccactcccaaaacc

SEQ ID NO: 235043 - DNA, 75 bp, Artificial Sequence
  Synthetic
atcgccaggcgccaccgggctactcccgctatgcgagcggcaagagctctgctacggagggccaaacgcgtgggg

SEQ ID NO: 235044 - DNA, 75 bp, Artificial Sequence
  Synthetic
ggtggtgcgcacctcgcgctcgaaagcccccgggatttcttcctcaatctcttcttcttccactaacatctcttc

SEQ ID NO: 235045 - DNA, 75 bp, Artificial Sequence
  Synthetic
cattcagcctaaatacgctatgcaactagaaatcaccatactaattgtaattggaattcttatactatctgttat

SEQ ID NO: 235046 - DNA, 75 bp, Artificial Sequence
  Synthetic
ccgctatgcgagcggcaagagctctgctacggagggccaaacgcgtggggcgaagagctatgcttagagcggcca

SEQ ID NO: 235047 - DNA, 75 bp, Artificial Sequence
  Synthetic
acacacatcgaaagggccactgcgttcgaccgtatggatgtgcaataatgactcatgtaaacaacgtgttgaata

SEQ ID NO: 235048 - DNA, 75 bp, Artificial Sequence
  Synthetic
ccccaaggcggcgtgtgcagtggcgtggacgcaaagtgcggcctgtgctgagacctggaaccacggtggtcttta

SEQ ID NO: 235049 - DNA, 75 bp, Artificial Sequence
  Synthetic
catgactgaccagttgactgtctggtgccccgggcgcacgagctcggtgtacttgaggcgcgagtaggcgcgggt

SEQ ID NO: 235050 - DNA, 75 bp, Artificial Sequence
  Synthetic
gtcaaagatgtaatcgttgcaggtgcgcaccaggtactggtagccgatgagaaagtgcggcggtggctggcggta

SEQ ID NO: 235051 - DNA, 75 bp, Artificial Sequence
  Synthetic
ttcccttggacaatgggaatcccacccctagtctcaagccagtcaccctgcaacaagtgctgcccgtgcctccac

SEQ ID NO: 235052 - DNA, 75 bp, Artificial Sequence
  Synthetic
ccctagtctcaagccagtcaccctgcaacaagtgctgcccgtgcctccacgcagaggcaacaagcgagagggtga

SEQ ID NO: 235053 - DNA, 75 bp, Artificial Sequence
  Synthetic
tcactgctcctgcgattccatcgagtgcacctacaccctgctgaagaccctatgcggcctaagagacctgctacc

SEQ ID NO: 235054 - DNA, 75 bp, Artificial Sequence
  Synthetic
atggtgcccaagcgccagcggctggaggacgtgctggagaaaatgaaagtggatcccgatatacaacctgaggtc

SEQ ID NO: 235055 - DNA, 75 bp, Artificial Sequence
  Synthetic
aggacgtgctggagaaaatgaaagtggatcccgatatacaacctgaggtcaaagtgagacccatcaagcaggtgg

SEQ ID NO: 235056 - DNA, 75 bp, Artificial Sequence
  Synthetic
agacatcaagattcccaccgagtcaatggaagtccaaaccgaacctgcaaagcccacaaccacctccattgaggt

SEQ ID NO: 235057 - DNA, 75 bp, Artificial Sequence
  Synthetic
tagcgctaggagtagttgcgggtgggctggtgcttatcctctgctacctatacacaccttgctgtgcttatttag

SEQ ID NO: 235058 - DNA, 75 bp, Artificial Sequence
  Synthetic
atgggggtcgtactagtcgcgcttgctttactttcgcttttgggtctgggctctgctaatcttcctctcaatcac

SEQ ID NO: 235059 - DNA, 75 bp, Artificial Sequence
  Synthetic
tcgccgccgccccaccagcaatctgactcccgctgctctggtgcggagagtgtatcgcgatggccgcgcggatcc

SEQ ID NO: 235060 - DNA, 75 bp, Artificial Sequence
  Synthetic
gcttgtattgttcgtgctgctcaggcattagtttaaaagaggttctaagttcgttatccagcctgtacttctcca

SEQ ID NO: 235061 - DNA, 75 bp, Artificial Sequence
  Synthetic
taaaaacacttacttgaaatcagaaataaggtttctgtctacgttgtttccaagcagcacctcacttccctcttc

SEQ ID NO: 235062 - DNA, 75 bp, Artificial Sequence
  Synthetic
tgctcctgcaactactgcagccgcagccgtgtgcggcgcgggacagcccgcctatgatctggacttggaagaggg

SEQ ID NO: 235063 - DNA, 75 bp, Artificial Sequence
  Synthetic
tgtgcgatatggtcatgttcatgagcagacagtatgacctatggcctcccagcaaagagaacattgtggcattct

SEQ ID NO: 235064 - DNA, 75 bp, Artificial Sequence
  Synthetic
ggtctggaccgaagacggctgctgcgggacgaggatttcgaggtcgatgaagtgacagggatcagccccgctagg

SEQ ID NO: 235065 - DNA, 75 bp, Artificial Sequence
  Synthetic
aggactctcgcgaggcgtacgtgccccagcagaacctgttcagggacaggagcggcgaggagccagaggagatgc

SEQ ID NO: 235066 - DNA, 75 bp, Artificial Sequence
  Synthetic
gggatagtgaaaactacattcatggaatatgttactacatgactagttatgatagaagtctatttcccttgaaca

SEQ ID NO: 235067 - DNA, 75 bp, Artificial Sequence
  Synthetic
tagctttaagccatattctggcacagcttacaattcactggctcctaagggcgcgcccaatacatctcagtggat

SEQ ID NO: 235068 - DNA, 75 bp, Artificial Sequence
  Synthetic
gtaactaccaccacaaacacatttggcattgcttccatgaagggagacaatattactaaagaaggtttagaaatt

SEQ ID NO: 235069 - DNA, 75 bp, Artificial Sequence
  Synthetic
cccgccgccatcagccccgggtgaaatggaagtggaggaagatctccctccccttgaaaagcggggcgacaagcg

SEQ ID NO: 235070 - DNA, 75 bp, Artificial Sequence
  Synthetic
cccttgaaaagcggggcgacaagcgtccgcgccccgatctggaggagacactagtcacacgctcagacaacccgc

SEQ ID NO: 235071 - DNA, 75 bp, Artificial Sequence
  Synthetic
atagaaattctaaaagacgtcccatctattctcctatgattagtcgtccccatatggctctgaatgaaatctaag

SEQ ID NO: 235072 - DNA, 75 bp, Artificial Sequence
  Synthetic
ccatgctacgggtcttttgcaagacctacaaatataaaagggggccaagctaaaaacagaaaagtaaaaccaacc

SEQ ID NO: 235073 - DNA, 75 bp, Artificial Sequence
  Synthetic
tccgcgccccgatctggaggagacactagtcacacgctcagacaacccgccctcctacgaggaggcagtgaagct

SEQ ID NO: 235074 - DNA, 75 bp, Artificial Sequence
  Synthetic
gctaatgaaggagtggacatagacccaccttctgagaccctcgataccccaggggtgattgtggagagcggcaga

SEQ ID NO: 235075 - DNA, 75 bp, Artificial Sequence
  Synthetic
acagcccgtcgccgtagccagaccgcatcctgggggcactccacgtccgaatgcaaactggcagagtactctgaa

SEQ ID NO: 235076 - DNA, 75 bp, Artificial Sequence
  Synthetic
ctggacgcggcagggtgtgagcttccttacgtagaagaggtggatgaaggcgaggaggaggagggcgagtacctg

SEQ ID NO: 235077 - DNA, 75 bp, Artificial Sequence
  Synthetic
tcctatgatgaggtgtatggggatgatgatattctggagcaggcggccgaccgcctgggcgagtttgcttatggc

SEQ ID NO: 235078 - DNA, 75 bp, Artificial Sequence
  Synthetic
gggtgtgagcttccttacatagaagaggtggatgaagtcgaggacgaggagggcgagtacttggaagactgatgg

SEQ ID NO: 235079 - DNA, 75 bp, Artificial Sequence
  Synthetic
gttttcctctggatggcataggaccagcgaaaacatatcaaggcattaaatctaaagacaatggatgggaaaaag

SEQ ID NO: 235080 - DNA, 75 bp, Artificial Sequence
  Synthetic
gttgaccgggaagacaatacctacgcatacaaagttcgatacaccttggctgtgggcgacaacagagtgctggat

SEQ ID NO: 235081 - DNA, 75 bp, Artificial Sequence
  Synthetic
catacaaagttcgatacaccttggctgtgggcgacaacagagtgctggatatggccagcactttctttgacattc

SEQ ID NO: 235082 - DNA, 75 bp, Artificial Sequence
  Synthetic
ctctgcacccatccattattccaactccgggttaccgaggcactcgctactaccgcagcaggagcagcacttccc

SEQ ID NO: 235083 - DNA, 75 bp, Artificial Sequence
  Synthetic
tcaacattggcgccaggtggtctcttgacccaatggacaatgtgaatccattcaaccaccaccgcaatgctggtc

SEQ ID NO: 235084 - DNA, 75 bp, Artificial Sequence
  Synthetic
gctgatgggatcaggatccacagtctctcgaagcatgattttaatagccctcaacattaacatcctggtgcgatg

SEQ ID NO: 235085 - DNA, 75 bp, Artificial Sequence
  Synthetic
tgccccagtgaaagcagaaggtggtgatatcactaaagacaaaggtcttccaattggttcagaaattacagacgg

SEQ ID NO: 235086 - DNA, 75 bp, Artificial Sequence
  Synthetic
atcttaccacttacacttttggaaatgccccagtgaaagcagaaggtggtgatatcactaaagacaaaggtcttc

SEQ ID NO: 235087 - DNA, 75 bp, Artificial Sequence
  Synthetic
tggtcttcagtcatagaagctcgggtttcattttcctcacaacgtggtaactgggctctggtgtaagggtgatgt

SEQ ID NO: 235088 - DNA, 75 bp, Artificial Sequence
  Synthetic
caatggtcgttatgtgcctttccacatacaagtgcctcaaaaattctttgctgtcaagaacctacttcttctacc

SEQ ID NO: 235089 - DNA, 75 bp, Artificial Sequence
  Synthetic
aaactataccaaccagaacctcaggtgggagatgaaacttggactgacacagatggaacagctgagaagtatggt

SEQ ID NO: 235090 - DNA, 75 bp, Artificial Sequence
  Synthetic
tgggagatgaaacttggactgacacagatggaacagctgagaagtatggtggtagagctctaaagccagaaacta

SEQ ID NO: 235091 - DNA, 75 bp, Artificial Sequence
  Synthetic
tgattgggttaactatccttgctgttatcctttactttatcttttgccgccaaatacccaatgtagttaagaaac

SEQ ID NO: 235092 - DNA, 75 bp, Artificial Sequence
  Synthetic
aatgtaaattagatgacgccccctccagaacacactgcccacatacataatttccttgggcatatgcatgttcac

SEQ ID NO: 235093 - DNA, 75 bp, Artificial Sequence
  Synthetic
tgctaaacccactaacgtcaaaggcggacaggcaaaacaaaaaactactgaacaactgcaaaaccagcaggttga

SEQ ID NO: 235094 - DNA, 75 bp, Artificial Sequence
  Synthetic
tttccttgggcatatgcatgttcacaatttctctgtaccatggacagcgctggttaatcatacagcccctaataa

SEQ ID NO: 235095 - DNA, 75 bp, Artificial Sequence
  Synthetic
ggacaggcaaaacaaaaaactactgaacaactgcaaaaccagcaggttgaatatgatattgacatgaactttttt

SEQ ID NO: 235096 - DNA, 75 bp, Artificial Sequence
  Synthetic
tgttctgaggaaatcatccacggtagcatatgcaaatcccaaccaagcaatgcaactggattgcgtttcaagcag

SEQ ID NO: 235097 - DNA, 75 bp, Artificial Sequence
  Synthetic
tcagtccaaaaattgtgatgtatgcagaaaatgtagacttggaaaccccagacactcatgtggtgtacaaacctg

SEQ ID NO: 235098 - DNA, 75 bp, Artificial Sequence
  Synthetic
ctcttcgggggttaaaaacatatcccagggaatgggaagctcttgcaaaacagtaaagctggcagaacaaggaag

SEQ ID NO: 235099 - DNA, 75 bp, Artificial Sequence
  Synthetic
ccgagagccggcctggaccctccggtggaggaggcggaggagtagctgacctgtttcctgaactgcgacgggtgc

SEQ ID NO: 235100 - DNA, 75 bp, Artificial Sequence
  Synthetic
tgaatgcggtggttgacttgcaggacagaaacacagaactatcatatcaactactgcttgactctctgggtgaca

SEQ ID NO: 235101 - DNA, 75 bp, Artificial Sequence
  Synthetic
ggaagggtacaatgtggcccaatgtaacatgaccaaagactggttcctggttcagatgcttgccaactacaacat

SEQ ID NO: 235102 - DNA, 75 bp, Artificial Sequence
  Synthetic
attttcagctttccagccttgaattattcgtgtcagttcttgtggtaaatccaatccacacattacaaacaggtc

SEQ ID NO: 235103 - DNA, 75 bp, Artificial Sequence
  Synthetic
ttccttgtttaccacttatttgattttggatggaacgcccttaatgcactcacttacccacaagaaccagaggaa

SEQ ID NO: 235104 - DNA, 75 bp, Artificial Sequence
  Synthetic
ttgaaccaaatggagagggtgcagattggaaagagcctgacataaatggaacaagtgaaattggacaaggaaatc

SEQ ID NO: 235105 - DNA, 75 bp, Artificial Sequence
  Synthetic
attgggaggtggccattaggaattatgctaagatatctctgaggcctgataaacagtatagaattaccaagaaga

SEQ ID NO: 235106 - DNA, 75 bp, Artificial Sequence
  Synthetic
agctaatctctggagaagttttctttattccaatgtggctctgtatctcccagactcctacaaatacaccccagc

SEQ ID NO: 235107 - DNA, 75 bp, Artificial Sequence
  Synthetic
tagccagaagccccccgggaacaagagcaggggacgctacagtgcagtacaagcgcagacctccccaattggctc

SEQ ID NO: 235108 - DNA, 75 bp, Artificial Sequence
  Synthetic
tattccaatgtggctctgtatctcccagactcctacaaatacaccccagccaatgtcactcttccaactaacacc

SEQ ID NO: 235109 - DNA, 75 bp, Artificial Sequence
  Synthetic
ccactttatttacagtaagtgtatttaagtgaaatttaaaggaatagtgtagctgtttaataactgttgaatggt

SEQ ID NO: 235110 - DNA, 75 bp, Artificial Sequence
  Synthetic
gggtggttcccccatccctggtggatacctacgtaaacattggcgccagatggtctttggatgccatggacaatg

SEQ ID NO: 235111 - DNA, 75 bp, Artificial Sequence
  Synthetic
tacctacgtaaacattggcgccagatggtctttggatgccatggacaatgtcaacccctttaaccatcaccgcaa

SEQ ID NO: 235112 - DNA, 75 bp, Artificial Sequence
  Synthetic
cttttgggcaatggtcgttacgtgcctttccacattcaagtgcctcagaaattctttgctgtgaaaaacctgctg

SEQ ID NO: 235113 - DNA, 75 bp, Artificial Sequence
  Synthetic
ctttccacattcaagtgcctcagaaattctttgctgtgaaaaacctgctgcttctacccggttcttacacctacg

SEQ ID NO: 235114 - DNA, 75 bp, Artificial Sequence
  Synthetic
tcggccggtttccgcgacaagcgagggtttggcagccccgtcatttctaagaccccgccagccgacttctccagt

SEQ ID NO: 235115 - DNA, 75 bp, Artificial Sequence
  Synthetic
catggtcctgcagagttcccttggtaatgatctccgggtcgatggtgccagcataagttttaccagcatcaatct

SEQ ID NO: 235116 - DNA, 75 bp, Artificial Sequence
  Synthetic
taaatacacatacaaagcctcatcagccatggcttaccagacaaagtacagcgggcgcacaaagcacaagctcta

SEQ ID NO: 235117 - DNA, 75 bp, Artificial Sequence
  Synthetic
aatgatctccgggtcgatggtgccagcataagttttaccagcatcaatctctatgccaccttcttccccatggcc

SEQ ID NO: 235118 - DNA, 75 bp, Artificial Sequence
  Synthetic
ccatgctgcgcaatgacaccaatgatcaatcattcaatgactacctttccgctgccaacatgctctaccccatcc

SEQ ID NO: 235119 - DNA, 75 bp, Artificial Sequence
  Synthetic
cccagatggccaaacgagctcgtctaagcagctccttcaacccggtctacccctatgaagatgaaagcagttcac

SEQ ID NO: 235120 - DNA, 75 bp, Artificial Sequence
  Synthetic
gccttcagaggctggtccttcaccagactcaaaaccaaggagactccctctttgggatcagggttcgatccctac

SEQ ID NO: 235121 - DNA, 75 bp, Artificial Sequence
  Synthetic
acttgcaacgtcattttcccacggtcgcgccgccccttttagccgttcaccccgcagccaatcaccacacagcgc

SEQ ID NO: 235122 - DNA, 75 bp, Artificial Sequence
  Synthetic
tttgggatcagggttcgatccctactttgtttactctggttctataccctacctggatggcaccttctaccttaa

SEQ ID NO: 235123 - DNA, 75 bp, Artificial Sequence
  Synthetic
ttccgcaatcccaacaagcgtcacttcctctttctcacggtacgtcacatcccattaacttgcaacgtcattttc

SEQ ID NO: 235124 - DNA, 75 bp, Artificial Sequence
  Synthetic
gctaaaaggggcggcgcggccgtgggaaaatgacgtttttgggggtggagtgtttttgcaagttgtcgcggtaaa

SEQ ID NO: 235125 - DNA, 75 bp, Artificial Sequence
  Synthetic
cccaatgtaacatgaccaaagactggttcctggtccagatgcttgccaactacaacattggataccagggcttct

SEQ ID NO: 235126 - DNA, 75 bp, Artificial Sequence
  Synthetic
cgttaaccccacagccaatcaccacacaccccacaatttttaaaatcacctcatttacatattggcaccattcca

SEQ ID NO: 235127 - DNA, 75 bp, Artificial Sequence
  Synthetic
catgtactccttcttcagaaacttccagcccatgagtagacaggtggttgatgagattaactacaaagactataa

SEQ ID NO: 235128 - DNA, 75 bp, Artificial Sequence
  Synthetic
cagcccatgagtagacaggtggttgatgagattaactacaaagactataaagctgtcgccgtaccctaccagcat

SEQ ID NO: 235129 - DNA, 75 bp, Artificial Sequence
  Synthetic
tggctcctaccatgcgtcagggtcaagcgtaccctgctaactacccataccccctaattggaaccactgcagtaa

SEQ ID NO: 235130 - DNA, 75 bp, Artificial Sequence
  Synthetic
cttcgctgtcctggctgatgtcttgcagagggacatgcttggtcttcctgggcttcttcttgggagggatcgggg

SEQ ID NO: 235131 - DNA, 75 bp, Artificial Sequence
  Synthetic
cagatgccccagaaaataccacaaccaccctggtcacctcccccttctccttttcctatattagagaagatgact

SEQ ID NO: 235132 - DNA, 75 bp, Artificial Sequence
  Synthetic
ggattccatttgagatagtcatggatttagattccacattccacacagtttcagagctagataatcttggatcag

SEQ ID NO: 235133 - DNA, 75 bp, Artificial Sequence
  Synthetic
actacccggacgagttcataccgaacttcgacgcaattagcgagtcagtggacggctacgattgatgtctggtga

SEQ ID NO: 235134 - DNA, 75 bp, Artificial Sequence
  Synthetic
agagctcatgcccgtcttctcaaagagtttctacaacgagcaagccgtgtactcccagcagctccgccagtccac

SEQ ID NO: 235135 - DNA, 75 bp, Artificial Sequence
  Synthetic
ttccctgagaatcagatcctcatccgcccgccggcgcccaccattaccaccgtcagtgaaaacgttcctgctctc

SEQ ID NO: 235136 - DNA, 75 bp, Artificial Sequence
  Synthetic
accgctccctcgcctgcaacccccagttgctaagcgagacccagatcatcggcaccttcgagttgcagggtccca

SEQ ID NO: 235137 - DNA, 75 bp, Artificial Sequence
  Synthetic
aataaaaagcactttatttttacatgcactaaggctctggttttttgctcattcgttttcatcattcacttagaa

SEQ ID NO: 235138 - DNA, 75 bp, Artificial Sequence
  Synthetic
cggagcacgaggaggagctgaaacgttttctagacagagaggatgacgaccgcccagagcatcaagcagatggcg

SEQ ID NO: 235139 - DNA, 75 bp, Artificial Sequence
  Synthetic
ttagaagatactgagcagtctccgatgttgtgtcccagcggcgaggatgtccaagcgcaaatacaaggaagagat

SEQ ID NO: 235140 - DNA, 75 bp, Artificial Sequence
  Synthetic
tcctggcttggtcgggggttatccctgggtacacggccttcatgaaggcttcgtactgcttgaaagcttcctgag

SEQ ID NO: 235141 - DNA, 75 bp, Artificial Sequence
  Synthetic
actctcataggacccccaatcacttcagaggtcatttggaccaaactgggaagcgttgattactttgatataatc

SEQ ID NO: 235142 - DNA, 75 bp, Artificial Sequence
  Synthetic
agatggcacctctcgcccccactgtgttgatgaaaaatgacagctaggtcaaacataatgcgattttccaggtgc

SEQ ID NO: 235143 - DNA, 75 bp, Artificial Sequence
  Synthetic
aggccagcacaaaagaggccacgtgggaggggtagcggtcattgtcaaccagggggtccaccttctccacggtat

SEQ ID NO: 235144 - DNA, 75 bp, Artificial Sequence
  Synthetic
tctcgctggctgggtaccaactccccccgagatttggaagaaaggcgcaagcttatgatggctgtagtgctagta

SEQ ID NO: 235145 - DNA, 75 bp, Artificial Sequence
  Synthetic
ccgccgggggggtataaaagggggcgggtctctgctcgtcctcactgtcttccggatcgctgtccaggagcgcca

SEQ ID NO: 235146 - DNA, 75 bp, Artificial Sequence
  Synthetic
tggatgcccgcgcccattgcaaccaccgccagtaccgctcgaagaccccggcgaaagtatggtcctgcgagtctg

SEQ ID NO: 235147 - DNA, 75 bp, Artificial Sequence
  Synthetic
cgtccccattactggctaccgaggaagaaactcgcgccgtagaaggatgttgggtagcgggatgcgtcgccacag

SEQ ID NO: 235148 - DNA, 75 bp, Artificial Sequence
  Synthetic
agtatggtgaacaccaatcatggtacctagaaatttcttcttcaccatactcatctgtgcttttaatgtttgcgc

SEQ ID NO: 235149 - DNA, 75 bp, Artificial Sequence
  Synthetic
tcgtagttgagcgcctcggccgcgtggcctttggcacggagcttacctttggaagttttatggcaggcggggcag

SEQ ID NO: 235150 - DNA, 75 bp, Artificial Sequence
  Synthetic
gagaagaaactgactaaggtgagtattgggaaaactttggggtgggattttcagatggacagattgagtaaaaat

SEQ ID NO: 235151 - DNA, 75 bp, Artificial Sequence
  Synthetic
cagcttggccaccagttcggcagtgacaaggacatccaaggcgcagtagtcaagggtctcttggatgatgtcata

SEQ ID NO: 235152 - DNA, 75 bp, Artificial Sequence
  Synthetic
ctgctgctgcagcgcccgctccaaagcctgtcgctaccccgaagcccaccaccgtacagcccgtcgccgtagcca

SEQ ID NO: 235153 - DNA, 75 bp, Artificial Sequence
  Synthetic
caaatgccactaacactctcaatgtgcagactactttaaaacatgacatggaaaaccacactacctcctatgcat

SEQ ID NO: 235154 - DNA, 75 bp, Artificial Sequence
  Synthetic
gccacgtgaccaggggtccccgccgggggggtataaaagggggcgggcctctgttcgtcctcactgtcttccgga

SEQ ID NO: 235155 - DNA, 75 bp, Artificial Sequence
  Synthetic
acgagcttgttgttgatttaaaatcaagtgttttttatttcatttttcgcgcacggtatgccctagaccaccgat

SEQ ID NO: 235156 - DNA, 75 bp, Artificial Sequence
  Synthetic
tggaccatctgctcatcaaacgagcaagtccactttcagaaaaccagaacatgcaggatccagacgcctcggacg

SEQ ID NO: 235157 - DNA, 75 bp, Artificial Sequence
  Synthetic
gacgcaagcttatgatggctgtagtgctagtaactgttgagttggagtgtctgcgccgcttttttaccgaccccg

SEQ ID NO: 235158 - DNA, 75 bp, Artificial Sequence
  Synthetic
caacagagtgctggatatggccagcaccttctttgacatccggggggtgcttgacagaggtcccagtttcaagcc

SEQ ID NO: 235159 - DNA, 75 bp, Artificial Sequence
  Synthetic
gcacctgcccctacgtctacaaggccctgggcatagtcgcgccgcgcgtcctttcaagccgcactttctaaaaaa

SEQ ID NO: 235160 - DNA, 75 bp, Artificial Sequence
  Synthetic
ttcgtgcggcaggcatgcaagatctccaacgtggagctcaccaacctggtttcatacatgggcattttgcatgag

SEQ ID NO: 235161 - DNA, 75 bp, Artificial Sequence
  Synthetic
acaccaccctgaagggggaggcccgccgcgactacatccgagactgtgtctacctctacctctgccatacctggc

SEQ ID NO: 235162 - DNA, 75 bp, Artificial Sequence
  Synthetic
gcgcgctcataggggttaagaggggtgccccagggcatggggtgggtgagcgcggaggcatacatgccacagata

SEQ ID NO: 235163 - DNA, 75 bp, Artificial Sequence
  Synthetic
attaaagttaaaaccgatgacactaatggatgggaaaaagatgctaatgttgctacagctaatgaaatagccata

SEQ ID NO: 235164 - DNA, 75 bp, Artificial Sequence
  Synthetic
gctggaatgccactgccgatgcaatttatgcacaccccaccgctccctcgcctgcaacccccagttgctaagcga

SEQ ID NO: 235165 - DNA, 75 bp, Artificial Sequence
  Synthetic
tatgttataggagtatctaacaattttaatatgctaactacatacagaaatataaattttactgcggagctgttt

SEQ ID NO: 235166 - DNA, 75 bp, Artificial Sequence
  Synthetic
cttgggcgcaaggaaaatggattctggggagtatgcatccgcgccgcaggaggcgcaaacagtttcacattccac

SEQ ID NO: 235167 - DNA, 75 bp, Artificial Sequence
  Synthetic
gggtcaaaaacaagttttccgccatattttttgatgcgtttcttacctttggtctccatgagttcgtgtcctcgt

SEQ ID NO: 235168 - DNA, 75 bp, Artificial Sequence
  Synthetic
cagcttgggcgcgaggaaaatggattcgggggagtatgcatccgcaccgcaggaggcgcagacggtttcgcactc

SEQ ID NO: 235169 - DNA, 75 bp, Artificial Sequence
  Synthetic
accctcagggtccggcccacggagtgcggattaccatcgaagggggaatagactctcgcctgcatcgcatcttct

SEQ ID NO: 235170 - DNA, 75 bp, Artificial Sequence
  Synthetic
ccagacccttcctcctctgatccaggactctaactctaccttaccagcaccatccactactaaccttcccgaaac

SEQ ID NO: 235171 - DNA, 75 bp, Artificial Sequence
  Synthetic
caaggatgtaaatatggtcttgcaaagttctcttggcaacgacctcagaacagatggtgctaccatcagttttac

SEQ ID NO: 235172 - DNA, 75 bp, Artificial Sequence
  Synthetic
tgacaccaatgaccagtcattcaatgactacctctctgcagctaacatgctctacccaattccagcaaatgccac

SEQ ID NO: 235173 - DNA, 75 bp, Artificial Sequence
  Synthetic
gctctattccctacctggatggtaccttctacctcaaccacactttcaagaaggtgtccatcatgtttgactcct

SEQ ID NO: 235174 - DNA, 75 bp, Artificial Sequence
  Synthetic
gtcacccttggcacctgtcctttgccctcgtcatgagtaaagagattcccacgccttacatgtggagctatcagc

SEQ ID NO: 235175 - DNA, 75 bp, Artificial Sequence
  Synthetic
ccattccaacacaacaactctggatttgtgggttacctcgctccaaccattcgtcagggtcaagcttatccagct

SEQ ID NO: 235176 - DNA, 75 bp, Artificial Sequence
  Synthetic
agccggggctccgggggcgaggtcttccagcatgaggcggtggtatccgtagatgtacctggacatccaggtgat

SEQ ID NO: 235177 - DNA, 75 bp, Artificial Sequence
  Synthetic
cgctgtatcaccctggaaaagtccacccagaccgtgcagggcccgcgctccgcagcctgtggacttttttgctgc

SEQ ID NO: 235178 - DNA, 75 bp, Artificial Sequence
  Synthetic
actttacaacaccaaccagatcttccagaagacccagacccttcctcctctgatccaggactctaactctacctt

SEQ ID NO: 235179 - DNA, 75 bp, Artificial Sequence
  Synthetic
accggctctgggcataaaattgcgagtgatgcgaaaaggctgtggtacttccgctcgattgttgatcacctgggc

SEQ ID NO: 235180 - DNA, 75 bp, Artificial Sequence
  Synthetic
cttgcttatagttattcgccctagacaaagcaatgaggaaaaagagaaaatgccttaacctttttcctcatacct

SEQ ID NO: 235181 - DNA, 75 bp, Artificial Sequence
  Synthetic
gcgcagtgagcgccagcagaaggcgtgagctgagcgacagagaacttatgcacagcttgcaaagagctctgacgg

SEQ ID NO: 235182 - DNA, 75 bp, Artificial Sequence
  Synthetic
cccgaaactgcgtcaccaaaaaaaagtacagtttcacttccgcaatcccaacaagcggcacttcctctttctcac

SEQ ID NO: 235183 - DNA, 75 bp, Artificial Sequence
  Synthetic
cagggttccgtgtcctttgggtgccactaccgtacctttgttttttcttttgatcggtggtggctctcttgcttc

SEQ ID NO: 235184 - DNA, 75 bp, Artificial Sequence
  Synthetic
gtacagtttcacttccgcaatcccaacaagcggcacttcctctttctcacgggacgtcacatccgcttaacttgc

SEQ ID NO: 235185 - DNA, 75 bp, Artificial Sequence
  Synthetic
acagcccacactttttaaaatcacctcatttacatattggcaccattccatctataaggtatattattgatgatg

SEQ ID NO: 235186 - DNA, 75 bp, Artificial Sequence
  Synthetic
ttttttgtaggtcctgtgtctgatgatgagtcgccttctcctgattcaactacctcacctcctgaaattcaggcg

SEQ ID NO: 235187 - DNA, 75 bp, Artificial Sequence
  Synthetic
aagttgaaaaactgggagttacgcgcggacacggtcaactcctcttccagaagacggatgagttcggcgatggtg

SEQ ID NO: 235188 - DNA, 75 bp, Artificial Sequence
  Synthetic
cgcggcgacgtcgacggcgcacgggcaaacggtcgatgaatcgttcaatgacctctccgcggcggcggcgcatgg

SEQ ID NO: 235189 - DNA, 75 bp, Artificial Sequence
  Synthetic
aaatcaccatactaattgtaattggaattcttgtactatctgttattctttattttatattctgccgtcaaatac

SEQ ID NO: 235190 - DNA, 75 bp, Artificial Sequence
  Synthetic
gatacgcaggcgattggccattccccaagcattatcctgacatctagccagatctttgtagtagtcttgcatgag

SEQ ID NO: 235191 - DNA, 75 bp, Artificial Sequence
  Synthetic
atctggccagatctttatagtagtcttgcatgagtcgttccacgggcacttcttcttcgcccgctctgccatgca

SEQ ID NO: 235192 - DNA, 75 bp, Artificial Sequence
  Synthetic
ctccttgcttagacccgagagggaaaagaacttccccaacaatgggatagagagcctggtggataagatgagtag

SEQ ID NO: 235193 - DNA, 75 bp, Artificial Sequence
  Synthetic
agagcctggtggataagatgagtagatggaagacctatgcacaggatcacaaagacgagcctaggatcttggggg

SEQ ID NO: 235194 - DNA, 75 bp, Artificial Sequence
  Synthetic
atcgtgaacgcgctggtggagaacaaggccatccgtcccgatgaggccgggctggtatacaatgctctcttggag

SEQ ID NO: 235195 - DNA, 75 bp, Artificial Sequence
  Synthetic
agagatgtcatccaaattcaccaatgcaaaaaaggcatattttgtttggtaaaacaagccaagatatcctacgag

SEQ ID NO: 235196 - DNA, 75 bp, Artificial Sequence
  Synthetic
ggagccagtgctgcgtcaagctttagaacgctcagttctcggggctgggagtggctcgcgcccgtagtctggaga

SEQ ID NO: 235197 - DNA, 75 bp, Artificial Sequence
  Synthetic
gtggctcgcgcccgtagtctggagaatcaatcgccagggttgcgttgcggtgtgccccggttcgagtcttagcgc

SEQ ID NO: 235198 - DNA, 75 bp, Artificial Sequence
  Synthetic
agttgctggaaatataatcaggcagagtttcttgtaaaaattgaataaaagaaaaattttccaaaaaaacattca

SEQ ID NO: 235199 - DNA, 75 bp, Artificial Sequence
  Synthetic
gagggggacttacagtggatgacactgatgggaccttacaagaaaacatacgtgctacagcacccattactaaaa

SEQ ID NO: 235200 - DNA, 75 bp, Artificial Sequence
  Synthetic
cgtgctacagcacccattactaaaaataatcattctgtagaactatccattggaaatggattagaaacacaaaac

SEQ ID NO: 235201 - DNA, 75 bp, Artificial Sequence
  Synthetic
ataatcattctgtagaactatccattggaaatggattagaaacacaaaacaataaactatgtgccaaattgggaa

SEQ ID NO: 235202 - DNA, 75 bp, Artificial Sequence
  Synthetic
ctgggatgggaccccgaaactaagttaatcatgcctggggtctacacctatgaggccttccatcctgacattgtg

SEQ ID NO: 235203 - DNA, 75 bp, Artificial Sequence
  Synthetic
ccaccatgggcaggagttcgtcagaatgtcatgggatccactgtggatgggagacccgtccagcccgccaattcc

SEQ ID NO: 235204 - DNA, 75 bp, Artificial Sequence
  Synthetic
catttgtataaaggatagtattaacaccttatggactggaataaagcctccacctaactgtcaaattgtggaaaa

SEQ ID NO: 235205 - DNA, 75 bp, Artificial Sequence
  Synthetic
taatcatgcctggggtctacacctatgaggccttccatcctgacattgtgctactgcctggttgtggggtggact

SEQ ID NO: 235206 - DNA, 75 bp, Artificial Sequence
  Synthetic
agccgccgccgctactgctgccgccaacaccatccttggaatgggctattacggaagcatcgttgccaattccag

SEQ ID NO: 235207 - DNA, 75 bp, Artificial Sequence
  Synthetic
actttagtattagtaaaaaacggagggcttgttaatggctacgtatctctagttggtgtatcagacactgtgaac

SEQ ID NO: 235208 - DNA, 75 bp, Artificial Sequence
  Synthetic
ggcttgttaatggctacgtatctctagttggtgtatcagacactgtgaaccaaatgttcacacaaaagtcagcaa

SEQ ID NO: 235209 - DNA, 75 bp, Artificial Sequence
  Synthetic
gcttggcatcaggaagagacacccattccaggaaggctttcagatcatgtatgatgatctcgaagggggtaacat

SEQ ID NO: 235210 - DNA, 75 bp, Artificial Sequence
  Synthetic
atgatgatctcgaagggggtaacattcctgcccttctggatgtagaaacctatgaaaaaagcaaaaaggaaaatg

SEQ ID NO: 235211 - DNA, 75 bp, Artificial Sequence
  Synthetic
ctcttctggaaatctattaactgatgaatcaaacttaaaaattccacttaaaaataaatcttctacagcgaccag

SEQ ID NO: 235212 - DNA, 75 bp, Artificial Sequence
  Synthetic
agtaacaactgatgcaaaaatggttgctgaaacttcagctgaagcggcagttgcagtagtagtagatactattaa

SEQ ID NO: 235213 - DNA, 75 bp, Artificial Sequence
  Synthetic
ggaacaaaatgacagtgtgcccagaggtgataattaccaatctgctaaagacatgaaagcatctgatgaaacagc

SEQ ID NO: 235214 - DNA, 75 bp, Artificial Sequence
  Synthetic
tgaaaactatattcatggaatatgttactatatgactagttatgatagaagtctagttcccttaaacatttccat

SEQ ID NO: 235215 - DNA, 75 bp, Artificial Sequence
  Synthetic
tcttccaccacggggtgaacttcccccgcaatgtcttgcattactaccgtcacctccacagcccctactacagcc

SEQ ID NO: 235216 - DNA, 75 bp, Artificial Sequence
  Synthetic
tccaatgttgcctatgccatacaatttgaatggaatctaaatgcaaaagaatctccagaaagcaacatagctacg

SEQ ID NO: 235217 - DNA, 75 bp, Artificial Sequence
  Synthetic
ggctgagggacctctgctcggttattgataacctgagcggccaagactatctcatcaaagccgttgatgttgtgc

SEQ ID NO: 235218 - DNA, 75 bp, Artificial Sequence
  Synthetic
cagcagcaagaacctccagcagaaaaccagcagcagttagaacacccacagcaggtgcaacaggaggaggactga

SEQ ID NO: 235219 - DNA, 75 bp, Artificial Sequence
  Synthetic
agagcaaattcctaagcagctgagacttgccgcacccagtgggaccgtaaatgaccccaattacgggttgcagat

SEQ ID NO: 235220 - DNA, 75 bp, Artificial Sequence
  Synthetic
aggttagtaggcagtgtcaggagattgacttgcatgatcttttccagggcgtgagggaggttcagatggtacttg

SEQ ID NO: 235221 - DNA, 75 bp, Artificial Sequence
  Synthetic
cacccgcccccctcgcacttagaagatactgagcagtctccgatgttgtgtcccagcggcgaggatgtccaagcg

SEQ ID NO: 235222 - DNA, 75 bp, Artificial Sequence
  Synthetic
tggaggagtttactccctctgtctacttcaaccccttctccggctctcctgggcattatccggacgagttcatac

SEQ ID NO: 235223 - DNA, 75 bp, Artificial Sequence
  Synthetic
ggaggaggagaggatccttagatatgtgcagcagagcgtgggattgtttctgatgcaagagggggcaactccgac

SEQ ID NO: 235224 - DNA, 75 bp, Artificial Sequence
  Synthetic
actactgaaacaaccacactggctgttgcagaggaaactagtgaagatgataatataactagaggagatacttat

SEQ ID NO: 235225 - DNA, 75 bp, Artificial Sequence
  Synthetic
cgcttaacttgcctgtctgtgtgtgtatgtgtcatcatcacgccgccgccgcagcaacagcagaggagaaaagga

SEQ ID NO: 235226 - DNA, 75 bp, Artificial Sequence
  Synthetic
tctggtatcaatggggtggtggatctggccaaccaggccgtgcagaaacagataaacagccgcctggacccgccg

SEQ ID NO: 235227 - DNA, 75 bp, Artificial Sequence
  Synthetic
gcggcgatgttaagctggacgtactcgcgcgccacacatttccattcagggaagatggttgtcagttcatccgga

SEQ ID NO: 235228 - DNA, 75 bp, Artificial Sequence
  Synthetic
tgccattgccacgtcaagctttagaacgctcagttctcgggccgtgagtggctcgcgcccgtagtctggagaatc

SEQ ID NO: 235229 - DNA, 75 bp, Artificial Sequence
  Synthetic
ctcgctggctcctaagggagcccccaatacatgtcagtggattgccaagggggcgcctgttaccgatcaagccaa

SEQ ID NO: 235230 - DNA, 75 bp, Artificial Sequence
  Synthetic
caggaattaacagatgttacttacgcttttggcaatgctccagtgcaagcagaagccaaaattacaaaagatggt

SEQ ID NO: 235231 - DNA, 75 bp, Artificial Sequence
  Synthetic
aagatgaacaaaagccaatatatgctgacaaattgtatcagccagaaccccaaattggcgatgaacagtggcatg

SEQ ID NO: 235232 - DNA, 75 bp, Artificial Sequence
  Synthetic
tgacaaattgtatcagccagaaccccaaattggcgatgaacagtggcatgacaccactggtactaatgaacaata

SEQ ID NO: 235233 - DNA, 75 bp, Artificial Sequence
  Synthetic
tggaatggtgccaatatgtaaatgaggtaatttaaaaaagtgcgcgctgtgtggtgattggctgtggggttaacg

SEQ ID NO: 235234 - DNA, 75 bp, Artificial Sequence
  Synthetic
acaaacatgaaaccatgctatggctcatttgccagacccacaaataaaaaaggcggtcaggctaaaactagaaaa

SEQ ID NO: 235235 - DNA, 75 bp, Artificial Sequence
  Synthetic
catttgccagacccacaaataaaaaaggcggtcaggctaaaactagaaaaatagaaaaagaagaaaatggagtta

SEQ ID NO: 235236 - DNA, 75 bp, Artificial Sequence
  Synthetic
tgatatggacttttatgacttaagatcacaaagagcaaattatgatcctaaaattgttctttattctgaaaatgt

SEQ ID NO: 235237 - DNA, 75 bp, Artificial Sequence
  Synthetic
aactacattggtttcagggacaactttgttggacttatgttttacaacagtactggcaacatgggcgtgctggcc

SEQ ID NO: 235238 - DNA, 75 bp, Artificial Sequence
  Synthetic
tggtcgacttgcaggacaggaacacagaactgtcctaccagctgctgcttgactctctgggtgacagaaccagat

SEQ ID NO: 235239 - DNA, 75 bp, Artificial Sequence
  Synthetic
ttaagtcatggtatagagaaccacactacctcttatgagctcacaaacattactacccatcatcctaaatatgct

SEQ ID NO: 235240 - DNA, 75 bp, Artificial Sequence
  Synthetic
agaactgtcctaccagctgctgcttgactctctgggtgacagaaccagatactttagcatgtggaatcaggccgt

SEQ ID NO: 235241 - DNA, 75 bp, Artificial Sequence
  Synthetic
attattgaaaaccacggtgtggaagacgaacttcctaactattgttttccattagatggagtggggccaattacg

SEQ ID NO: 235242 - DNA, 75 bp, Artificial Sequence
  Synthetic
acgaacttcctaactattgttttccattagatggagtggggccaattacgggcacttatcagggggttgagcctg

SEQ ID NO: 235243 - DNA, 75 bp, Artificial Sequence
  Synthetic
gaaaaacacaaaagtaaatggagcaaatgaaattggcaagggaaataactatgctatggaaattaatctacaagc

SEQ ID NO: 235244 - DNA, 75 bp, Artificial Sequence
  Synthetic
taacctatggagaagttttctatactccaacgtggctctctatctgccagacggttacaaatataccccagccaa

SEQ ID NO: 235245 - DNA, 75 bp, Artificial Sequence
  Synthetic
acctatatcccaccatgcagctaatggtgcccaagcgccagaggctagaagacgtactggagaaaatgaaagtgg

SEQ ID NO: 235246 - DNA, 75 bp, Artificial Sequence
  Synthetic
acctatggctatataaacggtcgagtagtatccccatctttggtggattcatacatcaacattggagccagatgg

SEQ ID NO: 235247 - DNA, 75 bp, Artificial Sequence
  Synthetic
tagtatccccatctttggtggattcatacatcaacattggagccagatggtctttggatcttatggacaatgtaa

SEQ ID NO: 235248 - DNA, 75 bp, Artificial Sequence
  Synthetic
tgggctgcgctaccgatccatgcttctaggcaatggccgctatgtgcccttccacatccaagtgccacagaaatt

SEQ ID NO: 235249 - DNA, 75 bp, Artificial Sequence
  Synthetic
ccagcaaattgactcccgccgccctggtgcggagagtgtaccgcgatggtcgcgctgaacctctgacgctgccgc

SEQ ID NO: 235250 - DNA, 75 bp, Artificial Sequence
  Synthetic
gcgcgcgctaccatccaagcatcaccacttaatgactgttgacgctgcctccttgcagatatggccctcacttgc

SEQ ID NO: 235251 - DNA, 75 bp, Artificial Sequence
  Synthetic
ccaatgccactaacattcccatctccattccatctcgcaactgggctgccttcagaggctggtcttttaccagac

SEQ ID NO: 235252 - DNA, 75 bp, Artificial Sequence
  Synthetic
aggtcgttggagatgcgcccaatgagttgagagaatgcattcatgcccgcctcgttccagacgcggctgtagacc

SEQ ID NO: 235253 - DNA, 75 bp, Artificial Sequence
  Synthetic
cagggcaggctctgagaaataagcttaaggaacaaaacttccaacagaaggtggtcgatgggatcgcctctggta

SEQ ID NO: 235254 - DNA, 75 bp, Artificial Sequence
  Synthetic
atacccagctaactacccctacccgctcattggaaccactgctgtcaccagcgtcacccagaaaaagttcttgtg

SEQ ID NO: 235255 - DNA, 75 bp, Artificial Sequence
  Synthetic
gttgttttcaagcagcacctcacttccctcttcccaactctggtactctaagcctcggcgggtggcatacttcct

SEQ ID NO: 235256 - DNA, 75 bp, Artificial Sequence
  Synthetic
tcttcatttctttatccccagatggccaaacgagttcgactaagcagctccttcaatccggtctacccctatgaa

SEQ ID NO: 235257 - DNA, 75 bp, Artificial Sequence
  Synthetic
tctcggtgacggcacgaccgttctccctgggtctcaaagtgaagacgcctccgcgcatctccctgaagtggtgac

SEQ ID NO: 235258 - DNA, 75 bp, Artificial Sequence
  Synthetic
ttataaaccctggtttcatttcctcaaatggttttacacaaagtccagacggagttcttacgctcaaatgtgttg

SEQ ID NO: 235259 - DNA, 75 bp, Artificial Sequence
  Synthetic
tctagacatcaaggtgggaggagggcttaaagtagacagcactgatggttccttagaagaagacatgggcattgc

SEQ ID NO: 235260 - DNA, 75 bp, Artificial Sequence
  Synthetic
cttaaagtagacagcactgatggttccttagaagaagacatgggcattgcagctccccttaccaaagttaaccac

SEQ ID NO: 235261 - DNA, 75 bp, Artificial Sequence
  Synthetic
ggctagagacaaaagaaaacaaactttatgtaaaactgggagaaggacttaaatttaactctggtagtataaaca

SEQ ID NO: 235262 - DNA, 75 bp, Artificial Sequence
  Synthetic
ttatgtaaaactgggagaaggacttaaatttaactctggtagtataaacattgaccatgatattaacaccttatg

SEQ ID NO: 235263 - DNA, 75 bp, Artificial Sequence
  Synthetic
tgtataattacggaagatggagaagctaatgacagcaagctcaccctaatacttgttaagacaggcggactagtt

SEQ ID NO: 235264 - DNA, 75 bp, Artificial Sequence
  Synthetic
ctaatgacagcaagctcaccctaatacttgttaagacaggcggactagttaatgcttatgtctcattaatgggtg

SEQ ID NO: 235265 - DNA, 75 bp, Artificial Sequence
  Synthetic
gaaaagtccacccagaccgtgcagggcccgcgctccgcagcctgtggacttttttgctgcatgttcctccacgct

SEQ ID NO: 235266 - DNA, 75 bp, Artificial Sequence
  Synthetic
cacagataaaagtgctcaaattactgttgatatatactttgataatgaaggaaaagttcttactgaactatcagc

SEQ ID NO: 235267 - DNA, 75 bp, Artificial Sequence
  Synthetic
gttgatatatactttgataatgaaggaaaagttcttactgaactatcagcacttaaaacaggtcttaaacataaa

SEQ ID NO: 235268 - DNA, 75 bp, Artificial Sequence
  Synthetic
aagcacaaaactgcaaaggctttatgcccagcttaactgcatacccatttagaaatccaactaaacctaccaaag

SEQ ID NO: 235269 - DNA, 75 bp, Artificial Sequence
  Synthetic
atcccaacaagcgtaacttcctctttctcacgatacgtcacatccgattaacttacaacgtcattttcccacggt

SEQ ID NO: 235270 - DNA, 75 bp, Artificial Sequence
  Synthetic
gcccagcttaactgcatacccatttagaaatccaactaaacctaccaaaggaagagaagactacatctatggaat

SEQ ID NO: 235271 - DNA, 75 bp, Artificial Sequence
  Synthetic
ttccggcacagcttacaattcactcgctcctaagggcgcgcccaatacatctcagtggatagttacaacaaatgg

SEQ ID NO: 235272 - DNA, 75 bp, Artificial Sequence
  Synthetic
acactctatgagctaaaaaccactgttactctaaactacagtgttattagttctctatgtgcatatgcaatgcac

SEQ ID NO: 235273 - DNA, 75 bp, Artificial Sequence
  Synthetic
cagagccagagacaacccccactactcttattacctcccccttctccttttcctacattagagaagatgactgac

SEQ ID NO: 235274 - DNA, 75 bp, Artificial Sequence
  Synthetic
tacgggtcttttgcaagacctacaaacataaaagggggccaagctaaaaacagaaaagtaaaaccaacaaccgaa

SEQ ID NO: 235275 - DNA, 75 bp, Artificial Sequence
  Synthetic
acggggaaaatgacgaaaaagctacatacacttttggcaatgccccagtaaaagccgatgctgacattacaaaag

SEQ ID NO: 235276 - DNA, 75 bp, Artificial Sequence
  Synthetic
atacacttttggcaatgccccagtaaaagccgatgctgacattacaaaagacggactaccaataggtttggaagt

SEQ ID NO: 235277 - DNA, 75 bp, Artificial Sequence
  Synthetic
atctacgctaataagctttaccaaccagaaccccaggtgggacaggaatcgtggactgatacagatggcactgaa

SEQ ID NO: 235278 - DNA, 75 bp, Artificial Sequence
  Synthetic
cagaaccccaggtgggacaggaatcgtggactgatacagatggcactgaagaaaaatacggaggcagagtactta

SEQ ID NO: 235279 - DNA, 75 bp, Artificial Sequence
  Synthetic
caagcgcagtatcgaggtgacccattttgcataccccgctgtcaacctgcctcccaaagtcatgagcgctgtcat

SEQ ID NO: 235280 - DNA, 75 bp, Artificial Sequence
  Synthetic
ctatgggtcttttgctaaacctactaatgtgaaaggcggacaggcaaaagtgaaaacagaagaaggcaacaacat

SEQ ID NO: 235281 - DNA, 75 bp, Artificial Sequence
  Synthetic
ctggatcgaagacgggtgctgcaagacgaggattttgaggtcgatgaagtgacagggatcagcccagctagggca

SEQ ID NO: 235282 - DNA, 75 bp, Artificial Sequence
  Synthetic
tgaaaacagaagaaggcaacaacattgaatatgacattgacatgaacttttttgacttaagatcacaaaaacaag

SEQ ID NO: 235283 - DNA, 75 bp, Artificial Sequence
  Synthetic
gccacatccatctcgataatgtgatccttctggatcatgatagtgccatgcaggcatttcaccttgccttcataa

SEQ ID NO: 235284 - DNA, 75 bp, Artificial Sequence
  Synthetic
ttttttgttgcccagatgcatcccgtgctgcgacagatgcgcccccagcaacagcccccttctcagcagcagcta

SEQ ID NO: 235285 - DNA, 75 bp, Artificial Sequence
  Synthetic
cgcacccggtgcactcccaattgttgtgggcgatctcagaataagaatgcaccaatccctgcaggaatcttccca

SEQ ID NO: 235286 - DNA, 75 bp, Artificial Sequence
  Synthetic
tctccattagcacggccattacttccatgcccttctcccaggcagagaccaggggtagactcatgggattcctaa

SEQ ID NO: 235287 - DNA, 75 bp, Artificial Sequence
  Synthetic
atggtgtggaagatgaacttcccaactactgttttccactggacggcatcggtccgcgaacagatagttacaagg

SEQ ID NO: 235288 - DNA, 75 bp, Artificial Sequence
  Synthetic
ggtccgcgaacagatagttacaaggagattcagttaaatggagaccaagcttggaaagatgtaaatccaaatggt

SEQ ID NO: 235289 - DNA, 75 bp, Artificial Sequence
  Synthetic
tgtaatggagcttcttcctgacattctcgtattttgcaaagcagaacctagtcttggcacagcacacgtcccgtc

SEQ ID NO: 235290 - DNA, 75 bp, Artificial Sequence
  Synthetic
cgcggctggccattgtgttctcctaggcagagaaacaacagacatggagactcagccatcgctgccaacatcgct

SEQ ID NO: 235291 - DNA, 75 bp, Artificial Sequence
  Synthetic
accccgggactgtggacctccgcctacctgcgcaagttctcccccgaggactaccacccctatgagatcaggttc

SEQ ID NO: 235292 - DNA, 75 bp, Artificial Sequence
  Synthetic
cgcaccgaagtgcccatcagtgtggaagagctcagccgcgcctacgagctcaacctgttctcgcctcgggtgccc

SEQ ID NO: 235293 - DNA, 75 bp, Artificial Sequence
  Synthetic
tgggcgtccagcgctgccagggtccgatccttccatggtcgcagcgtccgagtcagggttgtttccgtcacggtg

SEQ ID NO: 235294 - DNA, 75 bp, Artificial Sequence
  Synthetic
gcgcagtatcgaggtcacccattttgcctaccccgctgtcaacctgccccccaaagtcatgagcgctgtcatgga

SEQ ID NO: 235295 - DNA, 75 bp, Artificial Sequence
  Synthetic
ccccttcccgaagaccagaacatgcaggatccagacgcctcggacgagggcaagccggtggttagtgacgagcag

SEQ ID NO: 235296 - DNA, 75 bp, Artificial Sequence
  Synthetic
ttctatgaggaccaatcacagccgcccaaaaccgagctctcagcctgcgtcatcactcagggggcaattctcgcc

SEQ ID NO: 235297 - DNA, 75 bp, Artificial Sequence
  Synthetic
caattgcaagccatccaaaaatcccgccaagaatttttgctgaaaaaggggaacggggtctacctcgacccccag

SEQ ID NO: 235298 - DNA, 75 bp, Artificial Sequence
  Synthetic
gggacatgcttggtcttcctgggcttcttcttgggagggatcgggggaggactgttgctccgctccggagacagg

SEQ ID NO: 235299 - DNA, 75 bp, Artificial Sequence
  Synthetic
acaggccccctgttcccagagttggaagtccacccgcttcttgtaggcggggttgggcaaagcgaaagtaacatc

SEQ ID NO: 235300 - DNA, 75 bp, Artificial Sequence
  Synthetic
tttaataaaaactgagttaagactcaccttcggactaccgcttcttcaacccggactttacaacaccagccagac

SEQ ID NO: 235301 - DNA, 75 bp, Artificial Sequence
  Synthetic
tcgccaagaatttctgctaaaaaagggaaacggggtctaccttgaccctcagaccggtgaggagctcaacacaag

SEQ ID NO: 235302 - DNA, 75 bp, Artificial Sequence
  Synthetic
tcccttgctgaattttgatatttaatttttttatagcatcatgaaaaaactaagtatcctagcttttattttgtt

SEQ ID NO: 235303 - DNA, 75 bp, Artificial Sequence
  Synthetic
tctccagaagcctcctttctgccaatactactactcccaaaaccggaggtgagctccgtggtctccctactgaca

SEQ ID NO: 235304 - DNA, 75 bp, Artificial Sequence
  Synthetic
actttaagtcatgatatagagaaccacactacctcttatgtgcccacaaacattactacccatcccaaacatgct

SEQ ID NO: 235305 - DNA, 75 bp, Artificial Sequence
  Synthetic
acactacctcttatgtgcccacaaacattactacccatcccaaacatgctatgcaactagaaatcaccatgctaa

SEQ ID NO: 235306 - DNA, 75 bp, Artificial Sequence
  Synthetic
ctggcccgaccgccccatggacggaaaccccaccatgaagttgctgactggggtgtccaacagcatgctccaatc

SEQ ID NO: 235307 - DNA, 75 bp, Artificial Sequence
  Synthetic
tagacctaggaataacaatatcaaagaaaaaatgccctaatctttttcaaaactttgttttcagccatgattact

SEQ ID NO: 235308 - DNA, 75 bp, Artificial Sequence
  Synthetic
gaaaaaatgccctaatctttttcaaaactttgttttcagccatgattactgtcacaactatttttgctattgcta

SEQ ID NO: 235309 - DNA, 75 bp, Artificial Sequence
  Synthetic
acctattagacacaccatttacacaggtcaaaactatacattgtgggtcccaaaaaactattcaaatgttctatg

SEQ ID NO: 235310 - DNA, 75 bp, Artificial Sequence
  Synthetic
ggtcaaaactatacattgtgggtcccaaaaaactattcaaatgttctatggatatactacacaggatcatggcaa

SEQ ID NO: 235311 - DNA, 75 bp, Artificial Sequence
  Synthetic
cactgctacctattccgtctggccaactacctctcctaccactcggatgtgatcgaggatgtgagcggagacggc

SEQ ID NO: 235312 - DNA, 75 bp, Artificial Sequence
  Synthetic
ccaaagtttcatacccagagcttaaacacaattgtactgacacaaacctgacacttattaatgttaatgcaagct

SEQ ID NO: 235313 - DNA, 75 bp, Artificial Sequence
  Synthetic
acacaattgtactgacacaaacctgacacttattaatgttaatgcaagctatactgcagactactatgcttacaa

SEQ ID NO: 235314 - DNA, 75 bp, Artificial Sequence
  Synthetic
atacgccagcagcaggaacgtgccgccaaggagctcagggatgctattgaaattcaccagtgcaaaaaaggcata

SEQ ID NO: 235315 - DNA, 75 bp, Artificial Sequence
  Synthetic
tacaaaattaaagtgcaaaacttaaccacaccgcagccaccaaaaccaaccacaactattgtaatcacaactacc

SEQ ID NO: 235316 - DNA, 75 bp, Artificial Sequence
  Synthetic
ccacaccgcagccaccaaaaccaaccacaactattgtaatcacaactaccaaatccaaaaaacctgctaaaacaa

SEQ ID NO: 235317 - DNA, 75 bp, Artificial Sequence
  Synthetic
attgtttttgagtaggcaaatctctgatcattttgaaaattcaacactagcagatgaaacgcaaattcctgtttc

SEQ ID NO: 235318 - DNA, 75 bp, Artificial Sequence
  Synthetic
gatcattttgaaaattcaacactagcagatgaaacgcaaattcctgtttctatgattgggataatcacagcagtg

SEQ ID NO: 235319 - DNA, 75 bp, Artificial Sequence
  Synthetic
tttgtatgatcacctatgcttgctgctacaggaagtttcatcatgaaaaagttgatccactactaaattttgatt

SEQ ID NO: 235320 - DNA, 75 bp, Artificial Sequence
  Synthetic
ctacaggaagtttcatcatgaaaaagttgatccactactaaattttgatttttaattttttttctttagctcaat

SEQ ID NO: 235321 - DNA, 75 bp, Artificial Sequence
  Synthetic
gaaggacttacattcaattccaacaacatttgcattgatgacaatattaacaccctatggacaggagttaacccc

SEQ ID NO: 235322 - DNA, 75 bp, Artificial Sequence
  Synthetic
gccgcagcgatcggggcgataccaggcatagcttccgtggcggttcaggcctcgcagcgccactgacattggaaa

SEQ ID NO: 235323 - DNA, 75 bp, Artificial Sequence
  Synthetic
ctttcaactatcaaatttactgtagaactttcttttataaaaaatgttactgtatcagaaggacaaaatataaca

SEQ ID NO: 235324 - DNA, 75 bp, Artificial Sequence
  Synthetic
aactttcttttataaaaaatgttactgtatcagaaggacaaaatataacattagtcgggattaacaccactgaca

SEQ ID NO: 235325 - DNA, 75 bp, Artificial Sequence
  Synthetic
ttgggaaactcaagtaggtactagaagacaaaatgtatgtaatttaaaccttacaaaatacatctgtgaaggtgt

SEQ ID NO: 235326 - DNA, 75 bp, Artificial Sequence
  Synthetic
agacaaaatgtatgtaatttaaaccttacaaaatacatctgtgaaggtgttaatcttaccattattaactgcact

SEQ ID NO: 235327 - DNA, 75 bp, Artificial Sequence
  Synthetic
gaagatgaaagcagctcacaacacccctttataaaccctggtttcatttcctcaaatggttttacacaaagccca

SEQ ID NO: 235328 - DNA, 75 bp, Artificial Sequence
  Synthetic
gagaatcttacactacacaaaaaaagggttacacacaaggatacttcattcacaattatgcggtgtattatttaa

SEQ ID NO: 235329 - DNA, 75 bp, Artificial Sequence
  Synthetic
cgtgtaacttggtcctggaacacaggagttgccccagaagtgcaaacctctgctactaccctagtcacctctcca

SEQ ID NO: 235330 - DNA, 75 bp, Artificial Sequence
  Synthetic
gcgcgccggatcggccggtttccgcgacgtttctaagaccccgccagccgacttctccagtttacgggagcgagc

SEQ ID NO: 235331 - DNA, 75 bp, Artificial Sequence
  Synthetic
gggttacacacaaggatacttcattcacaattatgcggtgtattatttaaaagttatcatgtccactacaccagc

SEQ ID NO: 235332 - DNA, 75 bp, Artificial Sequence
  Synthetic
attacattgacaaccaaaagtatgcttcgccctaaagctgaagccttaaatttcttaactaatgtgcagactgct

SEQ ID NO: 235333 - DNA, 75 bp, Artificial Sequence
  Synthetic
ttcgccctaaagctgaagccttaaatttcttaactaatgtgcagactgctgaaacacatgctacctcaaatcctt

SEQ ID NO: 235334 - DNA, 75 bp, Artificial Sequence
  Synthetic
ctcgcttgttacacccttaaaacatatatcagtttctttgcaactacaaatcacttttctcattgtaatgggaat

SEQ ID NO: 235335 - DNA, 75 bp, Artificial Sequence
  Synthetic
tatatcttttgccgccaaatacccaacgttcaaaggcgacctatatataggcctatcataggagaaccccaacaa

SEQ ID NO: 235336 - DNA, 75 bp, Artificial Sequence
  Synthetic
cttttttttttttgttttttgttgcccagatgcatcccgtgctgcgacagatgcgcccccagcaacagccccctt

SEQ ID NO: 235337 - DNA, 75 bp, Artificial Sequence
  Synthetic
aatgccaccacatacacatttggcattgcttccacgaagggagacaatattactaaggaaggtttagaaattggg

SEQ ID NO: 235338 - DNA, 75 bp, Artificial Sequence
  Synthetic
gcgagcatctcgatttaacgcgggtcgcgagctgcgccacggtctggatcgaagacgggtgctgcaagacgagga

SEQ ID NO: 235339 - DNA, 75 bp, Artificial Sequence
  Synthetic
tcaggcttatctaaaaccatgcaggctatgctaccagtcattctgattctgctgctcccctgcgttgccttagct

SEQ ID NO: 235340 - DNA, 75 bp, Artificial Sequence
  Synthetic
cgcaatgacaggatgcaccgcgcggtgagcgccagcaggaggcgcgagctgagcgacagagaacttatgcacagc

SEQ ID NO: 235341 - DNA, 75 bp, Artificial Sequence
  Synthetic
tctatctatataatataccttatagatggaatggtgccaatatgtaaatgaggtgattttaaaaagtgtggatcg

SEQ ID NO: 235342 - DNA, 75 bp, Artificial Sequence
  Synthetic
tgtggtgattggctgtggggttaacggctaaaaggggcggtgcgaccgtgggaaaatgacgttttgtgggggtgg

SEQ ID NO: 235343 - DNA, 75 bp, Artificial Sequence
  Synthetic
taatctccttgggcatatgcatgttcacaatctctctataccatggacagcgctggttaatcatacagcccataa

SEQ ID NO: 235344 - DNA, 75 bp, Artificial Sequence
  Synthetic
acttaaaatcagaaataaggtttttgtctgcgttgttttcgagcagcacctcacttccctcttcccaactttggt

SEQ ID NO: 235345 - DNA, 75 bp, Artificial Sequence
  Synthetic
tcaaattttagttcctcttctttgcccacaatcttcatttctttatccccagatggccaaacgagctcggctaag

SEQ ID NO: 235346 - DNA, 75 bp, Artificial Sequence
  Synthetic
gaggccgtagtgccctcccgctccaaccccacccacgagaaggtcctggctatcgtgaacgcgctggtggagaac

SEQ ID NO: 235347 - DNA, 75 bp, Artificial Sequence
  Synthetic
ttcccctaatgggtttacacaaagtcaagacggggctcttacactcaagtgtgttgcacctcttactaccaccag

SEQ ID NO: 235348 - DNA, 75 bp, Artificial Sequence
  Synthetic
gtaacagcggatggtcttcagtcatagaagctctggtttcattttcctcacagcgtggtaaaggggccctcaaat

SEQ ID NO: 235349 - DNA, 75 bp, Artificial Sequence
  Synthetic
ggggggcttagagtagaccccactgatggatcattggaagaagacacaaaagtcaatgcccctttatccaaaaca

SEQ ID NO: 235350 - DNA, 75 bp, Artificial Sequence
  Synthetic
atggatcattggaagaagacacaaaagtcaatgcccctttatccaaaacaaaccactccataagtcttgaaactg

SEQ ID NO: 235351 - DNA, 75 bp, Artificial Sequence
  Synthetic
tcagctttgtgcaaaactgggagagggactaaaattcaacttaaacaaaatctgcgtagactatgacattaatac

SEQ ID NO: 235352 - DNA, 75 bp, Artificial Sequence
  Synthetic
ggactaaaattcaacttaaacaaaatctgcgtagactatgacattaatactctttggacaggagtaaaccccaac

SEQ ID NO: 235353 - DNA, 75 bp, Artificial Sequence
  Synthetic
gcgaatccaatgattgtaaactaacttttatactaaacaaaaacggagcgcttgttaatgcttatgtatcagtgg

SEQ ID NO: 235354 - DNA, 75 bp, Artificial Sequence
  Synthetic
ttttatactaaacaaaaacggagcgcttgttaatgcttatgtatcagtggttggtgtaaccgacctattcaatat

SEQ ID NO: 235355 - DNA, 75 bp, Artificial Sequence
  Synthetic
tttaatgcccaactgtattttgattctgatggcaatttaattactgacttatcgtcccttaaaaccccattaaat

SEQ ID NO: 235356 - DNA, 75 bp, Artificial Sequence
  Synthetic
ctgatggcaatttaattactgacttatcgtcccttaaaaccccattaaatcataagacgggacaacaaatgtcta

SEQ ID NO: 235357 - DNA, 75 bp, Artificial Sequence
  Synthetic
tttcatgcccagcattgctgcttatccatttaataacaatgacagggccaaagaaaattacatttatggaacttg

SEQ ID NO: 235358 - DNA, 75 bp, Artificial Sequence
  Synthetic
gtttttattgctttttgggcggggactcaggtatataagtagaagcagacctgtgtggttagctcataggagctg

SEQ ID NO: 235359 - DNA, 75 bp, Artificial Sequence
  Synthetic
caagcccaacacacaccccgaaactgcgtcagcagggaaaagtacagtttcacttccgcaatcccaacaagcgta

SEQ ID NO: 235360 - DNA, 75 bp, Artificial Sequence
  Synthetic
ccatttaataacaatgacagggccaaagaaaattacatttatggaacttgttattataaagcattagacaacact

SEQ ID NO: 235361 - DNA, 75 bp, Artificial Sequence
  Synthetic
attttggaagaccttaggaagactaggcaactgttagagaacgcttcggacggagtctccggtttttggagattc

SEQ ID NO: 235362 - DNA, 75 bp, Artificial Sequence
  Synthetic
tgctcaacaggcgagcaatgactgctactacagcttattgcataagcattacatggtcatggaatgtaggaacag

SEQ ID NO: 235363 - DNA, 75 bp, Artificial Sequence
  Synthetic
ctccagaaacaaccacaaccaccctggtcacctcccccttttacttttcctacattagagaagatgactgacatc

SEQ ID NO: 235364 - DNA, 75 bp, Artificial Sequence
  Synthetic
aatataccttatagatggaatggtgccaatatgcaaatgaggtaatttaaaaaagtgcgcgctgtgtggtgattg

SEQ ID NO: 235365 - DNA, 75 bp, Artificial Sequence
  Synthetic
catgaactctgattatttcaccaatgctatcctgaacccacactggctgcccccacctggtttctacactggcga

SEQ ID NO: 235366 - DNA, 75 bp, Artificial Sequence
  Synthetic
aaaatcagtttacaggattcgagtagttattttgcctcccccttcccattttatagaatacaccaatctctcccc

SEQ ID NO: 235367 - DNA, 75 bp, Artificial Sequence
  Synthetic
gggcgcatgttgtaaaagtgaaagtaaaataaaaatgcaactcaccaaggccatggcgaccgagcgtgcgttcgt

SEQ ID NO: 235368 - DNA, 75 bp, Artificial Sequence
  Synthetic
gctactcccgccatgcgagctgcaaaagctattctgcggagggccaaacgtgtggggcgaagagccatgcttaga

SEQ ID NO: 235369 - DNA, 75 bp, Artificial Sequence
  Synthetic
gctaaaaggggcggcgcgaccgtgggaaaatgacgttttgtgggggtggagtttttttgcaagttgtcgcgggaa

SEQ ID NO: 235370 - DNA, 75 bp, Artificial Sequence
  Synthetic
ctgatgaacaatgccatcattgacaactacctggaaattggcagacagaatggagtgctggaaagtgacattggt

SEQ ID NO: 235371 - DNA, 75 bp, Artificial Sequence
  Synthetic
atgtgacgcataaaaaggctttttttctcacggaactacttagttttcccacggtatttaacaggaaatgaggta

SEQ ID NO: 235372 - DNA, 75 bp, Artificial Sequence
  Synthetic
atataccccctatttgattttggctggaatgctcccaatgcacatgatcatccccaagacccagaggaacacatt

SEQ ID NO: 235373 - DNA, 75 bp, Artificial Sequence
  Synthetic
cagctgtaacttatggccgttcacacctaactgtacctgttggctcaacatgtacactacaaggaccccaagaag

SEQ ID NO: 235374 - DNA, 75 bp, Artificial Sequence
  Synthetic
cttaccagtgtaacatgaatcatgtaaaagtgttgttggaaccagatgccttttccagaatgagcctaacaggaa

SEQ ID NO: 235375 - DNA, 75 bp, Artificial Sequence
  Synthetic
gggcagggatacgttgcggaactgtaacctgttctgccacttgaactcggggatcaccagcttgggaactggaat

SEQ ID NO: 235376 - DNA, 75 bp, Artificial Sequence
  Synthetic
caaaagcaggagcattttctaattcctcaatcatcatattacattcctgtaccattcccagataattttcatctt

SEQ ID NO: 235377 - DNA, 75 bp, Artificial Sequence
  Synthetic
ttacagtatggtgaacatcaatcatgattcctagaaatttcttcttcaccatactcatctgtgctttcaatgtct

SEQ ID NO: 235378 - DNA, 75 bp, Artificial Sequence
  Synthetic
ccattctcatctcgcccagtaataataccggttggggactgtatgcgcccaccaagatgtatggaggcgcccgca

SEQ ID NO: 235379 - DNA, 75 bp, Artificial Sequence
  Synthetic
ctcgttgagtgacaaacaggctgtccgtgtccccgtagactgattttacaggcctcttctccagtggagtgcctc

SEQ ID NO: 235380 - DNA, 75 bp, Artificial Sequence
  Synthetic
tctatgaggaccagtcacatcctcccaaagtcgagctctcagcctgcgtcatcacccagggagcaattctggccc

SEQ ID NO: 235381 - DNA, 75 bp, Artificial Sequence
  Synthetic
taataaagacacttacttgaaatcagcaatacagtctttgtcaaaactttctaccagcagcacctcaccctcttc

SEQ ID NO: 235382 - DNA, 75 bp, Artificial Sequence
  Synthetic
tgtatggaggcgcccgcaaacgctctacccagcaccctgtgcgcgttcgcggtcatttccgcgctccctggggcg

SEQ ID NO: 235383 - DNA, 75 bp, Artificial Sequence
  Synthetic
ggtcatttccgcgctccctggggcgcactcaagggtcgtacccgcactcggaccacggtcgatgatgtgatcgac

SEQ ID NO: 235384 - DNA, 75 bp, Artificial Sequence
  Synthetic
cagcaagtctgctaatgcccaactatgctctgcacccatccatcattcccactccgggttacagaggcactcgct

SEQ ID NO: 235385 - DNA, 75 bp, Artificial Sequence
  Synthetic
caccaccattcttaaacacaccctcataatgacaaaatatcttgctcctgtgtcacctgcagcaaattgagaatg

SEQ ID NO: 235386 - DNA, 75 bp, Artificial Sequence
  Synthetic
tgcgagtgatgcgaaaaggctgtggtacttccgctcggttattgataacctgggcagctaggacgatctcgtcga

SEQ ID NO: 235387 - DNA, 75 bp, Artificial Sequence
  Synthetic
tgagacgctgcggactcaggttagtaggcagtgtcaggagattaacttgcatgatcttttggagggcgtgcggga

SEQ ID NO: 235388 - DNA, 75 bp, Artificial Sequence
  Synthetic
tatcatctcctgcttgcatgaatgcgggggcaacatatccttcacccggcgatacctgctcttccaccacggtgt

SEQ ID NO: 235389 - DNA, 75 bp, Artificial Sequence
  Synthetic
tccatcgtctcagcggcatctcgctgacatcgcccagagcttccaagcgctccatggcctcgtagaagtccacgg

SEQ ID NO: 235390 - DNA, 75 bp, Artificial Sequence
  Synthetic
agcatacaatccagacatgttagcatcagttaaagagaaaaaacagccaacatagcctctgggtataattatgct

SEQ ID NO: 235391 - DNA, 75 bp, Artificial Sequence
  Synthetic
tccctacctggatggcactttttaccttaaccacactttcaagaaggtctccatcatgtttgactcctcagtcag

SEQ ID NO: 235392 - DNA, 75 bp, Artificial Sequence
  Synthetic
catcccgtgctgcgacagatgcgcccccaacaacagcccccctcgcagcagcagcagcagcaatcacaaaaggct

SEQ ID NO: 235393 - DNA, 75 bp, Artificial Sequence
  Synthetic
taactggtcccggtactgacgaaaatgctgcccgactgccatcttttctggggtgacgcaatagaaggtttgggg

SEQ ID NO: 235394 - DNA, 75 bp, Artificial Sequence
  Synthetic
aagggggcgggccggcgcggggaggtgacgtgatttgtgtgggaggagttatgttgcaagttctcgcggtaaaag

SEQ ID NO: 235395 - DNA, 75 bp, Artificial Sequence
  Synthetic
cgaagcggtggtaggccccggtgttgattgtgtaggagcagttggccatgactgaccagttgactgtctggtgcc

SEQ ID NO: 235396 - DNA, 75 bp, Artificial Sequence
  Synthetic
ggggagagcactggctggcttttggttggaacccgcgctccaacacctgctacctttttgatccttttgggttct

SEQ ID NO: 235397 - DNA, 75 bp, Artificial Sequence
  Synthetic
ggttagtaggcagtgtcaggagattgacttgcatgatcttttcgagggcgtgagggaggttcagatggtacttga

SEQ ID NO: 235398 - DNA, 75 bp, Artificial Sequence
  Synthetic
cggccaagtagcagtttaccatgagttcgtagttgagcgcctcggctgcgtggcccttggcgcggagcttacctt

SEQ ID NO: 235399 - DNA, 75 bp, Artificial Sequence
  Synthetic
gaaaacgaaagcgatgagcggctcgactccgtggcctgggggaacgtgaacgggttgggtcgcggtgtaccccgg

SEQ ID NO: 235400 - DNA, 75 bp, Artificial Sequence
  Synthetic
cgcttcacgaactgtatgatttagaggtagacgggccggaggatcccaatgaggaagctgtgaatgggtttttta

SEQ ID NO: 235401 - DNA, 75 bp, Artificial Sequence
  Synthetic
ctctgctgctgttcaggcaacgtcgcccccggtccctctaaatacacatacaaagcctcatcagccatggcttac

SEQ ID NO: 235402 - DNA, 75 bp, Artificial Sequence
  Synthetic
gctgaaatggacttgcgttgttatgaagagggttttcctccgagtgatgatgaagatgaggaaagtgagcagtcc

SEQ ID NO: 235403 - DNA, 75 bp, Artificial Sequence
  Synthetic
actattatgctcgctttgctatatgagaacgcactgccactttatttacagtaagtgtgtttaagtgaaatttaa

SEQ ID NO: 235404 - DNA, 75 bp, Artificial Sequence
  Synthetic
tctgctcttcctcactgtcttccggatcgctgtccaggaacgtcagctgttggggtaggtattccctctcgaagg

SEQ ID NO: 235405 - DNA, 75 bp, Artificial Sequence
  Synthetic
tgttttttgttgaccagatgcatccagtgctgcgacagatgcgcccccagcaacaggccccttctcagcaacagc

SEQ ID NO: 235406 - DNA, 75 bp, Artificial Sequence
  Synthetic
aggaacagtgaagctgttttaataactttgttgaatgggggatttatgttttacttgtgatttttttataggtcc

SEQ ID NO: 235407 - DNA, 75 bp, Artificial Sequence
  Synthetic
cctgattcaactacctcacctcctgaaattcaggcgcccgtccctgcaaacgtatgcaagcccattcctgtgaag

SEQ ID NO: 235408 - DNA, 75 bp, Artificial Sequence
  Synthetic
aaaaggactctcgcgaggcgtacgtgccccagcagaacctgttcagggacaggagcggcgaggagccagaggaga

SEQ ID NO: 235409 - DNA, 75 bp, Artificial Sequence
  Synthetic
gggtggggatggacctttggactttagtacccggaaactgccaaggcaatgagtgccctgcacctgtgtttattt

SEQ ID NO: 235410 - DNA, 75 bp, Artificial Sequence
  Synthetic
ccggccatgccagcggttctggaggaggagcagcaggaggacaatccgagagccggcctggaccctccggtggag

SEQ ID NO: 235411 - DNA, 75 bp, Artificial Sequence
  Synthetic
tagcacagccatcacttccatgcccttctcccaggcagataccaggggcaagctcaaaggattcctaacagcaat

SEQ ID NO: 235412 - DNA, 75 bp, Artificial Sequence
  Synthetic
ttggctttaagtttaatgagtcgcaggcgtcctgaaactgtttggtggcatgaggttcagagcgaaggcagggat

SEQ ID NO: 235413 - DNA, 75 bp, Artificial Sequence
  Synthetic
tcattcttgtcgatcttctcaacacttctcttgccatccttctcaatgatgcgcaccggggggtagctgaagccc

SEQ ID NO: 235414 - DNA, 75 bp, Artificial Sequence
  Synthetic
gtagggacagcatcccttctccacggggagagagtatgcttgggcagccttgcgcagtgaggtatgagtgagggc

SEQ ID NO: 235415 - DNA, 75 bp, Artificial Sequence
  Synthetic
tgtatgatctgatcaacatcctgcaaagtattatagtgcaggaacgtagcctgggtttggctgagaaagtggcag

SEQ ID NO: 235416 - DNA, 75 bp, Artificial Sequence
  Synthetic
taaatggatccgacaaacccacttcagcaagggatacgttttggatttcatagcagcagctttgtggagaacatg

SEQ ID NO: 235417 - DNA, 75 bp, Artificial Sequence
  Synthetic
gagggcatgcgggaggttcagatggtacttgatctccacgggtccgttggtggagatgtcgatggcttgcagggt

SEQ ID NO: 235418 - DNA, 75 bp, Artificial Sequence
  Synthetic
agcagcaaagcctttatgccaagtactacagcttatccctttaacaccactactagggatagtgaaaactatatt

SEQ ID NO: 235419 - DNA, 75 bp, Artificial Sequence
  Synthetic
agcaaattcctgagcagctgagacttgccgcacccagtgggaccgtaaatgaccccgattacgggttgcagatgg

SEQ ID NO: 235420 - DNA, 75 bp, Artificial Sequence
  Synthetic
atgcaagatctccaacgtggagcttaccaacctggtttcttacatgggcattttgcatgagaaccggctagggca

SEQ ID NO: 235421 - DNA, 75 bp, Artificial Sequence
  Synthetic
attggccgatgtgtctgaaggaacggacgtgaaactcactattcaacctgtagaaaaagatagtaagaatagaag

SEQ ID NO: 235422 - DNA, 75 bp, Artificial Sequence
  Synthetic
ggggaggcccgccgtgactacatccgagactgtgtctacctctacctctgccatacctggcagactggcatgggt

SEQ ID NO: 235423 - DNA, 75 bp, Artificial Sequence
  Synthetic
ttcttgctaaccaaccggtcgcagaagatccctcctcagtatgcgcttaccgctgaggaggagcggatcctcaga

SEQ ID NO: 235424 - DNA, 75 bp, Artificial Sequence
  Synthetic
aactatggaagatactgagatatgatgacactaaaccgagggtgcgcgcatgcgaatgcggaggcaagcatgcta

SEQ ID NO: 235425 - DNA, 75 bp, Artificial Sequence
  Synthetic
ggtctagcatgagctcatcaggggggtccgcatctatggtgaatattcccgggagcagatccttgtcaaaatagc

SEQ ID NO: 235426 - DNA, 75 bp, Artificial Sequence
  Synthetic
catctgccattctcgagctgccagcgcgcgctcataggggttgagaggggtgccccagggcatggggtgggtgag

SEQ ID NO: 235427 - DNA, 75 bp, Artificial Sequence
  Synthetic
ggtcttctattccttcttcatctcgggaaggtgagacgatgctgctggtgatgaaattaaagtaggcagttctaa

SEQ ID NO: 235428 - DNA, 75 bp, Artificial Sequence
  Synthetic
gcaggcaagcagccgctgtcgcagcggcgactattgccgacatggcccaatcgcgaagaggcaatgtatactggg

SEQ ID NO: 235429 - DNA, 75 bp, Artificial Sequence
  Synthetic
acctgctcttccaccacggtgtgaacttcccccgcaatatcttgcattactaccgtcacctccacagcccctact

SEQ ID NO: 235430 - DNA, 75 bp, Artificial Sequence
  Synthetic
aaccggatctttccaaccctctatgccatcttccagcagagtcgggggcaagagcaggaactgaaagtaaaaaac

SEQ ID NO: 235431 - DNA, 75 bp, Artificial Sequence
  Synthetic
aaggggggagggggtctagcatgaactcatcaggggggtccgcatctatggtaaatattcccggtagcaaatctt

SEQ ID NO: 235432 - DNA, 75 bp, Artificial Sequence
  Synthetic
gcaaagccacccctcgcggatacaaagtaaaaggcacaggagaataaaaaatataattatttctctgctgctgtt

SEQ ID NO: 235433 - DNA, 75 bp, Artificial Sequence
  Synthetic
tggcacgtcggcgccgcgcgcgggtaggttctggtactgcgccctgagaagacttgcgtgcgcgacgacgcggcg

SEQ ID NO: 235434 - DNA, 75 bp, Artificial Sequence
  Synthetic
agaaagtggcagccatcaactactcggtcttgagcctgggcaagtactacgctcgcaagatctacaagaccccct

SEQ ID NO: 235435 - DNA, 75 bp, Artificial Sequence
  Synthetic
atgtctaatggtggcgcggctgagctagctcgactgcgacacctagaccactgccgccgctttcgctgcttcgcc

SEQ ID NO: 235436 - DNA, 75 bp, Artificial Sequence
  Synthetic
atcttatcaacattctacagagtatcatagtgcaggagcggagcctgggcctggccgaaaaggtggctgccatca

SEQ ID NO: 235437 - DNA, 75 bp, Artificial Sequence
  Synthetic
ccccgcagccaatcaccacacagcgcgcacttttttaaattacctcatttgcatgttggcaccattccatctata

SEQ ID NO: 235438 - DNA, 75 bp, Artificial Sequence
  Synthetic
gacgacccgcaaccccgaagcctttagacagcaaccccaggccaaccgcctttcggccatcctggaggccgtagt

SEQ ID NO: 235439 - DNA, 75 bp, Artificial Sequence
  Synthetic
agtcagatctccactttgaaaaaatgagacacctgcgattcctgcctcaggaaatctccattgagaccggggatg

SEQ ID NO: 235440 - DNA, 75 bp, Artificial Sequence
  Synthetic
gagacacctgcgattcctgcctcaggaaatctccattgagaccggggatgaaatactgcagtttgtggtaaatgc

SEQ ID NO: 235441 - DNA, 75 bp, Artificial Sequence
  Synthetic
cctgatgggagacgatccggagccgcctgcgcagcctttcgatcctcctacgcttcatgaactgtatgatttaga

SEQ ID NO: 235442 - DNA, 75 bp, Artificial Sequence
  Synthetic
agtgaagacgcctccgcgcatctccctgaagtggtgactgggaggctctccgttgggcagggacagggcgctgat

SEQ ID NO: 235443 - DNA, 75 bp, Artificial Sequence
  Synthetic
gaaaaaattgcctgaacttggtgctgctgaaatggatttgcactgttatgaagagggctttcctccgagtgatga

SEQ ID NO: 235444 - DNA, 75 bp, Artificial Sequence
  Synthetic
gggagtgcacgccccggtaggagatcgtgcgaccgtgtctagcttgctgacccccaactcccgcctactgctgct

SEQ ID NO: 235445 - DNA, 75 bp, Artificial Sequence
  Synthetic
gcttgtgattttttataggtcctgtgtctgatgctgatgaatcgccttctcctgattcaactacctcacctcctg

SEQ ID NO: 235446 - DNA, 75 bp, Artificial Sequence
  Synthetic
gacgctggtgacgcgcgcagacgagcccccttcatacgaggaggcagtaaagctcggaatgcccactaccaggcc

SEQ ID NO: 235447 - DNA, 75 bp, Artificial Sequence
  Synthetic
agcagctttgtggagaacatggaaggctcgcaggctgaggataatcttagattactggccagtgcagcctctggg

SEQ ID NO: 235448 - DNA, 75 bp, Artificial Sequence
  Synthetic
tatgatcctgatgtacgtgttattgaaaatcatggtgtggaagatgaacttcccaactactgttttccactggac

SEQ ID NO: 235449 - DNA, 75 bp, Artificial Sequence
  Synthetic
acctgatatagcttccttggaagaggttccaaagatcttcgagggtctgggcaataatgagactcgggccgcaaa

SEQ ID NO: 235450 - DNA, 75 bp, Artificial Sequence
  Synthetic
tttttttgttttttgtcgcccagatgcatccagtgctgcgacagatgcgcccccagcaacaggccccttctcagc

SEQ ID NO: 235451 - DNA, 75 bp, Artificial Sequence
  Synthetic
ggcataggtgttccaacaaccagttacaaatcaatagttccaaatggagacaatgcgcctaattggaaggaacct

SEQ ID NO: 235452 - DNA, 75 bp, Artificial Sequence
  Synthetic
ttggctttaagtttaatgagtcgcaggcgtcctgaaactgtttggtggcatgaggttcagagtgagggcagggat

SEQ ID NO: 235453 - DNA, 75 bp, Artificial Sequence
  Synthetic
gccactaacattggaaaaaacttataaataaaaaatagaatggactctgacgctcctggtcctgtgactatgttt

SEQ ID NO: 235454 - DNA, 75 bp, Artificial Sequence
  Synthetic
gagctgcgccacggtctggatcgaagacgggtgctgcgggacgaggatttcgaggttgatgaggcgacggggatc

SEQ ID NO: 235455 - DNA, 75 bp, Artificial Sequence
  Synthetic
catgttcagcaacaagttcaaggctcgggtgatggtgtctagagaggcctcaaagattgattcagagaaaaatga

SEQ ID NO: 235456 - DNA, 75 bp, Artificial Sequence
  Synthetic
gatgggtataatgggattgtctttatggctaacactaaattaattctgcacggttgtagcttttttgggtttaat

SEQ ID NO: 235457 - DNA, 75 bp, Artificial Sequence
  Synthetic
aggttagtgtaagaggctgtagtttttatgcaggctggattgcactatcaggcaggaccaagagtcagttgtctg

SEQ ID NO: 235458 - DNA, 75 bp, Artificial Sequence
  Synthetic
gcccgaggggagatggttgtatgatctgatcaatatcctgcaaagcattgtagtgcaggaacgcagcctgggtct

SEQ ID NO: 235459 - DNA, 75 bp, Artificial Sequence
  Synthetic
ccgaataccgcaatcaaaatgttgcggcacttcttaggcttatttaaaaccatgcaggctatgctaccagtcatt

SEQ ID NO: 235460 - DNA, 75 bp, Artificial Sequence
  Synthetic
ggttgccgacgcccgtaattatactcctactgcgcctacatctactgtggatgcagttattgacagtgtagtggc

SEQ ID NO: 235461 - DNA, 75 bp, Artificial Sequence
  Synthetic
cgataaaacatatcagccagagcctcaagttggagaagaatcatggactgatactgatggaacaaatgaaaagtt

SEQ ID NO: 235462 - DNA, 75 bp, Artificial Sequence
  Synthetic
cgacagagaacttatgcacagcttgcaaagagctctgacgggggctgggaccgagggggagaactactttgacat

SEQ ID NO: 235463 - DNA, 75 bp, Artificial Sequence
  Synthetic
gtagccgaatatgaaaaaagcaaaaaggaaattgcaagcagcactactactactactgcagtaacaactgttgca

SEQ ID NO: 235464 - DNA, 75 bp, Artificial Sequence
  Synthetic
aggaaattgcaagcagcactactactactactgcagtaacaactgttgcaagaaatgttgctgatacttcagttg

SEQ ID NO: 235465 - DNA, 75 bp, Artificial Sequence
  Synthetic
tactattaaggcagaaaatgacagtgcggtcagaggcgataactttcaatcgaaaaatgacatgaaagcatctga

SEQ ID NO: 235466 - DNA, 75 bp, Artificial Sequence
  Synthetic
ggtggatgaaggcgaggacgaggagggcgagtacctggaagactgatggcgcgacccgtatttttgctagatgga

SEQ ID NO: 235467 - DNA, 75 bp, Artificial Sequence
  Synthetic
cgaaaaatgacatgaaagcatctgaggaagtaacggtggtgcctgtaagtccgcccacagtaactgaaactgaaa

SEQ ID NO: 235468 - DNA, 75 bp, Artificial Sequence
  Synthetic
agaaaaggataccaaggatcgcagttacaatgtcatctctggcaccaatgatactgcctatcgcagttggtacct

SEQ ID NO: 235469 - DNA, 75 bp, Artificial Sequence
  Synthetic
attctggcccaattgcaagccatccaaaaatcccgccaagaatttctactgaaaaagggtaagggggtctacctt

SEQ ID NO: 235470 - DNA, 75 bp, Artificial Sequence
  Synthetic
tacttgaaatcagcaataaggtctctgttgaaattttctcccagcagcacctcacttccctcttcccaactctgg

SEQ ID NO: 235471 - DNA, 75 bp, Artificial Sequence
  Synthetic
ccattctcatctcacccagtaataacaccggttgggggctgcgcacacccaccaggatgtacggaggcgctcgca

SEQ ID NO: 235472 - DNA, 75 bp, Artificial Sequence
  Synthetic
tacccccgccatgcgagctgcaagagctctgctgcggagagccaaacgcgtggggcgaagagccatgcttagagc

SEQ ID NO: 235473 - DNA, 75 bp, Artificial Sequence
  Synthetic
aaatttcactgcagagctgttttttgattctactggtaatttattaactagcctttcatccctaaaaactccact

SEQ ID NO: 235474 - DNA, 75 bp, Artificial Sequence
  Synthetic
ttcctgtgggacgatgtggacagcagcatattctccccgcctcccggttataccgtttggaagaaggaagggggc

SEQ ID NO: 235475 - DNA, 75 bp, Artificial Sequence
  Synthetic
gaaaaagaaaactacatttacggaacttgttactacacagctagtgatcacactgcttttcccattgacatatct

SEQ ID NO: 235476 - DNA, 75 bp, Artificial Sequence
  Synthetic
ggcgagtttgcttatggcaaacgcagccgctccagtcccaaggatgaggcggtgtccatccccttggatcatgga

SEQ ID NO: 235477 - DNA, 75 bp, Artificial Sequence
  Synthetic
atcaacatcggcgccaggtggtctcttgacccaatggacaatgtaaatccattcaaccaccaccgcaatgctggt

SEQ ID NO: 235478 - DNA, 75 bp, Artificial Sequence
  Synthetic
caatttgtggaggagtttactccctctgtctacttcaaccccttctccggatctcctgggcactacccggacgag

SEQ ID NO: 235479 - DNA, 75 bp, Artificial Sequence
  Synthetic
cagtaccgctcgaagaccacggcgaaagtatggtcctgcgagtctgctgatgcccaactatgctctgcacccatc

SEQ ID NO: 235480 - DNA, 75 bp, Artificial Sequence
  Synthetic
ccagatgtttacaagtacacgccacctaacattactctgcccgctaacaccaacacctatgagtacatgaacggg

SEQ ID NO: 235481 - DNA, 75 bp, Artificial Sequence
  Synthetic
ccatctcgcaactgggcagccttcaggggctggtccttcaccaggctcaaaaccaaggagactccatctcttgga

SEQ ID NO: 235482 - DNA, 75 bp, Artificial Sequence
  Synthetic
cattattccaactcctggttaccgaggcactcgctactaccgcagccggagcaccacttcccgccgccgcaaaac

SEQ ID NO: 235483 - DNA, 75 bp, Artificial Sequence
  Synthetic
gaactatcagaacgaccacagcaacttcctgaccacggtggtgcagaacaatgactttacccccacggaggccag

SEQ ID NO: 235484 - DNA, 75 bp, Artificial Sequence
  Synthetic
cttcttcgctgtcttgactgatgtcttgcatggggatatgtttggtcttccttggcttctttttggggggtatcg

SEQ ID NO: 235485 - DNA, 75 bp, Artificial Sequence
  Synthetic
ggggtggctttctgaccgctttgattcccattatcgccgcggcgattggggcagtaccaggcatagcttccgtgg

SEQ ID NO: 235486 - DNA, 75 bp, Artificial Sequence
  Synthetic
caacgtgaacgagtacatgttcagcaacaagttcaaggcgcgggtgatggtgtccagaaaggctcctgaaggtgt

SEQ ID NO: 235487 - DNA, 75 bp, Artificial Sequence
  Synthetic
aacaagttcaaggcgcgggtgatggtgtccagaaaggctcctgaaggtgttacagtagatgacaaatatgatcac

SEQ ID NO: 235488 - DNA, 75 bp, Artificial Sequence
  Synthetic
ggtttgagtttacactgccagaaggcaacttctcagccactatgacaattgatttaatgaacaatgccatcatag

SEQ ID NO: 235489 - DNA, 75 bp, Artificial Sequence
  Synthetic
tactatgagacaaggggaaccttacccagccaattatccatacccgctcatcggaactactgccgttaagagtgt

SEQ ID NO: 235490 - DNA, 75 bp, Artificial Sequence
  Synthetic
caacttctcagccactatgacaattgatttaatgaacaatgccatcatagacaactacctgggagttggtagaca

SEQ ID NO: 235491 - DNA, 75 bp, Artificial Sequence
  Synthetic
ggtgtcaagtttgacactagaaacttcaggctcgggtgggacccagaaactaagttaatcatgcccggggtctac

SEQ ID NO: 235492 - DNA, 75 bp, Artificial Sequence
  Synthetic
acctcagctgggagatgaaacttggactgaccttgatggaaagaccgaaaagtatgggggcagggctctcaaacc

SEQ ID NO: 235493 - DNA, 75 bp, Artificial Sequence
  Synthetic
agacctgggctgcggaccctatttcctgggaacctttgacaagcgtttcccggggttcatggcccccgacaagct

SEQ ID NO: 235494 - DNA, 75 bp, Artificial Sequence
  Synthetic
tcattggcccctaagggcgctcccaatacatctcagtggcttaataagggagatgaagaggatggggaagacgac

SEQ ID NO: 235495 - DNA, 75 bp, Artificial Sequence
  Synthetic
caattatggcgaccctgagaaaggaataaggtcctggacactgctcaccacctcggatgtcacctgcggggcgga

SEQ ID NO: 235496 - DNA, 75 bp, Artificial Sequence
  Synthetic
atgcgccagtaaaagccgaagctgaaattacaaaagaaggactgccaataggtttggaagttccatctgaaggtg

SEQ ID NO: 235497 - DNA, 75 bp, Artificial Sequence
  Synthetic
aattacaaaagaaggactgccaataggtttggaagttccatctgaaggtggccctaaacccatttatgctgataa

SEQ ID NO: 235498 - DNA, 75 bp, Artificial Sequence
  Synthetic
ggagaggaatcttggactgatacggatggcacagatgaaaaatatggaggcagagcacttaaacctgaaactaaa

SEQ ID NO: 235499 - DNA, 75 bp, Artificial Sequence
  Synthetic
cccagtggtgggtgcagagcttatgcccgtcttctcaaagagtttctacaacgagcaagccgtgtactcccagca

SEQ ID NO: 235500 - DNA, 75 bp, Artificial Sequence
  Synthetic
tactcttacaaagttcgctacacactggctgtgggcgacaacagagtgctggatatggccagcaccttctttgac

SEQ ID NO: 235501 - DNA, 75 bp, Artificial Sequence
  Synthetic
atggcacagatgaaaaatatggaggcagagcacttaaacctgaaactaaaatgaaaccctgctacgggtctttcg

SEQ ID NO: 235502 - DNA, 75 bp, Artificial Sequence
  Synthetic
atcaggggcgtgcttgacagaggtcccagtttcaagccatactctggcacagcttacaactccctggctcctaaa

SEQ ID NO: 235503 - DNA, 75 bp, Artificial Sequence
  Synthetic
gcaggcaaaagtgaagaaagaagaagaaggcaaggttgaatatgacattgacatgaactttttcgacctaagatc

SEQ ID NO: 235504 - DNA, 75 bp, Artificial Sequence
  Synthetic
gaaggcaaggttgaatatgacattgacatgaactttttcgacctaagatcacaaatgactggcctcaagcctaaa

SEQ ID NO: 235505 - DNA, 75 bp, Artificial Sequence
  Synthetic
actcatcttactttcgttctcaccgcgcgcgcatcgaaagggccaccgcgtttgaccgtatggatatgcaataag

SEQ ID NO: 235506 - DNA, 75 bp, Artificial Sequence
  Synthetic
ggaccctgccgttgcgcagcagtatccggggagtccagcgcgtgaccgttactgacgccagacgccgcacctgtc

SEQ ID NO: 235507 - DNA, 75 bp, Artificial Sequence
  Synthetic
ttgatgaaggaaagaaaattacagacaacggtgtggaagcagctgatgacaatgcaaaagctacttacacttttg

SEQ ID NO: 235508 - DNA, 75 bp, Artificial Sequence
  Synthetic
atctagaaactcctgacactcatgtggtgtacaaacctggagcttcagatgctagctctcatgcaaaccttggtc

SEQ ID NO: 235509 - DNA, 75 bp, Artificial Sequence
  Synthetic
gtagacgatctggcgaaagatggcatgtgaatttgaagagatggtgggtctttgaaagatgttaaaatgggcatg

SEQ ID NO: 235510 - DNA, 75 bp, Artificial Sequence
  Synthetic
ctcatctcgcccagtaataataccggttggggactgcgcgcgcccaccaagatgtacggaggcgcccgcaaacgc

SEQ ID NO: 235511 - DNA, 75 bp, Artificial Sequence
  Synthetic
gtagcagtagaagttactggcgaagatgatgaaactaaaccaatttatgcagataagttgtatcagccagaacca

SEQ ID NO: 235512 - DNA, 75 bp, Artificial Sequence
  Synthetic
gttctggcgggagtcagagtgacccgcgggcagggatacgttgcggaactgtaacctgttctgccacttgaactc

SEQ ID NO: 235513 - DNA, 75 bp, Artificial Sequence
  Synthetic
atcggactcatgtactacaacagtactggcaacatgggagtgctggctggacaagcgtctcagctaaatgcagtg

SEQ ID NO: 235514 - DNA, 75 bp, Artificial Sequence
  Synthetic
ggtgtacaaacctggagcttcagatgctagctctcatgcaaaccttggtcaacagtccatgcccaatagacctaa

SEQ ID NO: 235515 - DNA, 75 bp, Artificial Sequence
  Synthetic
ctggcaacatgggagtgctggctggacaagcgtctcagctaaatgcagtggttgacttgcaagacagaaacacag

SEQ ID NO: 235516 - DNA, 75 bp, Artificial Sequence
  Synthetic
tggcggtagagcacttaagcctgacactaaaatgaaaccatgttacggatcttttgctaaaccaaccaatactaa

SEQ ID NO: 235517 - DNA, 75 bp, Artificial Sequence
  Synthetic
atgatgaaactaaaccaatttatgcagataagttgtatcagccagaaccacaggtaggagaggaaacatggactg

SEQ ID NO: 235518 - DNA, 75 bp, Artificial Sequence
  Synthetic
ttctctgggggacagaaccagatatttcagtatgtggaatcaagcagtggatagctatgacccagatgtgcgtgt

SEQ ID NO: 235519 - DNA, 75 bp, Artificial Sequence
  Synthetic
ttcagtatgtggaatcaagcagtggatagctatgacccagatgtgcgtgttattgagaaccatggtgtggaagat

SEQ ID NO: 235520 - DNA, 75 bp, Artificial Sequence
  Synthetic
actaaaatgaaaccatgttacggatcttttgctaaaccaaccaatactaaaggtggtcaggcaaaagtaaaaaag

SEQ ID NO: 235521 - DNA, 75 bp, Artificial Sequence
  Synthetic
caaaagttcaatatgacattgatatgaacttctttgaagaaagatctcagaaaaatggcagtcccaaaattgtga

SEQ ID NO: 235522 - DNA, 75 bp, Artificial Sequence
  Synthetic
tcgtcgcaagagccgaaggaggcgcattgccaggcgccaccgggctactcccgccatgcgagctgcaagagctct

SEQ ID NO: 235523 - DNA, 75 bp, Artificial Sequence
  Synthetic
ccacggggagagagtatgcttgggctgccttgcgcagtgaggtatgagtgagggcgaaagtgtccctgaccatga

SEQ ID NO: 235524 - DNA, 75 bp, Artificial Sequence
  Synthetic
tggatggtgtaggtccgcgaatagacagttacaagggaattgagacaaatggtgatgaaaccactacttggaaag

SEQ ID NO: 235525 - DNA, 75 bp, Artificial Sequence
  Synthetic
gaacttctttgaagaaagatctcagaaaaatggcagtcccaaaattgtgatgtatgcagaaaatgtagatttgga

SEQ ID NO: 235526 - DNA, 75 bp, Artificial Sequence
  Synthetic
aaacctggtacttcagaagacagttcacatgctaatctgggtcaacagtctatgcccaatagacccaactacatt

SEQ ID NO: 235527 - DNA, 75 bp, Artificial Sequence
  Synthetic
cacatgctaatctgggtcaacagtctatgcccaatagacccaactacattggctttagggataattttatcggcc

SEQ ID NO: 235528 - DNA, 75 bp, Artificial Sequence
  Synthetic
atggggatcagcatcatcctggcttggttgggagttatccctgggtacacagccttcatgaaggcttcgtactgc

SEQ ID NO: 235529 - DNA, 75 bp, Artificial Sequence
  Synthetic
acatggcccaaccgcgaagaggcaatgtgtactgggtgcgcgacgcctctggtcagcgcgtgcccgtgcgcaccc

SEQ ID NO: 235530 - DNA, 75 bp, Artificial Sequence
  Synthetic
catgggagtgctggctggtcaagcatctcagttgaatgcggtggttgacttgcaagacagaaacacagaactgtc

SEQ ID NO: 235531 - DNA, 75 bp, Artificial Sequence
  Synthetic
tgcaagacagaaacacagaactgtcttaccaattattgcttgactctctgggcgacaggaccagatactttagca

SEQ ID NO: 235532 - DNA, 75 bp, Artificial Sequence
  Synthetic
aatcatggagtggaagacgagcttcccaactactgctttccattagatggagtgggcccaagaacagttagctac

SEQ ID NO: 235533 - DNA, 75 bp, Artificial Sequence
  Synthetic
catgcaggcatttcaccttgccttcataatcggtgcatccatgagcccacagagcgcacccggtgcactcccaat

SEQ ID NO: 235534 - DNA, 75 bp, Artificial Sequence
  Synthetic
cagtgctgtttgtaactggtcccggtactggcgaaaatgctggccgactgccatcttttctggggtgatacagta

SEQ ID NO: 235535 - DNA, 75 bp, Artificial Sequence
  Synthetic
acgcagcagatgctaatggttggaaaaatgttactccaactggaatcagtgaaattgctaaaggcaatcctttcg

SEQ ID NO: 235536 - DNA, 75 bp, Artificial Sequence
  Synthetic
aaatgttactccaactggaatcagtgaaattgctaaaggcaatcctttcgccatggaaattaatctccaagccaa

SEQ ID NO: 235537 - DNA, 75 bp, Artificial Sequence
  Synthetic
ctgccacaggagattatctccagcgagaccgggatcgaaatactggagtttgtggtaaataccctgatgggagat

SEQ ID NO: 235538 - DNA, 75 bp, Artificial Sequence
  Synthetic
tttaagcggtcctatgatgaggtgtacggggatgacgatattcttgagcaggcggcagaccgcctgggcgagttt

SEQ ID NO: 235539 - DNA, 75 bp, Artificial Sequence
  Synthetic
aatgtggccctgtatctaccagattcctacaaatacaccccggccaatgttactcttcccaccaacaccaacact

SEQ ID NO: 235540 - DNA, 75 bp, Artificial Sequence
  Synthetic
cctacaaatacaccccggccaatgttactcttcccaccaacaccaacacttatgactacctgaacggacgggtgg

SEQ ID NO: 235541 - DNA, 75 bp, Artificial Sequence
  Synthetic
tgtaaacattggagccagatggtctcttgatgccatggacaatgttaatccatttaaccaccaccgcaatgctgg

SEQ ID NO: 235542 - DNA, 75 bp, Artificial Sequence
  Synthetic
agacgtactggagaaaatgaaagtggatcccgatatccagcctgaggtcaaagtgagacccatcaaggaagtggc

SEQ ID NO: 235543 - DNA, 75 bp, Artificial Sequence
  Synthetic
ggcaatggtcgctatgttccattccacatacaagtgcctcagaaattctttgctatcaagaacctgttgcttctc

SEQ ID NO: 235544 - DNA, 75 bp, Artificial Sequence
  Synthetic
acttcagaaaggatgtgaacatggtcctgcagagttcccttggtaatgatctcagaactgatggagccagcatca

SEQ ID NO: 235545 - DNA, 75 bp, Artificial Sequence
  Synthetic
gacatcaagattcccaccgagtccatggaagtgcagaccgaacctgcaaagcccacagccacctccattgaggtg

SEQ ID NO: 235546 - DNA, 75 bp, Artificial Sequence
  Synthetic
gcccacagccacctccattgaggtgcagacggatccctggatgcccgcgcccgttgccgcccacagcaccactcg

SEQ ID NO: 235547 - DNA, 75 bp, Artificial Sequence
  Synthetic
atcttctgtctcgatggtggtcatgctgacgagcccccgcgggaggcaagtccagacctcggcgcgggaggggcg

SEQ ID NO: 235548 - DNA, 75 bp, Artificial Sequence
  Synthetic
tccgggttaccgaggcactcgctactaccgcagccggagcagcacctcccgccgccgcaaaacacctgcaagtcg

SEQ ID NO: 235549 - DNA, 75 bp, Artificial Sequence
  Synthetic
atgccaccaacattcccatttccattccatctcgcaactgggctgccttcaggggctggtccttcaccagactca

SEQ ID NO: 235550 - DNA, 75 bp, Artificial Sequence
  Synthetic
ataaaattatgtcagctgctgagtgttttattgcttcttgggtggggacttggatatataagtaggagcagatct

SEQ ID NO: 235551 - DNA, 75 bp, Artificial Sequence
  Synthetic
tgctgttccctaccagcacaacaactctggctttgtgggttacatggctcctaccatgcgacaggggcaagctta

SEQ ID NO: 235552 - DNA, 75 bp, Artificial Sequence
  Synthetic
tccccgaagtgttggccacctaccacatcttttttaagaaccaaaagattccagtctcctgccgcgccaaccgca

SEQ ID NO: 235553 - DNA, 75 bp, Artificial Sequence
  Synthetic
catcttttttaagaaccaaaagattccagtctcctgccgcgccaaccgcacccgcgccgatgccctgctcaactt

SEQ ID NO: 235554 - DNA, 75 bp, Artificial Sequence
  Synthetic
gtctcagcggcatttcgctgacatcgcccagggcttccaagcgctccatggcctcgtagaagtccacagcgaagt

SEQ ID NO: 235555 - DNA, 75 bp, Artificial Sequence
  Synthetic
cacggtcaactcctcctccagaagacggatgagttcggcgatggtggcgcgcacctcgcgctcgaaagcccccgg

SEQ ID NO: 235556 - DNA, 75 bp, Artificial Sequence
  Synthetic
cgcatcggcccgccaccttggacttgcctcctccccctgctgctgcagcgccagttcccaagcctgtcgctacca

SEQ ID NO: 235557 - DNA, 75 bp, Artificial Sequence
  Synthetic
attttactgcagagctgtttttcgattctactggtaatttactaactagactctcatccctcaaaactccactta

SEQ ID NO: 235558 - DNA, 75 bp, Artificial Sequence
  Synthetic
atggcccccgacaagctcgcctgcgccattgttaacacggccggtcgcgagacggggggagagcactggctggct

SEQ ID NO: 235559 - DNA, 75 bp, Artificial Sequence
  Synthetic
acctgttggttggaacctgaggatgattgggaagtggccattaggaattatgctaagatatctctgaggcctgat

SEQ ID NO: 235560 - DNA, 75 bp, Artificial Sequence
  Synthetic
ggaaccccaccgtggcccctacccacgatgtgaccaccgaccgtagccagcggctgatgctgcgctttgtgcccg

SEQ ID NO: 235561 - DNA, 75 bp, Artificial Sequence
  Synthetic
gcggatggtggcgaggagcaccaggtctttgggtccggcttgctggatgcgcaggcgatcggccattccccaagc

SEQ ID NO: 235562 - DNA, 75 bp, Artificial Sequence
  Synthetic
tggccagcaccttctttgacatcaggggggtgcttgacagaggtcccagtttcaagccatactctggcacagctt

SEQ ID NO: 235563 - DNA, 75 bp, Artificial Sequence
  Synthetic
ttcaagccatactctggcacagcttacaattccctggcgcctaagggcgcgcccaatacatgccagtggattgcc

SEQ ID NO: 235564 - DNA, 75 bp, Artificial Sequence
  Synthetic
ccacgaagcgatggtaggctccggtgttaatggtgtaggagcagttggccatgactgaccagttgactgtctggt

SEQ ID NO: 235565 - DNA, 75 bp, Artificial Sequence
  Synthetic
tcaatttatgcagacaaattgtatcagccagagccccaaattggcgatgaacaatggcatgacaccactggcact

SEQ ID NO: 235566 - DNA, 75 bp, Artificial Sequence
  Synthetic
acccaattctctcgaccatgaatcacttgagaatgaaaaatatctatagtagcacaacatagacataaatgcatg

SEQ ID NO: 235567 - DNA, 75 bp, Artificial Sequence
  Synthetic
cagatacacatattgtgtataaaccaggaacagatgaaactagttcctctgttaacttgggacagcaggcaatgc

SEQ ID NO: 235568 - DNA, 75 bp, Artificial Sequence
  Synthetic
acccgatcatttggtgcttgcctgcactggagcggagttcggttctagtggtgaagaaactgactaaagtgagta

SEQ ID NO: 235569 - DNA, 75 bp, Artificial Sequence
  Synthetic
ccaacagacccaactacattggttttagggacaacttcattggacttatgttttacaacagtaccggcaacatgg

SEQ ID NO: 235570 - DNA, 75 bp, Artificial Sequence
  Synthetic
agaggaggagatggaagattgggacagccaggcagaggaggtggacagcctggaggaagacagtttggaggagga

SEQ ID NO: 235571 - DNA, 75 bp, Artificial Sequence
  Synthetic
agcatcgttgccaattccagttcctctaataacccttcaaccctggctgaggacaagctacttgttctcttggct

SEQ ID NO: 235572 - DNA, 75 bp, Artificial Sequence
  Synthetic
ctacaagctaacctctggagaagttttctatattccaatgtggctctgtatttaccagacggttacaaatatacc

SEQ ID NO: 235573 - DNA, 75 bp, Artificial Sequence
  Synthetic
taggcgaactgtctaagcaggtggcccagttgcgtgagcaaactgagtctgctgttgccacagcaaagtctaaat

SEQ ID NO: 235574 - DNA, 75 bp, Artificial Sequence
  Synthetic
cagctaaaagtgggagggggacttacagtggatgacaccaacggttttttgaaagaaaacataagtgccaccaca

SEQ ID NO: 235575 - DNA, 75 bp, Artificial Sequence
  Synthetic
ctgttggtttaagaaatgggggccatactagtcgtgcttgctttactttcgcttttgggtctgggctctgctaat

SEQ ID NO: 235576 - DNA, 75 bp, Artificial Sequence
  Synthetic
ccactcgttaagactggtcactctataggtttaccactaggagccggattgggaacgaatgaaaataaactttgt

SEQ ID NO: 235577 - DNA, 75 bp, Artificial Sequence
  Synthetic
cgcaatgcaggcctgcgttaccgttccatgcttttaggaaatggtcgctatgtgcctttccacatccaagtgcct

SEQ ID NO: 235578 - DNA, 75 bp, Artificial Sequence
  Synthetic
ccatgcttttaggaaatggtcgctatgtgcctttccacatccaagtgcctcagaaattctttgctgtcaagaacc

SEQ ID NO: 235579 - DNA, 75 bp, Artificial Sequence
  Synthetic
tcaattcaaacaacatttgcattgatgacaatattaacaccttatggacaggagtcaaccccaccgaagccaact

SEQ ID NO: 235580 - DNA, 75 bp, Artificial Sequence
  Synthetic
tcatatcatagtagcctgacgaacaggtggataaatcagtctttccatcacaagacaagccacagggtctccagc

SEQ ID NO: 235581 - DNA, 75 bp, Artificial Sequence
  Synthetic
ctatgagtggaacttcagaaaggacgtaaacatggtcctgcaaagttcccttggtaatgatctcagaactgatgg

SEQ ID NO: 235582 - DNA, 75 bp, Artificial Sequence
  Synthetic
gtaaacatggtcctgcaaagttcccttggtaatgatctcagaactgatggtgctagcatcagttttaccagcatc

SEQ ID NO: 235583 - DNA, 75 bp, Artificial Sequence
  Synthetic
tttctgcagctaacatgctctaccctattccagccaatgcaaccaacatccccatttccattccctctcgcaatt

SEQ ID NO: 235584 - DNA, 75 bp, Artificial Sequence
  Synthetic
gctgtttctggtagtgcaacacagcagggacaatgaggcattcagggaggcgctgctgaacatcaccgagcccga

SEQ ID NO: 235585 - DNA, 75 bp, Artificial Sequence
  Synthetic
acatcatagttatgctcctgagtcaggtcatcataagccattttaataaactttgggcggagggtgccagattgg

SEQ ID NO: 235586 - DNA, 75 bp, Artificial Sequence
  Synthetic
aatatcctgcaaagtattatagtgcaggaacgcagcctaggtctggctgagaaagtggcagccatcaactactct

SEQ ID NO: 235587 - DNA, 75 bp, Artificial Sequence
  Synthetic
tcatattgtattcgtataacttggtcctggaacacaggagatgccccagaggtgcaaacctctgctacaacccta

SEQ ID NO: 235588 - DNA, 75 bp, Artificial Sequence
  Synthetic
gtttcacttccgcaatcccaacaagcgtcacttcctctttctcacggtgcgtcacatccgactaacttgcaagat

SEQ ID NO: 235589 - DNA, 75 bp, Artificial Sequence
  Synthetic
ggggtggagtttgtgacgtggcgcggggcgtgggaacggggcgggtgacgtagtagtgtggcggaagtgtgatgt

SEQ ID NO: 235590 - DNA, 75 bp, Artificial Sequence
  Synthetic
tcttgcatccgcataccccgcgccactgggtcgtcttcattcagccgccgcaccgtgcgcttacctcccttgccg

SEQ ID NO: 235591 - DNA, 75 bp, Artificial Sequence
  Synthetic
ttcgcgggaaaactgaataagaggaagtgaaatctgaataattttgtgttactcatagcgcgtaatatttgtcta

SEQ ID NO: 235592 - DNA, 75 bp, Artificial Sequence
  Synthetic
agtgaaatctgaataattttgtgttactcatagcgcgtaatatttgtctagggccgcggggactttgaccgttta

SEQ ID NO: 235593 - DNA, 75 bp, Artificial Sequence
  Synthetic
ctcaggtgttttccgcgttccgggtcaaagttggcgttttattattatagtcagctgacgtgtagtgtatttata

SEQ ID NO: 235594 - DNA, 75 bp, Artificial Sequence
  Synthetic
caaagttggcgttttattattatagtcagctgacgtgtagtgtatttatacccggtgagttcctcaagaggccac

SEQ ID NO: 235595 - DNA, 75 bp, Artificial Sequence
  Synthetic
tctcctccgagccgctccgacaccgggactgaaaatgagacatattatctgccacggaggtgttattaccgaaga

SEQ ID NO: 235596 - DNA, 75 bp, Artificial Sequence
  Synthetic
ggactgaaaatgagacatattatctgccacggaggtgttattaccgaagaaatggccgccagtcttttggaccag

SEQ ID NO: 235597 - DNA, 75 bp, Artificial Sequence
  Synthetic
atcttccacctcctagccattttgaaccacctacccttcacgaactgtatgatttagacgtgacggcccccgaag

SEQ ID NO: 235598 - DNA, 75 bp, Artificial Sequence
  Synthetic
accacctacccttcacgaactgtatgatttagacgtgacggcccccgaagatcccaacgaggaggcggtttcgca

SEQ ID NO: 235599 - DNA, 75 bp, Artificial Sequence
  Synthetic
gcggtgcaggaagggattgacttactcacttttccgccggcgcccggttctccggagccgcctcacctttcccgg

SEQ ID NO: 235600 - DNA, 75 bp, Artificial Sequence
  Synthetic
tcacttttccgccggcgcccggttctccggagccgcctcacctttcccggcagcccgagcagccggagcagagag

SEQ ID NO: 235601 - DNA, 75 bp, Artificial Sequence
  Synthetic
ccttgtaccggaggtgatcgatcttacctgccacgaggctggctttccacccagtgacgacgaggatgaagaggg

SEQ ID NO: 235602 - DNA, 75 bp, Artificial Sequence
  Synthetic
acctgccacgaggctggctttccacccagtgacgacgaggatgaagagggtgaggagtttgtgttagattatgtg

SEQ ID NO: 235603 - DNA, 75 bp, Artificial Sequence
  Synthetic
cttgtcattatcaccggaggaatacgggggacccagatattatgtgttcgctttgctatatgaggacctgtggca

SEQ ID NO: 235604 - DNA, 75 bp, Artificial Sequence
  Synthetic
tgtttgtctacagtaagtgaaaattatgggcagtgggtgatagagtggtgggtttggtgtggtaatttttttttt

SEQ ID NO: 235605 - DNA, 75 bp, Artificial Sequence
  Synthetic
aatttttacagttttgtggtttaaagaattttgtattgtgatttttttaaaaggtcctgtgtctgaacctgagcc

SEQ ID NO: 235606 - DNA, 75 bp, Artificial Sequence
  Synthetic
aatagtagtacggatagctgtgactccggtccttctaacacacctcctgagatacacccggtggtcccgctgtgc

SEQ ID NO: 235607 - DNA, 75 bp, Artificial Sequence
  Synthetic
ccggtccttctaacacacctcctgagatacacccggtggtcccgctgtgccccattaaaccagttgccgtgagag

SEQ ID NO: 235608 - DNA, 75 bp, Artificial Sequence
  Synthetic
atgtatcgaggacttgcttaacgagcctgggcaacctttggacttgagctgtaaacgccccaggccataaggtgt

SEQ ID NO: 235609 - DNA, 75 bp, Artificial Sequence
  Synthetic
gtaaacgccccaggccataaggtgtaaacctgtgattgcgtgtgtggttaacgcctttgtttgctgaatgagttg

SEQ ID NO: 235610 - DNA, 75 bp, Artificial Sequence
  Synthetic
aatgtttaacttgcatggcgtgttaaatggggcggggcttaaagggtatataatgcgccgtgggctaatcttggt

SEQ ID NO: 235611 - DNA, 75 bp, Artificial Sequence
  Synthetic
tacatctgacctcatggaggcttgggagtgtttggaagatttttctgctgtgcgtaacttgctggaacagagctc

SEQ ID NO: 235612 - DNA, 75 bp, Artificial Sequence
  Synthetic
tttctgtggggctcatcccaggcaaagttagtctgcagaattaaggaggattacaagtgggaatttgaagagctt

SEQ ID NO: 235613 - DNA, 75 bp, Artificial Sequence
  Synthetic
agttagtctgcagaattaaggaggattacaagtgggaatttgaagagcttttgaaatcctgtggtgagctgtttg

SEQ ID NO: 235614 - DNA, 75 bp, Artificial Sequence
  Synthetic
gcttttccaagagaaggtcatcaagactttggatttttccacaccggggcgcgctgcggctgctgttgctttttt

SEQ ID NO: 235615 - DNA, 75 bp, Artificial Sequence
  Synthetic
gcgctgcggctgctgttgcttttttgagttttataaaggataaatggagcgaagaaacccatctgagcggggggt

SEQ ID NO: 235616 - DNA, 75 bp, Artificial Sequence
  Synthetic
tgcgacgtcagacaacgggggagcgctccttttggcttccttccaggcgcggcggctgctgcgctagcttttttg

SEQ ID NO: 235617 - DNA, 75 bp, Artificial Sequence
  Synthetic
agagcccatggaacccgagagccggcctggaccctcgggaatgaatgttgtacaggtggctgaactgtatccaga

SEQ ID NO: 235618 - DNA, 75 bp, Artificial Sequence
  Synthetic
gatcaaggataattgcgctaatgagcttgatctgctggcgcagaagtattccatagagcagctgaccacttactg

SEQ ID NO: 235619 - DNA, 75 bp, Artificial Sequence
  Synthetic
ccatagagcagctgaccacttactggctgcagccaggggatgattttgaggaggctattagggtatatgcaaagg

SEQ ID NO: 235620 - DNA, 75 bp, Artificial Sequence
  Synthetic
caagatcagcaaacttgtaaatatcaggaattgttgctacatttctgggaacggggccgaggtggagatagatac

SEQ ID NO: 235621 - DNA, 75 bp, Artificial Sequence
  Synthetic
ggaggatagggtggcctttagatgtagcatgataaatatgtggccgggggtgcttggcatggacggggtggttat

SEQ ID NO: 235622 - DNA, 75 bp, Artificial Sequence
  Synthetic
aattttagcggtacggttttcctggccaataccaaccttatcctacacggtgtaagcttctatgggtttaacaat

SEQ ID NO: 235623 - DNA, 75 bp, Artificial Sequence
  Synthetic
tgtaagcttctatgggtttaacaatacctgtgtggaagcctggaccgatgtaagggttcggggctgtgcctttta

SEQ ID NO: 235624 - DNA, 75 bp, Artificial Sequence
  Synthetic
cgccccaaaagcagggcttcaattaagaaatgcctctttgaaaggtgtaccttgggtatcctgtctgagggtaac

SEQ ID NO: 235625 - DNA, 75 bp, Artificial Sequence
  Synthetic
acatagtagagcccgagggccgctggctgctcgatttgataaacattctgcagagcatagtggtgcaggagcgca

SEQ ID NO: 235626 - DNA, 75 bp, Artificial Sequence
  Synthetic
agctcggtcacgtgctctacggcatctcgatccagcatatctcctcgtttcgcgggttggggcggctttcgctgt

SEQ ID NO: 235627 - DNA, 75 bp, Artificial Sequence
  Synthetic
gcataacatactgacccgctgttccttgcatttgggtaacaggaggggggtgttcctaccttaccaatgcaattt

SEQ ID NO: 235628 - DNA, 75 bp, Artificial Sequence
  Synthetic
taggaaccagcctgtgatgctggatgtgaccgaggagctgaggcccgatcacttggtgctggcctgcacccgcgc

SEQ ID NO: 235629 - DNA, 75 bp, Artificial Sequence
  Synthetic
ccgccgccatgagcaccaactcgtttgatggaagcattgtgagctcatatttgacaacgcgcatgcccccatggg

SEQ ID NO: 235630 - DNA, 75 bp, Artificial Sequence
  Synthetic
tgatggaagcattgtgagctcatatttgacaacgcgcatgcccccatgggccggggtgcgtcagaatgtgatggg

SEQ ID NO: 235631 - DNA, 75 bp, Artificial Sequence
  Synthetic
ctgcccgcaaactctactaccttgacctacgagaccgtgtctggaacgccgttggagactgcagcctccgccgcc

SEQ ID NO: 235632 - DNA, 75 bp, Artificial Sequence
  Synthetic
cctacgagaccgtgtctggaacgccgttggagactgcagcctccgccgccgcttcagccgctgcagccaccgccc

SEQ ID NO: 235633 - DNA, 75 bp, Artificial Sequence
  Synthetic
cctgagcccgcttgcaagcagtgcagcttcccgttcatccgcccgcgatgacaagttgacggctcttttggcaca

SEQ ID NO: 235634 - DNA, 75 bp, Artificial Sequence
  Synthetic
gcatatcgagggcccggcgcacggcgtccggctcaccacccaggtagagcttacacgtagcctgattcgggagtt

SEQ ID NO: 235635 - DNA, 75 bp, Artificial Sequence
  Synthetic
actctgtttggatttggatcaagcaagtgtcttgctgtctttatttaggggttttgcgcgcgcggtaggcccggg

SEQ ID NO: 235636 - DNA, 75 bp, Artificial Sequence
  Synthetic
gtggaggtagcaccactgcagagcttcatgctgcggggtggtgttgtagatgatccagtcgtagcaggagcgctg

SEQ ID NO: 235637 - DNA, 75 bp, Artificial Sequence
  Synthetic
cgtttttacccacccaaagcagaccaaagcaaacctcacctccggtttgcacaagcgggccagtaagtaccttac

SEQ ID NO: 235638 - DNA, 75 bp, Artificial Sequence
  Synthetic
agtagcaagctgattgccaggggcaggcccttggtgtaagtgtttacaaagcggttaagctgggatgggtgcata

SEQ ID NO: 235639 - DNA, 75 bp, Artificial Sequence
  Synthetic
ggcccttggtgtaagtgtttacaaagcggttaagctgggatgggtgcatacgtggggatatgagatgcatcttgg

SEQ ID NO: 235640 - DNA, 75 bp, Artificial Sequence
  Synthetic
gcggttaagctgggatgggtgcatacgtggggatatgagatgcatcttggactgtatttttaggttggctatgtt

SEQ ID NO: 235641 - DNA, 75 bp, Artificial Sequence
  Synthetic
gaggcaaccctgaactacctgctgaccaaccggcggcagaagatcccctcgttgcacagtttaaacagcgaggag

SEQ ID NO: 235642 - DNA, 75 bp, Artificial Sequence
  Synthetic
atgttgtgcagaaccaccagcacagtgtatccggtgcacttgggaaatttgtcatgtagcttagaaggaaatgcg

SEQ ID NO: 235643 - DNA, 75 bp, Artificial Sequence
  Synthetic
tgtatccggtgcacttgggaaatttgtcatgtagcttagaaggaaatgcgtggaagaacttggagacgcccttgt

SEQ ID NO: 235644 - DNA, 75 bp, Artificial Sequence
  Synthetic
ctgcgcccacacctacagcctgagcgtaaccagacattactcccattttcccaaaacaggaggtgagctcaactc

SEQ ID NO: 235645 - DNA, 75 bp, Artificial Sequence
  Synthetic
gtccataatgatggcaatgggcccacgggcggcggcctgggcgaagatatttctgggatcactaacgtcatagtt

SEQ ID NO: 235646 - DNA, 75 bp, Artificial Sequence
  Synthetic
cgggcggcggcctgggcgaagatatttctgggatcactaacgtcatagttgtgttccaggatgagatcgtcatag

SEQ ID NO: 235647 - DNA, 75 bp, Artificial Sequence
  Synthetic
gggtgccagactgcggtataatggttccatccggcccaggggcgtagttaccctcacagatttgcatttcccacg

SEQ ID NO: 235648 - DNA, 75 bp, Artificial Sequence
  Synthetic
tgccttagggttgccgcctgctgcacgcacgtttgtacctattgtcagctttttaaacgctgggggcgacatcca

SEQ ID NO: 235649 - DNA, 75 bp, Artificial Sequence
  Synthetic
ccctcacagatttgcatttcccacgctttgagttcagatggggggatcatgtctacctgcggggcgatgaagaaa

SEQ ID NO: 235650 - DNA, 75 bp, Artificial Sequence
  Synthetic
gcggcggcggcggcaggagcagagcccatggaacccgagagccggcctggaccctcgggaatgaatgttgtacag

SEQ ID NO: 235651 - DNA, 75 bp, Artificial Sequence
  Synthetic
gctcgcccttgcggcagtctgcagcgctgtcaaaaaggttgagtttaaggaaccagcttgcaatgttacatttaa

SEQ ID NO: 235652 - DNA, 75 bp, Artificial Sequence
  Synthetic
gctgggaagaaagcaggttcctgagcagctgcgacttaccgcagccggtgggcccgtaaatcacacctattaccg

SEQ ID NO: 235653 - DNA, 75 bp, Artificial Sequence
  Synthetic
gcagctgccgtcatccctgagcaggggggccacttcgttaagcatgtccctgactcgcatgttttccctgaccaa

SEQ ID NO: 235654 - DNA, 75 bp, Artificial Sequence
  Synthetic
agcgatagcagttcttgcaaggaagcaaagtttttcaacggtttgagaccgtccgccgtaggcatgcttttgagc

SEQ ID NO: 235655 - DNA, 75 bp, Artificial Sequence
  Synthetic
tccagacgggccagggtcatgtctttccacgggcgcagggtcctcgtcagcgtagtctgggtcacggtgaagggg

SEQ ID NO: 235656 - DNA, 75 bp, Artificial Sequence
  Synthetic
agcttgcccttggaggaggcgccgcacgaggggcagtgcagacttttgagggcgtagagcttgggcgcgagaaat

SEQ ID NO: 235657 - DNA, 75 bp, Artificial Sequence
  Synthetic
acgaggggcagtgcagacttttgagggcgtagagcttgggcgcgagaaataccgattccggggagtaggcatccg

SEQ ID NO: 235658 - DNA, 75 bp, Artificial Sequence
  Synthetic
gcattccacgagccaggtgagctctggccgttcggggtcaaaaaccaggtttcccccatgctttttgatgcgttt

SEQ ID NO: 235659 - DNA, 75 bp, Artificial Sequence
  Synthetic
ggccgttcggggtcaaaaaccaggtttcccccatgctttttgatgcgtttcttacctctggtttccatgagccgg

SEQ ID NO: 235660 - DNA, 75 bp, Artificial Sequence
  Synthetic
tgtccgtgtccccgtatacagacttgagaggcctgtcctcgagcggtgttccgcggtcctcctcgtatagaaact

SEQ ID NO: 235661 - DNA, 75 bp, Artificial Sequence
  Synthetic
gagaggcctgtcctcgagcggtgttccgcggtcctcctcgtatagaaactcggaccactctgagacaaaggctcg

SEQ ID NO: 235662 - DNA, 75 bp, Artificial Sequence
  Synthetic
aagtgggaggggtagcggtcgttgtccactagggggtccactcgctccagggtgtgaagacacatgtcgccctct

SEQ ID NO: 235663 - DNA, 75 bp, Artificial Sequence
  Synthetic
cgaggaggatttgatattcacctggcccgcggtgatgcctttgagggtggccgcatccatctggtcagaaaagac

SEQ ID NO: 235664 - DNA, 75 bp, Artificial Sequence
  Synthetic
ccgcatccatctggtcagaaaagacaatctttttgttgtcaagcttggtggcaaacgacccgtagagggcgttgg

SEQ ID NO: 235665 - DNA, 75 bp, Artificial Sequence
  Synthetic
acagcaacttggcgatggagcgcagggtttggtttttgtcgcgatcggcgcgctccttggccgcgatgtttagct

SEQ ID NO: 235666 - DNA, 75 bp, Artificial Sequence
  Synthetic
ccattcgggaaagacggtggtgcgctcgtcgggcaccaggtgcacgcgccaaccgcggttgtgcagggtgacaag

SEQ ID NO: 235667 - DNA, 75 bp, Artificial Sequence
  Synthetic
cgtaggcgctcgttggtccagcagaggcggccgcccttgcgcgagcagaatggcggtagggggtctagctgcgtc

SEQ ID NO: 235668 - DNA, 75 bp, Artificial Sequence
  Synthetic
ggcggccgcccttgcgcgagcagaatggcggtagggggtctagctgcgtctcgtccggggggtctgcgtccacgg

SEQ ID NO: 235669 - DNA, 75 bp, Artificial Sequence
  Synthetic
gtcgaagtagtctatcttgcatccttgcaagtctagcgcctgctgccatgcgcgggcggcaagcgcgcgctcgta

SEQ ID NO: 235670 - DNA, 75 bp, Artificial Sequence
  Synthetic
tgcaagtctagcgcctgctgccatgcgcgggcggcaagcgcgcgctcgtatgggttgagtgggggaccccatggc

SEQ ID NO: 235671 - DNA, 75 bp, Artificial Sequence
  Synthetic
acatgccgcaaatgtcgtaaacgtagaggggctctctgagtattccaagatatgtagggtagcatcttccaccgc

SEQ ID NO: 235672 - DNA, 75 bp, Artificial Sequence
  Synthetic
gatatggttggacgctggaagacgttgaagctggcgtctgtgagacctaccgcgtcacgcacgaaggaggcgtag

SEQ ID NO: 235673 - DNA, 75 bp, Artificial Sequence
  Synthetic
tgaagctggcgtctgtgagacctaccgcgtcacgcacgaaggaggcgtaggagtcgcgcagcttgttgaccagct

SEQ ID NO: 235674 - DNA, 75 bp, Artificial Sequence
  Synthetic
gcagtagtccagggtttccttgatgatgtcatacttatcctgtcccttttttttccacagctcgcggttgaggac

SEQ ID NO: 235675 - DNA, 75 bp, Artificial Sequence
  Synthetic
atgtcatacttatcctgtcccttttttttccacagctcgcggttgaggacaaactcttcgcggtctttccagtac

SEQ ID NO: 235676 - DNA, 75 bp, Artificial Sequence
  Synthetic
gcgccagaccgtctgaagacaccttcaaccccgtgtatccatatgacacagaaaccgggcctccaactgtgccct

SEQ ID NO: 235677 - DNA, 75 bp, Artificial Sequence
  Synthetic
acaaggccctgggcatagtctcgccgcgcgtcctatcgagccgcactttttgagcaaacatgtcaatccttatat

SEQ ID NO: 235678 - DNA, 75 bp, Artificial Sequence
  Synthetic
caatggtttccaagaaagtccccctggagttctctctctacgcgtctccgaacctttggacacctcccacggcat

SEQ ID NO: 235679 - DNA, 75 bp, Artificial Sequence
  Synthetic
ccgaacggtaagagcctagcatgtagaactggttgacggcctggtaggcgcagcatcccttttctacgggtagcg

SEQ ID NO: 235680 - DNA, 75 bp, Artificial Sequence
  Synthetic
gaactggttgacggcctggtaggcgcagcatcccttttctacgggtagcgcgtatgcctgcgcggccttccggag

SEQ ID NO: 235681 - DNA, 75 bp, Artificial Sequence
  Synthetic
gcttgcgcttaaaatgggcagcggtcttaccctagacaaggccggaaacctcacctcccaaaatgtaaccactgt

SEQ ID NO: 235682 - DNA, 75 bp, Artificial Sequence
  Synthetic
tccctgaccatgactttgaggtactggtatttgaagtcagtgtcgtcgcatccgccctgctcccagagcaaaaag

SEQ ID NO: 235683 - DNA, 75 bp, Artificial Sequence
  Synthetic
tccaacataagtttggacacctccgcaccacttacaattacctcaggcgccctaacagtggcaaccaccgctcct

SEQ ID NO: 235684 - DNA, 75 bp, Artificial Sequence
  Synthetic
tccgccctgctcccagagcaaaaagtccgtgcgctttttggaacgcggatttggcagggcgaaggtgacatcgtt

SEQ ID NO: 235685 - DNA, 75 bp, Artificial Sequence
  Synthetic
caccacttacaattacctcaggcgccctaacagtggcaaccaccgctcctctgatagttactagcggcgctctta

SEQ ID NO: 235686 - DNA, 75 bp, Artificial Sequence
  Synthetic
ataaagttgcgtgtgatgcggaagggtcccggcacctcggaacggttgttaattacctgggcggcgagcacgatc

SEQ ID NO: 235687 - DNA, 75 bp, Artificial Sequence
  Synthetic
cgtgcaagactccaaactaagcattgctactaaagggcccattacagtgtcagatggaaagctagccctgcaaac

SEQ ID NO: 235688 - DNA, 75 bp, Artificial Sequence
  Synthetic
aattacctgggcggcgagcacgatctcgtcaaagccgttgatgttgtggcccacaatgtaaagttccaagaagcg

SEQ ID NO: 235689 - DNA, 75 bp, Artificial Sequence
  Synthetic
gctactaaagggcccattacagtgtcagatggaaagctagccctgcaaacatcagcccccctctctggcagtgac

SEQ ID NO: 235690 - DNA, 75 bp, Artificial Sequence
  Synthetic
cacccccgctaactactgccacgggtagcttgggcattaacatggaagatcctatttatgtaaataatggaaaaa

SEQ ID NO: 235691 - DNA, 75 bp, Artificial Sequence
  Synthetic
tagcttgggcattaacatggaagatcctatttatgtaaataatggaaaaataggaattaaaataagcggtccttt

SEQ ID NO: 235692 - DNA, 75 bp, Artificial Sequence
  Synthetic
cttcaggggagctgagcccgtgctctgaaagggcccagtctgcaagatgagggttggaagcgacgaatgagctcc

SEQ ID NO: 235693 - DNA, 75 bp, Artificial Sequence
  Synthetic
ctaacagtagttactggaccaggtgtcaccgttgaacaaaactcccttagaaccaaagttgcaggagctattggt

SEQ ID NO: 235694 - DNA, 75 bp, Artificial Sequence
  Synthetic
caggtggtcgcgaaaggtcctaaactggcgacctatggccattttttctggggtgatgcagtagaaggtaagcgg

SEQ ID NO: 235695 - DNA, 75 bp, Artificial Sequence
  Synthetic
tggcgacctatggccattttttctggggtgatgcagtagaaggtaagcgggtcttgttcccagcggtcccatcca

SEQ ID NO: 235696 - DNA, 75 bp, Artificial Sequence
  Synthetic
tcaccgttgaacaaaactcccttagaaccaaagttgcaggagctattggttatgattcatcaaacaacatggaaa

SEQ ID NO: 235697 - DNA, 75 bp, Artificial Sequence
  Synthetic
aaataacaacttactaattctagatgtggattacccatttgatgctcaaacaaaactacgtcttaaactggggca

SEQ ID NO: 235698 - DNA, 75 bp, Artificial Sequence
  Synthetic
gtggattacccatttgatgctcaaacaaaactacgtcttaaactggggcagggacctctgtatattaatgcatct

SEQ ID NO: 235699 - DNA, 75 bp, Artificial Sequence
  Synthetic
gaggcctatacctttttaatgcatcaaacaatactaaaaaactggaagttagcataaaaaaatccagtggactaa

SEQ ID NO: 235700 - DNA, 75 bp, Artificial Sequence
  Synthetic
aaacaatactaaaaaactggaagttagcataaaaaaatccagtggactaaactttgataatactgccatagctat

SEQ ID NO: 235701 - DNA, 75 bp, Artificial Sequence
  Synthetic
ggatctcccgccaccaattggaggagtggctattgatgtggtgaaagtagaagtccctgcgacgggccgaacact

SEQ ID NO: 235702 - DNA, 75 bp, Artificial Sequence
  Synthetic
gatacaaacacatctgagtctccagatatcaacccaataaaaactaaaattggctctggcattgattacaatgaa

SEQ ID NO: 235703 - DNA, 75 bp, Artificial Sequence
  Synthetic
gcagtactggcagcggtgcacgggctgtacatcctgcacgaggttgacctgacgaccgcgcacaaggaagcagag

SEQ ID NO: 235704 - DNA, 75 bp, Artificial Sequence
  Synthetic
atatcaacccaataaaaactaaaattggctctggcattgattacaatgaaaacggtgccatgattactaaacttg

SEQ ID NO: 235705 - DNA, 75 bp, Artificial Sequence
  Synthetic
gacgaccgcgcacaaggaagcagagtgggaatttgagcccctcgcctggcgggtttggctggtggtcttctactt

SEQ ID NO: 235706 - DNA, 75 bp, Artificial Sequence
  Synthetic
aggggccattacaataggaaacaaaaatgatgacaaacttaccctgtggacaaccccagacccatctcctaactg

SEQ ID NO: 235707 - DNA, 75 bp, Artificial Sequence
  Synthetic
aatgatgacaaacttaccctgtggacaaccccagacccatctcctaactgcagaattcattcagataatgactgc

SEQ ID NO: 235708 - DNA, 75 bp, Artificial Sequence
  Synthetic
ctgctcgaggggagttacggtggatcggaccaccacgccgcgcgagcccaaagtccagatgtccgcgcgcggcgg

SEQ ID NO: 235709 - DNA, 75 bp, Artificial Sequence
  Synthetic
gtgggagtcaagtactagctactgtagctgctttggctgtatctggagatctttcatccatgacaggcaccgttg

SEQ ID NO: 235710 - DNA, 75 bp, Artificial Sequence
  Synthetic
agctgctttggctgtatctggagatctttcatccatgacaggcaccgttgcaagtgttagtatattccttagatt

SEQ ID NO: 235711 - DNA, 75 bp, Artificial Sequence
  Synthetic
aactcctcacttaaaaaacattactggaactttagaaatgggaactcaactaatgcaaatccatacacaaatgca

SEQ ID NO: 235712 - DNA, 75 bp, Artificial Sequence
  Synthetic
ctggttggtggcggcgtcgatggcttgcaagaggccgcatccccgcggcgcgactacggtaccgcgcggcgggcg

SEQ ID NO: 235713 - DNA, 75 bp, Artificial Sequence
  Synthetic
ggaactttagaaatgggaactcaactaatgcaaatccatacacaaatgcagttggatttatgcctaaccttctag

SEQ ID NO: 235714 - DNA, 75 bp, Artificial Sequence
  Synthetic
ccaggtgatacctaatttccaggggctggttggtggcggcgtcgatggcttgcaagaggccgcatccccgcggcg

SEQ ID NO: 235715 - DNA, 75 bp, Artificial Sequence
  Synthetic
tgctaaaaataacattgtcagtcaagtttacttgcatggtgataaaactaaacctatgatacttaccattacact

SEQ ID NO: 235716 - DNA, 75 bp, Artificial Sequence
  Synthetic
taatggcactagtgaatccacagaaactagcgaggtaagcacttactctatgtcttttacatggtcctgggaaag

SEQ ID NO: 235717 - DNA, 75 bp, Artificial Sequence
  Synthetic
acgagcgactacccgacgccgaaccaccactggaacccgccgccgccgtcgccgtcgccagcccgtgctggcccc

SEQ ID NO: 235718 - DNA, 75 bp, Artificial Sequence
  Synthetic
acgtctcctgagttgtcttgataggcgatctcggccatgaactgctcgatctcttcctcctggagatctccgcgt

SEQ ID NO: 235719 - DNA, 75 bp, Artificial Sequence
  Synthetic
cgatctcggccatgaactgctcgatctcttcctcctggagatctccgcgtccggctcgctccacggtggcggcga

SEQ ID NO: 235720 - DNA, 75 bp, Artificial Sequence
  Synthetic
ctgcgagaaggcgttgaggcctccctcgttccagacgcggctgtagaccacgcccccttcggcatcgcgggcgcg

SEQ ID NO: 235721 - DNA, 75 bp, Artificial Sequence
  Synthetic
tcgttccagacgcggctgtagaccacgcccccttcggcatcgcgggcgcgcatgaccacctgcgcgagattgagc

SEQ ID NO: 235722 - DNA, 75 bp, Artificial Sequence
  Synthetic
agtttcgcaggcgctgaaagaggtagttgagggtggtggcggtgtgttctgccacgaagaagtacataacccagc

SEQ ID NO: 235723 - DNA, 75 bp, Artificial Sequence
  Synthetic
cgatcatctccccgcggcgacggcgcatggtctcggtgacggcgcggccgttctcgcgggggcgcagttggaaga

SEQ ID NO: 235724 - DNA, 75 bp, Artificial Sequence
  Synthetic
ggttggcggggggctgccatgcggcagggatacggcgctaacgatgcatctcaacaattgttgtgtaggtactcc

SEQ ID NO: 235725 - DNA, 75 bp, Artificial Sequence
  Synthetic
agggatacggcgctaacgatgcatctcaacaattgttgtgtaggtactccgccgccgagggacctgagcgagtcc

SEQ ID NO: 235726 - DNA, 75 bp, Artificial Sequence
  Synthetic
gccgccgagggacctgagcgagtccgcatcgaccggatcggaaaacctctcgagaaaggcgtctaaccagtcaca

SEQ ID NO: 235727 - DNA, 75 bp, Artificial Sequence
  Synthetic
gtcgcaaggtaggctgagcaccgtggcgggcggcagcgggcggcggtcggggttgtttctggcggaggtgctgct

SEQ ID NO: 235728 - DNA, 75 bp, Artificial Sequence
  Synthetic
gcgggcggcagcgggcggcggtcggggttgtttctggcggaggtgctgctgatgatgtaattaaagtaggcggtc

SEQ ID NO: 235729 - DNA, 75 bp, Artificial Sequence
  Synthetic
gcaccatgtccttgggtccggcctgctgaatgcgcaggcggtcggccatgccccaggcttcgttttgacatcggc

SEQ ID NO: 235730 - DNA, 75 bp, Artificial Sequence
  Synthetic
ctgaatgcgcaggcggtcggccatgccccaggcttcgttttgacatcggcgcaggtctttgtagtagtcttgcat

SEQ ID NO: 235731 - DNA, 75 bp, Artificial Sequence
  Synthetic
tctccttcctcttgtcctgcatctcttgcatctatcgctgcggcggcggcggagtttggccgtaggtggcgccct

SEQ ID NO: 235732 - DNA, 75 bp, Artificial Sequence
  Synthetic
aatatggcctgctgcacctgcgtgagggtagactggaagtcatccatgtccacaaagcggtggtatgcgcccgtg

SEQ ID NO: 235733 - DNA, 75 bp, Artificial Sequence
  Synthetic
caccaggtactggtatcccaccaaaaagtgcggcggcggctggcggtagaggggccagcgtagggtggccggggc

SEQ ID NO: 235734 - DNA, 75 bp, Artificial Sequence
  Synthetic
cggacgcggttccagatgttgcgcagcggcaaaaagtgctccatggtcgggacgctctggccggtcaggcgcgcg

SEQ ID NO: 235735 - DNA, 75 bp, Artificial Sequence
  Synthetic
aaaaggagagcctgtaagcgggcactcttccgtggtctggtggataaattcgcaagggtatcatggcggacgacc

SEQ ID NO: 235736 - DNA, 75 bp, Artificial Sequence
  Synthetic
ggggttcgagccccgtatccggccgtccgccgtgatccatgcggttaccgcccgcgtgtcgaacccaggtgtgcg

SEQ ID NO: 235737 - DNA, 75 bp, Artificial Sequence
  Synthetic
ctggccgcgcgcagcgtaagcggttaggctggaaagcgaaagcattaagtggctcgctccctgtagccggagggt

SEQ ID NO: 235738 - DNA, 75 bp, Artificial Sequence
  Synthetic
tgcatccggtgctgcggcagatgcgcccccctcctcagcagcggcaagagcaagagcagcggcagacatgcaggg

SEQ ID NO: 235739 - DNA, 75 bp, Artificial Sequence
  Synthetic
ccccgcggcgccgggcccggcactacctggacttggaggagggcgagggcctggcgcggctaggagcgccctctc

SEQ ID NO: 235740 - DNA, 75 bp, Artificial Sequence
  Synthetic
cgaggaggtggctataggactgatgcatctgtgggactttgtaagcgcgctggagcaaaacccaaatagcaagcc

SEQ ID NO: 235741 - DNA, 75 bp, Artificial Sequence
  Synthetic
tggagcaaaacccaaatagcaagccgctcatggcgcagctgttccttatagtgcagcacagcagggacaacgagg

SEQ ID NO: 235742 - DNA, 75 bp, Artificial Sequence
  Synthetic
ctcgatttgataaacatcctgcagagcatagtggtgcaggagcgcagcttgagcctggctgacaaggtggccgcc

SEQ ID NO: 235743 - DNA, 75 bp, Artificial Sequence
  Synthetic
gcaagttttacgcccgcaagatataccataccccttacgttcccatagacaaggaggtaaagatcgaggggttct

SEQ ID NO: 235744 - DNA, 75 bp, Artificial Sequence
  Synthetic
ccataccccttacgttcccatagacaaggaggtaaagatcgaggggttctacatgcgcatggcgctgaaggtgct

SEQ ID NO: 235745 - DNA, 75 bp, Artificial Sequence
  Synthetic
tatcgcaacgagcgcatccacaaggccgtgagcgtgagccggcggcgcgagctcagcgaccgcgagctgatgcac

SEQ ID NO: 235746 - DNA, 75 bp, Artificial Sequence
  Synthetic
gtcctactttgacgcgggcgctgacctgcgctgggccccaagccgacgcgccctggaggcagctggggccggacc

SEQ ID NO: 235747 - DNA, 75 bp, Artificial Sequence
  Synthetic
ctgcgctgggccccaagccgacgcgccctggaggcagctggggccggacctgggctggcggtggcacccgcgcgc

SEQ ID NO: 235748 - DNA, 75 bp, Artificial Sequence
  Synthetic
aatatgacgaggacgatgagtacgagccagaggacggcgagtactaagcggtgatgtttctgatcagatgatgca

SEQ ID NO: 235749 - DNA, 75 bp, Artificial Sequence
  Synthetic
gccagaggacggcgagtactaagcggtgatgtttctgatcagatgatgcaagacgcaacggacccggcggtgcgg

SEQ ID NO: 235750 - DNA, 75 bp, Artificial Sequence
  Synthetic
gccttaactccacggacgactggcgccaggtcatggaccgcatcatgtcgctgactgcgcgcaatcctgacgcgt

SEQ ID NO: 235751 - DNA, 75 bp, Artificial Sequence
  Synthetic
taatggtgactgagacaccgcaaagtgaggtgtaccagtctgggccagactattttttccagaccagtagacaag

SEQ ID NO: 235752 - DNA, 75 bp, Artificial Sequence
  Synthetic
accgcgcgaccgtgtctagcttgctgacgcccaactcgcgcctgttgctgctgctaatagcgcccttcacggaca

SEQ ID NO: 235753 - DNA, 75 bp, Artificial Sequence
  Synthetic
gcaaggcctggccagtgtttgagcacaacatactgacccgctgttccttgcatttgggtaacaggaggggggtgt

SEQ ID NO: 235754 - DNA, 75 bp, Artificial Sequence
  Synthetic
gtttctacaccgggggattcgaggtgcccgagggtaacgatggattcctctgggacgacatagacgacagcgtgt

SEQ ID NO: 235755 - DNA, 75 bp, Artificial Sequence
  Synthetic
tgggacgacatagacgacagcgtgttttccccgcaaccgcagaccctgctagagttgcaacagcgcgagcaggca

SEQ ID NO: 235756 - DNA, 75 bp, Artificial Sequence
  Synthetic
cctgcctccggcatttcccaacaacgggatagagagcctagtggacaagatgagtagatggaagacgtacgcgca

SEQ ID NO: 235757 - DNA, 75 bp, Artificial Sequence
  Synthetic
cgcccgcccacccgtcgtcaaaggcacgaccgtcagcggggtctggtgtgggaggacgatgactcggcagacgac

SEQ ID NO: 235758 - DNA, 75 bp, Artificial Sequence
  Synthetic
acgaccgtcagcggggtctggtgtgggaggacgatgactcggcagacgacagcagcgtcctggatttgggaggga

SEQ ID NO: 235759 - DNA, 75 bp, Artificial Sequence
  Synthetic
agcagcgtcctggatttgggagggagtggcaacccgtttgcgcaccttcgccccaggctggggagaatgttttaa

SEQ ID NO: 235760 - DNA, 75 bp, Artificial Sequence
  Synthetic
aaaaactcaccaaggccatggcaccgagcgttggttttcttgtattccccttagtatgcggcgcgcggcgatgta

SEQ ID NO: 235761 - DNA, 75 bp, Artificial Sequence
  Synthetic
aagatgatgatgatgaacttgacgacgaggtggaactgttgcacgcgaccgcgcccaggcggcgggtacagtgga

SEQ ID NO: 235762 - DNA, 75 bp, Artificial Sequence
  Synthetic
ttagtatgcggcgcgcggcgatgtatgaggaaggtcctcctccctcctacgagagtgtggtgagcgcggcgccag

SEQ ID NO: 235763 - DNA, 75 bp, Artificial Sequence
  Synthetic
cgatgctcccctggacccgccgtttgtgcctccgcggtacctgcggcctaccggggggagaaacagcatccgtta

SEQ ID NO: 235764 - DNA, 75 bp, Artificial Sequence
  Synthetic
gtgcctccgcggtacctgcggcctaccggggggagaaacagcatccgttactctgagttggcacccctattcgac

SEQ ID NO: 235765 - DNA, 75 bp, Artificial Sequence
  Synthetic
acaagtcaacggatgtggcatccctgaactaccagaacgaccacagcaactttctgaccacggtcattcaaaaca

SEQ ID NO: 235766 - DNA, 75 bp, Artificial Sequence
  Synthetic
gaactaccagaacgaccacagcaactttctgaccacggtcattcaaaacaatgactacagcccgggggaggcaag

SEQ ID NO: 235767 - DNA, 75 bp, Artificial Sequence
  Synthetic
cggtcgcactggggcggcgacctgaaaaccatcctgcataccaacatgccaaatgtgaacgagttcatgtttacc

SEQ ID NO: 235768 - DNA, 75 bp, Artificial Sequence
  Synthetic
aaaccatcctgcataccaacatgccaaatgtgaacgagttcatgtttaccaataagtttaaggcgcgggtgatgg

SEQ ID NO: 235769 - DNA, 75 bp, Artificial Sequence
  Synthetic
agactggggtttgaccccgtcactggtcttgtcatgcctggggtatatacaaacgaagccttccatccagacatc

SEQ ID NO: 235770 - DNA, 75 bp, Artificial Sequence
  Synthetic
gtcttgtcatgcctggggtatatacaaacgaagccttccatccagacatcattttgctgccaggatgcggggtgg

SEQ ID NO: 235771 - DNA, 75 bp, Artificial Sequence
  Synthetic
aggcggcagcaacagcagtggcagcggcgcggaagagaactccaacgcggcagccgcggcaatgcagccggtgga

SEQ ID NO: 235772 - DNA, 75 bp, Artificial Sequence
  Synthetic
ggcgcggaagagaactccaacgcggcagccgcggcaatgcagccggtggaggacatgaacgatcatgccattcgc

SEQ ID NO: 235773 - DNA, 75 bp, Artificial Sequence
  Synthetic
tacaacctaataagcaatgacagcaccttcacccagtaccgcagctggtaccttgcatacaactacggcgaccct

SEQ ID NO: 235774 - DNA, 75 bp, Artificial Sequence
  Synthetic
tgctttgcactcctgacgtaacctgcggctcggagcaggtctactggtcgttgccagacatgatgcaagaccccg

SEQ ID NO: 235775 - DNA, 75 bp, Artificial Sequence
  Synthetic
cagcaactttccggtggtgggcgccgagctgttgcccgtgcactccaagagcttctacaacgaccaggccgtcta

SEQ ID NO: 235776 - DNA, 75 bp, Artificial Sequence
  Synthetic
gcttctacaacgaccaggccgtctactcccaactcatccgccagtttacctctctgacccacgtgttcaatcgct

SEQ ID NO: 235777 - DNA, 75 bp, Artificial Sequence
  Synthetic
cagatcacgggacgctaccgctgcgcaacagcatcggaggagtccagcgagtgaccattactgacgccagacgcc

SEQ ID NO: 235778 - DNA, 75 bp, Artificial Sequence
  Synthetic
ctatcgagccgcactttttgagcaagcatgtccatccttatatcgcccagcaataacacaggctggggcctgcgc

SEQ ID NO: 235779 - DNA, 75 bp, Artificial Sequence
  Synthetic
ttcccaagcaagatgtttggcggggccaagaagcgctccgaccaacacccagtgcgcgtgcgcgggcactaccgc

SEQ ID NO: 235780 - DNA, 75 bp, Artificial Sequence
  Synthetic
gccgcactgggcgcaccaccgtcgatgacgccatcgacgcggtggtggaggaggcgcgcaactacacgcccacgc

SEQ ID NO: 235781 - DNA, 75 bp, Artificial Sequence
  Synthetic
gcccggcgctatgctaaaatgaagagacggcggaggcgcgtagcacgtcgccaccgccgccgacccggcactgcc

SEQ ID NO: 235782 - DNA, 75 bp, Artificial Sequence
  Synthetic
ttaaccgcgcacgtcgcaccggccgacgggcggccatgcgggccgctcgaaggctggccgcgggtattgtcactg

SEQ ID NO: 235783 - DNA, 75 bp, Artificial Sequence
  Synthetic
aagacggtggtgcgctcgtcgggcaccaggcgcacgcgccaaccgcggttgtgcagggtgacgaggtcaacgctg

SEQ ID NO: 235784 - DNA, 75 bp, Artificial Sequence
  Synthetic
agcgcaaaatcaaagaagagatgctccaggtcatcgcgccggagatctatggccccccgaagaaggaagagcagg

SEQ ID NO: 235785 - DNA, 75 bp, Artificial Sequence
  Synthetic
cgcgtaaaacgtgttttgcgacccggcaccaccgtagtctttacgcccggtgagcgctccacccgcacctacaag

SEQ ID NO: 235786 - DNA, 75 bp, Artificial Sequence
  Synthetic
gcaccaccgtagtctttacgcccggtgagcgctccacccgcacctacaagcgcgtgtatgatgaggtgtacggcg

SEQ ID NO: 235787 - DNA, 75 bp, Artificial Sequence
  Synthetic
aatactacctctttgaacgaccggcaaggcaatgctactaaaccaaaagtggttttgtacagtgaagatgtaaat

SEQ ID NO: 235788 - DNA, 75 bp, Artificial Sequence
  Synthetic
cgagcgcctcggggagtttgcctacggaaagcggcataaggacatgctggcgttgccgctggacgagggcaaccc

SEQ ID NO: 235789 - DNA, 75 bp, Artificial Sequence
  Synthetic
ctggagcccgaggtccgcgtgcggccaatcaagcaggtggcgccgggactgggcgtgcagaccgtggacgttcag

SEQ ID NO: 235790 - DNA, 75 bp, Artificial Sequence
  Synthetic
cggtcgctgcggccgcgtccaagacctctacggaggtgcaaacggacccgtggatgtttcgcgtttcagcccccc

SEQ ID NO: 235791 - DNA, 75 bp, Artificial Sequence
  Synthetic
ccagcccgtgctggccccgatttccgtgcgcagggtggctcgcgaaggaggcaggaccctggtgctgccaacagc

SEQ ID NO: 235792 - DNA, 75 bp, Artificial Sequence
  Synthetic
gtgcgcagggtggctcgcgaaggaggcaggaccctggtgctgccaacagcgcgctaccaccccagcatcgtttaa

SEQ ID NO: 235793 - DNA, 75 bp, Artificial Sequence
  Synthetic
atatggccctcacctgccgcctccgtttcccggtgccgggattccgaggaagaatgcaccgtaggaggggcatgg

SEQ ID NO: 235794 - DNA, 75 bp, Artificial Sequence
  Synthetic
gcgtcgtgcgcaccaccggcggcggcgcgcgtcgcaccgtcgcatgcgcggcggtatcctgcccctccttattcc

SEQ ID NO: 235795 - DNA, 75 bp, Artificial Sequence
  Synthetic
aataaaaagtctggactctcacgctcgcttggtcctgtaactattttgtagaatggaagacatcaactttgcgtc

SEQ ID NO: 235796 - DNA, 75 bp, Artificial Sequence
  Synthetic
ccgttcatgggaaactggcaagatatcggcaccagcaatatgagcggtggcgccttcagctggggctcgctgtgg

SEQ ID NO: 235797 - DNA, 75 bp, Artificial Sequence
  Synthetic
tagaggctcatctccgccgaacttcatgaccagcatgaagggcacgagctgcttcccaaaggcccccatccaagt

SEQ ID NO: 235798 - DNA, 75 bp, Artificial Sequence
  Synthetic
ccgttaagaactatggcagcaaggcctggaacagcagcacaggccagatgctgagggataagttgaaagagcaaa

SEQ ID NO: 235799 - DNA, 75 bp, Artificial Sequence
  Synthetic
cctggcctctggcattagcggggtggtggacctggccaaccaggcagtgcaaaataagattaacagtaagcttga

SEQ ID NO: 235800 - DNA, 75 bp, Artificial Sequence
  Synthetic
ggttgacagtattacccagaaaaagtttctttgcgatcgcaccctttggcgcatcccattctccagtaactttat

SEQ ID NO: 235801 - DNA, 75 bp, Artificial Sequence
  Synthetic
ccaccggccgtggagacagtgtctccagaggggcgtggcgaaaagcgtccgcgccccgacagggaagaaactctg

SEQ ID NO: 235802 - DNA, 75 bp, Artificial Sequence
  Synthetic
cgtacgaggaggcactaaagcaaggcctgcccaccacccgtcccatcgcgcccatggctaccggagtgctgggcc

SEQ ID NO: 235803 - DNA, 75 bp, Artificial Sequence
  Synthetic
cgcgtccctgcgccgcgccgccagcggtccgcgatcgttgcggcccgtagccagtggcaactggcaaagcacact

SEQ ID NO: 235804 - DNA, 75 bp, Artificial Sequence
  Synthetic
gtgtcatgtatgcgtccatgtcgccgccagaggagctgctgagccgccgcgcgcccgctttccaagatggctacc

SEQ ID NO: 235805 - DNA, 75 bp, Artificial Sequence
  Synthetic
tagaaaccccacggtggcgcctacgcacgacgtgaccacagaccggtcccagcgtttgacgctgcggttcatccc

SEQ ID NO: 235806 - DNA, 75 bp, Artificial Sequence
  Synthetic
tgtggaccgtgaggatactgcgtactcgtacaaggcgcggttcaccctagctgtgggtgataaccgtgtgctgga

SEQ ID NO: 235807 - DNA, 75 bp, Artificial Sequence
  Synthetic
cttttaagccctactctggcactgcctacaacgccctggctcccaagggtgccccaaatccttgcgaatgggatg

SEQ ID NO: 235808 - DNA, 75 bp, Artificial Sequence
  Synthetic
cctagaagaagaggacgatgacaacgaagacgaagtagacgagcaagctgagcagcaaaaaactcacgtatttgg

SEQ ID NO: 235809 - DNA, 75 bp, Artificial Sequence
  Synthetic
gaagacgaagtagacgagcaagctgagcagcaaaaaactcacgtatttgggcaggcgccttattctggtataaat

SEQ ID NO: 235810 - DNA, 75 bp, Artificial Sequence
  Synthetic
gtgtcgaaggtcaaacacctaaatatgccgataaaacatttcaacctgaacctcaaataggagaatctcagtggt

SEQ ID NO: 235811 - DNA, 75 bp, Artificial Sequence
  Synthetic
tgccgataaaacatttcaacctgaacctcaaataggagaatctcagtggtacgaaactgaaattaatcatgcagc

SEQ ID NO: 235812 - DNA, 75 bp, Artificial Sequence
  Synthetic
ccaatgaaaccatgttacggttcatatgcaaaacccacaaatgaaaatggagggcaaggcattcttgtaaagcaa

SEQ ID NO: 235813 - DNA, 75 bp, Artificial Sequence
  Synthetic
atgcaaaacccacaaatgaaaatggagggcaaggcattcttgtaaagcaacaaaatggaaagctagaaagtcaag

SEQ ID NO: 235814 - DNA, 75 bp, Artificial Sequence
  Synthetic
tgaggcgaccgcaggcaatggtgataacttgactcctaaagtggtattgtacagtgaagatgtagatatagaaac

SEQ ID NO: 235815 - DNA, 75 bp, Artificial Sequence
  Synthetic
aacttgactcctaaagtggtattgtacagtgaagatgtagatatagaaaccccagacactcatatttcttacatg

SEQ ID NO: 235816 - DNA, 75 bp, Artificial Sequence
  Synthetic
gagaactaatgggccaacaatctatgcccaacaggcctaattacattgcttttagggacaattttattggtctaa

SEQ ID NO: 235817 - DNA, 75 bp, Artificial Sequence
  Synthetic
gcccaacaggcctaattacattgcttttagggacaattttattggtctaatgtattacaacagcacgggtaatat

SEQ ID NO: 235818 - DNA, 75 bp, Artificial Sequence
  Synthetic
cagttgaatgctgttgtagatttgcaagacagaaacacagagctttcataccagcttttgcttgattccattggt

SEQ ID NO: 235819 - DNA, 75 bp, Artificial Sequence
  Synthetic
aagacagaaacacagagctttcataccagcttttgcttgattccattggtgatagaaccaggtacttttctatgt

SEQ ID NO: 235820 - DNA, 75 bp, Artificial Sequence
  Synthetic
tccagatgttagaattattgaaaatcatggaactgaagatgaacttccaaattactgctttccactgggaggtgt

SEQ ID NO: 235821 - DNA, 75 bp, Artificial Sequence
  Synthetic
catggaactgaagatgaacttccaaattactgctttccactgggaggtgtgattaatacagagactcttaccaag

SEQ ID NO: 235822 - DNA, 75 bp, Artificial Sequence
  Synthetic
atggatgggaaaaagatgctacagaattttcagataaaaatgaaataagagttggaaataattttgccatggaaa

SEQ ID NO: 235823 - DNA, 75 bp, Artificial Sequence
  Synthetic
attttcagataaaaatgaaataagagttggaaataattttgccatggaaatcaatctaaatgccaacctgtggag

SEQ ID NO: 235824 - DNA, 75 bp, Artificial Sequence
  Synthetic
ctgtatttgcccgacaagctaaagtacagtccttccaacgtaaaaatttctgataacccaaacacctacgactac

SEQ ID NO: 235825 - DNA, 75 bp, Artificial Sequence
  Synthetic
acagtccttccaacgtaaaaatttctgataacccaaacacctacgactacatgaacaagcgagtggtggctcccg

SEQ ID NO: 235826 - DNA, 75 bp, Artificial Sequence
  Synthetic
tggagcacgctggtcccttgactatatggacaacgtcaacccatttaaccaccaccgcaatgctggcctgcgcta

SEQ ID NO: 235827 - DNA, 75 bp, Artificial Sequence
  Synthetic
atggacaacgtcaacccatttaaccaccaccgcaatgctggcctgcgctaccgctcaatgttgctgggcaatggt

SEQ ID NO: 235828 - DNA, 75 bp, Artificial Sequence
  Synthetic
tgcctcagaagttctttgccattaaaaacctccttctcctgccgggctcatacacctacgagtggaacttcagga

SEQ ID NO: 235829 - DNA, 75 bp, Artificial Sequence
  Synthetic
aaacctccttctcctgccgggctcatacacctacgagtggaacttcaggaaggatgttaacatggttctgcagag

SEQ ID NO: 235830 - DNA, 75 bp, Artificial Sequence
  Synthetic
gacggagccagcattaagtttgatagcatttgcctttacgccaccttcttccccatggcccacaacaccgcctcc

SEQ ID NO: 235831 - DNA, 75 bp, Artificial Sequence
  Synthetic
gcatttgcctttacgccaccttcttccccatggcccacaacaccgcctccacgcttgaggccatgcttagaaacg

SEQ ID NO: 235832 - DNA, 75 bp, Artificial Sequence
  Synthetic
ctatctctccgccgccaacatgctctaccctatacccgccaacgctaccaacgtgcccatatccatcccctcccg

SEQ ID NO: 235833 - DNA, 75 bp, Artificial Sequence
  Synthetic
taccctatacccgccaacgctaccaacgtgcccatatccatcccctcccgcaactgggcggctttccgcggctgg

SEQ ID NO: 235834 - DNA, 75 bp, Artificial Sequence
  Synthetic
aaaccccatcactgggctcgggctacgacccttattacacctactctggctctataccctacctagatggaacct

SEQ ID NO: 235835 - DNA, 75 bp, Artificial Sequence
  Synthetic
cgacccttattacacctactctggctctataccctacctagatggaaccttttacctcaaccacacctttaagaa

SEQ ID NO: 235836 - DNA, 75 bp, Artificial Sequence
  Synthetic
gtcagctggcctggcaatgaccgcctgcttacccccaacgagtttgaaattaagcgctcagttgacggggagggt

SEQ ID NO: 235837 - DNA, 75 bp, Artificial Sequence
  Synthetic
ccaaagactggttcctggtacaaatgctagctaactacaacattggctaccagggcttctatatcccagagagct

SEQ ID NO: 235838 - DNA, 75 bp, Artificial Sequence
  Synthetic
tagaaacttccagcccatgagccgtcaggtggtggatgatactaaatacaaggactaccaacaggtgggcatcct

SEQ ID NO: 235839 - DNA, 75 bp, Artificial Sequence
  Synthetic
acaccaacacaacaactctggatttgttggctaccttgcccccaccatgcgcgaaggacaggcctaccctgctaa

SEQ ID NO: 235840 - DNA, 75 bp, Artificial Sequence
  Synthetic
agaagcaagcaacatcaacaacagctgccgccatgggctccagtgagcaggaactgaaagccattgtcaaagatc

SEQ ID NO: 235841 - DNA, 75 bp, Artificial Sequence
  Synthetic
tgcagcacagcagggacaacgaggcattcagggacgcgctgctaaacatagtagagcccgagggccgctggctgc

SEQ ID NO: 235842 - DNA, 75 bp, Artificial Sequence
  Synthetic
aaacatgctacctctttgagccctttggcttttctgaccagcgactcaagcaggtttaccagtttgagtacgagt

SEQ ID NO: 235843 - DNA, 75 bp, Artificial Sequence
  Synthetic
gcctttgccaactggccccaaactcccatggatcacaaccccaccatgaaccttattaccggggtacccaactcc

SEQ ID NO: 235844 - DNA, 75 bp, Artificial Sequence
  Synthetic
ccaccctgcgtcgcaaccaggaacagctctacagcttcctggagcgccactcgccctacttccgcagccacagtg

SEQ ID NO: 235845 - DNA, 75 bp, Artificial Sequence
  Synthetic
taatgtactagagacactttcaataaaggcaaatgcttttatttgtacactctcgggtgattatttacccccacc

SEQ ID NO: 235846 - DNA, 75 bp, Artificial Sequence
  Synthetic
caaaggggttctgccgcgcatcgctatgcgccactggcagggacacgttgcgatactggtgtttagtgctccact

SEQ ID NO: 235847 - DNA, 75 bp, Artificial Sequence
  Synthetic
taaactcaggcacaaccatccgcggcagctcggtgaagttttcactccacaggctgcgcaccatcaccaacgcgt

SEQ ID NO: 235848 - DNA, 75 bp, Artificial Sequence
  Synthetic
cgacgcgctgcttcagcgcgtggctcgctacaacagcggcaacgtgcagaccaacctggaccggctggtggggga

SEQ ID NO: 235849 - DNA, 75 bp, Artificial Sequence
  Synthetic
gaagtcgcagttggggcctccgccctgcgcgcgcgagttgcgatacacagggttgcagcactggaacactatcag

SEQ ID NO: 235850 - DNA, 75 bp, Artificial Sequence
  Synthetic
tgggctccatggttgcactgaacgccttcctaagcacacagcccgccaacgtgccgcgggggcaggaggactaca

SEQ ID NO: 235851 - DNA, 75 bp, Artificial Sequence
  Synthetic
caggctttgagttgcactcgcaccgtagtggcatcaaaaggtgaccgtgcccggtctgggcgttaggatacagcg

SEQ ID NO: 235852 - DNA, 75 bp, Artificial Sequence
  Synthetic
gcgtcggtgttggagatctgcaccacatttcggccccaccggttcttcacgatcttggccttgctagactgctcc

SEQ ID NO: 235853 - DNA, 75 bp, Artificial Sequence
  Synthetic
gatcttggccttgctagactgctccttcagcgcgcgctgcccgttttcgctcgtcacatccatttcaatcacgtg

SEQ ID NO: 235854 - DNA, 75 bp, Artificial Sequence
  Synthetic
ttgtaggtcacctctgcaaacgactgcaggtacgcctgcaggaatcgccccatcatcgtcacaaaggtcttgttg

SEQ ID NO: 235855 - DNA, 75 bp, Artificial Sequence
  Synthetic
cctgtgttctgaccgtggtttgcaactgtcctaaccctggattacatcaagatctttgttgtcatctctgtgctg

SEQ ID NO: 235856 - DNA, 75 bp, Artificial Sequence
  Synthetic
tggtcaggcagtagtttgaagttcgcctttagatcgttatccacgtggtacttgtccatcagcgcgcgcgcagcc

SEQ ID NO: 235857 - DNA, 75 bp, Artificial Sequence
  Synthetic
cctttagatcgttatccacgtggtacttgtccatcagcgcgcgcgcagcctccatgcccttctcccacgcagaca

SEQ ID NO: 235858 - DNA, 75 bp, Artificial Sequence
  Synthetic
ttcttgggcgcaatggccaaatccgccgccgaggtcgatggccgcgggctgggtgtgcgcggcaccagcgcgtct

SEQ ID NO: 235859 - DNA, 75 bp, Artificial Sequence
  Synthetic
ccgccgaggtcgatggccgcgggctgggtgtgcgcggcaccagcgcgtcttgtgatgagtcttcctcgtcctcgg

SEQ ID NO: 235860 - DNA, 75 bp, Artificial Sequence
  Synthetic
cctccatggttgggggacgtcgcgccgcaccgcgtccgcgctcgggggtggtttcgcgctgctcctcttcccgac

SEQ ID NO: 235861 - DNA, 75 bp, Artificial Sequence
  Synthetic
cgatgccgccaacgcgcctaccaccttccccgtcgaggcacccccgcttgaggaggaggaagtgattatcgagca

SEQ ID NO: 235862 - DNA, 75 bp, Artificial Sequence
  Synthetic
gggcggggggacgaaaggcatggcgactacctagatgtgggagacgacgtgctgttgaagcatctgcagcgccag

SEQ ID NO: 235863 - DNA, 75 bp, Artificial Sequence
  Synthetic
taccccccaaacgccaagaaaacggcacatgcgagcccaacccgcgcctcaacttctaccccgtatttgccgtgc

SEQ ID NO: 235864 - DNA, 75 bp, Artificial Sequence
  Synthetic
cacatgcgagcccaacccgcgcctcaacttctaccccgtatttgccgtgccagaggtgcttgccacctatcacat

SEQ ID NO: 235865 - DNA, 75 bp, Artificial Sequence
  Synthetic
gcctcgctcaacgaagtgccaaaaatctttgagggtcttggacgcgacgagaagcgcgcggcaaacgctctgcaa

SEQ ID NO: 235866 - DNA, 75 bp, Artificial Sequence
  Synthetic
ttaccgtggagcttgagtgcatgcagcggttctttgctgacccggagatgcagcgcaagctagaggaaacattgc

SEQ ID NO: 235867 - DNA, 75 bp, Artificial Sequence
  Synthetic
gtggagctctgcaacctggtctcctaccttggaattttgcacgaaaaccgccttgggcaaaacgtgcttcattcc

SEQ ID NO: 235868 - DNA, 75 bp, Artificial Sequence
  Synthetic
agcgctccgtggccgcgcacctggcggacatcattttccccgaacgcctgcttaaaaccctgcaacagggtctgc

SEQ ID NO: 235869 - DNA, 75 bp, Artificial Sequence
  Synthetic
cttaaaaccctgcaacagggtctgccagacttcaccagtcaaagcatgttgcagaactttaggaactttatccta

SEQ ID NO: 235870 - DNA, 75 bp, Artificial Sequence
  Synthetic
cgttcagatacccaccaccagtagcactagtattgccaccgccacagagggcatggagacacaaacgtccccggt

SEQ ID NO: 235871 - DNA, 75 bp, Artificial Sequence
  Synthetic
cacgcccacgagattaggttctacgaagaccaatcccgcccgccaaatgcggagcttaccgcctgcgtcattacc

SEQ ID NO: 235872 - DNA, 75 bp, Artificial Sequence
  Synthetic
aagccatcaacaaagcccgccaagagtttctgctacgaaagggacggggggtttacttggacccccagtccggcg

SEQ ID NO: 235873 - DNA, 75 bp, Artificial Sequence
  Synthetic
aggagctcaacccaatccccccgccgccgcagccctatcagcagcagccgcgggcccttgcttcccaggatggca

SEQ ID NO: 235874 - DNA, 75 bp, Artificial Sequence
  Synthetic
ggaagcttccgaggtcgaagaggtgtcagacgaaacaccgtcaccctcggtcgcattcccctcgccggcgcccca

SEQ ID NO: 235875 - DNA, 75 bp, Artificial Sequence
  Synthetic
gctacaacctccgctcctcaggcgccgccggcactgcccgttcgccgacccaaccgtagatgggacaccactgga

SEQ ID NO: 235876 - DNA, 75 bp, Artificial Sequence
  Synthetic
caaccgtagatgggacaccactggaaccagggccggtaagtccaagcagccgccgccgttagcccaagagcaaca

SEQ ID NO: 235877 - DNA, 75 bp, Artificial Sequence
  Synthetic
attttatgaaatgtgtgacattaccatgtacatgagcaaacagtataagttgtggcccccacaaaagtgtgtgga

SEQ ID NO: 235878 - DNA, 75 bp, Artificial Sequence
  Synthetic
accagggccggtaagtccaagcagccgccgccgttagcccaagagcaacaacagcgccaaggctaccgctcatgg

SEQ ID NO: 235879 - DNA, 75 bp, Artificial Sequence
  Synthetic
cttgcttgcaagactgtgggggcaacatctccttcgcccgccgctttcttctctaccatcacggcgtggccttcc

SEQ ID NO: 235880 - DNA, 75 bp, Artificial Sequence
  Synthetic
ctctaccatcacggcgtggccttcccccgtaacatcctgcattactaccgtcatctctacagcccatactgcacc

SEQ ID NO: 235881 - DNA, 75 bp, Artificial Sequence
  Synthetic
gcagcggccacacagaagcaaaggcgaccggatagcaagactctgacaaagcccaagaaatccacagcggcggca

SEQ ID NO: 235882 - DNA, 75 bp, Artificial Sequence
  Synthetic
tggcgcccaacgaacccgtatcgacccgcgagcttagaaacaggatttttcccactctgtatgctatatttcaac

SEQ ID NO: 235883 - DNA, 75 bp, Artificial Sequence
  Synthetic
ttcagtaaatactgcgcgctgactcttaaggactagtttcgcgccctttctcaaatttaagcgcgaaaactacgt

SEQ ID NO: 235884 - DNA, 75 bp, Artificial Sequence
  Synthetic
tgggccagcacacacccgtaacgctggacctgcctccccccgccgacacccagcagaaacctgtgctgccagggc

SEQ ID NO: 235885 - DNA, 75 bp, Artificial Sequence
  Synthetic
cagcacctgtcgtcagcgccattatgagcaaggaaattcccacgccctacatgtggagttaccagccacaaatgg

SEQ ID NO: 235886 - DNA, 75 bp, Artificial Sequence
  Synthetic
gcgactggaagatgtcttggaaaaaatgaccgtggagcctgggctggagcccgaggtccgcgtgcggccaatcaa

SEQ ID NO: 235887 - DNA, 75 bp, Artificial Sequence
  Synthetic
accttaatccccgtagttggcccgctgccctggtgtaccaggaaagtcccgctcccaccactgtggtacttccca

SEQ ID NO: 235888 - DNA, 75 bp, Artificial Sequence
  Synthetic
gctcccaccactgtggtacttcccagagacgcccaggccgaagttcagatgactaactcaggggcgcagcttgcg

SEQ ID NO: 235889 - DNA, 75 bp, Artificial Sequence
  Synthetic
cgcccgggcagggtataactcacctgacaatcagagggcgaggtattcagctcaacgacgagtcggtgagctcct

SEQ ID NO: 235890 - DNA, 75 bp, Artificial Sequence
  Synthetic
cgcttggtctccgtccggacgggacatttcagatcggcggcgccggccgtccttcattcacgcctcgtcaggcaa

SEQ ID NO: 235891 - DNA, 75 bp, Artificial Sequence
  Synthetic
tgagccgcgctctggaggcattggaactctgcaatttattgaggagtttgtgccatcggtctactttaacccctt

SEQ ID NO: 235892 - DNA, 75 bp, Artificial Sequence
  Synthetic
gatcaatttattcctaactttgacgcggtaaaggactcggcggacggctacgactgaatgttaagtggagaggca

SEQ ID NO: 235893 - DNA, 75 bp, Artificial Sequence
  Synthetic
tccactgtcgccgccacaagtgctttgcccgcgactccggtgagttttgctactttgaattgcccgaggatcata

SEQ ID NO: 235894 - DNA, 75 bp, Artificial Sequence
  Synthetic
gcttaccgcccagggagagcttgcccgtagcctgattcgggagtttacccagcgccccctgctagttgagcggga

SEQ ID NO: 235895 - DNA, 75 bp, Artificial Sequence
  Synthetic
tacatcaagatctttgttgccatctctgtgctgagtataataaatacagaaattaaaatatactggggctcctat

SEQ ID NO: 235896 - DNA, 75 bp, Artificial Sequence
  Synthetic
tcacccgcccaagcaaaccaaggcgaaccttacctggtacttttaacatctctccctctgtgatttacaacagtt

SEQ ID NO: 235897 - DNA, 75 bp, Artificial Sequence
  Synthetic
aaccttacctggtacttttaacatctctccctctgtgatttacaacagtttcaacccagacggagtgagtctacg

SEQ ID NO: 235898 - DNA, 75 bp, Artificial Sequence
  Synthetic
tccatcagaaaaaacaccaccctccttacctgccgggaacgtacgagtgcgtcaccggccgctgcaccacaccta

SEQ ID NO: 235899 - DNA, 75 bp, Artificial Sequence
  Synthetic
ttacctgccgggaacgtacgagtgcgtcaccggccgctgcaccacacctaccgcctgaccgtaaaccagactttt

SEQ ID NO: 235900 - DNA, 75 bp, Artificial Sequence
  Synthetic
ttaccagaacaggaggtgagcttagaaaacccttagggtattaggccaaaggcgcagctactgtggggtttatga

SEQ ID NO: 235901 - DNA, 75 bp, Artificial Sequence
  Synthetic
aaaacccttagggtattaggccaaaggcgcagctactgtggggtttatgaacaattcaagcaactctacgggcta

SEQ ID NO: 235902 - DNA, 75 bp, Artificial Sequence
  Synthetic
ggggttggggttattctctgtcttgtgattctctttattcttatactaacgcttctctgcctaaggctcgccgcc

SEQ ID NO: 235903 - DNA, 75 bp, Artificial Sequence
  Synthetic
tgattctctttattcttatactaacgcttctctgcctaaggctcgccgcctgctgtgtgcacatttgcatttatt

SEQ ID NO: 235904 - DNA, 75 bp, Artificial Sequence
  Synthetic
ccacccaagatgattaggtacataatcctaggtttactcacccttgcgtcagcccacggtaccacccaaaaggtg

SEQ ID NO: 235905 - DNA, 75 bp, Artificial Sequence
  Synthetic
tcctaggtttactcacccttgcgtcagcccacggtaccacccaaaaggtggattttaaggagccagcctgtaatg

SEQ ID NO: 235906 - DNA, 75 bp, Artificial Sequence
  Synthetic
gtgcaccactcttataaaatgcaccacagaacatgaaaagctgcttattcgccacaaaaacaaaattggcaagta

SEQ ID NO: 235907 - DNA, 75 bp, Artificial Sequence
  Synthetic
acatgagcaaacagtataagttgtggcccccacaaaattgtgtggaaaacactggcactttctgctgcactgcta

SEQ ID NO: 235908 - DNA, 75 bp, Artificial Sequence
  Synthetic
ctgtaccctactctatattaaatacaaaagcagacgcagctttattgaggaaaagaaaatgccttaatttactaa

SEQ ID NO: 235909 - DNA, 75 bp, Artificial Sequence
  Synthetic
aaaagcagacgcagctttattgaggaaaagaaaatgccttaatttactaagttacaaagctaatgtcaccactaa

SEQ ID NO: 235910 - DNA, 75 bp, Artificial Sequence
  Synthetic
ccgccctaaaacctacgtcacccgccccgttcccacgccccgcgccacgtcacaaactccaccccctcattatca

SEQ ID NO: 235911 - DNA, 75 bp, Artificial Sequence
  Synthetic
aaattcaaaaagttagcattataattagaataggatttaaaccccccggtcatttcctgctcaataccattcccc

SEQ ID NO: 235912 - DNA, 75 bp, Artificial Sequence
  Synthetic
tagaataggatttaaaccccccggtcatttcctgctcaataccattcccctgaacaattgactctatgtgggata

SEQ ID NO: 235913 - DNA, 75 bp, Artificial Sequence
  Synthetic
caggcttcctggatgtcagcatctgactttggccagcacctgtcccgcggatttgttccagtccaactacagcga

SEQ ID NO: 235914 - DNA, 75 bp, Artificial Sequence
  Synthetic
actttggccagcacctgtcccgcggatttgttccagtccaactacagcgacccaccctaacagagatgaccaaca

SEQ ID NO: 235915 - DNA, 75 bp, Artificial Sequence
  Synthetic
acttacatctaccacaaatacaccccaagtttctgcctttgtcaataactgggataacttgggcatgtggtggtt

SEQ ID NO: 235916 - DNA, 75 bp, Artificial Sequence
  Synthetic
caagtttctgcctttgtcaataactgggataacttgggcatgtggtggttctccatagcgcttatgtttgtatgc

SEQ ID NO: 235917 - DNA, 75 bp, Artificial Sequence
  Synthetic
gcctaaagcgcaaacgcgcccgaccacccatctatagtcccatcattgtgctacacccaaacaatgatggaatcc

SEQ ID NO: 235918 - DNA, 75 bp, Artificial Sequence
  Synthetic
acaactcaggcttcgtaggctacctcgctcccaccatgcgcgagggacaggcttaccccgccaatgttccctacc

SEQ ID NO: 235919 - DNA, 75 bp, Artificial Sequence
  Synthetic
atagattggacggactgaaacacatgttcttttctcttacagtatgattaaatgagacatgattcctcgagtttt

SEQ ID NO: 235920 - DNA, 75 bp, Artificial Sequence
  Synthetic
tagtattacccagaaaaagttcctgtgcgaccgcaccctctggcgcatcccattctccagtaactttatgtccat

SEQ ID NO: 235921 - DNA, 75 bp, Artificial Sequence
  Synthetic
ttttgtgcgtgctccacattggctgcggtttctcacatcgaagtagactgcattccagccttcacagtctatttg

SEQ ID NO: 235922 - DNA, 75 bp, Artificial Sequence
  Synthetic
cggtttctcacatcgaagtagactgcattccagccttcacagtctatttgctttacggatttgtcaccctcacgc

SEQ ID NO: 235923 - DNA, 75 bp, Artificial Sequence
  Synthetic
aaccttctctacgcaaactccgcccacgcgctagacatgacttttgaggtggatcccatggacgagcccaccctt

SEQ ID NO: 235924 - DNA, 75 bp, Artificial Sequence
  Synthetic
catcgcctttatccagtgcattgactgggtctgtgtgcgctttgcatatctcagacaccatccccagtacaggga

SEQ ID NO: 235925 - DNA, 75 bp, Artificial Sequence
  Synthetic
tgggtctgtgtgcgctttgcatatctcagacaccatccccagtacagggacaggactatagctgagcttcttaga

SEQ ID NO: 235926 - DNA, 75 bp, Artificial Sequence
  Synthetic
gacttttctgctgattatttgcaccctatctgcgttttgttccccgacctccaagcctcaaagacatatatcatg

SEQ ID NO: 235927 - DNA, 75 bp, Artificial Sequence
  Synthetic
ctttcagggacaattttattggcctaatgtattataacagcactggcaacatgggtgttcttgctggtcaggcat

SEQ ID NO: 235928 - DNA, 75 bp, Artificial Sequence
  Synthetic
ctatctgcgttttgttccccgacctccaagcctcaaagacatatatcatgcagattcactcgtatatggaatatt

SEQ ID NO: 235929 - DNA, 75 bp, Artificial Sequence
  Synthetic
atctttccgaagcctggttatatgcaatcatctctgttatggtgttctgcagtaccatcttagccctagctatat

SEQ ID NO: 235930 - DNA, 75 bp, Artificial Sequence
  Synthetic
aatcatctctgttatggtgttctgcagtaccatcttagccctagctatatatccctaccttgacattggctggaa

SEQ ID NO: 235931 - DNA, 75 bp, Artificial Sequence
  Synthetic
actttccccgcgcccgctatgcttccactgcaacaagttgttgccggcggctttgtcccagccaatcagcctcgc

SEQ ID NO: 235932 - DNA, 75 bp, Artificial Sequence
  Synthetic
cactgcaacaagttgttgccggcggctttgtcccagccaatcagcctcgccccacttctcccacccccactgaaa

SEQ ID NO: 235933 - DNA, 75 bp, Artificial Sequence
  Synthetic
aggcgataatggagatactacatggacaaaagatgaaacttttgcaacacgtaatgaaataggagtgggtaacaa

SEQ ID NO: 235934 - DNA, 75 bp, Artificial Sequence
  Synthetic
agatgactgacaccctagatctagaaatggacggaattattacagagcagcgcctgctagaaagacgcagggcag

SEQ ID NO: 235935 - DNA, 75 bp, Artificial Sequence
  Synthetic
aatggacggaattattacagagcagcgcctgctagaaagacgcagggcagcggccgagcaacagcgcatgaatca

SEQ ID NO: 235936 - DNA, 75 bp, Artificial Sequence
  Synthetic
caccagtgcaaaaggggtatcttttgtctggtaaagcaggccaaagtcacctacgacagtaataccaccggacac

SEQ ID NO: 235937 - DNA, 75 bp, Artificial Sequence
  Synthetic
gtctggtaaagcaggccaaagtcacctacgacagtaataccaccggacaccgccttagctacaagttgccaacca

SEQ ID NO: 235938 - DNA, 75 bp, Artificial Sequence
  Synthetic
gggagaaaagcccattaccataactcagcactcggtagaaaccgaaggctgcattcactcaccttgtcaaggacc

SEQ ID NO: 235939 - DNA, 75 bp, Artificial Sequence
  Synthetic
tctgccgcgcatcgctgtgcgccactggcagggacacgttgcgatactggtatttggggctccacttaaactcag

SEQ ID NO: 235940 - DNA, 75 bp, Artificial Sequence
  Synthetic
gcattcactcaccttgtcaaggacctgaggatctctgcacccttattaagaccctgtgcggtctcaaagatctta

SEQ ID NO: 235941 - DNA, 75 bp, Artificial Sequence
  Synthetic
gtacaaccattcgcggtagctcggtgaagttttcgctccacaagctgcggaccatcaccagcgcgtttagcaagt

SEQ ID NO: 235942 - DNA, 75 bp, Artificial Sequence
  Synthetic
aataaagcatcacttacttaaaatcagttagcaaatttctgtccagtttattcagcagcacctccttgccctcct

SEQ ID NO: 235943 - DNA, 75 bp, Artificial Sequence
  Synthetic
agttagcaaatttctgtccagtttattcagcagcacctccttgccctcctcccagctctggtattgcagcttcct

SEQ ID NO: 235944 - DNA, 75 bp, Artificial Sequence
  Synthetic
ctaaatggaatgtcagtttcctcctgttcctgtccatccgcacccactatcttcatgttgttgcagatgaagcgc

SEQ ID NO: 235945 - DNA, 75 bp, Artificial Sequence
  Synthetic
gttcctgtccatccgcacccactatcttcatgttgttgcagatgaagcgcgcaagaccgtctgaagataccttca

SEQ ID NO: 235946 - DNA, 75 bp, Artificial Sequence
  Synthetic
aaccggtcctccaactgtgccttttcttactcctccctttgtatcccccaatgggtttcaagagagtccccctgg

SEQ ID NO: 235947 - DNA, 75 bp, Artificial Sequence
  Synthetic
catttcgcggttgggccttcacacgcttgaagacaaaggaaaccccttccctgggatcaggctacgacccttact

SEQ ID NO: 235948 - DNA, 75 bp, Artificial Sequence
  Synthetic
cttactcctccctttgtatcccccaatgggtttcaagagagtccccctggggtactctctttgcgcctatccgaa

SEQ ID NO: 235949 - DNA, 75 bp, Artificial Sequence
  Synthetic
aacatgccgcaagacttgccggaaaactgattggccggacaggccgcgtcgtgcacgcagcaccttgcgtcggtg

SEQ ID NO: 235950 - DNA, 75 bp, Artificial Sequence
  Synthetic
ttgcgctcaaaatgggcaacggcctctctctggacgaggccggcaaccttacctcccaaaatgtaaccactgtga

SEQ ID NO: 235951 - DNA, 75 bp, Artificial Sequence
  Synthetic
ctctctggacgaggccggcaaccttacctcccaaaatgtaaccactgtgagcccacctctcaaaaaaaccaagtc

SEQ ID NO: 235952 - DNA, 75 bp, Artificial Sequence
  Synthetic
cccctcacagttacctcagaagccctaactgtggctgccgccgcacctctaatggtcgcgggcaacacactcacc

SEQ ID NO: 235953 - DNA, 75 bp, Artificial Sequence
  Synthetic
taactgtggctgccgccgcacctctaatggtcgcgggcaacacactcaccatgcaatcacaggccccgctaaccg

SEQ ID NO: 235954 - DNA, 75 bp, Artificial Sequence
  Synthetic
ttcctggtgcagatgttggccaactacaatattggctaccagggcttctacattccagaaagctacaaggaccgc

SEQ ID NO: 235955 - DNA, 75 bp, Artificial Sequence
  Synthetic
cacccaaggacccctcacagtgtcagaaggaaagctagccctgcaaacatcaggccccctcaccaccaccgatag

SEQ ID NO: 235956 - DNA, 75 bp, Artificial Sequence
  Synthetic
gaaggaaagctagccctgcaaacatcaggccccctcaccaccaccgatagcagtacccttactatcactgcctca

SEQ ID NO: 235957 - DNA, 75 bp, Artificial Sequence
  Synthetic
gcttgggcattgacttgaaagagcccatttatacacaaaatggaaaactaggactaaagtacggggctcctttgc

SEQ ID NO: 235958 - DNA, 75 bp, Artificial Sequence
  Synthetic
catttatacacaaaatggaaaactaggactaaagtacggggctcctttgcatgtaacagacgacctaaacacttt

SEQ ID NO: 235959 - DNA, 75 bp, Artificial Sequence
  Synthetic
actattaataatacttccttgcaaactaaagttactggagccttgggttttgattcacaaggcaatatgcaactt

SEQ ID NO: 235960 - DNA, 75 bp, Artificial Sequence
  Synthetic
ctaaagttactggagccttgggttttgattcacaaggcaatatgcaacttaatgtagcaggaggactaaggattg

SEQ ID NO: 235961 - DNA, 75 bp, Artificial Sequence
  Synthetic
ttcactttccgcttcgctgggctcttcctcttcctcttgcgtccgcataccccgcgccactgggtcgtcttcatt

SEQ ID NO: 235962 - DNA, 75 bp, Artificial Sequence
  Synthetic
tcctcttcctcttgcgtccgcataccccgcgccactgggtcgtcttcattcagccgccgcaccgtgcgcttacct

SEQ ID NO: 235963 - DNA, 75 bp, Artificial Sequence
  Synthetic
tgatgttagttatccgtttgatgctcaaaaccaactaaatctaagactaggacagggccctctttttataaactc

SEQ ID NO: 235964 - DNA, 75 bp, Artificial Sequence
  Synthetic
caaaaccaactaaatctaagactaggacagggccctctttttataaactcagcccacaacttggatattaactac

SEQ ID NO: 235965 - DNA, 75 bp, Artificial Sequence
  Synthetic
cttcaaacaattccaaaaagcttgaggttaacctaagcactgccaaggggttgatgtttgacgctacagccatag

SEQ ID NO: 235966 - DNA, 75 bp, Artificial Sequence
  Synthetic
ggttaacctaagcactgccaaggggttgatgtttgacgctacagccatagccattaatgcaggagatgggcttga

SEQ ID NO: 235967 - DNA, 75 bp, Artificial Sequence
  Synthetic
gcgttggccaaatccgccgccgaggtcgatggccttggactgggtgtgcgcggcaccagcgcgtcttgtgatgag

SEQ ID NO: 235968 - DNA, 75 bp, Artificial Sequence
  Synthetic
acaaatcccctcaaaacaaaaattggccatggcctagaatttgattcaaacaaggctatggttcctaaactagga

SEQ ID NO: 235969 - DNA, 75 bp, Artificial Sequence
  Synthetic
gccatggcctagaatttgattcaaacaaggctatggttcctaaactaggaactggccttagttttgacagcacag

SEQ ID NO: 235970 - DNA, 75 bp, Artificial Sequence
  Synthetic
taatgataagctaactttgtggaccacaccagctccatctcctaactgtagactaaatgcagagaaagatgctaa

SEQ ID NO: 235971 - DNA, 75 bp, Artificial Sequence
  Synthetic
acaccagctccatctcctaactgtagactaaatgcagagaaagatgctaaactcactttggtcttaacaaaatgt

SEQ ID NO: 235972 - DNA, 75 bp, Artificial Sequence
  Synthetic
cagttttggctgttaaaggcagtttggctccaatatctggaacagttcaaagtgctcatcttattataagatttg

SEQ ID NO: 235973 - DNA, 75 bp, Artificial Sequence
  Synthetic
ggctccaatatctggaacagttcaaagtgctcatcttattataagatttgacgaaaatggagtgctactaaacaa

SEQ ID NO: 235974 - DNA, 75 bp, Artificial Sequence
  Synthetic
aactttagaaatggagatcttactgaaggcacagcctatacaaacgctgttggatttatgcctaacctatcagct

SEQ ID NO: 235975 - DNA, 75 bp, Artificial Sequence
  Synthetic
aaggcacagcctatacaaacgctgttggatttatgcctaacctatcagcttatccaaaatctcacggtaaaactg

SEQ ID NO: 235976 - DNA, 75 bp, Artificial Sequence
  Synthetic
ttacttaaacggagacaaaactaaacctgtaacactaaccattacactaaacggtacacaggaaacaggagacac

SEQ ID NO: 235977 - DNA, 75 bp, Artificial Sequence
  Synthetic
ttttcatgggactggtctggccacaactacattaatgaaatatttgccacatcctcttacactttttcatacatt

SEQ ID NO: 235978 - DNA, 75 bp, Artificial Sequence
  Synthetic
ccgggaaaaaatgagacatttcacctacgatggcggtgtgctcaccggccagctggctgctcaggtcctggacac

SEQ ID NO: 235979 - DNA, 75 bp, Artificial Sequence
  Synthetic
ttcattcagtagtatagccccaccaccacatagcttatacagatcaccgtaccttaatcaaactcacagaaccct

SEQ ID NO: 235980 - DNA, 75 bp, Artificial Sequence
  Synthetic
accttaatcaaactcacagaaccctagtattcaacctgccacctccctcccaacacacagagtacacagtccttt

SEQ ID NO: 235981 - DNA, 75 bp, Artificial Sequence
  Synthetic
caacacacagagtacacagtcctttctccccggctggccttaaaaagcatcatatcatgggtaacagacatattc

SEQ ID NO: 235982 - DNA, 75 bp, Artificial Sequence
  Synthetic
tgggctatagtgtgggtgggtggtctttgtggtgtttttttttttttaatatatgttagggggttatgctaaata

SEQ ID NO: 235983 - DNA, 75 bp, Artificial Sequence
  Synthetic
gaaggagaagtccacgcctacatgggggtagagtcataatcgtgcatcaggatagggcggtggtgctgcagcagc

SEQ ID NO: 235984 - DNA, 75 bp, Artificial Sequence
  Synthetic
gggtagagtcataatcgtgcatcaggatagggcggtggtgctgcagcagcgcgcgaataaactgctgccgccgcc

SEQ ID NO: 235985 - DNA, 75 bp, Artificial Sequence
  Synthetic
ggcagtggtctcctcagcgatgattcgcaccgcccgcagcataaggcgccttgtcctccgggcacagcagcgcac

SEQ ID NO: 235986 - DNA, 75 bp, Artificial Sequence
  Synthetic
gcccctgtgtcccgttaagcccgttgccgtgagagtcagtgggcggcggtctgctgtggagtgcattgaggactt

SEQ ID NO: 235987 - DNA, 75 bp, Artificial Sequence
  Synthetic
taactgcagcacagcaccacaatattgttcaaaatcccacagtgcaaggcgctgtatccaaagctcatggcgggg

SEQ ID NO: 235988 - DNA, 75 bp, Artificial Sequence
  Synthetic
tgttcaaaatcccacagtgcaaggcgctgtatccaaagctcatggcggggaccacagaacccacgtggccatcat

SEQ ID NO: 235989 - DNA, 75 bp, Artificial Sequence
  Synthetic
gctgtatccaaagctcatggcggggaccacagaacccacgtggccatcataccacaagcgcaggtagattaagtg

SEQ ID NO: 235990 - DNA, 75 bp, Artificial Sequence
  Synthetic
ataaacattacctcttttggcatgttgtaattcaccacctcccggtaccatataaacctctgattaaacatggcg

SEQ ID NO: 235991 - DNA, 75 bp, Artificial Sequence
  Synthetic
ctcaaaaggaggtagacgatccctactgtacggagtgcgccgagacaaccgagatcgtgttggtcgtagtgtcat

SEQ ID NO: 235992 - DNA, 75 bp, Artificial Sequence
  Synthetic
gatggcgggcgctcgggcttgggagaggggcgcttctttttctttttggacgcaatggccaaatccgccgtcgag

SEQ ID NO: 235993 - DNA, 75 bp, Artificial Sequence
  Synthetic
gccaaatggaacgccggacgtagtcatatttcctgaagcaaaaccaggtgcgggcgtgacaaacagatctgcgtc

SEQ ID NO: 235994 - DNA, 75 bp, Artificial Sequence
  Synthetic
aacctgggaaccgggctgagcggccatccacatcgggagtgaatgtcggacaggtggcggatctttttccagaac

SEQ ID NO: 235995 - DNA, 75 bp, Artificial Sequence
  Synthetic
tgtgtagtagttgtagtatatccactctctcaaagcatccaggcgccccctggcttcgggttctatgtaaactcc

SEQ ID NO: 235996 - DNA, 75 bp, Artificial Sequence
  Synthetic
tccaccaccgcagaataagccacacccagccaacctacacattcgttctgcgagtcacacacgggaggagcggga

SEQ ID NO: 235997 - DNA, 75 bp, Artificial Sequence
  Synthetic
gctgtccatggtctggagctcccgcggcgtcaggtcaggcgggagctcctgcaggtttacctcgcatagccgggt

SEQ ID NO: 235998 - DNA, 75 bp, Artificial Sequence
  Synthetic
ttttattccaaaagattatccaaaacctcaaaatgaagatctattaagtgaacgcgctcccctccggtggcgtgg

SEQ ID NO: 235999 - DNA, 75 bp, Artificial Sequence
  Synthetic
aacgcgctcccctccggtggcgtggtcaaactctacagccaaagaacagataatggcatttgtaagatgttgcac

SEQ ID NO: 236000 - DNA, 75 bp, Artificial Sequence
  Synthetic
aatggcttccaaaaggcaaacggccctcacgtccaagtggacgtaaaggctaaacccttcagggtgaatctcctc

SEQ ID NO: 236001 - DNA, 75 bp, Artificial Sequence
  Synthetic
taaacccttcagggtgaatctcctctataaacattccagcaccttcaaccatgcccaaataattctcatctcgcc

SEQ ID NO: 236002 - DNA, 75 bp, Artificial Sequence
  Synthetic
catggtgaatatgtggccgggggtgctgggcatggacggggtggtgattatgaatgtgaggttcacggggcccaa

SEQ ID NO: 236003 - DNA, 75 bp, Artificial Sequence
  Synthetic
atcccgaatattaagtccggccattgtaaaaatctgctccagagcgccctccaccttcagcctcaagcagcgaat

SEQ ID NO: 236004 - DNA, 75 bp, Artificial Sequence
  Synthetic
gtaaaaatctgctccagagcgccctccaccttcagcctcaagcagcgaatcatgattgcaaaaattcaggttcct

SEQ ID NO: 236005 - DNA, 75 bp, Artificial Sequence
  Synthetic
cggaacattaacaaaaataccgcgatcccgtaggtcccttcgcagggccagctgaacataatcgtgcaggtctgc

SEQ ID NO: 236006 - DNA, 75 bp, Artificial Sequence
  Synthetic
ccaggaaccttgacaaaagaacccacactgattatgacacgcatactcggagctatgctaaccagcgtagccccg

SEQ ID NO: 236007 - DNA, 75 bp, Artificial Sequence
  Synthetic
ccgtgccaaccgcagccgagcggacaagcagctggccttgcggcagggcgctgtcatacctgatatcgcctcgct

SEQ ID NO: 236008 - DNA, 75 bp, Artificial Sequence
  Synthetic
gatataaaatgcaaggtgctgctcaaaaaatcaggcaaagcctcgcgcaaaaaagaaagcacatcgtagtcatgc

SEQ ID NO: 236009 - DNA, 75 bp, Artificial Sequence
  Synthetic
ccggaaccaccacagaaaaagacaccatttttctctcaaacatgtctgcgggtttctgcataaacacaaaataaa

SEQ ID NO: 236010 - DNA, 75 bp, Artificial Sequence
  Synthetic
gaagcctgtcttacaacaggaaaaacaacccttataagcataagacggactacggccatgccggcgtgaccgtaa

SEQ ID NO: 236011 - DNA, 75 bp, Artificial Sequence
  Synthetic
ttcctgccctatcaatgcaaccttagccacaccaagatcttgctagagcccgagagcatgtccaaggtgaacttg

SEQ ID NO: 236012 - DNA, 75 bp, Artificial Sequence
  Synthetic
aacaaaccgaggagggcctacccgcagttggcgatgagcagctggcgcgctggcttgagacgcgcgagcctgccg

SEQ ID NO: 236013 - DNA, 75 bp, Artificial Sequence
  Synthetic
acttggaggagcgacgcaagctaatgatggccgcagtgcttgttaccgtggagcttgagtgcatgcagcggttct

SEQ ID NO: 236014 - DNA, 75 bp, Artificial Sequence
  Synthetic
cttcttcttcaatctcctcttccataagggcctccccttcttcttcttctggcggcggtgggggaggggggacac

SEQ ID NO: 236015 - DNA, 75 bp, Artificial Sequence
  Synthetic
agcccgggggaatacatacccgcaggcgtagagacaacattacagcccccataggaggtataacaaaattaatag

SEQ ID NO: 236016 - DNA, 75 bp, Artificial Sequence
  Synthetic
aaaaccctcctgcctaggcaaaatagcaccctcccgctccagaacaacatacagcgcttcacagcggcagcctaa

SEQ ID NO: 236017 - DNA, 75 bp, Artificial Sequence
  Synthetic
gagccatgagcgggagcagcagcagcagcagcagcagcagcagcgccttggatggcagcatcgtgagcccttatt

SEQ ID NO: 236018 - DNA, 75 bp, Artificial Sequence
  Synthetic
acacggcaccagctcaatcagtcacagtgtaaaaaagggccaagtgcagagcgagtatatataggactaaaaaat

SEQ ID NO: 236019 - DNA, 75 bp, Artificial Sequence
  Synthetic
aacacccagaaaaccgcacgcgaacctacgcccagaaacgaaagccaaaaaacccacaacttcctcaaatcgtca

SEQ ID NO: 236020 - DNA, 75 bp, Artificial Sequence
  Synthetic
ctacccagaccagtttattcctaactttgacgcggtaaaggactcggcggacggctacgattgaatgtccagtgg

SEQ ID NO: 236021 - DNA, 75 bp, Artificial Sequence
  Synthetic
gatcatatcgagggcccggcgcacggcgtccggcttaccacccagggagagcttacacgtagccttattcgggag

SEQ ID NO: 236022 - DNA, 75 bp, Artificial Sequence
  Synthetic
atttttacagttttgtggtttaaagaattttgtattgtgattttttaaaaggtcctgtgtctgaacctgagcctg

SEQ ID NO: 236023 - DNA, 75 bp, Artificial Sequence
  Synthetic
caccactctcataaaatgcaccacagaacatgaaaaacttattattcgccacaaagacaaagttggcaagtacgc

SEQ ID NO: 236024 - DNA, 75 bp, Artificial Sequence
  Synthetic
gattctaacaactataatgttacagtatttcagggtaatgattctaaggcttttctgtatagatttccattttat

SEQ ID NO: 236025 - DNA, 75 bp, Artificial Sequence
  Synthetic
tatttcagggtaatgattctaaggcttttctgtatagatttccattttatgagatgtgtgatattactatgtaca

SEQ ID NO: 236026 - DNA, 75 bp, Artificial Sequence
  Synthetic
tccacaaaaatgtgtggaaaacactggcaccttctgctttactgctctcctaattacaataattgctttggtgtg

SEQ ID NO: 236027 - DNA, 75 bp, Artificial Sequence
  Synthetic
ggcaccttctgctttactgctctcctaattacaataattgctttggtgtgtaccctgctttatcttaaatacaaa

SEQ ID NO: 236028 - DNA, 75 bp, Artificial Sequence
  Synthetic
agaaaatgccttaattaaatttttttatacaaatcagcatggtgccaaaaattgcttcacttgcttgtatgctgc

SEQ ID NO: 236029 - DNA, 75 bp, Artificial Sequence
  Synthetic
tatacaaatcagcatggtgccaaaaattgcttcacttgcttgtatgctgccgcttgcaaaaacaattacaacgtt

SEQ ID NO: 236030 - DNA, 75 bp, Artificial Sequence
  Synthetic
taaactacatgagcgcgggaccccacatgatatcccgggtcaacggaatccgcgcccaccgaaaccgaattctcc

SEQ ID NO: 236031 - DNA, 75 bp, Artificial Sequence
  Synthetic
atgcacccattagctccaaagctgtcgctgtataactttttttagttatttgcaaaggctgcaatcccaatgcag

SEQ ID NO: 236032 - DNA, 75 bp, Artificial Sequence
  Synthetic
cgctgtataactttttttagttatttgcaaaggctgcaatcccaatgcagtagcgcgcacttttaccatgcttaa

SEQ ID NO: 236033 - DNA, 75 bp, Artificial Sequence
  Synthetic
tggaatatgtgctcccaggtgggcaaatcaagaccacgcctgcaaccttgacgtcaggcttttctggactgtcat

SEQ ID NO: 236034 - DNA, 75 bp, Artificial Sequence
  Synthetic
aatcaagaccacgcctgcaaccttgacgtcaggcttttctggactgtcatcacctgactttgaacagcgcctgtt

SEQ ID NO: 236035 - DNA, 75 bp, Artificial Sequence
  Synthetic
tctgagatgaccgacgcagcggacaacgccgctaccggactaacatctacccaagatatcccccaagcttttgcc

SEQ ID NO: 236036 - DNA, 75 bp, Artificial Sequence
  Synthetic
acgccgctaccggactaacatctacccaagatatcccccaagcttttgcctttgtcaatgaatgggctggcttgg

SEQ ID NO: 236037 - DNA, 75 bp, Artificial Sequence
  Synthetic
tatgtttgtttgtctcatcattatgtggctcatttgctgtctaaagcgcaaacgcgcccgaccacgcatctatag

SEQ ID NO: 236038 - DNA, 75 bp, Artificial Sequence
  Synthetic
tggctcatttgctgtctaaagcgcaaacgcgcccgaccacgcatctatagacccattattgtgcttaacccagac

SEQ ID NO: 236039 - DNA, 75 bp, Artificial Sequence
  Synthetic
ggctgaaacacatgtttttttctcttacagtatgattaaatgaaacatgattcctcgagttcttatattcttgac

SEQ ID NO: 236040 - DNA, 75 bp, Artificial Sequence
  Synthetic
tacagtatgattaaatgaaacatgattcctcgagttcttatattcttgacccttgttgcgcttctatgtgcatgc

SEQ ID NO: 236041 - DNA, 75 bp, Artificial Sequence
  Synthetic
gtggagaggcagagcaactgcgcctgacacacctcgaccactgccgccgccacaagtgctttgcccgcggctccg

SEQ ID NO: 236042 - DNA, 75 bp, Artificial Sequence
  Synthetic
ggatttgatgttcacctgtcccgaggtgatacctttgagggtgcctgcgtccatctggtcagaaaacacgatctt

SEQ ID NO: 236043 - DNA, 75 bp, Artificial Sequence
  Synthetic
tcgaagtagactgcattccaccatttacagtatacctgctttacggatttgtcacccttaccctcatctgcagcc

SEQ ID NO: 236044 - DNA, 75 bp, Artificial Sequence
  Synthetic
tacagtatacctgctttacggatttgtcacccttaccctcatctgcagcctcatcactgtagtcatcgccttcat

SEQ ID NO: 236045 - DNA, 75 bp, Artificial Sequence
  Synthetic
cgtattgcatacctcaggcatcatccgcaatacaggaacagaactatagctgatcttcttagaattctttaatca

SEQ ID NO: 236046 - DNA, 75 bp, Artificial Sequence
  Synthetic
gtgattaagcataacatggtgtgtggcaactgcgaggacagggcctctcagatgctaacctgctcggacggcaac

SEQ ID NO: 236047 - DNA, 75 bp, Artificial Sequence
  Synthetic
cgcaatacaggaacagaactatagctgatcttcttagaattctttaatcatgaaacagattgtgatttttctgct

SEQ ID NO: 236048 - DNA, 75 bp, Artificial Sequence
  Synthetic
gctggtggcgacctcgccgcgcaggcgctcgttagtccagcagaggcggccgcccttgcgcgagcagaagggggg

SEQ ID NO: 236049 - DNA, 75 bp, Artificial Sequence
  Synthetic
tgctcccaaacctccgcgcctcccaaaaggctcatatcctgcagattcactcaaatatggaacattcccaattgc

SEQ ID NO: 236050 - DNA, 75 bp, Artificial Sequence
  Synthetic
aaaggctcatatcctgcagattcactcaaatatggaacattcccaattgctacaacaaacacagcgatctgtccg

SEQ ID NO: 236051 - DNA, 75 bp, Artificial Sequence
  Synthetic
tgtcatggtattttgcagcaccatatttgctctagccatttacccctaccttgacattggctggaatgccataga

SEQ ID NO: 236052 - DNA, 75 bp, Artificial Sequence
  Synthetic
tttgctctagccatttacccctaccttgacattggctggaatgccatagatgccatgaaccaccccacttttcca

SEQ ID NO: 236053 - DNA, 75 bp, Artificial Sequence
  Synthetic
tcatttgtaatttacaacagtttccagcgagacgaagtaagtttgccacacaaccttctcggcttcaactacacc

SEQ ID NO: 236054 - DNA, 75 bp, Artificial Sequence
  Synthetic
aggttgttgccggtggcgttgctccagcgaatcagcctcccccaccttctcctacccccactgagattagctact

SEQ ID NO: 236055 - DNA, 75 bp, Artificial Sequence
  Synthetic
agcgaatcagcctcccccaccttctcctacccccactgagattagctactttaatctaacaggcggagatgactg

SEQ ID NO: 236056 - DNA, 75 bp, Artificial Sequence
  Synthetic
agcgatgaagatacagattgaggtactgaaatgtgtgggcgtggcttaagggtgggaaagaatatataaggtggg

SEQ ID NO: 236057 - DNA, 75 bp, Artificial Sequence
  Synthetic
aattagtaccgagcaacgcctgctacacaggcgcaaggcagcggccgaacaacagcgcctacatcaggagctcca

SEQ ID NO: 236058 - DNA, 75 bp, Artificial Sequence
  Synthetic
cacaggcgcaaggcagcggccgaacaacagcgcctacatcaggagctccaagacatgattaacctgcaccagtgc

SEQ ID NO: 236059 - DNA, 75 bp, Artificial Sequence
  Synthetic
aacaggccaaagtcaactacgagaagaacggcaacgaccaccgtcttagctacaagcttccttccaagcgtcaaa

SEQ ID NO: 236060 - DNA, 75 bp, Artificial Sequence
  Synthetic
gaacggcaacgaccaccgtcttagctacaagcttccttccaagcgtcaaaaactggtgctcattataggagacaa

SEQ ID NO: 236061 - DNA, 75 bp, Artificial Sequence
  Synthetic
gtggaaactgagggctgcctacactgcccctgtcagggcccagaggacctatgcactcttattaagaccctgtgt

SEQ ID NO: 236062 - DNA, 75 bp, Artificial Sequence
  Synthetic
gcccctgtcagggcccagaggacctatgcactcttattaagaccctgtgtggtcttagagatcttattcccttta

SEQ ID NO: 236063 - DNA, 75 bp, Artificial Sequence
  Synthetic
tcaataaaatcacttacttaaattcagttagcaggtctctgtccactttattcaacagcacctcatttccctcct

SEQ ID NO: 236064 - DNA, 75 bp, Artificial Sequence
  Synthetic
cgggaacttaatgtcgtttctcagcagctgttggagctgcgccagcaggtttctgccctgaaggcttcctcccct

SEQ ID NO: 236065 - DNA, 75 bp, Artificial Sequence
  Synthetic
cccagctttggtacctcagccgtcttttggccgcaaactttctccacagtctaaatggaatgtcagattcctcct

SEQ ID NO: 236066 - DNA, 75 bp, Artificial Sequence
  Synthetic
ggcccgggaccagcggtctcggtcgttgagggtcctgtgtattttttccaggacgtggtagagatggctctggat

SEQ ID NO: 236067 - DNA, 75 bp, Artificial Sequence
  Synthetic
tataagtttggaaacatccgcgccccttacagtcacctcaggcgccctaaccatggccacagcttcgcctttggt

SEQ ID NO: 236068 - DNA, 75 bp, Artificial Sequence
  Synthetic
gcccaccctgcgccgcaaccaggaacagctctacagcttcctggagcgccactcgccctacttccgcagccacag

SEQ ID NO: 236069 - DNA, 75 bp, Artificial Sequence
  Synthetic
ttgtcttggtaggcgatctcggccatgaactgctcgatctcttcctcctggaggtctccgcgtccggcgcgctcc

SEQ ID NO: 236070 - DNA, 75 bp, Artificial Sequence
  Synthetic
ctgaccaaatccgccagaaggcgctcgccgcccagcgatagcagttcttgcaaggaagcaaagtttttcaacggt

SEQ ID NO: 236071 - DNA, 75 bp, Artificial Sequence
  Synthetic
catctccccgcggcggcggcgcatggtctcggtgacggcgcggccgttctcccgggggcgcagctggaagacgcc

SEQ ID NO: 236072 - DNA, 75 bp, Artificial Sequence
  Synthetic
aacagagggctgcctgcacttcccctatcagggtccagaggacctctgcactcttattaaaaccatgtgtggtat

SEQ ID NO: 236073 - DNA, 75 bp, Artificial Sequence
  Synthetic
tatcagggtccagaggacctctgcactcttattaaaaccatgtgtggtattagagatcttattccattcaactaa

SEQ ID NO: 236074 - DNA, 75 bp, Artificial Sequence
  Synthetic
tataaaagggggtgggggcgcgttcgtcctcactctcttccgcatcgctgtctgcgagggccagctgttggggtg

SEQ ID NO: 236075 - DNA, 75 bp, Artificial Sequence
  Synthetic
gacttctgcgctaaggttgtcagtttccaaaaacgaggaggatttgatattcacctggcccgcggtgatgccttt

SEQ ID NO: 236076 - DNA, 75 bp, Artificial Sequence
  Synthetic
taatcgtatagttcgtgcgagggggcgaggaggtcgggaccgaggttgctacgggcgggctgctctgctcgaaag

SEQ ID NO: 236077 - DNA, 75 bp, Artificial Sequence
  Synthetic
ttaagccctactctggcactgcctacaacgcactggcccccaagggtgcccccaactcgtgcgagtgggaacaaa

SEQ ID NO: 236078 - DNA, 75 bp, Artificial Sequence
  Synthetic
gcacgatctcgtcaaagccgttgatgttgtggcccacgatgtaaagttccaagaagcgcggggtgcccttaatgg

SEQ ID NO: 236079 - DNA, 75 bp, Artificial Sequence
  Synthetic
atgaaactgcacaagtggatgctcaagaacttgacgaagaggagaatgaagccaatgaagctcaggcgcgagaac

SEQ ID NO: 236080 - DNA, 75 bp, Artificial Sequence
  Synthetic
agaacttgacgaagaggagaatgaagccaatgaagctcaggcgcgagaacaggaacaagctaagaaaacccatgt

SEQ ID NO: 236081 - DNA, 75 bp, Artificial Sequence
  Synthetic
ataaaaataactaaagaaggtctacaaataggaactgccgacgccacagtagcaggtgccggcaaagaaattttc

SEQ ID NO: 236082 - DNA, 75 bp, Artificial Sequence
  Synthetic
aaataggaactgccgacgccacagtagcaggtgccggcaaagaaattttcgcagacaaaacttttcaacctgaac

SEQ ID NO: 236083 - DNA, 75 bp, Artificial Sequence
  Synthetic
cgaagcggatgccacagcagctggtggaagggttcttaaaaagacaactcccatgaaaccctgctatggctcata

SEQ ID NO: 236084 - DNA, 75 bp, Artificial Sequence
  Synthetic
aaaaagggccaagtgcagagcgagtatatataggactaaaaaatgacgtaacggttaaagtccacaaaaaacacc

SEQ ID NO: 236085 - DNA, 75 bp, Artificial Sequence
  Synthetic
cgagccaaacgctcatcagtgatattaataaactccccgggcagctcgcttaagttcatgtcgctgtccagctgc

SEQ ID NO: 236086 - DNA, 75 bp, Artificial Sequence
  Synthetic
ggaagggttcttaaaaagacaactcccatgaaaccctgctatggctcatacgctagacccaccaattccaacggc

SEQ ID NO: 236087 - DNA, 75 bp, Artificial Sequence
  Synthetic
atggtaaattggaaagtcaagtcgaaatgcaatttttttccacatccacaaatgccacaaatgaagttaacaata

SEQ ID NO: 236088 - DNA, 75 bp, Artificial Sequence
  Synthetic
aatgcaatttttttccacatccacaaatgccacaaatgaagttaacaatatacaaccaacagttgtattgtacag

SEQ ID NO: 236089 - DNA, 75 bp, Artificial Sequence
  Synthetic
gatactcatctttcttataaacctaaaatgggggataaaaatgccaaagtcatgcttggacaacaagcaatgcca

SEQ ID NO: 236090 - DNA, 75 bp, Artificial Sequence
  Synthetic
catgcttggacaacaagcaatgccaaacagaccaaattacattgcttttagagacaattttattggtctcatgta

SEQ ID NO: 236091 - DNA, 75 bp, Artificial Sequence
  Synthetic
gtccttgctggtcaggcatcgcagttgaacgctgttgtagatttgcaagacagaaacacagagctgtcctaccag

SEQ ID NO: 236092 - DNA, 75 bp, Artificial Sequence
  Synthetic
tgaacgctgttgtagatttgcaagacagaaacacagagctgtcctaccagcttttgcttgattcaattggcgaca

SEQ ID NO: 236093 - DNA, 75 bp, Artificial Sequence
  Synthetic
tcaagctgttgacagctatgatccagatgtcagaattattgagaaccatggaactgaggatgagttgccaaatta

SEQ ID NO: 236094 - DNA, 75 bp, Artificial Sequence
  Synthetic
attactgacacttttcaagctgttaaaacaactgctgctaacggggaccaaggcaatactacctggcaaaaagat

SEQ ID NO: 236095 - DNA, 75 bp, Artificial Sequence
  Synthetic
cagagcgtgagcctgaacctgatgcgcgacggggtgacgcccagcgtggcgctggacatgaccgcgcgcaacatg

SEQ ID NO: 236096 - DNA, 75 bp, Artificial Sequence
  Synthetic
atggtagcgcgggtctctgtctcaaaaggaggtaggcgatccctactgtacggagtgcgccgagacaaccgagat

SEQ ID NO: 236097 - DNA, 75 bp, Artificial Sequence
  Synthetic
tcctgtgggacgacatggacgacagcgtgttctccccgcgaccgcaggcgctggcggaggcgtccctactgcgtc

SEQ ID NO: 236098 - DNA, 75 bp, Artificial Sequence
  Synthetic
cgtgttctccccgcgaccgcaggcgctggcggaggcgtccctactgcgtcccaagaaggaggagagtcgccacgg

SEQ ID NO: 236099 - DNA, 75 bp, Artificial Sequence
  Synthetic
ctttccgagcctggtggggtctctgcacagcgggcgcaccacccgcccgcggctgctgggcgaggacgagtacct

SEQ ID NO: 236100 - DNA, 75 bp, Artificial Sequence
  Synthetic
ccagaagacggatgagctcggcgacagtgtcgcgcacctcgcgctcaaaggctacaggggcctcttcttcttctt

SEQ ID NO: 236101 - DNA, 75 bp, Artificial Sequence
  Synthetic
cctgggagggagcggcaacccgttcgcgcacctgcgcccccgcctggggaggatgttttaaaaaaaagaagcatg

SEQ ID NO: 236102 - DNA, 75 bp, Artificial Sequence
  Synthetic
tccctttagtatgcggcgcgcggcgatgtaccaggagggacctcctccctcttacgagagcgtggtgggcgcggc

SEQ ID NO: 236103 - DNA, 75 bp, Artificial Sequence
  Synthetic
gggtgatggtgtcgcgctcgcacaccaaggacgaccgggtggagctgaagtacgagtgggtggagttcgagctgc

SEQ ID NO: 236104 - DNA, 75 bp, Artificial Sequence
  Synthetic
ccgtgaccgggctggtcatgcccggggtgtacaccaacgaggcctttcatcccgacgtcatcctgctgcccggct

SEQ ID NO: 236105 - DNA, 75 bp, Artificial Sequence
  Synthetic
gttggccataacggaccagttaacggtctggtgacccggctgcgagagctcggtgtacctgagacgcgagtaagc

SEQ ID NO: 236106 - DNA, 75 bp, Artificial Sequence
  Synthetic
ggggggcaacatccccgcgctcctcgatgtggaggcctaccaggatagcttgaaggaaaacgaggcggggcagga

SEQ ID NO: 236107 - DNA, 75 bp, Artificial Sequence
  Synthetic
gccggggctccgggggcgaggtcttccaacataaggcgatgatatccgtagatgtacctggacatccaggtgatg

SEQ ID NO: 236108 - DNA, 75 bp, Artificial Sequence
  Synthetic
cctggaccctgctgtgcacgccggacgtgacctgcggctcggagcaggtgtactggtcgctgcccgacatgatgc

SEQ ID NO: 236109 - DNA, 75 bp, Artificial Sequence
  Synthetic
ggggtttgcctccccgtcatgcaagaccccgcttgcaaattcctccggaaacagggacgagccccttttttgctt

SEQ ID NO: 236110 - DNA, 75 bp, Artificial Sequence
  Synthetic
ggcaagagcaagagcagcggcagacatgcagggcaccctccccttctcctaccgcgtcaggaggggcaacatccg

SEQ ID NO: 236111 - DNA, 75 bp, Artificial Sequence
  Synthetic
gggcagtgggtgatagagtggtgggtttggtgtggtaattttttttttaatttttgcagttttgtggtttaaaga

SEQ ID NO: 236112 - DNA, 75 bp, Artificial Sequence
  Synthetic
cgcgcccagcaagatgttcggaggggcgaggaagcgctccgagcagcaccccgtgcgcgtgcgcgggcacttccg

SEQ ID NO: 236113 - DNA, 75 bp, Artificial Sequence
  Synthetic
acatcacctgtgtccagagaatgcaatagtagtacggatagctgtgactccggtccttctaacacacctcctgag

SEQ ID NO: 236114 - DNA, 75 bp, Artificial Sequence
  Synthetic
tggcctgaaccgcgagcggttgctgcgcgaggaggactttgagcccgacgcgcggaccgggattagtcccgcgcg

SEQ ID NO: 236115 - DNA, 75 bp, Artificial Sequence
  Synthetic
cgcacacgtggcggccgccgacctggtaaccgcgtacgagcagacggtgaaccaggagattaactttcaaaaaag

SEQ ID NO: 236116 - DNA, 75 bp, Artificial Sequence
  Synthetic
tctgcagagcatagtggtgcaggagcgcagcttgagcctggctgacaaggtggccgccattaactattccatgct

SEQ ID NO: 236117 - DNA, 75 bp, Artificial Sequence
  Synthetic
gggctaaagggggtaaagagggagcggggggcttgtgagtctacagaggaggctaggaatctagcttttagctta

SEQ ID NO: 236118 - DNA, 75 bp, Artificial Sequence
  Synthetic
aataaaaaacaggtctctgcgctccctcacccgcagctgcctgtatcacaaaagcgaagatcagcttcggcgcac

SEQ ID NO: 236119 - DNA, 75 bp, Artificial Sequence
  Synthetic
gacgtggtcattcccaccggcaacacccccgccgccgccgccaccaccaccgctacctccacggatatggagacg

SEQ ID NO: 236120 - DNA, 75 bp, Artificial Sequence
  Synthetic
cagccgcagccgccgctgcagccaccgccgcgacctcctcggcggaggtgcagacggacccctggctgccgccgg

SEQ ID NO: 236121 - DNA, 75 bp, Artificial Sequence
  Synthetic
atccttccatcgcgcccacccccggctaccgaggctacacctaccgcccgcgaagagccaagggctccacccgcc

SEQ ID NO: 236122 - DNA, 75 bp, Artificial Sequence
  Synthetic
ggccagactattttttccagaccagtagacaaggcctgcagaccgtaaacctgagccaggctttcaagaacttgc

SEQ ID NO: 236123 - DNA, 75 bp, Artificial Sequence
  Synthetic
gggatcgcctccgtggccttgcaggcgtcccagaggcgttgacagacttgcaaacttgcaaatatggaaaaaaaa

SEQ ID NO: 236124 - DNA, 75 bp, Artificial Sequence
  Synthetic
ggaaagcttccgcaggccaagcagcttgtccgatctaggcgctgcggccccgcggtcagatgctagtagcccatt

SEQ ID NO: 236125 - DNA, 75 bp, Artificial Sequence
  Synthetic
cctattgtcagctttttaaacgctgggggcgacatccaagatgaggtacatgattttaggcttgctcgcccttgc

SEQ ID NO: 236126 - DNA, 75 bp, Artificial Sequence
  Synthetic
gcaatcaaacatacattggtcaaacatttgccactaattcctacaccttctcctacattgcccaagaataaagaa

SEQ ID NO: 236127 - DNA, 75 bp, Artificial Sequence
  Synthetic
ctgagcaacttgttgggcatccgcaagcggcaacccttccaggagggctttaggatcacctacgatgacctggag

SEQ ID NO: 236128 - DNA, 75 bp, Artificial Sequence
  Synthetic
ccggtggatgacatgaacgatcatgccattcgcggcgacacctttgccacacgggcggaggagaagcgcgctgag

SEQ ID NO: 236129 - DNA, 75 bp, Artificial Sequence
  Synthetic
acagaaccagatacttttccatgtggaatcaggcagtggacagttatgacccagatgtcagaattattgaaaatc

SEQ ID NO: 236130 - DNA, 75 bp, Artificial Sequence
  Synthetic
tgacgcgggcgggcccccggaggtagggggggctccggacccgccgggagagggggcaggggcacgtcggcgccg

SEQ ID NO: 236131 - DNA, 75 bp, Artificial Sequence
  Synthetic
caatctcctcttccataagggcctccccttcttcttcttctggtggcggtgggggaggggcacggcggcgacgac

SEQ ID NO: 236132 - DNA, 75 bp, Artificial Sequence
  Synthetic
aaccccaactcctacgattacatgaacaagcgagtggtggccccggggctggtggactgctacatcaacctgggc

SEQ ID NO: 236133 - DNA, 75 bp, Artificial Sequence
  Synthetic
tactgggtgcgcgactcggttagcggcctgcgcgtgcccgtgcgcacccgccccccgcgcaactagattgcaata

SEQ ID NO: 236134 - DNA, 75 bp, Artificial Sequence
  Synthetic
atcaaagaagagatgctccaggtcatcgcgccggagatctatggccccccgaagaaggaagagcaggattacaag

SEQ ID NO: 236135 - DNA, 75 bp, Artificial Sequence
  Synthetic
caggtaagttccggaaccaccacagaaaaagacaccatttttctctcaaacatgtctgcgggttcctgcataaac

SEQ ID NO: 236136 - DNA, 75 bp, Artificial Sequence
  Synthetic
agcagatctacgagttcgagtacgagggcctgctgcgtcgcagcgccatcgcctcctcgcccgaccgctgcgtca

SEQ ID NO: 236137 - DNA, 75 bp, Artificial Sequence
  Synthetic
gggcctgctgcgtcgcagcgccatcgcctcctcgcccgaccgctgcgtcaccctcgagaagtccacccagaccgt

SEQ ID NO: 236138 - DNA, 75 bp, Artificial Sequence
  Synthetic
aagggaaataataaagatgtacacacttttttctctcaataaatggcattttttatttatacatgctctctgggg

SEQ ID NO: 236139 - DNA, 75 bp, Artificial Sequence
  Synthetic
aaccggccgtttatcaatcgcctaatggactacttgcatcgcgcggccgccgtgaaccccgagtatttcaccaat

SEQ ID NO: 236140 - DNA, 75 bp, Artificial Sequence
  Synthetic
aaatcgaaagggttctgccgggagtcgccgtgcgccacgggcagggacacgttgcggtactggtagcgggtgccc

SEQ ID NO: 236141 - DNA, 75 bp, Artificial Sequence
  Synthetic
cacctgccgccccaggaagggcgcgtgccccggtttcgagttgcagtcgcagcgcagcgggatcagcaggtgccc

SEQ ID NO: 236142 - DNA, 75 bp, Artificial Sequence
  Synthetic
acgtactttgacattcgcggcgtgctggaccggggccccacttttaagccctactccggcactgcctacaacgcc

SEQ ID NO: 236143 - DNA, 75 bp, Artificial Sequence
  Synthetic
tggaccggggccccacttttaagccctactccggcactgcctacaacgccctagctcccaagggtgcccccaact

SEQ ID NO: 236144 - DNA, 75 bp, Artificial Sequence
  Synthetic
tcaggtacaggtagcggctgaagacgatcaagacgacgacgaagaagaggaacaactacctcagcagagaaatgg

SEQ ID NO: 236145 - DNA, 75 bp, Artificial Sequence
  Synthetic
gatcaagacgacgacgaagaagaggaacaactacctcagcagagaaatggcaaaaaaactcacgtatatgctcag

SEQ ID NO: 236146 - DNA, 75 bp, Artificial Sequence
  Synthetic
acaaaaacggcctgcagataggaactaacggtgcagccactgaaggaaataaggaaatttacgcagataaaactt

SEQ ID NO: 236147 - DNA, 75 bp, Artificial Sequence
  Synthetic
taacggtgcagccactgaaggaaataaggaaatttacgcagataaaacttatcaacctgaaccacaaataggaga

SEQ ID NO: 236148 - DNA, 75 bp, Artificial Sequence
  Synthetic
tccgtagcaggtggaagggttcttaaaaagactactcccatgaaaccatgctatggctcctatgccagacctacc

SEQ ID NO: 236149 - DNA, 75 bp, Artificial Sequence
  Synthetic
aaaagactactcccatgaaaccatgctatggctcctatgccagacctaccaattctaacggaggtcagggcgtta

SEQ ID NO: 236150 - DNA, 75 bp, Artificial Sequence
  Synthetic
gctccttctcctataggcagaaagagatcatggagtctctcatgcaagtcgagaaggaggaggacagcctaaccg

SEQ ID NO: 236151 - DNA, 75 bp, Artificial Sequence
  Synthetic
aagtcaagtagaaatgcaatttttttcaacttctgtaaatgctatgaacgaggcaaacgctattcaacctaaact

SEQ ID NO: 236152 - DNA, 75 bp, Artificial Sequence
  Synthetic
aggcaaacgctattcaacctaaactagtgttgtatagtgaagatgtaaatatggaaaccccagacactcatcttt

SEQ ID NO: 236153 - DNA, 75 bp, Artificial Sequence
  Synthetic
agatttgcaagacagaaacacagagctgtcctaccaacttttgcttgattctattggtgatcgaaccagatactt

SEQ ID NO: 236154 - DNA, 75 bp, Artificial Sequence
  Synthetic
ctgtcctaccaacttttgcttgattctattggtgatcgaaccagatacttttccatgtggaatcaggctgtagac

SEQ ID NO: 236155 - DNA, 75 bp, Artificial Sequence
  Synthetic
tcgagaaccatggaactgaggatgaattgccaaattattgttttcctcttggcggaattggggtgacggacacct

SEQ ID NO: 236156 - DNA, 75 bp, Artificial Sequence
  Synthetic
tgctggccacctaccacatcttcttccaaaactgcaagatccccctctcctgccgcgccaaccgcacccgcgccg

SEQ ID NO: 236157 - DNA, 75 bp, Artificial Sequence
  Synthetic
atcaagctattaaggctacaaatggaaatggaggcgccactacctgggctcaggacaatacttttgcagaacgaa

SEQ ID NO: 236158 - DNA, 75 bp, Artificial Sequence
  Synthetic
tacattaaccttggggcgcgctggtctctggactacatggacaacgttaatccctttaaccaccaccgcaatgcg

SEQ ID NO: 236159 - DNA, 75 bp, Artificial Sequence
  Synthetic
ctctggactacatggacaacgttaatccctttaaccaccaccgcaatgcgggcctgcgttaccgctccatgttgt

SEQ ID NO: 236160 - DNA, 75 bp, Artificial Sequence
  Synthetic
tcacattcaggtgccccaaaagttttttgccattaaaaacctcctcctcctgccaggctcatacacatatgaatg

SEQ ID NO: 236161 - DNA, 75 bp, Artificial Sequence
  Synthetic
atcttagggttgacggggctagcattaagtttgacagcatttgtctttacgccaccttcttccccatggcccaca

SEQ ID NO: 236162 - DNA, 75 bp, Artificial Sequence
  Synthetic
taagtttgacagcatttgtctttacgccaccttcttccccatggcccacaacacggcctccacgctggaagccat

SEQ ID NO: 236163 - DNA, 75 bp, Artificial Sequence
  Synthetic
taagactaaggaaaccccatccctgggttccggctacgacccttactatacctactctggctccataccctacct

SEQ ID NO: 236164 - DNA, 75 bp, Artificial Sequence
  Synthetic
ggttccggctacgacccttactatacctactctggctccataccctacctagacggaaccttttaccttaatcac

SEQ ID NO: 236165 - DNA, 75 bp, Artificial Sequence
  Synthetic
ttgactcttctgttagctggcctggcaatgaccgtctgcttacccccaacgagtttgaaatcaagcgttcagtcg

SEQ ID NO: 236166 - DNA, 75 bp, Artificial Sequence
  Synthetic
atgcaacatgaccaaagactggttcttggtacagatgctggccaactacaacataggctaccagggcttttatat

SEQ ID NO: 236167 - DNA, 75 bp, Artificial Sequence
  Synthetic
tcccaccatgcgagagggacaggcttaccccgccaacttcccctacccgcttataggcaagaccgcggttgacag

SEQ ID NO: 236168 - DNA, 75 bp, Artificial Sequence
  Synthetic
gctgcgcaacccgaggtcgaaaagcctcagaagaaaccggtgattaaacccctgacagaggacagcaagaaacgc

SEQ ID NO: 236169 - DNA, 75 bp, Artificial Sequence
  Synthetic
cgccacccgcccgcagacccaaccgtagatgggacaccacaggaaccggggtcggtaagtccaagtgcccaccgc

SEQ ID NO: 236170 - DNA, 75 bp, Artificial Sequence
  Synthetic
acctctctgacccacgtgttcaatcgctttcccgagaaccagattttggcgcgcccgccagcccccaccatcacc

SEQ ID NO: 236171 - DNA, 75 bp, Artificial Sequence
  Synthetic
acactttcaataaaggcaaatgcttttatttgtacactctcgggtgattatttaccccccacccttgtcgtctgc

SEQ ID NO: 236172 - DNA, 75 bp, Artificial Sequence
  Synthetic
agatcagcttcggcgcacgctggaggacgcggaggcactcttcagcaaatactgcgcgctcactcttaaggacta

SEQ ID NO: 236173 - DNA, 75 bp, Artificial Sequence
  Synthetic
tttcaatcacgtgctccttatttatcataatgctcccgtgtagacacttaagctcgccttcgatctcagcgcagc

SEQ ID NO: 236174 - DNA, 75 bp, Artificial Sequence
  Synthetic
ccgaccagttcatcccgaactttgacgcggtgaaggactcggcggacggctacgactgaatgtcaggtgccgagg

SEQ ID NO: 236175 - DNA, 75 bp, Artificial Sequence
  Synthetic
ttcgcccgcggctccggtgagttctgctactttcagctacccgaggagcataccgaggggccggcgcacggcgtc

SEQ ID NO: 236176 - DNA, 75 bp, Artificial Sequence
  Synthetic
ttgccgtgcttgattagcaccggtgggttgctgaaacccaccatttgtagcgccacatcttctctttcttcctcg

SEQ ID NO: 236177 - DNA, 75 bp, Artificial Sequence
  Synthetic
gcgggcgctcggacttgggagaggggcgcttctttttcttcttgggcgcgttggccaaatccgccgccgaggttg

SEQ ID NO: 236178 - DNA, 75 bp, Artificial Sequence
  Synthetic
ggagtcagtcgagaaggaggacagcctaaccgccccctctgagttcgccaccaccgcctccaccgatgccgccaa

SEQ ID NO: 236179 - DNA, 75 bp, Artificial Sequence
  Synthetic
gccgtgcccggaattgcatccgtggccttgcaggcgcagagacactgattaaaaacaagttgcatgtggaaaaat

SEQ ID NO: 236180 - DNA, 75 bp, Artificial Sequence
  Synthetic
tgattatcgagcaggacccaggttttgtaagcgaagacgacgaggaccgctcagtaccaacagaggataaaaagc

SEQ ID NO: 236181 - DNA, 75 bp, Artificial Sequence
  Synthetic
cgcccgttcatgggaaactggcaagatatcggcaccagcaatatgagcggtggcgccttcagctggggctcgctg

SEQ ID NO: 236182 - DNA, 75 bp, Artificial Sequence
  Synthetic
acctgatgcgcgacggggtaacgcccagcgtggcgctggacatgaccgcgcgcaacatggaaccgggcatgtatg

SEQ ID NO: 236183 - DNA, 75 bp, Artificial Sequence
  Synthetic
gccagggctacgtgcgccaggcctgcaagatctccaacgtggagctctgcaacctggtctcctaccttggaattt

SEQ ID NO: 236184 - DNA, 75 bp, Artificial Sequence
  Synthetic
tcagcgtttgacgctgcggttcatccccgtggaccgcgaggataccgcatactcgtacaaggcgcggttcaccct

SEQ ID NO: 236185 - DNA, 75 bp, Artificial Sequence
  Synthetic
acctcaaggagctgcagaagctgctaaagcaaaacttgaaggacctatggacggccttcaatgagcgctccgtgg

SEQ ID NO: 236186 - DNA, 75 bp, Artificial Sequence
  Synthetic
ttcctagcgactttgtgcccattaagtaccgcgaatgccctccgccgctttggggtcactgctaccttctgcagc

SEQ ID NO: 236187 - DNA, 75 bp, Artificial Sequence
  Synthetic
agaatgttacattcaactccacggccgacgcccggtggtcgtggagtggctccggtagctacctagatatctgca

SEQ ID NO: 236188 - DNA, 75 bp, Artificial Sequence
  Synthetic
gacccaccgcccagagacgaccaccgccaccaccccacacacctccaccgaccggatgccggccaacatcgcccc

SEQ ID NO: 236189 - DNA, 75 bp, Artificial Sequence
  Synthetic
tcccaggatggcacccaaaaagaagctgcagctgccgccgccgccacccacggacgaggaggaatactgggacag

SEQ ID NO: 236190 - DNA, 75 bp, Artificial Sequence
  Synthetic
tggttcgccataggcatgatggcgctctgcctgcttctgctctggctcatctgctgcctccaccgcaggcgagcc

SEQ ID NO: 236191 - DNA, 75 bp, Artificial Sequence
  Synthetic
gatccatagattggatggcctgaaaaacctacttttttcttttacagtatgataaattgagacatgcctcgcatt

SEQ ID NO: 236192 - DNA, 75 bp, Artificial Sequence
  Synthetic
gacaggaacattgcccaacttctaagacttctctaatcatgcataagaccgtgatctgcctcctgatcctctgca

SEQ ID NO: 236193 - DNA, 75 bp, Artificial Sequence
  Synthetic
gtgggtgagaatcccatcaccgtcacccagcactcggtggagaccgaggggtgtctgcactccccctgtcggggt

SEQ ID NO: 236194 - DNA, 75 bp, Artificial Sequence
  Synthetic
gcccgcgcttgcaccgtccgaagaaaagcgcggcctaaagcgcgagtctggtgacttggcacccaccgtgcagct

SEQ ID NO: 236195 - DNA, 75 bp, Artificial Sequence
  Synthetic
tattcagctcaacgacgagtcggtgagctcctcgcttggtctccgtccggacggaacatttcagatcggcggcgc

SEQ ID NO: 236196 - DNA, 75 bp, Artificial Sequence
  Synthetic
cgtcctcggagccgcgctccggaggcattggaactctacaatttattgaggagttcgtgccttcggtttacttca

SEQ ID NO: 236197 - DNA, 75 bp, Artificial Sequence
  Synthetic
cactatcttcatgttgttgcagatgaagcgcaccaaaacgtctgacgagagcttcaaccccgtgtacccctatga

SEQ ID NO: 236198 - DNA, 75 bp, Artificial Sequence
  Synthetic
agaggcagagcaactgcgtctaacacacctcgaccactgccgccgccacaagtgctttgcccgcgactccggtga

SEQ ID NO: 236199 - DNA, 75 bp, Artificial Sequence
  Synthetic
gcatgctcgccctgaaaatgggaagtggcctctccctggacgacgccggcaacctcacctctcaagatgtcacca

SEQ ID NO: 236200 - DNA, 75 bp, Artificial Sequence
  Synthetic
caagaccaacctcagcctagaaacctcagcccccctaactgtgagcacctcaggcgccctcaccgtagcagccgc

SEQ ID NO: 236201 - DNA, 75 bp, Artificial Sequence
  Synthetic
caggcgccctcaccgtagcagccgccgctcccctggcggtggccggcacctccctcaccatgcaatcagaggccc

SEQ ID NO: 236202 - DNA, 75 bp, Artificial Sequence
  Synthetic
ttgtaatttacaacagtttccagcgagacaaagtaagtttgccacacaaccttttcggcttcaactataccatca

SEQ ID NO: 236203 - DNA, 75 bp, Artificial Sequence
  Synthetic
ctgccgggaacgtacgagtgcgtcaccggttgctgcgcccacacctacagcctgaccgtaaccagacattactcc

SEQ ID NO: 236204 - DNA, 75 bp, Artificial Sequence
  Synthetic
tgctgagattttttaattaagtatatgagcaattcaagtaactctacaagcttgtctaatttttctggaattggg

SEQ ID NO: 236205 - DNA, 75 bp, Artificial Sequence
  Synthetic
tgagcaattcaagtaactctacaagcttgtctaatttttctggaattggggtcggggttatccttactcttgtaa

SEQ ID NO: 236206 - DNA, 75 bp, Artificial Sequence
  Synthetic
tcacatctggaaataccaaaaagctagaagttaatatcaaaacagccaaaggcctcatttatgatgacactgcta

SEQ ID NO: 236207 - DNA, 75 bp, Artificial Sequence
  Synthetic
aaggaaccagcttgcaatgttacatttaaatccgaagctaatgaatgcaccactcttataaaatgcaccacagaa

SEQ ID NO: 236208 - DNA, 75 bp, Artificial Sequence
  Synthetic
ttaaatccgaagctaatgaatgcaccactcttataaaatgcaccacagaacatgaaaagcttattattcgccaca

SEQ ID NO: 236209 - DNA, 75 bp, Artificial Sequence
  Synthetic
ggcctaagctttgacaacacaggtgccatcacagtgggcaacaaaaatgatgacaagcttaccttgtggaccaca

SEQ ID NO: 236210 - DNA, 75 bp, Artificial Sequence
  Synthetic
atatgctatttggcagccaggtgatactaacgactataatgtcacagtcttccaaggtgaaaatcataaaacttt

SEQ ID NO: 236211 - DNA, 75 bp, Artificial Sequence
  Synthetic
actaacgactataatgtcacagtcttccaaggtgaaaatcataaaacttttatgtataaatttccattttatgaa

SEQ ID NO: 236212 - DNA, 75 bp, Artificial Sequence
  Synthetic
gcaaacagtacaagttgtggcccccacaaaagtgtttagagaacactggcaccttttgttccaccgctctgctta

SEQ ID NO: 236213 - DNA, 75 bp, Artificial Sequence
  Synthetic
aaaatggagttctactaagcaattcttctcttgacccccaatactggaactacagaaaaggtgaccttacagagg

SEQ ID NO: 236214 - DNA, 75 bp, Artificial Sequence
  Synthetic
cctactttatctcaaatacaaaagcagacgcagttttattgatgaaaagaaaatgccttgattttccgcttgcta

SEQ ID NO: 236215 - DNA, 75 bp, Artificial Sequence
  Synthetic
agacgcagttttattgatgaaaagaaaatgccttgattttccgcttgctaaacccttgccaacaaaagccaatgt

SEQ ID NO: 236216 - DNA, 75 bp, Artificial Sequence
  Synthetic
cgggaaagattatacccacaaccttcaaatcaaactttcctggacgttagcgcctgacttctgccagcgcctgca

SEQ ID NO: 236217 - DNA, 75 bp, Artificial Sequence
  Synthetic
caaatcaaactttcctggacgttagcgcctgacttctgccagcgcctgcactgcaaatttgatcaaacccagctt

SEQ ID NO: 236218 - DNA, 75 bp, Artificial Sequence
  Synthetic
gcgcccacaacggactatcgcaacaccactgctaccggactaaaatctgccctaaatttaccccaagttcatgcc

SEQ ID NO: 236219 - DNA, 75 bp, Artificial Sequence
  Synthetic
ttcaccctggctgtgggtgacaaccgcgtgcttgatatggcttccacgtactttgacatccgcggcgtgctggac

SEQ ID NO: 236220 - DNA, 75 bp, Artificial Sequence
  Synthetic
ccactgctaccggactaaaatctgccctaaatttaccccaagttcatgcctttgtcaatgactgggcgagcttgg

SEQ ID NO: 236221 - DNA, 75 bp, Artificial Sequence
  Synthetic
tatgtttgtttgccttattattatgtggcttatttgttgcctaaagcgcagacgcgccagaccccccatctatag

SEQ ID NO: 236222 - DNA, 75 bp, Artificial Sequence
  Synthetic
tggcttatttgttgcctaaagcgcagacgcgccagaccccccatctataggcctatcattgtgctcaacccacac

SEQ ID NO: 236223 - DNA, 75 bp, Artificial Sequence
  Synthetic
gtctgaaaccatgttctcttcttttacagtatgattaaatgagacatgattcctcgagtccttatattattgacc

SEQ ID NO: 236224 - DNA, 75 bp, Artificial Sequence
  Synthetic
acagtatgattaaatgagacatgattcctcgagtccttatattattgacccttgttgcgcttttctgtgcgtgct

SEQ ID NO: 236225 - DNA, 75 bp, Artificial Sequence
  Synthetic
cgaagtagattgcatcccacctttcacagtttacctgctttacggatttgtcacccttatcctcatctgcagcct

SEQ ID NO: 236226 - DNA, 75 bp, Artificial Sequence
  Synthetic
acagtttacctgctttacggatttgtcacccttatcctcatctgcagcctcgtcactgtagtcatcgccttcatt

SEQ ID NO: 236227 - DNA, 75 bp, Artificial Sequence
  Synthetic
gcattgcgtaccttaggcaccatccgcaatacagagacaggactatagctgatcttctcagaattctttaattat

SEQ ID NO: 236228 - DNA, 75 bp, Artificial Sequence
  Synthetic
ctctttcttcctcgctgtccacgatcacctctggtgatggcgggcgctcgggcttgggagaagggcgcttctttt

SEQ ID NO: 236229 - DNA, 75 bp, Artificial Sequence
  Synthetic
gcaatacagagacaggactatagctgatcttctcagaattctttaattatgaaacggattgtcacttttgttttg

SEQ ID NO: 236230 - DNA, 75 bp, Artificial Sequence
  Synthetic
tttgctcccaaacctcagcgcctcccaaaagacatatttcctgcagattcactcaaatatggaacattcccagct

SEQ ID NO: 236231 - DNA, 75 bp, Artificial Sequence
  Synthetic
caaaagacatatttcctgcagattcactcaaatatggaacattcccagctgctacaacaaacagagcgatttgtc

SEQ ID NO: 236232 - DNA, 75 bp, Artificial Sequence
  Synthetic
ttttttgggggcgcccggggaggcggcggcgacggggacggggacgacacgtcctccatggttgggggacgtcgc

SEQ ID NO: 236233 - DNA, 75 bp, Artificial Sequence
  Synthetic
tctgtcatggttttttgcagtaccatttttgccctagccatatacccataccttgacattggttggaatgccata

SEQ ID NO: 236234 - DNA, 75 bp, Artificial Sequence
  Synthetic
tttttgccctagccatatacccataccttgacattggttggaatgccatagatgccatgaaccaccctactttcc

SEQ ID NO: 236235 - DNA, 75 bp, Artificial Sequence
  Synthetic
acaggttattgccccaatcaatcagcctcgccccccttctcccacccccactgagattagctactttaatttgac

SEQ ID NO: 236236 - DNA, 75 bp, Artificial Sequence
  Synthetic
cctcgccccccttctcccacccccactgagattagctactttaatttgacaggtggagatgactgaatctctaga

SEQ ID NO: 236237 - DNA, 75 bp, Artificial Sequence
  Synthetic
gaacagcgcctactagaaaggcgcaaggcggcgtccgagcgagaacgcctaaaacaagaagttgaagacatggtt

SEQ ID NO: 236238 - DNA, 75 bp, Artificial Sequence
  Synthetic
aggcggcgtccgagcgagaacgcctaaaacaagaagttgaagacatggttaacctgcaccagtgtaaaagaggta

SEQ ID NO: 236239 - DNA, 75 bp, Artificial Sequence
  Synthetic
acttacctacgaaaaaaccactaccggcaaccgccttagctacaagctacccacccagcgccaaaaactggtgct

SEQ ID NO: 236240 - DNA, 75 bp, Artificial Sequence
  Synthetic
ggcaaccgccttagctacaagctacccacccagcgccaaaaactggtgcttatggtgggagaaaaacctatcacc

SEQ ID NO: 236241 - DNA, 75 bp, Artificial Sequence
  Synthetic
cgcgtggcaggcctccttgcgtctgcggtctcgccgtctagctcgctccgtgtgatagttgtagtacagccactc

SEQ ID NO: 236242 - DNA, 75 bp, Artificial Sequence
  Synthetic
gccttttagctgcgaactttctccaaagtctaaatgggatgtcaaattcctcatgttcttgtccctccgcaccca

SEQ ID NO: 236243 - DNA, 75 bp, Artificial Sequence
  Synthetic
aatctttgagggtcttggacgcgacgagaagcgcgcggcaaacgctctgcaacaggaaaacagcgaaaatgaaag

SEQ ID NO: 236244 - DNA, 75 bp, Artificial Sequence
  Synthetic
ctatcttcatattgttgcagatgaaacgcgccagaccgtctgaagacaccttcaaccctgtgtacccatatgaca

SEQ ID NO: 236245 - DNA, 75 bp, Artificial Sequence
  Synthetic
acgcgccagaccgtctgaagacaccttcaaccctgtgtacccatatgacacggaaaccggccctccaactgtgcc

SEQ ID NO: 236246 - DNA, 75 bp, Artificial Sequence
  Synthetic
agccaagcaatacactcgctctgcgagcggcagacaggaggagcgggcagagatgggaggaccatgataaaaaat

SEQ ID NO: 236247 - DNA, 75 bp, Artificial Sequence
  Synthetic
ccaaatgggttccaagaaagtccccccggagtgctttctttgcgtctttcagaacctttggttacctcacacggc

SEQ ID NO: 236248 - DNA, 75 bp, Artificial Sequence
  Synthetic
ccggagtgctttctttgcgtctttcagaacctttggttacctcacacggcatgcttgcgctaaaaatgggcagcg

SEQ ID NO: 236249 - DNA, 75 bp, Artificial Sequence
  Synthetic
ccttacatcaaatacaatcactgtttctcaaccgctaaaaaaaacaaagtccaatataactttggaaacatccgc

SEQ ID NO: 236250 - DNA, 75 bp, Artificial Sequence
  Synthetic
ccaatataactttggaaacatccgcgccccttacagtcagctcaggcgccctaaccatggccacaacttcgcctt

SEQ ID NO: 236251 - DNA, 75 bp, Artificial Sequence
  Synthetic
catgcaatcacaagcaccgctaaccgtgcaagactcaaaacttagcattgctaccaaagagccacttacagtgtt

SEQ ID NO: 236252 - DNA, 75 bp, Artificial Sequence
  Synthetic
aaaatctgctcaagagcgccctccaccttcatcatcaagcagcgcatcatgattgcaaaaattcaggttcttcag

SEQ ID NO: 236253 - DNA, 75 bp, Artificial Sequence
  Synthetic
gtgcaagactcaaaacttagcattgctaccaaagagccacttacagtgttagatggaaaactggccctgcagaca

SEQ ID NO: 236254 - DNA, 75 bp, Artificial Sequence
  Synthetic
acaacgccctcactatcactacctcacctcctcttactactgcaaatggtagtctggctgttaccatggaaaacc

SEQ ID NO: 236255 - DNA, 75 bp, Artificial Sequence
  Synthetic
acctcctcttactactgcaaatggtagtctggctgttaccatggaaaacccactttacaacaacaatggaaaact

SEQ ID NO: 236256 - DNA, 75 bp, Artificial Sequence
  Synthetic
caagtggccaccgactcacatgcactaacactaggtactggtcagggggttgcagttcataacaatttgctacat

SEQ ID NO: 236257 - DNA, 75 bp, Artificial Sequence
  Synthetic
ttgatacatctggcaacatggaacttaaaactggagatggcctctatgtggatagcgccggtcctaaccaaaaac

SEQ ID NO: 236258 - DNA, 75 bp, Artificial Sequence
  Synthetic
aggccttgcttttgacaacaccgcaataacaattaacgctggaaaagggttggaatttgaaacagactcctcaaa

SEQ ID NO: 236259 - DNA, 75 bp, Artificial Sequence
  Synthetic
ataacaattaacgctggaaaagggttggaatttgaaacagactcctcaaacggaaatcccataaaaacaaaaatt

SEQ ID NO: 236260 - DNA, 75 bp, Artificial Sequence
  Synthetic
atggagctatggttgcaaaacttggaacaggcctcagttttgacagctccggagccataacaatgggcagcataa

SEQ ID NO: 236261 - DNA, 75 bp, Artificial Sequence
  Synthetic
aacaggcctcagttttgacagctccggagccataacaatgggcagcataaacaatgacagacttactctttggac

SEQ ID NO: 236262 - DNA, 75 bp, Artificial Sequence
  Synthetic
agaattgcttcagataaagactgcaagctaactctggcgctaacaaaatgtggcagtcaaattttgggcactgtt

SEQ ID NO: 236263 - DNA, 75 bp, Artificial Sequence
  Synthetic
agctaactctggcgctaacaaaatgtggcagtcaaattttgggcactgtttcagctttggcagtatcaggtaata

SEQ ID NO: 236264 - DNA, 75 bp, Artificial Sequence
  Synthetic
cagtgtaaacttggttcttagatttgatgacaacggagtgcttatgtcaaattcatcactggacaaacagtattg

SEQ ID NO: 236265 - DNA, 75 bp, Artificial Sequence
  Synthetic
gatgacaacggagtgcttatgtcaaattcatcactggacaaacagtattggaactttagaaacggggactccact

SEQ ID NO: 236266 - DNA, 75 bp, Artificial Sequence
  Synthetic
aaacaacataaagcgcttccacaggagcagccataacaaagacccgagccttaccagtaaaataaaaaagatctc

SEQ ID NO: 236267 - DNA, 75 bp, Artificial Sequence
  Synthetic
ttgggtttatgccaaacctaaaagcttacccaaaaactcaaagtaaaactgcaaaaagtaatattgttagccagg

SEQ ID NO: 236268 - DNA, 75 bp, Artificial Sequence
  Synthetic
gggtttacttggacccccagtccggcgaggagctcaacccaatccccccgccgccgcagccctatcagcagcagc

SEQ ID NO: 236269 - DNA, 75 bp, Artificial Sequence
  Synthetic
ttggtcatggaacagtggacaatacactaatgacaaatttgccaccaattcctataccttctcctacatttccca

SEQ ID NO: 236270 - DNA, 75 bp, Artificial Sequence
  Synthetic
acatgtaaaaataatgtactaggagacactttcaataaaggcaaatgttttttatttgtacactctcgggtgatt

SEQ ID NO: 236271 - DNA, 75 bp, Artificial Sequence
  Synthetic
cagtgatattaataaactccccgggcagctcgcttaagttcatgtcgctgtccagctgctgagccacaggctgct

SEQ ID NO: 236272 - DNA, 75 bp, Artificial Sequence
  Synthetic
agcctttgcgccttcagagaagaacatgccgcaagacttgccggaaaactgattggccggacaggccgcgtcatg

SEQ ID NO: 236273 - DNA, 75 bp, Artificial Sequence
  Synthetic
ttgtcatgatatcaatgttggcacaacacaggcacacgtgcatacacttcctcaggattataagctcctcccgcg

SEQ ID NO: 236274 - DNA, 75 bp, Artificial Sequence
  Synthetic
ccattcctgaatcagcgtaaatcccacactgcagggaaggcctcgcacataactcacgttgtgcattgtcaaagt

SEQ ID NO: 236275 - DNA, 75 bp, Artificial Sequence
  Synthetic
gcaactgtcctaaccctggattacatcaagatctttgttgccatctctgtgctgagtataataaatacagaaatt

SEQ ID NO: 236276 - DNA, 75 bp, Artificial Sequence
  Synthetic
ggtggaacttgagggtgacaacgcgcgcctagccgtgctaaaacgcagcatcgaggtcacccactttgcctaccc

SEQ ID NO: 236277 - DNA, 75 bp, Artificial Sequence
  Synthetic
aggcaaaatagcaccctcccgctccagaacaacatacagcgcttccacagcggcagccataacagtcagccttac

SEQ ID NO: 236278 - DNA, 75 bp, Artificial Sequence
  Synthetic
cactcgacacggcaccagctcaatcagtcacagtgtataaaaagggccaagtacagagcgagtatatataggact

SEQ ID NO: 236279 - DNA, 75 bp, Artificial Sequence
  Synthetic
cgccccgttcccacgccccgcgccacgtcacaaactccaccccctcattatcatattggcttcaatccaaaataa

SEQ ID NO: 236280 - DNA, 75 bp, Artificial Sequence
  Synthetic
tgggcagtgggtgatagagtggtgggttcggtgtggtaatttttttttttaatttttgcagttttgtggtttaaa

SEQ ID NO: 236281 - DNA, 75 bp, Artificial Sequence
  Synthetic
aatttttgcagttttgtggtttaaagaattttgtattgtgattttttttaaaaggtcctgtgtctgaacctgagc

SEQ ID NO: 236282 - DNA, 75 bp, Artificial Sequence
  Synthetic
aaaggtcctgtgtctgaacctgagcctgagcccgagccagaaccggagcctgcaagacctgcccggcgtcctaaa

SEQ ID NO: 236283 - DNA, 75 bp, Artificial Sequence
  Synthetic
gcatctgtggagagcggtggtgagacacaagaatcgcctgctactgttgtcttccgtccgcccggcaataatacc

SEQ ID NO: 236284 - DNA, 75 bp, Artificial Sequence
  Synthetic
cacaagaatcgcctgctactgttgtcttccgtccgcccggcaataataccgacggaggagcagcagcagcaacag

SEQ ID NO: 236285 - DNA, 75 bp, Artificial Sequence
  Synthetic
aggggctaaagggggtaaagagggagcggggggcttctgaggctacagaggaggctaggaatttaacttttagct

SEQ ID NO: 236286 - DNA, 75 bp, Artificial Sequence
  Synthetic
gagttgcggcatggcctgaaccgcgagcggttgctgcgcgaggaggactttgagcccgacgcgcggaccgggatt

SEQ ID NO: 236287 - DNA, 75 bp, Artificial Sequence
  Synthetic
cacggtgaaggggtgcgctccgggctgcgcgctggccagggtgcgcttgaggctggtcctgctggtgctgaagcg

SEQ ID NO: 236288 - DNA, 75 bp, Artificial Sequence
  Synthetic
ccactcgctccagggtgtgaagacacatgtccccctcttcggcatcaaggaaggtgattggtttgtaggtgtagg

SEQ ID NO: 236289 - DNA, 75 bp, Artificial Sequence
  Synthetic
cgcgcagcagcagggcaacctgggctccatggttgcactaaacgccttcctgagtacacagcccgccaacgtgcc

SEQ ID NO: 236290 - DNA, 75 bp, Artificial Sequence
  Synthetic
caagaacttgcaggggctgtggggggtgcgggctcccacaggcgaccgcgcgaccgtgtctagcttgctgacgcc

SEQ ID NO: 236291 - DNA, 75 bp, Artificial Sequence
  Synthetic
tcacttgctgacactgtaccgcgaggccataggtcaggcgcatgtggacgagcatactttccaggagattacaag

SEQ ID NO: 236292 - DNA, 75 bp, Artificial Sequence
  Synthetic
ccgcccgcgcctgctgggcgaggaggagtacctaaacaactcgctgctgcagccgcagcgcgaaaagaacctgcc

SEQ ID NO: 236293 - DNA, 75 bp, Artificial Sequence
  Synthetic
tttaaaaaaactacaattcccaatacatgcaagttactccgccctaaaacctacgtcacccgccccgttcccacg

SEQ ID NO: 236294 - DNA, 75 bp, Artificial Sequence
  Synthetic
agaggcggcgctgcgaaaggaaagcttccgcaggccaagcagcttgtccgatctaggcgctgcggccccgcggtc

SEQ ID NO: 236295 - DNA, 75 bp, Artificial Sequence
  Synthetic
aggtggagctgaaatacgagtgggtggagttcacgctgcccgagggcaactactccgagaccatgaccatagacc

SEQ ID NO: 236296 - DNA, 75 bp, Artificial Sequence
  Synthetic
gaggacctgtggcatgtttgtctacagtaagtgaaattatgggcagtgggtgatagagtggtgggtttggtgtgg

SEQ ID NO: 236297 - DNA, 75 bp, Artificial Sequence
  Synthetic
ttcccgcactgttggatgtggacgcctaccaggcaagcttgaaagatgacaccgaacagggcgggggtggcgcag

SEQ ID NO: 236298 - DNA, 75 bp, Artificial Sequence
  Synthetic
ccctgataacatccaccaccgcagaataagccacacccagccaacttatacattcgctctgcgagtcacacacgg

SEQ ID NO: 236299 - DNA, 75 bp, Artificial Sequence
  Synthetic
tccatggtctggagctcccgcggcgtcaggtcaggcgggagctcctgcaggtttacctcgcatagccgggtcagg

SEQ ID NO: 236300 - DNA, 75 bp, Artificial Sequence
  Synthetic
ggtgtccttggatgatgcatctaaaagcggtgacgcgggcgggcccccggaggtagggggggctccggacccgcc

SEQ ID NO: 236301 - DNA, 75 bp, Artificial Sequence
  Synthetic
gagcactacttgaaagtgggcaggcagaacggggttctggaaagcgacatcggggtaaagtttgacacccgcaac

SEQ ID NO: 236302 - DNA, 75 bp, Artificial Sequence
  Synthetic
cgccgcgcgcgggcaggagctggtgctgcgcgcggaggttgctggcgaacgcgacgacgcggcggttgatctcct

SEQ ID NO: 236303 - DNA, 75 bp, Artificial Sequence
  Synthetic
tacttagactcgtactgttgtatgtatccagcggcggcggcgcgcatcgaagctatgtccaagcgcaaaatcaaa

SEQ ID NO: 236304 - DNA, 75 bp, Artificial Sequence
  Synthetic
gaagcagggccaggtcggcgacaacgcgctcggctaatatggcctgctgcacctgcgtgagggtagactggaagt

SEQ ID NO: 236305 - DNA, 75 bp, Artificial Sequence
  Synthetic
cgctactgcccgaatatgccctacatccttccatcgcgcctacccccggctatcgtggctacacctaccgcccca

SEQ ID NO: 236306 - DNA, 75 bp, Artificial Sequence
  Synthetic
aggcgcggcggctgctgcgctagcttttttggccactggccgcgcgcggcgtaagcggttaggctggaaagcgaa

SEQ ID NO: 236307 - DNA, 75 bp, Artificial Sequence
  Synthetic
tctgggggtgcaatccctaaagcgccgacgatgcttttgaatagctaacgtgtcgtatgtgtgtcatgtatgcgt

SEQ ID NO: 236308 - DNA, 75 bp, Artificial Sequence
  Synthetic
cgaggcgtacgtgccgcggcagaacctgtttcgcgaccgcgagggagaggagcccgaggagatgcgggatcgaaa

SEQ ID NO: 236309 - DNA, 75 bp, Artificial Sequence
  Synthetic
ggaagcggtggtcccggcgcgcgcaaaccccacgcacgagaaggtgctggcgatcgtaaacgcgctggccgaaaa

SEQ ID NO: 236310 - DNA, 75 bp, Artificial Sequence
  Synthetic
ctatccgccgccaacatgctttaccccatacccgccaacgccaccaacgtgcccatctctatcccctcgcgcaac

SEQ ID NO: 236311 - DNA, 75 bp, Artificial Sequence
  Synthetic
gagaaccagattttggcgcgcccgccagcccccaccatcaccaccgtcagtgaaaacgttcctgctctcacagat

SEQ ID NO: 236312 - DNA, 75 bp, Artificial Sequence
  Synthetic
ttcggccccaccggttcttcacgatcttggccttgctagactgctccttcagcgcgcgctgcccgttttcgctcg

SEQ ID NO: 236313 - DNA, 75 bp, Artificial Sequence
  Synthetic
ttcttcctcgctgtccacaatcacctctggggatggcgggcgctcgggcttgggagatgggcgcttctttttctt

SEQ ID NO: 236314 - DNA, 75 bp, Artificial Sequence
  Synthetic
ttgaaaaacatgtaaaaataatgtactagagacactttcaataaaggcaaatgcttttatttgtacactctcggg

SEQ ID NO: 236315 - DNA, 75 bp, Artificial Sequence
  Synthetic
aggtcagctgcaacccgcggtgctcctcgttcagccaggtcttgcatacggccgccagagcttccacttggtcag

SEQ ID NO: 236316 - DNA, 75 bp, Artificial Sequence
  Synthetic
cccgtgttgatggtgtaagtgcagttggccataacggaccagttaacggtctggtggcccggctgcgagagctcg

SEQ ID NO: 236317 - DNA, 75 bp, Artificial Sequence
  Synthetic
attatcggtacctttgagctgcagggtccctcgcctgacgaaaagtccgcggctccggggttgaaactcactccg

SEQ ID NO: 236318 - DNA, 75 bp, Artificial Sequence
  Synthetic
ggccgtggagacagtgttgccagatgggcgtggcgaaaagcgcccgcgccccgacagggaagagactctggtgac

SEQ ID NO: 236319 - DNA, 75 bp, Artificial Sequence
  Synthetic
gcaaatttgtacctgaggactaccacgcccacgagattaggttctacgaagaccaatcccgcccgcccaatgcgg

SEQ ID NO: 236320 - DNA, 75 bp, Artificial Sequence
  Synthetic
acacctgtaacgctggacctgcctccccccgctgacacccagcagaaacctgtgctgccagggccgtccgccgtt

SEQ ID NO: 236321 - DNA, 75 bp, Artificial Sequence
  Synthetic
gaacaaacagaggagggcctacccgcagttggcgacgagcagctagcgcgctggcttcaaacgcgcgagcctgcc

SEQ ID NO: 236322 - DNA, 75 bp, Artificial Sequence
  Synthetic
cacaaggccgtgagcgtgagccggcggcgcgagctcagcgaccgcgagctgatgcacagcctgcaaagggccctg

SEQ ID NO: 236323 - DNA, 75 bp, Artificial Sequence
  Synthetic
caattcctgcgagtgggaacaagaagaaccaactcaggaaatggctgaagaacttgaagatgaggaggaggcaga

SEQ ID NO: 236324 - DNA, 75 bp, Artificial Sequence
  Synthetic
gaagcaccacaagctgatcagaaggttaagaagactcatgtatatgctcaggctcctttggcaggggaaaaaatt

SEQ ID NO: 236325 - DNA, 75 bp, Artificial Sequence
  Synthetic
ttaagaagactcatgtatatgctcaggctcctttggcaggggaaaaaattaccgccaatggcttgcaaatagttt

SEQ ID NO: 236326 - DNA, 75 bp, Artificial Sequence
  Synthetic
agtttttgccgatcccacttatcaacctgaacctcaggttggagaatctcagtggaatgaagctgaagcaactgc

SEQ ID NO: 236327 - DNA, 75 bp, Artificial Sequence
  Synthetic
cctgaacctcaggttggagaatctcagtggaatgaagctgaagcaactgcatctggaggcagagtactaaaaaag

SEQ ID NO: 236328 - DNA, 75 bp, Artificial Sequence
  Synthetic
gatcgtatgccagacctacaaataaaaatgggggtcaaggtatactagtagcaaacaaccaaggtgctctagagt

SEQ ID NO: 236329 - DNA, 75 bp, Artificial Sequence
  Synthetic
aaatgggggtcaaggtatactagtagcaaacaaccaaggtgctctagagtctaaagttgaaatgcagttttttgc

SEQ ID NO: 236330 - DNA, 75 bp, Artificial Sequence
  Synthetic
agaaatgctgttcagccaagtattgttttgtacagtgaggatgttaatatggaaactcctgatactcacatttca

SEQ ID NO: 236331 - DNA, 75 bp, Artificial Sequence
  Synthetic
ttttgtacagtgaggatgttaatatggaaactcctgatactcacatttcatacaaaccaagcaaaactgatgaaa

SEQ ID NO: 236332 - DNA, 75 bp, Artificial Sequence
  Synthetic
agcaatgccaaacagacccaattacatcgcttttagggacaattttattggccttatgtattacaacagcactgg

SEQ ID NO: 236333 - DNA, 75 bp, Artificial Sequence
  Synthetic
atcgcttttagggacaattttattggccttatgtattacaacagcactggtaacatgggtgtccttgctggacaa

SEQ ID NO: 236334 - DNA, 75 bp, Artificial Sequence
  Synthetic
acttgcaggacagaaacacagagctgtcatatcaacttttgcttgattctattggcgatagaaccagatactttt

SEQ ID NO: 236335 - DNA, 75 bp, Artificial Sequence
  Synthetic
gtcatatcaacttttgcttgattctattggcgatagaaccagatacttttccatgtggaatcaggctgtagacag

SEQ ID NO: 236336 - DNA, 75 bp, Artificial Sequence
  Synthetic
gaaaatcatggaactgaggatgagttgccaaattactgcttcccacttggcggtataggggtaactgacacctac

SEQ ID NO: 236337 - DNA, 75 bp, Artificial Sequence
  Synthetic
tgccaaattactgcttcccacttggcggtataggggtaactgacacctaccaaggtataaaatcaaacggaaacg

SEQ ID NO: 236338 - DNA, 75 bp, Artificial Sequence
  Synthetic
tgacgattttgcggcacgtaatgaaataggtgtgggaaacaactttgccctggagattaaccttaatgccaacct

SEQ ID NO: 236339 - DNA, 75 bp, Artificial Sequence
  Synthetic
ataggtgtgggaaacaactttgccctggagattaaccttaatgccaacctatggagaaatttcctctactccaac

SEQ ID NO: 236340 - DNA, 75 bp, Artificial Sequence
  Synthetic
taaaatacactcctacaaatgtggaaatatctcccaaccctaattcatacgattatatgaacaagcgagtggtgg

SEQ ID NO: 236341 - DNA, 75 bp, Artificial Sequence
  Synthetic
aatatctcccaaccctaattcatacgattatatgaacaagcgagtggtggctcccgggttggtggattgctacat

SEQ ID NO: 236342 - DNA, 75 bp, Artificial Sequence
  Synthetic
gactacatggacaacgtcaacccctttaaccatcaccgcaatgcgggcctacgctaccgctccatgttgctgggc

SEQ ID NO: 236343 - DNA, 75 bp, Artificial Sequence
  Synthetic
ttaaccatcaccgcaatgcgggcctacgctaccgctccatgttgctgggcaacggtcgctacgtgccctttcaca

SEQ ID NO: 236344 - DNA, 75 bp, Artificial Sequence
  Synthetic
cattaagaacctcctactcttgccgggctcatacacctacgagtggaacttcaggaaagatgttaacatggtcct

SEQ ID NO: 236345 - DNA, 75 bp, Artificial Sequence
  Synthetic
ggctcatacacctacgagtggaacttcaggaaagatgttaacatggtcctgcaaagctccctaggaaacgaccta

SEQ ID NO: 236346 - DNA, 75 bp, Artificial Sequence
  Synthetic
ttgacagcatttgcctctacgccaccttttttccgatggcccacaacaccgcctcaacgcttgaagccatgctta

SEQ ID NO: 236347 - DNA, 75 bp, Artificial Sequence
  Synthetic
tgcttgtattcccctggacaatttactctatgtgggatatgctccaggcgggcaagattatacccacaaccttca

SEQ ID NO: 236348 - DNA, 75 bp, Artificial Sequence
  Synthetic
aagatcttggttgtgggccatattttttgggcacctatgacaagcgcttcccaggctttgtttccccacacaagc

SEQ ID NO: 236349 - DNA, 75 bp, Artificial Sequence
  Synthetic
cggtcgcgagactgggggcgtacactggatggcctttgcctggaacccgcgctcaaaaacatgctacctctttga

SEQ ID NO: 236350 - DNA, 75 bp, Artificial Sequence
  Synthetic
acgagtcactcctgcgccgtagcgccattgcctcttcccccgaccgctgtataacgctggaaaagtccacccaaa

SEQ ID NO: 236351 - DNA, 75 bp, Artificial Sequence
  Synthetic
ctgtggcctattctgctgcatgtttctccacgcctttgccaactggccccaaactcccatggatcacaaccccac

SEQ ID NO: 236352 - DNA, 75 bp, Artificial Sequence
  Synthetic
tggccagcacgctcttgtcggagatcagatccgcgtccaggtcctccgcgttgctcagggcgaacggagtcaact

SEQ ID NO: 236353 - DNA, 75 bp, Artificial Sequence
  Synthetic
gaccgtgcccggtctgggcgttaggatacagcgccttcataaaggcctggatctgcttaaaagccacctgggcct

SEQ ID NO: 236354 - DNA, 75 bp, Artificial Sequence
  Synthetic
agtataatgttacagttttccagggtaaaagtcataaaacttttatgtatacttttccattttatgaaatgtgcg

SEQ ID NO: 236355 - DNA, 75 bp, Artificial Sequence
  Synthetic
acttacttaaaatcagtcagcaaatctttgtccagcttattcagcatcacctcctttccctcctcccaactctgg

SEQ ID NO: 236356 - DNA, 75 bp, Artificial Sequence
  Synthetic
gccgctcgaaggctggccgcgggtattgtcactgtgccccccaggtccaggcgacgagcggccgccgcagcagcc

SEQ ID NO: 236357 - DNA, 75 bp, Artificial Sequence
  Synthetic
ccagcggcggcggcgcgcaacgaagctatgtccaagcgcaaaatcaaagaagagatgctccaggtcatcgcgccg

SEQ ID NO: 236358 - DNA, 75 bp, Artificial Sequence
  Synthetic
aaagatgatgatgatgaacttgacgacgaggtggaactgctgcacgcaaccgcgcccaggcggcgggtacagtgg

SEQ ID NO: 236359 - DNA, 75 bp, Artificial Sequence
  Synthetic
cgcgggctgggtgtgcgcggcaccagcgcgtcttgtgacgagtcttcttcgtcctcggactcgagacgccgcctc

SEQ ID NO: 236360 - DNA, 75 bp, Artificial Sequence
  Synthetic
agcgccagtgcgctattatctgcgacgcgttgcaagagcgcagcgatgtgcccctcgccatagcggatgttagcc

SEQ ID NO: 236361 - DNA, 75 bp, Artificial Sequence
  Synthetic
ggtcacccactttgcctacccggcacttaacctaccccccaaggttatgagcacagtcatgagcgagctgatcgt

SEQ ID NO: 236362 - DNA, 75 bp, Artificial Sequence
  Synthetic
tattacgctaaatggaacagatgaaaccaaccaagtaagcaaatactcaatatcattcagttggtcatggaacag

SEQ ID NO: 236363 - DNA, 75 bp, Artificial Sequence
  Synthetic
gatgcaaacttgcaagaacaaaccgaggagggcctacccgcagttggcgatgagcagctggcgcgctggcttgag

SEQ ID NO: 236364 - DNA, 75 bp, Artificial Sequence
  Synthetic
gcgccgcgactacgtccgcgactgcgtttacttatttctatgctacacctggcaaacggccatgggcgtgtggca

SEQ ID NO: 236365 - DNA, 75 bp, Artificial Sequence
  Synthetic
tcatggaagacgtgagcggtgacggcctactggagtgtcactgtcgctgcaacctatgcaccccgcaccgctccc

SEQ ID NO: 236366 - DNA, 75 bp, Artificial Sequence
  Synthetic
gctgccgccgccacccacggacgaggaggaatactgggacagtcaggcagaggaggttttggacgaggaggagga

SEQ ID NO: 236367 - DNA, 75 bp, Artificial Sequence
  Synthetic
accctcggtcgcattcccctcgccggcgccccagaaatcggcaaccggtccaagcatggctacaacctccgctcc

SEQ ID NO: 236368 - DNA, 75 bp, Artificial Sequence
  Synthetic
catcatcaataatataccttattttggattgaagccaatatgataatgaggtgggcggagcggggcggggcgggg

SEQ ID NO: 236369 - DNA, 75 bp, Artificial Sequence
  Synthetic
aaaatacaaccccaccaatgtggaaatatctgacaaccccaacacctacgactacatgaacaagcgagtggtggc

SEQ ID NO: 236370 - DNA, 75 bp, Artificial Sequence
  Synthetic
cgtttctcctgagcctccgaccctgaccaggcagcccgatcgccgtgttggacctgcgactatgccccatctgct

SEQ ID NO: 236371 - DNA, 75 bp, Artificial Sequence
  Synthetic
cctgcacgtctcctgagttgtcttgataggcgatctcggccatgaactgctcgatctcttcctcctggagatctc

SEQ ID NO: 236372 - DNA, 75 bp, Artificial Sequence
  Synthetic
catcatcaataatataccttattttggattgaggccaatatgataatgaggtgggcggggcgaggcggggcgggt

SEQ ID NO: 236373 - DNA, 75 bp, Artificial Sequence
  Synthetic
tcacccacccaaacctgcgatttgcacaggcgggccaaaaagtaccttgccggtacttaacggctcttcctttgt

SEQ ID NO: 236374 - DNA, 75 bp, Artificial Sequence
  Synthetic
acaggcgggccaaaaagtaccttgccggtacttaacggctcttcctttgtgatttacaacagtttcaaccaagac

SEQ ID NO: 236375 - DNA, 75 bp, Artificial Sequence
  Synthetic
tttacagtaagtttgtgattggtgggtcggtgggctgtagtgtgggtaggtggtctgtggttttttttttttaat

SEQ ID NO: 236376 - DNA, 75 bp, Artificial Sequence
  Synthetic
gggcttatcagaaaaaatcaccctccttacctgccgggaacgtaccagtgcgtcaccggtcgccgcacccaccgc

SEQ ID NO: 236377 - DNA, 75 bp, Artificial Sequence
  Synthetic
caacagacctcaataattcccattttccataagaggaggtgagcttaaccccctggaagcgcatttttactgttt

SEQ ID NO: 236378 - DNA, 75 bp, Artificial Sequence
  Synthetic
tccataagaggaggtgagcttaaccccctggaagcgcatttttactgtttttaggcaaggtgtatgaactctact

SEQ ID NO: 236379 - DNA, 75 bp, Artificial Sequence
  Synthetic
ccctggaagcgcatttttactgtttttaggcaaggtgtatgaactctactaactctacgggcttttctgcttcag

SEQ ID NO: 236380 - DNA, 75 bp, Artificial Sequence
  Synthetic
ggtcattctcactcttgtaattctctttatttttatactagcgcttctgtgtcttaggcttgccgcctgctgcgc

SEQ ID NO: 236381 - DNA, 75 bp, Artificial Sequence
  Synthetic
attaaacgctggggacgccacccaagatgattaaatacatcattttaagcttgcttaccctagcggcagtctgca

SEQ ID NO: 236382 - DNA, 75 bp, Artificial Sequence
  Synthetic
gacaaagctggcaagtatgctgtatatgctatttggcagcctggagaccctaacaactataatgttacagttttt

SEQ ID NO: 236383 - DNA, 75 bp, Artificial Sequence
  Synthetic
aaacagtataagttgtggcccccacaaaagtgtgtggagaacactggcactttttgctttactgctctcctgatt

SEQ ID NO: 236384 - DNA, 75 bp, Artificial Sequence
  Synthetic
gggttaccggagaccccgaggttaagtgttcgctgtgctatatgaggctgacctcttcctttatctacagtaagt

SEQ ID NO: 236385 - DNA, 75 bp, Artificial Sequence
  Synthetic
tcctttatattaaatttaaaagcagacgcagctttattgaagaaaagaaaatgccttagcatgctgccgccgctt

SEQ ID NO: 236386 - DNA, 75 bp, Artificial Sequence
  Synthetic
gtgattaaaaagcaccaccgacagctcctcggtcatgtccggagtcataatgtaagactcggtaaacacatcagg

SEQ ID NO: 236387 - DNA, 75 bp, Artificial Sequence
  Synthetic
ttttttgtgtaggtgggctttttgggtaggtgggttttgtggcaggacaggtgtaaatgttgcttgtgttttttt

SEQ ID NO: 236388 - DNA, 75 bp, Artificial Sequence
  Synthetic
acgcagctttattgaagaaaagaaaatgccttagcatgctgccgccgcttcttgcttgcattgcaaaacagctta

SEQ ID NO: 236389 - DNA, 75 bp, Artificial Sequence
  Synthetic
cttgcaacggccccctcaaagctccccactttaccctgcttaatgtcattcccatggacaatggactctgtggaa

SEQ ID NO: 236390 - DNA, 75 bp, Artificial Sequence
  Synthetic
ccactttaccctgcttaatgtcattcccatggacaatggactctgtggaatatgtgccaggttggcaaggcaaga

SEQ ID NO: 236391 - DNA, 75 bp, Artificial Sequence
  Synthetic
cataaacacctgaaaaaccctcctgcctaggcaaaatagcaccctcccgctccagaacaacatacagcgcttcca

SEQ ID NO: 236392 - DNA, 75 bp, Artificial Sequence
  Synthetic
gctttcctggactgagagcgcctgacttcaacagcacctgccccgtggagttcatccagcaacttcagcagctcg

SEQ ID NO: 236393 - DNA, 75 bp, Artificial Sequence
  Synthetic
cttcaacagcacctgccccgtggagttcatccagcaacttcagcagctcgccttcgacatggtcgacacagtgaa

SEQ ID NO: 236394 - DNA, 75 bp, Artificial Sequence
  Synthetic
aaaaaacaccactcgacacggcaccagctcaatcagtcacagtgtaaaaaagggccaagtgcagagcgagtatat

SEQ ID NO: 236395 - DNA, 75 bp, Artificial Sequence
  Synthetic
acatctacccaagatatgccccaagtttctacctttgttaataattgggcaaacttgggcatgtggtggttttca

SEQ ID NO: 236396 - DNA, 75 bp, Artificial Sequence
  Synthetic
tttctacctttgttaataattgggcaaacttgggcatgtggtggttttcaatagcgcttatgtttgtctgcctta

SEQ ID NO: 236397 - DNA, 75 bp, Artificial Sequence
  Synthetic
aaacgaaagccaaaaaacccacaacttcctcaaatcgtcacttccgttttcccacgttacgtcacttcccatttt

SEQ ID NO: 236398 - DNA, 75 bp, Artificial Sequence
  Synthetic
aaagcgcaaacacgcccgaccacccatttataagcccattattgtgcttaacccaaacaatgatggaatacatag

SEQ ID NO: 236399 - DNA, 75 bp, Artificial Sequence
  Synthetic
atttataagcccattattgtgcttaacccaaacaatgatggaatacatagattggacgggctgaacacttgttct

SEQ ID NO: 236400 - DNA, 75 bp, Artificial Sequence
  Synthetic
agacatgattcctcgagtttttatattattgacccttgttgcgcttttctgcgcgtgctccacattggccgcggt

SEQ ID NO: 236401 - DNA, 75 bp, Artificial Sequence
  Synthetic
ttattgacccttgttgcgcttttctgcgcgtgctccacattggccgcggttgctaacatcgaagtagactgcatt

SEQ ID NO: 236402 - DNA, 75 bp, Artificial Sequence
  Synthetic
acggatttgtcacccttacgctcatctgcagcctcatcactgtagtgatcgcctttattcaatgcattgactggg

SEQ ID NO: 236403 - DNA, 75 bp, Artificial Sequence
  Synthetic
ctgcagcctcatcactgtagtgatcgcctttattcaatgcattgactgggtctgtgtgcgcattgcataccttag

SEQ ID NO: 236404 - DNA, 75 bp, Artificial Sequence
  Synthetic
gccatagctgagcttcttagaattctttaattatgaaaattacttggattttcttactaattttttacaccttaa

SEQ ID NO: 236405 - DNA, 75 bp, Artificial Sequence
  Synthetic
gtgtgtcgccccaagagcaggagttccattaaaaaatgcttgtttgagaggtgcaccctgggggtgctggcggag

SEQ ID NO: 236406 - DNA, 75 bp, Artificial Sequence
  Synthetic
tttaattatgaaaattacttggattttcttactaattttttacaccttaactgtggtttgctcccagacctccaa

SEQ ID NO: 236407 - DNA, 75 bp, Artificial Sequence
  Synthetic
agatttactcgtatatggaacattccaagttgctacactgaaaaaagcgacctgtccgaaacctggttgtatgcc

SEQ ID NO: 236408 - DNA, 75 bp, Artificial Sequence
  Synthetic
caagttgctacactgaaaaaagcgacctgtccgaaacctggttgtatgccatcatctcggtttttgtattttgta

SEQ ID NO: 236409 - DNA, 75 bp, Artificial Sequence
  Synthetic
cccctacctggatattggatggaacgccatagacgccatgagccattccactttccccgcgcccgctataattca

SEQ ID NO: 236410 - DNA, 75 bp, Artificial Sequence
  Synthetic
gccacagccgcaaggcctggcccgtgttcgagcacaatgtgttgacccgctgctccttgcatctgggcaacagga

SEQ ID NO: 236411 - DNA, 75 bp, Artificial Sequence
  Synthetic
gccatagacgccatgagccattccactttccccgcgcccgctataattcagatgcagccaattgttgccggcggc

SEQ ID NO: 236412 - DNA, 75 bp, Artificial Sequence
  Synthetic
ctccttctcccactcccactgagattagctactttaatctaacaggcggagatgactgacggcctagatttagaa

SEQ ID NO: 236413 - DNA, 75 bp, Artificial Sequence
  Synthetic
tagctactttaatctaacaggcggagatgactgacggcctagatttagaaatggacggaattatcaccgagcagc

SEQ ID NO: 236414 - DNA, 75 bp, Artificial Sequence
  Synthetic
ggcagagcaggaacgcctaaatcaggagctccaagacatggttaacctgcaccagtgtaaaagaggtattttttg

SEQ ID NO: 236415 - DNA, 75 bp, Artificial Sequence
  Synthetic
gagctccaagacatggttaacctgcaccagtgtaaaagaggtattttttgtctggttaagcaggcaaaagttacc

SEQ ID NO: 236416 - DNA, 75 bp, Artificial Sequence
  Synthetic
ggcttagctacaagctgcccgccaagcgccaaaaactgctgcttatggtgggagaaaggcccatcaccgtcactc

SEQ ID NO: 236417 - DNA, 75 bp, Artificial Sequence
  Synthetic
tgggcgtggtctgggggtgggaagcaatatataagttgggggtcttagggtctctgtgtctgttttgcagaggga

SEQ ID NO: 236418 - DNA, 75 bp, Artificial Sequence
  Synthetic
gcgccaaaaactgctgcttatggtgggagaaaggcccatcaccgtcactcagcagtcagtagaaactgagggctg

SEQ ID NO: 236419 - DNA, 75 bp, Artificial Sequence
  Synthetic
gaggacctttgcacccttattaagactttatgcggtcttagagatcttattccctttaactaataaacaatacaa

SEQ ID NO: 236420 - DNA, 75 bp, Artificial Sequence
  Synthetic
ctttatgcggtcttagagatcttattccctttaactaataaacaatacaataaatgtaatcaataaagaatcact

SEQ ID NO: 236421 - DNA, 75 bp, Artificial Sequence
  Synthetic
tatccaatttattcagcagcacctcctttccctcctcccaactctggtacctcagtcgtcttctagctgcaaact

SEQ ID NO: 236422 - DNA, 75 bp, Artificial Sequence
  Synthetic
ctttccctcctcccaactctggtacctcagtcgtcttctagctgcaaactttctccacagtttaaatgggatgtc

SEQ ID NO: 236423 - DNA, 75 bp, Artificial Sequence
  Synthetic
gcacccactattttcatgttgttgcagatgaagcgcgccagaccgtctgaagacaccttcaaccccgtgtaccct

SEQ ID NO: 236424 - DNA, 75 bp, Artificial Sequence
  Synthetic
ccgccgttcgcgatgacaagctgaccgccctgctggcgcagttggatgcgcttacccgggaactgggtgaccttt

SEQ ID NO: 236425 - DNA, 75 bp, Artificial Sequence
  Synthetic
tgtctcccccaatgggttccaagaaagtccccctggggtgctttctctgcgcctttccgaaccactcgtcacctc

SEQ ID NO: 236426 - DNA, 75 bp, Artificial Sequence
  Synthetic
agtccccctggggtgctttctctgcgcctttccgaaccactcgtcacctcccacggcatgcttgcgctcaaaatg

SEQ ID NO: 236427 - DNA, 75 bp, Artificial Sequence
  Synthetic
gggaatgcttctcctgcaaatgccgtttaagataaataaaaccagactctgtttggattaaagaaaagtagcaag

SEQ ID NO: 236428 - DNA, 75 bp, Artificial Sequence
  Synthetic
ccggcaaccttacatcacaaaatataaccaccgtcactgagccattaaaaaaaacaaagtccaacataagcctgg

SEQ ID NO: 236429 - DNA, 75 bp, Artificial Sequence
  Synthetic
aaccaccgtcactgagccattaaaaaaaacaaagtccaacataagcctggaaacctccgcgcccctcacagttac

SEQ ID NO: 236430 - DNA, 75 bp, Artificial Sequence
  Synthetic
gccgcacctttggtggtcgcgggcaacagtcttaccgtgcagtcacaggccccgttaaccgtgcaagactctaaa

SEQ ID NO: 236431 - DNA, 75 bp, Artificial Sequence
  Synthetic
acagtcttaccgtgcagtcacaggccccgttaaccgtgcaagactctaaacttagcattgccaccaaaggacccc

SEQ ID NO: 236432 - DNA, 75 bp, Artificial Sequence
  Synthetic
cctgcaaacatcgggccccctttctgccactgataacaacacccttactattactacttcaccccctataactac

SEQ ID NO: 236433 - DNA, 75 bp, Artificial Sequence
  Synthetic
gccactgataacaacacccttactattactacttcaccccctataactactacaaatggtagtttgggtgttaac

SEQ ID NO: 236434 - DNA, 75 bp, Artificial Sequence
  Synthetic
atggcaaactggggctcagagttgcaggtcctttgcaagtgaccaacgactctcacgcactaacagtaggtacag

SEQ ID NO: 236435 - DNA, 75 bp, Artificial Sequence
  Synthetic
aggtcctttgcaagtgaccaacgactctcacgcactaacagtaggtacaggtcagggtgttgccattgataataa

SEQ ID NO: 236436 - DNA, 75 bp, Artificial Sequence
  Synthetic
gcaatagggtatgatacatctggcaacatggaacttaaaactggagggggagtgcgtgtagacagtgtaaatagg

SEQ ID NO: 236437 - DNA, 75 bp, Artificial Sequence
  Synthetic
acatggaacttaaaactggagggggagtgcgtgtagacagtgtaaataggcgtcttatactcgatgttgattatc

SEQ ID NO: 236438 - DNA, 75 bp, Artificial Sequence
  Synthetic
cctaaaactaggacagggacccctatatgtaaactcaagcacacacaacttggatttaaactacaataaaggcct

SEQ ID NO: 236439 - DNA, 75 bp, Artificial Sequence
  Synthetic
tatgtaaactcaagcacacacaacttggatttaaactacaataaaggccttcacttgtttacaactggaaactct

SEQ ID NO: 236440 - DNA, 75 bp, Artificial Sequence
  Synthetic
caacaaaaggtcttatttttgacaccgatgctgttgcaataaatgcagcacaaggtctagaatttggtaatgata

SEQ ID NO: 236441 - DNA, 75 bp, Artificial Sequence
  Synthetic
cgatgctgttgcaataaatgcagcacaaggtctagaatttggtaatgatacgtcaacaaatacaaacccacttaa

SEQ ID NO: 236442 - DNA, 75 bp, Artificial Sequence
  Synthetic
tatgactcaaacggtggtatgattcccaaacttggaacaggccttagttttgatactacaggggctataacagtg

SEQ ID NO: 236443 - DNA, 75 bp, Artificial Sequence
  Synthetic
ccaaacttggaacaggccttagttttgatactacaggggctataacagtgggaaacaaaagcgatgacaaactta

SEQ ID NO: 236444 - DNA, 75 bp, Artificial Sequence
  Synthetic
acctaattgtcaaatatactcagaaaaagatgctaagctaacactagttttaactaaatgtggcagtcaggtact

SEQ ID NO: 236445 - DNA, 75 bp, Artificial Sequence
  Synthetic
aaagatgctaagctaacactagttttaactaaatgtggcagtcaggtacttgcaactgtgtcagcactggctgta

SEQ ID NO: 236446 - DNA, 75 bp, Artificial Sequence
  Synthetic
gaacaataagtagtgctcacattattctcagatttaatgaacatggggtgctaatgaatcattctggtttggatc

SEQ ID NO: 236447 - DNA, 75 bp, Artificial Sequence
  Synthetic
cagcgcggccagagtcatgtccttccatgggcgcagggtcctcgtcagggtggtctgggtcacggtgaaggggtg

SEQ ID NO: 236448 - DNA, 75 bp, Artificial Sequence
  Synthetic
tctcagatttaatgaacatggggtgctaatgaatcattctggtttggatccccaatactggaatttcagaaaagg

SEQ ID NO: 236449 - DNA, 75 bp, Artificial Sequence
  Synthetic
actaacgcagttggttttatgcccaaccttaaagcttacccaaaaactcaaagtagaactgcaaaaagcaacatt

SEQ ID NO: 236450 - DNA, 75 bp, Artificial Sequence
  Synthetic
accttaaagcttacccaaaaactcaaagtagaactgcaaaaagcaacattgttagtcaggtttatcttaatggag

SEQ ID NO: 236451 - DNA, 75 bp, Artificial Sequence
  Synthetic
tattacacttaatggaactgatgaaaatcaaaccactcccgccagtacatactcaatttcattttcatggagctg

SEQ ID NO: 236452 - DNA, 75 bp, Artificial Sequence
  Synthetic
cggaccagtttattcccaactttgacgcggtgaaagactcggcggacggctacgactgaatgaccagtggagagg

SEQ ID NO: 236453 - DNA, 75 bp, Artificial Sequence
  Synthetic
tcttccgcatcgctgtctgcgagggccagctgctggggtgagtattccctctcgaaggcgggcatgacctcagcg

SEQ ID NO: 236454 - DNA, 75 bp, Artificial Sequence
  Synthetic
cagctccagcctgtcccagagctcggtgatgtgctctacggcatctcgatccagcagatctcctcgtttcgcggg

SEQ ID NO: 236455 - DNA, 75 bp, Artificial Sequence
  Synthetic
gtccggggggtccgcgtccaccgtgaagaccccggggcgcaggcgcgcgtcgaagtagtcgatcttgcatccttg

SEQ ID NO: 236456 - DNA, 75 bp, Artificial Sequence
  Synthetic
tgatgttcacctgtccggaagtgatacctttgagcgtacctgggtccatctggtcagaaaacactatttttttgt

SEQ ID NO: 236457 - DNA, 75 bp, Artificial Sequence
  Synthetic
aaaccctcctgcctaggcaaaatagcaccctcccgctccagaacaacatacagcgcttccacagcggcagccata

SEQ ID NO: 236458 - DNA, 75 bp, Artificial Sequence
  Synthetic
catcatcaataatataccttattttggattgaagccaatatgataatgagatgggtggcgcggggcggggcgcgg

SEQ ID NO: 236459 - DNA, 75 bp, Artificial Sequence
  Synthetic
ggattgaagccaatatgataatgagatgggtggcgcggggcggggcgcggggcgggaggcgggttcgggggcggg

SEQ ID NO: 236460 - DNA, 75 bp, Artificial Sequence
  Synthetic
ccggcgggcggggcggtgtggcggaagtggactttgtaagtgtggcggatgtgacttgctagtgtcgggcgcggt

SEQ ID NO: 236461 - DNA, 75 bp, Artificial Sequence
  Synthetic
aacgcccacgggaagtgacatttttcccgcggtttttaccggatgttgtagtgaatttgggcgtaaccaagtaag

SEQ ID NO: 236462 - DNA, 75 bp, Artificial Sequence
  Synthetic
atttggccattttcgcgggaaaactgaaacggggaagtgaaatctgattaatttcgcgttagtcataccgcgtaa

SEQ ID NO: 236463 - DNA, 75 bp, Artificial Sequence
  Synthetic
ggccgattacgtggaggactcgcccaggtgttttttgaggtgaatttccgcgttccgggtcaaagtctccgtttt

SEQ ID NO: 236464 - DNA, 75 bp, Artificial Sequence
  Synthetic
tgtatttataccctctgatctcgtcaagaggccactcttgagtgccagcgagtagagttttctcctctgccgctc

SEQ ID NO: 236465 - DNA, 75 bp, Artificial Sequence
  Synthetic
gctcgaaggctatgggaatctcttcctccgccagcatcaccacctcttcctcttcttcctcctctggcacttcca

SEQ ID NO: 236466 - DNA, 75 bp, Artificial Sequence
  Synthetic
ctacgatctggatgtggtggggcccagcgatccgaacgagcaggcggtttccagtttttttccagagtccatgtt

SEQ ID NO: 236467 - DNA, 75 bp, Artificial Sequence
  Synthetic
cttgagacccctcctccgatcgtggattcccccgatccgccgcagctgactaggcagcccgagcgctgtgcggga

SEQ ID NO: 236468 - DNA, 75 bp, Artificial Sequence
  Synthetic
ctgaggtgatcgatctcacctgtaatgagtctggttttccacccagcgaggatgaggacgaagagggtgagcagt

SEQ ID NO: 236469 - DNA, 75 bp, Artificial Sequence
  Synthetic
tatcaccggaaaaacacaggagactcccagattatgtgttctctgtgttatatgaagatgacctgtatgtttatt

SEQ ID NO: 236470 - DNA, 75 bp, Artificial Sequence
  Synthetic
tatgaagatgacctgtatgtttatttacagtaagtttatcatcggtgggcaggtgggctatagtgtgggtggtgg

SEQ ID NO: 236471 - DNA, 75 bp, Artificial Sequence
  Synthetic
tcaggggttatgctgaagacttttttattgtgatttttaaaggtccagtgtctgagcccgagcaagaacctgaac

SEQ ID NO: 236472 - DNA, 75 bp, Artificial Sequence
  Synthetic
tattgtgatttttaaaggtccagtgtctgagcccgagcaagaacctgaaccggagcctgagccttctcgccccag

SEQ ID NO: 236473 - DNA, 75 bp, Artificial Sequence
  Synthetic
cccagcgcaccggtagcgagaggcctcagcagcgcggagaccaccgactccggtgcttcctcatcacccccggag

SEQ ID NO: 236474 - DNA, 75 bp, Artificial Sequence
  Synthetic
ttgatgtcccccaaggcctccaggcgctccatggcctcgtagaagtccacggcgaagttgaaaaactgggagttg

SEQ ID NO: 236475 - DNA, 75 bp, Artificial Sequence
  Synthetic
tgcattgaggacttgctttttgattcacaggaacctttggacttgagcttgaaacgccccaggcattaaacctgg

SEQ ID NO: 236476 - DNA, 75 bp, Artificial Sequence
  Synthetic
ctatgtttgcttttgaatgacttaatgtgtatagataataaagagtgagataatgttttaattgcatggtgtgtt

SEQ ID NO: 236477 - DNA, 75 bp, Artificial Sequence
  Synthetic
agttcgtgccttgctggacgagagctctaacaatacctcttggtggtggaggtatttgtggggctctccccaggg

SEQ ID NO: 236478 - DNA, 75 bp, Artificial Sequence
  Synthetic
ggattctttgaatctaggccaccaggctctcttccaggagaaggtcatcaggactttggatttttccacaccggg

SEQ ID NO: 236479 - DNA, 75 bp, Artificial Sequence
  Synthetic
ctagcttttttgaaggatagatggagcgaagagacccacttgagttcgggctacgtcctggattttctggccatg

SEQ ID NO: 236480 - DNA, 75 bp, Artificial Sequence
  Synthetic
ttccgtccgcccgttgctgattccggcggaggagcaacaggccgggtcagaggaccgggcccgtcgggatccgga

SEQ ID NO: 236481 - DNA, 75 bp, Artificial Sequence
  Synthetic
tttttccagaactgcggcggattttgactattagggaggatgggcaatttgttaagggtcttaagagggagaggg

SEQ ID NO: 236482 - DNA, 75 bp, Artificial Sequence
  Synthetic
gactattagggaggatgggcaatttgttaagggtcttaagagggagaggggggcttctgagcataacgaggaggc

SEQ ID NO: 236483 - DNA, 75 bp, Artificial Sequence
  Synthetic
gcgctgcttcagcgcgtggctcgttacaacagcggcaacgtgcagaccaacctggaccggctggtgggggatgtg

SEQ ID NO: 236484 - DNA, 75 bp, Artificial Sequence
  Synthetic
accagacaccgtccagagtgcatcacttttcagcagattaaggacaattgtgccaatgagttggatctgttgggt

SEQ ID NO: 236485 - DNA, 75 bp, Artificial Sequence
  Synthetic
cttttcagcagattaaggacaattgtgccaatgagttggatctgttgggtcagaagtatagcatagagcagctga

SEQ ID NO: 236486 - DNA, 75 bp, Artificial Sequence
  Synthetic
tgatctggaggaagctattagggtgtatgctaaggtggccctgcggcccgattgcaagtacaagctcaaggggct

SEQ ID NO: 236487 - DNA, 75 bp, Artificial Sequence
  Synthetic
ggtgaatatcaggaattgttgctacatttctggcaacggggcggaggtggagatagagaccgaagacagggtggc

SEQ ID NO: 236488 - DNA, 75 bp, Artificial Sequence
  Synthetic
tcctgcacggggtgagcttctatgggtttaacaacacctgtgtggaggcctggaccgatgtgaaggtccgcggtt

SEQ ID NO: 236489 - DNA, 75 bp, Artificial Sequence
  Synthetic
agttccattaagaaatgcttgtttgagaggtgcaccttggggatcctggccgagggcaactgcagggtgcgccac

SEQ ID NO: 236490 - DNA, 75 bp, Artificial Sequence
  Synthetic
accagccacagccggaaggcctggcccgtgttcgagcacaacttgctgacccgctgctccttgcatctgggcaac

SEQ ID NO: 236491 - DNA, 75 bp, Artificial Sequence
  Synthetic
gatgctggatgtgaccgaggagctgaggacagaccacttggttctggcctgcaccagggccgagtttggttctag

SEQ ID NO: 236492 - DNA, 75 bp, Artificial Sequence
  Synthetic
ggttggacagacagcgcctgctgcgcgaggaggactttgagcccgacacgcagacgggcatcagccccgcgcgcg

SEQ ID NO: 236493 - DNA, 75 bp, Artificial Sequence
  Synthetic
cagcagcagcagtagcagcagcgccttggatggcagcatcgtgagcccttatttgacgacgcggatgccccactg

SEQ ID NO: 236494 - DNA, 75 bp, Artificial Sequence
  Synthetic
ttggatggcagcatcgtgagcccttatttgacgacgcggatgccccactgggccggggtgcgtcagaatgtgatg

SEQ ID NO: 236495 - DNA, 75 bp, Artificial Sequence
  Synthetic
ggccggggtgcgtcagaatgtgatgggctccagcatcgacggccgacccgtcctgcccgcaaattccgccacgct

SEQ ID NO: 236496 - DNA, 75 bp, Artificial Sequence
  Synthetic
ccgttggacgccaccgccgccgccgccgccaccgcagccgcctcggccgtgcgcagcctggccacggactttgca

SEQ ID NO: 236497 - DNA, 75 bp, Artificial Sequence
  Synthetic
ccgccaccgcagccgcctcggccgtgcgcagcctggccacggactttgcattcctgggaccactggcgacagggg

SEQ ID NO: 236498 - DNA, 75 bp, Artificial Sequence
  Synthetic
aacagcggcaacgtgcagaccaacctggaccggctggtgggggacgtgcgcgaggcggtggcgcagcgggagcgc

SEQ ID NO: 236499 - DNA, 75 bp, Artificial Sequence
  Synthetic
atgcttctcccacaaatgccgtttaagataaataaaaccagactctgtttggattaaagaaaagtagcaagtgca

SEQ ID NO: 236500 - DNA, 75 bp, Artificial Sequence
  Synthetic
ctgcggggcgatgaagaaaacggtttccggagccggggagattaactgggatgagagcaggtttctaagcagctg

SEQ ID NO: 236501 - DNA, 75 bp, Artificial Sequence
  Synthetic
aaaacaccactcgacacggcaccagctcaatcagtcacagtgtaaaaagggccaagtacagagcgagtatatata

SEQ ID NO: 236502 - DNA, 75 bp, Artificial Sequence
  Synthetic
aggacgagtacctgaacaactccctgatgcagccggtgcgggagaaaaacctgccccccgccttccccaacaacg

SEQ ID NO: 236503 - DNA, 75 bp, Artificial Sequence
  Synthetic
cagaaggcgctcgccgcccagggacagcagctcttgcaaggaagcaaagtttttcagcggcttgaggccgtccgc

SEQ ID NO: 236504 - DNA, 75 bp, Artificial Sequence
  Synthetic
catcatcaataatataccttattttggattgaagccaatatgataatgaggtgggcggagcggggcggagttggg

SEQ ID NO: 236505 - DNA, 75 bp, Artificial Sequence
  Synthetic
gggcgggccgggaggtgtggcggaagttgagtttgtaagtgtggcggatgagacttgctagcgccggatgtggta

SEQ ID NO: 236506 - DNA, 75 bp, Artificial Sequence
  Synthetic
gcttgaggctggttctgctggtgctgaagcgctgccggtcttcgccctgcgcgtcggccaggtagcatttgacca

SEQ ID NO: 236507 - DNA, 75 bp, Artificial Sequence
  Synthetic
gagccgccgtacgtgcctccgcggtacctgcggcctacggggggaagaaacagcatccgttactcggagctggcg

SEQ ID NO: 236508 - DNA, 75 bp, Artificial Sequence
  Synthetic
ggcagagcaggctcttgagcgcgtagagcttgggggcgaggaagaccgattcgggggagtaggcgtccgcgccgc

SEQ ID NO: 236509 - DNA, 75 bp, Artificial Sequence
  Synthetic
tcgggggagtaggcgtccgcgccgcaggccccgcacacggtctcgcactccaccagccaggtgagctcggggcgc

SEQ ID NO: 236510 - DNA, 75 bp, Artificial Sequence
  Synthetic
agaggccactcttgagtgccagcgagtagagttttctcctctgccgcttcgctccgctccgacaccgggggaaaa

SEQ ID NO: 236511 - DNA, 75 bp, Artificial Sequence
  Synthetic
catgctttttgatgcgtttcttacctcgggtctccatgaggtggtgtccccgctcggtgacgaagaggctgtccg

SEQ ID NO: 236512 - DNA, 75 bp, Artificial Sequence
  Synthetic
gtctgctcaccggccagctggctgcctcggtcctggacgccctgatcgaggaggtattggccgacaattatcctc

SEQ ID NO: 236513 - DNA, 75 bp, Artificial Sequence
  Synthetic
ctcggtcctggacgccctgatcgaggaggtattggccgacaattatcctcctccagctcattttgagccgcctac

SEQ ID NO: 236514 - DNA, 75 bp, Artificial Sequence
  Synthetic
cgctcggtgacgaagaggctgtccgtgtctccgtagaccgacttgaggggtcttttctccaggggggtccctcgg

SEQ ID NO: 236515 - DNA, 75 bp, Artificial Sequence
  Synthetic
actctgagacgaaggcccgcgtccaggccaggacgaaggaggctatgtgggaggggtagcggtcgttgtccacta

SEQ ID NO: 236516 - DNA, 75 bp, Artificial Sequence
  Synthetic
gtggtggcacctagcgacccgaacgagcaggcggtttccagtttttttcctgactctatgctgttggccagccag

SEQ ID NO: 236517 - DNA, 75 bp, Artificial Sequence
  Synthetic
aagacacatgtcgccttcctcggcgtccaggaaggtgattggcttgtaggtgtaggccacgtgaccgggggttcc

SEQ ID NO: 236518 - DNA, 75 bp, Artificial Sequence
  Synthetic
tgtaggccacgtgaccgggggttcctgacgggggggtataaaagggggtgggggcgcgctcgtcgtcactctctt

SEQ ID NO: 236519 - DNA, 75 bp, Artificial Sequence
  Synthetic
ggttgtcagtttccaaaaacgaggaggatttgatgttcacctgtcccgaggtgatacctttgagggtacccgcgt

SEQ ID NO: 236520 - DNA, 75 bp, Artificial Sequence
  Synthetic
atacaggagacccccaaattatgtgttccctgtgttatatgaagacgacctgtatgtttatttacagtaagtttg

SEQ ID NO: 236521 - DNA, 75 bp, Artificial Sequence
  Synthetic
tttattgtccagcttggtggcgaacgacccgtagagggcgttggagagcagcttggcgatggagcgcagggtctg

SEQ ID NO: 236522 - DNA, 75 bp, Artificial Sequence
  Synthetic
tgtatgtttatttacagtaagtttgtgattggtgggtcggtgggctgtagtgtgggtaggtggtctgtggttttt

SEQ ID NO: 236523 - DNA, 75 bp, Artificial Sequence
  Synthetic
gcttgaaggaagaagaggcgggagagggcagcggcggcggcggcggcggtcaggaggagggcggggcctcctctg

SEQ ID NO: 236524 - DNA, 75 bp, Artificial Sequence
  Synthetic
aaggtccggtgtctgaacctgagcaggaagctgaaccggagcctgagagtcgccccaggagaaggcctgcaattc

SEQ ID NO: 236525 - DNA, 75 bp, Artificial Sequence
  Synthetic
ggaagctgaaccggagcctgagagtcgccccaggagaaggcctgcaattctaactagaccgagtgcacctgtagc

SEQ ID NO: 236526 - DNA, 75 bp, Artificial Sequence
  Synthetic
accgattccggtccttcctcatcccctccagagattcaccccgtggtgcctttgtgtcccctcaagcccgttgcc

SEQ ID NO: 236527 - DNA, 75 bp, Artificial Sequence
  Synthetic
ctccagagattcaccccgtggtgcctttgtgtcccctcaagcccgttgccgtgagagttagtgggcggagggccg

SEQ ID NO: 236528 - DNA, 75 bp, Artificial Sequence
  Synthetic
ggggggtccgcgtccacggtgaaaaccccggggcgcaggcgcgcgtcgaagtagtctatcttgcaaccttgcatg

SEQ ID NO: 236529 - DNA, 75 bp, Artificial Sequence
  Synthetic
taatgagacacaggaacctttggacttgagctgtaaacgccctaggcaataaacctgcttacctggactgaatga

SEQ ID NO: 236530 - DNA, 75 bp, Artificial Sequence
  Synthetic
gttgacgcctatgtttgcttttgaatgacttaatgtgtatataataaagagtgagataatgtttaattgcatggt

SEQ ID NO: 236531 - DNA, 75 bp, Artificial Sequence
  Synthetic
gagcggcgggccccagggcatggggtgggtgagtgcggaggcgtacatgccgcagatgtcatagacgtagagggg

SEQ ID NO: 236532 - DNA, 75 bp, Artificial Sequence
  Synthetic
gggtagcagcggccgccgcggatgctggcgcgcacgtagtcatacagctcgtgcgagggggcgaggaggtcgggg

SEQ ID NO: 236533 - DNA, 75 bp, Artificial Sequence
  Synthetic
gggtatataagcttccctgggctaaacttggttacacttgacctcatggaggcctgggagtgtttagagagcttt

SEQ ID NO: 236534 - DNA, 75 bp, Artificial Sequence
  Synthetic
ggcctgggagtgtttagagagctttgccgaagtgcgtgctttgctggaagagagctctaataatacctctgggtg

SEQ ID NO: 236535 - DNA, 75 bp, Artificial Sequence
  Synthetic
ccgcgcggaagacgatctgcctgaagatggcatgcgagttggaagagatggtggggcgctggaagacgttgaagc

SEQ ID NO: 236536 - DNA, 75 bp, Artificial Sequence
  Synthetic
aggaggattacaagtgggaatttgaacagcttttgaaatcctgtggtgagctcttggattctttgaatctgggcc

SEQ ID NO: 236537 - DNA, 75 bp, Artificial Sequence
  Synthetic
catcaggactttggatttttccacaccggggcgcattgctgccggggttgcttttctagcttttttgaaggataa

SEQ ID NO: 236538 - DNA, 75 bp, Artificial Sequence
  Synthetic
tacttagcctgccccttctttttccacagctcgcggttgaggacaaactcttcgcggtctttccagtactcttgg

SEQ ID NO: 236539 - DNA, 75 bp, Artificial Sequence
  Synthetic
cttttctagcttttttgaaggataaatggagcgaagagacccacttgagttcgggatacgtcctggattttctgg

SEQ ID NO: 236540 - DNA, 75 bp, Artificial Sequence
  Synthetic
atggagcgaagagacccacttgagttcgggatacgtcctggattttctggccatacaactgtggagagcatggat

SEQ ID NO: 236541 - DNA, 75 bp, Artificial Sequence
  Synthetic
ggtaagagcctagcatgtagaactggttgacggcctggtaggcgcagcagcccttctccacggggagggcgtagg

SEQ ID NO: 236542 - DNA, 75 bp, Artificial Sequence
  Synthetic
ttgtcttccgtccgtccgttgctgattcagccggaggagcagcagaccgggccggaggaccgggctcgtccggaa

SEQ ID NO: 236543 - DNA, 75 bp, Artificial Sequence
  Synthetic
cccttctccacggggagggcgtaggcctgcgcggccttgcggagcgaggtgtgggtcagggcgaaggtgtccctg

SEQ ID NO: 236544 - DNA, 75 bp, Artificial Sequence
  Synthetic
accatgactttgaggtactggtgcttgaagtcggagtcgtcgcagccgccccgctcccagagcgagaagtcggtg

SEQ ID NO: 236545 - DNA, 75 bp, Artificial Sequence
  Synthetic
ccagaggagagggcgcccgcggcggcgccggagaggagcgcgtggaacctgggagccggcctgaacggccatcca

SEQ ID NO: 236546 - DNA, 75 bp, Artificial Sequence
  Synthetic
gggagccggcctgaacggccatccacatcgggagtgaatgttggacaggtggcggatctctttccagaactgcga

SEQ ID NO: 236547 - DNA, 75 bp, Artificial Sequence
  Synthetic
catcgggagtgaatgttggacaggtggcggatctctttccagaactgcgacgaatcttgactattagggaggatg

SEQ ID NO: 236548 - DNA, 75 bp, Artificial Sequence
  Synthetic
ttgcgggtgatgcggaagggccccggcacttcagagcggttgttgatgacctgggcggcgagcacgatctcgtcg

SEQ ID NO: 236549 - DNA, 75 bp, Artificial Sequence
  Synthetic
ggagcggggggcttctgaacataacgaggaggccagtaatttagcttttagtctgatgaccagacaccgtcccga

SEQ ID NO: 236550 - DNA, 75 bp, Artificial Sequence
  Synthetic
ctgggcggcgagcacgatctcgtcgaagccgttgatgttgtggcccacgatgtagagttccaggaagcggggccg

SEQ ID NO: 236551 - DNA, 75 bp, Artificial Sequence
  Synthetic
gtgcattacttttcagcagattaaagataattgtgccaatgagttagatctgctgggtcagaagtacagcataga

SEQ ID NO: 236552 - DNA, 75 bp, Artificial Sequence
  Synthetic
agctcttcgtaggtgagctcctcgggcgaggcgaggccgtgctcggccagggcccagtccgcgaggtgcgggttg

SEQ ID NO: 236553 - DNA, 75 bp, Artificial Sequence
  Synthetic
gcgaggcgaggccgtgctcggccagggcccagtccgcgaggtgcgggttgtctctgaggaaggactcccagaggt

SEQ ID NO: 236554 - DNA, 75 bp, Artificial Sequence
  Synthetic
cgcgggccaggagggtctgcaggcggtccctgaaggtcctgaactggcggcccacggccattttttcgggggtga

SEQ ID NO: 236555 - DNA, 75 bp, Artificial Sequence
  Synthetic
gagcagatgtactggtcgctgccaaacatgatgcaagacccggtgaccttccgttccacgcggcaggttagcaac

SEQ ID NO: 236556 - DNA, 75 bp, Artificial Sequence
  Synthetic
gtccctgaaggtcctgaactggcggcccacggccattttttcgggggtgatgcagtagaaggtgagggggtcttg

SEQ ID NO: 236557 - DNA, 75 bp, Artificial Sequence
  Synthetic
agggcgagatcgcgcgcggcggtgaccaggcgctcgtcgcccccgaatttcatgaccagcatgaagggcacgagc

SEQ ID NO: 236558 - DNA, 75 bp, Artificial Sequence
  Synthetic
tgaatatgtggcctggggtgctgggcatggacggggtggtgattatgaatgtgaggttcacggggcccaatttta

SEQ ID NO: 236559 - DNA, 75 bp, Artificial Sequence
  Synthetic
atgacgaggtgtacggcgacgaagacctgctggagcaggccaacgatcgctccggagagtttgcttacgggaagc

SEQ ID NO: 236560 - DNA, 75 bp, Artificial Sequence
  Synthetic
ggtgctggcgctgccgctggaccggggcaaccccacccccagcctgaagcccgtgaccctgcagcaggtgctgcc

SEQ ID NO: 236561 - DNA, 75 bp, Artificial Sequence
  Synthetic
cggttgcttcatgctagtcaagagcgtggcggttatcaagcataacatggtgtgcggcaacagcgaggacaaggc

SEQ ID NO: 236562 - DNA, 75 bp, Artificial Sequence
  Synthetic
cgcgcacgaggaagccgagggggaatctgagccccccgcctggctcgcggcatggctggtgctcttctactttgg

SEQ ID NO: 236563 - DNA, 75 bp, Artificial Sequence
  Synthetic
ccacacgctccaaaatcatgtccgtactcatctcgcccagcaacaacaccggctgggggctgcgcgcacccagca

SEQ ID NO: 236564 - DNA, 75 bp, Artificial Sequence
  Synthetic
aacatgtaaaaataatgtactaggagacactttcaataaaggcaaatgtttttatttgtacactcttgggtgatt

SEQ ID NO: 236565 - DNA, 75 bp, Artificial Sequence
  Synthetic
atgcgtgtccgtctccgtctggctcctcgaggggtgttacggtggagcggaccaccacgccgcgcgagccgcagg

SEQ ID NO: 236566 - DNA, 75 bp, Artificial Sequence
  Synthetic
ctcgaggggtgttacggtggagcggaccaccacgccgcgcgagccgcaggtccagatatcggcgcgcggcggtcg

SEQ ID NO: 236567 - DNA, 75 bp, Artificial Sequence
  Synthetic
gtggcggttatcaagcataacatggtgtgcggcaacagcgaggacaaggcctcgcagatgctgacctgctcggat

SEQ ID NO: 236568 - DNA, 75 bp, Artificial Sequence
  Synthetic
gtgttgacccgctgctctttgcatctgggcaacaggaggggtgtgttcctgccctatcaatgcaacttgagccac

SEQ ID NO: 236569 - DNA, 75 bp, Artificial Sequence
  Synthetic
tgggagctgtccatggtctggagctcccgcggcggcggcaggtcagccgggagttcttgcaggttcacctcgcag

SEQ ID NO: 236570 - DNA, 75 bp, Artificial Sequence
  Synthetic
actacacacccggcgcgccgaccgcctccgccgtgtccaccgtggaccaggcgatcgaaagcgtggtacaggggg

SEQ ID NO: 236571 - DNA, 75 bp, Artificial Sequence
  Synthetic
cccgcggcggcggcaggtcagccgggagttcttgcaggttcacctcgcagagtcgggccagggcgcggggcaggt

SEQ ID NO: 236572 - DNA, 75 bp, Artificial Sequence
  Synthetic
ctccgccgtgtccaccgtggaccaggcgatcgaaagcgtggtacagggggcgcggcactatgccaaccttaaaag

SEQ ID NO: 236573 - DNA, 75 bp, Artificial Sequence
  Synthetic
ctcttccagcgccgccgccgccgccactagcaccgcggacatggagacgcagactagctcctccctcgtcgcccc

SEQ ID NO: 236574 - DNA, 75 bp, Artificial Sequence
  Synthetic
catcgccggagaccccgggctactgccgccgcgcgccttaccaaggctctgctcaagcgcgccaggcgaactggc

SEQ ID NO: 236575 - DNA, 75 bp, Artificial Sequence
  Synthetic
ccgccgcgcgccttaccaaggctctgctcaagcgcgccaggcgaactggccaccgggccgccatgagggccgcac

SEQ ID NO: 236576 - DNA, 75 bp, Artificial Sequence
  Synthetic
ggtgccgcgggcgggcccccggaggtagggggggctccggtcccgcgggcaggggcggcagcggcacgtcggcgt

SEQ ID NO: 236577 - DNA, 75 bp, Artificial Sequence
  Synthetic
cgtggccccgcgggcacaaaggcgcgcggccgctgccgccgccgccgccatttccagcttggcctcgacgcggcg

SEQ ID NO: 236578 - DNA, 75 bp, Artificial Sequence
  Synthetic
acgacgcggcggttgatctcctggatctggcgcctctgcgtgaagacgacgggcccggtgagcttgaacctgaaa

SEQ ID NO: 236579 - DNA, 75 bp, Artificial Sequence
  Synthetic
tctggcgcctctgcgtgaagacgacgggcccggtgagcttgaacctgaaagagagttcgacagaatcaatctcgg

SEQ ID NO: 236580 - DNA, 75 bp, Artificial Sequence
  Synthetic
gggcccggtgagcttgaacctgaaagagagttcgacagaatcaatctcggtgtcattgaccgcggcctggcgcag

SEQ ID NO: 236581 - DNA, 75 bp, Artificial Sequence
  Synthetic
gagtccgccctcgttccagactcggctgtagaccacgcccccctggtcgtcgcgggcgcgcatgaccacctgcgc

SEQ ID NO: 236582 - DNA, 75 bp, Artificial Sequence
  Synthetic
ggcctgagcggaggcagccgccgtgcgcaccggcggcgacgcgccaccagccgacgcatgcgcggcggggtgctg

SEQ ID NO: 236583 - DNA, 75 bp, Artificial Sequence
  Synthetic
aacggccccgcgagagtctaaaagaggacctgctggcgctaccgctggacgagggcaatcccaccccgagtctga

SEQ ID NO: 236584 - DNA, 75 bp, Artificial Sequence
  Synthetic
acggcgaagttgaaaaactgggagttgcgcgccgacacggtcaactcctcctccagaagacggatgagctcggcg

SEQ ID NO: 236585 - DNA, 75 bp, Artificial Sequence
  Synthetic
ggacctgctggcgctaccgctggacgagggcaatcccaccccgagtctgaagccggtgaccctgcaacaggtgct

SEQ ID NO: 236586 - DNA, 75 bp, Artificial Sequence
  Synthetic
taggcccgagtccagcgttctcggtcgttgagggtgcggtgtatcttctccaggacgtggtagaggtggctctgg

SEQ ID NO: 236587 - DNA, 75 bp, Artificial Sequence
  Synthetic
aggctatggggatctcttcctccgctagcatcaccacctcctcctcttcctcctcttctggcacttccatgatgg

SEQ ID NO: 236588 - DNA, 75 bp, Artificial Sequence
  Synthetic
gcgcccggcgtgggagtccagaccgtggacgttaggattcccacggaggagatggaaacccaaaccgccactccc

SEQ ID NO: 236589 - DNA, 75 bp, Artificial Sequence
  Synthetic
tggacgttaggattcccacggaggagatggaaacccaaaccgccactccctcttcggcggctagcgccaccaccg

SEQ ID NO: 236590 - DNA, 75 bp, Artificial Sequence
  Synthetic
tggcgatgtttcctcccagatcccttctgggattcatgttgtggaggaccaccagcacagtatatccggtgcact

SEQ ID NO: 236591 - DNA, 75 bp, Artificial Sequence
  Synthetic
ggacccctggctacctgccgccactgccgccgccgccgccgccgccgccgccgccccccgttcgcgcgggcgcaa

SEQ ID NO: 236592 - DNA, 75 bp, Artificial Sequence
  Synthetic
gccgccgccgccgccgccgccgccgccgccccccgttcgcgcgggcgcaagagaaattatccagcggccagcgcg

SEQ ID NO: 236593 - DNA, 75 bp, Artificial Sequence
  Synthetic
tttggacttgagcattaaacgccctaggcaataaaccccacctaagtaataaaccccacctaagtaataaaactt

SEQ ID NO: 236594 - DNA, 75 bp, Artificial Sequence
  Synthetic
ccccaggcttcgttctggcatcggcgcaggtccttgtagtagtcttgcatgagcctttccaccggcacctcttct

SEQ ID NO: 236595 - DNA, 75 bp, Artificial Sequence
  Synthetic
ggatgatggttccctcgggccccggggcgtagttgccttcgcagatctgcatttcccaggccttaatttctgagg

SEQ ID NO: 236596 - DNA, 75 bp, Artificial Sequence
  Synthetic
gcaggtccttgtagtagtcttgcatgagcctttccaccggcacctcttctccttcctcttctgcttcttccatgt

SEQ ID NO: 236597 - DNA, 75 bp, Artificial Sequence
  Synthetic
accccgaaccccctgagcggttggagcagggccaggtcggcgacgacgcgctcggccaggatggcctgctgcacc

SEQ ID NO: 236598 - DNA, 75 bp, Artificial Sequence
  Synthetic
ggtcgtacatgcacatctcgggccaggacgcctcggagtacctgagccccgggctggtgcagttcgcccgcgcca

SEQ ID NO: 236599 - DNA, 75 bp, Artificial Sequence
  Synthetic
ccaagtccacgaagcggtggtaggcgcccgtgttgatggtgtaggtgcagttggccatgacggaccagttgacgg

SEQ ID NO: 236600 - DNA, 75 bp, Artificial Sequence
  Synthetic
ttggccatgacggaccagttgacggtctggtggcccggttgcgacatctcggtgtacctgagtcgcgagtaggcg

SEQ ID NO: 236601 - DNA, 75 bp, Artificial Sequence
  Synthetic
cctcgaccaggtccgccagaaggcgctcgccgcccagggacagcagctcttgcaaggaagcaaagtttttcagcg

SEQ ID NO: 236602 - DNA, 75 bp, Artificial Sequence
  Synthetic
tctagactctcacgctcgcttggtcctgtgactattttgtagaaaaaagatggaagacatcaactttgcgtcgct

SEQ ID NO: 236603 - DNA, 75 bp, Artificial Sequence
  Synthetic
aagtccgcaccaggtactggtagcccaccaggaagtgcggcggcggctggcggtagaggggccagcgcagggtgg

SEQ ID NO: 236604 - DNA, 75 bp, Artificial Sequence
  Synthetic
tccaggcggtcccagagctcggtgacgtgctctacggcatctctatccagcatatctcctcgtttcgcgggttgg

SEQ ID NO: 236605 - DNA, 75 bp, Artificial Sequence
  Synthetic
caccaggaagtgcggcggcggctggcggtagaggggccagcgcagggtggcgggggctccgggggccaggtcttc

SEQ ID NO: 236606 - DNA, 75 bp, Artificial Sequence
  Synthetic
atgtacctggacatccaggtgatacccgcggcggtggtggaggcgcgcgggaagtcgcgcacccggttccagatg

SEQ ID NO: 236607 - DNA, 75 bp, Artificial Sequence
  Synthetic
ccgcggcggtggtggaggcgcgcgggaagtcgcgcacccggttccagatgttgcgcaggggcagaaagtgctcca

SEQ ID NO: 236608 - DNA, 75 bp, Artificial Sequence
  Synthetic
gacatagctaaccaggccgtgcagaaaaagataaacagtcatctggacccccgccctcaggtggaggaaacgcct

SEQ ID NO: 236609 - DNA, 75 bp, Artificial Sequence
  Synthetic
agggcctcggttcgagccccgggtccgggccggacggtccgccatgatccacgcggttaccgcccgcgtgtcgaa

SEQ ID NO: 236610 - DNA, 75 bp, Artificial Sequence
  Synthetic
cgggccggacggtccgccatgatccacgcggttaccgcccgcgtgtcgaacccaggtgtgcgacgtcagacaacg

SEQ ID NO: 236611 - DNA, 75 bp, Artificial Sequence
  Synthetic
ctggccgggcgccggcgccgcgtaagagactaagccgcgaaagcgaaagcagtaagtggctcgctccccgtagcc

SEQ ID NO: 236612 - DNA, 75 bp, Artificial Sequence
  Synthetic
gcccaccactcgtcccatagctcccatggccaccggtgtggtgggtcacaggcaacacacccccgcgacactaga

SEQ ID NO: 236613 - DNA, 75 bp, Artificial Sequence
  Synthetic
agtaagtggctcgctccccgtagccggagggatccttgctaagggttgcgttgcggcgaaccccggttcgaatcc

SEQ ID NO: 236614 - DNA, 75 bp, Artificial Sequence
  Synthetic
cgccagccaaaggcggtgcccgctccctccacttccgccgccaacagagtgcctctgcgccgcgctgcgagcggc

SEQ ID NO: 236615 - DNA, 75 bp, Artificial Sequence
  Synthetic
gctaaggtgttggattggcctccccctcgtataaagaccccgcttgcggattgactccggacacggggacgagcc

SEQ ID NO: 236616 - DNA, 75 bp, Artificial Sequence
  Synthetic
gcctctgcgccgcgctgcgagcggcccccgggcctcgcgagtcagcggcaactggcagagcacactgaacagcat

SEQ ID NO: 236617 - DNA, 75 bp, Artificial Sequence
  Synthetic
ccttttatttttgctttccccagatgcatccggtgttgcggcagatgcgccccccgccccagcagcagcaacaac

SEQ ID NO: 236618 - DNA, 75 bp, Artificial Sequence
  Synthetic
gctgggtcaacagtccatgcccaacaggcccaattacatcgccttcagagacaactttatcgggctcatgtatta

SEQ ID NO: 236619 - DNA, 75 bp, Artificial Sequence
  Synthetic
gcaagctagctaacgtgttgtatgtgtgtatgcgtcctatgtcgccgccagaggagctgttgagccgccggcgcc

SEQ ID NO: 236620 - DNA, 75 bp, Artificial Sequence
  Synthetic
gtggtcgtacatgcacatctcgggccaggacgcttcggagtacctgagccccgggctggtgcagttcgcccgcgc

SEQ ID NO: 236621 - DNA, 75 bp, Artificial Sequence
  Synthetic
gacgaccccgaggagcccccgcggcgcagggccagacactacctggacctggaggagggcgagggcctggcgcgg

SEQ ID NO: 236622 - DNA, 75 bp, Artificial Sequence
  Synthetic
caggacgcttcggagtacctgagccccgggctggtgcagttcgcccgcgccacagacacctacttcaacatgagt

SEQ ID NO: 236623 - DNA, 75 bp, Artificial Sequence
  Synthetic
ggaggagggcgagggcctggcgcggctgggggcgccgtctcccgagcgccacccgcgggtgcagctgaagcgcga

SEQ ID NO: 236624 - DNA, 75 bp, Artificial Sequence
  Synthetic
tttctaaaaacgaggaggatttgatgttcacctgtcccgagctgatgcctttgagggtgcctgcgtccatctggt

SEQ ID NO: 236625 - DNA, 75 bp, Artificial Sequence
  Synthetic
ctcgcgcgaggcgtacgtgcctcggcagaacctgttcagggaccgcgcgggcgaggagcccgaggagatgcggga

SEQ ID NO: 236626 - DNA, 75 bp, Artificial Sequence
  Synthetic
ctgcggcaggggctgaaccgcgagcggctgctgcgcgaggaggactttgagcccgacgcgcggacggggatcagc

SEQ ID NO: 236627 - DNA, 75 bp, Artificial Sequence
  Synthetic
gtgctggacatggcctccacttactttgacatccggggggtgctggacaggggccccacttttaagccctactcg

SEQ ID NO: 236628 - DNA, 75 bp, Artificial Sequence
  Synthetic
ggctgctgcgcgaggaggactttgagcccgacgcgcggacggggatcagccccgcgcgcgcgcacgtggcggccg

SEQ ID NO: 236629 - DNA, 75 bp, Artificial Sequence
  Synthetic
ttgacatccggggggtgctggacaggggccccacttttaagccctactcgggcactgcctacaaccccctggccc

SEQ ID NO: 236630 - DNA, 75 bp, Artificial Sequence
  Synthetic
gacggtgaaccaggagatcaacttccaaaagagtttcaacaaccacgtgcgcacgctggtggcgcgcgaggaggt

SEQ ID NO: 236631 - DNA, 75 bp, Artificial Sequence
  Synthetic
gtgggaacaagaggaaaatcaggtggtcgctgcagatgatgaacttgaagatgaagaagcgcaagcacaagagga

SEQ ID NO: 236632 - DNA, 75 bp, Artificial Sequence
  Synthetic
gtcgctgcagatgatgaacttgaagatgaagaagcgcaagcacaagaggaagcccctgctaaaaaaattcatgta

SEQ ID NO: 236633 - DNA, 75 bp, Artificial Sequence
  Synthetic
accccaacagcaagcctctgacggcgcagctgttcctgatagtgcagcacagcagggacaacgaggcgtttaggg

SEQ ID NO: 236634 - DNA, 75 bp, Artificial Sequence
  Synthetic
aaaagattaccaaggatggtttgcaaataggtactgaagtcgtaggagatacatctaaggacacttttgcagata

SEQ ID NO: 236635 - DNA, 75 bp, Artificial Sequence
  Synthetic
aataggtactgaagtcgtaggagatacatctaaggacacttttgcagataaaacattccaacccgaacctcagat

SEQ ID NO: 236636 - DNA, 75 bp, Artificial Sequence
  Synthetic
gatgccacagtagcaggaggtagagttttgaaaaagactacccctatgagaccttgctatggatcctatgccagg

SEQ ID NO: 236637 - DNA, 75 bp, Artificial Sequence
  Synthetic
cgcgctcgtaggggttgagcggcgggccccagggcatggggtgggtgagcgcggaggcgtacatgccgcagatgt

SEQ ID NO: 236638 - DNA, 75 bp, Artificial Sequence
  Synthetic
ttttgaaaaagactacccctatgagaccttgctatggatcctatgccaggcctaccaatgccaacgggggtcaag

SEQ ID NO: 236639 - DNA, 75 bp, Artificial Sequence
  Synthetic
tcgatgctgagcctgggcaagttttacgcgcgcaagatctaccagacgccgtacgtgcccatagacaaggaggtg

SEQ ID NO: 236640 - DNA, 75 bp, Artificial Sequence
  Synthetic
agtgttggagtctaaagtagaaatgcaatttttctctaacaccacaacccttaatgcgcgggatggaaccggcaa

SEQ ID NO: 236641 - DNA, 75 bp, Artificial Sequence
  Synthetic
caatttttctctaacaccacaacccttaatgcgcgggatggaaccggcaatcccgaaccaaaggtggtgttgtac

SEQ ID NO: 236642 - DNA, 75 bp, Artificial Sequence
  Synthetic
tggcgctgaaggtgctcaccctgagcgacgacctgggcgtgtaccgcaacgagcgcatccacaaggccgtgagcg

SEQ ID NO: 236643 - DNA, 75 bp, Artificial Sequence
  Synthetic
gagcgcatccacaaggccgtgagcgtgagccggcggcgcgagctgagcgaccgcgagctgatgcacagcctgcag

SEQ ID NO: 236644 - DNA, 75 bp, Artificial Sequence
  Synthetic
ccgatactcatctgtcttacaagcccaaaaaggatgatgttaatgccaaaatcatgttgggtcagcaagccatgc

SEQ ID NO: 236645 - DNA, 75 bp, Artificial Sequence
  Synthetic
tgagccggcggcgcgagctgagcgaccgcgagctgatgcacagcctgcagcgggcgctggcgggcgccggcagcg

SEQ ID NO: 236646 - DNA, 75 bp, Artificial Sequence
  Synthetic
caaaaaggatgatgttaatgccaaaatcatgttgggtcagcaagccatgcccaacagacccaacctcattggatt

SEQ ID NO: 236647 - DNA, 75 bp, Artificial Sequence
  Synthetic
ggaggcgtaggactcgcgcagcttgtgcaccagctcggcggtgacctgcacgtcgagcgcgcagtagtcgagggt

SEQ ID NO: 236648 - DNA, 75 bp, Artificial Sequence
  Synthetic
cgatgcgggggcggacctgcgctgggcgcccagccggcgggccctggaggccgcgggggtccgcgaggactatga

SEQ ID NO: 236649 - DNA, 75 bp, Artificial Sequence
  Synthetic
ccgcgggggtccgcgaggactatgacgaggacggcgaggaggatgaggagtacgagctagaggagggcgagtacc

SEQ ID NO: 236650 - DNA, 75 bp, Artificial Sequence
  Synthetic
ttttacaacagcaccggtaacatgggagtgctggcgggtcaggcctctcagttgaatgctgtggtggacttgcag

SEQ ID NO: 236651 - DNA, 75 bp, Artificial Sequence
  Synthetic
gagtgctggcgggtcaggcctctcagttgaatgctgtggtggacttgcaggatagaaacacagaactgtcatatc

SEQ ID NO: 236652 - DNA, 75 bp, Artificial Sequence
  Synthetic
cggtagatgcaagacccgaacgtggtggacccggcgctgcgggcggctctgcagagccagccgtccggccttaac

SEQ ID NO: 236653 - DNA, 75 bp, Artificial Sequence
  Synthetic
tagaaccagatacttctccatgtggaaccaggcagtggatagctatgatccagatgtcagaattattgaaaacca

SEQ ID NO: 236654 - DNA, 75 bp, Artificial Sequence
  Synthetic
gcagagccagccgtccggccttaactcctcagacgactggcgacaggtcatggaccgcatcatgtcgctgacggc

SEQ ID NO: 236655 - DNA, 75 bp, Artificial Sequence
  Synthetic
aaccaggcagtggatagctatgatccagatgtcagaattattgaaaaccatggggttgaggatgaactgcccaac

SEQ ID NO: 236656 - DNA, 75 bp, Artificial Sequence
  Synthetic
gaattactgatacttatcaagggataaaaaataccaatggcaatggtcagtggaccaaagatgatcagttcgcgg

SEQ ID NO: 236657 - DNA, 75 bp, Artificial Sequence
  Synthetic
cagccgcaggccaacaggctctccgccatcctggaggcggtggtgcctgcgcgctcgaaccccacgcacgagaag

SEQ ID NO: 236658 - DNA, 75 bp, Artificial Sequence
  Synthetic
aaaaaataccaatggcaatggtcagtggaccaaagatgatcagttcgcggaccgcaacgaaataggggtgggaaa

SEQ ID NO: 236659 - DNA, 75 bp, Artificial Sequence
  Synthetic
gcgctcgaaccccacgcacgagaaggtgctggccatagtgaacgcgctggccgagaacagggccatccgcccgga

SEQ ID NO: 236660 - DNA, 75 bp, Artificial Sequence
  Synthetic
caggccaacctttggaggaacttcctctatgcgaacgtggggctctacctgccagacaagctcaagtacaacccc

SEQ ID NO: 236661 - DNA, 75 bp, Artificial Sequence
  Synthetic
accaacgtggacatctctgacaaccccaacacttatgactacatgaacaagcgggtggtggcccccggcctggta

SEQ ID NO: 236662 - DNA, 75 bp, Artificial Sequence
  Synthetic
catggtggcgctgaatgccttcctgagcacgcagccggccaacgtgccgcgggggcaggaagactacaccaactt

SEQ ID NO: 236663 - DNA, 75 bp, Artificial Sequence
  Synthetic
agcacgcagccggccaacgtgccgcgggggcaggaagactacaccaactttgtgagcgcgctgcggctgatggtg

SEQ ID NO: 236664 - DNA, 75 bp, Artificial Sequence
  Synthetic
ggccgtgctcggccagggcccagtccgccagatgcgggttgtccgcgaggaaggaccgccagaggtcgcgggcca

SEQ ID NO: 236665 - DNA, 75 bp, Artificial Sequence
  Synthetic
accagtcgggcccggactacttcttccagaccagcagacagggcctgcagacggtgaacctgagccaggctttca

SEQ ID NO: 236666 - DNA, 75 bp, Artificial Sequence
  Synthetic
ccagaccagcagacagggcctgcagacggtgaacctgagccaggctttcaagaacctgcgggggctgtggggcgt

SEQ ID NO: 236667 - DNA, 75 bp, Artificial Sequence
  Synthetic
agtcctgaactggcggcccacggccatcttttcgggggtgacgcagtagaaggtgagggggtcttgctgccagga

SEQ ID NO: 236668 - DNA, 75 bp, Artificial Sequence
  Synthetic
aacatggtcctacagagctctctgggcaacgaccttagggtagatggggccagcatcaagtttgacagcatcacc

SEQ ID NO: 236669 - DNA, 75 bp, Artificial Sequence
  Synthetic
acggtgtccagcctgctgacgcccaactcgcgcctgctgctgctgctgatcgcgccgttcacggacagcggcagc

SEQ ID NO: 236670 - DNA, 75 bp, Artificial Sequence
  Synthetic
actcgcgcctgctgctgctgctgatcgcgccgttcacggacagcggcagcgtgtcccgggacacctacctggggc

SEQ ID NO: 236671 - DNA, 75 bp, Artificial Sequence
  Synthetic
acctgctgaccctgtaccgcgaggccatcgggcaggcgcaggtggacgagcacaccttccaggagatcaccagcg

SEQ ID NO: 236672 - DNA, 75 bp, Artificial Sequence
  Synthetic
cccagccaaggccaccaacgtgcccatctccattccctctcgcaactgggccgccttcagaggctgggcctttac

SEQ ID NO: 236673 - DNA, 75 bp, Artificial Sequence
  Synthetic
ttttcttttctcaataaatggcaactttatttatacatgctctctctcgggtattcatttccccaccacccacca

SEQ ID NO: 236674 - DNA, 75 bp, Artificial Sequence
  Synthetic
agatgcacctgccgaccgcggacgaggaagctgagtgggaatctgagccccccgcatggctcgcggcctggctgg

SEQ ID NO: 236675 - DNA, 75 bp, Artificial Sequence
  Synthetic
gcccagcgtggcgctggacatgaccgcgcgcaacatggaaccgggcatgtacgccgcgcaccggccttacatcaa

SEQ ID NO: 236676 - DNA, 75 bp, Artificial Sequence
  Synthetic
tgaacctgatgcgcgacggggtgacgcccagcgtggcgctggacatgaccgcgcgcaacatggaaccgggcatgt

SEQ ID NO: 236677 - DNA, 75 bp, Artificial Sequence
  Synthetic
gcggcggccgtgaaccccgagtactttaccaacgccatcctgaacccgcactggctcccgccgcccgggttctac

SEQ ID NO: 236678 - DNA, 75 bp, Artificial Sequence
  Synthetic
aggatgtactccttcttcagaaatttccaacccatgagccgacaggtggtggacgagaccaattacaaggactat

SEQ ID NO: 236679 - DNA, 75 bp, Artificial Sequence
  Synthetic
catggacgacagcgtgttctccccgcggccgcaggcgctggcggaggcgtccctgctgcgtcccaagaaggagga

SEQ ID NO: 236680 - DNA, 75 bp, Artificial Sequence
  Synthetic
acaacaactcgggtttcgtgggctacctggcgcccaccatgcgcgagggtcaggcctaccccgccaacttcccct

SEQ ID NO: 236681 - DNA, 75 bp, Artificial Sequence
  Synthetic
ggcggcgtcgatggcttgcaggaggccgcagccccggggcgcgacgacggtgccccgcggggcggtgaagctgcc

SEQ ID NO: 236682 - DNA, 75 bp, Artificial Sequence
  Synthetic
cgcggcagcagcggcgtggcttctctgtccgagctgggggcggcagccgccgcgcgccccgggtccctgggcggc

SEQ ID NO: 236683 - DNA, 75 bp, Artificial Sequence
  Synthetic
cgcgcgccccgggtccctgggcggcagcccctttccgagcctggtggggtctctgcacagcgagcgcaccacccg

SEQ ID NO: 236684 - DNA, 75 bp, Artificial Sequence
  Synthetic
ccgcagccccggggcgcgacgacggtgccccgcggggcggtgaagctgccgccgccgctcctgctgtcgccgccg

SEQ ID NO: 236685 - DNA, 75 bp, Artificial Sequence
  Synthetic
cgccttccccaacaacgggatagagagcctggtggacaagatgagcagatggaagacctatgcgcaggagcacag

SEQ ID NO: 236686 - DNA, 75 bp, Artificial Sequence
  Synthetic
acgcggcgccagcgccacgaccggcagcgggggctggtgtgggatgacgaggactccgcggacgatagcagcgtg

SEQ ID NO: 236687 - DNA, 75 bp, Artificial Sequence
  Synthetic
accgagcaagagctcagggccatcgccagagacctgggatgcggaccctactttttgggcacctatgacaaacgc

SEQ ID NO: 236688 - DNA, 75 bp, Artificial Sequence
  Synthetic
aaaactcaccaaggccatggcgaccgagcgttggtttcttgtgttcccttcagtatgcggcgcgcggcgatgtac

SEQ ID NO: 236689 - DNA, 75 bp, Artificial Sequence
  Synthetic
caggctcaaggggttcaccaccgtcgcagtcgccgccgcgctttcgctttccgctccgctgttctcttcttcctc

SEQ ID NO: 236690 - DNA, 75 bp, Artificial Sequence
  Synthetic
tgcattacccttgagaagtccaccgagaccgtgcaggggccccactcggccgcctgcggtctcttctgttgcatg

SEQ ID NO: 236691 - DNA, 75 bp, Artificial Sequence
  Synthetic
gtcggcggacgtggcctccctgaactaccagaacgaccacagcaattttttgaccacggtcatccagaacaatga

SEQ ID NO: 236692 - DNA, 75 bp, Artificial Sequence
  Synthetic
ctcagagtcccatggattgcaaccccaccatgaacttgctaaagggagtgcccaacgccatgctccagagccccc

SEQ ID NO: 236693 - DNA, 75 bp, Artificial Sequence
  Synthetic
cagaccatcaatctggatgaccggtcgcactggggcggcgacctgaaaaccatcctgcacaccaacatgcccaac

SEQ ID NO: 236694 - DNA, 75 bp, Artificial Sequence
  Synthetic
ttcctcctcttcggggggcggcggcggcggtgggggagggggcgctcggcgccggcggcggcgcaccgggaggcg

SEQ ID NO: 236695 - DNA, 75 bp, Artificial Sequence
  Synthetic
atgaacaacgcgatcgtggagcactatctgaaagtgggcaggcagaacggggtcctggagagcgacatcggggtc

SEQ ID NO: 236696 - DNA, 75 bp, Artificial Sequence
  Synthetic
cgccgtcgccatctagaaatcgaaagggttctgccgcgcgtcgccgtgcgccacgggcagagacacgttgcgata

SEQ ID NO: 236697 - DNA, 75 bp, Artificial Sequence
  Synthetic
ggtcctggagagcgacatcggggtcaagttcgacaccaggaacttccgcctggggctggaccccgtgaccgggct

SEQ ID NO: 236698 - DNA, 75 bp, Artificial Sequence
  Synthetic
ctgggcatccgcaagcggcagcccttccaggagggcttcaggatcacctacgaggacctggaggggggcaacatc

SEQ ID NO: 236699 - DNA, 75 bp, Artificial Sequence
  Synthetic
tccaggagggcttcaggatcacctacgaggacctggaggggggcaacatccccgcgctcctcgatgtggaggcct

SEQ ID NO: 236700 - DNA, 75 bp, Artificial Sequence
  Synthetic
tgagccctccgccgccaccgccgcggacgacgcgcccaccaccgccgccaccaccaccaccattaccaccctacc

SEQ ID NO: 236701 - DNA, 75 bp, Artificial Sequence
  Synthetic
ggcgggacaggaggataccgcccccgccgcctccgccgccgccgagcagggcgaggatgctgctgacaccgcggc

SEQ ID NO: 236702 - DNA, 75 bp, Artificial Sequence
  Synthetic
gtctttgtagtagtcttgcatgagcctttccaccggcacctcttctccttcttcttctgacatctctgctgcatc

SEQ ID NO: 236703 - DNA, 75 bp, Artificial Sequence
  Synthetic
gccgcctcagtgccaaaagaggataaaaagcaagaccaggacgacgcagagacagatgaggcagcagtcgggcgg

SEQ ID NO: 236704 - DNA, 75 bp, Artificial Sequence
  Synthetic
aggaggaggacatgaatgacagtgcggtgcgcggagacaccttcgtcacccggggggaggaaaagcaagcggagg

SEQ ID NO: 236705 - DNA, 75 bp, Artificial Sequence
  Synthetic
cccctgccccccatgcgcgtcaccccgaaccccctgagcggctggagcagggccaggtcggcgacgacgcgctcg

SEQ ID NO: 236706 - DNA, 75 bp, Artificial Sequence
  Synthetic
gctatggtggtggaggctgccgagcaggaggaggacatgaatgacagtgcggtgcgcggagacaccttcgtcacc

SEQ ID NO: 236707 - DNA, 75 bp, Artificial Sequence
  Synthetic
ggtgcgcggagacaccttcgtcacccggggggaggaaaagcaagcggaggccgaggccgcggccgaggaaaagca

SEQ ID NO: 236708 - DNA, 75 bp, Artificial Sequence
  Synthetic
gcggcggcggcgttggccgcggcggaggctgagtctgaggggaccaagcccgccaaggagcccgtgattaagccc

SEQ ID NO: 236709 - DNA, 75 bp, Artificial Sequence
  Synthetic
ctgaccgaagatagcaagaagcgcagttacaacctgctcaaggacagcaccaacaccgcgtaccgcagctggtac

SEQ ID NO: 236710 - DNA, 75 bp, Artificial Sequence
  Synthetic
tgaccgttactgacgccagacgccgcacctgcccctacgtttacaaggccttgggcatagtctcgccgcgcgtcc

SEQ ID NO: 236711 - DNA, 75 bp, Artificial Sequence
  Synthetic
cggttaccgcccgcgtgtcgaacccaggtggcgacgtcagacaacggtggagtgttccttttgggttttttccaa

SEQ ID NO: 236712 - DNA, 75 bp, Artificial Sequence
  Synthetic
tcttcccggcgcgcgcccccgctgttgcgcgctcttaccgcctgcaccaaggggtcgtcttcaggcaagcgccgc

SEQ ID NO: 236713 - DNA, 75 bp, Artificial Sequence
  Synthetic
cacctgcccctacgtttacaaggccttgggcatagtctcgccgcgcgtcctttccagccgcactttttgagcaac

SEQ ID NO: 236714 - DNA, 75 bp, Artificial Sequence
  Synthetic
gccgcgtaagagactagagtgcaaaagcgaaagcagtaagtggctcgctccctgtagcccggaggatccttgcta

SEQ ID NO: 236715 - DNA, 75 bp, Artificial Sequence
  Synthetic
agcgaaagcagtaagtggctcgctccctgtagcccggaggatccttgctaagggttgcgttgcggcgaaccccgg

SEQ ID NO: 236716 - DNA, 75 bp, Artificial Sequence
  Synthetic
ccactatttctggggaggggcttctccgctctgcggcaaaggcggcggatcgcttcttttttttcttgggagccg

SEQ ID NO: 236717 - DNA, 75 bp, Artificial Sequence
  Synthetic
tcgggccggccggaaccgcggctaaggcgggattggcctccccctcattaaagaccccgcttgcggattcctccg

SEQ ID NO: 236718 - DNA, 75 bp, Artificial Sequence
  Synthetic
acctgggcatcctgcacgagaaccgcctcgggcagaacgtcctgcactccaccctcaaaggggaggcgcgccgcg

SEQ ID NO: 236719 - DNA, 75 bp, Artificial Sequence
  Synthetic
gacacaggggacgagcccctttttacttttgcttttctcagatgcatccggtgctgcggcagatgcgccccccgc

SEQ ID NO: 236720 - DNA, 75 bp, Artificial Sequence
  Synthetic
cggccatccagaccgtggtgcggggcgcgcggcggtacgccaagctgaagagccgccggaagcgcgtggcccgcc

SEQ ID NO: 236721 - DNA, 75 bp, Artificial Sequence
  Synthetic
agccgccggaagcgcgtggcccgccgccaccgccgccgacccggggccgccgccaaacgcgccgccgcggccctg

SEQ ID NO: 236722 - DNA, 75 bp, Artificial Sequence
  Synthetic
gcaagagcgtcaccagcagcagcgggagtcatgcagggccccctcgcccacgctcggcggtccggcgacctcggc

SEQ ID NO: 236723 - DNA, 75 bp, Artificial Sequence
  Synthetic
cgctcggcggtccggcgacctcggcgtccgcggccgtgtctggagccggcggcggggggctggcggacgacccgg

SEQ ID NO: 236724 - DNA, 75 bp, Artificial Sequence
  Synthetic
ccgcttggccgccggcatcaccgccgccaccatggccccccgtacccgaagacgcgcggccgccgccgccgccgc

SEQ ID NO: 236725 - DNA, 75 bp, Artificial Sequence
  Synthetic
cgccggggcaacgtgtactgggtgcgcgactcggtgaccggcacgcgcgtgcccgtgcgcttccgccccccgcgg

SEQ ID NO: 236726 - DNA, 75 bp, Artificial Sequence
  Synthetic
gcccgtgcgcttccgccccccgcggacttgagatgatgtgaaaaaacaacactgagtctcctgctgttgtgtgta

SEQ ID NO: 236727 - DNA, 75 bp, Artificial Sequence
  Synthetic
agataaagcgggtcaaaaagaaaaagaaagatgatgacgatgccgatggggaggtggagttcctgcgcgccacgg

SEQ ID NO: 236728 - DNA, 75 bp, Artificial Sequence
  Synthetic
cgccccggcaccgcggtggtcttcacgcccggcgagcgctccacccggactttcaagcgcgtctatgacgaggtg

SEQ ID NO: 236729 - DNA, 75 bp, Artificial Sequence
  Synthetic
gcgcgctggagcagaaccccaacagcaagcctctgacggcgcagctgttcctgatagtgcagcacagcagggaca

SEQ ID NO: 236730 - DNA, 75 bp, Artificial Sequence
  Synthetic
tggctcctggacctgattaacatcttgcagagcatagtggtgcaggagcgcagcctgagcctggccgacaaggtg

SEQ ID NO: 236731 - DNA, 75 bp, Artificial Sequence
  Synthetic
gcgcgagggcggcgacctggcgcccaccgtgcagctcatggtgcccaagcggcagaggctggaggatgtgctgga

SEQ ID NO: 236732 - DNA, 75 bp, Artificial Sequence
  Synthetic
accgtgcagctcatggtgcccaagcggcagaggctggaggatgtgctggagaaaatgaaagtagaccccggtctg

SEQ ID NO: 236733 - DNA, 75 bp, Artificial Sequence
  Synthetic
ctacaccttctcctacattgcccaggaataaagaatcgtgaacctgttgcatgttatgtttcaacgtgtttattt

SEQ ID NO: 236734 - DNA, 75 bp, Artificial Sequence
  Synthetic
tcaagcaggtggcgccgggcctcggcgtgcagaccgtggacgtggtcatccccaccggcaactcccccgccgcca

SEQ ID NO: 236735 - DNA, 75 bp, Artificial Sequence
  Synthetic
atgttatgtttcaacgtgtttatttttcaattgcagaaaatttcaagtcatttttcattcagtagtatagcccca

SEQ ID NO: 236736 - DNA, 75 bp, Artificial Sequence
  Synthetic
ggccgagtcctacttcgaggcgggggcggacctgcgctgggtgcccagccggagggccctggaggccgcgggggc

SEQ ID NO: 236737 - DNA, 75 bp, Artificial Sequence
  Synthetic
catggagacacagaccgatcccgccgcagccgcagccgccgccgcagccgcgacctcctcggcggaggtgcagac

SEQ ID NO: 236738 - DNA, 75 bp, Artificial Sequence
  Synthetic
ccgccgcgaggactatgcagacgaggaggaggaggatgacgaggagtacgagctagaggagggcgagtacctgga

SEQ ID NO: 236739 - DNA, 75 bp, Artificial Sequence
  Synthetic
acaagaacgccatagtcgcctgcttgcaagactgcgggggcaacatctccttcgcccgccgcttcctgctcttcc

SEQ ID NO: 236740 - DNA, 75 bp, Artificial Sequence
  Synthetic
gcccgcactggctccagtctccgtgaggagagtggcgcgcgacggacacaccctggtgctgcccagggcgcgcta

SEQ ID NO: 236741 - DNA, 75 bp, Artificial Sequence
  Synthetic
gttgtggttcttgcagatatggccctcacttgccgcctccgtttcccggtgccgggataccgaggaggaagatcg

SEQ ID NO: 236742 - DNA, 75 bp, Artificial Sequence
  Synthetic
cgcggcgatcggcgccgtgcccgggatcgcctccgtggccttgcaagcgtcccagaggcattgacagacttgcaa

SEQ ID NO: 236743 - DNA, 75 bp, Artificial Sequence
  Synthetic
ttgcgtcgctggccccgcgtcacggctcgcgcccgttcctgggacactggaacgatatcggcaccagcaacatga

SEQ ID NO: 236744 - DNA, 75 bp, Artificial Sequence
  Synthetic
aacgatatcggcaccagcaacatgagcggtggcgccttcagttggggctctctgtggagcggcattaaaagtatc

SEQ ID NO: 236745 - DNA, 75 bp, Artificial Sequence
  Synthetic
cccgggcctggaacagcagcacgggccagatgttgagagacaagttgaaagagcagaacttccagcagaaggtgg

SEQ ID NO: 236746 - DNA, 75 bp, Artificial Sequence
  Synthetic
ccgcgcgctggggcaggaggacacgggcagcctggaggcgaccctgaactacctgctgaccaaccggcggcagaa

SEQ ID NO: 236747 - DNA, 75 bp, Artificial Sequence
  Synthetic
gtacctgaagactaccacgcccacgagatcaggttttacgaggaccaatcccgcccgcccaaggcggagctgacc

SEQ ID NO: 236748 - DNA, 75 bp, Artificial Sequence
  Synthetic
cggggtggtggacctggccaaccaggccgtgcagaataagatcaacagcagactggacccccggccgccggtgga

SEQ ID NO: 236749 - DNA, 75 bp, Artificial Sequence
  Synthetic
gacgacagcgtgttctccccgcggccgcaggcgctggcggaggcgtcgctgctccgcctccccaagaaggaagag

SEQ ID NO: 236750 - DNA, 75 bp, Artificial Sequence
  Synthetic
agagcacgctgaacagcatcgtgggtctgggggtgcggtccgtgaagcgccgccgatgctactgaatagcttagc

SEQ ID NO: 236751 - DNA, 75 bp, Artificial Sequence
  Synthetic
cctctctgtccgagctgggggcggcggccgcgcggcccgggtccctggggggcagcccctttcccagcctggtgg

SEQ ID NO: 236752 - DNA, 75 bp, Artificial Sequence
  Synthetic
gatggcgaccccatcgatgatgccgcagtggtcgtacatgcacatctcgggccaggacgcctcggagtacctgag

SEQ ID NO: 236753 - DNA, 75 bp, Artificial Sequence
  Synthetic
ggcagcgggggctggtgtgggatgacgaggactccgcggacgatagcagcgtgctggacctgggggggagcggcg

SEQ ID NO: 236754 - DNA, 75 bp, Artificial Sequence
  Synthetic
gggccaagaagtacctcacctggtacttcaacggcaccccctttgtggtttacaacagcttcgaccaggacggag

SEQ ID NO: 236755 - DNA, 75 bp, Artificial Sequence
  Synthetic
gtgctggacctgggggggagcggcggcaacccgttcgcgcacctgcgcccccgcctggggaggatgtttcaataa

SEQ ID NO: 236756 - DNA, 75 bp, Artificial Sequence
  Synthetic
ttcaccctggccgtgggcgacaaccgcgtgctggacatggcctccacctactttgacatccgcggggtgctggac

SEQ ID NO: 236757 - DNA, 75 bp, Artificial Sequence
  Synthetic
gcgtgctggacatggcctccacctactttgacatccgcggggtgctggaccggggtcccactttcaagccctact

SEQ ID NO: 236758 - DNA, 75 bp, Artificial Sequence
  Synthetic
caaggttttttaagcggataaataaaaaactcaccaaggccatggcgaccgagcgttgttggtttcttgttgtgt

SEQ ID NO: 236759 - DNA, 75 bp, Artificial Sequence
  Synthetic
ccccaagggcgctcccaactcctgcgagtgggagcaagaggaaactcaggcagttgaagaagcagcagaagagga

SEQ ID NO: 236760 - DNA, 75 bp, Artificial Sequence
  Synthetic
tcccttagtatgcggcgcgcggcgatgtaccacgagggacctcctccctcttatgagagcgtggtgggcgcggcg

SEQ ID NO: 236761 - DNA, 75 bp, Artificial Sequence
  Synthetic
gagtgggagcaagaggaaactcaggcagttgaagaagcagcagaagaggaagaagaagatgctgacggtcaagct

SEQ ID NO: 236762 - DNA, 75 bp, Artificial Sequence
  Synthetic
agactcatgtatatgctcaggctcccctttctggcgaaaaaattagtaaagatggtctgcaaataggaacggacg

SEQ ID NO: 236763 - DNA, 75 bp, Artificial Sequence
  Synthetic
cctttctggcgaaaaaattagtaaagatggtctgcaaataggaacggacgctacagctacagaacaaaaacctat

SEQ ID NO: 236764 - DNA, 75 bp, Artificial Sequence
  Synthetic
gtacctggtggacaacaagtcggcggacgtggcctccctgaactaccagaacgaccacagcaattttttgaccac

SEQ ID NO: 236765 - DNA, 75 bp, Artificial Sequence
  Synthetic
gaaccccaaatcggggagtcacagtggaatgaggcagatgctacagtcgccggcggtagagtgctaaagaaatct

SEQ ID NO: 236766 - DNA, 75 bp, Artificial Sequence
  Synthetic
ggaatgaggcagatgctacagtcgccggcggtagagtgctaaagaaatctactcccatgaaaccatgctatggtt

SEQ ID NO: 236767 - DNA, 75 bp, Artificial Sequence
  Synthetic
tggaggtcagggtgtactaacggcaaatgcccagggacagctagaatctcaggttgaaatgcaattcttttcaac

SEQ ID NO: 236768 - DNA, 75 bp, Artificial Sequence
  Synthetic
ttctgaaaacgcccgtaacgagactaacaacattcagcccaaattggtgctgtatagtgaggatgtgcacatgga

SEQ ID NO: 236769 - DNA, 75 bp, Artificial Sequence
  Synthetic
aagcccgcaaaaagcgatgacaattcaaaaatcatgctgggtcagcagtccatgcccaacagacctaattacatc

SEQ ID NO: 236770 - DNA, 75 bp, Artificial Sequence
  Synthetic
tctcagttgaatgcagtggtggacttgcaagacagaaacacagaactgtcctaccagctcttgcttgattccatg

SEQ ID NO: 236771 - DNA, 75 bp, Artificial Sequence
  Synthetic
tgtggaatcaggcagtggacagttatgacccagatgttagaattattgaaaatcatggaactgaagacgagctcc

SEQ ID NO: 236772 - DNA, 75 bp, Artificial Sequence
  Synthetic
aatcatggaactgaagacgagctccccaactattgtttccctctgggtggcataggggtaactgacacttaccag

SEQ ID NO: 236773 - DNA, 75 bp, Artificial Sequence
  Synthetic
tcctggatgtggaggcctaccaggatagcttgaaggaagaagaggcgggagagggcagcggcggcggcggcggcg

SEQ ID NO: 236774 - DNA, 75 bp, Artificial Sequence
  Synthetic
cataggggtaactgacacttaccaggctgttaaaaccaacaatggcaataacgggggccaggtgacttggacaaa

SEQ ID NO: 236775 - DNA, 75 bp, Artificial Sequence
  Synthetic
gagggcagcggcggcggcggcggcgccggtcaggaggagggcggggcctcctctgaggcctctgcggacgcagcc

SEQ ID NO: 236776 - DNA, 75 bp, Artificial Sequence
  Synthetic
tgcgccacaatgtggcctccgactgtggttgcttcatgctagtgaaaagcgtggctgtgattaagcataacatgg

SEQ ID NO: 236777 - DNA, 75 bp, Artificial Sequence
  Synthetic
aggcggccgaccccgcgatggtggtagaggaagagaaggatatgaatgacgaggcggtgcgcggcgacacctttg

SEQ ID NO: 236778 - DNA, 75 bp, Artificial Sequence
  Synthetic
gaaataggggtgggaaacaatttcgctatggagatcaacctcagtgccaacctgtggagaaacttcctgtactcc

SEQ ID NO: 236779 - DNA, 75 bp, Artificial Sequence
  Synthetic
ctatggagatcaacctcagtgccaacctgtggagaaacttcctgtactccaacgtggcgctgtacctaccagaca

SEQ ID NO: 236780 - DNA, 75 bp, Artificial Sequence
  Synthetic
ggaggccgaggccgcggcagaggaggcggcagcagcggcggcggcagtagaggcggcggccgaggcggagaagcc

SEQ ID NO: 236781 - DNA, 75 bp, Artificial Sequence
  Synthetic
gggtactattacgggcagcggggagaaatgattaattactggcgaccccacaaggactacatgctgcatgtagtc

SEQ ID NO: 236782 - DNA, 75 bp, Artificial Sequence
  Synthetic
ctggactacatggacaacgtcaaccccttcaaccaccaccgcaatgcgggcctgcgctaccgctccatgctcctg

SEQ ID NO: 236783 - DNA, 75 bp, Artificial Sequence
  Synthetic
ggcaacgggcgctacgtgcccttccacatccaggtgccccagaagttctttgccatcaagaacctcctcctcctg

SEQ ID NO: 236784 - DNA, 75 bp, Artificial Sequence
  Synthetic
tgattggtgggtcggtgggctgtagtgtgggtaggtggtctgtggtttttttttttaatatcagcttgggctaaa

SEQ ID NO: 236785 - DNA, 75 bp, Artificial Sequence
  Synthetic
ctcagggtggacggggccagcatcaagttcgagagcatctgcctctacgccaccttcttccccatggcccacaac

SEQ ID NO: 236786 - DNA, 75 bp, Artificial Sequence
  Synthetic
tcaggaacgacaccaacgaccagtccttcaatgactacctctccgccgccaacatgctctaccccatacccgcca

SEQ ID NO: 236787 - DNA, 75 bp, Artificial Sequence
  Synthetic
aggaagcgctccgaccagcaccccgtgcgcgtgcgcgggcactaccgcgctccctggggcgcgcacaaacgcggg

SEQ ID NO: 236788 - DNA, 75 bp, Artificial Sequence
  Synthetic
cccctcgcgcaactgggcggccttccgcggctgggccttcacccgcctcaagaccaaggagaccccctccctggg

SEQ ID NO: 236789 - DNA, 75 bp, Artificial Sequence
  Synthetic
ggtggagcaggcgcgcaactacacgcccgcggtctccaccgtggacgcggctatcgagagcgtggtgcgaggcgc

SEQ ID NO: 236790 - DNA, 75 bp, Artificial Sequence
  Synthetic
tttcaagaaggtctcggtcaccttcgactcctcggtcagctggccgggcaacgaccgtctgctcacccccaacga

SEQ ID NO: 236791 - DNA, 75 bp, Artificial Sequence
  Synthetic
cgccggaggcgcgtggcccgccgccaccgccgccgacccgggagcgccgccaagcgcgccgccgccgccttgctc

SEQ ID NO: 236792 - DNA, 75 bp, Artificial Sequence
  Synthetic
tgtcgcttgcgaatccagataccacaatgtcacagttgtgacaggagaaaatgttacattcaactccacggccga

SEQ ID NO: 236793 - DNA, 75 bp, Artificial Sequence
  Synthetic
caagcgcgccgccgccgccttgctccgtcgggccagacgcacgggccgccgcgccgccatgagggccgcgcgccg

SEQ ID NO: 236794 - DNA, 75 bp, Artificial Sequence
  Synthetic
ggggagggctacaacgtggcccagtgcaacatgaccaaggactggttcctggtccagatgctggccaactacaac

SEQ ID NO: 236795 - DNA, 75 bp, Artificial Sequence
  Synthetic
acgaccgtctgctcacccccaacgagttcgagatcaagcgctcggtcgacggggagggctacaacgtggcccagt

SEQ ID NO: 236796 - DNA, 75 bp, Artificial Sequence
  Synthetic
ggtagctatgtatacatctgcaatagctccacctcccctagcatgtcctctcccaagtaccactgcaatgccagt

SEQ ID NO: 236797 - DNA, 75 bp, Artificial Sequence
  Synthetic
atcggctaccagggcttctacatcccagagagctacaaggacaggatgtactccttcttcaggaacttccagccc

SEQ ID NO: 236798 - DNA, 75 bp, Artificial Sequence
  Synthetic
ccaagtacaaggactaccaggaggtgggcatcatccaccagcacaacaactcgggcttcgtgggctacctcgccc

SEQ ID NO: 236799 - DNA, 75 bp, Artificial Sequence
  Synthetic
gggcatcatccaccagcacaacaactcgggcttcgtgggctacctcgcccccaccatgcgcgagggacaggccta

SEQ ID NO: 236800 - DNA, 75 bp, Artificial Sequence
  Synthetic
tcaacaacaccaccactgagtctcctgctgttgtgtgtatcccagcggcgcgcgcgcacacggcgacatgtccaa

SEQ ID NO: 236801 - DNA, 75 bp, Artificial Sequence
  Synthetic
agcagcagcagcagcagcagcagcagattcctgactttaatcctagccagctcaacaaccaccgccaccgctgac

SEQ ID NO: 236802 - DNA, 75 bp, Artificial Sequence
  Synthetic
ataggtaagaccgcggtcgacagcatcacccagaaaaagttcctctgcgaccgcaccctctggcgcatccccttc

SEQ ID NO: 236803 - DNA, 75 bp, Artificial Sequence
  Synthetic
tcacccagaaaaagttcctctgcgaccgcaccctctggcgcatccccttctccagcaacttcatgtccatgggtg

SEQ ID NO: 236804 - DNA, 75 bp, Artificial Sequence
  Synthetic
accacccacagctccgcgcccgaaaccacccacacccaccacccagagacgaccgcggcctccagcgaccagatg

SEQ ID NO: 236805 - DNA, 75 bp, Artificial Sequence
  Synthetic
gtcaaaaagaaaaagaaagatgacgatgatggcgaggtggagtttctgcgcgccacggcgcccaggcgcccgctg

SEQ ID NO: 236806 - DNA, 75 bp, Artificial Sequence
  Synthetic
gctggcgctgccgctggaccggggcaaccccacccccagcctgaagcccgtgaccctgcagcaggtgctgccgag

SEQ ID NO: 236807 - DNA, 75 bp, Artificial Sequence
  Synthetic
acaagctggcctgcgccatcgtcaacacggccggccgcgagaccgggggcgtgcactggctggccttcgcctgga

SEQ ID NO: 236808 - DNA, 75 bp, Artificial Sequence
  Synthetic
gtcaccctcactctcatctgcagcctaatcacagtagtcatcgccttcatccagtgcattgactacatctgtgtg

SEQ ID NO: 236809 - DNA, 75 bp, Artificial Sequence
  Synthetic
tggtcatccccaccggcgcctcctcttccagcgccgccgccgccgccactagcaccgcggacatggagacgcaga

SEQ ID NO: 236810 - DNA, 75 bp, Artificial Sequence
  Synthetic
ctcctcggcggaggtacagacggacccctggatgccgccgccggcgaccgccccctcgcgcgcacgccgcgggcg

SEQ ID NO: 236811 - DNA, 75 bp, Artificial Sequence
  Synthetic
gtgcccaactccatgctccagagcccccaggtcgagcccaccctgcgccgcaaccaggagcagctctacagcttc

SEQ ID NO: 236812 - DNA, 75 bp, Artificial Sequence
  Synthetic
cctggtgctgcacggggtgagcttctatggctttaacaacacctgtgtggaggcctggaccgatgtgaaggtccg

SEQ ID NO: 236813 - DNA, 75 bp, Artificial Sequence
  Synthetic
ccctggatgccgccgccggcgaccgccccctcgcgcgcacgccgcgggcgcaggaagtacggtgccgccagcgcg

SEQ ID NO: 236814 - DNA, 75 bp, Artificial Sequence
  Synthetic
ccgaggctacagttaccgcccgcgaagagccaagggctccacccgccgcacccgccgcgccgccacctctacccg

SEQ ID NO: 236815 - DNA, 75 bp, Artificial Sequence
  Synthetic
gtacacactttttttctcaataaatggcatttttttatttatacaagctctctggggtattcatttcccaccacc

SEQ ID NO: 236816 - DNA, 75 bp, Artificial Sequence
  Synthetic
cagcccgcgctggctccgatctccgtgagaagagtggcgcgcaacggggacaccttggtgctgcccagggcgcgc

SEQ ID NO: 236817 - DNA, 75 bp, Artificial Sequence
  Synthetic
caccttggtgctgcccagggcgcgctaccaccccagcatcgtttaaaaagcctgttgtggttcttgcagatatgg

SEQ ID NO: 236818 - DNA, 75 bp, Artificial Sequence
  Synthetic
cctgttgtggttcttgcagatatggccctcacttgccgcctccgtttcccggtgccgggataccgaggaagatcg

SEQ ID NO: 236819 - DNA, 75 bp, Artificial Sequence
  Synthetic
cagcgcgttcatcaggtcgggcgccgagatcttgaagtcgcagttggggccgccgccctgcgcgcgcgagttgcg

SEQ ID NO: 236820 - DNA, 75 bp, Artificial Sequence
  Synthetic
gagatcttgaagtcgcagttggggccgccgccctgcgcgcgcgagttgcggtacaccgggttgcagcactggaac

SEQ ID NO: 236821 - DNA, 75 bp, Artificial Sequence
  Synthetic
atcgcctccgtggccttgcaggcgtcccagaggcgttgacacagacttcttgcaagcttgcaaaaatatggaaaa

SEQ ID NO: 236822 - DNA, 75 bp, Artificial Sequence
  Synthetic
aaggtgctgaggtacgacgagaccaggtcccggtgcaggccctgcgagtgcgggggcaagcatatgaggaaccag

SEQ ID NO: 236823 - DNA, 75 bp, Artificial Sequence
  Synthetic
gtacagcgcgcgcatgaaggcctgcatctggcggaaggccatctgggccttggcgccctccgagaagaacatgcc

SEQ ID NO: 236824 - DNA, 75 bp, Artificial Sequence
  Synthetic
agcagcgcgcgtcggtgttggcgatctgcaccacgttgcgcccccaccggttcttcacgatcttggccttggacg

SEQ ID NO: 236825 - DNA, 75 bp, Artificial Sequence
  Synthetic
gttctcgctggtcacatccatctcgatcacatgttccttgttcaccatgctgctgccgtgcagacacttcagctc

SEQ ID NO: 236826 - DNA, 75 bp, Artificial Sequence
  Synthetic
tgctgccgtgcagacacttcagctcgccctccgtctcggtgcagcggtgctgccacagcgcgcagcccgtgggct

SEQ ID NO: 236827 - DNA, 75 bp, Artificial Sequence
  Synthetic
gccctccgtctcggtgcagcggtgctgccacagcgcgcagcccgtgggctcgaaagacttgtaggtcacctccgc

SEQ ID NO: 236828 - DNA, 75 bp, Artificial Sequence
  Synthetic
ggggcgaaaagcgcccgcggcccgacagggaagagaccactctggtcacgcacaccgatgagccgcccccctacg

SEQ ID NO: 236829 - DNA, 75 bp, Artificial Sequence
  Synthetic
aagcggcccatcatggtcacgaaggtcttgttgctgctgaaggtcagctgcagcccgcggtgctcctcgttcagc

SEQ ID NO: 236830 - DNA, 75 bp, Artificial Sequence
  Synthetic
gccaccggggtggtgggccgccacacccccgccacgctggacctgcctcctcctcctgtttcttcttcggccgcc

SEQ ID NO: 236831 - DNA, 75 bp, Artificial Sequence
  Synthetic
gaagttcaccttcagctcattctccacgtggtacttgtccatcagcgtgcgcgccgcctccatgcccttctccca

SEQ ID NO: 236832 - DNA, 75 bp, Artificial Sequence
  Synthetic
acgtggtacttgtccatcagcgtgcgcgccgcctccatgcccttctcccaggccgacaccagcggcaggctcacg

SEQ ID NO: 236833 - DNA, 75 bp, Artificial Sequence
  Synthetic
tgcccggtccgcccgcggccgccccccgtcccaccgccagtcgagcgcccctgcgtcgcgcggccagcggccccc

SEQ ID NO: 236834 - DNA, 75 bp, Artificial Sequence
  Synthetic
gggttcttcaccatcaccgtggccgccgcctccgccgcgctttcgctttccgccccgctgttctcttcctcttcc

SEQ ID NO: 236835 - DNA, 75 bp, Artificial Sequence
  Synthetic
ccgcctccgccgcgctttcgctttccgccccgctgttctcttcctcttcctcctcttcctcgccgccgcccactc

SEQ ID NO: 236836 - DNA, 75 bp, Artificial Sequence
  Synthetic
caactggcagaacacgctgaacagcatcgtgggtctgggggtgcagtccgtgaagcgccgccgatgctactgaat

SEQ ID NO: 236837 - DNA, 75 bp, Artificial Sequence
  Synthetic
atcgtgggtctgggggtgcagtccgtgaagcgccgccgatgctactgaatagcttagctaacggtgttgtatgtg

SEQ ID NO: 236838 - DNA, 75 bp, Artificial Sequence
  Synthetic
aggagctgctgagtcgccgccgttcgcgcgcccaccgccactaccaccgccggtaccactccagcgcccctcaag

SEQ ID NO: 236839 - DNA, 75 bp, Artificial Sequence
  Synthetic
acctatgaaaaaacaggtgacacccaccgcctaggatacaagctgcccacacagcgccaaaagtttgcccttatg

SEQ ID NO: 236840 - DNA, 75 bp, Artificial Sequence
  Synthetic
cagtaccgaggcacgcttctttttcttcctgggggcgttcgccagctccgcggctgcggccgctgccgaggtcga

SEQ ID NO: 236841 - DNA, 75 bp, Artificial Sequence
  Synthetic
cggctgcggccgctgccgaggtcgaaggccgagggctgggcgtgcgcggcaccagcgcgtcctgcgagccgtcct

SEQ ID NO: 236842 - DNA, 75 bp, Artificial Sequence
  Synthetic
cccagcactccgtggagacagaaggctgcattcatgctccctgcaggggcgctgactgcctctacaccttgatca

SEQ ID NO: 236843 - DNA, 75 bp, Artificial Sequence
  Synthetic
ccgcgtccgcgctcgggggtggtctcgcgctggtcctcttcccgactggccatctcccactgctccttctcctat

SEQ ID NO: 236844 - DNA, 75 bp, Artificial Sequence
  Synthetic
cgtagttgtgttccagggtgagatcgtcataggccatttttataaagcgcgggcggagggtgcccgactggggga

SEQ ID NO: 236845 - DNA, 75 bp, Artificial Sequence
  Synthetic
cccaagggcgcccccaactcctgcgagtgggagcaattagaagaagcccaggccgctttggaagacgaagaatta

SEQ ID NO: 236846 - DNA, 75 bp, Artificial Sequence
  Synthetic
cagcctaaccgccccctctgagccctccaccaccgccgccaccaccgccaatgccgccgcggacgacgcgcccac

SEQ ID NO: 236847 - DNA, 75 bp, Artificial Sequence
  Synthetic
agtgggagcaattagaagaagcccaggccgctttggaagacgaagaattagaagaagacgaggaaccacaagatg

SEQ ID NO: 236848 - DNA, 75 bp, Artificial Sequence
  Synthetic
atacgctcaggcgcccctttctggagaacaaattactaaagacggtctgcaaatagggtcagataacacagaagc

SEQ ID NO: 236849 - DNA, 75 bp, Artificial Sequence
  Synthetic
gaacaaattactaaagacggtctgcaaatagggtcagataacacagaagctcagtctaagcctatatatgcagat

SEQ ID NO: 236850 - DNA, 75 bp, Artificial Sequence
  Synthetic
ttggggaatcccaatggaatgaagcagatgctacagcagctgggggtagagtgctgaaaaaaaccactcctatga

SEQ ID NO: 236851 - DNA, 75 bp, Artificial Sequence
  Synthetic
agatgctacagcagctgggggtagagtgctgaaaaaaaccactcctatgaagccatgctatggctcatatgcccg

SEQ ID NO: 236852 - DNA, 75 bp, Artificial Sequence
  Synthetic
gacgacgtgctgcttaagcacctgcaccgccagtgcgtcatcgtctgcgacgcgctgcaggagcgctgcgaagtg

SEQ ID NO: 236853 - DNA, 75 bp, Artificial Sequence
  Synthetic
ggtgtgctggtggctgatgataagggtgtccttcaatctaaagttgaaatgcaatttttttcaaccactactacg

SEQ ID NO: 236854 - DNA, 75 bp, Artificial Sequence
  Synthetic
cgcgctgcaggagcgctgcgaagtgcccctggacgtggcggaggtcagccgcgcctacgagcggcacctcttcgc

SEQ ID NO: 236855 - DNA, 75 bp, Artificial Sequence
  Synthetic
caaagccaaaactagtgctgtacagcgaggatgtgcacatggaaactccagacacacacatctcttacaagccta

SEQ ID NO: 236856 - DNA, 75 bp, Artificial Sequence
  Synthetic
gagaacggcacctgcgagcccaacccgcgtctcaacttctacccggtcttcgcggtacccgaggtgctggccacc

SEQ ID NO: 236857 - DNA, 75 bp, Artificial Sequence
  Synthetic
tcacggccccacttagcattaataatgacagcctaggactagacatgcaagcgcccatcagctctcgagatggaa

SEQ ID NO: 236858 - DNA, 75 bp, Artificial Sequence
  Synthetic
cctaactgtggccgagggtatcaatgctttggcagtagccacaggtaatggtattggactaaatgaaaccaacac

SEQ ID NO: 236859 - DNA, 75 bp, Artificial Sequence
  Synthetic
ctgatattgcctctctggaggaagtgcccaagatcttcgagggtctcggtcgcgacgagaaacgggcggcgaacg

SEQ ID NO: 236860 - DNA, 75 bp, Artificial Sequence
  Synthetic
gctttggcagtagccacaggtaatggtattggactaaatgaaaccaacacacacctgcaggcaaaactggtcgcg

SEQ ID NO: 236861 - DNA, 75 bp, Artificial Sequence
  Synthetic
ctctgcacggagacagcgaaaacgagagtcactcgggggtgctggtggagctcgagggcgacaacgcgcgcctgg

SEQ ID NO: 236862 - DNA, 75 bp, Artificial Sequence
  Synthetic
acattaagctaagcgtcgcaggaggcatgaggctaaacaataacacactgatactagatgtaaactacccatttg

SEQ ID NO: 236863 - DNA, 75 bp, Artificial Sequence
  Synthetic
atactagatgtaaactacccatttgaggctcaaggccaactgagcctaagagtgggctcgggcccactatatgta

SEQ ID NO: 236864 - DNA, 75 bp, Artificial Sequence
  Synthetic
cacccactttgcctacccggcgctcaacctgccccccaaggtcatgagtgtggtcatgggcgagctcatcatgcg

SEQ ID NO: 236865 - DNA, 75 bp, Artificial Sequence
  Synthetic
ttgtttccctctgggaggcataggggtaactgacacttaccaggctattaagactaatggcaatggtcaaggaga

SEQ ID NO: 236866 - DNA, 75 bp, Artificial Sequence
  Synthetic
aacctgccccccaaggtcatgagtgtggtcatgggcgagctcatcatgcgccgcgcccagcccctggccgcggat

SEQ ID NO: 236867 - DNA, 75 bp, Artificial Sequence
  Synthetic
aaggcctgcccgcggtcagcgacgagcagctggcgcgctggctggagacccgcgaccccgcgcagctggaggagc

SEQ ID NO: 236868 - DNA, 75 bp, Artificial Sequence
  Synthetic
tttgcagaccgcaacgagataggggtgggaaacaacttcgccatggagattaacctcagtgccaacctgtggagg

SEQ ID NO: 236869 - DNA, 75 bp, Artificial Sequence
  Synthetic
taacctcagtgccaacctgtggaggaacttcctctactccaacgtggccctgtacctgccagacaagcttaagta

SEQ ID NO: 236870 - DNA, 75 bp, Artificial Sequence
  Synthetic
cagaaaaacctatacagactaaaataggtctaggcatggagtatgacactgagggagccatgatgacaaaactag

SEQ ID NO: 236871 - DNA, 75 bp, Artificial Sequence
  Synthetic
agaaactcggaccactctgagacgaaggcccgcgtccaggccaggacgaaggaggctaggtgggaggggtaccgg

SEQ ID NO: 236872 - DNA, 75 bp, Artificial Sequence
  Synthetic
aggtctaggcatggagtatgacactgagggagccatgatgacaaaactaggctctggactaagctttgacaattc

SEQ ID NO: 236873 - DNA, 75 bp, Artificial Sequence
  Synthetic
aatgatgacaggcttactttgtggaccacaccggacccatcgcccaactgtcagatttactctgaaaaagatgct

SEQ ID NO: 236874 - DNA, 75 bp, Artificial Sequence
  Synthetic
ccacaccggacccatcgcccaactgtcagatttactctgaaaaagatgctaaactaaccttggtactgactaaat

SEQ ID NO: 236875 - DNA, 75 bp, Artificial Sequence
  Synthetic
accacgatgttattcatgatcccacagtgcaaggcgctgtatccaaagctcatgcccggaaccaccgcccccacg

SEQ ID NO: 236876 - DNA, 75 bp, Artificial Sequence
  Synthetic
atctatcgccgctcttaaaggtagccttgtgccaatcactagtgcaatcagtgtggttcaggtatacctaaggtt

SEQ ID NO: 236877 - DNA, 75 bp, Artificial Sequence
  Synthetic
cttgtgccaatcactagtgcaatcagtgtggttcaggtatacctaaggtttgatgaaaatggggtactaatgagt

SEQ ID NO: 236878 - DNA, 75 bp, Artificial Sequence
  Synthetic
ccctcagggacctctggacgggcttcaacgagcgctcggtggccgccgcgctggcggacatcatcttccccgagc

SEQ ID NO: 236879 - DNA, 75 bp, Artificial Sequence
  Synthetic
ggaattttagaaacggagactcaactaatggcacaccatatacaaacgcagtgggttttatgcctaatctactgg

SEQ ID NO: 236880 - DNA, 75 bp, Artificial Sequence
  Synthetic
taatggcacaccatatacaaacgcagtgggttttatgcctaatctactggcctatcctaaaggtcaaactacaac

SEQ ID NO: 236881 - DNA, 75 bp, Artificial Sequence
  Synthetic
ctgaaccaagaggctaggacctgcccaccggctatgcactgcagggaacccgggttggaacaatgacaatgcaga

SEQ ID NO: 236882 - DNA, 75 bp, Artificial Sequence
  Synthetic
gtttacatgaatggggacgatactaaacccatgacatttacaatcaacttcaatggccttagtgaaacaggggat

SEQ ID NO: 236883 - DNA, 75 bp, Artificial Sequence
  Synthetic
ggccacttgctgcgcgctgcccagcgacttcgtgcccatcaagtacagggagtgcccgccgccgctctggggcca

SEQ ID NO: 236884 - DNA, 75 bp, Artificial Sequence
  Synthetic
ttgagctgcacgtactcgcgcgcgacgcagcgccactcggggaagacggtggtgcgctcgtcgggcaccaggcgc

SEQ ID NO: 236885 - DNA, 75 bp, Artificial Sequence
  Synthetic
caatggccttagtgaaacaggggatacccctgtcagtaaatattccatgacattctcatggaggtggccaaatgg

SEQ ID NO: 236886 - DNA, 75 bp, Artificial Sequence
  Synthetic
gacttcgtgcccatcaagtacagggagtgcccgccgccgctctggggccactgctacctcttccagctggccaac

SEQ ID NO: 236887 - DNA, 75 bp, Artificial Sequence
  Synthetic
tggaagacgtgagcggcgagggcctgctcgagtgccactgccgctgcaacctctgcacgccccaccgctctctag

SEQ ID NO: 236888 - DNA, 75 bp, Artificial Sequence
  Synthetic
ccataccctacctggacggaaccttctacctcaaccacactttcaagaaggtctcggtcaccttcgactcctcgg

SEQ ID NO: 236889 - DNA, 75 bp, Artificial Sequence
  Synthetic
gagtcagattatcggtaccttcgagctgcagggtccctcgcctgacgagaagtccgcggctccggggctgaaact

SEQ ID NO: 236890 - DNA, 75 bp, Artificial Sequence
  Synthetic
actaccacgcccacgagatcaggttctacgaagaccaatcccgcccgcccaaggcggagctcaccgcctgcgtca

SEQ ID NO: 236891 - DNA, 75 bp, Artificial Sequence
  Synthetic
attgcaagccatcaacaaagcccgccgagagttcttgctgaaaaagggtcggggggtgtacctggacccccagtc

SEQ ID NO: 236892 - DNA, 75 bp, Artificial Sequence
  Synthetic
gaggactgggacagtcaggcagaggaggtttcggacgaggagcaggaggagatgatggaagactgggaggaggac

SEQ ID NO: 236893 - DNA, 75 bp, Artificial Sequence
  Synthetic
accagccgcaccgcggcgtcatcgagaccgtgtacctgcgcacgcccttctcggccggcaacgccaccacctaaa

SEQ ID NO: 236894 - DNA, 75 bp, Artificial Sequence
  Synthetic
cgtcgcagccgccccgctcccagagcgagaagtcggtgcgctttttggagcgggggttgggcagcgcgaaggtga

SEQ ID NO: 236895 - DNA, 75 bp, Artificial Sequence
  Synthetic
gccgcttcctgctattccaccacggggtcgcctttccccgcaatgtcctgcattactaccgtcatctctacagcc

SEQ ID NO: 236896 - DNA, 75 bp, Artificial Sequence
  Synthetic
tggccttcgcctggaacccgcgctccaaaacatgctacctctttgaccccttcggattctcggaccagcggctca

SEQ ID NO: 236897 - DNA, 75 bp, Artificial Sequence
  Synthetic
cctactgcagcggcgacccagaggcggcagcggcagccacagcggcgaccaccacctaggaagatatcctccgcg

SEQ ID NO: 236898 - DNA, 75 bp, Artificial Sequence
  Synthetic
ggcagcggcagccacagcggcgaccaccacctaggaagatatcctccgcgggcaagacagcggcagcagcggcca

SEQ ID NO: 236899 - DNA, 75 bp, Artificial Sequence
  Synthetic
gcctcctcgcccgaccgctgcgtcaccctcgagaagtccacccagaccgtgcaggggcccgactcggccgcctgc

SEQ ID NO: 236900 - DNA, 75 bp, Artificial Sequence
  Synthetic
cggctctacagcttcctggagcgccactcgccctacttccgccgccacagcgcgcagatcaggggggccacctct

SEQ ID NO: 236901 - DNA, 75 bp, Artificial Sequence
  Synthetic
actcgccctacttccgccgccacagcgcgcagatcaggggggccacctctttctgtcgcatgcaagagatgcaag

SEQ ID NO: 236902 - DNA, 75 bp, Artificial Sequence
  Synthetic
caaatactgcgcgctcactcttaaagactagctccgcgcccttctcgaatttaggcgggagaaaactacgtcatc

SEQ ID NO: 236903 - DNA, 75 bp, Artificial Sequence
  Synthetic
ccgagatgagcaaagagattcccacgccatacatgtggagctaccagccgcagatgggactcgcggcgggagcgg

SEQ ID NO: 236904 - DNA, 75 bp, Artificial Sequence
  Synthetic
gccatacatgtggagctaccagccgcagatgggactcgcggcgggagcggcccaggactactccacccgcatgaa

SEQ ID NO: 236905 - DNA, 75 bp, Artificial Sequence
  Synthetic
atctcacaggtcaacgggatccgcgcccagcgaaaccaaatactgctggaacaggcggccatcaccgccacgccc

SEQ ID NO: 236906 - DNA, 75 bp, Artificial Sequence
  Synthetic
gagcactcgtgctggcttttgtaaaagcgagcgcagtactggcagcgctgcacgggctgtacctcttgcacgaga

SEQ ID NO: 236907 - DNA, 75 bp, Artificial Sequence
  Synthetic
acaggcggccatcaccgccacgccccgccataatctcaacccccgaaattggcccgccgccctcgtgtaccagga

SEQ ID NO: 236908 - DNA, 75 bp, Artificial Sequence
  Synthetic
cgcgggtcagcaccagcgcgttcatcaggtcgggcgccgagatcttgaagtcgcagttggggccgccgccctgcg

SEQ ID NO: 236909 - DNA, 75 bp, Artificial Sequence
  Synthetic
cttccgcgtgacgcccaggccgaagtccagatgactaactcaggggcgcagctcgcgggcggctttcgtcacggg

SEQ ID NO: 236910 - DNA, 75 bp, Artificial Sequence
  Synthetic
tttcccacggtacgtcacttccgcatatagtaaaactacgctacccaacatgcaagaagccacgccccaaaacac

SEQ ID NO: 236911 - DNA, 75 bp, Artificial Sequence
  Synthetic
aacggggtcagcttgggcacctgccgccccaggaagggagcgtgccccggcttggaattgcagtcgcagcgcagc

SEQ ID NO: 236912 - DNA, 75 bp, Artificial Sequence
  Synthetic
catcggaaccctccagttcgtggaggagttcgtgccctcggtctacttcaaccccttctcgggaccgcccggacg

SEQ ID NO: 236913 - DNA, 75 bp, Artificial Sequence
  Synthetic
ccgccgctcctccccgccccgccccgctccgcccacctcattatcatattggcttcaatccaaaataaggtatat

SEQ ID NO: 236914 - DNA, 75 bp, Artificial Sequence
  Synthetic
cgagaactggttcgcggggcagctcgcgtcgtgcaggcagcagcgcgcgtcggtgttggcgatctgcaccacgtt

SEQ ID NO: 236915 - DNA, 75 bp, Artificial Sequence
  Synthetic
acggctacgactgaatgtcaggtgccgaggcagagcagcttcgcctgagacacctcgagcactgccgccgccaca

SEQ ID NO: 236916 - DNA, 75 bp, Artificial Sequence
  Synthetic
gttctgctactttcagctacccgaggagcataccgaggggccggcgcacggcgtccgcctgaccacccagggcga

SEQ ID NO: 236917 - DNA, 75 bp, Artificial Sequence
  Synthetic
gacacttcagctcgccctccacctcggtgcagcggtgctgccacagcgcgcagcccgtgggctcgaaatgcttgt

SEQ ID NO: 236918 - DNA, 75 bp, Artificial Sequence
  Synthetic
ttcaccctccgtcccctgctagtggagcgggagcggggtccctgtgtcctaactatcgcctgcaactgccctaac

SEQ ID NO: 236919 - DNA, 75 bp, Artificial Sequence
  Synthetic
cccaggcgaacctcacctgcggtctgcatcggagggccaagaagtacctcacctggtacttcaacggcaccccct

SEQ ID NO: 236920 - DNA, 75 bp, Artificial Sequence
  Synthetic
acctggtacttcaacggcaccccctttgtggtttacaacagcttcgacggggacggagtctccctgaaagaccag

SEQ ID NO: 236921 - DNA, 75 bp, Artificial Sequence
  Synthetic
acaagaacaccaccctccaactcttccctccctacctgccgggaacctacgagtgcgtcaccggccgctgcaccc

SEQ ID NO: 236922 - DNA, 75 bp, Artificial Sequence
  Synthetic
ctcctcctcttcttcctcgccgcccgcgcgcagcccccgcaccacggggtcgtcttcctgcaggcgccgcaccga

SEQ ID NO: 236923 - DNA, 75 bp, Artificial Sequence
  Synthetic
ccctccctacctgccgggaacctacgagtgcgtcaccggccgctgcacccacctcacccgcctgatcgtaaacca

SEQ ID NO: 236924 - DNA, 75 bp, Artificial Sequence
  Synthetic
ctcttccccagaacaggaggtgagctcaggaaactccccggggaccagggcggagacgtaccttcgacccttgtg

SEQ ID NO: 236925 - DNA, 75 bp, Artificial Sequence
  Synthetic
ttgctcgtcctcgctgtccactatgacctcgggggagggcgacctcagaaccgtggcgcgctgcctcttcttttt

SEQ ID NO: 236926 - DNA, 75 bp, Artificial Sequence
  Synthetic
gccgagggctgggcgtgcgcggcaccagcgcgtcctgcgagccgtcctcgtcctcggactcgaggcggcagcgag

SEQ ID NO: 236927 - DNA, 75 bp, Artificial Sequence
  Synthetic
aactctaccctttcttcggaatcaggtgacttctctgaaatcgggcttggtgtgctgcttactctgttgattttt

SEQ ID NO: 236928 - DNA, 75 bp, Artificial Sequence
  Synthetic
tgtgctgcttactctgttgatttttttccttatcatactcagccttctgtgcctcaggctcgccgcctgctgcgc

SEQ ID NO: 236929 - DNA, 75 bp, Artificial Sequence
  Synthetic
aagttagtttgtagaatcaaggaggattacaagtgggaatttgaagagcttttgaaatcctgtggtgagctattg

SEQ ID NO: 236930 - DNA, 75 bp, Artificial Sequence
  Synthetic
ttccttatcatactcagccttctgtgcctcaggctcgccgcctgctgcgcacacatctatatctactgctggttg

SEQ ID NO: 236931 - DNA, 75 bp, Artificial Sequence
  Synthetic
gatgaacaggtacatggtcctatcgatcctaggcctgctggccctggcggcctgcagcgccgccaaaaaagagat

SEQ ID NO: 236932 - DNA, 75 bp, Artificial Sequence
  Synthetic
tcaaagcctacgtcacccgccccgcctcgccccgcccacctcattatcatattggcctcaatccaaaataggtat

SEQ ID NO: 236933 - DNA, 75 bp, Artificial Sequence
  Synthetic
gcagcgagaccgcgctgacgatgcatctcaacaattgctgcgtaggtacgccgccgagggacctgagggagtcca

SEQ ID NO: 236934 - DNA, 75 bp, Artificial Sequence
  Synthetic
atcctaggcctgctggccctggcggcctgcagcgccgccaaaaaagagattacctttgaggagcccgcttgcaat

SEQ ID NO: 236935 - DNA, 75 bp, Artificial Sequence
  Synthetic
ggattgaagccaatatgataatgaggtgggcggagcgggatgtgacgcggggcgggaggcggggcgcggggcggg

SEQ ID NO: 236936 - DNA, 75 bp, Artificial Sequence
  Synthetic
aatgcaccaccctcgtcaaatgcgttaccaatcatgagaggctgcgcatcgactacaaaaacaaaactggccagt

SEQ ID NO: 236937 - DNA, 75 bp, Artificial Sequence
  Synthetic
caagtcgagaaggaggaggacagcctaaccaccaccgccccctctgagccctccgccgccaccgccgcggacgac

SEQ ID NO: 236938 - DNA, 75 bp, Artificial Sequence
  Synthetic
ccggcgggcggggaggtgtggcggaagttgagtttgcaagtgtggcggatgtgacttgctagtgccggacgcggt

SEQ ID NO: 236939 - DNA, 75 bp, Artificial Sequence
  Synthetic
ccattaccaccctacccggcgacgcagccccgatcgagaaggaagtgttgatcgagcaggacccgggttttgtga

SEQ ID NO: 236940 - DNA, 75 bp, Artificial Sequence
  Synthetic
ttgcggtctatagtgtgtttacgcccggagacccctctaactactctgtcaccgtcttccagggcggacagtcta

SEQ ID NO: 236941 - DNA, 75 bp, Artificial Sequence
  Synthetic
catcatcaataatataccttattttggattgaagccaatatgataatgaggtgggcggagcgggatgtgacgcgg

SEQ ID NO: 236942 - DNA, 75 bp, Artificial Sequence
  Synthetic
agccccgatcgagaaggaagtgttgatcgagcaggacccgggttttgtgagcgaagaggaggatgaggaggatga

SEQ ID NO: 236943 - DNA, 75 bp, Artificial Sequence
  Synthetic
aaaattcaggcagaggcgaatctttatcgatgaaaagaaaatgccttgatcgctaacaccggctttctatctgca

SEQ ID NO: 236944 - DNA, 75 bp, Artificial Sequence
  Synthetic
agctggctgctcaggtcctggacaccctgatcgaggaggtattggctgataattatcctcccgcgactcctttcg

SEQ ID NO: 236945 - DNA, 75 bp, Artificial Sequence
  Synthetic
aatcaccaccaccctccttgcgattgcccatgggttgacacgaatcgaagtgccagtggggtccaatgtcaccat

SEQ ID NO: 236946 - DNA, 75 bp, Artificial Sequence
  Synthetic
tgatctggaggtggtggggcccaacgatccgaacgagcaggcggtttccgaattttttcccgagtccatgttgtt

SEQ ID NO: 236947 - DNA, 75 bp, Artificial Sequence
  Synthetic
gcccatgggttgacacgaatcgaagtgccagtggggtccaatgtcaccatggtgggccccgccggcaattccacc

SEQ ID NO: 236948 - DNA, 75 bp, Artificial Sequence
  Synthetic
ttgcaagtacaagctcaaggggctggtgaatatcaggaattgttgctacatttctggcaacggggcggaggtgga

SEQ ID NO: 236949 - DNA, 75 bp, Artificial Sequence
  Synthetic
cagacccctcctccgatcaccgtttcccccgatccgccgccgctgagtaggcagcccgagcgctgcgtgggacct

SEQ ID NO: 236950 - DNA, 75 bp, Artificial Sequence
  Synthetic
gtctggttttccacccagcgaggatgaggacgaagagggtgagcagtttgtgttagattctgtggatcaacccgg

SEQ ID NO: 236951 - DNA, 75 bp, Artificial Sequence
  Synthetic
acaaggactacatgctgcatgtagtcgaggcacttcccactaccacccccactaccacctctcccaccaccacta

SEQ ID NO: 236952 - DNA, 75 bp, Artificial Sequence
  Synthetic
agattatgtgttctctgtgttatatgaagatgacctgtatgtttatttacagtaagtttgtgatcggtgggcagg

SEQ ID NO: 236953 - DNA, 75 bp, Artificial Sequence
  Synthetic
atagtgagccgccctaagagcaggagttccattaagaaatgcttgtttgagaggtgcaccttggggatcctggcc

SEQ ID NO: 236954 - DNA, 75 bp, Artificial Sequence
  Synthetic
tgggctatagtgtgggtgggtggtctttgtggtgtttttttttttaatatatgttagggggttatgctaaatact

SEQ ID NO: 236955 - DNA, 75 bp, Artificial Sequence
  Synthetic
tccagtgtctgagcccgagcaggaacctgagccggagcctgagcctcctcgccccaggagaaagcctgcaatttt

SEQ ID NO: 236956 - DNA, 75 bp, Artificial Sequence
  Synthetic
gctggaggagcggcgcaagctcatgatggccgcggtgctcgtcaccgtggagctcgagtgtctgcagcgcttctt

SEQ ID NO: 236957 - DNA, 75 bp, Artificial Sequence
  Synthetic
cagagctccgcttgcctgacccaggaggctgtggagcccgttgccctgaagcagatcggtgattcaataattgac

SEQ ID NO: 236958 - DNA, 75 bp, Artificial Sequence
  Synthetic
gccccaggagaaagcctgcaattttaactagacccagcgcaccggtagcgaggggcctcagcagtgcggagacca

SEQ ID NO: 236959 - DNA, 75 bp, Artificial Sequence
  Synthetic
accctcccgattctactttccacatcacgggtaccaaagaccctaacctctctttctacctgatgctgctgctct

SEQ ID NO: 236960 - DNA, 75 bp, Artificial Sequence
  Synthetic
tctttctacctgatgctgctgctctgtatctctgtggtctcttccgcgctgatgttactggggatgttctgctgc

SEQ ID NO: 236961 - DNA, 75 bp, Artificial Sequence
  Synthetic
ccctccggagattcatcctgtggtgcccctgtgtcccattaagcccgttgccgtgagagttagtgggcggcggtc

SEQ ID NO: 236962 - DNA, 75 bp, Artificial Sequence
  Synthetic
ctcgctctcagggccaaccactgatgcccttcccctaccccccggattttgcagataacaagatatgagctcgct

SEQ ID NO: 236963 - DNA, 75 bp, Artificial Sequence
  Synthetic
ttgctagagcccgagagcatgtccaaggtgaacttgaacggggtgtttgacatgaccatgaagatctggaaggtg

SEQ ID NO: 236964 - DNA, 75 bp, Artificial Sequence
  Synthetic
gcccttcccctaccccccggattttgcagataacaagatatgagctcgctgctgacactaaccgctttactagcc

SEQ ID NO: 236965 - DNA, 75 bp, Artificial Sequence
  Synthetic
ctacacgtggcagacggccatgggggtctggcagcagtgcctggaggagcgcaacctcaaggagctggagaagct

SEQ ID NO: 236966 - DNA, 75 bp, Artificial Sequence
  Synthetic
actcgagattccacaatgtcacagctgtggcaggagaaaatgttactttcaactccacggccgatacccagtggt

SEQ ID NO: 236967 - DNA, 75 bp, Artificial Sequence
  Synthetic
tggacgggcttcaacgagcgctcggtggccgccgcgctggcggacatcatcttccccgagcgcctgctcaaaacc

SEQ ID NO: 236968 - DNA, 75 bp, Artificial Sequence
  Synthetic
aactccacggccgatacccagtggtcgtggagtggctcaggtagctacttaactatctgcaatagctccacttcc

SEQ ID NO: 236969 - DNA, 75 bp, Artificial Sequence
  Synthetic
ttggtgggcaaggaaagacccacgcttacaacctggaagttcgccagcccagaaccactacccaagcttctccca

SEQ ID NO: 236970 - DNA, 75 bp, Artificial Sequence
  Synthetic
catcaccagcagcagcagcagccacagcagcagcagcagattattgactttggttttggccagctcatctgccgc

SEQ ID NO: 236971 - DNA, 75 bp, Artificial Sequence
  Synthetic
agcagcagcagcagattattgactttggttttggccagctcatctgccgctacccaggccatctacagctctgtg

SEQ ID NO: 236972 - DNA, 75 bp, Artificial Sequence
  Synthetic
gcaactgttgtctaccgtccgcccgctgctgattccggcggaggagcaacaggccgggtcagaggaccgggcccg

SEQ ID NO: 236973 - DNA, 75 bp, Artificial Sequence
  Synthetic
ctgctgattccggcggaggagcaacaggccgggtcagaggaccgggcccgtcgggatccggagcagggggcgccg

SEQ ID NO: 236974 - DNA, 75 bp, Artificial Sequence
  Synthetic
aaaaccagtggatgcggccgaggtctccgccctcgtcaatgactgggcggggctgggaatgtggtggttcgccat

SEQ ID NO: 236975 - DNA, 75 bp, Artificial Sequence
  Synthetic
aggcatgatggcgctctgcctgcttctgctctggctcatctgctgcctccaccgcaggcgagccagaccccccat

SEQ ID NO: 236976 - DNA, 75 bp, Artificial Sequence
  Synthetic
ccgccgccagcatacatgcttctggaggaagaggaggactgggacagtcaggcagaggaggtttcggacgaggac

SEQ ID NO: 236977 - DNA, 75 bp, Artificial Sequence
  Synthetic
gttccttctcccaccttttctggggtgttctacgctggccgctgtgtctcacctggaggtagactgcctctcacc

SEQ ID NO: 236978 - DNA, 75 bp, Artificial Sequence
  Synthetic
agcaggccgatggccagggggaggcccttggtgtaagtgtttacaaaacggttaagttgggaagggtgcattcgg

SEQ ID NO: 236979 - DNA, 75 bp, Artificial Sequence
  Synthetic
ataacctccgctcctccggcgccggcgcccacccgcagcagacccaaccgtagatgggacactacaggaaccggg

SEQ ID NO: 236980 - DNA, 75 bp, Artificial Sequence
  Synthetic
tgcccaacttctaagactgctctaatcatgcataagactgtgatctgccttctgatcctctgcatcctgcccacc

SEQ ID NO: 236981 - DNA, 75 bp, Artificial Sequence
  Synthetic
gtcggtaagtccaagtgccccccagcgccgcccccgcaacaggagcaacagcagcagcagcggcgacagggctac

SEQ ID NO: 236982 - DNA, 75 bp, Artificial Sequence
  Synthetic
aatctccgcgcaaaagacatgcctcctgccgcttcacccaactgtggaatatacccaaatgctacaacgaaaaga

SEQ ID NO: 236983 - DNA, 75 bp, Artificial Sequence
  Synthetic
aagaacttggagacgcccttgtggcctcccagattttccatgcattcgtccatgatgatggcaatgggcccgcgg

SEQ ID NO: 236984 - DNA, 75 bp, Artificial Sequence
  Synthetic
tgcagcactgtctttgccctcatgatctacccctactttgatttgggatggaacgcgatcgatgccatgaattac

SEQ ID NO: 236985 - DNA, 75 bp, Artificial Sequence
  Synthetic
tggcttttccccgcaatgtcctgcattactaccgtcatctctacagcccctactgcggcggcggcggcgacccag

SEQ ID NO: 236986 - DNA, 75 bp, Artificial Sequence
  Synthetic
gaacgcgatcgatgccatgaattaccccacctttcccgcacccgagataattccactgcgacaagttgtgcccgt

SEQ ID NO: 236987 - DNA, 75 bp, Artificial Sequence
  Synthetic
cctacgcccactgaaatcagctactttaacctaacaggcggagatgactgacgccctagatctagaaatggacgg

SEQ ID NO: 236988 - DNA, 75 bp, Artificial Sequence
  Synthetic
tcgcagatctgcatttcccaggccttaatctcggaggggggaatcatatccacctgcggggcgatgaagaaaacg

SEQ ID NO: 236989 - DNA, 75 bp, Artificial Sequence
  Synthetic
agtgcggttgcttcatgcttgtcaagagcgtggcgataatcaagcataatatggtgtgtggcaacagcgaggaca

SEQ ID NO: 236990 - DNA, 75 bp, Artificial Sequence
  Synthetic
ttaacctaacaggcggagatgactgacgccctagatctagaaatggacggcatcagtaccgagcagcgtctccta

SEQ ID NO: 236991 - DNA, 75 bp, Artificial Sequence
  Synthetic
ggatggcaactgccacttgctgaagaccatccatataaccagccacggccggaaggcctggcccgtgttcgagca

SEQ ID NO: 236992 - DNA, 75 bp, Artificial Sequence
  Synthetic
accatccatataaccagccacggccggaaggcctggcccgtgttcgagcacaacgtgctgacccgctgctccttg

SEQ ID NO: 236993 - DNA, 75 bp, Artificial Sequence
  Synthetic
agcaggctaaagtcacctacgagaagaccggcaacagccaccgcctcagttacaaattgcccacccagcgccaga

SEQ ID NO: 236994 - DNA, 75 bp, Artificial Sequence
  Synthetic
aggcactcttcagcaaatactgcgcgctgactcttaaggactagccgcgcgcccttctcgaatttaggcgggaga

SEQ ID NO: 236995 - DNA, 75 bp, Artificial Sequence
  Synthetic
ctgcaccctggtaaagaccctgtgcggtctcagagatttagtcccctttaactaatcaaacactggaatcaataa

SEQ ID NO: 236996 - DNA, 75 bp, Artificial Sequence
  Synthetic
cagcaggtctctgtccagtttattcagcagcacctccttcccctcctcccaactctggtactccaaacgccttct

SEQ ID NO: 236997 - DNA, 75 bp, Artificial Sequence
  Synthetic
gattgaggtgggtgagtgggcgtggcctggggtggtaatgaaaatatataagttgggggtcttagggtctcttta

SEQ ID NO: 236998 - DNA, 75 bp, Artificial Sequence
  Synthetic
taatgggatccgcgccgagcgaaaccaaatactgctggaacaggcggccataaccgccacaccccgtcatgacct

SEQ ID NO: 236999 - DNA, 75 bp, Artificial Sequence
  Synthetic
caaatactgctggaacaggcggccataaccgccacaccccgtcatgacctcaatccccgaaattggcccgccgcc

SEQ ID NO: 237000 - DNA, 75 bp, Artificial Sequence
  Synthetic
agcagcacctccttcccctcctcccaactctggtactccaaacgccttctggcggcaaacttcctccacaccctg

SEQ ID NO: 237001 - DNA, 75 bp, Artificial Sequence
  Synthetic
gtccctccgcacccactatcttcatgttgttgcagatgaagcgcaccaaaacgtctgacgagagcttcaaccccg

SEQ ID NO: 237002 - DNA, 75 bp, Artificial Sequence
  Synthetic
cctggggtggtaatgaaaatatataagttgggggtcttagggtctctttatttgtgttgcagagacctccgccgg

SEQ ID NO: 237003 - DNA, 75 bp, Artificial Sequence
  Synthetic
cctcccttcgtgtctcccgatggattccaagaaagcccccccggggtcctgtctctgaacctggccgagcccctg

SEQ ID NO: 237004 - DNA, 75 bp, Artificial Sequence
  Synthetic
cggtctccgtccggacggaaccttccagatcgccggatcaggtcgctcctcattcacgcctcgccaggcgtacct

SEQ ID NO: 237005 - DNA, 75 bp, Artificial Sequence
  Synthetic
gatgacaagctgaccgccctgctggcgcagttggatgcgcttacccgggaactgggcgacctttctcagcaggtc

SEQ ID NO: 237006 - DNA, 75 bp, Artificial Sequence
  Synthetic
actgtaagcacctcaggcgccctcaccgtagcagccgccgctcccctggcggtggccggcacctccctcaccatg

SEQ ID NO: 237007 - DNA, 75 bp, Artificial Sequence
  Synthetic
gaaggactcggcggacggctacgactgaatgtcaagtgctgaggcagagagcgttcgcctgaaacacctcgagca

SEQ ID NO: 237008 - DNA, 75 bp, Artificial Sequence
  Synthetic
caaaggccccctgaccgtgtctgaaggcaaactggccttgcaaacatcggccccgctgacggccgctgacagcag

SEQ ID NO: 237009 - DNA, 75 bp, Artificial Sequence
  Synthetic
ggcaaactggccttgcaaacatcggccccgctgacggccgctgacagcagcaccctcaccgttagctccactcca

SEQ ID NO: 237010 - DNA, 75 bp, Artificial Sequence
  Synthetic
tgggcttggacatggaagaccccatgtatactcacgatggaaaactgggaataagaattgggggtccactaagag

SEQ ID NO: 237011 - DNA, 75 bp, Artificial Sequence
  Synthetic
gtatactcacgatggaaaactgggaataagaattgggggtccactaagagtagtagacagcttgcacacactcac

SEQ ID NO: 237012 - DNA, 75 bp, Artificial Sequence
  Synthetic
tcccctgctagtggagcgggagcggggttcttgtgtcataactatcgcctgcaactgccctaaccctggattaca

SEQ ID NO: 237013 - DNA, 75 bp, Artificial Sequence
  Synthetic
ccggctgctgggcgaggacgagtacctgaacaactccctgatgcagccggtgcgggagaaaaacctgccccccgc

SEQ ID NO: 237014 - DNA, 75 bp, Artificial Sequence
  Synthetic
gtagataacaatgccctccaaactagagttacgggcgccctaggttatgacacatcaggaaatctacaactgaga

SEQ ID NO: 237015 - DNA, 75 bp, Artificial Sequence
  Synthetic
gagttacgggcgccctaggttatgacacatcaggaaatctacaactgagagccgcagggggtatgcgaattgatg

SEQ ID NO: 237016 - DNA, 75 bp, Artificial Sequence
  Synthetic
ggcatacccatttgatgctcaaaacaatctcagccttagacttggtcagggacccctgtatgtaaatacagacca

SEQ ID NO: 237017 - DNA, 75 bp, Artificial Sequence
  Synthetic
attggcgatgtttccgcccagatcccttctgggattcatgttgtgcaggaccaccagtacagtgtatccggtgca

SEQ ID NO: 237018 - DNA, 75 bp, Artificial Sequence
  Synthetic
aatctcagccttagacttggtcagggacccctgtatgtaaatacagaccacaacctggatttaaattgcaacaga

SEQ ID NO: 237019 - DNA, 75 bp, Artificial Sequence
  Synthetic
ccaagaagtacctcacctggtacttcaacggcaccccctttgtggtttacaacagcttcgaccaggacggagttg

SEQ ID NO: 237020 - DNA, 75 bp, Artificial Sequence
  Synthetic
acacaaaaaaacttgagactaaaattagctcaggcttagactatgacaccaatggtgctgtcattattaaacttg

SEQ ID NO: 237021 - DNA, 75 bp, Artificial Sequence
  Synthetic
tagctcaggcttagactatgacaccaatggtgctgtcattattaaacttggcactggtctaagcttcgacaacac

SEQ ID NO: 237022 - DNA, 75 bp, Artificial Sequence
  Synthetic
ggtgatgataaactgactctgtggacgaccccagacccatctccaaattgcagaattcactcagacaaagactgc

SEQ ID NO: 237023 - DNA, 75 bp, Artificial Sequence
  Synthetic
cgaccccagacccatctccaaattgcagaattcactcagacaaagactgcaagtttactctcgtcctaactaagt

SEQ ID NO: 237024 - DNA, 75 bp, Artificial Sequence
  Synthetic
aggtgagctcaggaaaccccctggggcccagggcggagacttaccttcgacccttgtggggttaggattttttat

SEQ ID NO: 237025 - DNA, 75 bp, Artificial Sequence
  Synthetic
cgccgccctagcggtatcaggaaatctggcttcgataacaggcaccgttgccagcgttaccatctttcttagatt

SEQ ID NO: 237026 - DNA, 75 bp, Artificial Sequence
  Synthetic
aaagcttccttgagatttgttctctccctttacttttatgaacagctcaacttctaataacgctaccttttctca

SEQ ID NO: 237027 - DNA, 75 bp, Artificial Sequence
  Synthetic
ctggcttcgataacaggcaccgttgccagcgttaccatctttcttagatttgatcagaatggagtgcttatggaa

SEQ ID NO: 237028 - DNA, 75 bp, Artificial Sequence
  Synthetic
ggaacttcagaaatggcaattcaactaatgctgccccctacaccaacgcagttgggttcatgccaaacctcgcag

SEQ ID NO: 237029 - DNA, 75 bp, Artificial Sequence
  Synthetic
cacctataaccggctgcagctggtagttgagagagctgcagctgccgtcgtcccggaggaggggggccacctcgt

SEQ ID NO: 237030 - DNA, 75 bp, Artificial Sequence
  Synthetic
acttagccttctgtgcctcaggctcgccgcctgctgcgcacatatctacatctacagccggttgcttaactgctg

SEQ ID NO: 237031 - DNA, 75 bp, Artificial Sequence
  Synthetic
taatgctgccccctacaccaacgcagttgggttcatgccaaacctcgcagcgtaccccaaaacgcaaagccagac

SEQ ID NO: 237032 - DNA, 75 bp, Artificial Sequence
  Synthetic
gtttacttgaatggagacaaatccaaacccatgacccttaccatcaccctcaatggaactaatgaatccagtgaa

SEQ ID NO: 237033 - DNA, 75 bp, Artificial Sequence
  Synthetic
ctcaggtgctatgtctgctggccctggtggcctgcagtgccgccgtcaattttgaggaacccgcttgcaatgtga

SEQ ID NO: 237034 - DNA, 75 bp, Artificial Sequence
  Synthetic
ggtggcctgcagtgccgccgtcaattttgaggaacccgcttgcaatgtgactttcaagcctgaaggcgcacattg

SEQ ID NO: 237035 - DNA, 75 bp, Artificial Sequence
  Synthetic
aacccatgacccttaccatcaccctcaatggaactaatgaatccagtgaaactagtcaggtgagtcactactcca

SEQ ID NO: 237036 - DNA, 75 bp, Artificial Sequence
  Synthetic
cgggcaatatgccactgaaacctttgccaccaactccttcaccttttcttacattgctgaacaataaaaagcatg

SEQ ID NO: 237037 - DNA, 75 bp, Artificial Sequence
  Synthetic
tctcatgacaaactgctcatcgcctacaaaaacaaaacaggcgagttcgcggtctatagcgtgtggcaacccgga

SEQ ID NO: 237038 - DNA, 75 bp, Artificial Sequence
  Synthetic
acattgctgaacaataaaaagcatgacgctgatgttcatttctgattcttattttattattttcaaacacaacaa

SEQ ID NO: 237039 - DNA, 75 bp, Artificial Sequence
  Synthetic
acaaaaacaaaacaggcgagttcgcggtctatagcgtgtggcaacccggagaccataataactactcagtcaccg

SEQ ID NO: 237040 - DNA, 75 bp, Artificial Sequence
  Synthetic
tagcttaatagacacagtagcttaatagacccagtagtgcaaagccccattctagcttataaatcagacagtgat

SEQ ID NO: 237041 - DNA, 75 bp, Artificial Sequence
  Synthetic
attcgattacacctttcccttcgaggagatgtgtgaagcggtcatgtacctgtccaaacagtacaagctgtggcc

SEQ ID NO: 237042 - DNA, 75 bp, Artificial Sequence
  Synthetic
tgtccaaacagtacaagctgtggccccccacccccgaggcgtgtgtggaaaacactgggtctttctgctgtctct

SEQ ID NO: 237043 - DNA, 75 bp, Artificial Sequence
  Synthetic
accttttgattcaggaaatcatgatcatcacaggatcctagtcttcaggccgccccctccctcccaagacacaga

SEQ ID NO: 237044 - DNA, 75 bp, Artificial Sequence
  Synthetic
aatctgcacgctgctgtacatgaaattcaggcagaggcgaatctttatcgatgagaaaaaaatgccttgatcgct

SEQ ID NO: 237045 - DNA, 75 bp, Artificial Sequence
  Synthetic
atacacagtcctctccccccgactggctttaaataacaccatctggttggtcacagacatgttcttaggggttat

SEQ ID NO: 237046 - DNA, 75 bp, Artificial Sequence
  Synthetic
ttgaaggaagaagaggcgggagagggcagcggcggtggcgccggtcaggaggagggcggggcctcctctgaggcc

SEQ ID NO: 237047 - DNA, 75 bp, Artificial Sequence
  Synthetic
aggcgctcgtcggtgatgttgataaactctcccggcagctcgctcaagttcacgtcgctgtccagcggctgaacc

SEQ ID NO: 237048 - DNA, 75 bp, Artificial Sequence
  Synthetic
accgcctacaactccctggcccccaagggcgcccccaactcctgcgagtgggagcaagtggagccagctgaagag

SEQ ID NO: 237049 - DNA, 75 bp, Artificial Sequence
  Synthetic
tccatgaggcggtgtccccgctcggtgacgaagaggctgtccgtgtctccgtagaccgacttgaggggtctgttc

SEQ ID NO: 237050 - DNA, 75 bp, Artificial Sequence
  Synthetic
ctgccgccgccgctccgtccggcaggaaaacaacacgccggtggtctcctccgcgataatccgcaccgcccgcag

SEQ ID NO: 237051 - DNA, 75 bp, Artificial Sequence
  Synthetic
tgattaattactggcgaccccacaaggactacatgctgcatgtagtcaaggcagtccccactactaccaccccca

SEQ ID NO: 237052 - DNA, 75 bp, Artificial Sequence
  Synthetic
cagtgcagggcgctgtatccaaagctcatgccgggaaccaccgcccccacgtggccatcgtaccacaagcgcacg

SEQ ID NO: 237053 - DNA, 75 bp, Artificial Sequence
  Synthetic
tcccacgccggcgggcccaccggtgcggcctcagaaaccaccgagctttgcttctgccaatgcactaacgccagc

SEQ ID NO: 237054 - DNA, 75 bp, Artificial Sequence
  Synthetic
acgtgctggacacaaacattacttccttgggcatgttgtaattcaccacctcccggtaccagataaacctctggt

SEQ ID NO: 237055 - DNA, 75 bp, Artificial Sequence
  Synthetic
cggcctcagaaaccaccgagctttgcttctgccaatgcactaacgccagcgcccacgaactgttcgacctggaga

SEQ ID NO: 237056 - DNA, 75 bp, Artificial Sequence
  Synthetic
cgcttgcccggtcccgctgcccgcagagccggtcgccctgaagcagctcggtgatccatttaatgactctcctgt

SEQ ID NO: 237057 - DNA, 75 bp, Artificial Sequence
  Synthetic
ttatccctctcccgaatacccgcccgactctaccttccacatcacgggcaccaacgaccccaacctctccttcta

SEQ ID NO: 237058 - DNA, 75 bp, Artificial Sequence
  Synthetic
ggaacaggagcccactactaaaacacatgtatatgctcaagctcccctttctggcgagaaaattaccaaagatgg

SEQ ID NO: 237059 - DNA, 75 bp, Artificial Sequence
  Synthetic
ccaacgaccccaacctctccttctacctgatgctgctgctttgtatctctgtggtatcttccgcgctcatgttac

SEQ ID NO: 237060 - DNA, 75 bp, Artificial Sequence
  Synthetic
tggcacaacacagacacacgtgcatgcactttctcatgattagcagctcttccctcgtcaggatcatatcccaag

SEQ ID NO: 237061 - DNA, 75 bp, Artificial Sequence
  Synthetic
cctgatgctgctgctttgtatctctgtggtatcttccgcgctcatgttactgggcatgttctgctgcctcatctg

SEQ ID NO: 237062 - DNA, 75 bp, Artificial Sequence
  Synthetic
aaaacccacacagcagggaaggcctcgcacataactcacgttgtgcatggtcagcgtgttgcattccggaaacag

SEQ ID NO: 237063 - DNA, 75 bp, Artificial Sequence
  Synthetic
tcagcgtgttgcattccggaaacagcggatgatcctccagtatcgaggcgcgggtctcgttctcacagggaggta

SEQ ID NO: 237064 - DNA, 75 bp, Artificial Sequence
  Synthetic
gcgacctcgccgcgcaggcgctcgttggtccagcagaggcggccgcccttgcgcgagcagaaggggggcaggggg

SEQ ID NO: 237065 - DNA, 75 bp, Artificial Sequence
  Synthetic
caccacggtagctatttagacatctgcaatagctccacctcccctaacatgtcctttcccaagtaccactgcaat

SEQ ID NO: 237066 - DNA, 75 bp, Artificial Sequence
  Synthetic
gggcgtgttggtggcggcgtcgatggcttgcaggagcccgcagccccggggcgcgacgacggtgccccgcggggt

SEQ ID NO: 237067 - DNA, 75 bp, Artificial Sequence
  Synthetic
cctccacctcggacaatggactctatgtaggctatgtgacacccggtgggcagggaaagactcatgcctacaacc

SEQ ID NO: 237068 - DNA, 75 bp, Artificial Sequence
  Synthetic
atgtagactccgtcttgcaccgcggccctgataatatccaccaccgtagaataagcaacacccagccaagcaata

SEQ ID NO: 237069 - DNA, 75 bp, Artificial Sequence
  Synthetic
tgcaagttcgccacccctccaccaccgccaccacctctgccgcccctacccgcagcagcagcatcagcagcagca

SEQ ID NO: 237070 - DNA, 75 bp, Artificial Sequence
  Synthetic
cgccaccacctctgccgcccctacccgcagcagcagcatcagcagcagcagattcctgactttaatcctagccag

SEQ ID NO: 237071 - DNA, 75 bp, Artificial Sequence
  Synthetic
ttgcagaccctacattccagccagaaccccaagttggcgaatctcagtggaatgaggcggatgctacagcagctg

SEQ ID NO: 237072 - DNA, 75 bp, Artificial Sequence
  Synthetic
aaaccacccacacccaccacccagagacgaccgcggcctccagcgaccagatgtcggccaacatcaccgcctcgg

SEQ ID NO: 237073 - DNA, 75 bp, Artificial Sequence
  Synthetic
tacggccaaagcacagacaacggcatttctaagatgttccttaatggcgtccaaaagacacaccgctctcaagtt

SEQ ID NO: 237074 - DNA, 75 bp, Artificial Sequence
  Synthetic
tccggctgattttccaatatagacgcgccggcggcgtccaccaaacccagataattttcttctctccagcggttt

SEQ ID NO: 237075 - DNA, 75 bp, Artificial Sequence
  Synthetic
cgccggcggcgtccaccaaacccagataattttcttctctccagcggtttagaatctgtctaagcaaatccctta

SEQ ID NO: 237076 - DNA, 75 bp, Artificial Sequence
  Synthetic
taacaaaaattcctctgtcgcgcagatcccttcgcagggcaagctgaacataatcagacaggtctgaacggacca

SEQ ID NO: 237077 - DNA, 75 bp, Artificial Sequence
  Synthetic
gacacttctcccactttttctggggtgttctacgctggccgccgtctctcacctcgaggtagactgcctcacacc

SEQ ID NO: 237078 - DNA, 75 bp, Artificial Sequence
  Synthetic
cagagcgagaagtcggtgcgcttcttggagcgggggttgggcagcgcgaaggtgacatcgttgaagaggatcttg

SEQ ID NO: 237079 - DNA, 75 bp, Artificial Sequence
  Synthetic
tatgcccgccccacaaatgccaatgggggccaaggtgtgctaaaggcaaatgcccagggagtgctcgagtctcag

SEQ ID NO: 237080 - DNA, 75 bp, Artificial Sequence
  Synthetic
cacatcataatcatgctcatgcagatagttgcaggtaagctcaggaaccaaaacggaataacacacgattttcct

SEQ ID NO: 237081 - DNA, 75 bp, Artificial Sequence
  Synthetic
tgcccaactcctaagactgctctaatcatgcataagactgtgatctgcctcctcatcctcctctccctgcccgct

SEQ ID NO: 237082 - DNA, 75 bp, Artificial Sequence
  Synthetic
tagttgcaggtaagctcaggaaccaaaacggaataacacacgattttcctctcaaacatgacttcgcggatactg

SEQ ID NO: 237083 - DNA, 75 bp, Artificial Sequence
  Synthetic
aacctccacgaaaaagacatgcctcctgtcgcttgagccaactgtggaatattcccaaatgctacaatgaaaaga

SEQ ID NO: 237084 - DNA, 75 bp, Artificial Sequence
  Synthetic
ctgtcgcttgagccaactgtggaatattcccaaatgctacaatgaaaagagcgagctttccgaagcctggctata

SEQ ID NO: 237085 - DNA, 75 bp, Artificial Sequence
  Synthetic
aaagtcctgaactggcgacccacggccatcttttcgggggtgatgcagtagaaggtgagggggtcttgctgccag

SEQ ID NO: 237086 - DNA, 75 bp, Artificial Sequence
  Synthetic
tgcagcacaatctttgccctcatgatctacccccactttgatttgggatggaatgcggtcgatgccatgaattac

SEQ ID NO: 237087 - DNA, 75 bp, Artificial Sequence
  Synthetic
tctacccccactttgatttgggatggaatgcggtcgatgccatgaattaccctacctttcccgcgcccgatatga

SEQ ID NO: 237088 - DNA, 75 bp, Artificial Sequence
  Synthetic
gtatacacgtctggattgtgaacatcagacaaacaaagaaatcgagccacgtagcccggaggtataatcacccgc

SEQ ID NO: 237089 - DNA, 75 bp, Artificial Sequence
  Synthetic
cgtcgccctcaatcaacgccccccatcccctacacccactgaggtcagctactttaatctaacaggcggagatga

SEQ ID NO: 237090 - DNA, 75 bp, Artificial Sequence
  Synthetic
tcccctacacccactgaggtcagctactttaatctaacaggcggagatgactgacactctagatctagaaatgga

SEQ ID NO: 237091 - DNA, 75 bp, Artificial Sequence
  Synthetic
ctctacatcgtaggtgacaaagaggcgctccgtgcgaggatgcgagccgatcgggaagaactggatctcccgcca

SEQ ID NO: 237092 - DNA, 75 bp, Artificial Sequence
  Synthetic
ccataggaggaatcacaaaattagtaggagaaaaaaatacataaacaccagaaaaaccctgttgctgaggcaaaa

SEQ ID NO: 237093 - DNA, 75 bp, Artificial Sequence
  Synthetic
ctacagaggcgcaagcaggcggctgaacaagagcgcctcaatcaggagctccgagatctcattaacctgcaccag

SEQ ID NO: 237094 - DNA, 75 bp, Artificial Sequence
  Synthetic
cagacgcgcgcagtcgttgatactctagaccagggaaaacgaaagccggtcagcgggcactcttccgtggtctgg

SEQ ID NO: 237095 - DNA, 75 bp, Artificial Sequence
  Synthetic
ccgcagtcgccgccgccgccggcagcccgcgctggctccgatctccgtgaaaagagtggcgcgcaacgggaacac

SEQ ID NO: 237096 - DNA, 75 bp, Artificial Sequence
  Synthetic
tcaagcaggccgatgtcacctacgagaaaaccggtaacagccaccgcctcagctacaagctgcccacccaacgcc

SEQ ID NO: 237097 - DNA, 75 bp, Artificial Sequence
  Synthetic
gtaaaaggccaagtgccgagagagtatatataggaataaaaagtgacgtaaacgggcaaagtccaaaaaacgccc

SEQ ID NO: 237098 - DNA, 75 bp, Artificial Sequence
  Synthetic
cccgaaacgaaagccaaaaaacactagacactcccttccggcgtcaacttccgctttcccacgctacgtcacttc

SEQ ID NO: 237099 - DNA, 75 bp, Artificial Sequence
  Synthetic
cctctgcaccctggtaaagaccctgtgtggtcttagagatctaatcccctttaactaatcaaacactggaatcaa

SEQ ID NO: 237100 - DNA, 75 bp, Artificial Sequence
  Synthetic
ccccagtcaaacaaactacgtatcccgaacttccaagttgccacgcccaaaacaccgcctacacctccccgcccg

SEQ ID NO: 237101 - DNA, 75 bp, Artificial Sequence
  Synthetic
aacaccgcctacacctccccgcccgccggcccgcccccgaacccgcctcccgccccgcgccccgccccgcgccac

SEQ ID NO: 237102 - DNA, 75 bp, Artificial Sequence
  Synthetic
ggcgatcggcgccgtgcccgggatcgcctccgtggccttgcaggcgtcccagaggcgttgacacagacttcttgc

SEQ ID NO: 237103 - DNA, 75 bp, Artificial Sequence
  Synthetic
cgccccgcgccccgccccgcgccacccatctcattatcatattggcttcaatccaaaataaggtatattattgat

SEQ ID NO: 237104 - DNA, 75 bp, Artificial Sequence
  Synthetic
catcatcaataatataccttattttggattgtggccaatatgataatgaggtgggcggggcgggtgacgtaggac

SEQ ID NO: 237105 - DNA, 75 bp, Artificial Sequence
  Synthetic
cggaagtgtggcatttgtaagtgggaggagctcacatgtaagcttccgtcgcggaaaatgtgacgtttttgatga

SEQ ID NO: 237106 - DNA, 75 bp, Artificial Sequence
  Synthetic
gcggaaaatgtgacgtttttgatgagcgccgcctacctccggaagtgccaattttcgcgcgcttttcaccggata

SEQ ID NO: 237107 - DNA, 75 bp, Artificial Sequence
  Synthetic
acccctcccttcgtgtcccccgacggatttcaagaaagcccccccggggtcctgtctctgcgcctgtcagagccc

SEQ ID NO: 237108 - DNA, 75 bp, Artificial Sequence
  Synthetic
gtaagatttggccattttcgcgcgaaaagtgaaacggggaagtgaaaactgaataatagggcgttagtcatagcg

SEQ ID NO: 237109 - DNA, 75 bp, Artificial Sequence
  Synthetic
aaagtgaaacggggaagtgaaaactgaataatagggcgttagtcatagcgcgtaatatttaccgagggccgaggg

SEQ ID NO: 237110 - DNA, 75 bp, Artificial Sequence
  Synthetic
cctggatgacgccggcaacctcacctctcaagatgtcaccactgtcacccctcccctcaaaaaaaccaagaccaa

SEQ ID NO: 237111 - DNA, 75 bp, Artificial Sequence
  Synthetic
ccctgaaaatgggaagtggcctctccctggatgacgccggcaacctcacctctcaagatgtcaccactgtcaccc

SEQ ID NO: 237112 - DNA, 75 bp, Artificial Sequence
  Synthetic
cagcagactggacccccggccgccggtggaggagctgccgccggcgctggagacggtgtcccccgatgggcgggg

SEQ ID NO: 237113 - DNA, 75 bp, Artificial Sequence
  Synthetic
tgcccaggtgttttttacgtgaatttccgcgttccgggtcaaagtctccgtttttattgtcaccgtcatctgacg

SEQ ID NO: 237114 - DNA, 75 bp, Artificial Sequence
  Synthetic
tccgcgttccgggtcaaagtctccgtttttattgtcaccgtcatctgacgcggagggtatttaaacccgctgcgc

SEQ ID NO: 237115 - DNA, 75 bp, Artificial Sequence
  Synthetic
cagcgagaagagttttctcctccgctccgtttcggcgatcgaaaaatgagacatttagcctgcactccgggtctt

SEQ ID NO: 237116 - DNA, 75 bp, Artificial Sequence
  Synthetic
ccagggacccctgaccgtgtctgaaggcaaactcaccttgcagacatcggctccactgacggccgctgacagcag

SEQ ID NO: 237117 - DNA, 75 bp, Artificial Sequence
  Synthetic
ggcaaactcaccttgcagacatcggctccactgacggccgctgacagcagcaccctcactgttagtgccacacct

SEQ ID NO: 237118 - DNA, 75 bp, Artificial Sequence
  Synthetic
tccgtttcggcgatcgaaaaatgagacatttagcctgcactccgggtcttttgtccggccgggcggcgtccgagc

SEQ ID NO: 237119 - DNA, 75 bp, Artificial Sequence
  Synthetic
cctgagcgatgattttccgtctactacccactttagcccacctactcttcacgaactgtacgatctggatgtact

SEQ ID NO: 237120 - DNA, 75 bp, Artificial Sequence
  Synthetic
tgagcattgacatgcaggccccaatttataccaccaatggaaaactggcacttaacattggtgctcccctgcatg

SEQ ID NO: 237121 - DNA, 75 bp, Artificial Sequence
  Synthetic
ttataccaccaatggaaaactggcacttaacattggtgctcccctgcatgtggtagacaccctaaatgcactaac

SEQ ID NO: 237122 - DNA, 75 bp, Artificial Sequence
  Synthetic
acccactttagcccacctactcttcacgaactgtacgatctggatgtactggtggatgtgaacgatcccaacgag

SEQ ID NO: 237123 - DNA, 75 bp, Artificial Sequence
  Synthetic
agtctgcgcttttggccgcccaggagggatttgacctacacactccgccgctgcctattttagagtctccgctgc

SEQ ID NO: 237124 - DNA, 75 bp, Artificial Sequence
  Synthetic
ataaatggaagagccctgcaaactagagtcacgggtgccctcagttatgacacagaaggcaacatccaactgcaa

SEQ ID NO: 237125 - DNA, 75 bp, Artificial Sequence
  Synthetic
gagtcacgggtgccctcagttatgacacagaaggcaacatccaactgcaagccggagggggtatgcgcattgaca

SEQ ID NO: 237126 - DNA, 75 bp, Artificial Sequence
  Synthetic
gggatttgacctacacactccgccgctgcctattttagagtctccgctgccggagcccagtggtataccttatat

SEQ ID NO: 237127 - DNA, 75 bp, Artificial Sequence
  Synthetic
gacctgacctgccacgagccgggctttccgcccagcgacgatgagggtgagccttttgttttagattatgctgag

SEQ ID NO: 237128 - DNA, 75 bp, Artificial Sequence
  Synthetic
agcttatccatttgatgctcaaaacaacctcagccttagacttggccaaggtcccctaattgttaactctgccca

SEQ ID NO: 237129 - DNA, 75 bp, Artificial Sequence
  Synthetic
aacctcagccttagacttggccaaggtcccctaattgttaactctgcccacaacttggatcttaaccttaacaga

SEQ ID NO: 237130 - DNA, 75 bp, Artificial Sequence
  Synthetic
gggggagggggcgctcggcgccggcggcggcgcaccgggaggcggtccacgaagcgcgcgatcatctccccgcgg

SEQ ID NO: 237131 - DNA, 75 bp, Artificial Sequence
  Synthetic
acacgaaaaaactggaagttaacataaaaacagccaaaggtctattttacgatggcaccgctatagcaatcaatg

SEQ ID NO: 237132 - DNA, 75 bp, Artificial Sequence
  Synthetic
caggtgacgggctacagtttgggtctggatcagatacaaatccattgcaaactaaacttggattggggctggaat

SEQ ID NO: 237133 - DNA, 75 bp, Artificial Sequence
  Synthetic
ccggtgtccgagccagacccggagcccgaccgcgatcccgagccggatcccgagcctcctcgcagggcaaggaaa

SEQ ID NO: 237134 - DNA, 75 bp, Artificial Sequence
  Synthetic
ccgaccgcgatcccgagccggatcccgagcctcctcgcagggcaaggaaattaccttctattctgtgcaagccta

SEQ ID NO: 237135 - DNA, 75 bp, Artificial Sequence
  Synthetic
ccaccggatccgaaaacctttcgaggaaagcgtctaaccagtcgcagtcgcaaggtaggctgagcaccgtggcgg

SEQ ID NO: 237136 - DNA, 75 bp, Artificial Sequence
  Synthetic
agacagcactgactctggcacttctacctctcctcctgaaattcacccagtggttcctctgggtatacataaacc

SEQ ID NO: 237137 - DNA, 75 bp, Artificial Sequence
  Synthetic
cttgtggaccacaccagacccctccccaaactgcagaattaattcagaaaaagatgctaaactcacactagtttt

SEQ ID NO: 237138 - DNA, 75 bp, Artificial Sequence
  Synthetic
ggcggaggtgctgctgatgatgtaattgaagtaggcggacttgacacggcggatggtcgacaggagcaccatgtc

SEQ ID NO: 237139 - DNA, 75 bp, Artificial Sequence
  Synthetic
ccccaccttcaagccctactccggcaccgcctacaactccctggcccccaagggcgcccccaactcctgcgagtg

SEQ ID NO: 237140 - DNA, 75 bp, Artificial Sequence
  Synthetic
gccagcgtttctgttttatctgtaaaaggcagccttgcccccattagtggcacagtaactagcgcccagattgtt

SEQ ID NO: 237141 - DNA, 75 bp, Artificial Sequence
  Synthetic
acttgcttaacgatcccgagggacctttggacttgagcattaaacgccctaggcaataaaccccacctaagtaat

SEQ ID NO: 237142 - DNA, 75 bp, Artificial Sequence
  Synthetic
aagaagaggatgttgttgatcctcaggaacaggagcccactactaaaacacatgtatatgctcaagctccccttt

SEQ ID NO: 237143 - DNA, 75 bp, Artificial Sequence
  Synthetic
aaggcagccttgcccccattagtggcacagtaactagcgcccagattgttttaagatttgatgaaaacggagttt

SEQ ID NO: 237144 - DNA, 75 bp, Artificial Sequence
  Synthetic
acctctcctcctgaaattcacccagtggttcctctgggtatacataaacctgttgctattagagtttgcgggcga

SEQ ID NO: 237145 - DNA, 75 bp, Artificial Sequence
  Synthetic
ccaatactggaactatagaaaaggcgattctacagaaggcagtgcatataccaatgctgtgggatttatgcccaa

SEQ ID NO: 237146 - DNA, 75 bp, Artificial Sequence
  Synthetic
gcccaatgtttgcttttgaatgacttcatgtgtataataaaagtgagtgtggtcataggtctcttgtttgtctgg

SEQ ID NO: 237147 - DNA, 75 bp, Artificial Sequence
  Synthetic
gcagcaggaggcactaaagacttatttgcagaccctacattccagccagaaccccaagttggcgaatctcagtgg

SEQ ID NO: 237148 - DNA, 75 bp, Artificial Sequence
  Synthetic
gattctacagaaggcagtgcatataccaatgctgtgggatttatgcccaacctcacagcataccctaaaacacag

SEQ ID NO: 237149 - DNA, 75 bp, Artificial Sequence
  Synthetic
tcatgtgtataataaaagtgagtgtggtcataggtctcttgtttgtctgggcggggcttaagggtatataagttt

SEQ ID NO: 237150 - DNA, 75 bp, Artificial Sequence
  Synthetic
taagtcaagtttacttgaatggggacaaaacaaaacccatgaccctaaccatcaccctcaatggaactaatgaaa

SEQ ID NO: 237151 - DNA, 75 bp, Artificial Sequence
  Synthetic
gaccccaatggaggcgtgggggtgcttggaggagtttgcggacgtgcgccgtttgctggacgagagctctagcaa

SEQ ID NO: 237152 - DNA, 75 bp, Artificial Sequence
  Synthetic
tcccatgaaaccttgctatggctcatatgcccgccccacaaatgccaatgggggccaaggtgtgctaaaggcaaa

SEQ ID NO: 237153 - DNA, 75 bp, Artificial Sequence
  Synthetic
caaaacaaaacccatgaccctaaccatcaccctcaatggaactaatgaaacaggggatgctacagtaagcacgta

SEQ ID NO: 237154 - DNA, 75 bp, Artificial Sequence
  Synthetic
ttggaggagtttgcggacgtgcgccgtttgctggacgagagctctagcaatacctatactatttggaggtatctg

SEQ ID NO: 237155 - DNA, 75 bp, Artificial Sequence
  Synthetic
aatggaagtaattacattaatgacaccttccaaaccaactcctttaccttctcctacatcgcccaagaataaaaa

SEQ ID NO: 237156 - DNA, 75 bp, Artificial Sequence
  Synthetic
tttgcagaattaagcaggattacaagtgcgattttgaagagctttttagttcctgtggtgagcttttgcaatcct

SEQ ID NO: 237157 - DNA, 75 bp, Artificial Sequence
  Synthetic
ctacaaatgccacaaacgagcaaaacaacatccagcccaaattggtgctgtacagcgaggatgtgcatatggaga

SEQ ID NO: 237158 - DNA, 75 bp, Artificial Sequence
  Synthetic
ccttccaaaccaactcctttaccttctcctacatcgcccaagaataaaaaagcatgacgctttgttctctgattc

SEQ ID NO: 237159 - DNA, 75 bp, Artificial Sequence
  Synthetic
gtgcgattttgaagagctttttagttcctgtggtgagcttttgcaatccttgaatctgggccaccaggctatctt

SEQ ID NO: 237160 - DNA, 75 bp, Artificial Sequence
  Synthetic
ttacaacaaaatcattcaagtcattctccatttagcttaatagacccagtagtgcaaagccccatactagcttat

SEQ ID NO: 237161 - DNA, 75 bp, Artificial Sequence
  Synthetic
gatttttccactcccgggcgcaccgccgcttgtgtggcttttgtgtcttttgtgcaagataaatggagcggggag

SEQ ID NO: 237162 - DNA, 75 bp, Artificial Sequence
  Synthetic
ctccatttagcttaatagacccagtagtgcaaagccccatactagcttatttcagacagtataaatttaaccata

SEQ ID NO: 237163 - DNA, 75 bp, Artificial Sequence
  Synthetic
ccgcttgtgtggcttttgtgtcttttgtgcaagataaatggagcggggagacccacctgagtcacggctacgtgc

SEQ ID NO: 237164 - DNA, 75 bp, Artificial Sequence
  Synthetic
caacatccagcccaaattggtgctgtacagcgaggatgtgcatatggagaccccagacacacacatctcctacaa

SEQ ID NO: 237165 - DNA, 75 bp, Artificial Sequence
  Synthetic
tcatcacaggatcctagtcgtcaggccgccccctccctgccaagacacagaatacacaatcctctccccccggct

SEQ ID NO: 237166 - DNA, 75 bp, Artificial Sequence
  Synthetic
gagggcttacaacaaatggaagattcagaaggaactgtacggttccgccctacgtcgtccacttctgcagcggca

SEQ ID NO: 237167 - DNA, 75 bp, Artificial Sequence
  Synthetic
aatacacaatcctctccccccggctggctttaaacaacaccatctggttggtgacagacaggttcttcggggtta

SEQ ID NO: 237168 - DNA, 75 bp, Artificial Sequence
  Synthetic
tacgtcgtccacttctgcagcggcaggggctgatgtttcccgaccatcgccagcatcagaatctggaagacgagt

SEQ ID NO: 237169 - DNA, 75 bp, Artificial Sequence
  Synthetic
ggccatcgggcaggcgcaggtggacgagcacaccttccaggagatcaccagcgtgagccgcgcgctggggcagga

SEQ ID NO: 237170 - DNA, 75 bp, Artificial Sequence
  Synthetic
cagcttgagagccggcctggaccctcctcaggaggaatgaatctcccgcaggtggttgagctgtttcccgaactg

SEQ ID NO: 237171 - DNA, 75 bp, Artificial Sequence
  Synthetic
tcacgtcgctgtccagcggctgaacctcatgctgacgcggtaactgcgcgaccggctgctgaacaaacggaggcc

SEQ ID NO: 237172 - DNA, 75 bp, Artificial Sequence
  Synthetic
aactattgtttccctctgggaggcatagggataactgacacttaccaggccattaagactaatggcaatggggca

SEQ ID NO: 237173 - DNA, 75 bp, Artificial Sequence
  Synthetic
cctcaggaggaatgaatctcccgcaggtggttgagctgtttcccgaactgagacgggtcctgactatcagggagg

SEQ ID NO: 237174 - DNA, 75 bp, Artificial Sequence
  Synthetic
gagggatcggggtgagggagatgatgaggcggctagcaatttagcttttagtctgataactcgccaccgaccgga

SEQ ID NO: 237175 - DNA, 75 bp, Artificial Sequence
  Synthetic
gaggcggctagcaatttagcttttagtctgataactcgccaccgaccggaatgtattacctatcagcagattaag

SEQ ID NO: 237176 - DNA, 75 bp, Artificial Sequence
  Synthetic
tccgctataatccgcaccgcccgcagcataagcctcctcgttctccgcgcgcagcaccgcaccctgatctcgctc

SEQ ID NO: 237177 - DNA, 75 bp, Artificial Sequence
  Synthetic
ttttgggtcagaagtatagcatagaacagcttaccacttactggcttcagcccggggatgattgggaagaggcga

SEQ ID NO: 237178 - DNA, 75 bp, Artificial Sequence
  Synthetic
acagcttaccacttactggcttcagcccggggatgattgggaagaggcgatcagggtgtatgcaaaggtggccct

SEQ ID NO: 237179 - DNA, 75 bp, Artificial Sequence
  Synthetic
aaagaccccgcttgcggattgactccggacacggggacgagcccccttttatttttgctttccccagatgcatcc

SEQ ID NO: 237180 - DNA, 75 bp, Artificial Sequence
  Synthetic
acagtgcaaggcgctgtatccaaagctcatgcccggaaccaccgcccccacgtgaccgtcgtaccagaagcgcag

SEQ ID NO: 237181 - DNA, 75 bp, Artificial Sequence
  Synthetic
actaagttggttaatattagaaactgctgctatatttctggaaacggggccgaagtggagatagatactgaggac

SEQ ID NO: 237182 - DNA, 75 bp, Artificial Sequence
  Synthetic
gctgctatatttctggaaacggggccgaagtggagatagatactgaggacagggtggctattagatgttgcatga

SEQ ID NO: 237183 - DNA, 75 bp, Artificial Sequence
  Synthetic
ccccagcagcaacaccagcagcaagagcggcagccacagcagcagcagcgggagtcatgcagggccccctcgccc

SEQ ID NO: 237184 - DNA, 75 bp, Artificial Sequence
  Synthetic
aacgtgctggacataaacatcacctccttgggcatgttgtaattcaccacctcccggtaccagatgaatctctga

SEQ ID NO: 237185 - DNA, 75 bp, Artificial Sequence
  Synthetic
ggagtcatgcagggccccctcgcccacccttggcggcccggccacttcggcgtccgcggccgtgtccggcgccgg

SEQ ID NO: 237186 - DNA, 75 bp, Artificial Sequence
  Synthetic
gatggatggggtgatatttatgaatgtgaggtttacgggccccaactttaatggtacggtgtttatgggcaacac

SEQ ID NO: 237187 - DNA, 75 bp, Artificial Sequence
  Synthetic
gtgaggtttacgggccccaactttaatggtacggtgtttatgggcaacaccaacttgctcctgcatggtgcgagt

SEQ ID NO: 237188 - DNA, 75 bp, Artificial Sequence
  Synthetic
tagaggcctggaccgatgtaaaggttcgaggttgttccttttatagctgttggaaggcggtggtgtgtcgcccta

SEQ ID NO: 237189 - DNA, 75 bp, Artificial Sequence
  Synthetic
tcgaggttgttccttttatagctgttggaaggcggtggtgtgtcgccctaaaagcaggggttctgtgaagaaatg

SEQ ID NO: 237190 - DNA, 75 bp, Artificial Sequence
  Synthetic
ttggcgcaacacagacacacgtgcatacacttcctcatgattagcagctcctccctcgtcaggatcatatcccaa

SEQ ID NO: 237191 - DNA, 75 bp, Artificial Sequence
  Synthetic
atcctttctgagggcaactccagggtgcgccataatgtggcttcgaactgcggttgcttcatgcaagtgaagggg

SEQ ID NO: 237192 - DNA, 75 bp, Artificial Sequence
  Synthetic
tgcgccataatgtggcttcgaactgcggttgcttcatgcaagtgaagggggtgagcgttatcaagcataactcag

SEQ ID NO: 237193 - DNA, 75 bp, Artificial Sequence
  Synthetic
ctctcagatgctgacctgctttgatggcaactgtcacctgttgaagaccattcatataagcagtcaccccagaaa

SEQ ID NO: 237194 - DNA, 75 bp, Artificial Sequence
  Synthetic
ggcaactgtcacctgttgaagaccattcatataagcagtcaccccagaaaggcctggcccgtgtttgagcataac

SEQ ID NO: 237195 - DNA, 75 bp, Artificial Sequence
  Synthetic
tgggggtcaggaggggtatgttcctgccttaccagtgtaacttcagccacactaaaatcctgctggaacccgagt

SEQ ID NO: 237196 - DNA, 75 bp, Artificial Sequence
  Synthetic
cctccttgcgtctacggtctcgccgcttaactcgctccgtgtgatagttgtagtacagccactctctcaaagcgt

SEQ ID NO: 237197 - DNA, 75 bp, Artificial Sequence
  Synthetic
gccttaccagtgtaacttcagccacactaaaatcctgctggaacccgagtgcatgactaaggtcagcctgaatgg

SEQ ID NO: 237198 - DNA, 75 bp, Artificial Sequence
  Synthetic
tggaaggtgctgaggtatgatgagaccaggaccaggtgccgaccctgcgagtgcggcggcaagcacatgagaaat

SEQ ID NO: 237199 - DNA, 75 bp, Artificial Sequence
  Synthetic
gccctgataatatccaccaccgtagaataagccacaccaagccaagcaatacactcgctctgcgagcggcagaca

SEQ ID NO: 237200 - DNA, 75 bp, Artificial Sequence
  Synthetic
ccaggaccaggtgccgaccctgcgagtgcggcggcaagcacatgagaaatcagcctgtgatgttggatgtgaccg

SEQ ID NO: 237201 - DNA, 75 bp, Artificial Sequence
  Synthetic
ccatcataaaattttaaagaatattttccaatatttcgaaatcaagatctaccaaatggcagcgctcccctccac

SEQ ID NO: 237202 - DNA, 75 bp, Artificial Sequence
  Synthetic
gctggcctgcaccagggccgagtttgggtctagcgatgaggataccgattgaggtgggtaaggtgggcgtggcta

SEQ ID NO: 237203 - DNA, 75 bp, Artificial Sequence
  Synthetic
ttccaatatttcgaaatcaagatctaccaaatggcagcgctcccctccactggcgcggtcaaactctacggccaa

SEQ ID NO: 237204 - DNA, 75 bp, Artificial Sequence
  Synthetic
gggtctagcgatgaggataccgattgaggtgggtaaggtgggcgtggctagcagggtgggcgtgtataaattggg

SEQ ID NO: 237205 - DNA, 75 bp, Artificial Sequence
  Synthetic
tgttcccggacggcgtctaaaagacaaaccgctctcaagtcgacataaattataagccaaaagccatcgggttca

SEQ ID NO: 237206 - DNA, 75 bp, Artificial Sequence
  Synthetic
tgcaacagccgccgccatgagcgacaccggcaacagctttgatggaagcatcttcagcccctatctgacagtgcg

SEQ ID NO: 237207 - DNA, 75 bp, Artificial Sequence
  Synthetic
accggcaacagctttgatggaagcatcttcagcccctatctgacagtgcgcatgcctcactgggccggagtgcgt

SEQ ID NO: 237208 - DNA, 75 bp, Artificial Sequence
  Synthetic
agatccactatggacgcgccggcggcgtccaccaaacccaaataattttcttctctccagcgcagcaaaatccca

SEQ ID NO: 237209 - DNA, 75 bp, Artificial Sequence
  Synthetic
tgctctatgccaactccgcccacgcgctcgacatgaccttcgaggtcgaccccatggacgagcccacccttctct

SEQ ID NO: 237210 - DNA, 75 bp, Artificial Sequence
  Synthetic
acgaggccttccatcccgacatcatcctgctgcccggctgcggggtggacttcacttacagccgcctgagcaacc

SEQ ID NO: 237211 - DNA, 75 bp, Artificial Sequence
  Synthetic
ttctctccagcgcagcaaaatcccagtaagcaactccctgatattaagatgaaccatgccaaaaatctgttcaag

SEQ ID NO: 237212 - DNA, 75 bp, Artificial Sequence
  Synthetic
atggacgtcccgttctgccttcaaattcgtctactatggcctacgcgaccgtgggaggaactccgctggacgccg

SEQ ID NO: 237213 - DNA, 75 bp, Artificial Sequence
  Synthetic
agcgccctccaccttcattctcaagcagcgcatcatgattgcaaaaattcaggttcctcagacacctgtatgaga

SEQ ID NO: 237214 - DNA, 75 bp, Artificial Sequence
  Synthetic
ttcgtctactatggcctacgcgaccgtgggaggaactccgctggacgccgcgacctccgccgccgcctccgccgc

SEQ ID NO: 237215 - DNA, 75 bp, Artificial Sequence
  Synthetic
acggacctttacagctctttggtggcgagcagcgcggcctctcgcgcgtctgctcgggatgagaaactgactgct

SEQ ID NO: 237216 - DNA, 75 bp, Artificial Sequence
  Synthetic
cgagcagcgcggcctctcgcgcgtctgctcgggatgagaaactgactgctctgctgcttaaactggaagacttga

SEQ ID NO: 237217 - DNA, 75 bp, Artificial Sequence
  Synthetic
gcaggtttccagcttgcgtgagagcagccttgcctccccctaatggcccataatataaataaaagccagtctgtt

SEQ ID NO: 237218 - DNA, 75 bp, Artificial Sequence
  Synthetic
agccttgcctccccctaatggcccataatataaataaaagccagtctgtttggattaagcaagtgtatgttcttt

SEQ ID NO: 237219 - DNA, 75 bp, Artificial Sequence
  Synthetic
ccgggaccagcggtctcggtcgtttagggtgcggtggattctttccaacacgtggtacaggtggctctggatgtt

SEQ ID NO: 237220 - DNA, 75 bp, Artificial Sequence
  Synthetic
ctggttaaaaaatcaggcaaagcctcgcgcaaaaaagctaagacatcataatcatgctcatgcaggtagttgcag

SEQ ID NO: 237221 - DNA, 75 bp, Artificial Sequence
  Synthetic
agggtgcggtggattctttccaacacgtggtacaggtggctctggatgtttagatacatgggcatgagtccatcc

SEQ ID NO: 237222 - DNA, 75 bp, Artificial Sequence
  Synthetic
gtaagctcaggaaccaaaacggaataacacacgattttcctctcaaacatgacttccaggtgactgcataagaaa

SEQ ID NO: 237223 - DNA, 75 bp, Artificial Sequence
  Synthetic
gagcttcgtgctcgggggtggtgttgtatatgatccagtcgtagcaggagcgctgggcgtggtgctgaaaaatgt

SEQ ID NO: 237224 - DNA, 75 bp, Artificial Sequence
  Synthetic
gtatatgatccagtcgtagcaggagcgctgggcgtggtgctgaaaaatgtccttaagcaagaggcttatagctag

SEQ ID NO: 237225 - DNA, 75 bp, Artificial Sequence
  Synthetic
aaataaattaaacattggaagcctgtctcacaacaggaaaaaccactctgatcaacataagacgggccacgggca

SEQ ID NO: 237226 - DNA, 75 bp, Artificial Sequence
  Synthetic
tctcacaacaggaaaaaccactctgatcaacataagacgggccacgggcatgcccgcgtgaccataaaaaaatcg

SEQ ID NO: 237227 - DNA, 75 bp, Artificial Sequence
  Synthetic
tggccccagagtcccatggaccgcaaccccaccatgaacttgctgacggggatccccaactccatgctccagagc

SEQ ID NO: 237228 - DNA, 75 bp, Artificial Sequence
  Synthetic
acaaatctgcttagctgggaggggtgcatccggggggatatgatgtgcatcttggactggatttttaggttggct

SEQ ID NO: 237229 - DNA, 75 bp, Artificial Sequence
  Synthetic
gatagctccccggtcatgtcgggggtcatcatgtgagactgtgtatacacgtccgggctgttgacatcggtcaaa

SEQ ID NO: 237230 - DNA, 75 bp, Artificial Sequence
  Synthetic
atgttcccgcccagatcccttctgggattcatgttgtgcaggaccaccagcacggtatatccagtgcacttggga

SEQ ID NO: 237231 - DNA, 75 bp, Artificial Sequence
  Synthetic
tcatcatgtgagactgtgtatacacgtccgggctgttgacatcggtcaaagaaagaaatcgagctacatagcccg

SEQ ID NO: 237232 - DNA, 75 bp, Artificial Sequence
  Synthetic
gtacagcaaaacggtccccataggaggaatcacaaaattagtaggagaaaaaaaaacataaacaccagaaaaacc

SEQ ID NO: 237233 - DNA, 75 bp, Artificial Sequence
  Synthetic
cttgtggcctcccagattttccatacattcgtccatgatgatggcaatgggcccgtgggaagctgcctgagcaaa

SEQ ID NO: 237234 - DNA, 75 bp, Artificial Sequence
  Synthetic
tagttgtgttccagggtgaggtcatcataggacatctttacgaatcgggggcgaagggtcccggactgggggatg

SEQ ID NO: 237235 - DNA, 75 bp, Artificial Sequence
  Synthetic
cataggacatctttacgaatcgggggcgaagggtcccggactgggggatgatggtaccctcgggccccggggcgt

SEQ ID NO: 237236 - DNA, 75 bp, Artificial Sequence
  Synthetic
cttccacaggagcagccatgacaaagacccgagtcttaccaggaaaattttaaaaaagattcctcaacgcagcac

SEQ ID NO: 237237 - DNA, 75 bp, Artificial Sequence
  Synthetic
atgccaagcgccgagcgagtatatataggaataaaaagtgacgtaaacggttaaagtccagaaaacgcccagaaa

SEQ ID NO: 237238 - DNA, 75 bp, Artificial Sequence
  Synthetic
ccaggctttcatttcagagggagggatcatatccacctgcggggcgatgaaaaagacagtttctggcgcagggga

SEQ ID NO: 237239 - DNA, 75 bp, Artificial Sequence
  Synthetic
ttaaagtccagaaaacgcccagaaaaaccgcacgcgaacctacgccccgaaacgaaagccaaaaaacagtaaaca

SEQ ID NO: 237240 - DNA, 75 bp, Artificial Sequence
  Synthetic
atcatatccacctgcggggcgatgaaaaagacagtttctggcgcaggggagattaactgggatgagagcaggttt

SEQ ID NO: 237241 - DNA, 75 bp, Artificial Sequence
  Synthetic
cggtgggcccatatatcacgcctatcaccggctgcagctggtagttaagagagctgcagctgccgtcctcccgga

SEQ ID NO: 237242 - DNA, 75 bp, Artificial Sequence
  Synthetic
caccggctgcagctggtagttaagagagctgcagctgccgtcctcccggagcaggggggccacctcgttgagcat

SEQ ID NO: 237243 - DNA, 75 bp, Artificial Sequence
  Synthetic
cgccgccccgccccgcgcctcccaactccgccccgctccgcccacctcattatcatattggcttcaatccaaaat

SEQ ID NO: 237244 - DNA, 75 bp, Artificial Sequence
  Synthetic
accagttccgccagaaggcgctcgccgcccagcgaaagcagctcttgcaaggaagcaaaatttttcagcggtttc

SEQ ID NO: 237245 - DNA, 75 bp, Artificial Sequence
  Synthetic
cgcccagcgaaagcagctcttgcaaggaagcaaaatttttcagcggtttcaggccatcggccgtgggcatgtttt

SEQ ID NO: 237246 - DNA, 75 bp, Artificial Sequence
  Synthetic
acgatggcttcctgtgggacgacatggacgacagcgtgttctccccgcggccgcaggcgctggcggaggcgtccc

SEQ ID NO: 237247 - DNA, 75 bp, Artificial Sequence
  Synthetic
cctgtcccagagctcggtgatgtgctctacggcatctcgatccagcagatctcctcgtttcgcgggttggggcgg

SEQ ID NO: 237248 - DNA, 75 bp, Artificial Sequence
  Synthetic
gcttctctgtccgagctgggggcggccgccgcgcgccccgggtccctagggggcagcccctttccgagcctggtg

SEQ ID NO: 237249 - DNA, 75 bp, Artificial Sequence
  Synthetic
cttcgccctgcgcgtcggccaggtagcatttgaccatggtctcgtagtcgagaccctcggcggcgtgccccttgg

SEQ ID NO: 237250 - DNA, 75 bp, Artificial Sequence
  Synthetic
gccgcacgaggggcactgcaggctcttcagggcgtagagcttgggagcgagaaacacggactctggggagtaggc

SEQ ID NO: 237251 - DNA, 75 bp, Artificial Sequence
  Synthetic
ttcagggcgtagagcttgggagcgagaaacacggactctggggagtaggcgtccgcgccgcaggccgagcagacc

SEQ ID NO: 237252 - DNA, 75 bp, Artificial Sequence
  Synthetic
cgtgctggacctgggagggagcggcaacccgttcgcgcacctgcgcccccgcctggggaggatgttttaaaaaag

SEQ ID NO: 237253 - DNA, 75 bp, Artificial Sequence
  Synthetic
gttccgggcggtcagggtcaaaaaccaggttgcccccatgctttttgatgcgtttcttacctcggctttccatga

SEQ ID NO: 237254 - DNA, 75 bp, Artificial Sequence
  Synthetic
aacccgttcgcgcacctgcgcccccgcctggggaggatgttttaaaaaagcaagaagcatgatgcaaaaaattgg

SEQ ID NO: 237255 - DNA, 75 bp, Artificial Sequence
  Synthetic
ggcggtgtcccttctcggtgacgaagaggctgtccgtgtccccgtagaccgacttcaggggcctgtcttccagcg

SEQ ID NO: 237256 - DNA, 75 bp, Artificial Sequence
  Synthetic
aggccatggcgaccgagcgttggtttcttgttgtgttccctttagtatgcgacgcgcggcgatgtaccaggaggg

SEQ ID NO: 237257 - DNA, 75 bp, Artificial Sequence
  Synthetic
cctcctccgcgtccagaaaagtgattggcttgtaggtgtaggacacgtgaccgggggttcccgacgggggggtat

SEQ ID NO: 237258 - DNA, 75 bp, Artificial Sequence
  Synthetic
tggtggcgaacgacccgtagagggcgttggagagcagcttggcgatggagcgcagggtctggtttttgtcgcggt

SEQ ID NO: 237259 - DNA, 75 bp, Artificial Sequence
  Synthetic
gagttgcacgtactcgcgggccacgcacttccactcggggaagacggtggtgcgctcgtctgggatcaggcgcac

SEQ ID NO: 237260 - DNA, 75 bp, Artificial Sequence
  Synthetic
gatggtaaagaccccggggagcaggcgcgggtcaaagtagtcgatcttgcaagcttgcatgtccagagcccgctg

SEQ ID NO: 237261 - DNA, 75 bp, Artificial Sequence
  Synthetic
agggcatggggtgggtgagcgcggaggcgtacatgccgcagatgtcatacacgtacaggggttccctgaggatgc

SEQ ID NO: 237262 - DNA, 75 bp, Artificial Sequence
  Synthetic
ccccgctgagcagggcgaggatgccgccgccgcagccggcgcggccgaggcggaggccgaacccgccatggtggt

SEQ ID NO: 237263 - DNA, 75 bp, Artificial Sequence
  Synthetic
cccgcggatgctggcgcgcacgtagtcatagagctcgtgggagggggccagcatgttgggcccgaggttggtgcg

SEQ ID NO: 237264 - DNA, 75 bp, Artificial Sequence
  Synthetic
atctgcctgaagatggcatgggagttggaggagatggtgggccgctggaagacgttgaagcttgcttcttgcaag

SEQ ID NO: 237265 - DNA, 75 bp, Artificial Sequence
  Synthetic
gagaagcaggcggcggaggcggcagcggctttggccgcggcagaggcggctgaggctgagtcggagggggccaag

SEQ ID NO: 237266 - DNA, 75 bp, Artificial Sequence
  Synthetic
cagctcggcggtgacctggacgtcgagcgcacagtagtcgagggtctcgcggataatgtcatacttatcctcccc

SEQ ID NO: 237267 - DNA, 75 bp, Artificial Sequence
  Synthetic
aggacgaactcttcgcggtctttccagtactcttggaggggaaacccgtccgtgtccgaacggtaagagcctagc

SEQ ID NO: 237268 - DNA, 75 bp, Artificial Sequence
  Synthetic
agtactcttggaggggaaacccgtccgtgtccgaacggtaagagcctagcatgtagaactggttgacggcctggt

SEQ ID NO: 237269 - DNA, 75 bp, Artificial Sequence
  Synthetic
cagcgcgtaggcctgcgccgccttgcggagggaggtgtgggtgagggcgaaagtgtccctgaccatgactttgag

SEQ ID NO: 237270 - DNA, 75 bp, Artificial Sequence
  Synthetic
cggagggaggtgtgggtgagggcgaaagtgtccctgaccatgactttgaggtattgatgtctgaagtctgtgtca

SEQ ID NO: 237271 - DNA, 75 bp, Artificial Sequence
  Synthetic
tgtagtccgtgcgctttttggagcgcgggttgggcagggagaaggtgaggtcattgaagaggatcttccccgctc

SEQ ID NO: 237272 - DNA, 75 bp, Artificial Sequence
  Synthetic
cgggttgggcagggagaaggtgaggtcattgaagaggatcttccccgctcgaggcatgaagtttctggtgatgcg

SEQ ID NO: 237273 - DNA, 75 bp, Artificial Sequence
  Synthetic
gcccaccacgcggcccatcgcgcccatggccaccggggtggtgggccgccacacccccgccacgctggacttgcc

SEQ ID NO: 237274 - DNA, 75 bp, Artificial Sequence
  Synthetic
ttgttgatgacctgggcggccaggacgatctcgtcaaagccgtttatgttgtggcccacgatgtagagctccagg

SEQ ID NO: 237275 - DNA, 75 bp, Artificial Sequence
  Synthetic
cgatctcgtcaaagccgtttatgttgtggcccacgatgtagagctccaggaagcggggctggcccttaatggagg

SEQ ID NO: 237276 - DNA, 75 bp, Artificial Sequence
  Synthetic
cagaaggcggcacagccgggcccgcccgcgaccgcctcccgttcctccgccggtcctctgcgccgcgcggccagc

SEQ ID NO: 237277 - DNA, 75 bp, Artificial Sequence
  Synthetic
ctcgcccagcaataactccggctggggactgctgcgcgcgcccagcaagatgttcggaggggcgaggaagcgctc

SEQ ID NO: 237278 - DNA, 75 bp, Artificial Sequence
  Synthetic
aagctcctcgggcgattccaggccgtgctcctccagggcccagtcttgcaagtgagggttggccgccaggaagga

SEQ ID NO: 237279 - DNA, 75 bp, Artificial Sequence
  Synthetic
tgctcctccagggcccagtcttgcaagtgagggttggccgccaggaaggatcgccagaggtcgcgggccatgagg

SEQ ID NO: 237280 - DNA, 75 bp, Artificial Sequence
  Synthetic
caccaccgtggacgacgccatcgactcggtggtggagcaggcgcgcaactacaggcccgcggtctccaccgtgga

SEQ ID NO: 237281 - DNA, 75 bp, Artificial Sequence
  Synthetic
tgaactgccgccccacggccatcttttcgggggtgatgcagtagaaggtgagggggtctttctcccaggggtccc

SEQ ID NO: 237282 - DNA, 75 bp, Artificial Sequence
  Synthetic
cgcggcagcgaccagagcctcgtcgccccccagtttcatgaccagcatgaagggcacgagttgcttgccaaaggc

SEQ ID NO: 237283 - DNA, 75 bp, Artificial Sequence
  Synthetic
tgcttcgccgggccaagcgcacgggccgccgcgccgccatgagggccgcgcgccgcctggccgccggcatcaccg

SEQ ID NO: 237284 - DNA, 75 bp, Artificial Sequence
  Synthetic
gaaccccacggtggcgcccacgcacgatgtgaccaccgaccggtctcagcgcctgacgctgcggttcattcccgt

SEQ ID NO: 237285 - DNA, 75 bp, Artificial Sequence
  Synthetic
aagacgcgcggccgccgccgccgccgcggccatcagcgacatggccaccaggcgccggggcaacgtgtactgggt

SEQ ID NO: 237286 - DNA, 75 bp, Artificial Sequence
  Synthetic
gaggattggctgttgatgtggtgaaagtagaagtcccgtctgcgggccgagcactcgtgctggcttttgtaaaag

SEQ ID NO: 237287 - DNA, 75 bp, Artificial Sequence
  Synthetic
cgggttgtatatcttgcacgaggtgaacctggcgacctctgacgaggaagcgcagcgggaatctaagtcccccgc

SEQ ID NO: 237288 - DNA, 75 bp, Artificial Sequence
  Synthetic
gtgcccgtgcgcttccgccccccgcggacttgatgtgtgaaaaacaacactgagtctcctgctgttgtgtgtatc

SEQ ID NO: 237289 - DNA, 75 bp, Artificial Sequence
  Synthetic
aacctggcgacctctgacgaggaagcgcagcgggaatctaagtcccccgcctggggtcccgtgtggctggtggtc

SEQ ID NO: 237290 - DNA, 75 bp, Artificial Sequence
  Synthetic
gcatctgtctcctggagggcgatggtggagcagaccaccacgccgcgagagccgcaggtccagatctcggcgctc

SEQ ID NO: 237291 - DNA, 75 bp, Artificial Sequence
  Synthetic
tagaagaagcccaggccgctgtggaagacgaagaattagaagatgaagacgaggaaccacaggatgaggcacctg

SEQ ID NO: 237292 - DNA, 75 bp, Artificial Sequence
  Synthetic
tggagcagaccaccacgccgcgagagccgcaggtccagatctcggcgctcggcgggcggagtttgatgacgacat

SEQ ID NO: 237293 - DNA, 75 bp, Artificial Sequence
  Synthetic
atgatgccgatggggaggtggagtttctgcgcgccacggcgcccaggcgcccggtgcagtggaagggccggcgcg

SEQ ID NO: 237294 - DNA, 75 bp, Artificial Sequence
  Synthetic
ctccagctcccgcggcggcaggtcagccgggagttcctggaggttcacctcgcagagacgggtcaaggcgcggac

SEQ ID NO: 237295 - DNA, 75 bp, Artificial Sequence
  Synthetic
ggctcccctttctggagaagaaattactaaaaacggtttgcaaatagggtcagataacacagaagcccagtctaa

SEQ ID NO: 237296 - DNA, 75 bp, Artificial Sequence
  Synthetic
gccgggagttcctggaggttcacctcgcagagacgggtcaaggcgcggacagtgttgagatggtatctgatttca

SEQ ID NO: 237297 - DNA, 75 bp, Artificial Sequence
  Synthetic
actaaaaacggtttgcaaatagggtcagataacacagaagcccagtctaagcccatatatgcagatcctacattc

SEQ ID NO: 237298 - DNA, 75 bp, Artificial Sequence
  Synthetic
cccagtggaatgaggcagatgctacagttgccggcggtagagtgctaaagaaatccactcccatgaagccatgct

SEQ ID NO: 237299 - DNA, 75 bp, Artificial Sequence
  Synthetic
tggcttgcaggaggccgcagccccggggggccacgatggttccccgcggggcgcgaggggaggcggaagctgggg

SEQ ID NO: 237300 - DNA, 75 bp, Artificial Sequence
  Synthetic
gggggccacgatggttccccgcggggcgcgaggggaggcggaagctgggggtgtgttcagaagcggtgacgcggg

SEQ ID NO: 237301 - DNA, 75 bp, Artificial Sequence
  Synthetic
agttgccggcggtagagtgctaaagaaatccactcccatgaagccatgctatggttcctatgcaagacccacaaa

SEQ ID NO: 237302 - DNA, 75 bp, Artificial Sequence
  Synthetic
gtggctgatgataagggggttcttcaatctaaagttgaattgcaatttttttcaaatactactactcttaatcag

SEQ ID NO: 237303 - DNA, 75 bp, Artificial Sequence
  Synthetic
ccggccccacaggcatgggcggcaggggcacgtcttcgccgcgcgcgggcaggggctggtgctggctccgaagag

SEQ ID NO: 237304 - DNA, 75 bp, Artificial Sequence
  Synthetic
ttcaaatactactactcttaatcagcgggagggtaacgatacaaaaccaaaagtggtgctgtatagcgaagatgt

SEQ ID NO: 237305 - DNA, 75 bp, Artificial Sequence
  Synthetic
gggcacgtcttcgccgcgcgcgggcaggggctggtgctggctccgaagagcgcttgcgtgcgcgacgacgcgacg

SEQ ID NO: 237306 - DNA, 75 bp, Artificial Sequence
  Synthetic
tgagtgaagaccacgggtcccgtgaccttgaacctgaaagagagttcgacagaatcaatctcggcatcgttgaca

SEQ ID NO: 237307 - DNA, 75 bp, Artificial Sequence
  Synthetic
gcggcctggcgcaggatctcctgcacgtcgcccgagttgtcctggtaggcgatttctgccatgaactgctcgatc

SEQ ID NO: 237308 - DNA, 75 bp, Artificial Sequence
  Synthetic
caggtggcaccgggtctcggcgtgcagaccgtggacgtggtcattcccaccggcaactcccccgccgccgccacc

SEQ ID NO: 237309 - DNA, 75 bp, Artificial Sequence
  Synthetic
agaccgtggacgtggtcattcccaccggcaactcccccgccgccgccaccaccaccaccgctacctccacggaca

SEQ ID NO: 237310 - DNA, 75 bp, Artificial Sequence
  Synthetic
cggcgcgctccacggtggccgccaggtcgttggagatgcgacccatgagctgcgagaaggcgttgagtccgccct

SEQ ID NO: 237311 - DNA, 75 bp, Artificial Sequence
  Synthetic
gtcgttggagatgcgacccatgagctgcgagaaggcgttgagtccgccctcgttccagacccggctgtagaccac

SEQ ID NO: 237312 - DNA, 75 bp, Artificial Sequence
  Synthetic
ggcagcagcagcgccagccacagcggcgaccacctaggaagacctccgcgggcaagacggcgggagccgggagac

SEQ ID NO: 237313 - DNA, 75 bp, Artificial Sequence
  Synthetic
ggctccccgcgcgcgccgcgggcgcaggaagtacggcgccgccaacgcgctcctgcccgagtacgccttgcatcc

SEQ ID NO: 237314 - DNA, 75 bp, Artificial Sequence
  Synthetic
atgaccacctgggccaggttgagctccacgtgtcgcgtgaagacggcgtagttgcgcaggcgctggaaaaggtag

SEQ ID NO: 237315 - DNA, 75 bp, Artificial Sequence
  Synthetic
gttgcgcaggcgctggaaaaggtagttcagggtggtggcggtgtgctcggcgacgaagaagtacatgacccagcg

SEQ ID NO: 237316 - DNA, 75 bp, Artificial Sequence
  Synthetic
tctgggcggcataggggtaactgacacttaccaggccattaaaaccaatggcaatggtcaagaaaacccaacctg

SEQ ID NO: 237317 - DNA, 75 bp, Artificial Sequence
  Synthetic
cgccgtcgccgcagccgtcgccagcccgcactggccccaatctccgtgaggagagtggcgcgcgacggacgcacc

SEQ ID NO: 237318 - DNA, 75 bp, Artificial Sequence
  Synthetic
ggatgagctcggcgacagtgtcgcgcacctcgcgctcgaaggccacggggggcgcttcttcctcttccacctctt

SEQ ID NO: 237319 - DNA, 75 bp, Artificial Sequence
  Synthetic
ctcagccgggacgggagggggcggcggcgggggaggggcgcggcggcggcggcggcgcaccgggaggcggtcgat

SEQ ID NO: 237320 - DNA, 75 bp, Artificial Sequence
  Synthetic
ggcgggggaggggcgcggcggcggcggcggcgcaccgggaggcggtcgatgaagcgctcgatcatctccccccgc

SEQ ID NO: 237321 - DNA, 75 bp, Artificial Sequence
  Synthetic
gcgcaccggcggcgacgcgccaccagccgacgcatgcgcggcggggtgctgcccctgctgatccccctgatcgcc

SEQ ID NO: 237322 - DNA, 75 bp, Artificial Sequence
  Synthetic
cgcggccgttctcccgggggcgcagctcgaagacgccgcctctcatctcgccgcggggcgggcggccgtgaggta

SEQ ID NO: 237323 - DNA, 75 bp, Artificial Sequence
  Synthetic
ccgcggggcgggcggccgtgaggtagcgagacggcgctgactatgcatcttaacaattgctgtgtaggtacgccg

SEQ ID NO: 237324 - DNA, 75 bp, Artificial Sequence
  Synthetic
gaaagcgtctatccagtcgcagtcgcaaggtaggctgagcaccgtggcgggcgggggcgggtcgggagagttcct

SEQ ID NO: 237325 - DNA, 75 bp, Artificial Sequence
  Synthetic
ttaaagtaggcggtcttgagaaggcggatggtggacaggagcaccatgtctttgggtccggcctgttggatgcgg

SEQ ID NO: 237326 - DNA, 75 bp, Artificial Sequence
  Synthetic
ggatggtggacaggagcaccatgtctttgggtccggcctgttggatgcggaggcggtcggccatgccccaggcct

SEQ ID NO: 237327 - DNA, 75 bp, Artificial Sequence
  Synthetic
gtagtagtcttgcatgagtctttccaccggcacctcttctccttcctcttctccatctcgccggtggtttctcgc

SEQ ID NO: 237328 - DNA, 75 bp, Artificial Sequence
  Synthetic
atcatcgtcacaaaggtcttgttgctggtgaaggtcagctgcaacccgcggtgctcctcgttcagccaggtcttg

SEQ ID NO: 237329 - DNA, 75 bp, Artificial Sequence
  Synthetic
cccctgagcggctgcagcagggccaggtcggcgaccacgcgctcggccaagatggcctgctgtacctgagtgagg

SEQ ID NO: 237330 - DNA, 75 bp, Artificial Sequence
  Synthetic
tcccccgatgggcggggcgaaaagcgcccgcggcccgatagggaagagaccactctggtcacgcagaccgatgag

SEQ ID NO: 237331 - DNA, 75 bp, Artificial Sequence
  Synthetic
gatggtgtaggtgcagttggccatgacggaccagttgacggtctggtgtcccggctgcgagagctccgtgtaccg

SEQ ID NO: 237332 - DNA, 75 bp, Artificial Sequence
  Synthetic
aacacgtagtcgttgcaagtccgcaccagatactggtagcccaccaggaagtgcggcggaggttggcgatagagg

SEQ ID NO: 237333 - DNA, 75 bp, Artificial Sequence
  Synthetic
ccagatactggtagcccaccaggaagtgcggcggaggttggcgatagaggggccagcgctgggtggcgggggcgc

SEQ ID NO: 237334 - DNA, 75 bp, Artificial Sequence
  Synthetic
gcggtggtatccgtagatgtacctggacatccaggtgatgccggcggcggtggtggtggcgcgcgcgtagtcgcg

SEQ ID NO: 237335 - DNA, 75 bp, Artificial Sequence
  Synthetic
gacatccaggtgatgccggcggcggtggtggtggcgcgcgcgtagtcgcggacccggttccagatgtttcgcagg

SEQ ID NO: 237336 - DNA, 75 bp, Artificial Sequence
  Synthetic
cgctctggccggtgaggcgcgcgcagtcgttgacgctctatacacacacaaaaacgaaagcgtttacagggcttt

SEQ ID NO: 237337 - DNA, 75 bp, Artificial Sequence
  Synthetic
gtcgttgacgctctatacacacacaaaaacgaaagcgtttacagggctttcgttctgtagcctggaggaaagtaa

SEQ ID NO: 237338 - DNA, 75 bp, Artificial Sequence
  Synthetic
gttcgagaccaagctgagctcggccggctgaagccgcagctaacgtggtattggcagtcccgtctcgacccaggc

SEQ ID NO: 237339 - DNA, 75 bp, Artificial Sequence
  Synthetic
ggctgaagccgcagctaacgtggtattggcagtcccgtctcgacccaggccctgtatcctccaggatacggtcga

SEQ ID NO: 237340 - DNA, 75 bp, Artificial Sequence
  Synthetic
cgcccgtggcgcgatctgggatagatggtcgcgatgagaggacaaaagcggctcgcttccgtagtctggagaaac

SEQ ID NO: 237341 - DNA, 75 bp, Artificial Sequence
  Synthetic
tggtcgcgatgagaggacaaaagcggctcgcttccgtagtctggagaaacaatcgccagggttgcgttgcggcgt

SEQ ID NO: 237342 - DNA, 75 bp, Artificial Sequence
  Synthetic
gcgtgctggacatggcctccacctactttgacatccgcggcgtgctggaccgcggccccacctttaagccctact

SEQ ID NO: 237343 - DNA, 75 bp, Artificial Sequence
  Synthetic
ctcggatcggccggaaccgcggctaacgtgggctgtggcagccccgtcctcaggaccccgccagccgacttctcc

SEQ ID NO: 237344 - DNA, 75 bp, Artificial Sequence
  Synthetic
ccccaagggcgcgcccaacccatgcgagtgggatgaggctgctactgcccttgacattgatttgaacgcagaaga

SEQ ID NO: 237345 - DNA, 75 bp, Artificial Sequence
  Synthetic
gagtgggatgaggctgctactgcccttgacattgatttgaacgcagaagaagatgaagaaggcgatgaagcccaa

SEQ ID NO: 237346 - DNA, 75 bp, Artificial Sequence
  Synthetic
acgtgggctgtggcagccccgtcctcaggaccccgccagccgacttctccagttacgggagcgagccccttttgt

SEQ ID NO: 237347 - DNA, 75 bp, Artificial Sequence
  Synthetic
ccgtgctgcggcagatgcgcccctcgccccggcccgatcagcagcagcaacagcaggcatgcagacccccctctc

SEQ ID NO: 237348 - DNA, 75 bp, Artificial Sequence
  Synthetic
atgtatttggccaggcgccatactccggacagaacattacaaaagaaggcatacagataggcattgatgctacca

SEQ ID NO: 237349 - DNA, 75 bp, Artificial Sequence
  Synthetic
atacagataggcattgatgctaccagtcaagcccaaacacctctatatgccgacaaaacattccaacccgaacct

SEQ ID NO: 237350 - DNA, 75 bp, Artificial Sequence
  Synthetic
gccccggcccgatcagcagcagcaacagcaggcatgcagacccccctctcctctccccgccccggtcaccacggc

SEQ ID NO: 237351 - DNA, 75 bp, Artificial Sequence
  Synthetic
ggcgcgctggagtcagatgagccaccgcggcggcgacctaggcagtatctggacttggaagagggcgagggactg

SEQ ID NO: 237352 - DNA, 75 bp, Artificial Sequence
  Synthetic
agacagagattagctatggagcgggacgggtgctaaaaaagaccactctcatgaaaccttgctatgggtcatatg

SEQ ID NO: 237353 - DNA, 75 bp, Artificial Sequence
  Synthetic
cgcggcggcgacctaggcagtatctggacttggaagagggcgagggactggcgcggctgggggcgagctctccag

SEQ ID NO: 237354 - DNA, 75 bp, Artificial Sequence
  Synthetic
acgggtgctaaaaaagaccactctcatgaaaccttgctatgggtcatatgcaaggcctactaatgagaacggagg

SEQ ID NO: 237355 - DNA, 75 bp, Artificial Sequence
  Synthetic
aagggacgcgcgcgaggcgtacctgccgcggcagaacctgtttcgcgaccgcgggggcgaggagcccgaggagat

SEQ ID NO: 237356 - DNA, 75 bp, Artificial Sequence
  Synthetic
ggaaagaaagaaagtcaagtggaaatgcaatttttctccactactcaggcagctgcgggtaattcagataatcct

SEQ ID NO: 237357 - DNA, 75 bp, Artificial Sequence
  Synthetic
acttccgccgccacagcgcacagatcaggagggccacctccttctgccacttgcaagagatgcaagaagggtaat

SEQ ID NO: 237358 - DNA, 75 bp, Artificial Sequence
  Synthetic
tgcaatttttctccactactcaggcagctgcgggtaattcagataatcctactccaaagcttgttttgtacagcg

SEQ ID NO: 237359 - DNA, 75 bp, Artificial Sequence
  Synthetic
ccgcggcagaacctgtttcgcgaccgcgggggcgaggagcccgaggagatgcgagactgcaggttccaagcaggg

SEQ ID NO: 237360 - DNA, 75 bp, Artificial Sequence
  Synthetic
tacacacatttcatacatgcccactaacaacgaaaccaattcaagagaactgttgggacaacaggccatgcccaa

SEQ ID NO: 237361 - DNA, 75 bp, Artificial Sequence
  Synthetic
aacaacgaaaccaattcaagagaactgttgggacaacaggccatgcccaacaggcctaattacatcggcttcaga

SEQ ID NO: 237362 - DNA, 75 bp, Artificial Sequence
  Synthetic
cgagcagacggtgaaccaggagcgcaacttccaaaaaagcttcaacaaccacgtgcgcacgctggtggcgcgcga

SEQ ID NO: 237363 - DNA, 75 bp, Artificial Sequence
  Synthetic
aacttccaaaaaagcttcaacaaccacgtgcgcacgctggtggcgcgcgaggaggtgaccctgggtctcatgcat

SEQ ID NO: 237364 - DNA, 75 bp, Artificial Sequence
  Synthetic
tgcagaatcccagcagcaagcccctgaccgcgcagctgttcctggtggtgcagcacagcagggacaacgaggcct

SEQ ID NO: 237365 - DNA, 75 bp, Artificial Sequence
  Synthetic
gaccgcgcagctgttcctggtggtgcagcacagcagggacaacgaggccttcagggaggcgctgctgaacatcac

SEQ ID NO: 237366 - DNA, 75 bp, Artificial Sequence
  Synthetic
gacctgataaacatcctgcagagcatagtggtgcaggagcgcagcctgagcctggccgagaaggtggcggccatt

SEQ ID NO: 237367 - DNA, 75 bp, Artificial Sequence
  Synthetic
tacggaaacttttacaaaagtcaagcctaaagctggacaggacgctcagtgggaaaaagattcagaattttcaga

SEQ ID NO: 237368 - DNA, 75 bp, Artificial Sequence
  Synthetic
ccgtaatcaatgggatcattactgctctaatcgaatctgtatcaagcccagagccatctgcgacgggcaaaatct

SEQ ID NO: 237369 - DNA, 75 bp, Artificial Sequence
  Synthetic
aactattctatgctgagtctgggcaagttctacgcccgcaagatctacaagaccccctacgtgcccatagacaag

SEQ ID NO: 237370 - DNA, 75 bp, Artificial Sequence
  Synthetic
aacttcgctatggaaatcaacatcaatgccaacctgtggaggaacttcctgtactccaacgtggccctgtacctg

SEQ ID NO: 237371 - DNA, 75 bp, Artificial Sequence
  Synthetic
atgccaacctgtggaggaacttcctgtactccaacgtggccctgtacctgccagacaagcttaagtatactccat

SEQ ID NO: 237372 - DNA, 75 bp, Artificial Sequence
  Synthetic
cctgagcgacgacctgggagtgtaccgcaacgagcgcatccacaaggccgtgagcgccagccggcggcgcgagct

SEQ ID NO: 237373 - DNA, 75 bp, Artificial Sequence
  Synthetic
cactcccactactaccacccccaccactactactagcactgctactaccgctgcccgcaaagctattacccgcaa

SEQ ID NO: 237374 - DNA, 75 bp, Artificial Sequence
  Synthetic
ctgcagcgcgcgctgaccggcgcgggcgagggcgacagggaggtcgagtcctacttcgacatgggggccgacctg

SEQ ID NO: 237375 - DNA, 75 bp, Artificial Sequence
  Synthetic
gcgagggcgacagggaggtcgagtcctacttcgacatgggggccgacctgcactggcagccaagccgccgcgccc

SEQ ID NO: 237376 - DNA, 75 bp, Artificial Sequence
  Synthetic
ccccctggcggccaatgacgaggaagaggaggactatgagctagaggagggcgagtacctggaggactgacctgg

SEQ ID NO: 237377 - DNA, 75 bp, Artificial Sequence
  Synthetic
gaggaggactatgagctagaggagggcgagtacctggaggactgacctggctggtggtgttttggtatagatgca

SEQ ID NO: 237378 - DNA, 75 bp, Artificial Sequence
  Synthetic
agttctttgccatcaagaacctcctcctcctgccgggctcctacacctacgagtggaacttcaggaaggatgtca

SEQ ID NO: 237379 - DNA, 75 bp, Artificial Sequence
  Synthetic
gtccgggcggcgctgcagagccagccgtccggcattaactcctctgacgactgggccgcggccatgggtcgcatc

SEQ ID NO: 237380 - DNA, 75 bp, Artificial Sequence
  Synthetic
cgtccggcattaactcctctgacgactgggccgcggccatgggtcgcatcatggccctgaccgcgcgcaaccccg

SEQ ID NO: 237381 - DNA, 75 bp, Artificial Sequence
  Synthetic
ccacaacaccgcctccacgctcgaggccatgctcaggaacgacaccaacgaccagtccttcaatgactacctctc

SEQ ID NO: 237382 - DNA, 75 bp, Artificial Sequence
  Synthetic
taaccggctggcggccatcttggaagcggtagtgcccgcgcgctccaaccccacccacgagaaggtgctggccat

SEQ ID NO: 237383 - DNA, 75 bp, Artificial Sequence
  Synthetic
gcggtagtgcccgcgcgctccaaccccacccacgagaaggtgctggccatagtcaacgcgttggcggagagcagg

SEQ ID NO: 237384 - DNA, 75 bp, Artificial Sequence
  Synthetic
tggtgtacgatgcgctgctgcagcgggtggcgcggtacaacagcggcaacgtgcagaccaacctggaccgcctgg

SEQ ID NO: 237385 - DNA, 75 bp, Artificial Sequence
  Synthetic
ggtggcgcggtacaacagcggcaacgtgcagaccaacctggaccgcctggtgacggacgtgcgcgaggccgtggc

SEQ ID NO: 237386 - DNA, 75 bp, Artificial Sequence
  Synthetic
ggtaacctgggctcgctggtggcgctaaacgccttcctcagcacccagccggccaacgtaccgcgggggcaggag

SEQ ID NO: 237387 - DNA, 75 bp, Artificial Sequence
  Synthetic
ggggtcgtcttcctgcaggcgctgcaccttgcgcttgccgttgcgcccctgcttgatgcgcacgggcgggttgct

SEQ ID NO: 237388 - DNA, 75 bp, Artificial Sequence
  Synthetic
caactccacggccgacacccagtggtcatggagccaccacggtagctatgtatacatctgcaatagctccacctc

SEQ ID NO: 237389 - DNA, 75 bp, Artificial Sequence
  Synthetic
gcttgatgcgcacgggcgggttgctgaagcccaccatcaccagcgcggcctcttcttgctcgtcctcgctgtcca

SEQ ID NO: 237390 - DNA, 75 bp, Artificial Sequence
  Synthetic
taaacgccttcctcagcacccagccggccaacgtaccgcgggggcaggaggactacaccaacttcttaagcgcgc

SEQ ID NO: 237391 - DNA, 75 bp, Artificial Sequence
  Synthetic
tcagagcgaggtgtaccagtcggggcccgactacttcttccagaccagcagacagggcttgcaaaccgtgaacct

SEQ ID NO: 237392 - DNA, 75 bp, Artificial Sequence
  Synthetic
cccgactacttcttccagaccagcagacagggcttgcaaaccgtgaacctgagccaggcttttaagaacctgcgg

SEQ ID NO: 237393 - DNA, 75 bp, Artificial Sequence
  Synthetic
ccggcgaccgggctacggtgtccagcctgctaacccccaactcgcgcctgctgctgctgctgatcgcgcccttca

SEQ ID NO: 237394 - DNA, 75 bp, Artificial Sequence
  Synthetic
gggggcgcgcggggcggcggaggcggcggcggcgacggagacggggacgagacatcgtccagggtgggtggacgg

SEQ ID NO: 237395 - DNA, 75 bp, Artificial Sequence
  Synthetic
gcggcggcgacggagacggggacgagacatcgtccagggtgggtggacggcgggccgcgccgcgtccgcgctcgg

SEQ ID NO: 237396 - DNA, 75 bp, Artificial Sequence
  Synthetic
ctggggcaggaggacacgggcagcctgcaggcgaccctgaactacctgctcaccaacaggcggcagaagattccc

SEQ ID NO: 237397 - DNA, 75 bp, Artificial Sequence
  Synthetic
aggagcgcatcttgcgctacgtgcagcagagcgtgagcctgaacctgatgcgcgacggcgtgacgcccagcgtgg

SEQ ID NO: 237398 - DNA, 75 bp, Artificial Sequence
  Synthetic
atgatgggatccatagattggatggtctgaaaaacctacttttctcttttacagtatgataaattgagacatgcc

SEQ ID NO: 237399 - DNA, 75 bp, Artificial Sequence
  Synthetic
actacttgcatcgggcggcggccgtgaaccccgagtacttcaccaatgccattctgaatccccactggatgcccc

SEQ ID NO: 237400 - DNA, 75 bp, Artificial Sequence
  Synthetic
gaaccccgagtacttcaccaatgccattctgaatccccactggatgccccctccgggtttctacaacggggactt

SEQ ID NO: 237401 - DNA, 75 bp, Artificial Sequence
  Synthetic
gccgtcgggttccaccgagcaggagctcagggccatcgtcagagacctgggatgcgggccctattttttgggcac

SEQ ID NO: 237402 - DNA, 75 bp, Artificial Sequence
  Synthetic
gccaaaagaggataaaaagcaagaccaggacgacgcagataaggatgagacagcagtcgggcgggggaacggaag

SEQ ID NO: 237403 - DNA, 75 bp, Artificial Sequence
  Synthetic
ttcctctgggatgacatggatgacagtgtgttctcccccaacccgctgcgcgccgcgtctctgcgattgaaggag

SEQ ID NO: 237404 - DNA, 75 bp, Artificial Sequence
  Synthetic
gtgtgttctcccccaacccgctgcgcgccgcgtctctgcgattgaaggagggctctgacagggaaggaccgagga

SEQ ID NO: 237405 - DNA, 75 bp, Artificial Sequence
  Synthetic
gaccgggggcgtgcactggctggccttcgcctggaacccgcgctccaaaacatgctttctctttgaccccttcgg

SEQ ID NO: 237406 - DNA, 75 bp, Artificial Sequence
  Synthetic
gtaccgagacaggaacattgcccaacttctaagactgctctaatcatgcataagactgtgatctgcctcctcatc

SEQ ID NO: 237407 - DNA, 75 bp, Artificial Sequence
  Synthetic
ggcggtgggcgcaacgggcgcggcggcgcggggcagcagccccttccccagcctggcggactctctgaatagcgg

SEQ ID NO: 237408 - DNA, 75 bp, Artificial Sequence
  Synthetic
gcgcggggcagcagccccttccccagcctggcggactctctgaatagcgggcgggtgagcaggccccgcttgcta

SEQ ID NO: 237409 - DNA, 75 bp, Artificial Sequence
  Synthetic
ccctgctacagcccgtgagggacaaaaacgctcagcggcagcagtttcccaacaacgggatagagagcctggtgg

SEQ ID NO: 237410 - DNA, 75 bp, Artificial Sequence
  Synthetic
aaacgctcagcggcagcagtttcccaacaacgggatagagagcctggtggacaagatgtccagatggaagacgta

SEQ ID NO: 237411 - DNA, 75 bp, Artificial Sequence
  Synthetic
ttcgtgcactggccccagagtcccatggaccgcaaccccaccatgaacttgctgacgggggtgcccaactccatg

SEQ ID NO: 237412 - DNA, 75 bp, Artificial Sequence
  Synthetic
gaccgccagccgcggcctctgccgccccctagacagcgctggcagcggcgcgcgtccaaccgccgctggaggcag

SEQ ID NO: 237413 - DNA, 75 bp, Artificial Sequence
  Synthetic
cccctagacagcgctggcagcggcgcgcgtccaaccgccgctggaggcaggggcccgaggacgatgatgactctg

SEQ ID NO: 237414 - DNA, 75 bp, Artificial Sequence
  Synthetic
gggcgggagcgggaaccccttttcgcacctgcgcccacgcctgggcaagatgttttaaaagagaaaaataaaact

SEQ ID NO: 237415 - DNA, 75 bp, Artificial Sequence
  Synthetic
ccacttgcaagagatgcaagaagggaaataataacgatgtacacacttttttctctcaataaatggcattttttt

SEQ ID NO: 237416 - DNA, 75 bp, Artificial Sequence
  Synthetic
aaataataacgatgtacacacttttttctctcaataaatggcatttttttatttatacatgctctctggggtatt

SEQ ID NO: 237417 - DNA, 75 bp, Artificial Sequence
  Synthetic
ggtttttttgttcccttccttagtatgcggcgcgcggcgatgttcgaggaggggcctcccccctcttacgagagc

SEQ ID NO: 237418 - DNA, 75 bp, Artificial Sequence
  Synthetic
tgcggcgcgcggcgatgttcgaggaggggcctcccccctcttacgagagcgcgatgggaatttctcctgcggcgc

SEQ ID NO: 237419 - DNA, 75 bp, Artificial Sequence
  Synthetic
gccgccgccgccatctggctctctttagaaatcgaaagggttctgccgggagtcgccgtgcgccacgggcaggga

SEQ ID NO: 237420 - DNA, 75 bp, Artificial Sequence
  Synthetic
agtcgccgtgcgccacgggcagggacacgttgcggtactggtagcgggtgccccacttgaactcgggcaccacca

SEQ ID NO: 237421 - DNA, 75 bp, Artificial Sequence
  Synthetic
ccctgcagcctccctacgtgcctcctcggtacctgcaacctacaggggggagaaatagcatctgttactctgagc

SEQ ID NO: 237422 - DNA, 75 bp, Artificial Sequence
  Synthetic
acgagtcggtgagctcctcgcttggtctccgtccggacgggacatttcagatcggcggcgccggccgctcttcat

SEQ ID NO: 237423 - DNA, 75 bp, Artificial Sequence
  Synthetic
gcggacgtggcctccctgaactaccagaacgaccacagcgattttttgaccacggtgatccaaaacaacgacttc

SEQ ID NO: 237424 - DNA, 75 bp, Artificial Sequence
  Synthetic
ccataaacctggacaacaggtcgaactggggcggcgacctgaagactatcctgcacaccaatatgcccaacgtga

SEQ ID NO: 237425 - DNA, 75 bp, Artificial Sequence
  Synthetic
ggccagcacgctgcggtcggagatcagctcggcgtccaggtcctccgcgttgctcagcgcgaacggggtcatctt

SEQ ID NO: 237426 - DNA, 75 bp, Artificial Sequence
  Synthetic
ctggggcggcgacctgaagactatcctgcacaccaatatgcccaacgtgaacgagttcatgttcaccaactcttt

SEQ ID NO: 237427 - DNA, 75 bp, Artificial Sequence
  Synthetic
gagcagggggaggcgaagtacgagtgggtggacttcacgctgcccgagggcaactactcagagaccatgactctc

SEQ ID NO: 237428 - DNA, 75 bp, Artificial Sequence
  Synthetic
gggtggacttcacgctgcccgagggcaactactcagagaccatgactctcgacctgatgaacaatgcgatcgtgg

SEQ ID NO: 237429 - DNA, 75 bp, Artificial Sequence
  Synthetic
gaacggggtgaaggagagcgatatcggggtcaagtttgacaccagaaactttcgtctgggctgggaccccgtgac

SEQ ID NO: 237430 - DNA, 75 bp, Artificial Sequence
  Synthetic
ggggtcaagtttgacaccagaaactttcgtctgggctgggaccccgtgaccgggctggtcatgccgggggtctac

SEQ ID NO: 237431 - DNA, 75 bp, Artificial Sequence
  Synthetic
tagtgctcctgcccggctgtggggtggacttcacccagagccggctgagcaacctgctgggcgttcgcaagcggc

SEQ ID NO: 237432 - DNA, 75 bp, Artificial Sequence
  Synthetic
ggacttcacccagagccggctgagcaacctgctgggcgttcgcaagcggcaacctttccaggagggtttcaagat

SEQ ID NO: 237433 - DNA, 75 bp, Artificial Sequence
  Synthetic
cggacctcatggaagacgtgagcggcgagggcctgctcgagtgccactgccgctgcaacctctgcacgccccacc

SEQ ID NO: 237434 - DNA, 75 bp, Artificial Sequence
  Synthetic
aacattcccgcgctccttgatctggacgcctacgaggagagcttgaaacccgaggagagcgctggcgacagcggc

SEQ ID NO: 237435 - DNA, 75 bp, Artificial Sequence
  Synthetic
ttagctctgggtccctcaccgtcgcggccgccgctccactggcggtggccggcacctctctcaccatgcaatctc

SEQ ID NO: 237436 - DNA, 75 bp, Artificial Sequence
  Synthetic
acgcctacgaggagagcttgaaacccgaggagagcgctggcgacagcggcgagagtggcgaggagcaagccggcg

SEQ ID NO: 237437 - DNA, 75 bp, Artificial Sequence
  Synthetic
ggccgccgctccactggcggtggccggcacctctctcaccatgcaatctcaggcccccttgacggtgcaagatgc

SEQ ID NO: 237438 - DNA, 75 bp, Artificial Sequence
  Synthetic
cgaaagtactcccgcagtggcggcggacgctgcggaggtcgagccggaggccatgcagcaggacgcagaggaggg

SEQ ID NO: 237439 - DNA, 75 bp, Artificial Sequence
  Synthetic
gacgctgcggaggtcgagccggaggccatgcagcaggacgcagaggagggcgcgcaggaggacatgaacgatggg

SEQ ID NO: 237440 - DNA, 75 bp, Artificial Sequence
  Synthetic
cccctaaccgtgtctgaaggcaaactcaccttgcagacatcggctccacttacggccgccgacagcagcactctc

SEQ ID NO: 237441 - DNA, 75 bp, Artificial Sequence
  Synthetic
ctccacctggtcgggcagcatcttgaagttcaccttcagctcattctccacgtggtacttgtccatcagcgcgcg

SEQ ID NO: 237442 - DNA, 75 bp, Artificial Sequence
  Synthetic
tcaccttgcagacatcggctccacttacggccgccgacagcagcactctcactgttggcaccacaccgccaatca

SEQ ID NO: 237443 - DNA, 75 bp, Artificial Sequence
  Synthetic
cccggggcgaagaaaaagaggcagaggcggcggcggcgacggcggaagccgaaaccgaggcagaggcagagcccg

SEQ ID NO: 237444 - DNA, 75 bp, Artificial Sequence
  Synthetic
ggcggcggcggcgacggcggaagccgaaaccgaggcagaggcagagcccgagaccgaagttatggaagacatgaa

SEQ ID NO: 237445 - DNA, 75 bp, Artificial Sequence
  Synthetic
agatatggaagaccccatgtatactcatgatggaaaactgggaatcagaattggtggcccactgcaagtagtaga

SEQ ID NO: 237446 - DNA, 75 bp, Artificial Sequence
  Synthetic
ggttcttcaccatcgccgtggccgccgccgccgcggccccctccgccgcgctttcgctttccgccccgctgttct

SEQ ID NO: 237447 - DNA, 75 bp, Artificial Sequence
  Synthetic
cgccgccgcggccccctccgccgcgctttcgctttccgccccgctgttctcttcctcttcctcctcttcctcctc

SEQ ID NO: 237448 - DNA, 75 bp, Artificial Sequence
  Synthetic
tttgccacccggggcgaagagaaggcggcggaggcagaagccgcggctgaggaggcggctgcggctgcggccgag

SEQ ID NO: 237449 - DNA, 75 bp, Artificial Sequence
  Synthetic
cggcggaggcagaagccgcggctgaggaggcggctgcggctgcggccgaggctgaggctgcggctgaggctaagg

SEQ ID NO: 237450 - DNA, 75 bp, Artificial Sequence
  Synthetic
ccgctacccccgccgccgccccagcagcgggaccttgcttcccaggatggcacccagaaagaagcagcagccgcc

SEQ ID NO: 237451 - DNA, 75 bp, Artificial Sequence
  Synthetic
acaatgcccttcaaactaaagttgcgggtgccctgggttatgactcatctggcaatctagaattgcgagccgcag

SEQ ID NO: 237452 - DNA, 75 bp, Artificial Sequence
  Synthetic
catgatggaaaactgggaatcagaattggtggcccactgcaagtagtagacagcttgcacacactcactgtagtt

SEQ ID NO: 237453 - DNA, 75 bp, Artificial Sequence
  Synthetic
tcaggctgaggaggaggcggcggctgaagcagttaaggaaaaggcccaggcagagcaggaagagaaaaaacctgt

SEQ ID NO: 237454 - DNA, 75 bp, Artificial Sequence
  Synthetic
gaagcagttaaggaaaaggcccaggcagagcaggaagagaaaaaacctgtcattcaacctctaaaagaagatagc

SEQ ID NO: 237455 - DNA, 75 bp, Artificial Sequence
  Synthetic
ccatttgatgctcagaacaatctcagccttagacttggtcagggacctttatatgtgaacaccaatcacaaccta

SEQ ID NO: 237456 - DNA, 75 bp, Artificial Sequence
  Synthetic
gggtgccctgggttatgactcatctggcaatctagaattgcgagccgcagggggtatgcgaattaacacaggggg

SEQ ID NO: 237457 - DNA, 75 bp, Artificial Sequence
  Synthetic
gccttagacttggtcagggacctttatatgtgaacaccaatcacaacctagatttaaattgcaacagaggtctga

SEQ ID NO: 237458 - DNA, 75 bp, Artificial Sequence
  Synthetic
agggcagcacctttacccagtaccgcagctggtacctggcttacaactacggcgacccggttaagggggtgcgct

SEQ ID NO: 237459 - DNA, 75 bp, Artificial Sequence
  Synthetic
cagctggtacctggcttacaactacggcgacccggttaagggggtgcgctcgtggaccctgctctgcacgccgga

SEQ ID NO: 237460 - DNA, 75 bp, Artificial Sequence
  Synthetic
caaacttgaaactaaaatcgattcgggcttagactataacgccaatggggctatcattgctaaacttggcactgg

SEQ ID NO: 237461 - DNA, 75 bp, Artificial Sequence
  Synthetic
ggcttagactataacgccaatggggctatcattgctaaacttggcactgggttaacctttgacaacacaggtgcc

SEQ ID NO: 237462 - DNA, 75 bp, Artificial Sequence
  Synthetic
acaaactcactctgtggactaccccagatccctctcctaactgcagaattcacgcagacaaagactgcaagttta

SEQ ID NO: 237463 - DNA, 75 bp, Artificial Sequence
  Synthetic
agatccctctcctaactgcagaattcacgcagacaaagactgcaagtttactctagtcctgactaagtgtggaag

SEQ ID NO: 237464 - DNA, 75 bp, Artificial Sequence
  Synthetic
actccaagagtttttacaacgagcaggctgtctactcccagctgatccgccaggccacctctctgacccacgtgt

SEQ ID NO: 237465 - DNA, 75 bp, Artificial Sequence
  Synthetic
ctggcggtgtctggaaacctatcatcaatgacaggcactgtctccagcgttaccatctttctcagattcgatcag

SEQ ID NO: 237466 - DNA, 75 bp, Artificial Sequence
  Synthetic
caatgacaggcactgtctccagcgttaccatctttctcagattcgatcagaatggagttcttatggaaaattcct

SEQ ID NO: 237467 - DNA, 75 bp, Artificial Sequence
  Synthetic
ccgccccctctgagcccaccaccgccgccaccgccgccgccagtgccgccgcggacgacgcgcccaccgagacca

SEQ ID NO: 237468 - DNA, 75 bp, Artificial Sequence
  Synthetic
cagaaatggtaattccaccaatgccaccccctacaccaatgcggttgggttcatgcccaacctcagcgcctaccc

SEQ ID NO: 237469 - DNA, 75 bp, Artificial Sequence
  Synthetic
accccctacaccaatgcggttgggttcatgcccaacctcagcgcctaccccaaaacccagagtcaaactgcaaaa

SEQ ID NO: 237470 - DNA, 75 bp, Artificial Sequence
  Synthetic
tacatggggacaaatctaaacccatgatccttaccattacccttaatggcacaaatgaatccagtgaaactagtc

SEQ ID NO: 237471 - DNA, 75 bp, Artificial Sequence
  Synthetic
ccaaaatcatgtccatactcatctcacccagcaacaataccggctgggggctgcgcgcgcccagcaagatgtttg

SEQ ID NO: 237472 - DNA, 75 bp, Artificial Sequence
  Synthetic
gatccttaccattacccttaatggcacaaatgaatccagtgaaactagtcaggtgagtcactactccatgtcatt

SEQ ID NO: 237473 - DNA, 75 bp, Artificial Sequence
  Synthetic
gcacccagtgcgcgtgcgcggccactaccgcgcgccctggggagcgcacaagcgcgggcgcacagggcgcaccac

SEQ ID NO: 237474 - DNA, 75 bp, Artificial Sequence
  Synthetic
tatgccaccgaaacctttgccaccaactcttttaccttctcctacattgctgaacaataaagaagcataacgctg

SEQ ID NO: 237475 - DNA, 75 bp, Artificial Sequence
  Synthetic
agcgcgggcgcacagggcgcaccactgtggacgacgtcattgactccgtagtggagcaggcgcgccactacacac

SEQ ID NO: 237476 - DNA, 75 bp, Artificial Sequence
  Synthetic
ccggcgcgccaaccccccccgccgtgtccaccgtggaccaggcgatcaatagcgtggtacagggggcgcggcgct

SEQ ID NO: 237477 - DNA, 75 bp, Artificial Sequence
  Synthetic
gtccaccgtggaccaggcgatcaatagcgtggtacagggggcgcggcgctatgccaaccttaaaagtcgccgccg

SEQ ID NO: 237478 - DNA, 75 bp, Artificial Sequence
  Synthetic
agaccccgtgccgccgccgccgcgcgccttgctaaggctctgcttaagcgcgccaggcgaactggccaccgggcg

SEQ ID NO: 237479 - DNA, 75 bp, Artificial Sequence
  Synthetic
ccgccgctgcaagtgccgcgaccccgcggacacgaaggcgcgcggccgccgccgccgccgccgctatttccaact

SEQ ID NO: 237480 - DNA, 75 bp, Artificial Sequence
  Synthetic
gcggacacgaaggcgcgcggccgccgccgccgccgccgctatttccaacttggcctcaacgcggcgcggtaacat

SEQ ID NO: 237481 - DNA, 75 bp, Artificial Sequence
  Synthetic
ggcacacgggtgcccgtgcgctttcgccccccgcggaattagcacaagacaacatacacactgagtctcctgctg

SEQ ID NO: 237482 - DNA, 75 bp, Artificial Sequence
  Synthetic
gccccccgcggaattagcacaagacaacatacacactgagtctcctgctgttgtgtatcccagcggcgaccgtca

SEQ ID NO: 237483 - DNA, 75 bp, Artificial Sequence
  Synthetic
cagaggccgaggtatccagctcaacgacgagtcggtgagctcttcgctcggtctccgtccggacggaactttcca

SEQ ID NO: 237484 - DNA, 75 bp, Artificial Sequence
  Synthetic
aattaaagaagagatgctccaggtcatcgcgccggagatctatgggcccccgaagaaggaggaggaggattacaa

SEQ ID NO: 237485 - DNA, 75 bp, Artificial Sequence
  Synthetic
atcgcgccggagatctatgggcccccgaagaaggaggaggaggattacaagccccgcaagctaaagcgggtcaaa

SEQ ID NO: 237486 - DNA, 75 bp, Artificial Sequence
  Synthetic
tccgcaccgcccgcagcatgagctttctcgttctccgcgcgcagcaccgcaccctgatctcgctcaggttggcgc

SEQ ID NO: 237487 - DNA, 75 bp, Artificial Sequence
  Synthetic
aggcggtggagtttgtccgccgcatggcgcccaggcgccccgtgcagtggaagggtcggcgcgtgcagcgcgtcc

SEQ ID NO: 237488 - DNA, 75 bp, Artificial Sequence
  Synthetic
ggcgcccaggcgccccgtgcagtggaagggtcggcgcgtgcagcgcgtcctgcgccccggcaccgcggtggtttt

SEQ ID NO: 237489 - DNA, 75 bp, Artificial Sequence
  Synthetic
actttcaagcgggtgtacgatgaggtgtacggcgacgaggatctgttggagcaggccaaccatcgctttggggag

SEQ ID NO: 237490 - DNA, 75 bp, Artificial Sequence
  Synthetic
gctgccgctggacgagggcaatcccaccccgagtctaaagccggtgaccctacaacaggtgctgccgctaagcgc

SEQ ID NO: 237491 - DNA, 75 bp, Artificial Sequence
  Synthetic
aagcgcgagggcggggacctggcacccaccgtgcagctgatggtgcccaagcggcagaagctggaagacgtgctg

SEQ ID NO: 237492 - DNA, 75 bp, Artificial Sequence
  Synthetic
ccaccgtgcagctgatggtgcccaagcggcagaagctggaagacgtgctggagaaaatgaaagtagagcccggga

SEQ ID NO: 237493 - DNA, 75 bp, Artificial Sequence
  Synthetic
tgagtttaataaacgctgagatcagaatctactggggctcctgtcgccatcctgtgaacgccaccgtcttcaccc

SEQ ID NO: 237494 - DNA, 75 bp, Artificial Sequence
  Synthetic
cattaagcaggtggcgcccggcgttggagtccagaccgtggacgttagaattcccacggaagagatggaaaccca

SEQ ID NO: 237495 - DNA, 75 bp, Artificial Sequence
  Synthetic
tcaccagccagagcatgctgcagaacttcaggactttcatcctggagcgctcgggcatcctgccggccacctgct

SEQ ID NO: 237496 - DNA, 75 bp, Artificial Sequence
  Synthetic
ggagtccagaccgtggacgttagaattcccacggaagagatggaaacccaaaccgccactccctcttcggcagcg

SEQ ID NO: 237497 - DNA, 75 bp, Artificial Sequence
  Synthetic
tagaggtgcagacggacccctggctacccgccgccgctgtcgccgccgccccacgttcgcgcgggcgcaagagaa

SEQ ID NO: 237498 - DNA, 75 bp, Artificial Sequence
  Synthetic
acccgccgccgctgtcgccgccgccccacgttcgcgcgggcgcaagagaaactatccagcggccagcgcgctcat

SEQ ID NO: 237499 - DNA, 75 bp, Artificial Sequence
  Synthetic
atcgcacccacccccgggtaccgcgggtactcgtaccgcccgcgcagatcagccggcacccgcggccgccgccgc

SEQ ID NO: 237500 - DNA, 75 bp, Artificial Sequence
  Synthetic
ggtactcgtaccgcccgcgcagatcagccggcacccgcggccgccgccgccgtgcgaccacaaccacccgccgcc

SEQ ID NO: 237501 - DNA, 75 bp, Artificial Sequence
  Synthetic
gacccccgtgtctgtaagaaaggtggctcgctcggggagcacgctggtggtgcccagagcgcgctaccaccccag

SEQ ID NO: 237502 - DNA, 75 bp, Artificial Sequence
  Synthetic
gctcgctcggggagcacgctggtggtgcccagagcgcgctaccaccccagcatcgtttaaagccggtctctgtat

SEQ ID NO: 237503 - DNA, 75 bp, Artificial Sequence
  Synthetic
aatcaaagcttccttgagatttgttctttccttctacgtgtatgaacacctcagcctccaataactctacccttt

SEQ ID NO: 237504 - DNA, 75 bp, Artificial Sequence
  Synthetic
tgtcgccttcgcttcccggtgccgggataccgaggaagaactcaccgccgcagaggcatggcgggcagcggtctc

SEQ ID NO: 237505 - DNA, 75 bp, Artificial Sequence
  Synthetic
cagaggcatggcgggcagcggtctccgcggcggccgtcgccatcgccggcgcgcaaagagcaggcgcatgcgcgg

SEQ ID NO: 237506 - DNA, 75 bp, Artificial Sequence
  Synthetic
ctaatcgccgcggcgatcggcgccgtgcccgggatcgcctccgtggccctgcaggcgtcccagaaacattgactc

SEQ ID NO: 237507 - DNA, 75 bp, Artificial Sequence
  Synthetic
tgcccgggatcgcctccgtggccctgcaggcgtcccagaaacattgactcttgcaaccttgcaagcttgcatttt

SEQ ID NO: 237508 - DNA, 75 bp, Artificial Sequence
  Synthetic
acatgcttctggaggaagaggaggactgggacagtcaggcagaggaggtttcggacgaggaggaggagatgatgg

SEQ ID NO: 237509 - DNA, 75 bp, Artificial Sequence
  Synthetic
actattttgtagaaaaaagatggaagacatcaactttgcgtcgctggccccgcgtcacggctcacgcccgttcat

SEQ ID NO: 237510 - DNA, 75 bp, Artificial Sequence
  Synthetic
gaggtggcagacgcaacaccatcaccctcggtcgcagccccctcgccggggcccctgaagtcctccgagcccagc

SEQ ID NO: 237511 - DNA, 75 bp, Artificial Sequence
  Synthetic
agcagtatgagcggtggcgccttcagctggggcagtctgtggagcggccttaaaaattttggttccaccattaag

SEQ ID NO: 237512 - DNA, 75 bp, Artificial Sequence
  Synthetic
gctggggcagtctgtggagcggccttaaaaattttggttccaccattaagaactatggcaacaaagcgtggaaca

SEQ ID NO: 237513 - DNA, 75 bp, Artificial Sequence
  Synthetic
gatgcggtcatgtacatgtcaaaacagtacaacctgtggcctccctctccccaggcgtgtgtggaaaatactggg

SEQ ID NO: 237514 - DNA, 75 bp, Artificial Sequence
  Synthetic
caagttgaaagagcaaaacttccaggaaaaggtggcgcagggcctggcctctggcatcagcggggtggtggacat

SEQ ID NO: 237515 - DNA, 75 bp, Artificial Sequence
  Synthetic
gcgccagggctaccgctcgtggcgcgggcacaagaacgccatagtcgcctgcttgcaagactgcgggggcaacat

SEQ ID NO: 237516 - DNA, 75 bp, Artificial Sequence
  Synthetic
ctggcatcagcggggtggtggacatagctaaccaggccgtgcaaaaaaagataaacagtcatctagacccccgcc

SEQ ID NO: 237517 - DNA, 75 bp, Artificial Sequence
  Synthetic
agctaaccaggccgtgcaaaaaaagataaacagtcatctagacccccgcccaccggtggaggaaacgcctccagc

SEQ ID NO: 237518 - DNA, 75 bp, Artificial Sequence
  Synthetic
aaaggcgaaaagcgcccgcggcccgacagggaagagaccctggtgtcacacatcgaggagccgccctcttacgag

SEQ ID NO: 237519 - DNA, 75 bp, Artificial Sequence
  Synthetic
tctctacagcccctactgcggcagcggcgacccagaggcggcagcgtcagccgcagcggagaccaccagctagga

SEQ ID NO: 237520 - DNA, 75 bp, Artificial Sequence
  Synthetic
cacctccctactaatcaccaccaccctccttgcgattgcccatgggttgacacgaatcgaagtgccagtggggtc

SEQ ID NO: 237521 - DNA, 75 bp, Artificial Sequence
  Synthetic
gaggcagtcaaggccggcctgcccaccactcgccccatagctcccatggccaccggtgtggtgggccacaggcaa

SEQ ID NO: 237522 - DNA, 75 bp, Artificial Sequence
  Synthetic
ccgcagcggagaccaccagctaggaagacctcatcctccgcgggcaagacggcggcagcggccaggagacccgcg

SEQ ID NO: 237523 - DNA, 75 bp, Artificial Sequence
  Synthetic
ccactcgccccatagctcccatggccaccggtgtggtgggccacaggcaacacactcccgcaacactagatctgc

SEQ ID NO: 237524 - DNA, 75 bp, Artificial Sequence
  Synthetic
gcgcactgcgcctctcgcccaacgaacccctctcgacccgggagctcagacacaggatcttccccactctgtatg

SEQ ID NO: 237525 - DNA, 75 bp, Artificial Sequence
  Synthetic
aatttgtccgcaatcaatgggttcatttctgctctaaccgaatcagtatcaagcccagagccatctgcgatgggc

SEQ ID NO: 237526 - DNA, 75 bp, Artificial Sequence
  Synthetic
gccaaaggcggcgacggtgcccgctccctccacttccgccgccaacagagtgtccctgcgccgcactgcgggcgc

SEQ ID NO: 237527 - DNA, 75 bp, Artificial Sequence
  Synthetic
tgtccctgcgccgcactgcgggcgcccctcggggaccgcgactgagcggcaactggcagagcacactgaacagca

SEQ ID NO: 237528 - DNA, 75 bp, Artificial Sequence
  Synthetic
gaaacgccgccgttgctactgaataagcaagctagctaacgtgttgtatgtgtgtatgcgtcctatgtcgccgcc

SEQ ID NO: 237529 - DNA, 75 bp, Artificial Sequence
  Synthetic
gcggaggcactcttcagcaaatactgcgcgctcactcttaaggactagctccgcgcccttctcgaatttaggcgg

SEQ ID NO: 237530 - DNA, 75 bp, Artificial Sequence
  Synthetic
cactaccgctgcccgtcatacccgcaaaagcaccatgattagcacaaagccccctcgtgctcactcccacgccgg

SEQ ID NO: 237531 - DNA, 75 bp, Artificial Sequence
  Synthetic
tgtgtatgcgtcctatgtcgccgccagaggagctgttgagccgctcacgccgtctgcactccagcgaatttcaag

SEQ ID NO: 237532 - DNA, 75 bp, Artificial Sequence
  Synthetic
aaaacaacataaagcgcttccacaggagcagccatgacaaagacccgagtcttaccaggaaaattttaaaaaaga

SEQ ID NO: 237533 - DNA, 75 bp, Artificial Sequence
  Synthetic
gcactaacgccagcgctcatgaactgttcgacctggagaatgaggatgcccagcagagctccgcttgcctgaccc

SEQ ID NO: 237534 - DNA, 75 bp, Artificial Sequence
  Synthetic
ccaggacgcttcggagtacctgagccccgggcttgtgcagttcgcccgcgccaccgacacctacttcagcctgag

SEQ ID NO: 237535 - DNA, 75 bp, Artificial Sequence
  Synthetic
gcacccacccacgatgtgaccacggaccggtcgcagcgcctgacgctgcggttcatccccgtggatcgagaggac

SEQ ID NO: 237536 - DNA, 75 bp, Artificial Sequence
  Synthetic
tcacgctggccgtgggcgacaaccgcgtgctggacatggcctccacctactttgacatccggggggtgctggaca

SEQ ID NO: 237537 - DNA, 75 bp, Artificial Sequence
  Synthetic
cgtgctggacatggcctccacctactttgacatccggggggtgctggacaggggtcccacctttaagccctactc

SEQ ID NO: 237538 - DNA, 75 bp, Artificial Sequence
  Synthetic
cccaagggcgctcccaattcttgcgagtgggatgagaaggaagctaatcaggcagtaatcgacgaggaagacgaa

SEQ ID NO: 237539 - DNA, 75 bp, Artificial Sequence
  Synthetic
agtgggatgagaaggaagctaatcaggcagtaatcgacgaggaagacgaagatttgccagaagaacaagaagcag

SEQ ID NO: 237540 - DNA, 75 bp, Artificial Sequence
  Synthetic
ttccagctcgccggagccggccgctcttcgttcacgccccgccaggcgtacctgactctgcagacctcgtcctcg

SEQ ID NO: 237541 - DNA, 75 bp, Artificial Sequence
  Synthetic
cgctcaggctgcttattctggcataaatatttctaaagatggaatacaagttggtgtggaaggcattgacactca

SEQ ID NO: 237542 - DNA, 75 bp, Artificial Sequence
  Synthetic
aatatttctaaagatggaatacaagttggtgtggaaggcattgacactcagcaaaaattgatatatgcagataaa

SEQ ID NO: 237543 - DNA, 75 bp, Artificial Sequence
  Synthetic
gagaaactcagtggaatgaaacggaaataacttatggagcaggaagggtactaaagaagaccactcccatgaggc

SEQ ID NO: 237544 - DNA, 75 bp, Artificial Sequence
  Synthetic
aataacttatggagcaggaagggtactaaagaagaccactcccatgaggccttgttatggttcttatgccaaacc

SEQ ID NO: 237545 - DNA, 75 bp, Artificial Sequence
  Synthetic
attcttgccgaacaaaatggcaaactggaaagtcaagtggaaatgcagttttactcttctaccaacactcccctt

SEQ ID NO: 237546 - DNA, 75 bp, Artificial Sequence
  Synthetic
tggaaagtcaagtggaaatgcagttttactcttctaccaacactccccttgtgaacggacaggaaaatcttactc

SEQ ID NO: 237547 - DNA, 75 bp, Artificial Sequence
  Synthetic
cgtagatctagaaacgccagacactcatatttcttacagacctggcgctcaagatgtaaattcccgagaaatgct

SEQ ID NO: 237548 - DNA, 75 bp, Artificial Sequence
  Synthetic
catatttcttacagacctggcgctcaagatgtaaattcccgagaaatgctgggccagcaggccatgcccaacaga

SEQ ID NO: 237549 - DNA, 75 bp, Artificial Sequence
  Synthetic
gcccagaaacgaccaccgccaccaccctacacacctccagcgatcagatgccgaccaacatcacccccttggctc

SEQ ID NO: 237550 - DNA, 75 bp, Artificial Sequence
  Synthetic
actttattggacttatgtactacaacagcacaggcaacatgggagtgctggcaggacaggcctcccagctgaacg

SEQ ID NO: 237551 - DNA, 75 bp, Artificial Sequence
  Synthetic
cagcacaggcaacatgggagtgctggcaggacaggcctcccagctgaacgctgtggtagacttgcaagacagaaa

SEQ ID NO: 237552 - DNA, 75 bp, Artificial Sequence
  Synthetic
cttgattccattggagacagatcaagatacttttccatgtggaaccaggcagtggacagctatgacccagatgtc

SEQ ID NO: 237553 - DNA, 75 bp, Artificial Sequence
  Synthetic
gatacttttccatgtggaaccaggcagtggacagctatgacccagatgtcagaattattgaaaaccacggtacag

SEQ ID NO: 237554 - DNA, 75 bp, Artificial Sequence
  Synthetic
ccaccatcctaaaccagctggccaaaacctgcccgccggctatacactgcagggaaccgggactggaacaatgac

SEQ ID NO: 237555 - DNA, 75 bp, Artificial Sequence
  Synthetic
ccctctaggaggaataattaacactgaaagttacagaaagataaaacttactgctggtcagaataatcaatggga

SEQ ID NO: 237556 - DNA, 75 bp, Artificial Sequence
  Synthetic
gaaagttacagaaagataaaacttactgctggtcagaataatcaatgggaaaaagatgacacttttgcagaaaag

SEQ ID NO: 237557 - DNA, 75 bp, Artificial Sequence
  Synthetic
ttgccatggagatcaatatccaggcaaacctgtggagaaacttcttgtattctaatgtggccctctacctgccag

SEQ ID NO: 237558 - DNA, 75 bp, Artificial Sequence
  Synthetic
aaacctgtggagaaacttcttgtattctaatgtggccctctacctgccagataagatgaagtattctccctccaa

SEQ ID NO: 237559 - DNA, 75 bp, Artificial Sequence
  Synthetic
gttttaatcaaagcttccttgagatttatcctctccatttacgtgtatgaacacctcagcctccagtaactctac

SEQ ID NO: 237560 - DNA, 75 bp, Artificial Sequence
  Synthetic
acctatgactacatgaacaaaagagtggtgcctccaggcctggtggactgctatgtcaatctgggggccaggtgg

SEQ ID NO: 237561 - DNA, 75 bp, Artificial Sequence
  Synthetic
tggtgcctccaggcctggtggactgctatgtcaatctgggggccaggtggtccctcgatgtgatggataacatga

SEQ ID NO: 237562 - DNA, 75 bp, Artificial Sequence
  Synthetic
gggcctgcgataccgttccatgcttttgggtaacggccgctacgtgcccttccacatccaggtgccccaaaagtt

SEQ ID NO: 237563 - DNA, 75 bp, Artificial Sequence
  Synthetic
ttgggtaacggccgctacgtgcccttccacatccaggtgccccaaaagttctttgccatcaaaagccttctactc

SEQ ID NO: 237564 - DNA, 75 bp, Artificial Sequence
  Synthetic
ggtacacaattctaaccatcctaggcctgctggccctggcggcctgcagcgccgccaccaaaaaagaggttacct

SEQ ID NO: 237565 - DNA, 75 bp, Artificial Sequence
  Synthetic
cctgctggccctggcggcctgcagcgccgccaccaaaaaagaggttacctttgaggagcccgcttgcaatgtaac

SEQ ID NO: 237566 - DNA, 75 bp, Artificial Sequence
  Synthetic
ggaatttcagaaaggatgtgaacatggtcctacagagctctctgggcaacgaccttagggtggatggggccagca

SEQ ID NO: 237567 - DNA, 75 bp, Artificial Sequence
  Synthetic
ggtcctacagagctctctgggcaacgaccttagggtggatggggccagcatcaaatttgacagcattgccctcta

SEQ ID NO: 237568 - DNA, 75 bp, Artificial Sequence
  Synthetic
accaccctggtcaaatgcgttaccaagcatgagaggttgcgcatcgactacaaaaacatgactggcaggtatgcg

SEQ ID NO: 237569 - DNA, 75 bp, Artificial Sequence
  Synthetic
gtctatagtatctttacgcccggagacccctctaactactctgtcaccgtctttgagggcggtcagtttaagaaa

SEQ ID NO: 237570 - DNA, 75 bp, Artificial Sequence
  Synthetic
agcaagagcgcctcaatcaggagctccgagatctcgttaacctgcaccagtgcaaaagaggcatcttttgtctgg

SEQ ID NO: 237571 - DNA, 75 bp, Artificial Sequence
  Synthetic
ccaacgctaccaacgtgcccatctccattccctctcgcaactgggctgccttcagaggctgggcatttacccgcc

SEQ ID NO: 237572 - DNA, 75 bp, Artificial Sequence
  Synthetic
gtcaaaacagtacaacctgtggccccccactccccaggcgtgtgtggaaaatactgggtctttctgctgtgtggc

SEQ ID NO: 237573 - DNA, 75 bp, Artificial Sequence
  Synthetic
gggctcgggttttgacccctactttgtctactcgggatccatcccctacctggatggcaccttctacctcaacca

SEQ ID NO: 237574 - DNA, 75 bp, Artificial Sequence
  Synthetic
tatgactcctctgtcagctggccgggcaacgaccgcctgctcacccccaatgagttcgaggtcaagcgcgccgtg

SEQ ID NO: 237575 - DNA, 75 bp, Artificial Sequence
  Synthetic
gtactccttcttcagaaacttccaacccatgagccggcaggtggtagatgaaactaaatacaaggactaccaggc

SEQ ID NO: 237576 - DNA, 75 bp, Artificial Sequence
  Synthetic
gattattaattactggcgaccccacaaggactacatgctgcatgtagtcgaggcagttcccactacctcccccac

SEQ ID NO: 237577 - DNA, 75 bp, Artificial Sequence
  Synthetic
cctgctctatgccaactccgcccatgcgctggacatgacttttgaggtggaccccatggacgagcccacccttct

SEQ ID NO: 237578 - DNA, 75 bp, Artificial Sequence
  Synthetic
gcgctggacatgacttttgaggtggaccccatggacgagcccacccttctctatattgtgtttgaagtgttcgac

SEQ ID NO: 237579 - DNA, 75 bp, Artificial Sequence
  Synthetic
atgcccagcagagctccgcttgcccggccccggcggctgtggagcccgttgccctgaagcagatcggtgattctt

SEQ ID NO: 237580 - DNA, 75 bp, Artificial Sequence
  Synthetic
gcggtgtcatcgagaccgtgtacctgcgtacgcccttctcagccggcaacgccaccacctaaggagacagcgccg

SEQ ID NO: 237581 - DNA, 75 bp, Artificial Sequence
  Synthetic
gccaccacctaaggagacagcgccgccgcctgcatgacgggttccaccgagcaagagctcagggccattgccaga

SEQ ID NO: 237582 - DNA, 75 bp, Artificial Sequence
  Synthetic
gcaagagctcagggccattgccagagacctgggatgcggaccctattttttgggcacctatgacaaacgcttccc

SEQ ID NO: 237583 - DNA, 75 bp, Artificial Sequence
  Synthetic
gcctgcgccatcgtcaacacggccgcgcgcgagaccgggggcgtgcactggctggcctttggctgggatccgcgc

SEQ ID NO: 237584 - DNA, 75 bp, Artificial Sequence
  Synthetic
cagcaccctcacagtcagtgccacaccaccccttagcacaagcaatggcagcttgggtattgacatgcaagcccc

SEQ ID NO: 237585 - DNA, 75 bp, Artificial Sequence
  Synthetic
cgcgcgagaccgggggcgtgcactggctggcctttggctgggatccgcgctccaaaacttgctacctctttgacc

SEQ ID NO: 237586 - DNA, 75 bp, Artificial Sequence
  Synthetic
tcgctgctgacactaaccgctttactagcctgcgctgctctaacccttgtcgcttgcgaatccagattccacaat

SEQ ID NO: 237587 - DNA, 75 bp, Artificial Sequence
  Synthetic
caggcagatctatgagtttgagtacgaggggctgctgcgccgcagcgcgctcgcctcctcgcccgaccgctgcat

SEQ ID NO: 237588 - DNA, 75 bp, Artificial Sequence
  Synthetic
caccctcgagaagtccaccgagaccgtgcagggaccccactcggccgcctgcggtctcttctgttgcatgtttct

SEQ ID NO: 237589 - DNA, 75 bp, Artificial Sequence
  Synthetic
tgacacatcaggaaacctagaattgagagctgcagggggtatgcgagttgatgcaaatggtcaacttatccttga

SEQ ID NO: 237590 - DNA, 75 bp, Artificial Sequence
  Synthetic
caagtaccaatgcaatgccaccctgttcaccctcatcaacgcctccaccctggacaatggactctatgtaggcta

SEQ ID NO: 237591 - DNA, 75 bp, Artificial Sequence
  Synthetic
cgtaccccccggtgggcaaggaaagacccacgcttacaacctggaagtgcgccagcccagaaccactacccagcc

SEQ ID NO: 237592 - DNA, 75 bp, Artificial Sequence
  Synthetic
acctacgatggcggtgtgctcaccggccagctggctgctgaggtcctggacaccctgatcgaggaggtattggct

SEQ ID NO: 237593 - DNA, 75 bp, Artificial Sequence
  Synthetic
aacagctttaccgcttcctggagcgccactccccctacttccgcagccacagcgcgcgcatccggggggccacct

SEQ ID NO: 237594 - DNA, 75 bp, Artificial Sequence
  Synthetic
gccagctggctgctgaggtcctggacaccctgatcgaggaggtattggctgataattatcctccctcgactcctt

SEQ ID NO: 237595 - DNA, 75 bp, Artificial Sequence
  Synthetic
agcagcagcagcaacagaagcagattcctgactttcattttggccagctcatccgccgccaccgctcagaccacc

SEQ ID NO: 237596 - DNA, 75 bp, Artificial Sequence
  Synthetic
gcaagacggaaaatgatgtacagcatgcttttaataaatgtaaagactgtgcactttatttatacacgggctctt

SEQ ID NO: 237597 - DNA, 75 bp, Artificial Sequence
  Synthetic
ctcaggctcagatacaaatccattaaaaactaaacttggattaggactggattatgactccagcagagccataat

SEQ ID NO: 237598 - DNA, 75 bp, Artificial Sequence
  Synthetic
taggcaacaaaaatgatgacaagctcaccttgtggaccacaccagacccatctcctaactgtagaatctattcag

SEQ ID NO: 237599 - DNA, 75 bp, Artificial Sequence
  Synthetic
caccaccatgcggggcagtggttcctcggggaagttctcgctccacagggtgcgggtcagctgcagcgcgctcag

SEQ ID NO: 237600 - DNA, 75 bp, Artificial Sequence
  Synthetic
tcggggaagttctcgctccacagggtgcgggtcagctgcagcgcgctcaggaggtcgggagccgagatcttgaag

SEQ ID NO: 237601 - DNA, 75 bp, Artificial Sequence
  Synthetic
cgcgcgagttgcggtacacggggttgcagcactggaacaccagcagggccggattattcacgctggccagcaggc

SEQ ID NO: 237602 - DNA, 75 bp, Artificial Sequence
  Synthetic
gcagcactggaacaccagcagggccggattattcacgctggccagcaggctctcgtcgctgatcatgtcgctgtc

SEQ ID NO: 237603 - DNA, 75 bp, Artificial Sequence
  Synthetic
aatggggtcatcttgcagacctgcctgcccaggaaaggcgggagcccaggcttgccgttgcagtcgcagcgcagg

SEQ ID NO: 237604 - DNA, 75 bp, Artificial Sequence
  Synthetic
cttatcccaccttttctggggtgttctacgctggccgctgtgtctcacctggaggtagactgtctccagcccttc

SEQ ID NO: 237605 - DNA, 75 bp, Artificial Sequence
  Synthetic
tgcccaggaaaggcgggagcccaggcttgccgttgcagtcgcagcgcaggggcattagcaggtgcccacggcccg

SEQ ID NO: 237606 - DNA, 75 bp, Artificial Sequence
  Synthetic
catgaaggcttcgatctgcctaaaagccacctgggtcttggctccctccgaaaagaacatcccacaggacttgct

SEQ ID NO: 237607 - DNA, 75 bp, Artificial Sequence
  Synthetic
gccacctgggtcttggctccctccgaaaagaacatcccacaggacttgctggagaactggttcgcgggacagctg

SEQ ID NO: 237608 - DNA, 75 bp, Artificial Sequence
  Synthetic
tggaatggaagtaattacattaatgaaacgttccaaaccaactccttcaccttctcctacatcgcccaagaataa

SEQ ID NO: 237609 - DNA, 75 bp, Artificial Sequence
  Synthetic
cagtgttggcgatctgcaccacgttgcgaccccaccggtttttcactatcttggccttggaagcctgctccttta

SEQ ID NO: 237610 - DNA, 75 bp, Artificial Sequence
  Synthetic
cttctcctacatcgcccaagaataaaaagcatgacgctgttgatttgattcaatgtgtttctgttttattttcaa

SEQ ID NO: 237611 - DNA, 75 bp, Artificial Sequence
  Synthetic
gcgaccccaccggtttttcactatcttggccttggaagcctgctcctttagcgcgcgctggccgttctcgctggt

SEQ ID NO: 237612 - DNA, 75 bp, Artificial Sequence
  Synthetic
ttgttgatcatgtttgtcccgtgcagacactttaggtcgccctccgtctgggtgcagcggtgctcccacagcgcg

SEQ ID NO: 237613 - DNA, 75 bp, Artificial Sequence
  Synthetic
cgcttcacccaactgtggaatatccccaaatgctacaacgaaaagagcgagctctccgaagcctggctgtatggg

SEQ ID NO: 237614 - DNA, 75 bp, Artificial Sequence
  Synthetic
gacactttaggtcgccctccgtctgggtgcagcggtgctcccacagcgcgcaaccggtgggctcccaattcttgt

SEQ ID NO: 237615 - DNA, 75 bp, Artificial Sequence
  Synthetic
gcactgtctttgccctgatgatctacccccacattgatttgggatggaacgcgatcgatgccatgagttacccca

SEQ ID NO: 237616 - DNA, 75 bp, Artificial Sequence
  Synthetic
gtaggcctgcaggaagcgccccatcatggtcataaaggtcttctggctcgtaaaggtcagctgcaggccgcgatg

SEQ ID NO: 237617 - DNA, 75 bp, Artificial Sequence
  Synthetic
gcgatcgatgccatgagttaccccacctttcccgcgcccgagatgattccactgcgacaggtcgtacccgttgtc

SEQ ID NO: 237618 - DNA, 75 bp, Artificial Sequence
  Synthetic
atggtcataaaggtcttctggctcgtaaaggtcagctgcaggccgcgatgctcttcgttcagccaggtcttgcag

SEQ ID NO: 237619 - DNA, 75 bp, Artificial Sequence
  Synthetic
cgggcagcatcttaaaatttgtcttcaggtcgttatccacgtggtacttgtccatcatggcacgcgccgcctcca

SEQ ID NO: 237620 - DNA, 75 bp, Artificial Sequence
  Synthetic
gaccggctgctggacaaacggaggccgcgcctacaagggggtagagtcataatcctcggtcaggatagggcggtg

SEQ ID NO: 237621 - DNA, 75 bp, Artificial Sequence
  Synthetic
gggcaggcttagggggtttatcacttccaccggcgaggacaccgtactttcgatttcttcttcctccccctcttc

SEQ ID NO: 237622 - DNA, 75 bp, Artificial Sequence
  Synthetic
ccggcgcgcgcccacgctgctgcgcgctttcaccgcctgcaccaaggggtcgttttcaggcaagcgccgcaccga

SEQ ID NO: 237623 - DNA, 75 bp, Artificial Sequence
  Synthetic
atcagcaccggcggattgctgaagcccaccatggtcagcgccgcctgctcttcttcgtcttcgctgtctaccact

SEQ ID NO: 237624 - DNA, 75 bp, Artificial Sequence
  Synthetic
atctctggggaagggcttctccgctctgcggcggcggcgcgcttcttttttttcttgggagcagccgtgatggag

SEQ ID NO: 237625 - DNA, 75 bp, Artificial Sequence
  Synthetic
cgcgcgaagacggcgtagttgcgcagacgctggaagaggtagttgagggtggtggcggtgtgctcggccacgaag

SEQ ID NO: 237626 - DNA, 75 bp, Artificial Sequence
  Synthetic
gcgtggggctgggggtacgcggtaccagggcctcgtcgccctcggactcttcctctgactccaggcggcggcgga

SEQ ID NO: 237627 - DNA, 75 bp, Artificial Sequence
  Synthetic
cagggcctcgtcgccctcggactcttcctctgactccaggcggcggcggagtcgcttctttgggggcgcgcgcgt

SEQ ID NO: 237628 - DNA, 75 bp, Artificial Sequence
  Synthetic
gacggggacgggacgccctccacagggggtggtcttcgcgcagacccgcggccgcgctcgggggtcttctcgcgc

SEQ ID NO: 237629 - DNA, 75 bp, Artificial Sequence
  Synthetic
ggggtggtcttcgcgcagacccgcggccgcgctcgggggtcttctcgcgctggtcttggtcccgactggccattg

SEQ ID NO: 237630 - DNA, 75 bp, Artificial Sequence
  Synthetic
tcggcgacggtgtcgcgcacctcgcgctcgaaggctatggggatctcttcctccgctagcatcaccacctcctcc

SEQ ID NO: 237631 - DNA, 75 bp, Artificial Sequence
  Synthetic
acataaggagtctatcatgcaagtcgagaaggaggagagcttaaccaccccctctgagaccgccgtcgccgtcgc

SEQ ID NO: 237632 - DNA, 75 bp, Artificial Sequence
  Synthetic
gagaaggaggagagcttaaccaccccctctgagaccgccgtcgccgtcgcccccgctgccgccgacgcgcccgcc

SEQ ID NO: 237633 - DNA, 75 bp, Artificial Sequence
  Synthetic
cccccgccgacgcacccctgttcgaggaagcggccgtggagcaggacccgggctttgtctcggcagaggaggatt

SEQ ID NO: 237634 - DNA, 75 bp, Artificial Sequence
  Synthetic
ggaagcggccgtggagcaggacccgggctttgtctcggcagaggaggatttgcaagaggaggagaataaggagga

SEQ ID NO: 237635 - DNA, 75 bp, Artificial Sequence
  Synthetic
aaagagcaagacgagcacgacgcagacgcacaccagggtgaagtcgggcggggggacggagggcatggcggcgcc

SEQ ID NO: 237636 - DNA, 75 bp, Artificial Sequence
  Synthetic
acgcacaccagggtgaagtcgggcggggggacggagggcatggcggcgccgactacctagacgaaggaaacgacg

SEQ ID NO: 237637 - DNA, 75 bp, Artificial Sequence
  Synthetic
gtgcgccatcgtctgcgacgctctgcaggagcgcagcgaggtgcccctcagcgtggcggaggtcagccgcgccta

SEQ ID NO: 237638 - DNA, 75 bp, Artificial Sequence
  Synthetic
gggccccctgaccgtgtctgaaggcaaactggccttgcagacctcggccccgctgacggccgctgacagcagcac

SEQ ID NO: 237639 - DNA, 75 bp, Artificial Sequence
  Synthetic
caggagcgcagcgaggtgcccctcagcgtggcggaggtcagccgcgcctacgagctcagcctcttttccccccgg

SEQ ID NO: 237640 - DNA, 75 bp, Artificial Sequence
  Synthetic
cctcaccgtcagcgccacaccgccccttagcacaagcaatggcagcttgggtattgacatgcaagcccccattta

SEQ ID NO: 237641 - DNA, 75 bp, Artificial Sequence
  Synthetic
gcacatgcgagcccaacccgcgcctcaacttctaccccgcctttgtggtgcccgaggtcctggccacctatcaca

SEQ ID NO: 237642 - DNA, 75 bp, Artificial Sequence
  Synthetic
caacttctaccccgcctttgtggtgcccgaggtcctggccacctatcacatcttctttcaaaattgcaagatccc

SEQ ID NO: 237643 - DNA, 75 bp, Artificial Sequence
  Synthetic
aactttggcgctcccctgcatgtggtagacagcctaaatgcactgactgtagtgactggccaaggtcttacgata

SEQ ID NO: 237644 - DNA, 75 bp, Artificial Sequence
  Synthetic
cgcgccgataagatgctggccctgcgccagggcgaccacatacctgatatcgccgctttggaagatgtgccaaag

SEQ ID NO: 237645 - DNA, 75 bp, Artificial Sequence
  Synthetic
tctcaggtgccctcaactatgactcatcaggaaacctagaattgagagctgcagggggtatgcgagttgatgcaa

SEQ ID NO: 237646 - DNA, 75 bp, Artificial Sequence
  Synthetic
gccagggcgaccacatacctgatatcgccgctttggaagatgtgccaaagatcttcgagggtctggggcgcaacg

SEQ ID NO: 237647 - DNA, 75 bp, Artificial Sequence
  Synthetic
atcaggaaacctagaattgagagctgcagggggtatgcgagttgatgcaaatggcaaacttatccttgacgtagc

SEQ ID NO: 237648 - DNA, 75 bp, Artificial Sequence
  Synthetic
acaggaaaacagcgaaaatgagagtcacactggagcgctggtggagctcgagggcgacaacgcccgcctggcggt

SEQ ID NO: 237649 - DNA, 75 bp, Artificial Sequence
  Synthetic
ctcagccttagacttggacagggacccctgtttgttaactctgcccacaacttggatgttaactacaacagaggc

SEQ ID NO: 237650 - DNA, 75 bp, Artificial Sequence
  Synthetic
cacactggagcgctggtggagctcgagggcgacaacgcccgcctggcggtgctcaagcgcagcatcgaggtcacc

SEQ ID NO: 237651 - DNA, 75 bp, Artificial Sequence
  Synthetic
tgccccccaaagtcatgaacgcggtcatggacgggctgatcatgcgccgcggccagcccctcgctccagatgcaa

SEQ ID NO: 237652 - DNA, 75 bp, Artificial Sequence
  Synthetic
catggacgggctgatcatgcgccgcggccagcccctcgctccagatgcaaacttgcatgaggagaccgaggacgg

SEQ ID NO: 237653 - DNA, 75 bp, Artificial Sequence
  Synthetic
gcgatgggctagagtttggctcaggctcagatacaaatccattaaaaactaaacttggattgggactagagtatg

SEQ ID NO: 237654 - DNA, 75 bp, Artificial Sequence
  Synthetic
ctgacgcgctggctggagaacgcggaccccgccgaactggaggagcggcgcaagatgatgatggccgcggtgctg

SEQ ID NO: 237655 - DNA, 75 bp, Artificial Sequence
  Synthetic
accccgccgaactggaggagcggcgcaagatgatgatggccgcggtgctggtcaccgtagagctggagtgtctgc

SEQ ID NO: 237656 - DNA, 75 bp, Artificial Sequence
  Synthetic
acaacaatgatgacaagcttaccttgtggaccacaccagacccctctcccaactgtagaatttattcagaaaaag

SEQ ID NO: 237657 - DNA, 75 bp, Artificial Sequence
  Synthetic
gcagagaaaggtcgaggagaccctacactacaccttccgccagggctacgtgcgccaggcttgcaagatctccaa

SEQ ID NO: 237658 - DNA, 75 bp, Artificial Sequence
  Synthetic
taaatgcggcagtcaggtgttggccagcgtttctgttttatctgtaaaaggcagccttgcgcccatcagtggcac

SEQ ID NO: 237659 - DNA, 75 bp, Artificial Sequence
  Synthetic
tacctgggcatcttgcatgagaaccgccttgggcagagcgtgctacactccaccctgcgcggggaggcgcgccgc

SEQ ID NO: 237660 - DNA, 75 bp, Artificial Sequence
  Synthetic
tcttcctctgctacacctggcagacggccatgggggtctggcagcagtgcctggaggagcgcaacctcaaggagc

SEQ ID NO: 237661 - DNA, 75 bp, Artificial Sequence
  Synthetic
taagcaattcttctcttgacccccaatactggaactacagaaaaggtgaccttacagagggcactgcatatacca

SEQ ID NO: 237662 - DNA, 75 bp, Artificial Sequence
  Synthetic
attaattaacttaaacattggaagcctgtctcacaacaggaaaaaccactttaatcaacataagacgggccacgg

SEQ ID NO: 237663 - DNA, 75 bp, Artificial Sequence
  Synthetic
cttacagagggcactgcatataccaacgcagtgggatttatgcccaacctcacagcatacccaaaaacacagagt

SEQ ID NO: 237664 - DNA, 75 bp, Artificial Sequence
  Synthetic
gagcgctcggtggccgccgcgctagccgacctcatcttccccgagcgcctgctcaaaaccctccagcaggggctg

SEQ ID NO: 237665 - DNA, 75 bp, Artificial Sequence
  Synthetic
gccaggtttacttgaatggggacaaatccaaacccatgatcctcaccattaccctcaatggaactaatgaaacag

SEQ ID NO: 237666 - DNA, 75 bp, Artificial Sequence
  Synthetic
ccgacctcatcttccccgagcgcctgctcaaaaccctccagcaggggctgcccgacttcaccagccaaagcatgt

SEQ ID NO: 237667 - DNA, 75 bp, Artificial Sequence
  Synthetic
ggagcgttctggcatcctacccgccacctgctgcgccctgcccagcgactttgtccccctcgtgtaccgcgagtg

SEQ ID NO: 237668 - DNA, 75 bp, Artificial Sequence
  Synthetic
acctgctgcgccctgcccagcgactttgtccccctcgtgtaccgcgagtgccccccgccgctgtggggccactgc

SEQ ID NO: 237669 - DNA, 75 bp, Artificial Sequence
  Synthetic
catgtcattctcatggaattggaatggaagtaattacattaatgaaacgttccaaaccaactctttcaccttctc

SEQ ID NO: 237670 - DNA, 75 bp, Artificial Sequence
  Synthetic
atgacgctgttgtttgattcaatgtgtttctgtttttatttttcaagcacaacaaaatcattttcaagtcatttt

SEQ ID NO: 237671 - DNA, 75 bp, Artificial Sequence
  Synthetic
tgtcctaccacgcggacctcatggaagactccagcggcgaggggctcatggagtgccactgccgctgcaacctct

SEQ ID NO: 237672 - DNA, 75 bp, Artificial Sequence
  Synthetic
agactccagcggcgaggggctcatggagtgccactgccgctgcaacctctgcacgccccaccgctccctggtctg

SEQ ID NO: 237673 - DNA, 75 bp, Artificial Sequence
  Synthetic
acagcagcgggagtcatgcagggccccctcacccaccctcggcggcccggccacctcggcgtccgcggccgtgtc

SEQ ID NO: 237674 - DNA, 75 bp, Artificial Sequence
  Synthetic
cagattatcggtaccttcgagctacagggtccgtcctcctcagacgagaagtccgcggctccggggctaaaactc

SEQ ID NO: 237675 - DNA, 75 bp, Artificial Sequence
  Synthetic
tcatcatcacaggatcctagtcgtcaggccgccccctccctcccaagacacagaatacacagtcctctccccccg

SEQ ID NO: 237676 - DNA, 75 bp, Artificial Sequence
  Synthetic
aggccgccccctccctcccaagacacagaatacacagtcctctccccccgactggctttaaacaacaccatctgg

SEQ ID NO: 237677 - DNA, 75 bp, Artificial Sequence
  Synthetic
aggcggagctgaccgcctgcgtcatcacccagggcgagatcctaggccaattgcaagccatccaaaaagcccgcc

SEQ ID NO: 237678 - DNA, 75 bp, Artificial Sequence
  Synthetic
gggggtgtatctggacccccagtcgggtgaggagctcaacccggttcccccgctgccgccgccgcgggaccttgc

SEQ ID NO: 237679 - DNA, 75 bp, Artificial Sequence
  Synthetic
ttcccaggataagcatcgccatggctcccagaaagaagcagcagcggccgccactgccgccaccccacacgctgg

SEQ ID NO: 237680 - DNA, 75 bp, Artificial Sequence
  Synthetic
tcctccgcgataatccgcaccgcccgcagcatcagcttcctcgttctccgcgcgcagcaccgcaccctgatctcg

SEQ ID NO: 237681 - DNA, 75 bp, Artificial Sequence
  Synthetic
tcaggcagaggaggtttcggacgaggaggagccggagacggagatggaagagtgggaggaggacagcttagacga

SEQ ID NO: 237682 - DNA, 75 bp, Artificial Sequence
  Synthetic
gaggagccggagacggagatggaagagtgggaggaggacagcttagacgaggaggcttccgaagccgaagaggca

SEQ ID NO: 237683 - DNA, 75 bp, Artificial Sequence
  Synthetic
cagccccctcgcaggcgcccccgaagtccgctcccagcatcagcagcaacagcagcgctataacctccgctcctc

SEQ ID NO: 237684 - DNA, 75 bp, Artificial Sequence
  Synthetic
atgaacgtgctggccatatacatcacttccttgggcatgttgtaattcaccacctcccgataccagataaacctc

SEQ ID NO: 237685 - DNA, 75 bp, Artificial Sequence
  Synthetic
cagacccaaccgtagatgggacaccaccggaaccggggccggtaagtcctccgggagaggcaagcaagcgcagcg

SEQ ID NO: 237686 - DNA, 75 bp, Artificial Sequence
  Synthetic
ctgcccaccggctatgcactgcagggaacccgggttggaacaatgacaatgcagactccagggctcgtaaccgtg

SEQ ID NO: 237687 - DNA, 75 bp, Artificial Sequence
  Synthetic
tgcaagactgcggggggaacatctccttcgcccgccgcttcctgctcttccaccacggtgtggccttcccccgta

SEQ ID NO: 237688 - DNA, 75 bp, Artificial Sequence
  Synthetic
ctacagcccctactgcggcggcagtgagccagaggcggccggcggcagcggcgcccgtttcggtgcctaggaaga

SEQ ID NO: 237689 - DNA, 75 bp, Artificial Sequence
  Synthetic
gagccagaggcggccggcggcagcggcgcccgtttcggtgcctaggaagacccagggcaagacttcagccaagaa

SEQ ID NO: 237690 - DNA, 75 bp, Artificial Sequence
  Synthetic
gtcgcgggggccctgcgcctgacggtgaacgaacccctgtcgacccgcgaactgaggaaccgaatcttccccact

SEQ ID NO: 237691 - DNA, 75 bp, Artificial Sequence
  Synthetic
ctctatgccatcttccagcagagcagagggcaggatcaggaactgaaagtaaaaaacaggtctctgcgctccctc

SEQ ID NO: 237692 - DNA, 75 bp, Artificial Sequence
  Synthetic
agcgccgccgtcatgagcaaggacattcccacgccatacatgtggagctatcagccgcagatgggactcgcggcg

SEQ ID NO: 237693 - DNA, 75 bp, Artificial Sequence
  Synthetic
ttcccacgccatacatgtggagctatcagccgcagatgggactcgcggcgggcgcctcccaggattactccaccc

SEQ ID NO: 237694 - DNA, 75 bp, Artificial Sequence
  Synthetic
acacatgatctcacaggttaatgacatccgcacccatcgaaaccaaatattggtggagcaggcggcaattaccac

SEQ ID NO: 237695 - DNA, 75 bp, Artificial Sequence
  Synthetic
atccgcacccatcgaaaccaaatattggtggagcaggcggcaattaccaccacgccccgcaataatcccaacccc

SEQ ID NO: 237696 - DNA, 75 bp, Artificial Sequence
  Synthetic
aagatctatcaagtggcagcgctcccctccactggcgcggtcaaactctacggccaaagcacagataacggcatt

SEQ ID NO: 237697 - DNA, 75 bp, Artificial Sequence
  Synthetic
cctccactggcgcggtcaaactctacggccaaagcacagataacggcatttctaagatgttccttaacggcatcc

SEQ ID NO: 237698 - DNA, 75 bp, Artificial Sequence
  Synthetic
atcaggaaattcccggccccaccaccgtactacttccgcgtgattcccaggccgaagtccaaatgactaactcag

SEQ ID NO: 237699 - DNA, 75 bp, Artificial Sequence
  Synthetic
cgtactacttccgcgtgattcccaggccgaagtccaaatgactaactcaggggcacagctcgcgggcggctgtcg

SEQ ID NO: 237700 - DNA, 75 bp, Artificial Sequence
  Synthetic
aataaactattaatgaaaacccatccggctgattgtccaatatagacccgccggcggcgtccaccaaacccagat

SEQ ID NO: 237701 - DNA, 75 bp, Artificial Sequence
  Synthetic
ggtataactcacctggagatccgaggcagaggtattcagctcaacgacgagtcggtgagctcctcgctcggtctc

SEQ ID NO: 237702 - DNA, 75 bp, Artificial Sequence
  Synthetic
ccggcggcgtccaccaaacccagataattttcgtctctccagcgatttaaaatctgtctaagcaaatcccttatg

SEQ ID NO: 237703 - DNA, 75 bp, Artificial Sequence
  Synthetic
gcagaggtattcagctcaacgacgagtcggtgagctcctcgctcggtctcagacctgacgggaccttccagatag

SEQ ID NO: 237704 - DNA, 75 bp, Artificial Sequence
  Synthetic
gccccgccaggcgtacctaactctgcagagctcgtcctcggcgccgcgctcgggcggcatcgggactctccagtt

SEQ ID NO: 237705 - DNA, 75 bp, Artificial Sequence
  Synthetic
cagagctcgtcctcggcgccgcgctcgggcggcatcgggactctccagttcgtgcaggagtttgtgccctcggtc

SEQ ID NO: 237706 - DNA, 75 bp, Artificial Sequence
  Synthetic
ccggtcgctacccggaccagttcatcccgaactttgacgccgcgagggactcggtggacggctacgactgaatgt

SEQ ID NO: 237707 - DNA, 75 bp, Artificial Sequence
  Synthetic
ggtcgcaggggcaacgtgtactgggtgcgcgactcggttagcggcctgcgcgtgcccgtgcgcacccgccccccg

SEQ ID NO: 237708 - DNA, 75 bp, Artificial Sequence
  Synthetic
cccgaactttgacgccgcgagggactcggtggacggctacgactgaatgtcgggtggacccggtgcagagcaact

SEQ ID NO: 237709 - DNA, 75 bp, Artificial Sequence
  Synthetic
cgccgccctcagtgctttgcccgctgtcagaccggtgagttccagtatttttccctgcccgactcgcacccggac

SEQ ID NO: 237710 - DNA, 75 bp, Artificial Sequence
  Synthetic
gtcagaccggtgagttccagtatttttccctgcccgactcgcacccggacggcccggcgcacggggtgcgctttt

SEQ ID NO: 237711 - DNA, 75 bp, Artificial Sequence
  Synthetic
cctaatcagggagttcaccgcccgtcccctactggcggagttggaaaaggggccttctatcctaaccattgcctg

SEQ ID NO: 237712 - DNA, 75 bp, Artificial Sequence
  Synthetic
cccctactggcggagttggaaaaggggccttctatcctaaccattgcctgcatctgctctaaccctggattacac

SEQ ID NO: 237713 - DNA, 75 bp, Artificial Sequence
  Synthetic
aattaattaaatatcttaaatatcagaagcctgtcttacaacaggaaaaaccactctgattaacataagacgagc

SEQ ID NO: 237714 - DNA, 75 bp, Artificial Sequence
  Synthetic
ctgagtataataaaggctgagatcagaatctactcgggctcctgtcgccatcctgtcaacgccaccgtccaagcc

SEQ ID NO: 237715 - DNA, 75 bp, Artificial Sequence
  Synthetic
gaatctactcgggctcctgtcgccatcctgtcaacgccaccgtccaagcccggcccgatcagcccgaggtgaacc

SEQ ID NO: 237716 - DNA, 75 bp, Artificial Sequence
  Synthetic
aaaaattggtccccgtgatttacaagtaccacagacagctccccggtcatgtcgggggtcatcatgtgagactgt

SEQ ID NO: 237717 - DNA, 75 bp, Artificial Sequence
  Synthetic
aaggaaatacctagcttggtactacaacagcactccctttgtggtttacaacagctttgaccaggacggggtctc

SEQ ID NO: 237718 - DNA, 75 bp, Artificial Sequence
  Synthetic
gtatacacgtctgggttgttaacatcagacagagaaagaaatcggcctatgtagcccggaggtataatcacccgc

SEQ ID NO: 237719 - DNA, 75 bp, Artificial Sequence
  Synthetic
aacagcactccctttgtggtttacaacagctttgaccaggacggggtctcactgagggataacctctcgaacctg

SEQ ID NO: 237720 - DNA, 75 bp, Artificial Sequence
  Synthetic
ccctcgagctacttcctccttacctgcccgggacttaccagtgtgtcaccggtccctgcacccacacccacctgt

SEQ ID NO: 237721 - DNA, 75 bp, Artificial Sequence
  Synthetic
gcccgggacttaccagtgtgtcaccggtccctgcacccacacccacctgttgatcgtaaacgactctcttccgag

SEQ ID NO: 237722 - DNA, 75 bp, Artificial Sequence
  Synthetic
tgcgggagaaaaacctgccccccgccttccccaacaacgggatagagagcctggtggacaagatgagcagatgga

SEQ ID NO: 237723 - DNA, 75 bp, Artificial Sequence
  Synthetic
cagttccccagaacaggaggtgagctcaggaaaccccgggtaaagaagggtggacaagagttaacacttgtgggg

SEQ ID NO: 237724 - DNA, 75 bp, Artificial Sequence
  Synthetic
tggacaagagttaacacttgtggggtttctggtgtatgtgacgctggtggtggctcttttgattaaggcttttcc

SEQ ID NO: 237725 - DNA, 75 bp, Artificial Sequence
  Synthetic
ttttatgaacaactcgactagtgctaacgggaccctacccaacgaatcgggattgaatatcggtaaccaggttgc

SEQ ID NO: 237726 - DNA, 75 bp, Artificial Sequence
  Synthetic
aacgggaccctacccaacgaatcgggattgaatatcggtaaccaggttgcagtttcacttttgattaccttcata

SEQ ID NO: 237727 - DNA, 75 bp, Artificial Sequence
  Synthetic
agacactcccttccggcgtcaacttccgctttcccacgctacgtcacttccccggtcaaacaaactacatttccc

SEQ ID NO: 237728 - DNA, 75 bp, Artificial Sequence
  Synthetic
ttctgtgcctgcggatcgggggctgctgcatccacgtttatatctggtgctggctgtttagaaggttcggagacc

SEQ ID NO: 237729 - DNA, 75 bp, Artificial Sequence
  Synthetic
acaccgcccacacctccccgcccgccggcccgccccgcgccccgcctcccgccccgcgtcacatcccgctccgcc

SEQ ID NO: 237730 - DNA, 75 bp, Artificial Sequence
  Synthetic
gccccgcgtcacatcccgctccgcccacctcattatcatattggcttcaatccaaaataaggtatattattgatg

SEQ ID NO: 237731 - DNA, 75 bp, Artificial Sequence
  Synthetic
ctgcatccacgtttatatctggtgctggctgtttagaaggttcggagaccaccgcaggtagaataatgctgctta

SEQ ID NO: 237732 - DNA, 75 bp, Artificial Sequence
  Synthetic
cagctgccaagccttttccgaggctgactttatagagccccagtgcaatatcacttataaatctgaacgtgccat

SEQ ID NO: 237733 - DNA, 75 bp, Artificial Sequence
  Synthetic
gactttatagagccccagtgcaatatcacttataaatctgaacgtgccatctgtactattctaatcaaatgtgtt

SEQ ID NO: 237734 - DNA, 75 bp, Artificial Sequence
  Synthetic
aatacaaagatcaatcaaaaaaagacgcactttacagcagctggcaaccaggagatgatcaaaaatacaatgtaa

SEQ ID NO: 237735 - DNA, 75 bp, Artificial Sequence
  Synthetic
cgcactttacagcagctggcaaccaggagatgatcaaaaatacaatgtaaccgtcttccagggcaaactctccaa

SEQ ID NO: 237736 - DNA, 75 bp, Artificial Sequence
  Synthetic
gagcagatgtgtgactttgtcatgtacatggaaaagcagtacaagctgtggcctccaactccccagggctgtgtg

SEQ ID NO: 237737 - DNA, 75 bp, Artificial Sequence
  Synthetic
acatggaaaagcagtacaagctgtggcctccaactccccagggctgtgtggaaaatccaggctctttctgtatga

SEQ ID NO: 237738 - DNA, 75 bp, Artificial Sequence
  Synthetic
actaatactcacgcttctgtatctcagatttaaatcaaggcaaagctttattgatgaaaagaaaatgccataatc

SEQ ID NO: 237739 - DNA, 75 bp, Artificial Sequence
  Synthetic
agatttaaatcaaggcaaagctttattgatgaaaagaaaatgccataatcgctttcacgcttgattgctaacacc

SEQ ID NO: 237740 - DNA, 75 bp, Artificial Sequence
  Synthetic
aatcaccctactaatcacctccctccttgcgattgcccatgggttggaacgaatcgaagtccctgtgggggccaa

SEQ ID NO: 237741 - DNA, 75 bp, Artificial Sequence
  Synthetic
cttgcgattgcccatgggttggaacgaatcgaagtccctgtgggggccaatgttaccctggtggggcctgtcggc

SEQ ID NO: 237742 - DNA, 75 bp, Artificial Sequence
  Synthetic
atactaaaaatcaatgggtttcttactgcactaacaaaaacagccacaagcccagagccatctgcgatgggcaaa

SEQ ID NO: 237743 - DNA, 75 bp, Artificial Sequence
  Synthetic
ctgcactaacaaaaacagccacaagcccagagccatctgcgatgggcaaaatctaaccttgattgatgttcaatt

SEQ ID NO: 237744 - DNA, 75 bp, Artificial Sequence
  Synthetic
cagctgggtacaatgattaattactggagaccccacagagattacatgcttcacgtagtaaagggtcccattagc

SEQ ID NO: 237745 - DNA, 75 bp, Artificial Sequence
  Synthetic
ggagaccccacagagattacatgcttcacgtagtaaagggtcccattagcagcccaaccaccacctctaccacac

SEQ ID NO: 237746 - DNA, 75 bp, Artificial Sequence
  Synthetic
cagcactgccgcccagcctcctcatagcagaacaaccacttttatcaattccaagtcccactccccccacattgc

SEQ ID NO: 237747 - DNA, 75 bp, Artificial Sequence
  Synthetic
gagaccaccgagatctgcttctgcaaatgctctgacgccattgcccaggatttggaagatcacgaggaagatgag

SEQ ID NO: 237748 - DNA, 75 bp, Artificial Sequence
  Synthetic
catcagaggcagaagcgctaccggtggccctaaaacagtatgcagacccccacaccacccccgaccttcctccac

SEQ ID NO: 237749 - DNA, 75 bp, Artificial Sequence
  Synthetic
ggccctaaaacagtatgcagacccccacaccacccccgaccttcctccaccttcccagaagccaagtttcctggg

SEQ ID NO: 237750 - DNA, 75 bp, Artificial Sequence
  Synthetic
atactagctctgacatctgttgctattttggccgctctgctggtgcttctatgctctatatgctacctgatctgc

SEQ ID NO: 237751 - DNA, 75 bp, Artificial Sequence
  Synthetic
ttttggccgctctgctggtgcttctatgctctatatgctacctgatctgctgcagaaagaaaaaatctcacggcc

SEQ ID NO: 237752 - DNA, 75 bp, Artificial Sequence
  Synthetic
cccttaccctccagagctgggcgaccacaaactttaagtctgcagtagctatctgcccatcccttgtcagtcgac

SEQ ID NO: 237753 - DNA, 75 bp, Artificial Sequence
  Synthetic
cacaaactttaagtctgcagtagctatctgcccatcccttgtcagtcgacagcgatgagccccactaatctaaca

SEQ ID NO: 237754 - DNA, 75 bp, Artificial Sequence
  Synthetic
ttaatgagaccaccgctcctcaagacctgtacgatggtgtctccgcgctggttaaccagtgggatcacctgggca

SEQ ID NO: 237755 - DNA, 75 bp, Artificial Sequence
  Synthetic
cctgtacgatggtgtctccgcgctggttaaccagtgggatcacctgggcatatggtggctcctcataggagcagt

SEQ ID NO: 237756 - DNA, 75 bp, Artificial Sequence
  Synthetic
atcatctgctgcatcaaaagcagaagacccaggcggcggcccatctacaggcccttcgtcatcacacctgaagat

SEQ ID NO: 237757 - DNA, 75 bp, Artificial Sequence
  Synthetic
actgacgccagacgccgcacctgcccctacgtttacaaggccttgggcatagtctcgccgcgcgtcctttccagc

SEQ ID NO: 237758 - DNA, 75 bp, Artificial Sequence
  Synthetic
tgcagaggctaaagcagctactcttctcttttacagcatggtaaattgaatcatgccccgcattttcatctactt

SEQ ID NO: 237759 - DNA, 75 bp, Artificial Sequence
  Synthetic
ctcttttacagcatggtaaattgaatcatgccccgcattttcatctacttgcttctccttccactttttctgggc

SEQ ID NO: 237760 - DNA, 75 bp, Artificial Sequence
  Synthetic
tcatgccccgcattttcatctacttgcttctccttccactttttctgggctcctctacattggccgctgtgtccc

SEQ ID NO: 237761 - DNA, 75 bp, Artificial Sequence
  Synthetic
cttcacagtctacctgcttttcggctttgtcatctgcacctttgtctgcagcgttatcactgtagtgatctgctt

SEQ ID NO: 237762 - DNA, 75 bp, Artificial Sequence
  Synthetic
tttgtcatctgcacctttgtctgcagcgttatcactgtagtgatctgcttcatacagtgcatcgactacatctgt

SEQ ID NO: 237763 - DNA, 75 bp, Artificial Sequence
  Synthetic
acccccagtatcgcaacagggacatagcggctctcctaagacttgtttaaatcatggccaaattaactgtgattg

SEQ ID NO: 237764 - DNA, 75 bp, Artificial Sequence
  Synthetic
agcggctctcctaagacttgtttaaatcatggccaaattaactgtgattggtcttctgattatctgctgcgtcct

SEQ ID NO: 237765 - DNA, 75 bp, Artificial Sequence
  Synthetic
aataccaccaccagcgctcccagaaagagacatgtatcctgcagcttcaagcgtccctggaatataccccaatgc

SEQ ID NO: 237766 - DNA, 75 bp, Artificial Sequence
  Synthetic
agagacatgtatcctgcagcttcaagcgtccctggaatataccccaatgctttactgatgaacctgaaatctctt

SEQ ID NO: 237767 - DNA, 75 bp, Artificial Sequence
  Synthetic
ccttctcatcttctgcagtacggttattgctcttgccatctacccttcccttaacctgggctggaatgctgtcaa

SEQ ID NO: 237768 - DNA, 75 bp, Artificial Sequence
  Synthetic
attgctcttgccatctacccttcccttaacctgggctggaatgctgtcaactctatggaatatcccaccttccca

SEQ ID NO: 237769 - DNA, 75 bp, Artificial Sequence
  Synthetic
ttctaaacgcgtttcctcctcctccagttcaaaatcagtttcgccctccgtcccctacgcccactgaggtcagct

SEQ ID NO: 237770 - DNA, 75 bp, Artificial Sequence
  Synthetic
agttcaaaatcagtttcgccctccgtcccctacgcccactgaggtcagctactttaatctaacaggcggagatga

SEQ ID NO: 237771 - DNA, 75 bp, Artificial Sequence
  Synthetic
cggtctctgcagcgagcaacgcacactagagaggcgccggcaaaaagcagagctcgagcgtcttaaacaagagct

SEQ ID NO: 237772 - DNA, 75 bp, Artificial Sequence
  Synthetic
ctagagaggcgccggcaaaaagcagagctcgagcgtcttaaacaagagctccaagacgcggtggccatacaccag

SEQ ID NO: 237773 - DNA, 75 bp, Artificial Sequence
  Synthetic
tgaaacaggccacgctcacctatgaaaaaacaggtgacacccaccgcctaggatacaagctgcccacacaacgcc

SEQ ID NO: 237774 - DNA, 75 bp, Artificial Sequence
  Synthetic
acaacccatcaccgtcacccagcactctgtggagacagaaggctgcatacacgctccctgcaggggcgctgactg

SEQ ID NO: 237775 - DNA, 75 bp, Artificial Sequence
  Synthetic
tctgtggagacagaaggctgcatacacgctccctgcaggggcgctgactgtctctacaccttgatcaaaaccctc

SEQ ID NO: 237776 - DNA, 75 bp, Artificial Sequence
  Synthetic
tcaattgatcataactgtaatcaataaaaaatcacttacttgaaatctgatagcaagcctttgtccaattttttc

SEQ ID NO: 237777 - DNA, 75 bp, Artificial Sequence
  Synthetic
agcaacacttccttcccctcttcccaactctggtactctaggcgcctcctagctgcaaacttcctccacagtctg

SEQ ID NO: 237778 - DNA, 75 bp, Artificial Sequence
  Synthetic
catcagggtccgccccatcaagcaggtggcgccgggcctcggcgtgcagaccgtggacgtggtcatccccaccgg

SEQ ID NO: 237779 - DNA, 75 bp, Artificial Sequence
  Synthetic
gtccctccgcacccacgatcttcatgttgttacagatgaaacgcgcgagatcgtctgacgagaccttcaaccccg

SEQ ID NO: 237780 - DNA, 75 bp, Artificial Sequence
  Synthetic
gttgttacagatgaaacgcgcgagatcgtctgacgagaccttcaaccccgtgtacccctacgataccgagatcgc

SEQ ID NO: 237781 - DNA, 75 bp, Artificial Sequence
  Synthetic
cctccctttgtgtcccccgcaggaatgcaagaaaatccagctggggtgctgtccctgcacctgtcagagcccctt

SEQ ID NO: 237782 - DNA, 75 bp, Artificial Sequence
  Synthetic
tgcaagaaaatccagctggggtgctgtccctgcacctgtcagagccccttaccacccacaatggggccctgactc

SEQ ID NO: 237783 - DNA, 75 bp, Artificial Sequence
  Synthetic
ggacaaggaagggaatctcacttcccaaaacatcaccagtgtcgatccccctctcaaaaaaagtaagaacaacat

SEQ ID NO: 237784 - DNA, 75 bp, Artificial Sequence
  Synthetic
caaaacatcaccagtgtcgatccccctctcaaaaaaagtaagaacaacatcagcctccagaccgccgcacccctc

SEQ ID NO: 237785 - DNA, 75 bp, Artificial Sequence
  Synthetic
tttttgccactccccccctagcggtcagtggtgacaaccttactgtgcagtctcaggcccctctcactttggaag

SEQ ID NO: 237786 - DNA, 75 bp, Artificial Sequence
  Synthetic
cgccgccgcagacgccagcccgcactggctccagtctccgtgaggagagtggcgcgcgacggacacaccctggtg

SEQ ID NO: 237787 - DNA, 75 bp, Artificial Sequence
  Synthetic
tctcaggcccctctcactttggaagactcaaaactaactctggccaccaaaggacccctaactgtgtccgaaggc

SEQ ID NO: 237788 - DNA, 75 bp, Artificial Sequence
  Synthetic
ccctgcatgcaagtgacagcagcagcctgggccttagcgtcacggccccacttagcattaacaatgacagcctag

SEQ ID NO: 237789 - DNA, 75 bp, Artificial Sequence
  Synthetic
cctgggccttagcgtcacggccccacttagcattaacaatgacagcctaggactagatctgcaggcacccattgt

SEQ ID NO: 237790 - DNA, 75 bp, Artificial Sequence
  Synthetic
aatatagcaggccccctagctgtagccgatagcattaatgctttgacagtaggcactggcaaaggtattggacta

SEQ ID NO: 237791 - DNA, 75 bp, Artificial Sequence
  Synthetic
ccgatagcattaatgctttgacagtaggcactggcaaaggtattggactaaatgaaaccagcactcacttgcaag

SEQ ID NO: 237792 - DNA, 75 bp, Artificial Sequence
  Synthetic
tgataccaatggcaatattaagctaagcgttgcaggaggcatgaggctaaacaatgacacactgatactagatgt

SEQ ID NO: 237793 - DNA, 75 bp, Artificial Sequence
  Synthetic
taaaaaagtctagactctcacgctcgcttggtcctgtgactattttgtagaatggaagacatcaactttgcgtcg

SEQ ID NO: 237794 - DNA, 75 bp, Artificial Sequence
  Synthetic
aaactacccatttgaagctcaaggtcaactaagcctaagagtgggcacaggtccactgtatgtagattctagcag

SEQ ID NO: 237795 - DNA, 75 bp, Artificial Sequence
  Synthetic
aggggattgtatataacatcatctaacaaccaaaacggtctagaggccaacattaaactaacaaaaggccttgtg

SEQ ID NO: 237796 - DNA, 75 bp, Artificial Sequence
  Synthetic
acaaccaaaacggtctagaggccaacattaaactaacaaaaggccttgtgtatgaaggaaatgccatagcagtta

SEQ ID NO: 237797 - DNA, 75 bp, Artificial Sequence
  Synthetic
cactactgccacatcggaaggtgtgtatcctatacagtctaagataggtttgggaatggaatatgataccaacgg

SEQ ID NO: 237798 - DNA, 75 bp, Artificial Sequence
  Synthetic
tatcctatacagtctaagataggtttgggaatggaatatgataccaacggagccatgatggcaaaactaggctcc

SEQ ID NO: 237799 - DNA, 75 bp, Artificial Sequence
  Synthetic
ccattgtggtgggaaacaaaaatgatgacaaacttaccctatggaccacacctgacccgtctcctaactgtagaa

SEQ ID NO: 237800 - DNA, 75 bp, Artificial Sequence
  Synthetic
tgacaaacttaccctatggaccacacctgacccgtctcctaactgtagaatttattctgaaaaagatactaaact

SEQ ID NO: 237801 - DNA, 75 bp, Artificial Sequence
  Synthetic
agtcaaatcctaggcacagtatctgcccttgctgtcagaggcagccttgcgcccatcactaacgcatccagcata

SEQ ID NO: 237802 - DNA, 75 bp, Artificial Sequence
  Synthetic
cccttgctgtcagaggcagccttgcgcccatcactaacgcatccagcatagtccaaatatttctacgatttgatg

SEQ ID NO: 237803 - DNA, 75 bp, Artificial Sequence
  Synthetic
atcgctagacggtgattactggaattacagaaatggggactccactaatggcacaccatatacaaatgcagtagg

SEQ ID NO: 237804 - DNA, 75 bp, Artificial Sequence
  Synthetic
tacagaaatggggactccactaatggcacaccatatacaaatgcagtaggctttatgcctaatctagctgcctat

SEQ ID NO: 237805 - DNA, 75 bp, Artificial Sequence
  Synthetic
aaagcagtattgtaagccaggtatacatggatggtgatactactaaacctataacactaaaaataaactttaatg

SEQ ID NO: 237806 - DNA, 75 bp, Artificial Sequence
  Synthetic
tgtatgtgtgtatgcgccctatgtcgccgccagaggagctgctgagtcgccgccgttcgcgcgcccaccaccacc

SEQ ID NO: 237807 - DNA, 75 bp, Artificial Sequence
  Synthetic
gcattgatgaaacaacagaaaatacccctgttagtaaatattccatgacattctcatggagctggcccaccgcaa

SEQ ID NO: 237808 - DNA, 75 bp, Artificial Sequence
  Synthetic
aaactcttttactttctcctacatcgcccaagaataaagaaagcacagagatgcttgtttttgatttcaaaattg

SEQ ID NO: 237809 - DNA, 75 bp, Artificial Sequence
  Synthetic
gcccaagaataaagaaagcacagagatgcttgtttttgatttcaaaattgtgtgcttttatttattttcaagctt

SEQ ID NO: 237810 - DNA, 75 bp, Artificial Sequence
  Synthetic
tagagcttaatgaaactgcatgagaacccttccacatagcttaaattatcaccagtgcaaatggagaaaaatcaa

SEQ ID NO: 237811 - DNA, 75 bp, Artificial Sequence
  Synthetic
acccttccacatagcttaaattatcaccagtgcaaatggagaaaaatcaacatacctttttatccagatatcata

SEQ ID NO: 237812 - DNA, 75 bp, Artificial Sequence
  Synthetic
accctcccaactcacagaatacacagtcctttccccccggctggctttaaacaacactatctcattggtaacaga

SEQ ID NO: 237813 - DNA, 75 bp, Artificial Sequence
  Synthetic
ggccgtgggcgacaaccgcgtgctggacatggcctccacctactttgacatccgcggggtgctggaccggggtcc

SEQ ID NO: 237814 - DNA, 75 bp, Artificial Sequence
  Synthetic
gtcctttccccccggctggctttaaacaacactatctcattggtaacagacatattcttaggtgtaataatccac

SEQ ID NO: 237815 - DNA, 75 bp, Artificial Sequence
  Synthetic
ggtcagtgatgttaataaactccccaggcagctctttcaagttcacgtcgctgtccaactgctgaagcgctcgcg

SEQ ID NO: 237816 - DNA, 75 bp, Artificial Sequence
  Synthetic
aggcagctctttcaagttcacgtcgctgtccaactgctgaagcgctcgcggctccgactgcgcctctagcggagg

SEQ ID NO: 237817 - DNA, 75 bp, Artificial Sequence
  Synthetic
tataaaggagtagagtcataatcccccataagaatagggcggtgatgctgcaacaaggcgcgcagcaactcctgc

SEQ ID NO: 237818 - DNA, 75 bp, Artificial Sequence
  Synthetic
caacaaggcgcgcagcaactcctgccgccgcctctccgtacgacaggaatgcaacggggtggtggtctcctccgc

SEQ ID NO: 237819 - DNA, 75 bp, Artificial Sequence
  Synthetic
agcgtcctcgtcctccgggcacagcagcgcattctgatctcactgagatcggcgcagtaagtgcagcacaacacc

SEQ ID NO: 237820 - DNA, 75 bp, Artificial Sequence
  Synthetic
agcgcattctgatctcactgagatcggcgcagtaagtgcagcacaacaccaagatgttatttaagatcccacagt

SEQ ID NO: 237821 - DNA, 75 bp, Artificial Sequence
  Synthetic
ggcgggaaggacagcccccacgtgaccatcataccagatcctcaggtaaatcaaatgacgacctctcatgaacac

SEQ ID NO: 237822 - DNA, 75 bp, Artificial Sequence
  Synthetic
gttaccgcccgcgtgtcgaacccaggtgtgcgacgtcagacaacgggggagcgctccttttggcttccttccagg

SEQ ID NO: 237823 - DNA, 75 bp, Artificial Sequence
  Synthetic
ccatcataccagatcctcaggtaaatcaaatgacgacctctcatgaacacgctggacatgtacatcacctccttg

SEQ ID NO: 237824 - DNA, 75 bp, Artificial Sequence
  Synthetic
gataccacaggcatcgctgattaattaaagacccctcgagcaccatcctgaaccaggaagccagcacctgacccc

SEQ ID NO: 237825 - DNA, 75 bp, Artificial Sequence
  Synthetic
taaagacccctcgagcaccatcctgaaccaggaagccagcacctgaccccccgccaggcactgcagggaccccgg

SEQ ID NO: 237826 - DNA, 75 bp, Artificial Sequence
  Synthetic
cagcgctcgtagccgtgaaccatagagctggtcattatatccacattggcacaacacagacacactttcatacac

SEQ ID NO: 237827 - DNA, 75 bp, Artificial Sequence
  Synthetic
tacaatagcactggcaacatgggagtgcttgcaggtcaggcctctcagttgaatgcagtggtggacttgcaagac

SEQ ID NO: 237828 - DNA, 75 bp, Artificial Sequence
  Synthetic
agctggtcattatatccacattggcacaacacagacacactttcatacactttttcatgattagcagctcctctc

SEQ ID NO: 237829 - DNA, 75 bp, Artificial Sequence
  Synthetic
gggtcctgtgtattttttccaggacgtggtagaggtggctctggatgttcagatacatgggcataagcccgtctc

SEQ ID NO: 237830 - DNA, 75 bp, Artificial Sequence
  Synthetic
cacccactcttgaatcaaggtaaatcccacacagcagggcaggcctctcacataactcacgttatgcatagtgag

SEQ ID NO: 237831 - DNA, 75 bp, Artificial Sequence
  Synthetic
cccacacagcagggcaggcctctcacataactcacgttatgcatagtgagcgtgtcgcaatctggaaataccgga

SEQ ID NO: 237832 - DNA, 75 bp, Artificial Sequence
  Synthetic
tctccgtctcaaagggaggtaaacggtccctcgtgtagggacagtggcgggataatcgagatcgtgttgaacgta

SEQ ID NO: 237833 - DNA, 75 bp, Artificial Sequence
  Synthetic
gtccctcgtgtagggacagtggcgggataatcgagatcgtgttgaacgtagagtcatgccaaagggaacagcgga

SEQ ID NO: 237834 - DNA, 75 bp, Artificial Sequence
  Synthetic
ccaagtgcgcgcgtggcagctatccctgcgtcttctgtctcgccgcctgccccgctcggtgtagtagttgtaata

SEQ ID NO: 237835 - DNA, 75 bp, Artificial Sequence
  Synthetic
ctgcgtcttctgtctcgccgcctgccccgctcggtgtagtagttgtaatacagccactccctcagaccgtcaagg

SEQ ID NO: 237836 - DNA, 75 bp, Artificial Sequence
  Synthetic
caacaccgtcctgcagcgccgccctgatgacatccaccaccgtagagtatgccaagcccagccacgaaatgcact

SEQ ID NO: 237837 - DNA, 75 bp, Artificial Sequence
  Synthetic
gatgacatccaccaccgtagagtatgccaagcccagccacgaaatgcactcactttgacagcgagagataggagg

SEQ ID NO: 237838 - DNA, 75 bp, Artificial Sequence
  Synthetic
tgtcctaaccctggattacatcaagatctttgttgtcatctctgtgctgagtataataaatacagaaattagaat

SEQ ID NO: 237839 - DNA, 75 bp, Artificial Sequence
  Synthetic
atagtaaaagaacttttattccaatcgatcctctacaatgtcaaagtgtagatctatcagatggcactggtctcc

SEQ ID NO: 237840 - DNA, 75 bp, Artificial Sequence
  Synthetic
cgatcctctacaatgtcaaagtgtagatctatcagatggcactggtctcctccgctgagtcgatcaaaaataaca

SEQ ID NO: 237841 - DNA, 75 bp, Artificial Sequence
  Synthetic
tcaaatgctgcacaagggcttgcagcataaaatcgcctcgaaagtccaccgcaagcagaacatcaaagccaccgc

SEQ ID NO: 237842 - DNA, 75 bp, Artificial Sequence
  Synthetic
cataaaatcgcctcgaaagtccaccgcaagcagaacatcaaagccaccgcccctatcatgatctatgataaaaac

SEQ ID NO: 237843 - DNA, 75 bp, Artificial Sequence
  Synthetic
tagttttcatctctccatcgtgaaaaaatatttacaagctcctcctttaaatcacctccaaccaattcaaaaagt

SEQ ID NO: 237844 - DNA, 75 bp, Artificial Sequence
  Synthetic
aaatatttacaagctcctcctttaaatcacctccaaccaattcaaaaagttgagccagaccgccctccaccttca

SEQ ID NO: 237845 - DNA, 75 bp, Artificial Sequence
  Synthetic
aaaaattcaggctcctcagacacctgtataagattgagaagcggaacgttaacatcaatgtttcgctcgcgaaga

SEQ ID NO: 237846 - DNA, 75 bp, Artificial Sequence
  Synthetic
gtataagattgagaagcggaacgttaacatcaatgtttcgctcgcgaagatcgcgcctcagtgcaagcatgatat

SEQ ID NO: 237847 - DNA, 75 bp, Artificial Sequence
  Synthetic
gtagtcggggtgctgggattttttaattaagtatatgagcaattcaagtaattctacaagcttgtctaatttttc

SEQ ID NO: 237848 - DNA, 75 bp, Artificial Sequence
  Synthetic
cgaggacatctccccgccaggaaccaactcaacggagcctatgctgattataatacgcatattcggggctatgct

SEQ ID NO: 237849 - DNA, 75 bp, Artificial Sequence
  Synthetic
aactcaacggagcctatgctgattataatacgcatattcggggctatgctaaccagcacggcccccaaataggcg

SEQ ID NO: 237850 - DNA, 75 bp, Artificial Sequence
  Synthetic
gaacagtttgggttaaaaaatcaggcaaacactcgcgcaaaaaagcaagaacatcataaccatgctcatgcaaat

SEQ ID NO: 237851 - DNA, 75 bp, Artificial Sequence
  Synthetic
caaacactcgcgcaaaaaagcaagaacatcataaccatgctcatgcaaatagatgcaagtaagctcaggaacgac

SEQ ID NO: 237852 - DNA, 75 bp, Artificial Sequence
  Synthetic
tgctggccaactacaacatcggctaccagggcttctacatcccagagagctacaaggacaggatgtactccttct

SEQ ID NO: 237853 - DNA, 75 bp, Artificial Sequence
  Synthetic
caattttttaagttcctcgtaggtgagctcttcaggggagctgagcccgtgctctgacagggcccagtctgcaag

SEQ ID NO: 237854 - DNA, 75 bp, Artificial Sequence
  Synthetic
agctcttcaggggagctgagcccgtgctctgacagggcccagtctgcaagatgagggttggaagcgacgaatgag

SEQ ID NO: 237855 - DNA, 75 bp, Artificial Sequence
  Synthetic
tcaaacatgactgcgagccctgcaaaaaataaaaaagaaacattacacaagagtagcctgccttacaatgggata

SEQ ID NO: 237856 - DNA, 75 bp, Artificial Sequence
  Synthetic
aaaataaaaaagaaacattacacaagagtagcctgccttacaatgggatagactactctaaccaacataagacgg

SEQ ID NO: 237857 - DNA, 75 bp, Artificial Sequence
  Synthetic
aaaaaaaattatccgtgtgattaaaaagaagcacagataactggccagtcatatccggagtcatcacgtgcgaac

SEQ ID NO: 237858 - DNA, 75 bp, Artificial Sequence
  Synthetic
aagaagcacagataactggccagtcatatccggagtcatcacgtgcgaacccgtgtagacccccgggttggacac

SEQ ID NO: 237859 - DNA, 75 bp, Artificial Sequence
  Synthetic
atgtatcccggaggaatgataacactaagacgaagatacaacagaataaccccatgggggggaataacaaagtta

SEQ ID NO: 237860 - DNA, 75 bp, Artificial Sequence
  Synthetic
taagacgaagatacaacagaataaccccatgggggggaataacaaagttagtaggtgaataaaaacgataaacac

SEQ ID NO: 237861 - DNA, 75 bp, Artificial Sequence
  Synthetic
aatagcgccctccccttccaaaacaacatacagcgcttccacagcagccatgacaaaagactgaaaacactcaaa

SEQ ID NO: 237862 - DNA, 75 bp, Artificial Sequence
  Synthetic
acatacagcgcttccacagcagccatgacaaaagactgaaaacactcaaaagacttagtcttaccaggaaaataa

SEQ ID NO: 237863 - DNA, 75 bp, Artificial Sequence
  Synthetic
atcagagtgtgaagaaggccaagtgccgaacgagtatatataggaattaaaaatgacgtaaatgtgtaaaggtca

SEQ ID NO: 237864 - DNA, 75 bp, Artificial Sequence
  Synthetic
ccgaacgagtatatataggaattaaaaatgacgtaaatgtgtaaaggtcagaaaacgcccagaaaaatacacaga

SEQ ID NO: 237865 - DNA, 75 bp, Artificial Sequence
  Synthetic
aaaaaatacccagaagttcctcaacaaccgccacttccgctttcccacgatacgtcacttcctcgaaaatagcaa

SEQ ID NO: 237866 - DNA, 75 bp, Artificial Sequence
  Synthetic
actacatttcccacatgtacaaaaccgaaacccctccccttgtcaccgcccacaacttacatcatcacaaacgtc

SEQ ID NO: 237867 - DNA, 75 bp, Artificial Sequence
  Synthetic
aaatcctacgtcacccgccccgcccacctcattatcatattggccacaatccaaaataaggtatattattgatga

SEQ ID NO: 237868 - DNA, 75 bp, Artificial Sequence
  Synthetic
ggaggaggcagaggaggaggcagaagcaccacaagctgatcagaaggttaagaagactcatgtatatgctcaggc

SEQ ID NO: 237869 - DNA, 75 bp, Artificial Sequence
  Synthetic
ttcttcttctggcggcggtgggggaggggggacacggcggcgacgacggcgcaccgggaggcggtcgacaaagcg

SEQ ID NO: 237870 - DNA, 75 bp, Artificial Sequence
  Synthetic
tttgcagttttgtggtttaaaagaattttgtattgtgatttttttttaaaaggtcctgtgtctgaacctgagcct

SEQ ID NO: 237871 - DNA, 75 bp, Artificial Sequence
  Synthetic
attgttgcagatgaaacgcgccagaccgtctgaagacaccttcaaccccgtgtacccttatgacacggaaaccgg

SEQ ID NO: 237872 - DNA, 75 bp, Artificial Sequence
  Synthetic
gctgcggccgctgccgaggtcgaaggccgagggctgggcgtgcgcggcaccagcgcgtcctgcgagccgtcctcg

SEQ ID NO: 237873 - DNA, 75 bp, Artificial Sequence
  Synthetic
ttcctacaccttctcctacattgcccaggaataaaaaatcattatatgttatgtttcaacgtgttttattttcaa

SEQ ID NO: 237874 - DNA, 75 bp, Artificial Sequence
  Synthetic
cagcgacgcacccccgctcgagaatgaagtgctgatcgagcaggacccgggttttgtgagcggagaggaggatga

SEQ ID NO: 237875 - DNA, 75 bp, Artificial Sequence
  Synthetic
atgacggctacctagacgtgggagacgacgtgctgcttaagcacctgcaccgccagtgcgtcatcgtctgcgacg

SEQ ID NO: 237876 - DNA, 75 bp, Artificial Sequence
  Synthetic
cgcgaggaggtggctataggactgatgcatctgtgggactttgtaagcgcgctggagcaaaacccaaatagcaag

SEQ ID NO: 237877 - DNA, 75 bp, Artificial Sequence
  Synthetic
cgaaagcatgtccaaggtgaacctgaacggggtgtttgacatgaccatgaagatctggaaggtgctgaggtacga

SEQ ID NO: 237878 - DNA, 75 bp, Artificial Sequence
  Synthetic
tgcactacaccttccgccagggctacgtgcgccaggcctgcaagatctccaacgtggagctctgcaacctggtct

SEQ ID NO: 237879 - DNA, 75 bp, Artificial Sequence
  Synthetic
agatctggaaggtgctgaggtacgatgagacccgcaccaggtgcagaccctgcgagtgtggcggtaaacatatta

SEQ ID NO: 237880 - DNA, 75 bp, Artificial Sequence
  Synthetic
cagcctagacgaggaagcttcagaggccgaagaggtggcagacgcaacaccatcaccctcggtcgcagccccctc

SEQ ID NO: 237881 - DNA, 75 bp, Artificial Sequence
  Synthetic
tggtacttgtccatcagcgcgcgcgcagcctccatgcccttctcccacgcagacacgatcggcagactcagcggg

SEQ ID NO: 237882 - DNA, 75 bp, Artificial Sequence
  Synthetic
gggcaggggctaaagggggtaaagagggagcggggggcttctgaggctacagaggaggctaggaatctaactttt

SEQ ID NO: 237883 - DNA, 75 bp, Artificial Sequence
  Synthetic
tttatgagttgtgcgatgcggtcatgtacatgtcaaaacagtacaacctgtggcctccctctccccaggcgtgtg

SEQ ID NO: 237884 - DNA, 75 bp, Artificial Sequence
  Synthetic
gctctaatctgcacggtgctatatataaaattcaggcagaggcgaatctttatcgatgaaaagaaaatgccttga

SEQ ID NO: 237885 - DNA, 75 bp, Artificial Sequence
  Synthetic
gagccgatcgggaagaactggatctcccgccaccagttggaggagtggctgttgatgtggtgaaagtagaagtcc

SEQ ID NO: 237886 - DNA, 75 bp, Artificial Sequence
  Synthetic
gcgcacgtaatcgtatagttcgtgcgagggagcgaggaggtcgggaccgaggttgctacgggcgggctgctctgc

SEQ ID NO: 237887 - DNA, 75 bp, Artificial Sequence
  Synthetic
tgccccaaaagttttttgccattaaaaacctcctcctcctgccaggctcatacacatatgaatggaacttcagga

SEQ ID NO: 237888 - DNA, 75 bp, Artificial Sequence
  Synthetic
aaaatgggaagtggcctctccctggacgacgctggcaaccttacctctcaagatattacctccactacccctccc

SEQ ID NO: 237889 - DNA, 75 bp, Artificial Sequence
  Synthetic
cctgtagccggagggttattttccaagggttgagtcgcgggacccccggttcgagtctcgggccggccggactgc

SEQ ID NO: 237890 - DNA, 75 bp, Artificial Sequence
  Synthetic
acaaagaccgcatgtactcgttcttcagaaacttccagcccatgagccggcaagtggtggacgatactaaataca

SEQ ID NO: 237891 - DNA, 75 bp, Artificial Sequence
  Synthetic
aaaagtttctttgcgaccgcaccctgtggcgcatccccttctccagtaactttatgtccatgggtgcgctcacag

SEQ ID NO: 237892 - DNA, 75 bp, Artificial Sequence
  Synthetic
caccagccgcaccgcggcgtcatcgagaccgtgtacctgcgcacgcccttctcggccggcaacgccacaacataa

SEQ ID NO: 237893 - DNA, 75 bp, Artificial Sequence
  Synthetic
caggatagggcggtgatgcagcagcagcgagcgaaacatctgctgccgccgccgctccgtccggcaggaaaacaa

SEQ ID NO: 237894 - DNA, 75 bp, Artificial Sequence
  Synthetic
cagcagcagggcaacctgggctccatggttgcactaaacgccttcctgagtacacagcccgccaacgtgccgcgg

SEQ ID NO: 237895 - DNA, 75 bp, Artificial Sequence
  Synthetic
cgcctgatggactacttgcatcgcgcggccgccgtaaaccccgaatatttcaccaatgccatcttgaacccacac

SEQ ID NO: 237896 - DNA, 75 bp, Artificial Sequence
  Synthetic
accgagatcgtgttgagcgtagtgtcatggaaaagggaacgccggacgtggtcatacttcttgaagcagaaccag

SEQ ID NO: 237897 - DNA, 75 bp, Artificial Sequence
  Synthetic
caagtggcagcgctcccctccactggcgcggtcaaactctacggccaaagcacagacaacggcatttctaagatg

SEQ ID NO: 237898 - DNA, 75 bp, Artificial Sequence
  Synthetic
accctatactgattatgacgcgcatactcggggctatgctgaccagcgtagcgccgatgtaggcgtgctgcatgg

SEQ ID NO: 237899 - DNA, 75 bp, Artificial Sequence
  Synthetic
catgctcatgcagatagttgcaggtaagctcaggaaccaaaacggaataacacacgattttcctctcaaacatga

SEQ ID NO: 237900 - DNA, 75 bp, Artificial Sequence
  Synthetic
ggcaatgcagccggtggagaacgatcatgccattcgcggcgacacctttgccacggaagagaagcgcgctgaggc

SEQ ID NO: 237901 - DNA, 75 bp, Artificial Sequence
  Synthetic
caaggcagcggcagcggccgccgccgccgcggaggctgcacaacccgatggcgagaagcctcagaagaaaccggt

SEQ ID NO: 237902 - DNA, 75 bp, Artificial Sequence
  Synthetic
taaaagtgacgtttttggtgtgcgccggtgtacacgggaagtgacaattttcgcgcggttttaggcggatgttgt

SEQ ID NO: 237903 - DNA, 75 bp, Artificial Sequence
  Synthetic
aactctgcagacctcgtcctcggagccgcgctccggaggcattggaactctacaatttattgaggagttcgtgcc

SEQ ID NO: 237904 - DNA, 75 bp, Artificial Sequence
  Synthetic
caccaccgtcgatgacgccatcgacgcggtggtggaggaggcgcgcaactacacgcccacgccgccgccagtgtc

SEQ ID NO: 237905 - DNA, 75 bp, Artificial Sequence
  Synthetic
agtggcaactggcaaagcacactgaacagcatcgtgggtctgggggtgcaatccctgaagcgccgacgatgcttc

SEQ ID NO: 237906 - DNA, 75 bp, Artificial Sequence
  Synthetic
cgtactttgacatccgcggcgtgctggacaggggccctacttttaagccctactctggcactgcctacaacgctc

SEQ ID NO: 237907 - DNA, 75 bp, Artificial Sequence
  Synthetic
tagctcccaagggcgctcccaactcctgtgagtgggaacaaaccgaagatagcggccgggcggttgccgaggatg

SEQ ID NO: 237908 - DNA, 75 bp, Artificial Sequence
  Synthetic
agaagaggaagagcaaaacgctcgagatcaggctactaagaaaacacatgtctatgcccaggctcctttgtctgg

SEQ ID NO: 237909 - DNA, 75 bp, Artificial Sequence
  Synthetic
gatcaggctactaagaaaacacatgtctatgcccaggctcctttgtctggagaaacaattacaaaaagcgggcta

SEQ ID NO: 237910 - DNA, 75 bp, Artificial Sequence
  Synthetic
cacaagctaaacctgtatatgcagatccttcctatcaaccagaacctcaaattggcgagtctcagtggaacgaag

SEQ ID NO: 237911 - DNA, 75 bp, Artificial Sequence
  Synthetic
tccttcctatcaaccagaacctcaaattggcgagtctcagtggaacgaagctgatgctaatgcggcaggagggag

SEQ ID NO: 237912 - DNA, 75 bp, Artificial Sequence
  Synthetic
aaaccatgctatggatcttatgccaggcctacaaatccttttggtggacaatccgttctggttccggatgaaaaa

SEQ ID NO: 237913 - DNA, 75 bp, Artificial Sequence
  Synthetic
aacaactttgccatggaaattaacctaaatgccaacctatggagaaatttcctttactccaatattgcgctgtac

SEQ ID NO: 237914 - DNA, 75 bp, Artificial Sequence
  Synthetic
gtgaagatgtaaatatggaaaccccagacacacatttgtcttacaaacctggaaaaggtgatgaaaattctaaag

SEQ ID NO: 237915 - DNA, 75 bp, Artificial Sequence
  Synthetic
ctatgttgggtcaacaatctatgccaaacagacccaattacattgctttcagggacaattttattggcctaatgt

SEQ ID NO: 237916 - DNA, 75 bp, Artificial Sequence
  Synthetic
ctaaatgccgtggtagatttgcaagacagaaacacagagctgtcctatcaactcttgcttgattccataggtgat

SEQ ID NO: 237917 - DNA, 75 bp, Artificial Sequence
  Synthetic
acagaaacacagagctgtcctatcaactcttgcttgattccataggtgatagaaccagatatttttctatgtgga

SEQ ID NO: 237918 - DNA, 75 bp, Artificial Sequence
  Synthetic
agatgttagaatcattgaaaaccatggaactgaggatgaattgccaaattattgttttcctcttgggggtattgg

SEQ ID NO: 237919 - DNA, 75 bp, Artificial Sequence
  Synthetic
ggaactgaggatgaattgccaaattattgttttcctcttgggggtattggggtaactgacacctatcaagctatt

SEQ ID NO: 237920 - DNA, 75 bp, Artificial Sequence
  Synthetic
ttcgccctgcgcgtcggccaggtagcatttgaccatggtgtcatagtccagcccctccgcggcgtggcccttggc

SEQ ID NO: 237921 - DNA, 75 bp, Artificial Sequence
  Synthetic
ctttaatgactacctttccgccgccaacatgctataccccatacccgccaacgccaccaacgtgcccatctctat

SEQ ID NO: 237922 - DNA, 75 bp, Artificial Sequence
  Synthetic
agacaaaggaaactccttccctgggatcaggctacgacccttactacacctactctggctccataccataccttg

SEQ ID NO: 237923 - DNA, 75 bp, Artificial Sequence
  Synthetic
atcaggctacgacccttactacacctactctggctccataccataccttgacggaaccttctatcttaatcacac

SEQ ID NO: 237924 - DNA, 75 bp, Artificial Sequence
  Synthetic
gactcttctgttagctggccgggcaacgaccgcctgcttactcccaatgagtttgagattaagcgctcagttgac

SEQ ID NO: 237925 - DNA, 75 bp, Artificial Sequence
  Synthetic
acgaccgcctgcttactcccaatgagtttgagattaagcgctcagttgacggggagggctacaacgtagctcagt

SEQ ID NO: 237926 - DNA, 75 bp, Artificial Sequence
  Synthetic
ggtgcagatgttggccaactacaacattggctatcaaggcttttacattccagaaagctacaaggatcgcatgta

SEQ ID NO: 237927 - DNA, 75 bp, Artificial Sequence
  Synthetic
cagaaagctacaaggatcgcatgtactccttttttagaaacttccaacccatgagccggcaagtggttgacgata

SEQ ID NO: 237928 - DNA, 75 bp, Artificial Sequence
  Synthetic
tggaattcttcaccagcataacaactcaggattcgtaggctacctcgctcccaccatgcgcgagggacaggctta

SEQ ID NO: 237929 - DNA, 75 bp, Artificial Sequence
  Synthetic
cttattttggattgaagccaatatgataatgagggggtggagtttgtgacgtggcgcggggcgtgggaacggggc

SEQ ID NO: 237930 - DNA, 75 bp, Artificial Sequence
  Synthetic
ataatgagggggtggagtttgtgacgtggcgcggggcgtgggaacggggcgggtgacgtagtagtgtggcggaag

SEQ ID NO: 237931 - DNA, 75 bp, Artificial Sequence
  Synthetic
tctacgcaaactccgcccacgcgctagacatgactttgaggtggatcccatggacgagcccacccttctttatgt

SEQ ID NO: 237932 - DNA, 75 bp, Artificial Sequence
  Synthetic
ccagcgcgtcttgtgacgagtcttcttcgtcctcggactcgagacgccgcctcagccgcttttttgggggcgcgc

SEQ ID NO: 237933 - DNA, 75 bp, Artificial Sequence
  Synthetic
gaggttgctggcgaacgcgacgacgcggcggttgatctcctgaatctggcgcctctgcgtgaagacgacgggccc

SEQ ID NO: 237934 - DNA, 75 bp, Artificial Sequence
  Synthetic
gaggcagggctctcaaaaaagaaaccaaaatgaaaccatgctatggctcttttgctagaccgactaatgaaaaag

SEQ ID NO: 237935 - DNA, 75 bp, Artificial Sequence
  Synthetic
gtaaacaaaagttaatatgcaaatgagcttttgaattttaacggtttcggggcggagccaacgctgattggacga

SEQ ID NO: 237936 - DNA, 75 bp, Artificial Sequence
  Synthetic
agttgggaccggtgctctgcgcgcgcgagttgcggtacacggggttgcagcactggaacaccatcagactggggt

SEQ ID NO: 237937 - DNA, 75 bp, Artificial Sequence
  Synthetic
tgatcaaggtctaccttctaaagaacaagacataacaatggctttctttgatagtccacaagctgacacctcagg

SEQ ID NO: 237938 - DNA, 75 bp, Artificial Sequence
  Synthetic
caagacataacaatggctttctttgatagtccacaagctgacacctcaggtgttgataacaaaccagatatggta

SEQ ID NO: 237939 - DNA, 75 bp, Artificial Sequence
  Synthetic
gacgcacggctaacggtcgccgcggaggcgtggcctagcccggaagcaagtcgcggggctgatgacgtataaaaa

SEQ ID NO: 237940 - DNA, 75 bp, Artificial Sequence
  Synthetic
aatattagatgacaaaagtgctggagggttaaaagatttaattggcaaacttgcggttttaacagggaaaggaat

SEQ ID NO: 237941 - DNA, 75 bp, Artificial Sequence
  Synthetic
aaacacctgacactcatgtggtgttcaagccaggaaaagaggatgacagttcagaagtaaatttaactcagcagt

SEQ ID NO: 237942 - DNA, 75 bp, Artificial Sequence
  Synthetic
agcggactttagacccggaaacggccgattttcccgcggccacgcccggatatgaggtaattctgggcggatgca

SEQ ID NO: 237943 - DNA, 75 bp, Artificial Sequence
  Synthetic
ccatgccaaacaggccaaattacatcggttttagagacaattttgtgggcctcatgtattacaacagcactggta

SEQ ID NO: 237944 - DNA, 75 bp, Artificial Sequence
  Synthetic
agtgaaattaggtcattttggcgcgaaaactgaatgaggaagtgaaaagcgaaaaataccggtccctcccagggc

SEQ ID NO: 237945 - DNA, 75 bp, Artificial Sequence
  Synthetic
ggaatatttaccgagggccgagagactttgaccgattacgtgggggtttcgattgcggtgtttttttcgcgaatt

SEQ ID NO: 237946 - DNA, 75 bp, Artificial Sequence
  Synthetic
ctttgaccgattacgtgggggtttcgattgcggtgtttttttcgcgaatttccgcgtccgtgtcaaagtccggtg

SEQ ID NO: 237947 - DNA, 75 bp, Artificial Sequence
  Synthetic
gagccgccagctggccgccctgacccagcaggtgtccgagctccgcgaacagcagcagcagcaaaataaatgatt

SEQ ID NO: 237948 - DNA, 75 bp, Artificial Sequence
  Synthetic
cgcgcacactttggacaacaccagacacatctcctaattgcaggattgataaggagaaggattcaaaactcactt

SEQ ID NO: 237949 - DNA, 75 bp, Artificial Sequence
  Synthetic
gtacgaggccatgctgcgccgcagcgccctggcctcctcgcccgaccgctgtctcagcctcgaacagtccaccca

SEQ ID NO: 237950 - DNA, 75 bp, Artificial Sequence
  Synthetic
aatattagctaatgtgtctttgattgtggtgtcaggaaaatatcaatacatagaccacgctacaaatccaactct

SEQ ID NO: 237951 - DNA, 75 bp, Artificial Sequence
  Synthetic
gtggtgtcaggaaaatatcaatacatagaccacgctacaaatccaactcttaaatcatttaaaataaaacttctt

SEQ ID NO: 237952 - DNA, 75 bp, Artificial Sequence
  Synthetic
gcgagtagagatttctctgagctccgctcccagagaccgagaaaaatgagacacctgcgcctcctgccttcaact

SEQ ID NO: 237953 - DNA, 75 bp, Artificial Sequence
  Synthetic
caagttcaaaccttgattccacatattggaactttagaagtgacaatttaactgtatctgaggcatataaaaatg

SEQ ID NO: 237954 - DNA, 75 bp, Artificial Sequence
  Synthetic
aggtgttaaatatgaaaacggagctggtggaaatggaacttggaaagtagatgacacagttacaaggcaaaatca

SEQ ID NO: 237955 - DNA, 75 bp, Artificial Sequence
  Synthetic
ttggaactttagaagtgacaatttaactgtatctgaggcatataaaaatgcagttgaatttatgcctaatttggt

SEQ ID NO: 237956 - DNA, 75 bp, Artificial Sequence
  Synthetic
ttatgcagggtgaccaggtccacgctggtggccacctcgccgcgcaggggctcattcgtccagcagaggcgcccg

SEQ ID NO: 237957 - DNA, 75 bp, Artificial Sequence
  Synthetic
tctaaaaaatatgcaagggatatagtctatgggaacatatatcttggaggtttgccatatcagccagttgtaatt

SEQ ID NO: 237958 - DNA, 75 bp, Artificial Sequence
  Synthetic
gaggctgtgaatttaatatttccagaatctatgattcttcaggctgacatagccaacgaatctactccacttcat

SEQ ID NO: 237959 - DNA, 75 bp, Artificial Sequence
  Synthetic
tctatgggaacatatatcttggaggtttgccatatcagccagttgtaattaaggttacttttaatgaagaagcag

SEQ ID NO: 237960 - DNA, 75 bp, Artificial Sequence
  Synthetic
atttgtatggaataaagaatatgccagggttgaatttgaaaccacttcctttaccttctcctatattgcccaaca

SEQ ID NO: 237961 - DNA, 75 bp, Artificial Sequence
  Synthetic
agggttgaatttgaaaccacttcctttaccttctcctatattgcccaacaataaaagaccaataaacgtgttttt

SEQ ID NO: 237962 - DNA, 75 bp, Artificial Sequence
  Synthetic
catccccgcgccgcgctgcatattcgggtagagggccttgacaaaggccgcgatctgcttgaaagcttgctgggc

SEQ ID NO: 237963 - DNA, 75 bp, Artificial Sequence
  Synthetic
ctcccagttcttgtgcgcaatcccgctgtggctgaagatgtaaccttgcaacatgcggcccatgatggtgctaaa

SEQ ID NO: 237964 - DNA, 75 bp, Artificial Sequence
  Synthetic
ctgctagattctctgaatcttggccaccagtcccttttccaggaaagggtactccacagccttgatttttccagc

SEQ ID NO: 237965 - DNA, 75 bp, Artificial Sequence
  Synthetic
gccactccccttactttcgctcccaccgcgccgccatcgaacacgccaccgcttttgataaaatgaaacaactgc

SEQ ID NO: 237966 - DNA, 75 bp, Artificial Sequence
  Synthetic
tttcatgtatctttattgatttttacaccagcacgagtagacagtctcccaccaccagcccattttacagtgtac

SEQ ID NO: 237967 - DNA, 75 bp, Artificial Sequence
  Synthetic
ggcggcgaggggctcctctcctgctccggcggatagcgcgccgacccgtggccccggggcggagtggcctctcgg

SEQ ID NO: 237968 - DNA, 75 bp, Artificial Sequence
  Synthetic
ccttcctggacgggagcaatccctccaggactatctatgaaagcatacagagattcagccatagctcagcccgct

SEQ ID NO: 237969 - DNA, 75 bp, Artificial Sequence
  Synthetic
ttttctttttgccagatgcatcccgtcctgcgccaaatgcgtcccacccccccggcgaccaccgcaaccgcggcc

SEQ ID NO: 237970 - DNA, 75 bp, Artificial Sequence
  Synthetic
tgtccatggtgtcgcggagatccaggtccgggggcagggttctgaggttgacctcgtagaggcgggtgagggcgt

SEQ ID NO: 237971 - DNA, 75 bp, Artificial Sequence
  Synthetic
tcttcatgaacatgaagttcaatggagagaagtttaatggggtgctgttcatggccaacagccacatgaccctgc

SEQ ID NO: 237972 - DNA, 75 bp, Artificial Sequence
  Synthetic
aaattcatttttgaagtcatgtgtgatatcacactgcatgtggctagacttcatggcttgtggccccctaccaag

SEQ ID NO: 237973 - DNA, 75 bp, Artificial Sequence
  Synthetic
tcacttttgcccttacatgtaacttagtcgtagggcgccatcttgcccacgtccaaaatggcttacatgtccagt

SEQ ID NO: 237974 - DNA, 75 bp, Artificial Sequence
  Synthetic
atggctgcagtttcttcggcttcaacaatatgtgcgcagaggtctggggcgcttccaagatcaggggatgtaagt

SEQ ID NO: 237975 - DNA, 75 bp, Artificial Sequence
  Synthetic
tttatggctgctggatgggcgtggtcggaagacccaagagcgagatgtctgtgaagcagtgtgtgtttgagaaat

SEQ ID NO: 237976 - DNA, 75 bp, Artificial Sequence
  Synthetic
catccccgccctcctggatgtcaagcaatatttggatagcaaaaagaagcttgaggaagctacccagaatgcaac

SEQ ID NO: 237977 - DNA, 75 bp, Artificial Sequence
  Synthetic
caccccagaaagaagtggccagtgtttgagaataacctgctgatcaagtgccatatgcacctgggagccagaagg

SEQ ID NO: 237978 - DNA, 75 bp, Artificial Sequence
  Synthetic
ggagaacgatgccttctccagggtgaacctgaacggcatctttgacatggatgtctcggtgtacaagatcctgag

SEQ ID NO: 237979 - DNA, 75 bp, Artificial Sequence
  Synthetic
gtccagagtatgtatatgttaatatgggagagaacaaaaccttagttggacctccaggaataccagttacttggt

SEQ ID NO: 237980 - DNA, 75 bp, Artificial Sequence
  Synthetic
tggcctccagcctttccatggcctcgtagaagtccacggcgaagttgaaaaactgggcgttgcgggccgagaccg

SEQ ID NO: 237981 - DNA, 75 bp, Artificial Sequence
  Synthetic
gctggctgtgcttatgctggaggactttgtggatacagttctggatgacgaactgcatccaactccgttcgagct

SEQ ID NO: 237982 - DNA, 75 bp, Artificial Sequence
  Synthetic
atccagcggcgcaggggcatctcgctgatgtcgccgatggcctccagcctttccatggcctcgtagaaatccacg

SEQ ID NO: 237983 - DNA, 75 bp, Artificial Sequence
  Synthetic
gtctttttgcttttctgcagacatcatgaacgggaccggcggggccttcgaaggggggctttttagcccttattt

SEQ ID NO: 237984 - DNA, 75 bp, Artificial Sequence
  Synthetic
ggagttcgtcagaatgtgatgggatcgacggtggatgggcgcccagtgcttccagcaaattcctcgaccatgacc

SEQ ID NO: 237985 - DNA, 75 bp, Artificial Sequence
  Synthetic
actatgcttgtgtgattgtggaggaacaagtagtgattgaaaattctaccgagccagtggagggctgtagaaaat

SEQ ID NO: 237986 - DNA, 75 bp, Artificial Sequence
  Synthetic
cccggtagaggtgggattggatgttgaggtacatgggcatgagcccgtcccgggggtggaggtagcaccactgca

SEQ ID NO: 237987 - DNA, 75 bp, Artificial Sequence
  Synthetic
atgttgccacccagatcccgccgggggttcatgttgtgcaggaccaccaggacggtgtagcccgtgcacttgggg

SEQ ID NO: 237988 - DNA, 75 bp, Artificial Sequence
  Synthetic
ggttcatgttgtgcaggaccaccaggacggtgtagcccgtgcacttggggaacttgtcatgcaacttggaaggga

SEQ ID NO: 237989 - DNA, 75 bp, Artificial Sequence
  Synthetic
gacggtgtagcccgtgcacttggggaacttgtcatgcaacttggaagggaatgcgtggaagaatttggagacgcc

SEQ ID NO: 237990 - DNA, 75 bp, Artificial Sequence
  Synthetic
aacttgtcatgcaacttggaagggaatgcgtggaagaatttggagacgcccttgtgcccgcccaggttttccatg

SEQ ID NO: 237991 - DNA, 75 bp, Artificial Sequence
  Synthetic
gagtatgagtggtttgagtttaccctgcccgagggcaacttttccgagaccatgaccatagacctgatgaacaac

SEQ ID NO: 237992 - DNA, 75 bp, Artificial Sequence
  Synthetic
gcgccatcttgcccacgtccaaaatggctttcatgaccggccacgcctccgcgccggccgttagccgtgcgtcgt

SEQ ID NO: 237993 - DNA, 75 bp, Artificial Sequence
  Synthetic
gatgagctgcgaagagagcaggtttctcaacagctgggacttgccgcacccggtcgggccgtagatgaccccgat

SEQ ID NO: 237994 - DNA, 75 bp, Artificial Sequence
  Synthetic
ctatctatataatataccccacaaagtaaacaaaagttaatatgcaaatgagcttttgaatttggggcggggccg

SEQ ID NO: 237995 - DNA, 75 bp, Artificial Sequence
  Synthetic
gcggtcccagagctcggtgacgtgctctacggcatctcgatccagcagacttcctcgtttcgggggttgggacga

SEQ ID NO: 237996 - DNA, 75 bp, Artificial Sequence
  Synthetic
cagggttgagtcgcggcagaacccggttcgcggacggccgcggcgagcgggacttggtcaccccgccgatttaaa

SEQ ID NO: 237997 - DNA, 75 bp, Artificial Sequence
  Synthetic
ggatcgccaggcctctacccggacgagtttataccgaacttcgacgcagtgagagaagcggtggacggctacgac

SEQ ID NO: 237998 - DNA, 75 bp, Artificial Sequence
  Synthetic
agacccaagagcgagatgtctgtgaagcagtgtgtgtttgagaaatgctacctgggagtctctaccgagggcaat

SEQ ID NO: 237999 - DNA, 75 bp, Artificial Sequence
  Synthetic
tcctggaccgcggtcccagcttcaaaccctactcgggcacggcttacaacagcctggcccccaagggcgccccca

SEQ ID NO: 238000 - DNA, 75 bp, Artificial Sequence
  Synthetic
accctactcgggcacggcttacaacagcctggcccccaagggcgcccccaactccagtcagtgggatgctgaaga

SEQ ID NO: 238001 - DNA, 75 bp, Artificial Sequence
  Synthetic
agcctggcccccaagggcgcccccaactccagtcagtgggatgctgaagagaaaaaagatacgcagggaaatgag

SEQ ID NO: 238002 - DNA, 75 bp, Artificial Sequence
  Synthetic
gcgtggcaccaatggcaggaacaaatataacaaagaaaggattgttgcttggaacagatgaaactgccgaggctg

SEQ ID NO: 238003 - DNA, 75 bp, Artificial Sequence
  Synthetic
gcagttgaccatgagctcgtagttgagggcctcggcggcgtggcccttggcgcggagcttgcccttggaagagcg

SEQ ID NO: 238004 - DNA, 75 bp, Artificial Sequence
  Synthetic
gtaaaaaagatatctatgcagatgaaacatatcagccagaaccacaggtaggagaagaaaactggcaagaaaatg

SEQ ID NO: 238005 - DNA, 75 bp, Artificial Sequence
  Synthetic
aaggaaaaattgctataatctttttctttttcacagaaccatgaatgctttgaccagtgtcgtgctgctctctct

SEQ ID NO: 238006 - DNA, 75 bp, Artificial Sequence
  Synthetic
cagttttcccccgttctttttgatgcgcttcttacctcgcgtctccatgagtctgtgtccgcgctcggtgacaaa

SEQ ID NO: 238007 - DNA, 75 bp, Artificial Sequence
  Synthetic
gatgagaccaagtccagggtgcgcgcttgcgagtgcgggggcagacacaccaggatgcagccagtggccctggat

SEQ ID NO: 238008 - DNA, 75 bp, Artificial Sequence
  Synthetic
tggctttctttgacacacctggtggaacattgaatggaagtggaactgaagaatataaggcagacattgtgatgt

SEQ ID NO: 238009 - DNA, 75 bp, Artificial Sequence
  Synthetic
aacattgaatggaagtggaactgaagaatataaggcagacattgtgatgtacactgaaaatgtaaatctggaaac

SEQ ID NO: 238010 - DNA, 75 bp, Artificial Sequence
  Synthetic
aacatcttgcagagcatcgtagtgcaggagcgcagcctgagcctggccgagaaggtggcggcgatcaactactcg

SEQ ID NO: 238011 - DNA, 75 bp, Artificial Sequence
  Synthetic
cgatacacgtagagctaagctcatcctctacaatccttttgtagagggaacctaccagtgccagagcggaccttg

SEQ ID NO: 238012 - DNA, 75 bp, Artificial Sequence
  Synthetic
ccaggaacttcagatgacagttcagaaatcaatctagttcagcagtccatgcccaacagaccaaactacattgga

SEQ ID NO: 238013 - DNA, 75 bp, Artificial Sequence
  Synthetic
gcccaacagaccaaactacattggattcagagacaactttgtggggctcatgtattacaacagcactggcaatat

SEQ ID NO: 238014 - DNA, 75 bp, Artificial Sequence
  Synthetic
tggcttgtaggtgtaggccacgtgaccgggggtccccgacgggggggtataaaagggggcgggtctgtgctcgtc

SEQ ID NO: 238015 - DNA, 75 bp, Artificial Sequence
  Synthetic
ccgggggtccccgacgggggggtataaaagggggcgggtctgtgctcgtcctcactctcttccgcgtcgctgtcc

SEQ ID NO: 238016 - DNA, 75 bp, Artificial Sequence
  Synthetic
aagacagaaacactgagctgtcttaccagctcttgctagattctctgggtgacagaaccagatactttagcatgt

SEQ ID NO: 238017 - DNA, 75 bp, Artificial Sequence
  Synthetic
attccctctcgagagcgggcatgacctcggcactcaggttgtcagtttctagaaacgaggaggatttgatgttgg

SEQ ID NO: 238018 - DNA, 75 bp, Artificial Sequence
  Synthetic
tggaactaattctacataccagggtgtgaaagttacaactaatgaaggagctttggaaagcgaatggggtaaaga

SEQ ID NO: 238019 - DNA, 75 bp, Artificial Sequence
  Synthetic
acgcaaaactgatgaaaaccataaaaatggaatgcatcagaaagtcgaacaaaatcctgaaactaagaaagaaca

SEQ ID NO: 238020 - DNA, 75 bp, Artificial Sequence
  Synthetic
ccagaacttccagcagaaggtggtggacgggctggcctcgggcattaacggggtggtggacatcgcgaaccaggc

SEQ ID NO: 238021 - DNA, 75 bp, Artificial Sequence
  Synthetic
ctgccgagccgcggggtcaagcgcgagggcgagaacatgtacccgaccatgcagatcatggtgcccaagcgccgg

SEQ ID NO: 238022 - DNA, 75 bp, Artificial Sequence
  Synthetic
aaaacattgcaaactacaattcaggttatgattcctattggaactaattatactttagtggggccttcgccacca

SEQ ID NO: 238023 - DNA, 75 bp, Artificial Sequence
  Synthetic
tgcgctcgtcgggcacgatcctgacgcgccagccgcggttatgcagggtgaccaggtccacgctggtggccacct

SEQ ID NO: 238024 - DNA, 75 bp, Artificial Sequence
  Synthetic
gaaaggatgggtttggaatgaaacagtacaatcttaaggttattgctccaaaagcttccactcgcaaacctcttt

SEQ ID NO: 238025 - DNA, 75 bp, Artificial Sequence
  Synthetic
ccctattttaagacacacttgtgatgggcaaaatattacacttattaatgttaatgctacatttgaggctgatta

SEQ ID NO: 238026 - DNA, 75 bp, Artificial Sequence
  Synthetic
aggatgcatcatccaaggccatctgccactcgcgggcggccagcgctcgctcgtaggggttgaggggcggacccc

SEQ ID NO: 238027 - DNA, 75 bp, Artificial Sequence
  Synthetic
cagtgtcgtgctgctctctcttcttgtagcttttagtcaggcaggaattattaacttaaatgtatcatggggaat

SEQ ID NO: 238028 - DNA, 75 bp, Artificial Sequence
  Synthetic
aaccgcaactcgtacctgggccacctgctgacgctgtatagggaggccataggccaggcgcaggtggacgagcag

SEQ ID NO: 238029 - DNA, 75 bp, Artificial Sequence
  Synthetic
ctgaaccacctttgcatcttacaaataacaaattagggatagctttagacgctccatttgatgttatagacaata

SEQ ID NO: 238030 - DNA, 75 bp, Artificial Sequence
  Synthetic
ggcgtacatgccgcagatgtcgtagacatagatgggctccgagaggatgccgatgtaggtgggataacagcgccc

SEQ ID NO: 238031 - DNA, 75 bp, Artificial Sequence
  Synthetic
agcacgtactttgacatccgcggcgtcctggaccgcggtcccagcttcaaaccctactcgggcacggcttacaac

SEQ ID NO: 238032 - DNA, 75 bp, Artificial Sequence
  Synthetic
acaagcctagcaataaagataggccaaatccaaaagtaaaaaatcctcagaaacaaaacacacacaagacaaaca

SEQ ID NO: 238033 - DNA, 75 bp, Artificial Sequence
  Synthetic
ctggggctgctcggcgcggaagacgatctggcgaaagatggcgtgcgagttggaggagatggtgggccgttggaa

SEQ ID NO: 238034 - DNA, 75 bp, Artificial Sequence
  Synthetic
agcatagtcacacttagtgcagctgaagctaaatgctttcatacttataacttaactagaggggaaaatattaca

SEQ ID NO: 238035 - DNA, 75 bp, Artificial Sequence
  Synthetic
gcgctcatccccataatcgccgcggccattggcacgatcccgggcatagcttccgttgcgctgcaggcgtcgcag

SEQ ID NO: 238036 - DNA, 75 bp, Artificial Sequence
  Synthetic
gatgttaaagtgggcgtggggcaagcggaccgagtcgcggatgaagtgcgcgtaggagtcttgcagcttggcgac

SEQ ID NO: 238037 - DNA, 75 bp, Artificial Sequence
  Synthetic
cgtaggagtcttgcagcttggcgacgagctcggcggtgacgaggacgtccatggcgcagtagtccagcgtttcgc

SEQ ID NO: 238038 - DNA, 75 bp, Artificial Sequence
  Synthetic
gcacgcctagcgagggcgcggtgggacggagcccctttcctagcttggggagtttgcatagcctgccgggctcgg

SEQ ID NO: 238039 - DNA, 75 bp, Artificial Sequence
  Synthetic
agtactcccggagcgggaatcctcgatcgtccgcacggtaagagcccagcatgtagaaatggttcacggccttgt

SEQ ID NO: 238040 - DNA, 75 bp, Artificial Sequence
  Synthetic
attatgtacgctgaaaacgtgaatctggaaacaccagacactcacgtcgtttacaagccaggcaaagaggataac

SEQ ID NO: 238041 - DNA, 75 bp, Artificial Sequence
  Synthetic
ggcttcagaatcatgtatgaggatctagaagggggcaacatccccgccctgctgaatgtgaccaagtacttggaa

SEQ ID NO: 238042 - DNA, 75 bp, Artificial Sequence
  Synthetic
tcttcttttctcttttacagtatggtgatcagccatgattcctaggttcttcctatttaacatcctcttctgtct

SEQ ID NO: 238043 - DNA, 75 bp, Artificial Sequence
  Synthetic
ccaaggtgttaagccaaaagatggcggcaacggcggatgggatgcaaatgctaatgctgcaaggcaaaaccgcat

SEQ ID NO: 238044 - DNA, 75 bp, Artificial Sequence
  Synthetic
cccgagaatttcatgaccagcatgaaggggacgagctgcttgccgaaggaccccatccaggtgtaggtttctaca

SEQ ID NO: 238045 - DNA, 75 bp, Artificial Sequence
  Synthetic
tcgtaggtgacaaagagccgctccgtgcgaggatgagagccgattgggaagaactggatttcctgccaccagttg

SEQ ID NO: 238046 - DNA, 75 bp, Artificial Sequence
  Synthetic
agtagaaatcccgccggcgaaccgagcactcgtgctgatgcttgtaaaagcgtccgcagtactcgcagcgctgca

SEQ ID NO: 238047 - DNA, 75 bp, Artificial Sequence
  Synthetic
gaagtatctgaaggataaggaagaagctggcactacagatgcaaataccattaaggctcagaatgatgcagtccc

SEQ ID NO: 238048 - DNA, 75 bp, Artificial Sequence
  Synthetic
gagaggctgacgagcccgcgcgggagccaggtccagatctcggcgcggcgggggcggagagcgaagacgagggcg

SEQ ID NO: 238049 - DNA, 75 bp, Artificial Sequence
  Synthetic
aagaggagacaactttgcttcagcggcagatgccaaagcggcaggaaaagaaattgagttgaaagccattttaaa

SEQ ID NO: 238050 - DNA, 75 bp, Artificial Sequence
  Synthetic
tgtttaccaaggtgttaagttacaaactggtcaaactgacaaatggcagaaagatgatgatgtttcaacacaaaa

SEQ ID NO: 238051 - DNA, 75 bp, Artificial Sequence
  Synthetic
gcgtggcgctcgggcaggtcccggtgctgcgccctgagagcgctggcgtgcgcgacgacgcggcggttgacatcc

SEQ ID NO: 238052 - DNA, 75 bp, Artificial Sequence
  Synthetic
gctgcgccctgagagcgctggcgtgcgcgacgacgcggcggttgacatcctggatctgccgcctctgcgtgaaga

SEQ ID NO: 238053 - DNA, 75 bp, Artificial Sequence
  Synthetic
tccttcaagtacacgccggccaacgtcacgctgcccaccaacaccaacacctacgagtacatgaacggccgcgtg

SEQ ID NO: 238054 - DNA, 75 bp, Artificial Sequence
  Synthetic
ccgaccgtcctttcgctgttgccgctcagtcatccaactgaagtacatccattcccaaaggttgtgaagaagttc

SEQ ID NO: 238055 - DNA, 75 bp, Artificial Sequence
  Synthetic
ggtgaaggtcagttgcagggcgcgggcctcctcgttcagccaggtctggcacatcttctggaagatctcggtctg

SEQ ID NO: 238056 - DNA, 75 bp, Artificial Sequence
  Synthetic
aaaaacttcccccctggggtcctgtcacttaaactggctgatccaatcaccatcaacaatggggatgtctcactt

SEQ ID NO: 238057 - DNA, 75 bp, Artificial Sequence
  Synthetic
agcaacagactggtaacctaagcgtaaaccctgatgcacccttgcaagttgcaagtgataagctacagcttgctc

SEQ ID NO: 238058 - DNA, 75 bp, Artificial Sequence
  Synthetic
aaaccctgatgcacccttgcaagttgcaagtgataagctacagcttgctctggctcctccattcgaggtcagaga

SEQ ID NO: 238059 - DNA, 75 bp, Artificial Sequence
  Synthetic
acagccaggtcaaaacccactctattttcaaggtgctcgactgtggcttcgagcagtggctctacgcgtacatcc

SEQ ID NO: 238060 - DNA, 75 bp, Artificial Sequence
  Synthetic
aatggattaaaagtactagataattccattactggattgactggattattgaatacacttgtggtattaactgga

SEQ ID NO: 238061 - DNA, 75 bp, Artificial Sequence
  Synthetic
ccattactggattgactggattattgaatacacttgtggtattaactggaaggggaataggaacggaggaattaa

SEQ ID NO: 238062 - DNA, 75 bp, Artificial Sequence
  Synthetic
atctcgctgatgtcgccgatggcctccagcctttccatggcctcgtagaaatccacggcgaagttgaaaaactgg

SEQ ID NO: 238063 - DNA, 75 bp, Artificial Sequence
  Synthetic
aggagtcggcttgcgtgtaagacttggagatgacggcgggctgacatttgataaaaagggtgatttagtagcctg

SEQ ID NO: 238064 - DNA, 75 bp, Artificial Sequence
  Synthetic
ggagatgacggcgggctgacatttgataaaaagggtgatttagtagcctggaataaaaaagatgacaggcgcacc

SEQ ID NO: 238065 - DNA, 75 bp, Artificial Sequence
  Synthetic
cttcctcttcttccatgacgacctcttcttctatttcttcctctgggggcggtggtggtggcggggcccgacgac

SEQ ID NO: 238066 - DNA, 75 bp, Artificial Sequence
  Synthetic
gacggcgacgcaccgggagacggtcgacgaagcgctcgatcatctccccgcggcggcgacgcatggtttcggtga

SEQ ID NO: 238067 - DNA, 75 bp, Artificial Sequence
  Synthetic
caaattgcaaaatgagtacagaaaaggattctaaacttacgttgacacttacaaagtgtggaagtcaggttctgg

SEQ ID NO: 238068 - DNA, 75 bp, Artificial Sequence
  Synthetic
gacgaagcgctcgatcatctccccgcggcggcgacgcatggtttcggtgacggcgcgaccccgttcgcgaggacg

SEQ ID NO: 238069 - DNA, 75 bp, Artificial Sequence
  Synthetic
ggattctaaacttacgttgacacttacaaagtgtggaagtcaggttctgggaaatgtatctttacttgcagttac

SEQ ID NO: 238070 - DNA, 75 bp, Artificial Sequence
  Synthetic
actacaaagaaggatgtaaaaatatctttactatttgatgagaatggaattctattaccatcttcgtcccttagc

SEQ ID NO: 238071 - DNA, 75 bp, Artificial Sequence
  Synthetic
ctttactatttgatgagaatggaattctattaccatcttcgtcccttagcaaagattattggaattacagaagtg

SEQ ID NO: 238072 - DNA, 75 bp, Artificial Sequence
  Synthetic
gatcggagaatctttcgaggaaagcgtctagccaatcgcagtcgcaaggtaagctcaaacacgtagcagccctgt

SEQ ID NO: 238073 - DNA, 75 bp, Artificial Sequence
  Synthetic
taataatgcagttccattcatgccaaacctgacagcttatccaaaaccaagcgctcaaaatgcaaaaaactattc

SEQ ID NO: 238074 - DNA, 75 bp, Artificial Sequence
  Synthetic
agtctggagaagcatcgccagggttgagtcgcggcagaacccggttcgcggacggccgcggcgagcgggacttgg

SEQ ID NO: 238075 - DNA, 75 bp, Artificial Sequence
  Synthetic
aacctgacagcttatccaaaaccaagcgctcaaaatgcaaaaaactattcaagaactaaaatcataagtaatgtc

SEQ ID NO: 238076 - DNA, 75 bp, Artificial Sequence
  Synthetic
ctgtaattatcactattgcatttaatcaggaaactgaaaatggatgtgcttattctataacatttaccttcactt

SEQ ID NO: 238077 - DNA, 75 bp, Artificial Sequence
  Synthetic
gtttgatgttacatcttttaccttctcatatcttacccaagagaacaaagacaaagactaataaaatgttttgaa

SEQ ID NO: 238078 - DNA, 75 bp, Artificial Sequence
  Synthetic
ccccgacgcccctgagcggctgcacgagcgccaggtcggcgacgacgcgctcggcgaggatggcctgttgcacgc

SEQ ID NO: 238079 - DNA, 75 bp, Artificial Sequence
  Synthetic
gagcgccaggtcggcgacgacgcgctcggcgaggatggcctgttgcacgcgggtgagggtgtcctggaagtcgtc

SEQ ID NO: 238080 - DNA, 75 bp, Artificial Sequence
  Synthetic
agcatgaggcggtggtagccgtagaggtagcgggacatccaggtgatgccggcggcggtggtggaggcgcgcggg

SEQ ID NO: 238081 - DNA, 75 bp, Artificial Sequence
  Synthetic
gagacttggtagcatttaataaaaaagaagataagcgcaccctatggacaactccagacacatctccaaattgca

SEQ ID NO: 238082 - DNA, 75 bp, Artificial Sequence
  Synthetic
gggaactggatttagtgtctataagccacacagtttcctggcgagccaaacgggggtcggtgattgagatgaagc

SEQ ID NO: 238083 - DNA, 75 bp, Artificial Sequence
  Synthetic
aggctggagccgcgactaacgtggtattggcactcccgtctcgacccgagcccgatagccgccaggatacggcgg

SEQ ID NO: 238084 - DNA, 75 bp, Artificial Sequence
  Synthetic
gtggacgcctacatcaacatcggcgcccgctggtcgctggaccccatggacaatgtcaaccccttcaaccaccac

SEQ ID NO: 238085 - DNA, 75 bp, Artificial Sequence
  Synthetic
gccgaggaagaagccgctagtggaggaggaggtgatggaagaagaatgggacagccaggcagaggaggacgactg

SEQ ID NO: 238086 - DNA, 75 bp, Artificial Sequence
  Synthetic
tacgggagcgagcccccttttttctttttgccagatgcatcccgtcctgcgccaaatgcgtcccacccccccggc

SEQ ID NO: 238087 - DNA, 75 bp, Artificial Sequence
  Synthetic
tgatggaacccacgtgaccatcgtaccagatgcggcagtatatcaggtgcctgcccctcatgaacacactgccca

SEQ ID NO: 238088 - DNA, 75 bp, Artificial Sequence
  Synthetic
gcgtgcagctgcagaaggacgtgcgcccggcgtacgtgcctgcgcagaacctgttcagggaccgcagcggggagg

SEQ ID NO: 238089 - DNA, 75 bp, Artificial Sequence
  Synthetic
cgctcagtcatccaactgaagtacagccattcccgcaggttctccagcagctcctgtgcatctgatgaaacaaaa

SEQ ID NO: 238090 - DNA, 75 bp, Artificial Sequence
  Synthetic
ccctcgagctggaatgcatgcgccgcttcttcagcgaccccgacaccctgcgcaaggtcgaggagaccctgcact

SEQ ID NO: 238091 - DNA, 75 bp, Artificial Sequence
  Synthetic
ggaccgcggtcccagcttcaaaccctactcgggcacggcttacaacagcctggcccccaagggcgcccccaatcc

SEQ ID NO: 238092 - DNA, 75 bp, Artificial Sequence
  Synthetic
aagaagttaccaagacatttggaattgccgccatgggaggcagtaatatttctgaaaacggtttgcagattggaa

SEQ ID NO: 238093 - DNA, 75 bp, Artificial Sequence
  Synthetic
accaatatatgcagacaaaactttccagccagaacctcaagttggagaagaaaactggcaggataatgatgaata

SEQ ID NO: 238094 - DNA, 75 bp, Artificial Sequence
  Synthetic
agcgcagcctgagcttggccgagaaggtggcggcgatcaactactcggtgctgagcctgggcaagttttacgcgc

SEQ ID NO: 238095 - DNA, 75 bp, Artificial Sequence
  Synthetic
ggtggcggcgatcaactactcggtgctgagcctgggcaagttttacgcgcgcaagatttacaagacgccgtacgt

SEQ ID NO: 238096 - DNA, 75 bp, Artificial Sequence
  Synthetic
ctgagcctgggcaagttttacgcgcgcaagatttacaagacgccgtacgtgcccatagacaaggaggtgaagata

SEQ ID NO: 238097 - DNA, 75 bp, Artificial Sequence
  Synthetic
gcaagatttacaagacgccgtacgtgcccatagacaaggaggtgaagatagacagcttttacatgcgcatggcgc

SEQ ID NO: 238098 - DNA, 75 bp, Artificial Sequence
  Synthetic
gccctcagctcacgtctcagcgtcagctgcaaaaagtcactcaagtcctcagccactacagctgacaattcagag

SEQ ID NO: 238099 - DNA, 75 bp, Artificial Sequence
  Synthetic
ggaaggagggcaggctaaattgaaagaaacacccaatggcgctgatcctcaatatgatgtggacatggctttctt

SEQ ID NO: 238100 - DNA, 75 bp, Artificial Sequence
  Synthetic
cagccagaacctcaagttggagaagaaaactggcaggataatgatgaatattatggaggcagggctcttaaaaaa

SEQ ID NO: 238101 - DNA, 75 bp, Artificial Sequence
  Synthetic
aagttgcatgagaatttttgttgtactctttgtgctgagtttaataaaagctgaaataagaatcttctctggacc

SEQ ID NO: 238102 - DNA, 75 bp, Artificial Sequence
  Synthetic
agaggaggaggatgcacccgctgcggggtactgacgcctccgtgatgtgtttttagatgcagcaagccccggacc

SEQ ID NO: 238103 - DNA, 75 bp, Artificial Sequence
  Synthetic
gactgggaggccgcgatgcaacgcatcatggccctgacgacccgcaaccccgagtcctttagacaacagccgcag

SEQ ID NO: 238104 - DNA, 75 bp, Artificial Sequence
  Synthetic
acgcagcagcgcgcgtcatggctggtcagttgcaccacgctccgaccccagcggttctgggtcaccttggccttg

SEQ ID NO: 238105 - DNA, 75 bp, Artificial Sequence
  Synthetic
aggcggtggtcccctctcggaccaaccccacgcacgagaaggtgctggcgatcgtgaacgcgctggcggagaaca

SEQ ID NO: 238106 - DNA, 75 bp, Artificial Sequence
  Synthetic
ccttggacggtattcaaactaattcagcctaccaaggtgttaaactaaaggataatccaacaggaggcggagcta

SEQ ID NO: 238107 - DNA, 75 bp, Artificial Sequence
  Synthetic
atcgtgaacgcgctggcggagaacaaggccatccgtcccgacgaggccgggctggtgtacaacgccctgctggag

SEQ ID NO: 238108 - DNA, 75 bp, Artificial Sequence
  Synthetic
ggtgacggacgtgcgcgaggccgtggcgcagcgcgagcggttcaagaacgagggcctgggctcgctggtggcgct

SEQ ID NO: 238109 - DNA, 75 bp, Artificial Sequence
  Synthetic
gcagtaatggaaaagtcctctaaatagttgactaaaacaccaggtaccacaatgtggtagctgacaccgtggcgc

SEQ ID NO: 238110 - DNA, 75 bp, Artificial Sequence
  Synthetic
ccacgaacagccacgatgtaacatcaccacaggcaatgagaggaacgactgctctgtagtgatcaaatgcgagca

SEQ ID NO: 238111 - DNA, 75 bp, Artificial Sequence
  Synthetic
agggcctgggctcgctggtggcgctgaacgccttcctggcgacgcagccggcgaacgtgccgcgcgggcaggacg

SEQ ID NO: 238112 - DNA, 75 bp, Artificial Sequence
  Synthetic
aagaagcaacctttccaagagggcttcagaatcatgtatgaggatctagtagggggcaacatccccgccctcctg

SEQ ID NO: 238113 - DNA, 75 bp, Artificial Sequence
  Synthetic
tgaccagtgtcgtgctgctctctcttcttgtggtttttagtcagggaaaaatagatagtgaagatattattggtc

SEQ ID NO: 238114 - DNA, 75 bp, Artificial Sequence
  Synthetic
ggctgtggggcgtgcaggcgcccgtgggcgaccggtcgacggtgagcagcttgctgacgcccaactcgcggctgc

SEQ ID NO: 238115 - DNA, 75 bp, Artificial Sequence
  Synthetic
tggcatggaccaagagttcagctttgcgatggtccaaaaattttacatacagaatttaatcacacctgtaatgaa

SEQ ID NO: 238116 - DNA, 75 bp, Artificial Sequence
  Synthetic
aatgtcagaatgggacaaaatgtaactctagttgggccagtagatactccagttaattggcatggaccaaaacat

SEQ ID NO: 238117 - DNA, 75 bp, Artificial Sequence
  Synthetic
taaaaaccccgccaaaaaaaaacacacacgccctgggtgtttttcgcgaaaacacttccgcgttctcacttcctc

SEQ ID NO: 238118 - DNA, 75 bp, Artificial Sequence
  Synthetic
aggagggggccacccccagcgccgcgctggacatgaccgcgcgcaacatggaacctagcatgtacgccgccaacc

SEQ ID NO: 238119 - DNA, 75 bp, Artificial Sequence
  Synthetic
tacatccagaagttaatcatacatgcaatgaacagaacctcacattgctgtttgttaactacactttctggggag

SEQ ID NO: 238120 - DNA, 75 bp, Artificial Sequence
  Synthetic
ggcggaggcggagtcttccatgcgggtgaccccgacgcccctgagcggctgcacgagcgccaggtcggcgacgac

SEQ ID NO: 238121 - DNA, 75 bp, Artificial Sequence
  Synthetic
catactttggatttaacagatatggtactgacagagtgcattatgaggttacaataatagatggcttcgaaaatg

SEQ ID NO: 238122 - DNA, 75 bp, Artificial Sequence
  Synthetic
aagtcagcacaagcctagcagtaaagataggccaaatccaaaagtaaaaaatcctcagaaacaaaacacacacaa

SEQ ID NO: 238123 - DNA, 75 bp, Artificial Sequence
  Synthetic
ctaatcaaactcttgtgggacctcctggttcaaaagttgactggtatgaaggaaaaaatggtgaccttgtaaaac

SEQ ID NO: 238124 - DNA, 75 bp, Artificial Sequence
  Synthetic
ccacgaccggcagcggggcctggtgtgggacgacgaggactcggccgacgatagcagcgtgttggacttgggcgg

SEQ ID NO: 238125 - DNA, 75 bp, Artificial Sequence
  Synthetic
gttactgtctatacaataccgcgtaataaaactgttaaaattcaacctcataccacaaaaggaaccacagggggt

SEQ ID NO: 238126 - DNA, 75 bp, Artificial Sequence
  Synthetic
aggacctatatgatctggaggtagatgcccatgatgacgacccgaacgaagaggctgtgaatttaatatttccag

SEQ ID NO: 238127 - DNA, 75 bp, Artificial Sequence
  Synthetic
ctcgtacgagagcgtgatggcgcaggcgaccctggaggttccgtttgtgcctccgcggtatatggctcctacgga

SEQ ID NO: 238128 - DNA, 75 bp, Artificial Sequence
  Synthetic
gcgaccctggaggttccgtttgtgcctccgcggtatatggctcctacggagggcagaaacagcattcgttactcg

SEQ ID NO: 238129 - DNA, 75 bp, Artificial Sequence
  Synthetic
ctcgcgtgtacttggtggacaacaagtcggcggacatcgcttccctgaactaccaaaacgaccacagcaacttcc

SEQ ID NO: 238130 - DNA, 75 bp, Artificial Sequence
  Synthetic
tgaccacggtggtgcagaacaacgatttcacccccgccgaggccagcacgcagacgataaattttgacgagcggt

SEQ ID NO: 238131 - DNA, 75 bp, Artificial Sequence
  Synthetic
aaaatcgaggacttgttgcaggacatgggtggggatgaacctttggacctgagcttgaaacgccccaggaactag

SEQ ID NO: 238132 - DNA, 75 bp, Artificial Sequence
  Synthetic
tcgaatgcatgcgccgcttcttcaccgaccccgagaccctgcgcaaggtcgaggagaccctgcactacactttca

SEQ ID NO: 238133 - DNA, 75 bp, Artificial Sequence
  Synthetic
tatgagattacaatcattgaaattccaacaaccaaagctccaaccacagttaggacaactagggaaacaaccaca

SEQ ID NO: 238134 - DNA, 75 bp, Artificial Sequence
  Synthetic
cactatgtaaacgcaactatggggcaaaacttaacattagtgggacctgcaaacattccagttacttggcttagt

SEQ ID NO: 238135 - DNA, 75 bp, Artificial Sequence
  Synthetic
agcctaccactgtgcccaccacacatactgaaaccactactcaaactacacagctatacacaacagtgcagaata

SEQ ID NO: 238136 - DNA, 75 bp, Artificial Sequence
  Synthetic
gtgctgacgctgagcgacgacctgggcgtgtaccgcaacgaccgcatccacaaggccgtgagcacgagccggcgg

SEQ ID NO: 238137 - DNA, 75 bp, Artificial Sequence
  Synthetic
aacgagaccttcaacctcaccaaccagactgaggtaaaactcaactgcagaccaggggacaaatacatcctctgg

SEQ ID NO: 238138 - DNA, 75 bp, Artificial Sequence
  Synthetic
tgcttcggttaatgaaaccgtcatcgcattgaaactggatcaagatcgaggtttggatatgcaaattacttttct

SEQ ID NO: 238139 - DNA, 75 bp, Artificial Sequence
  Synthetic
gtttggatatgcaaattacttttctaattgtctgtgggatctttattcttgcggttcttctctactatgtctttt

SEQ ID NO: 238140 - DNA, 75 bp, Artificial Sequence
  Synthetic
ttcgcaagaagcaacctttccaagagggcttcagaatcatgtatgaggatctagaaggtggcaacatccccgccc

SEQ ID NO: 238141 - DNA, 75 bp, Artificial Sequence
  Synthetic
aatcgcaagcgcccagagcgcattacctggcatgagctacagatggagtgcagggatgaggtgggcctgatgcag

SEQ ID NO: 238142 - DNA, 75 bp, Artificial Sequence
  Synthetic
atttgcaactccagcgcaagagacagcagctgataagaaggtagaagtcttgcccattgaaaaggatgagagtgg

SEQ ID NO: 238143 - DNA, 75 bp, Artificial Sequence
  Synthetic
attcctaggttcttcctatttaacatcctcttctgtctcttcaacgtgtgcgctgccttcgcggccgtctcgcac

SEQ ID NO: 238144 - DNA, 75 bp, Artificial Sequence
  Synthetic
tgcagcactggaacaccatcagactggggtacttcacgctggccagcacgctcttgtcgctgatctgatccttgt

SEQ ID NO: 238145 - DNA, 75 bp, Artificial Sequence
  Synthetic
cccgaatacagggacgagaacgtagccagaatcttaaggctcatctgaccatgcagactctgctcatactgctat

SEQ ID NO: 238146 - DNA, 75 bp, Artificial Sequence
  Synthetic
ccccgagaagggggtgcagtcgtggacgctgctcaccaccccggacgtcacctgcggcgcggagcaagtctactg

SEQ ID NO: 238147 - DNA, 75 bp, Artificial Sequence
  Synthetic
ccagaatcttaaggctcatctgaccatgcagactctgctcatactgctatccctattctcccataccctcgctga

SEQ ID NO: 238148 - DNA, 75 bp, Artificial Sequence
  Synthetic
gtggtcccctctcggaccaaccccacgcacgagaaggtgctggcgatcgtgaacgcgctggcggagaacaaggcc

SEQ ID NO: 238149 - DNA, 75 bp, Artificial Sequence
  Synthetic
gagctatggaatttcttagactgctatgatgctaaaatggacatgccttcctattacttggtgattgtggggata

SEQ ID NO: 238150 - DNA, 75 bp, Artificial Sequence
  Synthetic
cgccgagctcatgcccttccgcgccaagagcttttacaacgacctcgccgtctactcccagctcatccgcagcta

SEQ ID NO: 238151 - DNA, 75 bp, Artificial Sequence
  Synthetic
tgtacaacgccctgctggagcgcgtgggccgctacaacagcacgaacgtgcagtccaacctggaccggctggtga

SEQ ID NO: 238152 - DNA, 75 bp, Artificial Sequence
  Synthetic
gcgcgagataaacagccgcctggacccgcggccgcccacggtggtggagatggaagatgcaactcttccgccgcc

SEQ ID NO: 238153 - DNA, 75 bp, Artificial Sequence
  Synthetic
ctcacagatcacgggacgctaccgctgcgcagcagtatccgcggagtccagcgagtgaccgtcactgacgcccgt

SEQ ID NO: 238154 - DNA, 75 bp, Artificial Sequence
  Synthetic
gttttaatccccaacaacctcaccagtggacttactttctctaccaacaaaacaaagctcatccttcaccaccct

SEQ ID NO: 238155 - DNA, 75 bp, Artificial Sequence
  Synthetic
aggccctgggcatagtcgcgccgcgcgtgctttccagtcgcaccttctaaaaaaatgtctattctcatctcgccc

SEQ ID NO: 238156 - DNA, 75 bp, Artificial Sequence
  Synthetic
tttaacaagacacgccggcttgtggaggatagttcagacgggtgctccggtttctggagacactggtttggaact

SEQ ID NO: 238157 - DNA, 75 bp, Artificial Sequence
  Synthetic
gcggtcatcgacagcgtggtggccgacgcgcgcgactatgccagacgcaagagccggcggcgacggatcgccagg

SEQ ID NO: 238158 - DNA, 75 bp, Artificial Sequence
  Synthetic
cgccaccggagcacgcccgccatgcgcgccgcccgggctctgctgcgccgcgccagacgcacgggccgccgggcc

SEQ ID NO: 238159 - DNA, 75 bp, Artificial Sequence
  Synthetic
ttcctcactcccccctttgtctcctccgatggattccaaaacttcccccctggggtcctgtcactcaaactggct

SEQ ID NO: 238160 - DNA, 75 bp, Artificial Sequence
  Synthetic
gctgaatcccactcccacgatcacggcatcttcttcctggggcatctcttcgtcggggtctaccttggtcacatg

SEQ ID NO: 238161 - DNA, 75 bp, Artificial Sequence
  Synthetic
atgtctcactcaaggtgggaggggggctcactgtggaacaagatagtggaaagttaattgtgaatcctaaggctc

SEQ ID NO: 238162 - DNA, 75 bp, Artificial Sequence
  Synthetic
gactcgcagacgagcggccgccgccgccgccgcggccatctctagcatgaccagacccaggcgcggaaacgtgta

SEQ ID NO: 238163 - DNA, 75 bp, Artificial Sequence
  Synthetic
ccagacccaggcgcggaaacgtgtactgggtgcgcgactccgtcacgggcgtgcgcgtgcccgtgcgcacccgtc

SEQ ID NO: 238164 - DNA, 75 bp, Artificial Sequence
  Synthetic
gtgcgcgtgcccgtgcgcacccgtcctcctcgtccctgatctaatgcttgtgtcctcccccgcaagcgacgatgt

SEQ ID NO: 238165 - DNA, 75 bp, Artificial Sequence
  Synthetic
aactcacacatttggcgtggcagccatgggaggagaaaacattacaaaaaatggtcttcaaattggcactgaaat

SEQ ID NO: 238166 - DNA, 75 bp, Artificial Sequence
  Synthetic
tggcacaagtgctcacggtggaaccatagatgtgagaatagggaaaaacggaagtcttgcatttgacaaagatgg

SEQ ID NO: 238167 - DNA, 75 bp, Artificial Sequence
  Synthetic
atgggaggagaaaacattacaaaaaatggtcttcaaattggcactgaaattaccgccgacaatcaaaagaaagaa

SEQ ID NO: 238168 - DNA, 75 bp, Artificial Sequence
  Synthetic
aaaaaaggatgaggtggacgagggggcagtagagtttgtgcgcgagttcgctccgcggcggcgcgtaaattggaa

SEQ ID NO: 238169 - DNA, 75 bp, Artificial Sequence
  Synthetic
cagaacctcaagtaggagaggagaactggcaagaaaatgaagtcttctatggcggcagagctctcaagaaagaaa

SEQ ID NO: 238170 - DNA, 75 bp, Artificial Sequence
  Synthetic
gaatatcagacatgcctgctacatctcagggaacggggcagaggtgatcatcgataccctggataaggctgcctt

SEQ ID NO: 238171 - DNA, 75 bp, Artificial Sequence
  Synthetic
ctggcaagaaaatgaagtcttctatggcggcagagctctcaagaaagaaacaaaaatgaagccttgttatggttc

SEQ ID NO: 238172 - DNA, 75 bp, Artificial Sequence
  Synthetic
ggaggtcaggcaaaattcaaaacacctgctgaaggacaggaacctaaagaacttgacattgaccttgctttcttt

SEQ ID NO: 238173 - DNA, 75 bp, Artificial Sequence
  Synthetic
tgatattcatgaacatcaagttcaatggagagaagtttaatggggtgctgttcatggccaacagccacatgaccc

SEQ ID NO: 238174 - DNA, 75 bp, Artificial Sequence
  Synthetic
ctgctgaaggacaggaacctaaagaacttgacattgaccttgctttctttgacactgacggcggaacagctgaca

SEQ ID NO: 238175 - DNA, 75 bp, Artificial Sequence
  Synthetic
gaggagctgatctcgctgccgctggacgaaagcaaccccacgccgagcctgaagcccgtgaccctgcagcaggtg

SEQ ID NO: 238176 - DNA, 75 bp, Artificial Sequence
  Synthetic
gtatgctgaaaatgtgaatcttgaaactccagatacacatgtagtttacaaaccaggcaaggaagatgacagttc

SEQ ID NO: 238177 - DNA, 75 bp, Artificial Sequence
  Synthetic
atggtgcccaagcgccggcgcgtggaggacgtgctggacaccgtgaaaatggatgtggagcccgaggtcaaggtg

SEQ ID NO: 238178 - DNA, 75 bp, Artificial Sequence
  Synthetic
aggacgtgctggacaccgtgaaaatggatgtggagcccgaggtcaaggtgcgccccatcaagcaggtggcgccgg

SEQ ID NO: 238179 - DNA, 75 bp, Artificial Sequence
  Synthetic
gttccctcgggccccggggcgaagttcccctcgcagatctgcatctcccaggctttcatctcggagggggggatc

SEQ ID NO: 238180 - DNA, 75 bp, Artificial Sequence
  Synthetic
atgcccaacagaccaaactacattggtttcagggacaactttgtaggtctcatgtattacaatagcactggcaac

SEQ ID NO: 238181 - DNA, 75 bp, Artificial Sequence
  Synthetic
acaacgggccatattttggttttggcaaagacaatgttgacagagagcagtatgaggtttccattattagtttat

SEQ ID NO: 238182 - DNA, 75 bp, Artificial Sequence
  Synthetic
tctaccgccgccacggctaccgagcctcccaggaggcgaagatggggcgccgccagccggctgatgcccaactac

SEQ ID NO: 238183 - DNA, 75 bp, Artificial Sequence
  Synthetic
gtggaactctgcggtggacagttacgatccagatgtcaggatcattgaaaatcacggtgtggaagatgaacttcc

SEQ ID NO: 238184 - DNA, 75 bp, Artificial Sequence
  Synthetic
catgcgtcgcatcatggatcagctcatcatgccccacatcgaggccctcgatgaaagtcaggagcagcgccccga

SEQ ID NO: 238185 - DNA, 75 bp, Artificial Sequence
  Synthetic
ttgggaactaatgctacctatcaaggtgtaaaagtatcaactggagatggtgctacgcaaagcggatgggcaaaa

SEQ ID NO: 238186 - DNA, 75 bp, Artificial Sequence
  Synthetic
gagagatggctctcacttgccgcctgcgcatccccgtcccgaattaccgaggaagatcccgccgcaggagaggca

SEQ ID NO: 238187 - DNA, 75 bp, Artificial Sequence
  Synthetic
caactaaaaccaagtccaatgtcagaccttacaccacaaagagcactacagttaatgcaacagatggaaatggtc

SEQ ID NO: 238188 - DNA, 75 bp, Artificial Sequence
  Synthetic
ccctttgtctcctccgatggattcaaaaacttcccccctggggtcctgtcactcaaactggctgatccaatcacc

SEQ ID NO: 238189 - DNA, 75 bp, Artificial Sequence
  Synthetic
tcatccccataatcgccgcggccatcggcacgatcccgggcatagcttccgttgcgctgcaggcgtcgcagcgcc

SEQ ID NO: 238190 - DNA, 75 bp, Artificial Sequence
  Synthetic
actcaaactggctgatccaatcaccatcaccaatggggatgtttcgcttaaggtgggaggtggtctcactttgca

SEQ ID NO: 238191 - DNA, 75 bp, Artificial Sequence
  Synthetic
tagactctgacacacctggtcctgtatatttttagaatggaagacatcaattttgcgtccctggctccgcggcac

SEQ ID NO: 238192 - DNA, 75 bp, Artificial Sequence
  Synthetic
aacatgaaaaacagagtgttcagtggggaaagaacataacgcttgtgggtcctaatgataaacctgttgaatggc

SEQ ID NO: 238193 - DNA, 75 bp, Artificial Sequence
  Synthetic
ttttgcgtccctggctccgcggcacggcacgcggccgttcatgggcacctggaacgagatcggcaccagccagct

SEQ ID NO: 238194 - DNA, 75 bp, Artificial Sequence
  Synthetic
aacactgaaccacctttgcaacttacaaataacaaattagggattgctttagacgctccatttgatgttatagac

SEQ ID NO: 238195 - DNA, 75 bp, Artificial Sequence
  Synthetic
aatactcttgtagtattaactggaaagggtattggaacagaatcaacagataatggtgggagcatatgcgttaga

SEQ ID NO: 238196 - DNA, 75 bp, Artificial Sequence
  Synthetic
ttattatttattttttcgcgcgcggtaggccctggtccacctctcccgatcattgagagtgcggtggattttttc

SEQ ID NO: 238197 - DNA, 75 bp, Artificial Sequence
  Synthetic
agaaggtcctccaggaatacctattgactggctcggaccaactaatcagctttgtaaaggaaaagaaattttaca

SEQ ID NO: 238198 - DNA, 75 bp, Artificial Sequence
  Synthetic
tttttattccaaacggtctcgaaggacgataaagtgcaagtcacgcaggtgacagcgttccccgccgctgtgctg

SEQ ID NO: 238199 - DNA, 75 bp, Artificial Sequence
  Synthetic
actgttaagttatgtatttatgaaattacaatcattgaaattccaacaaccaaagctccaaccacagttaggaca

SEQ ID NO: 238200 - DNA, 75 bp, Artificial Sequence
  Synthetic
gaatttcttagactgctatcaggagaaaatggatatgccttcctattacttggtgattgttggggtagtcatggt

SEQ ID NO: 238201 - DNA, 75 bp, Artificial Sequence
  Synthetic
gcgccgccgatgctattgaaagagaggaaagaggacactaaagggagagcttaacttgtatgtgccttaccgcca

SEQ ID NO: 238202 - DNA, 75 bp, Artificial Sequence
  Synthetic
ggaaagaggacactaaagggagagcttaacttgtatgtgccttaccgccagagaacgcgcgaagatggccacccc

SEQ ID NO: 238203 - DNA, 75 bp, Artificial Sequence
  Synthetic
ctcgatgatgccgcagtgggcgtacatgcacatcgccgggcaggacgcctcggagtacctgagcccgggtctggt

SEQ ID NO: 238204 - DNA, 75 bp, Artificial Sequence
  Synthetic
actgtggcaatcgtggtgggagtgattgcgggcttcataactataatcattgtcattctgtgctacatctgctgc

SEQ ID NO: 238205 - DNA, 75 bp, Artificial Sequence
  Synthetic
aaagacaccaatgctggcgatcaagcattaaaaacccacacacatggcgtagctgctatggggggaacagatatc

SEQ ID NO: 238206 - DNA, 75 bp, Artificial Sequence
  Synthetic
ccgcccggcactgcagggagcccggggatgagcagtgacaatgcaggatccagcgctcgtacccgctcaccatct

SEQ ID NO: 238207 - DNA, 75 bp, Artificial Sequence
  Synthetic
actgacggcgatggtcagctaactaaaaatcatgatatcacaatgaatttctttgacactcctggaggaacagtt

SEQ ID NO: 238208 - DNA, 75 bp, Artificial Sequence
  Synthetic
cctcgtccaaaatggcttccatgtccggccacgcctccgcgccgaccgttgacgccgtgcgtcgtgacgtcagta

SEQ ID NO: 238209 - DNA, 75 bp, Artificial Sequence
  Synthetic
ctacacagctagacactacagtgcagaatagtactgtgttggttaggtatttgttaagggaggaaagtactactg

SEQ ID NO: 238210 - DNA, 75 bp, Artificial Sequence
  Synthetic
gaatagtactgtgttggttaggtatttgttaagggaggaaagtactactgaacagacagaggctacctcaagtgc

SEQ ID NO: 238211 - DNA, 75 bp, Artificial Sequence
  Synthetic
acattgttatgtatgctgagaatgtgcatctggaaactccagacacgcatgtggtgtacaaaccaggaacttctg

SEQ ID NO: 238212 - DNA, 75 bp, Artificial Sequence
  Synthetic
aagcttggtataaaagcaggtcatggattgaaagtcattgacaactcaatttctggtttggaaggcttggtaggt

SEQ ID NO: 238213 - DNA, 75 bp, Artificial Sequence
  Synthetic
gcatctggaaactccagacacgcatgtggtgtacaaaccaggaacttctgatgagagttcagaagcaaatttggt

SEQ ID NO: 238214 - DNA, 75 bp, Artificial Sequence
  Synthetic
gattgaaagtcattgacaactcaatttctggtttggaaggcttggtaggtatgcttgtagttttgactggtcagg

SEQ ID NO: 238215 - DNA, 75 bp, Artificial Sequence
  Synthetic
tagtggaaatctaaaggtgaaccctaaagctcccttgcaagttgcagctgataaacagctggaaattgcactagc

SEQ ID NO: 238216 - DNA, 75 bp, Artificial Sequence
  Synthetic
aactacatcggcttcagggacaactttgtgggtctcatgtactataacagcactggcaacatgggtgtgctggct

SEQ ID NO: 238217 - DNA, 75 bp, Artificial Sequence
  Synthetic
tcaagaccctttgcggactccgcgacctcctccccatgaactgatgttgattaaaagcccaaaaaccaatcagcc

SEQ ID NO: 238218 - DNA, 75 bp, Artificial Sequence
  Synthetic
aaatatgacactcgcaccctttggacaactccagacccatcgccaaattgcaaagttcttgaagcgaaagactca

SEQ ID NO: 238219 - DNA, 75 bp, Artificial Sequence
  Synthetic
gattctctgggtgacagaaccagatactttagcatgtggaactctgcagtggacagttatgatcctgatgtcagg

SEQ ID NO: 238220 - DNA, 75 bp, Artificial Sequence
  Synthetic
gcggaagtcagatactagcaaatatgtcattgttaattcttaaaggaacatatgaatatataagtaacagtacag

SEQ ID NO: 238221 - DNA, 75 bp, Artificial Sequence
  Synthetic
gtcattgttaattcttaaaggaacatatgaatatataagtaacagtacagctaataagaattttactatcaagtt

SEQ ID NO: 238222 - DNA, 75 bp, Artificial Sequence
  Synthetic
atgaacttccaaactattgcttcccattggatggagctggcactaatgctacctaccaaggtgtaaaagttaaaa

SEQ ID NO: 238223 - DNA, 75 bp, Artificial Sequence
  Synthetic
acctaccaaggtgtaaaagttaaaaatggccaagatggagatgtaaacgcagattgggaaaaagatccaaatctt

SEQ ID NO: 238224 - DNA, 75 bp, Artificial Sequence
  Synthetic
atggatggttctagtcttgacaaagaatactggaactataaaagtgatgattcagtcatgtcaaaggcatatgaa

SEQ ID NO: 238225 - DNA, 75 bp, Artificial Sequence
  Synthetic
aatactggaactataaaagtgatgattcagtcatgtcaaaggcatatgaaaatgcagtaccattcatgcccaact

SEQ ID NO: 238226 - DNA, 75 bp, Artificial Sequence
  Synthetic
tgtccaggtcctcggcgttgctcaggccgaacggggtcatcttgcacagctggcggcccaggaagggcacgctct

SEQ ID NO: 238227 - DNA, 75 bp, Artificial Sequence
  Synthetic
ttctactgctaatccatctacagacaaaaaaagtaagggaaagaatgcaattgtatcgaatgtttatctggaagg

SEQ ID NO: 238228 - DNA, 75 bp, Artificial Sequence
  Synthetic
ctgtcactcaaactggctgacccaatcaccatcactaatggggatgtctcactcaaggtgggaggtggactcact

SEQ ID NO: 238229 - DNA, 75 bp, Artificial Sequence
  Synthetic
acctgcccgactcatacaagtacacgccggccaacgtcacgctgcccgccaataccaacacctacgagtacatga

SEQ ID NO: 238230 - DNA, 75 bp, Artificial Sequence
  Synthetic
aaaaaaagtaagggaaagaatgcaattgtatcgaatgtttatctggaaggaagggtgtatcagccagttgcaatt

SEQ ID NO: 238231 - DNA, 75 bp, Artificial Sequence
  Synthetic
gatgtacttattccatgacttttgattttgtttggagtaaagtgtataatgatccaattccatttgatacatcat

SEQ ID NO: 238232 - DNA, 75 bp, Artificial Sequence
  Synthetic
tcaccaaccagactgaggtaaaactcaactgcagaccagggggcaaatatatcatctggctctttgagaacactt

SEQ ID NO: 238233 - DNA, 75 bp, Artificial Sequence
  Synthetic
ttttgtttggagtaaagtgtataatgatccaattccatttgatacatcatctctgactttttcatatattgccca

SEQ ID NO: 238234 - DNA, 75 bp, Artificial Sequence
  Synthetic
caacgacggtattgaaatacccaacaaccttaccagtggactaacttacaccaccagaaagactaagctagtact

SEQ ID NO: 238235 - DNA, 75 bp, Artificial Sequence
  Synthetic
acgtgcccttccacatccaagtgccccaaaagttctttgccatcaagaacctgctcctgctccccggctcctaca

SEQ ID NO: 238236 - DNA, 75 bp, Artificial Sequence
  Synthetic
ccaccagaaagactaagctagtactctacaatccttttgtagagggaacctaccactgcaagagcggatcttgct

SEQ ID NO: 238237 - DNA, 75 bp, Artificial Sequence
  Synthetic
tggaagccatgctgcgcaacgacaccaacgaccagtccttcaacgactacctctcggccgccaacatgctctacc

SEQ ID NO: 238238 - DNA, 75 bp, Artificial Sequence
  Synthetic
agtccttaccaaatgcggatctcaaattctagcaaatgtgtctttgcttgctgttgctggaagttatcttaatat

SEQ ID NO: 238239 - DNA, 75 bp, Artificial Sequence
  Synthetic
ggtgggagtcatattgaagtggtcgggtatttgattttaggggtggtcctgggtgggtgcatagcggtgctatat

SEQ ID NO: 238240 - DNA, 75 bp, Artificial Sequence
  Synthetic
attctagcaaatgtgtctttgcttgctgttgctggaagttatcttaatatgacagctactactccaaagagtata

SEQ ID NO: 238241 - DNA, 75 bp, Artificial Sequence
  Synthetic
aagggcttctaattaatacatcttctattgacaaaggatattggaattatagaaataataacaacgttgttggaa

SEQ ID NO: 238242 - DNA, 75 bp, Artificial Sequence
  Synthetic
tattgacaaaggatattggaattatagaaataataacaacgttgttggaactgcctatgaaaacgcaattccatt

SEQ ID NO: 238243 - DNA, 75 bp, Artificial Sequence
  Synthetic
cctcaaccacaccttcaagaaggtctccatcatgttcgactcctcggtcagctggcccggcaacgaccggctgct

SEQ ID NO: 238244 - DNA, 75 bp, Artificial Sequence
  Synthetic
gatgccgatgtaggtgggataacagcgccccccgcggatgctggcgcgcacgtagtcatacaactcgtgcgaggg

SEQ ID NO: 238245 - DNA, 75 bp, Artificial Sequence
  Synthetic
agtaatcataagatgcgagcatgaatgtcctctcaacatcacattcaagaataagaccatgggaaatgtatgggt

SEQ ID NO: 238246 - DNA, 75 bp, Artificial Sequence
  Synthetic
tccatcatgttcgactcctcggtcagctggcccggcaacgaccggctgctcacgccgaacgagttcgagatcaag

SEQ ID NO: 238247 - DNA, 75 bp, Artificial Sequence
  Synthetic
ctgtgcttactcaataacatttgattttgcctggaacaaagactacgttggtcaatttgataccacctcttttac

SEQ ID NO: 238248 - DNA, 75 bp, Artificial Sequence
  Synthetic
cctgggcaacaagtttaggaaccccacggtggccccgacccacgatgtgaccacggaccggtcccagcgtctgac

SEQ ID NO: 238249 - DNA, 75 bp, Artificial Sequence
  Synthetic
ggaccgcatgtactccttcttccgcaacttccagcccatgagcaggcaggtggtcgatgagatcaactacaagga

SEQ ID NO: 238250 - DNA, 75 bp, Artificial Sequence
  Synthetic
aacttccagcccatgagcaggcaggtggtcgatgagatcaactacaaggactacaaggccgtcaccctgcccttc

SEQ ID NO: 238251 - DNA, 75 bp, Artificial Sequence
  Synthetic
aaaaattgctataaatctttttctttttcgcagaaccatgaatactttgaccagtgtcgtgctgctctctcttct

SEQ ID NO: 238252 - DNA, 75 bp, Artificial Sequence
  Synthetic
ccagtgtcgtgctgctctctcttcttgtggtttttagtcagggacaaatagaacatgaaaaacagagtgttcagt

SEQ ID NO: 238253 - DNA, 75 bp, Artificial Sequence
  Synthetic
ggggaaagaacataacgcttgtgggtcctaacgataagcctgttgaatggcatgggcctagagatcagctttgta

SEQ ID NO: 238254 - DNA, 75 bp, Artificial Sequence
  Synthetic
attcaatcacacatgtaatgaacaaaacctcacactgctgtttgtgaacaacactttccagggaaaatattatgg

SEQ ID NO: 238255 - DNA, 75 bp, Artificial Sequence
  Synthetic
tcgaggtggaccccatggatgagcccaccctcctctatcttctcttcgaagttttcgacgtggtcagagtgcacc

SEQ ID NO: 238256 - DNA, 75 bp, Artificial Sequence
  Synthetic
caccctcctctatcttctcttcgaagttttcgacgtggtcagagtgcaccagccgcaccgcggcgtcatcgaggc

SEQ ID NO: 238257 - DNA, 75 bp, Artificial Sequence
  Synthetic
acactttccagggaaaatattatggctttagaaatgatggtaaaggtatgaaacaaattgaactaacagtagtcc

SEQ ID NO: 238258 - DNA, 75 bp, Artificial Sequence
  Synthetic
gggttctacacgggcgagtacgacatgcccgaccccaacgatgggttcctgtgggacgacgtggacagcgcggtg

SEQ ID NO: 238259 - DNA, 75 bp, Artificial Sequence
  Synthetic
tttgtcaaagccaaaacaagtcaatgtccaatatggacataatgtaacattagaaggtcctccaggaatacctat

SEQ ID NO: 238260 - DNA, 75 bp, Artificial Sequence
  Synthetic
cacgacgcacggccgacggtcgccgcggaggcgtggcctagcccggaagcaagtcgcggggctgatgacgtataa

SEQ ID NO: 238261 - DNA, 75 bp, Artificial Sequence
  Synthetic
tgactggcttggaccaactaatcagctttgtaaaggaaaacaaattttacatccagaaataaaccacacctgcaa

SEQ ID NO: 238262 - DNA, 75 bp, Artificial Sequence
  Synthetic
gtaaactacactcatcgcggagcgtattttggctttaacaaagacggaactgataggcaacactatgaagttact

SEQ ID NO: 238263 - DNA, 75 bp, Artificial Sequence
  Synthetic
attttggctttaacaaagacggaactgataggcaacactatgaagttactattctagatggcttcagagatgcag

SEQ ID NO: 238264 - DNA, 75 bp, Artificial Sequence
  Synthetic
tcataaaacaaaaggaaaaacttcttcaaaacagaaaaaaacacaaaaaaataactctcatagaaatgatgatgt

SEQ ID NO: 238265 - DNA, 75 bp, Artificial Sequence
  Synthetic
tcaaaacagaaaaaaacacaaaaaaataactctcatagaaatgatgatgttaaagagttagattttccaagtgga

SEQ ID NO: 238266 - DNA, 75 bp, Artificial Sequence
  Synthetic
ctgttgcatgttcttgcatgccttcgtgcactggcccgaccgacccatggacgggaaccccaccatgaacttgct

SEQ ID NO: 238267 - DNA, 75 bp, Artificial Sequence
  Synthetic
ctggttcaaaagttgattggtacacaacaaaaaatggtgactttacaaaattgtgcgatggattgaacggtccaa

SEQ ID NO: 238268 - DNA, 75 bp, Artificial Sequence
  Synthetic
ccccctccactttcataatcaggcagaccttcatattagcagcagatctggctgctccaaaacctgcagcgtgtt

SEQ ID NO: 238269 - DNA, 75 bp, Artificial Sequence
  Synthetic
aacaaaaaatggtgactttacaaaattgtgcgatggattgaacggtccaaagaatctgtgtaattatcagaactt

SEQ ID NO: 238270 - DNA, 75 bp, Artificial Sequence
  Synthetic
ctgccctgtgacctgagctcgcgtctaagcgtcagctgtaaaaagtcactcaagtcctgggccaccacagatgcc

SEQ ID NO: 238271 - DNA, 75 bp, Artificial Sequence
  Synthetic
gatgaaggaacttattttgggtctaatgaacagtcaaagcattacagagttactgtctatacaaaacctagaaat

SEQ ID NO: 238272 - DNA, 75 bp, Artificial Sequence
  Synthetic
atgaacagtcaaagcattacagagttactgtctatacaaaacctagaaatcaaactaaaagaattcagccatata

SEQ ID NO: 238273 - DNA, 75 bp, Artificial Sequence
  Synthetic
actggagtatatgcaagttatttaaaagtcgaaggggttctcgcgctcgtcgttgtgcgccgcgctggggagggc

SEQ ID NO: 238274 - DNA, 75 bp, Artificial Sequence
  Synthetic
ctgacagcgcgtcgctcaagcatggttagtacagatgagagtctgaaaaagagaaagcatgcactaaaccaaagt

SEQ ID NO: 238275 - DNA, 75 bp, Artificial Sequence
  Synthetic
gggcggagatcttgaaatcgcagttggggccggtgctctgcgcgcgcgagttgcggtacacggggttgcagcact

SEQ ID NO: 238276 - DNA, 75 bp, Artificial Sequence
  Synthetic
ctcagtaactttcatttcagaaccatgaaggctttaacagcttttggtctgatcttaatcacactaagctacact

SEQ ID NO: 238277 - DNA, 75 bp, Artificial Sequence
  Synthetic
ttgcggtacacggggttgcagcactggaacaccatcagactggggtacttcacactggccagcacgctcttgtcg

SEQ ID NO: 238278 - DNA, 75 bp, Artificial Sequence
  Synthetic
ttaatgtaaccagaggagaaaatattacactctcaggagcaggaattaatactacatggacagcttatcataata

SEQ ID NO: 238279 - DNA, 75 bp, Artificial Sequence
  Synthetic
tacactctcaggagcaggaattaatactacatggacagcttatcataatagtggaaatggaggaaaacatggatg

SEQ ID NO: 238280 - DNA, 75 bp, Artificial Sequence
  Synthetic
aagggcacgctctgaggcttgtggttacactcgcagtgcacgggcatcagcatcatccccgcgccgcgctgcata

SEQ ID NO: 238281 - DNA, 75 bp, Artificial Sequence
  Synthetic
gggcgctatctgtgcaatggcaacagcagtactatttctaatcttacatttgtagcaagcagaaattcttctgac

SEQ ID NO: 238282 - DNA, 75 bp, Artificial Sequence
  Synthetic
agcgagacccaggtcatcggtaccttcgagctgcaaggtccgcaggagtccaccgctccgctgaaactcacgccg

SEQ ID NO: 238283 - DNA, 75 bp, Artificial Sequence
  Synthetic
ctaataatgatgattatgaagttgtaaaatcatgttattataatgttaaaatcattgagcttccaaccactagag

SEQ ID NO: 238284 - DNA, 75 bp, Artificial Sequence
  Synthetic
acagtcctctactaaagagacaacacagcctaccactgtgcccactacacaaccaaccaccacagccagtacaac

SEQ ID NO: 238285 - DNA, 75 bp, Artificial Sequence
  Synthetic
cagcctaccactgtgcccactacacaaccaaccaccacagccagtacaactattgagaccactactcacactaca

SEQ ID NO: 238286 - DNA, 75 bp, Artificial Sequence
  Synthetic
cgttacgtcacttctgcccttacatgtaactcagtcgtagggcgccatcttgcccacgtccaaaatggcttccat

SEQ ID NO: 238287 - DNA, 75 bp, Artificial Sequence
  Synthetic
tcagctgcaaaaagtcactcaagtcctcggccactacagctgacaattcagagccagggctaagcgtgggactgg

SEQ ID NO: 238288 - DNA, 75 bp, Artificial Sequence
  Synthetic
gtactgtgttggttaggtttttgttgagggaggaaagtactactgaacagacagaggctacctcaagtgccttca

SEQ ID NO: 238289 - DNA, 75 bp, Artificial Sequence
  Synthetic
gtaaacaaaagttaatatgcaaatgagcttttaaattttaacggttttagggcagggccaatgttaattggttaa

SEQ ID NO: 238290 - DNA, 75 bp, Artificial Sequence
  Synthetic
agcttttaaattttaacggttttagggcagggccaatgttaattggttaacaagcggtaatgcagttgacgtcaa

SEQ ID NO: 238291 - DNA, 75 bp, Artificial Sequence
  Synthetic
tcatccaggtctggcacatcttttggaagatctcggtctgctcgggcatgagcttgtaagcatcgcgcaggccgc

SEQ ID NO: 238292 - DNA, 75 bp, Artificial Sequence
  Synthetic
agcggactttaaacccggaaacggccgattttcccacggccacgcccggatatgaggtaattttgggcggttgca

SEQ ID NO: 238293 - DNA, 75 bp, Artificial Sequence
  Synthetic
cacgcctcgcccgactgtctcgggcccttccccacctacctcctctttgccctgctcacctgcacctgcgtctgc

SEQ ID NO: 238294 - DNA, 75 bp, Artificial Sequence
  Synthetic
ggatatcttagagtatcagtggtttgagtttaccctgcccgagggcaacttttccgagaccatgaccatagacct

SEQ ID NO: 238295 - DNA, 75 bp, Artificial Sequence
  Synthetic
ggcttgcttcttttttggagggctgtccacggggaccacgtcctcctcggaagacccggagcccacccgctgata

SEQ ID NO: 238296 - DNA, 75 bp, Artificial Sequence
  Synthetic
gagtagagttttctctaaactgtgctcccaaagtttaagaaaaatgagacacctgcacctcctgtcttcaactgt

SEQ ID NO: 238297 - DNA, 75 bp, Artificial Sequence
  Synthetic
gcgccagtccctcatcctccgggacgccctggccgaccggagcgaaacccccctcagcgtcgaggagctgtgtcg

SEQ ID NO: 238298 - DNA, 75 bp, Artificial Sequence
  Synthetic
ggcctacgagctcaacctcttctcgccgcgcgtgccccccaaacgccagcccaacggcacctgcgagcccaaccc

SEQ ID NO: 238299 - DNA, 75 bp, Artificial Sequence
  Synthetic
ctctggggcccggcgcgcgcatacctgatatcgcttccctggaagaggtgcccaagatcttcgaagggctcggtc

SEQ ID NO: 238300 - DNA, 75 bp, Artificial Sequence
  Synthetic
ccacaaaccttttgtagagggaacctaccagtgccgacacggaccttgtgttcacacattccaattggtgaacct

SEQ ID NO: 238301 - DNA, 75 bp, Artificial Sequence
  Synthetic
ggtcacactagcgccctggtagagttggaaggcgacaacgccaggctggccgtgctcaagcgcagcgtcgagctc

SEQ ID NO: 238302 - DNA, 75 bp, Artificial Sequence
  Synthetic
gggtgggtgcatagcggtgctgtatcaacttccttgctgggtcgaaatcagggtatttatctgctgggtcagaca

SEQ ID NO: 238303 - DNA, 75 bp, Artificial Sequence
  Synthetic
ttaagaaggattataaagaggaatttgaaaatctttttgccgactgctctggcctgctagattctctgaatcttg

SEQ ID NO: 238304 - DNA, 75 bp, Artificial Sequence
  Synthetic
cccccgcaggcaggactcgcagacgagcggccgctgccgccgccgcggccatctctagcatgaccagacccaggc

SEQ ID NO: 238305 - DNA, 75 bp, Artificial Sequence
  Synthetic
gcgcgctggctcgggacccgcgagccccaggctttggaacagcggcgcaagctcatgctggccgtggtcctggtc

SEQ ID NO: 238306 - DNA, 75 bp, Artificial Sequence
  Synthetic
ttgtctcctccgatggattcaaaaacttcccccctggggtcctgtcactcaaactggctgacccaatcaccatag

SEQ ID NO: 238307 - DNA, 75 bp, Artificial Sequence
  Synthetic
ggaagtctgactgtagaccctaaggctcccttgcaacttgcaaatgataaaaaacttgagcttgtttatgatgat

SEQ ID NO: 238308 - DNA, 75 bp, Artificial Sequence
  Synthetic
gccggtgtgatgaatatgaattccatgatattcatgaacatcaagttcaatggagagaagtttaatggggtgctg

SEQ ID NO: 238309 - DNA, 75 bp, Artificial Sequence
  Synthetic
aaaagtattagatgacaaaagtgctggagggttgaaagatttaattggcaaacttgtggttttaacaggaaaagg

SEQ ID NO: 238310 - DNA, 75 bp, Artificial Sequence
  Synthetic
ttggccaccagtcccttttccaggaaagggtactccacagccttgatttttccagcccagggcgcactacagccg

SEQ ID NO: 238311 - DNA, 75 bp, Artificial Sequence
  Synthetic
gacgatggtagtagcagaggggttggtataaatgtaagactcggcacagatggaggtctgtcctttgacaggaaa

SEQ ID NO: 238312 - DNA, 75 bp, Artificial Sequence
  Synthetic
tatgtccgcgactgcgtctttctctttctctgccacacatggcaagcagccatgggcgtgtggcagcagtgtctc

SEQ ID NO: 238313 - DNA, 75 bp, Artificial Sequence
  Synthetic
tctattattgttcttaagggtaaatatgaatttgttaaaaaagaaacagagcctaagtcctttgatgttaaattg

SEQ ID NO: 238314 - DNA, 75 bp, Artificial Sequence
  Synthetic
gttgtaatggtacactaatagggccacctaaaactccagttgagtggtatgatggcagaggacacaaactttgtg

SEQ ID NO: 238315 - DNA, 75 bp, Artificial Sequence
  Synthetic
ctgtttgacagcaaaggagtgcttctaccaacttcaaatctttccaaagaatattggaactatagaagttatgat

SEQ ID NO: 238316 - DNA, 75 bp, Artificial Sequence
  Synthetic
atattggaactatagaagttatgataacaacataggaactccttatgaaaatgcagttccatttatgccaaatct

SEQ ID NO: 238317 - DNA, 75 bp, Artificial Sequence
  Synthetic
aacaacataggaactccttatgaaaatgcagttccatttatgccaaatctaaaagcttatccaaaaccaactaaa

SEQ ID NO: 238318 - DNA, 75 bp, Artificial Sequence
  Synthetic
gcttagcaaggtgctgacatccatggccaggggagtgaagagggagaggagcgatgggggcaataccgggctgat

SEQ ID NO: 238319 - DNA, 75 bp, Artificial Sequence
  Synthetic
ccctactcgggcacggcttacaacagcctggcccccaagggcgcccccaattccagtcagtgggaacagaaaaag

SEQ ID NO: 238320 - DNA, 75 bp, Artificial Sequence
  Synthetic
cacctgttctgacaacacgaaggcctttattaaaacctgaagatgttgtaattactaagggaaacaacaaaactc

SEQ ID NO: 238321 - DNA, 75 bp, Artificial Sequence
  Synthetic
tgtaagcaacttctactttggagggcaagcatatcaacctgggacaataataattaagtttaatgaggaaataga

SEQ ID NO: 238322 - DNA, 75 bp, Artificial Sequence
  Synthetic
attactaagggaaacaacaaaactcttgtgggacctccagatacaccagttgattggtatgatggctcaggacat

SEQ ID NO: 238323 - DNA, 75 bp, Artificial Sequence
  Synthetic
ccgcagcacgcggatctcacggcctgcgtcatcacccagggcgcgatcctcgcccaattgcacgccatccaaaaa

SEQ ID NO: 238324 - DNA, 75 bp, Artificial Sequence
  Synthetic
gcgtcatcacccagggcgcgatcctcgcccaattgcacgccatccaaaaatcccgccaagagtttcttctgaaaa

SEQ ID NO: 238325 - DNA, 75 bp, Artificial Sequence
  Synthetic
cgcccaattgcacgccatccaaaaatcccgccaagagtttcttctgaaaaagggtagaggggtctacctggaccc

SEQ ID NO: 238326 - DNA, 75 bp, Artificial Sequence
  Synthetic
aactaaaacaggaaaaagatgagaaaccaaggtctggccatgacaagcagaaatcaaaatcacaggaaagacaaa

SEQ ID NO: 238327 - DNA, 75 bp, Artificial Sequence
  Synthetic
aagcaggagccgctagtggaggagatggaagaagaatgggacagccaggcagaggaggacgaatgggaggaggag

SEQ ID NO: 238328 - DNA, 75 bp, Artificial Sequence
  Synthetic
acatagagatgttgtcaaagaagttagttttagaactggaactaatcaaactctagtgggacctccaggatctaa

SEQ ID NO: 238329 - DNA, 75 bp, Artificial Sequence
  Synthetic
ggtgggacatttagtgaactttgtaaaggcgatgataaacactattcttgcaattctcaaaacttgacaataatc

SEQ ID NO: 238330 - DNA, 75 bp, Artificial Sequence
  Synthetic
gacggtaagcacgagcggcagggctaccgatcatggagggcccacaaagccgcgatcatcgcctgcttgcaagac

SEQ ID NO: 238331 - DNA, 75 bp, Artificial Sequence
  Synthetic
gccgctacctgctcttccaccgcggggtgaacatcccccgcaacgtgttgcattactaccgtcaccttcacagct

SEQ ID NO: 238332 - DNA, 75 bp, Artificial Sequence
  Synthetic
ccatatcctgaagaacatccatgtgacctcccaccccagaaaaaagtggccagtgtttgagaataacctgctgat

SEQ ID NO: 238333 - DNA, 75 bp, Artificial Sequence
  Synthetic
aactacaactgaaggaactacaaaaagcagcactaatgaatcagatgaaaactttgctttgcaacagggtaacaa

SEQ ID NO: 238334 - DNA, 75 bp, Artificial Sequence
  Synthetic
agcagcactaatgaatcagatgaaaactttgctttgcaacagggtaacaatggggaaaataatcaatctgatgaa

SEQ ID NO: 238335 - DNA, 75 bp, Artificial Sequence
  Synthetic
tttatgccatttttcagcagagtcgaggtcagcagcaagagctcaaagtaaaaaaccggtctctgcgctcgctca

SEQ ID NO: 238336 - DNA, 75 bp, Artificial Sequence
  Synthetic
cggatctggcagcagtactgcttttcagggagttaaagtaaaaaccccggctggtactggtcaaaacactgtatg

SEQ ID NO: 238337 - DNA, 75 bp, Artificial Sequence
  Synthetic
aaatgaagccatgctatggttcatttgctaaacccacaaacaaggaaggtgggcaggctaaattgaaagaaacac

SEQ ID NO: 238338 - DNA, 75 bp, Artificial Sequence
  Synthetic
aggtcagcagcaagagctcaaagtaaaaaaccggtctctgcgctcgctcacccgcagttgcttgtaccacaaaaa

SEQ ID NO: 238339 - DNA, 75 bp, Artificial Sequence
  Synthetic
gaagacgccgaggctctgttccacaagtactgcgcgctcactcttaaagactaaggcgcgcccacccggaaaaaa

SEQ ID NO: 238340 - DNA, 75 bp, Artificial Sequence
  Synthetic
tgttgtacactgaaaatgtagatttggaaactccagatacacatgtggtgtacaaaccaggcaaagaggatgaca

SEQ ID NO: 238341 - DNA, 75 bp, Artificial Sequence
  Synthetic
tcaaaaacttaatcttactaggggagaaaacattacactcgcaggagcaggtcttaacaacacatggtctgtata

SEQ ID NO: 238342 - DNA, 75 bp, Artificial Sequence
  Synthetic
ggcgggaattacctcatcgccaccatgagcaaggagattcccaccccttacatgtggagctatcagccccagatg

SEQ ID NO: 238343 - DNA, 75 bp, Artificial Sequence
  Synthetic
gttctgaagctaatttaactcagcagtccatgcctaacagaccaaactacattggcttcagagacaactttgtgg

SEQ ID NO: 238344 - DNA, 75 bp, Artificial Sequence
  Synthetic
gaaaacattacactcgcaggagcaggtcttaacaacacatggtctgtatatcaccatgatggacaaaaaaatgga

SEQ ID NO: 238345 - DNA, 75 bp, Artificial Sequence
  Synthetic
tggtcgctggaccccatggacaacgtcaaccccttcaaccaccaccgcaacgcgggcctgcgctaccgctccatg

SEQ ID NO: 238346 - DNA, 75 bp, Artificial Sequence
  Synthetic
aacgccatggccaataacgggatagagagtctggtggacaaactgaaccgctggaagacctacgctcaggaccat

SEQ ID NO: 238347 - DNA, 75 bp, Artificial Sequence
  Synthetic
acggtcgctacgtctgcaaaggagatagcaatactatcactaatcttactgtagtggctaatgcaaatttaacta

SEQ ID NO: 238348 - DNA, 75 bp, Artificial Sequence
  Synthetic
aagctcaacccgcgtaattggccctccaccctggtgtatcaggaaatccccgggccgactaccgtactacttccg

SEQ ID NO: 238349 - DNA, 75 bp, Artificial Sequence
  Synthetic
ttactaagactcagtcactttcatttcagaaccatgaaggctttcacagcttgcgttctgattagcctagtcaca

SEQ ID NO: 238350 - DNA, 75 bp, Artificial Sequence
  Synthetic
cgggccgactaccgtactacttccgcgtgacgcactggccgaagtccgcatgactaactcaggtgtccagctggc

SEQ ID NO: 238351 - DNA, 75 bp, Artificial Sequence
  Synthetic
actaaattatgcatttatgaggtgtcaatcattgaacttccaaccactagagcaccaaccacagttaggacaact

SEQ ID NO: 238352 - DNA, 75 bp, Artificial Sequence
  Synthetic
tgactaactcaggtgtccagctggccggcggcgcttcccggtgcccgctccgcccacaatcgggtataaaaaccc

SEQ ID NO: 238353 - DNA, 75 bp, Artificial Sequence
  Synthetic
caatcattgaacttccaaccactagagcaccaaccacagttaggacaactagggaaacaactactgaacccacta

SEQ ID NO: 238354 - DNA, 75 bp, Artificial Sequence
  Synthetic
tagcaatactatcactaatcttactgtagtggctaatgcaaatttaactagcagaaaatttcaatcatatagcta

SEQ ID NO: 238355 - DNA, 75 bp, Artificial Sequence
  Synthetic
gtcctttcgctgctgccgctcagtcatccaactgaagtacatccattctcgaagattctggagaagttcctctgc

SEQ ID NO: 238356 - DNA, 75 bp, Artificial Sequence
  Synthetic
ccaggccaacctgtggaagagttttctgtactcgaacgtggccctgtacctgcccgactcctacaagtacacgcc

SEQ ID NO: 238357 - DNA, 75 bp, Artificial Sequence
  Synthetic
ctccatcccctcgcgcaactgggccgccttccgcggctggagtttcacccggctcaagaccaaggaaactccctc

SEQ ID NO: 238358 - DNA, 75 bp, Artificial Sequence
  Synthetic
gtacaactactgagaccactactcaaactacacagctagacacaacagtgcagaatagcactgtgttggttaggt

SEQ ID NO: 238359 - DNA, 75 bp, Artificial Sequence
  Synthetic
ctggaccactgccgccgcctgcgctgcttcgcccgggagagctgcggactcatctactttgagtttcccgaggag

SEQ ID NO: 238360 - DNA, 75 bp, Artificial Sequence
  Synthetic
caatgtgaacgagtacatgttcaccagcaagtttaaggcgcgggtgatggtggctagaaaaaaggcggaaggggc

SEQ ID NO: 238361 - DNA, 75 bp, Artificial Sequence
  Synthetic
caccccaacggtcctgcacacggagtgcggatcaccgtagagggcaccaccgagtctcacctggtcaggttcttc

SEQ ID NO: 238362 - DNA, 75 bp, Artificial Sequence
  Synthetic
cgagtctcacctggtcaggttcttcacccagcaacccttcctggtcgagcgggaccggggcgccaccacctacac

SEQ ID NO: 238363 - DNA, 75 bp, Artificial Sequence
  Synthetic
caacatgatcctgcagagttccctcggaaacgacctgcgcgtcgacggcgcctccgtccgcttcgacagcgtcaa

SEQ ID NO: 238364 - DNA, 75 bp, Artificial Sequence
  Synthetic
atgcaaatttgtggaactatggaatttcttagactgctatgatgctaaaatggatatgccttcatattacttggt

SEQ ID NO: 238365 - DNA, 75 bp, Artificial Sequence
  Synthetic
gtctacctcaccaaccagactgaggtaaaactcacctgcagaccacacaagacctatatcatctggttcttcgag

SEQ ID NO: 238366 - DNA, 75 bp, Artificial Sequence
  Synthetic
ctcactgcaacgacggtgttgaacttccaaacaacctttccagtggactgagttacgatacacatagagctaagc

SEQ ID NO: 238367 - DNA, 75 bp, Artificial Sequence
  Synthetic
gccaagcctcctcgtagatgggatcgagtgaagggtgacggtaagcacgagcggcagggctaccgatcatggagg

SEQ ID NO: 238368 - DNA, 75 bp, Artificial Sequence
  Synthetic
gtgagctaaggcttcccccttctgaggagggggttagcccatacgaagtggtcgggtatttgattttaggggtgg

SEQ ID NO: 238369 - DNA, 75 bp, Artificial Sequence
  Synthetic
tgcatctactccctcctcaagaccctttgcggactccgcgacctcctccccatgaactgatgttgattaaaagcc

SEQ ID NO: 238370 - DNA, 75 bp, Artificial Sequence
  Synthetic
gtagtcattcaaggccataaatctgccttggtagccattaggaatcagcacgctcactctcaggtgaagcaaaac

SEQ ID NO: 238371 - DNA, 75 bp, Artificial Sequence
  Synthetic
gcggacttccaccgccgccgccgtgcgcaccaccgtcgacgacgtcatcgactcggtggtcgccgacgcgcgcaa

SEQ ID NO: 238372 - DNA, 75 bp, Artificial Sequence
  Synthetic
agaataaatcattggaactaatcattcaataaagatcacttacttgaaatctgaaagtatgtctctggtgtagtt

SEQ ID NO: 238373 - DNA, 75 bp, Artificial Sequence
  Synthetic
gcagcgccctggcctcctcgcccgaccgctgtctcagcctcgagcagtccacccagaccgtgcaggggcccgact

SEQ ID NO: 238374 - DNA, 75 bp, Artificial Sequence
  Synthetic
tgagcagaactacacggtcactgtccatggtagcgatggaaatcacactttcggtttcaaattcatttttgaagt

SEQ ID NO: 238375 - DNA, 75 bp, Artificial Sequence
  Synthetic
gctagacttcatggcttgtggccccctaccaaggaaaacatggttgggttttctttggcttttgtgatcatggcc

SEQ ID NO: 238376 - DNA, 75 bp, Artificial Sequence
  Synthetic
gccgccgccgcggccatctctagcatgaccagacccaggcgcggaaacgtgtactgggtgcgcgactccgtcacg

SEQ ID NO: 238377 - DNA, 75 bp, Artificial Sequence
  Synthetic
aaggaaaaattgctataaattctttttcttttcacagcaccatgaatactttgaccagtgtcgtgctgctctctc

SEQ ID NO: 238378 - DNA, 75 bp, Artificial Sequence
  Synthetic
acatgtaactcagccgtatggcgccatattgcccacgtccaaaatggcttccatgtccagccacgcctccgcgcc

SEQ ID NO: 238379 - DNA, 75 bp, Artificial Sequence
  Synthetic
aatggggatgtctcactcaagttgggaggcggactgacggtggaaaaagagtctggaaacttaactgtgaaccct

SEQ ID NO: 238380 - DNA, 75 bp, Artificial Sequence
  Synthetic
atattgcccacgtccaaaatggcttccatgtccagccacgcctccgcgccgaccgttgacgccgtgcgtgttgac

SEQ ID NO: 238381 - DNA, 75 bp, Artificial Sequence
  Synthetic
gacaattggaattagcatatgattctccatttgatgttaaaaacaatatgcttactcttaaagcaggtcacggct

SEQ ID NO: 238382 - DNA, 75 bp, Artificial Sequence
  Synthetic
tccatttgatgttaaaaacaatatgcttactcttaaagcaggtcacggcttagcagttgtaacgaaagacaatac

SEQ ID NO: 238383 - DNA, 75 bp, Artificial Sequence
  Synthetic
ctccacatgcgccggctcatctgcagggcgcccagtatgtcaggcgcggagatcttgaaatcgcagttgggaccg

SEQ ID NO: 238384 - DNA, 75 bp, Artificial Sequence
  Synthetic
gaagcggtgatgcaaatgacgtcacgacgcacggctgacggtcgccgcggaggcgtggcctagcccggaagcaag

SEQ ID NO: 238385 - DNA, 75 bp, Artificial Sequence
  Synthetic
aagtctcatgaaagaacttacctaggttacagacatgacagtaagggaaaagtagactataaggttacagtcata

SEQ ID NO: 238386 - DNA, 75 bp, Artificial Sequence
  Synthetic
cttgttgttttaactggcaaaggcattggcactggcacaagtgctcacggtggaaccatagatgtgagaatagga

SEQ ID NO: 238387 - DNA, 75 bp, Artificial Sequence
  Synthetic
gttacagacatgacagtaagggaaaagtagactataaggttacagtcataccacctcctccagccactcgcaagc

SEQ ID NO: 238388 - DNA, 75 bp, Artificial Sequence
  Synthetic
ttggcactggcacaagtgctcacggtggaaccatagatgtgagaataggaaaaaacggaagtctggcatttgaca

SEQ ID NO: 238389 - DNA, 75 bp, Artificial Sequence
  Synthetic
ctttgtcagagcctcattatgttactgtgactatgggcgataacataactttagtgggaccctcagacctgccag

SEQ ID NO: 238390 - DNA, 75 bp, Artificial Sequence
  Synthetic
taaagaaaatgacaggcgcactctatggacaactccagacacatctccaaattgcaaaatgagtgaagtcaaaga

SEQ ID NO: 238391 - DNA, 75 bp, Artificial Sequence
  Synthetic
ttacatggtatgatggagaaggaaataaattctgcgatggagaaaaagttgaacatgcagaatttaatcatacat

SEQ ID NO: 238392 - DNA, 75 bp, Artificial Sequence
  Synthetic
accgtagagggcaccaccgagtctcacctggtcaggttcttcacccagcaacccttcctggtcgagcgggaccgg

SEQ ID NO: 238393 - DNA, 75 bp, Artificial Sequence
  Synthetic
aaatgcggaagtcaaattctaggaagtgtatctttgcttgctgtaaaaggagaatatcaaaatatgactgccagt

SEQ ID NO: 238394 - DNA, 75 bp, Artificial Sequence
  Synthetic
gtgtatctttgcttgctgtaaaaggagaatatcaaaatatgactgccagtactaataagaatgtaaaaataacac

SEQ ID NO: 238395 - DNA, 75 bp, Artificial Sequence
  Synthetic
ctgcttgaaagcttgctgggccttggccccctcgctgaagaacaggccgcagctcttcccgctgaactggttatt

SEQ ID NO: 238396 - DNA, 75 bp, Artificial Sequence
  Synthetic
gcatacattggttataacaaagacggttctgatagagaattatatgaggtgtcagtcaaaaccttgtttcagaac

SEQ ID NO: 238397 - DNA, 75 bp, Artificial Sequence
  Synthetic
agggtatttaaaccagtcgagcccgtcaagaggccactcttgagtgccagcgagtagagatttctctgagctccg

SEQ ID NO: 238398 - DNA, 75 bp, Artificial Sequence
  Synthetic
atcgccgagcccgagggccgctggctgctggagctgatcaacatcttgcagagcatcgtagtgcaggagcgcagc

SEQ ID NO: 238399 - DNA, 75 bp, Artificial Sequence
  Synthetic
cgtagtcgttgcaggtgcgcacgaggtactggtatccgactaggaagtgcggcggcggctggcggtagagcggcc

SEQ ID NO: 238400 - DNA, 75 bp, Artificial Sequence
  Synthetic
gttagaaggatccagtcttgataaagagtactggaactttagaaacaatgattctactgtgtctggaaaatatga

SEQ ID NO: 238401 - DNA, 75 bp, Artificial Sequence
  Synthetic
ctcccagagtgtgagaaaaatgagacacctgcgcctcctgcctgaaactgtgcctatggacatggctgtgcttct

SEQ ID NO: 238402 - DNA, 75 bp, Artificial Sequence
  Synthetic
ctaaaagctatgccagaagtcacatatttggaaatgtatatattgatgctaagccatataatccagtggttatta

SEQ ID NO: 238403 - DNA, 75 bp, Artificial Sequence
  Synthetic
tcagccaacacaattgtatgttaggccttttactaatgttagtttaactggacctccaaatggcaaggttacttg

SEQ ID NO: 238404 - DNA, 75 bp, Artificial Sequence
  Synthetic
gagtactggaactttagaaacaatgattctactgtgtctggaaaatatgaaaatgctgttccgttcatgcctaac

SEQ ID NO: 238405 - DNA, 75 bp, Artificial Sequence
  Synthetic
aaattagcttcaatcaagagacacaaaacaattgtgtctattctatatcatttgactacacttgctctaaagagt

SEQ ID NO: 238406 - DNA, 75 bp, Artificial Sequence
  Synthetic
gtatgatggcgaacttaatgatccatgtgaacaaaagtacaaactcagaactttttgcaatcagcaaaatctaac

SEQ ID NO: 238407 - DNA, 75 bp, Artificial Sequence
  Synthetic
gcccatgatgacgacccgaacgaagaggctgtgaatttaatatttccagaatctatgattcttcaggctgacata

SEQ ID NO: 238408 - DNA, 75 bp, Artificial Sequence
  Synthetic
agcctcccaggaggcgaagatggggcgccgccagccggctgatgcccaactacgtgttgcatccttccatcatcc

SEQ ID NO: 238409 - DNA, 75 bp, Artificial Sequence
  Synthetic
gatggcatctattatggcactgatgaaaaagataaggcaaatcgttacagaataaaagtaaatactacaaatcac

SEQ ID NO: 238410 - DNA, 75 bp, Artificial Sequence
  Synthetic
gaaactgatgaaaacgaatcaaaaattccctcagctactgtggcaatcgtggtgggagtgattgcgggctttgta

SEQ ID NO: 238411 - DNA, 75 bp, Artificial Sequence
  Synthetic
ggtgggagtgattgcgggctttgtaactctgatcattgtcttcatatgctacatctgctgccgcaagcgtcccag

SEQ ID NO: 238412 - DNA, 75 bp, Artificial Sequence
  Synthetic
actctgatcattgtcttcatatgctacatctgctgccgcaagcgtcccaggtcatacaatcatatggtagaccca

SEQ ID NO: 238413 - DNA, 75 bp, Artificial Sequence
  Synthetic
cagtcactctcatttcagaaccatgaaggctttcacagcttgcgttctgattagcatagtcacacttagttcagc

SEQ ID NO: 238414 - DNA, 75 bp, Artificial Sequence
  Synthetic
agaggtggtaaaattacattgaatgggacttatccacaaactacatggacaagatatcataaagatggatggaaa

SEQ ID NO: 238415 - DNA, 75 bp, Artificial Sequence
  Synthetic
ggacttatccacaaactacatggacaagatatcataaagatggatggaaaaatatctgtgaatggaatgttactg

SEQ ID NO: 238416 - DNA, 75 bp, Artificial Sequence
  Synthetic
acagcagaagattccggcgcagtacgcgctgtcggccgaggaggagcgcatcctgagatatgtgcagcagagcgt

SEQ ID NO: 238417 - DNA, 75 bp, Artificial Sequence
  Synthetic
agcctgcgccgggcgctggtagggggcgccgccggcggcgaggagtcctactttgacatgggggcggacctgcat

SEQ ID NO: 238418 - DNA, 75 bp, Artificial Sequence
  Synthetic
taccttggtcacatgcttggtctttctggcttgcttcttttttggagggctgtccacggggaccacgtcctcctc

SEQ ID NO: 238419 - DNA, 75 bp, Artificial Sequence
  Synthetic
cattactattactgccactgccaacattacttctggcacatacaaagctgaaagctataaaaatgaaatcaaaaa

SEQ ID NO: 238420 - DNA, 75 bp, Artificial Sequence
  Synthetic
actaaggctcccaccacaaccagtacaactattaagaccactactcacactacagtgcaaaatactactttattg

SEQ ID NO: 238421 - DNA, 75 bp, Artificial Sequence
  Synthetic
ctcatcctcagggacgccctggccgaccggagcgagacccccctcagcgtcgaggagctaagtagggcctacgag

SEQ ID NO: 238422 - DNA, 75 bp, Artificial Sequence
  Synthetic
atggaggtgtggactatccttgcagactttagcaagacacgccggcttgtagaggatagttcagacgggtgctcc

SEQ ID NO: 238423 - DNA, 75 bp, Artificial Sequence
  Synthetic
cgatcctgcaggtggacgagccgccctcgtacgaggaggccgtcaaggccggcatgcccaccacgcgcatcatcg

SEQ ID NO: 238424 - DNA, 75 bp, Artificial Sequence
  Synthetic
gcaaatttaacttcgcttgcttggactaatgaaaccggagtatcattgatgcatggccagccttactcaggtttg

SEQ ID NO: 238425 - DNA, 75 bp, Artificial Sequence
  Synthetic
tttgaaaatctttttgccgactgctctggcctgcttgattctctgaattttggccaccagtcccttttccaggaa

SEQ ID NO: 238426 - DNA, 75 bp, Artificial Sequence
  Synthetic
ttaaggaatcttctcttctcttttacagtatggtgatcagccatgattcctaggttcttcctatttaacatcctc

SEQ ID NO: 238427 - DNA, 75 bp, Artificial Sequence
  Synthetic
ggattccccttaacacatcagccaggacattgtaggccatcccaatccagttaatgcagcctggtctatcattca

SEQ ID NO: 238428 - DNA, 75 bp, Artificial Sequence
  Synthetic
gacattgtaggccatcccaatccagttaatgcagcctggtctatcattcagaggaggtgggggaagaactggaag

SEQ ID NO: 238429 - DNA, 75 bp, Artificial Sequence
  Synthetic
cgtgctggagagcgatatcggagtcaagtttgacagcaggaatttcagactgggctgggacccggagaccaagct

SEQ ID NO: 238430 - DNA, 75 bp, Artificial Sequence
  Synthetic
ctcatcgactggtgctgcgcgcgctataattatctccaccacagtcccgaatacagggacgagaacgtagccaga

SEQ ID NO: 238431 - DNA, 75 bp, Artificial Sequence
  Synthetic
atacagggacgagaacgtagccagaatcttaaggctcatctgaccatgcagactctgctcatgctgctatccctc

SEQ ID NO: 238432 - DNA, 75 bp, Artificial Sequence
  Synthetic
tgaggatctagaagggggcaacatccctgccctgctggatgtggatgcatacctcaaaagcaagaatgatctgga

SEQ ID NO: 238433 - DNA, 75 bp, Artificial Sequence
  Synthetic
caacagcctggcccccaagggcgcccccaattccagtcagtgggaacagaaaaaggccactgggggagctgatgc

SEQ ID NO: 238434 - DNA, 75 bp, Artificial Sequence
  Synthetic
gcagaccttcataatagcaacagatctggctgctccaccacctgcagcgtgttcaaaacaacaagattcaatgag

SEQ ID NO: 238435 - DNA, 75 bp, Artificial Sequence
  Synthetic
gccgctatgggaggattggacattacagacaaaggtttgcaaattggaatagatgaagataatgtagatggagat

SEQ ID NO: 238436 - DNA, 75 bp, Artificial Sequence
  Synthetic
gcgctcgacggtggcggcaaggtcatttgagatgcgacccataagctgcgaaaaggcacccaggccgctctcgtt

SEQ ID NO: 238437 - DNA, 75 bp, Artificial Sequence
  Synthetic
cgaacagctgagagccgctggcaaggagctggttattaaacccatcaaggaagatgctagcaaaaggagctataa

SEQ ID NO: 238438 - DNA, 75 bp, Artificial Sequence
  Synthetic
cagacaaaggtttgcaaattggaatagatgaagataatgtagatggagatgatgagatatatgccgacaaaactt

SEQ ID NO: 238439 - DNA, 75 bp, Artificial Sequence
  Synthetic
tgaaaacgaatcaaaaattccctcagctactgtggcaatcgtggtgggagtgattgcgggctttgtaactctgat

SEQ ID NO: 238440 - DNA, 75 bp, Artificial Sequence
  Synthetic
ggaaaactggaaagaaagttttaatttctatggaggcagagctattaagaaagacaccaaaatgaagccatgcta

SEQ ID NO: 238441 - DNA, 75 bp, Artificial Sequence
  Synthetic
ttctatggaggcagagctattaagaaagacaccaaaatgaagccatgctatggttcctatgccagacccaccaat

SEQ ID NO: 238442 - DNA, 75 bp, Artificial Sequence
  Synthetic
atcctgcccgccacctgcaacgccttcccctccgactttgtcccgctgagctaccgcgagtgtcccccgccgctg

SEQ ID NO: 238443 - DNA, 75 bp, Artificial Sequence
  Synthetic
aaactggagaagatatagaccctaacaaggactttgacatagacatggctttctttgatctaaagcaagctgaca

SEQ ID NO: 238444 - DNA, 75 bp, Artificial Sequence
  Synthetic
ttctttgatctaaagcaagctgacacaggaggtaataacaatcaagcagacgtggttatgtataccgaaaatatt

SEQ ID NO: 238445 - DNA, 75 bp, Artificial Sequence
  Synthetic
tgagctcgtcttccaggagccggatgagctcggcaatggtggcgcgcacctcgcgctcaaaatccccgggagcct

SEQ ID NO: 238446 - DNA, 75 bp, Artificial Sequence
  Synthetic
tccactttcataatcaggcagaccttcataatagaaacagatcctgctgctccaccacctgcagcgtgttcaaaa

SEQ ID NO: 238447 - DNA, 75 bp, Artificial Sequence
  Synthetic
catgtacggaggagccaagaagcgctcccagcagcaccccgtccgcgtccgcggccacttccgcgctccctgggg

SEQ ID NO: 238448 - DNA, 75 bp, Artificial Sequence
  Synthetic
agattctggaaattatgaacatcaaaaattatctttttatatgttgacaataattgaactgcctacaactaaggc

SEQ ID NO: 238449 - DNA, 75 bp, Artificial Sequence
  Synthetic
ccgtctacccctatggctacgcgcggaatcagaatatccccttcctcactcccccctttgtctcctccgatggat

SEQ ID NO: 238450 - DNA, 75 bp, Artificial Sequence
  Synthetic
caacgcataaccaaattgcaagaggcaacctgtacgccatggagatcaacctccaggccaacctgtggaagagtt

SEQ ID NO: 238451 - DNA, 75 bp, Artificial Sequence
  Synthetic
tcaaagtgggagggggtctcactttgcaagatggaactggaaaactaacagtcaatgctgatccacctttgcaac

SEQ ID NO: 238452 - DNA, 75 bp, Artificial Sequence
  Synthetic
aggcccatctacaggccagtgattggggaacctcagccactccaagtggatggaggcttaaggaatcttctcttc

SEQ ID NO: 238453 - DNA, 75 bp, Artificial Sequence
  Synthetic
aactgctggccctgctggccgagctggaagccctgagccgccagctggccgccctgacccagcaggtgtccgatc

SEQ ID NO: 238454 - DNA, 75 bp, Artificial Sequence
  Synthetic
cgcaccctatggacaactccagacacatctccaaattgcaagattgatcaagataaggactctaagttaactctg

SEQ ID NO: 238455 - DNA, 75 bp, Artificial Sequence
  Synthetic
cgacatggatgtcgacaaaaaaccctcgaccagcatcgaggtgcagaccgacccctggctcccagcctccaccgc

SEQ ID NO: 238456 - DNA, 75 bp, Artificial Sequence
  Synthetic
tattggctaatgtgtcattaattgtcgtagctggtaagtacaaaattatcaataacaatactcaaccagctctca

SEQ ID NO: 238457 - DNA, 75 bp, Artificial Sequence
  Synthetic
cgtagctggtaagtacaaaattatcaataacaatactcaaccagctctcaaaggatttaccattaaattattgtt

SEQ ID NO: 238458 - DNA, 75 bp, Artificial Sequence
  Synthetic
tcttcaaatcttggtaaatcatattggaactttagaaatgaaaattcaattatgtcaacagcttatgaaaaagct

SEQ ID NO: 238459 - DNA, 75 bp, Artificial Sequence
  Synthetic
cctatccaaaacctaccgctggctctaaaaaatatgcaagagatatagtttatggaaacatctaccttggtggaa

SEQ ID NO: 238460 - DNA, 75 bp, Artificial Sequence
  Synthetic
cgaaaaccccgccgggtagtggctcgcgcccgtagtctggagaagcattgccagggttacgtcgcggcagaaccc

SEQ ID NO: 238461 - DNA, 75 bp, Artificial Sequence
  Synthetic
ttagttgggccaagacttatgtaaatgttgaatttgaaacaacctcttttaccttttcctatatcgcccaagaat

SEQ ID NO: 238462 - DNA, 75 bp, Artificial Sequence
  Synthetic
gaaagaccaataaacgtgtttttcatttcaaaattttcatgtatctttattgatttttacaccagcacgggtagt

SEQ ID NO: 238463 - DNA, 75 bp, Artificial Sequence
  Synthetic
tgcgctctgtgttacatgaaaaagaacttcagctttatttacagtaagtggagtgaatgtgagagaggctgagtg

SEQ ID NO: 238464 - DNA, 75 bp, Artificial Sequence
  Synthetic
tgtgacgcatgcaaggtgtggtttatgactcatgggcggggcttagtcctatataagtggcaacacctgggcact

SEQ ID NO: 238465 - DNA, 75 bp, Artificial Sequence
  Synthetic
atcaccatgttattcagcagcccataattcagggcgctccagccaaagctcatgttggggatgatggaacccacg

SEQ ID NO: 238466 - DNA, 75 bp, Artificial Sequence
  Synthetic
atgaaaaacaaactggcggccaaccaaaatctgttacccaaacatttggatctgctccaatgggaggcagcaata

SEQ ID NO: 238467 - DNA, 75 bp, Artificial Sequence
  Synthetic
tctgctccaatgggaggcagcaatattactattgaaggattggttattggaactaaggaggaagaaggcaatgcc

SEQ ID NO: 238468 - DNA, 75 bp, Artificial Sequence
  Synthetic
gccttctatggaggaagggctcttaaaaaggataccaaaatgaaaccatgttacggttcatttgctagacccacc

SEQ ID NO: 238469 - DNA, 75 bp, Artificial Sequence
  Synthetic
ctcccgcccgacactgcagggagcccggggatgaacagtggcaatgcaggatccagcgctcgtacccgctcacca

SEQ ID NO: 238470 - DNA, 75 bp, Artificial Sequence
  Synthetic
taaagctcaacgatcagggtcagccaactaaagattatgacatagacctggcattctttgatactccgggcggaa

SEQ ID NO: 238471 - DNA, 75 bp, Artificial Sequence
  Synthetic
aactaaagattatgacatagacctggcattctttgatactccgggcggaacacctccaacaggcagtggtcaaca

SEQ ID NO: 238472 - DNA, 75 bp, Artificial Sequence
  Synthetic
atgtacactgaaaatgtcaaccttgaaaccccagacacccacgtggtatataagccaggaaaagaggatgagagt

SEQ ID NO: 238473 - DNA, 75 bp, Artificial Sequence
  Synthetic
taagccaggaaaagaggatgagagttctgaaataaatttgacacagcagtccatgcccaacagacctaactacat

SEQ ID NO: 238474 - DNA, 75 bp, Artificial Sequence
  Synthetic
tggtttcctcatcagatcgtggtaaacgggccctgcgatatggatgatggcggagcgagctggattgaatctcgg

SEQ ID NO: 238475 - DNA, 75 bp, Artificial Sequence
  Synthetic
gcactaatgctacatatcaaggtgtaaaagttaaagatggcgaagatggaaatgagaatgctgattgggtaaaag

SEQ ID NO: 238476 - DNA, 75 bp, Artificial Sequence
  Synthetic
ctcatgtattacaacagcaccggcaatatgggtgtgctggctggtcaggcttctcagttgaacgctgtggtcgac

SEQ ID NO: 238477 - DNA, 75 bp, Artificial Sequence
  Synthetic
tttgcattgtagtggattctcttgcgtaccttgtcgtacttctgccagcagaaatgggcccttgaacagcagata

SEQ ID NO: 238478 - DNA, 75 bp, Artificial Sequence
  Synthetic
aaggaactacaaaatcaaccttaggtaatcacagctttgaattgcaactggcagatgatcaatctaatcaacagg

SEQ ID NO: 238479 - DNA, 75 bp, Artificial Sequence
  Synthetic
gaaatgggcccttgaacagcagatacccctcctgcggccgtcctttcgctgctgccgctcagtcatccaactgaa

SEQ ID NO: 238480 - DNA, 75 bp, Artificial Sequence
  Synthetic
aggcgtaaaggtgaaaacaggtcaggatggagctgaggagaccgagtgggaaaaagatgaaactgttgcaagaca

SEQ ID NO: 238481 - DNA, 75 bp, Artificial Sequence
  Synthetic
gataaagtgcaagtcacgcaggtgacagcgttcccctccgctgtgctggtggaaacagacagccaggtcaaaacc

SEQ ID NO: 238482 - DNA, 75 bp, Artificial Sequence
  Synthetic
agcaaaccttccaggagatcacaagcgtaagccgtgcactggggcagaacgacaccgacagtttgagggccaccc

SEQ ID NO: 238483 - DNA, 75 bp, Artificial Sequence
  Synthetic
ccagccttgaattatctctacaaattgttggtgtaagtccactccgcacatgtggaaaagctcccacagtgcccc

SEQ ID NO: 238484 - DNA, 75 bp, Artificial Sequence
  Synthetic
gctccaaagctagcacccaaaaactgcatgctggaataagctctctttgtgtctccggtgatgccttccaaaatg

SEQ ID NO: 238485 - DNA, 75 bp, Artificial Sequence
  Synthetic
ctcgctgtccttctctactttgtctgctgcaaggccagagaaaaatctaggcggcccatctacaggccagtaatc

SEQ ID NO: 238486 - DNA, 75 bp, Artificial Sequence
  Synthetic
ccagggaccacaatgtggtagcttacaccgcgtcgctgaagcatggttagtagagatgagagtctgaaaaacaga

SEQ ID NO: 238487 - DNA, 75 bp, Artificial Sequence
  Synthetic
ggggaacctcagccactccaagtggatggaggcttaaggaatcttctcttctcttttacagtatggtgatcagcc

SEQ ID NO: 238488 - DNA, 75 bp, Artificial Sequence
  Synthetic
ccgcctttcaaaagagacaggaagcaatgcgcacgcctagcgagggcgctgtgggaaggagcccctttcctagct

SEQ ID NO: 238489 - DNA, 75 bp, Artificial Sequence
  Synthetic
tagagatgagagtctgaaaaacagaaagcatgcactaaactaaggtggctatttttactgaaggaaaaatcactc

SEQ ID NO: 238490 - DNA, 75 bp, Artificial Sequence
  Synthetic
acaatctgacggtaccaggggaagcgctggttgaacatgcacccgtaaatgactctcctgaaccacacggccagc

SEQ ID NO: 238491 - DNA, 75 bp, Artificial Sequence
  Synthetic
aaaaatcacatcggactgggttagtatgtccctggcatggtagtcattcaaggccataaatctgccctgatatcc

SEQ ID NO: 238492 - DNA, 75 bp, Artificial Sequence
  Synthetic
gcaggcctgcaagatctccaacgtggagctgaccaacctggtctcctgcctggggatcctgcacgagaaccgcct

SEQ ID NO: 238493 - DNA, 75 bp, Artificial Sequence
  Synthetic
tggggatcctgcacgagaaccgcctggggcagaccgtgcttcactctaccctgaagggcgaggcgcgtcgggact

SEQ ID NO: 238494 - DNA, 75 bp, Artificial Sequence
  Synthetic
aaaaaacacacacgccctgggtgttttttcgcgaaaacacttccgcgttctcacttcctcgtatcgatttcgtga

SEQ ID NO: 238495 - DNA, 75 bp, Artificial Sequence
  Synthetic
gctccgccccgaaaccgttaaaattcaaaagctcatttgcatattaacttttgtttactttgtggggtatattat

SEQ ID NO: 238496 - DNA, 75 bp, Artificial Sequence
  Synthetic
cgcgctgcatattcgggtagagggccttgacaaaggccgagatctgcttgaaagcttgctgggccttggccccct

SEQ ID NO: 238497 - DNA, 75 bp, Artificial Sequence
  Synthetic
gagaagacgatgcaaatgacgtcacgacgcacggcgttaacggtcgccgcggaggcgtggcctagcccggaagca

SEQ ID NO: 238498 - DNA, 75 bp, Artificial Sequence
  Synthetic
ggaggcgtggcctagcccggaagcaagtcgcggggctgatgacgtataaaaaagcggactttagacccggaaacg

SEQ ID NO: 238499 - DNA, 75 bp, Artificial Sequence
  Synthetic
gatatgaggtaattctgggcggatgcaagtgaaattaggtcattttggcgcgaaaactgaatgaggaagtgaaaa

SEQ ID NO: 238500 - DNA, 75 bp, Artificial Sequence
  Synthetic
aaggcggcaacatccccgcacttctaaatgtaaccaagtacttggaaagcaagaagacgctacagaaggcagtgg

SEQ ID NO: 238501 - DNA, 75 bp, Artificial Sequence
  Synthetic
aaatgtaaccaagtacttggaaagcaagaagacgctacagaaggcagtggaaaatgctgctaaagttaatgctcc

SEQ ID NO: 238502 - DNA, 75 bp, Artificial Sequence
  Synthetic
aatattatacctggaaccacggacaccctgtaccgcagttggtacctgtcctatacctacggggaccccaaaaag

SEQ ID NO: 238503 - DNA, 75 bp, Artificial Sequence
  Synthetic
accctggacaagtcagccttcaggtgttgcatgatgggaatgagagccggtgtgatgaatatgaattccatgatc

SEQ ID NO: 238504 - DNA, 75 bp, Artificial Sequence
  Synthetic
cccagcgatcccagcgtaagcgcacggcgagatcgcgagcgagggcgaccagctcggggtcccccgagaatttca

SEQ ID NO: 238505 - DNA, 75 bp, Artificial Sequence
  Synthetic
ctggggatcctgcacgagaaccgcctgggacagaccgtgctccactctaccctgaagggcgaggcgcggcgggac

SEQ ID NO: 238506 - DNA, 75 bp, Artificial Sequence
  Synthetic
tttgtttctaggtccggtgtcagaggatgagtcatcaccctcagaagaagaccacccgtctccccctgatctcac

SEQ ID NO: 238507 - DNA, 75 bp, Artificial Sequence
  Synthetic
tgtcctggtaggcgatctcggacatgaactgctcgatctcctcctcctggagatcgccgcggcccgcgcgctcga

SEQ ID NO: 238508 - DNA, 75 bp, Artificial Sequence
  Synthetic
cccgaggacgcccggcccgtggtcagcgacgagatgctcgcgcgctggctcgggacccgcgacccccaggccctg

SEQ ID NO: 238509 - DNA, 75 bp, Artificial Sequence
  Synthetic
cagtttgattcctcctcttttaccttctcctatattgctcaagaaaatgaggacgaagacaaataaaatgtttta

SEQ ID NO: 238510 - DNA, 75 bp, Artificial Sequence
  Synthetic
cacgggtcaacggggtccgtaaccatcgaaaccagatattgttggagcaggcggcggtcacctccacgcccaggg

SEQ ID NO: 238511 - DNA, 75 bp, Artificial Sequence
  Synthetic
acctcgtagaggcgggtgagggcgtgcttgagatgcagatggtacttgatctccacgggtgagttggtggccgtg

SEQ ID NO: 238512 - DNA, 75 bp, Artificial Sequence
  Synthetic
ttgcccacgtccaaaatggtttccatgtccagccacgcctccgcggcgaccgttaacgccgtgcgtcgtgacgtc

SEQ ID NO: 238513 - DNA, 75 bp, Artificial Sequence
  Synthetic
ctggaagaggtagttgagggtggtggcgatgtgctcggtgacgaagaagtacatgatccagcggcgcaggggcat

SEQ ID NO: 238514 - DNA, 75 bp, Artificial Sequence
  Synthetic
gtgctccactctaccctgaagggcgaggcgcggcgggactatgtccgcgactgcgtctttctctttctctgccac

SEQ ID NO: 238515 - DNA, 75 bp, Artificial Sequence
  Synthetic
catcatcaataatataccccacaaagtaaacaaaagttaatatgcaaatgagcttttgaatttagggcggggccg

SEQ ID NO: 238516 - DNA, 75 bp, Artificial Sequence
  Synthetic
gatgacgtataaaaaagcggactttagacccggaaacggccgattttcccgcggccacgcccggatatgaggtaa

SEQ ID NO: 238517 - DNA, 75 bp, Artificial Sequence
  Synthetic
tagttgcgcaggcgctgaaaaaggtagttaagggtggtggcaatgtgctcggtaacaaagaagtacatgatccag

SEQ ID NO: 238518 - DNA, 75 bp, Artificial Sequence
  Synthetic
agttaagggtggtggcaatgtgctcggtaacaaagaagtacatgatccagcggcgcaggggcatttcgctgatgt

SEQ ID NO: 238519 - DNA, 75 bp, Artificial Sequence
  Synthetic
ttttttcgcgaatatccgcgtccgtgtcaaagtccggtgtttatgtcacagatcagctgatccacagggtattta

SEQ ID NO: 238520 - DNA, 75 bp, Artificial Sequence
  Synthetic
acatggcagtcggccatgggtgtgtggcagcagtgtctagaggacgagaacctgaaggagctggacaagcttctt

SEQ ID NO: 238521 - DNA, 75 bp, Artificial Sequence
  Synthetic
tttgtggatacagtattggaggatgaactgcatccaagtccgttcgagctgggacccacacttcaggacctctat

SEQ ID NO: 238522 - DNA, 75 bp, Artificial Sequence
  Synthetic
gggatgagttgggcctgatgcaggataaatatggcctggagcagataaaaacccattggttgaacccagatgagg

SEQ ID NO: 238523 - DNA, 75 bp, Artificial Sequence
  Synthetic
acgaccctaacgaagaggctgtgaatttaatatttccagaatctatgattctccaggctgacatagccagcgaag

SEQ ID NO: 238524 - DNA, 75 bp, Artificial Sequence
  Synthetic
ttccaaaacacctcactcgctgttgtcaatacccgtgacgacgacggtgttttaatccccaacaacctcaccagt

SEQ ID NO: 238525 - DNA, 75 bp, Artificial Sequence
  Synthetic
gcgcgtaggagtcttgcagcttggcaacgagctcggcggtgacaaggacgtccatggcgcagtagtccagcgttt

SEQ ID NO: 238526 - DNA, 75 bp, Artificial Sequence
  Synthetic
gaagttgtccatgtcaacaaagcggtggtaggccccggtgttgatggtgtaggtgcagttggccataagcgacca

SEQ ID NO: 238527 - DNA, 75 bp, Artificial Sequence
  Synthetic
ctgggagtgaaaagtctgaagcgccgccgatgctattaagagaggaaagaggacactaaagggagagcttaactt

SEQ ID NO: 238528 - DNA, 75 bp, Artificial Sequence
  Synthetic
tgagaatttttgctgtactctgtgtgctgagtttaataaaagctgaaatcagactctactctggaatccagtgtc

SEQ ID NO: 238529 - DNA, 75 bp, Artificial Sequence
  Synthetic
ccttcagggagctcctgatggaggtgtggactatccttgcggactttaacaagacacgccggcttgtagaggata

SEQ ID NO: 238530 - DNA, 75 bp, Artificial Sequence
  Synthetic
cttcaccaccgaagaacaggtaaactttacctgcaaaccacacaagaagtacatcatctggttatatcagaactc

SEQ ID NO: 238531 - DNA, 75 bp, Artificial Sequence
  Synthetic
tgagatacgatgagaccaagtccagggtgcgcgcttgcgagtgcgggggcagacacaccaggatgcagccagtgg

SEQ ID NO: 238532 - DNA, 75 bp, Artificial Sequence
  Synthetic
tcgaacgacggtgttcttctaccaaacaacctcacaagtggacttaccttctctgttagaagggcaaagctaatt

SEQ ID NO: 238533 - DNA, 75 bp, Artificial Sequence
  Synthetic
tcattggggtaaaaatataacactagttggaccgccagaaaaacctattgaatggcatggaccaagagttcagct

SEQ ID NO: 238534 - DNA, 75 bp, Artificial Sequence
  Synthetic
tttggcccccaagggcgccccaaactccagtcagtggattacaaaacaaactaatgctggaaacgaaactacaaa

SEQ ID NO: 238535 - DNA, 75 bp, Artificial Sequence
  Synthetic
tccagtcagtggattacaaaacaaactaatgctggaaacgaaactacaaaaactcacacatacggtgtcgctgcc

SEQ ID NO: 238536 - DNA, 75 bp, Artificial Sequence
  Synthetic
ttgtggtgtttctggttgacaaatggagccagcaaacccacctaaccagggattacatcctggacttcacggcca

SEQ ID NO: 238537 - DNA, 75 bp, Artificial Sequence
  Synthetic
agggtctgcaaattggtgttgacaaaactgaaaacaaaaatgagcctatctatgcaaacgaaatctatcagccag

SEQ ID NO: 238538 - DNA, 75 bp, Artificial Sequence
  Synthetic
gcagcggggacagagaatcttgaactactggcttctacagccagcagctccgggtcttcttcgtctacacagaca

SEQ ID NO: 238539 - DNA, 75 bp, Artificial Sequence
  Synthetic
aactgaaaacaaaaatgagcctatctatgcaaacgaaatctatcagccagaacctcaagtaggagaagaaaacct

SEQ ID NO: 238540 - DNA, 75 bp, Artificial Sequence
  Synthetic
ggcagagcccttaaaaaggaaaccaaaatgaagccttgttatggctcatttgctagacccacaaatgaaaaagga

SEQ ID NO: 238541 - DNA, 75 bp, Artificial Sequence
  Synthetic
atgcagaacaaaaaggatattgataaagattttccaagaggatctaatcaaactcttgtgggacctcctggttca

SEQ ID NO: 238542 - DNA, 75 bp, Artificial Sequence
  Synthetic
aaatgaagccttgttatggctcatttgctagacccacaaatgaaaaaggagggcaggctgtatttaaaactggaa

SEQ ID NO: 238543 - DNA, 75 bp, Artificial Sequence
  Synthetic
ccgccctgacccagcaggtgtccgagctccgcgagcagcaacagcagcaaaataaatgattcaataaacacagat

SEQ ID NO: 238544 - DNA, 75 bp, Artificial Sequence
  Synthetic
tgacataacaatggctttctttgatactcctggcgacactaatgctgaagacacagaacttgaagcagacattgt

SEQ ID NO: 238545 - DNA, 75 bp, Artificial Sequence
  Synthetic
actcctggcgacactaatgctgaagacacagaacttgaagcagacattgttatgtacaccgaaaatgttaatctt

SEQ ID NO: 238546 - DNA, 75 bp, Artificial Sequence
  Synthetic
acaagccaggacctttagaagacagttcagaaattaatttaacacagcagtccatgccaaacaggccaaactaca

SEQ ID NO: 238547 - DNA, 75 bp, Artificial Sequence
  Synthetic
ttcagaaattaatttaacacagcagtccatgccaaacaggccaaactacattggcttcagggacaactttgtagg

SEQ ID NO: 238548 - DNA, 75 bp, Artificial Sequence
  Synthetic
cagggttctgaggttgacctcgtagaggcgggtgagggcgtgcttgagatgcagatggtacttgatctccacggg

SEQ ID NO: 238549 - DNA, 75 bp, Artificial Sequence
  Synthetic
caaactcttattggaccacctggaaaaaatgttgattggattaagctttccagcggaagcgatgctgttgtaaca

SEQ ID NO: 238550 - DNA, 75 bp, Artificial Sequence
  Synthetic
gtcactctcatttcagaaccatgaaggctttaacagcttgcgttctgattagcctaatcacacttagttcggctg

SEQ ID NO: 238551 - DNA, 75 bp, Artificial Sequence
  Synthetic
gaatgcagttttgtgatggaaatacaattaagaacccacaaatcaagcatagctgtgatcaacagaatctaactt

SEQ ID NO: 238552 - DNA, 75 bp, Artificial Sequence
  Synthetic
tccaaactattgctttccattggacggagctggtactaatgctacatatcagggtgttaaagttaaaaatggaca

SEQ ID NO: 238553 - DNA, 75 bp, Artificial Sequence
  Synthetic
aggaggaaatattacactcacaggagcaggattaaatactacatggaaaagatatcatcttaatggatttaaaga

SEQ ID NO: 238554 - DNA, 75 bp, Artificial Sequence
  Synthetic
gcaggattaaatactacatggaaaagatatcatcttaatggatttaaagatatttgcaaatggagtgatccatca

SEQ ID NO: 238555 - DNA, 75 bp, Artificial Sequence
  Synthetic
ggagctggtactaatgctacatatcagggtgttaaagttaaaaatggacaggatggtgacaacaacgcagaatgg

SEQ ID NO: 238556 - DNA, 75 bp, Artificial Sequence
  Synthetic
gaaaccaaatttgcaagggtaacatcgtcgccatggaaattaaccttcaggccaacctgtggaaaagttttctgt

SEQ ID NO: 238557 - DNA, 75 bp, Artificial Sequence
  Synthetic
ctattaccaatatcacagttattgcaaacaaaaatataacttctggtgaacttagagctgacagtttttacataa

SEQ ID NO: 238558 - DNA, 75 bp, Artificial Sequence
  Synthetic
cttagagctgacagtttttacataagaccagacggctatgaaaatcaaaaacttgttatttataagctagatatt

SEQ ID NO: 238559 - DNA, 75 bp, Artificial Sequence
  Synthetic
aagtaaggttgaacaaggtaataaatggaaaactaataccactcaaagtggtggtaaaaaaaccaaaacagatca

SEQ ID NO: 238560 - DNA, 75 bp, Artificial Sequence
  Synthetic
cagcctactactgtgcccaccacagtcagtacaactattgagaccactacccacactacacagttagacactaca

SEQ ID NO: 238561 - DNA, 75 bp, Artificial Sequence
  Synthetic
aaaaaaacacacacgccctgggtgtttttcacaaaaacacttccgcgttctcacttcctcgtatcgattttgtga

SEQ ID NO: 238562 - DNA, 75 bp, Artificial Sequence
  Synthetic
tactgaacagacagaggctacctcaagtgccttcagcagcactgcaaatttaacttcgcttgcttcggtaaatga

SEQ ID NO: 238563 - DNA, 75 bp, Artificial Sequence
  Synthetic
aaattacttttctggttgtctgtgggatctttattcttgtggttcttctgtactttgtctgctgcaaagccagag

SEQ ID NO: 238564 - DNA, 75 bp, Artificial Sequence
  Synthetic
atataccccacaaagtaaacaaaagttaatatgcaaatgagcttttgaattttaacggttttggggcggagccaa

SEQ ID NO: 238565 - DNA, 75 bp, Artificial Sequence
  Synthetic
tactttgtctgctgcaaagccagagagaaatctagcaggcccatctacaggccagtaatcggggatcctcagcca

SEQ ID NO: 238566 - DNA, 75 bp, Artificial Sequence
  Synthetic
ttaatatgcaaatgagcttttgaattttaacggttttggggcggagccaacgctgattggtcgagaagcggtgat

SEQ ID NO: 238567 - DNA, 75 bp, Artificial Sequence
  Synthetic
tgtggcaatcgtggtgggtgtgattgcgggctttgtaactctgatcattgtcttcatatgctacatctgctgccg

SEQ ID NO: 238568 - DNA, 75 bp, Artificial Sequence
  Synthetic
ttggacttgggcgggagcggtggtggggccaacccgttcgcgcatctgcagcccagactggggcggcggatgttt

SEQ ID NO: 238569 - DNA, 75 bp, Artificial Sequence
  Synthetic
tttttgctattaacatcacttctggaacttataaagccgaaggatataaaaaagaggttaggactttttcatcta

SEQ ID NO: 238570 - DNA, 75 bp, Artificial Sequence
  Synthetic
aacttataaagccgaaggatataaaaaagaggttaggactttttcatctaaaaatcaaagacatacaattgaaga

SEQ ID NO: 238571 - DNA, 75 bp, Artificial Sequence
  Synthetic
ctgccctcgctgctaaagactattctcaatgcaaatttgcggacatatggaatttcttagactgctatcaagaaa

SEQ ID NO: 238572 - DNA, 75 bp, Artificial Sequence
  Synthetic
tgagcgcatgtacaacatgctgacctgcgactcgggggtctgtcatatcctgaagaacatccatgtgacctccca

SEQ ID NO: 238573 - DNA, 75 bp, Artificial Sequence
  Synthetic
tttatttaatctaacaataattgaaccgccaactactaaggcacccactaccactaaaccaaccacagttaggac

SEQ ID NO: 238574 - DNA, 75 bp, Artificial Sequence
  Synthetic
atacttttgtataatttaacaatatttgaactgccaaccactaaagcacccaccacagttaggacaactagggaa

SEQ ID NO: 238575 - DNA, 75 bp, Artificial Sequence
  Synthetic
atggtgatcagccatgattcctaggttcttcctatttaacatcctcttctgtctattcaacatctgtgctgcctt

SEQ ID NO: 238576 - DNA, 75 bp, Artificial Sequence
  Synthetic
ttgaactgccaaccactaaagcacccaccacagttaggacaactagggaaacaactgcacagcctactacaaatc

SEQ ID NO: 238577 - DNA, 75 bp, Artificial Sequence
  Synthetic
aagcggttgagctgggagggatgcatgcggggggagatgatgtgtagtttggcctggatcttgaggttggcgatg

SEQ ID NO: 238578 - DNA, 75 bp, Artificial Sequence
  Synthetic
aacaacacagcccactacaattacaactagggaggtaactactcacactacacagttagacactacagtgcagaa

SEQ ID NO: 238579 - DNA, 75 bp, Artificial Sequence
  Synthetic
aaaggcgcgcgtccacgccaagacaaaggaggccacgtgcgaggggtagcggtcgttgtccaccagggggtccac

SEQ ID NO: 238580 - DNA, 75 bp, Artificial Sequence
  Synthetic
gaatcatgtatgaggatctagaagggggcaacatccccgctctcctggataccaaaaaatatctggatagcaaga

SEQ ID NO: 238581 - DNA, 75 bp, Artificial Sequence
  Synthetic
agatccaaaagcctcatgtgctctgtgctatatgaaacagactttcagctttatttacagtaagtagagtgaatg

SEQ ID NO: 238582 - DNA, 75 bp, Artificial Sequence
  Synthetic
gggcaacatccccgctctcctggataccaaaaaatatctggatagcaagaaagacattgaagatgcaaagcagaa

SEQ ID NO: 238583 - DNA, 75 bp, Artificial Sequence
  Synthetic
cttgcttcaataaatgaaaccatcgtgccgatgatgctggaacaagatttaagaggtttggatatgcaaatcact

SEQ ID NO: 238584 - DNA, 75 bp, Artificial Sequence
  Synthetic
cagtaaacagcggcagggtgagtcggccgcatttgctgggcgaggacgagtacctgaacgactcgctgctgcggc

SEQ ID NO: 238585 - DNA, 75 bp, Artificial Sequence
  Synthetic
tctcccccaaataaacaatcattggaaataatcattcaataaagatcacttacttgaaatctgaaagtatgtctc

SEQ ID NO: 238586 - DNA, 75 bp, Artificial Sequence
  Synthetic
ggcggggcttagtcctatataagtggcaacacctgggcactcaggcacagaccttcagggagttcctgatggatg

SEQ ID NO: 238587 - DNA, 75 bp, Artificial Sequence
  Synthetic
gtggtgcgctcgtcgggcacgatcctgacgcgccagccgcggttatgcagggtgaccaggtccacgctggtggcc

SEQ ID NO: 238588 - DNA, 75 bp, Artificial Sequence
  Synthetic
cccctttgtctcctccgatggattccaaaacttcccccctggtgtcctgtcactcaaactggctgacccaatcac

SEQ ID NO: 238589 - DNA, 75 bp, Artificial Sequence
  Synthetic
cgccgcctgcggactcttctgttgcatgttcttgcatgccttcgtgcactggcccgatcgacccatggacgggaa

SEQ ID NO: 238590 - DNA, 75 bp, Artificial Sequence
  Synthetic
tgactatgcagactctgctcatactgctatccctcctatcccctgtccttgctgctaaagactattctcaatgta

SEQ ID NO: 238591 - DNA, 75 bp, Artificial Sequence
  Synthetic
aacaagatagtggaaagctaattgtgaatcctaaggctcccttgcaagttgcaaatgacaaattagagctttctt

SEQ ID NO: 238592 - DNA, 75 bp, Artificial Sequence
  Synthetic
gtgcccaatggcatgctacaatcgccacaggtgctgcccaccctccggcgcaaccaggaggagctctaccgcttc

SEQ ID NO: 238593 - DNA, 75 bp, Artificial Sequence
  Synthetic
taataaacttagtttaaaagtagggcatggactaaaagtgttggatgagaaaaatgctggaggattgaaagattt

SEQ ID NO: 238594 - DNA, 75 bp, Artificial Sequence
  Synthetic
cgtccagcgctgccagcgtcatgtccttccagggtctcagggtccgcgtgagcgtggtctccgtcacggtgaagg

SEQ ID NO: 238595 - DNA, 75 bp, Artificial Sequence
  Synthetic
ggaaaaggaataggcgttgaagagttaaaaaacgctgataatactaataggggagttggaattaatgtaagactg

SEQ ID NO: 238596 - DNA, 75 bp, Artificial Sequence
  Synthetic
ccgctgccgtgcgcaccaccgttgacgacgtcatcgactcggtggtcgccgacgcgcgcaactatactcccgccc

SEQ ID NO: 238597 - DNA, 75 bp, Artificial Sequence
  Synthetic
taaaaaacgctgataatactaataggggagttggaattaatgtaagactgggtaaagatggaggtttgtcctttg

SEQ ID NO: 238598 - DNA, 75 bp, Artificial Sequence
  Synthetic
gccccccgcggatgctggcgcgcacgtagtcatacaactcatgcgagggggccaagaaggcggggccgagattgg

SEQ ID NO: 238599 - DNA, 75 bp, Artificial Sequence
  Synthetic
gaataagcatgatgacagacgcactttatggacaactccagacccatctccaaattgtacaattgatgaggaaag

SEQ ID NO: 238600 - DNA, 75 bp, Artificial Sequence
  Synthetic
ttatggacaactccagacccatctccaaattgtacaattgatgaggaaagagattcaaagctcactttagtgtta

SEQ ID NO: 238601 - DNA, 75 bp, Artificial Sequence
  Synthetic
gacgatctggcgaaagatggcatgcgagttggaggagatggtgggccgttggaagatgttaaagtgggcgtgggg

SEQ ID NO: 238602 - DNA, 75 bp, Artificial Sequence
  Synthetic
tctatattggaggcttgccagataaaactgttgttataactattaagttgaatgcagaaactgaatctgcttatt

SEQ ID NO: 238603 - DNA, 75 bp, Artificial Sequence
  Synthetic
aactgttgttataactattaagttgaatgcagaaactgaatctgcttattcaatgacatttgaatttacatgggc

SEQ ID NO: 238604 - DNA, 75 bp, Artificial Sequence
  Synthetic
agagggggttaggcagagcgaaagtgacgtcattgaagagaatcttgcctgcccgcggcatgaaattgcgggtga

SEQ ID NO: 238605 - DNA, 75 bp, Artificial Sequence
  Synthetic
actttcatccatctggtcagaaaagactatttttttattgtcaagcttggtggcgaaggagccatagagggcgtt

SEQ ID NO: 238606 - DNA, 75 bp, Artificial Sequence
  Synthetic
gggcggccattgctcgctcgtaggggttgaggggcggaccccagggcatgggatgcgtgagggcggaggcgtaca

SEQ ID NO: 238607 - DNA, 75 bp, Artificial Sequence
  Synthetic
gtccccggagaatttcatgaccagcatgaaggggacgagctgcttgccgaaggaccccatccaggtgtaggtttc

SEQ ID NO: 238608 - DNA, 75 bp, Artificial Sequence
  Synthetic
gctcgtcaggggggtccgcatcgatggtgaagatgcccggacagagttccttgtcaaaatagtctatttttgagg

SEQ ID NO: 238609 - DNA, 75 bp, Artificial Sequence
  Synthetic
gacggagaggctgacgagcccgcgcgggagccaggtccagatctcggcgcggcgggggcggagagcgaagacgag

SEQ ID NO: 238610 - DNA, 75 bp, Artificial Sequence
  Synthetic
ttagaagcggtgtcgcggacgtgctcccggcggcagcggcggttccggccccgcgggcaggggcggcagaggcac

SEQ ID NO: 238611 - DNA, 75 bp, Artificial Sequence
  Synthetic
cttcctctgggggcggtggtggtggcggggcccgacgacgacggcgacgcaccgggagacggtcgacgaagcgct

SEQ ID NO: 238612 - DNA, 75 bp, Artificial Sequence
  Synthetic
tttgcagtccccgaggcccttgccacttatcacatcttttttaagaaccaaaagatccccgtttcctgccgtgcc

SEQ ID NO: 238613 - DNA, 75 bp, Artificial Sequence
  Synthetic
acctgaaagacagttcaacagaatcaatctcggcgtcattgacggcggcctgacgcaggatctcttgcacgtcgc

SEQ ID NO: 238614 - DNA, 75 bp, Artificial Sequence
  Synthetic
cgtcgatgcggattccccttaaaacatcagccaggacattgtaggccatcccaatccagttaatgcatcctgatc

SEQ ID NO: 238615 - DNA, 75 bp, Artificial Sequence
  Synthetic
cagcgtcagctgtaaaaagtcactcaagtcctcagacaccacagctgccaactctgagcctgggctaagcgtggg

SEQ ID NO: 238616 - DNA, 75 bp, Artificial Sequence
  Synthetic
cattcaaatccccaccgacatggatgtcgacaaaaaaccctcgaccagcatcgaggtgcagaccgacccctggct

SEQ ID NO: 238617 - DNA, 75 bp, Artificial Sequence
  Synthetic
gaacatgcaaccgtaaatgactctcctgaaccacacagccagcaggacacctcccgcccggcactgcagggaacc

SEQ ID NO: 238618 - DNA, 75 bp, Artificial Sequence
  Synthetic
ctatggttcctttgctaaacccacaaacaaggaaggtggccaggctaaattgaaagaaacacccaatggtgctga

SEQ ID NO: 238619 - DNA, 75 bp, Artificial Sequence
  Synthetic
aacaaggaaggtggccaggctaaattgaaagaaacacccaatggtgctgatcctcaatatgatgtggacatggcc

SEQ ID NO: 238620 - DNA, 75 bp, Artificial Sequence
  Synthetic
gggtgttgttcagtcagtgaggccctggtctcctcatcagatcgtggtaaacgggccctgcggtatggatgatgg

SEQ ID NO: 238621 - DNA, 75 bp, Artificial Sequence
  Synthetic
acaactttgtggggctcatgtattacaacagcactggaaacatgggtgtgctggctggtcaggcttcccaattga

SEQ ID NO: 238622 - DNA, 75 bp, Artificial Sequence
  Synthetic
cgtggagctaaccaacctggtctcctgcctggggatcctacacgagaaccgcctggggcagactgtgcttcactc

SEQ ID NO: 238623 - DNA, 75 bp, Artificial Sequence
  Synthetic
ttgctagattctctgggtgacagaaccagatactttagcatgtggaactctgcggtggacagttatgatcccgat

SEQ ID NO: 238624 - DNA, 75 bp, Artificial Sequence
  Synthetic
tggaagatgaacttccaaactattgcttccccttggacggtgttcaaactaattcagcctaccaaggtgttaaac

SEQ ID NO: 238625 - DNA, 75 bp, Artificial Sequence
  Synthetic
agcgcgtcccttgaggaggaacttcaggagtggcggccctggctggtggttttcatgttcgcctgcgtgggactc

SEQ ID NO: 238626 - DNA, 75 bp, Artificial Sequence
  Synthetic
cttccccttggacggtgttcaaactaattcagcctaccaaggtgttaaactaaaggctaatcaagcaggaggtgg

SEQ ID NO: 238627 - DNA, 75 bp, Artificial Sequence
  Synthetic
tgggcgtccagcgcggccagcgtcatgtccttccagggtctcagggtccgcgtgagcgtggtctccgtcacggtg

SEQ ID NO: 238628 - DNA, 75 bp, Artificial Sequence
  Synthetic
tgctgatgatgtaattgaagtaggcgtttttgaggcggcggatggtggcgaggaggaccaggtccttgggtcccg

SEQ ID NO: 238629 - DNA, 75 bp, Artificial Sequence
  Synthetic
cggccacgcctccgcggcggccgttagccgtgcgtcgtgacgtcatttgcatcaccgcttctcgtccaatcagcg

SEQ ID NO: 238630 - DNA, 75 bp, Artificial Sequence
  Synthetic
ctgtcttctcccggcaaaaatcacatcggactgggttagtatgcccctggcatggtagtcattcaaggccataaa

SEQ ID NO: 238631 - DNA, 75 bp, Artificial Sequence
  Synthetic
ggtacttgatttctacgggtgagttggtggccgtgtccacgcattgcatgagcccgtagctgcgcggggccacga

SEQ ID NO: 238632 - DNA, 75 bp, Artificial Sequence
  Synthetic
ccaagtgccccaaaagttctttgccatcaagaacctgctcctgctcccgggctcctacacctacgagtggaactt

SEQ ID NO: 238633 - DNA, 75 bp, Artificial Sequence
  Synthetic
gaggaagtgaaaagcgaaaaataccggtcccgcccagggcggaatatttaccgagggccgagagactttgaccga

SEQ ID NO: 238634 - DNA, 75 bp, Artificial Sequence
  Synthetic
gctcctacacctacgagtggaacttccgcaaggacgtcaacatgatcctgcagagttccctcggcaacgacctgc

SEQ ID NO: 238635 - DNA, 75 bp, Artificial Sequence
  Synthetic
gtcctctaaataagtcactagggccccagggaccacaatgtgatagctgacagcgcgtcgctcaagcatggttag

SEQ ID NO: 238636 - DNA, 75 bp, Artificial Sequence
  Synthetic
ccatggtcggcacggtctggccggtgagacgcgcgcagtcattgacgctctagaggcaaaaacgaaagcggttga

SEQ ID NO: 238637 - DNA, 75 bp, Artificial Sequence
  Synthetic
aaccccacggtggctcccacccacgatgtgaccacggaccggtcccagcgtctgacgctgcgctttgtgcccgtg

SEQ ID NO: 238638 - DNA, 75 bp, Artificial Sequence
  Synthetic
tggaagaggtagttgagggtggtggcgatgtgctcggtgacgaagaagtacatgatccagcggcgcaggggcatc

SEQ ID NO: 238639 - DNA, 75 bp, Artificial Sequence
  Synthetic
aaaaatcacatcggactgggttagtatgcccctggcatggtagtcattcaaggccataaatctgccttggtagcc

SEQ ID NO: 238640 - DNA, 75 bp, Artificial Sequence
  Synthetic
catgatccagcggcgcaggggcatctcgctgatgtcgccgatggcctccagcctttccatggcctcgtagaaatc

SEQ ID NO: 238641 - DNA, 75 bp, Artificial Sequence
  Synthetic
gccatcttgcccacgtccaaaatggcttccatgtccggccacgcctccgcggcgaccgtcggccgtgcgtcgtga

SEQ ID NO: 238642 - DNA, 75 bp, Artificial Sequence
  Synthetic
cccgcaacgtgttgcattactaccgtcaccttcacagctaacaaaaagcaagtaaaagaagtcgccggaggagga

SEQ ID NO: 238643 - DNA, 75 bp, Artificial Sequence
  Synthetic
ccaatcagcgttggctccgccccaaaaccgttaaaattcaaaagctcatttgcatattaacttttgtttactttg

SEQ ID NO: 238644 - DNA, 75 bp, Artificial Sequence
  Synthetic
tttatttacagtaagtggagtgaatgtgagagaggctgagtgcttaacacatcactgtgtgatgcttgaacagct

SEQ ID NO: 238645 - DNA, 75 bp, Artificial Sequence
  Synthetic
ctaggtccggtgtcagaggatgagtcatcaccctcagaagaagaccacccgtctccccctgatctcacagatgac

SEQ ID NO: 238646 - DNA, 75 bp, Artificial Sequence
  Synthetic
aagacccacagccagccgacttctccagttacgggagcgagcccccttttttctttttgccagatgcatcccgtc

SEQ ID NO: 238647 - DNA, 75 bp, Artificial Sequence
  Synthetic
gttcagggaccgcagcggggaggagcccgaggagatgcgcgactgccggtttcgggcgggcagggagctgcgcga

SEQ ID NO: 238648 - DNA, 75 bp, Artificial Sequence
  Synthetic
cgacttaggtataaaaacactgctgatccgaggcaaaggcatacaacttaacaacgagttggtgagctcttccat

SEQ ID NO: 238649 - DNA, 75 bp, Artificial Sequence
  Synthetic
agcaagcctctgacggcgcagctgttcctggtggtgcagcacagcagggacaacgaggcgttcagggaggcgctg

SEQ ID NO: 238650 - DNA, 75 bp, Artificial Sequence
  Synthetic
gtgaagagggagaggagcgatgggggcaataccgggatgatgaccgagctgactgccagcctgatgaatcgcaag

SEQ ID NO: 238651 - DNA, 75 bp, Artificial Sequence
  Synthetic
ctcggtttactttaaccccttttcaggctccccaggcctctaccccgacgagttcataccgaacttcgacgcagt

SEQ ID NO: 238652 - DNA, 75 bp, Artificial Sequence
  Synthetic
actttaagctgcccgaggagcaccctaacggccctgcacacggagtgcggatcaccgtagagggcaccaccaagt

SEQ ID NO: 238653 - DNA, 75 bp, Artificial Sequence
  Synthetic
cggcacggtctggccggtgagacgcgcgcagtcattgacgctctagaggcaaaaacgaaagcggttgagcgggct

SEQ ID NO: 238654 - DNA, 75 bp, Artificial Sequence
  Synthetic
gtactgacgcctccgtgatgtgtttttagatgtcccagcaagccccggaccccgccataagggcggcgctgcaaa

SEQ ID NO: 238655 - DNA, 75 bp, Artificial Sequence
  Synthetic
aactttacctgcaaaccccacaagaagtacctcatctggttcctcaagaacactacttttgcagtagttaacacc

SEQ ID NO: 238656 - DNA, 75 bp, Artificial Sequence
  Synthetic
ggtcaccccgccgatttaaagacccacagccagccgacttctccagttacgggagcgagcccccttttttctttt

SEQ ID NO: 238657 - DNA, 75 bp, Artificial Sequence
  Synthetic
agacagagatggacttggaagagggcgaagggctggcgagactgggggcgccgtccccggagcgacacccccgcg

SEQ ID NO: 238658 - DNA, 75 bp, Artificial Sequence
  Synthetic
gggttagcccatacaaggtggtcgggtatttaattttaggggcggtcctgggtgggtgcatagcggtgctagccc

SEQ ID NO: 238659 - DNA, 75 bp, Artificial Sequence
  Synthetic
gtatttaattttaggggcggtcctgggtgggtgcatagcggtgctagcccaactgccttgctgggtggaaatcaa

SEQ ID NO: 238660 - DNA, 75 bp, Artificial Sequence
  Synthetic
tcaagcaagatgatagcaagagaagttacaacctcatcgagggaaccatggacacgctgtaccgcagctggtacc

SEQ ID NO: 238661 - DNA, 75 bp, Artificial Sequence
  Synthetic
cgaacgagtttgaaattaagcgcagcgtcgacggggagggctataacgtggcccaatgcaacatgaccaaggact

SEQ ID NO: 238662 - DNA, 75 bp, Artificial Sequence
  Synthetic
agttattaaatgcgagcatcaatgccctctcaacattacatttaaaaaccgtaccatggggaatgcatgggtagg

SEQ ID NO: 238663 - DNA, 75 bp, Artificial Sequence
  Synthetic
aatgtggtttttaaagtgcaagcccaggtatggaaatgagcagaaggaaaaattgctataaattttttttttttt

SEQ ID NO: 238664 - DNA, 75 bp, Artificial Sequence
  Synthetic
cgctggacatgaccgcgcgcaacatggaacctagcatgtacgccgccaaccggccgttcatcaataagctgatgg

SEQ ID NO: 238665 - DNA, 75 bp, Artificial Sequence
  Synthetic
ctcttcgtcggggtctaccttggtcacatgcttggtcttcctggcttgcttctttggcagttttggagggctgtc

SEQ ID NO: 238666 - DNA, 75 bp, Artificial Sequence
  Synthetic
cggccgttcatcaataagctgatggactacctgcaccgcgcggcggccatgaacacggactactttaccaatgcc

SEQ ID NO: 238667 - DNA, 75 bp, Artificial Sequence
  Synthetic
gatgcgacccatgagctgcgagaaggcgcccaggccgctctcgttccagacgcggctgtagaccacgtccccgtc

SEQ ID NO: 238668 - DNA, 75 bp, Artificial Sequence
  Synthetic
gagctgtcttaccagctcttgctagattctctgggtgacagaaccagatactttagcatgtggaactctgcggtg

SEQ ID NO: 238669 - DNA, 75 bp, Artificial Sequence
  Synthetic
ctatgaaccataacatgactttagtgggtcccttaaacctgccagttacatggtatgatggagaaggaaataaat

SEQ ID NO: 238670 - DNA, 75 bp, Artificial Sequence
  Synthetic
ccgctggaagacctacgctcaggaccatagggacgcgcccgcgccgcggcgacagcgccacgaccggcagcgggg

SEQ ID NO: 238671 - DNA, 75 bp, Artificial Sequence
  Synthetic
tcaaaaccttgtttcaaaacggggctaaacaaagtaaggttgaacaaagtaatattggacaaggtaatactgctc

SEQ ID NO: 238672 - DNA, 75 bp, Artificial Sequence
  Synthetic
tcttctcgccgcgcgtgccccccaaacgccagcccaacggcacctgcgagcccaacccgcgtctcaacttctacc

SEQ ID NO: 238673 - DNA, 75 bp, Artificial Sequence
  Synthetic
aataaaactcaccaaggccatagcgtgcgttctcttccttgttagagatgaggcgtgcggtggtgtcttcctctc

SEQ ID NO: 238674 - DNA, 75 bp, Artificial Sequence
  Synthetic
gagcggtcgcggtggggcggtgatctgaagaccattctgcacaccaacatgcccaatgtgaacgagtacatgttc

SEQ ID NO: 238675 - DNA, 75 bp, Artificial Sequence
  Synthetic
tccaagggcatacaattatatggtagacccactactcagcttctcctactaaaactcagtcattcttatttcaga

SEQ ID NO: 238676 - DNA, 75 bp, Artificial Sequence
  Synthetic
ttctgattagcatagtcacacttagtctttctcaaatcattaatgtaaatgttaccagaggaggtagtattacat

SEQ ID NO: 238677 - DNA, 75 bp, Artificial Sequence
  Synthetic
gatatcttagagtatgagtggtttgagtttaccctgcccgagggcaacttttccgagaccatgaccatagacctg

SEQ ID NO: 238678 - DNA, 75 bp, Artificial Sequence
  Synthetic
cgcagcagcgcgcgtcatggctggtcagttgcaccacgcttctcccccagcggttctgggtcactttggccttgc

SEQ ID NO: 238679 - DNA, 75 bp, Artificial Sequence
  Synthetic
cagccagtacatacactacacagctaaacacaacagtgcagaatagtactgtgttggttaggtacttgctgaggg

SEQ ID NO: 238680 - DNA, 75 bp, Artificial Sequence
  Synthetic
gaggcgatacccacctcactgtagctcaagaaaaagcagctgaaaaggagctagtgatcgtaccaattgaaaagg

SEQ ID NO: 238681 - DNA, 75 bp, Artificial Sequence
  Synthetic
ttatctgtgggatctttattctcgtggttcttttgtactttgtttgctgcaaagccagaaaaaaatctaggagac

SEQ ID NO: 238682 - DNA, 75 bp, Artificial Sequence
  Synthetic
atacaagccaggaaaagaggatgacagttcagaagtaaatttgacacagcagtccatgcccaacaggcctaacta

SEQ ID NO: 238683 - DNA, 75 bp, Artificial Sequence
  Synthetic
tgtggacttccgcgtacctgcgcaaatttgtacccgaggactaccacgcccacgagataaagttcttcgaggacc

SEQ ID NO: 238684 - DNA, 75 bp, Artificial Sequence
  Synthetic
aaactcttaaggcttatatgaccatgcagactctgctaatactgctatcccttttatcccccgcccttgccactt

SEQ ID NO: 238685 - DNA, 75 bp, Artificial Sequence
  Synthetic
gccgcggttatgcagggtgaccaggtccacgctggtggccacctcgccgcgcaggggctcgttggtccagcagag

SEQ ID NO: 238686 - DNA, 75 bp, Artificial Sequence
  Synthetic
ttgattactctaaatgcaaatttgttgagctatggaatttcttaaactgctataatgctacaatggatatgcctt

SEQ ID NO: 238687 - DNA, 75 bp, Artificial Sequence
  Synthetic
ctttccaagagggcttcagaatcatgtatgaggatctagaagggggcaacatccccgccctcctggatgtcaagc

SEQ ID NO: 238688 - DNA, 75 bp, Artificial Sequence
  Synthetic
tttgctattatgatctacccctgttttgatctcggctggaactctgttggggcatttacatacacactacaaaac

SEQ ID NO: 238689 - DNA, 75 bp, Artificial Sequence
  Synthetic
tttgccagacctactaatgaaaagggaggtcaggctaaatttgtacttgaccaggaaggaaagccaactaaaaat

SEQ ID NO: 238690 - DNA, 75 bp, Artificial Sequence
  Synthetic
tgatgccatcaacatccaccagtgcaagaaaggcattttttgcctggtcaaacaggcaaaaattacctacgagct

SEQ ID NO: 238691 - DNA, 75 bp, Artificial Sequence
  Synthetic
atcatgtatgaggatctagaagggggcaacatccccgcactccttgatgtggccaagtacttggaaagcaagaag

SEQ ID NO: 238692 - DNA, 75 bp, Artificial Sequence
  Synthetic
aacccgggtctcccccagcatgccgaggaagaagcaggagccgctagtggaggagatggaagaagaatgggacag

SEQ ID NO: 238693 - DNA, 75 bp, Artificial Sequence
  Synthetic
ccgctgaaaccaatggaacccctagaggagacagtgatgttgcaagagaggtggaaaaggcagctcaaactcagc

SEQ ID NO: 238694 - DNA, 75 bp, Artificial Sequence
  Synthetic
aaggtagaggaagcaattaagaaggccgctgaaaccaatggaacccctagaggagacagtgatgttgcaagagag

SEQ ID NO: 238695 - DNA, 75 bp, Artificial Sequence
  Synthetic
gtgtatctactccctccttaagaccctttgcggacttcgcgacctcctacccataaactaattgattaaagttta

SEQ ID NO: 238696 - DNA, 75 bp, Artificial Sequence
  Synthetic
gttccacaagtactgcgcgctcactcttaaagactaaggcgcgcccacccggaaaaaaggcgggaattacctcat

SEQ ID NO: 238697 - DNA, 75 bp, Artificial Sequence
  Synthetic
gaaaccaatcacaccccattccccattttcccacataaacaatcattagaaataattacttaataaaaattactt

SEQ ID NO: 238698 - DNA, 75 bp, Artificial Sequence
  Synthetic
gaatcaaaatatccccttccttactcccccctttgtctcctccaatggattccaaaacttcccccctggggttct

SEQ ID NO: 238699 - DNA, 75 bp, Artificial Sequence
  Synthetic
accatcaccaatggaaatgtctcactcaaggttggaggtgggctaactttgcaagaagaaactggaaaactaaca

SEQ ID NO: 238700 - DNA, 75 bp, Artificial Sequence
  Synthetic
tggaggagtttgtgccctcggtctacttcaaccccttctcgggctcgccaggcctctacccggacgagttcatac

SEQ ID NO: 238701 - DNA, 75 bp, Artificial Sequence
  Synthetic
ctgaggcagacgcttaaaggcgggctgcccgactttatgagccagagcatgttgcaaaactaccgcactttcatt

SEQ ID NO: 238702 - DNA, 75 bp, Artificial Sequence
  Synthetic
ccacttccgcgctccctggggcgcttacaagcgcgggcggacttccaccgccgccgccgtgcgcaccaccgtcga

SEQ ID NO: 238703 - DNA, 75 bp, Artificial Sequence
  Synthetic
gttaatactcttgtagtattaactggaaagggtattggaacagattcacataatggtggaaatatatgtgttaga

SEQ ID NO: 238704 - DNA, 75 bp, Artificial Sequence
  Synthetic
actcgggcacggcttacaacagcctggcccccaagggcgcccccaatcccagtcagtggactaccaaagaaaagc

SEQ ID NO: 238705 - DNA, 75 bp, Artificial Sequence
  Synthetic
gctctgctgcgccgcgccagacgcacgggccgccgggccatgatgcgagccgcgcgccgcgccgccactgcaccc

SEQ ID NO: 238706 - DNA, 75 bp, Artificial Sequence
  Synthetic
tgttgtcaacgcccgtgacgacgacggtgttttaatccccaacaacctcaccagtggacttactttcagcaccag

SEQ ID NO: 238707 - DNA, 75 bp, Artificial Sequence
  Synthetic
gagagcgaagacgagggcgcgcagttgggagctgtccatggtgtcgcggagatccaggtccgggggcagggttct

SEQ ID NO: 238708 - DNA, 75 bp, Artificial Sequence
  Synthetic
attggagcagtgtctggagcgggcttaaaaatttcggctcgacgctccggacctatgggaacaaggcctggaata

SEQ ID NO: 238709 - DNA, 75 bp, Artificial Sequence
  Synthetic
gattatcctttccctggtggggggtttactggcctgccacgaacagccacgatgtaacattaccacaggcaatga

SEQ ID NO: 238710 - DNA, 75 bp, Artificial Sequence
  Synthetic
ataatccccacagccctcagcatcagtcttctggtgcgtcgggcacagcaccgcattctaatttcgctcatgttt

SEQ ID NO: 238711 - DNA, 75 bp, Artificial Sequence
  Synthetic
acattacattcaagaataagaccatgggaaatgtatgggtgggattctggcaaccaggagatgagcagaactaca

SEQ ID NO: 238712 - DNA, 75 bp, Artificial Sequence
  Synthetic
cgcgaaccaggccgtgcagcgcgagataaacagccgcctggacccgcgcccgcccgccgccacggtggtggagat

SEQ ID NO: 238713 - DNA, 75 bp, Artificial Sequence
  Synthetic
aaatgcgagcaccagtgtcctctcaacattacattcaagaataagaccatgggaaatgtatgggtgggattctgg

SEQ ID NO: 238714 - DNA, 75 bp, Artificial Sequence
  Synthetic
atggttgggttttctttggcttttgtgatcatggcctgcttgatgtcaggtctgctggtaggggctctagtgtgg

SEQ ID NO: 238715 - DNA, 75 bp, Artificial Sequence
  Synthetic
tctgctggtaggggctctagtgtggttcctgaagcgcaagcccaggtacggaaatgaggagaaggaaaaattgct

SEQ ID NO: 238716 - DNA, 75 bp, Artificial Sequence
  Synthetic
ccagcttcaaaccctactcgggcacggcttacaacagcctggcccccaagggcgctcccaatcccagtcagtggg

SEQ ID NO: 238717 - DNA, 75 bp, Artificial Sequence
  Synthetic
tgataagacacatacttatggctcagccgccatgggaggaagcaacatcaccattgaaggtttagtaattggaac

SEQ ID NO: 238718 - DNA, 75 bp, Artificial Sequence
  Synthetic
ggcgcccgctggtcgctggaccccatggacaacgtcaacccctttaaccaccaccgcaatgcgggcctgcgctac

SEQ ID NO: 238719 - DNA, 75 bp, Artificial Sequence
  Synthetic
gccagccgcaggcgcccagccagcaaacgccgccgccgcaccgccacccgccgccgtctggcccccgcccgcgtg

SEQ ID NO: 238720 - DNA, 75 bp, Artificial Sequence
  Synthetic
ggctctcaccagatccagggtagcgggacacaggcacactgacatacatctttttaaaatttttacttcctttgt

SEQ ID NO: 238721 - DNA, 75 bp, Artificial Sequence
  Synthetic
ccgccgtctggcccccgcccgcgtgcgccgcgtaaccacgcgccggggccgctcgctcgttctgcccaccgtgcg

SEQ ID NO: 238722 - DNA, 75 bp, Artificial Sequence
  Synthetic
aaagatatttttgcaaataaactttatcaaccagaacctcaagtaggtgaagaaaactggcaagagtctgaagcc

SEQ ID NO: 238723 - DNA, 75 bp, Artificial Sequence
  Synthetic
caaaccaaacataaagagctaagacacacatgtaatatgcagaacataactttgctgtctgtaaatactagtttt

SEQ ID NO: 238724 - DNA, 75 bp, Artificial Sequence
  Synthetic
agcggtgctagctcagctgccttgctgggtggaaatcaaaatctttatatgctgggtaagacattgtggggagga

SEQ ID NO: 238725 - DNA, 75 bp, Artificial Sequence
  Synthetic
tttgctgtctgtaaatactagttttaatggagactattttggctttaaaaatgataatagcggtatgaaacacta

SEQ ID NO: 238726 - DNA, 75 bp, Artificial Sequence
  Synthetic
aagacacaaaaatgaagccctgctatggctcatttgcaagacctaccaatgaaaaaggcggacaagctaaattta

SEQ ID NO: 238727 - DNA, 75 bp, Artificial Sequence
  Synthetic
taaagttacagttatccctcctaaaccaaccactcggaaacctttacctccaccacactatgtcaacgcaactat

SEQ ID NO: 238728 - DNA, 75 bp, Artificial Sequence
  Synthetic
tggctcatttgcaagacctaccaatgaaaaaggcggacaagctaaatttaagccagtggaagaggggcagcaacc

SEQ ID NO: 238729 - DNA, 75 bp, Artificial Sequence
  Synthetic
caccacactatgtcaacgcaactatgggtcaaaacttaacattagtgggtccagcaaacattccagttacttggc

SEQ ID NO: 238730 - DNA, 75 bp, Artificial Sequence
  Synthetic
ttctttgacacacctggaggcaccatcacaggaggcacaggcgaagaatataaagcagacattgtgttgtacact

SEQ ID NO: 238731 - DNA, 75 bp, Artificial Sequence
  Synthetic
ccagcaaacattccagttacttggctcagtgaatttggcaccttgtgtgagggtaaaaaaattttgcatgaagaa

SEQ ID NO: 238732 - DNA, 75 bp, Artificial Sequence
  Synthetic
cgtactcgtacaaggcgcgcttcactctggccgtgggcgacaaccgggtgctagacatggccagcacttactttg

SEQ ID NO: 238733 - DNA, 75 bp, Artificial Sequence
  Synthetic
tacaacagtactggcaacatgggtgtgctggctggtcaggcctctcagttgaatgctgtggtcgacttgcaagac

SEQ ID NO: 238734 - DNA, 75 bp, Artificial Sequence
  Synthetic
gaatgctgtggtcgacttgcaagacagaaacaccgagctgtcttaccagctcttgctagattctctgggtgacag

SEQ ID NO: 238735 - DNA, 75 bp, Artificial Sequence
  Synthetic
gtgtagctcctatgggtggagaaaacattacaattagcggtttgcaaattggaacagatactacaaatggcaaac

SEQ ID NO: 238736 - DNA, 75 bp, Artificial Sequence
  Synthetic
aggcatctggaccactgccgccgcctgcactgctttgcccgggagagctgcgggcttatctactttgagcttccc

SEQ ID NO: 238737 - DNA, 75 bp, Artificial Sequence
  Synthetic
tcttgctagattctctgggtgacagaaccagatactttagcatgtggaactctgcggtggatagctatgatccag

SEQ ID NO: 238738 - DNA, 75 bp, Artificial Sequence
  Synthetic
atgtcaggatcattgaaaatcacggtgtggaagatgaacttccaaactattgcttcccattgaatggcactggca

SEQ ID NO: 238739 - DNA, 75 bp, Artificial Sequence
  Synthetic
ataaaacacacatgcaatgggccaaatgtaactttgattaatgtcacaaaaccatacgaaggaagctattatggc

SEQ ID NO: 238740 - DNA, 75 bp, Artificial Sequence
  Synthetic
ccttctatggaggaagggctcttaaaaaggaaaccaagatgaaaccatgctatggctcatttgccagacccacaa

SEQ ID NO: 238741 - DNA, 75 bp, Artificial Sequence
  Synthetic
ccaattcaacatatcttggcgtaaaggtgaaaccagatcaagatggtgatgttgaaagcgagtgggataaagatg

SEQ ID NO: 238742 - DNA, 75 bp, Artificial Sequence
  Synthetic
gtcaaaccttacactacaaagggcactacagtgaatgcaacaaatgccaatggcctcaaaaatgctttgcaacag

SEQ ID NO: 238743 - DNA, 75 bp, Artificial Sequence
  Synthetic
aagagaccctgaaaaaagtcaagaagattttgacatagacctagcattctttgatactccgggaggaactttaac

SEQ ID NO: 238744 - DNA, 75 bp, Artificial Sequence
  Synthetic
gattttgacatagacctagcattctttgatactccgggaggaactttaacaggtggtggaacggaatacaaagca

SEQ ID NO: 238745 - DNA, 75 bp, Artificial Sequence
  Synthetic
gatggtgaatcagaaaatgatcaagaatcaaaaattccatcagctactgtggcaatcgtggtgggtgtgattgcg

SEQ ID NO: 238746 - DNA, 75 bp, Artificial Sequence
  Synthetic
gccagggctaagcgtgggactggcaagcgtgagggagtactttaatgctccaaagctagcacctaaaaactgcat

SEQ ID NO: 238747 - DNA, 75 bp, Artificial Sequence
  Synthetic
ttaatcttgaaaccccggacacccacgtggtgtataaaccaggcaaagatgatgacagttcagaaatcaacttgg

SEQ ID NO: 238748 - DNA, 75 bp, Artificial Sequence
  Synthetic
gtagacccactactcagcttctcttactgagactcagtcactttcatttcagaaccatgaaggctttcacagctt

SEQ ID NO: 238749 - DNA, 75 bp, Artificial Sequence
  Synthetic
actgagactcagtcactttcatttcagaaccatgaaggctttcacagcttgcgttctgattagcataatcacact

SEQ ID NO: 238750 - DNA, 75 bp, Artificial Sequence
  Synthetic
ttactgaaggaaaaatgactctttttagcagcagggtacccactgggtggcccttgcggacatacaaaaattggt

SEQ ID NO: 238751 - DNA, 75 bp, Artificial Sequence
  Synthetic
actgaaaacaagaatgagcctatttatgcaaatgaaatataccagccagaacctcaggtaggagaggaaaacttg

SEQ ID NO: 238752 - DNA, 75 bp, Artificial Sequence
  Synthetic
gttctcgctggtcacatccatctccaccacgtggtccttgtggatcatcaccgttccatgcagacacttgagctg

SEQ ID NO: 238753 - DNA, 75 bp, Artificial Sequence
  Synthetic
tcccacagggcgcagccggtgcactcccagttcttgtgcgcgatcccgctgtggctgaagatgtaaccttgcaac

SEQ ID NO: 238754 - DNA, 75 bp, Artificial Sequence
  Synthetic
tagagagacaaccacacagcctactactgtgcccactacacaaccaaccaccacagtcagtacaactattgagac

SEQ ID NO: 238755 - DNA, 75 bp, Artificial Sequence
  Synthetic
tacctgcccgactcctacaagtacacgccggccaacgtcacgctgcccaccaacaccaacacctacgagtacatg

SEQ ID NO: 238756 - DNA, 75 bp, Artificial Sequence
  Synthetic
cgccggccaacgtcacgctgcccaccaacaccaacacctacgagtacatgaacggccgcgtggtggccccctcgc

SEQ ID NO: 238757 - DNA, 75 bp, Artificial Sequence
  Synthetic
agtagacaaagagcacagcagtacaagcgccaacagcagtaactaactacttactgacctagctgagtacttaaa

SEQ ID NO: 238758 - DNA, 75 bp, Artificial Sequence
  Synthetic
tggtggacgcctacatcaacatcggcgcgcgctggtccctggaccccatggacaacgtcaaccccttcaaccacc

SEQ ID NO: 238759 - DNA, 75 bp, Artificial Sequence
  Synthetic
ttgcaagacagaaacacagagctgtcttaccagctcttgctagattctctgggtgacagaaccagatactttagc

SEQ ID NO: 238760 - DNA, 75 bp, Artificial Sequence
  Synthetic
caacatggctaaagtccgcttttttatacgtcatcggccctgcgacttgcttccgggctaggccacgcctctgcg

SEQ ID NO: 238761 - DNA, 75 bp, Artificial Sequence
  Synthetic
caattaacattggccctgccctaaaaccgttaaaatttaaaagctcatttgcatattaacttttgtttactttgt

SEQ ID NO: 238762 - DNA, 75 bp, Artificial Sequence
  Synthetic
agactataaggttacagtcataccacctcctccaaccactcgcaagcctttgtcagagcctcattatgttactgt

SEQ ID NO: 238763 - DNA, 75 bp, Artificial Sequence
  Synthetic
tcttaagactcctatgaccatgcagactctgctcatactgttatccctcctgtcccctgcccttgctgattactc

SEQ ID NO: 238764 - DNA, 75 bp, Artificial Sequence
  Synthetic
gcgcagcgtcgacggggagggctacaacgtggcccaatgcaacatgaccaaggactggttcctcgtccagatgct

SEQ ID NO: 238765 - DNA, 75 bp, Artificial Sequence
  Synthetic
agttcctctgcgacagggtcatgtggcgcatccccttctccagcaacttcatgtccatgggcgcccttaccgacc

SEQ ID NO: 238766 - DNA, 75 bp, Artificial Sequence
  Synthetic
ccatcccctcgcgcaactgggccgccttccgcggctggagtttcaccaggctcaagaccaaggaaactccctccc

SEQ ID NO: 238767 - DNA, 75 bp, Artificial Sequence
  Synthetic
gcggaccttgcttccacagttttactttggtgaacgttaccggcagcagcacagccgctccagaaactaaccttc

SEQ ID NO: 238768 - DNA, 75 bp, Artificial Sequence
  Synthetic
cctcgcgtcttcatgagtctgtgtccgcgttcggtgacaaacaggctgtctgtgtccccgtagacggacttgatt

SEQ ID NO: 238769 - DNA, 75 bp, Artificial Sequence
  Synthetic
gtgcccgagggctacaaggaccgcatgtactccttcttccgcaacttccagcccatgagcaggcaggtggtcgat

SEQ ID NO: 238770 - DNA, 75 bp, Artificial Sequence
  Synthetic
ctgggagtgaaaagtctgaagcgccgccgatgctattgaaagagaggaaggaagacactaaagggagagcttaac

SEQ ID NO: 238771 - DNA, 75 bp, Artificial Sequence
  Synthetic
gtgcagccgtgatcccacagggcgcagccggtgcactcccagttcttatgcgcgataccgctgtggctgaagatg

SEQ ID NO: 238772 - DNA, 75 bp, Artificial Sequence
  Synthetic
tgctacatgttcgacccctttgggttctcggaccgccggctcaagcagatttacagcttcgagtacgaggccatg

SEQ ID NO: 238773 - DNA, 75 bp, Artificial Sequence
  Synthetic
tctttttcaagaaccaaaagatccccatctcctgtcgcgccaatcgcactcgcgccgacgcgctcctcgctctgg

SEQ ID NO: 238774 - DNA, 75 bp, Artificial Sequence
  Synthetic
aacagctgtgctaagtgtggtttatttttgttactaggtccggtgtcagaggatgagtcatcaccctcagaagaa

SEQ ID NO: 238775 - DNA, 75 bp, Artificial Sequence
  Synthetic
cccccctttgtctcctccgatggattccaaaacttcccccctggggtcctgtcactcaaactggctgacccaatc

SEQ ID NO: 238776 - DNA, 75 bp, Artificial Sequence
  Synthetic
aaagtcgaaggggttctcgcgctcgtcgttgtgcgccgcgctggggagggccacgttgcggtactggtacttggg

SEQ ID NO: 238777 - DNA, 75 bp, Artificial Sequence
  Synthetic
tattcaaattacttttttagttgtctgtgggatctttattcttacggttcttttgtactttgtctgctgcaaaac

SEQ ID NO: 238778 - DNA, 75 bp, Artificial Sequence
  Synthetic
tatgaggaaggttttcctcccagcgattcagaggacgaacggggtgagcagagcatggctataatctcagactat

SEQ ID NO: 238779 - DNA, 75 bp, Artificial Sequence
  Synthetic
ccgactgtcttgggcctttccccacctaccttctttttgccctgctcacctgcacctgcgtctgcagcattgtct

SEQ ID NO: 238780 - DNA, 75 bp, Artificial Sequence
  Synthetic
ttatcctaaaatcatcaataatggaacagctaatcctgaagataaaaaaagtgcagccaagaaaactattgtcac

SEQ ID NO: 238781 - DNA, 75 bp, Artificial Sequence
  Synthetic
tccttgtccaggtcctcggcgttgctcaggccgaacggggtcatcttgcacagctggcggcccaggaagggcacg

SEQ ID NO: 238782 - DNA, 75 bp, Artificial Sequence
  Synthetic
cttcgacgagcgcaccgtcgcctcggacctggccgagatcgtgttccccgagcgcctgaggcagacgctgaaagg

SEQ ID NO: 238783 - DNA, 75 bp, Artificial Sequence
  Synthetic
tagtgggtcaaacgtaactttagttggtccagatggaaaggtcacttggtatgatgatgatttaaaaagaccatg

SEQ ID NO: 238784 - DNA, 75 bp, Artificial Sequence
  Synthetic
aatcatgtatgaggatctagaagggggtaacatccccgctctcctggataccaaaaaatatctggatagcaagaa

SEQ ID NO: 238785 - DNA, 75 bp, Artificial Sequence
  Synthetic
gctgcaaagcaacagggagatggtgctgtcactagaggcgatacccacctcactgtagctcaagaaaaagcagct

SEQ ID NO: 238786 - DNA, 75 bp, Artificial Sequence
  Synthetic
taaaaccctttgcggactccgcaaccttcttcccacaaactaactgatttaagcccaaaaaccaatcaaaccccc

SEQ ID NO: 238787 - DNA, 75 bp, Artificial Sequence
  Synthetic
cgtggccccggggcggagtggcctctcggtccatgaaccggcgcacgtcctgactgccgccggccattgtttcct

SEQ ID NO: 238788 - DNA, 75 bp, Artificial Sequence
  Synthetic
attcttgtgcgcgatcccgctgtggctgaagatgtaaccttgcaacatgcggcccatcacggtgctaaatgattt

SEQ ID NO: 238789 - DNA, 75 bp, Artificial Sequence
  Synthetic
gaccttgtcgtcgtcaactcaacgagaccgtctacctcaccaaccagactgaggtaaaactcacctgcagaccac

SEQ ID NO: 238790 - DNA, 75 bp, Artificial Sequence
  Synthetic
cacgagcaacccaaaatcgagcaggacctgggcttggaagagccggctcgtctagaacccccacaggatgaacag

SEQ ID NO: 238791 - DNA, 75 bp, Artificial Sequence
  Synthetic
aaacgggccctgcgatatggatgatggcggagcgagctcgattgttcctcggtgctcattgtagtgcaccctctt

SEQ ID NO: 238792 - DNA, 75 bp, Artificial Sequence
  Synthetic
ggtgctcattgtagtgcaccctcttgcgtaccttgtcgtacttctgccagcagaaagtggccctggaacagcaga

SEQ ID NO: 238793 - DNA, 75 bp, Artificial Sequence
  Synthetic
tggctacctgggaggagaggaggatgtgctgctgaaacacctgcagcgccagtccctcatcctccgggacgccct

SEQ ID NO: 238794 - DNA, 75 bp, Artificial Sequence
  Synthetic
ggtatccatgcccttctcccatgacgagaccagaggcaaactcagggggttgcgcacgttcaggataccgggggt

SEQ ID NO: 238795 - DNA, 75 bp, Artificial Sequence
  Synthetic
ggatacttggtagcatggaacccaaagtatgacacgcgcacactttggacaacaccagacacatctccaaactgc

SEQ ID NO: 238796 - DNA, 75 bp, Artificial Sequence
  Synthetic
ttatggaatcttcaaatcttggtaaatcatattggaactttcgaaatcaaaattcaattatgtcaacagcttatg

SEQ ID NO: 238797 - DNA, 75 bp, Artificial Sequence
  Synthetic
tgccctctcccctcagctcgcgtctcagcgtcagctgtaaaaagtcactcaagtcctcagccaccacagctgcca

SEQ ID NO: 238798 - DNA, 75 bp, Artificial Sequence
  Synthetic
agagctccataattagcccccaaaaactgcatgctggaataagctctctttgtgtctccggtgatgccttccaag

SEQ ID NO: 238799 - DNA, 75 bp, Artificial Sequence
  Synthetic
ggagaaggaaaaattgctataaatctttttcttttcgcagaaccatgaatactttgaccagtgtcgtgctgctct

SEQ ID NO: 238800 - DNA, 75 bp, Artificial Sequence
  Synthetic
aggtcgaggagaccctgcactacactttcaggcacggttttgtcaggcaggcctgcaagatctccaacgtggagc

SEQ ID NO: 238801 - DNA, 75 bp, Artificial Sequence
  Synthetic
tgggtggccctcgcggacatacaaaaatcggtccgtgtggttaaagagcagcacagagagatcatgtcttctccc

SEQ ID NO: 238802 - DNA, 75 bp, Artificial Sequence
  Synthetic
taccccgccgtcaacctcccgcccaaggtcatgcgtcgcatcatggatcagctcatcatgccccacatcgaggcc

SEQ ID NO: 238803 - DNA, 75 bp, Artificial Sequence
  Synthetic
ccgaggacgcccagcccgtggtcagcgacgagcagctcgcgcgctggctcgggaaccgcgacccccaggtcctgg

SEQ ID NO: 238804 - DNA, 75 bp, Artificial Sequence
  Synthetic
gtgactcaacttccgggttcccacgttacgtcacttctgcccttacatgtggctccgccgtagggcgccatcttg

SEQ ID NO: 238805 - DNA, 75 bp, Artificial Sequence
  Synthetic
aagtatggctcaaatagaacattgcagggcccaagtgttactccagttagttggtatgatggtgaaggaaatcgg

SEQ ID NO: 238806 - DNA, 75 bp, Artificial Sequence
  Synthetic
cccccagcatgccgaggaagaagccgctagtggaggaggagatggaagaagaatgggacagccaggcagaggagg

SEQ ID NO: 238807 - DNA, 75 bp, Artificial Sequence
  Synthetic
ggaggaagaattggaagaggtggaagaggagcaggcaacagagcagcccgtcgccgcaccatccgcgccggcagc

SEQ ID NO: 238808 - DNA, 75 bp, Artificial Sequence
  Synthetic
ttactttgcaagaaggaagtctgactgtagaccctaaggctcccttgcaacttgcaaacaataaaaaacttgagc

SEQ ID NO: 238809 - DNA, 75 bp, Artificial Sequence
  Synthetic
ggggagggcgtaagcttgagcggccttgcggagcgaggtgtgcgtcagggcgaaggtgtccctgaccatgacttt

SEQ ID NO: 238810 - DNA, 75 bp, Artificial Sequence
  Synthetic
taatgtcactaggggtgggaatgctacactagatggaccatttaacaataacacatggacaagatatcatgacga

SEQ ID NO: 238811 - DNA, 75 bp, Artificial Sequence
  Synthetic
tacgtttggcgttgctcccatgggcggaactaacatcacaattagcggtttgcaaattggaactgaggaagaaga

SEQ ID NO: 238812 - DNA, 75 bp, Artificial Sequence
  Synthetic
ggaactaacatcacaattagcggtttgcaaattggaactgaggaagaagatggaaatcctacaaaggagattttt

SEQ ID NO: 238813 - DNA, 75 bp, Artificial Sequence
  Synthetic
ctcaaataggagaagaaaactggcaggacactgagaatttttatggcggtagagctcttaagaaagacaccaaaa

SEQ ID NO: 238814 - DNA, 75 bp, Artificial Sequence
  Synthetic
ggacactgagaatttttatggcggtagagctcttaagaaagacaccaaaatgaaaccttgctatggctcttttgc

SEQ ID NO: 238815 - DNA, 75 bp, Artificial Sequence
  Synthetic
caagctaagttaaaacttgacgcccaaggtcagtcaactaaagattatgacattgacctggctttctttgactca

SEQ ID NO: 238816 - DNA, 75 bp, Artificial Sequence
  Synthetic
aaggtcagtcaactaaagattatgacattgacctggctttctttgactcacctggaggaaatacaacagctggtg

SEQ ID NO: 238817 - DNA, 75 bp, Artificial Sequence
  Synthetic
tgtcatgtacactgagaatgcttatctggaaacaccagatacccatgtagtttacaagccaggaacctctgatga

SEQ ID NO: 238818 - DNA, 75 bp, Artificial Sequence
  Synthetic
tactactgatcagacagaggctacctcaagtgccttcagcagcactgcaaatttaacttcgcttgcttggactaa

SEQ ID NO: 238819 - DNA, 75 bp, Artificial Sequence
  Synthetic
tcagaaccatgaaggctttcacagcttttgttctgattagcttagtcacacttagttcaactgctgcggctgctt

SEQ ID NO: 238820 - DNA, 75 bp, Artificial Sequence
  Synthetic
ttactgagactcagtcactttcatttcagaaccatgaaggctttcacagcttttgttctgattagcttagtcaca

SEQ ID NO: 238821 - DNA, 75 bp, Artificial Sequence
  Synthetic
aggagaaaacattacactaacaggtgcaggaattaataatacatggtcagtatatcaccatgatggatcaaagaa

SEQ ID NO: 238822 - DNA, 75 bp, Artificial Sequence
  Synthetic
gcaggaattaataatacatggtcagtatatcaccatgatggatcaaagaatggatatcaagaagtatgtccatgg

SEQ ID NO: 238823 - DNA, 75 bp, Artificial Sequence
  Synthetic
gctaagtgtggtttattttgttactaggtccggtgtcagaggatgagtcatcaccctcagaagaagaccgcccgt

SEQ ID NO: 238824 - DNA, 75 bp, Artificial Sequence
  Synthetic
gagatagcagtactattactaatcttacagttgtagctaatgcaaatttaacaagcagaaaatttaaatcatata

SEQ ID NO: 238825 - DNA, 75 bp, Artificial Sequence
  Synthetic
tgcgggaactggacttggggtctataatccacacagtttcctggcgagccaaacggggatcggtgattgaaatga

SEQ ID NO: 238826 - DNA, 75 bp, Artificial Sequence
  Synthetic
attacaatcattgaaattccaacaaccaaagctccaaccacagttaggacaactagggaaacaaccacgcagaca

SEQ ID NO: 238827 - DNA, 75 bp, Artificial Sequence
  Synthetic
atcaaggtgttaaagttaaaaatggggaagatggtgatattgagagcgaatgggaaaaagacaccaatgtcgcag

SEQ ID NO: 238828 - DNA, 75 bp, Artificial Sequence
  Synthetic
ctacctgaccttgcagagcagctcttcggagcctcgctccggaggcatcggaaccctccagtttgtggaggagtt

SEQ ID NO: 238829 - DNA, 75 bp, Artificial Sequence
  Synthetic
ttcccaccccttacatgtggagctatcagccccagatgggcctggccgcgggcgcctcccaggactactccaccc

SEQ ID NO: 238830 - DNA, 75 bp, Artificial Sequence
  Synthetic
caatgccatcttgaacccgcattggctcccgccgccagggttctacacgggcgagtacgacatgcccgaccccaa

SEQ ID NO: 238831 - DNA, 75 bp, Artificial Sequence
  Synthetic
agacactggtttggaactcctctatctcgcctggtgtacacagttaagaaggattataacgaggaatttgaaaat

SEQ ID NO: 238832 - DNA, 75 bp, Artificial Sequence
  Synthetic
ctcgcctggtgtacacagttaagaaggattataacgaggaatttgaaaatctttttgctgactgctctggcctgc

SEQ ID NO: 238833 - DNA, 75 bp, Artificial Sequence
  Synthetic
ccgactaggaagtgcggcggcggctggcggtagagcggccagcgctgggtggccggcgcgcccggggccaggtcc

SEQ ID NO: 238834 - DNA, 75 bp, Artificial Sequence
  Synthetic
aacacctgcgccaacgacggtattgaaatacccaacaaccttaccagtggactaacttacaccaccagaaagact

SEQ ID NO: 238835 - DNA, 75 bp, Artificial Sequence
  Synthetic
tagagggaacctaccactgccagagcggaccttgcttccacactttcactttggtgaacgttaccggcagcagca

SEQ ID NO: 238836 - DNA, 75 bp, Artificial Sequence
  Synthetic
cggaccttgcttccacactttcactttggtgaacgttaccggcagcagcacagccgctccagaaacatctaacct

SEQ ID NO: 238837 - DNA, 75 bp, Artificial Sequence
  Synthetic
tcggttgaggcatctggaccactgccgccgcctgcgctgcttcgcccgggagagctgcggcctcatctactttga

SEQ ID NO: 238838 - DNA, 75 bp, Artificial Sequence
  Synthetic
accggaggtgagctctgggttccctctctaacagaggggggtaaacatattgaagcggttgggtatttgatttta

SEQ ID NO: 238839 - DNA, 75 bp, Artificial Sequence
  Synthetic
ctctgcgacagggtcatgtggcgcatccccttctccagcaacttcatgtccatgggcgccctcaccgacctgggt

SEQ ID NO: 238840 - DNA, 75 bp, Artificial Sequence
  Synthetic
ttgagcatcctacaacaaaatcgcccaccactgctaatacagctacatcaattaaatcaacaaccacacagccta

SEQ ID NO: 238841 - DNA, 75 bp, Artificial Sequence
  Synthetic
atcacccagcagtcgggcgagaccagcggctgcatccactgctcctgcgaaagccccgagtgcatctactccctc

SEQ ID NO: 238842 - DNA, 75 bp, Artificial Sequence
  Synthetic
attggagttaagtttgacagcagaaatttcaagctgggctgggacccggtgactaagctggtgatgccgggggtc

SEQ ID NO: 238843 - DNA, 75 bp, Artificial Sequence
  Synthetic
ggtagtcagtctcccaccaccagcccatttcacagtataaacaattctctcagcacgggtggccttaaataggga

SEQ ID NO: 238844 - DNA, 75 bp, Artificial Sequence
  Synthetic
tggctgctggatgggagtggtcggaagacccaagagcgagatgtctgtgaagcagtgtgtgtttgagaagtgcta

SEQ ID NO: 238845 - DNA, 75 bp, Artificial Sequence
  Synthetic
ttgccagagcggaccttgtactcacaccttccatttggtgaacgtcaccagcagcagcaacagctcagaaactaa

SEQ ID NO: 238846 - DNA, 75 bp, Artificial Sequence
  Synthetic
accttccatttggtgaacgtcaccagcagcagcaacagctcagaaactaacctctcttctcgtactaacagacct

SEQ ID NO: 238847 - DNA, 75 bp, Artificial Sequence
  Synthetic
aatgtggtgaaaggctgcacggatgagcgcatgtacaacatgctgacctgcgactcaggggtctgtcatatcctg

SEQ ID NO: 238848 - DNA, 75 bp, Artificial Sequence
  Synthetic
catgttcgacccatttgggttctcggaccgccggctcaagcagatttacagcttcgagtacgaggctatgctgcg

SEQ ID NO: 238849 - DNA, 75 bp, Artificial Sequence
  Synthetic
atgtttttctttccacagcatcatgaatacagtgatccgtatcgtgctgctctctcttcttgtagcttttagtca

SEQ ID NO: 238850 - DNA, 75 bp, Artificial Sequence
  Synthetic
tctctcttcttgtagcttttagtcaggcaggatttcatactatcaatgctacatggtgggctaatataactttag

SEQ ID NO: 238851 - DNA, 75 bp, Artificial Sequence
  Synthetic
tcgtacctgggccacctgctgacgctgtaccgcgaggccataggccaggcgcaggtggacgagcagaccttccag

SEQ ID NO: 238852 - DNA, 75 bp, Artificial Sequence
  Synthetic
ctggtatgataaacagggaatgcagttctgtgatggaaatacagttaagaatcctcaaataagacatgagtgtaa

SEQ ID NO: 238853 - DNA, 75 bp, Artificial Sequence
  Synthetic
agcagagagtgcactgtagtcatcaaatgcgagcacgactgcccactaaacattacattcaagaataacaccatg

SEQ ID NO: 238854 - DNA, 75 bp, Artificial Sequence
  Synthetic
gtgaacaaaacccatgaaaggacatacatgggttataatagacagagtactcataaggaagactataaagtcata

SEQ ID NO: 238855 - DNA, 75 bp, Artificial Sequence
  Synthetic
cgcagtacgcactgtcggccgaggaggaaaggatcctgagatatgtgcagcagagcgtagggctgttcctgatgc

SEQ ID NO: 238856 - DNA, 75 bp, Artificial Sequence
  Synthetic
aaagttgaacatgcagaatttaatcatacatgtgacgtgcaaaatcttacactgttgtttataaatcttacacat

SEQ ID NO: 238857 - DNA, 75 bp, Artificial Sequence
  Synthetic
gatggggcttatcttggctataatcaccagggaactaaaagaacttggtatgaggttgtagtgacagatggtttt

SEQ ID NO: 238858 - DNA, 75 bp, Artificial Sequence
  Synthetic
gtaaatgttaaatctggtacaaaccacacccttgaaggtcctagaaaaactccagttcagtggtatgggggtgct

SEQ ID NO: 238859 - DNA, 75 bp, Artificial Sequence
  Synthetic
gagcataaacagggtgggcagaaacaggaggggcaaaaagagacaagtcaaaagaaagctaatgacaaacagaag

SEQ ID NO: 238860 - DNA, 75 bp, Artificial Sequence
  Synthetic
aggaggggcaaaaagagacaagtcaaaagaaagctaatgacaaacagaaggcgacacacaggaggccatcaaaac

SEQ ID NO: 238861 - DNA, 75 bp, Artificial Sequence
  Synthetic
ctaaaatacatcacaaggaattgaatcacacttgctctattcagaacataactcttacattcataaacagaacac

SEQ ID NO: 238862 - DNA, 75 bp, Artificial Sequence
  Synthetic
tcacacttgctctattcagaacataactcttacattcataaacagaacacatcatggaacatactatggttttgg

SEQ ID NO: 238863 - DNA, 75 bp, Artificial Sequence
  Synthetic
actgattacagtttctagtgggtctaacttaacattacttgggccagatggaaaggtcacttggtatgatgatga

SEQ ID NO: 238864 - DNA, 75 bp, Artificial Sequence
  Synthetic
ctatgacaatcaaaattcaaaagtgtatcatgtcagagtagatgtagagcctcctagaccccgtgctacttgggc

SEQ ID NO: 238865 - DNA, 75 bp, Artificial Sequence
  Synthetic
acgctgattggctgttggaagagccgttactgacgtcacgacgcacggcgtcaacggtcggcgcggaggcgtggc

SEQ ID NO: 238866 - DNA, 75 bp, Artificial Sequence
  Synthetic
cagaaattaatcacacttgcaatgctcaaaaccttactttgctatttgtgaatgaaacacatgaaagaacatatt

SEQ ID NO: 238867 - DNA, 75 bp, Artificial Sequence
  Synthetic
tcaaaaccttactttgctatttgtgaatgaaacacatgaaagaacatattatggaattagtggtgattggaaaca

SEQ ID NO: 238868 - DNA, 75 bp, Artificial Sequence
  Synthetic
tgcttgatgtgcccaagtacttggaaagcaagaagaaactggaggaagccgctaaggaagctggcaataccaaag

SEQ ID NO: 238869 - DNA, 75 bp, Artificial Sequence
  Synthetic
acaaagacacatttaaatattaaaaatttgggccaacgcaaaactgatgaaaaccataaaaatggaatgcaacag

SEQ ID NO: 238870 - DNA, 75 bp, Artificial Sequence
  Synthetic
tacaattcaggttatgattcctattggaactaattatactttagtggggccttcgccaccagtgagctggcatac

SEQ ID NO: 238871 - DNA, 75 bp, Artificial Sequence
  Synthetic
acttattaatgttaatgctacatttgaagctgattactatggctcgaacaataagagtgaatcaaaacactacag

SEQ ID NO: 238872 - DNA, 75 bp, Artificial Sequence
  Synthetic
tggatggaaaaatatctgtgaatggaatgttacagcctataaatgcttcagtaatggaagcattacaattactgc

SEQ ID NO: 238873 - DNA, 75 bp, Artificial Sequence
  Synthetic
gtaatggaagcattacaattactgccactgctaatattacttctggcacaatcaaggcagaaagctataaaaatg

SEQ ID NO: 238874 - DNA, 75 bp, Artificial Sequence
  Synthetic
cactgctaatattacttctggcacaatcaaggcagaaagctataaaaatgaaatgaaaaaaatggtatataaaaa

SEQ ID NO: 238875 - DNA, 75 bp, Artificial Sequence
  Synthetic
gatcaggcactattattcagaccgcttactaccaaaggaagcatgatcattactactgaaaatcaaaactttgaa

SEQ ID NO: 238876 - DNA, 75 bp, Artificial Sequence
  Synthetic
tggattccaaaacttcccccctggggtcctgtcactcaaactggctgacccaatcaccatcgccaatggaaatgt

SEQ ID NO: 238877 - DNA, 75 bp, Artificial Sequence
  Synthetic
ggaaattatgagtatcagaaattatctttttataatctgacaattattgagctgccaactactaaggctcccaca

SEQ ID NO: 238878 - DNA, 75 bp, Artificial Sequence
  Synthetic
aaatctgccttggtagccattaggaatcagcacgctcactctcaggtgaagcaaaaccaccccatgcggaggaat

SEQ ID NO: 238879 - DNA, 75 bp, Artificial Sequence
  Synthetic
gttaggacaacgcagcctaccactgtacccactacacatccaaccaccacagccagtacaactactgagaccaca

SEQ ID NO: 238880 - DNA, 75 bp, Artificial Sequence
  Synthetic
tagtgcagccgcagctaaatgcttccatacttataacttaactagaggggaaaatattacattatcaggtgctgg

SEQ ID NO: 238881 - DNA, 75 bp, Artificial Sequence
  Synthetic
gtcgcgcgaagaggagctcatctcgctgccgctggacgagagcaaccccacgccgagcctgaagcccgtgaccct

SEQ ID NO: 238882 - DNA, 75 bp, Artificial Sequence
  Synthetic
cacaatgggtggaaacaagtttgtccatggaatgacggacgctatgtgtgcgttggaaacagcagtaccataact

SEQ ID NO: 238883 - DNA, 75 bp, Artificial Sequence
  Synthetic
cgttggaaacagcagtaccataactaaccttacagttgtggctaatgcaaatttatcatcaactgttaaatttag

SEQ ID NO: 238884 - DNA, 75 bp, Artificial Sequence
  Synthetic
ggggtctaaggaatcttctcttctctttttcagtatggtgattcagccatgattcctaggttcttcctatttaac

SEQ ID NO: 238885 - DNA, 75 bp, Artificial Sequence
  Synthetic
gatggatatgaaagcaatccatcatgcttttatactgtcaatgtaattgagcttccaaccaccagatcgccaact

SEQ ID NO: 238886 - DNA, 75 bp, Artificial Sequence
  Synthetic
gcttttatactgtcaatgtaattgagcttccaaccaccagatcgccaactaccaccacagtcagtacaactgctg

SEQ ID NO: 238887 - DNA, 75 bp, Artificial Sequence
  Synthetic
gatgcaaatggaaagcttaaaagcgaatcaaatcttagtggttattggaactatagaagtgataatagtgttgtc

SEQ ID NO: 238888 - DNA, 75 bp, Artificial Sequence
  Synthetic
tagtagagatgagagtctgaaaaacagaaagcatgcactaaaccagagtggccagtctcactgaaggaaaaatca

SEQ ID NO: 238889 - DNA, 75 bp, Artificial Sequence
  Synthetic
gccaccgagcctcccaggaggcgaagatggggccctgccaaccggctgatgcccaactacgtattgcatccttcc

SEQ ID NO: 238890 - DNA, 75 bp, Artificial Sequence
  Synthetic
gccagaatcttaaggctcatttgaccatgcagactctgctcatactgctatccctcctctcccctgccctcgctg

SEQ ID NO: 238891 - DNA, 75 bp, Artificial Sequence
  Synthetic
aaagcttatgaaacccctgtgccttttgacacctcctccatgacattctcatatatcgcccaggaaaatgaagac

SEQ ID NO: 238892 - DNA, 75 bp, Artificial Sequence
  Synthetic
agctacaatgtgatcgagggaaccacagacaccctgtaccgcagttggtacctgtcctatacctacggggacccc

SEQ ID NO: 238893 - DNA, 75 bp, Artificial Sequence
  Synthetic
ggagacccgagtgcttcctgtgctctgtgttacatgaaagccaacttcagctttatttacagtaagtggagtgaa

SEQ ID NO: 238894 - DNA, 75 bp, Artificial Sequence
  Synthetic
acaacatgtgtgcagaagtctggggtgcttccaagatcaggggatgtaagttttatggctgctggatgggagtgg

SEQ ID NO: 238895 - DNA, 75 bp, Artificial Sequence
  Synthetic
gcgaccttctccccatgaactgatgttgattaaaatcccagaaaccaatcagccccttaccccattcccctccca

SEQ ID NO: 238896 - DNA, 75 bp, Artificial Sequence
  Synthetic
cttacttgaaatctgaaagtatgtctctggtgtagttgttcagcagcacctcggtaccctcctcccagctctggt

SEQ ID NO: 238897 - DNA, 75 bp, Artificial Sequence
  Synthetic
cccagcttcaaaccctattcgggcacagcttacaacagcctagcccccaagggcgctccaaactccagtcagtgg

SEQ ID NO: 238898 - DNA, 75 bp, Artificial Sequence
  Synthetic
ggtctggggcgcttccaagatcaggggatgtaagttttatggctgctggatgggcgtggtcggaagacccaagag

SEQ ID NO: 238899 - DNA, 75 bp, Artificial Sequence
  Synthetic
tcgcggctggagtttcacccgcctaaaaaccaaggaaactccctccctcggctcgggttttgacccctactttgt

SEQ ID NO: 238900 - DNA, 75 bp, Artificial Sequence
  Synthetic
atagttcagacgggtgctccggtttctggagacactggtttggaactcctctatctcgcctggtgtacacagtta

SEQ ID NO: 238901 - DNA, 75 bp, Artificial Sequence
  Synthetic
atcaaacagttaagacacacacacatggcgtagctgctatgggaggaacagatattacagcaaagggtttgcaaa

SEQ ID NO: 238902 - DNA, 75 bp, Artificial Sequence
  Synthetic
gcatgagcggttccagcgaacgagaactcgcggccatcgtgcgcgacctgggctgcgggccctactttttgggca

SEQ ID NO: 238903 - DNA, 75 bp, Artificial Sequence
  Synthetic
tgcaggtcctatttatgcaaatgaaatataccagccagagcctcaaataggagaagaaaacttgcaagatgttga

SEQ ID NO: 238904 - DNA, 75 bp, Artificial Sequence
  Synthetic
ctgcttgattcactgaatctcggccaccaggctctattccaggaaagggtcctccacagccttgatttttccagc

SEQ ID NO: 238905 - DNA, 75 bp, Artificial Sequence
  Synthetic
aaaaaagaaacaaaaatgaaaccttgctatggctcatttgccagacccacaaatgaaaaaggcggtcaagccaaa

SEQ ID NO: 238906 - DNA, 75 bp, Artificial Sequence
  Synthetic
tttataactggagaagatggtcagccaactaaaaatcatgatatcacaatgaatttctttgacactcctggtggc

SEQ ID NO: 238907 - DNA, 75 bp, Artificial Sequence
  Synthetic
tccaaaacttcccccctggtgtcctgtcactcaaattggctgacccaatcgctatcagcaatggtgatgtctcac

SEQ ID NO: 238908 - DNA, 75 bp, Artificial Sequence
  Synthetic
cttctgatgaaagttccgaagcaaatttggttcagcagtccatgccaaacaggcccaactatattggcttcaggg

SEQ ID NO: 238909 - DNA, 75 bp, Artificial Sequence
  Synthetic
gaattggagaaggaggtggtttaacttttgatgataaaggttatttagtagcatggaacaataaacatgacatcc

SEQ ID NO: 238910 - DNA, 75 bp, Artificial Sequence
  Synthetic
ttttgatgataaaggttatttagtagcatggaacaataaacatgacatccgcacactttggacaactttagaccc

SEQ ID NO: 238911 - DNA, 75 bp, Artificial Sequence
  Synthetic
ttggaacagacaaaaaactggaattggctttagcacctccatttaatgttaaagataataagctagctctgctag

SEQ ID NO: 238912 - DNA, 75 bp, Artificial Sequence
  Synthetic
tactgacaaagtgcggaagtcagattttggcaaatgtatctctaattatagtcaacggaaagttcaagatcctta

SEQ ID NO: 238913 - DNA, 75 bp, Artificial Sequence
  Synthetic
taaatcatttaacatcaaactactgtttgatcaaaatggagttctattggaaaattcaaacattgaaaaacagta

SEQ ID NO: 238914 - DNA, 75 bp, Artificial Sequence
  Synthetic
tttgatcaaaatggagttctattggaaaattcaaacattgaaaaacagtacctaaactttagaagtggagactct

SEQ ID NO: 238915 - DNA, 75 bp, Artificial Sequence
  Synthetic
aagatagccctgcgcccagattgcaagtacaggatcaccaagacggtgaatatcagacatgcctgctacatctca

SEQ ID NO: 238916 - DNA, 75 bp, Artificial Sequence
  Synthetic
aaggactctaaactaacattggtccttacaaagtgcggaagtcagatattggctaatgtatctcttcttgttgtc

SEQ ID NO: 238917 - DNA, 75 bp, Artificial Sequence
  Synthetic
caattggatttatgcctaatttactagcttatgctaaagctacaactgatcagtctaaaatttatgcaaggaaca

SEQ ID NO: 238918 - DNA, 75 bp, Artificial Sequence
  Synthetic
ttacaaagtgcggaagtcagatattggctaatgtatctcttcttgttgtcaaaggaaggtttcaaaacctaaatt

SEQ ID NO: 238919 - DNA, 75 bp, Artificial Sequence
  Synthetic
ctatatatggaaatatctacttagataatcagccatataatccagttgtaattaaaattacttttaataatgaag

SEQ ID NO: 238920 - DNA, 75 bp, Artificial Sequence
  Synthetic
ctgaatgtcctatggtgactcggctgagctcgctcggttgaggcatctggaccactgccgccgcctgcgctgctt

SEQ ID NO: 238921 - DNA, 75 bp, Artificial Sequence
  Synthetic
tagttgcgcaggcgctggaagaggtagttgagggtggtggcgatgtgctcggtgacgaagaagtacatgatccag

SEQ ID NO: 238922 - DNA, 75 bp, Artificial Sequence
  Synthetic
agcatttgcaataaaattactgtttgatgaaaatgggattcttaaagactcatcaaatcttgacaagaactattg

SEQ ID NO: 238923 - DNA, 75 bp, Artificial Sequence
  Synthetic
taactattcatggaccaaggactatgacaatatcccttttgattctacttcatttaccttctcctatatcgccca

SEQ ID NO: 238924 - DNA, 75 bp, Artificial Sequence
  Synthetic
ttagcagagcaatataaaaatgcagttggctttatgccaaatttagcagcttatcccaaatctaccaccactcag

SEQ ID NO: 238925 - DNA, 75 bp, Artificial Sequence
  Synthetic
atctataaaagcatacagagattcagccatagctcagcccgcttaccagtagacagagagcacagcagtacaagc

SEQ ID NO: 238926 - DNA, 75 bp, Artificial Sequence
  Synthetic
ttattgatttttacaccagcacgggtagtcagtctcccaccaccagcccatttcacagtgtaaacaattctctca

SEQ ID NO: 238927 - DNA, 75 bp, Artificial Sequence
  Synthetic
cccacggtggtggagatggaagatgcaactcttccgccgcccaagggcgagaagcggccgcggcccgacgcggag

SEQ ID NO: 238928 - DNA, 75 bp, Artificial Sequence
  Synthetic
tactgcatctgtcctaccccgaagttgcatgagaatttttgctgtactctttgtggtgagtttaataaaagctaa

SEQ ID NO: 238929 - DNA, 75 bp, Artificial Sequence
  Synthetic
aaaattacttttaatcaagaagcagatagtgcttattctatcactttaaactattcatggggtaaggattatgaa

SEQ ID NO: 238930 - DNA, 75 bp, Artificial Sequence
  Synthetic
tatggtgccatgttacccacgtccaaaatggcttccatgtccggccaagcctccgcggcggccgtcggccgtgcg

SEQ ID NO: 238931 - DNA, 75 bp, Artificial Sequence
  Synthetic
aaatggcttccatgtccggccaagcctccgcggcggccgtcggccgtgcgtcgtgacgtcactaacagtttttgc

SEQ ID NO: 238932 - DNA, 75 bp, Artificial Sequence
  Synthetic
cagcatcagtctcctggtgcgtcgggcacagcaccgcatcctgatctctgccatgttctcacagtaagtgcagca

SEQ ID NO: 238933 - DNA, 75 bp, Artificial Sequence
  Synthetic
atactaacactcctaaaaccggaggtgagctctgggttccctctctgacagaggggggtaaacatattgaagcgg

SEQ ID NO: 238934 - DNA, 75 bp, Artificial Sequence
  Synthetic
aaaactgaatgaggaagtgaaaagtgaaaaataccggtcccgcccagggcggaatatttaccgagggccgagaga

SEQ ID NO: 238935 - DNA, 75 bp, Artificial Sequence
  Synthetic
ggctataatatggttcctgaggcacaagcccaggtatggaaatctggaaaaggaaaaattgctataatgtttttc

SEQ ID NO: 238936 - DNA, 75 bp, Artificial Sequence
  Synthetic
gtgcccttggacatggccgcattattgctggatgactttgtgagtacagtattggaggatgaactgcatccaact

SEQ ID NO: 238937 - DNA, 75 bp, Artificial Sequence
  Synthetic
caggagcaggaggaggagaacttaaccacccacgagcaacccaaaattgagcaggacctgggcttggaagagccg

SEQ ID NO: 238938 - DNA, 75 bp, Artificial Sequence
  Synthetic
ttgcgtaccttgtcgtacttctgccagcagaaatgggcccttgaacagcagatacctctccttctcctgtctttc

SEQ ID NO: 238939 - DNA, 75 bp, Artificial Sequence
  Synthetic
aagcatgagcggctccagcgaaagagagctcgcggccatcgtgcgcgacctgggatgcgggccctactttttggg

SEQ ID NO: 238940 - DNA, 75 bp, Artificial Sequence
  Synthetic
gtccatgcccaacagaccaaactacattggcttcagagacaattttgtggggctcatgtactacaacagcactgg

SEQ ID NO: 238941 - DNA, 75 bp, Artificial Sequence
  Synthetic
atgcagcctggtctatcattcagaggaggtgggggaagaactggaagaaccatttttattccaagcggtctcgaa

SEQ ID NO: 238942 - DNA, 75 bp, Artificial Sequence
  Synthetic
gaaggcggggccgagattggtgcgctggggctgctcggcgcggaagacgatctggcgaaagatggcatgcgagtt

SEQ ID NO: 238943 - DNA, 75 bp, Artificial Sequence
  Synthetic
acatcaagcagatgctcgtcaggggggtccgcatcgatggtgaagatgcccggacagagttccttgtcaaaataa

SEQ ID NO: 238944 - DNA, 75 bp, Artificial Sequence
  Synthetic
aagggcaacatctatgccatggagattaacctccaggccaacctgtggaagagttttctgtactcgaacgtggcc

SEQ ID NO: 238945 - DNA, 75 bp, Artificial Sequence
  Synthetic
gactggcaagcgtgatggagtactttaaagctccaaagctagcacccaaaaactgcacgctggaataagctctct

SEQ ID NO: 238946 - DNA, 75 bp, Artificial Sequence
  Synthetic
ccctccactttcataatcaggcagaccttcatattagaaacagatcctgctgctccaccacctgcagcgtgttca

SEQ ID NO: 238947 - DNA, 75 bp, Artificial Sequence
  Synthetic
ggtgagtgataaagcgaggtagtttttctttaatcatttgagtgatagaaaagtcctctaaataagtcactagga

SEQ ID NO: 238948 - DNA, 75 bp, Artificial Sequence
  Synthetic
gcaaaaatcacatcggactgggttagtatgcccctggcatggtagtcatttaaggccataaatctgccttggtag

SEQ ID NO: 238949 - DNA, 75 bp, Artificial Sequence
  Synthetic
ccttcaggtgttgcatgatgggaatgagagccggagtgatgaatatgaattccatgatcttcatgaacatgaagt

SEQ ID NO: 238950 - DNA, 75 bp, Artificial Sequence
  Synthetic
tcaatggagagaagtttaatggggtgatgttcatggccaacagccacatgaccctgcacggatgcagtttcttcg

SEQ ID NO: 238951 - DNA, 75 bp, Artificial Sequence
  Synthetic
ttggatatacaaattactttcctgattgtctgtggggtctttatcctcgctgtccttctctactttgtctgctgc

SEQ ID NO: 238952 - DNA, 75 bp, Artificial Sequence
  Synthetic
catcatcaataatataccccacaaagtaaacaaaagttaatatgcaaatgagcttttgaattttaacggttttgg

SEQ ID NO: 238953 - DNA, 75 bp, Artificial Sequence
  Synthetic
cgtcgcgcgcgcgcatgaccacctgcgcaaggttgagctccacgtgccgcgtgaagacggcgtagttgcgcaggc

SEQ ID NO: 238954 - DNA, 75 bp, Artificial Sequence
  Synthetic
agcttttgaattttaacggttttggggcggagccaacgctgattggacgagaagcggtgatgcaaataacgtcac

SEQ ID NO: 238955 - DNA, 75 bp, Artificial Sequence
  Synthetic
ctttatcagcgcgctgcggctgatggtgaccgaggtgccccagagcgaggtgtaccagtcgggcccggactactt

SEQ ID NO: 238956 - DNA, 75 bp, Artificial Sequence
  Synthetic
tcacctgcacctgcgtctgcagcattgtctgcctggtcatcaccttcctgcagctcatcgactggtgctgcgcgc

SEQ ID NO: 238957 - DNA, 75 bp, Artificial Sequence
  Synthetic
cggccccgccctaaattcaaaagctcatttgcatattaacttttgtttactttgtggggtatattattgatgatg

SEQ ID NO: 238958 - DNA, 75 bp, Artificial Sequence
  Synthetic
ggcattcacatacacactagaaagcagttcactagcctccacgccaccacccacaccgcctccccgcagaaatca

SEQ ID NO: 238959 - DNA, 75 bp, Artificial Sequence
  Synthetic
gctggaggactatgtgagtacagtattggaggacgaactacatccatctccatttgagctgggacctacacttca

SEQ ID NO: 238960 - DNA, 75 bp, Artificial Sequence
  Synthetic
acacttgcagcgccaatccatcatcctccgggacgccctggccgaccggagcgaaacccccctcagcgtcgagga

SEQ ID NO: 238961 - DNA, 75 bp, Artificial Sequence
  Synthetic
acgacccgaacgaagaggctgtgaatttaatatttccagaatctctgattcttcaggctgacatagccagcgaag

SEQ ID NO: 238962 - DNA, 75 bp, Artificial Sequence
  Synthetic
accccaacgacgggttcctgtgggacgacgtggacagcgcggtgttctcgcccgcctttcaaaagcgacaggaag

SEQ ID NO: 238963 - DNA, 75 bp, Artificial Sequence
  Synthetic
ggagtgaatgtgagagaggctgagtgcttaacacataactgggtgatgcttaaacagctgtgctaagtgtggttt

SEQ ID NO: 238964 - DNA, 75 bp, Artificial Sequence
  Synthetic
gtctcctgcctggggatcctgcacgagaaccgcctggggcagaccgtgctccactctaccctgaagggcgaggcg

SEQ ID NO: 238965 - DNA, 75 bp, Artificial Sequence
  Synthetic
tgagcttgaaacgccccaggaactaggcgcagctgtgcttagtcatgtgtaaataaagttgtacaataaaagtat

SEQ ID NO: 238966 - DNA, 75 bp, Artificial Sequence
  Synthetic
ctatcagtaatggcgatgtctcactcaaggtgggagggggactcactgtggaacaagatagtggaaacctaagtg

SEQ ID NO: 238967 - DNA, 75 bp, Artificial Sequence
  Synthetic
aaggagtcggtttatgtgtgagaattggagaaggaggtggtttaacttttgatgataaaggttatttagtagcat

SEQ ID NO: 238968 - DNA, 75 bp, Artificial Sequence
  Synthetic
tgcagccactgcaaatgatgcgcccaggggagatacttttgtcaatgaagctcaagagaaggcagctcagaagca

SEQ ID NO: 238969 - DNA, 75 bp, Artificial Sequence
  Synthetic
ctcaagagaaggcagctcagaagcagctagtgatcgagcccattgaaaaggatgacagcaacagaagttataatc

SEQ ID NO: 238970 - DNA, 75 bp, Artificial Sequence
  Synthetic
ttttggaaatatttacctagattcgcaagcatataatccagtggttattaaaattacttttaatcaagaagcaga

SEQ ID NO: 238971 - DNA, 75 bp, Artificial Sequence
  Synthetic
actcgtacctgggccacctgctgacgctgtaccgcgaggccataggccaggcgcaggtggacgagcaaaccttcc

SEQ ID NO: 238972 - DNA, 75 bp, Artificial Sequence
  Synthetic
gactactccacccgcatgaactggctcagtgccgggccctcaatgatctcacaggtcaacgggatccgtaaccat

SEQ ID NO: 238973 - DNA, 75 bp, Artificial Sequence
  Synthetic
gcaagaagcaacctttccaagagggcttcagaatcatgtatgaggatctagaaggtggcaacatccccgccctcc

SEQ ID NO: 238974 - DNA, 75 bp, Artificial Sequence
  Synthetic
tgagcgcatgtacaacatgctgacctgcgactcgggggtctgccatatcctgaagaacatccatgtgacctccca

SEQ ID NO: 238975 - DNA, 75 bp, Artificial Sequence
  Synthetic
tggccctggatgtgaccgaggagctgagaccagaccacctggtgatggcctgtaccgggaccgagttcagctcca

SEQ ID NO: 238976 - DNA, 75 bp, Artificial Sequence
  Synthetic
tgtaccgggaccgagttcagctccagtggggaggacacagattagaggtaggtttgagtagtgggcgtggctaat

SEQ ID NO: 238977 - DNA, 75 bp, Artificial Sequence
  Synthetic
gtggacattgaaatggattctcttgcgtaccttgtcgtacttctgccagcagaaagtggctcgggaacagcagat

SEQ ID NO: 238978 - DNA, 75 bp, Artificial Sequence
  Synthetic
tcgtcagaatgtgatgggatctacggtggacgggcgcccagtgcttccagcaaattcctcgaccatgacctacgc

SEQ ID NO: 238979 - DNA, 75 bp, Artificial Sequence
  Synthetic
tgctataaattctttttcttttcacagcaccatgaatactttgaccagtgtcgtgctgctctctcttcttgtatg

SEQ ID NO: 238980 - DNA, 75 bp, Artificial Sequence
  Synthetic
cgaccccaacgacgggttcctgtgggacgacgtggacagcgcggtgttctccccgaccttgcaaaagcgccagga

SEQ ID NO: 238981 - DNA, 75 bp, Artificial Sequence
  Synthetic
ccgcaggcgcccagccaccaagcgccgccgccgcaccacccgccgccgtctggccccagcccgcgtgcgccgcgt

SEQ ID NO: 238982 - DNA, 75 bp, Artificial Sequence
  Synthetic
cagcttctcttactgaaactcagtcactctcatttcagaaccatgaaggctttcacagcttgcgttctgattagc

SEQ ID NO: 238983 - DNA, 75 bp, Artificial Sequence
  Synthetic
gttctgcccaccgtgcgctaccaccccagcatcctttaatccgtgtgctgtgatactgttgcagagagatggctc

SEQ ID NO: 238984 - DNA, 75 bp, Artificial Sequence
  Synthetic
tggaggatgctgctaaggaagccgccaaagctaatgcgcccataagaggagacagtgatgtttcaagagcggctg

SEQ ID NO: 238985 - DNA, 75 bp, Artificial Sequence
  Synthetic
aacagccacgatgtaacatcaccacaggcaatgagaggagtgtgatatgcacagtagtcatcaaatgcgagcata

SEQ ID NO: 238986 - DNA, 75 bp, Artificial Sequence
  Synthetic
caaagctaatgcgcccataagaggagacagtgatgtttcaagagcggctgaaaaggcagctgaaaagcagttagt

SEQ ID NO: 238987 - DNA, 75 bp, Artificial Sequence
  Synthetic
agtggcagaagttacaacctgatcaaggatacccacgataccctgtaccgaagctggtacctgtcctatacctac

SEQ ID NO: 238988 - DNA, 75 bp, Artificial Sequence
  Synthetic
tgcatctcccaggctttcatctcggagggggggatcatgtccacctgcggggcgatgaaaaaaacggtttccggg

SEQ ID NO: 238989 - DNA, 75 bp, Artificial Sequence
  Synthetic
aagctggtacctgtcctatacctacggggaccccgagaagggagtgcagtcgtggacgctgctcaccaccccgga

SEQ ID NO: 238990 - DNA, 75 bp, Artificial Sequence
  Synthetic
ctacaaggccctgggcatagtcgcgccgcgcgtgctttccagtcgcaccttctaaaaaaatgtctattctcatct

SEQ ID NO: 238991 - DNA, 75 bp, Artificial Sequence
  Synthetic
cccttcctggacgggagcaatccctccagggctatctatgaaagcatacagagattcagccatagctcagcccgc

SEQ ID NO: 238992 - DNA, 75 bp, Artificial Sequence
  Synthetic
ttatggctctaatgacggttcagctcattacagagtttcagtctatgacccagtacagaaaaaaagggttatgaa

SEQ ID NO: 238993 - DNA, 75 bp, Artificial Sequence
  Synthetic
gactcatcctgctggtgctgaaacgggcacggtcttcgccctgcgcgtcggcgagatagcagttgaccatgagct

SEQ ID NO: 238994 - DNA, 75 bp, Artificial Sequence
  Synthetic
cgtccaaaatggcttccatgtccggccacgcctccgcggcgaccgttagccgtgcgtcgtgacgtcatttgcatc

SEQ ID NO: 238995 - DNA, 75 bp, Artificial Sequence
  Synthetic
aaaaaaatgtctattctcatctcgcccagcaataacaccgctggggtcttactagacccagcaccatgtacggag

SEQ ID NO: 238996 - DNA, 75 bp, Artificial Sequence
  Synthetic
aagcaacctttccaagagggcttcagaatcatgtatgaggatctagaagggggcaacatccccgccctccttgat

SEQ ID NO: 238997 - DNA, 75 bp, Artificial Sequence
  Synthetic
agaagctagaggaggcagtggagaacgctgctaaagctaatggtcctgcaagaggagacagtagtgtcccaagag

SEQ ID NO: 238998 - DNA, 75 bp, Artificial Sequence
  Synthetic
cgctgctaaagctaatggtcctgcaagaggagacagtagtgtcccaagagatgtggaaaaggcagctgaaaaaga

SEQ ID NO: 238999 - DNA, 75 bp, Artificial Sequence
  Synthetic
gctcgtcttccaggagccggatgagctcggcgatggtggcgcgcacctcgcgctcgaaatccccgggggcctcct

SEQ ID NO: 239000 - DNA, 75 bp, Artificial Sequence
  Synthetic
gatgatagcaagagaagttacaacctcatcgagggaaccatggacaccctgtaccgaagctggtacctgtcctat

SEQ ID NO: 239001 - DNA, 75 bp, Artificial Sequence
  Synthetic
catgtccccctcctccgcatccaagaaggtgattggcttgtaggtgtaggccacgtgaccgggggtccccgacgg

SEQ ID NO: 239002 - DNA, 75 bp, Artificial Sequence
  Synthetic
atggtgtagcttccatgcctggaattgatattacagacaaaggtcttcaaattggaattgacgccaacaaagatg

SEQ ID NO: 239003 - DNA, 75 bp, Artificial Sequence
  Synthetic
tgatattacagacaaaggtcttcaaattggaattgacgccaacaaagatgaagatgaaggcaatgaaatttttgc

SEQ ID NO: 239004 - DNA, 75 bp, Artificial Sequence
  Synthetic
ctacattggcttcagagacaactttgtggggcttatgtattacaacagcactggcaacatgggtgtgctggctgg

SEQ ID NO: 239005 - DNA, 75 bp, Artificial Sequence
  Synthetic
caagtgggggaggaaaattggcaagaaagcgaaaacttttatggaggcagggcgcttaaaaaagaaaccaaaatg

SEQ ID NO: 239006 - DNA, 75 bp, Artificial Sequence
  Synthetic
aaagcgaaaacttttatggaggcagggcgcttaaaaaagaaaccaaaatgaagccttgctatggctcatttgcca

SEQ ID NO: 239007 - DNA, 75 bp, Artificial Sequence
  Synthetic
tatgcttgtgtggttgtggaagagcattttgtgttggacaatcctgaggtgcccgggcaaggctgtagatcctgc

SEQ ID NO: 239008 - DNA, 75 bp, Artificial Sequence
  Synthetic
ggctaaattcaaaacgcctgataaagaaggagagcaaccaaaagaatatgacatagatatgaatttctttgatat

SEQ ID NO: 239009 - DNA, 75 bp, Artificial Sequence
  Synthetic
gaaggagagcaaccaaaagaatatgacatagatatgaatttctttgatattccaaacaccggaacaggcggcaat

SEQ ID NO: 239010 - DNA, 75 bp, Artificial Sequence
  Synthetic
acattgtactttatgctgagaatatgaatttggaaactccagacacacatgtggtgtacaaaccaggaaaagagg

SEQ ID NO: 239011 - DNA, 75 bp, Artificial Sequence
  Synthetic
cccctgcaagtgcacagacccaccccagtcagacccagtggcgagaggcgagcagctgttgaaaaaattgaggac

SEQ ID NO: 239012 - DNA, 75 bp, Artificial Sequence
  Synthetic
cactggcaacatgggtgtgctggctggtcaggcctctcagttgaatgctgtggttgacttgcaagacagaaacac

SEQ ID NO: 239013 - DNA, 75 bp, Artificial Sequence
  Synthetic
gcataccagggtgttaaagtaaaaaatgggactgttgctggcaaagtggaatgggatccagacacaaaagttgct

SEQ ID NO: 239014 - DNA, 75 bp, Artificial Sequence
  Synthetic
gcacggcttacaacagcctggcccccaagagcgctcccaatcccagccagtgggatgcaaaggaaaaggaaggag

SEQ ID NO: 239015 - DNA, 75 bp, Artificial Sequence
  Synthetic
aaaaacatttggtgttgccgctacaggtggttttaatattacagatcagggtttgttacttggaactgaggaaac

SEQ ID NO: 239016 - DNA, 75 bp, Artificial Sequence
  Synthetic
gaccctttgcggacttcgcgacctcctcccaatgaactgatgttgattaaaaggcccagaaaccaatcagcccct

SEQ ID NO: 239017 - DNA, 75 bp, Artificial Sequence
  Synthetic
ggtggttttaatattacagatcagggtttgttacttggaactgaggaaacagctgaaaacgttaaaaaggatatc

SEQ ID NO: 239018 - DNA, 75 bp, Artificial Sequence
  Synthetic
ccagcacaacaactcgggcttcaccggctacctcgcacccaccatgcgtcaggggcagccctaccccgccaactt

SEQ ID NO: 239019 - DNA, 75 bp, Artificial Sequence
  Synthetic
aacctcaagttggtgaagaaaactggcaggaaagtgaagccttttatggaggaagggctattaagaaagacacca

SEQ ID NO: 239020 - DNA, 75 bp, Artificial Sequence
  Synthetic
gcaggaaagtgaagccttttatggaggaagggctattaagaaagacaccaaaatgaagccatgctatggttcatt

SEQ ID NO: 239021 - DNA, 75 bp, Artificial Sequence
  Synthetic
ggacaggctaaatttaaaacactagatgggcaagttacaaaagatccagatattgactttgcttactttgacgtc

SEQ ID NO: 239022 - DNA, 75 bp, Artificial Sequence
  Synthetic
atgggcaagttacaaaagatccagatattgactttgcttactttgacgtccctggcggaaaagctccaacaggca

SEQ ID NO: 239023 - DNA, 75 bp, Artificial Sequence
  Synthetic
agatataattttgtacacagaaaatgttaatctggaaacaccagatactcacatagtgtataaacctggcaaaga

SEQ ID NO: 239024 - DNA, 75 bp, Artificial Sequence
  Synthetic
acacaacagtccatgccaaacagacccaactacattggctttagggacaactttgtaggtctcatgtactacaac

SEQ ID NO: 239025 - DNA, 75 bp, Artificial Sequence
  Synthetic
ccacctatcaaggtgtaaaaattacaggtaataatgatggcgatcttgaaaccgaatgggaaagagatgaagcaa

SEQ ID NO: 239026 - DNA, 75 bp, Artificial Sequence
  Synthetic
ggcgaagtgcttaacccgggtcttccccagcatgccgagaaagaagcaggagccactagtggaggagatggaaga

SEQ ID NO: 239027 - DNA, 75 bp, Artificial Sequence
  Synthetic
cgcattgcatgagcccgtagctgcgcggggccacgaccgtgccgcggtgcgcttttagaagcggtgtcgcggacg

SEQ ID NO: 239028 - DNA, 75 bp, Artificial Sequence
  Synthetic
ccccaaaagttctttgccatcaagaacctgcttctgctcccgggctcctacacctacgagtggaacttccgcaag

SEQ ID NO: 239029 - DNA, 75 bp, Artificial Sequence
  Synthetic
tcggtgtacaagatcctgagatacgatgagaccaagtccagggtgcgcgcttgcgagtgcgggggcagacacacc

SEQ ID NO: 239030 - DNA, 75 bp, Artificial Sequence
  Synthetic
catcccctacctcgacgggaccttctacctcaaccacaccttcaagaaggtctccatcatgttcgactcctcggt

SEQ ID NO: 239031 - DNA, 75 bp, Artificial Sequence
  Synthetic
accgccgcagccgcggcagccgcagccgccatgacagcgacgagactggcctcgagctacatgcccagcagcagc

SEQ ID NO: 239032 - DNA, 75 bp, Artificial Sequence
  Synthetic
aggatccagcgctcatacccgctcaccatctgggctctcaccaggtccagggtagcggggcacaggcacactgac

SEQ ID NO: 239033 - DNA, 75 bp, Artificial Sequence
  Synthetic
accatcgtaccagatgcggcagtatatcaggtgcctgccccttataaacacactgcccatatacataatctcttt

SEQ ID NO: 239034 - DNA, 75 bp, Artificial Sequence
  Synthetic
cgcgcgctggctcgggacccgcgacccccaggctttggaacagcggcgcaagctcatgctggccgtggtcctggt

SEQ ID NO: 239035 - DNA, 75 bp, Artificial Sequence
  Synthetic
cccttcctggtcgagcgggaccggggtgcaaccacctacaccgtgtactgcatttgtccaaccccgaagttgcat

SEQ ID NO: 239036 - DNA, 75 bp, Artificial Sequence
  Synthetic
ggcagttgttaagggaaaagctcaaagaccagaacttccagcagaaggtggtggacgggctggcctcgggcatta

SEQ ID NO: 239037 - DNA, 75 bp, Artificial Sequence
  Synthetic
gcacatgtggaaaagttcccacagcgccccctccactttcataatcaggcagaccttcatattagcaacagatct

SEQ ID NO: 239038 - DNA, 75 bp, Artificial Sequence
  Synthetic
aaactgcacgctggaataagctctctttgtgtcaccggtgattccttccaagaggtgagtgataaagcgaggtag

SEQ ID NO: 239039 - DNA, 75 bp, Artificial Sequence
  Synthetic
gctctagaggcaaaaacgaaagcggttgagcgggctcttcctccgtagcctggcggaacgcaaacgggttaggcc

SEQ ID NO: 239040 - DNA, 75 bp, Artificial Sequence
  Synthetic
gacgctgaaaggcggcctgcccgacttcatgagccagagcatgatacaaaactaccgcactttcattctcgagcg

SEQ ID NO: 239041 - DNA, 75 bp, Artificial Sequence
  Synthetic
actgggtggccctcgcggacatacaaaaatcgatccgtgtggttaaagagcagcacagttagctcctgtcttctc

SEQ ID NO: 239042 - DNA, 75 bp, Artificial Sequence
  Synthetic
cagcctggccccaaaaggtgcccccaactccagtcagtgggagcagaaaaaaactactggtggaggcaatgacat

SEQ ID NO: 239043 - DNA, 75 bp, Artificial Sequence
  Synthetic
gccatgggtggagaagacattacagaaaagggccttcaaattggcattgatgaaactaaagaagaaaataacaag

SEQ ID NO: 239044 - DNA, 75 bp, Artificial Sequence
  Synthetic
gtcatcttgcacagctggcgacccaggaagggcacgctctgaggcttgtggttacactcgcagtgcacgggcatc

SEQ ID NO: 239045 - DNA, 75 bp, Artificial Sequence
  Synthetic
ctggcaggaaacatttgttttttatggcggtagagctcttaagaaggacaccaaaatgaaaccatgctatggctc

SEQ ID NO: 239046 - DNA, 75 bp, Artificial Sequence
  Synthetic
cagaacctcaagtgggagaagaaaactggcaggaaacatttgttttttatggcggtagagctcttaagaaggaca

SEQ ID NO: 239047 - DNA, 75 bp, Artificial Sequence
  Synthetic
gtcgagcgggaccggggcgccaccacctacaccgtctactgcatctgtccaaccccgaagttgcatgagaatttt

SEQ ID NO: 239048 - DNA, 75 bp, Artificial Sequence
  Synthetic
cagttcagaaatcaatttggttcaacagtccatgccaaatagacccaactacattggcttcagggacaactttgt

SEQ ID NO: 239049 - DNA, 75 bp, Artificial Sequence
  Synthetic
aatgcagttgacgtcaagacgtacggccggcggttgccgcaaaggcgtggcccaacccggaagcaagtcgcgggg

SEQ ID NO: 239050 - DNA, 75 bp, Artificial Sequence
  Synthetic
gagccgaacgagcagacggggatcagccccgcgcgcgcgcacgtggcggcggccaacctggtgacggcctacgag

SEQ ID NO: 239051 - DNA, 75 bp, Artificial Sequence
  Synthetic
tccaaaagagtttcaacaaccacgtgcgcaccctgatcgcgcgcgaggaggtggccctgggcctgatgcacctgt

SEQ ID NO: 239052 - DNA, 75 bp, Artificial Sequence
  Synthetic
acttaacgcataatggagcatacattggttataccaaagacggttctgatagagaattatatgaggtgtcagtca

SEQ ID NO: 239053 - DNA, 75 bp, Artificial Sequence
  Synthetic
accaaggtgtaaaaattacagatggaaatgatggtgatgtcaatgatgactgggaaaaagacaccgcagtatctg

SEQ ID NO: 239054 - DNA, 75 bp, Artificial Sequence
  Synthetic
gttttttttcgccaatttccgcgtccgtgttaaatccggtgtttatgttacacatcagctgatccacagggtatt

SEQ ID NO: 239055 - DNA, 75 bp, Artificial Sequence
  Synthetic
tgattaacatcttgcagagcatcgtagtgcaggagcgcagcctgagcctggccgagaaggtggcggcgatcaact

SEQ ID NO: 239056 - DNA, 75 bp, Artificial Sequence
  Synthetic
cctacgagtggaacttccgcaaggatgtcaacatgatcctgcagagttcccttggcaacgacctgcgcgtcgacg

SEQ ID NO: 239057 - DNA, 75 bp, Artificial Sequence
  Synthetic
aacctattgaatggcatggaccaagagttcagctttgcgatggtccaaaaatcttacatccagaatttaatcaca

SEQ ID NO: 239058 - DNA, 75 bp, Artificial Sequence
  Synthetic
caggtgaactttacctgcaaaccccacaagaagtacctcatctggttcttccagaacactactcttgcagtagtc

SEQ ID NO: 239059 - DNA, 75 bp, Artificial Sequence
  Synthetic
atcttacatccagaatttaatcacacctgtaatgaacagaatctcactctgatattcttgaacaacacttttaat

SEQ ID NO: 239060 - DNA, 75 bp, Artificial Sequence
  Synthetic
cctgtaatgaacagaatctcactctgatattcttgaacaacacttttaatgggaggtactatggtattattgatt

SEQ ID NO: 239061 - DNA, 75 bp, Artificial Sequence
  Synthetic
cttattatggttctaacaatgacgaccatagacagtatagagtcactgtctatacaataccgcgtaataaaactg

SEQ ID NO: 239062 - DNA, 75 bp, Artificial Sequence
  Synthetic
cccggccaaggccaccaacgtgcccatttccatcccctcgcgcaactgggccgccttccgcggctggagtttcac

SEQ ID NO: 239063 - DNA, 75 bp, Artificial Sequence
  Synthetic
gtcatgcgtcgcatcatggatcagctcatcatgccccacatcgaggccctcgatgagacgcaagagcagcgcccc

SEQ ID NO: 239064 - DNA, 75 bp, Artificial Sequence
  Synthetic
aatgaacagtttgctctgcaacaaggtaatgataaaaccaatcaagatgatgaacaaattccatcaactactgtg

SEQ ID NO: 239065 - DNA, 75 bp, Artificial Sequence
  Synthetic
ttaaaattcaacctcataccacaaaaggaaccacagggggtgccacagttaatgaacagtttgctctgcaacaag

SEQ ID NO: 239066 - DNA, 75 bp, Artificial Sequence
  Synthetic
ttggtgaacgttaccagcagcagtacaaccgctccagaaacaactaacctttcttctgatactaacaaacctcat

SEQ ID NO: 239067 - DNA, 75 bp, Artificial Sequence
  Synthetic
tgaagtggtcgggtatttgattttaggggtggtcctgggtgggtgcatagcggtgctatatcaccttccttgctg

SEQ ID NO: 239068 - DNA, 75 bp, Artificial Sequence
  Synthetic
ggagaacaaggccatccgtcccgacgaggccgggctggtgtacaacgccctgctggagcgcgtgggccgctacaa

SEQ ID NO: 239069 - DNA, 75 bp, Artificial Sequence
  Synthetic
agttcagctggttatattcaagttaatgtgactagaggtgggaacattacattgaatggaccactacaaaatact

SEQ ID NO: 239070 - DNA, 75 bp, Artificial Sequence
  Synthetic
gttggcaacatatctgtacatggtctggtccgtcatataagtgccatactaataatggaagcattacaatttttg

SEQ ID NO: 239071 - DNA, 75 bp, Artificial Sequence
  Synthetic
taaagctgaaggatataaaaaagaggttaggactttctcatctacaaatcaaaaacatacaattgaagattctgg

SEQ ID NO: 239072 - DNA, 75 bp, Artificial Sequence
  Synthetic
gcccctttcctagcttagggagtttgcatagcttgccgggctcggtgaacagcggcagggtgagccggccgcgct

SEQ ID NO: 239073 - DNA, 75 bp, Artificial Sequence
  Synthetic
gccctccgtcacccagaaaaagttcctctgcgacagggtcatgtggcgcatccccttctccagcaacttcatgtc

SEQ ID NO: 239074 - DNA, 75 bp, Artificial Sequence
  Synthetic
ttatataatttaacaataattgaactgccgaccactaaagcacccacgacagttaggacaactagggaaacaacc

SEQ ID NO: 239075 - DNA, 75 bp, Artificial Sequence
  Synthetic
ggccaggcgcaggtggacgagcagaccttccaggagatcactagcgtgagccgcgcgctggggcagaacgacacc

SEQ ID NO: 239076 - DNA, 75 bp, Artificial Sequence
  Synthetic
acacagcctactacaaagccaactaccagtccaacaacacagcctactacagttagtacaactatggaggacact

SEQ ID NO: 239077 - DNA, 75 bp, Artificial Sequence
  Synthetic
tcttgctgaccaatagacagcagaagatcccggcgcaatatgcgctgtcggccgaggaggaaaggatcctgagat

SEQ ID NO: 239078 - DNA, 75 bp, Artificial Sequence
  Synthetic
ttcaataaatgagaccctcgtgccgatgaaacaggatcaacctaattactcaggtttggatatgcaaattacttt

SEQ ID NO: 239079 - DNA, 75 bp, Artificial Sequence
  Synthetic
cgccaaccggccgttcatcaataagctgatggactacctgcaccgcgcggcgtccatgaactcggactactttac

SEQ ID NO: 239080 - DNA, 75 bp, Artificial Sequence
  Synthetic
gcaacatggaacctagcatgtacgccgccaaccggccgttcatcaataagctgatggactacctgcaccgcgcgg

SEQ ID NO: 239081 - DNA, 75 bp, Artificial Sequence
  Synthetic
caatcaaaattcaaaagtgtatcatgtcagagtagatttagaacctcctagaccccgtgctactttggctcctcc

SEQ ID NO: 239082 - DNA, 75 bp, Artificial Sequence
  Synthetic
cgcgcgctacaattatctccaccacagtcccgaatacagggacgagaacgtagccagaatcttaaggctcatatg

SEQ ID NO: 239083 - DNA, 75 bp, Artificial Sequence
  Synthetic
acacaaaaccataaaaatgcaatgcaacagaaagtcgaacagaaagtcgaacagaagccttcaaaaaggcctaaa

SEQ ID NO: 239084 - DNA, 75 bp, Artificial Sequence
  Synthetic
aggttacaattcctattggaagtaattatactttagtgggaccttcaccgccagtgagctggcatactacaaaaa

SEQ ID NO: 239085 - DNA, 75 bp, Artificial Sequence
  Synthetic
gagtatatgcaagttatttaaaagtcgaaggggttatcccgctcgtcgttgtgcgccgcgctggggagggccacg

SEQ ID NO: 239086 - DNA, 75 bp, Artificial Sequence
  Synthetic
gaatcaaaacactacagagtcaaggttttcaaacaaagaaaagatcaggcgctattattcagaccacttactacc

SEQ ID NO: 239087 - DNA, 75 bp, Artificial Sequence
  Synthetic
aggtaatgacaaaaccaatcaaaatgatgaacaaattccatcaactactgtggcaatcgtggtgggagtgatctc

SEQ ID NO: 239088 - DNA, 75 bp, Artificial Sequence
  Synthetic
cgaagcggtggtaggcccctgtgttgatggtgtaggtgcagttggccatgagcgaccagttgacggtctgcaggc

SEQ ID NO: 239089 - DNA, 75 bp, Artificial Sequence
  Synthetic
gatggtgtaggtgcagttggccatgagcgaccagttgacggtctgcaggccgggctgcacgacctcggagtacct

SEQ ID NO: 239090 - DNA, 75 bp, Artificial Sequence
  Synthetic
ttagtgcagatgcagctatatgctttcatacctataacttaactagaggtgaaaatattacattagcaggtgctg

SEQ ID NO: 239091 - DNA, 75 bp, Artificial Sequence
  Synthetic
taccactaaacccgccacagttaggacaactattgaaaccactactcaaactacacagctagacactacagtgca

SEQ ID NO: 239092 - DNA, 75 bp, Artificial Sequence
  Synthetic
ggaggggggctcaccttgcaagaaggaactggggacctaaaggtgaacgctaagtccccattgcaagttgcaact

SEQ ID NO: 239093 - DNA, 75 bp, Artificial Sequence
  Synthetic
aagacgaaactaaaaatgcagctgcggctacagccgatacaaccactaggggtgatacatttgcaactccagcgc

SEQ ID NO: 239094 - DNA, 75 bp, Artificial Sequence
  Synthetic
gaactggggacctaaaggtgaacgctaagtccccattgcaagttgcaactaataaacagttggagattgcacttg

SEQ ID NO: 239095 - DNA, 75 bp, Artificial Sequence
  Synthetic
caaacttgctttaaaaattggccatggattagccgttgtggatgaaaatcatactcacttacaatcactaatagg

SEQ ID NO: 239096 - DNA, 75 bp, Artificial Sequence
  Synthetic
tatagttagtgtagattggggaaaaaatctaacattagagggacctaaagaaacaccagttgaatggtggggtgg

SEQ ID NO: 239097 - DNA, 75 bp, Artificial Sequence
  Synthetic
ggattagccgttgtggatgaaaatcatactcacttacaatcactaataggtacacttgttattttaactggcaag

SEQ ID NO: 239098 - DNA, 75 bp, Artificial Sequence
  Synthetic
taagtcacagatgtaatatccagaacataactttactgtttgtaaatactagttttaatggagactactttggct

SEQ ID NO: 239099 - DNA, 75 bp, Artificial Sequence
  Synthetic
cggaagtggaggtggtttgtcatttgataaagacggaaacctagttgcttggaacaaagacaatgataggcgaac

SEQ ID NO: 239100 - DNA, 75 bp, Artificial Sequence
  Synthetic
ccaaattgcaacattgaccaagaaaaggactctaaactaacattggttcttacaaaatgtggaagtcagatactg

SEQ ID NO: 239101 - DNA, 75 bp, Artificial Sequence
  Synthetic
aggactctaaactaacattggttcttacaaaatgtggaagtcagatactggctaatatgtctttgcttgtagtca

SEQ ID NO: 239102 - DNA, 75 bp, Artificial Sequence
  Synthetic
taaggttaatgcaactgatgattacaaaaagtttagtatcaagctgctatttgatgccaagggacgtttattgga

SEQ ID NO: 239103 - DNA, 75 bp, Artificial Sequence
  Synthetic
caccacagtcccgaatacagggacgagaacgtagccagaatcttaaggctcatatgaccatgcagactctgctca

SEQ ID NO: 239104 - DNA, 75 bp, Artificial Sequence
  Synthetic
aaaaagtttagtatcaagctgctatttgatgccaagggacgtttattggaaggatctagtttagataaagcttat

SEQ ID NO: 239105 - DNA, 75 bp, Artificial Sequence
  Synthetic
catatgaccatgcagactctgctcatactgctatccctcctatcccctgcccttgctgatgattactctaaatgc

SEQ ID NO: 239106 - DNA, 75 bp, Artificial Sequence
  Synthetic
acataggtacagcttatgaagaagctgttggttttatgccaaacacaacagcatacccaaaactgcctaatcctc

SEQ ID NO: 239107 - DNA, 75 bp, Artificial Sequence
  Synthetic
tgttggttttatgccaaacacaacagcatacccaaaactgcctaatcctccaacttcatctaccactcctataga

SEQ ID NO: 239108 - DNA, 75 bp, Artificial Sequence
  Synthetic
aaaggacagaagagaaaacaaaattcaactcaggtgatttgggtagaaaacaatctagacctaagaaaaaagaca

SEQ ID NO: 239109 - DNA, 75 bp, Artificial Sequence
  Synthetic
gttagtaatctctaccttggtggacaagctggaaacccagtggctacaactattagttttaatgaagaaattgat

SEQ ID NO: 239110 - DNA, 75 bp, Artificial Sequence
  Synthetic
ttgattttgcttggaataagacatatgaaaatgtgcagtttgattcctcttttttaactttctcatatattgctc

SEQ ID NO: 239111 - DNA, 75 bp, Artificial Sequence
  Synthetic
cggcgaggggctgctcgagtgccactgccgctgcaacctgtgctccccgcaccgctccctggtctgcaaccccca

SEQ ID NO: 239112 - DNA, 75 bp, Artificial Sequence
  Synthetic
ccaaggtcacagtctggtggaacgagaagaacgcacagattcatactcggaaaacaggatgggtctgtgcctctc

SEQ ID NO: 239113 - DNA, 75 bp, Artificial Sequence
  Synthetic
gaggggtctacctggacccccagacgggcgaggtgctcaacccgggtctcccccagcatgccgaggaagaagccg

SEQ ID NO: 239114 - DNA, 75 bp, Artificial Sequence
  Synthetic
atgggatcgagtgaagggtgacggtaagcacgagcggcagggctaccgatcatggagggcccacaaagccgcgat

SEQ ID NO: 239115 - DNA, 75 bp, Artificial Sequence
  Synthetic
cctggaccaggcggcggagcgggcgggcgagttcgcctacgggaagcggtcgcgcgaagaggagctgatctcgct

SEQ ID NO: 239116 - DNA, 75 bp, Artificial Sequence
  Synthetic
ctccattgcaagttgcagatgataaaaaacttgaactatcttatgataatccatttgaagttagcgcaaataaac

SEQ ID NO: 239117 - DNA, 75 bp, Artificial Sequence
  Synthetic
aaaacttgaactatcttatgataatccatttgaagttagcgcaaataaacttagcttaaaagtagggcatggact

SEQ ID NO: 239118 - DNA, 75 bp, Artificial Sequence
  Synthetic
taaaaccagcagcacatggtaatccacggacagaacttacattatgataatctgcatgatcacaatcgggcaata

SEQ ID NO: 239119 - DNA, 75 bp, Artificial Sequence
  Synthetic
tccgcgactgcgtctttctctttctctgccacacatggcagtcggccatgggcgtgtggcagcagtgtctcgagg

SEQ ID NO: 239120 - DNA, 75 bp, Artificial Sequence
  Synthetic
ggaggattgcaagaattaattggcaaacttgtaattttaactggaaaaggaataggtgttgaagagttaaaaaac

SEQ ID NO: 239121 - DNA, 75 bp, Artificial Sequence
  Synthetic
ctcgggcattaacggggtggtggacatcgcgaaccaggccgtgcagcgcgagataaacagccgcctggacccgcg

SEQ ID NO: 239122 - DNA, 75 bp, Artificial Sequence
  Synthetic
acctagcatgtacgccgccaaccggccgtttatcaataagctgatggactacctgcaccgcgcggcgtccatgaa

SEQ ID NO: 239123 - DNA, 75 bp, Artificial Sequence
  Synthetic
ttgaacccgcactggctcccgccgccggggttctacacgggcgagtacgacatgcccgaccccaacgacgggttt

SEQ ID NO: 239124 - DNA, 75 bp, Artificial Sequence
  Synthetic
gcgagaagcggccgcggcccgacgcggaggagacgatcctgcaggtggacgagccgccctcgtacgaggaggccg

SEQ ID NO: 239125 - DNA, 75 bp, Artificial Sequence
  Synthetic
aacttactttggttcttacaaaatgcggtagccagatattggctactatggcttttcaagttgtgaagggaactt

SEQ ID NO: 239126 - DNA, 75 bp, Artificial Sequence
  Synthetic
cggtagccagatattggctactatggcttttcaagttgtgaagggaacttatgaaaatatcagtaagaacacagc

SEQ ID NO: 239127 - DNA, 75 bp, Artificial Sequence
  Synthetic
gtaatgaaacccgccacccttgacctgcctccaccacccacgcccgctccaccgaaggcagctccggtcgtgcag

SEQ ID NO: 239128 - DNA, 75 bp, Artificial Sequence
  Synthetic
tgcctccaccacccacgcccgctccaccgaaggcagctccggtcgtgcaggcccccccggtggcgaccgccgtgc

SEQ ID NO: 239129 - DNA, 75 bp, Artificial Sequence
  Synthetic
ttatttgatgataatggaaaacttctagaaggatctagtttagataaagattattggaacttcagaaatgatgat

SEQ ID NO: 239130 - DNA, 75 bp, Artificial Sequence
  Synthetic
ttattggaacttcagaaatgatgattctattatgcccaaccaatacgacaatgcagtgccgtttatgccaaacct

SEQ ID NO: 239131 - DNA, 75 bp, Artificial Sequence
  Synthetic
tggagaagttcctctgcatctgatgaaacaaaaaacccgtccatgcgaattcccctcatcacatcagccaggact

SEQ ID NO: 239132 - DNA, 75 bp, Artificial Sequence
  Synthetic
tcaactgtcttgccatctactgacaaaaagagtaatggtaaaaatactattgtttctaacctttatctggaagga

SEQ ID NO: 239133 - DNA, 75 bp, Artificial Sequence
  Synthetic
aaaagagtaatggtaaaaatactattgtttctaacctttatctggaaggaaaggcatatcagccagttgcggtta

SEQ ID NO: 239134 - DNA, 75 bp, Artificial Sequence
  Synthetic
cgcagcaagataaaattcaggtcacggaggtggcacctctctcctccactgttttggtggaaacagacagccaaa

SEQ ID NO: 239135 - DNA, 75 bp, Artificial Sequence
  Synthetic
ctgtacctattcaataacatttgagtttggatgggctaaaacctatgatgttccaattccatttgattcttcctc

SEQ ID NO: 239136 - DNA, 75 bp, Artificial Sequence
  Synthetic
ggaggtggcacctctctcctccactgttttggtggaaacagacagccaaatcaaaaattatgcgattctcaaggt

SEQ ID NO: 239137 - DNA, 75 bp, Artificial Sequence
  Synthetic
ttccaattccatttgattcttcctcatttaccttctcctatattgcccaagaaaacaaagacacggacgaataaa

SEQ ID NO: 239138 - DNA, 75 bp, Artificial Sequence
  Synthetic
acatccgcggcgtcctggaccgcggtcccagcttcaaaccctactcgggcacggcctacaacagcctggccccca

SEQ ID NO: 239139 - DNA, 75 bp, Artificial Sequence
  Synthetic
ctccacacgtacatccagaaacaacagcacattgaaagcgggcccgccatcctgctcctcaatcatcatgttaca

SEQ ID NO: 239140 - DNA, 75 bp, Artificial Sequence
  Synthetic
acggcctacaacagcctggcccccaagggcgcccccaactccagccagtgggctgacaaagaaagggtgaatgga

SEQ ID NO: 239141 - DNA, 75 bp, Artificial Sequence
  Synthetic
tcatttttccagccttggattatcgctacaaactgttggtgtaagtccactccacacatgttgaaaagctcccac

SEQ ID NO: 239142 - DNA, 75 bp, Artificial Sequence
  Synthetic
agacatttggtgtggcagccatgggtggagaagacattacggaaaagggtctgaagattggaactgatacaacag

SEQ ID NO: 239143 - DNA, 75 bp, Artificial Sequence
  Synthetic
tggagaagacattacggaaaagggtctgaagattggaactgatacaacagcaaatgaaccaatatttgcagacaa

SEQ ID NO: 239144 - DNA, 75 bp, Artificial Sequence
  Synthetic
ggcagaccttcataatagcaacagatctggctgttcgatcacctgcagcgtattcagaataaaaagatttaattg

SEQ ID NO: 239145 - DNA, 75 bp, Artificial Sequence
  Synthetic
tctggctgttcgatcacctgcagcgtattcagaataaaaagatttaattgtctgccctgggccctgagctcgcgt

SEQ ID NO: 239146 - DNA, 75 bp, Artificial Sequence
  Synthetic
ggagaggaaaactggcaggaaacatttgttttctatggaggaagagctcttaaaaaagaaaccaaaatgaagcct

SEQ ID NO: 239147 - DNA, 75 bp, Artificial Sequence
  Synthetic
ttgttttctatggaggaagagctcttaaaaaagaaaccaaaatgaagccttgctatggttcatttgccagaccga

SEQ ID NO: 239148 - DNA, 75 bp, Artificial Sequence
  Synthetic
ggaaaacaggatgggtctgtgcctctccatcagcgccctcaacagtctctgccgccggggctcggtgcggctgct

SEQ ID NO: 239149 - DNA, 75 bp, Artificial Sequence
  Synthetic
tccatcagcgccctcaacagtctctgccgccggggctcggtgcggctgctgcagatgggatcgggatcgcaagtc

SEQ ID NO: 239150 - DNA, 75 bp, Artificial Sequence
  Synthetic
tcaagtcctcagccaccacggctgacaattcagagcacggccgaagcgtggggctgccaagccaaatagagtatt

SEQ ID NO: 239151 - DNA, 75 bp, Artificial Sequence
  Synthetic
atttataattggagataatggtcaacccactgaaaaccatgacataacaatggctttctttgacactcctggtgg

SEQ ID NO: 239152 - DNA, 75 bp, Artificial Sequence
  Synthetic
caattcagagcacggccgaagcgtggggctgccaagccaaatagagtatttcagcgagccatagtgtgctcccat

SEQ ID NO: 239153 - DNA, 75 bp, Artificial Sequence
  Synthetic
cccactgaaaaccatgacataacaatggctttctttgacactcctggtggtacgatcacaggaggtactggtggt

SEQ ID NO: 239154 - DNA, 75 bp, Artificial Sequence
  Synthetic
ttgttatgtacactgaaaatataaatcttgaaactccagatacccatgtggtgtacaagccaggcaaagaagatg

SEQ ID NO: 239155 - DNA, 75 bp, Artificial Sequence
  Synthetic
gtgtacaagccaggcaaagaagatgatagctcagaaattaacttggtgcaacagtccatgcccaacagacccaac

SEQ ID NO: 239156 - DNA, 75 bp, Artificial Sequence
  Synthetic
gccccatccccaattactcataagaataaatcattggaattaatcattcaataaagatcacttacttgaaatctg

SEQ ID NO: 239157 - DNA, 75 bp, Artificial Sequence
  Synthetic
ataaatcattggaattaatcattcaataaagatcacttacttgaaatctgaaagtatgtctctggtgtagttgtt

SEQ ID NO: 239158 - DNA, 75 bp, Artificial Sequence
  Synthetic
agacattcagccatagcttagcccgcttaccagtagacaaagagcacagcagtacaagcgccaacagcaataact

SEQ ID NO: 239159 - DNA, 75 bp, Artificial Sequence
  Synthetic
cagcacagttagctcctgtcttctcccggcaaaaatcacatcggactgggttagtatgccactggcatggtagtc

SEQ ID NO: 239160 - DNA, 75 bp, Artificial Sequence
  Synthetic
gatgacttcaaccccgtctacccctatggctacgcgcggaatcagaatatccccttccttactcccccctttgtc

SEQ ID NO: 239161 - DNA, 75 bp, Artificial Sequence
  Synthetic
aacttcccaactattgttttccattggacggctcaggcactaattcagctttccaaggtgtaaaaattaagcaaa

SEQ ID NO: 239162 - DNA, 75 bp, Artificial Sequence
  Synthetic
gggagatcgtccttcactcccaaccaggcctacctgaccttgcagagcagctcttcggagcctcgctccggaggc

SEQ ID NO: 239163 - DNA, 75 bp, Artificial Sequence
  Synthetic
ggcggcctttgatgtgcggcagctttttaagctcctcgtaggtaaggtcctcagggcattgcaggccgtgctgct

SEQ ID NO: 239164 - DNA, 75 bp, Artificial Sequence
  Synthetic
ggctgacccaatagccatcgtcaatggggatgtctcactcaaggtgggaggtggactcactttgcaagaaggaaa

SEQ ID NO: 239165 - DNA, 75 bp, Artificial Sequence
  Synthetic
ttccaaggtgtaaaaattaagcaaaaccaagacggagatgttaatgatgattgggaaaaggatgataaggtgtcc

SEQ ID NO: 239166 - DNA, 75 bp, Artificial Sequence
  Synthetic
atccgcggcgtcctggaccgcggtcccagcttcaaaccctactcgggcacagcttacaacagcctggcccccaag

SEQ ID NO: 239167 - DNA, 75 bp, Artificial Sequence
  Synthetic
ttgcaagttgcaaatgacaacaaattggagctttcttatgcagacccatttgaggttaaagacactaagctacaa

SEQ ID NO: 239168 - DNA, 75 bp, Artificial Sequence
  Synthetic
gcttccgggttgggccacgcctttgcggcaaccgccggccgtacgtcttgacgtcaactgcattaccgcttgtta

SEQ ID NO: 239169 - DNA, 75 bp, Artificial Sequence
  Synthetic
cggcaaccgccggccgtacgtcttgacgtcaactgcattaccgcttgttaaccacttaacgttggccctgcccta

SEQ ID NO: 239170 - DNA, 75 bp, Artificial Sequence
  Synthetic
tggagctttcttatgcagacccatttgaggttaaagacactaagctacaattaaaagtaggtcatggtttaaaag

SEQ ID NO: 239171 - DNA, 75 bp, Artificial Sequence
  Synthetic
ccagcttcaaaccctactcgggcacagcttacaacagcctggcccccaagggcgcccccaactccagtcagtggg

SEQ ID NO: 239172 - DNA, 75 bp, Artificial Sequence
  Synthetic
tcttcaaagtctaattggaaatctcgtagttttaacaggaaaaggaattggcactcaagaattaaaagacaaaga

SEQ ID NO: 239173 - DNA, 75 bp, Artificial Sequence
  Synthetic
aaacaaaagttaatatgcaaatgagcttttgaatttagggcggggccgacgctgattggccgttgcaagaaccgt

SEQ ID NO: 239174 - DNA, 75 bp, Artificial Sequence
  Synthetic
gtagttttaacaggaaaaggaattggcactcaagaattaaaagacaaagacgatgaaactaaaaatataggagtt

SEQ ID NO: 239175 - DNA, 75 bp, Artificial Sequence
  Synthetic
acgaaagtctggcgtttgacaaagatggaaatttggtagcatgggataatgaaaacgacaggcgcactctatgga

SEQ ID NO: 239176 - DNA, 75 bp, Artificial Sequence
  Synthetic
tggaaatttggtagcatgggataatgaaaacgacaggcgcactctatggacaactccagacacatctccaaattg

SEQ ID NO: 239177 - DNA, 75 bp, Artificial Sequence
  Synthetic
tccgaccacgcctccgcggcgaccgttagccgtgcgtcgtgacgtcatttgcatcgtcttctctcgtccaatcag

SEQ ID NO: 239178 - DNA, 75 bp, Artificial Sequence
  Synthetic
taccttatccacgagatacacagcgcgtcccttaaggaaaaacttcaggagtggcggccctggctggtggttttc

SEQ ID NO: 239179 - DNA, 75 bp, Artificial Sequence
  Synthetic
gggatcccgtgtcgtcgcactcgcaacgagaccttcaacctcaccaaccagactgaggtaaaactcaactgcaag

SEQ ID NO: 239180 - DNA, 75 bp, Artificial Sequence
  Synthetic
aaacttactttagtccttactaaatgcggatctcaaattctagcaagtgtgtctttgcttgctgtcgctggaagt

SEQ ID NO: 239181 - DNA, 75 bp, Artificial Sequence
  Synthetic
gcggatctcaaattctagcaagtgtgtctttgcttgctgtcgctggaagttatcttaatatgacagctagtactc

SEQ ID NO: 239182 - DNA, 75 bp, Artificial Sequence
  Synthetic
ttttttcgcgaatttccgcgtccgtgtcaaagtccggtgtttatgtcacctggtcagctgatccgcagggtattt

SEQ ID NO: 239183 - DNA, 75 bp, Artificial Sequence
  Synthetic
gtttgactcaaaagggcttctaatgactacatcttctattgataaaggatattggaattatagaaataaaaacag

SEQ ID NO: 239184 - DNA, 75 bp, Artificial Sequence
  Synthetic
atttctctgagctccgctcccagagtgtgagaaaaatgagacacctgcgtctcctgccagcaactgtgcctttgg

SEQ ID NO: 239185 - DNA, 75 bp, Artificial Sequence
  Synthetic
attggaattatagaaataaaaacagcgttgttggaactgcttatgaaaacgcaattccatttatgccaaatttag

SEQ ID NO: 239186 - DNA, 75 bp, Artificial Sequence
  Synthetic
ctttgtcagtacagtattggaggacgaactgcatccaagtcctttcgagctgggacccacacttcaggacctcta

SEQ ID NO: 239187 - DNA, 75 bp, Artificial Sequence
  Synthetic
agactctaaaatttatgctagaagcaaaattgttggaaatgtttatttagcaggtttggcttaccaaccaattgt

SEQ ID NO: 239188 - DNA, 75 bp, Artificial Sequence
  Synthetic
aaaattgttggaaatgtttatttagcaggtttggcttaccaaccaattgtcataacagttagttttaatcaggag

SEQ ID NO: 239189 - DNA, 75 bp, Artificial Sequence
  Synthetic
taacatttgaatttgcctggaacaaagactacgttggtcaatttgataccacctcctttaccttctcttatattg

SEQ ID NO: 239190 - DNA, 75 bp, Artificial Sequence
  Synthetic
agactacgttggtcaatttgataccacctcctttaccttctcttatattgcccaagaatgaaagaccaataaacg

SEQ ID NO: 239191 - DNA, 75 bp, Artificial Sequence
  Synthetic
ctgccaactactaaggctcccacagttaggacaacgcagcctaccactgtacccactacacatccaaccaccaca

SEQ ID NO: 239192 - DNA, 75 bp, Artificial Sequence
  Synthetic
gtggctattctcactgaaggaaaaatcactctctccagcagcagggtgcccactgggtggccctcgcggacatac

SEQ ID NO: 239193 - DNA, 75 bp, Artificial Sequence
  Synthetic
tcactctctccagcagcagggtgcccactgggtggccctcgcggacatacaaaaatcggtccgtgtggttaaaga

SEQ ID NO: 239194 - DNA, 75 bp, Artificial Sequence
  Synthetic
atccatctccaccacgtggtccttgtggatcatcaccgtcccatgcagacacttgagctggccttccacctcggt

SEQ ID NO: 239195 - DNA, 75 bp, Artificial Sequence
  Synthetic
tccccaccgacatggatgtcgacaaaaaaccctcgaccagcatcgaggtgcagaccgacccctggctcccagctt

SEQ ID NO: 239196 - DNA, 75 bp, Artificial Sequence
  Synthetic
ccggtgcactcccaattcttgtgcgcgatcccgctgtggctgaagatgtaaccttgcaacaggcgacccatgatg

SEQ ID NO: 239197 - DNA, 75 bp, Artificial Sequence
  Synthetic
ttcctgaggcacaagcccaggtacggaaatctggaaaaggaaaaattgctataaatgtttttctttccacagcat

SEQ ID NO: 239198 - DNA, 75 bp, Artificial Sequence
  Synthetic
gtgctaaagctcttctgggtggtgaaggtcagttgcatcccgcgggcctcctcgttcatccaggtctggcacatc

SEQ ID NO: 239199 - DNA, 75 bp, Artificial Sequence
  Synthetic
tcggcaacgacctgcgcgtcgacggcgcctccgtccgcttcgacagcgtcaacctctacgccaccttcttcccca

SEQ ID NO: 239200 - DNA, 75 bp, Artificial Sequence
  Synthetic
aacctctacgccaccttcttccccatggcgcacaacaccgcctccaccctggaagccatgctgcgcaacgacacc

SEQ ID NO: 239201 - DNA, 75 bp, Artificial Sequence
  Synthetic
tcctcggtgctcattgtagtggattcttttgcgtaccttgtcgtacttctgccagcagaaattggctcgggaaca

SEQ ID NO: 239202 - DNA, 75 bp, Artificial Sequence
  Synthetic
tatagtaatacctcctcctcctgctactgtaaagccacaaccagaaccagaatatgtgtttatttatattggaga

SEQ ID NO: 239203 - DNA, 75 bp, Artificial Sequence
  Synthetic
actgtaaagccacaaccagaaccagaatatgtgtttatttatattggagacaacaaaactctagaaggtcctcca

SEQ ID NO: 239204 - DNA, 75 bp, Artificial Sequence
  Synthetic
tgtccggccacgcctccgcgccgaccgttgacgccgtgcgtcgtgacgtcagtaacggctcttccaacagccaat

SEQ ID NO: 239205 - DNA, 75 bp, Artificial Sequence
  Synthetic
aggatggaaagaaattttgcgaaggggaaagagtttatcatccagaatacaatcacacatgtgacaaacaaaacc

SEQ ID NO: 239206 - DNA, 75 bp, Artificial Sequence
  Synthetic
ggaaagagtttatcatccagaatacaatcacacatgtgacaaacaaaaccttatactgctgtttgtaaattttac

SEQ ID NO: 239207 - DNA, 75 bp, Artificial Sequence
  Synthetic
aattatcaaggaactcaaaggacacagtatgaggttacagtcttagatctttttccaaactctggtcaaatgaaa

SEQ ID NO: 239208 - DNA, 75 bp, Artificial Sequence
  Synthetic
gggggtgcccaacggcatgctacaatcgccacaggtgctgcccaccctccggcgcaaccaggaggagctctaccg

SEQ ID NO: 239209 - DNA, 75 bp, Artificial Sequence
  Synthetic
tgaggcaatgcttgttacagtaactgctggttctaacttaactttagttgggcctaaaccagaaggaaaagttac

SEQ ID NO: 239210 - DNA, 75 bp, Artificial Sequence
  Synthetic
ttggttcgatggagatttaaaaagaccatgtgagcctaattatagactaagacatgaatgtaatactcaaaactt

SEQ ID NO: 239211 - DNA, 75 bp, Artificial Sequence
  Synthetic
acaacagcactggcaacatgggtgtgctggctggtcaggcatctcagttgaatgctgtggtcgacttgcaagaca

SEQ ID NO: 239212 - DNA, 75 bp, Artificial Sequence
  Synthetic
atgacaaagatgaaggcaaaaggtacagagtgaaagtaaatactacaaattctcaagctgtaaaaattcagccat

SEQ ID NO: 239213 - DNA, 75 bp, Artificial Sequence
  Synthetic
ccctgcactacactttcaggcacggtttcgtcaggcaggcctgcaagatctccaacgtggagctgaccaacctgg

SEQ ID NO: 239214 - DNA, 75 bp, Artificial Sequence
  Synthetic
aatttaatatttccagaatctatgattcttcaggctgacatagccaacgaatctatacctactccacttcataca

SEQ ID NO: 239215 - DNA, 75 bp, Artificial Sequence
  Synthetic
tatgtgtgcagaggtctggggcgccgctaagatcaggggatgtaagttttatggctgctggatgggcgtggtcgg

SEQ ID NO: 239216 - DNA, 75 bp, Artificial Sequence
  Synthetic
tgctcgagtgagacactgctcttccatggagacgggctgcttctgcctggtgaagggcacagcctcgatcaagca

SEQ ID NO: 239217 - DNA, 75 bp, Artificial Sequence
  Synthetic
tcggaccgccggctcaagcagatttacagcttcgagtacgaggccatgctgcgccgcagcgccctggcctcctcg

SEQ ID NO: 239218 - DNA, 75 bp, Artificial Sequence
  Synthetic
ccgttctcgctggtcacatccatctccaccacgtggtccttgtgaatcatcaccgttccatgcagacacttgagc

SEQ ID NO: 239219 - DNA, 75 bp, Artificial Sequence
  Synthetic
cgggaaccccaccatgaacttgctgacgggggtgcccaacggcatgctacaatcgccacaggtgctgcccaccct

SEQ ID NO: 239220 - DNA, 75 bp, Artificial Sequence
  Synthetic
ctcccaattcttgtgcgcgatcccgctgtggctgaagatgtaaccttgcaacaggcgacccataatggtgctaaa

SEQ ID NO: 239221 - DNA, 75 bp, Artificial Sequence
  Synthetic
accacagttaggacaactaaggacacaacacagcctaccactgcacccactacacatccaaccaccacagccagt

SEQ ID NO: 239222 - DNA, 75 bp, Artificial Sequence
  Synthetic
ctacagtgcagaatactactttattgattgggtttttactgagaggaaatgaaagtactactgatcagacagagg

SEQ ID NO: 239223 - DNA, 75 bp, Artificial Sequence
  Synthetic
gcgactgactacccactgacccagctccctatttaaaggcaccttacactgacgtaatgaccaaaggtctaaaaa

SEQ ID NO: 239224 - DNA, 75 bp, Artificial Sequence
  Synthetic
atgtggctccgtcgtagggcgccatcttgcccacgcctccgcgccgaccgttgacgccgtgcgtcgtgacgtcac

SEQ ID NO: 239225 - DNA, 75 bp, Artificial Sequence
  Synthetic
aataaaagctaaactcctacaatactctgggatcccgtgtcgtcgcactcgcaacgagaccttcaacctcaccaa

SEQ ID NO: 239226 - DNA, 75 bp, Artificial Sequence
  Synthetic
atacctgaattggaagaggaggatgagatagacctccggtgctacgaggaaggttttcctcccagcgattcagag

SEQ ID NO: 239227 - DNA, 75 bp, Artificial Sequence
  Synthetic
tatgtccgcgactgtgtatttctctttctctgccacacatggcaagcagccatgggcgtgtggcagcagtgtctc

SEQ ID NO: 239228 - DNA, 75 bp, Artificial Sequence
  Synthetic
tctaccttggtcacatgcttggtctttctggcttgcttcttttttggagggctgtccacggggaccacgtcctcc

SEQ ID NO: 239229 - DNA, 75 bp, Artificial Sequence
  Synthetic
acagggcactgccggtgcactcccagttcttgtgcgcgatcccgctgtggctaaagatgtaaccttgcaacaggc

SEQ ID NO: 239230 - DNA, 75 bp, Artificial Sequence
  Synthetic
gctgtccacggggaccacgtcctcctcggaagacccggagcccacccgctgatactttcggcgcttggtgggcag

SEQ ID NO: 239231 - DNA, 75 bp, Artificial Sequence
  Synthetic
tcctgcgctctgtgctatatgaaacagactttcagctttatttacagtaagtggagtgaatgtgagagaggctga

SEQ ID NO: 239232 - DNA, 75 bp, Artificial Sequence
  Synthetic
acaagcttcttgctagaaacattaaaaagctgtggacgggcttcgatgagcgcaccgtcgcctcggacctggccg

SEQ ID NO: 239233 - DNA, 75 bp, Artificial Sequence
  Synthetic
ggcatccatgcccttctcccaggacgagaccagaggcagactcagggggttgcgcacgttcaggacaccgggggt

SEQ ID NO: 239234 - DNA, 75 bp, Artificial Sequence
  Synthetic
cccaccactcggatgtgatcgaggacgtgagcggcgaggggctgctagagtgccactgccgctgcaacctgtgct

SEQ ID NO: 239235 - DNA, 75 bp, Artificial Sequence
  Synthetic
catcactaatggggatgtctcgctcaaggtgggagggggactcgccttgcaagaaggaagtggacagctaacagt

SEQ ID NO: 239236 - DNA, 75 bp, Artificial Sequence
  Synthetic
gggcgccttcaattggagcagtgtctggagcgggcttaaaaatttcggctcgacgctccggacctatgggaacaa

SEQ ID NO: 239237 - DNA, 75 bp, Artificial Sequence
  Synthetic
gcaaatgataaattagaattagcacttgatgctccatttcaagaaaaaaatggaaaactggtattgaaaacagga

SEQ ID NO: 239238 - DNA, 75 bp, Artificial Sequence
  Synthetic
cgacgctccggacctatgggaacaaggcctggaatagtagcactgggcagttgttaagggaaaagctcaaagacc

SEQ ID NO: 239239 - DNA, 75 bp, Artificial Sequence
  Synthetic
cctatataagtggtaacacctgggcactcaggcacagaccttcagggagctcctgatggaggtgtggactatcct

SEQ ID NO: 239240 - DNA, 75 bp, Artificial Sequence
  Synthetic
tggaaaactggtattgaaaacaggacatggtttagctgttttaactaaagataacacccacataccagacttaat

SEQ ID NO: 239241 - DNA, 75 bp, Artificial Sequence
  Synthetic
cgccagcccaacggcacctgcgagcccaacccgcgtctcaacttctatcccgtctttgcggtccccgaggccctt

SEQ ID NO: 239242 - DNA, 75 bp, Artificial Sequence
  Synthetic
tggaacccttgtagtagtaactggaaatggaattggtacaggtagtgtagctggcggaggaaccatagatgtaag

SEQ ID NO: 239243 - DNA, 75 bp, Artificial Sequence
  Synthetic
cggccattgtttcctaggggaagatggagcagccgcgtaagcaggagcaggaggatgagaacttaaccacccacg

SEQ ID NO: 239244 - DNA, 75 bp, Artificial Sequence
  Synthetic
ggagcagccgcgtaagcaggagcaggaggatgagaacttaaccacccacgaacaagcaaaaatcgagcaggacct

SEQ ID NO: 239245 - DNA, 75 bp, Artificial Sequence
  Synthetic
tttgataaaaagggtgatttagtagcctggaataaaaaagatgacaggcgcactttatggacaacgccagatcca

SEQ ID NO: 239246 - DNA, 75 bp, Artificial Sequence
  Synthetic
gcatacctgatatcgcttccctggaagaggtgcccaagatcttcgaagggctcggtcgggacgagacgcgcgcgg

SEQ ID NO: 239247 - DNA, 75 bp, Artificial Sequence
  Synthetic
ccacaggatgaacaggagcacgagcaagacgcaggccaggaggagaccgacgctgggctcgagcatggctaccta

SEQ ID NO: 239248 - DNA, 75 bp, Artificial Sequence
  Synthetic
caaaggatgcaaaacttactcttgtcttaacaaagtgcggaagtcagattttagcttctgtttcaattattgtac

SEQ ID NO: 239249 - DNA, 75 bp, Artificial Sequence
  Synthetic
ggaagagggttacactagcgccctggtagagttggaaggcgacaacgccaggctggccgtgcttaagcgcagcgt

SEQ ID NO: 239250 - DNA, 75 bp, Artificial Sequence
  Synthetic
gaaggagacaagcgttaaagagttcagtattaagttactgtttgataaaaatggagtgcttttgcctgaatctaa

SEQ ID NO: 239251 - DNA, 75 bp, Artificial Sequence
  Synthetic
cgagctcacccatttcgcctaccccgccgtcaacctcccgcccaaggtcatgcgtcgcatcatggatcagctcat

SEQ ID NO: 239252 - DNA, 75 bp, Artificial Sequence
  Synthetic
agaagtgatgatttaactatagccaagccatatgaaaatgcagtacctttcatgccaaatttaaaggcataccca

SEQ ID NO: 239253 - DNA, 75 bp, Artificial Sequence
  Synthetic
gccgcccttgcgcgagcagaaagggggcagcacatcaagcagatgctcgtcaggggggtccgcatcgatggtgaa

SEQ ID NO: 239254 - DNA, 75 bp, Artificial Sequence
  Synthetic
agaccctgcgcaaggtcgaggagaccctgcactacactttcagacacggtttcgtcaggcaggcctgcaagatct

SEQ ID NO: 239255 - DNA, 75 bp, Artificial Sequence
  Synthetic
tactccataactttgaaatttggatggggaaagacatatgaaacacccataccatttgatacctcttctttcacc

SEQ ID NO: 239256 - DNA, 75 bp, Artificial Sequence
  Synthetic
aagatgttacaaagacatttggacttgccgccatgggaggcagtaatatttctaaagacggtttgcagattggaa

SEQ ID NO: 239257 - DNA, 75 bp, Artificial Sequence
  Synthetic
ggaaggtgggcaggctaaattgaaagaaacacccaatggtaccgatcctcaatacgatgtggacatggctttctt

SEQ ID NO: 239258 - DNA, 75 bp, Artificial Sequence
  Synthetic
ccacagctcgcggttgagggcgtactcctcgtcatccttccagtactcccggagcgggaatcctcgatcgtccgc

SEQ ID NO: 239259 - DNA, 75 bp, Artificial Sequence
  Synthetic
gactttgtcccgctgagctaccgcgagtgtcccccgccgctgtggagccactgctacctcttgcagctggccaac

SEQ ID NO: 239260 - DNA, 75 bp, Artificial Sequence
  Synthetic
ctaccgagggcaatgctagagtgagacattgctcttccatggagacgggctgcttctgcctggtgaagggcacag

SEQ ID NO: 239261 - DNA, 75 bp, Artificial Sequence
  Synthetic
ctactgctgactattcaataacatttgactttgcatggagcaaagcttatgaaacccctgtgccttttgacacct

SEQ ID NO: 239262 - DNA, 75 bp, Artificial Sequence
  Synthetic
aggcagagcgaaagtgacgtcattgaagagaatcttgcctgctcgcggcatgaaattgcgggtgatgcggaaagg

SEQ ID NO: 239263 - DNA, 75 bp, Artificial Sequence
  Synthetic
agattctcttggtgacagaaccagatattttagtatgtggaactctgcggtggacagctatgatcccgatgtcag

SEQ ID NO: 239264 - DNA, 75 bp, Artificial Sequence
  Synthetic
agcctatcaaggtgttaaactaaagcctgatcaaacaggaggcggagttaatggagattgggtaaaggatgatga

SEQ ID NO: 239265 - DNA, 75 bp, Artificial Sequence
  Synthetic
cgaagccgttgatgttgtgcccgacgatgtatagttccatgaatcgcgggcggcctttgatgtgcggcagctttt

SEQ ID NO: 239266 - DNA, 75 bp, Artificial Sequence
  Synthetic
catttcagcccataatcaaattggaaagggcaacatctttgccatggagatcaacctccaggccaacctgtggaa

SEQ ID NO: 239267 - DNA, 75 bp, Artificial Sequence
  Synthetic
ctagacttcatggcttgtggccccctaccaaggagaacatggttgggttttctttggcttttgtgatcatggcct

SEQ ID NO: 239268 - DNA, 75 bp, Artificial Sequence
  Synthetic
catctcggggaacggggcagaggtggtcatcgataccctggacaaggccgccttcaggtgttgcatgatgggaat

SEQ ID NO: 239269 - DNA, 75 bp, Artificial Sequence
  Synthetic
acaaggccctgggcatagtcgcgccgcgcgtgctctctagtcgcaccttttaaaaaatgtccattcttatctcgc

SEQ ID NO: 239270 - DNA, 75 bp, Artificial Sequence
  Synthetic
ctggggcgctgctaagatcaggggatgtaagttttatggctgctggatgggcgtggtcggaagacccaagagcga

SEQ ID NO: 239271 - DNA, 75 bp, Artificial Sequence
  Synthetic
ggcccacggccatcttttctggggtgacgcagtagaaggtgagggggtcccgctcccagcgatcccagcgtaagc

SEQ ID NO: 239272 - DNA, 75 bp, Artificial Sequence
  Synthetic
caagatttaatgaggttctgccctctgccctcagctcgcgcctcagcgtcagctgtaaaaagtcactcaagtcct

SEQ ID NO: 239273 - DNA, 75 bp, Artificial Sequence
  Synthetic
cttctgcctggaactgtgcctatggacatggccgcattattgctacaggactttgtggatacagtattggaggac

SEQ ID NO: 239274 - DNA, 75 bp, Artificial Sequence
  Synthetic
tcttgcagggaagcaaagtttttcaggggcttaagcccgtcggccatgggcatcttggcgagggtctgcgagagg

SEQ ID NO: 239275 - DNA, 75 bp, Artificial Sequence
  Synthetic
gaacttcgacgcagtgagagaagcggtggacggctacgactgaatgtcctatggtgactcggctgagctcgctcg

SEQ ID NO: 239276 - DNA, 75 bp, Artificial Sequence
  Synthetic
ggaatcagcacgctcactctcaggtgaagcaaaaccaccccatgcggaggaatgtggaaagattctgggcaaaag

SEQ ID NO: 239277 - DNA, 75 bp, Artificial Sequence
  Synthetic
cgcccctgcaagtgatcagacccaccccagtcagactcagtggggagaggcgaatggctgttgaaaaaattgagg

SEQ ID NO: 239278 - DNA, 75 bp, Artificial Sequence
  Synthetic
tcctgcctgcgcttatccccataatcgccgcggccattggcacgatcccgggcatagcttccgttgcgctgcaag

SEQ ID NO: 239279 - DNA, 75 bp, Artificial Sequence
  Synthetic
gtatggcgccatattgcccacgtccaaaatggcttccatgtccagccacgcctccgcggcgaccgtcggccgtgc

SEQ ID NO: 239280 - DNA, 75 bp, Artificial Sequence
  Synthetic
cacgcagacaactactagggaaacaacacagcctactactgtacccactacacatccaaccaccacagtcagtac

SEQ ID NO: 239281 - DNA, 75 bp, Artificial Sequence
  Synthetic
atacgaagtggtcgggtatttgattttaggggtggtcctgggtgggtgcatagcggtgctagctcagctgccttg

SEQ ID NO: 239282 - DNA, 75 bp, Artificial Sequence
  Synthetic
ctggacttcgcagccatgcacctgtggagggcctggatcaggcagcggggacagagaatcttgaactactggctt

SEQ ID NO: 239283 - DNA, 75 bp, Artificial Sequence
  Synthetic
attccaagagctgtggaacaagcggctgaaaaggatctggtcattgtaccagtaacacaagatgaaagcaagaga

SEQ ID NO: 239284 - DNA, 75 bp, Artificial Sequence
  Synthetic
cccttgctgatgatgattactctaagtgcaaatttgtggagctatggaatttcttagactgctatgatgctaaaa

SEQ ID NO: 239285 - DNA, 75 bp, Artificial Sequence
  Synthetic
ctggtaggggctctagtgtggtttctgaaacgcaagcccaggtatggaaatgaagagaaggaaaaattgctataa

SEQ ID NO: 239286 - DNA, 75 bp, Artificial Sequence
  Synthetic
gccgtgggcgacaaccgggtgctagacatggccagcacgtactttgacatccgcggcgtcctggaccgcggtccc

SEQ ID NO: 239287 - DNA, 75 bp, Artificial Sequence
  Synthetic
caggcaggatttcatactatcaatgctacatggtgggctaatataactttagtgggacccccagacacaccagtc

SEQ ID NO: 239288 - DNA, 75 bp, Artificial Sequence
  Synthetic
accaaaatcaaaaagaaactcgcacttacggcgtagccgccactggcggatataacattacaaaagaaggacttc

SEQ ID NO: 239289 - DNA, 75 bp, Artificial Sequence
  Synthetic
ggttttgcaatggcagtagagttaagaatcctcaaatcagacatacatgtaatgatcaaaaccttactttgatcc

SEQ ID NO: 239290 - DNA, 75 bp, Artificial Sequence
  Synthetic
gaatcctcaaatcagacatacatgtaatgatcaaaaccttactttgatccatgtgaacaaaacttatgaaagaac

SEQ ID NO: 239291 - DNA, 75 bp, Artificial Sequence
  Synthetic
tgcatctactccctcctcaagaccctttgcggacttcgcgacctcctccccatgaactgattgattaaagcccaa

SEQ ID NO: 239292 - DNA, 75 bp, Artificial Sequence
  Synthetic
gttgttgatgacctgggcggcgaggacgatctcgtcgaagccgttgatgttgtgcccgacgatgtagagttccat

SEQ ID NO: 239293 - DNA, 75 bp, Artificial Sequence
  Synthetic
actaaaaaagaagactacaaagttgtagttataccacctcctcctgctactgtaaaaccacagccagagccagag

SEQ ID NO: 239294 - DNA, 75 bp, Artificial Sequence
  Synthetic
tagttataccacctcctcctgctactgtaaaaccacagccagagccagagtatgtgtttgtttatatgggagaga

SEQ ID NO: 239295 - DNA, 75 bp, Artificial Sequence
  Synthetic
agccccaaataaacaatcattggaaataatcattcaataaagatcacttacttgaaatctgaaagtatgtctctg

SEQ ID NO: 239296 - DNA, 75 bp, Artificial Sequence
  Synthetic
ataatcattcaataaagatcacttacttgaaatctgaaagtatgtctctggtgtagttgtttagcagcacctcgg

SEQ ID NO: 239297 - DNA, 75 bp, Artificial Sequence
  Synthetic
aactccagtcacatggtttaatcaggatggaaagaaattttgtgaaggagaaaaagttcttcatccagaatttaa

SEQ ID NO: 239298 - DNA, 75 bp, Artificial Sequence
  Synthetic
gatggaaagaaattttgtgaaggagaaaaagttcttcatccagaatttaaccacacctgtgacaaacaaaacctt

SEQ ID NO: 239299 - DNA, 75 bp, Artificial Sequence
  Synthetic
atgatggagcttaccttgggtacaatcatcaaggaacccagagaacacactatgaagttacagtattagatcttt

SEQ ID NO: 239300 - DNA, 75 bp, Artificial Sequence
  Synthetic
tatgaagttacagtattagatctttttccagattctggccaaatgaaaattgaacatcataactggcagaaacag

SEQ ID NO: 239301 - DNA, 75 bp, Artificial Sequence
  Synthetic
aaacaaatcaaacaaaagttaatgacaggagaaaaacagcgcaaaaaagaccatcaaagctaaagccggcaacta

SEQ ID NO: 239302 - DNA, 75 bp, Artificial Sequence
  Synthetic
caggagaaaaacagcgcaaaaaagaccatcaaagctaaagccggcaactattgaggcaatgctggttacagtgac

SEQ ID NO: 239303 - DNA, 75 bp, Artificial Sequence
  Synthetic
caagatggaaccggaaaactaactattgacaccaagactcccttgcaagttgcaaataataaattagaacttgcg

SEQ ID NO: 239304 - DNA, 75 bp, Artificial Sequence
  Synthetic
aacgtggtattggcactcccgtctcgacccgagcccgatagccgccaggatacggcggagagccctttttgccgg

SEQ ID NO: 239305 - DNA, 75 bp, Artificial Sequence
  Synthetic
ggacctaaagcagaaggaaaagttacttggtttgatggagatttaaaaagaccatgtgagcctaattacagacta

SEQ ID NO: 239306 - DNA, 75 bp, Artificial Sequence
  Synthetic
cttggtttgatggagatttaaaaagaccatgtgagcctaattacagactaagacacgaatgtaataatcaaaact

SEQ ID NO: 239307 - DNA, 75 bp, Artificial Sequence
  Synthetic
ttgacaccaagactcccttgcaagttgcaaataataaattagaacttgcgtttgatgcaccattgtatgaaaaaa

SEQ ID NO: 239308 - DNA, 75 bp, Artificial Sequence
  Synthetic
ccatggattagctgttttaaccaaagacattggcataccagaattaattggatcccttgtgatcttaactggaaa

SEQ ID NO: 239309 - DNA, 75 bp, Artificial Sequence
  Synthetic
gacattggcataccagaattaattggatcccttgtgatcttaactggaaaaggaattgggacaggtactgttgca

SEQ ID NO: 239310 - DNA, 75 bp, Artificial Sequence
  Synthetic
ttatgagggaacttactatggtacaaatgacaaagatgagggcaaaaggtacagagtgaaagtaaatactacaaa

SEQ ID NO: 239311 - DNA, 75 bp, Artificial Sequence
  Synthetic
tgggtgatgatggaggtttatcatttgataaaaagggtgatctagtagcctggaataaaaaaaatgacaggcgca

SEQ ID NO: 239312 - DNA, 75 bp, Artificial Sequence
  Synthetic
tataccagacaaactactcctgatcaagagcacaaatttgaattacagttcgaaactaatggaaattatgattca

SEQ ID NO: 239313 - DNA, 75 bp, Artificial Sequence
  Synthetic
tgataaaaagggtgatctagtagcctggaataaaaaaaatgacaggcgcactttgtggacaacacctgatccatc

SEQ ID NO: 239314 - DNA, 75 bp, Artificial Sequence
  Synthetic
aaagattcaaaactaactttaattcttacaaaatgtggaagtcagatcctagcaagtttttcactgcttgtagtc

SEQ ID NO: 239315 - DNA, 75 bp, Artificial Sequence
  Synthetic
ttacaaaatgtggaagtcagatcctagcaagtttttcactgcttgtagtcaaagggacgtatacaactgttgata

SEQ ID NO: 239316 - DNA, 75 bp, Artificial Sequence
  Synthetic
ggaaagcttaaaagcgaatcaaaccttagtggttattggaattatagaagtgataatagtgttgttagtactccc

SEQ ID NO: 239317 - DNA, 75 bp, Artificial Sequence
  Synthetic
tcataatgttaccagagatggatatatcacattaaatgtaacaattgataatactacctggacaagatatcattt

SEQ ID NO: 239318 - DNA, 75 bp, Artificial Sequence
  Synthetic
caaataccacggcttatccaaaaatcattaatagtacaactgatcctgaaaataagaaaagttcggctaaaaaaa

SEQ ID NO: 239319 - DNA, 75 bp, Artificial Sequence
  Synthetic
aaataagtggcatcaaatttgtacgtggtcagacccatcatacaaatgtcacagcaatggcagcattaccattca

SEQ ID NO: 239320 - DNA, 75 bp, Artificial Sequence
  Synthetic
gcgcgcaactacacccccgccccctccaccgtggacgcggtcatcgacagcgtggtggccgacgcgcgcgactat

SEQ ID NO: 239321 - DNA, 75 bp, Artificial Sequence
  Synthetic
aataagaaaagttcggctaaaaaaactattgttggcaatgtctacctagaaggtaatgcgggtcaaccagtagcc

SEQ ID NO: 239322 - DNA, 75 bp, Artificial Sequence
  Synthetic
tacaaagctgaaagttttactaactggtttagatattacggtaatcataaacatgaaattcatatttttaacata

SEQ ID NO: 239323 - DNA, 75 bp, Artificial Sequence
  Synthetic
aagattctggagattatgaacaacaaaaaatatatctatataatctaacaataattgaaccgccaactactaggg

SEQ ID NO: 239324 - DNA, 75 bp, Artificial Sequence
  Synthetic
gtagttcaaggacatgcaggtgccgtcgtccctaaggagaggggccacctcgttgagcatgtctctgacttggag

SEQ ID NO: 239325 - DNA, 75 bp, Artificial Sequence
  Synthetic
ccagcgtcatgtccttccagggtctcagggtccgcgtgagggtggtctccgtcacggtgaaggggtgggccccgg

SEQ ID NO: 239326 - DNA, 75 bp, Artificial Sequence
  Synthetic
ttcccaacctacctcctctttgccctgctcacctgcacctgcgtctgcagcattgtctgcctggtcatcaccttc

SEQ ID NO: 239327 - DNA, 75 bp, Artificial Sequence
  Synthetic
tattcgggcacggcttacaacagcctggccccaaaaggtgcccccaactccagtcagtgggagcagaaaaaaact

SEQ ID NO: 239328 - DNA, 75 bp, Artificial Sequence
  Synthetic
cgctcaccatctgagctctcaccaagtccagggtagcggggcacaggcacactgacatacatctttttaaaattt

SEQ ID NO: 239329 - DNA, 75 bp, Artificial Sequence
  Synthetic
gggttgctccttcaacgcgcgctgcccgttctcgctggtcacatccatctccaccacgtggtccttgtggatcat

SEQ ID NO: 239330 - DNA, 75 bp, Artificial Sequence
  Synthetic
ggccgccaaggagctccttgatgccatcaacatccaccagtgcaagaagggcatcttctgcctggtcaaacaggc

SEQ ID NO: 239331 - DNA, 75 bp, Artificial Sequence
  Synthetic
agacgagccggcagggcttgcagacggtgaacctgagtcaggctttcaagaacctgcgcgggctgtggggcgtgc

SEQ ID NO: 239332 - DNA, 75 bp, Artificial Sequence
  Synthetic
ccacgggtgagttggtggccgtgtccacgcattgcatgagcccgtagctgcgcggggccacgaccgtgccgcggt

SEQ ID NO: 239333 - DNA, 75 bp, Artificial Sequence
  Synthetic
gatgtcaaattcctggtccacaattttcattgtcttccctcttagatgtcaaagaggctccgggtggaagatgac

SEQ ID NO: 239334 - DNA, 75 bp, Artificial Sequence
  Synthetic
ttcaaccccgtctacccctatggctacgcgcggaatcagaatatccccttcctcactcccccctttgtctcctcc

SEQ ID NO: 239335 - DNA, 75 bp, Artificial Sequence
  Synthetic
tcactttgcaagatggaagcctaactgtaaaccctaaggctccactgcaagttaatactgataaaaaacttgagc

SEQ ID NO: 239336 - DNA, 75 bp, Artificial Sequence
  Synthetic
tagtgctaataaacttagtttaaaagtaggacatggattaaaagtattagatgaaaaaagtgctgcggggttaaa

SEQ ID NO: 239337 - DNA, 75 bp, Artificial Sequence
  Synthetic
gtaggacatggattaaaagtattagatgaaaaaagtgctgcggggttaaaagatttaattggcaaacttgtggtt

SEQ ID NO: 239338 - DNA, 75 bp, Artificial Sequence
  Synthetic
ctggtcagttgcaccacgcttctcccccagcggttctgggtcactttggccttgctgggttgctccttcaacgcg

SEQ ID NO: 239339 - DNA, 75 bp, Artificial Sequence
  Synthetic
cagcagaggaattggtataaatgtaagagcaagagaagggttgacatttgacaatgatggatacttggtagcatg

SEQ ID NO: 239340 - DNA, 75 bp, Artificial Sequence
  Synthetic
agtcagcgacgagcagctcgcgcgctggctcgggtcccgcaacccccaggtcctggagcagcggcgcaagctcat

SEQ ID NO: 239341 - DNA, 75 bp, Artificial Sequence
  Synthetic
caaactgcacaattgctcaagataaggactctaaactcactttggtacttacaaagtgtggaagtcaaatattag

SEQ ID NO: 239342 - DNA, 75 bp, Artificial Sequence
  Synthetic
ggactctaaactcactttggtacttacaaagtgtggaagtcaaatattagctaatgtgtctttgattgtggtcgc

SEQ ID NO: 239343 - DNA, 75 bp, Artificial Sequence
  Synthetic
aagacaaatccaaaaataaaaagttttactattaaactgctatttaataagaacggagtgcttttagacaactca

SEQ ID NO: 239344 - DNA, 75 bp, Artificial Sequence
  Synthetic
ttactattaaactgctatttaataagaacggagtgcttttagacaactcaaatcttggaaaagcttattggaact

SEQ ID NO: 239345 - DNA, 75 bp, Artificial Sequence
  Synthetic
ggaggcgtacatgccgcagatgtcatagacatagatgggctccgagaggatgccgatgtaggtgggataacagcg

SEQ ID NO: 239346 - DNA, 75 bp, Artificial Sequence
  Synthetic
ttgctagtcccttcctggacgggagcgatccctccagggctatctatgaaagcatacagagattcagccatagct

SEQ ID NO: 239347 - DNA, 75 bp, Artificial Sequence
  Synthetic
gacagcttatgaaaaagcaattggttttatgcctaatttggtagcgtatccaaaacccagtaattctaaaaaata

SEQ ID NO: 239348 - DNA, 75 bp, Artificial Sequence
  Synthetic
actaacggttcttgcaacggccaattagcgctggccccgccctaaattcaaaagctcatttgcatattaactttt

SEQ ID NO: 239349 - DNA, 75 bp, Artificial Sequence
  Synthetic
ctatctatataatataccccacaaagtaaacaaaagttaatatgcaaatgagcttttgaatttagggcgtggtcg

SEQ ID NO: 239350 - DNA, 75 bp, Artificial Sequence
  Synthetic
ggaggacaggaggatgtgctgctaaaacacttgcagcgccagtcctttatcctccgggacgctctggccgaccga

SEQ ID NO: 239351 - DNA, 75 bp, Artificial Sequence
  Synthetic
tctgtgcctctccatcagcgccctcagcagtctctgccgccggggctcggtgcggctgctgcaaatgggatcggg

SEQ ID NO: 239352 - DNA, 75 bp, Artificial Sequence
  Synthetic
cctgcccctcatgaacacactgcccatgtacatgatctctttgggcatgtttctgtttacaatctggcggtacca

SEQ ID NO: 239353 - DNA, 75 bp, Artificial Sequence
  Synthetic
ggggaagcgctggttgaacatgcacccgtaaatgactctcctgaaccacacggccagcagggtgcctcccgcccg

SEQ ID NO: 239354 - DNA, 75 bp, Artificial Sequence
  Synthetic
acgacccgaacgaagaggctgtgaatttaatatttccagaatctatgattcttcaggctgacatagccagcgaag

SEQ ID NO: 239355 - DNA, 75 bp, Artificial Sequence
  Synthetic
tcttggagcagggtaaagccagcagcacatggtaatccacggacagaacttacattatgataatctgcatgatca

SEQ ID NO: 239356 - DNA, 75 bp, Artificial Sequence
  Synthetic
gcattttgtgttggacaatcctgaggtgcccggggaaggctgtagatcctgccaatatcaccgggatcagaccgg

SEQ ID NO: 239357 - DNA, 75 bp, Artificial Sequence
  Synthetic
aaaattgaaaatcatagtgaggaaacagagcaaaaaaatgatgaacatcataactggcagaaacagggtgggcaa

SEQ ID NO: 239358 - DNA, 75 bp, Artificial Sequence
  Synthetic
tgttacatgaaaaccactttcagctttatttacagtaagtggagtgaatgtgagaggctgagtgcttaacacata

SEQ ID NO: 239359 - DNA, 75 bp, Artificial Sequence
  Synthetic
ccgcgggcctcctcgttcatccaggtctggcacatcttctggaagatctcggtctgctcgggcatgagcttgtaa

SEQ ID NO: 239360 - DNA, 75 bp, Artificial Sequence
  Synthetic
gacctggccgagattgtttttcctgaacgcctgaggcagacgcttaaaggcgggctgcccgactttatgagccag

SEQ ID NO: 239361 - DNA, 75 bp, Artificial Sequence
  Synthetic
actgcaacgacggtgttgaacttcccaacaacctttcaagtggactgagttacgataccagaaaagctaaactcg

SEQ ID NO: 239362 - DNA, 75 bp, Artificial Sequence
  Synthetic
aacctacaagtgtcagagcggaccttgtactcacaccttccatttggtgaacgtcaccagcagcaacaacagctc

SEQ ID NO: 239363 - DNA, 75 bp, Artificial Sequence
  Synthetic
aaaagtatatgtgacgcatgcaaggtgtggtttatgactcatgggcggggcttagtcctatataagtggcaacac

SEQ ID NO: 239364 - DNA, 75 bp, Artificial Sequence
  Synthetic
accacgtcctcctcggaagacccggagcccacccgctgatactttcggcgcttggtgggcagaggaggtggcggc

SEQ ID NO: 239365 - DNA, 75 bp, Artificial Sequence
  Synthetic
tatttgattttaggggtggtactgggtgggtgcatagcggtgctagctcagcttccttgctgggtcgaaatcaaa

SEQ ID NO: 239366 - DNA, 75 bp, Artificial Sequence
  Synthetic
gagctcgcgcctcaatgtcagctgcaaaaagtcacttaagtcctgggccactacagctgacaattcagagccagg

SEQ ID NO: 239367 - DNA, 75 bp, Artificial Sequence
  Synthetic
aaggaaaaatcactctctccagcagcagggtacccactgggtggcccttgcggacatacaaaaatcggtccgtgt

SEQ ID NO: 239368 - DNA, 75 bp, Artificial Sequence
  Synthetic
atataactttagtaggaccttcagatactccagtgacctggtatgatagcaagggattacagttttgtgacggaa

SEQ ID NO: 239369 - DNA, 75 bp, Artificial Sequence
  Synthetic
agcacactcacttttaggtgaagcaataccaccccatgcggaggaatgtggaaagattcagggcaaaaaaattat

SEQ ID NO: 239370 - DNA, 75 bp, Artificial Sequence
  Synthetic
ggaaacagaacagaaacatactgagcaaaataaggctgggcaaaaacagggtatagatacaaatcaaaagaaagt

SEQ ID NO: 239371 - DNA, 75 bp, Artificial Sequence
  Synthetic
aagcgaaaaataccggtcccgcccagggcggaatatttaccgagggccaacagactttgaccgattacgtggggt

SEQ ID NO: 239372 - DNA, 75 bp, Artificial Sequence
  Synthetic
gggcggaatatttaccgagggccaacagactttgaccgattacgtggggtttcgattacggtgttttttttcgcc

SEQ ID NO: 239373 - DNA, 75 bp, Artificial Sequence
  Synthetic
ctaatcagaatcacagatttgaattgcaaatcgaaaataatggaaatgatcaagaatcaaaaattccatctacta

SEQ ID NO: 239374 - DNA, 75 bp, Artificial Sequence
  Synthetic
tattgctggaggactatgtaaatacaatattggaggacgaactgcatttatctccgtttgagctgggacccacac

SEQ ID NO: 239375 - DNA, 75 bp, Artificial Sequence
  Synthetic
tgtcttacgagggtctttttgcttttctgcagacatcatgaacgggaccggcggggccttcgaaggggggctttt

SEQ ID NO: 239376 - DNA, 75 bp, Artificial Sequence
  Synthetic
ctcttgagtgccagcgagtagagatttctctgagctccgctcccagagtctgagaaaaatgagacacctgcgcct

SEQ ID NO: 239377 - DNA, 75 bp, Artificial Sequence
  Synthetic
ctatacctaaattggaagaggaggataagctagaccttcggtgttatgaggaaggttttcctcccagcgattcag

SEQ ID NO: 239378 - DNA, 75 bp, Artificial Sequence
  Synthetic
cctgtcttcaactgtgcctattgacatggccgcattattgctggaggattatgtgagtacaatattggaggacga

SEQ ID NO: 239379 - DNA, 75 bp, Artificial Sequence
  Synthetic
ggtttcgtcggctacctcgcacccaccatgcgccaggggcagccctaccccgccaacttcccctacccgctcatc

SEQ ID NO: 239380 - DNA, 75 bp, Artificial Sequence
  Synthetic
tggccgagctggaagccctgagccgccagctggccgccctgacccagcaggtgtccgagctccgcgagcagcagc

SEQ ID NO: 239381 - DNA, 75 bp, Artificial Sequence
  Synthetic
tctggagattatgaatatcagaaattatctttttatatgctgacaattattgagctgccaactactaaggctccc

SEQ ID NO: 239382 - DNA, 75 bp, Artificial Sequence
  Synthetic
aaaataaatgattcaataaacacagattctgattcaaacagcaaagcatctttattatttattttttcgcgcgcg

SEQ ID NO: 239383 - DNA, 75 bp, Artificial Sequence
  Synthetic
caacacaacctaccacatccagtacaactgttgagaccactactcacactacagtacagaatagtactgtattgg

SEQ ID NO: 239384 - DNA, 75 bp, Artificial Sequence
  Synthetic
gaagtggttgggtatttgattttaggggtggtactgggtgggtgcatagcagtgctgtatcaacttccttgctgg

SEQ ID NO: 239385 - DNA, 75 bp, Artificial Sequence
  Synthetic
gacacgaacgcctcctgcgctctgtgttacatgaaaaagaacttcagctttatttacagtaagtggagtgaatgt

SEQ ID NO: 239386 - DNA, 75 bp, Artificial Sequence
  Synthetic
ctgtactttgtctgctgcaaagccagagagaaatctaggaggcccatctacaggccagtaatcggggagcctcag

SEQ ID NO: 239387 - DNA, 75 bp, Artificial Sequence
  Synthetic
cttagtcatgtgtaaataaagttgtacaataaaaagtatatgtgacgcatgcaaggtgtggtttatgactcatgg

SEQ ID NO: 239388 - DNA, 75 bp, Artificial Sequence
  Synthetic
gagacactggtttggaactcctctatctcgcctggtgtacacagttaagaaggattataacgaggaatttgaaaa

SEQ ID NO: 239389 - DNA, 75 bp, Artificial Sequence
  Synthetic
ccacagccttgatttttccagcccagggcgcactacagccggggttgcttttgtggtttttctggttgacaaatg

SEQ ID NO: 239390 - DNA, 75 bp, Artificial Sequence
  Synthetic
gacgaggactcggccgacgatagcagcgtgttggacttgggcgggagcggtggggtcaacccgttcgcgcatctg

SEQ ID NO: 239391 - DNA, 75 bp, Artificial Sequence
  Synthetic
cctcatcctccgggacgccctggccgaccggagcgaaacccccctcagcgtcgaggagctgtgtcgggcctacga

SEQ ID NO: 239392 - DNA, 75 bp, Artificial Sequence
  Synthetic
cacctgtaacgaacagaacctcacgttgctgtttgttaatatgacacacaacgggccatattttggttttggcaa

SEQ ID NO: 239393 - DNA, 75 bp, Artificial Sequence
  Synthetic
gggtactgtttatggccaacagccacatgaccctgcatggttgcagtttttttggctttaacaatatgtgtgcag

SEQ ID NO: 239394 - DNA, 75 bp, Artificial Sequence
  Synthetic
ggttgaacccagatgaggattgggaggaggccattaagaaatatgccaagatagccctgcgcccagattgcaagt

SEQ ID NO: 239395 - DNA, 75 bp, Artificial Sequence
  Synthetic
gcagccgcgtaagcaggagcaggaggaggagaacttaaccacccacgagcaacccaaaatcgagcaggacctggg

SEQ ID NO: 239396 - DNA, 75 bp, Artificial Sequence
  Synthetic
tcaaactggctgacccaatagccatcactaatggggatgtctcacttaaggtgggagggggattgactgttgaaa

SEQ ID NO: 239397 - DNA, 75 bp, Artificial Sequence
  Synthetic
gtgatgaatatgaattccatgatcttcatgaacatgaagttcaatggagagaagtttaatggggtgctgttcatg

SEQ ID NO: 239398 - DNA, 75 bp, Artificial Sequence
  Synthetic
aaaattccatcagctactgtggcaatcgtggtgggtgtgattgcgggctttgtaactctgatcattgtcttcata

SEQ ID NO: 239399 - DNA, 75 bp, Artificial Sequence
  Synthetic
cgagacgcgtcgggactatgtccgcgactgcgtctttctctttctctgccatacctggcagtcggccatgggagt

SEQ ID NO: 239400 - DNA, 75 bp, Artificial Sequence
  Synthetic
aagtgcggaagtcagattttggctaatgtatctctgattgtagttaaaggaaagtttcaaaaccttaattacaaa

SEQ ID NO: 239401 - DNA, 75 bp, Artificial Sequence
  Synthetic
ttagtatcaaacttctgtttgatcaaaatggagttctattagaaaattcaaacgtagaaaaacagtacctcaatt

SEQ ID NO: 239402 - DNA, 75 bp, Artificial Sequence
  Synthetic
aaatggagttctattagaaaattcaaacgtagaaaaacagtacctcaattttagaaatggagactcaattattac

SEQ ID NO: 239403 - DNA, 75 bp, Artificial Sequence
  Synthetic
aggaaagtactactgaacagacagaggctacctcaagtgccttcagcagcactgcaaatttaacttcgcttgctt

SEQ ID NO: 239404 - DNA, 75 bp, Artificial Sequence
  Synthetic
tttatgccaaatttattagcttattctaaatctacaacttctcagtctaaaatttatgcaagaaacactatatat

SEQ ID NO: 239405 - DNA, 75 bp, Artificial Sequence
  Synthetic
acatcagccaggactctgtaggccatccccatccagttaatgctgccttgtctatcattcagagggggcggtggc

SEQ ID NO: 239406 - DNA, 75 bp, Artificial Sequence
  Synthetic
gtggagccactgctacctcttgcagctggccaactacatcgcctaccactcggatgtgatcgaggacgtgagcgg

SEQ ID NO: 239407 - DNA, 75 bp, Artificial Sequence
  Synthetic
ggtaatatatatttagatgctcagccatataatccagttattattaaaattattttcaatcaagaatcggaaagt

SEQ ID NO: 239408 - DNA, 75 bp, Artificial Sequence
  Synthetic
ccgaggagaaactgctggccctgctggctgagctggaagccctgagccgccagctgaccgccctgacccaggagg

SEQ ID NO: 239409 - DNA, 75 bp, Artificial Sequence
  Synthetic
cgagcccttgaccaccagggagctgaggaaccggatcttccccactctttatgccatttttcagcagagtcgagg

SEQ ID NO: 239410 - DNA, 75 bp, Artificial Sequence
  Synthetic
tgtctcgctcaaggtgggagggggactcactgttgaacaacagtctggaaatttaactatagatgccaaagcacc

SEQ ID NO: 239411 - DNA, 75 bp, Artificial Sequence
  Synthetic
ctcactgttgaacaacagtctggaaatttaactatagatgccaaagcacctttgcaagttgcaaatggtaaatta

SEQ ID NO: 239412 - DNA, 75 bp, Artificial Sequence
  Synthetic
cgtgaccctgcagcaggtgctgccccaggcggtgctgctgccgagccgcggggtcaagcgcgagggcgagagcat

SEQ ID NO: 239413 - DNA, 75 bp, Artificial Sequence
  Synthetic
gctcctgggtgagatcatcataagacattttaatgaatttggggcggagggtgccagattgggggactatggttc

SEQ ID NO: 239414 - DNA, 75 bp, Artificial Sequence
  Synthetic
gggtcaagcgcgagggcgagagcatgtacccgaccatgcagatcatggtgcccaagcgccggcgcgtggaggacg

SEQ ID NO: 239415 - DNA, 75 bp, Artificial Sequence
  Synthetic
aagttaaagataataaactttctttactagttggaaatggactaaaggtgatagatagatcagtctctgacttgc

SEQ ID NO: 239416 - DNA, 75 bp, Artificial Sequence
  Synthetic
actagttggaaatggactaaaggtgatagatagatcagtctctgacttgccaggtcttctaaactaccttgtagt

SEQ ID NO: 239417 - DNA, 75 bp, Artificial Sequence
  Synthetic
gaagagataaaaaacgcagacggaacaaacaaaggagttggattgcgtgtgagaatcgcagaagcaggtggctta

SEQ ID NO: 239418 - DNA, 75 bp, Artificial Sequence
  Synthetic
caaacaaaggagttggattgcgtgtgagaatcgcagaagcaggtggcttaacatttgatgataaaggtgaattag

SEQ ID NO: 239419 - DNA, 75 bp, Artificial Sequence
  Synthetic
ccccaccgacatggatgtcgacaaaaaaccctcgaccagcatcgaggtgcaaaccgacccctggctcccagcctc

SEQ ID NO: 239420 - DNA, 75 bp, Artificial Sequence
  Synthetic
gcgcaccctttggacaactctggatccatctccaaattgcagagttgatgaagaaaaggattcaaagtttacttt

SEQ ID NO: 239421 - DNA, 75 bp, Artificial Sequence
  Synthetic
ccatctccaaattgcagagttgatgaagaaaaggattcaaagtttactttagttttaacaaagtgtggaagtcag

SEQ ID NO: 239422 - DNA, 75 bp, Artificial Sequence
  Synthetic
aggaaccagcacactcacttttaggtgaagcaataccaccccatgcggaggaatgtggaaagattcagggcaaaa

SEQ ID NO: 239423 - DNA, 75 bp, Artificial Sequence
  Synthetic
atggctacgcgcggaatcaaaatattcccttcctcactcccccctttgtctcctccaatggatttcaaaacttcc

SEQ ID NO: 239424 - DNA, 75 bp, Artificial Sequence
  Synthetic
ttgtaaaaggtaaattccaaattttagatcataaggccaacactggccttagtaaagcttttgcaattaagttac

SEQ ID NO: 239425 - DNA, 75 bp, Artificial Sequence
  Synthetic
agatcataaggccaacactggccttagtaaagcttttgcaattaagttactatttgatgaaaatggagtccttaa

SEQ ID NO: 239426 - DNA, 75 bp, Artificial Sequence
  Synthetic
ggagcagccgcgtaagcaggagcaggaggaggacttaaccacccacgagcaacccaaaatcgagcaggacctggg

SEQ ID NO: 239427 - DNA, 75 bp, Artificial Sequence
  Synthetic
tcttggaattatagaagcgggaattctgttctgtcagagccatataaaaatgcaattggatttatgccaaattta

SEQ ID NO: 239428 - DNA, 75 bp, Artificial Sequence
  Synthetic
ctgttctgtcagagccatataaaaatgcaattggatttatgccaaatttagcagcgtatcctaaatctacaactt

SEQ ID NO: 239429 - DNA, 75 bp, Artificial Sequence
  Synthetic
agctcgaaatcggtgcgcttctttgagagggggttaggcagagcgaaagtgacgtcattgaagagaatcttgcct

SEQ ID NO: 239430 - DNA, 75 bp, Artificial Sequence
  Synthetic
aggcgcgcgagtcgaagacatagtcgttgcaggtgcgcacgaggtactggtagccgactaggaagtgcggcggcg

SEQ ID NO: 239431 - DNA, 75 bp, Artificial Sequence
  Synthetic
ttattaaaattacttttaatcaagaagcagatagtgcttattctatgacttttaactattcatggaccaaggatt

SEQ ID NO: 239432 - DNA, 75 bp, Artificial Sequence
  Synthetic
acaaggccctgggcatagtcgcgccgcgtgtgctttccagtcgcaccttctaaaaaatgtctattctcatctcgc

SEQ ID NO: 239433 - DNA, 75 bp, Artificial Sequence
  Synthetic
acgctgattggccgttgcaacgaccgttagtgacgtcacgacgcacggcgtcaacggtcggcgcggaggcgtggc

SEQ ID NO: 239434 - DNA, 75 bp, Artificial Sequence
  Synthetic
tctttattgatttttacaccagcacgggtagtcaatctcccaccaccagcccatttcacagtgtacacggttctc

SEQ ID NO: 239435 - DNA, 75 bp, Artificial Sequence
  Synthetic
ctgcatctgtcctaccccgaagttgcatgagaatttttgctgtactctgtgtgctgagtttaataaaagctaaac

SEQ ID NO: 239436 - DNA, 75 bp, Artificial Sequence
  Synthetic
gcctgatgcacctgtgggacctggcggaggccatcgtgcagaacccggacagcaagcctctgacggcgcagctgt

SEQ ID NO: 239437 - DNA, 75 bp, Artificial Sequence
  Synthetic
gaggacttggatgaggatgaggaagaggaggaggatgcacccgctgcggggtactgacgcctccgtgatgtgttt

SEQ ID NO: 239438 - DNA, 75 bp, Artificial Sequence
  Synthetic
agaagcttggcgatggatctcatggtctgatttttgtcacggtcggcgcgctccttggccgcgatgttgagctgg

SEQ ID NO: 239439 - DNA, 75 bp, Artificial Sequence
  Synthetic
ctggggcagaacgacaccgacagtctgagggccaccctgaacttcttgctgaccaatagacagcagaagatcccg

SEQ ID NO: 239440 - DNA, 75 bp, Artificial Sequence
  Synthetic
ccaccccagtcagacccagtggcgagaggcgagcagctgttgacaaaattgaggacttgttgcaggacatgggtg

SEQ ID NO: 239441 - DNA, 75 bp, Artificial Sequence
  Synthetic
tgaccagtgtcgtgctgctctctcttcttgtggtttttagtcagggaattgatgttagtgtacaatggggtctta

SEQ ID NO: 239442 - DNA, 75 bp, Artificial Sequence
  Synthetic
tcggccatgccccaggcctggccctgacaccggctcaggttcttgtagtagtcatgcatgagcctctcaatgtca

SEQ ID NO: 239443 - DNA, 75 bp, Artificial Sequence
  Synthetic
acggcagtgattatgttttagtgggaccaagagatccaccagttcaatggtttgggggtggagattttactatgt

SEQ ID NO: 239444 - DNA, 75 bp, Artificial Sequence
  Synthetic
aacaccagttgaatggcatggtcccagacatcagctttgtaaaggaaaggaaatttttaaccctcaattcaatca

SEQ ID NO: 239445 - DNA, 75 bp, Artificial Sequence
  Synthetic
tgctcggcgcggaagacgatctggcgaaagatggcatgcgagttggaggagatggtgggccgttggaagatgtta

SEQ ID NO: 239446 - DNA, 75 bp, Artificial Sequence
  Synthetic
accaagagatccaccagttcaatggtttgggggtggagattttactatgttctgtaatggaagtaaaactcactt

SEQ ID NO: 239447 - DNA, 75 bp, Artificial Sequence
  Synthetic
agacatcagctttgtaaaggaaaggaaatttttaaccctcaattcaatcacacatgtaatgaacagaaccttaca

SEQ ID NO: 239448 - DNA, 75 bp, Artificial Sequence
  Synthetic
gaacaaaacctgactttactgtcagttggctatggccatagaggtgattactatggttataggcatgataacaca

SEQ ID NO: 239449 - DNA, 75 bp, Artificial Sequence
  Synthetic
aaggagattatcatggattccagaaagacaacatgggaaagactagttacaaggttactgttactgcacctccag

SEQ ID NO: 239450 - DNA, 75 bp, Artificial Sequence
  Synthetic
ttggctatggccatagaggtgattactatggttataggcatgataacacagacagagaacattataaggttataa

SEQ ID NO: 239451 - DNA, 75 bp, Artificial Sequence
  Synthetic
agacaacatgggaaagactagttacaaggttactgttactgcacctccagcttacactagaaaacctttgtcaaa

SEQ ID NO: 239452 - DNA, 75 bp, Artificial Sequence
  Synthetic
aaaacccctttcaaaaataaaatatgttaatgttaccatgggccaaaatctaacactaagcggaccaccaggaac

SEQ ID NO: 239453 - DNA, 75 bp, Artificial Sequence
  Synthetic
ggtcataatgtaacattggttggtcctacaaaaactcctgtacagtggtatggtcctgagcataaactttgtgaa

SEQ ID NO: 239454 - DNA, 75 bp, Artificial Sequence
  Synthetic
gttaatgttaccatgggccaaaatctaacactaagcggaccaccaggaacgccagttacatggcttggtgaggga

SEQ ID NO: 239455 - DNA, 75 bp, Artificial Sequence
  Synthetic
ctacaaaaactcctgtacagtggtatggtcctgagcataaactttgtgaaggaaaaaaggttctgcatccagaag

SEQ ID NO: 239456 - DNA, 75 bp, Artificial Sequence
  Synthetic
ttttctatcgcgaacttaaccacacttgtacagaaaaggaccttatcctattgtttgtaaataggacgcataatg

SEQ ID NO: 239457 - DNA, 75 bp, Artificial Sequence
  Synthetic
cctcacactgttgtttgtcaatcgcacttttgcaggggcatatttgggatttgacaaaggtagtactgatagaca

SEQ ID NO: 239458 - DNA, 75 bp, Artificial Sequence
  Synthetic
ttgtacagaaaaggaccttatcctattgtttgtaaataggacgcataatggtccttatattggttacaacaaaga

SEQ ID NO: 239459 - DNA, 75 bp, Artificial Sequence
  Synthetic
acttttgcaggggcatatttgggatttgacaaaggtagtactgatagacagctctatgaagtaacaattcttgat

SEQ ID NO: 239460 - DNA, 75 bp, Artificial Sequence
  Synthetic
gtgtcagtattagatttaatgccaattgcaggacaaggtttggattcaaaaataaaaaaagaacagaaaagcctt

SEQ ID NO: 239461 - DNA, 75 bp, Artificial Sequence
  Synthetic
cgccgtgctcccagagctcgaaatcggtgcgcttcttcgagagggggttaggcagagcgaaagtgacgtcattga

SEQ ID NO: 239462 - DNA, 75 bp, Artificial Sequence
  Synthetic
aagatgatgctcctcaagaaaagtcaaaacagaaagacaggacaaagagtttagataggaaagcagaaaaacaaa

SEQ ID NO: 239463 - DNA, 75 bp, Artificial Sequence
  Synthetic
ttgcaggacaaggtttggattcaaaaataaaaaaagaacagaaaagccttcctaaaagaaagccaaaagataaag

SEQ ID NO: 239464 - DNA, 75 bp, Artificial Sequence
  Synthetic
aaaacagaaagacaggacaaagagtttagataggaaagcagaaaaacaaaaaacaaaagacgaggttaaagatct

SEQ ID NO: 239465 - DNA, 75 bp, Artificial Sequence
  Synthetic
atctaatcagacactgattggacctcctggacaaaaaattgattggcatgtgagcagtaatgatggacagtttaa

SEQ ID NO: 239466 - DNA, 75 bp, Artificial Sequence
  Synthetic
actcttgtgggtcctcctggtacaaaagttgactggtatacatctaaaaatggagatctaaaaaagttgtgtgat

SEQ ID NO: 239467 - DNA, 75 bp, Artificial Sequence
  Synthetic
cctggacaaaaaattgattggcatgtgagcagtaatgatggacagtttaaaaaactgtgtgaaactaaagatgga

SEQ ID NO: 239468 - DNA, 75 bp, Artificial Sequence
  Synthetic
aagttgactggtatacatctaaaaatggagatctaaaaaagttgtgtgatgggaaaactgggcctaaaaacctat

SEQ ID NO: 239469 - DNA, 75 bp, Artificial Sequence
  Synthetic
taacaattttaaacattagcagatcagatgaagggtcttactatggttccagtaatgacgcttcaacgcactata

SEQ ID NO: 239470 - DNA, 75 bp, Artificial Sequence
  Synthetic
caatgttagcagaaaagatgagggtagctattatggatctaacgatcagtcaaaacactacagagttactgttta

SEQ ID NO: 239471 - DNA, 75 bp, Artificial Sequence
  Synthetic
gtctcgaaggacgataaagtgcaagtcacgcaggtgacagcgttcaccgccgctgtgttggtggaaacatacagc

SEQ ID NO: 239472 - DNA, 75 bp, Artificial Sequence
  Synthetic
aaaattaaaccatatactactaagggaactacaaaaacaaccttaggcaatcacagctttgaactacaattggca

SEQ ID NO: 239473 - DNA, 75 bp, Artificial Sequence
  Synthetic
gaactacaaaaacaaccttaggcaatcacagctttgaactacaattggcagatgacgaatcaaaagatgatcaaa

SEQ ID NO: 239474 - DNA, 75 bp, Artificial Sequence
  Synthetic
ccttccttgctggatcgaaatcaaaatctttatctgctgggtcagacattgttgggaggaaccatgaaggggctc

SEQ ID NO: 239475 - DNA, 75 bp, Artificial Sequence
  Synthetic
tcatgtatgaggatctcgagggtggtaacatccccgccctcctggatgtcaagcaatatttggatagtaaaaaga

SEQ ID NO: 239476 - DNA, 75 bp, Artificial Sequence
  Synthetic
caaaagagtttcaacaaccatgtgcgcacgctgatcgcgcgcgaggaggtggccctgggcctgatgcacctgtgg

SEQ ID NO: 239477 - DNA, 75 bp, Artificial Sequence
  Synthetic
gaaaaattactttttttagcagcagggtgcccactgggtggcccttgcggacatacaaaaattggtccgtgtgat

SEQ ID NO: 239478 - DNA, 75 bp, Artificial Sequence
  Synthetic
gttcagacgggtgctccgggttctggagacactggtttggaactcctctatctcgtctggtgtacacagttaaga

SEQ ID NO: 239479 - DNA, 75 bp, Artificial Sequence
  Synthetic
tgttaatatgacacacaacgggccatattttggttttgacaaatacaatgttgacagagagcagtatgaggtttc

SEQ ID NO: 239480 - DNA, 75 bp, Artificial Sequence
  Synthetic
acgtaagcacgtcaagatcgaccggatcggaaaatttttgaaggaaagcgtctagccaatcgcagtcacaaggta

SEQ ID NO: 239481 - DNA, 75 bp, Artificial Sequence
  Synthetic
ccgaatacagggacgagaacgtagccagaatcttaaggctcatatgaccatgcagactctgctcatactgctatc

SEQ ID NO: 239482 - DNA, 75 bp, Artificial Sequence
  Synthetic
cagtacttagaagagccccctccccgacccccttccactgttagctactttcacataaccggcggcgatgactga

SEQ ID NO: 239483 - DNA, 75 bp, Artificial Sequence
  Synthetic
ctatgatgctaaaatggatatgccttcctattacttggtgattgtgggaatagtcatggtctgctcctgcacttt

SEQ ID NO: 239484 - DNA, 75 bp, Artificial Sequence
  Synthetic
tagtcatggtctgctcctgcactttctttgccattatgatctacccctgttttgatctcggctggaactctgttg

SEQ ID NO: 239485 - DNA, 75 bp, Artificial Sequence
  Synthetic
gggatcaccagtttgggcactggggtctcggggaaggtctcgctccacatgcgccggctcatctgcagggcgccc

SEQ ID NO: 239486 - DNA, 75 bp, Artificial Sequence
  Synthetic
cctcctcaagaccctttgcggacttcgcgacctcctccccatgaactgattgattaaagcccagaaaccaatcaa

SEQ ID NO: 239487 - DNA, 75 bp, Artificial Sequence
  Synthetic
gctgacccaatcgccatcgctaatgggaatgtctcactcaagatgggagggggactcactttgcaagaaggaact

SEQ ID NO: 239488 - DNA, 75 bp, Artificial Sequence
  Synthetic
ggaatgtctcactcaagatgggagggggactcactttgcaagaaggaactggaaatctaacagttaataccgaac

SEQ ID NO: 239489 - DNA, 75 bp, Artificial Sequence
  Synthetic
aataggtattgctttagatgccccatttgatgttataggtggcaagctcacactactagcaggccatggcttatc

SEQ ID NO: 239490 - DNA, 75 bp, Artificial Sequence
  Synthetic
tttgatgttataggtggcaagctcacactactagcaggccatggcttatctattataacagaagaaacatcaccg

SEQ ID NO: 239491 - DNA, 75 bp, Artificial Sequence
  Synthetic
tgctgacgctgtaccgcgaggccataggccaggcgcaggtggacgagcagaccttccaggagatcacgagcgtga

SEQ ID NO: 239492 - DNA, 75 bp, Artificial Sequence
  Synthetic
tggtattaactggaaaaggtcttggaacagatacaacagataatggtggaagtatacgtgttagagttggagagg

SEQ ID NO: 239493 - DNA, 75 bp, Artificial Sequence
  Synthetic
agcccgatagccgccaggatacggtgaagagcctttttgccggccgagtggggtcgctagatttgaaagcggtta

SEQ ID NO: 239494 - DNA, 75 bp, Artificial Sequence
  Synthetic
aacagatacaacagataatggtggaagtatacgtgttagagttggagagggcggtggcttatcatttaatgaggc

SEQ ID NO: 239495 - DNA, 75 bp, Artificial Sequence
  Synthetic
aaggaagatatgcgcaccttatggacaactccagatccatctccaaattgcaagataattgaggataaagactca

SEQ ID NO: 239496 - DNA, 75 bp, Artificial Sequence
  Synthetic
caactccagatccatctccaaattgcaagataattgaggataaagactcaaaactaactttaattctcacaaagt

SEQ ID NO: 239497 - DNA, 75 bp, Artificial Sequence
  Synthetic
actaagtgtggtttatttttgttactaggtccggtgtcagaggatgagtcatcacccttagaagaagaccacccg

SEQ ID NO: 239498 - DNA, 75 bp, Artificial Sequence
  Synthetic
gtctttgttggtagtcaagggaaaattcagtaatataaataataccacaaatccaaatgaagctgataaacaaat

SEQ ID NO: 239499 - DNA, 75 bp, Artificial Sequence
  Synthetic
ttcagtaatataaataataccacaaatccaaatgaagctgataaacaaatcacagttaagttgttgtttgatgca

SEQ ID NO: 239500 - DNA, 75 bp, Artificial Sequence
  Synthetic
cgcccctgcaagtgcgcagacccaccccggttaaaccaagtggcgagaggcgagcggctgttcacaaaattgagg

SEQ ID NO: 239501 - DNA, 75 bp, Artificial Sequence
  Synthetic
ctatggattcttcatattggaattatagaagtgataattccaatttatcccaaccatacaaaaaagcagttggat

SEQ ID NO: 239502 - DNA, 75 bp, Artificial Sequence
  Synthetic
tagaagtgataattccaatttatcccaaccatacaaaaaagcagttggattcatgcctagtaagactgcttatcc

SEQ ID NO: 239503 - DNA, 75 bp, Artificial Sequence
  Synthetic
gcttacaacagcctggctcccaagggcgcccccaactccagtcagtggactgctaaagaaaatcaaaaagatgtt

SEQ ID NO: 239504 - DNA, 75 bp, Artificial Sequence
  Synthetic
gaaataagtcaggcaaaaaataaaattgtaagcaatgtgtatcttggaggtaaaattgatcaaccatgtgttatt

SEQ ID NO: 239505 - DNA, 75 bp, Artificial Sequence
  Synthetic
tgggaggaattaatatatcaaaggatggtttacaaattggcgttgaagaaacagttgacaagcaagaaaaggaaa

SEQ ID NO: 239506 - DNA, 75 bp, Artificial Sequence
  Synthetic
tggtttacaaattggcgttgaagaaacagttgacaagcaagaaaaggaaatttatgctgacaagagtttccagcc

SEQ ID NO: 239507 - DNA, 75 bp, Artificial Sequence
  Synthetic
tgatgatggcaatgggcccgtgggctgcggctttggcaaagacgtttctggggtcagagacatcataattatgct

SEQ ID NO: 239508 - DNA, 75 bp, Artificial Sequence
  Synthetic
tggcaagagtcagaagccttctatggcggcagagctcttaagaaggacaccaagatgaaaccatgctatggttca

SEQ ID NO: 239509 - DNA, 75 bp, Artificial Sequence
  Synthetic
ccctgctcacctgcacctgcgtctgcagcattgtctgcctggtcattaccttcctgcagctcatcgactggtgct

SEQ ID NO: 239510 - DNA, 75 bp, Artificial Sequence
  Synthetic
gcggcagagctcttaagaaggacaccaagatgaaaccatgctatggttcatttgccagacccactaatgaaaagg

SEQ ID NO: 239511 - DNA, 75 bp, Artificial Sequence
  Synthetic
tgctgtcgaaggagaacagcctaaggaacttgatattgactttgctttctttgacactgactcaggtgacacaga

SEQ ID NO: 239512 - DNA, 75 bp, Artificial Sequence
  Synthetic
gaacttgatattgactttgctttctttgacactgactcaggtgacacagaatataaagcagatattgttatgtat

SEQ ID NO: 239513 - DNA, 75 bp, Artificial Sequence
  Synthetic
ttctgattagtgcgggaactggacttggggtctataatccacacagtttcctggcgagccaaacgggggtcggtg

SEQ ID NO: 239514 - DNA, 75 bp, Artificial Sequence
  Synthetic
gcagccgcgtaagcaggagcaggaggaggacttaaccacccacgagcaaccaaaaatcgagcaggacctgggctt

SEQ ID NO: 239515 - DNA, 75 bp, Artificial Sequence
  Synthetic
cagacactcatgttgtttacaaaccaggcaaagaggatgatagctctgaagcaaacttggttcagcagtccatgc

SEQ ID NO: 239516 - DNA, 75 bp, Artificial Sequence
  Synthetic
gcgagcccccttttttctttttgccagatgcatcccgtcctgcgccaaatgcgtcccacccccccggcgaccacc

SEQ ID NO: 239517 - DNA, 75 bp, Artificial Sequence
  Synthetic
tgccgtcgtcccggaggaggggggccacctcgttgagcatgtccctgacttggaggttttcccggacgagctcgc

SEQ ID NO: 239518 - DNA, 75 bp, Artificial Sequence
  Synthetic
tattctattgtgttttactttaaatggtacaaaacttatgaaaatgttcagtttgactcttcatcctttaacttc

SEQ ID NO: 239519 - DNA, 75 bp, Artificial Sequence
  Synthetic
gtttgactcttcatcctttaacttctcctacatcgcccaagaatgaaagaccaataaacgtgtttttcattttga

SEQ ID NO: 239520 - DNA, 75 bp, Artificial Sequence
  Synthetic
ctcgccacctatcacatctttttcaagaaccaaaagatccccgtctcctgccgcgccaaccgcacccgcgccgac

SEQ ID NO: 239521 - DNA, 75 bp, Artificial Sequence
  Synthetic
gaactaattccacatatcaaggtgtaaaaattacagatggaaatggtgctttgcaaaacggatgggcaaaagatg

SEQ ID NO: 239522 - DNA, 75 bp, Artificial Sequence
  Synthetic
ttggaattaatcattcaataaagatcacttacttgaaatctgaaagtatgtctctggtgtagttgttcagcagca

SEQ ID NO: 239523 - DNA, 75 bp, Artificial Sequence
  Synthetic
ctcactcaaggtgggagggggacttactttgcaagaaggaagtctgactgtagaccctaaggctcccttgcaact

SEQ ID NO: 239524 - DNA, 75 bp, Artificial Sequence
  Synthetic
gaacttacattatgataatctgcatgatcacaatcgggcaacagggggtgttgttcagtcagtgaggccctggtc

SEQ ID NO: 239525 - DNA, 75 bp, Artificial Sequence
  Synthetic
aggccgtgagcacgagccggcggcgcgagctgagcgaccgcgagctgatgctgagcctgcgccgggcgctggtag

SEQ ID NO: 239526 - DNA, 75 bp, Artificial Sequence
  Synthetic
ctacttcgacatgggggcggacctgcattggcagccgagccggcgcgccttggaggccgcctacggtccagagga

SEQ ID NO: 239527 - DNA, 75 bp, Artificial Sequence
  Synthetic
cgctcagtcatccaactgaagtacagccattcccgcaggttctcgagcagctcctgtgcatctgatgaaacaaaa

SEQ ID NO: 239528 - DNA, 75 bp, Artificial Sequence
  Synthetic
aaccctttggacaacacctgatccatcgcccaattgtaaagccgaaacagaaaaggactcaaagcttactttggt

SEQ ID NO: 239529 - DNA, 75 bp, Artificial Sequence
  Synthetic
tccatctggtcagaaaagacaatttttttattgtcaagcttggtggcaaaggagccatagagggcgttggagaga

SEQ ID NO: 239530 - DNA, 75 bp, Artificial Sequence
  Synthetic
taaaaacaaaattgtaagcaacttctactttggagggcaggcatatcaacctgggacaataataattaagtttaa

SEQ ID NO: 239531 - DNA, 75 bp, Artificial Sequence
  Synthetic
cgtgtggttaaagagcagcacagttagctcctgtcttctcccggcaaaaatcacatcggactgggttagtatgcc

SEQ ID NO: 239532 - DNA, 75 bp, Artificial Sequence
  Synthetic
ggggcaaggtatatgacaatccatttccatttgataccacctcttttaccttctcttatattgcccaagaaaatg

SEQ ID NO: 239533 - DNA, 75 bp, Artificial Sequence
  Synthetic
ggcgcccaggccgctctcgttccagacgcggctgtagaccacgtccccgtcgacgtcgcgcgcgcgcatgaccac

SEQ ID NO: 239534 - DNA, 75 bp, Artificial Sequence
  Synthetic
acgtgccgcgcgggcaggacgattacaccaactttatcagcgcgctgcggctgatggtgaccgaggtgccccaga

SEQ ID NO: 239535 - DNA, 75 bp, Artificial Sequence
  Synthetic
agcggcagcgtgaaccgcaactcgtacctgggtcacctgctgacgctgtaccgcgaggccataggccaggcgcag

SEQ ID NO: 239536 - DNA, 75 bp, Artificial Sequence
  Synthetic
gccccaaaaccgttaaaattcaaaagctcatttgcatattaacttttgtttactttgtggggtatattattgatg

SEQ ID NO: 239537 - DNA, 75 bp, Artificial Sequence
  Synthetic
gccaccctgaacttcttgctgaccaatagacagcagaagatcccggcgcagtacgcgctgtcggccgaggaggag

SEQ ID NO: 239538 - DNA, 75 bp, Artificial Sequence
  Synthetic
gacatgaccgcgcgcaacatggaacctagcatgtacgccgccaaccggccgtttatcaataagctgatggactac

SEQ ID NO: 239539 - DNA, 75 bp, Artificial Sequence
  Synthetic
tgcctgaccccaacgacgggtttttgtgggacgacgtggacagcgcggtgttctcaccgaccttgcaaaagcgcc

SEQ ID NO: 239540 - DNA, 75 bp, Artificial Sequence
  Synthetic
cacaaagtaaacaaaagttaatatgcaaatgagcttttgaattttaacggtttcggggcggagccaacgctgatt

SEQ ID NO: 239541 - DNA, 75 bp, Artificial Sequence
  Synthetic
cgagggcgcggtgggtcggagcccctttcctagcttagggagtttgcatagcttgccgggctcggtgaacagcgg

SEQ ID NO: 239542 - DNA, 75 bp, Artificial Sequence
  Synthetic
gtctcctcctcacatcgtggtaaacgggccctgcggtagggatgatggcggagcaagctcgactgttcctcggtg

SEQ ID NO: 239543 - DNA, 75 bp, Artificial Sequence
  Synthetic
cttgcccttggaaaagcgcccgcaggcgggacaaaggagggattgcagggcgtacagtttgggcgcaagaaagac

SEQ ID NO: 239544 - DNA, 75 bp, Artificial Sequence
  Synthetic
gatggggcgccgccagccggctgatgcccaactacgtgttgcatccttccattatcccgacgccgggctaccgcg

SEQ ID NO: 239545 - DNA, 75 bp, Artificial Sequence
  Synthetic
ggtgcagccgtgatcccacagggcgcagccggtgcactcccaattcttgtgcgcgatcccgctgtggctgaaaat

SEQ ID NO: 239546 - DNA, 75 bp, Artificial Sequence
  Synthetic
ctggtacgagctacagcaggagtgcagggatgagataggcctgatgcaggataaatatggcctggagcagataaa

SEQ ID NO: 239547 - DNA, 75 bp, Artificial Sequence
  Synthetic
tgaggatctcgaagggggcaacattcccgcacttctgaatgtgaccaagtacctggaaagcaagaagaagctaga

SEQ ID NO: 239548 - DNA, 75 bp, Artificial Sequence
  Synthetic
gctaatggtcctgcaagaggagacagtagtgtctcaagagaggtggaaaaggcagctgaaaaagagcttgtcatt

SEQ ID NO: 239549 - DNA, 75 bp, Artificial Sequence
  Synthetic
gtagtgtctcaagagaggtggaaaaggcagctgaaaaagagcttgtcattgagcccatcaagcaagatgatagca

SEQ ID NO: 239550 - DNA, 75 bp, Artificial Sequence
  Synthetic
cttgaacagctgtgctaagtgtggtttatttttgtttctaggtccggtgtcagaggatgagtcatcaccctcaga

SEQ ID NO: 239551 - DNA, 75 bp, Artificial Sequence
  Synthetic
ttccttcaacagaaccggcggctggctgaatcccactcccacgatcacggcttcttcctggggcatctcttcgtc

SEQ ID NO: 239552 - DNA, 75 bp, Artificial Sequence
  Synthetic
ggccctctcggacatacaaaaatcggtccgtgtggttaaagagcaacacagatagctcctgtcttctcccggcaa

SEQ ID NO: 239553 - DNA, 75 bp, Artificial Sequence
  Synthetic
gaaaaaattgaggacttgttacatgacatgggtggggatgaacctttggacctgagcttgaaacgccccaggaac

SEQ ID NO: 239554 - DNA, 75 bp, Artificial Sequence
  Synthetic
cccctccggtggcgaccgccgtgcgccgcgtccccgcccgccgccaggcccagaactggcagagcacgctgcaca

SEQ ID NO: 239555 - DNA, 75 bp, Artificial Sequence
  Synthetic
ggtgcgcttctttgagagggggttaggcagagcgaaagtgacgtcattgaagagaatcttgcctgctcgtggcat

SEQ ID NO: 239556 - DNA, 75 bp, Artificial Sequence
  Synthetic
gtaaacaaaagttaatatgcaaatgagcttttgaatttagggcgtggccaacgctgattggctgtttctgcgacc

SEQ ID NO: 239557 - DNA, 75 bp, Artificial Sequence
  Synthetic
tcaacggtcggcgcggaggcgtggcctaggccggaagcaagtcgcgtggctgatgacgtataaaaaagcggactt

SEQ ID NO: 239558 - DNA, 75 bp, Artificial Sequence
  Synthetic
cccagcttcaaaccctactcgggcacggcttacaacagcctggcccccaagggcgcccccaactccagtcagtgg

SEQ ID NO: 239559 - DNA, 75 bp, Artificial Sequence
  Synthetic
tcatgccccacatcgaggccctcgatgagacccaagagcagcgccccgaggacgcccggcccgtggtcagcgacg

SEQ ID NO: 239560 - DNA, 75 bp, Artificial Sequence
  Synthetic
tcacacatttggtgtggctgctatgggaggaacaaatattacaaaccagggtttgttaattggaactgaagaaac

SEQ ID NO: 239561 - DNA, 75 bp, Artificial Sequence
  Synthetic
gccactcttgagtgccagcgagtagagatttctctgagctccgctcccagagtctgagaaaaaatgagacacctg

SEQ ID NO: 239562 - DNA, 75 bp, Artificial Sequence
  Synthetic
cggcgcaagctcatgctggccgtggtcctggtcaccctcgagctcgaatgcatgcgccgcttcttcagcgacccc

SEQ ID NO: 239563 - DNA, 75 bp, Artificial Sequence
  Synthetic
ggaggaacaaatattacaaaccagggtttgttaattggaactgaagaaacagccgataatcctccaaaggaaatc

SEQ ID NO: 239564 - DNA, 75 bp, Artificial Sequence
  Synthetic
agatttctctgagctccgctcccagagtctgagaaaaaatgagacacctgcgcctcctgcctggaactgtgccta

SEQ ID NO: 239565 - DNA, 75 bp, Artificial Sequence
  Synthetic
aacctcaagtaggagaggaaaactggcaagacaccaatgcattttatggaggcagggctcttaagaaggaaacta

SEQ ID NO: 239566 - DNA, 75 bp, Artificial Sequence
  Synthetic
ggagatgctccaggtcgtcgccccggagatttacggaccaccccaggcggaccagaaaccccgcaaaatcaagcg

SEQ ID NO: 239567 - DNA, 75 bp, Artificial Sequence
  Synthetic
gcaagacaccaatgcattttatggaggcagggctcttaagaaggaaactaaaatgaaaccatgctatggatctta

SEQ ID NO: 239568 - DNA, 75 bp, Artificial Sequence
  Synthetic
ggacaggctaagcttaaaactggtgacaatatcgatcctaccaaggatttcgacatagatcttgctttcttcgat

SEQ ID NO: 239569 - DNA, 75 bp, Artificial Sequence
  Synthetic
gctcaatctcctcctcctggagatcgccgcgacccgcgcgctcgacggtggcggcaaggtcatttgagatgcgac

SEQ ID NO: 239570 - DNA, 75 bp, Artificial Sequence
  Synthetic
acaatatcgatcctaccaaggatttcgacatagatcttgctttcttcgatactcctggcggaaatcctccagcag

SEQ ID NO: 239571 - DNA, 75 bp, Artificial Sequence
  Synthetic
gttcaatggagagaagtttaatggggtgctgttcatggccaacagccacatgaccctgcatggctgcagtttctt

SEQ ID NO: 239572 - DNA, 75 bp, Artificial Sequence
  Synthetic
tctagaagggggcaacatccccgctctgcttgatgtggaagcatacctcaacagcaagaatgataaggaggaggc

SEQ ID NO: 239573 - DNA, 75 bp, Artificial Sequence
  Synthetic
ttccatagcctcgtaaaagtccacggcgaagttaaaaaactgggcgttgcgggccgataccgtgagctcgtcttc

SEQ ID NO: 239574 - DNA, 75 bp, Artificial Sequence
  Synthetic
gatcaagtgccatatgcacctgggagccagaaggggcaccttccagccgtaccagtgcaactttagccagaccaa

SEQ ID NO: 239575 - DNA, 75 bp, Artificial Sequence
  Synthetic
caagggtaacatctttgccatggagatcaacctccaggccaacctgtggaagagttttctgtactcgaacgtggc

SEQ ID NO: 239576 - DNA, 75 bp, Artificial Sequence
  Synthetic
gcaggtagacgagccgccctcgtacgaggaggccctcaaggccggcatgcccaccacacgcatcattgcgccaat

SEQ ID NO: 239577 - DNA, 75 bp, Artificial Sequence
  Synthetic
gcatcgatggtgaagatgcccggacagagttccttgtcaaaataatcaatttttgaggatgcatcatccaaggcc

SEQ ID NO: 239578 - DNA, 75 bp, Artificial Sequence
  Synthetic
ccgtctcgacccaagcccgatagccgccaggatacggtgaagagccttttttgccggccgaaaggggtcgctaaa

SEQ ID NO: 239579 - DNA, 75 bp, Artificial Sequence
  Synthetic
gccaggatacggtgaagagccttttttgccggccgaaaggggtcgctaaatttgaaagcggtcaaaaaccccgct

SEQ ID NO: 239580 - DNA, 75 bp, Artificial Sequence
  Synthetic
tttttgctgtactctttgtggtgagtttaataaaagctgaactaagaacctactttggaatcccttgtcgtcatc

SEQ ID NO: 239581 - DNA, 75 bp, Artificial Sequence
  Synthetic
caaccagaccaaggttcgtctgaactgcacaaccaacaggaagtaccttctctggacttttcaagacacctcact

SEQ ID NO: 239582 - DNA, 75 bp, Artificial Sequence
  Synthetic
gccggcatgcccaccacacgcatcattgcgccaatggccacgggtgtcatgaaacccgccacccttgacctgcct

SEQ ID NO: 239583 - DNA, 75 bp, Artificial Sequence
  Synthetic
tgctaatcaaatgcaaactcacacgtttggagttgctgccatgggtggcattgaaattacagctaagggtcttca

SEQ ID NO: 239584 - DNA, 75 bp, Artificial Sequence
  Synthetic
gaggaaccatgaaggggctcttgctgattatcctttccctggtggggggtgtactgtcatgccacgaacagccac

SEQ ID NO: 239585 - DNA, 75 bp, Artificial Sequence
  Synthetic
tttggagttgctgccatgggtggcattgaaattacagctaagggtcttcaaattggcattgatgcaaccaaagag

SEQ ID NO: 239586 - DNA, 75 bp, Artificial Sequence
  Synthetic
ccgacaaaacattccagccagagcctcaaataggagaagaaaactggcaggatagtgataattactatggaggca

SEQ ID NO: 239587 - DNA, 75 bp, Artificial Sequence
  Synthetic
tcaaataggagaagaaaactggcaggatagtgataattactatggaggcagagccatcaagaaagaaaccaagat

SEQ ID NO: 239588 - DNA, 75 bp, Artificial Sequence
  Synthetic
agacctaccaatgaaaaaggcggccaggctaaattcaaaacacctgaaaaagaaggtgaagaacccaaagaactt

SEQ ID NO: 239589 - DNA, 75 bp, Artificial Sequence
  Synthetic
aggctaaattcaaaacacctgaaaaagaaggtgaagaacccaaagaacttgacatagatttgaatttctttgata

SEQ ID NO: 239590 - DNA, 75 bp, Artificial Sequence
  Synthetic
tggaacaaatgttaatttcaaaccagacatgataatgtatgcagaaaatgtgaacttggaaaccccagacactca

SEQ ID NO: 239591 - DNA, 75 bp, Artificial Sequence
  Synthetic
aactgaaacacgcacatttggtgtggccgctatgggtggaatacttattgataaaaatggtcttcagattggaac

SEQ ID NO: 239592 - DNA, 75 bp, Artificial Sequence
  Synthetic
gatgcaagttctgaatctaacctcacacaacagtccatgcccaacagacccaactacattggatttagggacaac

SEQ ID NO: 239593 - DNA, 75 bp, Artificial Sequence
  Synthetic
gccgctatgggtggaatacttattgataaaaatggtcttcagattggaacagatgaaactaaacccaataacaag

SEQ ID NO: 239594 - DNA, 75 bp, Artificial Sequence
  Synthetic
acttgaaatttgttatggttgtaatggtacactaataggaccacataaaactccagttgagtggtatgacggcag

SEQ ID NO: 239595 - DNA, 75 bp, Artificial Sequence
  Synthetic
agccagaacctcaaataggtgaagaaaactggcaagatggagatgttttctatggaggcaggactattaaaaagg

SEQ ID NO: 239596 - DNA, 75 bp, Artificial Sequence
  Synthetic
aaactggcaagatggagatgttttctatggaggcaggactattaaaaaggaaaccaaaatgaagccatgctatgg

SEQ ID NO: 239597 - DNA, 75 bp, Artificial Sequence
  Synthetic
ggtacactaataggaccacataaaactccagttgagtggtatgacggcagaggacacaaactttgtgcaggatct

SEQ ID NO: 239598 - DNA, 75 bp, Artificial Sequence
  Synthetic
acacatgtgatttacaaaatatgacacttacatttgttaacttaactcataagggtacttactatggttttggca

SEQ ID NO: 239599 - DNA, 75 bp, Artificial Sequence
  Synthetic
aagggaggtcaggcaaaatttaaaactaatgccgaaggtcagcccacagaggagttagacattgacctgaacttc

SEQ ID NO: 239600 - DNA, 75 bp, Artificial Sequence
  Synthetic
aagggtacttactatggttttggcagtgataacaaaaactctaaagtataccaggttactattaagccacctgtt

SEQ ID NO: 239601 - DNA, 75 bp, Artificial Sequence
  Synthetic
ctgacaactcgcaggcctttattaaaacctgaagatattgtaatcactaagggaagcaacaaaactcttgtgggt

SEQ ID NO: 239602 - DNA, 75 bp, Artificial Sequence
  Synthetic
agtgtaccaaggtgtaaaagttaaaactactaacaatacagaatgggaaaaagacactgcagtatctgaacacaa

SEQ ID NO: 239603 - DNA, 75 bp, Artificial Sequence
  Synthetic
gggaagcaacaaaactcttgtgggtcctccagatacaccagttgactggtatgatggttcaggacataaattgtg

SEQ ID NO: 239604 - DNA, 75 bp, Artificial Sequence
  Synthetic
ggcccttggcgcggagcttgcccttggaagagcgcccgcaggcgggacagaggagggattgcagggcgtagagct

SEQ ID NO: 239605 - DNA, 75 bp, Artificial Sequence
  Synthetic
gaactcaatcacacctgtgatgagcagaaccttacactcatatttgtaaatgccacttttaagggaacctattat

SEQ ID NO: 239606 - DNA, 75 bp, Artificial Sequence
  Synthetic
cgcgcggaatcagaatatccccttcctcactcccccctttgtctcctccgatggattccaaaacttcccccctgg

SEQ ID NO: 239607 - DNA, 75 bp, Artificial Sequence
  Synthetic
agaaccttacactcatatttgtaaatgccacttttaagggaacctattatggctttagaaaagatggcacagaca

SEQ ID NO: 239608 - DNA, 75 bp, Artificial Sequence
  Synthetic
tgaggatctagtagggggcaacatccccgccctcctgaatgtcaaggagtatctgaaggataaggaagaagctgg

SEQ ID NO: 239609 - DNA, 75 bp, Artificial Sequence
  Synthetic
tgatttatatgcaaaacaactaaaacaggaaaaagatgaaaaaccaaggtctggccatgataagcagaaatcaaa

SEQ ID NO: 239610 - DNA, 75 bp, Artificial Sequence
  Synthetic
acagaagaaaggcatgggcatagagatgttgttaaagaagttagctttagaactggaactaatcaaactctagtg

SEQ ID NO: 239611 - DNA, 75 bp, Artificial Sequence
  Synthetic
ggcactggcaccaattctacataccaaggggttaaagaaacagctgctcagaatggatgggaaaaagatccaaat

SEQ ID NO: 239612 - DNA, 75 bp, Artificial Sequence
  Synthetic
aactggaactaatcaaactctagtgggcccaccagggtctaaggttgattggcttaaagttggaaatggtgggac

SEQ ID NO: 239613 - DNA, 75 bp, Artificial Sequence
  Synthetic
gtggttacactcgcagtgcacgggcatcagcatcatccccgcgccgcgctgcatattcgggtagagggccttgac

SEQ ID NO: 239614 - DNA, 75 bp, Artificial Sequence
  Synthetic
atttagcgaactttgtaaaagcgataataaacactattcttgtaattctcaaaacttaacaataatcaatgttac

SEQ ID NO: 239615 - DNA, 75 bp, Artificial Sequence
  Synthetic
cacgccggccaacgtcactctgcccaccaacaccaacacctacgagtacatgaacggccgcgtggtggccccctc

SEQ ID NO: 239616 - DNA, 75 bp, Artificial Sequence
  Synthetic
gctgtgcccttccagcacaacaactcgggcttcaccggctacctcgcacctaccttgcgccagggacagccctac

SEQ ID NO: 239617 - DNA, 75 bp, Artificial Sequence
  Synthetic
caaaaaaaactacaaaaagcagcactaatgaaacagatgaaaactttgctttgcaacagggtaacaatggggaaa

SEQ ID NO: 239618 - DNA, 75 bp, Artificial Sequence
  Synthetic
atcaatatgatgaaactaatattccttcaactactgtggcaatcgtggtgggagtgattgcgggcttcataacta

SEQ ID NO: 239619 - DNA, 75 bp, Artificial Sequence
  Synthetic
tacccagaaaaagtttctctgcgacagggtcatgtggcgcatccccttctccagcaacttcatgtctatgggcgc

SEQ ID NO: 239620 - DNA, 75 bp, Artificial Sequence
  Synthetic
tacacgggcgagtacgacatgcccgaccccaacgatgggtttttgtgggacgatgtggacagcgcggtgttttcc

SEQ ID NO: 239621 - DNA, 75 bp, Artificial Sequence
  Synthetic
tcagcttctcttactgagactcagtcactttcatttcagaaccatgaaggctttcacagcttgcgttctgattag

SEQ ID NO: 239622 - DNA, 75 bp, Artificial Sequence
  Synthetic
ctttcacagcttgcgttctgattagcctagtcacacttagtttagccaaaattaatcaaatcagtgtcaaaagag

SEQ ID NO: 239623 - DNA, 75 bp, Artificial Sequence
  Synthetic
ttatccaaatactacatggacaagatatcaccttacaaaatgggataatatttgcaaatggaatatttcaacata

SEQ ID NO: 239624 - DNA, 75 bp, Artificial Sequence
  Synthetic
tatcaccttacaaaatgggataatatttgcaaatggaatatttcaacatataaatgtcataataatggaagcatt

SEQ ID NO: 239625 - DNA, 75 bp, Artificial Sequence
  Synthetic
gtccgcatcgatggtgaagatgcccggacagagttccttgtcaaaataatctatttttgaggatgcatcatccaa

SEQ ID NO: 239626 - DNA, 75 bp, Artificial Sequence
  Synthetic
ctggattatacaagggagatagctataaaagagaagtgattacatcaatgtctagatttggaaatatgacagaca

SEQ ID NO: 239627 - DNA, 75 bp, Artificial Sequence
  Synthetic
cttcaacagaaccggaggctggctgaatcccactcccacgatcacggcttcttcctggggcatctcttcgtcggg

SEQ ID NO: 239628 - DNA, 75 bp, Artificial Sequence
  Synthetic
actacacatcaaaccaccgcagtcagtacaactattgaaaccactactcacactacacagctagacactacagtg

SEQ ID NO: 239629 - DNA, 75 bp, Artificial Sequence
  Synthetic
ccggctacctcgcacccaccatgcgccaggggcagccctaccccgccaacttcccctacccgctcatcggccaga

SEQ ID NO: 239630 - DNA, 75 bp, Artificial Sequence
  Synthetic
caacgccatcctgaacccgcactggctcccgccgccggggttctacacgggcgagtacgacatgcccgaccccaa

SEQ ID NO: 239631 - DNA, 75 bp, Artificial Sequence
  Synthetic
gaccgtggacattcagatccccaccgacatggatgtcgacaaaaaaccctcgaccagcatcgaggtgcagaccga

SEQ ID NO: 239632 - DNA, 75 bp, Artificial Sequence
  Synthetic
ggctggctgaatcccactcccacgatcacggcttcttcctggggcatctcttcgtcggggtctaccttggtcaca

SEQ ID NO: 239633 - DNA, 75 bp, Artificial Sequence
  Synthetic
gtcatcaccttcctgcagctcatcgactggtgctgcgcgcgctacaattacctacaccacagtcccgaatacagg

SEQ ID NO: 239634 - DNA, 75 bp, Artificial Sequence
  Synthetic
ctgcgtctgcagcattgtctgcctggtcatcaccttcctgcagctcatcgactggtgctgcgcgcgctacaatta

SEQ ID NO: 239635 - DNA, 75 bp, Artificial Sequence
  Synthetic
ggctcatctgaccatgcagactctgctcatactgctatccctcctataccctgcccttgctgatgattactctaa

SEQ ID NO: 239636 - DNA, 75 bp, Artificial Sequence
  Synthetic
ctcgccggcgacaagctggcctgcgccatcgtcaacacggccggccgcgagaccggaggcgtgcactggctcgcc

SEQ ID NO: 239637 - DNA, 75 bp, Artificial Sequence
  Synthetic
agctggcggcccaggaagggcacgctgtggggcttgtggttacactcgcagtgcacgggcattagcatcattccc

SEQ ID NO: 239638 - DNA, 75 bp, Artificial Sequence
  Synthetic
ggccatcttttctggggtgacgcagtagaaggtgagggggtcccgctcccagcgatcccagcgtaagcgcacggc

SEQ ID NO: 239639 - DNA, 75 bp, Artificial Sequence
  Synthetic
ccgcagaaatcagtttcccatgattcagtacttagaagagccccctcccggcccccttccactgttagctacttt

SEQ ID NO: 239640 - DNA, 75 bp, Artificial Sequence
  Synthetic
gtagcgttccatgagcacgtttatggtatccatgcccttctcccaggacgaaaccaaaggcagactcagggggtt

SEQ ID NO: 239641 - DNA, 75 bp, Artificial Sequence
  Synthetic
atgtttggtctttctgggctgcttcttttttggagggctgtccactggaaccacgtcctcctcggaagacccgga

SEQ ID NO: 239642 - DNA, 75 bp, Artificial Sequence
  Synthetic
ggcctacaacagcctggctcccaagggcgcccccaactccagtcagtggcttgcaaaagataccaatgctgctgg

SEQ ID NO: 239643 - DNA, 75 bp, Artificial Sequence
  Synthetic
ccctgtgttgatggtgtaggtgcagttggccatgagcgaccagttaacggtctgcaggccgggctgcacgacctc

SEQ ID NO: 239644 - DNA, 75 bp, Artificial Sequence
  Synthetic
tgttgtggaaaaagagtctggaaagctaagtgttgaccctaagactcccttgcaagttgcaagtgacaacaaatt

SEQ ID NO: 239645 - DNA, 75 bp, Artificial Sequence
  Synthetic
ctaagtgttgaccctaagactcccttgcaagttgcaagtgacaacaaattggagctttcttataatgctccattt

SEQ ID NO: 239646 - DNA, 75 bp, Artificial Sequence
  Synthetic
aattaaatggaaaagatgaacttaaggcagacattgtcatgtacactgaaaatgtcaacctggaaacacctgaca

SEQ ID NO: 239647 - DNA, 75 bp, Artificial Sequence
  Synthetic
ttgatgtaggccacggattaaaagttataggcaatgaagtatcaagcttgcctggattaataaataagcttgttg

SEQ ID NO: 239648 - DNA, 75 bp, Artificial Sequence
  Synthetic
tataggcaatgaagtatcaagcttgcctggattaataaataagcttgttgttttaactgggaagggaattggcac

SEQ ID NO: 239649 - DNA, 75 bp, Artificial Sequence
  Synthetic
gacccaactacattggcttcagggacaactttgtagggcttatgtattacaacagcactggcaacatgggtgtgc

SEQ ID NO: 239650 - DNA, 75 bp, Artificial Sequence
  Synthetic
gataaaataataggagttggaattaatgtaagagcaagaggaggattgtcatttgacaatgatggctacttagta

SEQ ID NO: 239651 - DNA, 75 bp, Artificial Sequence
  Synthetic
acgcaaacgggttaggccgcgcgtgtaccccggttcgagtcccctcgaatcaggctggagccgcgactaacgtgg

SEQ ID NO: 239652 - DNA, 75 bp, Artificial Sequence
  Synthetic
atgtaagagcaagaggaggattgtcatttgacaatgatggctacttagtagcttggaatccaaagtatgatacac

SEQ ID NO: 239653 - DNA, 75 bp, Artificial Sequence
  Synthetic
atctcctaattgcaagatgcttacaaaaaaggactcaaagcttacactcacacttacaaagtgcggaagtcaaat

SEQ ID NO: 239654 - DNA, 75 bp, Artificial Sequence
  Synthetic
aaaaaggactcaaagcttacactcacacttacaaagtgcggaagtcaaattttaggaaacgtatctttacttgct

SEQ ID NO: 239655 - DNA, 75 bp, Artificial Sequence
  Synthetic
cagatactttagcatgtggaactctgcggtggacagctatgatccagatgtcaggatcattgagaatcatggtgt

SEQ ID NO: 239656 - DNA, 75 bp, Artificial Sequence
  Synthetic
caaaggacgaaacaggagttaagataattttactatttgacagaaatggagttcttatgcaggaatcatcactcg

SEQ ID NO: 239657 - DNA, 75 bp, Artificial Sequence
  Synthetic
aattttactatttgacagaaatggagttcttatgcaggaatcatcactcgataaagaatattggaactatagaaa

SEQ ID NO: 239658 - DNA, 75 bp, Artificial Sequence
  Synthetic
ccggtcatctcccggtaatggggcgggtccccgttgggcagcgatagggcgctgacgatgcatcttatcaattgc

SEQ ID NO: 239659 - DNA, 75 bp, Artificial Sequence
  Synthetic
tatgaaaatgcagtggggtttatgccaaacttagtggcatatcctaaaccgacaagtgcagatgcaaaaaactat

SEQ ID NO: 239660 - DNA, 75 bp, Artificial Sequence
  Synthetic
caaacttagtggcatatcctaaaccgacaagtgcagatgcaaaaaactattcaagaagcaagataataagtaatg

SEQ ID NO: 239661 - DNA, 75 bp, Artificial Sequence
  Synthetic
accagtaattataattgccagttttaatcaggaaaccactaatggttgtgtctattctatttcatttgatttcac

SEQ ID NO: 239662 - DNA, 75 bp, Artificial Sequence
  Synthetic
aatcaggaaaccactaatggttgtgtctattctatttcatttgatttcacctgttcaaaggattacactggccaa

SEQ ID NO: 239663 - DNA, 75 bp, Artificial Sequence
  Synthetic
ggaggaggcctgaggatcgcggcgaacgagccctcgaccaccagggagctgaggaaccggatcttccccactctt

SEQ ID NO: 239664 - DNA, 75 bp, Artificial Sequence
  Synthetic
tctcctatatcgcccaagaatgaaagaccaataaacgtgtttttcatttgaaaattttcatgtatctttattgat

SEQ ID NO: 239665 - DNA, 75 bp, Artificial Sequence
  Synthetic
tcacagtaagtgcagcacataatcaccatgttattcagcagcccataattcagggtgctccagccaaagctcatg

SEQ ID NO: 239666 - DNA, 75 bp, Artificial Sequence
  Synthetic
ccaactcggcccacgcgctcgacatgacctttgaggtggaccccatggatgagcccaccctcctctatcttctct

SEQ ID NO: 239667 - DNA, 75 bp, Artificial Sequence
  Synthetic
tttttgctgtactctttgtggtgagtttaataaaagctgaaataagactctactctgggatcaagtgtcgtcata

SEQ ID NO: 239668 - DNA, 75 bp, Artificial Sequence
  Synthetic
ctggctcccaagggcgcccccaactccagtcagtgggaacagaaaaaggccaatgggggagctgatgaaatggaa

SEQ ID NO: 239669 - DNA, 75 bp, Artificial Sequence
  Synthetic
tccttctcctgtctttccgctgctgacgctcagtcatccaactgaagtacagccattcccgcaggttctcgagca

SEQ ID NO: 239670 - DNA, 75 bp, Artificial Sequence
  Synthetic
tcaccagtggactagccttctctgttaaaagggcaaagctaattcttcatcgccctattgtagaaggaacttacc

SEQ ID NO: 239671 - DNA, 75 bp, Artificial Sequence
  Synthetic
tgggaggaaaaaatattacagacaagggtttgcaaattggaacagatgaaaccaaagaggatgatgaagatgaga

SEQ ID NO: 239672 - DNA, 75 bp, Artificial Sequence
  Synthetic
gcgcccccaatcccagtcagtgggaacaggcaaaaacaggagctggtgtagaccaaaatcaaaaagaaactcgca

SEQ ID NO: 239673 - DNA, 75 bp, Artificial Sequence
  Synthetic
agaacctcaagttggagaagaaaactggaaagaaacatttgtttattatggaggaagagccattaagaaagacac

SEQ ID NO: 239674 - DNA, 75 bp, Artificial Sequence
  Synthetic
cattttccatttggtgaacgtcaccagcagcagcaacagctcagaaactaacctctcttctcgtactaacagacc

SEQ ID NO: 239675 - DNA, 75 bp, Artificial Sequence
  Synthetic
gggtttgcaaattggaacagatgaaaccaaagaggatgatgaagatgagatatatgctgacaaaacttttcaacc

SEQ ID NO: 239676 - DNA, 75 bp, Artificial Sequence
  Synthetic
tatgccagacctactaatgaaaagggcggacaggctaaatttttaaatggagaaaatggtcaaccatctaaagaa

SEQ ID NO: 239677 - DNA, 75 bp, Artificial Sequence
  Synthetic
ttccaagcggtctcgaaggacgataaagtgcaagtcacgcaggtgacagcgttccccgccgctgtgctggtggaa

SEQ ID NO: 239678 - DNA, 75 bp, Artificial Sequence
  Synthetic
gcggacaggctaaatttttaaatggagaaaatggtcaaccatctaaagaacaagacataacaatggctttctttg

SEQ ID NO: 239679 - DNA, 75 bp, Artificial Sequence
  Synthetic
tgaagaacatccatgtgacctcccacccccggaagaagtggccagtgtttgagaataacctactgatcaagtgcc

SEQ ID NO: 239680 - DNA, 75 bp, Artificial Sequence
  Synthetic
taataaaaatcaagcagacgtggttatgtatgccgaaaatattaatcttgaaactccagacactcatgtggtgta

SEQ ID NO: 239681 - DNA, 75 bp, Artificial Sequence
  Synthetic
atgtatgccgaaaatattaatcttgaaactccagacactcatgtggtgtataagccaggcaaggaagatgcaagc

SEQ ID NO: 239682 - DNA, 75 bp, Artificial Sequence
  Synthetic
tccagcacaagaaaaagcagctgatcagaaggtagaggtattgcccattgagaaagatgagagtggcagaagtta

SEQ ID NO: 239683 - DNA, 75 bp, Artificial Sequence
  Synthetic
ccatggccaacagacccaactacatcggcttcagggacaactttgtggggctgatgtactacaacagcactggta

SEQ ID NO: 239684 - DNA, 75 bp, Artificial Sequence
  Synthetic
agctgtaaaaagtcactcaagtcctcggccactacagatgccaattcagagccagggctaagcgtgggactggca

SEQ ID NO: 239685 - DNA, 75 bp, Artificial Sequence
  Synthetic
gccgtataccatacctactactcctgaaaataatcacaaatttgaattgcaaattgattctaatcaagacaatga

SEQ ID NO: 239686 - DNA, 75 bp, Artificial Sequence
  Synthetic
gatgtggcagcagtactgcttttcagggagttaaagtaacgaatccggctaccagtacgaataataacacacaat

SEQ ID NO: 239687 - DNA, 75 bp, Artificial Sequence
  Synthetic
gtgctacatctgctgccgcaagcgtcccaggtcatacaatcacatggtagacccactgctcagcttctcttacta

SEQ ID NO: 239688 - DNA, 75 bp, Artificial Sequence
  Synthetic
ttaacgacgagttggtaagctctgcaatcggtctgcgacctgatggagtgtttcaactagccggagccgggaaat

SEQ ID NO: 239689 - DNA, 75 bp, Artificial Sequence
  Synthetic
aaactcagtcactctcatttcagaaccatgaaggctttcacagcttgcgttctgattagcctagtcacacttagt

SEQ ID NO: 239690 - DNA, 75 bp, Artificial Sequence
  Synthetic
caaaatcaagcgggttaaaaaaaaggatgaggtggacgagggggcagtagagtttgtgcgcgagtttgctccgcg

SEQ ID NO: 239691 - DNA, 75 bp, Artificial Sequence
  Synthetic
gagcctcaagtaggagaagaaaactggcaggaaacagaagccttctatggaggaagggctcttaaaaaggaaacc

SEQ ID NO: 239692 - DNA, 75 bp, Artificial Sequence
  Synthetic
acaaggtaataaagggaaaactactactgctcaaagtggtggtaaaaaaaccaaaacagaacatagaaaccagag

SEQ ID NO: 239693 - DNA, 75 bp, Artificial Sequence
  Synthetic
gtgaactttacctgcaaactccacaagaagtacctcatctggtttttcaacaacactactcttgcagtagttaac

SEQ ID NO: 239694 - DNA, 75 bp, Artificial Sequence
  Synthetic
catgggtgtgctggccggtcaggcttctcagttgaatgctgtggtcgacttgcaagacagaaacacagagctgtc

SEQ ID NO: 239695 - DNA, 75 bp, Artificial Sequence
  Synthetic
ctccgcccacaatcgggtataaaaaccctggtgatccgaggcagaggcacacagcttaacgacgagttggtgagc

SEQ ID NO: 239696 - DNA, 75 bp, Artificial Sequence
  Synthetic
tgatcccgatgtcaggatcattgagaatcacggtgtggaagatgaacttcccaactattgcttcccattggatgg

SEQ ID NO: 239697 - DNA, 75 bp, Artificial Sequence
  Synthetic
caacctgtggaagagttttctgtactcgaacgtggcgctgtacctgcccgactcctacaagtacacgccggccaa

SEQ ID NO: 239698 - DNA, 75 bp, Artificial Sequence
  Synthetic
tgctgatgatgtaattgaagtaggtcgttttgaggcggcggatggtggcgaggaggaccaggtccttgggtcccg

SEQ ID NO: 239699 - DNA, 75 bp, Artificial Sequence
  Synthetic
tcatcatacacatgtcatagcaatggaagccttagtatttttgctttcaacattagttcaggtaaatataaagtt

SEQ ID NO: 239700 - DNA, 75 bp, Artificial Sequence
  Synthetic
gaagccttagtatttttgctttcaacattagttcaggtaaatataaagttcaaagttacactaacagttataatg

SEQ ID NO: 239701 - DNA, 75 bp, Artificial Sequence
  Synthetic
agttaagatgtttaatctaacagtaattgagattccatccactagagtacccaccacagttaggacaactatgga

SEQ ID NO: 239702 - DNA, 75 bp, Artificial Sequence
  Synthetic
cgtcaatggggatgtctcccttaaggttggagggggacttgccttgcaagaaggaagtggaaagctgacagtcaa

SEQ ID NO: 239703 - DNA, 75 bp, Artificial Sequence
  Synthetic
cccgactccgccgcctgcggactcttttgttgcatgttcttgcatgcctttgtgcactggcccgatcgacccatg

SEQ ID NO: 239704 - DNA, 75 bp, Artificial Sequence
  Synthetic
cgactggtgctgtgcgcgctacaattacctacaccacagtcccgaatacagggaccagagcgtagccagaatatt

SEQ ID NO: 239705 - DNA, 75 bp, Artificial Sequence
  Synthetic
ggacacaactgttaaagagttcagtattaagttactgtttgataaaaatggagtacttttacctgaatctaattt

SEQ ID NO: 239706 - DNA, 75 bp, Artificial Sequence
  Synthetic
tgctcatactgctatccctcctatcccctgccctcgcttctaaagactattctcaatgtaaatttgcagacatat

SEQ ID NO: 239707 - DNA, 75 bp, Artificial Sequence
  Synthetic
ttcaagaacgagggcctgggctcgctggtggcgctgaacgccttcctggcgacgcagccggcgaacgtgccgcgc

SEQ ID NO: 239708 - DNA, 75 bp, Artificial Sequence
  Synthetic
tcgttacagaataaaagtaaatactacaaatcacaaaactgttaaaattaagccacataccaaaaaaccttctgc

SEQ ID NO: 239709 - DNA, 75 bp, Artificial Sequence
  Synthetic
caggagataaaaaaagtagtggtaaaaataaaattgttagtaatgtgtattttggaggcgaggtttatcagccag

SEQ ID NO: 239710 - DNA, 75 bp, Artificial Sequence
  Synthetic
aaatctttttctcttcgcagaaccatgaatactttgaccagtgtcgtgctgctctctcttcttgtagctcttagt

SEQ ID NO: 239711 - DNA, 75 bp, Artificial Sequence
  Synthetic
ccagagctcgcgggccataagggtctggagctcgtcgcgaaagaggcggaactgctggcccacggccatcttttc

SEQ ID NO: 239712 - DNA, 75 bp, Artificial Sequence
  Synthetic
gcggcgtcatcgaggccgtctacctgcgcacgcccttctccgccggcaacgccaccacctaagcatgagcggctc

SEQ ID NO: 239713 - DNA, 75 bp, Artificial Sequence
  Synthetic
ctcgggcacggcctacaacagtctggctcccaagggcgcccccaatcccagtcagtggattgcaaaagaaaagca

SEQ ID NO: 239714 - DNA, 75 bp, Artificial Sequence
  Synthetic
aagtttttgctgacaaaacattccagcctgagcctcaggtcggagaggaaaactggcatgaaacttttaatttct

SEQ ID NO: 239715 - DNA, 75 bp, Artificial Sequence
  Synthetic
gcgttctcattagcatagtcacacttagtctctctcaaatgattaatgtaaatgttaccagaggaagtagtatta

SEQ ID NO: 239716 - DNA, 75 bp, Artificial Sequence
  Synthetic
atacatgggttataatagacagagtactcataaggaagactataaagttatagttataccgcctcgtcctgttac

SEQ ID NO: 239717 - DNA, 75 bp, Artificial Sequence
  Synthetic
atggaggcaggactctcaaaaaagaaactaaaatgaagccctgctatggatcatttgcaaggcctacaaatatta

SEQ ID NO: 239718 - DNA, 75 bp, Artificial Sequence
  Synthetic
gtacaagccaggcaaggaagatgcaagttctgaaattaacttgactcaacagtccatggccaacagacccaacta

SEQ ID NO: 239719 - DNA, 75 bp, Artificial Sequence
  Synthetic
agaaacaagtcaaaagaaaactaatgacacacaaaagccatcgcgcaggaggccatctaaactaaagccaaacac

SEQ ID NO: 239720 - DNA, 75 bp, Artificial Sequence
  Synthetic
ttggtccagctggaaaggtcacttggtacgatgatgatttaaaaagaccatgtgagactgggtataagttagact

SEQ ID NO: 239721 - DNA, 75 bp, Artificial Sequence
  Synthetic
tcggaagacccggagcccacccgctgatactttcggcgcttggtgggcagaggaggtagcggcggcgaggggctc

SEQ ID NO: 239722 - DNA, 75 bp, Artificial Sequence
  Synthetic
aacaaaagaatgggcaaaagcaaaatgaagaacaaaaacatggtgatcaaaaaacaagtcaaacaaaagttaatg

SEQ ID NO: 239723 - DNA, 75 bp, Artificial Sequence
  Synthetic
tctgattaatgtaactaaactgtacgaaggagtttactatggcactaatgacaaaagcgatagcaaaagatacag

SEQ ID NO: 239724 - DNA, 75 bp, Artificial Sequence
  Synthetic
tgaagaacaaaaacatggtgatcaaaaaacaagtcaaacaaaagttaatgacaggcgaaaagcagcgcagaaaag

SEQ ID NO: 239725 - DNA, 75 bp, Artificial Sequence
  Synthetic
gggcaacatctatgccatggagatcaacctccaggccaacctgtggaagagttttctatattcgaacgtggcctt

SEQ ID NO: 239726 - DNA, 75 bp, Artificial Sequence
  Synthetic
gaaggagtttactatggcactaatgacaaaagcgatagcaaaagatacagaataaaagtaaacactactaattct

SEQ ID NO: 239727 - DNA, 75 bp, Artificial Sequence
  Synthetic
cagaatcacaaatttgaaatgcaaattgaaaatggaaatgacgaatcaaaaataccctcaactactgtggcaatt

SEQ ID NO: 239728 - DNA, 75 bp, Artificial Sequence
  Synthetic
aggaagtgcggcggcggctggcggtagagcggccagcgctgggtggccggcgcgcccggggccaggtcctcgagc

SEQ ID NO: 239729 - DNA, 75 bp, Artificial Sequence
  Synthetic
tggatatatcacattaaatgtaacattgataatactacctggacaagatatcatttaaataagtcaccaaattta

SEQ ID NO: 239730 - DNA, 75 bp, Artificial Sequence
  Synthetic
ttgataatactacctggacaagatatcatttaaataagtcaccaaatttaggtcaaccatcaacaaatgctatgg

SEQ ID NO: 239731 - DNA, 75 bp, Artificial Sequence
  Synthetic
tctggccatacaaagaaagttttatactgttgatattatggtaatataacataaattcattactaactgtaatga

SEQ ID NO: 239732 - DNA, 75 bp, Artificial Sequence
  Synthetic
ctcagttactctcatttcagaaccatgaaggctttcacagcttgcgttctgattagtttagtcacacttagtcta

SEQ ID NO: 239733 - DNA, 75 bp, Artificial Sequence
  Synthetic
ataaattcattactaactgtaatgagcatccacaacaaaatcgcccccacgctaatacagctacatcaattaatg

SEQ ID NO: 239734 - DNA, 75 bp, Artificial Sequence
  Synthetic
ccagaggtggtagcatcacattaaatggaacctatccgcaaactacatggacaagatatcacacaaatggatgga

SEQ ID NO: 239735 - DNA, 75 bp, Artificial Sequence
  Synthetic
agcattacaattactgccactgctaatattacttctggcaaaatcaaggcagaaagctataaaaatgaaattaag

SEQ ID NO: 239736 - DNA, 75 bp, Artificial Sequence
  Synthetic
aaaacctgatcagccagcagtcattaaaactacctttaaccaagaaactggatgtgaatactctatcacatttga

SEQ ID NO: 239737 - DNA, 75 bp, Artificial Sequence
  Synthetic
aatgttgaatttgaaaccacctcttttaccttctcctatattgcccaagaatgaaagaccaataaacgtgttttt

SEQ ID NO: 239738 - DNA, 75 bp, Artificial Sequence
  Synthetic
atgctaacaattattgagcttccaactactaaggctcccaccacaattaggacaactgttgagaccactactcac

SEQ ID NO: 239739 - DNA, 75 bp, Artificial Sequence
  Synthetic
tttgttgagggaggaaagtactactgaacagacagaggctacctcaagtgccttcagcagcactgcaaatttaac

SEQ ID NO: 239740 - DNA, 75 bp, Artificial Sequence
  Synthetic
cgagaaccgcctggggcagaccgtgcttcactcgaccctgaagggcgaggcgcggcgggactacatccgcgactg

SEQ ID NO: 239741 - DNA, 75 bp, Artificial Sequence
  Synthetic
actttgtgaatacagtattggaggacgaactgcaaccaactccgttcgagctgggacccacacttcaggacctct

SEQ ID NO: 239742 - DNA, 75 bp, Artificial Sequence
  Synthetic
acaggcaaagatcacctacgagctcgtgtccggcggcaagcagcatcgcctcgcctatgagctgccccagcagaa

SEQ ID NO: 239743 - DNA, 75 bp, Artificial Sequence
  Synthetic
gacgctgaaaggcgggctgcccgacttcatgagccagagcatgttgcaaaactaccgcactttcattctcgagcg

SEQ ID NO: 239744 - DNA, 75 bp, Artificial Sequence
  Synthetic
ggagaccaaaatgcttcctgcgctctgtgttacatgaaaatgagcttcagctttatttacagtaagtggagtgaa

SEQ ID NO: 239745 - DNA, 75 bp, Artificial Sequence
  Synthetic
tgcatctactccctgctcaagaccctttgcggactccgcgacctcctccccatgaactgatgttgattaaaagcc

SEQ ID NO: 239746 - DNA, 75 bp, Artificial Sequence
  Synthetic
ttgctgggctgctccttcaacgcgcgctgtccgttctcgctggtcacatccatctccaccacgtggtccttgtgg

SEQ ID NO: 239747 - DNA, 75 bp, Artificial Sequence
  Synthetic
aaccaggccgtgcagcgcgagataaacagccgcctggacccgcggccgcccacggtggtggagatggaagatgca

SEQ ID NO: 239748 - DNA, 75 bp, Artificial Sequence
  Synthetic
aactggagacctaatagtcaatgctaaggctccattgcaagttgcaaataagaaattagagattgcgtttgatac

SEQ ID NO: 239749 - DNA, 75 bp, Artificial Sequence
  Synthetic
aaggctccattgcaagttgcaaataagaaattagagattgcgtttgatacaccattatatgaaaaaaatggaaga

SEQ ID NO: 239750 - DNA, 75 bp, Artificial Sequence
  Synthetic
cttcccccctggtgtcctttcgctaaaactggctgatccaatcgccattgtcaatgggaatgtttcactcaaggt

SEQ ID NO: 239751 - DNA, 75 bp, Artificial Sequence
  Synthetic
tagctgttctaaccaaagacaatactgtcataccagacttaattggaacccttgtaatcctaactggaaaaggaa

SEQ ID NO: 239752 - DNA, 75 bp, Artificial Sequence
  Synthetic
tgtcataccagacttaattggaacccttgtaatcctaactggaaaaggaattggcacaggtagtgttgcaggcgc

SEQ ID NO: 239753 - DNA, 75 bp, Artificial Sequence
  Synthetic
gtcgggcacagcaccgcatcctaatctcgctcatgttttcacagtaagtgcagcacataatgaccatgttattca

SEQ ID NO: 239754 - DNA, 75 bp, Artificial Sequence
  Synthetic
aatgatggtggattgtcatttgataaaaatggagacctagtagcttggaataaaaaagatgacagacgcactctg

SEQ ID NO: 239755 - DNA, 75 bp, Artificial Sequence
  Synthetic
aaaatggagacctagtagcttggaataaaaaagatgacagacgcactctgtggacaacaccagatccatctccca

SEQ ID NO: 239756 - DNA, 75 bp, Artificial Sequence
  Synthetic
aacttagtttaaaagtagggcaaggactaaaagtgttggatgaaaaagattctggaggattgcaaaatttacttg

SEQ ID NO: 239757 - DNA, 75 bp, Artificial Sequence
  Synthetic
ttcaaaactaactttgattcttacaaaatgcggaagtcagatcctagcaagcttttcactgcttgtggtcaaagg

SEQ ID NO: 239758 - DNA, 75 bp, Artificial Sequence
  Synthetic
tggtgaacgttaccggcagcagcacagccgctccagaaactaaccttccttctgatactatcaaacctcgtttcg

SEQ ID NO: 239759 - DNA, 75 bp, Artificial Sequence
  Synthetic
aaatgcggaagtcagatcctagcaagcttttcactgcttgtggtcaaagggacgtatgcaactgttgataaaaac

SEQ ID NO: 239760 - DNA, 75 bp, Artificial Sequence
  Synthetic
cttcaaaccctactcgggcacggcttacaacagcctggcccccaagggcgcccccaattccagtcagtgggatgc

SEQ ID NO: 239761 - DNA, 75 bp, Artificial Sequence
  Synthetic
aatggtaagttagtagcgtggaacaaacacaatgacacacgcactctttggacaactccagacccttctccaaat

SEQ ID NO: 239762 - DNA, 75 bp, Artificial Sequence
  Synthetic
aactactgtttgatgcaaatggaaagcttaaaagcgaatcaaatcttagtggttattggaactatagaagtgata

SEQ ID NO: 239763 - DNA, 75 bp, Artificial Sequence
  Synthetic
accacagcttatccaaaaattatcgatagcacaactaatcctgcagataagaaaagttcagctaaaaaaattatt

SEQ ID NO: 239764 - DNA, 75 bp, Artificial Sequence
  Synthetic
gaaaagttcagctaaaaaaattattgttggtaatgtctacctaggaggtaacccaggtcaaccagtagccgttgc

SEQ ID NO: 239765 - DNA, 75 bp, Artificial Sequence
  Synthetic
agattattggaacttcagaagtgatgattctattatacccaatcaatacgacaatgcagtgccgtttatgccaaa

SEQ ID NO: 239766 - DNA, 75 bp, Artificial Sequence
  Synthetic
aatatgagtggtttgagtttaccctgcccgagggcaacttttccgagaccatgaccatagacctgatgaacaacg

SEQ ID NO: 239767 - DNA, 75 bp, Artificial Sequence
  Synthetic
aaaatgaagacaaaacccaataaagtgttttgaaattaattcatgtatctttattgatttttacaccagcacggg

SEQ ID NO: 239768 - DNA, 75 bp, Artificial Sequence
  Synthetic
agtatcattgatgtatggccaacattacccaggtttggatatacaaatcactttcttgattgtctgtggggtctt

SEQ ID NO: 239769 - DNA, 75 bp, Artificial Sequence
  Synthetic
cagaatgcaaccagggctgctggagatatcagaggagacagtcatattccaagagctgtggaacaagcggctgaa

SEQ ID NO: 239770 - DNA, 75 bp, Artificial Sequence
  Synthetic
cgaccacgccctaaattcaaaagctcatttgcatattaacttttgtttactttgtggggtatattatatagatag

SEQ ID NO: 239771 - DNA, 75 bp, Artificial Sequence
  Synthetic
catcatcaataatataccccacaaagtaaacaaaagttaatatgcaaatgagcttttgaatttagggcgtggccg

SEQ ID NO: 239772 - DNA, 75 bp, Artificial Sequence
  Synthetic
taatgtcatagatggcacccatgacaccctctaccgaagttggtacctgtcctatacctacggggaccccgagaa

SEQ ID NO: 239773 - DNA, 75 bp, Artificial Sequence
  Synthetic
aggggactggaaactcttggagcagggtaaagccagcagcacatggtaatccacggacagaacttacattatgat

SEQ ID NO: 239774 - DNA, 75 bp, Artificial Sequence
  Synthetic
tcctgtcttcaactgtgcctattgacatggccgcattattgctggaggactatgtgagtacaatattggaggacg

SEQ ID NO: 239775 - DNA, 75 bp, Artificial Sequence
  Synthetic
gtagtttttctttaatcatgttagtaatagaaaaatcctctaaatacgtcactaggaccccagggaccacaatgt

SEQ ID NO: 239776 - DNA, 75 bp, Artificial Sequence
  Synthetic
ttcccctcatcacatcagccaggactctgtaggccatccccatccagttaatgctgccttgtctatcattcaaag

SEQ ID NO: 239777 - DNA, 75 bp, Artificial Sequence
  Synthetic
gcccactgggtggcccttgcggacatacaaaaattggtccgtgtgattaaaaagcagtacagcaagctcctgtct

SEQ ID NO: 239778 - DNA, 75 bp, Artificial Sequence
  Synthetic
aaccttttgtagagggaacctaccagtgccgacacggaccttgtgttcacaacttccatttggtgaaccttacca

SEQ ID NO: 239779 - DNA, 75 bp, Artificial Sequence
  Synthetic
agtcatttaaagccataaatgtgccctgataaccagtaggaacgagtacactgacttttaggtaaaccaatacca

SEQ ID NO: 239780 - DNA, 75 bp, Artificial Sequence
  Synthetic
atgaacctttggacctgagcttgaaacgccccaggaactaggcgcagctgcgcttagtcatgtgtaaataaagtt

SEQ ID NO: 239781 - DNA, 75 bp, Artificial Sequence
  Synthetic
tttatctgctgggtcagacattgtggggaggaaccatgaaggggctcttgctgattatcctttccctggtggggg

SEQ ID NO: 239782 - DNA, 75 bp, Artificial Sequence
  Synthetic
tacaggggcgactgctctgtagtcatcaaatgcgagcacaattgcccacttaacattacattcaaaaaccacacc

SEQ ID NO: 239783 - DNA, 75 bp, Artificial Sequence
  Synthetic
ccgcttattaaccaattaacgttggccctgccctaaaaccgttaaaatttaaaagctcatttgcatattaacttt

SEQ ID NO: 239784 - DNA, 75 bp, Artificial Sequence
  Synthetic
ttctttaatcatttgcgtaatagaaaagtcctctaaataagtcactaggaccccagggaccacaatgtggtagct

SEQ ID NO: 239785 - DNA, 75 bp, Artificial Sequence
  Synthetic
cagccttactcaggtttggatattcaaattacttttctggttgtctgtgggatctttattcttgtggttcttctg

SEQ ID NO: 239786 - DNA, 75 bp, Artificial Sequence
  Synthetic
ttttaggtgaagcaataccaccccatgcggaggaatgtggaaagatttagggcaaaagaaattatatctattgct

SEQ ID NO: 239787 - DNA, 75 bp, Artificial Sequence
  Synthetic
atggaaaatactatggcattagaaaggacgggtttggaatgaaacagtacactcttaaggttattgccccaaaag

SEQ ID NO: 239788 - DNA, 75 bp, Artificial Sequence
  Synthetic
aggaggccattaagaaatatgccaagatagccctgcgcccagattgcaagtacagggtgaccaagaccgtgaata

SEQ ID NO: 239789 - DNA, 75 bp, Artificial Sequence
  Synthetic
acctcagcaaattgatgttagaatgggtcaaaatgtaactctggttgggccagtagatactccagttaattggca

SEQ ID NO: 239790 - DNA, 75 bp, Artificial Sequence
  Synthetic
actacagccggggttgcttttgtggtttttctggttgacaaatggagccaggacacccaactgagcaggggctac

SEQ ID NO: 239791 - DNA, 75 bp, Artificial Sequence
  Synthetic
actttctggggagcatatcttggctttaacagatatggtactgacagagtgcattatgaggttacaataatagat

SEQ ID NO: 239792 - DNA, 75 bp, Artificial Sequence
  Synthetic
agccacttgaactcggggatcaccagtttgggcactggggtctcggggaagggtctcgctccacatgcgccggct

SEQ ID NO: 239793 - DNA, 75 bp, Artificial Sequence
  Synthetic
ttaacagatatggtactgacagagtgcattatgaggttacaataatagatggtttcaagaatgcaggacagcaaa

SEQ ID NO: 239794 - DNA, 75 bp, Artificial Sequence
  Synthetic
tagcaataaagataggccaaatccaaaagttaagaatcctcagagaacaaaaaacacacacaaaacaaacacgca

SEQ ID NO: 239795 - DNA, 75 bp, Artificial Sequence
  Synthetic
gccccacaaccgttaaaatcaaaagctcatttgcatattaacttttgtttactttgtggggtatattatatagat

SEQ ID NO: 239796 - DNA, 75 bp, Artificial Sequence
  Synthetic
catcatcaataatataccccacaaagtaaacaaaagttaatatgcaaatgaggttttaaatttagggcggggcta

SEQ ID NO: 239797 - DNA, 75 bp, Artificial Sequence
  Synthetic
gggcacggcttacaacagcctggcccccaaaggcgcccccaactctagtcagtgggaacaagctaaagctaccaa

SEQ ID NO: 239798 - DNA, 75 bp, Artificial Sequence
  Synthetic
tttggagtagccgctatgggcggagaagacattacagtgaaaggtcttcaaattggaactgatgaaactaaggaa

SEQ ID NO: 239799 - DNA, 75 bp, Artificial Sequence
  Synthetic
aagacattacagtgaaaggtcttcaaattggaactgatgaaactaaggaagatggagaggatgaaatttttgcag

SEQ ID NO: 239800 - DNA, 75 bp, Artificial Sequence
  Synthetic
agtgggagaacagaactggcaagaaacgtttgttttctatggaggcagagctcttaagaaagaaaccaaaatgaa

SEQ ID NO: 239801 - DNA, 75 bp, Artificial Sequence
  Synthetic
gaacagtttgctctgcaacaagataatgacagaaccaatcaaaatgatgaacaaattccatcaactactgtggca

SEQ ID NO: 239802 - DNA, 75 bp, Artificial Sequence
  Synthetic
acgtttgttttctatggaggcagagctcttaagaaagaaaccaaaatgaagccatgttatggctcttatgcgaga

SEQ ID NO: 239803 - DNA, 75 bp, Artificial Sequence
  Synthetic
atcgtggtgggagtgattgcgggcttcataactctgatcattgtaattctgtgctacatctgctgccgcaagcgt

SEQ ID NO: 239804 - DNA, 75 bp, Artificial Sequence
  Synthetic
ctaaatttacacttgatgaaaaaggtcagccaaccaaaattcctgatattacaatggatttctttgatagtccac

SEQ ID NO: 239805 - DNA, 75 bp, Artificial Sequence
  Synthetic
tcagccaaccaaaattcctgatattacaatggatttctttgatagtccacaagatgatacatcaggtgtaactaa

SEQ ID NO: 239806 - DNA, 75 bp, Artificial Sequence
  Synthetic
gaaaatgtaaatttagaagctcctgacacacatgtagtttacaaaccaggcaaagatgattctagttcttccgct

SEQ ID NO: 239807 - DNA, 75 bp, Artificial Sequence
  Synthetic
caaagatgattctagttcttccgctaacctcacacaacaggccatgcctaacagaccgaactacatcgggttcag

SEQ ID NO: 239808 - DNA, 75 bp, Artificial Sequence
  Synthetic
ttgaggacttgttacatgacatgggtggggatgaacctttggacctgagcttgaaacgccccaggaactaggcgc

SEQ ID NO: 239809 - DNA, 75 bp, Artificial Sequence
  Synthetic
gagtctctaccgagggcaatgctagagtgagacactgctcttccctggagacgggctgcttctgcctggtgaagg

SEQ ID NO: 239810 - DNA, 75 bp, Artificial Sequence
  Synthetic
aacagcaaagcatctttattatttattttttcgcgcgcggtaggccctggtccacctctcccgatcattgagagt

SEQ ID NO: 239811 - DNA, 75 bp, Artificial Sequence
  Synthetic
tgctggctggtcaggcctctcagttgaatgctgtggtcgacttgcaagacagaaacaccgagctgtcttaccagc

SEQ ID NO: 239812 - DNA, 75 bp, Artificial Sequence
  Synthetic
tagggaatcaaccacacagcctactacagttagtataactatggaggacactactcacactacacagctggacac

SEQ ID NO: 239813 - DNA, 75 bp, Artificial Sequence
  Synthetic
tcctgactgccgccggccattgtttcctaggggaagatggaggagcagccgcgtaagcaggagcaggaggaggac

SEQ ID NO: 239814 - DNA, 75 bp, Artificial Sequence
  Synthetic
ctaacagcacatacaaaggtgttaaagctggaactggaaacaattgggatgacgatgaaaatgttgcaagacaaa

SEQ ID NO: 239815 - DNA, 75 bp, Artificial Sequence
  Synthetic
ggtcaggcagcggggacagagaatcttgaactactggcttctacagccagcagctccgggtcttcttcgtctaca

SEQ ID NO: 239816 - DNA, 75 bp, Artificial Sequence
  Synthetic
acaggccagtaatcggggaacctcagccactccaagtggaagggggtctaaggaatcttctcttctctttttcag

SEQ ID NO: 239817 - DNA, 75 bp, Artificial Sequence
  Synthetic
acccgaggagcggcctggaccctccgtcggaagaggagctggattgaatcaggtatccagcctgtacccagagct

SEQ ID NO: 239818 - DNA, 75 bp, Artificial Sequence
  Synthetic
tcaaccagtaaccattaaaactacctttaatcaggaaactggatgtgaatattctatcacatttgattttagttg

SEQ ID NO: 239819 - DNA, 75 bp, Artificial Sequence
  Synthetic
ggccctgcttgtgtcattggtgagctcttccaataggtgcgtgataaagcctggcaggtgatctctaataaggct

SEQ ID NO: 239820 - DNA, 75 bp, Artificial Sequence
  Synthetic
attttcatgtatctttattgatttttacaccagcacgggtagtcagtctcccaccaccagcccatttcacagtat

SEQ ID NO: 239821 - DNA, 75 bp, Artificial Sequence
  Synthetic
ggctcgggtttcgacccctactttgtctactcgggctccatcccctacctcgacgggaccttctacctcaaccac

SEQ ID NO: 239822 - DNA, 75 bp, Artificial Sequence
  Synthetic
gctcgcgcgctggctcgggacccgcgacccccaggccctggagcagcggcgcaagctcatgctggccgtggtcct

SEQ ID NO: 239823 - DNA, 75 bp, Artificial Sequence
  Synthetic
tcttccctggagacgggctgcttctgcctggtgaagggcacagcctctctgaagcataatatggtgaagggctgc

SEQ ID NO: 239824 - DNA, 75 bp, Artificial Sequence
  Synthetic
cacaggcacactgacatacatctttttaaaatttttatttcctctggggtcaggatcatatcccaggggactgga

SEQ ID NO: 239825 - DNA, 75 bp, Artificial Sequence
  Synthetic
atcagcgttggctccgccccaaaaccgttaaaatcaaaagctcatttgcatattaacttttgtaaactttgtggg

SEQ ID NO: 239826 - DNA, 75 bp, Artificial Sequence
  Synthetic
tttgggcggttgcaaataaaattaggacatggtggcgccaaaactgaatgaggaagtgaaaagcgaaaaataccg

SEQ ID NO: 239827 - DNA, 75 bp, Artificial Sequence
  Synthetic
tttcttatgcagatccatttgaaactagtgctaataaacttagtttaaaagtagggcatggactaaaagtgttgg

SEQ ID NO: 239828 - DNA, 75 bp, Artificial Sequence
  Synthetic
tagtgctaataaacttagtttaaaagtagggcatggactaaaagtgttggatcagaaaaattctggaggattgca

SEQ ID NO: 239829 - DNA, 75 bp, Artificial Sequence
  Synthetic
ttaactggaaaaggaataggtgttgaagatttgaaaaacgatgatggtagtagcagaggagttggtataaatgtg

SEQ ID NO: 239830 - DNA, 75 bp, Artificial Sequence
  Synthetic
aagatttgaaaaacgatgatggtagtagcagaggagttggtataaatgtgaggttgggtaccgatggaggtctgt

SEQ ID NO: 239831 - DNA, 75 bp, Artificial Sequence
  Synthetic
cgcttggaacagaaaagatgatagacgtaccctttggacaacacctgatccatcgcctaattgtaaagctgaaac

SEQ ID NO: 239832 - DNA, 75 bp, Artificial Sequence
  Synthetic
cgtaccctttggacaacacctgatccatcgcctaattgtaaagctgaaacagagaaggactcaaagcttactttg

SEQ ID NO: 239833 - DNA, 75 bp, Artificial Sequence
  Synthetic
aagccctgagccgccagctggccgccctgacccagcaggtgtccgagctccgcgaacagcagcaaaataaatgat

SEQ ID NO: 239834 - DNA, 75 bp, Artificial Sequence
  Synthetic
gacgcacggctgacggtcgccgcggaggcgtggcctagcccggaagcaagtcgcggggctgatgacgtataaaaa

SEQ ID NO: 239835 - DNA, 75 bp, Artificial Sequence
  Synthetic
taaagcagaaaataaagtaagcagtgctaaaaacaaaattgtaagcaacttttactttggagggcagacatatca

SEQ ID NO: 239836 - DNA, 75 bp, Artificial Sequence
  Synthetic
ggtggattttttccaggacccggtagaggtgggattggatgttgaggtacatgggcatgagcccgtcccgggggt

SEQ ID NO: 239837 - DNA, 75 bp, Artificial Sequence
  Synthetic
gctaaaaacaaaattgtaagcaacttttactttggagggcagacatatcaacctgggacaataataattaagttt

SEQ ID NO: 239838 - DNA, 75 bp, Artificial Sequence
  Synthetic
tttactttggagggcagacatatcaacctgggacaataataattaagtttaatgaggagattgatgacacatgtg

SEQ ID NO: 239839 - DNA, 75 bp, Artificial Sequence
  Synthetic
atggggaaaaacttatgacaatccattcccatttgatactacttcttttaccttctcctatattgcccaagaaaa

SEQ ID NO: 239840 - DNA, 75 bp, Artificial Sequence
  Synthetic
tgaagacaaagactaataaagtgttttgaactgaaattatgtatctttattgatttttacaccagcacgcgtagt

SEQ ID NO: 239841 - DNA, 75 bp, Artificial Sequence
  Synthetic
tgggatcgggatcgcaagtctctctgactatgatccccacagccttcagcatcagtctcctggtgcgacgggcac

SEQ ID NO: 239842 - DNA, 75 bp, Artificial Sequence
  Synthetic
ggtttccggggcgggggtgatgagctgcgaggagagcaggtttctcaacagctgggacttgccgcacccggtcgg

SEQ ID NO: 239843 - DNA, 75 bp, Artificial Sequence
  Synthetic
tctgctcgggcatgagcttgtaagcatcgcgcaggccgctgtcgacgcggtagcgttccatcagcacgttcatgg

SEQ ID NO: 239844 - DNA, 75 bp, Artificial Sequence
  Synthetic
tgcttggtctttctggcttgcttcttttttggagggctgtccacggggaccacgtcctcctcggaagacccggag

SEQ ID NO: 239845 - DNA, 75 bp, Artificial Sequence
  Synthetic
cagcgttcccctccgctgtgctggtggaaacagatagccagatcaaaacttattctattttcaaggtgctcgatt

SEQ ID NO: 239846 - DNA, 75 bp, Artificial Sequence
  Synthetic
gtggcttcgagcagtggctctatgcgtacatccagcattaaaatcacattaaaggctggtccgccatcgatttca

SEQ ID NO: 239847 - DNA, 75 bp, Artificial Sequence
  Synthetic
tcatccatctggtcagaaaagactatttttttattgtcaagcttggtggcgaaggagccatagagggcattggag

SEQ ID NO: 239848 - DNA, 75 bp, Artificial Sequence
  Synthetic
tgtaagttttatggctgctggatgggcgtggttggaagacccaagagcgagatgtctgtgaagcagtgtgtgttt

SEQ ID NO: 239849 - DNA, 75 bp, Artificial Sequence
  Synthetic
ggcaccacaacgtggtagcagacaccgcgtcgctcaagcatggttagtagagatgagagtctgaaaaacagaaag

SEQ ID NO: 239850 - DNA, 75 bp, Artificial Sequence
  Synthetic
cgcgtcgctcaagcatggttagtagagatgagagtctgaaaaacagaaagcatgcactaaaccagagtggccagt

SEQ ID NO: 239851 - DNA, 75 bp, Artificial Sequence
  Synthetic
ctcactgagggaaaaatcactctctccagcagcaagatgcccaccgggtggccctcgcggacatacaaaaatcgg

SEQ ID NO: 239852 - DNA, 75 bp, Artificial Sequence
  Synthetic
atgccatggagatcaacctccaggccaacctgtggaagagttttctgtactcgaacgtggccctgtacctgcccg

SEQ ID NO: 239853 - DNA, 75 bp, Artificial Sequence
  Synthetic
caaccgccggccgtacgtcttgacgtcacctacattaccgcttgttaaccaattaacgttggccctgccctaaaa

SEQ ID NO: 239854 - DNA, 75 bp, Artificial Sequence
  Synthetic
cccactaacccagctccctatttaaaggcagtccttacactgacgtaatgaccaaaggtctaaaaaccccgccaa

SEQ ID NO: 239855 - DNA, 75 bp, Artificial Sequence
  Synthetic
cgccgtagggcgccatcttgcccgcgtccaacatggcttccatgtccggtcacgcctccgcgtccgagcgtcgtg

SEQ ID NO: 239856 - DNA, 75 bp, Artificial Sequence
  Synthetic
agagtttaggcgcgagaaaaacggactctggggcaaaggcatccgctccgcagtggacgcagacggtctcgcact

SEQ ID NO: 239857 - DNA, 75 bp, Artificial Sequence
  Synthetic
attggaggatgaactgcatccaactccgttcgagctgggacccacacttcaggacctctatgatctggaggtaga

SEQ ID NO: 239858 - DNA, 75 bp, Artificial Sequence
  Synthetic
cctgcgctctgtgttacatgaaatctactttcagctttatttacagtaagtggagtgaatgtgagagaggctgag

SEQ ID NO: 239859 - DNA, 75 bp, Artificial Sequence
  Synthetic
gctatcagccccagatgggcctggccgcgggcgcctcccaggactactccacccgcatgaactggctcagtgccg

SEQ ID NO: 239860 - DNA, 75 bp, Artificial Sequence
  Synthetic
ccaagtggaagggggtctaaggaatcttcttttctctttttcagtatggtgatcagccatgattcctaggttctt

SEQ ID NO: 239861 - DNA, 75 bp, Artificial Sequence
  Synthetic
acaatctcaccagtggactaaccttctcagttaaaagggcaaagctaattcttcatcgccctattgtagaaggaa

SEQ ID NO: 239862 - DNA, 75 bp, Artificial Sequence
  Synthetic
tagtgggcgtggctaaggtgactataaaggcgggtgtcttacgagggtctttttgcttttctgcagacatcatga

SEQ ID NO: 239863 - DNA, 75 bp, Artificial Sequence
  Synthetic
gaggtggtgaaactaggggagatacttttctcaccaccgaacagctgagagccgctggcaaggagctggttatta

SEQ ID NO: 239864 - DNA, 75 bp, Artificial Sequence
  Synthetic
ttctgcctggtgaagggcacggcctctctgaagcataatatggtgaagggctgcacggatgagcgcatgtacaac

SEQ ID NO: 239865 - DNA, 75 bp, Artificial Sequence
  Synthetic
gcacgacctcggagtacctgagccgcgagaaggcgcgcgagtcgaagacgtagtcgttgcaggtgcgcacaaggt

SEQ ID NO: 239866 - DNA, 75 bp, Artificial Sequence
  Synthetic
gtgcggcagctttttgagctcctcgtaggtgaggtcctcggggcattgcaggccgtgctgctcgagcgcccactc

SEQ ID NO: 239867 - DNA, 75 bp, Artificial Sequence
  Synthetic
cggttgagcgggctcttcctccgtagcctggcggaacgcaaacgggttaggccgcgcgtgtaccccggttcgagt

SEQ ID NO: 239868 - DNA, 75 bp, Artificial Sequence
  Synthetic
ccgtatcgtgctgctctctcttcttgtagctttcggtcaggcaggaattcatattattaatgctacatggtggga

SEQ ID NO: 239869 - DNA, 75 bp, Artificial Sequence
  Synthetic
gaaagcggccgaaaaccccgccgggtagtggctcgcgcccgtagtctggagaagcatcgccagggttgagtcgcg

SEQ ID NO: 239870 - DNA, 75 bp, Artificial Sequence
  Synthetic
taatataactttagtgggaccctcagatactccagttacctggtatgatggcaagggattgcaattttgtgacgg

SEQ ID NO: 239871 - DNA, 75 bp, Artificial Sequence
  Synthetic
agacatacttgtaatgatcaaaacttaactctgattcatgttaacaaaacccatgaaagaacatacatgggttac

SEQ ID NO: 239872 - DNA, 75 bp, Artificial Sequence
  Synthetic
taactctgattcatgttaacaaaacccatgaaagaacatacatgggttacagacatgacagtaagggaaaagtag

SEQ ID NO: 239873 - DNA, 75 bp, Artificial Sequence
  Synthetic
tcctcctgctactgtaaagccacaaccagatccagaaaatgtctttgtttatatgggaaataatgtaactttagt

SEQ ID NO: 239874 - DNA, 75 bp, Artificial Sequence
  Synthetic
ccagatccagaaaatgtctttgtttatatgggaaataatgtaactttagttggacctccaggaattccagttagt

SEQ ID NO: 239875 - DNA, 75 bp, Artificial Sequence
  Synthetic
tctgcgatggagataaaattattcatccagaattcaaccacacctgtgataaacaaaaccttacactgctgtttg

SEQ ID NO: 239876 - DNA, 75 bp, Artificial Sequence
  Synthetic
tccagaattcaaccacacctgtgataaacaaaaccttacactgctgtttgtaaactttacacatgatggaggcta

SEQ ID NO: 239877 - DNA, 75 bp, Artificial Sequence
  Synthetic
cagagaattcagtatgaggttatagttttagatcgatttccaaattctggtcagatgaaaattgaagaacaaagt

SEQ ID NO: 239878 - DNA, 75 bp, Artificial Sequence
  Synthetic
gaggaaacagaacagaaacatactgagcataataaggctggacaaaagcagggtatagatacaaatcaaaagaaa

SEQ ID NO: 239879 - DNA, 75 bp, Artificial Sequence
  Synthetic
aaaggccatcaagaagacggccgacaaacactcctgagacaaaacaacttacagtgtctattgggtctaacttaa

SEQ ID NO: 239880 - DNA, 75 bp, Artificial Sequence
  Synthetic
aaacactcctgagacaaaacaacttacagtgtctattgggtctaacttaactttagttggtccagatggaaaagt

SEQ ID NO: 239881 - DNA, 75 bp, Artificial Sequence
  Synthetic
agaccatgtgaagaacaaaactataggcttccacatcagtgtagtgctcagaacttaactttaattaatgtaact

SEQ ID NO: 239882 - DNA, 75 bp, Artificial Sequence
  Synthetic
gaacttaactttaattaatgtaactaaatctcatgagggaacttactatggcactaatgacaaagacgaaagcaa

SEQ ID NO: 239883 - DNA, 75 bp, Artificial Sequence
  Synthetic
gtgaccgaggttccccagagcgaggtgtaccagtcgggcccggactactttttccagactagcagacagggcctg

SEQ ID NO: 239884 - DNA, 75 bp, Artificial Sequence
  Synthetic
tgaactttacctgcaagccacacaagaagtacatcacctggttttaccagaacactactctagcagtagccaaca

SEQ ID NO: 239885 - DNA, 75 bp, Artificial Sequence
  Synthetic
aagatacagagtgaaagtgaacactacaaattctcaagctgtaaaaattaacccatataccagacctactactcc

SEQ ID NO: 239886 - DNA, 75 bp, Artificial Sequence
  Synthetic
ggtagttaagggtggtggcaatgtgctcggtaacaaaaaagtacataatccagcggcgcaggggcatttcgctga

SEQ ID NO: 239887 - DNA, 75 bp, Artificial Sequence
  Synthetic
cgtgcaggcgcccgtgggcgaccggtcgacggtgagcagcttgctgacgcccaactcgcggctgctgctgctgct

SEQ ID NO: 239888 - DNA, 75 bp, Artificial Sequence
  Synthetic
caaattgaaaataatgcaaatgatgaagaatcaaaaattccatctactactgtggcaatcgtggtgggagtgatt

SEQ ID NO: 239889 - DNA, 75 bp, Artificial Sequence
  Synthetic
ttcagaaccatgaaggctttcacagcttgcgttctgtttaacataatcacacttagtgtagctgcaaatggtttt

SEQ ID NO: 239890 - DNA, 75 bp, Artificial Sequence
  Synthetic
gtaatgtaacactgacaggagctggaattaatactacatggacagggtattttaatgagggtccaaaaggaaaaa

SEQ ID NO: 239891 - DNA, 75 bp, Artificial Sequence
  Synthetic
aattaatactacatggacagggtattttaatgagggtccaaaaggaaaaaatgggtggatgaatatttgcacatg

SEQ ID NO: 239892 - DNA, 75 bp, Artificial Sequence
  Synthetic
gtggtgctgctgccgggctgcggggtggacttcacagagagccgcctgagcaacctcctgggcattcgcaagaag

SEQ ID NO: 239893 - DNA, 75 bp, Artificial Sequence
  Synthetic
ccggtcatctcccggtaatagggcgggtccccgttgggtagcgaaagggcgctaacaatgcatcttattaattgc

SEQ ID NO: 239894 - DNA, 75 bp, Artificial Sequence
  Synthetic
ggaaatagcagtactattactaatcttacagttgtggcacttctaaatttaaccactaacagaagatttaaagca

SEQ ID NO: 239895 - DNA, 75 bp, Artificial Sequence
  Synthetic
gatcgaccggatcggaaaatttttgaaggaaagcgtctagccaatcgcagtcacaaggtaagcttaaacacgtag

SEQ ID NO: 239896 - DNA, 75 bp, Artificial Sequence
  Synthetic
gaaagttttactagtaacgatggttatgaaactaccagtgcaaaattttatgaaattaaaattattgagcttcca

SEQ ID NO: 239897 - DNA, 75 bp, Artificial Sequence
  Synthetic
cgcgccgctggccacgggtgtaatgaaacccgccacccttgacctgcctccaccacccacgcccgctccaccgaa

SEQ ID NO: 239898 - DNA, 75 bp, Artificial Sequence
  Synthetic
ctcctctttgccctgctaacctgcacctgcgtctgcagcattgtctgcgtggtcatcacctttctgcagctcatc

SEQ ID NO: 239899 - DNA, 75 bp, Artificial Sequence
  Synthetic
actctaaatgcaaattcgcggacatatggaatttcttagattgctatcaggagaaaattgatatgccctcctatt

SEQ ID NO: 239900 - DNA, 75 bp, Artificial Sequence
  Synthetic
aagcatcactagggttaagttacagcagaacccggttcgcggacggccgcggcaagcgggacttagttaccccgc

SEQ ID NO: 239901 - DNA, 75 bp, Artificial Sequence
  Synthetic
accctgcccgagggcaacttttccgagaccatgaccatagacctgatgaacaacgccatcttggaaaactacttg

SEQ ID NO: 239902 - DNA, 75 bp, Artificial Sequence
  Synthetic
gggcgggcgagttcgcctacgggaagcggtcgcgcgaagaggagctgatctcgctgccgctggacgagagcaacc

SEQ ID NO: 239903 - DNA, 75 bp, Artificial Sequence
  Synthetic
tataacagcctggcccccaagggcgcccccaactccagtcagtgggacgctaaagaaaataatggtcagggagaa

SEQ ID NO: 239904 - DNA, 75 bp, Artificial Sequence
  Synthetic
ctgccatgggcggttataatatcacaaaggatggactgcaaataggaatagatgaaaacaaggaagaagatgaag

SEQ ID NO: 239905 - DNA, 75 bp, Artificial Sequence
  Synthetic
aaaggatggactgcaaataggaatagatgaaaacaaggaagaagatgaagaaggaagagaaattttcgcagttaa

SEQ ID NO: 239906 - DNA, 75 bp, Artificial Sequence
  Synthetic
aggactatctataaaaagtatacagagagttcagccatagcttagcccgcttaccagtagacagaaagcacagca

SEQ ID NO: 239907 - DNA, 75 bp, Artificial Sequence
  Synthetic
actctcatttcagaaccatgaaggctttcacagcttacgttctgtttagcttagtcacactcattgcagctgcag

SEQ ID NO: 239908 - DNA, 75 bp, Artificial Sequence
  Synthetic
ggagaggaaaactggcaaaacacagaaaacttctacggaggcagagctcttaaaaaagaaaccaaaatgaaacca

SEQ ID NO: 239909 - DNA, 75 bp, Artificial Sequence
  Synthetic
tctcctggataccaaaaaatatctggatagcaagaaagaaattgaagatgcaaaacagaaagcggcccaggcagg

SEQ ID NO: 239910 - DNA, 75 bp, Artificial Sequence
  Synthetic
aaaacttctacggaggcagagctcttaaaaaagaaaccaaaatgaaaccatgctatggttcttttgccagaccca

SEQ ID NO: 239911 - DNA, 75 bp, Artificial Sequence
  Synthetic
aggtggcagcattacattaaatggtacttttaaaaatactacatggacaagatatcacacaaatggttggaaaaa

SEQ ID NO: 239912 - DNA, 75 bp, Artificial Sequence
  Synthetic
ctgaaaaagagctggttattgaacccatcgagcaagatgaaagcaagagaagctataatgtgatcaagggtaccc

SEQ ID NO: 239913 - DNA, 75 bp, Artificial Sequence
  Synthetic
ttttaaaactggtgaaaatggaaagcctaccgaagagctagatatcgatcttgctttctttgatctcagacaaaa

SEQ ID NO: 239914 - DNA, 75 bp, Artificial Sequence
  Synthetic
acttttaaaaatactacatggacaagatatcacacaaatggttggaaaaaaatttgtgaatggaatgttacagct

SEQ ID NO: 239915 - DNA, 75 bp, Artificial Sequence
  Synthetic
ttctcacttcctcgtatcgattttgtgactcaacttccgggttcccacgttacgtcacttctgcccttacatgta

SEQ ID NO: 239916 - DNA, 75 bp, Artificial Sequence
  Synthetic
ttactattactgctacaaatattacttctggcagatacaaagctgacagttacaaaaaagaaattagaacttcat

SEQ ID NO: 239917 - DNA, 75 bp, Artificial Sequence
  Synthetic
ttctggcagatacaaagctgacagttacaaaaaagaaattagaacttcattttttagaaataataaaactacatt

SEQ ID NO: 239918 - DNA, 75 bp, Artificial Sequence
  Synthetic
attggagaatgctgctaaagctaatggtcctgcaagaggagacagtagcgtctcaagagaggttgaaaaggcagc

SEQ ID NO: 239919 - DNA, 75 bp, Artificial Sequence
  Synthetic
atgtaaacctggaaacaccagacactcatgtggtgtacaaacctggaacttcagatgacagttccgaaattaact

SEQ ID NO: 239920 - DNA, 75 bp, Artificial Sequence
  Synthetic
cctaccgaagagctagatatcgatcttgctttctttgatctcagacaaaatgacactggtggaaataacaatcaa

SEQ ID NO: 239921 - DNA, 75 bp, Artificial Sequence
  Synthetic
agccgtgcgtcgtgacgttatttgcatcaccgcttctcgtccaatcagcgttggctccgccccaaaaccgttaaa

SEQ ID NO: 239922 - DNA, 75 bp, Artificial Sequence
  Synthetic
tatgtcagcaatccatgcccaacagacctaactacattggatttagagataactttgttgggctgatgtactaca

SEQ ID NO: 239923 - DNA, 75 bp, Artificial Sequence
  Synthetic
tccctcacccacgtcttcaaccgcttccccgacaaccagatcctctgccgcccgcccgcgcccaccatcaccacc

SEQ ID NO: 239924 - DNA, 75 bp, Artificial Sequence
  Synthetic
atcgccatcactaatggggatgtttcactcaaggtgggagggggtcttactgttgaaaaagatagtggaaatcta

SEQ ID NO: 239925 - DNA, 75 bp, Artificial Sequence
  Synthetic
cggtggacagctatgatcccgatgtcaggatcattgagaatcacggtgtggaagatgaacttccaaactattgct

SEQ ID NO: 239926 - DNA, 75 bp, Artificial Sequence
  Synthetic
aagttacaactgataaacagttggaaattgcactggcttatccatttgaagtcagtaatggcaagcttggcataa

SEQ ID NO: 239927 - DNA, 75 bp, Artificial Sequence
  Synthetic
aattgcactggcttatccatttgaagtcagtaatggcaagcttggcataaaagcaggtcatggattgaaagtcat

SEQ ID NO: 239928 - DNA, 75 bp, Artificial Sequence
  Synthetic
aatgagaccctcgtgccgatgatgcttgaagaacatagaaatccaggtttggatatgcaaattactttcctgatt

SEQ ID NO: 239929 - DNA, 75 bp, Artificial Sequence
  Synthetic
tactgcttaccaaggtgttgaacctgatacaactgttgctggtacaaacgacaaatggaaagtaaatgctaaagt

SEQ ID NO: 239930 - DNA, 75 bp, Artificial Sequence
  Synthetic
ttggcaggtacgcttgtagttttgactggaaaaggaataggtactgaaaatcttgaaaacagtgatgggtcaagt

SEQ ID NO: 239931 - DNA, 75 bp, Artificial Sequence
  Synthetic
ctttccagtcgcaccttctaaaaaatgtctattctcatctcgcccagcaataacaccggctggggtcttactaga

SEQ ID NO: 239932 - DNA, 75 bp, Artificial Sequence
  Synthetic
ctggaaaaggaataggtactgaaaatcttgaaaacagtgatgggtcaagtagaggagttggtataaacgtaagac

SEQ ID NO: 239933 - DNA, 75 bp, Artificial Sequence
  Synthetic
taccacagctgaggaagaggctgctaaaaaagagttagttattttgccagtaacagaagatgaaagcaaaagaag

SEQ ID NO: 239934 - DNA, 75 bp, Artificial Sequence
  Synthetic
tgataaaaagggtgatttagttgcttggaataaacatgatgacagacgcactctatggacaactcccgacccatc

SEQ ID NO: 239935 - DNA, 75 bp, Artificial Sequence
  Synthetic
ctctatggacaactcccgacccatccccaaattgtacaatcgatcaggaaagggattcaaagctcactttagtat

SEQ ID NO: 239936 - DNA, 75 bp, Artificial Sequence
  Synthetic
aacggccgcgtggtagccccctcactggtggacgcctacatcaacatcggcgcccgctggtcgctggatcccatg

SEQ ID NO: 239937 - DNA, 75 bp, Artificial Sequence
  Synthetic
ggctaatgtctctttacttgttgtaaaaggaaaatttagtaacataaacaataatactaatccaactgataaaaa

SEQ ID NO: 239938 - DNA, 75 bp, Artificial Sequence
  Synthetic
aaaggaaaatttagtaacataaacaataatactaatccaactgataaaaaaatcacagtaaagctactttttaat

SEQ ID NO: 239939 - DNA, 75 bp, Artificial Sequence
  Synthetic
cgcccgctggtcgctggatcccatggacaatgtcaaccccttcaaccaccaccgcaacgcgggcctgcgctaccg

SEQ ID NO: 239940 - DNA, 75 bp, Artificial Sequence
  Synthetic
cgcggcggcgatatgccagacgcaagagccggcgggcggacggatcgcccaggcgccattcggagcacgcccgcc

SEQ ID NO: 239941 - DNA, 75 bp, Artificial Sequence
  Synthetic
cgacacttaagaaagaatattggaactacagaaatgataattctactgtatctcaggcctatgataatgcagttc

SEQ ID NO: 239942 - DNA, 75 bp, Artificial Sequence
  Synthetic
ctacagaaatgataattctactgtatctcaggcctatgataatgcagttccttttatgccaaacataaaagctta

SEQ ID NO: 239943 - DNA, 75 bp, Artificial Sequence
  Synthetic
cagcggcggttccggccccgcgggcaggggcggcagaggcacgtcggcgtggcgctcgggcaggtcccggtgctg

SEQ ID NO: 239944 - DNA, 75 bp, Artificial Sequence
  Synthetic
taccgcagctggtacctgtcctatacctacggggaccccgagaagggggtgcagtcgtggacgctgctcaccacc

SEQ ID NO: 239945 - DNA, 75 bp, Artificial Sequence
  Synthetic
gctaaaccagaagataaaaaaagtgctgctaaaagatacattgtgagcaatgtctatattggaggcttgccagat

SEQ ID NO: 239946 - DNA, 75 bp, Artificial Sequence
  Synthetic
aaaactgttgttataactattaagtttaatgcagaaactgaatgtgcttattcgattacctttgaattcacatgg

SEQ ID NO: 239947 - DNA, 75 bp, Artificial Sequence
  Synthetic
caaagcagacattgttatgtacactgaaaatgtcaaccttgaaacacctgacactcatgtggtgtacaaaccagg

SEQ ID NO: 239948 - DNA, 75 bp, Artificial Sequence
  Synthetic
ggtgtagttgtttagcagcacctcggtcccctcctcccagctctggtactccagtccccggcgggcggcgaactt

SEQ ID NO: 239949 - DNA, 75 bp, Artificial Sequence
  Synthetic
gccgccgccgcaccaccacccgccgccgtctggcccccgcccgcgtgcgccgcgtaaccacgcgccggggccgct

SEQ ID NO: 239950 - DNA, 75 bp, Artificial Sequence
  Synthetic
acagacccaactacattggcttcagagacaattttgtggggctcatgtattacaacagcactggcaacatgggtg

SEQ ID NO: 239951 - DNA, 75 bp, Artificial Sequence
  Synthetic
tgatgcccaactacgtgttgcatccttccatcatcccgacgccgggctaccgcggcacccggtactacgccagcc

SEQ ID NO: 239952 - DNA, 75 bp, Artificial Sequence
  Synthetic
ccaatgctgcctaccaaggtgtaaaggttcaagatggtgaagacggggataaagaaactgaatgggaaaaagata

SEQ ID NO: 239953 - DNA, 75 bp, Artificial Sequence
  Synthetic
cagagcttagcaaggtgctgacatccatggccaggggagtgaagagggagaggagcgatgggggcaataccggga

SEQ ID NO: 239954 - DNA, 75 bp, Artificial Sequence
  Synthetic
gtaagacttggaagtggaggaggtttgtcatttgataaagacggaaacctagtagcctggaacaaagatgatgat

SEQ ID NO: 239955 - DNA, 75 bp, Artificial Sequence
  Synthetic
aggagcgatgggggcaataccgggatgatgaccgagctgacggccagcctgatgaatcgcaagcgcccagagcgc

SEQ ID NO: 239956 - DNA, 75 bp, Artificial Sequence
  Synthetic
ccgcaggagaggcatggcaggcagcggcctgaaccgccgccggcggcgggccatgcgcaggcgcctgagtggcgg

SEQ ID NO: 239957 - DNA, 75 bp, Artificial Sequence
  Synthetic
acccatctccaaattgcaaaattgatcaggacaaagactccaaacttacttttgtattaactaaatgtgggagtc

SEQ ID NO: 239958 - DNA, 75 bp, Artificial Sequence
  Synthetic
tcaggacaaagactccaaacttacttttgtattaactaaatgtgggagtcagattttggctaatatgtctttgct

SEQ ID NO: 239959 - DNA, 75 bp, Artificial Sequence
  Synthetic
ataaataacaaagtaaatggaactgatgattataaaaaatttacaataaagttattatttgatgaaaagggtgtt

SEQ ID NO: 239960 - DNA, 75 bp, Artificial Sequence
  Synthetic
atgattataaaaaatttacaataaagttattatttgatgaaaagggtgttttattaaaagactctagtcttgata

SEQ ID NO: 239961 - DNA, 75 bp, Artificial Sequence
  Synthetic
taataacaatgttggaagtgcatatgaagaagctgttggttttatgccaagtacaacagcttatcctaaaccacc

SEQ ID NO: 239962 - DNA, 75 bp, Artificial Sequence
  Synthetic
gaagaagctgttggttttatgccaagtacaacagcttatcctaaaccacctactcctcctactaatcctacaact

SEQ ID NO: 239963 - DNA, 75 bp, Artificial Sequence
  Synthetic
ctcgtacgaggaggccgtcaaggccggcatgcccaccacgcgcatcatcgcgccgctggccacgggtgtgatgaa

SEQ ID NO: 239964 - DNA, 75 bp, Artificial Sequence
  Synthetic
gcacaccaacatgcccaatgtgaacgagtacatgttcaccagcaagtttaaggcgcgggtgatggtggctaggaa

SEQ ID NO: 239965 - DNA, 75 bp, Artificial Sequence
  Synthetic
ataaatacgtaagtaacgtctaccttggcggacaagcaggcaacccagttgccacaactgttagttttaataagg

SEQ ID NO: 239966 - DNA, 75 bp, Artificial Sequence
  Synthetic
ctcgggcacagcctacaacagcctggcccccaagggtgcccccaatcctagtcagtggattaccaaagaaaagca

SEQ ID NO: 239967 - DNA, 75 bp, Artificial Sequence
  Synthetic
atttgactttgcttggaacaaaacttatgaaaatgtgcagtttgattcctcctttttaactttctcctatattgc

SEQ ID NO: 239968 - DNA, 75 bp, Artificial Sequence
  Synthetic
ctaccgagggcaatgctagagtgagacactgctcttccctggatacgggctgcttctgcctggtgaagggcacag

SEQ ID NO: 239969 - DNA, 75 bp, Artificial Sequence
  Synthetic
cacgcccgctccaccgaaggcagctccggttgtgcagccccctccggtggcgaccgccgtgcgccgcgtccccgc

SEQ ID NO: 239970 - DNA, 75 bp, Artificial Sequence
  Synthetic
aacgggttaggccgcgtgtgtaccccggttcgagtcccctcgaatcaggctggagccgcgactaacgtggtattg

SEQ ID NO: 239971 - DNA, 75 bp, Artificial Sequence
  Synthetic
ctaccagggcttccatgtgcccgagggctacaaggaccgcatgtactccttcttccgcaacttccagcccatgag

SEQ ID NO: 239972 - DNA, 75 bp, Artificial Sequence
  Synthetic
tgcactcccagttcttgtgcgcgatcccgctgtggctgaagatgtaaccttgcaacatgcggcccatgacggtgc

SEQ ID NO: 239973 - DNA, 75 bp, Artificial Sequence
  Synthetic
ctaaagggagagcttaacttgtatgtgccttaccgccagagaacgcgcgaagatggccaccccctcgatgatgcc

SEQ ID NO: 239974 - DNA, 75 bp, Artificial Sequence
  Synthetic
ctgtcgacgcggtagcgttccatcagcacgttcatggtatccatgcccttctcccaggacgagaccagaggcaga

SEQ ID NO: 239975 - DNA, 75 bp, Artificial Sequence
  Synthetic
tcatgtggcgcatccccttctccagcaacttcatgtccatgggcgccctcaccgacctgggtcagaacatgctct

SEQ ID NO: 239976 - DNA, 75 bp, Artificial Sequence
  Synthetic
tctcgtccaatcagcgctggccccgccctaaattcaaaagctcatttgcatgttaacttttgtttactttgtggg

SEQ ID NO: 239977 - DNA, 75 bp, Artificial Sequence
  Synthetic
ctatctatataatataccccacaaagttaatatgcaaatgagcttttaaattttaacggttttagggcagggcca

SEQ ID NO: 239978 - DNA, 75 bp, Artificial Sequence
  Synthetic
gttaatatgcaaatgagcttttaaattttaacggttttagggcagggccaacgttaagtggttaacaagcggtaa

SEQ ID NO: 239979 - DNA, 75 bp, Artificial Sequence
  Synthetic
gagagctcgcggccatcgtgcgcgacctgggctgcgggccctactttttgggcacccacgacaagcgcttcccgg

SEQ ID NO: 239980 - DNA, 75 bp, Artificial Sequence
  Synthetic
gatgacgtataaaaaagtggactttaaacccggaaacggccgattttcccacggccacgcccggatatgaggtaa

SEQ ID NO: 239981 - DNA, 75 bp, Artificial Sequence
  Synthetic
tcgggcacagcttacaacagtctggcccccaagggcgcccccaactccagtcagtgggaacagaaaaaggccaat

SEQ ID NO: 239982 - DNA, 75 bp, Artificial Sequence
  Synthetic
gtaggagaagaaaactggcaggaaacagaagccttctatggaggaagggctcttaaaaaggaaaccaagatgaaa

SEQ ID NO: 239983 - DNA, 75 bp, Artificial Sequence
  Synthetic
tccgtgttaaatccggtgtttatgttacacatcagctgatccacagggtatttaaaccagttaagcccgtcaaga

SEQ ID NO: 239984 - DNA, 75 bp, Artificial Sequence
  Synthetic
ggtaacatctacgccatggagatcaacctccaggccaacctctggaagagttttctgtactcgaacgtggccttg

SEQ ID NO: 239985 - DNA, 75 bp, Artificial Sequence
  Synthetic
gactactcttgagtgccagcgagtagagttttctctaaactttgcttttaaagtttaagaaaaatgagacacctg

SEQ ID NO: 239986 - DNA, 75 bp, Artificial Sequence
  Synthetic
ttgcccacgtccaaaatggcttccatgtccggccacgcctccgcggcgaccgttgacccgtgcgtcgtgacgtca

SEQ ID NO: 239987 - DNA, 75 bp, Artificial Sequence
  Synthetic
caacaccaacacctacgagtacatgaacggccgcgtggtagccccctcgctggtggacgcctacatcaacatcgg

SEQ ID NO: 239988 - DNA, 75 bp, Artificial Sequence
  Synthetic
cagcgtcggccacgccctaaattcaaaagctcatttgcatattaacttttgtttactttgtggggtatattattg

SEQ ID NO: 239989 - DNA, 75 bp, Artificial Sequence
  Synthetic
gatcaccagtttgggaacagcaatctcggggaaggtctcgctccacatgcgccggctcatctgcagggcgcccag

SEQ ID NO: 239990 - DNA, 75 bp, Artificial Sequence
  Synthetic
tgggagggatgcatgcggggggagatgatgtgcagtttggcctggatcttgaggttggcgatgttgccgcccaga

SEQ ID NO: 239991 - DNA, 75 bp, Artificial Sequence
  Synthetic
cccatcccagccaaggccaccaacgtgcccatctccatcccctcgcgcaactgggccgcctttcgcggctggagt

SEQ ID NO: 239992 - DNA, 75 bp, Artificial Sequence
  Synthetic
tcagactatgcgtgtgtggttgtggaaaatcattttgtgttggacaatcctgaggtgccagggcaaggctgtaaa

SEQ ID NO: 239993 - DNA, 75 bp, Artificial Sequence
  Synthetic
ctttggcaaagacgtttctggggtcagagacatcgtaattatgctcctgggtgagatcatcataagacattttaa

SEQ ID NO: 239994 - DNA, 75 bp, Artificial Sequence
  Synthetic
tctgtgttacatgaaaatgagcttcagctttatttacagtaagtggagtaaatgtaagagaggctaagtgcttaa

SEQ ID NO: 239995 - DNA, 75 bp, Artificial Sequence
  Synthetic
attgttctgcccaccgtgcgctaccaccccagcatcctttaatttgtgtgctgtgatactgttgcagagagatgg

SEQ ID NO: 239996 - DNA, 75 bp, Artificial Sequence
  Synthetic
tttgttctgcccaccgtgcgctaccaccccagcatcctttaatttgtgtgctgtgatactgttgcagagagatgg

SEQ ID NO: 239997 - DNA, 75 bp, Artificial Sequence
  Synthetic
cttgttctgcccaccgtgcgctaccaccccagcatcctttaatttgtgtgctgtgatactgttgcagagagatgg

SEQ ID NO: 239998 - DNA, 75 bp, Artificial Sequence
  Synthetic
gttgttctgcccaccgtgcgctaccaccccagcatcctttaatttgtgtgctgtgatactgttgcagagagatgg

SEQ ID NO: 239999 - DNA, 75 bp, Artificial Sequence
  Synthetic
tgacacgcccctgcaagtgcgcagacccaccccggttagaccgagtggcgagaggcgagcggctgtttacaaaat

SEQ ID NO: 240000 - DNA, 75 bp, Artificial Sequence
  Synthetic
atcctgagatatgtgcagcagagcgtagggctgttcctgatgcaggagggggccacccccagcgccgcgctggac

SEQ ID NO: 240001 - DNA, 75 bp, Artificial Sequence
  Synthetic
tttctctgccacacatggcaagcggccatgggcgtgtggcagcagtgtctcgaggacgagaacctgaaggagctg

SEQ ID NO: 240002 - DNA, 75 bp, Artificial Sequence
  Synthetic
aggcggtccccgcccagcgagagcagctcttgcagggaagcaaagtttttcaggggcttgagtccgtcggccatg

SEQ ID NO: 240003 - DNA, 75 bp, Artificial Sequence
  Synthetic
acaaacgttaggaaattcctaatggatgtgtggagtattcttggggaatttaacaagacacgccggcttgtggag

SEQ ID NO: 240004 - DNA, 75 bp, Artificial Sequence
  Synthetic
tccccgcaccgctccctggtctgcaacccccagctcctgagcgagacccaggtcatcggtaccttcgagctgcaa

SEQ ID NO: 240005 - DNA, 75 bp, Artificial Sequence
  Synthetic
ggctccatcccctatctcgatgggaccttctacctcaaccacaccttcaagaaggtctccatcatgttcgactcc

SEQ ID NO: 240006 - DNA, 75 bp, Artificial Sequence
  Synthetic
ggctccagcgaaagagagctcgcgtccatcgtgcgcgacctgggctgcgggcctactttttgggcacccacgaca

SEQ ID NO: 240007 - DNA, 75 bp, Artificial Sequence
  Synthetic
tgagacaaaggcgcgcgtccacgccaagacaaaggaggccacgtgcgaggggtagcggtcgttgtccaccagggg

SEQ ID NO: 240008 - DNA, 75 bp, Artificial Sequence
  Synthetic
caagatagccctgcgcccagattgcaagtacagggtgactaagaccgtgaatattaaacatgcctgctacatctc

SEQ ID NO: 240009 - DNA, 75 bp, Artificial Sequence
  Synthetic
gatactctggacaagtcagccttcaggtgttgcatgatgggaatgagagcaggagtaatgaatatgaattccatg

SEQ ID NO: 240010 - DNA, 75 bp, Artificial Sequence
  Synthetic
gtgcgccgcgctggggagggccacgttgcggtactggtacttgggctgccacttgaactcggggatcaccagttt

SEQ ID NO: 240011 - DNA, 75 bp, Artificial Sequence
  Synthetic
gcaatgctagagtaagacactgctcttccctagagacgggctgcttttgcctggtgaagggcacagcctcgatta

SEQ ID NO: 240012 - DNA, 75 bp, Artificial Sequence
  Synthetic
ttgggttctcggaccgccggctcaagcagatttacagcttcgagtacgaggccatgctgcgccgcagcgccctgg

SEQ ID NO: 240013 - DNA, 75 bp, Artificial Sequence
  Synthetic
cccaggcaggtggcgagatcagaggagacagtgctgatactaaagctgcagaacaggcggctgaaaaagagctgg

SEQ ID NO: 240014 - DNA, 75 bp, Artificial Sequence
  Synthetic
cctcgagcagtccacccagaccgtgcaggggcccgactccgccgcctgcggacttttctgttgcatgttcttgca

SEQ ID NO: 240015 - DNA, 75 bp, Artificial Sequence
  Synthetic
tgcagcgcactctcgaagacgccgaggctctgttccacaagtactgcgcgctcactcttaaagactaaggcgcgc

SEQ ID NO: 240016 - DNA, 75 bp, Artificial Sequence
  Synthetic
gggcccggcgcgcgcatacctgatattgcttccctggaagagtgcccaaaatcttcgaagggctcggtcgggacg

SEQ ID NO: 240017 - DNA, 75 bp, Artificial Sequence
  Synthetic
cagaccaaggttcgtctgaactgtacaaccaacaggaagtaccttctctggactttccaaaacacctcactcgct

SEQ ID NO: 240018 - DNA, 75 bp, Artificial Sequence
  Synthetic
acatccatctccaccacgtggtccttgtggatcatcaccgtcccatgcagacacttgagctggccttccacctcg

SEQ ID NO: 240019 - DNA, 75 bp, Artificial Sequence
  Synthetic
gcatgaaggaagcccagagctcgcgggccatgagggtctggagctcgtcgcgaaagaggcggaactgctggccca

SEQ ID NO: 240020 - DNA, 75 bp, Artificial Sequence
  Synthetic
gaaggtcagttgcagaccgcgggcctcctcgttcatccaggtctggcacatcttttggaagatctcggtctgctc

SEQ ID NO: 240021 - DNA, 75 bp, Artificial Sequence
  Synthetic
tcctcgttcatccaggtctggcacatcttttggaagatctcggtctgctcgggcatgagcttgtaagcatcgcgc

SEQ ID NO: 240022 - DNA, 75 bp, Artificial Sequence
  Synthetic
gcagcacagttgctcctgaaacaactaacctttcttctgatactaacaaacctcgtgtcggaggtgagctttggg

SEQ ID NO: 240023 - DNA, 75 bp, Artificial Sequence
  Synthetic
taacctttcttctgatactaacaaacctcgtgtcggaggtgagctttgggttccatctctaacagagggtgggag

SEQ ID NO: 240024 - DNA, 75 bp, Artificial Sequence
  Synthetic
caccgagcctcccaggaggcgaagatggggcgccgccagccggctgatgcccaactacgtgttgcatccttccat

SEQ ID NO: 240025 - DNA, 75 bp, Artificial Sequence
  Synthetic
cctcgtgtcggaggtgagctttgggttccatctctaacagagggtgggagttctattgaagtggttgggtatttg

SEQ ID NO: 240026 - DNA, 75 bp, Artificial Sequence
  Synthetic
ttagcacgtttcgtcaggcaggcatgcaagatctccaacgtggagctgaccaactggtctcctgcctgggaatcc

SEQ ID NO: 240027 - DNA, 75 bp, Artificial Sequence
  Synthetic
tactgtcatgccacgaacagccacgatgtaacatcaccacaggcaatgagagaagcgaatgctctgtagttatca

SEQ ID NO: 240028 - DNA, 75 bp, Artificial Sequence
  Synthetic
atggctggtcagttgcaccacgcttctcccccagcggttctgggtcactttggccttgctgggttgctccttcaa

SEQ ID NO: 240029 - DNA, 75 bp, Artificial Sequence
  Synthetic
aggaggggggctacctggttaagcatgtctctgacttggaggttttcccgaacaagctcgctaaggaggcggtcc

SEQ ID NO: 240030 - DNA, 75 bp, Artificial Sequence
  Synthetic
catgaatactttgaccagtgtcgtgctgctctctcttttagtcattaatgtggaatgtgccgatcctattatagt

SEQ ID NO: 240031 - DNA, 75 bp, Artificial Sequence
  Synthetic
cagttgaatggtggggtggaagaaacattcagcaactgtgcatagggaatcaaaccaaacataaagagctaagtc

SEQ ID NO: 240032 - DNA, 75 bp, Artificial Sequence
  Synthetic
aatggagactactttggctttaaaaatgataacagcggtatgaaacattataaagttacagttataccccctaaa

SEQ ID NO: 240033 - DNA, 75 bp, Artificial Sequence
  Synthetic
ttagtgaatatggcacattgtgtgagggtaaaaaaattttgcataaagaattgaatcacacctgtaacgaacaga

SEQ ID NO: 240034 - DNA, 75 bp, Artificial Sequence
  Synthetic
agcatgccgaagaagaacaggagccgctagtggaagagatggaagaagaatgggacagccagcagaagaagacga

SEQ ID NO: 240035 - DNA, 75 bp, Artificial Sequence
  Synthetic
gctagtggaagagatggaagaagaatgggacagccagcagaagaagacgaatgggaagaagagacagaagaagaa

SEQ ID NO: 240036 - DNA, 75 bp, Artificial Sequence
  Synthetic
catgccccacatcgaggccctcgatgaaagtcaggagcagcgccccgaggacgcccggcccgtggtcagcgacga

SEQ ID NO: 240037 - DNA, 75 bp, Artificial Sequence
  Synthetic
tttgacaaatacaatgttgacagagagcagtatgaggtttctataattagtttattcaaagtaggggcgggtcaa

SEQ ID NO: 240038 - DNA, 75 bp, Artificial Sequence
  Synthetic
gcacagacaccgtcgccgcaccatccgcgccgcagcccggcggtcacggatacaactcgcagtccgccaagctcc

SEQ ID NO: 240039 - DNA, 75 bp, Artificial Sequence
  Synthetic
ctgccattgccgctcctgattactctaaatgcaaatttgtggaactatggaatttcttagactgctatgatgcta

SEQ ID NO: 240040 - DNA, 75 bp, Artificial Sequence
  Synthetic
cggtaagcacgagcggcagggctacgaatcatggaggcccacaaagcgggatcatcgcctgcttgcaagactgcg

SEQ ID NO: 240041 - DNA, 75 bp, Artificial Sequence
  Synthetic
atgtaactttgattaatgtcacaaaaccatacgaaggaagctattatggctccagcgatgatggttcaagtcatt

SEQ ID NO: 240042 - DNA, 75 bp, Artificial Sequence
  Synthetic
gtcagaccttacaccacaaagggcactacagcaaatgcaacagatggcaatggtctcaaaaatgctttgcaacag

SEQ ID NO: 240043 - DNA, 75 bp, Artificial Sequence
  Synthetic
tggtctcaaaaatgctttgcaacaggaaaatgggcaaacagaaaatgatcaaaaatcaaaaattccatcaactac

SEQ ID NO: 240044 - DNA, 75 bp, Artificial Sequence
  Synthetic
agaagggcatcttctgcctggtcaaacaggcaaagatcacctacgagctcgtgtccggcggcaaacagcatcgcc

SEQ ID NO: 240045 - DNA, 75 bp, Artificial Sequence
  Synthetic
gcctgaggcagacgctgaaaggcgggctgcccgacttcatgagccagagcatgttgcaaaactaccgcactttca

SEQ ID NO: 240046 - DNA, 75 bp, Artificial Sequence
  Synthetic
ctggccgagatcgtcttccccgagcgcctgaggcagacgctgaaaggcgggctgcccgacttcatgagccagagc

SEQ ID NO: 240047 - DNA, 75 bp, Artificial Sequence
  Synthetic
cttgcgttctgattagcctagtcacacttagtttagctgcttacactcaagttagtgttcataggggaggtaata

SEQ ID NO: 240048 - DNA, 75 bp, Artificial Sequence
  Synthetic
ttacattagatggaccattaaaaaataccacatggttaaggtttcatttaaataattggcatcacatttgtactt

SEQ ID NO: 240049 - DNA, 75 bp, Artificial Sequence
  Synthetic
taccacatggttaaggtttcatttaaataattggcatcacatttgtacttggtctggtatttcatacaaatgtca

SEQ ID NO: 240050 - DNA, 75 bp, Artificial Sequence
  Synthetic
ctccgctgaaactcacgccggggttgtggacttccgcgtacctgcgcaaatttgtacccgaggactaccacgccc

SEQ ID NO: 240051 - DNA, 75 bp, Artificial Sequence
  Synthetic
ttccttgtcaaaataatcaatttttaaggatgcatcatccaaggccatttgccacttgcgggcggccagggctcg

SEQ ID NO: 240052 - DNA, 75 bp, Artificial Sequence
  Synthetic
gcttataacattacatctggaatctataaagccgaaggataccaaagagaaactagaacttcatattttaaaaat

SEQ ID NO: 240053 - DNA, 75 bp, Artificial Sequence
  Synthetic
ataaagccgaaggataccaaagagaaactagaacttcatattttaaaaatgaaagaaatacatttgaagatagtg

SEQ ID NO: 240054 - DNA, 75 bp, Artificial Sequence
  Synthetic
tttattcaatctaacaataattgaaccaccaactactaaagcacccactaccactaaaccaaccacagttaggac

SEQ ID NO: 240055 - DNA, 75 bp, Artificial Sequence
  Synthetic
tggggtcctgtcactcaaactggctgacccaatcgccatcactaatggggatgtctcactcaaggtgggaggggg

SEQ ID NO: 240056 - DNA, 75 bp, Artificial Sequence
  Synthetic
accacagccagtacaactgttgagaccactactcacactacacagctagacactacagtacataatagtactgtg

SEQ ID NO: 240057 - DNA, 75 bp, Artificial Sequence
  Synthetic
agaggagtcgccggaggaggcctgaggatcgcggcgaacgagccattgaccaccagggagctgaggaaccggatc

SEQ ID NO: 240058 - DNA, 75 bp, Artificial Sequence
  Synthetic
tgctacatctgctgccgcaagcgtcccaggtcatacaatcatatggtagacccactactcagcttctcttactga

SEQ ID NO: 240059 - DNA, 75 bp, Artificial Sequence
  Synthetic
accgaaaatcaagattgatccatacaccacaaagggaacaaccactgaaaatcatcatgagtttgaattacaaca

SEQ ID NO: 240060 - DNA, 75 bp, Artificial Sequence
  Synthetic
gcgtaggagtcttgcagcttggcaaccagctcggcagtgacaaggacgtccatggcgcagtagtccagcgtttcg

SEQ ID NO: 240061 - DNA, 75 bp, Artificial Sequence
  Synthetic
gcgcactctcgaagacgccgaggctctgtttcacaagtactgcgcgctcactcttaaagactaaggcgcgcccac

SEQ ID NO: 240062 - DNA, 75 bp, Artificial Sequence
  Synthetic
gatatagaaaaagactcaaaactaactttggtactgacaaagtgcggaagtcagattttggcaaatgtatctcta

SEQ ID NO: 240063 - DNA, 75 bp, Artificial Sequence
  Synthetic
catgaaggctttcacagcttgcgttctgattagcatagtcacacttagtgcagctgctggtaaatgctatcatac

SEQ ID NO: 240064 - DNA, 75 bp, Artificial Sequence
  Synthetic
attacacttacaggggcaggaatcaacactacatggacagcttatcacaacgatggaaaggggcaaaatggttgg

SEQ ID NO: 240065 - DNA, 75 bp, Artificial Sequence
  Synthetic
gaggcacacagctcaacgacgagttggtgagctcttcgatcggtctgcgaccggacggagtgttccaactagccg

SEQ ID NO: 240066 - DNA, 75 bp, Artificial Sequence
  Synthetic
cgatggaaaggggcaaaatggttggttgcccatctgtacatggggcgatcccatctatgtgtgccatggaaatag

SEQ ID NO: 240067 - DNA, 75 bp, Artificial Sequence
  Synthetic
gcggagcgaggtgtgcgtcagggcaaaggtgtccctgaccatgactttcaaaaactggtacttaaagtccgagtc

SEQ ID NO: 240068 - DNA, 75 bp, Artificial Sequence
  Synthetic
gtagcttacaaaaatttaactgacagaactattaaggcatatagctatgagaacaaagatgattatgaaacagta

SEQ ID NO: 240069 - DNA, 75 bp, Artificial Sequence
  Synthetic
taattgagattccatccactagagtacccaccacagttaggacaactatggaaacaacacagcctacaactgtgc

SEQ ID NO: 240070 - DNA, 75 bp, Artificial Sequence
  Synthetic
ggaaagggcccgggacgcaggctcggttgttgataacctgggcggctaggacaatctcgtcaaagccgttgatgt

SEQ ID NO: 240071 - DNA, 75 bp, Artificial Sequence
  Synthetic
gctgcggggtggacttcaccgagagccgcctgagcaacctcctgggcattcgcaagaagcaacctttccaagagg

SEQ ID NO: 240072 - DNA, 75 bp, Artificial Sequence
  Synthetic
ttgttgagcttccaaccactaaagcgcccacacagtctactacacatccaaccaccacagccagaacaactactc

SEQ ID NO: 240073 - DNA, 75 bp, Artificial Sequence
  Synthetic
aaccactacacagtcagacactacagtgcagaatactactttattgattgggtttttactaagagagaatgacag

SEQ ID NO: 240074 - DNA, 75 bp, Artificial Sequence
  Synthetic
ggctagacttcatggcttgtggccccctaccaaggataacatggttgggttttctttggcttttgtgatcatggc

SEQ ID NO: 240075 - DNA, 75 bp, Artificial Sequence
  Synthetic
ggcagctttttaagctcctcgtaggtaaggtcctcagggcattgcaggccgtgctgctccagtgcccactcctgg

SEQ ID NO: 240076 - DNA, 75 bp, Artificial Sequence
  Synthetic
tattacttggtgattgtggggatagtcatggtctgctcctgcactttctttgccatcatgatctacccctgtttt

SEQ ID NO: 240077 - DNA, 75 bp, Artificial Sequence
  Synthetic
tttcgggggtgatgcagtaaaaggtaagggggtcccgctcccagcgatcccagcgtaaacgcacggcaagatcgc

SEQ ID NO: 240078 - DNA, 75 bp, Artificial Sequence
  Synthetic
tctcttcgcagaaccatgaatacagtgatccgtatcgtgctgctctctcttcttgtaacttttagtcaggcagga

SEQ ID NO: 240079 - DNA, 75 bp, Artificial Sequence
  Synthetic
tcttgtaacttttagtcaggcaggattcataccatcaatgctacatggtgggctaatataactttagtgggacct

SEQ ID NO: 240080 - DNA, 75 bp, Artificial Sequence
  Synthetic
gtgttgaacttcccaacaacctttccagtggactgagttacgatacacgtagagctaagctcatcctctacaatc

SEQ ID NO: 240081 - DNA, 75 bp, Artificial Sequence
  Synthetic
gactgtctcgggcccttccccacctacctcctctttgccctgctcacctgcacctgcgtctgcagcattgtctgc

SEQ ID NO: 240082 - DNA, 75 bp, Artificial Sequence
  Synthetic
cgtttcggaggtgagctaaggcttcccccttctgaggagggggttagcccatacgaagtggtcgggtatttgatt

SEQ ID NO: 240083 - DNA, 75 bp, Artificial Sequence
  Synthetic
cccattcccatttccccaattattcataagaataaatcattggaattaatcattcaataaaatcacttacttgaa

SEQ ID NO: 240084 - DNA, 75 bp, Artificial Sequence
  Synthetic
aatgtctattctcatctcgcccagcaataacaccggctggggtcttactaggcccagcaccatgtacggaggagc

SEQ ID NO: 240085 - DNA, 75 bp, Artificial Sequence
  Synthetic
cccaaaaactgcatgctggaataagctctctttgtgtctccggtgatgccttccaataggtgagtgataaagcga

SEQ ID NO: 240086 - DNA, 75 bp, Artificial Sequence
  Synthetic
aaactggctgacccaatcgccatcaccaatgggaatgtctcactcaaggtgggagggggacttactgttgaacaa

SEQ ID NO: 240087 - DNA, 75 bp, Artificial Sequence
  Synthetic
ctaaggctcccttgcaagttgcaactgataatcaactggagatttcactggctgatccattcgaagtaaaaaaca

SEQ ID NO: 240088 - DNA, 75 bp, Artificial Sequence
  Synthetic
gcctatgagctgccccagcagaagcagaagttcacctgcatggtgggcgtcaaccccatagtcatcacccagcag

SEQ ID NO: 240089 - DNA, 75 bp, Artificial Sequence
  Synthetic
tgataatcaactggagatttcactggctgatccattcgaagtaaaaaacaaaaaactaagtttaaaggttggcca

SEQ ID NO: 240090 - DNA, 75 bp, Artificial Sequence
  Synthetic
catggtatgatggaaagggaatgcagttttgtgatggaaatacaattaagaacccacaaatcaagcatagctgta

SEQ ID NO: 240091 - DNA, 75 bp, Artificial Sequence
  Synthetic
catgaactgctcgatctcctcctcctggagatcgccgcgacccgcacgctcgacggtagcggcaaggtcattcga

SEQ ID NO: 240092 - DNA, 75 bp, Artificial Sequence
  Synthetic
atttcaactttgcaaggactactaggaaacttagtagttctaactggtatgggaattggaactgaagaactaaaa

SEQ ID NO: 240093 - DNA, 75 bp, Artificial Sequence
  Synthetic
gaaacttagtagttctaactggtatgggaattggaactgaagaactaaaaaaggacgataaaatagttgggtctg

SEQ ID NO: 240094 - DNA, 75 bp, Artificial Sequence
  Synthetic
tgcccactgggtggccctcgcggacatacaaaaatcggtccgtgtggttaaagagcagcacagttagctcctgtc

SEQ ID NO: 240095 - DNA, 75 bp, Artificial Sequence
  Synthetic
tggcggactgacatttgataaaaagggagacttagttgcttggaacaaagagaatgacaggcgcaccctttggac

SEQ ID NO: 240096 - DNA, 75 bp, Artificial Sequence
  Synthetic
ggagacttagttgcttggaacaaagagaatgacaggcgcaccctttggacaactccagacccatctccaaactgc

SEQ ID NO: 240097 - DNA, 75 bp, Artificial Sequence
  Synthetic
agcttactctagttttaacaaagtgcggaagtcagattctggccagtgtatcattgcttgttgttaaagggaagt

SEQ ID NO: 240098 - DNA, 75 bp, Artificial Sequence
  Synthetic
cggaagtcagattctggccagtgtatcattgcttgttgttaaagggaagtttgccaatattaacaataaaacaaa

SEQ ID NO: 240099 - DNA, 75 bp, Artificial Sequence
  Synthetic
tcagttaaattattgtttgatgccaatggtaaattattgacaggatcaagcctagatggaaattattggaattat

SEQ ID NO: 240100 - DNA, 75 bp, Artificial Sequence
  Synthetic
atggtaaattattgacaggatcaagcctagatggaaattattggaattataaaaacaaggatagtgtgattgggt

SEQ ID NO: 240101 - DNA, 75 bp, Artificial Sequence
  Synthetic
gttgaacaaggtaataaagggaaacctaatactgctcaaagtggtggtaaaaaaaccaaaacagaacatagaaac

SEQ ID NO: 240102 - DNA, 75 bp, Artificial Sequence
  Synthetic
tatgcctaattccacagcttatcctaaaatcatcaataatggaacagctaatcctgaagataaaaaaagtgcagc

SEQ ID NO: 240103 - DNA, 75 bp, Artificial Sequence
  Synthetic
gcccgccgctacctgctgttccaccgcggggtaaacatcccccgcaacgtgttgcattactaccgtcaccttcac

SEQ ID NO: 240104 - DNA, 75 bp, Artificial Sequence
  Synthetic
tgttgcccacgtccaaaatggcttacatgtccggccacgcctccgcggcgagcgtcggccgtgcgtcgtgacgtc

SEQ ID NO: 240105 - DNA, 75 bp, Artificial Sequence
  Synthetic
ccgtggctaccactattagtttcaacaaagaaactgaatctaattgtgtttattctataacctttgactttgctt

SEQ ID NO: 240106 - DNA, 75 bp, Artificial Sequence
  Synthetic
ggaacaaaacttacaaaaatgttccatttgattcatcttcgctaacattttcatatattgcccaagatgccgaag

SEQ ID NO: 240107 - DNA, 75 bp, Artificial Sequence
  Synthetic
gccaatcgcagtcacaaggtaagcttaaacacgtagcagccctgtggacactgttacaattgcgattgctaatga

SEQ ID NO: 240108 - DNA, 75 bp, Artificial Sequence
  Synthetic
ctgttacaattgcgattgctaatgatgtaattgaagtaggcgtttttcaggcggcggatggtggcaagaaggacc

SEQ ID NO: 240109 - DNA, 75 bp, Artificial Sequence
  Synthetic
aaatcacaaaactgttaaaattaagccacataccagagaacctcctgctgtacaagaaaaacagtttgaattaca

SEQ ID NO: 240110 - DNA, 75 bp, Artificial Sequence
  Synthetic
atacagatggtagcagcagaggaattggtataaatgtaagagcaagagaagggttgacatttgacaatgatggat

SEQ ID NO: 240111 - DNA, 75 bp, Artificial Sequence
  Synthetic
acgcacggcgtcaacggtcggcgcggaggcgtggcctagcccggaagcaagtcgcggggctgatgacgtataaaa

SEQ ID NO: 240112 - DNA, 75 bp, Artificial Sequence
  Synthetic
tataatccacacagtttcctggcgagccaaacgggggtcggtgattgagatgaagccgtcctctgaaaagtcatc

SEQ ID NO: 240113 - DNA, 75 bp, Artificial Sequence
  Synthetic
ggcggagtcttccatgcgggtgaccccgacgcccctaagcggctgcacgagcgccaggtcggcgacgacacgctc

SEQ ID NO: 240114 - DNA, 75 bp, Artificial Sequence
  Synthetic
aacccagacatggtcatgtatgctgagaatatgaatctggagacgccagatacacatgtggtgtacaaacctgga

SEQ ID NO: 240115 - DNA, 75 bp, Artificial Sequence
  Synthetic
gacatatggaatttcttagactgctatcaggagaaaattgatatgccctcctattacttggtgattgtgggaata

SEQ ID NO: 240116 - DNA, 75 bp, Artificial Sequence
  Synthetic
ttcaaaatcatgtatgaggatctagaaggtggcaacattcccgccctcctggataccaaaaaatatctggaaagt

SEQ ID NO: 240117 - DNA, 75 bp, Artificial Sequence
  Synthetic
tgctggaggactttgtgaatacagtattggaggacgaactgcatccaagtccgttcgagctgggacccacacttc

SEQ ID NO: 240118 - DNA, 75 bp, Artificial Sequence
  Synthetic
aaaagcagtggtaaaaataaaattgtgagtaatgtgtattttggaggtgaggtttatcagccaggagttatagtt

SEQ ID NO: 240119 - DNA, 75 bp, Artificial Sequence
  Synthetic
caaactgtgcttactccataactttgaaatttggatggggaaagacatatgaaacacccataccatttgatacct

SEQ ID NO: 240120 - DNA, 75 bp, Artificial Sequence
  Synthetic
agaagttacaacctgatcaaggatacccatgataccctgtaccgaagctggtacctgtcctatacctacggggac

SEQ ID NO: 240121 - DNA, 75 bp, Artificial Sequence
  Synthetic
tacctgaattggaagaggaggacgagctagacctccggtgttatgaggaaggttttcctcccagcgattcagagg

SEQ ID NO: 240122 - DNA, 75 bp, Artificial Sequence
  Synthetic
gttaggacaactacagaaacaaccacacatccaaccactactcacactacagtgcaaaatactactttattgatt

SEQ ID NO: 240123 - DNA, 75 bp, Artificial Sequence
  Synthetic
taaagtgttttgaactgaatttatgtatctttattgatttttacaccagcacgggtagtcagcctcccaccacca

SEQ ID NO: 240124 - DNA, 75 bp, Artificial Sequence
  Synthetic
taaatctttttctcttcgcagaaccatgaatactttgaccagtgtcgtgctgctctctcttcttgtagcttttag

SEQ ID NO: 240125 - DNA, 75 bp, Artificial Sequence
  Synthetic
ttgttcagtcagtgaagccctggtctcctcatcagatcgtggtaaacgggccctgcgatatggatgatggcggag

SEQ ID NO: 240126 - DNA, 75 bp, Artificial Sequence
  Synthetic
tgctgcagatgggatcgggatcgcaagtctctctgactatgatccccacagccttcagcatcagtctcctggtgc

SEQ ID NO: 240127 - DNA, 75 bp, Artificial Sequence
  Synthetic
aacttagtttaaaagtaggacatggattaaaaatattagatgacaaaagtgctggagggttgaaagatttaattg

SEQ ID NO: 240128 - DNA, 75 bp, Artificial Sequence
  Synthetic
ctcgacgggaccttctacctcaaccacaccttcaaaaaggtctccatcatgttcgactcctcggtcagctggccc

SEQ ID NO: 240129 - DNA, 75 bp, Artificial Sequence
  Synthetic
ctccggtttctggagacactggtttggaactcctctatctcgcctggtgtacactgttaagaaggattatcagga

SEQ ID NO: 240130 - DNA, 75 bp, Artificial Sequence
  Synthetic
gagaaaattgatatgccctcctattacttggtgattgtgggaatagtcatggtctgctcctgcactttctttgcc

SEQ ID NO: 240131 - DNA, 75 bp, Artificial Sequence
  Synthetic
caactcgggcttcaccggctacctcgcacccaccatgcgccaggggcagccctaccccgccaacttcccctaccc

SEQ ID NO: 240132 - DNA, 75 bp, Artificial Sequence
  Synthetic
cgcctccccgcagaaatcagttcccactgattcagtacttagaagagccccctccccggcccccttccactgtta

SEQ ID NO: 240133 - DNA, 75 bp, Artificial Sequence
  Synthetic
tgactgaccaccacctggacctcgagatggacggccaggcctccgagcagcgcatcctgcaactgcgcgtccgtc

SEQ ID NO: 240134 - DNA, 75 bp, Artificial Sequence
  Synthetic
gatggacggccaggcctccgagcagcgcatcctgcaactgcgcgtccgtcagcagcaggagcgggccgccaagga

SEQ ID NO: 240135 - DNA, 75 bp, Artificial Sequence
  Synthetic
gtaaaaagtcactcaagtcctcagccaccacagctgccaactctgagcctgggctaagcgtgggactggcaagcg

SEQ ID NO: 240136 - DNA, 75 bp, Artificial Sequence
  Synthetic
cagatgctaccttaagtgcctttagcagcactgcaaatttaactttgcttgcttggactaataaaaccggagtat

SEQ ID NO: 240137 - DNA, 75 bp, Artificial Sequence
  Synthetic
cgcaggtgacagcgttccccaccgctgtgttggtgaaaacacacagacaaatcaaaaaggactctattttcaagg

SEQ ID NO: 240138 - DNA, 75 bp, Artificial Sequence
  Synthetic
tgctcaactgtagcttcgagcagtggctctactctcacatcgataattaaaatcacattaaaggctggccctcca

SEQ ID NO: 240139 - DNA, 75 bp, Artificial Sequence
  Synthetic
aatagttgactaaaacaccaggtaccacaatgtggtagctgacaccgtggcgctcaagcatggttagtagagatg

SEQ ID NO: 240140 - DNA, 75 bp, Artificial Sequence
  Synthetic
ctccgcacatgtggaaaagctcccacagcgccccctccactttcataatcaggcagaccttcatattagaaacag

SEQ ID NO: 240141 - DNA, 75 bp, Artificial Sequence
  Synthetic
cgcggacatacaaaaatcggtccgtgtggttaaagagcagtacagtgagctcctgtcttctaccggcaaagatca

SEQ ID NO: 240142 - DNA, 75 bp, Artificial Sequence
  Synthetic
gtccccggcgggcggcgaacttcctccacaccttgaaagggatgtcaaattcctggtccacaattttcattgtct

SEQ ID NO: 240143 - DNA, 75 bp, Artificial Sequence
  Synthetic
tcagcacgctcactctcaggtgaagcaaaaccaccccatgcggaggaatgtggaaagattcggggcaaaagaaat

SEQ ID NO: 240144 - DNA, 75 bp, Artificial Sequence
  Synthetic
caaaaccaccccatgcggaggaatgtggaaagattcggggcaaaagaaattatatctattgctagacccttcctg

SEQ ID NO: 240145 - DNA, 75 bp, Artificial Sequence
  Synthetic
attaaaaatgtataatttaacaataattgaaccaccaactactaaagcacccactaccactaagcctaccacagt

SEQ ID NO: 240146 - DNA, 75 bp, Artificial Sequence
  Synthetic
attgaaccaccaactactaaagcacccactaccactaagcctaccacagttaagacaagcaggaaaattagcaca

SEQ ID NO: 240147 - DNA, 75 bp, Artificial Sequence
  Synthetic
actcaaactagctgacccaatagccatcgtcaatgggaatgtctcactcaaagtgggagggggtctcactttgca

SEQ ID NO: 240148 - DNA, 75 bp, Artificial Sequence
  Synthetic
ctaccactgtacctactacacaaccaaccatcatagccagtacaactactgagaccacaactcacactacacagc

SEQ ID NO: 240149 - DNA, 75 bp, Artificial Sequence
  Synthetic
aaaccctactcgggaacggcttacaacagtctggcccccaagggcgcccccaactccagtcagtgggagcagaaa

SEQ ID NO: 240150 - DNA, 75 bp, Artificial Sequence
  Synthetic
caaacaacaaattagggattgctttggacgctccatttgatgttatagataataaactcacattgttagcgggcc

SEQ ID NO: 240151 - DNA, 75 bp, Artificial Sequence
  Synthetic
aaaacacttccgcgttctcacttcctcgtatcgatttcgtgactcaacttccgggttcccacgttacgtcacttc

SEQ ID NO: 240152 - DNA, 75 bp, Artificial Sequence
  Synthetic
agaaatttttgcagacaaaacattccagccagaacctcaagtaggagaggagaactggcaagaaacttttaattt

SEQ ID NO: 240153 - DNA, 75 bp, Artificial Sequence
  Synthetic
gatcaagtgccatatgcacctgggagccagaaggggtaccttccagccgtaccagtgcaactttagccagaccaa

SEQ ID NO: 240154 - DNA, 75 bp, Artificial Sequence
  Synthetic
cagccagaacctcaagtaggagaggagaactggcaagaaacttttaatttctatggaggcagggctctcaagaag

SEQ ID NO: 240155 - DNA, 75 bp, Artificial Sequence
  Synthetic
ttgtggttcttctttactttgtcttttgcaaagccagacaaaaatctcatagaacaatctacaggccagtgattg

SEQ ID NO: 240156 - DNA, 75 bp, Artificial Sequence
  Synthetic
gatcctttgccagaccaatgaatgaaaaaggaggacaggctaaattcctaacaaaagaaaatggagaattgactg

SEQ ID NO: 240157 - DNA, 75 bp, Artificial Sequence
  Synthetic
cggccacgccctaaattcaaaagctcatttgcatattaacttttgtttactttgtggggtatattattgatgatg

SEQ ID NO: 240158 - DNA, 75 bp, Artificial Sequence
  Synthetic
aagatcaggacatagatttgaacttctttgatattaataacccagatacaggaggtgttgcaaatcagcctgaca

SEQ ID NO: 240159 - DNA, 75 bp, Artificial Sequence
  Synthetic
tgcaaatgacgtcacgacgcacggctaacggtcgccgcggaggcgtggcctagcctggaagcaagtcgcggggct

SEQ ID NO: 240160 - DNA, 75 bp, Artificial Sequence
  Synthetic
gtttacaagtcaggtaaagaggatgacagctctgaagctaacttgctacaacagtccatgccaaacagacccaac

SEQ ID NO: 240161 - DNA, 75 bp, Artificial Sequence
  Synthetic
gaccgagaaaaatgagacacctgcgccttctaccttcaactgtgcccggggacctggctgtgattatgctggagg

SEQ ID NO: 240162 - DNA, 75 bp, Artificial Sequence
  Synthetic
ccgtgcgtcgtgacgtcatttgcatcaccgcttctcgtccaatcagcgttgactccgccccaaaaccgttaaaat

SEQ ID NO: 240163 - DNA, 75 bp, Artificial Sequence
  Synthetic
tgaatttgaaaccacctcttttaccttttcctatatcgcccaagaatgaaagaccaataaacgtgtttttcattt

SEQ ID NO: 240164 - DNA, 75 bp, Artificial Sequence
  Synthetic
tagcccggaagcaagtcgcggggccgatgacgtataaaaaagcggactttaaacccggaaacggccgattttccc

SEQ ID NO: 240165 - DNA, 75 bp, Artificial Sequence
  Synthetic
gaatggcatgggttcaaatgctgcataccaaggtgttaagccaaaagataacggcggatgggatccaaatactaa

SEQ ID NO: 240166 - DNA, 75 bp, Artificial Sequence
  Synthetic
aatttaatatttccagaatctatgattcttcaggctgacatagccagtgaagccatagttactcctctacatact

SEQ ID NO: 240167 - DNA, 75 bp, Artificial Sequence
  Synthetic
tcgcgggctcgacgatgcgttttccgtccttgccttccttcaacagaaccggcggctggctgaatcccactccca

SEQ ID NO: 240168 - DNA, 75 bp, Artificial Sequence
  Synthetic
aattactcataagaataaatcattggaactaatcattcaataaagatcacttacttgaaatctgaaagtatgtct

SEQ ID NO: 240169 - DNA, 75 bp, Artificial Sequence
  Synthetic
aaataaaactcaccaaggccatagcgtgcgttctcttccttgttagaaatgaggcgcgcggtggtgtcctctcct

SEQ ID NO: 240170 - DNA, 75 bp, Artificial Sequence
  Synthetic
accggctacctcgcacccaccatgcgccaggggcagccctaccccgccaacttcccctacccgctcatcggctcc

SEQ ID NO: 240171 - DNA, 75 bp, Artificial Sequence
  Synthetic
accattaaattgttgtttgataaaaatggagtccttatggaatcttcaaatcttggtaaatcatattggaacttt

SEQ ID NO: 240172 - DNA, 75 bp, Artificial Sequence
  Synthetic
gcatatgatgctccatttgatgttaaaaacaacatgcttactattaaagcaggccatggcttagcagtggtaaca

SEQ ID NO: 240173 - DNA, 75 bp, Artificial Sequence
  Synthetic
agttacgcctccgcggcgaccgttagccgtgcgtcgtgacgtcatttgcatcaacgtttctcggccaatcagcag

SEQ ID NO: 240174 - DNA, 75 bp, Artificial Sequence
  Synthetic
tagccccgccctaaatttaaaacctcatttgcatattaacttttgtttactttgtggggtatattattgatgatg

SEQ ID NO: 240175 - DNA, 75 bp, Artificial Sequence
  Synthetic
ggcgcactctatggacaactccagacacatctccaaattgcaaaatgagtaaagaaaaagattcaaagcttactc

SEQ ID NO: 240176 - DNA, 75 bp, Artificial Sequence
  Synthetic
aaagaaaaagattcaaagcttactcttaccctaacaaaatgtggaagccaaattctaggaagtgtatctttatta

SEQ ID NO: 240177 - DNA, 75 bp, Artificial Sequence
  Synthetic
tgaccacaaacactaatagaataataacaattaaattgttgttcgatgctaagggtgtcttattgacttcttctt

SEQ ID NO: 240178 - DNA, 75 bp, Artificial Sequence
  Synthetic
ggaaggtctcgctccacatgcgccggctcatctgcagggcgcccagcatgtccggggcggagatcttgaaatcgc

SEQ ID NO: 240179 - DNA, 75 bp, Artificial Sequence
  Synthetic
gccctggagcagcggcgcaagctcatgctggccgtggtcctggtcaccctcgagctcgaatgcatgcgccgcttc

SEQ ID NO: 240180 - DNA, 75 bp, Artificial Sequence
  Synthetic
aagccacccagaatgcaaacagagttgctgcaaatggaggtggtgaaattaggggagatacttttcttaccaccg

SEQ ID NO: 240181 - DNA, 75 bp, Artificial Sequence
  Synthetic
aacaattaaattgttgttcgatgctaagggtgtcttattgacttcttcttcaattagtggtgattactggaactt

SEQ ID NO: 240182 - DNA, 75 bp, Artificial Sequence
  Synthetic
aataaatatgaaaatgcagtggcgtttatgcctaatttaactgcatatcctaaaccaactacaacgaaaagttac

SEQ ID NO: 240183 - DNA, 75 bp, Artificial Sequence
  Synthetic
ttatgcctaatttaactgcatatcctaaaccaactacaacgaaaagttacgctaggagctacatttatggaaacg

SEQ ID NO: 240184 - DNA, 75 bp, Artificial Sequence
  Synthetic
gctggttattaagcccattaaggaagatgctagcaagagaagctataatgtcataggggacacccatgacaccct

SEQ ID NO: 240185 - DNA, 75 bp, Artificial Sequence
  Synthetic
acatgtgcgccgaggtctggggagctgctaagatcaggggctgtaagttttatggctgctggatgggagtggtcg

SEQ ID NO: 240186 - DNA, 75 bp, Artificial Sequence
  Synthetic
tgaccaacctggtctcctgcctggggatcctgcatgagaaccgcctggggcagaccgtgctccactctaccctga

SEQ ID NO: 240187 - DNA, 75 bp, Artificial Sequence
  Synthetic
accagttattataaagataagttttaatcaggaaaaagatgtagactgtgcatactctattacatttgagtatac

SEQ ID NO: 240188 - DNA, 75 bp, Artificial Sequence
  Synthetic
ggaggaggatgaagaaatagacctccggtgctacgaggaaggttttcctcccagcgattcagaggacgaacaggg

SEQ ID NO: 240189 - DNA, 75 bp, Artificial Sequence
  Synthetic
ttgcactaaggattatgctaatcagcaatttgatgtgagctcctttaccttctcctatattgcccaagaatgaaa

SEQ ID NO: 240190 - DNA, 75 bp, Artificial Sequence
  Synthetic
cgagaacctgaaggagctggacaagcttcttgctagaaaccttaaaaagctgtggacgggcttcgacgagcgcac

SEQ ID NO: 240191 - DNA, 75 bp, Artificial Sequence
  Synthetic
gcttcgagcagtggctctacgcgtacatccagcataagaatcacattaaaggctggccctccatcgatttcatca

SEQ ID NO: 240192 - DNA, 75 bp, Artificial Sequence
  Synthetic
gatttagcttgtgtgattgtggaggaacaagttgtgattgaaaaatctaccgagccagtacaaggctgtaggaac

SEQ ID NO: 240193 - DNA, 75 bp, Artificial Sequence
  Synthetic
taaggcttttcccttctaaggaggggattagtccatacaaggtggttgggtattttattttaggggtggtcctgg

SEQ ID NO: 240194 - DNA, 75 bp, Artificial Sequence
  Synthetic
ggccactttcgcgctccctggggcgcttacaagcgcgggcggacctctgcccccgccgccgtgcgcaccaccgtc

SEQ ID NO: 240195 - DNA, 75 bp, Artificial Sequence
  Synthetic
cttacaagcgcgggcggacctctgcccccgccgccgtgcgcaccaccgtcgacgatgtcattgactcggtagtcg

SEQ ID NO: 240196 - DNA, 75 bp, Artificial Sequence
  Synthetic
cccagcaggtgtccgagctccgcgagcagcagcagcaaaataaatgattcaataaacacagattctgattcaaac

SEQ ID NO: 240197 - DNA, 75 bp, Artificial Sequence
  Synthetic
gggctctgctgcgccgtgccagacgcactggccgccgggccatgttgcaagccgcgcgtcgcgccgccgccgcac

SEQ ID NO: 240198 - DNA, 75 bp, Artificial Sequence
  Synthetic
cgcctccgcggcgaccgttaacgccgtgcgtcgtgacgtcatttgcatcgtcttctctcgtccaatcagcgttgg

SEQ ID NO: 240199 - DNA, 75 bp, Artificial Sequence
  Synthetic
tgaggcagacgctgaaaggcggcctgcccgacttcatgagccagagcatgttgcaaaactaccgcactttcattc

SEQ ID NO: 240200 - DNA, 75 bp, Artificial Sequence
  Synthetic
ttacaaagtgtggaagtcaaatattagccaatgtgtcattaattgtcgtagctggaaggtacaaaattatcaata

SEQ ID NO: 240201 - DNA, 75 bp, Artificial Sequence
  Synthetic
gccccgggctgggcgcttgcaagggtgcgcttgagactcatcctgctggtgctgaaacgggcacggtcttcgccc

SEQ ID NO: 240202 - DNA, 75 bp, Artificial Sequence
  Synthetic
catcgaaaccagatattgttggagcaggcggcagtcacctccacgcccagggcaaagctcaacccgcgtaattgg

SEQ ID NO: 240203 - DNA, 75 bp, Artificial Sequence
  Synthetic
aaaacttccagcaaaaggtggtggacggcctggcctcgggcattaacggggtagtggacattgcaaaccaggccg

SEQ ID NO: 240204 - DNA, 75 bp, Artificial Sequence
  Synthetic
ccactgacccagctccctatttaaaggcaccttacactgacgtaatgaccaaaggtctaaaaaccccgccaaaaa

SEQ ID NO: 240205 - DNA, 75 bp, Artificial Sequence
  Synthetic
ccaggggcgagaagcggccgcggcctgacgcggaggagacaaccctgcaggtagacgagccgccctcgtacgagg

SEQ ID NO: 240206 - DNA, 75 bp, Artificial Sequence
  Synthetic
tagggcgccatcttgcccacgtccaaaatggcttccatgaccggccacgcctccgcggcgaccgttagccgtgcg

SEQ ID NO: 240207 - DNA, 75 bp, Artificial Sequence
  Synthetic
gtaaacaaaagttaatatgcaaatgagcttttgaatttggggcggggccgccgctgattggctgttgcaagaacc

SEQ ID NO: 240208 - DNA, 75 bp, Artificial Sequence
  Synthetic
gaacaggtgaactttacctgcaagccacacaagaagtacatcatctggttttatcagaacactactctagcagta

SEQ ID NO: 240209 - DNA, 75 bp, Artificial Sequence
  Synthetic
tcaacggtcgccgcggaggcgtggcctagcccggaagcaagtcgcggggctgatgacgtataaaaaagcggactt

SEQ ID NO: 240210 - DNA, 75 bp, Artificial Sequence
  Synthetic
gagcaggcccccccggtggcaaccgccgtgcgccgcgttcccgcccgccgccaggcccagaactggcagagcacg

SEQ ID NO: 240211 - DNA, 75 bp, Artificial Sequence
  Synthetic
tggactaaccttctcagttaaaagggcaaagctaattcttcatcgccctattgtagaaggaacttaccagtgtca

SEQ ID NO: 240212 - DNA, 75 bp, Artificial Sequence
  Synthetic
ggacagccctaccccgccaacttcccctacccgcttatcggacagaccgccgtgccctccgttacccagaaaaag

SEQ ID NO: 240213 - DNA, 75 bp, Artificial Sequence
  Synthetic
gccatatcctgaagaacatccatgtgacctcccaccccagaaagaagtggccagtgtttgagaataacctgctga

SEQ ID NO: 240214 - DNA, 75 bp, Artificial Sequence
  Synthetic
aatttaatatttccagaatctctgattcttcaggctgacatagccagcgaagctatagttactcctctacatact

SEQ ID NO: 240215 - DNA, 75 bp, Artificial Sequence
  Synthetic
ggggctttagtgtggttcctgaagcgcaagcctaggtatggaaatgaggagaaggaaaaattgctataaatcttt

SEQ ID NO: 240216 - DNA, 75 bp, Artificial Sequence
  Synthetic
cagaaggggcaccttccagccgtaccagtgcaactttagccagaccaagctgctgttggagaacgatgccttctc

SEQ ID NO: 240217 - DNA, 75 bp, Artificial Sequence
  Synthetic
tggaagaggaggacgagatagaccttcggtgctatgaggaaggttttcctcccagcgattcagaggacgaacgtg

SEQ ID NO: 240218 - DNA, 75 bp, Artificial Sequence
  Synthetic
tttatgcagataaaacattccagccggaaccacaaataggggaaaataattggcaggacactaatgttttctatg

SEQ ID NO: 240219 - DNA, 75 bp, Artificial Sequence
  Synthetic
ggaaccacaaataggggaaaataattggcaggacactaatgttttctatggcggcagagctcttaaaaaggaaac

SEQ ID NO: 240220 - DNA, 75 bp, Artificial Sequence
  Synthetic
gggctccgagaggatgccgatgtaggtgggataacagcgccccccgcggatgctggcgcgcacgtagtcatacaa

SEQ ID NO: 240221 - DNA, 75 bp, Artificial Sequence
  Synthetic
tcgctcgacagcaccgccgcagccgcggcagccgcagccgccatgacagcgacgagactggcctcgagctacatg

SEQ ID NO: 240222 - DNA, 75 bp, Artificial Sequence
  Synthetic
tttgccagaccaactaataaaaaaggagggcaggctaaagttttaaccactgaagatggtcaacctacagaaaac

SEQ ID NO: 240223 - DNA, 75 bp, Artificial Sequence
  Synthetic
agatcagacatagctgtaatgatcaaaacttaactctgattcatgtgaacaaaacccatgaaagaacatacatgg

SEQ ID NO: 240224 - DNA, 75 bp, Artificial Sequence
  Synthetic
gagggcaggctaaagttttaaccactgaagatggtcaacctacagaaaactttgacatagacttggctttctttg

SEQ ID NO: 240225 - DNA, 75 bp, Artificial Sequence
  Synthetic
caatcttgatccagatatgattctgtatgccgaaaatgtaaatctagaaacacctgacacacatgtagtttataa

SEQ ID NO: 240226 - DNA, 75 bp, Artificial Sequence
  Synthetic
accaggcaaggatgatgcaagttctgccgctaacctcacacaacagtccatgccaaacagacccaactacatcgg

SEQ ID NO: 240227 - DNA, 75 bp, Artificial Sequence
  Synthetic
tgttaatatgggagagaacaaaaccttagttggacctccaggaattccagttagttggtttaatcaggatggatt

SEQ ID NO: 240228 - DNA, 75 bp, Artificial Sequence
  Synthetic
tggaactctgcggtggacagctatgatccagatgtcaggatcattgagaatcacggtgtggaggacgaacttcca

SEQ ID NO: 240229 - DNA, 75 bp, Artificial Sequence
  Synthetic
ccggtaccaatgccacataccaaggtgtggaaccagataatgctcaaggtcaaaatgataaatggaaaaaggacg

SEQ ID NO: 240230 - DNA, 75 bp, Artificial Sequence
  Synthetic
gaagacgccgccggtcatctcccggtaatggggcgggtccccgttgggcagcgatagggcgctgacgatgcatct

SEQ ID NO: 240231 - DNA, 75 bp, Artificial Sequence
  Synthetic
ccctcgctggtggacgcctacgtcaacattggcgcccgctggtcactggaccccatggacaacgttaaccccttt

SEQ ID NO: 240232 - DNA, 75 bp, Artificial Sequence
  Synthetic
ccccatggacaacgttaacccctttaaccaccaccgcaatgcgggcctgcgctaccgctccatgctgctgggcaa

SEQ ID NO: 240233 - DNA, 75 bp, Artificial Sequence
  Synthetic
cgaggacgagtacctgaacgactcgctgctgcagccgccgcgggccaagaacgccatggccaataacgggataga

SEQ ID NO: 240234 - DNA, 75 bp, Artificial Sequence
  Synthetic
caaacatccatgttggaggaagaaatgagggaggccatggacgagaacccgaggagcggcctggaccctccgtcg

SEQ ID NO: 240235 - DNA, 75 bp, Artificial Sequence
  Synthetic
agtggcaccaaatttgtacgtggtcagacccatcatacaaatgccacagtaatggcagcattactattcatgctt

SEQ ID NO: 240236 - DNA, 75 bp, Artificial Sequence
  Synthetic
taccactgtgcccactacacatccaaccaccacagtcagtacaactattgagaccactactcatactacacagct

SEQ ID NO: 240237 - DNA, 75 bp, Artificial Sequence
  Synthetic
ttggcgcggagcttgcccttggaagagtgaccgcaggcgggacagaggatggattgcagggcgtagagcttgggt

SEQ ID NO: 240238 - DNA, 75 bp, Artificial Sequence
  Synthetic
atcaccacagtcagtacaaccactgagacaactacccacactacacagctagacacatcagtgcagagtagtact

SEQ ID NO: 240239 - DNA, 75 bp, Artificial Sequence
  Synthetic
ggctacaaggaccgcatgtactccttctttcgcaacttccagcccatgagtaggcaggtggttgatgagattaac

SEQ ID NO: 240240 - DNA, 75 bp, Artificial Sequence
  Synthetic
ggctacctcaagtgccttcaacagcactgcaaatttaacttcgcttgcttcaataaatgagaccctcgtgccgtt

SEQ ID NO: 240241 - DNA, 75 bp, Artificial Sequence
  Synthetic
ctaaaaatgcagctgcggctacagccgttacaaccactaggggcgatacctttgcaactccagcacaagagaaag

SEQ ID NO: 240242 - DNA, 75 bp, Artificial Sequence
  Synthetic
cgttacaaccactaggggcgatacctttgcaactccagcacaagagaaagcagctgaaaagaaggtagaggtctt

SEQ ID NO: 240243 - DNA, 75 bp, Artificial Sequence
  Synthetic
cagcaagccccggaccccgccataagggcggcgctgcaaagccagccgtccggtctagcatcggacgactgggag

SEQ ID NO: 240244 - DNA, 75 bp, Artificial Sequence
  Synthetic
ctcgcccgactgtctagggcctttccccacctacctcctatttgccctgctcacctgcacctgcgtctgcagcat

SEQ ID NO: 240245 - DNA, 75 bp, Artificial Sequence
  Synthetic
gccgcacctgtccctacgtctacaaggccctgggcatagtcgcgccgcgcgtgctctccagtcgcaccttctaaa

SEQ ID NO: 240246 - DNA, 75 bp, Artificial Sequence
  Synthetic
ccgctctcgttccagacgcggctgtagaccacgtccccgtcggcgtcgcgcgcgcgcatgaccacctgcgcgagg

SEQ ID NO: 240247 - DNA, 75 bp, Artificial Sequence
  Synthetic
ctgcacggatgagcgcatgtacaacatgctgacctgcgactcgggggtctgccatatcctgaagaacatccatgt

SEQ ID NO: 240248 - DNA, 75 bp, Artificial Sequence
  Synthetic
tttgggttctcggaccgccggcttaagcagatttacagcttcgagtacgaggccatgttgcgtcgcagtgccctg

SEQ ID NO: 240249 - DNA, 75 bp, Artificial Sequence
  Synthetic
tttcttcctctgggggcggtggtggtggggcccgacgacgacggcgacgcaccgggagacggtcgacgaagcgct

SEQ ID NO: 240250 - DNA, 75 bp, Artificial Sequence
  Synthetic
actccccctactttcgctcccaccgcgccgccatcgaacacgccaccgcttttgataaaatgaaacaactgcgtg

SEQ ID NO: 240251 - DNA, 75 bp, Artificial Sequence
  Synthetic
agctgccccagcagaagcagaagttcacctgcatggtgggcgtcaaccccatagtcatcacccagcagtcgggcg

SEQ ID NO: 240252 - DNA, 75 bp, Artificial Sequence
  Synthetic
acgccgccgccgcaccaccacccgccgccgtctggcccccgcccgcgtgcgccgcgtgaccacgcgccggggccg

SEQ ID NO: 240253 - DNA, 75 bp, Artificial Sequence
  Synthetic
ctgcgaaagccccgagtgcatctactccctcctcaagaccctttgcggactccgcgacctcctccccatgaactg

SEQ ID NO: 240254 - DNA, 75 bp, Artificial Sequence
  Synthetic
ggaggagcccctttcctagcttagggagtttgcatagcttgccgggctcggtgaacagcggcagggtgagccggc

SEQ ID NO: 240255 - DNA, 75 bp, Artificial Sequence
  Synthetic
gcgccgctggccacgggtgtgatgaaacccgccacccttgacctgcctccaccacccgcgcccgctccaccgaag

SEQ ID NO: 240256 - DNA, 75 bp, Artificial Sequence
  Synthetic
cttaacaaaggccataatctgcttaaaagcttgctgggccttagctccctcgctaaaaaacaggccgcagctttt

SEQ ID NO: 240257 - DNA, 75 bp, Artificial Sequence
  Synthetic
cgggtagtcagtctcccaccaccagcccatttcacagtgtacacggttctctcagcacgggtggccttaaatagg

SEQ ID NO: 240258 - DNA, 75 bp, Artificial Sequence
  Synthetic
gaccagttaacggtctgcaggccgggctgcacaacctccgagtacctgagccgcgagaaggcgcgcgagtcaaag

SEQ ID NO: 240259 - DNA, 75 bp, Artificial Sequence
  Synthetic
gcagacacttaagctggccttccacctcggcacagccgtggtcccacagggcactgccggtgcactcccagtttt

SEQ ID NO: 240260 - DNA, 75 bp, Artificial Sequence
  Synthetic
atggaaacacacacctttggcgtggctgctatgggaggagaaaacattacaaaagatggtcttcaaattggcact

SEQ ID NO: 240261 - DNA, 75 bp, Artificial Sequence
  Synthetic
tggtaaaggtcagttgcatcccgcgggcctcctcgttcatccaggtctggcacattttttggaatatctcggtct

SEQ ID NO: 240262 - DNA, 75 bp, Artificial Sequence
  Synthetic
agacaccaaaatgaagccttgttatggatcctttgccagaccgatgaatgaaaaaggaggacaggctaaattcaa

SEQ ID NO: 240263 - DNA, 75 bp, Artificial Sequence
  Synthetic
gcgcaggccgctgtcgacgcggtagcgttccatgagcacgtttatggtatccatgcccttctcccaggacgaaac

SEQ ID NO: 240264 - DNA, 75 bp, Artificial Sequence
  Synthetic
aggaggtgttgcaaatcagcctgacattattatgtacgctgaaaacgtgaatctggaaacaccagacactcacgt

SEQ ID NO: 240265 - DNA, 75 bp, Artificial Sequence
  Synthetic
cgtaaaggtagcgggacatccaggtgatgccggcggcggtggtggaggcgcgcgggaactcgcggacgcggttcc

SEQ ID NO: 240266 - DNA, 75 bp, Artificial Sequence
  Synthetic
gcatcccgtcctgcgccaaatgcgtcccaccccccctccggcgaccaccgcgaccgcggccgtagcaggcgccgg

SEQ ID NO: 240267 - DNA, 75 bp, Artificial Sequence
  Synthetic
ttctctgggtgacagaaccagatactttagcatgtggaactctgcggtggacagctatgatccagatgtcaggat

SEQ ID NO: 240268 - DNA, 75 bp, Artificial Sequence
  Synthetic
tttattgatttttacaccagcacgggtagtcagtctcccaccaccagcccatttcacagtgtaaacgattctctc

SEQ ID NO: 240269 - DNA, 75 bp, Artificial Sequence
  Synthetic
ggcgggacagaggagggattgcagggcgtagagtttaggcgcgagaaaaacggactctggggcaaaggcatccgc

SEQ ID NO: 240270 - DNA, 75 bp, Artificial Sequence
  Synthetic
gaacttccaaactattgctttccactgaatggcatgggttcaaatgcagcctaccaaggtgttaagccaaaagat

SEQ ID NO: 240271 - DNA, 75 bp, Artificial Sequence
  Synthetic
aggagcagccgcgtaagcaggagcaggaggaggagaacttaaccacccacgagcaacccaaaattgagcaggacc

SEQ ID NO: 240272 - DNA, 75 bp, Artificial Sequence
  Synthetic
tcctcccccgcaagcgacgatgtcaaagcgcaaaatcaaggaggagatgctccaggtcgtcgccccggagattta

SEQ ID NO: 240273 - DNA, 75 bp, Artificial Sequence
  Synthetic
gcccaaggtcatgcgtcgcatcatggatcagcttatcacgccccacattgaggcccttgatgaaagccaaaagca

SEQ ID NO: 240274 - DNA, 75 bp, Artificial Sequence
  Synthetic
gtcagcgacgaaatgcttgcgcgctggctcggaaaccgcgacccccagtccctggagcagcggcgtaagctcatg

SEQ ID NO: 240275 - DNA, 75 bp, Artificial Sequence
  Synthetic
aatcaggctggagccgcgactaacgtggtattggcactcccgtctcgacccaagcccgatagccgccaggatacg

SEQ ID NO: 240276 - DNA, 75 bp, Artificial Sequence
  Synthetic
ctggccgtggtcctggtcaccctcgagttggaatgcatgcgccgcttttttagcgaccccgaaaccctgcgcaag

SEQ ID NO: 240277 - DNA, 75 bp, Artificial Sequence
  Synthetic
gcagcaagccccggaccccgccataagggcggcgctgcaaagccagccgtccggtctagcatcggacgactggga

SEQ ID NO: 240278 - DNA, 75 bp, Artificial Sequence
  Synthetic
tagcgaccccgaaaccctgcgcaaggttgaagagaccctgcactacactttcaggcacggctttgtcaggcaggc

SEQ ID NO: 240279 - DNA, 75 bp, Artificial Sequence
  Synthetic
tcaggcacggctttgtcaggcaggcctgcaagatctctaacgtggagctaaccaacctggtctcctgcctgggta

SEQ ID NO: 240280 - DNA, 75 bp, Artificial Sequence
  Synthetic
gttctcacttcctcgtatcgatttcgtgacttaacttccgggttcccacgttacgtcacttttgcccttacatgt

SEQ ID NO: 240281 - DNA, 75 bp, Artificial Sequence
  Synthetic
aactcagtcgtagggcgccatcttgcccacgtccaaaatggcttccatgtccagccacgcctccgcggcgaccgt

SEQ ID NO: 240282 - DNA, 75 bp, Artificial Sequence
  Synthetic
agaacctgaaggagctggacaagcttcttgctaaaaaccttaaaaagttatggacgggctttgacgagcgcaccg

SEQ ID NO: 240283 - DNA, 75 bp, Artificial Sequence
  Synthetic
tgcagacggtgaacctgagccaggctttcaagaacctgcgcgggctgtggggcgtgcaggcgcccgtgggcgacc

SEQ ID NO: 240284 - DNA, 75 bp, Artificial Sequence
  Synthetic
aatcccttcagggctatctatgaaagcatacaaacattcagccatagctcagcccgcttaccagtagacagcagt

SEQ ID NO: 240285 - DNA, 75 bp, Artificial Sequence
  Synthetic
atctaagggccacccttaacttcttgctgaccaatagacagcagaagatcccggcgcaatatgcgctgtcggccg

SEQ ID NO: 240286 - DNA, 75 bp, Artificial Sequence
  Synthetic
ttctaagggccacccttaacttcttgctgaccaatagacagcagaagatcccggcgcaatatgcgctgtcggccg

SEQ ID NO: 240287 - DNA, 75 bp, Artificial Sequence
  Synthetic
ctctaagggccacccttaacttcttgctgaccaatagacagcagaagatcccggcgcaatatgcgctgtcggccg

SEQ ID NO: 240288 - DNA, 75 bp, Artificial Sequence
  Synthetic
gtctaagggccacccttaacttcttgctgaccaatagacagcagaagatcccggcgcaatatgcgctgtcggccg

SEQ ID NO: 240289 - DNA, 75 bp, Artificial Sequence
  Synthetic
cgatctcggacatgaactgctcgatctcctcctcctggagatcgccgcggcccgcgcgctccacggtggcggcga

SEQ ID NO: 240290 - DNA, 75 bp, Artificial Sequence
  Synthetic
cggcggagagccctttttgccgatcgagggggtcgctagacttgaaagcggccgaaaaccctgccgggtagtggc

SEQ ID NO: 240291 - DNA, 75 bp, Artificial Sequence
  Synthetic
aacgactcgctgctgcagccgccgcgggtcaagaacgccatggccaataacgggatagagagtctggtggacaaa

SEQ ID NO: 240292 - DNA, 75 bp, Artificial Sequence
  Synthetic
tccaccgccgccgccgtgcgcaccaccgtcgacgacgttatcgactcggtggtcgccgatgcgcgcaactatacc

SEQ ID NO: 240293 - DNA, 75 bp, Artificial Sequence
  Synthetic
cggaatcagaatatccccttcctcactcccccctttgtctcctccaatggattcgaaaacttcccccctggggtc

SEQ ID NO: 240294 - DNA, 75 bp, Artificial Sequence
  Synthetic
gggcacggcttacaacagtttggcccccaagggcgcccccaactccagtcagtggactgacaaagaacggcaaaa

SEQ ID NO: 240295 - DNA, 75 bp, Artificial Sequence
  Synthetic
gatgttacaaaaacattcggagtagcagccaggggagggcttcatattactgataaaggactacaaataggagaa

SEQ ID NO: 240296 - DNA, 75 bp, Artificial Sequence
  Synthetic
gtaagaggagtcgccggaagaggaggcctcaggattgcggcggacgagcccttcaccaccagggagctaagaaac

SEQ ID NO: 240297 - DNA, 75 bp, Artificial Sequence
  Synthetic
cagccaggggagggcttcatattactgataaaggactacaaataggagaagatgaaaataacgaggatggtgaag

SEQ ID NO: 240298 - DNA, 75 bp, Artificial Sequence
  Synthetic
ccagccagaacctcaagtaggagaggaaaactggcaagatactgatgttttctatggcggcagagcgcttaaaaa

SEQ ID NO: 240299 - DNA, 75 bp, Artificial Sequence
  Synthetic
cgagtagagatttctctgagctccgctcccagagtgtgagaaaaatgagacacctgcgcctcctgcctggaactg

SEQ ID NO: 240300 - DNA, 75 bp, Artificial Sequence
  Synthetic
gaaaactggcaagatactgatgttttctatggcggcagagcgcttaaaaaggaaaccaaaatgaaaccatgctat

SEQ ID NO: 240301 - DNA, 75 bp, Artificial Sequence
  Synthetic
aaaaaggaggtcaagctaaatttttaaatggcgaaaacggtcaaccttctaaagatcaagatattacattagctt

SEQ ID NO: 240302 - DNA, 75 bp, Artificial Sequence
  Synthetic
aaatggcgaaaacggtcaaccttctaaagatcaagatattacattagctttctttgatcttaaacaaaatgacac

SEQ ID NO: 240303 - DNA, 75 bp, Artificial Sequence
  Synthetic
aacatgcccaatgtgaacgagtacatgttcaccagcaagtttaaggcgcgggtgatggtggctaggaagcaccca

SEQ ID NO: 240304 - DNA, 75 bp, Artificial Sequence
  Synthetic
gttgtcatgtacactgaaaatgtgtatctggaaaccccagacacccatgtggtgtacaaacctggcaaggaagat

SEQ ID NO: 240305 - DNA, 75 bp, Artificial Sequence
  Synthetic
ggtgtacaaacctggcaaggaagatacaagctccgctgctaaccttacacaacagtccatgcccaacaggcccaa

SEQ ID NO: 240306 - DNA, 75 bp, Artificial Sequence
  Synthetic
gtggggctcatgtattacaacagcactggcaacatgggtgtgctggctggtcaggcctctcagttgaatgctgtg

SEQ ID NO: 240307 - DNA, 75 bp, Artificial Sequence
  Synthetic
acagctatgatccagatgtcaggatcattgagaatcacggtgttgaagatgagcttccaaattattgcttcccac

SEQ ID NO: 240308 - DNA, 75 bp, Artificial Sequence
  Synthetic
atgtatgaggatctagaagggggcaacatccccgccctgctggatgtggaagcatacctcaaaagcaagaatgat

SEQ ID NO: 240309 - DNA, 75 bp, Artificial Sequence
  Synthetic
atatcaaggtgttaaatatgaaaacggagctggcaatggaagctggaaagtagatggcgaagttgcttctcagaa

SEQ ID NO: 240310 - DNA, 75 bp, Artificial Sequence
  Synthetic
tcagatcgccaagggtaatctgtatgccatggagataaaccttcaggccaacctgtggaagagttttctgtactc

SEQ ID NO: 240311 - DNA, 75 bp, Artificial Sequence
  Synthetic
ggggtctacacctacgaggccttccacccggacgtggtgctgctgccgggctgcggggtggacttcaccgagagc

SEQ ID NO: 240312 - DNA, 75 bp, Artificial Sequence
  Synthetic
aaagcgccaggaggcggtgcgcacgcccgcgagcgagggcgcggtgggtcggagcccctttcctagcttagggag

SEQ ID NO: 240313 - DNA, 75 bp, Artificial Sequence
  Synthetic
agatcagaggagacagtgctgatactagagctgcagagcaggcggctgaaaaagagctggttattgaacccatcg

SEQ ID NO: 240314 - DNA, 75 bp, Artificial Sequence
  Synthetic
gaacgactcgctgctgcagccgccgcgggtcaagaacgccatggtcaataacgggatagagagtctggtggacaa

SEQ ID NO: 240315 - DNA, 75 bp, Artificial Sequence
  Synthetic
gtggtgagtttaataaaagctgaaataagactctactctggaatccagtgtcgtcataatcgcaccgagaccatt

SEQ ID NO: 240316 - DNA, 75 bp, Artificial Sequence
  Synthetic
ccgaccacctggtgatggcctgtaccgggaccgagttcagctccagtggggaggacacagattagaggtaggttt

SEQ ID NO: 240317 - DNA, 75 bp, Artificial Sequence
  Synthetic
cccagactggggcgacggatgttttgaatgcaaaataaaactcaccaaggccatagcgtgcgttctcttccttgt

SEQ ID NO: 240318 - DNA, 75 bp, Artificial Sequence
  Synthetic
gaatgcaaaataaaactcaccaaggccatagcgtgcgttctcttccttgttagagatgaggcgcgcggtggtgtc

SEQ ID NO: 240319 - DNA, 75 bp, Artificial Sequence
  Synthetic
ctacgggaagcggtcgcgcgaagaggagctgatctcgctgccgctggacgagagcaaccccacgccgagcctgaa

SEQ ID NO: 240320 - DNA, 75 bp, Artificial Sequence
  Synthetic
aacttaccattgtcagagcggaccttgtcaccacattttccatttggtgaacgtcaccagcagcagcaacagctc

SEQ ID NO: 240321 - DNA, 75 bp, Artificial Sequence
  Synthetic
gattagtccatacaaggtggttgggtatttcattttaggggtggtcctgggtgggtggaaatcaatctttatctg

SEQ ID NO: 240322 - DNA, 75 bp, Artificial Sequence
  Synthetic
cctttccctggttgggggtgtactgtcatgccacgaacagccacgatgtaatattaccacaggcaatgagaggag

SEQ ID NO: 240323 - DNA, 75 bp, Artificial Sequence
  Synthetic
atattaccacaggcaatgagaggagtataatatgcacagtagttattaaatgcgagcataaatgtcctcttaaca

SEQ ID NO: 240324 - DNA, 75 bp, Artificial Sequence
  Synthetic
ggtcattgataccctggacaaggccgcctttaggtgttgcatgatgggaatgagagccggagtgatgaatatgaa

SEQ ID NO: 240325 - DNA, 75 bp, Artificial Sequence
  Synthetic
gtggtttgagtttaccctgcccgagggcaacttttccgagaccatgaccatagacctaatgaacaacgccatctt

SEQ ID NO: 240326 - DNA, 75 bp, Artificial Sequence
  Synthetic
ttacatggtatgataaaaagggaatgcagttttgtattggaaatacaattaagaacccgcaaatcaagcatagct

SEQ ID NO: 240327 - DNA, 75 bp, Artificial Sequence
  Synthetic
ctattaaggctcagaatgatgccgtcccaagaggagataactatgcatcagcggcagaagccaaagcagcaggaa

SEQ ID NO: 240328 - DNA, 75 bp, Artificial Sequence
  Synthetic
aagaaattgagttgaaggccattttgaaagatgattcagacagaagctacaatgtgatcgagggaaccacagaca

SEQ ID NO: 240329 - DNA, 75 bp, Artificial Sequence
  Synthetic
ccaccccggacgtcacctgcggcgcggagcaagtctactggtcgctgccggacctcatgcaagaccccgtcacct

SEQ ID NO: 240330 - DNA, 75 bp, Artificial Sequence
  Synthetic
agaaaaagttgagcatgcagaatttaatcatacatgtaacatccagaacctgacactgctctttgtcaacttaac

SEQ ID NO: 240331 - DNA, 75 bp, Artificial Sequence
  Synthetic
aaggttgaacaaggtaatactgctcaaagtggtggtaaaaaaaccaaaacagaacatagaaaccacagtgcaaaa

SEQ ID NO: 240332 - DNA, 75 bp, Artificial Sequence
  Synthetic
aaagtggtggtaaaaaaaccaaaacagaacatagaaaccacagtgcaaaaacaaaatcaacaaataaccttcagc

SEQ ID NO: 240333 - DNA, 75 bp, Artificial Sequence
  Synthetic
cgtgggtgggtggaaatcaatctttatctgctgtgttagacattgtggggaggaagcatgaaggggctcttacta

SEQ ID NO: 240334 - DNA, 75 bp, Artificial Sequence
  Synthetic
agtttaaattacaagttacaaaaactaataaaaaccaatcacaaattccctcagctactgtggcaatcgtggcgg

SEQ ID NO: 240335 - DNA, 75 bp, Artificial Sequence
  Synthetic
acccatgacaccctgtaccgaagctggtacctgtcctatacctacggggaccccgagaagggggtgcagtcgtgg

SEQ ID NO: 240336 - DNA, 75 bp, Artificial Sequence
  Synthetic
taataaaaaccaatcacaaattccctcagctactgtggcaatcgtggcgggagtgattgcgggctttgtaactct

SEQ ID NO: 240337 - DNA, 75 bp, Artificial Sequence
  Synthetic
tgctgccgcaagcgtttaagggcatacaatcatatggtagacccactacttagcttctcttactaaaacttagtt

SEQ ID NO: 240338 - DNA, 75 bp, Artificial Sequence
  Synthetic
catggcctcgtgctctggggtcgtgttgtagatgatccagtcatagcaggggcgctgggcgtggtgctggatgat

SEQ ID NO: 240339 - DNA, 75 bp, Artificial Sequence
  Synthetic
cagaaagggggcagcacatccaggaggtgctcgtcaggggggtccgcatcgatggtgaagatgccgggacagagt

SEQ ID NO: 240340 - DNA, 75 bp, Artificial Sequence
  Synthetic
atcacttaaactcatggaaaaatttatgcaagtggaatattacagcttacaagtgttatgataatggaagcatta

SEQ ID NO: 240341 - DNA, 75 bp, Artificial Sequence
  Synthetic
aagtgttatgataatggaagcattactattactgccactggtgaaattacttctggcagatacaaggcagaaagt

SEQ ID NO: 240342 - DNA, 75 bp, Artificial Sequence
  Synthetic
tattaaaaactaataaaactacatttgaagattctggaaattatgaacatcaaaaaataactttttatcagctaa

SEQ ID NO: 240343 - DNA, 75 bp, Artificial Sequence
  Synthetic
tcttattggaccacctggaaaaaatgttgattggactaaactttccagcggcagcgatgctgttgtaacactgtg

SEQ ID NO: 240344 - DNA, 75 bp, Artificial Sequence
  Synthetic
gccatgattcctaggttcttcctatttaacatccttttctgtctttttaacgtgtgcgctgcctttgcggccgtc

SEQ ID NO: 240345 - DNA, 75 bp, Artificial Sequence
  Synthetic
ccgagcctcccaggaggcgaagatggggccctgccaaccggctgatgcccaactacgtgttgcatccttccatca

SEQ ID NO: 240346 - DNA, 75 bp, Artificial Sequence
  Synthetic
aggaagctattatggctccagcgatgatggttcaagtcattacaaagttactgtgtatgatttatataaagcaaa

SEQ ID NO: 240347 - DNA, 75 bp, Artificial Sequence
  Synthetic
cacagtcccgaatatagggacaagaacgtagccaaaatcttaaggcttatataaccatgcagactctgctgatac

SEQ ID NO: 240348 - DNA, 75 bp, Artificial Sequence
  Synthetic
acgtagccaaaatcttaaggcttatataaccatgcagactctgctgatactgctattccttctatcccccgccct

SEQ ID NO: 240349 - DNA, 75 bp, Artificial Sequence
  Synthetic
taaaaccaagtctaaggtcaaaccttacaccacaaaaggcactacagtgaatgcaacagatggcaatggtctcaa

SEQ ID NO: 240350 - DNA, 75 bp, Artificial Sequence
  Synthetic
gggcaaacagaaaatgatcaagaatcaaaaattccatcagctactgtggcaatcgtggtgggtgtgattgcgggc

SEQ ID NO: 240351 - DNA, 75 bp, Artificial Sequence
  Synthetic
aaatttgttgagctatggaatttcttaaactgctacaatgctaaaatggatatgccttactattacttggtgatt

SEQ ID NO: 240352 - DNA, 75 bp, Artificial Sequence
  Synthetic
tatgccttactattacttggtgattgtgggaatcgttatggtctgctcctgcactttctttgccattataatcta

SEQ ID NO: 240353 - DNA, 75 bp, Artificial Sequence
  Synthetic
acttagaagagccccctccacgacccccttccactgttagctactttcacataaccggcggcaatgactgaccac

SEQ ID NO: 240354 - DNA, 75 bp, Artificial Sequence
  Synthetic
tttggaatggcagccatggctggagaagcaattactaacaagggactgcaaataggagtagataccacagatggt

SEQ ID NO: 240355 - DNA, 75 bp, Artificial Sequence
  Synthetic
aagcaattactaacaagggactgcaaataggagtagataccacagatggtaaacaagacccaatatatgcaaatc

SEQ ID NO: 240356 - DNA, 75 bp, Artificial Sequence
  Synthetic
ccatcaacatccaccagtgcaagaagggcattttctgcctggtcaaacaggcgaaaatcacctacgagctcctgt

SEQ ID NO: 240357 - DNA, 75 bp, Artificial Sequence
  Synthetic
gggggaagacagctggaatgatgatgttgcaccatcatatggcggtagggctctgaaaaaggaaaccaaaatgaa

SEQ ID NO: 240358 - DNA, 75 bp, Artificial Sequence
  Synthetic
gcgaaaatcacctacgagctcctgtccggcggcaagcagcatcgccttgcctatgagctgccccagcagaagcag

SEQ ID NO: 240359 - DNA, 75 bp, Artificial Sequence
  Synthetic
gttgcaccatcatatggcggtagggctctgaaaaaggaaaccaaaatgaaaccttgctatggctcgttcgccaga

SEQ ID NO: 240360 - DNA, 75 bp, Artificial Sequence
  Synthetic
aacaagtttaggaaccccacggtggctcccacccacgatgtgaccacggaccggtcccagcgtctgacgctgcgc

SEQ ID NO: 240361 - DNA, 75 bp, Artificial Sequence
  Synthetic
accacagccagtacaactattgaaaccactacacagctagacacaacagtgcagaatagtactgtgttggttagg

SEQ ID NO: 240362 - DNA, 75 bp, Artificial Sequence
  Synthetic
ctaaactcagagaccctgaaaaaagtcaagaagattttgacattgacatggctttctttgattccaacactatta

SEQ ID NO: 240363 - DNA, 75 bp, Artificial Sequence
  Synthetic
tcaagaagattttgacattgacatggctttctttgattccaacactattaacacaccagatgttgtgctgtatac

SEQ ID NO: 240364 - DNA, 75 bp, Artificial Sequence
  Synthetic
gattcccatgttgtttacaaagcaggaacttcagacgaaagctctgaaattaatttgggtcaacagtcaatgcca

SEQ ID NO: 240365 - DNA, 75 bp, Artificial Sequence
  Synthetic
ggcacggcctacaacagcctggctcccaagggcgcccccaactccagtcagtgggaaacaaaagaaaagcaaaat

SEQ ID NO: 240366 - DNA, 75 bp, Artificial Sequence
  Synthetic
aacaggccaaactacattggcttcagagacaactttgtggggctaatgtattacaacagcactggaaacatgggt

SEQ ID NO: 240367 - DNA, 75 bp, Artificial Sequence
  Synthetic
aaaatgttacaaaaacatttggagtggctgccatgggaggacttgatataactgatgaaggattgcaaataggag

SEQ ID NO: 240368 - DNA, 75 bp, Artificial Sequence
  Synthetic
taacctccaggccaacctgtggaagagttttctgtactcgaacgtggccctgtacctgcccgactcctacaagta

SEQ ID NO: 240369 - DNA, 75 bp, Artificial Sequence
  Synthetic
ctccgcggtagacagctatgatcccgatgtcaggatcattgaaaatcacggtgtggaagatgaacttccaaacta

SEQ ID NO: 240370 - DNA, 75 bp, Artificial Sequence
  Synthetic
ctacggaggcagagctcttaaaaaagacaccaaaatgaagccctgctatggatcatttgcaaggcctacaaatga

SEQ ID NO: 240371 - DNA, 75 bp, Artificial Sequence
  Synthetic
actggagagaatgtcgacccaacgaaagatttcgacattgatatggctttcttcgatcttaagcaaacagacact

SEQ ID NO: 240372 - DNA, 75 bp, Artificial Sequence
  Synthetic
cttcgatcttaagcaaacagacactggaacaacgcaaaatcagccagatatagttatgtacactgaaaatgtaaa

SEQ ID NO: 240373 - DNA, 75 bp, Artificial Sequence
  Synthetic
caagttctgaaattaacttgactcaacagtccatggcaaacagacccaactacattggtttcagagacaactttg

SEQ ID NO: 240374 - DNA, 75 bp, Artificial Sequence
  Synthetic
ctcaatgcaaatttgcggacatatggaatttcttagactgctatcaggagaaaatggatatgccttcctattact

SEQ ID NO: 240375 - DNA, 75 bp, Artificial Sequence
  Synthetic
atggtggcgcgcacctcgcgctcgaaatccccgggggcctcctcctcttcctcttcttccatgacgacctcttct

SEQ ID NO: 240376 - DNA, 75 bp, Artificial Sequence
  Synthetic
attgagaatcacggtgtggaagatgaacttccaaactattgctttccacttgatggcatgggttcaaatgcggcc

SEQ ID NO: 240377 - DNA, 75 bp, Artificial Sequence
  Synthetic
acgagctcggcggtgacgaggacgtccatggcgcagtagtccagcgtttcgcggatgatgtcataacccgcctct

SEQ ID NO: 240378 - DNA, 75 bp, Artificial Sequence
  Synthetic
gcaacggatgggatccaaatacagatgttgctgcccagaatcaaatcgccaagggcaacatctatgccatggaga

SEQ ID NO: 240379 - DNA, 75 bp, Artificial Sequence
  Synthetic
tagtgtagattggggaaaaaatcttacattagagggtcctaaagaaacaccagttgaatggtggggtggaagaaa

SEQ ID NO: 240380 - DNA, 75 bp, Artificial Sequence
  Synthetic
ggggcaaaacctaacattagtggggcctgcaaacattccagttacttggcttagtgaatatggcacgttgtgtga

SEQ ID NO: 240381 - DNA, 75 bp, Artificial Sequence
  Synthetic
ttaaatcacacctgtaacgaacagaacctcacgttactgtttgttaatatgacacacaacggaccatattttggc

SEQ ID NO: 240382 - DNA, 75 bp, Artificial Sequence
  Synthetic
acctcacgttactgtttgttaatatgacacacaacggaccatattttggctttgacaaatacaacattgatagag

SEQ ID NO: 240383 - DNA, 75 bp, Artificial Sequence
  Synthetic
tttgtttaaagttggcgctggacagaagaaaattgggaaaggacagaaaaaggaggaaaagacaaaaccaaactc

SEQ ID NO: 240384 - DNA, 75 bp, Artificial Sequence
  Synthetic
aagaaaattgggaaaggacagaaaaaggaggaaaagacaaaaccaaactctagtgatttgggacaaagacaatcc

SEQ ID NO: 240385 - DNA, 75 bp, Artificial Sequence
  Synthetic
aagaggtccaaatcaaaacaggagaaaatcgaacccttgttggtccacctggaaaagttgattggattaaacttt

SEQ ID NO: 240386 - DNA, 75 bp, Artificial Sequence
  Synthetic
aaatcgaacccttgttggtccacctggaaaagttgattggattaaactttccagtggaaacaataatgttcttaa

SEQ ID NO: 240387 - DNA, 75 bp, Artificial Sequence
  Synthetic
caagtacacgccggccaacgtcacgctgcccaccaacaccaacacctacgagtacatgaatggccgcgtggtagc

SEQ ID NO: 240388 - DNA, 75 bp, Artificial Sequence
  Synthetic
aaacacacatgtgatggtcaaaatttaacattaattaatgtgactagaatttatgacggaacttattatggttct

SEQ ID NO: 240389 - DNA, 75 bp, Artificial Sequence
  Synthetic
taacattaattaatgtgactagaatttatgacggaacttattatggttctagcaatgatggctcaagtcattaca

SEQ ID NO: 240390 - DNA, 75 bp, Artificial Sequence
  Synthetic
catgttattcagcagcccataatttagggtgctccagccaaagcttatgttggaaatgatggaacccacgtgacc

SEQ ID NO: 240391 - DNA, 75 bp, Artificial Sequence
  Synthetic
agttaataaaactaaatctatgcttaagccatacactacaaaaagaactacagtgaatgcaacagatgacagtgc

SEQ ID NO: 240392 - DNA, 75 bp, Artificial Sequence
  Synthetic
gggagatacttttctcaccaccgaacagctgagagccgctggcaaggagctggttattaagccaatcaaggaaga

SEQ ID NO: 240393 - DNA, 75 bp, Artificial Sequence
  Synthetic
ccgccgtgcgcaccaccgtcgacgacgtcatcgactcggtggtcgccgacgcgcgcaactacacccccgccccct

SEQ ID NO: 240394 - DNA, 75 bp, Artificial Sequence
  Synthetic
cgcgcagttgggagctgtccatggtgtcgcggagatccaggtccgggggcagggttctgaggttgacctcgtaga

SEQ ID NO: 240395 - DNA, 75 bp, Artificial Sequence
  Synthetic
gtcgcggagatccaggtccgggggcagggttctgaggttgacctcgtagaggcgggtgagggcgtgcttgagatg

SEQ ID NO: 240396 - DNA, 75 bp, Artificial Sequence
  Synthetic
atggtcagacccatcatacacatgtcatagtaatggaagccttagtatttttgctttcaacattagttcaggtaa

SEQ ID NO: 240397 - DNA, 75 bp, Artificial Sequence
  Synthetic
gtgtaccgcaacgaccgcatccacaaggccgtgagcacaagccggcggcgcgagctgagcgaccgcgagctgatg

SEQ ID NO: 240398 - DNA, 75 bp, Artificial Sequence
  Synthetic
gcatactctatcacctttaactttggatggggaaaaacttatgataatccatttccatttgatactacatccttt

SEQ ID NO: 240399 - DNA, 75 bp, Artificial Sequence
  Synthetic
aaaaacttgaagttaaaatgtttaatctaacagtaattgagcctccaaccactagagcacccaccacagttagga

SEQ ID NO: 240400 - DNA, 75 bp, Artificial Sequence
  Synthetic
gacgaaggccgcgatctgcttgaaagcttgctgggccttggccccctcgctaaaaaacaggccgcagctcttccc

SEQ ID NO: 240401 - DNA, 75 bp, Artificial Sequence
  Synthetic
gctgaactggttattcccgcacccggcatcatgcacgcagcagcgcgcgtcatggctggtcagttgcaccacgct

SEQ ID NO: 240402 - DNA, 75 bp, Artificial Sequence
  Synthetic
tttgaactgaatttatgtatctttattgatttttacaccagcacgggtagtcagtctcccaccaccagcccattt

SEQ ID NO: 240403 - DNA, 75 bp, Artificial Sequence
  Synthetic
accacagtcagtacaactattgagaccactactcatactacacagctagacacaacagtgcagaatactacttta

SEQ ID NO: 240404 - DNA, 75 bp, Artificial Sequence
  Synthetic
catccccgcgccgcgctgcatattcgggtagagggccttgacaaaggccaagatctgcttgaaagcttgctgggc

SEQ ID NO: 240405 - DNA, 75 bp, Artificial Sequence
  Synthetic
ccatctacaggccagtaatcggggaacctcagcctctccaagtggaagggggtctaaggaatcttctcttctctt

SEQ ID NO: 240406 - DNA, 75 bp, Artificial Sequence
  Synthetic
ccaccacgtggtccttgtggatcatcaccgtcccgtgcagacacttgagctggccttccacctcggtgcagccgt

SEQ ID NO: 240407 - DNA, 75 bp, Artificial Sequence
  Synthetic
tgatttactggtgctgaaggtcagttgcaggccgcgggcctcctcgttcagccaggtctggcacatcttctggaa

SEQ ID NO: 240408 - DNA, 75 bp, Artificial Sequence
  Synthetic
ccccagcggttctgggtcaccttggccttgctgggttgctccttcaacgcgcgctgcccgttctcgctggtcaca

SEQ ID NO: 240409 - DNA, 75 bp, Artificial Sequence
  Synthetic
cactccccttactttcgctcccaccgcgccgccatcgaacacgccaccgcttttgacaaaatgaaacaactgcgt

SEQ ID NO: 240410 - DNA, 75 bp, Artificial Sequence
  Synthetic
tacaacagcctggcccccaagggcgcccccaatccaagtcagtgggaacagaaaaagaatggcggtggcgccgat

SEQ ID NO: 240411 - DNA, 75 bp, Artificial Sequence
  Synthetic
ctcctctcccctgcccttgctgactgtaaatttgcggacatatggaatttcttagactgttatcaagagaaaatg

SEQ ID NO: 240412 - DNA, 75 bp, Artificial Sequence
  Synthetic
ttgccgccatgggaggtattgacattgacaaaaatggacttcaaataggagtcgaacaaacagctgacaatgggc

SEQ ID NO: 240413 - DNA, 75 bp, Artificial Sequence
  Synthetic
gcggtggtggtggcggggcccgacgacgacggcgacgcaccgggagacggtcgacgaagcgctcgatcatctccc

SEQ ID NO: 240414 - DNA, 75 bp, Artificial Sequence
  Synthetic
tgacaaaaatggacttcaaataggagtcgaacaaacagctgacaatgggcagaaagaaatctatgccgataaatt

SEQ ID NO: 240415 - DNA, 75 bp, Artificial Sequence
  Synthetic
gaggagaattggcatgaaacatttgtttattatggcggcagagctcttaagaaagacaccaagatgaagccttgc

SEQ ID NO: 240416 - DNA, 75 bp, Artificial Sequence
  Synthetic
cccgcactggctcccgccgccggggttctacacgggcgagtacgacatgcctgaccccaacgacgggtttttgtg

SEQ ID NO: 240417 - DNA, 75 bp, Artificial Sequence
  Synthetic
tttattatggcggcagagctcttaagaaagacaccaagatgaagccttgctatggctcatttgccagacctacca

SEQ ID NO: 240418 - DNA, 75 bp, Artificial Sequence
  Synthetic
gaccacaatgtggtagcttacaccgcgtcgctgaagcatggttagtagagatgaaagtctgaaaaacaaaaagca

SEQ ID NO: 240419 - DNA, 75 bp, Artificial Sequence
  Synthetic
aaaaactggagaaggagttgacccaaccaaggattttgatatagacctggctttcttcgacattccacaaaatgg

SEQ ID NO: 240420 - DNA, 75 bp, Artificial Sequence
  Synthetic
accaaggattttgatatagacctggctttcttcgacattccacaaaatggtgttcaggacaaccatgatccagac

SEQ ID NO: 240421 - DNA, 75 bp, Artificial Sequence
  Synthetic
atctggaaactccagatactcacatagtttacaagcctggcaaagaggatgagagctctgaagctaacttggtac

SEQ ID NO: 240422 - DNA, 75 bp, Artificial Sequence
  Synthetic
agctcctgtcttctcccggcaaaaatcacatcggactgggttagtatgcccctggcatggtagtcatttaaagcc

SEQ ID NO: 240423 - DNA, 75 bp, Artificial Sequence
  Synthetic
agtttacaagcctggcaaagaggatgagagctctgaagctaacttggtacagcagtctatgcccaacagacccaa

SEQ ID NO: 240424 - DNA, 75 bp, Artificial Sequence
  Synthetic
tttagcatgtggaactctgcggtggacagctatgatcccgatgtcaggatcattgaaaatcacggtgtggaagat

SEQ ID NO: 240425 - DNA, 75 bp, Artificial Sequence
  Synthetic
gtccccgaggcccttgccacctatcacatctttttcaagaaccaaaagatccccgtctcctgtcgcgccaaccgc

SEQ ID NO: 240426 - DNA, 75 bp, Artificial Sequence
  Synthetic
gtatcaaggtgtaaaagaacaattgaaccaaaatgacaaatgggaagtggataatgcaatatcaaatcagaaccg

SEQ ID NO: 240427 - DNA, 75 bp, Artificial Sequence
  Synthetic
tgaggtgaagcaatatcaccccatgcggaggaatgtggaaagattcggggcaaaagaaggtatatctattgctag

SEQ ID NO: 240428 - DNA, 75 bp, Artificial Sequence
  Synthetic
aaacttcccccctggggtcctgtcactcaaactggctgatccaatcgccatcgccaatgggaatgtctcactcaa

SEQ ID NO: 240429 - DNA, 75 bp, Artificial Sequence
  Synthetic
caacagtctggaaaactgagtgtggatactaaggcacccttgcaagttgcaaatgacaacaaattggagctatct

SEQ ID NO: 240430 - DNA, 75 bp, Artificial Sequence
  Synthetic
gggcgccattttcccgttcccaatatggctaaagtccgcttttttatacgtcatcggccccgcgacttgcttccg

SEQ ID NO: 240431 - DNA, 75 bp, Artificial Sequence
  Synthetic
tggctaaagtccgcttttttatacgtcatcggccccgcgacttgcttccgggttgggccacgcctttgcggcaac

SEQ ID NO: 240432 - DNA, 75 bp, Artificial Sequence
  Synthetic
gctccgccgtagggcgccatcttgccctcatccaaaatggcttccatgtccggccacgcctccgcgccgaccgtt

SEQ ID NO: 240433 - DNA, 75 bp, Artificial Sequence
  Synthetic
cctcatccaaaatggcttccatgtccggccacgcctccgcgccgaccgttacgccgtgcgtcgtgacgtcatttg

SEQ ID NO: 240434 - DNA, 75 bp, Artificial Sequence
  Synthetic
ccatggtttagcagttgtaactaaagaaaacacaagtcttcctagtctagttggaacacttgtagttttaactgg

SEQ ID NO: 240435 - DNA, 75 bp, Artificial Sequence
  Synthetic
ctgcattaccgcttgttaaccacttaacgttggccctgccctaaaaccgttaaaatttaaaagctcatttgcata

SEQ ID NO: 240436 - DNA, 75 bp, Artificial Sequence
  Synthetic
atactaaggcacccttgcaagttgcaaatgacaacaaattggagctatcttatgatgatccatttaaggtagaga

SEQ ID NO: 240437 - DNA, 75 bp, Artificial Sequence
  Synthetic
gaaaacacaagtcttcctagtctagttggaacacttgtagttttaactggaaaaggaataggtactggatcaagt

SEQ ID NO: 240438 - DNA, 75 bp, Artificial Sequence
  Synthetic
aacgttggccctgccctaaaaccgttaaaatttaaaagctcatttgcatattaactttgtggggtatattatata

SEQ ID NO: 240439 - DNA, 75 bp, Artificial Sequence
  Synthetic
gacttggtgaaggaggtgggttatcatttgatgaaaaaggagacttagtagcttgggacaaaaaaaatgatacac

SEQ ID NO: 240440 - DNA, 75 bp, Artificial Sequence
  Synthetic
atttgatgaaaaaggagacttagtagcttgggacaaaaaaaatgatacacgcaccctttggacaacacctgatcc

SEQ ID NO: 240441 - DNA, 75 bp, Artificial Sequence
  Synthetic
cgccggccgtacgtcttgacgtcaactgcattaccgcttgttaaccacttaacgttggccctgccctaaaaccgt

SEQ ID NO: 240442 - DNA, 75 bp, Artificial Sequence
  Synthetic
gcaagagactcaaagctaaccttagcacttacaaaatgtggtagtcaaattttggccactgtatctttacttgtt

SEQ ID NO: 240443 - DNA, 75 bp, Artificial Sequence
  Synthetic
cacttacaaaatgtggtagtcaaattttggccactgtatctttacttgttgttacgggcaaatatgctattataa

SEQ ID NO: 240444 - DNA, 75 bp, Artificial Sequence
  Synthetic
ctctattaagttactgtttaatgacaagggtgttttgttaagtgactcaaatcttgatgggacatattggaacta

SEQ ID NO: 240445 - DNA, 75 bp, Artificial Sequence
  Synthetic
aagggtgttttgttaagtgactcaaatcttgatgggacatattggaactatagaagcaacaataacaacataggc

SEQ ID NO: 240446 - DNA, 75 bp, Artificial Sequence
  Synthetic
aggggagtgaagagggagaggagcgatgggggcaataccgggatgatgaccgagctgacggccagcctgatgaat

SEQ ID NO: 240447 - DNA, 75 bp, Artificial Sequence
  Synthetic
gggcgtgtggcagcagtgtctcgaggacgagaacctgaaggagctggacaagcttcttgctagaaaccttaaaaa

SEQ ID NO: 240448 - DNA, 75 bp, Artificial Sequence
  Synthetic
ttatgccaagcacaacagcttatcctaagccaaccaacaacaccagcacagatccggataaaaaagtgagtcaag

SEQ ID NO: 240449 - DNA, 75 bp, Artificial Sequence
  Synthetic
taagccaaccaacaacaccagcacagatccggataaaaaagtgagtcaaggtaaaaataaaattgtaagcaatat

SEQ ID NO: 240450 - DNA, 75 bp, Artificial Sequence
  Synthetic
atcggaagcgcccagagcgcattacctggcacgagctacagcaggagtgcagggatgagataggcctgatgcagg

SEQ ID NO: 240451 - DNA, 75 bp, Artificial Sequence
  Synthetic
ccaggatttattgttgttaaatttaatcaggaaactgatgccaattgtgcatactctattacatttgattttgga

SEQ ID NO: 240452 - DNA, 75 bp, Artificial Sequence
  Synthetic
tggtggccgtgtccacgcattgcatgagcccgtagctgcgcggggccacgaccgtgccgcggtgggtttttaaaa

SEQ ID NO: 240453 - DNA, 75 bp, Artificial Sequence
  Synthetic
tggggtaaggtgtataaggatcctataccatatgatacctcttcttttactttctcatatatcgctcaagaatga

SEQ ID NO: 240454 - DNA, 75 bp, Artificial Sequence
  Synthetic
tctaagggccacccttaacttcttgctgaccaatagacagcagaagatcccggcgcaatatgcgctgtcggccga

SEQ ID NO: 240455 - DNA, 75 bp, Artificial Sequence
  Synthetic
cttttaaaaaatgtccattcttatctcgcccagcaataacaccggctggggtcttactaggcccagcaccatgta

SEQ ID NO: 240456 - DNA, 75 bp, Artificial Sequence
  Synthetic
ccgacgccgggctaccgcggcacccggtattacgccagccgcaggcgccccgcaggcaagcgccgtcgccgcacc

SEQ ID NO: 240457 - DNA, 75 bp, Artificial Sequence
  Synthetic
aagatccaaacaacaaaatttatgcagataaaacattccagccggaaccacaaataggggaaaataattggcagg

SEQ ID NO: 240458 - DNA, 75 bp, Artificial Sequence
  Synthetic
ccagcggttctgggtcactttggccttgctgggttgctccttcaacgcgcgctgaccgttctcgctggtcacatc

SEQ ID NO: 240459 - DNA, 75 bp, Artificial Sequence
  Synthetic
ctgccggtgcactcccagtttttgtgcgcgatcccgctgtggctaaagatgtaaccttgcaacaggcgacccatc

SEQ ID NO: 240460 - DNA, 75 bp, Artificial Sequence
  Synthetic
gcggtccccgaggcccttgccacttatcacatattttttaaaaaccaaaaaatccccgtttcctgccgcgccaac

SEQ ID NO: 240461 - DNA, 75 bp, Artificial Sequence
  Synthetic
tagatgatccagtcatagcaggggcgctgggcgtggtgctggatgatgtctttgaggaggagactgatggccacg

SEQ ID NO: 240462 - DNA, 75 bp, Artificial Sequence
  Synthetic
catgcccaatgtgaacgagtacatgttcaccagcaagtttaaggcgcgggtgatggtgtctaggaagcgcccaga

SEQ ID NO: 240463 - DNA, 75 bp, Artificial Sequence
  Synthetic
acacctgtgccaacgacggtattgaaatacctaacaaccttaccagtggactaacttacactaccagaaagacta

SEQ ID NO: 240464 - DNA, 75 bp, Artificial Sequence
  Synthetic
ggagtcaagtttgacagcaggaatttcaagctgggctgggacccggtgaccaagctggtgatgccaggggtctac

SEQ ID NO: 240465 - DNA, 75 bp, Artificial Sequence
  Synthetic
taacgcttgtgggtcctaatgataaacctgttgaatggcacggacctagagatcaactttgtaagggaaaacaaa

SEQ ID NO: 240466 - DNA, 75 bp, Artificial Sequence
  Synthetic
ctctttaatcatagcagtaatggaaaagtcctctaaataagtcactagggccccagggaccacaatgtggtagct

SEQ ID NO: 240467 - DNA, 75 bp, Artificial Sequence
  Synthetic
atgtaatgaacaaaacctcacactactttttgtgaataacactttccagggaatatattatggcattagaaatga

SEQ ID NO: 240468 - DNA, 75 bp, Artificial Sequence
  Synthetic
ctttttgtgaataacactttccagggaatatattatggcattagaaatgatggtagaggtatgaaacaaattcaa

SEQ ID NO: 240469 - DNA, 75 bp, Artificial Sequence
  Synthetic
tacatcctctggctctttgaaaacacttccttcgcagtctccaacgcctgcgccaacgacggtattgaaataccc

SEQ ID NO: 240470 - DNA, 75 bp, Artificial Sequence
  Synthetic
cttccttcgcagtctccaacgcctgcgccaacgacggtattgaaatacccaacaaccttaccagtggactaactt

SEQ ID NO: 240471 - DNA, 75 bp, Artificial Sequence
  Synthetic
accatacctgtaatgttcaaaatttaacacttttatttgtaaactatactcaccgtggagcatattttggcttta

SEQ ID NO: 240472 - DNA, 75 bp, Artificial Sequence
  Synthetic
aacacttttatttgtaaactatactcaccgtggagcatattttggctttaacaaagacggaactgacagacatca

SEQ ID NO: 240473 - DNA, 75 bp, Artificial Sequence
  Synthetic
tacgtcacttctgcccttacatgtggctccgccgtagggcgccatcttgcccacgtccaaaatggcttccatgtc

SEQ ID NO: 240474 - DNA, 75 bp, Artificial Sequence
  Synthetic
tccgctccgcagtgggcgcagacggtctcgcactcgacgagccaggtgagctcgggctgctcggggtcaaaaacc

SEQ ID NO: 240475 - DNA, 75 bp, Artificial Sequence
  Synthetic
ttcacaaatgcagggcagacaaaagaagagtcagtcagtgacaaatcaaaaggaaaaacttcttcaaaagagaaa

SEQ ID NO: 240476 - DNA, 75 bp, Artificial Sequence
  Synthetic
aagagtcagtcagtgacaaatcaaaaggaaaaacttcttcaaaagagaaaaaaactcaaaaaaataactctcaga

SEQ ID NO: 240477 - DNA, 75 bp, Artificial Sequence
  Synthetic
ttttcccagtggatctaatcaaactttagttggcccccctggatcaaaagttgattggtacacaacaaaaaatgg

SEQ ID NO: 240478 - DNA, 75 bp, Artificial Sequence
  Synthetic
ttgattggtacacaacaaaaaatggtgactttacaaaattgtgtgatggattaaatggaccaaaaaatctgtgta

SEQ ID NO: 240479 - DNA, 75 bp, Artificial Sequence
  Synthetic
tggtaggggctctagtgtggttcctgaagcgcaagcccaggtatggaaatgaggagaaggaaaaattgctataaa

SEQ ID NO: 240480 - DNA, 75 bp, Artificial Sequence
  Synthetic
gcgaatttccgcgtccgtgtcaaagtccggtgtttatgtcacagatcagctgatccacagggtatttaaaccagt

SEQ ID NO: 240481 - DNA, 75 bp, Artificial Sequence
  Synthetic
tctttgggtgataattacacactcgtaggtccacaagacactccagttacgtggtatgggggtaaaggtataaat

SEQ ID NO: 240482 - DNA, 75 bp, Artificial Sequence
  Synthetic
taggtccacaagacactccagttacgtggtatgggggtaaaggtataaataagttatgtgagggaaataacgttc

SEQ ID NO: 240483 - DNA, 75 bp, Artificial Sequence
  Synthetic
caatgagcagaatttaactctaattaatgtaaacaaaacatatgaggctaagtactatggttacagacatgacaa

SEQ ID NO: 240484 - DNA, 75 bp, Artificial Sequence
  Synthetic
aatgtaaacaaaacatatgaggctaagtactatggttacagacatgacaatactggcaaaaaagattttagaatt

SEQ ID NO: 240485 - DNA, 75 bp, Artificial Sequence
  Synthetic
gcaaagttcctcaaactcataacgttttcattaagagtgggcaaaactttacactccatggaccagaatacaccc

SEQ ID NO: 240486 - DNA, 75 bp, Artificial Sequence
  Synthetic
tttcattaagagtgggcaaaactttacactccatggaccagaatacacccctgttcaatggtttggtggtaaaaa

SEQ ID NO: 240487 - DNA, 75 bp, Artificial Sequence
  Synthetic
ccaggtccacgctggtggccacctcgccgcgcaggggctcgttggtccagcagagtcgcccgcccttgcgcgagc

SEQ ID NO: 240488 - DNA, 75 bp, Artificial Sequence
  Synthetic
actgtgcatcacaaagagcttaaacataaatgtaataagcaaaatattacattaatcaaagtcaatcagactttt

SEQ ID NO: 240489 - DNA, 75 bp, Artificial Sequence
  Synthetic
ataaatgtaataagcaaaatattacattaatcaaagtcaatcagacttttgaaggacattattatggttacagca

SEQ ID NO: 240490 - DNA, 75 bp, Artificial Sequence
  Synthetic
tcatgtcgttgtattaaattccgattcaaaaaatcaagctcagcgaaaaatcattgttacaaagaaaccagacaa

SEQ ID NO: 240491 - DNA, 75 bp, Artificial Sequence
  Synthetic
tcaaaaaatcaagctcagcgaaaaatcattgttacaaagaaaccagacaatggtgttgtaacaccaatacaggtt

SEQ ID NO: 240492 - DNA, 75 bp, Artificial Sequence
  Synthetic
caacacggccggccgcgagaccgggggcgtgcactggctcgcctttggctggaacccgcgctcgcgcacctgcta

SEQ ID NO: 240493 - DNA, 75 bp, Artificial Sequence
  Synthetic
cactagtgggacctactgatgtaccaattatttggtacgacaatggattagaagacccatgtaaagataaatata

SEQ ID NO: 240494 - DNA, 75 bp, Artificial Sequence
  Synthetic
aattatttggtacgacaatggattagaagacccatgtaaagataaatataaactaagggttgaatgtaatgaaca

SEQ ID NO: 240495 - DNA, 75 bp, Artificial Sequence
  Synthetic
aaaacatatgaaacctctttttatggctatggagacaaaagtcatgcaaagcgatacagagtaaaagtaaataca

SEQ ID NO: 240496 - DNA, 75 bp, Artificial Sequence
  Synthetic
ctaatgtggtttctgaaacgcaagcccaggtatggaaatgaggagaaggaaaaattgctataaattctttttctt

SEQ ID NO: 240497 - DNA, 75 bp, Artificial Sequence
  Synthetic
tgctgccttcgcggccgtctcgcacgcctcgcccgactgtctagggcctttccccacctacctcctctttgccct

SEQ ID NO: 240498 - DNA, 75 bp, Artificial Sequence
  Synthetic
aaaagaacttggtatgaggttgtagtgacagatggttttccaaaatcaggggagatgaaaatcgaagatcagagt

SEQ ID NO: 240499 - DNA, 75 bp, Artificial Sequence
  Synthetic
atcattatactagacagcctactactattactaatcacaaacaaaactttgaaatgcaagttgatgattctatta

SEQ ID NO: 240500 - DNA, 75 bp, Artificial Sequence
  Synthetic
gtagacccactactcagcttctcttactgaaactcagtcactctcatttcagaaccatgaaggctttcacagctt

SEQ ID NO: 240501 - DNA, 75 bp, Artificial Sequence
  Synthetic
aactattgttttccattggacggatgtggcagcagtactgcttttcagggagttaaagtaacgaatccggctacc

SEQ ID NO: 240502 - DNA, 75 bp, Artificial Sequence
  Synthetic
ctggtttggaactcctctagctcgcctggtgtacacagttaagaaggattatcaggaggaatttgaaaatctttt

SEQ ID NO: 240503 - DNA, 75 bp, Artificial Sequence
  Synthetic
agtgggtctaacttaacattacttgggccagatggaaaggtcacttggtatgatgatgatttaaaaagaccatgc

SEQ ID NO: 240504 - DNA, 75 bp, Artificial Sequence
  Synthetic
agaaccatgaaggctttcacagcttgcgttctgattagcatagtcacacttagtttaggtagcaaaaaatttttt

SEQ ID NO: 240505 - DNA, 75 bp, Artificial Sequence
  Synthetic
taattaccttaaatgtaacaatttcaaatactacgtggtcaagatatcatactgatggatggaaatcaatttgcg

SEQ ID NO: 240506 - DNA, 75 bp, Artificial Sequence
  Synthetic
agtgtgacaatcaaaacctaacgctaatcaatgtaactaaactttatgagggagtttactatggtactaatgaca

SEQ ID NO: 240507 - DNA, 75 bp, Artificial Sequence
  Synthetic
aaatactacgtggtcaagatatcatactgatggatggaaatcaatttgcgagtggtctgatccctcatacacatg

SEQ ID NO: 240508 - DNA, 75 bp, Artificial Sequence
  Synthetic
attcatgccttcaatattacttctggtcagtataaagctgaaagttatactgacagttatctaggactttggcaa

SEQ ID NO: 240509 - DNA, 75 bp, Artificial Sequence
  Synthetic
gtcagtataaagctgaaagttatactgacagttatctaggactttggcaatattacaaacatgaaattactatgt

SEQ ID NO: 240510 - DNA, 75 bp, Artificial Sequence
  Synthetic
cagatttgaattgcaaattgattctaatcaagacaatgacaaaattccatcaaccactgtggcaatcgtggtggg

SEQ ID NO: 240511 - DNA, 75 bp, Artificial Sequence
  Synthetic
aacaacaaaagcacccaccactgctaatacagccacaaccacacagcctactactagggaaacaacgcagcctag

SEQ ID NO: 240512 - DNA, 75 bp, Artificial Sequence
  Synthetic
aatacagccacaaccacacagcctactactagggaaacaacgcagcctagcactgtgcccactactcaaccaacc

SEQ ID NO: 240513 - DNA, 75 bp, Artificial Sequence
  Synthetic
agtcagcacaagcctagcaataaagatagaccaagtccaaaagtaaaaaatcctcagaaaacaaaaaacacacac

SEQ ID NO: 240514 - DNA, 75 bp, Artificial Sequence
  Synthetic
aaactacacagctagacacaacagtgcagaatagtactgtattggttaggtatttgttaagagaggaaagtacta

SEQ ID NO: 240515 - DNA, 75 bp, Artificial Sequence
  Synthetic
ctttcatttcagaaccatgaaggctttcacagcttgcgttctgattagcatagtcacattagtatcagctgatta

SEQ ID NO: 240516 - DNA, 75 bp, Artificial Sequence
  Synthetic
ggaaacattacattagatggaccattcgataatactacatggacaagatatcataatgatggacataaaaatggt

SEQ ID NO: 240517 - DNA, 75 bp, Artificial Sequence
  Synthetic
tcgataatactacatggacaagatatcataatgatggacataaaaatggttggatgaaaatttgcacatggactg

SEQ ID NO: 240518 - DNA, 75 bp, Artificial Sequence
  Synthetic
aaggtttcatgcaatgatcaaaacatcactttgattaatgtgaatgaaacctatgctggaacttattatggttct

SEQ ID NO: 240519 - DNA, 75 bp, Artificial Sequence
  Synthetic
tgaccaagacggtgaatatcagacatgcctgctacatctcagggaacggggcagaggtgatcatcgataccctgg

SEQ ID NO: 240520 - DNA, 75 bp, Artificial Sequence
  Synthetic
tggaagcattactatttttgctttcaacattacatccggagtttacaaagcagaagggtataaaaaagaggttag

SEQ ID NO: 240521 - DNA, 75 bp, Artificial Sequence
  Synthetic
cccgagtgcatctactccctgctcaagaccctttgcggactccgcgacctcctccccatgaactgatgttgatta

SEQ ID NO: 240522 - DNA, 75 bp, Artificial Sequence
  Synthetic
taatctaacaataattgaaccgccaactactaaagcacccaccatagttagaacaactactagggaaacaacaca

SEQ ID NO: 240523 - DNA, 75 bp, Artificial Sequence
  Synthetic
tccaaccaccacaactcacactacacatctagacactacagtgcagaatactactttattgattgggtttttaat

SEQ ID NO: 240524 - DNA, 75 bp, Artificial Sequence
  Synthetic
aacttcccacctggggtcctgtcactcaaactggctgacccaatcaccatcactaatggggatgtctcacttaag

SEQ ID NO: 240525 - DNA, 75 bp, Artificial Sequence
  Synthetic
tcaacagataatggcggaagcgtatgtgttagagttggagaaggtggcggcttatcatttaataatgatggagac

SEQ ID NO: 240526 - DNA, 75 bp, Artificial Sequence
  Synthetic
cactaatggggatgtctcacttaaggtgggaggaggacttactgtggaaaaagagtctggaaacttaactgtgaa

SEQ ID NO: 240527 - DNA, 75 bp, Artificial Sequence
  Synthetic
gcaaattcgcggacatatggaatttcttagactgctatcaggagaaaatggatatgccttcctattacttggtga

SEQ ID NO: 240528 - DNA, 75 bp, Artificial Sequence
  Synthetic
attctccatttgatgttaaaaacaacatgcttactcttaaagcaggacacggcttagcagtggtaacaaaagaca

SEQ ID NO: 240529 - DNA, 75 bp, Artificial Sequence
  Synthetic
gcacccactaccactaaaccaaccacagttaggacaactagagaaacaaccacacagcctactactgtgcccacc

SEQ ID NO: 240530 - DNA, 75 bp, Artificial Sequence
  Synthetic
ggtagcctatccaaaacctaccgctggctctaaaaaatatgcaagagatatagtttatggaaacatctaccttgg

SEQ ID NO: 240531 - DNA, 75 bp, Artificial Sequence
  Synthetic
ggaagtgtatctttgcttgctgtaaaaggagagtatcaaaatatgactgccaatactaaaaagaatgtaaaaata

SEQ ID NO: 240532 - DNA, 75 bp, Artificial Sequence
  Synthetic
tcttattagcaggatccagtctcgataaagagtactggaactttagaagtaatgattctactgtgtctggaaatt

SEQ ID NO: 240533 - DNA, 75 bp, Artificial Sequence
  Synthetic
tgcactttctttgccatcatgatctacccctgttttaatctcggctggaactctgttgaggcattcacatacaca

SEQ ID NO: 240534 - DNA, 75 bp, Artificial Sequence
  Synthetic
taaagagtactggaactttagaagtaatgattctactgtgtctggaaattatgaaaatgctgtccagttcatgcc

SEQ ID NO: 240535 - DNA, 75 bp, Artificial Sequence
  Synthetic
aattctaaaagctatgctagaagtgttatatttggaaatgtctatattgatgctaagccgtataatccagtagtt

SEQ ID NO: 240536 - DNA, 75 bp, Artificial Sequence
  Synthetic
attaaaattagcttcaatcaagagacacaaaataattgtgtctattctatatcttttgactacactttgtctaaa

SEQ ID NO: 240537 - DNA, 75 bp, Artificial Sequence
  Synthetic
atcgccgaggagaaactgctggccctgctggccgagctggaagccctgagccgccagctggccgccctgacccag

SEQ ID NO: 240538 - DNA, 75 bp, Artificial Sequence
  Synthetic
ccacctggacctcgagatggacggccaggcctccgagcagcgcatcctgcaactgcgcgtccgtcagcagcagga

SEQ ID NO: 240539 - DNA, 75 bp, Artificial Sequence
  Synthetic
gtcttccaggagcctgatgagctcggcgatggtggcgcgcacctcgcgctcgaaatccccgggggcctcctcttc

SEQ ID NO: 240540 - DNA, 75 bp, Artificial Sequence
  Synthetic
gagaagaacgcacagattcatactcggaaaacaggatgggtctgtgcctctccatcagcgccctcagcagtctct

SEQ ID NO: 240541 - DNA, 75 bp, Artificial Sequence
  Synthetic
aaccccatagtcatcacccagcagtcgggcgagaccagcggctgcatccactgctcctgcgaaagccccgagtgc

SEQ ID NO: 240542 - DNA, 75 bp, Artificial Sequence
  Synthetic
gagactgatggccacggggagccccttggtgtaggtgttggcgaagcggttgagctgggagggatgcatgcgggg

SEQ ID NO: 240543 - DNA, 75 bp, Artificial Sequence
  Synthetic
aaactaactgatttaagcccaaaaaccaatcaaacccccttttcccatctacccaaataaacatttattggaaat

SEQ ID NO: 240544 - DNA, 75 bp, Artificial Sequence
  Synthetic
ggactgactgtggaacaagatagtggaaacctaaaggtgaacactaaagctcccttgcaagttgcagctgataaa

SEQ ID NO: 240545 - DNA, 75 bp, Artificial Sequence
  Synthetic
ccaatcaaacccccttttcccatctacccaaataaacatttattggaaataattattcaataaagatcacttact

SEQ ID NO: 240546 - DNA, 75 bp, Artificial Sequence
  Synthetic
acgtgagcgcgtcgagatcgaccggatcggagaatctttcgaggaaagcgtctagccaatcgcagtcgcaaggta

SEQ ID NO: 240547 - DNA, 75 bp, Artificial Sequence
  Synthetic
tggtataaaagcaggtcatggattgaaagtcattgacaattcaatttctggtttagaaggcttggtaggcacgct

SEQ ID NO: 240548 - DNA, 75 bp, Artificial Sequence
  Synthetic
gaaacctaaaggtgaacactaaagctcccttgcaagttgcagctgataaacaattggaaattgcactggctgatc

SEQ ID NO: 240549 - DNA, 75 bp, Artificial Sequence
  Synthetic
aaagtcattgacaattcaatttctggtttagaaggcttggtaggcacgcttgtagttttgactggtcatggaatt

SEQ ID NO: 240550 - DNA, 75 bp, Artificial Sequence
  Synthetic
ggtgcctcccgcccgacactgcagggagcccggggatgaacagtggcaatgcaggatccagcgctcgtacccgct

SEQ ID NO: 240551 - DNA, 75 bp, Artificial Sequence
  Synthetic
atggatcgagcagaggagttggaataaacgtaagacttggaaaagatggaggtttatcctttgataaaaagggtg

SEQ ID NO: 240552 - DNA, 75 bp, Artificial Sequence
  Synthetic
atttagtagcatggaataaaaaatatgatactcgcaccctttggacaactccagacccatcgccaaattgcaaag

SEQ ID NO: 240553 - DNA, 75 bp, Artificial Sequence
  Synthetic
tcaaaatattcccttcctcactcccccctttgtctcctccaatggatttcaaaacttcccccctggggtcctgtc

SEQ ID NO: 240554 - DNA, 75 bp, Artificial Sequence
  Synthetic
tgatactcgcaccctttggacaactccagacccatcgccaaattgcaaagttattgaagccaaagactcaaaact

SEQ ID NO: 240555 - DNA, 75 bp, Artificial Sequence
  Synthetic
attaacaatcaaaatgtatcactcaaggttggaggggggctaactttgcaagaagaaactggaaaattaacagtt

SEQ ID NO: 240556 - DNA, 75 bp, Artificial Sequence
  Synthetic
gggtaaagccagcagcacatggtaatccacggacagaacttacattatgataatctgcatgatcacaatcgggca

SEQ ID NO: 240557 - DNA, 75 bp, Artificial Sequence
  Synthetic
agtcaaatactagcaaatatgtcattgctgatccttaaaggaacttatgaatatataagtaacgctatagctaat

SEQ ID NO: 240558 - DNA, 75 bp, Artificial Sequence
  Synthetic
tgctgatccttaaaggaacttatgaatatataagtaacgctatagctaataagagttttactattaagttactgt

SEQ ID NO: 240559 - DNA, 75 bp, Artificial Sequence
  Synthetic
tggttctagtcttgacaaagattactggaactataaaagtgatgactcagtgatgtcaaaggcatatgaaaatgc

SEQ ID NO: 240560 - DNA, 75 bp, Artificial Sequence
  Synthetic
agtacctgatccgcgagaaggcgcgcgagtcgaagacgtagtcgttgcaggtgcgcacgaggtactggtagccga

SEQ ID NO: 240561 - DNA, 75 bp, Artificial Sequence
  Synthetic
atggcttgtctattataacaaaagaaacatcaacactgcctggcttggttaatactcttgtagtattaactggaa

SEQ ID NO: 240562 - DNA, 75 bp, Artificial Sequence
  Synthetic
tggaactataaaagtgatgactcagtgatgtcaaaggcatatgaaaatgcagtcccatttatgcctaatttaaaa

SEQ ID NO: 240563 - DNA, 75 bp, Artificial Sequence
  Synthetic
aatactcttgtagtattaactggaaagggtattggaacagatttatcaaataatggtggaaatatatgtgttaga

SEQ ID NO: 240564 - DNA, 75 bp, Artificial Sequence
  Synthetic
ctactaatccatctacagacaaaaagagtaatggtaagaatgcaattgtatcaaatgtgtatctagaaggaagag

SEQ ID NO: 240565 - DNA, 75 bp, Artificial Sequence
  Synthetic
gagtaatggtaagaatgcaattgtatcaaatgtgtatctagaaggaagagcataccagccagttgcgattaccat

SEQ ID NO: 240566 - DNA, 75 bp, Artificial Sequence
  Synthetic
acttattctatgacatttgattttggatggagcaaagtgtacaatgatccaataccatttgatacatcttctcta

SEQ ID NO: 240567 - DNA, 75 bp, Artificial Sequence
  Synthetic
aataccatttgatacatcttctctaactttttcatatattgcccaagaaaatgaggacgaagacaaataaagtat

SEQ ID NO: 240568 - DNA, 75 bp, Artificial Sequence
  Synthetic
agagcttgggcgcgagaaagacggactcgggggcgaaagcgtccgctccgcagtgggcgcagacggtctcgcact

SEQ ID NO: 240569 - DNA, 75 bp, Artificial Sequence
  Synthetic
gctgaaagtggaggaactatagatgtaagacttggaagtggaggaggtttgtcatttgataaagacggaaaccta

SEQ ID NO: 240570 - DNA, 75 bp, Artificial Sequence
  Synthetic
aaaatatgcaagagatatagtttatggaaacatctaccttggcggaaagccacatcaaccagtaaccattaaaac

SEQ ID NO: 240571 - DNA, 75 bp, Artificial Sequence
  Synthetic
gaatactctattacatttgattttagttgggccaaaacttatgtaaatgttgaatttgaaactacctcttttacc

SEQ ID NO: 240572 - DNA, 75 bp, Artificial Sequence
  Synthetic
gttgggccaaaacttatgtaaatgttgaatttgaaactacctcttttaccttttcctatattgcccaagaataaa

SEQ ID NO: 240573 - DNA, 75 bp, Artificial Sequence
  Synthetic
aaaaatttcatgtatctttattgatttttacaccagcgcgggtacacattctcccaccaccagcccattttacag

SEQ ID NO: 240574 - DNA, 75 bp, Artificial Sequence
  Synthetic
ttttacaccagcgcgggtacacattctcccaccaccagcccattttacagtgtaaacaattctctcagcacgggt

SEQ ID NO: 240575 - DNA, 75 bp, Artificial Sequence
  Synthetic
gcccttaacagtctctgccgccggggctcggtgcggctgctacagatgggatcgggatcgcaagtctctttcact

SEQ ID NO: 240576 - DNA, 75 bp, Artificial Sequence
  Synthetic
cacctgtgggacctggcggaggccatcgtgcagaacccggacagcaagcctctgacggcgcagctgttcctggtg

SEQ ID NO: 240577 - DNA, 75 bp, Artificial Sequence
  Synthetic
ctgaaaaacagaaagcatgcactaaaccagggtggctattctcactgaaggaaaaatcactctctccagcagcag

SEQ ID NO: 240578 - DNA, 75 bp, Artificial Sequence
  Synthetic
ccctccaggactatctatgaaagcatacagagattcagccatagctctccgcttaccagtagacagagagcacag

SEQ ID NO: 240579 - DNA, 75 bp, Artificial Sequence
  Synthetic
agtgaaaaagtctgaagcgccgccgatgctattgaaagagaggaaagaggacactaaagggagagcttaacttgt

SEQ ID NO: 240580 - DNA, 75 bp, Artificial Sequence
  Synthetic
ccatccccaggtaattctcatttttccagccttggattatttctacaaattgttggtgtaagtccactccgcaca

SEQ ID NO: 240581 - DNA, 75 bp, Artificial Sequence
  Synthetic
gcttgagcggccttgcggagcgaggtgtgcgtcagggcgaaggtgtccctgaccatgactttcaagaactggtac

SEQ ID NO: 240582 - DNA, 75 bp, Artificial Sequence
  Synthetic
caatctggcggtaccatgggaagcgctggttgaacatgcacccgtaaatgactctcctgaaccacacggccagca

SEQ ID NO: 240583 - DNA, 75 bp, Artificial Sequence
  Synthetic
agaacttacattatgataatctgcatgatcacaatcgggcaatacagggtgttgttcagtcaaagaggccctggt

SEQ ID NO: 240584 - DNA, 75 bp, Artificial Sequence
  Synthetic
ctccttatcatatcgtggtaaacgggccctgcgatatggataatggcggagcaaggttgattgttccttggtgct

SEQ ID NO: 240585 - DNA, 75 bp, Artificial Sequence
  Synthetic
cttccatgaccggccacgcctccgcgccgaccgttgacgccgtacgtcgtgacgtcactaacggttcttgcaaca

SEQ ID NO: 240586 - DNA, 75 bp, Artificial Sequence
  Synthetic
cattgtagtgcaccctcttgcgtacctcgttgtacttttgccagcagaaagtggccctggaacagcaaatacctc

SEQ ID NO: 240587 - DNA, 75 bp, Artificial Sequence
  Synthetic
cgtcagctgcaaaaagtcactcaagtcctcagccactacagctgacaattcagagccagggctaagcgtgggact

SEQ ID NO: 240588 - DNA, 75 bp, Artificial Sequence
  Synthetic
gtggccctggaacagcaaatacctctcctccgaccgtcctttcgctgttgccgctcagtcatccaactgaagtac

SEQ ID NO: 240589 - DNA, 75 bp, Artificial Sequence
  Synthetic
gccaatcagcggcggccccgccccaaattcaaaagctcatttgcatattaacttttgtttactttgtggggtata

SEQ ID NO: 240590 - DNA, 75 bp, Artificial Sequence
  Synthetic
gtaaacaaaagttaatatgcaaatgagcttttgaatttagggcgtggccgacgctgattggacgagagaagacga

SEQ ID NO: 240591 - DNA, 75 bp, Artificial Sequence
  Synthetic
gtgaccctcgcggacatacaaaaatcggtccgtgtggttaaaaagcagcacagtcagctcatgtcttctcccagc

SEQ ID NO: 240592 - DNA, 75 bp, Artificial Sequence
  Synthetic
cctggctgtgattatgctggaggactttgtgaatacagttctggaggacgaactgcatccagagccatttgagct

SEQ ID NO: 240593 - DNA, 75 bp, Artificial Sequence
  Synthetic
taatagaaacaaatcctgctgctccaccacctgcagcgtgtttaaaacaacaacatttaataaggttctgccctc

SEQ ID NO: 240594 - DNA, 75 bp, Artificial Sequence
  Synthetic
actttgcttgtgtgattgtggaggagcaagatgtgattgaaaaatctactgagccagtacaaggctgtaggaact

SEQ ID NO: 240595 - DNA, 75 bp, Artificial Sequence
  Synthetic
gctggaataagctctttttgtatctccggtaatgccttccaaaatgtgaataataaagcgaggtagtttttcttt

SEQ ID NO: 240596 - DNA, 75 bp, Artificial Sequence
  Synthetic
tttaatgctccaaagctagcacccaaaaactgcatgctggaataagctctctttgtgtcaccggtgatgccttcc

SEQ ID NO: 240597 - DNA, 75 bp, Artificial Sequence
  Synthetic
tcgtcttctctcgtccaatcagcgctggccccgccctaaattcaaaagctcatttgcatattaacttttgtttac

SEQ ID NO: 240598 - DNA, 75 bp, Artificial Sequence
  Synthetic
gcccctgcaagtgttcagacccaccccagtcagagccagtggcgagaggcgagcggctgttgaaaaaattgagga

SEQ ID NO: 240599 - DNA, 75 bp, Artificial Sequence
  Synthetic
acatgcccgaccccaacgacgggttcctgtgggacgacgtggacagcgcggtgttctcgccgacctttcaaaagc

SEQ ID NO: 240600 - DNA, 75 bp, Artificial Sequence
  Synthetic
gccccaggaactaggcgcagctgcgcttagtcatgtgtaaataaagttgtacttatgtgacgcatgcaaggtgtg

SEQ ID NO: 240601 - DNA, 75 bp, Artificial Sequence
  Synthetic
aaggtatatttattgctagccccttcctggacgggagccatccctccagggctatctataaaagcatagagacat

SEQ ID NO: 240602 - DNA, 75 bp, Artificial Sequence
  Synthetic
agcgccaacagcaataactacttactgtgccagctcagtacttaaaggcagcttacactgacgtaatgaccaaag

SEQ ID NO: 240603 - DNA, 75 bp, Artificial Sequence
  Synthetic
tgtgccagctcagtacttaaaggcagcttacactgacgtaatgaccaaaggtgtaaaaaccccgccaaaaaaaaa

SEQ ID NO: 240604 - DNA, 75 bp, Artificial Sequence
  Synthetic
cgaactgcatccaacaccgttcgagctgggacccacacttcaggatctctatgatctggaggtagatgcccatga

SEQ ID NO: 240605 - DNA, 75 bp, Artificial Sequence
  Synthetic
tgtgctatatgaaacagactttcagctttatttacagtaagtagagtgaatgcgagagagactgagtgcttaaca

SEQ ID NO: 240606 - DNA, 75 bp, Artificial Sequence
  Synthetic
gcagggtgcagcgcgtgttgcggcccggcacggcggtggtgttcacgcccggcgagcggtcctcggtcaggagca

SEQ ID NO: 240607 - DNA, 75 bp, Artificial Sequence
  Synthetic
ctcctcaagaccctttgcggactccgcgacctcctccccatgaactgatgttgattaaaagcccaaaaaccaatc

SEQ ID NO: 240608 - DNA, 75 bp, Artificial Sequence
  Synthetic
ctgattatcctttccctggtggggggtgtactgtcatgccacgaacagccacgatgtaacatcaccacaggcaat

SEQ ID NO: 240609 - DNA, 75 bp, Artificial Sequence
  Synthetic
agtgtgaaccctaaggctccattgcaagttggaacagacaaaaaactggaattggctttagcacctccatttgat

SEQ ID NO: 240610 - DNA, 75 bp, Artificial Sequence
  Synthetic
tagtaggagatggattaaaggtaatagatagatcaatatctgatttgccaggattgttaaactatcttgtagttt

SEQ ID NO: 240611 - DNA, 75 bp, Artificial Sequence
  Synthetic
agatagatcaatatctgatttgccaggattgttaaactatcttgtagttttgactggcaaaggaattggaaatga

SEQ ID NO: 240612 - DNA, 75 bp, Artificial Sequence
  Synthetic
accatgggaaatgcatgggtgggcgactgggaaccaggagatgagcagaactacacggtcactgtccatggtagc

SEQ ID NO: 240613 - DNA, 75 bp, Artificial Sequence
  Synthetic
gcaaaccgtggacattcagatccccaccgacatggatgtcgacaaaaaaccctcgaccagcatcgaggtgcagac

SEQ ID NO: 240614 - DNA, 75 bp, Artificial Sequence
  Synthetic
caagattctgagatatgatgagaccaggtccagggtgcgcgcttgcgagtgcgggggcagacacaccaggatgca

SEQ ID NO: 240615 - DNA, 75 bp, Artificial Sequence
  Synthetic
atcaatgctacatggtgggctaatataactttagtgggaccctcagatattccagtcacatggtatgatagcact

SEQ ID NO: 240616 - DNA, 75 bp, Artificial Sequence
  Synthetic
ggattgcaattttgtgatggaagtacagttaagaatccacagatcagacatagttgtaatgatcaaaacttaact

SEQ ID NO: 240617 - DNA, 75 bp, Artificial Sequence
  Synthetic
tccaaggtcacagtctggtggaatgagaagaacgcacagattcatactcggaaaacaagatgggtctgtgcctct

SEQ ID NO: 240618 - DNA, 75 bp, Artificial Sequence
  Synthetic
ccgcccgccgccaggcccagaactggcagagcacgctgcacagtatcgtgggcctgggagtgaaaagtctgaagc

SEQ ID NO: 240619 - DNA, 75 bp, Artificial Sequence
  Synthetic
aaagaacatacatgggctataataagcagagtactcataaagaagactataaagtcacagttataccacctcctc

SEQ ID NO: 240620 - DNA, 75 bp, Artificial Sequence
  Synthetic
aaagaggacactaaagggagagcttaacttgtatgtgccttaccgccagagaacgcgcgaagatggccaccccct

SEQ ID NO: 240621 - DNA, 75 bp, Artificial Sequence
  Synthetic
ggcccggcacggcggtggtgttcacgcccggcgagcggtcctcggtcaggagcaagcgtagctatgacgaggtgt

SEQ ID NO: 240622 - DNA, 75 bp, Artificial Sequence
  Synthetic
aaatcttacactgttgtttataaatcttacacatgatggagcttatcttggttataatcgccagggaactaaaag

SEQ ID NO: 240623 - DNA, 75 bp, Artificial Sequence
  Synthetic
aattcaaccacacctgtgacatgcaaaatcttacactgttgtttataaatcttacacatgatggagcttatcttg

SEQ ID NO: 240624 - DNA, 75 bp, Artificial Sequence
  Synthetic
atgaccctgcatggctgcaagttcttcggattcaacaatatgtgtgcagaggtgtggggctcagccaagatcagg

SEQ ID NO: 240625 - DNA, 75 bp, Artificial Sequence
  Synthetic
gcagggtgagccggccgcgcttgctaggcgaggacgagtacctgaacgactcgctgctgcagccgccacgggcca

SEQ ID NO: 240626 - DNA, 75 bp, Artificial Sequence
  Synthetic
gatggttttccaaaatcagaagagatgaaggtagaagagcatagtaaagaaacagaacaaaaacagactggtcaa

SEQ ID NO: 240627 - DNA, 75 bp, Artificial Sequence
  Synthetic
tttgagaagtgctacctgggagtctctaccgagggcaatgctcgggtgagacactgttcttccatcgagacgggc

SEQ ID NO: 240628 - DNA, 75 bp, Artificial Sequence
  Synthetic
catgcaaggtgtggtttatgactcatgggcggggcttagtcctatataagtggtaacacctgggcactcaggcac

SEQ ID NO: 240629 - DNA, 75 bp, Artificial Sequence
  Synthetic
cctcgctcaagcataatgtgatcaaggggtgcacggatgagcgcatgtacaacatgctgacctgcgactcgggtg

SEQ ID NO: 240630 - DNA, 75 bp, Artificial Sequence
  Synthetic
gccagcacttactttgacatccgcggcgtcctggaccgcggtcccagcttcaaaccctactcgggcacggcttac

SEQ ID NO: 240631 - DNA, 75 bp, Artificial Sequence
  Synthetic
tctgccatatcctgaagaacatccatatcacctcccacgctagaaagaagtggccagtgtttgagaataacatgc

SEQ ID NO: 240632 - DNA, 75 bp, Artificial Sequence
  Synthetic
actaatgacagaggcaacagcaaaagatacagagtaaaagtaaacactactaattctcaaagtgtgaaaattcag

SEQ ID NO: 240633 - DNA, 75 bp, Artificial Sequence
  Synthetic
taattctcaaagtgtgaaaattcagccgtacaccaggcctactactcctgatcagaaacacagatttgaattgca

SEQ ID NO: 240634 - DNA, 75 bp, Artificial Sequence
  Synthetic
aattgattctaatcaagacaaaattccatcaactactgtggcaatcgtggtgggagtgatcgcgggctttgtaac

SEQ ID NO: 240635 - DNA, 75 bp, Artificial Sequence
  Synthetic
gcattcgcaagaagcaacctttccaagagggcttcagaatcatgtatgaggatctagaagggggcaacatccccg

SEQ ID NO: 240636 - DNA, 75 bp, Artificial Sequence
  Synthetic
cccttctcaatgtgaccaagtacttggaaagcaagaagaagctagaggaagcagtggagaatgcagctaaagcca

SEQ ID NO: 240637 - DNA, 75 bp, Artificial Sequence
  Synthetic
tgtcccaagagctgtagaaaaggctgctgagaaggagctagagattgttcccatcgaaaaggatgacagcaacag

SEQ ID NO: 240638 - DNA, 75 bp, Artificial Sequence
  Synthetic
tgacaataattgaactgcctacaaccaaggcacccaccacagttagtacaactacacagtcaactgttaagacca

SEQ ID NO: 240639 - DNA, 75 bp, Artificial Sequence
  Synthetic
ctccaggccaacctgtggaagagttttctgtactcgaacgtggccctgtacctgcccgactcctacaagtacacg

SEQ ID NO: 240640 - DNA, 75 bp, Artificial Sequence
  Synthetic
tgtaaaagttaaaaatggacaagatggggatcaagagagcgaatgggaaaaagacaccaatgtggcagatcgaaa

SEQ ID NO: 240641 - DNA, 75 bp, Artificial Sequence
  Synthetic
gttcttcctatttaacatcctcttctgtctcttcaacatctgtgctgcctttgcggcagtttcgcacgcctcgcc

SEQ ID NO: 240642 - DNA, 75 bp, Artificial Sequence
  Synthetic
aaagcaaggaactactggaggagtgcagcaagaaaaagatgtcacaaaaacatttggtgtggctgccaccggcgg

SEQ ID NO: 240643 - DNA, 75 bp, Artificial Sequence
  Synthetic
cagcaagaaaaagatgtcacaaaaacatttggtgtggctgccaccggcggaattaatataacaaaccagggtctg

SEQ ID NO: 240644 - DNA, 75 bp, Artificial Sequence
  Synthetic
agaatggcaaaaaagacatttatgcagacaagactttccagccagaacctcaagttggagaagaaaactggcagg

SEQ ID NO: 240645 - DNA, 75 bp, Artificial Sequence
  Synthetic
agacaagactttccagccagaacctcaagttggagaagaaaactggcaggaaaatgaagccttctatggaggaag

SEQ ID NO: 240646 - DNA, 75 bp, Artificial Sequence
  Synthetic
ttaaggcttatatgaccatgcagactctgctcatactgctatcgctcttatcccatgccctcgctactgctgatt

SEQ ID NO: 240647 - DNA, 75 bp, Artificial Sequence
  Synthetic
atcaccctcagaagaagaccacccgtctccccctgagctgtcaggcgaaacgcccctgcaagtgcacagacccac

SEQ ID NO: 240648 - DNA, 75 bp, Artificial Sequence
  Synthetic
aaaccatgctatggatcttttgctagacctactaatgagaaaggaggtcaggcaaagttcaaaccagttaatgaa

SEQ ID NO: 240649 - DNA, 75 bp, Artificial Sequence
  Synthetic
gacctactaatgagaaaggaggtcaggcaaagttcaaaccagttaatgaaggagaacaacctaaagatctggata

SEQ ID NO: 240650 - DNA, 75 bp, Artificial Sequence
  Synthetic
gggcaacggccgctacgtgcccttccacatccaagtgccccaaaagttctttgccatcaagaacctgctcctgct

SEQ ID NO: 240651 - DNA, 75 bp, Artificial Sequence
  Synthetic
tggcggaagtcctccagcaggtggtagtggggaagaatacaaagcagatataattttgtacactgaaaatgttaa

SEQ ID NO: 240652 - DNA, 75 bp, Artificial Sequence
  Synthetic
gtttacaagccaggaacttcagataacagttcagaaatcaatctggttcagcagtccatgccaaacagacccaac

SEQ ID NO: 240653 - DNA, 75 bp, Artificial Sequence
  Synthetic
gatgaccccgatgacgggttgcaggtggtagttcaaggagatgcagctgccgtcgtcccggaggaggggggccac

SEQ ID NO: 240654 - DNA, 75 bp, Artificial Sequence
  Synthetic
catctgccactcgcgggcggccatcgctcgctcgtaggggttgaggggcggaccccagggcatgggatgcgtgag

SEQ ID NO: 240655 - DNA, 75 bp, Artificial Sequence
  Synthetic
gcagtccatgccaaacagacccaactacattggctttagggacaactttgtaggtctcatgtattacaacagcac

SEQ ID NO: 240656 - DNA, 75 bp, Artificial Sequence
  Synthetic
gaccccagggcatgggatgcgtgagcgcggaggcgtacatgccgcagatgtcatagacatagatgggctccgaga

SEQ ID NO: 240657 - DNA, 75 bp, Artificial Sequence
  Synthetic
caggcttctcagttgaacgctgtggtcgacttgcaagacagaaacaccgagttatcttaccagctattgctagat

SEQ ID NO: 240658 - DNA, 75 bp, Artificial Sequence
  Synthetic
tatcaaggtgtaaagattacaaatggtaatgatggtgctgaagaaagtgagtgggagaaagacgatgcaatttct

SEQ ID NO: 240659 - DNA, 75 bp, Artificial Sequence
  Synthetic
aaaaaccaaaaaaacaatcagccccttcccctatcccaaattactcgcaaaaataaatcattggaactaatcatt

SEQ ID NO: 240660 - DNA, 75 bp, Artificial Sequence
  Synthetic
accctactcgggcacggcttacaacagcctggctcccaagggcgcccccaactccagtcagtgggatgctaaaga

SEQ ID NO: 240661 - DNA, 75 bp, Artificial Sequence
  Synthetic
agcctggctcccaagggcgcccccaactccagtcagtgggatgctaaagaaaaaaatggtggagctgaaactacc

SEQ ID NO: 240662 - DNA, 75 bp, Artificial Sequence
  Synthetic
ccatgggaggacttgacataacagacaaaggtcttcaaattggaactgatgaaaccaaagaagataataatgaaa

SEQ ID NO: 240663 - DNA, 75 bp, Artificial Sequence
  Synthetic
caaaggtcttcaaattggaactgatgaaaccaaagaagataataatgaaatttttgcagacaaaactttccaacc

SEQ ID NO: 240664 - DNA, 75 bp, Artificial Sequence
  Synthetic
tggcaggaaaatgaagttttctatggaggcagggctctcaaaaaagaaaccaaaatgaaaccatgctatggctct

SEQ ID NO: 240665 - DNA, 75 bp, Artificial Sequence
  Synthetic
tgtcctgcaggggcgtcccgcggtcctcctcgtagagaaactcggaccactctgagacgaaggcgcgcgtccacg

SEQ ID NO: 240666 - DNA, 75 bp, Artificial Sequence
  Synthetic
catcatcaataatataccttattttttttgtgtgagttaatatgcaaataaggcgtgaaaatttggggatggggc

SEQ ID NO: 240667 - DNA, 75 bp, Artificial Sequence
  Synthetic
ttttgtgtgagttaatatgcaaataaggcgtgaaaatttggggatggggcgcgctgattggctgtgacagcggcg

SEQ ID NO: 240668 - DNA, 75 bp, Artificial Sequence
  Synthetic
aggcgtgaaaatttggggatggggcgcgctgattggctgtgacagcggcgttcgttaggggcggggcaggtgacg

SEQ ID NO: 240669 - DNA, 75 bp, Artificial Sequence
  Synthetic
agttagtttgcaagttctggtggggaaaagtgacgtcaaacgaggtgtggtttaaacacggaaatactcaatttt

SEQ ID NO: 240670 - DNA, 75 bp, Artificial Sequence
  Synthetic
gtgtttttgggcggatgcaagtgaaaacggaccattttcgcgcgaaaactgaatgaggaagtgaaatctgagtaa

SEQ ID NO: 240671 - DNA, 75 bp, Artificial Sequence
  Synthetic
ctgtgttgctggtttaagaaatggggaagatcaccctagtgagctgcggtgcgctggtggcggtggtgctttcga

SEQ ID NO: 240672 - DNA, 75 bp, Artificial Sequence
  Synthetic
ggtcgctggaccccatggacaacgtaaatcccttcaaccaccaccgtaacgcgggcttgcgctaccgctccatgc

SEQ ID NO: 240673 - DNA, 75 bp, Artificial Sequence
  Synthetic
gagcgagattctggaactggtggtaaatgctatgatgggcgacgaccatccggaaccccccaccccatttgagac

SEQ ID NO: 240674 - DNA, 75 bp, Artificial Sequence
  Synthetic
gctcagacagcgactcttcactgcatacccctagacacgacagaggtgagaaagagatccccgggcttaaatggg

SEQ ID NO: 240675 - DNA, 75 bp, Artificial Sequence
  Synthetic
ggaatgcctgcccccaagcgatgatgaggacgagcaggcgattcagaacgcagcgagccatggagtgcaagccgt

SEQ ID NO: 240676 - DNA, 75 bp, Artificial Sequence
  Synthetic
tatcgtgtgcctgagcattcacatgctcatcgctattcgccccagaaataatgccgaaaaagagaaacagccata

SEQ ID NO: 240677 - DNA, 75 bp, Artificial Sequence
  Synthetic
atgccgaaaaagagaaacagccataacacgttttttcacacacctttttcagaccatggcctctgttaaattttt

SEQ ID NO: 240678 - DNA, 75 bp, Artificial Sequence
  Synthetic
agtcttgtgaatttcatcgcatcaatactggagataaagctgtgttatgtgcactttgctatatgagagcgtaca

SEQ ID NO: 240679 - DNA, 75 bp, Artificial Sequence
  Synthetic
gtcattcatggaatgagtaatgagaaaattactatttacactggcactaatcacacattgaaaggtccagaaaaa

SEQ ID NO: 240680 - DNA, 75 bp, Artificial Sequence
  Synthetic
ttaagtgaactttaaagggaggcaaagagtagggtgactgggtgatgactggtttatttatgtatatctgttttt

SEQ ID NO: 240681 - DNA, 75 bp, Artificial Sequence
  Synthetic
aaattactatttacactggcactaatcacacattgaaaggtccagaaaaagccacagaagtttcatggtattgtt

SEQ ID NO: 240682 - DNA, 75 bp, Artificial Sequence
  Synthetic
tgaactctgtggaaacaacaacaaaaaaaatgagagcattactctcatcaagtttcaatgtggatctgacttaac

SEQ ID NO: 240683 - DNA, 75 bp, Artificial Sequence
  Synthetic
atgatgagacccccactacagagtccactttgtcaccccctgaaattggcacgtctccatctgacaatattgtta

SEQ ID NO: 240684 - DNA, 75 bp, Artificial Sequence
  Synthetic
aaaaatgagagcattactctcatcaagtttcaatgtggatctgacttaaccctcattaacatcactagagactat

SEQ ID NO: 240685 - DNA, 75 bp, Artificial Sequence
  Synthetic
caggcatttcggacatggaattttatcaagtttctgtgtctgaacccaccacgcctagaatgaccacaaccacaa

SEQ ID NO: 240686 - DNA, 75 bp, Artificial Sequence
  Synthetic
aacctttggacttgtgtacccggaaacgccccaggcattaagtgccacacatgtgtgtttacttgaggtgatgtc

SEQ ID NO: 240687 - DNA, 75 bp, Artificial Sequence
  Synthetic
agtatttatagggtgtggagtgcaataaaatatgtgttgactttaagtgcgtggtttatgactcaggggagggga

SEQ ID NO: 240688 - DNA, 75 bp, Artificial Sequence
  Synthetic
gctcactaccaatggcttttttgccatgcttcaagtggctgaaaatagcaccagcattcaacccaccccacccag

SEQ ID NO: 240689 - DNA, 75 bp, Artificial Sequence
  Synthetic
taaaatatgtgttgactttaagtgcgtggtttatgactcaggggaggggactttgggtatataagcaggtgcaga

SEQ ID NO: 240690 - DNA, 75 bp, Artificial Sequence
  Synthetic
tgaggaaattcccaaatccatgattggcattattgttgctgtagtggtgtgcatgttgatcatcgccttgtgcat

SEQ ID NO: 240691 - DNA, 75 bp, Artificial Sequence
  Synthetic
tggagatttggacggttttggaagactttcacaagactaggcagctgctagagaacgcctcgaacggagtctctt

SEQ ID NO: 240692 - DNA, 75 bp, Artificial Sequence
  Synthetic
ctttcacaagactaggcagctgctagagaacgcctcgaacggagtctcttacctgtggagattctgcttcggcgg

SEQ ID NO: 240693 - DNA, 75 bp, Artificial Sequence
  Synthetic
acctgtggagattctgcttcggcggtgacctagctaagctagtctatagggccaaacaggattatagggaacaat

SEQ ID NO: 240694 - DNA, 75 bp, Artificial Sequence
  Synthetic
tggtctttttgacgctcttaacttgggccatcagtctcactttaaccagagaatttcaagagcccttgactttac

SEQ ID NO: 240695 - DNA, 75 bp, Artificial Sequence
  Synthetic
acaaatggagtcaagaaacccatttcagcagggattaccagctggatttcttagcagtagctttgtggagaacat

SEQ ID NO: 240696 - DNA, 75 bp, Artificial Sequence
  Synthetic
catatggtggcagttattcatgccctggacaaaacactgaagaaatgattttttacaaagtggaagtggttgatc

SEQ ID NO: 240697 - DNA, 75 bp, Artificial Sequence
  Synthetic
ctagacactctgaggatcctgagtctccagcagcaggaggatcaagaagagaatccgagagccggcctggaccct

SEQ ID NO: 240698 - DNA, 75 bp, Artificial Sequence
  Synthetic
ttttacaaagtggaagtggttgatcccactactccacctccacccgccacaactactcacaccacacacacagaa

SEQ ID NO: 240699 - DNA, 75 bp, Artificial Sequence
  Synthetic
aactactcacaccacacacacagaacaaagcacagcagaggcagcaaagttagccttgcaggtccaagacagttc

SEQ ID NO: 240700 - DNA, 75 bp, Artificial Sequence
  Synthetic
tagccttgcaggtccaagacagttcatttgttggcattacccctacacctgatcagcggtgtccggggctgctcg

SEQ ID NO: 240701 - DNA, 75 bp, Artificial Sequence
  Synthetic
gatcagcggtgtccggggctgctcgtcagcggcattgtcggtgtgctttcgggattagcagtcataatcatctgc

SEQ ID NO: 240702 - DNA, 75 bp, Artificial Sequence
  Synthetic
tagaacaagtcaagacttgttggttggagcctgaggatgattgggaggtagccatcaggaattatgccaagctgg

SEQ ID NO: 240703 - DNA, 75 bp, Artificial Sequence
  Synthetic
gattactaagctgataaatatcagaaatgcctgctacatctcagggaatggggctgaagtggagatctgtctcca

SEQ ID NO: 240704 - DNA, 75 bp, Artificial Sequence
  Synthetic
aatgcctgctacatctcagggaatggggctgaagtggagatctgtctccaggatagagtggctttcagatgctgc

SEQ ID NO: 240705 - DNA, 75 bp, Artificial Sequence
  Synthetic
ggatagagtggctttcagatgctgcatgatgaatatgtacccgggagtggtggacatggatggggtcacctttat

SEQ ID NO: 240706 - DNA, 75 bp, Artificial Sequence
  Synthetic
atgatgaatatgtacccgggagtggtggacatggatggggtcacctttatgaacatgaggttcaggggagatggg

SEQ ID NO: 240707 - DNA, 75 bp, Artificial Sequence
  Synthetic
ataccaagctgacagtgcatggatgctccttctttgggtttaataacacctgcatcgaggcttggggtcaggtcg

SEQ ID NO: 240708 - DNA, 75 bp, Artificial Sequence
  Synthetic
aatgcttgtttgagaggtgccacctgggggtgatgagcgagggcgaagccagaatccgccactgtgcctctaccg

SEQ ID NO: 240709 - DNA, 75 bp, Artificial Sequence
  Synthetic
gggggtgatgagcgagggcgaagccagaatccgccactgtgcctctaccgagacgggctgttttgtgctgtgcaa

SEQ ID NO: 240710 - DNA, 75 bp, Artificial Sequence
  Synthetic
gcaagccctggcctgagttcgagcacaatgtcatgaccaggtgcaatatgcatctgggggctcgccgaggcatgt

SEQ ID NO: 240711 - DNA, 75 bp, Artificial Sequence
  Synthetic
ttatgtaaaggtgctcctggagcccgatgtcatgtccagagtgagcctgacgggggtgtttgacatgaatgtgga

SEQ ID NO: 240712 - DNA, 75 bp, Artificial Sequence
  Synthetic
atctttatttgatttttcgcgcacggtaggccctggaccaccggcctcgatcattgagcacccggtggatctttt

SEQ ID NO: 240713 - DNA, 75 bp, Artificial Sequence
  Synthetic
ccgtcccgggggtgaaggtagctccattgcagggcctcgtgctcgggggtggtgttgtaaatcacccagtcatag

SEQ ID NO: 240714 - DNA, 75 bp, Artificial Sequence
  Synthetic
gcctgggattcatgttgtgcaggaccaccagcacggtgtatccggtgcacttggggaatttgtcatgcaacttgg

SEQ ID NO: 240715 - DNA, 75 bp, Artificial Sequence
  Synthetic
aaaaataatcatttgatttgaaataaagatacaatcatattgatgatttgagtttaacaaaaataaagaatcact

SEQ ID NO: 240716 - DNA, 75 bp, Artificial Sequence
  Synthetic
cgataaagaaaacggtttccggggcgggggagatgagctgggcggaaagcaggttgcggagtagctgggacttac

SEQ ID NO: 240717 - DNA, 75 bp, Artificial Sequence
  Synthetic
cccaatgaccggctgcaggtggtagttgagggagacacagctgccgtcctccctaagaaggggggccacctcgtt

SEQ ID NO: 240718 - DNA, 75 bp, Artificial Sequence
  Synthetic
ttgagggagacacagctgccgtcctccctaagaaggggggccacctcgttcatcatttggcgcacgtgcatgttc

SEQ ID NO: 240719 - DNA, 75 bp, Artificial Sequence
  Synthetic
actcatctccaacacggccgccaaggccgctgcccctctcagtttttccaacaacaccatttcccttaacatgga

SEQ ID NO: 240720 - DNA, 75 bp, Artificial Sequence
  Synthetic
gccgctgcccctctcagtttttccaacaacaccatttcccttaacatggatcaccccttttacactaaagatgga

SEQ ID NO: 240721 - DNA, 75 bp, Artificial Sequence
  Synthetic
gaaatcaccctcaagctgggagagggggtggacctcgactcctcgggaaaactcatctccaacacggccgccaag

SEQ ID NO: 240722 - DNA, 75 bp, Artificial Sequence
  Synthetic
gctctccgcccagcgagaggagctcctggagcgaggcgaagtttttcagcggcttgagcccgtcggccatgggca

SEQ ID NO: 240723 - DNA, 75 bp, Artificial Sequence
  Synthetic
cattaaatatactgagaacaagcattctaaacacactagctttaggttttggatcaggtttaggactccgtggct

SEQ ID NO: 240724 - DNA, 75 bp, Artificial Sequence
  Synthetic
tctaaacacactagctttaggttttggatcaggtttaggactccgtggctctgccttggcagtacagttagtctc

SEQ ID NO: 240725 - DNA, 75 bp, Artificial Sequence
  Synthetic
aacataaagcttaccttagacagaggtttgcatgttacaacaggagatgcaattgaaagcaacataagctgggct

SEQ ID NO: 240726 - DNA, 75 bp, Artificial Sequence
  Synthetic
gggcgactgcgggagtagggcgccagacgatgggcgtccagcgcggccagggtccggtccttccagggtcgcagc

SEQ ID NO: 240727 - DNA, 75 bp, Artificial Sequence
  Synthetic
gtttgcatgttacaacaggagatgcaattgaaagcaacataagctgggctaaaggtttaaaatttgaagatggag

SEQ ID NO: 240728 - DNA, 75 bp, Artificial Sequence
  Synthetic
cggtaaaggggtgcgcgccgggctgggcgcttgcgagggtgcgcttcaggctcatccggctggtcgagaaccgct

SEQ ID NO: 240729 - DNA, 75 bp, Artificial Sequence
  Synthetic
gttagagtttggaagcagtagtacagaaacaggtgtcgatgatgcttacccaatccaagttaaacttggatctgg

SEQ ID NO: 240730 - DNA, 75 bp, Artificial Sequence
  Synthetic
gaaacaggtgtcgatgatgcttacccaatccaagttaaacttggatctggccttagctttgacagtacaggagcc

SEQ ID NO: 240731 - DNA, 75 bp, Artificial Sequence
  Synthetic
caggtagcaattgaccatgagttcgtagttgagcgcctcggccgcgtggcctttggcgcggagcttacctttgga

SEQ ID NO: 240732 - DNA, 75 bp, Artificial Sequence
  Synthetic
ataaactcactttgtggacaacacctgatccatcaccaaactgtcaaatactcgcagaaaatgatgcaaaactaa

SEQ ID NO: 240733 - DNA, 75 bp, Artificial Sequence
  Synthetic
tgatccatcaccaaactgtcaaatactcgcagaaaatgatgcaaaactaacactttgcttgactaaatgtggtag

SEQ ID NO: 240734 - DNA, 75 bp, Artificial Sequence
  Synthetic
agggacttgagggcgtagagcttgggggcgaggaagacggactcgggggcgtaggcgtccgcgccgcagtgggcg

SEQ ID NO: 240735 - DNA, 75 bp, Artificial Sequence
  Synthetic
ttagttgtaggaagtggaaacctaaaccccattactggcaccgtaagcagtgctcaggtgtttctacgttttgat

SEQ ID NO: 240736 - DNA, 75 bp, Artificial Sequence
  Synthetic
accccattactggcaccgtaagcagtgctcaggtgtttctacgttttgatgcaaacggtgttcttttaacagaac

SEQ ID NO: 240737 - DNA, 75 bp, Artificial Sequence
  Synthetic
gtataggcagggagatagcatagatggcactccatatgccaatgctgtaggattcatgcccaatttaaaagctta

SEQ ID NO: 240738 - DNA, 75 bp, Artificial Sequence
  Synthetic
ggcactccatatgccaatgctgtaggattcatgcccaatttaaaagcttatccaaagtcacaaagttctactact

SEQ ID NO: 240739 - DNA, 75 bp, Artificial Sequence
  Synthetic
gtagaggaaacccgaccactctgagacgaaggcccgggtccaagccagcacgaaggaggccacgtgggagggata

SEQ ID NO: 240740 - DNA, 75 bp, Artificial Sequence
  Synthetic
acatgaatggagatgtttcaaaacctatgcttctcactataaccctcaatggtactgatgacagcaacagtacat

SEQ ID NO: 240741 - DNA, 75 bp, Artificial Sequence
  Synthetic
tgtccccctcgtccacatccaggaaggtgattggcttgtaagtgtaggccacgtgaccgggggtcccggccgggg

SEQ ID NO: 240742 - DNA, 75 bp, Artificial Sequence
  Synthetic
acatttggagctaactcttataccttctcctacatcgcccaagaatgaatactgtatcccaccctgcatgcccaa

SEQ ID NO: 240743 - DNA, 75 bp, Artificial Sequence
  Synthetic
aaaactctgaaacacaaaataaaataaagttcaagtgttttattgattcaacagttttacaggattcgagcagtt

SEQ ID NO: 240744 - DNA, 75 bp, Artificial Sequence
  Synthetic
aaagttcaagtgttttattgattcaacagttttacaggattcgagcagttatttttcctccaccctcccaggaca

SEQ ID NO: 240745 - DNA, 75 bp, Artificial Sequence
  Synthetic
tggaatacaccaccctctccccccgcacagccttgaacatctgaatgccattggtgatggacatgcttttggtct

SEQ ID NO: 240746 - DNA, 75 bp, Artificial Sequence
  Synthetic
ccttgtcggcgcgctccttggcggcgatgttgagctgcacgtactcgcgcgccacgcacttccattcggggaaga

SEQ ID NO: 240747 - DNA, 75 bp, Artificial Sequence
  Synthetic
tctgacctgccagccccggttatgcagggtgatgaggtcaacgctggtggccacctcgccgcgcaggggctcgtt

SEQ ID NO: 240748 - DNA, 75 bp, Artificial Sequence
  Synthetic
ccacctcgccgcgcaggggctcgttggtccagcagaggcggccgcccttgcgcgagcagaaggggggcagggggt

SEQ ID NO: 240749 - DNA, 75 bp, Artificial Sequence
  Synthetic
ggtccagcagaggcggccgcccttgcgcgagcagaaggggggcagggggtccagcataagctcgtcgggggggtc

SEQ ID NO: 240750 - DNA, 75 bp, Artificial Sequence
  Synthetic
gcggcccccgcggatgctggcgcgcacgtagtcatacaactcgtgcgagggggcgaggagcccggctccgagatt

SEQ ID NO: 240751 - DNA, 75 bp, Artificial Sequence
  Synthetic
ttggaagatgttgaagtgggcgtggggcaggccgaccgagtcgcggatgaagtgggcgtaggagtcttgcagctt

SEQ ID NO: 240752 - DNA, 75 bp, Artificial Sequence
  Synthetic
tctcttggatgatgtcatacttgagctggcccttttgtttccacagctcgcggttgagaaggaactcttcgcggt

SEQ ID NO: 240753 - DNA, 75 bp, Artificial Sequence
  Synthetic
ctttaggaactggtgcttgaagtcgatatcgtcgcagcccccctgctcccagagctggaagtccgtgcgcttctt

SEQ ID NO: 240754 - DNA, 75 bp, Artificial Sequence
  Synthetic
agagctggaagtccgtgcgcttcttgtaggcggggttgggcaaagcgaaagtaacatcgttgaagaggatcttgc

SEQ ID NO: 240755 - DNA, 75 bp, Artificial Sequence
  Synthetic
tccacgaaccgcgggcggcccttgacgtggggcagtttcttgagctcctcgtaggtgagctcgtcggggtcgctg

SEQ ID NO: 240756 - DNA, 75 bp, Artificial Sequence
  Synthetic
cggcgagatgggggttggcgcggaggaaggaagtccagagatccacggccagggcggtttgcagacgatcccggt

SEQ ID NO: 240757 - DNA, 75 bp, Artificial Sequence
  Synthetic
tcgtccccggagagtttcatgaccagcatgaaggggacgagctgcttgccgaaggaccccatccaggtgtaggtt

SEQ ID NO: 240758 - DNA, 75 bp, Artificial Sequence
  Synthetic
gcatgaaggggacgagctgcttgccgaaggaccccatccaggtgtaggtttccacatcgtaggtgaggaagagcc

SEQ ID NO: 240759 - DNA, 75 bp, Artificial Sequence
  Synthetic
ggggaagaactggatctcctgccaccagttggaggaatggctgttgatgtgatggaagtagaaatgccgacggcg

SEQ ID NO: 240760 - DNA, 75 bp, Artificial Sequence
  Synthetic
aaaatctctgccgcgatccctgagctcctccctcagcaataactgtaagtactctttcatatcctctccgaaatt

SEQ ID NO: 240761 - DNA, 75 bp, Artificial Sequence
  Synthetic
cagttggaggaatggctgttgatgtgatggaagtagaaatgccgacggcgcgccgaacattcgtgcttgtgttta

SEQ ID NO: 240762 - DNA, 75 bp, Artificial Sequence
  Synthetic
gcctgcatgaaagtctttgttgtctgctgtgtactgagtataataaaagctgagatcagcgactactccggactc

SEQ ID NO: 240763 - DNA, 75 bp, Artificial Sequence
  Synthetic
gctgcacgggatgcacgtgctgcacgagctgtacctgggttcctttgacgaggaatttcagtgggaagtggagtc

SEQ ID NO: 240764 - DNA, 75 bp, Artificial Sequence
  Synthetic
ctgcggagtcaggtcagtgggcagcggcggcgcgcggttgacttgcaggagtttttcaagggcgcgcgggaggtc

SEQ ID NO: 240765 - DNA, 75 bp, Artificial Sequence
  Synthetic
cggtggccggcgtgaatgattcgagaagaagcatacacccccggaacattggagtccgtgagtgaaaaaaagcgg

SEQ ID NO: 240766 - DNA, 75 bp, Artificial Sequence
  Synthetic
gcgggcggaagcggtttggcttccatggttaaaagcggcggcgaggacgcgcgccgggcggtaggggcggctcgg

SEQ ID NO: 240767 - DNA, 75 bp, Artificial Sequence
  Synthetic
ttttcaggtgcgtaaaaaatgtaattactcccctcctgcacaggcagcgaagctcccgatccctccagatacaca

SEQ ID NO: 240768 - DNA, 75 bp, Artificial Sequence
  Synthetic
ttctggtactgcgcccggagaagactggcgtgagcgacgacgcgacggttgacgtcctggatctgacgcctctgg

SEQ ID NO: 240769 - DNA, 75 bp, Artificial Sequence
  Synthetic
tggcgtgagcgacgacgcgacggttgacgtcctggatctgacgcctctgggtgaaggccacgggacccgtgagtt

SEQ ID NO: 240770 - DNA, 75 bp, Artificial Sequence
  Synthetic
accgagcggcagcagcagcggcacacaacaggcgcaagagtcagagaaaagactgagctctaacctgtccgcccg

SEQ ID NO: 240771 - DNA, 75 bp, Artificial Sequence
  Synthetic
cgcccgagttgtcctggtaggcaatctcggtcatgaactgctcgatctcctcctcctgaaggtctccgcggccgg

SEQ ID NO: 240772 - DNA, 75 bp, Artificial Sequence
  Synthetic
ctcggtcatgaactgctcgatctcctcctcctgaaggtctccgcggccggcgcgctccacggtggccgcgaggtc

SEQ ID NO: 240773 - DNA, 75 bp, Artificial Sequence
  Synthetic
gagaaggcgttcatgcccgcctcgttccagacgcggctgtaaaccacggcgccctcgggatcgcgggcgcgcatg

SEQ ID NO: 240774 - DNA, 75 bp, Artificial Sequence
  Synthetic
cgtcatcaaaacacgactttcaaattccgtcgaccgttaaaaacgtcacccgccccgcccctaacggtcgccgct

SEQ ID NO: 240775 - DNA, 75 bp, Artificial Sequence
  Synthetic
accacctgggcgaggttgagctccacgtggcgcgcaaaaaccgcgtagttgcagaggcgctggtagaggtagttg

SEQ ID NO: 240776 - DNA, 75 bp, Artificial Sequence
  Synthetic
catcatcaataatataccttatttttttgtgtgagttaatatgtaaataaggcgtgtaaatttggggatggggcg

SEQ ID NO: 240777 - DNA, 75 bp, Artificial Sequence
  Synthetic
ctaacatctcttctacttcctcctcaggcggtggtggcgggggagggggcctgcgtcgccggcggcgcacgggca

SEQ ID NO: 240778 - DNA, 75 bp, Artificial Sequence
  Synthetic
agcacggtttcttctggcggcggtggggtgtgggcgggggcgatgctgctggtgatgaagttgaaataggcggtt

SEQ ID NO: 240779 - DNA, 75 bp, Artificial Sequence
  Synthetic
gcaccaggtctttgggcccggcttgctggatgcgcagacggtcggccatgccccaggcgtggtcctgacacctgg

SEQ ID NO: 240780 - DNA, 75 bp, Artificial Sequence
  Synthetic
ctggatgcgcagacggtcggccatgccccaggcgtggtcctgacacctggccaggtccttgtagtagtcctgcat

SEQ ID NO: 240781 - DNA, 75 bp, Artificial Sequence
  Synthetic
aaatatcaccttaatgggtggaaaaatatctgcaattggagtgtaacagtttatacatgcgagggagttaatctt

SEQ ID NO: 240782 - DNA, 75 bp, Artificial Sequence
  Synthetic
gtcagcggctcgactccgtggcctggaggctaagcgaacgggttgggctgcgcgtgtaccccggttcgaatctcg

SEQ ID NO: 240783 - DNA, 75 bp, Artificial Sequence
  Synthetic
tggtactggcactcccgtctcgacccaggcctgcacaaaacctccaggatacggaggcgggtcgttttgcaaatt

SEQ ID NO: 240784 - DNA, 75 bp, Artificial Sequence
  Synthetic
gctcactgccgtagattggagaagaatcgccagggttgcgttgcggtgtgccccggttcgagaccgctcgggtcg

SEQ ID NO: 240785 - DNA, 75 bp, Artificial Sequence
  Synthetic
gtggctgccccgtcgtttccaagaccccataagccagccgacttctccagttacggagcgagcccctcttttgtt

SEQ ID NO: 240786 - DNA, 75 bp, Artificial Sequence
  Synthetic
actaccgccgcggccgccgtgagcggggccgggcagagtcagtatgacctggctttggaagagggcgaggggctg

SEQ ID NO: 240787 - DNA, 75 bp, Artificial Sequence
  Synthetic
ggctttggaagagggcgaggggctggcgcgcctgggggcgtcgtcgccggagcggcacccgcgcgtgcagatgaa

SEQ ID NO: 240788 - DNA, 75 bp, Artificial Sequence
  Synthetic
gaaagagggtgctgagggacgaggatttcgaggcggacgagctgacggggatcagccctgcgcgcgcgcacgtgg

SEQ ID NO: 240789 - DNA, 75 bp, Artificial Sequence
  Synthetic
tttcgaggcggacgagctgacggggatcagccctgcgcgcgcgcacgtggccgcggccaacctggtcacggcgta

SEQ ID NO: 240790 - DNA, 75 bp, Artificial Sequence
  Synthetic
aacttccaaaaatccttcaacaaccacgtgcgcaccctgatcgcgcgcgaggaggtgaccctgggcctgatgcac

SEQ ID NO: 240791 - DNA, 75 bp, Artificial Sequence
  Synthetic
gacctggtgaatattctgcagagcatcgtggtgcaggagcgcgggctgccgctgtccgagaagctggcggccatc

SEQ ID NO: 240792 - DNA, 75 bp, Artificial Sequence
  Synthetic
tcgtggtgcaggagcgcgggctgccgctgtccgagaagctggcggccatcaacttttcggtgctgagtttgggca

SEQ ID NO: 240793 - DNA, 75 bp, Artificial Sequence
  Synthetic
gaccccgtacgtgcccatagacaaggaggtgaagatcgacgggttttacatgcgcatgaccctgaaagtgctgac

SEQ ID NO: 240794 - DNA, 75 bp, Artificial Sequence
  Synthetic
ccaactggatgggggtagtgggcaggaccaagagtatgctgtctgtgaagaaatgcttgtttgagaggtgccacc

SEQ ID NO: 240795 - DNA, 75 bp, Artificial Sequence
  Synthetic
ctgcagcgggccctgaccggggccgggaccgagggggagagctactttgacatgggcgcggacctgcactggcag

SEQ ID NO: 240796 - DNA, 75 bp, Artificial Sequence
  Synthetic
acaatgtcatgaccaggtgcaatatgcatctgggggctcgccgaggcatgttcatgccctaccagtgcaacctga

SEQ ID NO: 240797 - DNA, 75 bp, Artificial Sequence
  Synthetic
cctcctgatcccgcaatgcgggcggcgctgcagagccagccgtccggcattaactcctcggacgattggacccag

SEQ ID NO: 240798 - DNA, 75 bp, Artificial Sequence
  Synthetic
cgctgcagagccagccgtccggcattaactcctcggacgattggacccaggccatgcaacgcatcatggcgctga

SEQ ID NO: 240799 - DNA, 75 bp, Artificial Sequence
  Synthetic
cgacccgcaaccccgaagcctttagacagcagccccaggccaaccggctctcggccatcctggaggccgtggtgc

SEQ ID NO: 240800 - DNA, 75 bp, Artificial Sequence
  Synthetic
acagcagccccaggccaaccggctctcggccatcctggaggccgtggtgccctcgcgctccaaccccacgcacga

SEQ ID NO: 240801 - DNA, 75 bp, Artificial Sequence
  Synthetic
ggtgaccgaggtgccccagagcgaggtgtaccagtcgggcccggactacttcttccagaccagtcgccagggctt

SEQ ID NO: 240802 - DNA, 75 bp, Artificial Sequence
  Synthetic
acgacccgggcaatctggaagccaccctgaacttcttgctgaccaaccggtcgcagaagatcccgccccagtacg

SEQ ID NO: 240803 - DNA, 75 bp, Artificial Sequence
  Synthetic
ctacacgggcgagtacgacatgcccgaccccaatgacgggtttctgtgggacgacgtggacagcagcgtgttctc

SEQ ID NO: 240804 - DNA, 75 bp, Artificial Sequence
  Synthetic
cccttgtggaagaaagagggcagcgaccggcgcccgtcctcggcgctgtccggccgcacgggtgctgccgcagcg

SEQ ID NO: 240805 - DNA, 75 bp, Artificial Sequence
  Synthetic
aatttggggcggagggtgcccgattgggggacgaaggtaccctcaatcccgggggcgtagtttccctcacagatc

SEQ ID NO: 240806 - DNA, 75 bp, Artificial Sequence
  Synthetic
agggggggatcatgtccacctgcggggcgataaagaaaacggtttccggggcgggggagatgagctgggcggaaa

SEQ ID NO: 240807 - DNA, 75 bp, Artificial Sequence
  Synthetic
ggggcagtgccgcccgtaaacgccgctggcacgacaggcagcggggactgatgtgggacgatgaggattccgccg

SEQ ID NO: 240808 - DNA, 75 bp, Artificial Sequence
  Synthetic
acgacagcagcgtgttggacttgggcgggagtggtggtggtaacccgttcgctcacctgcgcccccgcgtcgggc

SEQ ID NO: 240809 - DNA, 75 bp, Artificial Sequence
  Synthetic
taaatggtactcaccaaggccatggcgaccagcgtgcgttcgtttcttctctgttgtatctagtatgatgaggcg

SEQ ID NO: 240810 - DNA, 75 bp, Artificial Sequence
  Synthetic
ctgttgtatctagtatgatgaggcgtgcgtacccggagggtcctcctccctcgtacgagagcgtgatgcagcagg

SEQ ID NO: 240811 - DNA, 75 bp, Artificial Sequence
  Synthetic
ccaccgcggtacctggcgcctacggaggggcgaaacagcattcgttactcggagctggcacccttgtacgatacc

SEQ ID NO: 240812 - DNA, 75 bp, Artificial Sequence
  Synthetic
ggagctggcacccttgtacgataccacccggttgtacctggtggacaacaagtcggcggacatcgcctcgctgaa

SEQ ID NO: 240813 - DNA, 75 bp, Artificial Sequence
  Synthetic
ctgaccaccgtggtgcagaacaacgatttcacccccacggaggccagcacccagaccatcaactttgacgagcgc

SEQ ID NO: 240814 - DNA, 75 bp, Artificial Sequence
  Synthetic
agtaggggatgattatgatggtagtcaggatgagctgaaatacgagtgggtggagtttgagctgcccgaaggcaa

SEQ ID NO: 240815 - DNA, 75 bp, Artificial Sequence
  Synthetic
gctggtcatgcccggggtgtacaccaacgaggccttccaccccgacatcgtgctgttgcccggctgcggggtgga

SEQ ID NO: 240816 - DNA, 75 bp, Artificial Sequence
  Synthetic
atgctgggcatccgcaagaggcagcccttccaggagggtttccagatcatgtacgaggacctggatggaggtaac

SEQ ID NO: 240817 - DNA, 75 bp, Artificial Sequence
  Synthetic
cctatgagaaaagcaaggaggagagcgtcgccgcgtcaaccgcagccgtagccaccgcctctaccgaggtccggg

SEQ ID NO: 240818 - DNA, 75 bp, Artificial Sequence
  Synthetic
cgtcgccgcgtcaaccgcagccgtagccaccgcctctaccgaggtccggggcgataattttgctagcgccgcagc

SEQ ID NO: 240819 - DNA, 75 bp, Artificial Sequence
  Synthetic
cggtggagaaggatagcaaggataggagctacaacgtgctctcggacaagaaaaacaccgcctaccgcagctggt

SEQ ID NO: 240820 - DNA, 75 bp, Artificial Sequence
  Synthetic
cgagaagggcgtgcgctcctggacgctgctcaccacctcggacgtcacctgcggcgtggagcaagtctactggtc

SEQ ID NO: 240821 - DNA, 75 bp, Artificial Sequence
  Synthetic
ctgctcaccacctcggacgtcacctgcggcgtggagcaagtctactggtcgctgcccgacatgatgcaagacccg

SEQ ID NO: 240822 - DNA, 75 bp, Artificial Sequence
  Synthetic
gcagggtgatgaggtcaacgctggtggccacctcgccgcgcaggggctcgttggtccagcagaggcggccgccct

SEQ ID NO: 240823 - DNA, 75 bp, Artificial Sequence
  Synthetic
ttagcaactacccggtggtgggcgccgagctcatgcccgtctactccaagagcttcttcaacgagcaggccgtct

SEQ ID NO: 240824 - DNA, 75 bp, Artificial Sequence
  Synthetic
cgagctcatgcccgtctactccaagagcttcttcaacgagcaggccgtctactcgcagcagctgcgcgccttcac

SEQ ID NO: 240825 - DNA, 75 bp, Artificial Sequence
  Synthetic
gcaggaggtcggggtcgaagtagcttatgcaggtgcccagatcgtccagagaagcttgccattcgcgcacggcca

SEQ ID NO: 240826 - DNA, 75 bp, Artificial Sequence
  Synthetic
ttccctgagaaccagatcctcgtccgcccgcccgcgcccaccattaccaccgtcagtgaaaacgttcctgctctc

SEQ ID NO: 240827 - DNA, 75 bp, Artificial Sequence
  Synthetic
gcccgcccgcgcccaccattaccaccgtcagtgaaaacgttcctgctctcacagatcacgggaccctgccgctgc

SEQ ID NO: 240828 - DNA, 75 bp, Artificial Sequence
  Synthetic
cgtgaccgttactgacgccagacgccgcacctgcccctacgtctacaaggccctgggcatagtcgcgccgcgcgt

SEQ ID NO: 240829 - DNA, 75 bp, Artificial Sequence
  Synthetic
atgtccattctcatctcgcccagtaataacaccggttggggtctgcgcgcgcccagcaagatgtacggaggcgct

SEQ ID NO: 240830 - DNA, 75 bp, Artificial Sequence
  Synthetic
gcccagcaagatgtacggaggcgctcgccaacgctccacgcaacaccccgtgcgcgtgcgcgggcacttccgcgc

SEQ ID NO: 240831 - DNA, 75 bp, Artificial Sequence
  Synthetic
gccattttttcgggggtgacgcagtagaaggtgcgggggtcgccgtgccaacggtcccattttagctggagggcg

SEQ ID NO: 240832 - DNA, 75 bp, Artificial Sequence
  Synthetic
ggcgcgagccttgctgcgcagggccaggcgcacgggacgcagggccatgctcagggcggccagacgcgcggcttc

SEQ ID NO: 240833 - DNA, 75 bp, Artificial Sequence
  Synthetic
gcggcgagggaacgtgtactgggtgcgcgacgccgccaccggtgtgcgcgtgcccgtgcgcacccgcccccctcg

SEQ ID NO: 240834 - DNA, 75 bp, Artificial Sequence
  Synthetic
tgcccgtgcgcacccgcccccctcgcacttgaagatgttcacttcgcgatgttgatgtgtcccagcggcgaggag

SEQ ID NO: 240835 - DNA, 75 bp, Artificial Sequence
  Synthetic
aaggatgtccaagcgcaaattcaaggaagagatgctccaggtcatcgcgcctgagatctacggccccgcggcggc

SEQ ID NO: 240836 - DNA, 75 bp, Artificial Sequence
  Synthetic
gccccccggaggcgcgtgcagtggcgcgggcggaaagtgcgtccggtgctgagacccggcaccacggtggttttc

SEQ ID NO: 240837 - DNA, 75 bp, Artificial Sequence
  Synthetic
catccaagcgctcctacgatgaggtgtacggggacgaggatattctcgagcaggcggccgagcgcctgggcgagt

SEQ ID NO: 240838 - DNA, 75 bp, Artificial Sequence
  Synthetic
tccatcccgctggaccacggcaaccccacgccgagtcttaagcccgtgaccctgcagcaggtgctgccgagcgcg

SEQ ID NO: 240839 - DNA, 75 bp, Artificial Sequence
  Synthetic
agggcgaggatgtgtaccccaccatgcagctgatggtgcccaagcgccagaagctggaagacgtgctggagacca

SEQ ID NO: 240840 - DNA, 75 bp, Artificial Sequence
  Synthetic
gcagctgatggtgcccaagcgccagaagctggaagacgtgctggagaccatgaaggtggacccggacgtgcagcc

SEQ ID NO: 240841 - DNA, 75 bp, Artificial Sequence
  Synthetic
tcgttggagatgcggcccatgagctgcgagaaggcgttcatgcccgcctcgttccagacgcggctgtaaaccacg

SEQ ID NO: 240842 - DNA, 75 bp, Artificial Sequence
  Synthetic
ggagcccatggaaacgcagaccgaggtcgtgaagcccatcaccagcaccatggaggtgcagacggatccttggat

SEQ ID NO: 240843 - DNA, 75 bp, Artificial Sequence
  Synthetic
cgcaagtacggcgcggccagcctgctgatgcccaactacgcgctgcatccttccatcatccccacgccgggctac

SEQ ID NO: 240844 - DNA, 75 bp, Artificial Sequence
  Synthetic
cgcggcacgcgcttctaccacggctataccggctcccgccgccgcaagaccaccacccgccgccgtcgtcgccgc

SEQ ID NO: 240845 - DNA, 75 bp, Artificial Sequence
  Synthetic
gatgagctcggcgatggtggcgcgcacctcgcgctcgaaggctcccgggagttcctccacttcctcctcttcatc

SEQ ID NO: 240846 - DNA, 75 bp, Artificial Sequence
  Synthetic
ccaccggcggcggcgcgccatcagcaagcggttggggggaggcttcctgcccgcgctgatccccatcatcgccgc

SEQ ID NO: 240847 - DNA, 75 bp, Artificial Sequence
  Synthetic
atttttcgtccctggctccgcgacacggcacgcggccgtttatgggcacctggagcgacatcggcaccagccaac

SEQ ID NO: 240848 - DNA, 75 bp, Artificial Sequence
  Synthetic
agggcaggcgctgagagataagctgaaagagcagaacttccagcagaaggtagtcgatggcctcgcctcaggcat

SEQ ID NO: 240849 - DNA, 75 bp, Artificial Sequence
  Synthetic
tgaggtctcggtgatgcatgagaaatattccctagaacaagtcaagacttgttggttggagcccgaggatgattg

SEQ ID NO: 240850 - DNA, 75 bp, Artificial Sequence
  Synthetic
caacggggtggtggacctggccaatcaggccgtgcagcggcagatcaacagccgcctggacccggttccccccgc

SEQ ID NO: 240851 - DNA, 75 bp, Artificial Sequence
  Synthetic
caggccgtgcagcggcagatcaacagccgcctggacccggttccccccgccggctccgtggagatgccgcaggtg

SEQ ID NO: 240852 - DNA, 75 bp, Artificial Sequence
  Synthetic
cgacgcggaggagacgctgctgacgcacacggacgaaccgcccccgtacgaggaggcggtgaaactgggcctgcc

SEQ ID NO: 240853 - DNA, 75 bp, Artificial Sequence
  Synthetic
gctcgtggtacttgaggcgcgagtaggcgcgcgagtcgaagatgtagtcgttgcaggtgcgcaccaggtactggt

SEQ ID NO: 240854 - DNA, 75 bp, Artificial Sequence
  Synthetic
gtagtaagcccgcgaccttggacttgcctcctccgcccactccccgcccctccacagtggctaagcccctgccgc

SEQ ID NO: 240855 - DNA, 75 bp, Artificial Sequence
  Synthetic
gtctgggagtgcagagtgtgaagcgccgccgctgttattaaaaaacactgtagcgcttaacttgcttgtctgtgt

SEQ ID NO: 240856 - DNA, 75 bp, Artificial Sequence
  Synthetic
tagcgcttaacttgcttgtctgtgtatatgtgtatgtccgccgccgctgctgtccagaaggaggagtgaagagaa

SEQ ID NO: 240857 - DNA, 75 bp, Artificial Sequence
  Synthetic
gccaccccatcgatgctgccccagtgggcgtacatgcacatcgccggacaggacgcttcggagtacctgagtccg

SEQ ID NO: 240858 - DNA, 75 bp, Artificial Sequence
  Synthetic
gggcgtacatgcacatcgccggacaggacgcttcggagtacctgagtccgggtctggtgcagttcgcccgcgcca

SEQ ID NO: 240859 - DNA, 75 bp, Artificial Sequence
  Synthetic
tcgagcacaacgtcatgacccgctgcaatgtgcacctgggctcccgccgaggcatgttcatgccctaccagtgca

SEQ ID NO: 240860 - DNA, 75 bp, Artificial Sequence
  Synthetic
aagcgcggaaagcggccgaccgcaatggctcactgccgtagattggagaagaatcgccagggttgcgttgcggtg

SEQ ID NO: 240861 - DNA, 75 bp, Artificial Sequence
  Synthetic
acctactcgtacaaagtgcgctacacgctggccgtgggcgacaaccgcgtgctggacatggccagcacctacttt

SEQ ID NO: 240862 - DNA, 75 bp, Artificial Sequence
  Synthetic
tacctttggggcagctgccatgcccggtgttactgggaaaaagatagaagctgatgggctgcctattagaataga

SEQ ID NO: 240863 - DNA, 75 bp, Artificial Sequence
  Synthetic
ttcaacttctggaactgacacagtaatttatgctgataaaactttccaaccagaaccacaagttggaaatgacag

SEQ ID NO: 240864 - DNA, 75 bp, Artificial Sequence
  Synthetic
gaaaaatatggaggcagagctctaaaggacactacaaaaatgaaaccctgttatggttcattcgccaagcctacc

SEQ ID NO: 240865 - DNA, 75 bp, Artificial Sequence
  Synthetic
gctttctttgacagcaaaactattgttgctaactacgatccagatattgtaatgtacacagaaaatgttgacttg

SEQ ID NO: 240866 - DNA, 75 bp, Artificial Sequence
  Synthetic
acaaacctggaacagaggacaccagctctgaatccaatttgggtcagcaggccatgcctaacagacccaactaca

SEQ ID NO: 240867 - DNA, 75 bp, Artificial Sequence
  Synthetic
aatatgggggtgctggccggtcaggcctctcagctgaatgctgtggttgacttgcaagacagaaacactgaactg

SEQ ID NO: 240868 - DNA, 75 bp, Artificial Sequence
  Synthetic
ggtgtgggattgacagacacttaccagggtgttaaagttaaaacagatgcaggttctgaaaagtgggacaaagat

SEQ ID NO: 240869 - DNA, 75 bp, Artificial Sequence
  Synthetic
agggtgttaaagttaaaacagatgcaggttctgaaaagtgggacaaagatgacaccacagttagtaatgctaatg

SEQ ID NO: 240870 - DNA, 75 bp, Artificial Sequence
  Synthetic
catggaaatcaacatccaagccaacctgtggaggaacttcctctatgccaatgttgccctctatttgcctgataa

SEQ ID NO: 240871 - DNA, 75 bp, Artificial Sequence
  Synthetic
cgagtacctggaagactgatggcgcgaccgtatttttgctagatgcagcaacagccacctcctgatcccgcaatg

SEQ ID NO: 240872 - DNA, 75 bp, Artificial Sequence
  Synthetic
ttgcgctaccgctccatgctcctgggcaacgggcgctacgtgccattccacatccaggtgccccagaaatttttt

SEQ ID NO: 240873 - DNA, 75 bp, Artificial Sequence
  Synthetic
gccattaagagcctcctgctcctgcccgggtcctacacctacgagtggaacttccgcaaggacgtcaacatgatc

SEQ ID NO: 240874 - DNA, 75 bp, Artificial Sequence
  Synthetic
ccgggtcctacacctacgagtggaacttccgcaaggacgtcaacatgatcctgcagagttcccttggcaacgacc

SEQ ID NO: 240875 - DNA, 75 bp, Artificial Sequence
  Synthetic
gcgcggtagacgatctggcggaagatggcgtgggagttggaggagatggtgggcctttggaagatgttgaagtgg

SEQ ID NO: 240876 - DNA, 75 bp, Artificial Sequence
  Synthetic
cagcttggcgacgagctcggcggtgacgaggacgtccagggcgcagtagtcgagggtctcttggatgatgtcata

SEQ ID NO: 240877 - DNA, 75 bp, Artificial Sequence
  Synthetic
cggcaccttctacctcaaccacaccttcaagaaggtctccatcaccttcgactcttccgtcagctggcccggcaa

SEQ ID NO: 240878 - DNA, 75 bp, Artificial Sequence
  Synthetic
ttcaagaaggtctccatcaccttcgactcttccgtcagctggcccggcaacgaccggctcctgacgcccaacgag

SEQ ID NO: 240879 - DNA, 75 bp, Artificial Sequence
  Synthetic
ttcgaaatcaagcgcaccgtcgacggcgagggatacaacgtggcccagtgcaacatgaccaaggactggttcctg

SEQ ID NO: 240880 - DNA, 75 bp, Artificial Sequence
  Synthetic
gcgagggatacaacgtggcccagtgcaacatgaccaaggactggttcctggtccagatgctggcccactacaaca

SEQ ID NO: 240881 - DNA, 75 bp, Artificial Sequence
  Synthetic
cgagggctacaaggaccgcatgtactccttcttccgcaacttccagcccatgagccgccaggtggtggacgaggt

SEQ ID NO: 240882 - DNA, 75 bp, Artificial Sequence
  Synthetic
tccttcttccgcaacttccagcccatgagccgccaggtggtggacgaggttaactacaaggactaccaggccgtc

SEQ ID NO: 240883 - DNA, 75 bp, Artificial Sequence
  Synthetic
aagccaccctgaacttcttgctgaccaaccggtcgcagaagatcccgccccagtacgcgctgagcgccgaggagg

SEQ ID NO: 240884 - DNA, 75 bp, Artificial Sequence
  Synthetic
cgggcttcgttggatacctcgcgcccactatgcgccagggccagccctaccccgccaactacccctacccgctca

SEQ ID NO: 240885 - DNA, 75 bp, Artificial Sequence
  Synthetic
cacccagaaaaagttcatctgcgacagggtcatgtggcgcatccccttctccagcaacttcatgtccatgggcgc

SEQ ID NO: 240886 - DNA, 75 bp, Artificial Sequence
  Synthetic
tcagaagcggcggcgaggacgcgcgccgggcggcaggggcggctcggggcccggaggcaggggcggcaggggcac

SEQ ID NO: 240887 - DNA, 75 bp, Artificial Sequence
  Synthetic
agggtcatgtggcgcatccccttctccagcaacttcatgtccatgggcgcgctcaccgacctcggccagaacatg

SEQ ID NO: 240888 - DNA, 75 bp, Artificial Sequence
  Synthetic
tagacatgaatttcgaagtcgaccccatggatgagtccacccttctctatgttgtcttcgaagtcttcgacgtcg

SEQ ID NO: 240889 - DNA, 75 bp, Artificial Sequence
  Synthetic
accagccggggcagtgccgcccgtaaacgccgctggcacgacaggcagcggggactgatgtgggacgatgaggat

SEQ ID NO: 240890 - DNA, 75 bp, Artificial Sequence
  Synthetic
ccctggaaaagtccacccagaccgtgcagggtccgcgttcggccgcctgcgggcttttctgctgcatgttcctac

SEQ ID NO: 240891 - DNA, 75 bp, Artificial Sequence
  Synthetic
gcactctaccgcttcctcaactcccactctgcatactttcgctctcaccgcgcgcgcattgagaaggccaccgcc

SEQ ID NO: 240892 - DNA, 75 bp, Artificial Sequence
  Synthetic
cgctcgcgaggcctacgtgcccaagcagaacctgttcagagacaggagcggcgaggagcccgaggagatgcgcgc

SEQ ID NO: 240893 - DNA, 75 bp, Artificial Sequence
  Synthetic
ggtttcggcatggcccgcgggcagggacacgttgcggaactggtacttggccagccacttgaactcggggatcag

SEQ ID NO: 240894 - DNA, 75 bp, Artificial Sequence
  Synthetic
tgcccaacgtgaacgagttcatgtacagcaacaagttcaaggcgcgggtcatggtctcccgcaagacccccaacg

SEQ ID NO: 240895 - DNA, 75 bp, Artificial Sequence
  Synthetic
gtcatcttgcaggtctgccggcccatggtgggcacgcagccgggcttgtggttgcaatcgcagtgcagggggatc

SEQ ID NO: 240896 - DNA, 75 bp, Artificial Sequence
  Synthetic
tggtgggcacgcagccgggcttgtggttgcaatcgcagtgcagggggatcagcatcatctgggcctggtcggcgt

SEQ ID NO: 240897 - DNA, 75 bp, Artificial Sequence
  Synthetic
tcgtgcacgcagcagcgcgcgtcgttgttggccagctgcaccacgctgcgcccccagcggttctgggtaatcttg

SEQ ID NO: 240898 - DNA, 75 bp, Artificial Sequence
  Synthetic
tggatcatggtggtcccgtgcaggcaccgcagcttgccctcgacttcggtacagccgtgcagccacagcgcgcac

SEQ ID NO: 240899 - DNA, 75 bp, Artificial Sequence
  Synthetic
cgatctgggaatgcgcatgcacgaacccctgcaggaagcggcccatcatggtcgtcagggtcttgttactggtaa

SEQ ID NO: 240900 - DNA, 75 bp, Artificial Sequence
  Synthetic
aggtcagcggaatgccgcggtgctcctcgttgatgtacaggtggcagatgcggcgatacacctcgccctgctcgg

SEQ ID NO: 240901 - DNA, 75 bp, Artificial Sequence
  Synthetic
ctcgttgatgtacaggtggcagatgcggcgatacacctcgccctgctcgggcatcagttggaagttggattttag

SEQ ID NO: 240902 - DNA, 75 bp, Artificial Sequence
  Synthetic
aaagctccgcttgccgtccttctcggtgatccgcacgggggggtagctgaagcccacggccgccagctcctcctc

SEQ ID NO: 240903 - DNA, 75 bp, Artificial Sequence
  Synthetic
gtgatccgcacgggggggtagctgaagcccacggccgccagctcctcctcggcctctctttcgtcctcgctgtcc

SEQ ID NO: 240904 - DNA, 75 bp, Artificial Sequence
  Synthetic
ttcttcttggtccgaggccacgcggcggtaggtatgtctcttcaggggcagaggcggaggcgacgggctctcgcg

SEQ ID NO: 240905 - DNA, 75 bp, Artificial Sequence
  Synthetic
cttccgcgatcgggggtgcgctcccggcggcgctctaactgacttcctccgcggccggccattgtgttctcctag

SEQ ID NO: 240906 - DNA, 75 bp, Artificial Sequence
  Synthetic
agccatcgtcgccaacctcgccatctgcccccaccgccgacaagaagcagcagcagaatgagagcttaaccgccc

SEQ ID NO: 240907 - DNA, 75 bp, Artificial Sequence
  Synthetic
cagcccaacggcacctgcgagcccaacccacgcctcaacttctacccggtcttcgcggtgcccgaggccctggcc

SEQ ID NO: 240908 - DNA, 75 bp, Artificial Sequence
  Synthetic
acctaccacatctttttcaagaaccaaaggatccctgtctcctgtcgcgccaaccgcacccgcgccgactccctt

SEQ ID NO: 240909 - DNA, 75 bp, Artificial Sequence
  Synthetic
gggaccggcggccgtcctcggcgctgtccggtcgcgcgggtgctgccgcggcggtgcccgaggccgccagcccct

SEQ ID NO: 240910 - DNA, 75 bp, Artificial Sequence
  Synthetic
atgaggtgtacggggacgaggatattctcgagcaggcggccgagcgcctgggcgagtttgcttacggcaagcgca

SEQ ID NO: 240911 - DNA, 75 bp, Artificial Sequence
  Synthetic
caagcgcgcgtcgcccatctccaaggagatgcaagaccccgagagctccgaggagggcaagcccgtggtcagcga

SEQ ID NO: 240912 - DNA, 75 bp, Artificial Sequence
  Synthetic
gagatgcaagaccccgagagctccgaggagggcaagcccgtggtcagcgacgagcagctggcgcggtggctggga

SEQ ID NO: 240913 - DNA, 75 bp, Artificial Sequence
  Synthetic
catcaagcaggtggccccgggccttggcgtgcagaccgtggacatcaagatccccacggagcccatggaaacgca

SEQ ID NO: 240914 - DNA, 75 bp, Artificial Sequence
  Synthetic
agatctccaacgtggagctgaccaacctggtctcctacatgggcatcttgcacgagaaccgcctggggcagaacg

SEQ ID NO: 240915 - DNA, 75 bp, Artificial Sequence
  Synthetic
cctggtctcctacatgggcatcttgcacgagaaccgcctggggcagaacgtgctgcacaccaccctgcgcgggga

SEQ ID NO: 240916 - DNA, 75 bp, Artificial Sequence
  Synthetic
gccgccctggtgcggagagtgtaccgccgcggccgcgcgcctctgaccctgccgcgggcgcgctaccacccgagc

SEQ ID NO: 240917 - DNA, 75 bp, Artificial Sequence
  Synthetic
ccgagcgtctcaggctgacgctgcgcaacggtttgcccgactttatgagtcaaagcatgttgcaaaactttcgct

SEQ ID NO: 240918 - DNA, 75 bp, Artificial Sequence
  Synthetic
gggcctgctcgagtgccactgccgctgcaacctctgcacgccgcaccgctccctggcctgcaacccccagctgct

SEQ ID NO: 240919 - DNA, 75 bp, Artificial Sequence
  Synthetic
tcgccgcggcgatcggggcgatccccggcattgcttccgtggcggtgcaggcctctcagcgccactgagacacac

SEQ ID NO: 240920 - DNA, 75 bp, Artificial Sequence
  Synthetic
tgcaacctctgcacgccgcaccgctccctggcctgcaacccccagctgctgagcgagacccagatcatcggcacc

SEQ ID NO: 240921 - DNA, 75 bp, Artificial Sequence
  Synthetic
tggactctgacgctcctggtcctgtgatgtgtttttgtagacagatggaagacatcaatttttcgtccctggctc

SEQ ID NO: 240922 - DNA, 75 bp, Artificial Sequence
  Synthetic
caggttctacgaggaccaatcccagccgcccaaggccgagctgtcggcctgcgtcatcacccagggggcgatcct

SEQ ID NO: 240923 - DNA, 75 bp, Artificial Sequence
  Synthetic
ggcttcccccaggatgccccgaggaagcagcaagaagctgaaagtggagctgccgcccgtggaggatttggagga

SEQ ID NO: 240924 - DNA, 75 bp, Artificial Sequence
  Synthetic
gaggaggagatggaagactgggacagcactcaggcagaggacagcctgcaagacagtctggaagacgaggaggag

SEQ ID NO: 240925 - DNA, 75 bp, Artificial Sequence
  Synthetic
ccgccgccagaccgtcgtcctcggcggagaaagcaagcagcacggataccatctccgctccgggtcggggtcccg

SEQ ID NO: 240926 - DNA, 75 bp, Artificial Sequence
  Synthetic
ggagaaagcaagcagcacggataccatctccgctccgggtcggggtcccgctcgaccccacagtagatgggacga

SEQ ID NO: 240927 - DNA, 75 bp, Artificial Sequence
  Synthetic
gaccgggcgattcccgaaccccaccacccagaccggtaagaaggagcggcagggatacaagtcctggcgggggca

SEQ ID NO: 240928 - DNA, 75 bp, Artificial Sequence
  Synthetic
acccagaccggtaagaaggagcggcagggatacaagtcctggcgggggcacaaaaacgccatcgtctcctgcttg

SEQ ID NO: 240929 - DNA, 75 bp, Artificial Sequence
  Synthetic
tcacccggcgctacctgctctttcaccgcggggtgaacttcccccgcaacatcttgcattactaccgtcacctcc

SEQ ID NO: 240930 - DNA, 75 bp, Artificial Sequence
  Synthetic
tagaaaatccacagcggcggcggcggcaggtggactgaggatcgcggcgaacgagccggcgcagacccgggaact

SEQ ID NO: 240931 - DNA, 75 bp, Artificial Sequence
  Synthetic
ggcaggagcaggaactgaaagtcaagaaccgttctctgcgctcgctcacccgcagttgtctgtatcacaagagcg

SEQ ID NO: 240932 - DNA, 75 bp, Artificial Sequence
  Synthetic
tggggaacaagtttaggaaccccacggtggcgcctacccacgatgtgaccaccgaccgcagccagcggctgacgc

SEQ ID NO: 240933 - DNA, 75 bp, Artificial Sequence
  Synthetic
tggagctaccagccccagatgggcctggccgccggcgccgcccaggactactccacccgcatgaattggctcagc

SEQ ID NO: 240934 - DNA, 75 bp, Artificial Sequence
  Synthetic
tcaatccgcgtaattggcccgccgccctagtgtaccaggaaattccccagcccacgaccgtactacttccgcgag

SEQ ID NO: 240935 - DNA, 75 bp, Artificial Sequence
  Synthetic
cccacgaccgtactacttccgcgagacgcccaggccgaagtccagctgactaactcaggtgtccagctggcgggc

SEQ ID NO: 240936 - DNA, 75 bp, Artificial Sequence
  Synthetic
gttcattcgccaagcctaccaacaaagaaggtggtcaggctaacttaaaagattcagaacccgccgccaccactc

SEQ ID NO: 240937 - DNA, 75 bp, Artificial Sequence
  Synthetic
gaggatctgtacccgaccatgcagctgatggtgcccaagcgccagaagctggaggacgtgctggagcacatgaag

SEQ ID NO: 240938 - DNA, 75 bp, Artificial Sequence
  Synthetic
ttgaatgtcccatggtggcgcggctgacctagctcggcttcgacacctggaccactgccgccgctttcgctgctt

SEQ ID NO: 240939 - DNA, 75 bp, Artificial Sequence
  Synthetic
gacagaacccggtatttcagtatgtggaatcaggcggtggacagctatgatcctgatgtgcgcattattgaaaac

SEQ ID NO: 240940 - DNA, 75 bp, Artificial Sequence
  Synthetic
tactgcatctgcaaccaccccggcctgcatgaaagtctttgttgtctgctgtgtactgagtataataaaagctga

SEQ ID NO: 240941 - DNA, 75 bp, Artificial Sequence
  Synthetic
ctctgaccttcaccgggaacgaaacagagctccatctccagtgtaagccccacaaaaagtacctcacctggctgc

SEQ ID NO: 240942 - DNA, 75 bp, Artificial Sequence
  Synthetic
gcccaccaacaccaacacctacgagtacatgaacggccgggtggtggcgccctcgctggtggacgcctacattaa

SEQ ID NO: 240943 - DNA, 75 bp, Artificial Sequence
  Synthetic
accagggctccccaatcgccgttgttaaccactgcaacgacgacggagtcctgctgaacggccccgccaacctta

SEQ ID NO: 240944 - DNA, 75 bp, Artificial Sequence
  Synthetic
ctgctgaacggccccgccaaccttactttttccacccgcagaagcaagctactgctcttccgacccttcctacca

SEQ ID NO: 240945 - DNA, 75 bp, Artificial Sequence
  Synthetic
aagctgaaagaacagaacttccagcagaaggtggttgatggcctggcctcaggcatcaacggggtggttgacctg

SEQ ID NO: 240946 - DNA, 75 bp, Artificial Sequence
  Synthetic
tgggcagcgcggctgtagtgacggagaaggccgatccctgcttgacttttaaccccgacaaatgccagctgagtt

SEQ ID NO: 240947 - DNA, 75 bp, Artificial Sequence
  Synthetic
aaaacaagacgcggaacaatactctcgcgtccacatggcagcccggggaccccgagtggtacaccgtctctgtcc

SEQ ID NO: 240948 - DNA, 75 bp, Artificial Sequence
  Synthetic
ttctccatcgcttacagcttgtgcacggtgctaatcaccgcgatcgtgtgcctgagcattcacatgctcatcgct

SEQ ID NO: 240949 - DNA, 75 bp, Artificial Sequence
  Synthetic
ggcctaccaacacaacaactcgggcttcgttggatacctcgcgcccactatgcgccagggccagccctaccccgc

SEQ ID NO: 240950 - DNA, 75 bp, Artificial Sequence
  Synthetic
ttttcacacacctttttcagaccatggcctctgttacagccattatttattttttgggtcttctgggatttatca

SEQ ID NO: 240951 - DNA, 75 bp, Artificial Sequence
  Synthetic
tgcttatgttggttctaactgtgtactaactgggtaccagtcacaccaacgggtttcatggtactggtttgataa

SEQ ID NO: 240952 - DNA, 75 bp, Artificial Sequence
  Synthetic
ctaactgggtaccagtcacaccaacgggtttcatggtactggtttgataaaaaaaacacagcttatacactttgc

SEQ ID NO: 240953 - DNA, 75 bp, Artificial Sequence
  Synthetic
gcagtggtctttattacagctgcactaataataatatcacactacttcaagtgactaaacaatattctgggacat

SEQ ID NO: 240954 - DNA, 75 bp, Artificial Sequence
  Synthetic
acaggacacttactatagtgtcaaagtattggatccaactactcccagaactactaccaaacataccacaactaa

SEQ ID NO: 240955 - DNA, 75 bp, Artificial Sequence
  Synthetic
gtattggatccaactactcccagaactactaccaaacataccacaactaaaaagcccactatacctaaaaccact

SEQ ID NO: 240956 - DNA, 75 bp, Artificial Sequence
  Synthetic
tactgaaaacgaattggttgccctgttgcagaatggggagaataatagcagcagtcctctgcctaccacccccag

SEQ ID NO: 240957 - DNA, 75 bp, Artificial Sequence
  Synthetic
ggcattatcgctgctgtggtggtgtgtatggtcattatcatcttgtgcatgatgtactatgcctgctactacaga

SEQ ID NO: 240958 - DNA, 75 bp, Artificial Sequence
  Synthetic
gtatggtcattatcatcttgtgcatgatgtactatgcctgctactacagaaaacacagactgaacaacaagctgg

SEQ ID NO: 240959 - DNA, 75 bp, Artificial Sequence
  Synthetic
acccctactgaattttgatttttaattacaaattaattgtggttgatcccactacacctccacccaccacaacta

SEQ ID NO: 240960 - DNA, 75 bp, Artificial Sequence
  Synthetic
agaggcagtagcagagttagcaaagcagatttatgaagattcctttgttgctaatactcccacacacctcggacc

SEQ ID NO: 240961 - DNA, 75 bp, Artificial Sequence
  Synthetic
ctaatactcccacacacctcggaccgcaatgtccagggttagtagtcagcggcatcgtcggtgtgctttgtgggt

SEQ ID NO: 240962 - DNA, 75 bp, Artificial Sequence
  Synthetic
attggcattgtttttagtaatcctattcctagagttagctttattaaaccagttaatgttactgaagggagcaat

SEQ ID NO: 240963 - DNA, 75 bp, Artificial Sequence
  Synthetic
ttcctagagttagctttattaaaccagttaatgttactgaagggagcaatgtgacactggtaggtgtagagggtg

SEQ ID NO: 240964 - DNA, 75 bp, Artificial Sequence
  Synthetic
tgcaagacagaaacaccgagctgtcctaccagctcttgcttgactctttgggtgacagaacccggtatttcagta

SEQ ID NO: 240965 - DNA, 75 bp, Artificial Sequence
  Synthetic
ctaccagctcttgcttgactctttgggtgacagaacccggtatttcagtatgtggaaccaggcggtggacagtta

SEQ ID NO: 240966 - DNA, 75 bp, Artificial Sequence
  Synthetic
catgcgagggagttaatcttaccattgtcaatgcaacctcagctcaaaatggtagaattcaagggcaaagtgtta

SEQ ID NO: 240967 - DNA, 75 bp, Artificial Sequence
  Synthetic
aaccatggtgtggaggatgaattgccaaactattgcttccccttggacggctctggcactaacgccgcataccaa

SEQ ID NO: 240968 - DNA, 75 bp, Artificial Sequence
  Synthetic
ctctggcactaacgccgcataccaaggtgtgaaagtaaaagatggtcaagatggtgatgttgagagtgaatggga

SEQ ID NO: 240969 - DNA, 75 bp, Artificial Sequence
  Synthetic
gtcataccattgccaacacccagcccacctagcactactcaaaccactacatcaactcagcccaccgccaccaca

SEQ ID NO: 240970 - DNA, 75 bp, Artificial Sequence
  Synthetic
cacctagcactactcaaaccactacatcaactcagcccaccgccaccacaacagcagaggcatttttgttgctgc

SEQ ID NO: 240971 - DNA, 75 bp, Artificial Sequence
  Synthetic
cgttggccatcccgaagggggtcatcttgcaggtctgccggcccatggtgggcacgcagccgggcttgtggttgc

SEQ ID NO: 240972 - DNA, 75 bp, Artificial Sequence
  Synthetic
taccaataagcagactactaaatttttgtccactactgaaagccacaccacagctaccttgagagccttctctag

SEQ ID NO: 240973 - DNA, 75 bp, Artificial Sequence
  Synthetic
ttgtccactactgaaagccacaccacagctaccttgagagccttctctagcaccgctaatcttacctcgctttcc

SEQ ID NO: 240974 - DNA, 75 bp, Artificial Sequence
  Synthetic
cctctaccccagcttctcttcccactcccctgaagcaaaccgaaggcggtttgcaatggcagatcaccctactca

SEQ ID NO: 240975 - DNA, 75 bp, Artificial Sequence
  Synthetic
gccggagccgcttcaggtggagggaggtctaaggaatcttctcttctcttttacagtatggtgatttgaactatg

SEQ ID NO: 240976 - DNA, 75 bp, Artificial Sequence
  Synthetic
catcacctgcatctgctgctgtagcatagtctgcctgcttattaccttcttccagttcgttgactgggtctttgt

SEQ ID NO: 240977 - DNA, 75 bp, Artificial Sequence
  Synthetic
cgcagctgctcaggctcatctgataagcatgcgggctttgctacttctcatgcttctactattgctagctcccct

SEQ ID NO: 240978 - DNA, 75 bp, Artificial Sequence
  Synthetic
cccacccagtcccccaaagaggttcgaaactgtaaattccaagaaccctggaaattcctcaaatgctaccagctc

SEQ ID NO: 240979 - DNA, 75 bp, Artificial Sequence
  Synthetic
taattatcatgggaatcgtgaacatccttgcctgcaccttcttttcctttgtgatttacccccgctttgactttg

SEQ ID NO: 240980 - DNA, 75 bp, Artificial Sequence
  Synthetic
gctcccgcctgatcccgacacaccaccacagcagcagcaaaatcaggcacacgcaccaccaccacagcctaggcc

SEQ ID NO: 240981 - DNA, 75 bp, Artificial Sequence
  Synthetic
ttcctgctattagttacttcaatctaaccggtggagatgactgacccactcaacaacactgtcaacgacctcctg

SEQ ID NO: 240982 - DNA, 75 bp, Artificial Sequence
  Synthetic
gacatggacggccgcggctcggagcagcgtctcgcccaactccgcattcgccagcagcaggagagagccgtcaag

SEQ ID NO: 240983 - DNA, 75 bp, Artificial Sequence
  Synthetic
cggccattgtgttctcctagggaacaacaacaagcatggagactcagccatcgtcgccaacctcgccatctgccc

SEQ ID NO: 240984 - DNA, 75 bp, Artificial Sequence
  Synthetic
gcctctcctacgagctcctgcagcagcgccagaagttcacctgcctggtcggagtcaaccccatcgtcatcaccc

SEQ ID NO: 240985 - DNA, 75 bp, Artificial Sequence
  Synthetic
gagtgcgttcacaccctgatcaagaccctatgcggcctccgcgacctcctccccatgaactaatcaactaacccc

SEQ ID NO: 240986 - DNA, 75 bp, Artificial Sequence
  Synthetic
ccctatgcggcctccgcgacctcctccccatgaactaatcaactaaccccttaccccattacccatccagtaaaa

SEQ ID NO: 240987 - DNA, 75 bp, Artificial Sequence
  Synthetic
cctcagcgtggaggagctcagccgcgcctacgagctcaacctcttctcgccgcgcgtgccccccaagcgccagcc

SEQ ID NO: 240988 - DNA, 75 bp, Artificial Sequence
  Synthetic
ggtactgcaggccccggcgggctgcaaacttcctccacactctgaaggggatgtcaaattcctcctgtccctcaa

SEQ ID NO: 240989 - DNA, 75 bp, Artificial Sequence
  Synthetic
gtccaaaaagcgcgcgcgggtggatgatggcttcgaccccgtgtatccctacgatgcagacaacgcaccgaccgt

SEQ ID NO: 240990 - DNA, 75 bp, Artificial Sequence
  Synthetic
acgatgcagacaacgcaccgaccgtgcccttcatcaaccctcccttcgtctcttcagatggattccaagaaaagc

SEQ ID NO: 240991 - DNA, 75 bp, Artificial Sequence
  Synthetic
ccctgggggtgttgtcccttaggctggccgaccctgtcaccaccaagaatggggaaattaccctcaagctggggg

SEQ ID NO: 240992 - DNA, 75 bp, Artificial Sequence
  Synthetic
ggaaggcgacaacgcgcgtctggcggtgctcaagcgcacgatcgagctgacccatttcgcctacccggcgcttaa

SEQ ID NO: 240993 - DNA, 75 bp, Artificial Sequence
  Synthetic
aaaactcattgcaaacacagtaaacaaggccattgcccctctcagtttttccaacaacaccatttcccttaacat

SEQ ID NO: 240994 - DNA, 75 bp, Artificial Sequence
  Synthetic
ggaaaactatccttacaagtttctccaccattaagtatattaaaatcaacaattttgaatacattagctctagct

SEQ ID NO: 240995 - DNA, 75 bp, Artificial Sequence
  Synthetic
gcagcgccctggcagtacagttagcctctccacttacatttgatgataaagggaatataaagattaccctaaaca

SEQ ID NO: 240996 - DNA, 75 bp, Artificial Sequence
  Synthetic
ctctccacttacatttgatgataaagggaatataaagattaccctaaacaggggattgcatgttacaacaggaga

SEQ ID NO: 240997 - DNA, 75 bp, Artificial Sequence
  Synthetic
gctaaaggtataaaatttgaagatggtgccatagctacaaacattggtaaggggctagagttcggaaccagtagt

SEQ ID NO: 240998 - DNA, 75 bp, Artificial Sequence
  Synthetic
gtgccatagctacaaacattggtaaggggctagagttcggaaccagtagtacagaaacaggagttaataatgctt

SEQ ID NO: 240999 - DNA, 75 bp, Artificial Sequence
  Synthetic
tggtctcagctttgacagcacaggagccataatggctggcaataaagactatgataaattaactttgtggacaac

SEQ ID NO: 241000 - DNA, 75 bp, Artificial Sequence
  Synthetic
gccataatggctggcaataaagactatgataaattaactttgtggacaacgcctgacccatcaccaaactgtcaa

SEQ ID NO: 241001 - DNA, 75 bp, Artificial Sequence
  Synthetic
agagctctgcaagctcctgcagaagaacctcaaggccctgtggaccgggttcgacgagcgcaccaccgcctcgga

SEQ ID NO: 241002 - DNA, 75 bp, Artificial Sequence
  Synthetic
taacactttgcttaactaagtgtgacagtcaaatactggccactgtatcagttttggttgttagaagtggaaact

SEQ ID NO: 241003 - DNA, 75 bp, Artificial Sequence
  Synthetic
cagtcaaatactggccactgtatcagttttggttgttagaagtggaaacttaaacccaattactggcacagtaag

SEQ ID NO: 241004 - DNA, 75 bp, Artificial Sequence
  Synthetic
gatgcaaatggtgttcttttaacagaacactctacactaaaaaaatactggggctacaagcaaggagatagcata

SEQ ID NO: 241005 - DNA, 75 bp, Artificial Sequence
  Synthetic
aacactctacactaaaaaaatactggggctacaagcaaggagatagcatagatggcactccatacaccaatgctg

SEQ ID NO: 241006 - DNA, 75 bp, Artificial Sequence
  Synthetic
ttatccaaagacccaaagttctactactaaaaataatatagtgggtcaagtatacatgaatggagatgtttcaaa

SEQ ID NO: 241007 - DNA, 75 bp, Artificial Sequence
  Synthetic
actaaaaataatatagtgggtcaagtatacatgaatggagatgtttcaaaacccatgcttcttactataactctt

SEQ ID NO: 241008 - DNA, 75 bp, Artificial Sequence
  Synthetic
catactcaatgtcattttcatacacctggactaacggaagctatatcggagcaacatttggagctaactcataca

SEQ ID NO: 241009 - DNA, 75 bp, Artificial Sequence
  Synthetic
atcccaccctgcatgccaacccaccttttccctctatttataaatggaaactgaaacaaaaataaagttcaagtg

SEQ ID NO: 241010 - DNA, 75 bp, Artificial Sequence
  Synthetic
ccaagaattcttgctgaaaaagggccgcggggtctaccttgatccccagaccggtgaggagcttaaccccggctt

SEQ ID NO: 241011 - DNA, 75 bp, Artificial Sequence
  Synthetic
tatcctctccccacgcacagccttaaacatctgaatgctattggtaatggacatggttttgatctccacattcca

SEQ ID NO: 241012 - DNA, 75 bp, Artificial Sequence
  Synthetic
gggtcggtcaaggagatgaaaccctccgggcactcctgcatctgcacctcacagttcaacagctgagggctgtcc

SEQ ID NO: 241013 - DNA, 75 bp, Artificial Sequence
  Synthetic
cgggcgcagcagcggatgcggatctcactcaggtcggagcagtacgtgcagcacagcaccaccaagttgttcaac

SEQ ID NO: 241014 - DNA, 75 bp, Artificial Sequence
  Synthetic
gggtgaacttcccccgcaacatcttgcattactaccgtcacctccacagcccctactacttccaagaagaggcag

SEQ ID NO: 241015 - DNA, 75 bp, Artificial Sequence
  Synthetic
ctgatgtaaatcaggtggcgtcccctccagaacacactgcccatgtacatgatctccttgggcatgtgcaggttc

SEQ ID NO: 241016 - DNA, 75 bp, Artificial Sequence
  Synthetic
gctggttgaacatgcagccctggataattctgcggaaccagatggcaagtaccgtcccgcccgccatgcagcgca

SEQ ID NO: 241017 - DNA, 75 bp, Artificial Sequence
  Synthetic
tggatcaactgggaactaaacaagtctatgttggcacagcacaggcacacgctcatgcatgtcttcagcactctc

SEQ ID NO: 241018 - DNA, 75 bp, Artificial Sequence
  Synthetic
ctatgttggcacagcacaggcacacgctcatgcatgtcttcagcactctcaattcctcgggggtcaggaccatat

SEQ ID NO: 241019 - DNA, 75 bp, Artificial Sequence
  Synthetic
cccagggcacagggaactcttgcaggacagtgaacccggccgaacagggcaatcctcgcacggaacttacattgt

SEQ ID NO: 241020 - DNA, 75 bp, Artificial Sequence
  Synthetic
gtacggatgatggcgagataacgctaatcgtgttctggatcgtgtcatgatggagctgtttccggacattttcgt

SEQ ID NO: 241021 - DNA, 75 bp, Artificial Sequence
  Synthetic
ggcactgcacaccgctcgtcggcgacggtctcggcgcttcgagcgctcaatgttgaagttatagaacagccactc

SEQ ID NO: 241022 - DNA, 75 bp, Artificial Sequence
  Synthetic
cagggtataaagcggctggtgatccggggcagaggcacacagctcaacgacgaggtggtgagctcttcactgggt

SEQ ID NO: 241023 - DNA, 75 bp, Artificial Sequence
  Synthetic
aacaggaagaaccatgattaactttattccaaacggtctcggaacacttcaaaatgcaggtcccggaggtggcac

SEQ ID NO: 241024 - DNA, 75 bp, Artificial Sequence
  Synthetic
aaataacagccaggtcaaaggtaacacggttctcgagatgttccacggtggcttccagcaaagcctccacgcgca

SEQ ID NO: 241025 - DNA, 75 bp, Artificial Sequence
  Synthetic
tgaggtaaatccaagccagccatgataaaaagctcgcgcagagcgccctccaccggcattcttaagcacaccctc

SEQ ID NO: 241026 - DNA, 75 bp, Artificial Sequence
  Synthetic
ggaatatcaattgctctgccgcaatccctaagctcctcccttagcagtaactgtatgtactcattcatatcttct

SEQ ID NO: 241027 - DNA, 75 bp, Artificial Sequence
  Synthetic
caggaacaagagaagggcaagccacattacagataaagcgaagtcctccccagtgagcattgccaaatgtaagat

SEQ ID NO: 241028 - DNA, 75 bp, Artificial Sequence
  Synthetic
attacagataaagcgaagtcctccccagtgagcattgccaaatgtaagattgaaataagcatgctggctagaccc

SEQ ID NO: 241029 - DNA, 75 bp, Artificial Sequence
  Synthetic
tgaaataagcatgctggctagacccggtgatatcttccagataactggacagaaaatcaggcaagcaatttttaa

SEQ ID NO: 241030 - DNA, 75 bp, Artificial Sequence
  Synthetic
ggtgatatcttccagataactggacagaaaatcaggcaagcaatttttaagaaaattaacaaaagaaaagtcgtc

SEQ ID NO: 241031 - DNA, 75 bp, Artificial Sequence
  Synthetic
tggtgatctgtagaacaaaaaataaacatgcaatattaaaccatgctagcctggcgaacaggtggataaatcact

SEQ ID NO: 241032 - DNA, 75 bp, Artificial Sequence
  Synthetic
cttgaggcactacaatgcttaatcttaattccagcaaagcgaccccatgcggatgaagcacaaaattggcaggtg

SEQ ID NO: 241033 - DNA, 75 bp, Artificial Sequence
  Synthetic
tttcctacttagtggtgctttgttgctggtttaagaaatggggaagatcaccctagtgtgcggtgtgctggtggc

SEQ ID NO: 241034 - DNA, 75 bp, Artificial Sequence
  Synthetic
gagcgtccatagcttaccgagcacggcaggcgcaagagtcagagaaaaagctgagctctaacctaactgcccgct

SEQ ID NO: 241035 - DNA, 75 bp, Artificial Sequence
  Synthetic
ctcactgacgtaaaggccaaggtctaaaaatacccgccaacacgcccagaaaccggtgacacactaaaaaaatac

SEQ ID NO: 241036 - DNA, 75 bp, Artificial Sequence
  Synthetic
acgtcacctctcaacgactttcaaattccgtcgaccgttaaacacatcagttaccccgcccctaacgaacgccgc

SEQ ID NO: 241037 - DNA, 75 bp, Artificial Sequence
  Synthetic
acaacacttttatttttgagcacatgtgcaataccgccatgttcatgagcaggcagtaccatatgtggcccccac

SEQ ID NO: 241038 - DNA, 75 bp, Artificial Sequence
  Synthetic
tgtcacagccaatcagcgcgccccatccccaaattttcacgccttatttgcatattaactcacacaaaaaaaata

SEQ ID NO: 241039 - DNA, 75 bp, Artificial Sequence
  Synthetic
catcatcaataatataccttatagatggaatggtgccaatatgtaaatgaggtgatttaaaaaagtgcgcgctgt

SEQ ID NO: 241040 - DNA, 75 bp, Artificial Sequence
  Synthetic
tggaatggtgccaatatgtaaatgaggtgatttaaaaaagtgcgcgctgtgtggtgattggccgtggagtaaatg

SEQ ID NO: 241041 - DNA, 75 bp, Artificial Sequence
  Synthetic
ggtgatttaaaaaagtgcgcgctgtgtggtgattggccgtggagtaaatggctaaaaggggtggggtaatgctgg

SEQ ID NO: 241042 - DNA, 75 bp, Artificial Sequence
  Synthetic
agttatgttgcaagttattgtgttaaatgtgacgtaaaaccaggtgtggtttaaacacggaagtagacagttttc

SEQ ID NO: 241043 - DNA, 75 bp, Artificial Sequence
  Synthetic
aatgtgacgtaaaaccaggtgtggtttaaacacggaagtagacagttttcccacgcttactgacaggatatgagg

SEQ ID NO: 241044 - DNA, 75 bp, Artificial Sequence
  Synthetic
attctccattttcgcgcgaaaactgaatgaggaagtgaatgtctgagtcattttgcggttatgacagggtggagt

SEQ ID NO: 241045 - DNA, 75 bp, Artificial Sequence
  Synthetic
ttttgcggttatgacagggtggagtatttgccgagggccgagtagactttgaccgtttacgtggaggtttcgatt

SEQ ID NO: 241046 - DNA, 75 bp, Artificial Sequence
  Synthetic
cgtacggtgtcaaagttcggtgtttttacgtaggtgtcagctgattgccagggtatttaaacctgtgctgttcag

SEQ ID NO: 241047 - DNA, 75 bp, Artificial Sequence
  Synthetic
cgagaagagttttctcctccgcgccgtgagtcaaatttacactttgaaatatgaggcacctgagagacctgcccg

SEQ ID NO: 241048 - DNA, 75 bp, Artificial Sequence
  Synthetic
taccactggttctaattatacactgaaagggccaccctcaggtatgctttcgtggtattgctattttggaactga

SEQ ID NO: 241049 - DNA, 75 bp, Artificial Sequence
  Synthetic
accttcgctgcacgatttgtatgatctggaggtggatgtgcccgaggacgaccccaatgaggaggcggtaaatga

SEQ ID NO: 241050 - DNA, 75 bp, Artificial Sequence
  Synthetic
tttatttagcgatgccgcgctgctagctgccgaggaggctttaagccctagacacggcagaggtgataaaaagat

SEQ ID NO: 241051 - DNA, 75 bp, Artificial Sequence
  Synthetic
gcccggacacggctgtaagtcttgtgaatttcatcgtatgaatactggagataaagctgtgttatgtgcactttg

SEQ ID NO: 241052 - DNA, 75 bp, Artificial Sequence
  Synthetic
ctatgtttaattttttccagagccatgaaggcagttagcgctctagttttttgttctttgattggcattgttttt

SEQ ID NO: 241053 - DNA, 75 bp, Artificial Sequence
  Synthetic
actttagagggaggcagagagtagggtgactgggcaatgactggtttatttatgtatatctgttttttatatagg

SEQ ID NO: 241054 - DNA, 75 bp, Artificial Sequence
  Synthetic
acccccactacagagtccactttgttaccccctgaaattggcacgtccccacctaagaatattattagaccagtt

SEQ ID NO: 241055 - DNA, 75 bp, Artificial Sequence
  Synthetic
cagctgtggaatgtttggatgatttgcttcagggtggggatgaacctttggacttgtgtacccggaaacgcccca

SEQ ID NO: 241056 - DNA, 75 bp, Artificial Sequence
  Synthetic
gacggtcttggaagacttttacaagactaggcagctgctagagaacgcctcgaacggagtttcttacctgtggag

SEQ ID NO: 241057 - DNA, 75 bp, Artificial Sequence
  Synthetic
cgaacggagtttcttacctgtggagattttgcttcggtggcgacctagctaagctagtctataggaccaaacagg

SEQ ID NO: 241058 - DNA, 75 bp, Artificial Sequence
  Synthetic
agcccttgactttactactcctggcagaaccactgcagcagtagccttttttgcttttgttcttgacaaatggag

SEQ ID NO: 241059 - DNA, 75 bp, Artificial Sequence
  Synthetic
ttcccaggaacgccaacgccgccagcagcagcaggaggatcaagaagagaacccgagagccggcctggaccctcc

SEQ ID NO: 241060 - DNA, 75 bp, Artificial Sequence
  Synthetic
cagcagcaggaggatcaagaagagaacccgagagccggcctggaccctccggcggaggaggagtagctgacctgt

SEQ ID NO: 241061 - DNA, 75 bp, Artificial Sequence
  Synthetic
taggtctttgagtggtcgggaaaggggtattaagcgggagaggcatgatgagactaatcatagaactgaactaac

SEQ ID NO: 241062 - DNA, 75 bp, Artificial Sequence
  Synthetic
catgatgaatatgtacccgggggtggtggacatggatggggtcacctttatgaacattaggtttaggggagatgg

SEQ ID NO: 241063 - DNA, 75 bp, Artificial Sequence
  Synthetic
gtataatgggacggtctttatggccaataccaagctgacagtgcatggctgctccttctttgggtttaataacac

SEQ ID NO: 241064 - DNA, 75 bp, Artificial Sequence
  Synthetic
tatgatctgtggagcctcggacgagcgcggctaccaaatgctaacatgcgccggtgggaacagtcatatgctggc

SEQ ID NO: 241065 - DNA, 75 bp, Artificial Sequence
  Synthetic
attatgtgaaggtgctcttggagcccgatgccatgtccagagtaagcctgacgggggtgtttgacatgaatgtgg

SEQ ID NO: 241066 - DNA, 75 bp, Artificial Sequence
  Synthetic
ttgaattgatcaataaagaatcacttacttgaaatctgaaaccaggtctctgtccatgttttctgtcagcagcac

SEQ ID NO: 241067 - DNA, 75 bp, Artificial Sequence
  Synthetic
aaaataaagaatcacttacttgaaatctgataccaggtctctgtccatgttttctgccaacaccacctcactccc

SEQ ID NO: 241068 - DNA, 75 bp, Artificial Sequence
  Synthetic
agggggaggacctgcataaggggcagaatgactaaaatctgtgcttttctgtgtgttgcagcagcatgagcggaa

SEQ ID NO: 241069 - DNA, 75 bp, Artificial Sequence
  Synthetic
agcgtcgtgcgcggaatggccatgggcgccggctactatggcactctggtggccaactcaagttccactaataat

SEQ ID NO: 241070 - DNA, 75 bp, Artificial Sequence
  Synthetic
tttcccttaaaactgctgcccctttctacaacaacaatggaactttaagcctcaatgtctccacaccattagcag

SEQ ID NO: 241071 - DNA, 75 bp, Artificial Sequence
  Synthetic
tgctactgctgatggcccagcttgaggccttgagccagcgtctgggcgagctgacccaacaggtggctcagctgc

SEQ ID NO: 241072 - DNA, 75 bp, Artificial Sequence
  Synthetic
ctacaacaacaatggaactttaagcctcaatgtctccacaccattagcagtatttcccacatttaacactttagg

SEQ ID NO: 241073 - DNA, 75 bp, Artificial Sequence
  Synthetic
aggagcagacgcgggccgcggttgccacggtgaaatcaaaataaaaatcaatcaataaataaacaaacacagttg

SEQ ID NO: 241074 - DNA, 75 bp, Artificial Sequence
  Synthetic
acttcaaataagttgttgactgtacaactaactcatcctcttacattcagctcaaatagcatcacagtaaaaaca

SEQ ID NO: 241075 - DNA, 75 bp, Artificial Sequence
  Synthetic
aactaactcatcctcttacattcagctcaaatagcatcacagtaaaaacagacaaagggctatatattaactcca

SEQ ID NO: 241076 - DNA, 75 bp, Artificial Sequence
  Synthetic
tataagcctaaaaagaggactagtttttgacggtaatgctattgcaacatatattggaaatggcttagactatgg

SEQ ID NO: 241077 - DNA, 75 bp, Artificial Sequence
  Synthetic
tggatgttgaggtacatgggcatgagcccgtcccgggggtgaaggtagctccattgcagggcctcgtgctcgggg

SEQ ID NO: 241078 - DNA, 75 bp, Artificial Sequence
  Synthetic
agacccgtaattaccaaaattggagcaggattaaattttgatgctaacaaagcaatagctgtcaaactaggcaca

SEQ ID NO: 241079 - DNA, 75 bp, Artificial Sequence
  Synthetic
caggattaaattttgatgctaacaaagcaatagctgtcaaactaggcacaggtttaagttttgactccgctggtg

SEQ ID NO: 241080 - DNA, 75 bp, Artificial Sequence
  Synthetic
tgacaagctaacactttggactacccctgacccaagccctaattgtcaattactttcagacagagatgccaaatt

SEQ ID NO: 241081 - DNA, 75 bp, Artificial Sequence
  Synthetic
aggtgtttacaaacctgttgagctgggagggatgcatgcggggggaaattaaatgcattttggcctggatcttta

SEQ ID NO: 241082 - DNA, 75 bp, Artificial Sequence
  Synthetic
cctgacccaagccctaattgtcaattactttcagacagagatgccaaatttactctctgtcttacaaaatgcggt

SEQ ID NO: 241083 - DNA, 75 bp, Artificial Sequence
  Synthetic
tggcggctgttactgtaggatcagcactaaatccaattaatgacacagtcaaaagcgccatagttttccttagat

SEQ ID NO: 241084 - DNA, 75 bp, Artificial Sequence
  Synthetic
accaccagcacggtgtatccggtgcacttggggaatttgtcatgcaacttggaagggaaggcatgaaagaatttg

SEQ ID NO: 241085 - DNA, 75 bp, Artificial Sequence
  Synthetic
actaaatccaattaatgacacagtcaaaagcgccatagttttccttagatttgattccgatggtgtactcatgtc

SEQ ID NO: 241086 - DNA, 75 bp, Artificial Sequence
  Synthetic
ggcaatgggcccgtgggcagcggcttgggcgaagacgtttcggggatcggacacatcgtagttgtggtcctgggt

SEQ ID NO: 241087 - DNA, 75 bp, Artificial Sequence
  Synthetic
tggaactttagggagggacagaccactcaaagtgtagcctatacaaatgctgtgggattcatgccaaatataggt

SEQ ID NO: 241088 - DNA, 75 bp, Artificial Sequence
  Synthetic
ctcaaagtgtagcctatacaaatgctgtgggattcatgccaaatataggtgcatatccaaaaacccaaagtaaaa

SEQ ID NO: 241089 - DNA, 75 bp, Artificial Sequence
  Synthetic
aatttggggcgaagggtgcccgattgggggacaaaggtaccctcgatcccgggggcgtagtttccctcacagatc

SEQ ID NO: 241090 - DNA, 75 bp, Artificial Sequence
  Synthetic
ggtatatttaactggagaaactactatgccaatgacactaaccataactttcaatggcactgatgaaaaagacac

SEQ ID NO: 241091 - DNA, 75 bp, Artificial Sequence
  Synthetic
agggtggaatcatatccacctgcggggcgataaaaaaaacggtttccggagagggggagataagctgggcggaaa

SEQ ID NO: 241092 - DNA, 75 bp, Artificial Sequence
  Synthetic
tgctaccaactcattctctttttcctacatcgcccaggaataatcccacccagcaagccaaccccttttcccacc

SEQ ID NO: 241093 - DNA, 75 bp, Artificial Sequence
  Synthetic
accccgatgaccggctgcaggtggtagttgagggagagacagctgccgtcctcacggagaaggggcgccacctcg

SEQ ID NO: 241094 - DNA, 75 bp, Artificial Sequence
  Synthetic
tctcacgcactagttccgccaggagtcgctctccgcccagtgaaaggagctcctggagcgaggcgaagtttttta

SEQ ID NO: 241095 - DNA, 75 bp, Artificial Sequence
  Synthetic
tcgctctccgcccagtgaaaggagctcctggagcgaggcgaagttttttagcggcttaagcccgtcggccatggg

SEQ ID NO: 241096 - DNA, 75 bp, Artificial Sequence
  Synthetic
cgcagacggtttcgcactccacgagccaggtgaggtcgggctggtcggggtcaaaaaccagttttccaccgttct

SEQ ID NO: 241097 - DNA, 75 bp, Artificial Sequence
  Synthetic
gtaacaaagaggctgtccgtgtccccgtagaccgactttatgggccggtcctcgagtgggacgccgcggtcctcg

SEQ ID NO: 241098 - DNA, 75 bp, Artificial Sequence
  Synthetic
ggtcagaaaaaacaatctttttgttgtcaagtttggtggcaaaggagccgtagagggcgttggaaaggagcttgg

SEQ ID NO: 241099 - DNA, 75 bp, Artificial Sequence
  Synthetic
ccagatgatgcaattttgttgggtttcggtgacggcgggggagggaagaacaggaagaaccatgattaactttat

SEQ ID NO: 241100 - DNA, 75 bp, Artificial Sequence
  Synthetic
gcacgtagtcatacaactcgtgcgagggggcgaggagtccggctccgagattggagcggttgggtttttcggtgc

SEQ ID NO: 241101 - DNA, 75 bp, Artificial Sequence
  Synthetic
gtgggagttggaggagatggtgggtctttggaaaatgttaaagtgggcgtggggcaggccgaccgagtcgcggat

SEQ ID NO: 241102 - DNA, 75 bp, Artificial Sequence
  Synthetic
ttccaggtgcacgtttagggcctcgggaacaacgatggagtaagtgcaaggggtgcgttccagcatggttagtta

SEQ ID NO: 241103 - DNA, 75 bp, Artificial Sequence
  Synthetic
ggcggttgagaaggaactcttcgcggtccttccagtactcttcaaggggaaacccgtcctgatcggcacggtaag

SEQ ID NO: 241104 - DNA, 75 bp, Artificial Sequence
  Synthetic
tcacagccaatcagcgcgccccatccccaaatttacacgccttatttacatattaactcacacaaaaaaataagg

SEQ ID NO: 241105 - DNA, 75 bp, Artificial Sequence
  Synthetic
catcatcaataatatacctcaaacttttggtgcgcgttaatatgcaaatgagccgtttgaatttggggatggagg

SEQ ID NO: 241106 - DNA, 75 bp, Artificial Sequence
  Synthetic
ccttcttcaataatataccttcaaactttttgtgcgcgttaatatgcaaatgaggcgtttgaatttggggaggaa

SEQ ID NO: 241107 - DNA, 75 bp, Artificial Sequence
  Synthetic
ctttttgtgcgcgttaatatgcaaatgaggcgtttgaatttggggaggaagggcggtgattggtcgagggatgag

SEQ ID NO: 241108 - DNA, 75 bp, Artificial Sequence
  Synthetic
tgaggcgtttgaatttggggaggaagggcggtgattggtcgagggatgagcgaccgttaggggcggggcgagtga

SEQ ID NO: 241109 - DNA, 75 bp, Artificial Sequence
  Synthetic
ggagccagtttgcaagttctcgtgggaaaagtgacgtcaaacgaggtgtggtttgaacacggaaatactcaattt

SEQ ID NO: 241110 - DNA, 75 bp, Artificial Sequence
  Synthetic
acaagctgtacctgggttcctttgacgaggaatttcagtgggaagtggagttgtggtgcctgcatctggtgctgt

SEQ ID NO: 241111 - DNA, 75 bp, Artificial Sequence
  Synthetic
ttaccgtgtttttcacctaaatttccgcgtacggtgtcaaagtccggtgtttttacgtaggtgtcagctgatcgc

SEQ ID NO: 241112 - DNA, 75 bp, Artificial Sequence
  Synthetic
cgatgagaaaatcatcatcgcttccgggaacgagattctggaactggtggtaaatgccatgatgggcgacgaccc

SEQ ID NO: 241113 - DNA, 75 bp, Artificial Sequence
  Synthetic
atctggaggtggatgtgcccgaggacgatcccaatgaggaggcggtaaatgatttttttagcgatgccgcgctgc

SEQ ID NO: 241114 - DNA, 75 bp, Artificial Sequence
  Synthetic
tagctcagacagcgactcttcactgcatacccctagacccggcagaggtgagaaaaagatccccgagcttaaagg

SEQ ID NO: 241115 - DNA, 75 bp, Artificial Sequence
  Synthetic
gaggaatgcttgcccccgagcgatgatgaggacgagcaggcgatccagaacgcagcgagccagggagtgcaagcc

SEQ ID NO: 241116 - DNA, 75 bp, Artificial Sequence
  Synthetic
taaccacctgggcaaggttaagctccacgtggcgcgcaaagaccgcgtagttgcagaggcgctggtaaaggtagt

SEQ ID NO: 241117 - DNA, 75 bp, Artificial Sequence
  Synthetic
gattaagttgaactttagagggaggcagagagcagggtgactgggcgatgactggtttatttatgtatatatgtt

SEQ ID NO: 241118 - DNA, 75 bp, Artificial Sequence
  Synthetic
ctttatataggtcccgtctctgacgcagatgatgagacccccactacaaagtccacttcgtcacccccagaaatt

SEQ ID NO: 241119 - DNA, 75 bp, Artificial Sequence
  Synthetic
ctcgtaaaagtccacggcaaagttgaaaaactgggagttgcgtgccgagacggtcaactcctcctccagaagacg

SEQ ID NO: 241120 - DNA, 75 bp, Artificial Sequence
  Synthetic
gtccacttcgtcacccccagaaattggcacatctccacctgagaatattgttagaccagttcctgttagagccac

SEQ ID NO: 241121 - DNA, 75 bp, Artificial Sequence
  Synthetic
gatgagctcggcgatggtggcgcgcacctcgcgctcaaaggcacccgggagttcctccacttcttcctcttcatc

SEQ ID NO: 241122 - DNA, 75 bp, Artificial Sequence
  Synthetic
tcaggcggtggtggcgggggagggggcctgcgtcgccggcggcgcacgggcaaacggtcgatgaaacgctcgatg

SEQ ID NO: 241123 - DNA, 75 bp, Artificial Sequence
  Synthetic
gtctcaccgcgccggcgtcgcatggtctcggtgacggcgcgtccgtcctcgcggggccgcagcgtaaagacgccg

SEQ ID NO: 241124 - DNA, 75 bp, Artificial Sequence
  Synthetic
caataaaaaatgtgttgactttaagtgcgtggtttatgactcaggggtggggactgtgagtatataagcaggtgc

SEQ ID NO: 241125 - DNA, 75 bp, Artificial Sequence
  Synthetic
agggccaaacaggattatagtgaacaatttgaggttattttgagagagtgttctggtctttttgacgctcttaac

SEQ ID NO: 241126 - DNA, 75 bp, Artificial Sequence
  Synthetic
catggaagtgccagcgcctgaatgcaatctccggctacttgccggtacagccgctagacactctgaggatcctga

SEQ ID NO: 241127 - DNA, 75 bp, Artificial Sequence
  Synthetic
ccgctagacactctgaggatcctgaatctccaggagagtcccagggcacgccaacgtcgccagcagcagcagcag

SEQ ID NO: 241128 - DNA, 75 bp, Artificial Sequence
  Synthetic
tcgtcaaagtcgacgaagcggtggtaggctccggtgttgatggtgtaggagcagttggccatgacggaccagttg

SEQ ID NO: 241129 - DNA, 75 bp, Artificial Sequence
  Synthetic
aatgttgcgcagcggcagaaagtagttcatggtgggcacggtctggcccgtaagacgcgcgcagtcgttgatgct

SEQ ID NO: 241130 - DNA, 75 bp, Artificial Sequence
  Synthetic
ggttgccacggtgaaaaccaaataaaaaatgaatcaataaataaacggagacggttgttgattttaacacagagt

SEQ ID NO: 241131 - DNA, 75 bp, Artificial Sequence
  Synthetic
gtgaggggctgcagtttttcagccaactggatgggggtcgtgggcaggaccaagagtatgctgtccgtgaagaaa

SEQ ID NO: 241132 - DNA, 75 bp, Artificial Sequence
  Synthetic
cccccaccctccaccgcaacagcagccccctcctccgcaacagccggcgcttctgcctccgccccaacagcagca

SEQ ID NO: 241133 - DNA, 75 bp, Artificial Sequence
  Synthetic
ggctaccagatgctgacctgcgccggcgggaacagccatatgctggccaccgtacatgtggcttcccatgctcgc

SEQ ID NO: 241134 - DNA, 75 bp, Artificial Sequence
  Synthetic
atgtgaaggtgctgctggagcccgatgccatgtccagagtgagcctgacgggggtgtttgacatgaatgtggagg

SEQ ID NO: 241135 - DNA, 75 bp, Artificial Sequence
  Synthetic
gtgttgccctgcaccgggacggagttcggttccagcggggaagaatctgactagagtgagtagtgttctggggcg

SEQ ID NO: 241136 - DNA, 75 bp, Artificial Sequence
  Synthetic
gcaaaccgcttacggcgcagctattcctggtggtgcagcacagtcgggacaacgagactttcagggaggctctgc

SEQ ID NO: 241137 - DNA, 75 bp, Artificial Sequence
  Synthetic
cctggtggtgcagcacagtcgggacaacgagactttcagggaggctctgctgaatatcaccgagccagagggccg

SEQ ID NO: 241138 - DNA, 75 bp, Artificial Sequence
  Synthetic
gtgatgggatccacggtggacggccggcccgtgcagcccgcgaactcttcaaccctgacctatgcaaccctgagc

SEQ ID NO: 241139 - DNA, 75 bp, Artificial Sequence
  Synthetic
caccgcgcggtgagcgccagtaggcggcgcgagctaagcgatcaggagctaatgcacagcctgcagcgggccctc

SEQ ID NO: 241140 - DNA, 75 bp, Artificial Sequence
  Synthetic
gccagggtccggtccttccagggtcgcagcgtccgcgtcagcgtggtctccgtcacggtgaaggggtgcgcgccg

SEQ ID NO: 241141 - DNA, 75 bp, Artificial Sequence
  Synthetic
aagcctttagacagcagccccaggccaaccggctctcggccattttggaggccgtggtgccttcgcgctccaacc

SEQ ID NO: 241142 - DNA, 75 bp, Artificial Sequence
  Synthetic
gccatccgcggcgacgaggccgggctggtgtacaacgcgctgctggagcgcgtggcccgctacaacagcaccaac

SEQ ID NO: 241143 - DNA, 75 bp, Artificial Sequence
  Synthetic
tgaccgacgtgcgcgaggccgtggcccagcgcgaacggttccaccgcgagtccaacctgggatccatggtggcgc

SEQ ID NO: 241144 - DNA, 75 bp, Artificial Sequence
  Synthetic
ccagcgcgaacggttccaccgcgagtccaacctgggatccatggtggcgctaaatgccttcctcagcacgcagcc

SEQ ID NO: 241145 - DNA, 75 bp, Artificial Sequence
  Synthetic
gactacaccaactttatcagcgccctgcggctgatggtaaccgaggtaccccaaagcgaggtgtaccagtcgggc

SEQ ID NO: 241146 - DNA, 75 bp, Artificial Sequence
  Synthetic
ccaaagcgaggtgtaccagtcgggcccggactactttttccagaccagtcgccagggcttgcagaccgtaaacct

SEQ ID NO: 241147 - DNA, 75 bp, Artificial Sequence
  Synthetic
gaggaggggggccacctcgttcatcatctcgcgcacgtgcatgttctcgcgcaccagttccgccaggaggcgctc

SEQ ID NO: 241148 - DNA, 75 bp, Artificial Sequence
  Synthetic
cgcccgtttattaataagctgatggactacctgcatcgggcggccgccatgaactctgactattttaccaacgcc

SEQ ID NO: 241149 - DNA, 75 bp, Artificial Sequence
  Synthetic
gaggaagacggactcgggggcgtaggcgtccgcgccgcagtgggcgcagacggtctcgcactccacgagccaggt

SEQ ID NO: 241150 - DNA, 75 bp, Artificial Sequence
  Synthetic
cgctgaacagcgtccgcagcagcgagctgggcaggatcacgcgcccgcgcttgctgggcgaggaggagtacttaa

SEQ ID NO: 241151 - DNA, 75 bp, Artificial Sequence
  Synthetic
gaggtcgggctggtcggggtcaaaaaccagtttcccgccgttctttttgatgcgtttcttacctttggtctccat

SEQ ID NO: 241152 - DNA, 75 bp, Artificial Sequence
  Synthetic
ggagaaaaacttccccaataacggaatagagagtctggtggacaagatgaaccgctggaagacgtatgcgcagga

SEQ ID NO: 241153 - DNA, 75 bp, Artificial Sequence
  Synthetic
ggtgtgccgcggtcctcctcgtagaggaaccccgcccactccgagacgaaagcccgggtccaggccagcacgaaa

SEQ ID NO: 241154 - DNA, 75 bp, Artificial Sequence
  Synthetic
ggtgtgccgcggtcctcctcgtagaggaaccccgcccactccgagacgaaagcccgggtccaggccagcacgaat

SEQ ID NO: 241155 - DNA, 75 bp, Artificial Sequence
  Synthetic
ggtgtgccgcggtcctcctcgtagaggaaccccgcccactccgagacgaaagcccgggtccaggccagcacgaac

SEQ ID NO: 241156 - DNA, 75 bp, Artificial Sequence
  Synthetic
ggtgtgccgcggtcctcctcgtagaggaaccccgcccactccgagacgaaagcccgggtccaggccagcacgaag

SEQ ID NO: 241157 - DNA, 75 bp, Artificial Sequence
  Synthetic
cggagggtcctcctccctcgtatgaaagcgtgatgcagcaggcaatggcggcggcggcggcaatacagccaccac

SEQ ID NO: 241158 - DNA, 75 bp, Artificial Sequence
  Synthetic
cacaccaacatgcccaacgtgaaccagttcatgtacagcaacaagttcaaggcgcgggtcatggtctctcgcaag

SEQ ID NO: 241159 - DNA, 75 bp, Artificial Sequence
  Synthetic
cgccgcgcaggggctcattaatccagcagaggcgtccgcccttgcgcgagcagaaggggggcagggggtccagca

SEQ ID NO: 241160 - DNA, 75 bp, Artificial Sequence
  Synthetic
cgccgcgcaggggctcattattccagcagaggcgtccgcccttgcgcgagcagaaggggggcagggggtccagca

SEQ ID NO: 241161 - DNA, 75 bp, Artificial Sequence
  Synthetic
cgccgcgcaggggctcattactccagcagaggcgtccgcccttgcgcgagcagaaggggggcagggggtccagca

SEQ ID NO: 241162 - DNA, 75 bp, Artificial Sequence
  Synthetic
cgccgcgcaggggctcattagtccagcagaggcgtccgcccttgcgcgagcagaaggggggcagggggtccagca

SEQ ID NO: 241163 - DNA, 75 bp, Artificial Sequence
  Synthetic
gatggtgaagatgccgggcaggaggtcggggtcaaagtagctgatggaagtggccagatcgtccagggcagcttg

SEQ ID NO: 241164 - DNA, 75 bp, Artificial Sequence
  Synthetic
tcggggtcaaagtagctgatggaagtggccagatcgtccagggcagcttgccattcgcgcacggccagcgcgcgc

SEQ ID NO: 241165 - DNA, 75 bp, Artificial Sequence
  Synthetic
tggagagcgacattggcgtgaagttcgacacccgaaacttcaggctgggctgggaccccgtgaccgagctggtca

SEQ ID NO: 241166 - DNA, 75 bp, Artificial Sequence
  Synthetic
cgatgtaggtggggtagcagcgccccccgcggatgctggcgcgcacgtagtcatacagctcgtgcgagggggcga

SEQ ID NO: 241167 - DNA, 75 bp, Artificial Sequence
  Synthetic
tgccaggggtgtacaccaacgaggcatttcaccccgacattgtgctgctgcccggctgcggggtggactttaccg

SEQ ID NO: 241168 - DNA, 75 bp, Artificial Sequence
  Synthetic
actgggcttttcggcgcggtagacgatctggcggaaaatggcatgcgagttggaggagatggtgggcctttggaa

SEQ ID NO: 241169 - DNA, 75 bp, Artificial Sequence
  Synthetic
cggcaaccacagccgtagccaccgcctctaccgaggtccgggacgataattttgctagcgccgcagcagtggcgg

SEQ ID NO: 241170 - DNA, 75 bp, Artificial Sequence
  Synthetic
taagatagtcattcagccggtggagaaggatagcaaggagaggagctacaacgtgctctcggacaagaaaaacac

SEQ ID NO: 241171 - DNA, 75 bp, Artificial Sequence
  Synthetic
tcgcagcccccctgctcccagagctggaagtccgtgcgcttcttgtaggcggggttgggcaaagcgaaagtaaca

SEQ ID NO: 241172 - DNA, 75 bp, Artificial Sequence
  Synthetic
tcgacagaatcaatctcggtatcgttgacggcggcctgccgcaggatctcttgcacgtcgcccgagttgtcctgg

SEQ ID NO: 241173 - DNA, 75 bp, Artificial Sequence
  Synthetic
tgctgctcgagcgcccagtcggcgagatgggggttggcgcggaggaaggaagtccagagatccacggccagggcg

SEQ ID NO: 241174 - DNA, 75 bp, Artificial Sequence
  Synthetic
gcgcggttgacttgcaagagtttttccagggcgcgcgggaggtccaaatggtacttgatctccaccgcgccattg

SEQ ID NO: 241175 - DNA, 75 bp, Artificial Sequence
  Synthetic
gcgcggttgacttgcaagagtttttccagggcgcgcgggaggtccatatggtacttgatctccaccgcgccattg

SEQ ID NO: 241176 - DNA, 75 bp, Artificial Sequence
  Synthetic
gcgcggttgacttgcaagagtttttccagggcgcgcgggaggtccacatggtacttgatctccaccgcgccattg

SEQ ID NO: 241177 - DNA, 75 bp, Artificial Sequence
  Synthetic
gcgcggttgacttgcaagagtttttccagggcgcgcgggaggtccagatggtacttgatctccaccgcgccattg

SEQ ID NO: 241178 - DNA, 75 bp, Artificial Sequence
  Synthetic
gcgcggttgacttgcatgagtttttccagggcgcgcgggaggtccaaatggtacttgatctccaccgcgccattg

SEQ ID NO: 241179 - DNA, 75 bp, Artificial Sequence
  Synthetic
gcgcggttgacttgcatgagtttttccagggcgcgcgggaggtccatatggtacttgatctccaccgcgccattg

SEQ ID NO: 241180 - DNA, 75 bp, Artificial Sequence
  Synthetic
gcgcggttgacttgcatgagtttttccagggcgcgcgggaggtccacatggtacttgatctccaccgcgccattg

SEQ ID NO: 241181 - DNA, 75 bp, Artificial Sequence
  Synthetic
gcgcggttgacttgcatgagtttttccagggcgcgcgggaggtccagatggtacttgatctccaccgcgccattg

SEQ ID NO: 241182 - DNA, 75 bp, Artificial Sequence
  Synthetic
gcgcggttgacttgcacgagtttttccagggcgcgcgggaggtccaaatggtacttgatctccaccgcgccattg

SEQ ID NO: 241183 - DNA, 75 bp, Artificial Sequence
  Synthetic
gcgcggttgacttgcacgagtttttccagggcgcgcgggaggtccatatggtacttgatctccaccgcgccattg

SEQ ID NO: 241184 - DNA, 75 bp, Artificial Sequence
  Synthetic
gcgcggttgacttgcacgagtttttccagggcgcgcgggaggtccacatggtacttgatctccaccgcgccattg

SEQ ID NO: 241185 - DNA, 75 bp, Artificial Sequence
  Synthetic
gcgcggttgacttgcacgagtttttccagggcgcgcgggaggtccagatggtacttgatctccaccgcgccattg

SEQ ID NO: 241186 - DNA, 75 bp, Artificial Sequence
  Synthetic
gcgcggttgacttgcaggagtttttccagggcgcgcgggaggtccaaatggtacttgatctccaccgcgccattg

SEQ ID NO: 241187 - DNA, 75 bp, Artificial Sequence
  Synthetic
gcgcggttgacttgcaggagtttttccagggcgcgcgggaggtccatatggtacttgatctccaccgcgccattg

SEQ ID NO: 241188 - DNA, 75 bp, Artificial Sequence
  Synthetic
gcgcggttgacttgcaggagtttttccagggcgcgcgggaggtccacatggtacttgatctccaccgcgccattg

SEQ ID NO: 241189 - DNA, 75 bp, Artificial Sequence
  Synthetic
gcgcggttgacttgcaggagtttttccagggcgcgcgggaggtccagatggtacttgatctccaccgcgccattg

SEQ ID NO: 241190 - DNA, 75 bp, Artificial Sequence
  Synthetic
tcccgtgcccctggggtgtgaccaccgtcccccgtttcttcttgggcggctggggcgacgggggcggtgcctctt

SEQ ID NO: 241191 - DNA, 75 bp, Artificial Sequence
  Synthetic
tggggcgacgggggcggtgcctcttccatggttagaaacggcggcgaagacgcgcgccgggcggcaggggcggct

SEQ ID NO: 241192 - DNA, 75 bp, Artificial Sequence
  Synthetic
tggggcgacgggggcggtgcctcttccatggttagaatcggcggcgaagacgcgcgccgggcggcaggggcggct

SEQ ID NO: 241193 - DNA, 75 bp, Artificial Sequence
  Synthetic
tggggcgacgggggcggtgcctcttccatggttagaaccggcggcgaagacgcgcgccgggcggcaggggcggct

SEQ ID NO: 241194 - DNA, 75 bp, Artificial Sequence
  Synthetic
tggggcgacgggggcggtgcctcttccatggttagaagcggcggcgaagacgcgcgccgggcggcaggggcggct

SEQ ID NO: 241195 - DNA, 75 bp, Artificial Sequence
  Synthetic
gctggaccacggcaaccccacgccaagtctcaagcccgtgaccctgcagcaggtgttgccgaacgcggcgccgcg

SEQ ID NO: 241196 - DNA, 75 bp, Artificial Sequence
  Synthetic
cgggaactcgcggacgcggttccagatgttgcgcagcggcaggaagtagttcatggtgggcacggtctggcccgt

SEQ ID NO: 241197 - DNA, 75 bp, Artificial Sequence
  Synthetic
tccccacgccgggctaccgcggcacacgcttctaccacggctataccagctcccggcgccgcaagaccaccaccc

SEQ ID NO: 241198 - DNA, 75 bp, Artificial Sequence
  Synthetic
acggtcaactcctcctccagaagacggatgagctcggcgatggtggcgcgcacctcgcgctcgaaggcccccggg

SEQ ID NO: 241199 - DNA, 75 bp, Artificial Sequence
  Synthetic
acgggatctgaaaaccgctgaacgaaggcttcgaagccagtcgcagtcgcaaggtaagctgagcacggtttcttc

SEQ ID NO: 241200 - DNA, 75 bp, Artificial Sequence
  Synthetic
acgggatctgaaaaccgctgaacgaaggcttcgaagccagtcgcagtcgcaaggtatgctgagcacggtttcttc

SEQ ID NO: 241201 - DNA, 75 bp, Artificial Sequence
  Synthetic
acgggatctgaaaaccgctgaacgaaggcttcgaagccagtcgcagtcgcaaggtacgctgagcacggtttcttc

SEQ ID NO: 241202 - DNA, 75 bp, Artificial Sequence
  Synthetic
acgggatctgaaaaccgctgaacgaaggcttcgaagccagtcgcagtcgcaaggtaggctgagcacggtttcttc

SEQ ID NO: 241203 - DNA, 75 bp, Artificial Sequence
  Synthetic
tggaggaggagctgcctcccctggacaagcggggcgacaagcgtccccgtcccgacgcggaggagacgctgctga

SEQ ID NO: 241204 - DNA, 75 bp, Artificial Sequence
  Synthetic
tcccgtctagacccaagcatgcaccaaccctccaggatacggaggcgggtcgttttgcaacttttttttggaggc

SEQ ID NO: 241205 - DNA, 75 bp, Artificial Sequence
  Synthetic
tcccgtctagacccaagcttgcaccaaccctccaggatacggaggcgggtcgttttgcaacttttttttggaggc

SEQ ID NO: 241206 - DNA, 75 bp, Artificial Sequence
  Synthetic
tcccgtctagacccaagcctgcaccaaccctccaggatacggaggcgggtcgttttgcaacttttttttggaggc

SEQ ID NO: 241207 - DNA, 75 bp, Artificial Sequence
  Synthetic
tcccgtctagacccaagcgtgcaccaaccctccaggatacggaggcgggtcgttttgcaacttttttttggaggc

SEQ ID NO: 241208 - DNA, 75 bp, Artificial Sequence
  Synthetic
tcccgtcttgacccaagcatgcaccaaccctccaggatacggaggcgggtcgttttgcaacttttttttggaggc

SEQ ID NO: 241209 - DNA, 75 bp, Artificial Sequence
  Synthetic
tcccgtcttgacccaagcttgcaccaaccctccaggatacggaggcgggtcgttttgcaacttttttttggaggc

SEQ ID NO: 241210 - DNA, 75 bp, Artificial Sequence
  Synthetic
tcccgtcttgacccaagcctgcaccaaccctccaggatacggaggcgggtcgttttgcaacttttttttggaggc

SEQ ID NO: 241211 - DNA, 75 bp, Artificial Sequence
  Synthetic
tcccgtcttgacccaagcgtgcaccaaccctccaggatacggaggcgggtcgttttgcaacttttttttggaggc

SEQ ID NO: 241212 - DNA, 75 bp, Artificial Sequence
  Synthetic
tcccgtctcgacccaagcatgcaccaaccctccaggatacggaggcgggtcgttttgcaacttttttttggaggc

SEQ ID NO: 241213 - DNA, 75 bp, Artificial Sequence
  Synthetic
tcccgtctcgacccaagcttgcaccaaccctccaggatacggaggcgggtcgttttgcaacttttttttggaggc

SEQ ID NO: 241214 - DNA, 75 bp, Artificial Sequence
  Synthetic
tcccgtctcgacccaagcctgcaccaaccctccaggatacggaggcgggtcgttttgcaacttttttttggaggc

SEQ ID NO: 241215 - DNA, 75 bp, Artificial Sequence
  Synthetic
tcccgtctcgacccaagcgtgcaccaaccctccaggatacggaggcgggtcgttttgcaacttttttttggaggc

SEQ ID NO: 241216 - DNA, 75 bp, Artificial Sequence
  Synthetic
tcccgtctggacccaagcatgcaccaaccctccaggatacggaggcgggtcgttttgcaacttttttttggaggc

SEQ ID NO: 241217 - DNA, 75 bp, Artificial Sequence
  Synthetic
tcccgtctggacccaagcttgcaccaaccctccaggatacggaggcgggtcgttttgcaacttttttttggaggc

SEQ ID NO: 241218 - DNA, 75 bp, Artificial Sequence
  Synthetic
tcccgtctggacccaagcctgcaccaaccctccaggatacggaggcgggtcgttttgcaacttttttttggaggc

SEQ ID NO: 241219 - DNA, 75 bp, Artificial Sequence
  Synthetic
tcccgtctggacccaagcgtgcaccaaccctccaggatacggaggcgggtcgttttgcaacttttttttggaggc

SEQ ID NO: 241220 - DNA, 75 bp, Artificial Sequence
  Synthetic
aaccctccaggatacggaggcgggtcgttttgcaacttttttttggaggccggatgagactagtaagcgcggaaa

SEQ ID NO: 241221 - DNA, 75 bp, Artificial Sequence
  Synthetic
gggccctagctttaaaccctactccggcactgcctacaacagtctggctcccaagggagcgcccaatacctgcca

SEQ ID NO: 241222 - DNA, 75 bp, Artificial Sequence
  Synthetic
agtatgtggaatcaggcggtggacagctatgatcctgatgtgcgcattattgaaaaccatggtgtggaggatgaa

SEQ ID NO: 241223 - DNA, 75 bp, Artificial Sequence
  Synthetic
ctgatggactacttgcatcgggcggccgccatgaactctgactatttcaccaacgccatcctgaatccccactgg

SEQ ID NO: 241224 - DNA, 75 bp, Artificial Sequence
  Synthetic
gacagcagcgtgttggacttgggtgggagtggtggtggtaacccgttcgctcacctgcgcccccgcatcgggcgc

SEQ ID NO: 241225 - DNA, 75 bp, Artificial Sequence
  Synthetic
cggcgaggggtacaacgtggcccagtgcaacatgaccaaggactggttcttggtccagatgctggcccattacaa

SEQ ID NO: 241226 - DNA, 75 bp, Artificial Sequence
  Synthetic
cgtgcagcagaagcgtgggcctgttcctgatgcaggagggggccacccccagcgccgcgctcgacatgaccgcgc

SEQ ID NO: 241227 - DNA, 75 bp, Artificial Sequence
  Synthetic
atcatgcacaccaacatgcccaacgtgaacgagttcatgtacagcaacaagttcaaggcgcgggtcatggtctcc

SEQ ID NO: 241228 - DNA, 75 bp, Artificial Sequence
  Synthetic
gcacccccttctcggccggtaacgccaccacataaattattgcttcttgcaagaagccatggccgcaggctccgg

SEQ ID NO: 241229 - DNA, 75 bp, Artificial Sequence
  Synthetic
tgcgcccccgtatcgggcgcatgatgtaagagaaaccgaaaataaatgatactcaccaaggccatggcgaccagc

SEQ ID NO: 241230 - DNA, 75 bp, Artificial Sequence
  Synthetic
ctggctggccttcgcctggaacccgcgctcgaacacctgctacctcttcgaccccttcgggttctcggacgagcg

SEQ ID NO: 241231 - DNA, 75 bp, Artificial Sequence
  Synthetic
aaaagcaaggaggaagcagcagctgaggcaaccgcagccgtagccaccgcctctaccgaggtcaggggcgataat

SEQ ID NO: 241232 - DNA, 75 bp, Artificial Sequence
  Synthetic
caccctggaaaagtccacccagaccgtgcagggtccgcgctcggccgcctgcgggctcttctgctgcatgttcct

SEQ ID NO: 241233 - DNA, 75 bp, Artificial Sequence
  Synthetic
ctctaccgaggtcaggggcgataattttgcaagcgccgcagcagtggcagcggccgaggcggctgaaaccgaaag

SEQ ID NO: 241234 - DNA, 75 bp, Artificial Sequence
  Synthetic
tgaacttgctgacgggggtgcccaacggcatgctccagtcgccccaggtggaatctaccttgctccgcaaccagg

SEQ ID NO: 241235 - DNA, 75 bp, Artificial Sequence
  Synthetic
caaggcgcgggtgatggtctcccgcaagacccccaatggggtgacagtgacagaggattatgatggtagtcagga

SEQ ID NO: 241236 - DNA, 75 bp, Artificial Sequence
  Synthetic
gaacaacgccatcatcgacaattacttggcggtggggcggcagaacggggtgctggagagcgacatcggcgtgaa

SEQ ID NO: 241237 - DNA, 75 bp, Artificial Sequence
  Synthetic
cggggaacgaatcggtccacagcttccgtgtcagttgcagggcacccagcaggtcgggcgcggagatcttgaaat

SEQ ID NO: 241238 - DNA, 75 bp, Artificial Sequence
  Synthetic
gcgagagttgcggtacacggggttgcagcactggaacaccatcagggccggatgcttcacgctcgccagcaccgt

SEQ ID NO: 241239 - DNA, 75 bp, Artificial Sequence
  Synthetic
agggggtcatcttgcaggtctgccggcccatggtgggcacgcagccgggcttgtggttgcaatcgcagtgcaggg

SEQ ID NO: 241240 - DNA, 75 bp, Artificial Sequence
  Synthetic
cagcggccgaggcggctgaaaccgaaagtaagatagtcattcagccggtggagaaggatagcaagaacaggagct

SEQ ID NO: 241241 - DNA, 75 bp, Artificial Sequence
  Synthetic
cccgcggcggcggtgaaggaggaaagaaagccccgcaaaatcaagcgggtcaaaaaggacaaaaaggaagaagat

SEQ ID NO: 241242 - DNA, 75 bp, Artificial Sequence
  Synthetic
ctgcgcccccagcggttctgggtgatcttggcccggtcggggttctccttcagcgcgcgttgtccgttttcgctc

SEQ ID NO: 241243 - DNA, 75 bp, Artificial Sequence
  Synthetic
gtgaccctgcagcaggtgctgccgagcgcggcgccgcgaagggggttcaagcgcgagggcgaggatctgtatccc

SEQ ID NO: 241244 - DNA, 75 bp, Artificial Sequence
  Synthetic
caccagggggtcgttgtcattgagagtctcaaagctccgcttgccgtccttctcggtgatccgcacggggggata

SEQ ID NO: 241245 - DNA, 75 bp, Artificial Sequence
  Synthetic
tcctcggcctctctttcgttctcgctgtcctggctgacgtcctgcaggggcacatgcttggttttgcggggtttc

SEQ ID NO: 241246 - DNA, 75 bp, Artificial Sequence
  Synthetic
gttttcgctcaccactactatctcttcttcttggtccgaggccatgcggcggtaggtatgtctcttcaggggcag

SEQ ID NO: 241247 - DNA, 75 bp, Artificial Sequence
  Synthetic
gcgcttctaccgcggtcatacaaccagctcccgccgccgcaagaccaccactcgccgccgccgtcgccgcacagc

SEQ ID NO: 241248 - DNA, 75 bp, Artificial Sequence
  Synthetic
gccgcgcgcctctgaccctgccgcgcgcgcgctaccacccgagcatcgccatttaaaactttcgcctgctttgca

SEQ ID NO: 241249 - DNA, 75 bp, Artificial Sequence
  Synthetic
ctcctacgacgaggtgtacggggatgatgatattctggagcaggcggccgaacgcctgggcgagtttgcttacgg

SEQ ID NO: 241250 - DNA, 75 bp, Artificial Sequence
  Synthetic
ctcctacgacgaggtgtacggggatgatgatattctggagcaggcggccgatcgcctgggcgagtttgcttacgg

SEQ ID NO: 241251 - DNA, 75 bp, Artificial Sequence
  Synthetic
ctcctacgacgaggtgtacggggatgatgatattctggagcaggcggccgaccgcctgggcgagtttgcttacgg

SEQ ID NO: 241252 - DNA, 75 bp, Artificial Sequence
  Synthetic
ctcctacgacgaggtgtacggggatgatgatattctggagcaggcggccgagcgcctgggcgagtttgcttacgg

SEQ ID NO: 241253 - DNA, 75 bp, Artificial Sequence
  Synthetic
gcggccccagacatgcaagagatggaggaatccatcgagattgacctgggctatgtgacgcccgcggagcacgag

SEQ ID NO: 241254 - DNA, 75 bp, Artificial Sequence
  Synthetic
atccccacgccgggctaccgcggcacgcgcttctaccgcggtcataccagcagccgccgccgcaagaccaccact

SEQ ID NO: 241255 - DNA, 75 bp, Artificial Sequence
  Synthetic
ggctccgtggagatgccgcaggtggaggaggagctgcctcccctggacaagcggggcgagaagcgaccccgcccc

SEQ ID NO: 241256 - DNA, 75 bp, Artificial Sequence
  Synthetic
atggccctcacatgaccgccttcgcgttcccattacgggctaccgaggaagaaaaccgcgccgtagaaggctggc

SEQ ID NO: 241257 - DNA, 75 bp, Artificial Sequence
  Synthetic
aagcgccgccgctgctattaaacctaccgtagcgcttaacttgcttgtctgtgtgtgtatgtattatgtcgccgc

SEQ ID NO: 241258 - DNA, 75 bp, Artificial Sequence
  Synthetic
gcccgcgaccctggacttgcatcctccccagccttcccgcccatatacagtggctaagcccctgccgccggtggc

SEQ ID NO: 241259 - DNA, 75 bp, Artificial Sequence
  Synthetic
gcccgcgaccctggacttgcatcctccccagccttcccgcccatttacagtggctaagcccctgccgccggtggc

SEQ ID NO: 241260 - DNA, 75 bp, Artificial Sequence
  Synthetic
gcccgcgaccctggacttgcatcctccccagccttcccgcccatctacagtggctaagcccctgccgccggtggc

SEQ ID NO: 241261 - DNA, 75 bp, Artificial Sequence
  Synthetic
gcccgcgaccctggacttgcatcctccccagccttcccgcccatgtacagtggctaagcccctgccgccggtggc

SEQ ID NO: 241262 - DNA, 75 bp, Artificial Sequence
  Synthetic
gcccgcgaccctggacttgcttcctccccagccttcccgcccatatacagtggctaagcccctgccgccggtggc

SEQ ID NO: 241263 - DNA, 75 bp, Artificial Sequence
  Synthetic
gcccgcgaccctggacttgcttcctccccagccttcccgcccatttacagtggctaagcccctgccgccggtggc

SEQ ID NO: 241264 - DNA, 75 bp, Artificial Sequence
  Synthetic
gcccgcgaccctggacttgcttcctccccagccttcccgcccatctacagtggctaagcccctgccgccggtggc

SEQ ID NO: 241265 - DNA, 75 bp, Artificial Sequence
  Synthetic
gcccgcgaccctggacttgcttcctccccagccttcccgcccatgtacagtggctaagcccctgccgccggtggc

SEQ ID NO: 241266 - DNA, 75 bp, Artificial Sequence
  Synthetic
gcccgcgaccctggacttgcctcctccccagccttcccgcccatatacagtggctaagcccctgccgccggtggc

SEQ ID NO: 241267 - DNA, 75 bp, Artificial Sequence
  Synthetic
gcccgcgaccctggacttgcctcctccccagccttcccgcccatttacagtggctaagcccctgccgccggtggc

SEQ ID NO: 241268 - DNA, 75 bp, Artificial Sequence
  Synthetic
gcccgcgaccctggacttgcctcctccccagccttcccgcccatctacagtggctaagcccctgccgccggtggc

SEQ ID NO: 241269 - DNA, 75 bp, Artificial Sequence
  Synthetic
gcccgcgaccctggacttgcctcctccccagccttcccgcccatgtacagtggctaagcccctgccgccggtggc

SEQ ID NO: 241270 - DNA, 75 bp, Artificial Sequence
  Synthetic
gcccgcgaccctggacttgcgtcctccccagccttcccgcccatatacagtggctaagcccctgccgccggtggc

SEQ ID NO: 241271 - DNA, 75 bp, Artificial Sequence
  Synthetic
gcccgcgaccctggacttgcgtcctccccagccttcccgcccatttacagtggctaagcccctgccgccggtggc

SEQ ID NO: 241272 - DNA, 75 bp, Artificial Sequence
  Synthetic
gcccgcgaccctggacttgcgtcctccccagccttcccgcccatctacagtggctaagcccctgccgccggtggc

SEQ ID NO: 241273 - DNA, 75 bp, Artificial Sequence
  Synthetic
gcccgcgaccctggacttgcgtcctccccagccttcccgcccatgtacagtggctaagcccctgccgccggtggc

SEQ ID NO: 241274 - DNA, 75 bp, Artificial Sequence
  Synthetic
tgaagaggcgcgtcgccgagttgcaagatggccaccccatcgatgctgccccagtgggcgtacatgcacatcgcc

SEQ ID NO: 241275 - DNA, 75 bp, Artificial Sequence
  Synthetic
tccggcaccgcctacaacagcctggctcccaagggagcgcccaattccagccagtgggagcaaaatgaaaacaat

SEQ ID NO: 241276 - DNA, 75 bp, Artificial Sequence
  Synthetic
cctatggtgttgctgctatgggcggacttgatattacgaaagagggtcttcaaattggaactgatgctagtaagg

SEQ ID NO: 241277 - DNA, 75 bp, Artificial Sequence
  Synthetic
caaattggaactgatgctagtaaggaagatgacaatgaaatttatgccgatgaaacatatcagcccgagcctcaa

SEQ ID NO: 241278 - DNA, 75 bp, Artificial Sequence
  Synthetic
ccatgctatggctcatttgccagacctaccaatgtgaagggagggcaagccaaagtgaaaacagaagaaaatgtt

SEQ ID NO: 241279 - DNA, 75 bp, Artificial Sequence
  Synthetic
agccactgctacctgctgcgcttggccaactacctggcctaccactcggacgtgatccaggacgttagcggcgag

SEQ ID NO: 241280 - DNA, 75 bp, Artificial Sequence
  Synthetic
tctttgatattccaagcaccggcacagggagcaatggtacaaatgtaaatgataagccagacatggtcatgtaca

SEQ ID NO: 241281 - DNA, 75 bp, Artificial Sequence
  Synthetic
agggagcaatggtacaaatgtaaatgataagccagacatggtcatgtacactgaaaatgtgaatttggagacgcc

SEQ ID NO: 241282 - DNA, 75 bp, Artificial Sequence
  Synthetic
gcaacctatgcacgccgcaccgctccctggtctgcaacccccagctgttaagcgagacccaaatcatcggcacct

SEQ ID NO: 241283 - DNA, 75 bp, Artificial Sequence
  Synthetic
ggaacttcagatgacagctctgaagccaacttgtgccagcaggccatgccaaacagacctaactacattggtttc

SEQ ID NO: 241284 - DNA, 75 bp, Artificial Sequence
  Synthetic
gggctctgccgccaaggggggtttaaaacttaccccggggctgtggacctcggcctacttgcgcaagtttgtgcc

SEQ ID NO: 241285 - DNA, 75 bp, Artificial Sequence
  Synthetic
agagacaattttattgggctcatgtactacaacagtactggcaacatgggtgtactggctggtcaggcctcacag

SEQ ID NO: 241286 - DNA, 75 bp, Artificial Sequence
  Synthetic
tactaatgctgtttaccagggtgttaaagaaaaaactggcaataatggcgagtgggaagcagataccaatgttgc

SEQ ID NO: 241287 - DNA, 75 bp, Artificial Sequence
  Synthetic
aaagaaaaaactggcaataatggcgagtgggaagcagataccaatgttgcctctcagaaccagatatgcaagggt

SEQ ID NO: 241288 - DNA, 75 bp, Artificial Sequence
  Synthetic
tccaagccaacctgtggagaagtttcctctactcgaacgtggccctgtacctgcccgattcttacaagtacacgc

SEQ ID NO: 241289 - DNA, 75 bp, Artificial Sequence
  Synthetic
tagaaaattcacagcggcggcagcggcaggtggactgagaatcgcggcgaacgagccggtgcagacccgggagct

SEQ ID NO: 241290 - DNA, 75 bp, Artificial Sequence
  Synthetic
gcaggtggactgagaatcgcggcgaacgagccggtgcagacccgggagctgaggaaccggatttttcccaccctt

SEQ ID NO: 241291 - DNA, 75 bp, Artificial Sequence
  Synthetic
agcccgcgcccgcccacacacaaaaaaggcgggaaatacgtcacctgtgcacccccacccagcaccgctatgagt

SEQ ID NO: 241292 - DNA, 75 bp, Artificial Sequence
  Synthetic
cagatactcctaaaacagtcagcgctcaccgccacgccccgcaatcacctcaatccgcgtaattggcccgccacc

SEQ ID NO: 241293 - DNA, 75 bp, Artificial Sequence
  Synthetic
gcacaacaactcgggcttcgtcggctacctcgcgcccaccatgcgccaggggcagccctaccccgccaactaccc

SEQ ID NO: 241294 - DNA, 75 bp, Artificial Sequence
  Synthetic
caaatcgccggatcgggaagatcttccttcacgcctcgtcaggccgtgctaactttggaaagttcgtcctcgcaa

SEQ ID NO: 241295 - DNA, 75 bp, Artificial Sequence
  Synthetic
cgggctccggcgagcaggagctcagggccatcatccgcgacctgggctgcgggccctacttcctgggcaccttcg

SEQ ID NO: 241296 - DNA, 75 bp, Artificial Sequence
  Synthetic
gggccctacttcctgggcaccttcgataagcgcttcccgggattcatggccccgcacaagctggcctgcgccatc

SEQ ID NO: 241297 - DNA, 75 bp, Artificial Sequence
  Synthetic
accagcacaacaactcgggcttcgtcggctacctcgcgcccaccatgcgccagggccagccataccccgccaaat

SEQ ID NO: 241298 - DNA, 75 bp, Artificial Sequence
  Synthetic
accagcacaacaactcgggcttcgtcggctacctcgcgcccaccatgcgccagggccagccataccccgccaatt

SEQ ID NO: 241299 - DNA, 75 bp, Artificial Sequence
  Synthetic
accagcacaacaactcgggcttcgtcggctacctcgcgcccaccatgcgccagggccagccataccccgccaact

SEQ ID NO: 241300 - DNA, 75 bp, Artificial Sequence
  Synthetic
accagcacaacaactcgggcttcgtcggctacctcgcgcccaccatgcgccagggccagccataccccgccaagt

SEQ ID NO: 241301 - DNA, 75 bp, Artificial Sequence
  Synthetic
accagcacaacaactcgggcttcgtcggctacctcgcgcccaccatgcgccagggccagccttaccccgccaaat

SEQ ID NO: 241302 - DNA, 75 bp, Artificial Sequence
  Synthetic
accagcacaacaactcgggcttcgtcggctacctcgcgcccaccatgcgccagggccagccttaccccgccaatt

SEQ ID NO: 241303 - DNA, 75 bp, Artificial Sequence
  Synthetic
accagcacaacaactcgggcttcgtcggctacctcgcgcccaccatgcgccagggccagccttaccccgccaact

SEQ ID NO: 241304 - DNA, 75 bp, Artificial Sequence
  Synthetic
accagcacaacaactcgggcttcgtcggctacctcgcgcccaccatgcgccagggccagccttaccccgccaagt

SEQ ID NO: 241305 - DNA, 75 bp, Artificial Sequence
  Synthetic
accagcacaacaactcgggcttcgtcggctacctcgcgcccaccatgcgccagggccagccctaccccgccaaat

SEQ ID NO: 241306 - DNA, 75 bp, Artificial Sequence
  Synthetic
accagcacaacaactcgggcttcgtcggctacctcgcgcccaccatgcgccagggccagccctaccccgccaatt

SEQ ID NO: 241307 - DNA, 75 bp, Artificial Sequence
  Synthetic
accagcacaacaactcgggcttcgtcggctacctcgcgcccaccatgcgccagggccagccctaccccgccaact

SEQ ID NO: 241308 - DNA, 75 bp, Artificial Sequence
  Synthetic
accagcacaacaactcgggcttcgtcggctacctcgcgcccaccatgcgccagggccagccctaccccgccaagt

SEQ ID NO: 241309 - DNA, 75 bp, Artificial Sequence
  Synthetic
accagcacaacaactcgggcttcgtcggctacctcgcgcccaccatgcgccagggccagccgtaccccgccaaat

SEQ ID NO: 241310 - DNA, 75 bp, Artificial Sequence
  Synthetic
accagcacaacaactcgggcttcgtcggctacctcgcgcccaccatgcgccagggccagccgtaccccgccaatt

SEQ ID NO: 241311 - DNA, 75 bp, Artificial Sequence
  Synthetic
accagcacaacaactcgggcttcgtcggctacctcgcgcccaccatgcgccagggccagccgtaccccgccaact

SEQ ID NO: 241312 - DNA, 75 bp, Artificial Sequence
  Synthetic
accagcacaacaactcgggcttcgtcggctacctcgcgcccaccatgcgccagggccagccgtaccccgccaagt

SEQ ID NO: 241313 - DNA, 75 bp, Artificial Sequence
  Synthetic
tcaagacatgtaaaccgtgtgtgtatgttaaatgtctttaataaacagcactttcatgttacacatgcatctgag

SEQ ID NO: 241314 - DNA, 75 bp, Artificial Sequence
  Synthetic
gtgaacaacactttcatttttaagcacatgtgcaataccgccatgttcatgagcaggcagtacgatatgtggccc

SEQ ID NO: 241315 - DNA, 75 bp, Artificial Sequence
  Synthetic
ggtgctaatcaccgcgattgtgtgcctgagcattcacatgctcattgctattcgccccagaaataatgccgagaa

SEQ ID NO: 241316 - DNA, 75 bp, Artificial Sequence
  Synthetic
ccgggtgcttcacgctcgccagcaccgtcgcgtcggtgatgctctccacgtcgaggtcctcggcgttggccatcc

SEQ ID NO: 241317 - DNA, 75 bp, Artificial Sequence
  Synthetic
taataatatcacactacttcaagtgactaaacaatattctgggacatattatggaaccaattttaacacaaaaca

SEQ ID NO: 241318 - DNA, 75 bp, Artificial Sequence
  Synthetic
gccttcatgaaagcctccaattgcctgaacgcctgctgggccttggctccctcggtgaagaagaccccgcaggac

SEQ ID NO: 241319 - DNA, 75 bp, Artificial Sequence
  Synthetic
ttggatccaactactcccagaactaaaaccactaaattaacaaccagcaccacacttgctatgactacacacact

SEQ ID NO: 241320 - DNA, 75 bp, Artificial Sequence
  Synthetic
aaaacgaattggttgccctgacgcaaaatggggagaatagtagtagcaatcctttgcctaccacccccagtgaga

SEQ ID NO: 241321 - DNA, 75 bp, Artificial Sequence
  Synthetic
ctcgccacatccatctcgatcatgtgctccttctggatcatggtggtcccgtgcaggcaccgcagcttgccctcg

SEQ ID NO: 241322 - DNA, 75 bp, Artificial Sequence
  Synthetic
tatcgctgctgtagtggtgtgtatggtcattatcatcttgtgcatgatgtactatgcctgctactacagaaaaca

SEQ ID NO: 241323 - DNA, 75 bp, Artificial Sequence
  Synthetic
cttgtgggcgatctgggaatgcgcgtgcacgaagccctgcaggaagcggcccatcatggtggtcagggtcttgtt

SEQ ID NO: 241324 - DNA, 75 bp, Artificial Sequence
  Synthetic
tagaaccataaagatcctaagccttttttgtttttctataatttttacctctgctatttgtgaatcagtggataa

SEQ ID NO: 241325 - DNA, 75 bp, Artificial Sequence
  Synthetic
cggtgctcctcgttgatgtacaggtggcagatgcggcggtacacctcgccctgctcgggcatcagctggaagttg

SEQ ID NO: 241326 - DNA, 75 bp, Artificial Sequence
  Synthetic
gtagcagattcatgaagattcctttgttgctaatactcccacacaccccggaccgcaatgtccagggttagtagt

SEQ ID NO: 241327 - DNA, 75 bp, Artificial Sequence
  Synthetic
agcggtccatcagcatagtcatgatttccatacccttctcccaggccgagacgatgggcaggctcatagggttct

SEQ ID NO: 241328 - DNA, 75 bp, Artificial Sequence
  Synthetic
catttttgcttgctgctacagaaggcttcatcggcagaaatcagacccactgctgaacctctatgtttaattttt

SEQ ID NO: 241329 - DNA, 75 bp, Artificial Sequence
  Synthetic
cgcggccagggggtcgctctcgtccagggtctcaaagctccgcttgccgtccttctcggtgatccgcaccggggg

SEQ ID NO: 241330 - DNA, 75 bp, Artificial Sequence
  Synthetic
gattttccagaaccaatgaatgcacttagcactttagtttttttgaccttgattggctttgttttcagtaatcct

SEQ ID NO: 241331 - DNA, 75 bp, Artificial Sequence
  Synthetic
gattggctttgttttcagtaatcctattcctagagttagctttattaaactagttaatgttactgaagggggcaa

SEQ ID NO: 241332 - DNA, 75 bp, Artificial Sequence
  Synthetic
attcctagagttagctttattaaactagttaatgttactgaagggggcaatgtaatactggtaggtgtagagggt

SEQ ID NO: 241333 - DNA, 75 bp, Artificial Sequence
  Synthetic
gaccacatgcttggtcttgcggggtttcttcttgggcggcagcggcggcggagatgttggagatggcgaggggga

SEQ ID NO: 241334 - DNA, 75 bp, Artificial Sequence
  Synthetic
atctcttcctcttcttggtccgaggccacgcggcggtaggtatgtctcttcgggggcagaggcggaggcgacggg

SEQ ID NO: 241335 - DNA, 75 bp, Artificial Sequence
  Synthetic
ggttataccactgccaacacccagcccacctagcactacattaactgagcccaccaccgccacaacagcagaggc

SEQ ID NO: 241336 - DNA, 75 bp, Artificial Sequence
  Synthetic
ccacctagcactacattaactgagcccaccaccgccacaacagcagaggcaagcagttcgtctaggatccaaatg

SEQ ID NO: 241337 - DNA, 75 bp, Artificial Sequence
  Synthetic
gtcccactgctagtaccaataagcagtctactaaatttttgtccattactaaaagccacaccacagctacctcga

SEQ ID NO: 241338 - DNA, 75 bp, Artificial Sequence
  Synthetic
acctcgccatctgcccccaccgccgacgagaagcagcagcagcagaatgaaagcttaaccgccccgccgcccagc

SEQ ID NO: 241339 - DNA, 75 bp, Artificial Sequence
  Synthetic
cacttcgctttcctctaccccagcttcttttcccactcccctaaagcaaacccaaggcggcttgcaatggcagat

SEQ ID NO: 241340 - DNA, 75 bp, Artificial Sequence
  Synthetic
tggcagtgcgcttttcacaagaagagatacaccaagaacagccagagcaggaagcagagaatgagcagagtcagg

SEQ ID NO: 241341 - DNA, 75 bp, Artificial Sequence
  Synthetic
cctccacctgagcgggggggaggacgcgctcatcaagcatctggcccggcaggccaccatcgtcaaggatgcgct

SEQ ID NO: 241342 - DNA, 75 bp, Artificial Sequence
  Synthetic
tttgaactatgattcctagacagttctttatcattggtcttctctgtgcgctccaagtctgtgccaccctcgctt

SEQ ID NO: 241343 - DNA, 75 bp, Artificial Sequence
  Synthetic
tgggtctttgtgcgcattgcctacctgcgccaccacccccagtaccgcgaccaaagagtggcgcagctgcttagg

SEQ ID NO: 241344 - DNA, 75 bp, Artificial Sequence
  Synthetic
tgcgccaccacccccagtaccgcgaccaaagagtggcgcagctgcttaggcttatttgacaatcatgcgggcttt

SEQ ID NO: 241345 - DNA, 75 bp, Artificial Sequence
  Synthetic
ccacagcgccctggtcgagttggaaggcgacaacgcgcggctggcggtgctcaaacgcacggtcgagctgaccca

SEQ ID NO: 241346 - DNA, 75 bp, Artificial Sequence
  Synthetic
caccctgcgcggggaggcccgccgcgactacatccgcgactgcgtctacctgtacctctgccacacctggcagac

SEQ ID NO: 241347 - DNA, 75 bp, Artificial Sequence
  Synthetic
ggcgacaacgcgcggctggcggtgctcaaacgcacggtcgagctgacccatttcgcgtacccggctctgaacctg

SEQ ID NO: 241348 - DNA, 75 bp, Artificial Sequence
  Synthetic
tcaaacgcacggtcgagctgacccatttcgcgtacccggctctgaacctgccccccaaagtcatgagcgcggtca

SEQ ID NO: 241349 - DNA, 75 bp, Artificial Sequence
  Synthetic
gtcgcccatctccgaggacgagggcatgcaagactccgaggagggcaagcccgtggtcagcgacgagcagctggc

SEQ ID NO: 241350 - DNA, 75 bp, Artificial Sequence
  Synthetic
gcaactcctccgagtgcgtttacaccctgatcaagaccctctgcggcctccgcgacctcctccccataaactaac

SEQ ID NO: 241351 - DNA, 75 bp, Artificial Sequence
  Synthetic
cgcaccaccgcctcggacctggccgacctcattttccccgagcgcctcaggctgacgctgcgcaacggcctgccc

SEQ ID NO: 241352 - DNA, 75 bp, Artificial Sequence
  Synthetic
tgctgaaaaagggccacggggtctacttggacccccagaccggagaggagctcaaccccagcttcccccaggatg

SEQ ID NO: 241353 - DNA, 75 bp, Artificial Sequence
  Synthetic
ggtctacctcgacccccagaccggtgaggagctcaaccccggcttcccccaggatgccccgaggaaacaagaagc

SEQ ID NO: 241354 - DNA, 75 bp, Artificial Sequence
  Synthetic
aggatgccccgaggaaacaagaagctgaaagtggagctgccgcccgtggaggatttggaggaagactgggagaac

SEQ ID NO: 241355 - DNA, 75 bp, Artificial Sequence
  Synthetic
caccaaagatggaaaactatccttacaagtttctccaccattaagtatattaagatcaacaattctaaatacatt

SEQ ID NO: 241356 - DNA, 75 bp, Artificial Sequence
  Synthetic
tggaggaagactgggacagcactcaggcagaggaggacagcctgcaagacagtctggaggaagacgaggaggagg

SEQ ID NO: 241357 - DNA, 75 bp, Artificial Sequence
  Synthetic
acatcttgcattactaccgtcacctccacagcccctactacttccaagaagaggcagcagcagcagaaaaagacc

SEQ ID NO: 241358 - DNA, 75 bp, Artificial Sequence
  Synthetic
ctctcttcaacaagtactgcgcgctcactcttaaagagtagcccgcgcccgcccagtcgcagaaaaaggcgggaa

SEQ ID NO: 241359 - DNA, 75 bp, Artificial Sequence
  Synthetic
ccaacccacctttttcctttatctataaatggaaactgaaacaaaaataaagtttaagtgttttattgattcaac

SEQ ID NO: 241360 - DNA, 75 bp, Artificial Sequence
  Synthetic
acagttatctggaataagagcgatgagaatcataatccgcgaacgggatcgggcggttgtggcgcattaggcccc

SEQ ID NO: 241361 - DNA, 75 bp, Artificial Sequence
  Synthetic
agaatcataatccgcgaacgggatcgggcggttgtggcgcattaggccccgcaacagtcgctgtctacgccgctc

SEQ ID NO: 241362 - DNA, 75 bp, Artificial Sequence
  Synthetic
gggtcctgggactccctgcgcatgatgccaatggccctaagcatcagtcgcctggtacggcgggcacagcagcgg

SEQ ID NO: 241363 - DNA, 75 bp, Artificial Sequence
  Synthetic
tgccaatggccctaagcatcagtcgcctggtacggcgggcacagcagcggatgcgaatctcacttaggtcaaagc

SEQ ID NO: 241364 - DNA, 75 bp, Artificial Sequence
  Synthetic
gaactatgctgcccacatgtccatcgtaccagattctgatgtaaatcaggtggcgccccctccagaacacactgc

SEQ ID NO: 241365 - DNA, 75 bp, Artificial Sequence
  Synthetic
agccctggataatcctgcggaaccagatggccagcactgccccgcccgccatgcagcgcaaagaccccgggtcct

SEQ ID NO: 241366 - DNA, 75 bp, Artificial Sequence
  Synthetic
gaggagaaggccgatccctgcttgcatttcaatcccgacaaatgccagctgagttttcagcccgatggcaatcgg

SEQ ID NO: 241367 - DNA, 75 bp, Artificial Sequence
  Synthetic
acagccactcccttaaaacgtgcagtatctcctcagcctcttgggtgatgaaaatcccatttgccctaatggctc

SEQ ID NO: 241368 - DNA, 75 bp, Artificial Sequence
  Synthetic
gtgcacggcgctaatcaccgctatcgtgtgcctgagcattcacatgctcatcgctattcgccccagaaataatgc

SEQ ID NO: 241369 - DNA, 75 bp, Artificial Sequence
  Synthetic
gacaagctggaacacttactaagtgttgaattttaattttttagaaccatgaagatcctaggccttttaattttt

SEQ ID NO: 241370 - DNA, 75 bp, Artificial Sequence
  Synthetic
aaaagtcgtctaggtgcatgtttagagcctcaggaacaacgatggaataagtgcaaggagtgcgttccagcatgg

SEQ ID NO: 241371 - DNA, 75 bp, Artificial Sequence
  Synthetic
cgtggtattgctattttggatctgacactacagaaactgaattatgcaatcttaagaatggcaaaattcaaaatt

SEQ ID NO: 241372 - DNA, 75 bp, Artificial Sequence
  Synthetic
cgtggtattgctattttggatctgacactacagaaactgaattatgctatcttaagaatggcaaaattcaaaatt

SEQ ID NO: 241373 - DNA, 75 bp, Artificial Sequence
  Synthetic
cgtggtattgctattttggatctgacactacagaaactgaattatgccatcttaagaatggcaaaattcaaaatt

SEQ ID NO: 241374 - DNA, 75 bp, Artificial Sequence
  Synthetic
cgtggtattgctattttggatctgacactacagaaactgaattatgcgatcttaagaatggcaaaattcaaaatt

SEQ ID NO: 241375 - DNA, 75 bp, Artificial Sequence
  Synthetic
aagaagcatacactccgggaacattggcgtccgtgagtgaaaaaaagcggcctataaagcctcgaggcactacaa

SEQ ID NO: 241376 - DNA, 75 bp, Artificial Sequence
  Synthetic
tacaaaacctcagcgtccatagcttaccgagcacggcaggcgcaacagtcaaagaaaaagctcagctctaaccta

SEQ ID NO: 241377 - DNA, 75 bp, Artificial Sequence
  Synthetic
tcatgaaggcagttagcgctctagttttttgttctatgattggcattgttttttgcaatcctattcctaaagtta

SEQ ID NO: 241378 - DNA, 75 bp, Artificial Sequence
  Synthetic
tcatgaaggcagttagcgctctagttttttgttctttgattggcattgttttttgcaatcctattcctaaagtta

SEQ ID NO: 241379 - DNA, 75 bp, Artificial Sequence
  Synthetic
tcatgaaggcagttagcgctctagttttttgttctctgattggcattgttttttgcaatcctattcctaaagtta

SEQ ID NO: 241380 - DNA, 75 bp, Artificial Sequence
  Synthetic
tcatgaaggcagttagcgctctagttttttgttctgtgattggcattgttttttgcaatcctattcctaaagtta

SEQ ID NO: 241381 - DNA, 75 bp, Artificial Sequence
  Synthetic
ggccaaggtctaaaaatacccgccaacacgcccagaaaccggtgacacactaaaaaaatacgtacacttcctcaa

SEQ ID NO: 241382 - DNA, 75 bp, Artificial Sequence
  Synthetic
acacgcccagaaaccggtgacacactaaaaaaatacgtacacttcctcaaacacccatactggcgttatttccgg

SEQ ID NO: 241383 - DNA, 75 bp, Artificial Sequence
  Synthetic
tgaggggggcaatgtgacactggtaggtgtagagggtgctgaaaacaccacctggacaaaataccacctcaatgg

SEQ ID NO: 241384 - DNA, 75 bp, Artificial Sequence
  Synthetic
ggtgtagagggtgctgaaaacaccacctggacaaaataccacctcaatgggtggaaagatatttgcaattggagt

SEQ ID NO: 241385 - DNA, 75 bp, Artificial Sequence
  Synthetic
cgactttcaaattccgtcgaccgttaaacacatcagttatccgcccctaacagtcgccgctgttacgcccaatta

SEQ ID NO: 241386 - DNA, 75 bp, Artificial Sequence
  Synthetic
ttaatcttaccattgtcaatgccacctcagctcaaaatggtagaattcaaggacaaagtgtcagtgtatctaatg

SEQ ID NO: 241387 - DNA, 75 bp, Artificial Sequence
  Synthetic
aaacacatcagttatccgcccctaacagtcgccgctgttacgcccaattagcgcgcctattcccaaatttaataa

SEQ ID NO: 241388 - DNA, 75 bp, Artificial Sequence
  Synthetic
ggtattttacccaacatacttttatctatgacgttaaagtcataccactgcatacgcttagcccacttagcatta

SEQ ID NO: 241389 - DNA, 75 bp, Artificial Sequence
  Synthetic
ggtattttacccaacatacttttatctatgacgttaaagtcataccactgcttacgcttagcccacttagcatta

SEQ ID NO: 241390 - DNA, 75 bp, Artificial Sequence
  Synthetic
ggtattttacccaacatacttttatctatgacgttaaagtcataccactgcctacgcttagcccacttagcatta

SEQ ID NO: 241391 - DNA, 75 bp, Artificial Sequence
  Synthetic
ggtattttacccaacatacttttatctatgacgttaaagtcataccactgcgtacgcttagcccacttagcatta

SEQ ID NO: 241392 - DNA, 75 bp, Artificial Sequence
  Synthetic
acgtcacatttaacacaataacttgcaacataactcctcccacataagttacgtcacctcccagcattaccccac

SEQ ID NO: 241393 - DNA, 75 bp, Artificial Sequence
  Synthetic
caatcaccacacagcgcgcacttttttaaatcacctcatttacatattggcaccattccatctataaggtatatt

SEQ ID NO: 241394 - DNA, 75 bp, Artificial Sequence
  Synthetic
catcatcaataatatacctcaaacttttggtgcgcgttaatatgcaaatgaggcgtttgaatttggggatgcggg

SEQ ID NO: 241395 - DNA, 75 bp, Artificial Sequence
  Synthetic
acctccagtgccttctctagcaccgccaatctctcctcgctttcctatacaccaatcagtcccgataatactcct

SEQ ID NO: 241396 - DNA, 75 bp, Artificial Sequence
  Synthetic
acctccagtgccttctctagcaccgccaatctctcctcgctttcctatacaccaatcagtcccgttaatactcct

SEQ ID NO: 241397 - DNA, 75 bp, Artificial Sequence
  Synthetic
acctccagtgccttctctagcaccgccaatctctcctcgctttcctatacaccaatcagtcccgctaatactcct

SEQ ID NO: 241398 - DNA, 75 bp, Artificial Sequence
  Synthetic
acctccagtgccttctctagcaccgccaatctctcctcgctttcctatacaccaatcagtcccggtaatactcct

SEQ ID NO: 241399 - DNA, 75 bp, Artificial Sequence
  Synthetic
acctccagtgccttctctagcaccgccaatctctcctcgctttcctttacaccaatcagtcccgataatactcct

SEQ ID NO: 241400 - DNA, 75 bp, Artificial Sequence
  Synthetic
acctccagtgccttctctagcaccgccaatctctcctcgctttcctttacaccaatcagtcccgttaatactcct

SEQ ID NO: 241401 - DNA, 75 bp, Artificial Sequence
  Synthetic
acctccagtgccttctctagcaccgccaatctctcctcgctttcctttacaccaatcagtcccgctaatactcct

SEQ ID NO: 241402 - DNA, 75 bp, Artificial Sequence
  Synthetic
acctccagtgccttctctagcaccgccaatctctcctcgctttcctttacaccaatcagtcccggtaatactcct

SEQ ID NO: 241403 - DNA, 75 bp, Artificial Sequence
  Synthetic
acctccagtgccttctctagcaccgccaatctctcctcgctttcctctacaccaatcagtcccgataatactcct

SEQ ID NO: 241404 - DNA, 75 bp, Artificial Sequence
  Synthetic
acctccagtgccttctctagcaccgccaatctctcctcgctttcctctacaccaatcagtcccgttaatactcct

SEQ ID NO: 241405 - DNA, 75 bp, Artificial Sequence
  Synthetic
acctccagtgccttctctagcaccgccaatctctcctcgctttcctctacaccaatcagtcccgctaatactcct

SEQ ID NO: 241406 - DNA, 75 bp, Artificial Sequence
  Synthetic
acctccagtgccttctctagcaccgccaatctctcctcgctttcctctacaccaatcagtcccggtaatactcct

SEQ ID NO: 241407 - DNA, 75 bp, Artificial Sequence
  Synthetic
acctccagtgccttctctagcaccgccaatctctcctcgctttcctgtacaccaatcagtcccgataatactcct

SEQ ID NO: 241408 - DNA, 75 bp, Artificial Sequence
  Synthetic
acctccagtgccttctctagcaccgccaatctctcctcgctttcctgtacaccaatcagtcccgttaatactcct

SEQ ID NO: 241409 - DNA, 75 bp, Artificial Sequence
  Synthetic
acctccagtgccttctctagcaccgccaatctctcctcgctttcctgtacaccaatcagtcccgctaatactcct

SEQ ID NO: 241410 - DNA, 75 bp, Artificial Sequence
  Synthetic
acctccagtgccttctctagcaccgccaatctctcctcgctttcctgtacaccaatcagtcccggtaatactcct

SEQ ID NO: 241411 - DNA, 75 bp, Artificial Sequence
  Synthetic
ccacacagacaaccacatacagtacatcaaatcagcctaccaccactacagcagcagaggttgccagctcgtctg

SEQ ID NO: 241412 - DNA, 75 bp, Artificial Sequence
  Synthetic
ttgaacacggaaatactcaattttcccgcgctctctgacaggaaatgaggtgtttctgggcggatgcaagtgaaa

SEQ ID NO: 241413 - DNA, 75 bp, Artificial Sequence
  Synthetic
tgtttctgggcggatgcaagtgaaaacgggccattttcgcgcgaaaactgaatgaggaagtgaaaatctgagtaa

SEQ ID NO: 241414 - DNA, 75 bp, Artificial Sequence
  Synthetic
gcgagtcagatctacactttgaaagatgaggcacctgagagacctgcccggtaatgttttcctggctactgggaa

SEQ ID NO: 241415 - DNA, 75 bp, Artificial Sequence
  Synthetic
gccatgatgggtgacgaccctccggagccccctaccccatttgaggcgccttcgctgtacgatttgtatgatctg

SEQ ID NO: 241416 - DNA, 75 bp, Artificial Sequence
  Synthetic
aactatgattcctagacaattcttgatcactattcttatctgcctcctccaagtctgtgccaccctcgctctggt

SEQ ID NO: 241417 - DNA, 75 bp, Artificial Sequence
  Synthetic
agccccctaccccatttgaggcgccttcgctgtacgatttgtatgatctggaggtggatgtgcccgagaacgacc

SEQ ID NO: 241418 - DNA, 75 bp, Artificial Sequence
  Synthetic
gtttagcgatgccgcgctgctggctgccgagcaggctaatacggactctggctcagacagcgattcctctctcca

SEQ ID NO: 241419 - DNA, 75 bp, Artificial Sequence
  Synthetic
aaaaagatccccgagcttaaaggggaagagctcgacctgcgctgctatgaggaatgcttgcctccgagcgatgat

SEQ ID NO: 241420 - DNA, 75 bp, Artificial Sequence
  Synthetic
aagagctcgacctgcgctgctatgaggaatgcttgcctccgagcgatgatgaggaggacgaggaggcgattcgag

SEQ ID NO: 241421 - DNA, 75 bp, Artificial Sequence
  Synthetic
ggcgggcgagggctttagcctggactgtcctactctgcccggacacggctgtaagtcttgtgaatttcatcgcat

SEQ ID NO: 241422 - DNA, 75 bp, Artificial Sequence
  Synthetic
tgtcctactctgcccggacacggctgtaagtcttgtgaatttcatcgcatgaatactggagataagaatgtgatg

SEQ ID NO: 241423 - DNA, 75 bp, Artificial Sequence
  Synthetic
taggtcccgtctctgacgtagatgagacccccacttcagagtgcatttcatcacccccagaaattggcgaggaac

SEQ ID NO: 241424 - DNA, 75 bp, Artificial Sequence
  Synthetic
cgcccgaagatattattcatagaccagttgcagtgagagtcaccgggcggagagcagctgtggagagtttggatg

SEQ ID NO: 241425 - DNA, 75 bp, Artificial Sequence
  Synthetic
tcaaccccatcgtcatcacccagcagtctggcgataccaaggggtgcatccactgctcctgcgactcccccgact

SEQ ID NO: 241426 - DNA, 75 bp, Artificial Sequence
  Synthetic
acttgctacagggtggggatgaacctttggacttgtgtacccggaaacgccccaggcactaagtgccacacatgt

SEQ ID NO: 241427 - DNA, 75 bp, Artificial Sequence
  Synthetic
gtgtttacttaaggtgatgtcagtatttatagggtgtggagtgcaataaaatccgtgttgactttaagtgcgtgt

SEQ ID NO: 241428 - DNA, 75 bp, Artificial Sequence
  Synthetic
atccgtgttgactttaagtgcgtgttttatgactcaggggtggggactgtgggtatataagcaggtgcagacctg

SEQ ID NO: 241429 - DNA, 75 bp, Artificial Sequence
  Synthetic
tgaaataaagatcatattgatgatgattttacagaaataaaaaataatcatttgatttgaaataaagatacaatc

SEQ ID NO: 241430 - DNA, 75 bp, Artificial Sequence
  Synthetic
gggtatataagcaggtgcagacctgtgtggtcagttcagagcaggactcatggagatctggacggtcttggaaga

SEQ ID NO: 241431 - DNA, 75 bp, Artificial Sequence
  Synthetic
gagaactcatcggaggaagtctcttacctgtggagattttgcttcggtggggctctagctaagctagtctatagg

SEQ ID NO: 241432 - DNA, 75 bp, Artificial Sequence
  Synthetic
ttgaggatattttgagagagtgtcctggtatttttgactctctcaacttgggccatcagtctcactttaaccaga

SEQ ID NO: 241433 - DNA, 75 bp, Artificial Sequence
  Synthetic
tggtatttttgactctctcaacttgggccatcagtctcactttaaccagagtattctgagagcccttgacttttc

SEQ ID NO: 241434 - DNA, 75 bp, Artificial Sequence
  Synthetic
gtagccttttttgcctttatccttgacaaatggagtcaagaaacccatttcagcagggattaccgtctggactgc

SEQ ID NO: 241435 - DNA, 75 bp, Artificial Sequence
  Synthetic
acaaatggagtcaagaaacccatttcagcagggattaccgtctggactgcttagcagtagctttgtggagaacat

SEQ ID NO: 241436 - DNA, 75 bp, Artificial Sequence
  Synthetic
ctccggctacttgccagtacagccggtagacacgctgaggatcctgagtctccagtcaccccaggaacaccaacg

SEQ ID NO: 241437 - DNA, 75 bp, Artificial Sequence
  Synthetic
gtagacacgctgaggatcctgagtctccagtcaccccaggaacaccaacgccgccagcagccgcagcaggagcag

SEQ ID NO: 241438 - DNA, 75 bp, Artificial Sequence
  Synthetic
aagagaacccgagagccggtctggaccctccggtggcggaggaggaggagtagctgacttgtttcccgagctgcg

SEQ ID NO: 241439 - DNA, 75 bp, Artificial Sequence
  Synthetic
ccctccggtggcggaggaggaggagtagctgacttgtttcccgagctgcgccgggtgctgactaggtcttccagt

SEQ ID NO: 241440 - DNA, 75 bp, Artificial Sequence
  Synthetic
agaggcatgaggagactagccacagaactgaactgactgtcagtctgatgagccgcaggcgcccagaatcggtgt

SEQ ID NO: 241441 - DNA, 75 bp, Artificial Sequence
  Synthetic
cccctctcagtttttccaacaacaccatttcccttaacatggatacccctctttacaacaacaatggaaagctag

SEQ ID NO: 241442 - DNA, 75 bp, Artificial Sequence
  Synthetic
agacttgttggttggagcccgaggatgattgggagttagccatcaggaattatgccaagctagctctgaagccag

SEQ ID NO: 241443 - DNA, 75 bp, Artificial Sequence
  Synthetic
tacccgggggtggtgggcatggagggagtcacctttatgaacgcgaggttcaggggtgatgggtataatggggtg

SEQ ID NO: 241444 - DNA, 75 bp, Artificial Sequence
  Synthetic
gagtcacctttatgaacgcgaggttcaggggtgatgggtataatggggtggtctttatggccaacaccaagctga

SEQ ID NO: 241445 - DNA, 75 bp, Artificial Sequence
  Synthetic
cattttcatacacctggactaatggaagctatgttggagcaacatttggggctaactcttataccttctcataca

SEQ ID NO: 241446 - DNA, 75 bp, Artificial Sequence
  Synthetic
gtgtcagtgaagaaatgcctgttcgagaggtgccacctgggggtgatgagcgagggcgaagccaaagtcaaacac

SEQ ID NO: 241447 - DNA, 75 bp, Artificial Sequence
  Synthetic
agaggtgccacctgggggtgatgagcgagggcgaagccaaagtcaaacactgcgcctctaccgagacgggctgct

SEQ ID NO: 241448 - DNA, 75 bp, Artificial Sequence
  Synthetic
aagctatgttggagcaacatttggggctaactcttataccttctcatacatcgcccaagaatgaacactgtatcc

SEQ ID NO: 241449 - DNA, 75 bp, Artificial Sequence
  Synthetic
agtcaagcataacatgatctgtggggcctcggatgagcgcggctaccagatgctgacctgcgccggtgggaacag

SEQ ID NO: 241450 - DNA, 75 bp, Artificial Sequence
  Synthetic
gcctcggatgagcgcggctaccagatgctgacctgcgccggtgggaacagccatatgctggccaccgtgcatgtg

SEQ ID NO: 241451 - DNA, 75 bp, Artificial Sequence
  Synthetic
ccgctgcaatgtgcacctgggctcccgccgaggcatgttcatgccctaccagtgcaacatgcaatttgtgaaggt

SEQ ID NO: 241452 - DNA, 75 bp, Artificial Sequence
  Synthetic
agagtgagcctgacgggggtgtttgacatgaatgtggagctgtggaaaattctgagatatgatgaatccaagacc

SEQ ID NO: 241453 - DNA, 75 bp, Artificial Sequence
  Synthetic
acatgaatgtggagctgtggaaaattctgagatatgatgaatccaagaccaggtgccgggcctgcgaatgcggag

SEQ ID NO: 241454 - DNA, 75 bp, Artificial Sequence
  Synthetic
acatccaccctgcatgccaacccatttccctctatctatacatggaaaactctgaagcagaaaaaataaagttca

SEQ ID NO: 241455 - DNA, 75 bp, Artificial Sequence
  Synthetic
cggggaagaatctgactagagtgagtagtgcttgggggaggtggagggcttgtatgaggggcagaatgactaaaa

SEQ ID NO: 241456 - DNA, 75 bp, Artificial Sequence
  Synthetic
gtgcgtcagaatgtgatgggatccacggtggacggccggcccgtgcagcccgcgaactcttcaaccctgacctac

SEQ ID NO: 241457 - DNA, 75 bp, Artificial Sequence
  Synthetic
ccacacagtttcagagcgagccagtctcgggtcggtcagggagatgaaaccctccgggcactcctgcatctgcac

SEQ ID NO: 241458 - DNA, 75 bp, Artificial Sequence
  Synthetic
ttccgccgccagcgccgtgcgcggaatggccctgggcgccggctactacagctctctggtggccaactcgagttc

SEQ ID NO: 241459 - DNA, 75 bp, Artificial Sequence
  Synthetic
gaggagaagctgctgctgctgatggcccagctcgaggccctgacccagcgcctgggcgagctgacccagcaggtg

SEQ ID NO: 241460 - DNA, 75 bp, Artificial Sequence
  Synthetic
gtcttgaatctttatttgatttttcgcgcgcggtaggccctggaccaccggtctcgatcattgagcacccggtgg

SEQ ID NO: 241461 - DNA, 75 bp, Artificial Sequence
  Synthetic
gtcatagcaggggcgcagggcgtggtgctgcacgatgtccttgaggaggagactgatggccacgggcagcccctt

SEQ ID NO: 241462 - DNA, 75 bp, Artificial Sequence
  Synthetic
cccgctggttgaacatgcagccctggataattctgcggaaccagatggccagcaccgccccgcccgccatgcagc

SEQ ID NO: 241463 - DNA, 75 bp, Artificial Sequence
  Synthetic
tgtgcatggacagggtatcgcaatcaggcagcaccggatgatcctccaccagagaagcgcgggtctcggtctcct

SEQ ID NO: 241464 - DNA, 75 bp, Artificial Sequence
  Synthetic
cacaacgaggtaagggggccggcggttggtacggatgatggcgggatgacgctaatcgtgttctggatcgtgtca

SEQ ID NO: 241465 - DNA, 75 bp, Artificial Sequence
  Synthetic
taatgaatttggggcggagggtgcccgactgggggacgaaggtgccctcgatcccgggggcgtagttgccctcgc

SEQ ID NO: 241466 - DNA, 75 bp, Artificial Sequence
  Synthetic
ctcggagggggggatcatgtccacctgcggggcgatgaaaaaaacggtttccggggcgggggagatgagctgggc

SEQ ID NO: 241467 - DNA, 75 bp, Artificial Sequence
  Synthetic
agccacagtacagataaaccgaagtcctccccagtgagcattgccaaatgcaagactgctataagcatgctggct

SEQ ID NO: 241468 - DNA, 75 bp, Artificial Sequence
  Synthetic
cgggttggggcgactgcgggagtagggcaccaggcgatgggcgtccagcgaggccagggtccggtccttccaggg

SEQ ID NO: 241469 - DNA, 75 bp, Artificial Sequence
  Synthetic
agtccagcaaagcgatgccatgcggatgaagcacaaaattctcaggtgcgtacaaaatgtaattactcccctcct

SEQ ID NO: 241470 - DNA, 75 bp, Artificial Sequence
  Synthetic
cccggtgatatcttccagataactggacagaaaatcaggcaagcaatttttaagaaaatcaacaaaagaaaagtc

SEQ ID NO: 241471 - DNA, 75 bp, Artificial Sequence
  Synthetic
gcgtccatagcttaccgagcagcagcacacaacaggcgcaagagtcagagaaaggctgagctctaacctgtccac

SEQ ID NO: 241472 - DNA, 75 bp, Artificial Sequence
  Synthetic
ctggtctccatgagctcgtgtccccgctgggtgacaaagaggctgtccgtgtccccgtagaccgactttatgggc

SEQ ID NO: 241473 - DNA, 75 bp, Artificial Sequence
  Synthetic
gtgctttttgatgcgtttcttacctctggtctccatgagctcgtgtccccgctgggtgacaaagaggctgtccgt

SEQ ID NO: 241474 - DNA, 75 bp, Artificial Sequence
  Synthetic
gtccccgtagaccgactttatgggccggtcctcgagcggggtgccgcggtcctcgtcgtagaggaaccccgccca

SEQ ID NO: 241475 - DNA, 75 bp, Artificial Sequence
  Synthetic
ctgccgtcatttccgggttcccacgctacgtcatcaaaacacgactttcaaattccgtcgaccgttaaaaacgtc

SEQ ID NO: 241476 - DNA, 75 bp, Artificial Sequence
  Synthetic
cccgcatccccaaattcaaacacctcatttgcatattaacgcgcacaaaaagtttgaggtatattattgatgatg

SEQ ID NO: 241477 - DNA, 75 bp, Artificial Sequence
  Synthetic
catcatcaataatatacctcaaactttttgtgcgcgttaatatgcaaatgaggcgtttgaatttggggagggagg

SEQ ID NO: 241478 - DNA, 75 bp, Artificial Sequence
  Synthetic
tgttggggtaggtattccctctcgaaggcgggcatgacctcggcactcaggttgtcagtttctagaaacgaggag

SEQ ID NO: 241479 - DNA, 75 bp, Artificial Sequence
  Synthetic
ggatgagctaaaatacgagtgggtggagtttgagctgcccgaaggcaacttctcggtgaccatgaccatcgacct

SEQ ID NO: 241480 - DNA, 75 bp, Artificial Sequence
  Synthetic
tggcggcgatgttgagctgcacgtactcgcgcgccacgcacttccattcggggaagacggtggtgagctcgtcgg

SEQ ID NO: 241481 - DNA, 75 bp, Artificial Sequence
  Synthetic
acgtgcgcttcctcaaacgcccaaaccggcgtcatttccgggttcccacgctacgtcaccgctcagcgactttca

SEQ ID NO: 241482 - DNA, 75 bp, Artificial Sequence
  Synthetic
agctgtttgaatttggggagggaggaaggtgattggccgagagacgggcgaccgttaggggcggggcgggtgacg

SEQ ID NO: 241483 - DNA, 75 bp, Artificial Sequence
  Synthetic
ttccaggagggcttccagatcatgtacgaggatctggaggggggcaacatccccgccctcctggatgtcgaggcc

SEQ ID NO: 241484 - DNA, 75 bp, Artificial Sequence
  Synthetic
tcgcggtccttccagtactcttcgagggggaacccgtcctgatcggcacggtaagagcccaccatgtagaactgg

SEQ ID NO: 241485 - DNA, 75 bp, Artificial Sequence
  Synthetic
ccttctccacggggagggcataagcttgcgcggccttgcgcagggaggtgtgggtgagggcgaaggtgtcgcgca

SEQ ID NO: 241486 - DNA, 75 bp, Artificial Sequence
  Synthetic
ttgcgcggccttgcgcagggaggtgtgggtgagggcgaaggtgtcgcgcaccatgaccttgaggaactggtgctt

SEQ ID NO: 241487 - DNA, 75 bp, Artificial Sequence
  Synthetic
tgggcggcgaggacgatctcgtcgaagccgttgatgttgtgcccgacgatgtagagttccacgaatcgcgggcgg

SEQ ID NO: 241488 - DNA, 75 bp, Artificial Sequence
  Synthetic
gctcgtcgtaggtgagctcggcggggtcgctgaggccgtgctgctcaagggcccagtcggcgacgtgggggttgg

SEQ ID NO: 241489 - DNA, 75 bp, Artificial Sequence
  Synthetic
ccacggccattttttcgggggtgatgcagtagaaggtgcgggggtcgccgtgccagcggtcccacttgagctgga

SEQ ID NO: 241490 - DNA, 75 bp, Artificial Sequence
  Synthetic
tgtatgaggggcagaatgactaaaatctgtgtttttctgtgtgttgcagcagcatgagcggaagcgcctcctttg

SEQ ID NO: 241491 - DNA, 75 bp, Artificial Sequence
  Synthetic
tctgtgtttttctgtgtgttgcagcagcatgagcggaagcgcctcctttgagggaggggtattcagcccttatct

SEQ ID NO: 241492 - DNA, 75 bp, Artificial Sequence
  Synthetic
agcatgagcggaagcgcctcctttgagggaggggtattcagcccttatctgacggggcgtctcccctcctgggcg

SEQ ID NO: 241493 - DNA, 75 bp, Artificial Sequence
  Synthetic
cagcgccggcaggacccggagacgcgcggccacggcggcggcagcggccatcgccagcatgtcccgcccgcggcg

SEQ ID NO: 241494 - DNA, 75 bp, Artificial Sequence
  Synthetic
tcgcaacgctgcacgggatgcacgtgctgcacgagctgtacctgggttcctttgacgaggaatttcagtgggcag

SEQ ID NO: 241495 - DNA, 75 bp, Artificial Sequence
  Synthetic
gggccgcggttgccacggtgaaaaccaaataaaaaatgaatcaataaataaacggagacggttgttgattttaac

SEQ ID NO: 241496 - DNA, 75 bp, Artificial Sequence
  Synthetic
cacggcgccgttggtggcgacgtccacggcttgcagggtcccgtgcccctggggcgccaccaccgtgccccgttt

SEQ ID NO: 241497 - DNA, 75 bp, Artificial Sequence
  Synthetic
gcttccatgtcggtcagaagcggcggcgaggacgcgcgccgggcggcaggggcggctcggggcccggaggcaggg

SEQ ID NO: 241498 - DNA, 75 bp, Artificial Sequence
  Synthetic
aaagaatttggagacgcccttgtgaccgcccaggttttccatgcactcatccatgatgatggcgatgggcccgtg

SEQ ID NO: 241499 - DNA, 75 bp, Artificial Sequence
  Synthetic
ccgcggccggcgcgctcgacggtggccgcgaggtcgttggagatgcggcccatgagctgcgagaaggcgttcatg

SEQ ID NO: 241500 - DNA, 75 bp, Artificial Sequence
  Synthetic
ccgcgaggtcgttggagatgcggcccatgagctgcgagaaggcgttcatgccggcctcgttccagacgcggctgt

SEQ ID NO: 241501 - DNA, 75 bp, Artificial Sequence
  Synthetic
cgcgcgcatgaccacctgggcgaggttgagctcgacgtggcgcgtgaagaccgcgtagttgcagaggcgctggta

SEQ ID NO: 241502 - DNA, 75 bp, Artificial Sequence
  Synthetic
gacgtcgcccagggcttccaagcgctccatggcctcgtagaagtccacggcgaagttgaaaaactgggagttgcg

SEQ ID NO: 241503 - DNA, 75 bp, Artificial Sequence
  Synthetic
gtgacggcgcgcccgtcctcgcggggccgcagcgtgaagacgccgccgcgcatttccaggtggccgggggggtcc

SEQ ID NO: 241504 - DNA, 75 bp, Artificial Sequence
  Synthetic
ccgttgggcagggagagggcgctgacgatgcatcttatcaattgccccgtagggactccgcgcaaggacctgagc

SEQ ID NO: 241505 - DNA, 75 bp, Artificial Sequence
  Synthetic
ggtctggtggccgggacgcacgagctcgtggtacttgaggcgcgagtaggcgcgcgtgtcgaagatgtagtcgtt

SEQ ID NO: 241506 - DNA, 75 bp, Artificial Sequence
  Synthetic
tcgagcatggtgcggtggtagccgtagatgtacctggacatccaggtgatgccggcggcggtggtggaggcgcgc

SEQ ID NO: 241507 - DNA, 75 bp, Artificial Sequence
  Synthetic
tgttgcgcagcggcaggaagtagttcatggtgggcacggtctggcccgtgaggcgcgcgcagtcgtggatgctct

SEQ ID NO: 241508 - DNA, 75 bp, Artificial Sequence
  Synthetic
tcgtccatctggtcagaaaagacgatctttttgttgtcgagcttggtggcgaaggagccgtagagggcgttggag

SEQ ID NO: 241509 - DNA, 75 bp, Artificial Sequence
  Synthetic
actggcactcccgtctcgacccaagcctgcaccaaccctccaggatacggaggcgggtcgtttttgcaacttttt

SEQ ID NO: 241510 - DNA, 75 bp, Artificial Sequence
  Synthetic
agaatcgccagggttgcgttgcggtgtgccccggttcgaggccggccggattccgcggctaacgagggcgtggct

SEQ ID NO: 241511 - DNA, 75 bp, Artificial Sequence
  Synthetic
ttccgcggctaacgagggcgtggctgccccgtcgtttccaagacccctagccagccgacttctccagttacggag

SEQ ID NO: 241512 - DNA, 75 bp, Artificial Sequence
  Synthetic
gccggcgcttctgcccccgccccagcagcagcagcaacttccagccacgaccgccgcggccgccgtgagcggggc

SEQ ID NO: 241513 - DNA, 75 bp, Artificial Sequence
  Synthetic
gcaacttccaaaaatccttcaacaaccacgtgcgcaccctgatcgcgcgcgaggaggtgaccctgggcctgatgc

SEQ ID NO: 241514 - DNA, 75 bp, Artificial Sequence
  Synthetic
ttgcttccccctggatgggtctggcactaacgccgcttaccaaggtgtgaaagtaaaaaatggtcaagatggtga

SEQ ID NO: 241515 - DNA, 75 bp, Artificial Sequence
  Synthetic
ctgacggcgcagctgttcctggtggtgcagcatagtcgggacaacgaggcgttcagggaggcgctgctgaatatc

SEQ ID NO: 241516 - DNA, 75 bp, Artificial Sequence
  Synthetic
ggtgagcgccagcaggcggcgcgagctgagcgaccaggagctgatgcacagcctgcagcgggccctgaccggggc

SEQ ID NO: 241517 - DNA, 75 bp, Artificial Sequence
  Synthetic
cgtacctgggctacctgattaacctgtaccgcgaggccatcggccaggcgcacgtggacgagcagacctaccagg

SEQ ID NO: 241518 - DNA, 75 bp, Artificial Sequence
  Synthetic
gtaccgcgaggccatcggccaggcgcacgtggacgagcagacctaccaggagatcacccacgtgagccgcgcgct

SEQ ID NO: 241519 - DNA, 75 bp, Artificial Sequence
  Synthetic
gaggccaccctgaacttcctgctgaccaaccggtcgcagaagatcccgccccagtacgcgctgagcaccgaggag

SEQ ID NO: 241520 - DNA, 75 bp, Artificial Sequence
  Synthetic
ggagggggccacgcccagcgccgcgctcgacatgaccgcgcgcaacatggagcccagcatgtacgcccgcaaccg

SEQ ID NO: 241521 - DNA, 75 bp, Artificial Sequence
  Synthetic
tagacgccagcggcacgacaggcagcggggactggtgtgggacgatgaggattccgccgacgacagcagcgtgtt

SEQ ID NO: 241522 - DNA, 75 bp, Artificial Sequence
  Synthetic
ttcataataaacagcacatgtttatgccaccttctctgaggctctgactttatttagaaatcgaaggggttctgc

SEQ ID NO: 241523 - DNA, 75 bp, Artificial Sequence
  Synthetic
aacccgttcgctcacctgcgtccccgtatcgggcgcctgatgtaagaatctgaaaaaataaaaaacggtactcac

SEQ ID NO: 241524 - DNA, 75 bp, Artificial Sequence
  Synthetic
caaggccatggcgaccagcgtgcgttcttctctgttgtttgtagtagtatgatgaggcgcgtgtacccggagggt

SEQ ID NO: 241525 - DNA, 75 bp, Artificial Sequence
  Synthetic
acaactacttggcggtggggcggcagaacggggtgctggagagcgacatcggcgtgaagttcgacacgcgcaact

SEQ ID NO: 241526 - DNA, 75 bp, Artificial Sequence
  Synthetic
ccgcagctaacgtggtactggcactcccgtctcgacccaagcctgctaacgaaacctccaggatacggaggcggg

SEQ ID NO: 241527 - DNA, 75 bp, Artificial Sequence
  Synthetic
cgagctggtgatgccgggcgtgtacaccaacgaggccttccaccccgacatcgtcctgctgcccggctgcggcgt

SEQ ID NO: 241528 - DNA, 75 bp, Artificial Sequence
  Synthetic
accaacgaggccttccaccccgacatcgtcctgctgcccggctgcggcgtggacttcaccgagagccgcctcagc

SEQ ID NO: 241529 - DNA, 75 bp, Artificial Sequence
  Synthetic
tagcgccgccgcggcgaccgcagccgtggccaccgcctctaccgaggtgcggggcgataattttgctagcgccgc

SEQ ID NO: 241530 - DNA, 75 bp, Artificial Sequence
  Synthetic
gtggccaccgcctctaccgaggtgcggggcgataattttgctagcgccgcggcagtggccgaggcggctgaaacc

SEQ ID NO: 241531 - DNA, 75 bp, Artificial Sequence
  Synthetic
gaaagtaagatagtgatccagccggtggagaaggacagcaagaacaggagctacaacgtgctcgcggacaagaaa

SEQ ID NO: 241532 - DNA, 75 bp, Artificial Sequence
  Synthetic
gaccctgaaagtgctgaccctgagcgacgatctgggggtgtaccgcaacgacaggatgcaccgcgcggtgagcgc

SEQ ID NO: 241533 - DNA, 75 bp, Artificial Sequence
  Synthetic
tcgacagcgtggtggccgacgcgcgccggtacgcccgcgccaagagccggcggcggcgcatcgcccggcggcacc

SEQ ID NO: 241534 - DNA, 75 bp, Artificial Sequence
  Synthetic
gatgtccaagcgcaaatacaaggaagagatgctccaggtcatcgcgcctgagatctacggccccgcggtggtgaa

SEQ ID NO: 241535 - DNA, 75 bp, Artificial Sequence
  Synthetic
agacagcagcctcaggccaaccggctctcggccatcctggaggccgtggtgccctcgcgctcgaaccccacgcac

SEQ ID NO: 241536 - DNA, 75 bp, Artificial Sequence
  Synthetic
ggaggaaagaaagccccgcaaactgaagcgggtcaaaaaggacaaaaaggaggaggaagatgacggactggtgga

SEQ ID NO: 241537 - DNA, 75 bp, Artificial Sequence
  Synthetic
caccacggtggtcttcacgcccggcgagcgttccggctccgcctccaagcgctcctacgacgaggtgtacgggga

SEQ ID NO: 241538 - DNA, 75 bp, Artificial Sequence
  Synthetic
catggaaacgcagaccgagcccgtgaagcccagcaccagcaccatggaggtgcagacggatccctggatgcccgc

SEQ ID NO: 241539 - DNA, 75 bp, Artificial Sequence
  Synthetic
agacgcaagtacggcgcggccagcctgctgatgcccaactacgcgctgcatccttccatcatccccacgccgggc

SEQ ID NO: 241540 - DNA, 75 bp, Artificial Sequence
  Synthetic
gagagtgtaccgcagcgggcgcgagcctctgaccctgccgcgcgcgcgctaccacccgagcatcgccatttaact

SEQ ID NO: 241541 - DNA, 75 bp, Artificial Sequence
  Synthetic
catcgggcggccgccatgaactcggactactttaccaacgccatcttgaacccgcactggctcccgccgcccggg

SEQ ID NO: 241542 - DNA, 75 bp, Artificial Sequence
  Synthetic
gccctcacatgccgcctccgcgtccccattacgggctaccgaggaagaaagccgcgccgtagaaggctgacgggg

SEQ ID NO: 241543 - DNA, 75 bp, Artificial Sequence
  Synthetic
acttccagcagaaggtggtcgatggcctggcctcgggcatcaacggggtggtggacctggccaaccaggccgtgc

SEQ ID NO: 241544 - DNA, 75 bp, Artificial Sequence
  Synthetic
agaaacagatcaacagccgcctggacgcggtcccgcccgcgggctccgtggagatgccccaggtggaggaggagc

SEQ ID NO: 241545 - DNA, 75 bp, Artificial Sequence
  Synthetic
cctgtacgaggacctggaggggggcaacatccccgcgctcttggatgtcgaagcctatgagaaaagcaaggagga

SEQ ID NO: 241546 - DNA, 75 bp, Artificial Sequence
  Synthetic
cgcgaccctggacttgcctcctccccagccttcccgcccctccacagtggctaagcccctgccgccggtggccgt

SEQ ID NO: 241547 - DNA, 75 bp, Artificial Sequence
  Synthetic
ggaaagaaagccccgcaaactgaagcgggtcaaaaaggacaaaaaggaggaggaagatgtggacggactggtgga

SEQ ID NO: 241548 - DNA, 75 bp, Artificial Sequence
  Synthetic
ttcaaaccctactccggcaccgcctacaacagcctggcccccaagggagcacccaacacttgtcagtggacatat

SEQ ID NO: 241549 - DNA, 75 bp, Artificial Sequence
  Synthetic
aaaaaacctatacatatggaaatgcacccgtgcagggcattaacatcacaaaagatggtattcaacttggaactg

SEQ ID NO: 241550 - DNA, 75 bp, Artificial Sequence
  Synthetic
acccgtgcagggcattaacatcacaaaagatggtattcaacttggaactgacaccgatgatcagccaatctatgc

SEQ ID NO: 241551 - DNA, 75 bp, Artificial Sequence
  Synthetic
acatcactggtactgatgaaaagtatggaggcagagctcttaagcctgataccaaaatgaagccttgttatggtt

SEQ ID NO: 241552 - DNA, 75 bp, Artificial Sequence
  Synthetic
aggaggtcaggcaaatgtgaaaacaggaacaggcactactaaagaatatgacatagacatggctttctttgacaa

SEQ ID NO: 241553 - DNA, 75 bp, Artificial Sequence
  Synthetic
ggaacaggcactactaaagaatatgacatagacatggctttctttgacaacagaagtgcggccgctgccggccta

SEQ ID NO: 241554 - DNA, 75 bp, Artificial Sequence
  Synthetic
acagatgacagcagctcttctattaatttgggccagcaagccatgcccaacagacctaactacattggcttcaga

SEQ ID NO: 241555 - DNA, 75 bp, Artificial Sequence
  Synthetic
acaacagcactggcaatatgggggtgctggccggtcaggcttctcagctgaatgctgtggttgacttgcaagaca

SEQ ID NO: 241556 - DNA, 75 bp, Artificial Sequence
  Synthetic
aacagatacttatcagggaattaaggctaatggaactgatcaaaccacatggaccaaagatgacagtgtcaatga

SEQ ID NO: 241557 - DNA, 75 bp, Artificial Sequence
  Synthetic
gctaatggaactgatcaaaccacatggaccaaagatgacagtgtcaatgatgctaatgagataggcaagggtaat

SEQ ID NO: 241558 - DNA, 75 bp, Artificial Sequence
  Synthetic
aagccaacctgtggaggaacttcctctacgccaacgtggccctgtacctgcccgattcttacaagtacacgccgg

SEQ ID NO: 241559 - DNA, 75 bp, Artificial Sequence
  Synthetic
cttcagtctggggaacaagtttaggaaccccacggtggcgcccacgcacgatgtgaccaccgaccgcagccagcg

SEQ ID NO: 241560 - DNA, 75 bp, Artificial Sequence
  Synthetic
ggcggccaacatgctctaccccatcccggccaacgccaccaacgtgcccatctccatcccctcgcgcaactgggc

SEQ ID NO: 241561 - DNA, 75 bp, Artificial Sequence
  Synthetic
caaaccctactccggcaccgcctacaacagcctggctcccaagggagcgcccaacacttgccagtggacatataa

SEQ ID NO: 241562 - DNA, 75 bp, Artificial Sequence
  Synthetic
acctatacatatggaaatgcacctgtgcaaggcattagcattacaaaggatggtattcaacttggaactgacagc

SEQ ID NO: 241563 - DNA, 75 bp, Artificial Sequence
  Synthetic
tgcaaggcattagcattacaaaggatggtattcaacttggaactgacagcgatggtcaggcaatctatgcagacg

SEQ ID NO: 241564 - DNA, 75 bp, Artificial Sequence
  Synthetic
gggtgatgctgaatggcatgacatcactggtactgatgaaaaatatggaggcagagctcttaagcctgacaccaa

SEQ ID NO: 241565 - DNA, 75 bp, Artificial Sequence
  Synthetic
actggtactgatgaaaaatatggaggcagagctcttaagcctgacaccaaaatgaagccttgctatggttctttt

SEQ ID NO: 241566 - DNA, 75 bp, Artificial Sequence
  Synthetic
gccaggcaaatgtgaaaaccgaaacaggcggtaccaaagaatatgacattgacatggcattcttcgataatcgaa

SEQ ID NO: 241567 - DNA, 75 bp, Artificial Sequence
  Synthetic
gtgcagctgccgccggcctagccccagaaattgttttgtatactgagaatgtggatctggaaactccagataccc

SEQ ID NO: 241568 - DNA, 75 bp, Artificial Sequence
  Synthetic
ctttatcggtctgatgtactacaacagcactggcaatatgggtgtactggctggacaggcctcccagctgaatgc

SEQ ID NO: 241569 - DNA, 75 bp, Artificial Sequence
  Synthetic
ttcttgcaagatgacggcctgtgcgggctccggcgagcaggagctcagggccatcctccgcgacctgggctgcgg

SEQ ID NO: 241570 - DNA, 75 bp, Artificial Sequence
  Synthetic
ggatgaacttcctaactattgcttccccctggatgctgtgggtagaactgatacttaccagggaattaaggccaa

SEQ ID NO: 241571 - DNA, 75 bp, Artificial Sequence
  Synthetic
aagcgcttcccgggattcatggccccgcacaagctggcctgcgccatcgtcaacacggccggccgcgagaccggg

SEQ ID NO: 241572 - DNA, 75 bp, Artificial Sequence
  Synthetic
ctcaacgcccactccgcctactttcgctcccaccgcgcgcgcatcgagaaggccaccgccttcgaccgcatgaat

SEQ ID NO: 241573 - DNA, 75 bp, Artificial Sequence
  Synthetic
gaggctctgactttatttagaaatcgaaggggttctgccggctctcggcgtgccccgcgggcagggatacgttgc

SEQ ID NO: 241574 - DNA, 75 bp, Artificial Sequence
  Synthetic
tgccccgcgggcagggatacgttgcggaactggtacttgggcagccacttgaactcggggatcagcagcttgggc

SEQ ID NO: 241575 - DNA, 75 bp, Artificial Sequence
  Synthetic
cacggggttgcagcactggaacaccatcagggccgggtgcttcacgctcgccagcaccgtcgcgtcggtgatgcc

SEQ ID NO: 241576 - DNA, 75 bp, Artificial Sequence
  Synthetic
gtacatggccttcatgaaagcctccagctggcggaaggcctgctgcgccttgccgccctcggtgaagaagacccc

SEQ ID NO: 241577 - DNA, 75 bp, Artificial Sequence
  Synthetic
atcgtgtgctccttctggatcatcacggtcccgtgcaggcaccgcagcttgccctcggcctcggtgcagccgtgc

SEQ ID NO: 241578 - DNA, 75 bp, Artificial Sequence
  Synthetic
cggtcccgtgcaggcaccgcagcttgccctcggcctcggtgcagccgtgcagccacagcgcgcagccggtgctct

SEQ ID NO: 241579 - DNA, 75 bp, Artificial Sequence
  Synthetic
gtgcgagtgcacgaagccctgcaggaagcggcccatcatcgtggtcagggtcttgttgctggtgaaggtcagcgg

SEQ ID NO: 241580 - DNA, 75 bp, Artificial Sequence
  Synthetic
aagcggcccatcatcgtggtcagggtcttgttgctggtgaaggtcagcgggatgccgcggtgctcctcgttcaca

SEQ ID NO: 241581 - DNA, 75 bp, Artificial Sequence
  Synthetic
cctcgccctgctcgggcatcagctggaaggcggacttcaggtcgctctccacgcggtaccggtccatcagcagcg

SEQ ID NO: 241582 - DNA, 75 bp, Artificial Sequence
  Synthetic
tcgccgccgccgaggtcagggggtcgttctcgtccagggtctcaaacactcgcttgccgtccttctcggtgatgc

SEQ ID NO: 241583 - DNA, 75 bp, Artificial Sequence
  Synthetic
ccgcgctcccacacctgctacctcttcgaccccttcgggttctcggacgagcgcctcaagcagatctaccagttc

SEQ ID NO: 241584 - DNA, 75 bp, Artificial Sequence
  Synthetic
ctttcgtcctcgctgtcctggctgatgtcttgcaaaggcacatgcttggtcttgcggggtttctttttgggcggc

SEQ ID NO: 241585 - DNA, 75 bp, Artificial Sequence
  Synthetic
ggccgccagctcctcctcggcctgcctttcgtcctcgctgtcctggctgatgtcttgcaaaggcacatgcttggt

SEQ ID NO: 241586 - DNA, 75 bp, Artificial Sequence
  Synthetic
agcgcgagttctcgctcaccacgactatttcttctccttggccgtcgtccgagaccacgcggcggtaggcatgcc

SEQ ID NO: 241587 - DNA, 75 bp, Artificial Sequence
  Synthetic
gagaccacgcggcggtaggcatgcctcttctggggcagaggcggaggcgacgggctctcgcggttcggcgggcgg

SEQ ID NO: 241588 - DNA, 75 bp, Artificial Sequence
  Synthetic
attgtgttctcctagggagcaagcatggagactcagccatcgtcgccaacatcgccatctgcccccgccgccgcc

SEQ ID NO: 241589 - DNA, 75 bp, Artificial Sequence
  Synthetic
aaagcttaaccgccccgccgcccagccccacctccgacgcggccccagacatgcaagagatggaggaatccatcg

SEQ ID NO: 241590 - DNA, 75 bp, Artificial Sequence
  Synthetic
gggctcgagcatggcgactacctgagcggggcagaggacgtgctcatcaagcatctggcccgccaatgcatcatc

SEQ ID NO: 241591 - DNA, 75 bp, Artificial Sequence
  Synthetic
tggccacctaccacctctttttcaagaaccaaaggatccccgtctcctgccgcgccaaccgcacccgcgccgacg

SEQ ID NO: 241592 - DNA, 75 bp, Artificial Sequence
  Synthetic
catgagcgccgtcatggaccaggtgctcatcaagcgcgcctcgcccctctcggaggaggagatgcaggaccccga

SEQ ID NO: 241593 - DNA, 75 bp, Artificial Sequence
  Synthetic
cggaggaggagatgcaggaccccgagagctcggacgagggcaagcccgtggtcagcgacgagcagctggcgcgct

SEQ ID NO: 241594 - DNA, 75 bp, Artificial Sequence
  Synthetic
tcttcaggcacgggttcgtgcgccaggcctgcaagatctccaacgtggagctgaccaacctggtctcctacatgg

SEQ ID NO: 241595 - DNA, 75 bp, Artificial Sequence
  Synthetic
acgctgcgcaacggtctgcccgactttatgagccaaagcatgttgcaaaactttcgctctttcatcctcgaacgc

SEQ ID NO: 241596 - DNA, 75 bp, Artificial Sequence
  Synthetic
tccgggatcctgcccgccacctgctccgcgctgccctcggacttcgtgccgctgaccttccgcgagtgccccccg

SEQ ID NO: 241597 - DNA, 75 bp, Artificial Sequence
  Synthetic
ccaaggccgagctgtcggcctgcgtcatcacccagggggccatcctggcccaattgcaagccatccagaaatccc

SEQ ID NO: 241598 - DNA, 75 bp, Artificial Sequence
  Synthetic
tcccccaggatgccccgaggaagcagcaagaagctgaaagtggagctgccgctgccgccggaggatttggaggaa

SEQ ID NO: 241599 - DNA, 75 bp, Artificial Sequence
  Synthetic
agatggaagactgggacagcactcaggcagaggaggacagcctgcaagacagtctggaggaggaagacgaggtgg

SEQ ID NO: 241600 - DNA, 75 bp, Artificial Sequence
  Synthetic
ccacagcccctactactgtttccaagaagaggcagaaacccagcagcagcagaaaaccagcagcagcagcagcag

SEQ ID NO: 241601 - DNA, 75 bp, Artificial Sequence
  Synthetic
catgggcgtgtggcagcagtgcctggaggagcagaacctgaaagagctctgcaagctcctgcagaagaacctcaa

SEQ ID NO: 241602 - DNA, 75 bp, Artificial Sequence
  Synthetic
aggacgccgaggctctcttcaacaagtactgcgcgctcactcttaaagagtagcccgcgcccgcccacacacgga

SEQ ID NO: 241603 - DNA, 75 bp, Artificial Sequence
  Synthetic
tgccgctgaccttccgcgagtgccccccgccgctctggagccactgctacctgctgcgcctggccaactacctgg

SEQ ID NO: 241604 - DNA, 75 bp, Artificial Sequence
  Synthetic
cgcagagcgccctccaccggcattcttaagcacaccctcataattccaagagattctgctcctggttcacctgca

SEQ ID NO: 241605 - DNA, 75 bp, Artificial Sequence
  Synthetic
cgagacgcccaggccgaagtccagctgactaactcaggtgtccagctggccggcggcgccgccctgtgtcgtcac

SEQ ID NO: 241606 - DNA, 75 bp, Artificial Sequence
  Synthetic
cactctccagttcgtggaggagttcactccctcggtctacttcaaccccttctccggctcccccggccactaccc

SEQ ID NO: 241607 - DNA, 75 bp, Artificial Sequence
  Synthetic
aagcagccgccgccagaccgtcgtcctcggcggaggaggagaaagcaagcagcacggataccatctccgctccgg

SEQ ID NO: 241608 - DNA, 75 bp, Artificial Sequence
  Synthetic
accaggcaggctacggggtctccggcgcgaccctcgtagaagctgtcgccatgattgaaaagcatcaccgaaaga

SEQ ID NO: 241609 - DNA, 75 bp, Artificial Sequence
  Synthetic
accatcatcatgagcaaagagattcccacgccttacatgtggagctaccagccccagatgggcctggccgccggc

SEQ ID NO: 241610 - DNA, 75 bp, Artificial Sequence
  Synthetic
taacggtcgccctcctctcggccaatcacagccccgcatccccaaattcaaacgcctcatttgcatattaacgcg

SEQ ID NO: 241611 - DNA, 75 bp, Artificial Sequence
  Synthetic
caccggaggtgagctccgaggtcgaccaacctctgggatttactacggcccctgggaggtggtggggttaatagc

SEQ ID NO: 241612 - DNA, 75 bp, Artificial Sequence
  Synthetic
ggaggagttcactccctcggtctacttcaaccccttctccggctcccccggccactacccggacgagttcatccc

SEQ ID NO: 241613 - DNA, 75 bp, Artificial Sequence
  Synthetic
tgccagctgagttttcagcccgatggcaatcggtgcacggtgctgatcaagtgcggatgggaatgcgagaacgtg

SEQ ID NO: 241614 - DNA, 75 bp, Artificial Sequence
  Synthetic
gcaatcggtgcacggtgctgatcaagtgcggatgggaatgcgagaacgtgagaatcgagtacaataacaagactc

SEQ ID NO: 241615 - DNA, 75 bp, Artificial Sequence
  Synthetic
gcagcccggggaccccgagtggtacaccgtctctgtccccggtgctgacggctccccgcgcaccgtgaataatac

SEQ ID NO: 241616 - DNA, 75 bp, Artificial Sequence
  Synthetic
tttcatttttgcacacatgtgcgacacggtcatgtggatgagcaagcagtacgatatgtggccccccacgaagga

SEQ ID NO: 241617 - DNA, 75 bp, Artificial Sequence
  Synthetic
aataatgccgagaaagagaaacagccataacacgtttttttacacacctttttcagaccatggcctctgttactg

SEQ ID NO: 241618 - DNA, 75 bp, Artificial Sequence
  Synthetic
gggcactagcagcacttttgatcataaaaacttaactgtttttgttggttctgatgttacactacccgggcatca

SEQ ID NO: 241619 - DNA, 75 bp, Artificial Sequence
  Synthetic
aaaaacttaactgtttttgttggttctgatgttacactacccgggcatcaatcgcaccagagggtttcatggtat

SEQ ID NO: 241620 - DNA, 75 bp, Artificial Sequence
  Synthetic
atacactttgcaaaggtcatcagcaagccacatatcgcagtggtctttattacagatgcaataacaataacctca

SEQ ID NO: 241621 - DNA, 75 bp, Artificial Sequence
  Synthetic
agccacatatcgcagtggtctttattacagatgcaataacaataacctcacactactctcagttaatgcaaatta

SEQ ID NO: 241622 - DNA, 75 bp, Artificial Sequence
  Synthetic
gatcaagcataatatgatctgtggagcctcggacgagcgcggctaccagatgctgacctgcgccggtgggaacag

SEQ ID NO: 241623 - DNA, 75 bp, Artificial Sequence
  Synthetic
tttaacacaaaacaggacacttactatagtgtcaaagtattgaatccaacctctcctagaactaccactaagcct

SEQ ID NO: 241624 - DNA, 75 bp, Artificial Sequence
  Synthetic
atagtgtcaaagtattgaatccaacctctcctagaactaccactaagcctaccgctaccaccactactactgcaa

SEQ ID NO: 241625 - DNA, 75 bp, Artificial Sequence
  Synthetic
gaaaaccactgtgaagactacaacaactagaaccaccacaactacagagaccaccaccagcacacttgctgccac

SEQ ID NO: 241626 - DNA, 75 bp, Artificial Sequence
  Synthetic
actagaaccaccacaactacagagaccaccaccagcacacttgctgccactacacacacacacattgagctaacc

SEQ ID NO: 241627 - DNA, 75 bp, Artificial Sequence
  Synthetic
aaatccatgattggcattattgttgctgtagtggtgtgcatgttgatcatcgccttgtgcatggtgtactatgcc

SEQ ID NO: 241628 - DNA, 75 bp, Artificial Sequence
  Synthetic
tgttgaattttaattttttagaaccatgaagatcctaggccttttagttttttctatcattacctctgctctttg

SEQ ID NO: 241629 - DNA, 75 bp, Artificial Sequence
  Synthetic
tggacgcagctgccgccgcagctgctgcatctgccgccagcgccgtgcgcggaatggccatgggcgccggctact

SEQ ID NO: 241630 - DNA, 75 bp, Artificial Sequence
  Synthetic
gactctgaacaaactgagctttgcaatgcaatgagaggccaaatgccaacctcaaaaattaaacataaatgcaat

SEQ ID NO: 241631 - DNA, 75 bp, Artificial Sequence
  Synthetic
tcacgaaagcatatgctggcagttacacctgccctggagatgatgctgacagtatgattttttacaaagtaactg

SEQ ID NO: 241632 - DNA, 75 bp, Artificial Sequence
  Synthetic
ttgttgatcccactactccaccacccaccaccacaactactcataccacacacacagaacaaacaccagaggcag

SEQ ID NO: 241633 - DNA, 75 bp, Artificial Sequence
  Synthetic
atcatctgcatgttcatttttgcttgctgctatagaaggctttaccgacaaaaatcagacccactgctgaacctc

SEQ ID NO: 241634 - DNA, 75 bp, Artificial Sequence
  Synthetic
gaaggcagttagagttctagttttttgttctttgattggcattgtttttagtgctgggtttttgaaaaatcttac

SEQ ID NO: 241635 - DNA, 75 bp, Artificial Sequence
  Synthetic
gtggtgttgcacaatatctttgaggaggagactgatggccacgggcagccctttggtgtaggtgtttacaaatct

SEQ ID NO: 241636 - DNA, 75 bp, Artificial Sequence
  Synthetic
ctagtgggcatcagtggtcaaaatgtcagctggctaaaataccatctagataggtggaaagacatttgcgattgg

SEQ ID NO: 241637 - DNA, 75 bp, Artificial Sequence
  Synthetic
tcagctggctaaaataccatctagataggtggaaagacatttgcgattggaatgtcactgtgtatacatgtaatg

SEQ ID NO: 241638 - DNA, 75 bp, Artificial Sequence
  Synthetic
cacccaagatcaaaatggtaggtttaagggtcagagtttcactagaaataatgggtatgaatcccataacatgtt

SEQ ID NO: 241639 - DNA, 75 bp, Artificial Sequence
  Synthetic
aagggtcagagtttcactagaaataatgggtatgaatcccataacatgtttatctatgacgtcactgtcatcaga

SEQ ID NO: 241640 - DNA, 75 bp, Artificial Sequence
  Synthetic
gtcctgggtgagatcatcataggccattttaatgaatttggggcggagggtgcccgattgggggacaaaggtacc

SEQ ID NO: 241641 - DNA, 75 bp, Artificial Sequence
  Synthetic
attttaatgaatttggggcggagggtgcccgattgggggacaaaggtaccctcgatcccgggggcgtagttcccc

SEQ ID NO: 241642 - DNA, 75 bp, Artificial Sequence
  Synthetic
caaattatacactaaaaggtccagcaaaaggtatgctttcgtggtattgttggttcggaactgacgagcaacaga

SEQ ID NO: 241643 - DNA, 75 bp, Artificial Sequence
  Synthetic
ctactgaatttttgtccactgtcgagagccacaccacagctacctcgagtgccttctctagcaccgccaatctct

SEQ ID NO: 241644 - DNA, 75 bp, Artificial Sequence
  Synthetic
caaaacctcaaattctaaaatctctaattatcaatgcaatggcactgacttagtattgctcaatgtcacgaaagc

SEQ ID NO: 241645 - DNA, 75 bp, Artificial Sequence
  Synthetic
aattatcaatgcaatggcactgacttagtattgctcaatgtcacgaaagcatatgctggcagttacacctgccct

SEQ ID NO: 241646 - DNA, 75 bp, Artificial Sequence
  Synthetic
cagaactttgcaatgctcaaaaaggcaaaacctcaaattctaaaatctctaattatcaatgcaatggcactgact

SEQ ID NO: 241647 - DNA, 75 bp, Artificial Sequence
  Synthetic
gccttctctagcaccgccaatctctcctcgctttcctctacaccaatcagttccgctactactactcctagcccc

SEQ ID NO: 241648 - DNA, 75 bp, Artificial Sequence
  Synthetic
gcagatcaccctgctcattgtgatcgggttggtcatcctggccgtgttgctctactacatcttctgccgccgcat

SEQ ID NO: 241649 - DNA, 75 bp, Artificial Sequence
  Synthetic
tgttgcaagagttccaagcggtcccagagctcggtgatgtgctctacggcatctcgatccagcagacctcctcgt

SEQ ID NO: 241650 - DNA, 75 bp, Artificial Sequence
  Synthetic
cctcctacgtgctctttgccttcatcacctgcatctgctgctgtagcatagtctgcctgcttatcaccttcttcc

SEQ ID NO: 241651 - DNA, 75 bp, Artificial Sequence
  Synthetic
catcgcctacctgcgccaccacccccagtaccgcgaccagcgagtggcgcgactgctcaggctcctctgataagc

SEQ ID NO: 241652 - DNA, 75 bp, Artificial Sequence
  Synthetic
ttctgctgttagtgctcccccgtcccgtcgacccccggtcccccactcagtcccccgaggaggtccgcaaatgca

SEQ ID NO: 241653 - DNA, 75 bp, Artificial Sequence
  Synthetic
cgtcgacccccggtcccccactcagtcccccgaggaggtccgcaaatgcaaattccaagaaccctggaaattcct

SEQ ID NO: 241654 - DNA, 75 bp, Artificial Sequence
  Synthetic
atgcatcccagctggatcatgatcattgggatcgtgaacattctggcctgcaccctcatctcctttgtgatttac

SEQ ID NO: 241655 - DNA, 75 bp, Artificial Sequence
  Synthetic
ccctgctttgactttggttggaactcgccagaggcgctctatctcccgcctgaacctgacacaccaccacagcag

SEQ ID NO: 241656 - DNA, 75 bp, Artificial Sequence
  Synthetic
caccacagcctaggccacaatacatgcccatattagactatgaggccgagccacagcgacccatgctccccgcta

SEQ ID NO: 241657 - DNA, 75 bp, Artificial Sequence
  Synthetic
ccacagcgacccatgctccccgctattagttacttcaatctaaccggcggagatgactgacccactggccaacaa

SEQ ID NO: 241658 - DNA, 75 bp, Artificial Sequence
  Synthetic
atggacggccgcgcctcggagcagcgactcgcccaacttcgcattcgccagcagcaggagagagccgtcaaggag

SEQ ID NO: 241659 - DNA, 75 bp, Artificial Sequence
  Synthetic
gacagcggcatgcaatggcagatcaccctgctcattgtgatcgggttggtcatcctggccgtgttgctctactac

SEQ ID NO: 241660 - DNA, 75 bp, Artificial Sequence
  Synthetic
ctgcaggacggcatagccatccaccagtgcaagaaaggcatcttctgcctggtgaaacaggccaagatctcctac

SEQ ID NO: 241661 - DNA, 75 bp, Artificial Sequence
  Synthetic
tgcgtccacactctgatcaagaccctctgcggcctccgcgacctcctccccatgaactaatcacccccttatcca

SEQ ID NO: 241662 - DNA, 75 bp, Artificial Sequence
  Synthetic
catgaactaatcacccccttatccagtgaaataaagatcatattgatgatgatttaaataaaaaataatcatttg

SEQ ID NO: 241663 - DNA, 75 bp, Artificial Sequence
  Synthetic
gtgaaataaagatcatattgatgatgatttaaataaaaaataatcatttgatttgaaaataaagatacaatcata

SEQ ID NO: 241664 - DNA, 75 bp, Artificial Sequence
  Synthetic
ctgaaggggatgtcaaattcctcctgtccctcaatcttcattttatcttctatcagatgtccaaaaagcgcgtcc

SEQ ID NO: 241665 - DNA, 75 bp, Artificial Sequence
  Synthetic
agatgccgggcaggagctcggggtcgaagtagctgatgcaggtgcccagatcgtccagacttgcttgccagtcgc

SEQ ID NO: 241666 - DNA, 75 bp, Artificial Sequence
  Synthetic
gctgggggagggggtggacctcgacgactcgggaaaactcatctccaaaaatgccaccaaggccactgcccctct

SEQ ID NO: 241667 - DNA, 75 bp, Artificial Sequence
  Synthetic
cttaacatggctgcccctttttacaacaacaatggaacgttaagtctcaatgtttctacaccattagcagtattt

SEQ ID NO: 241668 - DNA, 75 bp, Artificial Sequence
  Synthetic
acaacaatggaacgttaagtctcaatgtttctacaccattagcagtatttcccacttttaacactttaggtatca

SEQ ID NO: 241669 - DNA, 75 bp, Artificial Sequence
  Synthetic
taataagttgctgactgtacagttaactcatcctcttacattcagctcaaatagcatcacagtaaaaacagacaa

SEQ ID NO: 241670 - DNA, 75 bp, Artificial Sequence
  Synthetic
actcatcctcttacattcagctcaaatagcatcacagtaaaaacagacaaaggactctatattaattctagtgga

SEQ ID NO: 241671 - DNA, 75 bp, Artificial Sequence
  Synthetic
gcctaaaaagaggactgatttttgatggtaatgctattgcaacataccttggaagtggtttagactatggatcct

SEQ ID NO: 241672 - DNA, 75 bp, Artificial Sequence
  Synthetic
catcatcaccaaaattggagcaggtttgaattttgatgctaataaagccatggctgtgaagctaggcacaggttt

SEQ ID NO: 241673 - DNA, 75 bp, Artificial Sequence
  Synthetic
ttgaattttgatgctaataaagccatggctgtgaagctaggcacaggtttaagttttgactctgccggtgcctta

SEQ ID NO: 241674 - DNA, 75 bp, Artificial Sequence
  Synthetic
cacccccttatccagtgaaataaatatcatattgatgatgatttaaataaaaaataatcatttgatttgaaataa

SEQ ID NO: 241675 - DNA, 75 bp, Artificial Sequence
  Synthetic
ccccagccctaattgtcaattactttcagacagagatgccaaatttaccctatgtcttacaaaatgcggtagtca

SEQ ID NO: 241676 - DNA, 75 bp, Artificial Sequence
  Synthetic
gctgttactgtaggttcagcactaaatccaattaatgacacagtaaaaagcgccatagtattccttagatttgat

SEQ ID NO: 241677 - DNA, 75 bp, Artificial Sequence
  Synthetic
atccaattaatgacacagtaaaaagcgccatagtattccttagatttgattccaatggtgtgctcatgtcaaact

SEQ ID NO: 241678 - DNA, 75 bp, Artificial Sequence
  Synthetic
ctttagggaaggacagaccacccaaagtgtggcctatacaaatgctgtgggatttatgcccaatctaggtgcata

SEQ ID NO: 241679 - DNA, 75 bp, Artificial Sequence
  Synthetic
aaaaatagtatagttagtcaggtatatttaaatggagaaaccactatgccaatgacactaacaataactttcaat

SEQ ID NO: 241680 - DNA, 75 bp, Artificial Sequence
  Synthetic
atttaaatggagaaaccactatgccaatgacactaacaataactttcaatggcactgatgaaaaagatacaacac

SEQ ID NO: 241681 - DNA, 75 bp, Artificial Sequence
  Synthetic
gcggtcccggtactgacggaactgctggcccacggccattttttcgggggtgacgcagtagaaggtgcgggggtc

SEQ ID NO: 241682 - DNA, 75 bp, Artificial Sequence
  Synthetic
tacatggcagtggactggagactataaggacaagaatattacctttgctaccaactcattctctttctcctacat

SEQ ID NO: 241683 - DNA, 75 bp, Artificial Sequence
  Synthetic
cgccgcccctctcagtttttccaacaacaccatttcccttaacatggatacccctctttataccaaagatggaaa

SEQ ID NO: 241684 - DNA, 75 bp, Artificial Sequence
  Synthetic
ccaactcattctctttctcctacatggcccaagaataaaccctgcatgccaaccccatccccaccgctctatgga

SEQ ID NO: 241685 - DNA, 75 bp, Artificial Sequence
  Synthetic
ttaaacatattaaaatcaaccattctgaacacattagctgtagcttatggatcaggtttaggactgagtggtggc

SEQ ID NO: 241686 - DNA, 75 bp, Artificial Sequence
  Synthetic
tgaacacattagctgtagcttatggatcaggtttaggactgagtggtggcactgctcttgcagtacagttggcct

SEQ ID NO: 241687 - DNA, 75 bp, Artificial Sequence
  Synthetic
aaatattaaaattaacctagccagtggtccattaacagttgatgcaagtcgacttagtatcaactgcaaaagagg

SEQ ID NO: 241688 - DNA, 75 bp, Artificial Sequence
  Synthetic
ggtccattaacagttgatgcaagtcgacttagtatcaactgcaaaagaggggtcactgtcactacctcaggagat

SEQ ID NO: 241689 - DNA, 75 bp, Artificial Sequence
  Synthetic
ctaaaggtataagatttgaaggtaatggcatagctgcaaacattggcagaggattggaatttggaaccactagta

SEQ ID NO: 241690 - DNA, 75 bp, Artificial Sequence
  Synthetic
tggcatagctgcaaacattggcagaggattggaatttggaaccactagtacagagactgatgtcacagatgcata

SEQ ID NO: 241691 - DNA, 75 bp, Artificial Sequence
  Synthetic
attgtcctcggtggtcgggatcacggttatctggaagaagcagaagagcggcggtgggaatcatagtccgcgaac

SEQ ID NO: 241692 - DNA, 75 bp, Artificial Sequence
  Synthetic
ggccttacctttgacagtacaggcgccattgttgcttggaacaaagaggatgataaacttacattatggaccaca

SEQ ID NO: 241693 - DNA, 75 bp, Artificial Sequence
  Synthetic
ggccccgcagcagtcgctgccgccgccgctccgtcaagctgctgctcagggggtccgggtccagtgactccctca

SEQ ID NO: 241694 - DNA, 75 bp, Artificial Sequence
  Synthetic
ccattgttgcttggaacaaagaggatgataaacttacattatggaccacagccgacccctcgccaaattgcaaaa

SEQ ID NO: 241695 - DNA, 75 bp, Artificial Sequence
  Synthetic
gggtccgggtccagtgactccctcagcatgatgcccacggccctcagcatcagtcgtctggtgcggcgggcgcag

SEQ ID NO: 241696 - DNA, 75 bp, Artificial Sequence
  Synthetic
cacactttgcttgacaaagtgtggaagtcaaattctgggtactgtgactgtattggcagtgaataatggaagtct

SEQ ID NO: 241697 - DNA, 75 bp, Artificial Sequence
  Synthetic
agtcaaattctgggtactgtgactgtattggcagtgaataatggaagtctcaacccaatcacaaacacagtaagc

SEQ ID NO: 241698 - DNA, 75 bp, Artificial Sequence
  Synthetic
cactgcagtacgtgcaacacaggaccaccaggttgttcaacagtccatagttcaacacgctccagccgaaactca

SEQ ID NO: 241699 - DNA, 75 bp, Artificial Sequence
  Synthetic
ttcaacacgctccagccgaaactcatcgcgggaaggatgctacccacgtggccgtcgtaccagatcctcaggtaa

SEQ ID NO: 241700 - DNA, 75 bp, Artificial Sequence
  Synthetic
atgcaagtggagttttgctaagcagctccacattagacaaagaatattggaacttcagaaagggagatgttacac

SEQ ID NO: 241701 - DNA, 75 bp, Artificial Sequence
  Synthetic
ctccacattagacaaagaatattggaacttcagaaagggagatgttacacctgctgagccctatactaatgctat

SEQ ID NO: 241702 - DNA, 75 bp, Artificial Sequence
  Synthetic
cgctgcccatgtacatgatctccttgggcatgtggcggttcaccacctcccggtaccacatcaccctctggttga

SEQ ID NO: 241703 - DNA, 75 bp, Artificial Sequence
  Synthetic
tatcctaaaaacacatctgcagcttcaaaaagccatattgtcagtcaagtttatctcaatggggatgaggccaaa

SEQ ID NO: 241704 - DNA, 75 bp, Artificial Sequence
  Synthetic
acatgcagccccggatgatcctgcggaaccacagggccagcaccgccccgcccgccatgcagcgaagagaccccg

SEQ ID NO: 241705 - DNA, 75 bp, Artificial Sequence
  Synthetic
cgccgcgcgcgggcaggttctggtactgcgcccggagaagactggcgtgagcgacgacgcgacggttgacgtcct

SEQ ID NO: 241706 - DNA, 75 bp, Artificial Sequence
  Synthetic
caaaaagccatattgtcagtcaagtttatctcaatggggatgaggccaaaccactgatgctgattattactttta

SEQ ID NO: 241707 - DNA, 75 bp, Artificial Sequence
  Synthetic
ccaccgctcgtacccgtggatcatctgggagctgaacaagtctatgttggcacagcacaggcacacgctcatgca

SEQ ID NO: 241708 - DNA, 75 bp, Artificial Sequence
  Synthetic
ctacagtatcacttttcaatggaaatgggatagtactaagtacacaggtgaaacacttgctaccagctccttcac

SEQ ID NO: 241709 - DNA, 75 bp, Artificial Sequence
  Synthetic
tgggatagtactaagtacacaggtgaaacacttgctaccagctccttcaccttctcctacatcgcccaagaatga

SEQ ID NO: 241710 - DNA, 75 bp, Artificial Sequence
  Synthetic
tctcttcagcactctcagctcctcgggggtcaaaaccatatcccagggcacggggaactcttgcaggacagcgaa

SEQ ID NO: 241711 - DNA, 75 bp, Artificial Sequence
  Synthetic
acccttcccaccccactctgtctatggaaaaaactctgaagcacaaaataaaataaagttcaagtgttttattga

SEQ ID NO: 241712 - DNA, 75 bp, Artificial Sequence
  Synthetic
gtgatcctccaccagagaagcgcgggtctcggtctcctcacagcgtggtaagggggccggccgatacgggtgatg

SEQ ID NO: 241713 - DNA, 75 bp, Artificial Sequence
  Synthetic
gaccgtgtcatgatgcagttgctttcggacattttcgtacttgctgtagcagaacctggtccgggcgctgcacac

SEQ ID NO: 241714 - DNA, 75 bp, Artificial Sequence
  Synthetic
cggacattttcgtacttgctgtagcagaacctggtccgggcgctgcacaccgatcgccggcggcggtctcggcgc

SEQ ID NO: 241715 - DNA, 75 bp, Artificial Sequence
  Synthetic
cgatgctgctggtgatgaagttgaaataggcggttctgagacggcggatggtggcgaggagcaccaggtccttgg

SEQ ID NO: 241716 - DNA, 75 bp, Artificial Sequence
  Synthetic
atctctgccgcgatccctaagctcctccctcagcaataactgtaagtactctttcatatcctctccgaaattttt

SEQ ID NO: 241717 - DNA, 75 bp, Artificial Sequence
  Synthetic
cacctcctcctcgcccgcgcggccgtgcatgcgcgtgagcccgaacccgcgctgcggctggacgagcgccaggtc

SEQ ID NO: 241718 - DNA, 75 bp, Artificial Sequence
  Synthetic
tgctagcctggcgaacaggtgggtaaatcgttctctccagcaccaggcaggccacggggtctccggcgcgaccct

SEQ ID NO: 241719 - DNA, 75 bp, Artificial Sequence
  Synthetic
aatcgttctctccagcaccaggcaggccacggggtctccggcgcgaccctcgtaaaaattgtcgctatgattgaa

SEQ ID NO: 241720 - DNA, 75 bp, Artificial Sequence
  Synthetic
tggccggcgtgaatgattcgacaagatgaatacacccccggaacattggcgtccgcgagtgaaaaaaagcgccca

SEQ ID NO: 241721 - DNA, 75 bp, Artificial Sequence
  Synthetic
gagcagcagcacacaacaggcgcaagagtcagagaaaggctgagctctaacctgtccacccgctctctgctcaat

SEQ ID NO: 241722 - DNA, 75 bp, Artificial Sequence
  Synthetic
aaaggccaaagtctaaaaatacccgccaaatagtcacacacgcccagcacacgcccagaaaccggtgacacactc

SEQ ID NO: 241723 - DNA, 75 bp, Artificial Sequence
  Synthetic
cgcccaaactgtcgtcatttccgggttcccacgctacgtcatcagaattcgactttcaaattccgtcgaccgtta

SEQ ID NO: 241724 - DNA, 75 bp, Artificial Sequence
  Synthetic
ttcccacgctacgtcatcagaattcgactttcaaattccgtcgaccgttaaacacgtcacccgccccgcccctaa

SEQ ID NO: 241725 - DNA, 75 bp, Artificial Sequence
  Synthetic
cccgcatccccaaattcaaacgcctcatttgcatattaacgcgcaccaaaagtttgaggtatattattgatgatg

SEQ ID NO: 241726 - DNA, 75 bp, Artificial Sequence
  Synthetic
catcatcaaataatatacctcaaactttttgtgcgcgttaatatgcaaatgaggcgtttgaatttggggagggag

SEQ ID NO: 241727 - DNA, 75 bp, Artificial Sequence
  Synthetic
tttgccagatgcatcccgtactgcggcagatgcgcccccaccctccaccacaaccgcccctaccgccgcagcagc

SEQ ID NO: 241728 - DNA, 75 bp, Artificial Sequence
  Synthetic
tttttgtgcgcgttaatatgcaaatgaggcgtttgaatttggggagggaggaaggtgattggctgcgacgaaggc

SEQ ID NO: 241729 - DNA, 75 bp, Artificial Sequence
  Synthetic
gaccgttaggggcggggcgggtgacgttttgatgacgtggccatgaggcggagccggtttgcaagttctcgtggg

SEQ ID NO: 241730 - DNA, 75 bp, Artificial Sequence
  Synthetic
tgcacgtttagagcctcgggaacaacgatgaagtaaatgcaagcggtgcgttccagcatggttagttagctgatc

SEQ ID NO: 241731 - DNA, 75 bp, Artificial Sequence
  Synthetic
gtcaagaggccactcttgagtgccagcgagtagagttttctcctccgcgccgcgagtcagatctacactttgaaa

SEQ ID NO: 241732 - DNA, 75 bp, Artificial Sequence
  Synthetic
tggtgcaggagcgcgggctgccgctgtccgagaagctggcggccatcaacttctcggtgctgagtctgggcaagt

SEQ ID NO: 241733 - DNA, 75 bp, Artificial Sequence
  Synthetic
caatcaccttcctccctccccaaattcaaacagctcatttgcatattaacgcgcaccaaaagtttgaggtatatt

SEQ ID NO: 241734 - DNA, 75 bp, Artificial Sequence
  Synthetic
ctatctatataatataccttattttttttgtgtgagttaatatgcaaataaggcgtgaaaatttggggatggggc

SEQ ID NO: 241735 - DNA, 75 bp, Artificial Sequence
  Synthetic
tacaaccattgtgtttacagtaagtgtgattaactttagttgggaaaggcagagggtgactgggtgctgactggt

SEQ ID NO: 241736 - DNA, 75 bp, Artificial Sequence
  Synthetic
gcgctggtggagaacaaggccatccgcggcgacgaggccggcctggtgtacaacgcgctgctggagcgcgtggcc

SEQ ID NO: 241737 - DNA, 75 bp, Artificial Sequence
  Synthetic
agcatgtacgccagcaaccgcccgttcatcaataaactgatggactacttgcatcgggcggccgccatgaactcg

SEQ ID NO: 241738 - DNA, 75 bp, Artificial Sequence
  Synthetic
gccggggcagcgccgcccgtaaacgccggtggcacgacaggcagcggggactgatgtgggacgatgaggattccg

SEQ ID NO: 241739 - DNA, 75 bp, Artificial Sequence
  Synthetic
catctgggatttattacggtccctgggaggtggtggggttaatagctttaggcttagtagcgggtgggcttttgg

SEQ ID NO: 241740 - DNA, 75 bp, Artificial Sequence
  Synthetic
gcatgaggggcagaatgactaaaatctgtgtttttctgtgcagcagcatgagcggaagcgcctcctttgagggag

SEQ ID NO: 241741 - DNA, 75 bp, Artificial Sequence
  Synthetic
accctgagctcctcgtccgtggacgcagctgccgccgcagctgctgcttccgccgccagcgccgtgcgcggaatg

SEQ ID NO: 241742 - DNA, 75 bp, Artificial Sequence
  Synthetic
ccggctgcggggtggacttcaccgagagccgcctcagcaacctgctgggcattcgcaagaggcagccattccagg

SEQ ID NO: 241743 - DNA, 75 bp, Artificial Sequence
  Synthetic
tctggaggggggcaacatccccgcactcctggatgtcgacgcctatgagaaaagcaaggaggaagcagcagctga

SEQ ID NO: 241744 - DNA, 75 bp, Artificial Sequence
  Synthetic
tgctgtgacctcacaggcaactactgaaaacgaattggttgccctgttgcagaatggggagaataatagcagcag

SEQ ID NO: 241745 - DNA, 75 bp, Artificial Sequence
  Synthetic
gaacctctatgtttaatttttgattttccagagccatgaaggcacttagcactttagtttttttgtccttgattg

SEQ ID NO: 241746 - DNA, 75 bp, Artificial Sequence
  Synthetic
tcggtgatgtgctctacggcatctcgatccagcagacctcctcgtttcgcgggttgggacgactgcgggagtagg

SEQ ID NO: 241747 - DNA, 75 bp, Artificial Sequence
  Synthetic
aatgcaacctcagctcaaaatggtagaattcaagggcaaagtgttagtgattctgaggggtattatacccaacat

SEQ ID NO: 241748 - DNA, 75 bp, Artificial Sequence
  Synthetic
ctgctctacttcatcttctgccgccgcatccccaacgcgaaaccggtctacaagcccatcgttatcgggcagccg

SEQ ID NO: 241749 - DNA, 75 bp, Artificial Sequence
  Synthetic
ggtgtccatcccgctggaccacggcaaccccacgccgagcctcaagcccgtgaccctgcagcaggtgctgccgag

SEQ ID NO: 241750 - DNA, 75 bp, Artificial Sequence
  Synthetic
ccacggagcccatggaaacgcagaccgagcccatgatcaagcccagtaccagcaccatggaggtgcagacggatc

SEQ ID NO: 241751 - DNA, 75 bp, Artificial Sequence
  Synthetic
ccccacgccgggctaccgcggcacgcgcttctaccgcggtcatacaaccagctcccgccgccgcaagaccaccac

SEQ ID NO: 241752 - DNA, 75 bp, Artificial Sequence
  Synthetic
ccgccgccgtcgtcgcagccgccgcagcagcaccgcgacttccgccgccgccctggtgcggagagtgtaccgcag

SEQ ID NO: 241753 - DNA, 75 bp, Artificial Sequence
  Synthetic
ctccgcgtccccattacgggctaccgaggaagaaagccgcgccgtagaaggctggcggggaacgggatgcgtcgc

SEQ ID NO: 241754 - DNA, 75 bp, Artificial Sequence
  Synthetic
tggagcagtctctggagcgggcttaagaatttcgggtccacgcttaaaacctatggcagcaaggcgtggaacagc

SEQ ID NO: 241755 - DNA, 75 bp, Artificial Sequence
  Synthetic
acccctttatacaccaaagatggaaaactatccttacaagtttctccaccattaagtatattaaaatcaacaatt

SEQ ID NO: 241756 - DNA, 75 bp, Artificial Sequence
  Synthetic
gcacctactttgacatccgcggcgtgctggaccggggccctagcttcaaaccctactccggcaccgcctacaaca

SEQ ID NO: 241757 - DNA, 75 bp, Artificial Sequence
  Synthetic
gctggaccggggccctagcttcaaaccctactccggcaccgcctacaacagcctggctcccaagggagcgcccaa

SEQ ID NO: 241758 - DNA, 75 bp, Artificial Sequence
  Synthetic
ccctactccggcaccgcctacaacagcctggctcccaagggagcgcccaattccagccagtgggagcaaaaaaag

SEQ ID NO: 241759 - DNA, 75 bp, Artificial Sequence
  Synthetic
cggagaatgtcacttatggtgtagctgccatgggaggaattgacatcgataaaaatggccttcaaattggaaccg

SEQ ID NO: 241760 - DNA, 75 bp, Artificial Sequence
  Synthetic
atgacaccaaagataacgataatgacatttatgcagacaaaacatatcagcctgagccgcaaataggagaggaaa

SEQ ID NO: 241761 - DNA, 75 bp, Artificial Sequence
  Synthetic
tggaggtagagctcttaaaaaagataccaaaatgaagccatgctatggctcatttgccagacctaccaatgtgaa

SEQ ID NO: 241762 - DNA, 75 bp, Artificial Sequence
  Synthetic
accaaaatgaagccatgctatggctcatttgccagacctaccaatgtgaaaggaggacaggcaaaaataaaaaca

SEQ ID NO: 241763 - DNA, 75 bp, Artificial Sequence
  Synthetic
tagacctagccttctttgatattcccaattctggcgcgggaaatggcacaaatgttaacaattatccagatatgg

SEQ ID NO: 241764 - DNA, 75 bp, Artificial Sequence
  Synthetic
caattctggcgcgggaaatggcacaaatgttaacaattatccagatatggttatgtatacagaaaatgtaaatct

SEQ ID NO: 241765 - DNA, 75 bp, Artificial Sequence
  Synthetic
tacaaaccaggaacttcagatgacagctcaaaggtcaacttgtgtcagcaatccatgcctaacagacccaattat

SEQ ID NO: 241766 - DNA, 75 bp, Artificial Sequence
  Synthetic
ggcttatgtactacaacagcactggcaatatgggtgtgctggctggtcaggcctctcaactgaatgccgtggtgg

SEQ ID NO: 241767 - DNA, 75 bp, Artificial Sequence
  Synthetic
tggagcaggcaccaattcggtttaccaaggtgttaaaccaaaaactgacaatggcaacgatcagtgggaaacaga

SEQ ID NO: 241768 - DNA, 75 bp, Artificial Sequence
  Synthetic
caaggtgttaaaccaaaaactgacaatggcaacgatcagtgggaaacagattccacagtttcaagtcacaatcag

SEQ ID NO: 241769 - DNA, 75 bp, Artificial Sequence
  Synthetic
gtggccctgtacctgcccgattcttacaagtacacgccggccaacatcaccctgcccaccaacaccaacacctac

SEQ ID NO: 241770 - DNA, 75 bp, Artificial Sequence
  Synthetic
cctcccggtaccacatcacccgctggttgaacatgcagccctggataattctgcggaaccagatggcaagtaccg

SEQ ID NO: 241771 - DNA, 75 bp, Artificial Sequence
  Synthetic
cttcttcctcctccactaacatctcttctacttcctcctcaggcggcagtggtggcgggggagggggcctgcgtc

SEQ ID NO: 241772 - DNA, 75 bp, Artificial Sequence
  Synthetic
gccggcggcgcacgggcagacggtcgatgaagcgctcgatggtctcgccgcgccggcgtcgcatggtctcggtga

SEQ ID NO: 241773 - DNA, 75 bp, Artificial Sequence
  Synthetic
cgccggcgtcgcatggtctcggtgacggcgcgcccgtcctcgcggggccgcagcgtgaagacgccgccgcgcatc

SEQ ID NO: 241774 - DNA, 75 bp, Artificial Sequence
  Synthetic
gatctgggtgagggtggtctggaagtcgtcgaagtcgacgaagcggtggtaggctccggtgttgatggtgtagga

SEQ ID NO: 241775 - DNA, 75 bp, Artificial Sequence
  Synthetic
tccggcgcgaccattgtagaagctgacattatgattaaaaagcatcaccgacagaccttcccggtggccggcatg

SEQ ID NO: 241776 - DNA, 75 bp, Artificial Sequence
  Synthetic
aacagccccctccacagccggcgcttctgcccccgccccagcagcaacttccagccacgaccgccgcggccgccg

SEQ ID NO: 241777 - DNA, 75 bp, Artificial Sequence
  Synthetic
cacgcggggcgggagctgcggcgcggcctggaccgaaagagggtgctgagggacgaggatttcgaggcggacgag

SEQ ID NO: 241778 - DNA, 75 bp, Artificial Sequence
  Synthetic
ctggtggtgcagcacagtcgggacaacgagacgttcagggaggcgctgctgaatatcaccgagcccgagggccgc

SEQ ID NO: 241779 - DNA, 75 bp, Artificial Sequence
  Synthetic
atcatcaaataatatacctcaaacttttggtgcgcgttaatatgcaaatgagctgtttgaatttggggatgcggg

SEQ ID NO: 241780 - DNA, 75 bp, Artificial Sequence
  Synthetic
cgaggtgcccctcagcgtggcggagctcagccgcgcctacgagcgcaacctcttctcgccgcgcgtgccccccaa

SEQ ID NO: 241781 - DNA, 75 bp, Artificial Sequence
  Synthetic
cgtagaagaggtggacgatgaggtggacgaggagggcgagtacctggaagactgatggcgcgaccgtatttttgc

SEQ ID NO: 241782 - DNA, 75 bp, Artificial Sequence
  Synthetic
gacgaggagggcgagtacctggaagactgatggcgcgaccgtatttttgctagatgcaacaacagccacctcctg

SEQ ID NO: 241783 - DNA, 75 bp, Artificial Sequence
  Synthetic
gaactcatcggagggagtctcttacctgtggagattctgcttcggtgggcctctagctaagctagtctatagggc

SEQ ID NO: 241784 - DNA, 75 bp, Artificial Sequence
  Synthetic
ggtggcgctgaacgccttcctcagcacccagcccgccaacgtgccccggggccaggaggactacaccaacttcat

SEQ ID NO: 241785 - DNA, 75 bp, Artificial Sequence
  Synthetic
tacgtgcagcagagcgtgggcctgttcctgatgcaggagggggccacccccagcgccgcgctcgacatgaccgcg

SEQ ID NO: 241786 - DNA, 75 bp, Artificial Sequence
  Synthetic
tcctgatgcaggagggggccacccccagcgccgcgctcgacatgaccgcgcgcaacatggagcccagcatgtacg

SEQ ID NO: 241787 - DNA, 75 bp, Artificial Sequence
  Synthetic
gctcccgccgcctgggttctacacgggcgagtacgacatgcccgaccccaatgacgggttcctgtgggacgatgt

SEQ ID NO: 241788 - DNA, 75 bp, Artificial Sequence
  Synthetic
ggaagaaggaaggcagcgaccgacgcccgtcctcggcgctgtccggccgcgagggtgctgccgcggcggtgcccg

SEQ ID NO: 241789 - DNA, 75 bp, Artificial Sequence
  Synthetic
aggaggagaaagcaagcagcacggataccatctccgctccgggtcggggtcgcggcggccgggcccacagtagat

SEQ ID NO: 241790 - DNA, 75 bp, Artificial Sequence
  Synthetic
ctcacctgcgcccccgcatcgggcgcatgatgtaagaaaccgaaaataaatgatactcaccaaggccatggcgac

SEQ ID NO: 241791 - DNA, 75 bp, Artificial Sequence
  Synthetic
atgatctcacgggtgaatgacatccgcgcccaccgaaaccagatactcctagaacagtcagcgctcaccgccacg

SEQ ID NO: 241792 - DNA, 75 bp, Artificial Sequence
  Synthetic
ggagtttgagctgcccgaaggcaacttctcggtgaccatgaccatcgacctgatgaacaacgccatcatcgacaa

SEQ ID NO: 241793 - DNA, 75 bp, Artificial Sequence
  Synthetic
ttgagctgggagggatgcatgcggggggagatgaggtgcatcttggcctggatcttgagattggcgatgttaccg

SEQ ID NO: 241794 - DNA, 75 bp, Artificial Sequence
  Synthetic
tccccgccctcctggatgtcgaggcctatgaggacagtaagaaaaaagcagaagccgaggcgactgcagccgtgg

SEQ ID NO: 241795 - DNA, 75 bp, Artificial Sequence
  Synthetic
caatgtgactagaggcgatacattcgccactcaggcggaggaagcagccgccctagcggtcgccgatgatagtga

SEQ ID NO: 241796 - DNA, 75 bp, Artificial Sequence
  Synthetic
acaacgtgctgccggacgaggtaaacaccgcctaccgcagctggtacctggcctacaactatggcgaccccgaga

SEQ ID NO: 241797 - DNA, 75 bp, Artificial Sequence
  Synthetic
tcaccgggaacgagaccgagctccagctccagtgtaagccccacaagaagtacctcacctggctgtaccagggct

SEQ ID NO: 241798 - DNA, 75 bp, Artificial Sequence
  Synthetic
actaacaaccaaactaaccaccaccgctaccgacgcgacctcgttgaatctaataccacccacaccggaggtgag

SEQ ID NO: 241799 - DNA, 75 bp, Artificial Sequence
  Synthetic
cttagtggtgctgtgttgctggtttaagaaatggggcagatcaccctagtgagctgcggtgtgctggtggcggtg

SEQ ID NO: 241800 - DNA, 75 bp, Artificial Sequence
  Synthetic
ccactccgagacgaaggcccgggtccaggccagcacgaaggaggccacgtgggaggggtagcggtcgttgtccac

SEQ ID NO: 241801 - DNA, 75 bp, Artificial Sequence
  Synthetic
gagccttgctgcgcagggccaggcgcacgggacgcagggccatgctcagggcggccagacgcgcggcttcaggcg

SEQ ID NO: 241802 - DNA, 75 bp, Artificial Sequence
  Synthetic
tgcgcgagttcgccccccggcggcgcgtgcagtggcgcgggcggaaggtgcgcccggtgctgagacccggcacca

SEQ ID NO: 241803 - DNA, 75 bp, Artificial Sequence
  Synthetic
cgtgcagtggcgcgggcggaaggtgcgcccggtgctgagacccggcaccaccgtggtcttcacgcccggcgagcg

SEQ ID NO: 241804 - DNA, 75 bp, Artificial Sequence
  Synthetic
gatgccgggcaggagctcggggtcgaagtagctgatgcaggtgcccagatcgtccagcgccgcttgccagtcgcg

SEQ ID NO: 241805 - DNA, 75 bp, Artificial Sequence
  Synthetic
cagtatgattttttacaaagtaactgttgttgatcctactactccacctccgcccaccaccacaactactcacac

SEQ ID NO: 241806 - DNA, 75 bp, Artificial Sequence
  Synthetic
gccgccgccgtcgccgcacccgccgcagcaccaccgcgacttccgccgccgccttggtgcggagagtgtaccgca

SEQ ID NO: 241807 - DNA, 75 bp, Artificial Sequence
  Synthetic
gaggcagcaggagagttagccttgcaggttcaggaagattcccttatggctaatacccctacacccgatcatcgg

SEQ ID NO: 241808 - DNA, 75 bp, Artificial Sequence
  Synthetic
gactgacgctcctggtcctgtgatgtgtgtttttagatggaagacatcaatttttcgtccctggcaccgcgacac

SEQ ID NO: 241809 - DNA, 75 bp, Artificial Sequence
  Synthetic
cagatgcccactacacacagttctaccactactagcatgcaaaccacacagacaaccactttttatacatcaact

SEQ ID NO: 241810 - DNA, 75 bp, Artificial Sequence
  Synthetic
gatgtagagttccacgaaccgtgggcggcccttgacgtggggcagcttcttgagctcctcgtaggtgagctcgtc

SEQ ID NO: 241811 - DNA, 75 bp, Artificial Sequence
  Synthetic
agccaagtagcgcagcgcctcagccacaggctttggctttgaaagctgcacaacctagtacaactactaggacca

SEQ ID NO: 241812 - DNA, 75 bp, Artificial Sequence
  Synthetic
acctcgagtgccttctctagcaccgccaatctctcctcgctttcctctacaccaatcagtcccgctactactcct

SEQ ID NO: 241813 - DNA, 75 bp, Artificial Sequence
  Synthetic
ggccgacggccattttttcgggggtgacgcagtagaaggtgcgggggtccccgtgccagcgatcccatttgagct

SEQ ID NO: 241814 - DNA, 75 bp, Artificial Sequence
  Synthetic
ggcctggccctcttctgcctcgatggtggtcatgctgacgagcccgcgcgggaggcaggtccagacctcggcgcg

SEQ ID NO: 241815 - DNA, 75 bp, Artificial Sequence
  Synthetic
acttgcaggagtttttccagggcgcgcgggaggtccagatggtacttgatctccaccgcgccgttggtggcgacg

SEQ ID NO: 241816 - DNA, 75 bp, Artificial Sequence
  Synthetic
tccggcaccgcctacaacagcctggctcccaagggagctcccaattccagccagtgggagcaagcaaaaacaggc

SEQ ID NO: 241817 - DNA, 75 bp, Artificial Sequence
  Synthetic
gcagcaggagagagccgtcaaggagctgcaggatgcggtggccatccaccagtgcaagaaaggcatcttctgcct

SEQ ID NO: 241818 - DNA, 75 bp, Artificial Sequence
  Synthetic
aatgggggaactatggaaacacacacatatggtgtggccccaatgggcggagagaatattacaaaagatggtctt

SEQ ID NO: 241819 - DNA, 75 bp, Artificial Sequence
  Synthetic
catatggtgtggccccaatgggcggagagaatattacaaaagatggtcttcaaattggaactgacgttacagcga

SEQ ID NO: 241820 - DNA, 75 bp, Artificial Sequence
  Synthetic
caaaacatttcaaccagaaccgcaagtaggagaagaaaattggcaagaaactgaaaacttttatggcggtagagc

SEQ ID NO: 241821 - DNA, 75 bp, Artificial Sequence
  Synthetic
gtaggagaagaaaattggcaagaaactgaaaacttttatggcggtagagctcttaaaaaagacacaaacatgaaa

SEQ ID NO: 241822 - DNA, 75 bp, Artificial Sequence
  Synthetic
ccaccaatgaaaaaggaggtcaagctaaacttaaagttggagatgatggagttccaaccaaagaattcgacatag

SEQ ID NO: 241823 - DNA, 75 bp, Artificial Sequence
  Synthetic
taaacttaaagttggagatgatggagttccaaccaaagaattcgacatagacctggctttctttgatactcccgg

SEQ ID NO: 241824 - DNA, 75 bp, Artificial Sequence
  Synthetic
tctgcggcctccgcgacctcctccccatgaactaatcaactaacccctaccccatttacccagatacaataaaga

SEQ ID NO: 241825 - DNA, 75 bp, Artificial Sequence
  Synthetic
tataaagcagacattgtcatgtataccgaaaacacgtatctggaaactccagacacgcatgtggtatacaaacca

SEQ ID NO: 241826 - DNA, 75 bp, Artificial Sequence
  Synthetic
ccgaaaacacgtatctggaaactccagacacgcatgtggtatacaaaccaggcaaggatgatgcaagttctgaaa

SEQ ID NO: 241827 - DNA, 75 bp, Artificial Sequence
  Synthetic
acgaagaaatacatgatccagcggcggagcggcatctcgctgacgtcgcccagcgcctccaagcgttccatggcc

SEQ ID NO: 241828 - DNA, 75 bp, Artificial Sequence
  Synthetic
caacagacccaactacattgggttcagggacaactttatcggtcttatgtactacaacagtactggcaatatggg

SEQ ID NO: 241829 - DNA, 75 bp, Artificial Sequence
  Synthetic
agggacaactttatcggtcttatgtactacaacagtactggcaatatgggtgtgcttgctggtcaggcctcccag

SEQ ID NO: 241830 - DNA, 75 bp, Artificial Sequence
  Synthetic
cctcgcgctcgaaggccccgggaacctcttcttccatctcctcttcttcctcttccactaacatctcttctactt

SEQ ID NO: 241831 - DNA, 75 bp, Artificial Sequence
  Synthetic
atcaggcggtggacagttatgatcctgatgtgcgcattattgaaaaccatggtgtggaagatgaacttcccaact

SEQ ID NO: 241832 - DNA, 75 bp, Artificial Sequence
  Synthetic
cactaacgccgcttaccaaggtgtgaaagtaaaaaatggtcaagatggtgatgttgagagcgaatgggaaaaaga

SEQ ID NO: 241833 - DNA, 75 bp, Artificial Sequence
  Synthetic
atttcccttaacctggatacccctttttataccaaagatggaaaattaaccatgcaggtaactgcaccattaaag

SEQ ID NO: 241834 - DNA, 75 bp, Artificial Sequence
  Synthetic
tttataccaaagatggaaaattaaccatgcaggtaactgcaccattaaagttagcaaacacagccatactaaaca

SEQ ID NO: 241835 - DNA, 75 bp, Artificial Sequence
  Synthetic
ttatgtaaaggtaacatttttgccatggagatcaatctccaggctaacctgtggagaagtttcctctactcgaac

SEQ ID NO: 241836 - DNA, 75 bp, Artificial Sequence
  Synthetic
tctgaaaaccgttgaacgaaggcttcgagccagtcgcagtcgcaaggtaggctgagcacggtttcttctggcggg

SEQ ID NO: 241837 - DNA, 75 bp, Artificial Sequence
  Synthetic
gtggccctgtacctgcccgactcctacaagtacacgccgaccaacgtcacgctgccgaccaacaccaacacctac

SEQ ID NO: 241838 - DNA, 75 bp, Artificial Sequence
  Synthetic
tttaggtctaagcaacaatgctctcactgttcaggtaacatctccactcacctttgataatagcaaagtcaagat

SEQ ID NO: 241839 - DNA, 75 bp, Artificial Sequence
  Synthetic
actgttcaggtaacatctccactcacctttgataatagcaaagtcaagattaacctaggtaatggaccactaatg

SEQ ID NO: 241840 - DNA, 75 bp, Artificial Sequence
  Synthetic
actgcttacggggcctgtatgttgcccctaataataccggactagaaaccaacataagctgggcaaacgcaatgc

SEQ ID NO: 241841 - DNA, 75 bp, Artificial Sequence
  Synthetic
ccctaataataccggactagaaaccaacataagctgggcaaacgcaatgcgctttgagggtaacgcaatggctgt

SEQ ID NO: 241842 - DNA, 75 bp, Artificial Sequence
  Synthetic
caatttggcactactagtacagaaacaggtgtcaccaatgcttaccccatacaagtcaaacttggcgcaggcctt

SEQ ID NO: 241843 - DNA, 75 bp, Artificial Sequence
  Synthetic
caggtgtcaccaatgcttaccccatacaagtcaaacttggcgcaggccttgcatttgatagcacaggggctattg

SEQ ID NO: 241844 - DNA, 75 bp, Artificial Sequence
  Synthetic
cctcactttgtggactacaccagacccctctccaaattgtaaaatagcttctgaaaaagatgcaaaactcacact

SEQ ID NO: 241845 - DNA, 75 bp, Artificial Sequence
  Synthetic
tcaccagcatcaacctctacgcaaccttcttccccatggcgcacaacacggcttccacgctcgaggccatgctgc

SEQ ID NO: 241846 - DNA, 75 bp, Artificial Sequence
  Synthetic
ccctctccaaattgtaaaatagcttctgaaaaagatgcaaaactcacactttgcttgacaaagtgtggtagtcaa

SEQ ID NO: 241847 - DNA, 75 bp, Artificial Sequence
  Synthetic
cagtcagtggcagcttggctcctatcacaggggctgttagtactgcacttgtatcactcaaattcaatgccaatg

SEQ ID NO: 241848 - DNA, 75 bp, Artificial Sequence
  Synthetic
cacaggggctgttagtactgcacttgtatcactcaaattcaatgccaatggagcccttttggacaaatcaactct

SEQ ID NO: 241849 - DNA, 75 bp, Artificial Sequence
  Synthetic
ctggtagccgatgaggaagtgcggcggcggctggcggtagagcggccatcgctcggtggcgggggcgccgggcgc

SEQ ID NO: 241850 - DNA, 75 bp, Artificial Sequence
  Synthetic
ccaccaacgtgcccatctccatcccctcgcgcaactgggccgccttccgcggctggtccttcacgcgcctcaaga

SEQ ID NO: 241851 - DNA, 75 bp, Artificial Sequence
  Synthetic
caaggagatctaattccaggtacaccatatacacatgctgtgggtttcatgcctaacaaaaaagcctaccctaaa

SEQ ID NO: 241852 - DNA, 75 bp, Artificial Sequence
  Synthetic
catatacacatgctgtgggtttcatgcctaacaaaaaagcctaccctaaaaacacaactgcagcttccaagagcc

SEQ ID NO: 241853 - DNA, 75 bp, Artificial Sequence
  Synthetic
tggagatgcagataagcctttatctcttatcatcactttcaatgaaactgatgatgaaacctgtgattactgcat

SEQ ID NO: 241854 - DNA, 75 bp, Artificial Sequence
  Synthetic
cttatcatcactttcaatgaaactgatgatgaaacctgtgattactgcatcaactttcaatggaaatggagtgct

SEQ ID NO: 241855 - DNA, 75 bp, Artificial Sequence
  Synthetic
caaccagttcattcaccttctcatacatcgcccaagaataaacccgccctgcatgccaccccttgtcccactgct

SEQ ID NO: 241856 - DNA, 75 bp, Artificial Sequence
  Synthetic
gcatgccaccccttgtcccactgctctacaatggaaaactctgaagcagaaaaataaagttcaagtgttttattg

SEQ ID NO: 241857 - DNA, 75 bp, Artificial Sequence
  Synthetic
agactagtaagcgcggaaagcggccgaccgcgatggctcgctgccgtagtctggagaagaatcgccagggttgcg

SEQ ID NO: 241858 - DNA, 75 bp, Artificial Sequence
  Synthetic
tttgtttttgccagatgcatcccgtactgcggcagatgcgcccccaccaccctccaccgcaacaacagccccctc

SEQ ID NO: 241859 - DNA, 75 bp, Artificial Sequence
  Synthetic
ccaccaagttgttcaacagtccatagttcaacgtgctccagccaaaactcatctgtggaactatgctgcccacat

SEQ ID NO: 241860 - DNA, 75 bp, Artificial Sequence
  Synthetic
tggaggcggcggcaggaccctacgtagaagaggtggacgatgaggtggacgagggcgagtacctggaagactgat

SEQ ID NO: 241861 - DNA, 75 bp, Artificial Sequence
  Synthetic
ctccgcctactttcgctcccaccgcgcgcgcatcgagaaggccaccgccttcgaccgcatgaatcaagacatgta

SEQ ID NO: 241862 - DNA, 75 bp, Artificial Sequence
  Synthetic
tccatcagcagcgtcatgacttccatgcccttctcccaggccgaaacgatcggcaggctcagggggttcttcacc

SEQ ID NO: 241863 - DNA, 75 bp, Artificial Sequence
  Synthetic
gagcgggagaagaacttccccaataacgggatagagagcctggtggacaagatgagccgctggaagacgtacgcg

SEQ ID NO: 241864 - DNA, 75 bp, Artificial Sequence
  Synthetic
aggcagcggggactgatgtgggacgatgaggattccgccgacgacagcagcgtgttggacttgggtgggagtggt

SEQ ID NO: 241865 - DNA, 75 bp, Artificial Sequence
  Synthetic
ttcccacgctacgtcatcagaattcgactttcaaatccgtcgaccgttaaacacgtcactcgccccgcccctaac

SEQ ID NO: 241866 - DNA, 75 bp, Artificial Sequence
  Synthetic
ttttgtgcgcgttaatatgcaaatgaggcgtttgaatttggggaggaagggttgtgattggctgcgggaagggcg

SEQ ID NO: 241867 - DNA, 75 bp, Artificial Sequence
  Synthetic
accaagagcagccagagcaggaagcagagagcgagcagaaccaggctgggctcgagcatggcgactacctgagcg

SEQ ID NO: 241868 - DNA, 75 bp, Artificial Sequence
  Synthetic
accgttaggggcggggcgagtgacgtttttatgacgtggccgtgaggaggagctagcttgcaagttcttgtggga

SEQ ID NO: 241869 - DNA, 75 bp, Artificial Sequence
  Synthetic
atttgccgagggccgagtagactttgaccgattacgtgggggtttcgattaccgtgtttttcacctaaatttccg

SEQ ID NO: 241870 - DNA, 75 bp, Artificial Sequence
  Synthetic
ggaacttcaggctgggctgggaccccgtgaccgagctggtcatgcccggggtgtacaccaacgaggccttccatc

SEQ ID NO: 241871 - DNA, 75 bp, Artificial Sequence
  Synthetic
cgagaagagttttctcctccgcgccgcgagtcagatctacactttgaaagatgaggcacctgagagacctgcccg

SEQ ID NO: 241872 - DNA, 75 bp, Artificial Sequence
  Synthetic
atgtcgaggcctatgaggaaagcaaggaaaaagctgaagccgaggcgactgcagccgtggctaccgccgcgacca

SEQ ID NO: 241873 - DNA, 75 bp, Artificial Sequence
  Synthetic
aggcgatacattcgccactgtggcggaggaagcagccgccctagcggtcgccgatgatagtgaaagtaagatagt

SEQ ID NO: 241874 - DNA, 75 bp, Artificial Sequence
  Synthetic
ggaggaggaggagtagctgacctgtttcctgaactgcgccgggtgctgactaggtcttcgagtggtcgggagagg

SEQ ID NO: 241875 - DNA, 75 bp, Artificial Sequence
  Synthetic
tgtgggtctgatgagccgcaagcgtccagaaacagtgtggtggcatgaggtgcagtcgactggcacagatgaggt

SEQ ID NO: 241876 - DNA, 75 bp, Artificial Sequence
  Synthetic
gaaaatccacagcggcggcaggtggactgaggatcgcggcgaacgagccggcgcagacccgggagctgaggaacc

SEQ ID NO: 241877 - DNA, 75 bp, Artificial Sequence
  Synthetic
aggctctcttcaacaagtactgcgcgctcactcttaaagagtagcccgcgcccgcccacacacggaaaaaggcgg

SEQ ID NO: 241878 - DNA, 75 bp, Artificial Sequence
  Synthetic
tcgagcaggcggccgagcgtctgggcgagtttgcttacggcaagcgcagccgccccgcgcccttgaaagaggagg

SEQ ID NO: 241879 - DNA, 75 bp, Artificial Sequence
  Synthetic
cggtgtccatcccgctggaccacggcaaccccacgccgagcctgaagccggtgaccctgcagcaggtgctgccga

SEQ ID NO: 241880 - DNA, 75 bp, Artificial Sequence
  Synthetic
gtgcagcccgaggtcaaggtgcggcccatcaagcaggtggccccgggcctgggcgtgcagaccgtggacatcaag

SEQ ID NO: 241881 - DNA, 75 bp, Artificial Sequence
  Synthetic
atccccacggagcccatggaaacgcagaccgagcccgtgaagcccagcaccagcaccatggaggtgcagacggat

SEQ ID NO: 241882 - DNA, 75 bp, Artificial Sequence
  Synthetic
gcagaggcacacagctcaacgacgaggtggtgagctcttcgctgggtctgcgacctgacggagtcttccaactcg

SEQ ID NO: 241883 - DNA, 75 bp, Artificial Sequence
  Synthetic
cgacctgacggagtcttccaactcgccggatcggggagatcttccttcacgcctcgtcaggccgtcctgactttg

SEQ ID NO: 241884 - DNA, 75 bp, Artificial Sequence
  Synthetic
gccgccgccgtcgtcgcagccgccgcagcagcaccgcgacttccgccttggtgcggagagtgtatcgcagcgggc

SEQ ID NO: 241885 - DNA, 75 bp, Artificial Sequence
  Synthetic
gacggaggacctgcgacccgatcatttggtgttgtcctgcaccgggacggagttcggttccagcggggaagaatc

SEQ ID NO: 241886 - DNA, 75 bp, Artificial Sequence
  Synthetic
ggcgccggctactacggcactctggtggccaactcgagttccaccaataatcccgccagcctgaacgaggagaag

SEQ ID NO: 241887 - DNA, 75 bp, Artificial Sequence
  Synthetic
tccaacccttcctccccgggacctatcagtgcgtctcgggaccctgccatcacaccttccacctgatcccgaata

SEQ ID NO: 241888 - DNA, 75 bp, Artificial Sequence
  Synthetic
caccgtcgcgacctttcctctgaatctaataccactaccggaggtgagctccgaggtcgaccaacctctgggatt

SEQ ID NO: 241889 - DNA, 75 bp, Artificial Sequence
  Synthetic
gggtgggcttttggctctctgctacctatacctcccttgctgttcgtacttagtggtgctgtgttgctggtttaa

SEQ ID NO: 241890 - DNA, 75 bp, Artificial Sequence
  Synthetic
cccccaggcgaactggcagagcactctgaacagcatcgtgggtctgggagtgcagagtgtgaagcgccgccgctg

SEQ ID NO: 241891 - DNA, 75 bp, Artificial Sequence
  Synthetic
tgctggacatggccagcacatactttgacatccgcggcgtgctggatcggggccccagtttcaaaccatactccg

SEQ ID NO: 241892 - DNA, 75 bp, Artificial Sequence
  Synthetic
tgctggacatggccagcacatactttgacatccgcggcgtgctggatcggggccccagtttcaaaccttactccg

SEQ ID NO: 241893 - DNA, 75 bp, Artificial Sequence
  Synthetic
tgctggacatggccagcacatactttgacatccgcggcgtgctggatcggggccccagtttcaaaccctactccg

SEQ ID NO: 241894 - DNA, 75 bp, Artificial Sequence
  Synthetic
tgctggacatggccagcacatactttgacatccgcggcgtgctggatcggggccccagtttcaaaccgtactccg

SEQ ID NO: 241895 - DNA, 75 bp, Artificial Sequence
  Synthetic
tgctggacatggccagcacttactttgacatccgcggcgtgctggatcggggccccagtttcaaaccatactccg

SEQ ID NO: 241896 - DNA, 75 bp, Artificial Sequence
  Synthetic
tgctggacatggccagcacttactttgacatccgcggcgtgctggatcggggccccagtttcaaaccttactccg

SEQ ID NO: 241897 - DNA, 75 bp, Artificial Sequence
  Synthetic
tgctggacatggccagcacttactttgacatccgcggcgtgctggatcggggccccagtttcaaaccctactccg

SEQ ID NO: 241898 - DNA, 75 bp, Artificial Sequence
  Synthetic
tgctggacatggccagcacttactttgacatccgcggcgtgctggatcggggccccagtttcaaaccgtactccg

SEQ ID NO: 241899 - DNA, 75 bp, Artificial Sequence
  Synthetic
tgctggacatggccagcacctactttgacatccgcggcgtgctggatcggggccccagtttcaaaccatactccg

SEQ ID NO: 241900 - DNA, 75 bp, Artificial Sequence
  Synthetic
tgctggacatggccagcacctactttgacatccgcggcgtgctggatcggggccccagtttcaaaccttactccg

SEQ ID NO: 241901 - DNA, 75 bp, Artificial Sequence
  Synthetic
tgctggacatggccagcacctactttgacatccgcggcgtgctggatcggggccccagtttcaaaccctactccg

SEQ ID NO: 241902 - DNA, 75 bp, Artificial Sequence
  Synthetic
tgctggacatggccagcacctactttgacatccgcggcgtgctggatcggggccccagtttcaaaccgtactccg

SEQ ID NO: 241903 - DNA, 75 bp, Artificial Sequence
  Synthetic
tgctggacatggccagcacgtactttgacatccgcggcgtgctggatcggggccccagtttcaaaccatactccg

SEQ ID NO: 241904 - DNA, 75 bp, Artificial Sequence
  Synthetic
tgctggacatggccagcacgtactttgacatccgcggcgtgctggatcggggccccagtttcaaaccttactccg

SEQ ID NO: 241905 - DNA, 75 bp, Artificial Sequence
  Synthetic
tgctggacatggccagcacgtactttgacatccgcggcgtgctggatcggggccccagtttcaaaccctactccg

SEQ ID NO: 241906 - DNA, 75 bp, Artificial Sequence
  Synthetic
tgctggacatggccagcacgtactttgacatccgcggcgtgctggatcggggccccagtttcaaaccgtactccg

SEQ ID NO: 241907 - DNA, 75 bp, Artificial Sequence
  Synthetic
caagggagcgcccaacacctcacagtggaaggattccgacagcaaaatgcatacttttggagttgctgccatgcc

SEQ ID NO: 241908 - DNA, 75 bp, Artificial Sequence
  Synthetic
tggaaggattccgacagcaaaatgcatacttttggagttgctgccatgcccggtgttgttggtaaaaaaatagaa

SEQ ID NO: 241909 - DNA, 75 bp, Artificial Sequence
  Synthetic
tggagcgaggcgaagtttttcagcggcttgagtccgtcggccatgggcattttggagagggtctgttgcaagagt

SEQ ID NO: 241910 - DNA, 75 bp, Artificial Sequence
  Synthetic
gttaaattttttaaacattgtgctcagtattgcttatgcctctggttatgcaaacatacagaaaaccctttatgt

SEQ ID NO: 241911 - DNA, 75 bp, Artificial Sequence
  Synthetic
attcatcctctggaactgataccataatttatgctgataaaactttccaaccagagccacaggttggaagtgaca

SEQ ID NO: 241912 - DNA, 75 bp, Artificial Sequence
  Synthetic
agtattgcttatgcctctggttatgcaaacatacagaaaaccctttatgtaggatctgatggtacactagagggt

SEQ ID NO: 241913 - DNA, 75 bp, Artificial Sequence
  Synthetic
aatttatgctgataaaactttccaaccagagccacaggttggaagtgacagttgggtcgacaccaatggtgcaga

SEQ ID NO: 241914 - DNA, 75 bp, Artificial Sequence
  Synthetic
ggtatttttatagaaccaacactgatccagttaaactttgtaagggtgaattgccgcgtacacataaaactccac

SEQ ID NO: 241915 - DNA, 75 bp, Artificial Sequence
  Synthetic
aaggacactacaaacatgaagccctgctacggttcttttgccaggcctaccaacaaagaaggtgggcaggctaac

SEQ ID NO: 241916 - DNA, 75 bp, Artificial Sequence
  Synthetic
gctacggttcttttgccaggcctaccaacaaagaaggtgggcaggctaacataaaagattctgaaactgccagca

SEQ ID NO: 241917 - DNA, 75 bp, Artificial Sequence
  Synthetic
tccagttaaactttgtaagggtgaattgccgcgtacacataaaactccacttacatttagttgcagcaataataa

SEQ ID NO: 241918 - DNA, 75 bp, Artificial Sequence
  Synthetic
caatatactggtacttattacagtacaaactttcatacaggacaagataaatattatactgttaaggtagaaaat

SEQ ID NO: 241919 - DNA, 75 bp, Artificial Sequence
  Synthetic
caaactttcatacaggacaagataaatattatactgttaaggtagaaaatcctaccactcctagaactaccacca

SEQ ID NO: 241920 - DNA, 75 bp, Artificial Sequence
  Synthetic
ggcattctttgacagcaaaaatattgccgctaactatgatccagatattgtaatgtacacagaaaatgttgagtt

SEQ ID NO: 241921 - DNA, 75 bp, Artificial Sequence
  Synthetic
tgtgaaaactacaactaggaccaccacaactacagaaaccaccaccagcacaacacttgctgcaactacacacac

SEQ ID NO: 241922 - DNA, 75 bp, Artificial Sequence
  Synthetic
tttaagccaggaacttcagatgaaagttcagaagccaatttgggccagcaggccatgcccaacagacccaactac

SEQ ID NO: 241923 - DNA, 75 bp, Artificial Sequence
  Synthetic
acaactacagaaaccaccaccagcacaacacttgctgcaactacacacacacacactaagctaaccttacagacc

SEQ ID NO: 241924 - DNA, 75 bp, Artificial Sequence
  Synthetic
aaaagggggataacagcaccacttccaatgaggagatacccaaatccatgattggcattattgttgctgtagtgg

SEQ ID NO: 241925 - DNA, 75 bp, Artificial Sequence
  Synthetic
gtcctaccagctcttgcttgactctctgggtgacagaaccaggtatttcagtatgtggaatcaggcggtggacag

SEQ ID NO: 241926 - DNA, 75 bp, Artificial Sequence
  Synthetic
tccccaattattgcttccctttgaatggtgtgggctttacagatacttaccagggtgttaaagttaagacagata

SEQ ID NO: 241927 - DNA, 75 bp, Artificial Sequence
  Synthetic
cagccgctgctggtaccaatggaacgcagtgggacaaagatgataccacagtcagcactgccaatgagatccact

SEQ ID NO: 241928 - DNA, 75 bp, Artificial Sequence
  Synthetic
caccctcaggtatgctttcgtggtattgctattttggaactgacactgatcaaactgaattatgcaattttcaaa

SEQ ID NO: 241929 - DNA, 75 bp, Artificial Sequence
  Synthetic
ctctaattatcaatgcaatggcactgatctgatactactcaatgtcacgaaagcatatggtggcagttattattg

SEQ ID NO: 241930 - DNA, 75 bp, Artificial Sequence
  Synthetic
aactattcataccacacacacagaacaaacaccagaggcaacagaagcagagttggccttccaggttcacggaga

SEQ ID NO: 241931 - DNA, 75 bp, Artificial Sequence
  Synthetic
ctgacctgccagccccgattatgcagggtgatgaggtccacactggtggccacctcgccgcgcaggggctcgttg

SEQ ID NO: 241932 - DNA, 75 bp, Artificial Sequence
  Synthetic
agttagcgctctagttttttgttctttgattggcattgtttttaatagtaaaattaccaaagttagctttattaa

SEQ ID NO: 241933 - DNA, 75 bp, Artificial Sequence
  Synthetic
aacatcacactagcaggtgtagaaggtgctcaaaacaccacctggacaaaataccatctaggatggagagatatt

SEQ ID NO: 241934 - DNA, 75 bp, Artificial Sequence
  Synthetic
gtgctcaaaacaccacctggacaaaataccatctaggatggagagatatttgcacctggaatgtaacttattatt

SEQ ID NO: 241935 - DNA, 75 bp, Artificial Sequence
  Synthetic
taacgctaaccaatctcagaatgggttaattaaaggacagagtgttagtgtgaccagtgatgggtactataccca

SEQ ID NO: 241936 - DNA, 75 bp, Artificial Sequence
  Synthetic
ttaattaaaggacagagtgttagtgtgaccagtgatgggtactatacccagcatagttttaactacaacattact

SEQ ID NO: 241937 - DNA, 75 bp, Artificial Sequence
  Synthetic
gccccagggcatggggtgggtgagcgcggaggcgtacatgccgcagatgtcgtagacgtagaggggctcctcgag

SEQ ID NO: 241938 - DNA, 75 bp, Artificial Sequence
  Synthetic
cacatacagtacatcaaatcagcctaccaccactacagcagcagaggttgccagctcgtctggggtccgagtggc

SEQ ID NO: 241939 - DNA, 75 bp, Artificial Sequence
  Synthetic
atttttgatgttggccccatctagcagtcccactgctagtaccaatgagcagactactgaatttttgtccactgt

SEQ ID NO: 241940 - DNA, 75 bp, Artificial Sequence
  Synthetic
gtgggcgtaggagtcttgcagcttggcgacgagctcggcggtgacgaggacgtccagagcgcagtagtcgagggt

SEQ ID NO: 241941 - DNA, 75 bp, Artificial Sequence
  Synthetic
aagcccatcgttatcgggcagccggagccgcttcaggtggaagggggtctaaggaatcttctcttctcttttaca

SEQ ID NO: 241942 - DNA, 75 bp, Artificial Sequence
  Synthetic
cttgtaggcgcagcagcccttctccacggggagggcgtaggcctgggcggccttgcgcagggaggtgtgcgtgag

SEQ ID NO: 241943 - DNA, 75 bp, Artificial Sequence
  Synthetic
atgcggaaaggctggggcacctcggcccggttgttgatgacctgggcggcgagcacgatctcgtcgaagccgttg

SEQ ID NO: 241944 - DNA, 75 bp, Artificial Sequence
  Synthetic
ttgttggccagctgcaccacgctgcgcccccagcggttctgggtgatcttggcccggtcggggttctccttcagc

SEQ ID NO: 241945 - DNA, 75 bp, Artificial Sequence
  Synthetic
ccagcagcagaatgaaagcttaaccgccccgccgcccagccccacctccgacgccgcggccccagacatgcaaga

SEQ ID NO: 241946 - DNA, 75 bp, Artificial Sequence
  Synthetic
cgcaccattaaagatattagacacagatctactaaaaacacttgttgttgcttatgggcagggattaggaacaaa

SEQ ID NO: 241947 - DNA, 75 bp, Artificial Sequence
  Synthetic
gatctactaaaaacacttgttgttgcttatgggcagggattaggaacaaacaccaatggtgctcttgttgcccaa

SEQ ID NO: 241948 - DNA, 75 bp, Artificial Sequence
  Synthetic
ccgctagcaaaattgcccttaatttaggcaatggaccattaaaagtggatgcaaatagactgaacattaattgca

SEQ ID NO: 241949 - DNA, 75 bp, Artificial Sequence
  Synthetic
aggcaatggaccattaaaagtggatgcaaatagactgaacattaattgcaaaagaggtatctatgtcactaccac

SEQ ID NO: 241950 - DNA, 75 bp, Artificial Sequence
  Synthetic
agttgggcaaatgctatgacatttataggaaatgccattggtgtcaatattgacacaaaaaaaggcctacagttc

SEQ ID NO: 241951 - DNA, 75 bp, Artificial Sequence
  Synthetic
taggaaatgccattggtgtcaatattgacacaaaaaaaggcctacagttcggcacttcaagcactgaaacagatg

SEQ ID NO: 241952 - DNA, 75 bp, Artificial Sequence
  Synthetic
aaaacttggagctggtcttacatttgacagcacaggtgccattgttgcttggaacaaagaagatgacaaacttac

SEQ ID NO: 241953 - DNA, 75 bp, Artificial Sequence
  Synthetic
gacagcacaggtgccattgttgcttggaacaaagaagatgacaaacttacactgtggaccacagccgatccatct

SEQ ID NO: 241954 - DNA, 75 bp, Artificial Sequence
  Synthetic
caggctggagccgcagctaacgtggtactggcactcccgtctcgacccaagcctgcacaaaacctccaggatacg

SEQ ID NO: 241955 - DNA, 75 bp, Artificial Sequence
  Synthetic
aggatgctaagcttacactctgcttgacaaagtgtggtagtcagatactgggcactgtttctctcatagctgttg

SEQ ID NO: 241956 - DNA, 75 bp, Artificial Sequence
  Synthetic
gacaaagtgtggtagtcagatactgggcactgtttctctcatagctgttgatactggtagcttaaatccaataac

SEQ ID NO: 241957 - DNA, 75 bp, Artificial Sequence
  Synthetic
tcacttaaattcgatgccaatggagttttgcaagccagttcaacactagataaagaatattggaatttcagaaaa

SEQ ID NO: 241958 - DNA, 75 bp, Artificial Sequence
  Synthetic
ttttgcaagccagttcaacactagataaagaatattggaatttcagaaaaggagatgtgacacctgctgacccct

SEQ ID NO: 241959 - DNA, 75 bp, Artificial Sequence
  Synthetic
caaccttaatgcatacccaaaaaacacaaacgcagctgcaaaaagtcacattgttggaaaagtatacctacatgg

SEQ ID NO: 241960 - DNA, 75 bp, Artificial Sequence
  Synthetic
aagagcggcgcaagctcatgatggccgtggtcctggtgaccgtggagctggagtgtctgcgccgcttcttcgccg

SEQ ID NO: 241961 - DNA, 75 bp, Artificial Sequence
  Synthetic
acaaacgcagctgcaaaaagtcacattgttggaaaagtatacctacatggggatgtaagcaagccactagacttg

SEQ ID NO: 241962 - DNA, 75 bp, Artificial Sequence
  Synthetic
atgaatcctgtacttattgcattaactttcagtggcagtggggaactgaccaatataaagatgaaacacttgcag

SEQ ID NO: 241963 - DNA, 75 bp, Artificial Sequence
  Synthetic
tagttattttccctccaccctcccaactcatggaatacaccatcctctccccacgcacagccttaaacatctgaa

SEQ ID NO: 241964 - DNA, 75 bp, Artificial Sequence
  Synthetic
gacctgctggaggccatcgtgcagaaccccaccagcaagccgctgacggcgcagctgttcctggtggtgcagcac

SEQ ID NO: 241965 - DNA, 75 bp, Artificial Sequence
  Synthetic
agctgagggctgtcctcggtggtcgggatcacggttatctggaagaagagcgatgagaatcataatccgcgaacg

SEQ ID NO: 241966 - DNA, 75 bp, Artificial Sequence
  Synthetic
ggatcgggcggttgtggcgcatcaggccccgcagcagtcgctgtctgcgccgctccgtcaagctgctgctcaagg

SEQ ID NO: 241967 - DNA, 75 bp, Artificial Sequence
  Synthetic
gccccgcagcagtcgctgtctgcgccgctccgtcaagctgctgctcaaggggtccgggtccagggactccctgcg

SEQ ID NO: 241968 - DNA, 75 bp, Artificial Sequence
  Synthetic
gcaaggggggtctgaaactcaccccggggctgtggacctcggcctacttgcgcaagttcgtgcccgaggactacc

SEQ ID NO: 241969 - DNA, 75 bp, Artificial Sequence
  Synthetic
caccgctcgcggccgtggatcaactgggagctgaacaggtctatgttggcacagcacaggcacacgctcatgcat

SEQ ID NO: 241970 - DNA, 75 bp, Artificial Sequence
  Synthetic
gtcttcagcactctcagttcctcgggggtcaggaccatgtcccagggcacggggaactcttgcaggacagtgaac

SEQ ID NO: 241971 - DNA, 75 bp, Artificial Sequence
  Synthetic
tggatcgtgtcatgatggagcttcttcctgacatcttcgtatttcatgtagcagaacctggtccgggcactgcac

SEQ ID NO: 241972 - DNA, 75 bp, Artificial Sequence
  Synthetic
gcagaacctggtccgggcactgcacaccgctcgccggcgacggtctcggcgcttcgagcgctcggtgttgaagtt

SEQ ID NO: 241973 - DNA, 75 bp, Artificial Sequence
  Synthetic
gaatgggccagacccagccagatgatgcaattttgttgggtttcggtgacggcgggggagggaagaacaggaaga

SEQ ID NO: 241974 - DNA, 75 bp, Artificial Sequence
  Synthetic
aatctctgccgcgatctctaagctcctccctcagcaataactgcaagtactctttcatatcttctccgaaatttt

SEQ ID NO: 241975 - DNA, 75 bp, Artificial Sequence
  Synthetic
accgggtgctaacgagcgccccttgtggaagaaggaaggcagcgaccggcgcccgtcctcggcgctgtccggccg

SEQ ID NO: 241976 - DNA, 75 bp, Artificial Sequence
  Synthetic
tgcccttctcgctgaacagtatccgcagcagcgagctgggcaggatcacgcgcccgcgcttgctgggcgaggagg

SEQ ID NO: 241977 - DNA, 75 bp, Artificial Sequence
  Synthetic
aataacgggatagagagcctggtggacaagatgagccgctggaagacgtacgcgcaggagcacagggacgatccc

SEQ ID NO: 241978 - DNA, 75 bp, Artificial Sequence
  Synthetic
tattaaaccatgctagcctggcgaacaggtgggtaaatcactctttccagcaccaggcaggctacggggtctccg

SEQ ID NO: 241979 - DNA, 75 bp, Artificial Sequence
  Synthetic
attcgcgaagacgcgtacactccgggaacattggcatccgtgagtgaaaaaaatcgccccaagaagccccgaggc

SEQ ID NO: 241980 - DNA, 75 bp, Artificial Sequence
  Synthetic
ttgagctgcccgaggagcaccctcagggcccggcccacggagtgcggatcgtcgtcgaagggggcctcgactccc

SEQ ID NO: 241981 - DNA, 75 bp, Artificial Sequence
  Synthetic
gggcccggcccacggagtgcggatcgtcgtcgaagggggcctcgactcccacctgcttcggatcttcagccagcg

SEQ ID NO: 241982 - DNA, 75 bp, Artificial Sequence
  Synthetic
gcagcaaagcccccgctccctccagaaacacatacaaagcctcagcgtccatagcttaccgagcacggcaggcgc

SEQ ID NO: 241983 - DNA, 75 bp, Artificial Sequence
  Synthetic
cggcggcggcggcgatgcagcccccgctggaggctccttacgtgcccccgcggtacctggcgcctacggaggggc

SEQ ID NO: 241984 - DNA, 75 bp, Artificial Sequence
  Synthetic
aaacacatacaaagcctcagcgtccatagcttaccgagcacggcaggcgcaagattcagagaaaaggctgagctc

SEQ ID NO: 241985 - DNA, 75 bp, Artificial Sequence
  Synthetic
caatatatagccctaacctacactgacgtaaaggccaaagtctaaaaatacccgccaaaatgacacacacgccca

SEQ ID NO: 241986 - DNA, 75 bp, Artificial Sequence
  Synthetic
agcgactactccggacttccgtgtgttcctgaatccatcaaccagtctttgttcttcaccgggaacgagaccgag

SEQ ID NO: 241987 - DNA, 75 bp, Artificial Sequence
  Synthetic
gttcttcaccgggaacgagaccgagctccagctccagtgtaagccccacaagaagtacctcacctggctgttcca

SEQ ID NO: 241988 - DNA, 75 bp, Artificial Sequence
  Synthetic
atcacagccccgcatccccaaattcaaacgcctcatttgcatattaacgcgcacaaaaagtttgaggtatattat

SEQ ID NO: 241989 - DNA, 75 bp, Artificial Sequence
  Synthetic
aatactaccacccacaccggaggtgagctccgaggtcgaccaacctctgggatttactacggcccctgggaggtg

SEQ ID NO: 241990 - DNA, 75 bp, Artificial Sequence
  Synthetic
ggtgtacaccaacgaggccttccatcccgatattgtgctgctgcccggctgcggggtggactttaccgagagccg

SEQ ID NO: 241991 - DNA, 75 bp, Artificial Sequence
  Synthetic
cagcagcaggaggatcaagaagagaacccgagagccggcctggaccctccggcggaggaggaggagtagctgacc

SEQ ID NO: 241992 - DNA, 75 bp, Artificial Sequence
  Synthetic
ttaagaaatggggaagatcaccctagtgagctgcggtgtgctggtggcggtggtggtgctttcgattgtgggact

SEQ ID NO: 241993 - DNA, 75 bp, Artificial Sequence
  Synthetic
tgtttcctgaactgcgccgggtgctgactaggtctttgagtggtcgggagaggggtattaagcgggagaggcatg

SEQ ID NO: 241994 - DNA, 75 bp, Artificial Sequence
  Synthetic
gagaaggccgatccctgcttgcatttcaatcccgacaaatgccagctgagttttcagcccgatggcaatcggtgc

SEQ ID NO: 241995 - DNA, 75 bp, Artificial Sequence
  Synthetic
gatgtcgaggcctacgagaaaagcaaggaggagaatgcagcagccgaggccgtggctaccgccgcgaccgccgag

SEQ ID NO: 241996 - DNA, 75 bp, Artificial Sequence
  Synthetic
cgtccagaaacagtgtggtggcatgaggtgcagttgactggcacagatgaggtgtcagtcatgcatgagaaattt

SEQ ID NO: 241997 - DNA, 75 bp, Artificial Sequence
  Synthetic
ggttggagcctgaggatgattgggaggtagccatcaggaattatgctaagctggctctaaggccagatagaaagt

SEQ ID NO: 241998 - DNA, 75 bp, Artificial Sequence
  Synthetic
cgccactcaggcggaggaagcagccgccctagcggtcgccgatgatagtgaaagtaccaagacagtgaccattca

SEQ ID NO: 241999 - DNA, 75 bp, Artificial Sequence
  Synthetic
agaaaaacaccgcctaccgcagctggtacctggcctacaactatggcgaccccgagaagggcgtgcgctcctgga

SEQ ID NO: 242000 - DNA, 75 bp, Artificial Sequence
  Synthetic
gccaataccaagctgacagtgcatggctgctccttctttgggtttaataacacctgcattgaggcctggggtcat

SEQ ID NO: 242001 - DNA, 75 bp, Artificial Sequence
  Synthetic
tttttcacacacctttttcagaccatggcctctgttaaatttttgcttttatttgccagtctcattgccgtcatt

SEQ ID NO: 242002 - DNA, 75 bp, Artificial Sequence
  Synthetic
gcgtgcggtcgcgcaccaccgtcgacgacgtgatcgaccaggtggtggccgacgcgcgcaactacacccccgccg

SEQ ID NO: 242003 - DNA, 75 bp, Artificial Sequence
  Synthetic
tgatgaatacaagaccaggtgccgagcctgcgagtgcggagggaagcatgccaggttccagcccgtgtgtgtgga

SEQ ID NO: 242004 - DNA, 75 bp, Artificial Sequence
  Synthetic
tactaagtgttgaattttaattttttagaaccatgaagatcctaggccttttaattttttctatcattacctctg

SEQ ID NO: 242005 - DNA, 75 bp, Artificial Sequence
  Synthetic
tatatgcaatggtactgatctgatactcctcaatatcacgaaatcatatgctggcagttacacctgccctggaga

SEQ ID NO: 242006 - DNA, 75 bp, Artificial Sequence
  Synthetic
ctccacctccacccaccacaactactcacaccacacacacagatcaaaccgcagcagaggaggcagcaaagttag

SEQ ID NO: 242007 - DNA, 75 bp, Artificial Sequence
  Synthetic
gatctacggccccgcggtggtgaaggaggaaagaaagccccgcaaaatcaagcgggtcaaaaaggacaaaaagga

SEQ ID NO: 242008 - DNA, 75 bp, Artificial Sequence
  Synthetic
aagcgccagaagctggaagacgtgctggagaccatgaaggtggacccggacgtgcagcccgaggtcaaggtgcgg

SEQ ID NO: 242009 - DNA, 75 bp, Artificial Sequence
  Synthetic
accacacagatgcccactacacacagttctaccactactaccatgcaaaccacacagacaaccactacatcaact

SEQ ID NO: 242010 - DNA, 75 bp, Artificial Sequence
  Synthetic
cccacgccgggctaccgcggcacgcgcttctaccgcggtcatacaagccgccgccgcaagaccaccactcgccgc

SEQ ID NO: 242011 - DNA, 75 bp, Artificial Sequence
  Synthetic
aagccggtctacaagcccatcattgtcgggcagccggagccgcttcaggtggaagggggtctaaggaatcttctc

SEQ ID NO: 242012 - DNA, 75 bp, Artificial Sequence
  Synthetic
cctcctccccatgaactaatcacccccttatccagtgaaataaagatcatattgatgatgatttaaataaaaaaa

SEQ ID NO: 242013 - DNA, 75 bp, Artificial Sequence
  Synthetic
ccttatccagtgaaataaagatcatattgatgatgatttaaataaaaaaataatcatttgatttgaaataaagat

SEQ ID NO: 242014 - DNA, 75 bp, Artificial Sequence
  Synthetic
acatacagctttggtaatgctcctgtccgaggtttggacattacagaagagggtctccaaattggaactgatgac

SEQ ID NO: 242015 - DNA, 75 bp, Artificial Sequence
  Synthetic
tccgaggtttggacattacagaagagggtctccaaattggaactgatgactcttcaaccgaaagcaagaaaattt

SEQ ID NO: 242016 - DNA, 75 bp, Artificial Sequence
  Synthetic
acctcaggttggagatgaggaatggcatgacaccattggggctgaagacaaatatggaggcagagctcttaaacc

SEQ ID NO: 242017 - DNA, 75 bp, Artificial Sequence
  Synthetic
catgacaccattggggctgaagacaaatatggaggcagagctcttaaacctgccaccaacatgaaaccctgttat

SEQ ID NO: 242018 - DNA, 75 bp, Artificial Sequence
  Synthetic
ctaagggaggtcaggctaaaaccagaaccaaagacgatggaactaccgagcctgatattgatatggccttctttg

SEQ ID NO: 242019 - DNA, 75 bp, Artificial Sequence
  Synthetic
aaccaaagacgatggaactaccgagcctgatattgatatggccttctttgacgatcgcagtcagcaggctagttt

SEQ ID NO: 242020 - DNA, 75 bp, Artificial Sequence
  Synthetic
gagaatgtggatttggagaccccagatacccacattatttacaaacccggtactgatgaaaccagttcttctttc

SEQ ID NO: 242021 - DNA, 75 bp, Artificial Sequence
  Synthetic
ctggcaggaggtcggggtcaaagtagctgatgcatgtgccaagatcgtccagagaagcttgccattcgcgcacgg

SEQ ID NO: 242022 - DNA, 75 bp, Artificial Sequence
  Synthetic
tactgatgaaaccagttcttctttcaacttgggccagcaatccatgcccaacaggcccaactacattggtttcag

SEQ ID NO: 242023 - DNA, 75 bp, Artificial Sequence
  Synthetic
tcacagacacattccagggaattaaggttaaaactaccaacaacggtactgctaatgctacagagtgggagtctg

SEQ ID NO: 242024 - DNA, 75 bp, Artificial Sequence
  Synthetic
gctaatgctacagagtgggagtctgatacttctgtcaataatgccaatgagattgccaagggtaatccatttgcc

SEQ ID NO: 242025 - DNA, 75 bp, Artificial Sequence
  Synthetic
cgattacatgaacggccgggtggtggcgccctcgctggtggactcctacatcaacatcggggcgcgctggtcgct

SEQ ID NO: 242026 - DNA, 75 bp, Artificial Sequence
  Synthetic
tgcgctaccgctccatgctcctgggcaacgggcgctacgtgcccttccacatccaggtgccccagaaatttttcg

SEQ ID NO: 242027 - DNA, 75 bp, Artificial Sequence
  Synthetic
acggccattttttcgggggtgacgcaataaaaggtgcgggggtcgccgtgccagcgatcccattttagctggagg

SEQ ID NO: 242028 - DNA, 75 bp, Artificial Sequence
  Synthetic
ccgagtgcaccagccccaccgcggcgtcatcgaggccgtctacctgcgcacccccttctcggccggtaacgccac

SEQ ID NO: 242029 - DNA, 75 bp, Artificial Sequence
  Synthetic
ccgcgccgttagtggcgacgtcgatggcttgcagggtcccgtgcccctggggagtgaccaccgtcccctgtttct

SEQ ID NO: 242030 - DNA, 75 bp, Artificial Sequence
  Synthetic
ttccatggttagaagcggcggcgaggacgcgcgccgggcggcaggggcggctcgggacctgcaggcaggggcggc

SEQ ID NO: 242031 - DNA, 75 bp, Artificial Sequence
  Synthetic
ccccatggacaagaaccccaccatgaacttgctgacgggggtgcccaacggcatgctccagtcgccccaggtgga

SEQ ID NO: 242032 - DNA, 75 bp, Artificial Sequence
  Synthetic
ggtgacaaagaagtacataatccagcggcgaagcggcatttcgctgacgtcgcccagggcttccaagcgctccat

SEQ ID NO: 242033 - DNA, 75 bp, Artificial Sequence
  Synthetic
tgtaacactgtgtgtgtatgttaaaatatcttttaataaacagcactttcatgttacacatgcatctgagatgat

SEQ ID NO: 242034 - DNA, 75 bp, Artificial Sequence
  Synthetic
atgccatgcggatgaagcacaaaattctcaggtgcgtacaaaatgtaattactcccctcctgcacaggcagcgaa

SEQ ID NO: 242035 - DNA, 75 bp, Artificial Sequence
  Synthetic
ttcaggtcggtctccacgcggtagcggtccatcagcatagtcatgatttccatgcccttctcccaggccgagacg

SEQ ID NO: 242036 - DNA, 75 bp, Artificial Sequence
  Synthetic
ggtccatcagcatagtcatgatttccatgcccttctcccaggccgagacgatgggtaggctcatggggttcttca

SEQ ID NO: 242037 - DNA, 75 bp, Artificial Sequence
  Synthetic
acaaccattgtgtttacagtaagtgtgattaactttagctggggaggcagagggtgactgggtgctgactggttt

SEQ ID NO: 242038 - DNA, 75 bp, Artificial Sequence
  Synthetic
aagcggtcagcggctcgactccgtggcctggaggctaagcaaacgggttgggctgcgcgtgtaccccggttcgaa

SEQ ID NO: 242039 - DNA, 75 bp, Artificial Sequence
  Synthetic
agctagtaagcacggaaagcggccgaccgcaatggctcgctgccagatttcgcagctaacgagggcgtggctgtc

SEQ ID NO: 242040 - DNA, 75 bp, Artificial Sequence
  Synthetic
ggagactcagccatcgccaacctcgccatctgcccccaccaccgccgacgagaagcagcagcagcagaatgaaag

SEQ ID NO: 242041 - DNA, 75 bp, Artificial Sequence
  Synthetic
cagtgcgctttcaatcgtcaagccaggaagataaagaacagccagagcaggaagcagagaacgagcagagtcaga

SEQ ID NO: 242042 - DNA, 75 bp, Artificial Sequence
  Synthetic
atattttacagagcattgtggtgcaggagcgcgggctgccgctgtccgaaaagctggcggccattaacttttcgg

SEQ ID NO: 242043 - DNA, 75 bp, Artificial Sequence
  Synthetic
ggaaagctactttgacatgggcgcagacctgcactggcagcccagccgccgggtcttggaagccgcggcggtccc

SEQ ID NO: 242044 - DNA, 75 bp, Artificial Sequence
  Synthetic
atcatttggtgttgtcctgcaacgggacggagttcggctccagcggggaagaatctgactagagtgagtagtgtt

SEQ ID NO: 242045 - DNA, 75 bp, Artificial Sequence
  Synthetic
gtggaagaagcagccgccgccagaccgtcgtcctcggcgggggagaaagcaagcagcacggataccatctccgct

SEQ ID NO: 242046 - DNA, 75 bp, Artificial Sequence
  Synthetic
tccatgcactcatccatgatgatggcgatgggcccgtgggcggcggcttgggcaaagacgtttcgggggtcggac

SEQ ID NO: 242047 - DNA, 75 bp, Artificial Sequence
  Synthetic
cgatgggcccgtgggcggcggcttgggcaaagacgtttcgggggtcggacacatcgtagttgtggtcctgggtga

SEQ ID NO: 242048 - DNA, 75 bp, Artificial Sequence
  Synthetic
cgcagccggtggggccgtagatgaccccgatgaccggctgcaggtggtagttgagggagagacagctgccgtcct

SEQ ID NO: 242049 - DNA, 75 bp, Artificial Sequence
  Synthetic
cgaggagcatcctcagggcccggcccacggagtgcggatcgtcgtcgaagggggcctagactcccacctgcttcg

SEQ ID NO: 242050 - DNA, 75 bp, Artificial Sequence
  Synthetic
accttccacctgatcccgaataccacctcttccccagcgccgctccccactaacaaccaaactaaccaccaccaa

SEQ ID NO: 242051 - DNA, 75 bp, Artificial Sequence
  Synthetic
acgtgaccgggggtcccggccgggggggtataaaagggggcgggcccctgctcgtcctcactgtcttccggatcg

SEQ ID NO: 242052 - DNA, 75 bp, Artificial Sequence
  Synthetic
taagaaatggggaagatcaccctagtgtgcggtgtgctggtgacggtggtgctttcgattctgggagggggaagc

SEQ ID NO: 242053 - DNA, 75 bp, Artificial Sequence
  Synthetic
ccgatccctgcttgactttcaaccccgataaatgccggctgagttttcagcccgatggcaatcggtgcgcggtgt

SEQ ID NO: 242054 - DNA, 75 bp, Artificial Sequence
  Synthetic
gctgacggctccctccgcacggtgaacaacactttcatttttgagcacatgtgcgataccgccatgttcatgagc

SEQ ID NO: 242055 - DNA, 75 bp, Artificial Sequence
  Synthetic
acaacactttcatttttgagcacatgtgcgataccgccatgttcatgagcaagcagtacggtatgtggcccccac

SEQ ID NO: 242056 - DNA, 75 bp, Artificial Sequence
  Synthetic
tgttacaatccttatttattttttgggccttgtgggcactatcagcagtttcgaccataaaaacgtaactgctta

SEQ ID NO: 242057 - DNA, 75 bp, Artificial Sequence
  Synthetic
ggccttgtgggcactatcagcagtttcgaccataaaaacgtaactgcttatgttggttctaactgtgtactatct

SEQ ID NO: 242058 - DNA, 75 bp, Artificial Sequence
  Synthetic
catggtactggtttgataaaaagaacacagcttatacactctgcaaaggctatcagcagcccacacatcgcagtg

SEQ ID NO: 242059 - DNA, 75 bp, Artificial Sequence
  Synthetic
gtctttattacagctgcaccaataataatatcacactacttcaagtaaccaaccaatattctgggacctactatg

SEQ ID NO: 242060 - DNA, 75 bp, Artificial Sequence
  Synthetic
cggttgagaaggaactcttcgcggtccttccagtactcttcgagggggaacccgtcctgatcggcacggtaagag

SEQ ID NO: 242061 - DNA, 75 bp, Artificial Sequence
  Synthetic
gatccaactactcccagaactactactaaacataccacaactaagaagcccactacacctaaaaagcctaccacg

SEQ ID NO: 242062 - DNA, 75 bp, Artificial Sequence
  Synthetic
ctaagcagaccactaccacagagccaaccacaaccagcaccacacttgctataactacacacactgagctgacct

SEQ ID NO: 242063 - DNA, 75 bp, Artificial Sequence
  Synthetic
cacaggcaactactgaaaatggttttgccctattgcaaaagggggagaacagtagcagcagtcctctgcctacta

SEQ ID NO: 242064 - DNA, 75 bp, Artificial Sequence
  Synthetic
atttttaattttttagaaccatgaagatcctaagcctttttgttttttctatcattacctctgctatttgtaaat

SEQ ID NO: 242065 - DNA, 75 bp, Artificial Sequence
  Synthetic
gatcctaagcctttttgttttttctatcattacctctgctatttgtaaatcagtggataaggacgttactgtcac

SEQ ID NO: 242066 - DNA, 75 bp, Artificial Sequence
  Synthetic
gggccttcctcaggtatgctttcgtggtattgttattttggaaatgatgataaacagacagagctttgtaatttc

SEQ ID NO: 242067 - DNA, 75 bp, Artificial Sequence
  Synthetic
ggtattgttattttggaaatgatgataaacagacagagctttgtaatttccagaacggaaaaaccaaaaattcta

SEQ ID NO: 242068 - DNA, 75 bp, Artificial Sequence
  Synthetic
tactgatttagtactgatgaatatcacgaaagcatatgctggcagttattcctgtcctggacaaaacaccgaaga

SEQ ID NO: 242069 - DNA, 75 bp, Artificial Sequence
  Synthetic
aatgattttttacaaattgattgtggttgatcccactacacctccacccaccacaactaccaatgcacctaccac

SEQ ID NO: 242070 - DNA, 75 bp, Artificial Sequence
  Synthetic
tacgtcctggccatcggcgtggccatcgtctgcctcgatggtggtcatgctgacgaggccgcgcgggaggcaggt

SEQ ID NO: 242071 - DNA, 75 bp, Artificial Sequence
  Synthetic
ttccagagccatgaaggcacttagcactttagtatttttgtccttgattggcattgttttcagtgctgggttttt

SEQ ID NO: 242072 - DNA, 75 bp, Artificial Sequence
  Synthetic
tggctctcacatgccgcattcgcgtccccattacgggctaccgaggaagaaaaccgcgccgtagaaggctggcgg

SEQ ID NO: 242073 - DNA, 75 bp, Artificial Sequence
  Synthetic
gataatgcaacactggtaggaatcagtggtcagaatgttagttggctaaaatatcatctagatgggtggaaacct

SEQ ID NO: 242074 - DNA, 75 bp, Artificial Sequence
  Synthetic
gtggtcagaatgttagttggctaaaatatcatctagatgggtggaaacctatttgcacctggaatgtcagtgtgt

SEQ ID NO: 242075 - DNA, 75 bp, Artificial Sequence
  Synthetic
cattaccaatgccacccaagatcagaatggcaggtttaagggtcagagtttcactagcaacaatggctatgaaac

SEQ ID NO: 242076 - DNA, 75 bp, Artificial Sequence
  Synthetic
aatggcaggtttaagggtcagagtttcactagcaacaatggctatgaaacccataacatgttcatctatgatgtc

SEQ ID NO: 242077 - DNA, 75 bp, Artificial Sequence
  Synthetic
ctaccacccaaacacccactacacatagctcaactcatgccatgcagaccactcagaccaccacttacactacat

SEQ ID NO: 242078 - DNA, 75 bp, Artificial Sequence
  Synthetic
tagctcaactcatgccatgcagaccactcagaccaccacttacactacatccattcagcccaccaccactacagc

SEQ ID NO: 242079 - DNA, 75 bp, Artificial Sequence
  Synthetic
ccccaagcattggctttgatggctgcacagcctagcagcatgactgctaaaaccaatgagcagactactgaattt

SEQ ID NO: 242080 - DNA, 75 bp, Artificial Sequence
  Synthetic
cacagcctagcagcatgactgctaaaaccaatgagcagactactgaatttttgtccactactcagagcagcacca

SEQ ID NO: 242081 - DNA, 75 bp, Artificial Sequence
  Synthetic
caccgccaatctcacctcgctttcttctacgccaatcagtaatgctactacctcccccgctcctcttcccactcc

SEQ ID NO: 242082 - DNA, 75 bp, Artificial Sequence
  Synthetic
cagctgcagatcaccctgctcattgtgatcggggtggtcatcctggcagtgctgctctactttatcttctgccgc

SEQ ID NO: 242083 - DNA, 75 bp, Artificial Sequence
  Synthetic
tgatcggggtggtcatcctggcagtgctgctctactttatcttctgccgccgcatccccaacgcgaaaccggcct

SEQ ID NO: 242084 - DNA, 75 bp, Artificial Sequence
  Synthetic
tgctgacgcacacggacgaaccgcccccgtacgaggaggcggtaaaactgggcctgcccaccacgcgtcccatcg

SEQ ID NO: 242085 - DNA, 75 bp, Artificial Sequence
  Synthetic
agaagtacatgatccagcggcggagcggcatctcgctgacgtcgcccagggcttccaagcgctccatggcctcgt

SEQ ID NO: 242086 - DNA, 75 bp, Artificial Sequence
  Synthetic
cctagacatttcattatcacttctctaatctgtgtgctccaagtctgtgccaccctcgctctcgtggctaacgcg

SEQ ID NO: 242087 - DNA, 75 bp, Artificial Sequence
  Synthetic
cgaactggcagagcactctgaacagcatcgtgggtctgggagtgcagagtgtgaagcgccgccgctgctattaaa

SEQ ID NO: 242088 - DNA, 75 bp, Artificial Sequence
  Synthetic
cagtaccgcgaccagagagtggcgcaactgttgagactcatctgatgataagcatgcgggctctgctactactcc

SEQ ID NO: 242089 - DNA, 75 bp, Artificial Sequence
  Synthetic
aactgttgagactcatctgatgataagcatgcgggctctgctactactcctcgcgcttctgctagttcccctcgc

SEQ ID NO: 242090 - DNA, 75 bp, Artificial Sequence
  Synthetic
acccagtcccctgaagaggttcgaaaatgtaaattccaagaaccctggaaattcctttcatgctacaaactcaaa

SEQ ID NO: 242091 - DNA, 75 bp, Artificial Sequence
  Synthetic
tgatcattggaatcgtgaacatccttgcctgtaccctcttctcctttgtgatttacccccgctttgactttgggt

SEQ ID NO: 242092 - DNA, 75 bp, Artificial Sequence
  Synthetic
cagcagcagcaaaatcaggcacacgcaccaccaccacagcctaggccacaatacatgcccatcttagactatgag

SEQ ID NO: 242093 - DNA, 75 bp, Artificial Sequence
  Synthetic
gccgagccacagcgagccatgcttcctgctattagttacttcaacctaaccggcggagatgactgaccccatggc

SEQ ID NO: 242094 - DNA, 75 bp, Artificial Sequence
  Synthetic
ccctctgcggcctccgcgacctcctccccatgaactaatcaactaacccctacccctttaccctccagtaaaaaa

SEQ ID NO: 242095 - DNA, 75 bp, Artificial Sequence
  Synthetic
gtcaccaccaagaacggggctgtcaccctcaagctgggggagggggtggacctcgacgactcgggaaaactcatt

SEQ ID NO: 242096 - DNA, 75 bp, Artificial Sequence
  Synthetic
tagtaagcgcggaaagcggccgtccgcgatggctcgctgccgtagtctggagaaagaatcgccagggttgcgttg

SEQ ID NO: 242097 - DNA, 75 bp, Artificial Sequence
  Synthetic
ttatataccaaagatggaaaactatccttacaagtttctccaccattaaatatattaagatcaacgattctgaac

SEQ ID NO: 242098 - DNA, 75 bp, Artificial Sequence
  Synthetic
acatttgatgataaaggaaatataaagattaccctagacaggggattgcatgttacgacaggaaatgcaattgaa

SEQ ID NO: 242099 - DNA, 75 bp, Artificial Sequence
  Synthetic
agcagccagccactaccgcggcggccgccgtgagcggagccggcgttcagtatgacctggccttggaagagggcg

SEQ ID NO: 242100 - DNA, 75 bp, Artificial Sequence
  Synthetic
taaaatttgaagatggagccatagctgccaacattggtaaagggctagagtttggcaccagtagtacagtaacag

SEQ ID NO: 242101 - DNA, 75 bp, Artificial Sequence
  Synthetic
tgccaacattggtaaagggctagagtttggcaccagtagtacagtaacaggtgttgacgacgcttatccaataca

SEQ ID NO: 242102 - DNA, 75 bp, Artificial Sequence
  Synthetic
tttgatagcacaggggctatcatggctggcaataaggaggatgacaaacttactttatggacaacacctgatcca

SEQ ID NO: 242103 - DNA, 75 bp, Artificial Sequence
  Synthetic
ctggcaataaggaggatgacaaacttactttatggacaacacctgatccatcgccaaattgtcaaatactcgcag

SEQ ID NO: 242104 - DNA, 75 bp, Artificial Sequence
  Synthetic
cttaacaaagtgtggtagtcaaatattggccactgtatcagtcttagtggtaggaagtggaaagttaaacccaat

SEQ ID NO: 242105 - DNA, 75 bp, Artificial Sequence
  Synthetic
ttggccactgtatcagtcttagtggtaggaagtggaaagttaaacccaattactggggaagtaagcagtgctcaa

SEQ ID NO: 242106 - DNA, 75 bp, Artificial Sequence
  Synthetic
gagtactcttagtaaacagctccacattgaaaaagtattgggggtataggcagggtgacagcatagatggtactc

SEQ ID NO: 242107 - DNA, 75 bp, Artificial Sequence
  Synthetic
attgaaaaagtattgggggtataggcagggtgacagcatagatggtactccatacaccaacgccgtaggtttcat

SEQ ID NO: 242108 - DNA, 75 bp, Artificial Sequence
  Synthetic
gtggaggaggtggacgatgaggaggaggagggcgagtacctggaagactgatggcgcgaccgtatttttgctaga

SEQ ID NO: 242109 - DNA, 75 bp, Artificial Sequence
  Synthetic
tcccaaagttctactactaaaaataatatagtgggacaagtatacatgaatggtgataattcaaaacctatgctt

SEQ ID NO: 242110 - DNA, 75 bp, Artificial Sequence
  Synthetic
atatagtgggacaagtatacatgaatggtgataattcaaaacctatgcttcttactataactctcaatggcactg

SEQ ID NO: 242111 - DNA, 75 bp, Artificial Sequence
  Synthetic
gtcattttcatacacctggactaatggaagttataccggagcaacatttggagctaactcatacacattttccta

SEQ ID NO: 242112 - DNA, 75 bp, Artificial Sequence
  Synthetic
gagctaactcatacacattttcctacattgcccaagaataatcccaccctgcatgccaaccccttttcccactct

SEQ ID NO: 242113 - DNA, 75 bp, Artificial Sequence
  Synthetic
agttcaagtgtttttattgattcaacagttttcacaggattcgagtagttattttccctcctccctcccaactca

SEQ ID NO: 242114 - DNA, 75 bp, Artificial Sequence
  Synthetic
caacaactcgggctttgtcggttacctcgcgcccaccatgcgccggggccagccctaccccgccaactaccccta

SEQ ID NO: 242115 - DNA, 75 bp, Artificial Sequence
  Synthetic
ctcgcggccgtggatcaactgggaactgaacaagtctatgttggcacagcacaggcacacgctcatgcatgtctt

SEQ ID NO: 242116 - DNA, 75 bp, Artificial Sequence
  Synthetic
caactcccactctgcctactttcgctgtcaccgcgcgcgcattcagaaggcaaccgcctttgaccgcatgaatca

SEQ ID NO: 242117 - DNA, 75 bp, Artificial Sequence
  Synthetic
cgcaatcaggcagcaccggatgatcctccaccagagaagcgcgggtctcggtctcctcacagcgaggtaaggggg

SEQ ID NO: 242118 - DNA, 75 bp, Artificial Sequence
  Synthetic
aaatatgtttaataaacagcactttttatgtgacacatgcatttgagataattttattcttaaaaatcaaaggga

SEQ ID NO: 242119 - DNA, 75 bp, Artificial Sequence
  Synthetic
acagccactccctcagagcatgcagtatctcctgagcctcttgggtgatgaaaatcccatccgccctgatggctc

SEQ ID NO: 242120 - DNA, 75 bp, Artificial Sequence
  Synthetic
gagatggcacctctcgcccccactgtgttggtggaaaataacagccaggtcaaaggtgacacggttctcgagatg

SEQ ID NO: 242121 - DNA, 75 bp, Artificial Sequence
  Synthetic
atggccttcatgaaagcctccagctgcttaaacgcctgctgggccttggctccctcggtaaagaagaccccgcag

SEQ ID NO: 242122 - DNA, 75 bp, Artificial Sequence
  Synthetic
taattcctcaatcatcatattacactcctgcaccatccccagataattttcatttttccagccttgaatgattcg

SEQ ID NO: 242123 - DNA, 75 bp, Artificial Sequence
  Synthetic
attaacaatgggaatatcaaaatctctgccgcgatccctaagctcctccctcaacaataactgtatgtaatcttt

SEQ ID NO: 242124 - DNA, 75 bp, Artificial Sequence
  Synthetic
gtgcaaggagtgcgctccagcatggttagtgttttttggtgatctgtagaacaaaaaaataaacatgcaatatta

SEQ ID NO: 242125 - DNA, 75 bp, Artificial Sequence
  Synthetic
gatttccatgcccttctcccaggccgatacaatgggcaggcttagggggttcatcaccgccatcttagcgctagc

SEQ ID NO: 242126 - DNA, 75 bp, Artificial Sequence
  Synthetic
gcgaccccatgcggatgaagcacaaaattggcaggtgcgtaaaaaatgtaattactcccctcctgcacaggcagc

SEQ ID NO: 242127 - DNA, 75 bp, Artificial Sequence
  Synthetic
gtggttgttcctgaggcgagggggagcgcgagttttcgctcaccactactatctcttcttcttggtccgaggcca

SEQ ID NO: 242128 - DNA, 75 bp, Artificial Sequence
  Synthetic
gcccaaaccggcgtcatttccgggttcccacgctacgtcacctatcagcgactttcaaattccgtcgaccgttaa

SEQ ID NO: 242129 - DNA, 75 bp, Artificial Sequence
  Synthetic
cacgaggaagagcttgcagtgcgcttttcaacccaggaagagatacaccaagaacagccagagcaggaagcagag

SEQ ID NO: 242130 - DNA, 75 bp, Artificial Sequence
  Synthetic
ggtcgcccttcccgcagccaatcacaacccttcctccccaaattcaaacgcctcatttgcatattaacgcgcaca

SEQ ID NO: 242131 - DNA, 75 bp, Artificial Sequence
  Synthetic
aacccttcctccccaaattcaaacgcctcatttgcatattaacgcgcacaaaaagtttgaggtatattattgatg

SEQ ID NO: 242132 - DNA, 75 bp, Artificial Sequence
  Synthetic
gcgggggggaggacgcgctcatcaagcatctggcccgacaggccatcatcgtcaaggacgcgctgcttgaccgca

SEQ ID NO: 242133 - DNA, 75 bp, Artificial Sequence
  Synthetic
cttattaagcgcgcgtcgcccatctccaaggagatgcaagaccccgagagctccgaggagggcaagcccgtggtc

SEQ ID NO: 242134 - DNA, 75 bp, Artificial Sequence
  Synthetic
gcgactgcgtctacctctacctttgccacacctggcagacggccatgggcgtgtggcagcagtgtctggaggagc

SEQ ID NO: 242135 - DNA, 75 bp, Artificial Sequence
  Synthetic
gatgcccaactacgcgctgcatccttccatcatccccacgccgggctaccgcggcacgcgcttctaccgcggcta

SEQ ID NO: 242136 - DNA, 75 bp, Artificial Sequence
  Synthetic
cccgccgcagcagcaccgcgacttccgccgccgccctggtgcggagagtgtaccgcagcgggcgcgagcctctga

SEQ ID NO: 242137 - DNA, 75 bp, Artificial Sequence
  Synthetic
cagaggaggaggagatggaagactgggacagcactcaggcagaggaggacagcctgcaagacagtctggaagacg

SEQ ID NO: 242138 - DNA, 75 bp, Artificial Sequence
  Synthetic
gcagcagcagcagccagcccgcgaccctggacttgcctccgcctgcttcccgcccctccacagtggctaagcccc

SEQ ID NO: 242139 - DNA, 75 bp, Artificial Sequence
  Synthetic
acaacagcctggctcccaagggagcgcccaacacttgccagtggacatataaagctgatggtgatactggtacag

SEQ ID NO: 242140 - DNA, 75 bp, Artificial Sequence
  Synthetic
gcctgtgcaaggcattagtattacaaaagatggtattcaacttggaactgacactgatgatcagcccatttatgc

SEQ ID NO: 242141 - DNA, 75 bp, Artificial Sequence
  Synthetic
tcgaagtgcagctgcggctggcctggccccagaaattgttttgtatactgagaatgtggatctggaaactccaga

SEQ ID NO: 242142 - DNA, 75 bp, Artificial Sequence
  Synthetic
cgacaacagggcaacaccctcctgaccctctactgcatctgcaaccaccccggcctgcatgaaagtctttgttgt

SEQ ID NO: 242143 - DNA, 75 bp, Artificial Sequence
  Synthetic
acagatgacagcagctcttctatcaatttgggtcagcagtccatgcccaacagacccaactacattggctttaga

SEQ ID NO: 242144 - DNA, 75 bp, Artificial Sequence
  Synthetic
gagtcctgctaaacggtcccgccaaccttactttttccacccgcagaagcaagctactgctcttccgacccttcc

SEQ ID NO: 242145 - DNA, 75 bp, Artificial Sequence
  Synthetic
cagcgccgctccccactaacaaccaaactaaccaccaccaacgctaccgtcgagacctcgttgaatctaatacca

SEQ ID NO: 242146 - DNA, 75 bp, Artificial Sequence
  Synthetic
cttttaaccccgacaaatgccagctgagttttcaaccagatggcaatcggtgcgcggtgttgattaagtgcgggt

SEQ ID NO: 242147 - DNA, 75 bp, Artificial Sequence
  Synthetic
ttataaaaacaagacgcggaacaatactctcgcgtccacatggcagcccggggaccccgagtggtacaccgtctc

SEQ ID NO: 242148 - DNA, 75 bp, Artificial Sequence
  Synthetic
cattttttacacacctttttcagaccatggcctctgttacagcccttatttattttttgggtcttctgggctcta

SEQ ID NO: 242149 - DNA, 75 bp, Artificial Sequence
  Synthetic
cttgccctcggcctcggtgcacccgtgcagccacagcgcgcagccggtgcactcccagttcttgtgggcgatctg

SEQ ID NO: 242150 - DNA, 75 bp, Artificial Sequence
  Synthetic
tattgctagctcccctggttgccccctttcccctcaaatcccccacccagtcccccaaagaggttcgaaaatgta

SEQ ID NO: 242151 - DNA, 75 bp, Artificial Sequence
  Synthetic
ttagctacttcaatctaaccggtgaagatgactgacccactgaacaacaccgtcaacgacctcctggacatggac

SEQ ID NO: 242152 - DNA, 75 bp, Artificial Sequence
  Synthetic
cccgccgccgccgacgagaaccagcagcagaatgaaagcttaaccgccccgccgcccagccccacctccgacgcc

SEQ ID NO: 242153 - DNA, 75 bp, Artificial Sequence
  Synthetic
agcaccacagcgccctggtggagttggaaggcgacaacgcgcgcctggcggtgctcaagcgcacggtcgagctga

SEQ ID NO: 242154 - DNA, 75 bp, Artificial Sequence
  Synthetic
gagcggcgcaagctcatgatggccgtggtcctggtgaccgtggagctggagtgtctgcgccgcttcttcgccgac

SEQ ID NO: 242155 - DNA, 75 bp, Artificial Sequence
  Synthetic
gatttggaggaagactgggagagcagtcaggcagaggaggaggagatggaagactgggacagcactcaggcagag

SEQ ID NO: 242156 - DNA, 75 bp, Artificial Sequence
  Synthetic
tggctgttccagggctccccgatcgccgttgtcaaccactgcgacaacgacggagtcctgctgagcggccccgcc

SEQ ID NO: 242157 - DNA, 75 bp, Artificial Sequence
  Synthetic
tcgggaccctgccatcacaccttccacctgatcccgaataccacagcgccgctccccgctactaacaaccaaact

SEQ ID NO: 242158 - DNA, 75 bp, Artificial Sequence
  Synthetic
gctcatcgctattcgccccagaaataatgccgaaaaagagaaacagccataacacgttttttcacacaccttttt

SEQ ID NO: 242159 - DNA, 75 bp, Artificial Sequence
  Synthetic
catcatcaaataatataccttaaacttttggtgcgcgttaatatgcaaatgaggtatttgaatttggggatgcgg

SEQ ID NO: 242160 - DNA, 75 bp, Artificial Sequence
  Synthetic
tgttataagtaatgagaaactcactatttacattggcactaaccacactttagacggaattccaaaatcctcatg

SEQ ID NO: 242161 - DNA, 75 bp, Artificial Sequence
  Synthetic
atttacattggcactaaccacactttagacggaattccaaaatcctcatggtattgctattttgatcaagatcca

SEQ ID NO: 242162 - DNA, 75 bp, Artificial Sequence
  Synthetic
gaccgttaggggcggggcgggtgacgttttgatgacgtgtttgtgaggcggagccggtttgcaagttctcgtggg

SEQ ID NO: 242163 - DNA, 75 bp, Artificial Sequence
  Synthetic
acaagggaaaaaatacaagcattcatttaattaactttaattgcggagacaatttgaaattaattaatatcacta

SEQ ID NO: 242164 - DNA, 75 bp, Artificial Sequence
  Synthetic
aagagtatggaggtatgtattactatgttgcagaaaataacaacatgcagttttatgaagttactgtaactaatc

SEQ ID NO: 242165 - DNA, 75 bp, Artificial Sequence
  Synthetic
caccaccacaaaaactacacctgttaccactatgcagctcactaccaataacatttttgccatgcgtcaaatggt

SEQ ID NO: 242166 - DNA, 75 bp, Artificial Sequence
  Synthetic
aggaatgcttgcctccgagcgatgatgaggaggacgaggaggcgattcgagctgcagcgaaccagggagtgaaag

SEQ ID NO: 242167 - DNA, 75 bp, Artificial Sequence
  Synthetic
gacaatgaggacgttactgtcgttgtcggaaccaattatacactgaaaggtccagcgaagggtatgctttcgtgg

SEQ ID NO: 242168 - DNA, 75 bp, Artificial Sequence
  Synthetic
aaggcagttagcactctagttttttgttctttgattggcactgtttttagtgttagctttttgaaacaaatcaat

SEQ ID NO: 242169 - DNA, 75 bp, Artificial Sequence
  Synthetic
tggtaggcgtagagggtgctcaaaataccacctggacaaaattccatctagatgggtggaaagaaatttgcacct

SEQ ID NO: 242170 - DNA, 75 bp, Artificial Sequence
  Synthetic
taccacctggacaaaattccatctagatgggtggaaagaaatttgcacctggaatgtcagtacttatacatgtga

SEQ ID NO: 242171 - DNA, 75 bp, Artificial Sequence
  Synthetic
gtcagccaaattcaaaagggttggattaaagggcaatctgttagtgttagcaatagtgggtactatacccagcat

SEQ ID NO: 242172 - DNA, 75 bp, Artificial Sequence
  Synthetic
caatagtgggtactatacccagcatactcttatctatgacattatagttataccactgcctacacctagcccacc

SEQ ID NO: 242173 - DNA, 75 bp, Artificial Sequence
  Synthetic
tgattaatatcagaaattcctgctacatttcagggaatggggccgaggtggagatcagtacccaggagagggcgg

SEQ ID NO: 242174 - DNA, 75 bp, Artificial Sequence
  Synthetic
gcttcaataacatgtgcatcgaggcctggggcagtgtttcagtgaggggatgcagcttttcagccaactggatgg

SEQ ID NO: 242175 - DNA, 75 bp, Artificial Sequence
  Synthetic
cgaccatcgcctctcctacgagctcctgcagcagcgccagaagttcacctgcctggtcggagtcaaccccatcgt

SEQ ID NO: 242176 - DNA, 75 bp, Artificial Sequence
  Synthetic
ccaccaagaacggggaaatcaccctcaagctgggagatggggtggacctcgactcctcgggaaaactcatctcca

SEQ ID NO: 242177 - DNA, 75 bp, Artificial Sequence
  Synthetic
acacggccaccaaggccgccgcccctctcagtttttccaacaacaccatttcccttaacatggataccccttttt

SEQ ID NO: 242178 - DNA, 75 bp, Artificial Sequence
  Synthetic
ctagacacagacttgctaaaaacacttgttgtagcttatggacaaggtttaggaacaaacaccactggtgccctt

SEQ ID NO: 242179 - DNA, 75 bp, Artificial Sequence
  Synthetic
ttgttgtagcttatggacaaggtttaggaacaaacaccactggtgcccttgttgcccaactagcatccccacttg

SEQ ID NO: 242180 - DNA, 75 bp, Artificial Sequence
  Synthetic
ccttaatttaggcaatggaccattgaaagtggatgcaaatagactgaacatcaattgcaatagaggactctatgt

SEQ ID NO: 242181 - DNA, 75 bp, Artificial Sequence
  Synthetic
aaagtggatgcaaatagactgaacatcaattgcaatagaggactctatgttactaccacaaaagatgcactggaa

SEQ ID NO: 242182 - DNA, 75 bp, Artificial Sequence
  Synthetic
cagctgccgtcctcgcggaggaggggggccacctcgttcatcatctcgcgcacatgcatgttctcgcgcacgagt

SEQ ID NO: 242183 - DNA, 75 bp, Artificial Sequence
  Synthetic
tgacatttataggaaatgccatgggtgtcaatattgatacacaaaaaggcttgcaatttggcaccactagtaccg

SEQ ID NO: 242184 - DNA, 75 bp, Artificial Sequence
  Synthetic
tgtcaatattgatacacaaaaaggcttgcaatttggcaccactagtaccgtcgcagatgttaaaaacgcttaccc

SEQ ID NO: 242185 - DNA, 75 bp, Artificial Sequence
  Synthetic
ctcacatttgacagcacaggtgcaattgttgcatggaacaaagatgatgacaagcttacactatggaccacagcc

SEQ ID NO: 242186 - DNA, 75 bp, Artificial Sequence
  Synthetic
ttgttgcatggaacaaagatgatgacaagcttacactatggaccacagccgacccctctccaaattgtcacatat

SEQ ID NO: 242187 - DNA, 75 bp, Artificial Sequence
  Synthetic
actttgcttgacaaagtgtggcagtcagattctgggcactgtttccctcatagctgttgatactggcagtttaaa

SEQ ID NO: 242188 - DNA, 75 bp, Artificial Sequence
  Synthetic
cagattctgggcactgtttccctcatagctgttgatactggcagtttaaatcccataacaggaacagtaaccact

SEQ ID NO: 242189 - DNA, 75 bp, Artificial Sequence
  Synthetic
caaatggagttttgcaaagcagctcaacactagactcagactattggaatttcagacagggagatgttacacctg

SEQ ID NO: 242190 - DNA, 75 bp, Artificial Sequence
  Synthetic
aacactagactcagactattggaatttcagacagggagatgttacacctgctgaagcctatactaatgctatagg

SEQ ID NO: 242191 - DNA, 75 bp, Artificial Sequence
  Synthetic
cctaaaaacacaagtggagctgcaaaaagtcacattgttgggaaagtgtacctacatggggatacaggcaaacca

SEQ ID NO: 242192 - DNA, 75 bp, Artificial Sequence
  Synthetic
aaagtcacattgttgggaaagtgtacctacatggggatacaggcaaaccactggacctcattattactttcaatg

SEQ ID NO: 242193 - DNA, 75 bp, Artificial Sequence
  Synthetic
ctgtattaactttcaatggcagtggggggctgatcaatataaaaatgaaacacttgccgtcagttcattcacctt

SEQ ID NO: 242194 - DNA, 75 bp, Artificial Sequence
  Synthetic
ggggctgatcaatataaaaatgaaacacttgccgtcagttcattcaccttttcctatattgctaaagaataaacc

SEQ ID NO: 242195 - DNA, 75 bp, Artificial Sequence
  Synthetic
caccagcgggtccaccttctccagggtatgcaagcacatgtccccctcgtccacatccaggaaggtgattggctt

SEQ ID NO: 242196 - DNA, 75 bp, Artificial Sequence
  Synthetic
tctcgaaggcgggcatgacctcggcactcaggttgtcagtttctagaaacgaggaggatttgatattgacggtgc

SEQ ID NO: 242197 - DNA, 75 bp, Artificial Sequence
  Synthetic
gaagttgtaaaacagccactctctcagaccgtgcagcagatctagggcctcaggagtgatgaagatcccatcatg

SEQ ID NO: 242198 - DNA, 75 bp, Artificial Sequence
  Synthetic
ggcggggtcgctgaggccgtgctgctcgagggcccagtcggcgacgtgggggttggcgctgaggaaggaagtcca

SEQ ID NO: 242199 - DNA, 75 bp, Artificial Sequence
  Synthetic
aaatcgcccaggcaatttttaagaaaatcaacaaaagaaaaatcctccaggtgcacgtttagagcctcgggaaca

SEQ ID NO: 242200 - DNA, 75 bp, Artificial Sequence
  Synthetic
agggcgcgcaggccggagctgtccagggtcctgagacgctgcggagtcaggtcagtgggcagcggcggcgcgcgg

SEQ ID NO: 242201 - DNA, 75 bp, Artificial Sequence
  Synthetic
acacactcaaaaaaatacgcgcacttcctcaaacgcccaaactgccgtcatttccgggttcccacgctacgtcat

SEQ ID NO: 242202 - DNA, 75 bp, Artificial Sequence
  Synthetic
gccaatcaccgccccgcatccccaaattcaaatacctcatttgcatattaacgcgcaccaaaagtttgaggtata

SEQ ID NO: 242203 - DNA, 75 bp, Artificial Sequence
  Synthetic
gtcgcgcgcgcgcatgaccacctgggcgaggttgagctccacgtggcgcgtgaagaccgcgtagttgcagaggcg

SEQ ID NO: 242204 - DNA, 75 bp, Artificial Sequence
  Synthetic
ccccaacgaggaggcggtaaatgatttatttagcgatgccgcgctgctagctgccgaggaggctttaagccctag

SEQ ID NO: 242205 - DNA, 75 bp, Artificial Sequence
  Synthetic
ccactaacatctcttctacttcctcctcaggaggcggcggcgggggaggggccctgcgtcgccggcggcgcacgg

SEQ ID NO: 242206 - DNA, 75 bp, Artificial Sequence
  Synthetic
gatccgaaaaccgctgaacgaaggcttcgagccagtcgcagtcgcaaggtaggctgagcccggtttcttgttctt

SEQ ID NO: 242207 - DNA, 75 bp, Artificial Sequence
  Synthetic
gccggccggattccgcggctaacgtgggcgtggctgccccgtcgtttccaagaccccttagccagccgacttctc

SEQ ID NO: 242208 - DNA, 75 bp, Artificial Sequence
  Synthetic
gggccgggaccgagggggagagctactttgacatgggcgcggacctgcgctggcagcccagccgccgggccttgg

SEQ ID NO: 242209 - DNA, 75 bp, Artificial Sequence
  Synthetic
ccaacgtgcagacgaacctggaccgcatggtgaccgacgtgcgcgaggcggtgtcgcagcgcgagcggttccacc

SEQ ID NO: 242210 - DNA, 75 bp, Artificial Sequence
  Synthetic
tgcagggactgtggggcgtgcaggccccggtcggggaccgcgcgacggtgtcgagcctgctgacgccgaactcgc

SEQ ID NO: 242211 - DNA, 75 bp, Artificial Sequence
  Synthetic
cccggtcggggaccgcgcgacggtgtcgagcctgctgacgccgaactcgcgcctgctgctgctgctggtggcgcc

SEQ ID NO: 242212 - DNA, 75 bp, Artificial Sequence
  Synthetic
gagtacgacatgcccgaccccaacgacgggttcctgtgggacgacgtggacagcagcgtgttctcgccgcgcccc

SEQ ID NO: 242213 - DNA, 75 bp, Artificial Sequence
  Synthetic
gaacagcgtgcgcagcagcgagctgggtcggctgacgcggccgcgcctgctgggcgaggaggagtacctgaacga

SEQ ID NO: 242214 - DNA, 75 bp, Artificial Sequence
  Synthetic
atggtagtcaggacgagctgacctacgagtgggtggagtttgagctgcccgagggcaacttctcggtgaccatga

SEQ ID NO: 242215 - DNA, 75 bp, Artificial Sequence
  Synthetic
ctttcaagagcccctcgtccatctggtcagaaaaaacaatctttttgttgtcaagtttggtggcaaaggagccgt

SEQ ID NO: 242216 - DNA, 75 bp, Artificial Sequence
  Synthetic
gcggcagcccttccaggagggcttccagatcctgtacgaggacctggaggggggcaacatccccgcgctgctgga

SEQ ID NO: 242217 - DNA, 75 bp, Artificial Sequence
  Synthetic
cagatcctgtacgaggacctggaggggggcaacatccccgcgctgctggacgtcgaagcctacgagaaaagcaag

SEQ ID NO: 242218 - DNA, 75 bp, Artificial Sequence
  Synthetic
cggccgtggctactgctgcgaccaccgatgcagatgcagctactactaccaggggcgatacattcgccacccagg

SEQ ID NO: 242219 - DNA, 75 bp, Artificial Sequence
  Synthetic
cgatgcagatgcagctactactaccaggggcgatacattcgccacccaggcggaggaagcagccgccctagcggc

SEQ ID NO: 242220 - DNA, 75 bp, Artificial Sequence
  Synthetic
gtcatcaagccggtggagaaggacagcaaggacaggagctacaacgttctatcggatggaaagaacaccgcctac

SEQ ID NO: 242221 - DNA, 75 bp, Artificial Sequence
  Synthetic
tggcaacgagctcggcagtaacaaggacgtccagggcgcagtagtcgagggtctcttggatgatgtcatacttga

SEQ ID NO: 242222 - DNA, 75 bp, Artificial Sequence
  Synthetic
cagcggcgaggaggatgtccaagcgcaaatacaaggaagagatgctccaggtcatcgcgcctgagatctacggcc

SEQ ID NO: 242223 - DNA, 75 bp, Artificial Sequence
  Synthetic
gcgcgagttcgccccccggcggcgcgtgcagtggcgcgggcggaaagtgaaaccggtgctgcggcccggcaccac

SEQ ID NO: 242224 - DNA, 75 bp, Artificial Sequence
  Synthetic
cgctgcacgggatgcacgtgctgcacaagctgtacctgggttcctttgacgaggaatttcagtgggaagtggagt

SEQ ID NO: 242225 - DNA, 75 bp, Artificial Sequence
  Synthetic
ccagatggtacttgatctccaccgcgccgttagtggcgacgtcgatggcttgcagggtcccgtgcccctggggag

SEQ ID NO: 242226 - DNA, 75 bp, Artificial Sequence
  Synthetic
gacgcacacggacgagccgcccccgtacgaggaggcggtgaaactgggtctgcccaccacgcggcccgtggcgcc

SEQ ID NO: 242227 - DNA, 75 bp, Artificial Sequence
  Synthetic
agcagcagcagccagcccgcgaccctggacttgcctccgcctcgcccctccacagtggctaagcccctgccgccg

SEQ ID NO: 242228 - DNA, 75 bp, Artificial Sequence
  Synthetic
ctggctcccaagggagcgcccaacacttgccagtggacatatactgataaccaaactgagaaaacagccacatat

SEQ ID NO: 242229 - DNA, 75 bp, Artificial Sequence
  Synthetic
acattacaaaagatggcattcaacttggaactgacagcgatggtcaggcaatctatgcagacgaaacttatcagc

SEQ ID NO: 242230 - DNA, 75 bp, Artificial Sequence
  Synthetic
tggaactgacagcgatggtcaggcaatctatgcagacgaaacttatcagcccgaacctcaggtgggagatcctga

SEQ ID NO: 242231 - DNA, 75 bp, Artificial Sequence
  Synthetic
gaaaaatatggaggcagagcgcttaaacctgccaccgacatgaaaccttgctatggctcttttgccaagccaact

SEQ ID NO: 242232 - DNA, 75 bp, Artificial Sequence
  Synthetic
gcagaacaaaaactgatggaacaactgagcctgatattgacatggccttttttgatggtagaaatgcaacaacag

SEQ ID NO: 242233 - DNA, 75 bp, Artificial Sequence
  Synthetic
gtatactgaaaatgtggatctggaaactccagatacccatattgtatacaaggcaggcacagatgacagcagctc

SEQ ID NO: 242234 - DNA, 75 bp, Artificial Sequence
  Synthetic
aggcaggcacagatgacagcagctcttcaattaatttgggtcagcagtccatgcccaacagacccaactacattg

SEQ ID NO: 242235 - DNA, 75 bp, Artificial Sequence
  Synthetic
catgtactacaacagcactggcaatatgggcgtactggctggtcaggcctcccagctgaatgctgtggtggactt

SEQ ID NO: 242236 - DNA, 75 bp, Artificial Sequence
  Synthetic
gtggaatcaggcggtggacagttatgaccccgatgtgcgcattattgaaaatcacggtgtggaggatgaactacc

SEQ ID NO: 242237 - DNA, 75 bp, Artificial Sequence
  Synthetic
atcacggtgtggaggatgaactacccaactattgcttccccctgaatgctgtgggtagaacagatagttatcagg

SEQ ID NO: 242238 - DNA, 75 bp, Artificial Sequence
  Synthetic
caactattgcttccccctgaatgctgtgggtagaacagatagttatcagggaattaagcccaatggaggcgatcc

SEQ ID NO: 242239 - DNA, 75 bp, Artificial Sequence
  Synthetic
gtcaatgattctaatgaattgggcaagggcaatcctttcgccatggagatcaacatccaggccaacctgtggcgg

SEQ ID NO: 242240 - DNA, 75 bp, Artificial Sequence
  Synthetic
caacatccaggccaacctgtggcggaacttcctctacgcgaacgtggccctgtacctgcccgactcctacaagta

SEQ ID NO: 242241 - DNA, 75 bp, Artificial Sequence
  Synthetic
aacttcctctacgcgaacgtggccctgtacctgcccgactcctacaagtacacgccggccaacatcacgctgccc

SEQ ID NO: 242242 - DNA, 75 bp, Artificial Sequence
  Synthetic
gctggtggacgcctacatcaacatcggggcgcgctggtcgctggaccccatggacaacgtcaaccccttcaacca

SEQ ID NO: 242243 - DNA, 75 bp, Artificial Sequence
  Synthetic
ccaccgcaacgcgggcctgcgctaccgctccatgctcctgggcaacgggcgctacgtgcccttccacatccaggt

SEQ ID NO: 242244 - DNA, 75 bp, Artificial Sequence
  Synthetic
catcaacctctacgccaccttcttccccatggcgcacaacaccgcctccacgctcgaggccatgctgcgcaacga

SEQ ID NO: 242245 - DNA, 75 bp, Artificial Sequence
  Synthetic
gacccctacttcgtctactcgggctccatcccctacctcgacggcaccttctacctcaaccacaccttcaagaag

SEQ ID NO: 242246 - DNA, 75 bp, Artificial Sequence
  Synthetic
ggccgtctacctgcgcacgcccttctcggccggcaacgccaccacctaagccgctcttgcttcttgcaagatgac

SEQ ID NO: 242247 - DNA, 75 bp, Artificial Sequence
  Synthetic
ccgctcttgcttcttgcaagatgacggcctgtggctccggcgagcaggagctcagggccatcctccgcgacctgg

SEQ ID NO: 242248 - DNA, 75 bp, Artificial Sequence
  Synthetic
tgctgcgccgcagcgccctggccaccgaggaccgctgcgtcaccctggaaaagtccacccagaccgtgcagggtc

SEQ ID NO: 242249 - DNA, 75 bp, Artificial Sequence
  Synthetic
tcgagaaggccaccgccttcgaccgcatgaatcaagacatgtaaaccgtgtgtatgtgaatgctttattcataat

SEQ ID NO: 242250 - DNA, 75 bp, Artificial Sequence
  Synthetic
ccacagcttgcgcgtgagttgcagggcgcccagcaggtcgggcgcggagatcttgaaatcgcagttgggacccgc

SEQ ID NO: 242251 - DNA, 75 bp, Artificial Sequence
  Synthetic
gggggtgcgctcctggcggcgctgctctgactgacttcctccgcggccggccattatgttctcctagggagcaac

SEQ ID NO: 242252 - DNA, 75 bp, Artificial Sequence
  Synthetic
ccattatgttctcctagggagcaacaagcatggagactcagccatcgtcgccaacatcgccatctgcccccgccg

SEQ ID NO: 242253 - DNA, 75 bp, Artificial Sequence
  Synthetic
ctacctgatatcgcctccttggaagaggttcccaagatcttcgagggtctgggcagcgacgagactcgggccgcg

SEQ ID NO: 242254 - DNA, 75 bp, Artificial Sequence
  Synthetic
acctggcagacgggcatgggcgtgtggcagcagtgcctggaggagcagaacctgaaagagctctgcaagctcctg

SEQ ID NO: 242255 - DNA, 75 bp, Artificial Sequence
  Synthetic
ccggagaggagctcaaccccagcttcccccaggatgccccgaggaagcagcaagaagctgaaagtggagctgccg

SEQ ID NO: 242256 - DNA, 75 bp, Artificial Sequence
  Synthetic
cccccaggatgccccgaggaagcagcaagaagctgaaagtggagctgccgccggaggatttggaggaagactggg

SEQ ID NO: 242257 - DNA, 75 bp, Artificial Sequence
  Synthetic
catcttgcattactaccgtcacctccacagcccctactactgtttccaagaagaggcagaaacccagcagcagca

SEQ ID NO: 242258 - DNA, 75 bp, Artificial Sequence
  Synthetic
gcggcaggtggactgaggatcgcggcgaacgagccggcgcagacccgggagctgaggaaccggatctttcccacc

SEQ ID NO: 242259 - DNA, 75 bp, Artificial Sequence
  Synthetic
catgagcaaagagattcccacgccttacatgtggagctaccagccccagatgggcctggccgccggcgccgccca

SEQ ID NO: 242260 - DNA, 75 bp, Artificial Sequence
  Synthetic
accctgtactgcatctgcaaccaccccggcctgcatgaaagtctttgttgtctgctgtgtactgagtataataaa

SEQ ID NO: 242261 - DNA, 75 bp, Artificial Sequence
  Synthetic
catcatcaataatataccttaaagctggaaacgagccaatatgataatgagtgaggaggggctaggggtggtgcg

SEQ ID NO: 242262 - DNA, 75 bp, Artificial Sequence
  Synthetic
tggaaacgagccaatatgataatgagtgaggaggggctaggggtggtgcgaagtgacgtataggtaggcggggtg

SEQ ID NO: 242263 - DNA, 75 bp, Artificial Sequence
  Synthetic
gtgaggaggggctaggggtggtgcgaagtgacgtataggtaggcggggtgggaaagggtggaggtgaatgacgtt

SEQ ID NO: 242264 - DNA, 75 bp, Artificial Sequence
  Synthetic
cctaacctccaccccgcgaagtcaattgaacccgcccaattggcctgctgcccaggtatatcaggaaaaccccgc

SEQ ID NO: 242265 - DNA, 75 bp, Artificial Sequence
  Synthetic
ggggtcgaaggttggggagtggcgcggcggaagtgacggatccggtagtatgttttgaccggaaatttggtgtat

SEQ ID NO: 242266 - DNA, 75 bp, Artificial Sequence
  Synthetic
tgggcgggtttttgtaactttttggttattttggcgcgaaaactgagtaatgcggaagttgaacgaactctggac

SEQ ID NO: 242267 - DNA, 75 bp, Artificial Sequence
  Synthetic
aaaaaactcccgtaacgttagaattgccaccacccgcgcccaccgtaccgcctatgccggctcccaccctgggta

SEQ ID NO: 242268 - DNA, 75 bp, Artificial Sequence
  Synthetic
tgcggaagttgaacgaactctggactttttatggctagggagggaaaactgctgatcattgctgaactttggggc

SEQ ID NO: 242269 - DNA, 75 bp, Artificial Sequence
  Synthetic
tttgacgtggcggtttccctacgtggcactgccacgcgaatgctcaaagtccttattttattgtgtgttcagccc

SEQ ID NO: 242270 - DNA, 75 bp, Artificial Sequence
  Synthetic
ttttgagggtatttaaacacagccagaacgtcaagaggccactcttgagtgccagcgagtagagttttctcctcc

SEQ ID NO: 242271 - DNA, 75 bp, Artificial Sequence
  Synthetic
gttgccgccgagatgagaatgctgccggacttcttcaccgggaactgggatgacatgttccaggggctgctggag

SEQ ID NO: 242272 - DNA, 75 bp, Artificial Sequence
  Synthetic
tgacatgttccaggggctgctggaggctgagcatccgtttgattttcctgaaccttctcaggcttttgaagagat

SEQ ID NO: 242273 - DNA, 75 bp, Artificial Sequence
  Synthetic
catcgccgggcaggacgcctcggagtatctgagtccgggcctggtgcagtttgcccgcgccaccgatacgtactt

SEQ ID NO: 242274 - DNA, 75 bp, Artificial Sequence
  Synthetic
ttcgcttcacaatctttttgatgtggagctggatgagtctgaaggggatccgaatgaggaagcggtagatggtat

SEQ ID NO: 242275 - DNA, 75 bp, Artificial Sequence
  Synthetic
cccaatggtgcgtccgtgactgtgtggctgcaacatctacatcggcgccgtaatccttgctactttgtctgaaaa

SEQ ID NO: 242276 - DNA, 75 bp, Artificial Sequence
  Synthetic
gtttcctaactggatgctgtccgaggaccacagtgctgacagtggtgcggcttcgggcgattctggggttggaga

SEQ ID NO: 242277 - DNA, 75 bp, Artificial Sequence
  Synthetic
agcgcttggattacatgaagatctgtgttcttttttgtgtgctaagtttaacaagtagcctaaggacttcaccta

SEQ ID NO: 242278 - DNA, 75 bp, Artificial Sequence
  Synthetic
agacctggtggaggttaatttggacttgaaatgctatgaagagggtttgcctcctagcggctcggaggctgatga

SEQ ID NO: 242279 - DNA, 75 bp, Artificial Sequence
  Synthetic
agctgaagaacgagcggaggaggaagagacggctgtgtcgaattatgtgaatattgctgagggtgctagtcagct

SEQ ID NO: 242280 - DNA, 75 bp, Artificial Sequence
  Synthetic
ggtgttggactgtccagaaaacccgggacgaggttgtcgggcttgtgattttcatcggggctctagtggaaatcc

SEQ ID NO: 242281 - DNA, 75 bp, Artificial Sequence
  Synthetic
caaaataaaagttagaggacaagcaccccttataggaacaaacatagacaaagacaatgggattcagataggaac

SEQ ID NO: 242282 - DNA, 75 bp, Artificial Sequence
  Synthetic
tgaagctatgtgtgctttatgttacatgcgtctgaccggtcactgcatttacagtaagtagagattttttttttt

SEQ ID NO: 242283 - DNA, 75 bp, Artificial Sequence
  Synthetic
atgcgtctgaccggtcactgcatttacagtaagtagagatttttttttttgttttatactgctggatgatgtgtg

SEQ ID NO: 242284 - DNA, 75 bp, Artificial Sequence
  Synthetic
ccccttataggaacaaacatagacaaagacaatgggattcagataggaacagacgcaacgaagcctatttatgcc

SEQ ID NO: 242285 - DNA, 75 bp, Artificial Sequence
  Synthetic
gacaaaacatatcaaccagagcctcaagtgggccaaacacagtggaacagtgaagttggtgccactgacaaggta

SEQ ID NO: 242286 - DNA, 75 bp, Artificial Sequence
  Synthetic
ggggttaacgtgcttttttgtgcttactaggtccgatttcagatgcggaaggagagtgtgagttggggtcaaatg

SEQ ID NO: 242287 - DNA, 75 bp, Artificial Sequence
  Synthetic
gcgggtagggtattgaaagataccacgccaatgttaccatgctacgggtcttacgccaaaccaacaaatgaaaag

SEQ ID NO: 242288 - DNA, 75 bp, Artificial Sequence
  Synthetic
aggagactgagctgccttgttctttgaccgccacggcaccagtaagacccaccccatgcagagtttcctgtagac

SEQ ID NO: 242289 - DNA, 75 bp, Artificial Sequence
  Synthetic
ggtggtcaggccaatcttataacaaacggaaccgatcaaactctaacaagcgacgttaacttacagttctttgcc

SEQ ID NO: 242290 - DNA, 75 bp, Artificial Sequence
  Synthetic
gacgcccagctgttgattgcatagaagatttacttgaggaggatccgacggatgaacctttaaacttgtccttaa

SEQ ID NO: 242291 - DNA, 75 bp, Artificial Sequence
  Synthetic
gatgaacctttaaacttgtccttaaagcgccccaagtcctcttgagattatgtagtaataaaattattgacgttt

SEQ ID NO: 242292 - DNA, 75 bp, Artificial Sequence
  Synthetic
ttggcaaacactcctaatgtgccaaaagccgttctttacgctgagaatgtggctattgaagcgcccgacacccat

SEQ ID NO: 242293 - DNA, 75 bp, Artificial Sequence
  Synthetic
accctgtgttttatttcttgggtgtgtccgcgggtatataagcaggtggagtggtttcagtgttagtttattctg

SEQ ID NO: 242294 - DNA, 75 bp, Artificial Sequence
  Synthetic
ttggtgtacaagtcagatgtagctcagggaaccgtaagttcggcagatcttttaacgcaacaggcagcgcccaac

SEQ ID NO: 242295 - DNA, 75 bp, Artificial Sequence
  Synthetic
atggagttttggagtgagctacaaagttatcagagcctccgacgcttgctggagttggcttctgccagaacttcc

SEQ ID NO: 242296 - DNA, 75 bp, Artificial Sequence
  Synthetic
agaccaaactacattggctttagggataacttcattggcctgatgtactacaactccacaggcaatatgggcgta

SEQ ID NO: 242297 - DNA, 75 bp, Artificial Sequence
  Synthetic
agctgttggaggtttatttttggttcaaccttaactaatgtaatttatagagctaaagaggactactcttcgcga

SEQ ID NO: 242298 - DNA, 75 bp, Artificial Sequence
  Synthetic
ttggctgggcaggcttcacagctaaatgctgtagtggacttgcaagacaggaacactgagttatcgtaccaactt

SEQ ID NO: 242299 - DNA, 75 bp, Artificial Sequence
  Synthetic
tttgctgagcttttgtcttttaaccctggaatttttgcatctttaaatttgggccaccactcatttttccaggaa

SEQ ID NO: 242300 - DNA, 75 bp, Artificial Sequence
  Synthetic
atgctggatgctcttggcgatcggagcagatatttttccatgtggaatcaggctgttgacagttacgaccccgac

SEQ ID NO: 242301 - DNA, 75 bp, Artificial Sequence
  Synthetic
gcagatatttttccatgtggaatcaggctgttgacagttacgaccccgacgtaagaatcattgagaaccacggag

SEQ ID NO: 242302 - DNA, 75 bp, Artificial Sequence
  Synthetic
attgtgatcaaaaacttagatttttcttcccccggccgtacggtttctgggcttgctttcatttgttttatattg

SEQ ID NO: 242303 - DNA, 75 bp, Artificial Sequence
  Synthetic
gatcaatggagcgcccaaacccatctgtcggagggatatactctggattacatgacaatggccctgtggagaacc

SEQ ID NO: 242304 - DNA, 75 bp, Artificial Sequence
  Synthetic
acagacacgtattctggcataaaagcaaacagcggaaactggactgcggacaacgacacttatgccgacagaggg

SEQ ID NO: 242305 - DNA, 75 bp, Artificial Sequence
  Synthetic
ctgctgcggaggaagagggtcttaggttgctcgccggcgcagcctccgcacggtctggatccagtgcgggaggag

SEQ ID NO: 242306 - DNA, 75 bp, Artificial Sequence
  Synthetic
gcagaaattgagtctgggaatatttttgccatggaaatcaatttggcggccaatctctggcgcagcttcttatat

SEQ ID NO: 242307 - DNA, 75 bp, Artificial Sequence
  Synthetic
caatctctggcgcagcttcttatattccaatgtagccctgtatttgcctgactcatacaaaattacgccagacaa

SEQ ID NO: 242308 - DNA, 75 bp, Artificial Sequence
  Synthetic
gttgctcgccggcgcagcctccgcacggtctggatccagtgcgggaggaggaggaggaggaggaggaggaggaga

SEQ ID NO: 242309 - DNA, 75 bp, Artificial Sequence
  Synthetic
acctgagggccggtctggatcctcaaacggaattgtaactgaacctgaccccgaagagggtactagcagtgggca

SEQ ID NO: 242310 - DNA, 75 bp, Artificial Sequence
  Synthetic
aaggggggagaaaaggaagttagaaaatgacggggcggattttctaaaggagttaaccttgagtttaatgtctcg

SEQ ID NO: 242311 - DNA, 75 bp, Artificial Sequence
  Synthetic
tattgccaccgcaaaaaaatcaaggccaaagttcaacatcaaccagtgcatatttgtttagaaaaataaaatttt

SEQ ID NO: 242312 - DNA, 75 bp, Artificial Sequence
  Synthetic
ttgttatcctgagtctgtctggtgggctgatttggaagatgagtttaaaaatggaaacatgaatcttttatacaa

SEQ ID NO: 242313 - DNA, 75 bp, Artificial Sequence
  Synthetic
gtatggatttgaacagctgaaaacacattggatggagccttgggaggactgggaactagctttgaatatgtttgc

SEQ ID NO: 242314 - DNA, 75 bp, Artificial Sequence
  Synthetic
caaagtggctcttcgcccagacactatttataccattaagaaaactgttaatatacgtaaatgtgcctatgtaat

SEQ ID NO: 242315 - DNA, 75 bp, Artificial Sequence
  Synthetic
tggaaatggagccgtggttagattccaaacctttgaccgggtggtttttaactgtgcaatgcagagtttaggtcc

SEQ ID NO: 242316 - DNA, 75 bp, Artificial Sequence
  Synthetic
tggggtgattggtatgagcggggtaacatttaataatgtcagatttgcagcagatggatttaatggcaaggtgtt

SEQ ID NO: 242317 - DNA, 75 bp, Artificial Sequence
  Synthetic
tgcttctaccactcaattaactttgcatggtgtgttttttcaaaattgcagcggtgtttgcgtggattcctgggg

SEQ ID NO: 242318 - DNA, 75 bp, Artificial Sequence
  Synthetic
tagggtgtctgccagaggttgtacgtttgtgggatgttggaaagggctggtggggcaaaacaagagccaaatgtc

SEQ ID NO: 242319 - DNA, 75 bp, Artificial Sequence
  Synthetic
tgtaaaaaaatgtgtgtttgaacgatgcattttggctatggtggtagaaggccaggcgcgaattcgacataatgc

SEQ ID NO: 242320 - DNA, 75 bp, Artificial Sequence
  Synthetic
gggttccgaaaatgtgtgctttttactgctgaagggaactgccagtgttaagcataatatgatttgtggcactgg

SEQ ID NO: 242321 - DNA, 75 bp, Artificial Sequence
  Synthetic
tcactctcagctgctaacttgcgcagatggaaactgtcagactctaaaagtgattcatgtggtttcccatcagcg

SEQ ID NO: 242322 - DNA, 75 bp, Artificial Sequence
  Synthetic
ccgcccctggcctgtttttgagcataacatgcttatgcgttgtaccatgcatttgggggctcgtcgtggcatgtt

SEQ ID NO: 242323 - DNA, 75 bp, Artificial Sequence
  Synthetic
ttctccatatcagagtaatttttgccatactaaagttttaatggaaactgatgctttttcgcgggtgtggtggag

SEQ ID NO: 242324 - DNA, 75 bp, Artificial Sequence
  Synthetic
cggggtgtttgatttgaccatagagctgtataaagtggtgagatatgatgagttaaaggctcgttgtcgcccctg

SEQ ID NO: 242325 - DNA, 75 bp, Artificial Sequence
  Synthetic
tgagtgtggagccaatcacatcaggttatatccagcaactctgaacgtgacggagcagctgcgcacggaccatca

SEQ ID NO: 242326 - DNA, 75 bp, Artificial Sequence
  Synthetic
gatgttgtcgtgtcttcgcaccgactacgaatccagcgatgaggattaagggtaaggggcggagcttattacagg

SEQ ID NO: 242327 - DNA, 75 bp, Artificial Sequence
  Synthetic
tataaagtctgggggtggaggaaggaaaggaagttttaaaatgagcggctccatggaagggaacgctgtgagttt

SEQ ID NO: 242328 - DNA, 75 bp, Artificial Sequence
  Synthetic
taagggtggggtgtttagcccatatttgacaacccgtcttcccgcttgggcaggagtacgtcagaatgtgatggg

SEQ ID NO: 242329 - DNA, 75 bp, Artificial Sequence
  Synthetic
ccgtacgccgttctcggccggtaacgccaccacataagaagctggccaatgggctccagcgagcaggagctggcc

SEQ ID NO: 242330 - DNA, 75 bp, Artificial Sequence
  Synthetic
ctccaacgtggacggtcgtcctgtcgcccccgccaattcagcaacccttacctatgccactgttggatcgtcggt

SEQ ID NO: 242331 - DNA, 75 bp, Artificial Sequence
  Synthetic
ggacaccgctgcggctgctgccgcttctgccgctgcctctactgctcgtggtatggcagctgattttggacttta

SEQ ID NO: 242332 - DNA, 75 bp, Artificial Sequence
  Synthetic
caatcaactggctgcgtctcggtcgttgagggaagaagatgccctgtctgtggtgctgacccgcctggaggagct

SEQ ID NO: 242333 - DNA, 75 bp, Artificial Sequence
  Synthetic
gtctcagcaattgcaagatttgtttgccaaagtggccctgcttaaccctcccgctaatgcttcttaaataaataa

SEQ ID NO: 242334 - DNA, 75 bp, Artificial Sequence
  Synthetic
agcgaagcgctttggcttccacgcctgaccactgcattacccttgtgaaatctacccagaccgttcagggacctt

SEQ ID NO: 242335 - DNA, 75 bp, Artificial Sequence
  Synthetic
aagacacaactgtttgaaaagtcaagagtgtttatttgtttcttttgcggtaggccctggaccacctgtcgcggt

SEQ ID NO: 242336 - DNA, 75 bp, Artificial Sequence
  Synthetic
cgttgaggactttgtggatgttttccaagacccggtacaaatgggcttggatgtttagatacatgggcataaggc

SEQ ID NO: 242337 - DNA, 75 bp, Artificial Sequence
  Synthetic
cgtccctggggtggaggtaggaccactggagggcgtcatgctcgggggtggtgttgtaaataatccagtcgtaac

SEQ ID NO: 242338 - DNA, 75 bp, Artificial Sequence
  Synthetic
agggtttttgggcatgaaactgaaatatgtccttaaggagcaggctaatggccaggggtagtcccttggtaaaag

SEQ ID NO: 242339 - DNA, 75 bp, Artificial Sequence
  Synthetic
tattaacaaatcgattaagttgggaaggatgcatgcggggggagattagatgcatttttgcctggatttttagat

SEQ ID NO: 242340 - DNA, 75 bp, Artificial Sequence
  Synthetic
tggcaatgttacccccgaggtcccgtctggggttcatgttgtgcaggaccaccagcacggtgtagccggtgcatt

SEQ ID NO: 242341 - DNA, 75 bp, Artificial Sequence
  Synthetic
tggggaatttgtcatgcaacttggaagggaaggcgtggaaaaactttgaaacccctttgtgaccccccagatttt

SEQ ID NO: 242342 - DNA, 75 bp, Artificial Sequence
  Synthetic
ccatgcactcatccataattatggcgatgggacctttggccgcagctttagcaaaaatgttattggggtgggata

SEQ ID NO: 242343 - DNA, 75 bp, Artificial Sequence
  Synthetic
catcatagttttgctccaacgtgagctcgtcataggccattttaacaaagcggggaagaagggttcctgactggg

SEQ ID NO: 242344 - DNA, 75 bp, Artificial Sequence
  Synthetic
ggattatggtaccttccggaccgggggcatagttaccctcgcaaatttgcatctcccaagccttaatttcggatg

SEQ ID NO: 242345 - DNA, 75 bp, Artificial Sequence
  Synthetic
ggggaatcatgtccacttggggggcgatgaaaaaaacggtttcggggggaggattaataagctgggaggaaagca

SEQ ID NO: 242346 - DNA, 75 bp, Artificial Sequence
  Synthetic
tttttccagatgaaacgagccagacttgaagatgacttcaaccccgtctacccttacgaacactacaatcccctt

SEQ ID NO: 242347 - DNA, 75 bp, Artificial Sequence
  Synthetic
ggttccgcagaagctgggatttgccgcagccagtggggccataaatgaccccgatgacaggctgcaattggtagt

SEQ ID NO: 242348 - DNA, 75 bp, Artificial Sequence
  Synthetic
ttaaggagctgcagctgccgtcttcccgcaggagtggggtaacttcgttcatcatgcttctgacatgctggtttt

SEQ ID NO: 242349 - DNA, 75 bp, Artificial Sequence
  Synthetic
ccctgaccaggtcttgcaagagacgttcaccacccagggaaagaagctcttccaagttgcggaaatgctttagtg

SEQ ID NO: 242350 - DNA, 75 bp, Artificial Sequence
  Synthetic
gttttaggccgtcggccatggtcattttttccaaagactgacgtagaagatagagccgatcccagagctcggtga

SEQ ID NO: 242351 - DNA, 75 bp, Artificial Sequence
  Synthetic
tatgctctatggcatctcgatccagcaaacttcttggttgcggggattgggccggctttggctgtacggtaccag

SEQ ID NO: 242352 - DNA, 75 bp, Artificial Sequence
  Synthetic
ccggtgggcgtccagaggggcgagggtgatgtctttccaaggccgaagagttcgcgttagggtggtctcggtgac

SEQ ID NO: 242353 - DNA, 75 bp, Artificial Sequence
  Synthetic
agtgaagggatgcgctccgggctgggcgcttgccagggttctcttcaggctcatcctgctggtgtgaaagcgcgc

SEQ ID NO: 242354 - DNA, 75 bp, Artificial Sequence
  Synthetic
gtcttcgccctgagagtcagccaagtagcattttagcatcagctcatagcttagggcttcggctgcgtgtccttt

SEQ ID NO: 242355 - DNA, 75 bp, Artificial Sequence
  Synthetic
ggctcgaagcttgcctttggaaatgtgctgacagctgggacagtagaggcatttcagggcgtagagtttgggtgc

SEQ ID NO: 242356 - DNA, 75 bp, Artificial Sequence
  Synthetic
caggaagacagattccggcgagtaagcgttggcaccgcactgtgcacacgtggtttcgcactccactaaccaggt

SEQ ID NO: 242357 - DNA, 75 bp, Artificial Sequence
  Synthetic
tagttcgggattttttggatcaaaaaccagactgcccccgtgttttttgatgcgtttcttacctcgggtttccat

SEQ ID NO: 242358 - DNA, 75 bp, Artificial Sequence
  Synthetic
tcctcctcgctgtccggaaccacttcgggcgacaaggtcggagcgtgtacttgctccggtacttgctccggtact

SEQ ID NO: 242359 - DNA, 75 bp, Artificial Sequence
  Synthetic
gaggcgatgaccggcttcggtgacaaagaggctgtcggtgtcgccgtataccgatttgagggtacgctgctccaa

SEQ ID NO: 242360 - DNA, 75 bp, Artificial Sequence
  Synthetic
tgcaagtttttgcgcagctttttcttgggaggcaatgacggagggcgctccgggctcgtctcctggaggtaggga

SEQ ID NO: 242361 - DNA, 75 bp, Artificial Sequence
  Synthetic
cggcgtgcctcggtcctccgcgtacagaaactcggaccattctgagacaaaagcccgggtccaggccagaacaaa

SEQ ID NO: 242362 - DNA, 75 bp, Artificial Sequence
  Synthetic
ggaggcaatttgggaggggtagcggtcgttttccaccagggggtcaaccttttctagggtgtgaaggcaaaggtc

SEQ ID NO: 242363 - DNA, 75 bp, Artificial Sequence
  Synthetic
atcttcctctgcatccataaatgtgattggtttataagtataggtcacgtgacctttggggtcttgcgtgggtgt

SEQ ID NO: 242364 - DNA, 75 bp, Artificial Sequence
  Synthetic
ataaagggcgtgtccgcgttcttcatcactttcttccgcatcgctgtgggcaagagccagctgttcgggtgagta

SEQ ID NO: 242365 - DNA, 75 bp, Artificial Sequence
  Synthetic
agatcagcccgaacaaaactccgaggacggccagcccgtggtttctgacgacgatctcgcacgctggcttgacac

SEQ ID NO: 242366 - DNA, 75 bp, Artificial Sequence
  Synthetic
cgcgcgctggaaggcgggcataacttcagcactcaaggtgtcagtttctacgaacgaggtggatttgattttaat

SEQ ID NO: 242367 - DNA, 75 bp, Artificial Sequence
  Synthetic
ccatgaccccaccactttgcaagaacggcgcaaaatgatgatggcggtcattctgattaccgttgagctcgagtg

SEQ ID NO: 242368 - DNA, 75 bp, Artificial Sequence
  Synthetic
ttgtcccgcggcaatgcttttgatggtggcagggtccatctggtcagaaaacacaatttttttattatctagttt

SEQ ID NO: 242369 - DNA, 75 bp, Artificial Sequence
  Synthetic
ccctccattatgctttccgtcatggctacgttcgacaagcgtgtaaaatttctaatgtagagcttagcaacttgg

SEQ ID NO: 242370 - DNA, 75 bp, Artificial Sequence
  Synthetic
ggtagcaaacgacccgtaaagggcgttggaaagcagcttggcaatggaacgcagcgtctggtttttctcgcgatc

SEQ ID NO: 242371 - DNA, 75 bp, Artificial Sequence
  Synthetic
ggcccgctccttggcggcgatgttgagctgcacgtactttcgtgccacgcagcgccactcgggaaagacagtggt

SEQ ID NO: 242372 - DNA, 75 bp, Artificial Sequence
  Synthetic
gcgctcgtcaggaagcaaccgtacctgccacccgcggttgtgcagggtgatcagatctatgctagtggccacctc

SEQ ID NO: 242373 - DNA, 75 bp, Artificial Sequence
  Synthetic
gccccttaggggctcgttggtccagcacaagcgtcctcccttgcgcgagcagtatgggggtagtacatctagtaa

SEQ ID NO: 242374 - DNA, 75 bp, Artificial Sequence
  Synthetic
gcttgccagactttgttagtcagagcattttgcaaaactttcgctcttttatcctcgagcgatccggtatcttac

SEQ ID NO: 242375 - DNA, 75 bp, Artificial Sequence
  Synthetic
gttttcagatggagggtcagcgtcaatggtgaagatgccaggaagtaggacgtggttgaaatagtcaatgggagt

SEQ ID NO: 242376 - DNA, 75 bp, Artificial Sequence
  Synthetic
gtcaacttgcaacagagcgcgttcccagtctcgaaccgctagggcgcgttcgtagggattgagcggcgagcccca

SEQ ID NO: 242377 - DNA, 75 bp, Artificial Sequence
  Synthetic
cctctgcacaccccaccgctctctggtctgcaataccgagctgctcaacgaaacccaagtaatcggtacctttga

SEQ ID NO: 242378 - DNA, 75 bp, Artificial Sequence
  Synthetic
cggcatgggatgggtaagcgcggaggcgtacatgccacatatgtcgtaaacataaagaggttcgcggagcacccc

SEQ ID NO: 242379 - DNA, 75 bp, Artificial Sequence
  Synthetic
aatgtaagtgggatagcaacgtcctccgcgaatgctggccctgacataatcatacatttcatgtgagggggctag

SEQ ID NO: 242380 - DNA, 75 bp, Artificial Sequence
  Synthetic
cacgcccaccaaattaagttctacgaagaccaatcccgacctcccaaagcccccctcacggcttgtgtcatcacc

SEQ ID NO: 242381 - DNA, 75 bp, Artificial Sequence
  Synthetic
tagtccattgcctagatccgaacgcttaggttttacgcttcggtacaagatctgtctaaagatggcgtgggagtt

SEQ ID NO: 242382 - DNA, 75 bp, Artificial Sequence
  Synthetic
ggaggaaattgtgggcctttgaaaaacgttaaatttggcttcgggcagacccacggcatcacagatgaattgggc

SEQ ID NO: 242383 - DNA, 75 bp, Artificial Sequence
  Synthetic
gtaggactctcgcagcttctgtaccaaggcggcggtgacaagcacatccaaagcgcagtagtcaagggtttcgcg

SEQ ID NO: 242384 - DNA, 75 bp, Artificial Sequence
  Synthetic
gttgaaagccagccgtagatgggacaccgtttccatcgcaggatctccaccagccccagttggtaagcagccgca

SEQ ID NO: 242385 - DNA, 75 bp, Artificial Sequence
  Synthetic
tatcagatcgtaacgagactgttgcttcttttcccaaagttcgcggttcaggaggtactcctcgcggtccttcca

SEQ ID NO: 242386 - DNA, 75 bp, Artificial Sequence
  Synthetic
gtaatcttcggccggaaagccacgttcgtctgcacggtaagaacccaacatgtaaaattggttgacagctttgta

SEQ ID NO: 242387 - DNA, 75 bp, Artificial Sequence
  Synthetic
tacctctgacaaacacgctccccataaataacacttccttgggcatgccacagtttacaatttctcgataccaag

SEQ ID NO: 242388 - DNA, 75 bp, Artificial Sequence
  Synthetic
aggacagcagcctttttccaccggaagagcgtacgcttgcgcggcctttctcagagaggtgtgtgtaagagcgaa

SEQ ID NO: 242389 - DNA, 75 bp, Artificial Sequence
  Synthetic
ggtgtcgcgcaccatgactttgaggaattggtgtttaaagtcagtgtcgtcgcaggcgccctgctcccagaggtg

SEQ ID NO: 242390 - DNA, 75 bp, Artificial Sequence
  Synthetic
atagtcggtgcgctttttggatagcggatttggcagggcaaatgtaatgtcattgaaaaggattttgccggcccg

SEQ ID NO: 242391 - DNA, 75 bp, Artificial Sequence
  Synthetic
tggcataaagttgcgggtgattttgaaaggtccgggcacgtccgagcggttgttaatcacctgagccgccagcac

SEQ ID NO: 242392 - DNA, 75 bp, Artificial Sequence
  Synthetic
gctggaagacgccgaggcactgttcaataaatactactcggtgtcttttaaggactgaaaagcccgcgctttttt

SEQ ID NO: 242393 - DNA, 75 bp, Artificial Sequence
  Synthetic
aatttcatcaaagccgttgatgttatgtcccacaatgtagagttccacaaatcggggtgttccctgtagtttggg

SEQ ID NO: 242394 - DNA, 75 bp, Artificial Sequence
  Synthetic
ggccttttttaactcctcgtaagtaagattatcaggagaaaatagtcccatttcaagtcgggcccattcggccac

SEQ ID NO: 242395 - DNA, 75 bp, Artificial Sequence
  Synthetic
ttggggattggcagcaaggaacgcttgccacagctgggtggcaaaatgggtttgcaaacggtcgcggtagtttcg

SEQ ID NO: 242396 - DNA, 75 bp, Artificial Sequence
  Synthetic
aaacttttttcctaccgccattttttcgggggtgaccacgtaaaaggtatggccgtcatttccccaggcatccca

SEQ ID NO: 242397 - DNA, 75 bp, Artificial Sequence
  Synthetic
ttgtagttcgtgggccagacggcaggcttcctccactagggtgtcatcccccgagagatgcataactagcataaa

SEQ ID NO: 242398 - DNA, 75 bp, Artificial Sequence
  Synthetic
cgggaccagttgcttaccaaaggctcccatccacgtgtaggtctcaacgtcgtaggtgacgaagaggcgttcaac

SEQ ID NO: 242399 - DNA, 75 bp, Artificial Sequence
  Synthetic
gcggggatgagagccgatcggaaagaaattgatctcctgccaccagccggaggactgggcgttgatatgatgaaa

SEQ ID NO: 242400 - DNA, 75 bp, Artificial Sequence
  Synthetic
gtagaagtttctccggcggaccgtgcattcgtgctgatatttgtaaaagcgggcgcaatactcgcagcgttgcac

SEQ ID NO: 242401 - DNA, 75 bp, Artificial Sequence
  Synthetic
gttctgcacctcttgaatgaggtgtacctggcgccctcgcacgagaaatcggagagggaaattaagaggctcctg

SEQ ID NO: 242402 - DNA, 75 bp, Artificial Sequence
  Synthetic
agcgctctgcctttctccctcgttgttctcttctgcacctgcacgctcctgctgtgggaggatgacggagggagt

SEQ ID NO: 242403 - DNA, 75 bp, Artificial Sequence
  Synthetic
gacgatgccccgcgaggcgcaggtccaaacctcgacgcggggaggctgaagcctgagagcgagagagcggatttg

SEQ ID NO: 242404 - DNA, 75 bp, Artificial Sequence
  Synthetic
ggagctgtccagggagtccaggaaggcttcgctgaggccggcgggcaaagaacgaaggttaacttgcagaaggcg

SEQ ID NO: 242405 - DNA, 75 bp, Artificial Sequence
  Synthetic
cttaatccttgctactttgtctgaaaagtctgtgatttttatttaccgccccagcgcttggattacatgaagatc

SEQ ID NO: 242406 - DNA, 75 bp, Artificial Sequence
  Synthetic
ggtaagggcggacgccaggcgttgatgaaacttaatttcaaggggggagttggtggaagtgtcaatagcgtagag

SEQ ID NO: 242407 - DNA, 75 bp, Artificial Sequence
  Synthetic
taacaagtagcctaaagacttcacctacagccgttggttctttacgtcagctgcaagattccaacaaaggtacac

SEQ ID NO: 242408 - DNA, 75 bp, Artificial Sequence
  Synthetic
gagaccttgtcctcgggaggctacaatggttcctcggaggcggaaggttgagggagggtttacatcatttgacgc

SEQ ID NO: 242409 - DNA, 75 bp, Artificial Sequence
  Synthetic
ggacgggcgcctgggggcagtggcggttcgggacccgcctgaagaggaggtagaagcacgttggcctggagctcg

SEQ ID NO: 242410 - DNA, 75 bp, Artificial Sequence
  Synthetic
ggtagcggttgatgctgagcccgcagctgactggcgtgcgcgacaacgcggcggttgagttcctggatacgtctt

SEQ ID NO: 242411 - DNA, 75 bp, Artificial Sequence
  Synthetic
tgttgagtgaagaccaagggtccccggactcggaacctgaaagaaagttcaacagaatcaatctccgcatcgttg

SEQ ID NO: 242412 - DNA, 75 bp, Artificial Sequence
  Synthetic
accgcgacctgacgcagaatttcctgcacgtcgcccgagttgtcttggtatgcgatctcggacataaactgatcg

SEQ ID NO: 242413 - DNA, 75 bp, Artificial Sequence
  Synthetic
atctcttcctcctggagctccccccaaccggcccgctccacggtggccgcaagatcgttggagatgcgacccatg

SEQ ID NO: 242414 - DNA, 75 bp, Artificial Sequence
  Synthetic
agctgggagaaggcgttaagcccgttttcgttccacacacggctgtagacaacgtcaccagtgtcgtcccgggcg

SEQ ID NO: 242415 - DNA, 75 bp, Artificial Sequence
  Synthetic
aaactccaaaggtcacaaaaacccgccaacgtaacacttccgccgcgccactccccaaccttcgaccccgacgtc

SEQ ID NO: 242416 - DNA, 75 bp, Artificial Sequence
  Synthetic
cgcattaccacctgggccacgttaagctcaacgtgacgggcaaacacggcgtagttgcgcaagcgctggaaaagg

SEQ ID NO: 242417 - DNA, 75 bp, Artificial Sequence
  Synthetic
attcgcctccaccctttcccaccccgcctacctctacgtcacatcgcacctcccctaacccctcctcactcatta

SEQ ID NO: 242418 - DNA, 75 bp, Artificial Sequence
  Synthetic
cgcacctcccctaacccctcctcactcattatcatattggctcgtttccagctttaaggtatattattgatgatg

SEQ ID NO: 242419 - DNA, 75 bp, Artificial Sequence
  Synthetic
tagttgagggtggtggcaatgtgctcacagacaaagaagtacataacccaacgccgaagagtcatttcgttgata

SEQ ID NO: 242420 - DNA, 75 bp, Artificial Sequence
  Synthetic
ttgccaagggcttccaagcgttccatggcttcgtaaaagtctaccgcaaagttgaagaattgggagttgcgggcc

SEQ ID NO: 242421 - DNA, 75 bp, Artificial Sequence
  Synthetic
gcgactgtcagctcgtcttgcaagaggcggattagctccgccacagtttctcgcacttcgcgttcaaaggcgccc

SEQ ID NO: 242422 - DNA, 75 bp, Artificial Sequence
  Synthetic
tcgcacttcgcgttcaaaggcgcccggcgcttcctcgatttcttcttccatgagttcttcctcctctgcaacagg

SEQ ID NO: 242423 - DNA, 75 bp, Artificial Sequence
  Synthetic
cacctcgggactcgcgggtgccggaacaggtcgtcggcggcgacgcctaatgggcagccgatcgacaaagcgttc

SEQ ID NO: 242424 - DNA, 75 bp, Artificial Sequence
  Synthetic
gatgatttctccgcggcgacgacgcatggtttcagtgacggcgtgtccgttctctcggggtcgcagctcgaatac

SEQ ID NO: 242425 - DNA, 75 bp, Artificial Sequence
  Synthetic
accgccttgcaatcccgttccggagatgggtggtagcaggtggggtccttcgggcagagacagggcgctaactat

SEQ ID NO: 242426 - DNA, 75 bp, Artificial Sequence
  Synthetic
gcatttgattatctgttgtgtaggcagagattgccaagcgttgttgagcgagtccaattggacgggatcagaaaa

SEQ ID NO: 242427 - DNA, 75 bp, Artificial Sequence
  Synthetic
cttttcaaggaaagcatcgagccaatcacagtcgcaaggtaagctcagaacggtgggctgtgggtttccacggga

SEQ ID NO: 242428 - DNA, 75 bp, Artificial Sequence
  Synthetic
catcatcaataatataccttaaaactggaaacgagccaatatgataatgagggaggagggactaggggtggtgta

SEQ ID NO: 242429 - DNA, 75 bp, Artificial Sequence
  Synthetic
cggtgggctgtgggtttccacgggaggtgatgctgctgatgagatagttaaagtaggcggttttcaaacggcgga

SEQ ID NO: 242430 - DNA, 75 bp, Artificial Sequence
  Synthetic
aggtgacgtagaggcgggcggggtgggaaagggtggaggcggatgacgtgtggggtcggaggacgggcgcggtgc

SEQ ID NO: 242431 - DNA, 75 bp, Artificial Sequence
  Synthetic
aagtaggcggttttcaaacggcggatggtggcaaggaggataacgtcttttggtccggcctgttggatccgcagg

SEQ ID NO: 242432 - DNA, 75 bp, Artificial Sequence
  Synthetic
ggcggaagtgacggaaaatctggtgtattgggcgggtttttgtaacttttggccattttggcgcgaaaactgagt

SEQ ID NO: 242433 - DNA, 75 bp, Artificial Sequence
  Synthetic
cggtcggccatgccccaggcttcgctctgacatcgacgtagatccttgtagaagtcttgcatgagtctttccacg

SEQ ID NO: 242434 - DNA, 75 bp, Artificial Sequence
  Synthetic
aatgaggacgtgggacgaactttggacttttgtgtttatggaggaaaaactgctgattattactgaactttggcc

SEQ ID NO: 242435 - DNA, 75 bp, Artificial Sequence
  Synthetic
ggaatttctatatctcctcggtcggccatgcgggtagagccgaacccgcggagaggctccaggagggccaggtcg

SEQ ID NO: 242436 - DNA, 75 bp, Artificial Sequence
  Synthetic
catgacgaaccggtttttctacgtggcagtgccacgagacggctcaaagtcctaattttttattgtgtgctcagc

SEQ ID NO: 242437 - DNA, 75 bp, Artificial Sequence
  Synthetic
gcgaccactctttctgccagcacggcttgctgaatttgagtaagggtgttttggaagtcatctaagtccacaaag

SEQ ID NO: 242438 - DNA, 75 bp, Artificial Sequence
  Synthetic
ccgtttgagggtatttaaacacagccagaacatcaagaggccactcttgagtgcgagcgagtagagttttctcct

SEQ ID NO: 242439 - DNA, 75 bp, Artificial Sequence
  Synthetic
cggtgataagagccggtgttaatggtgtacgtgcagttggccatgacggaccagtttacaacttgcattccgggc

SEQ ID NO: 242440 - DNA, 75 bp, Artificial Sequence
  Synthetic
ccattgctgttggcgcttttgacatagccaccaagatgagaatgctgccggatttttttaccgggaactgggatg

SEQ ID NO: 242441 - DNA, 75 bp, Artificial Sequence
  Synthetic
tgggtgatctctgtgtacctaaggcgggagtaggctcgggactcaaagacgtagtcgttgcaggttcgcaccaag

SEQ ID NO: 242442 - DNA, 75 bp, Artificial Sequence
  Synthetic
acatgttccaggggttgctggagactgaatatgtgtttgatttccctgaaccttctgaggcttctgaagaaatgt

SEQ ID NO: 242443 - DNA, 75 bp, Artificial Sequence
  Synthetic
tactggtagccaaccaggaagtgaggcggcggttcgcggtagaggggccatcgtagggttgctggggcgcccggc

SEQ ID NO: 242444 - DNA, 75 bp, Artificial Sequence
  Synthetic
cgcttcatgatctttttgatgtggaggtggatggtttcgaagaggacgccaaccaggaagcggttgatggtatgt

SEQ ID NO: 242445 - DNA, 75 bp, Artificial Sequence
  Synthetic
gcaaggtcctccagcataagacgatggtaatggtaaacatagcgagagagccaggtaattccggctgaggtggtc

SEQ ID NO: 242446 - DNA, 75 bp, Artificial Sequence
  Synthetic
ttcccgagaggttgctgtccgaggctgagagcgctgcagagagcggttcgggtgattctggggttggcgaagagt

SEQ ID NO: 242447 - DNA, 75 bp, Artificial Sequence
  Synthetic
gcagcgcgggtgaactcgcggactcggttccagatgttgcgcaacggtgagaaacgctccatggtgggcacgctt

SEQ ID NO: 242448 - DNA, 75 bp, Artificial Sequence
  Synthetic
tgttgccggttgatctggatttgaaatgctatgaagacggtttgcctcctagcgatcctgaaactgatgaggcta

SEQ ID NO: 242449 - DNA, 75 bp, Artificial Sequence
  Synthetic
tggccggtaagacgggcgcaatcttgtacgctctagatggaaaaatagagagcaatcacggactcttctccgtag

SEQ ID NO: 242450 - DNA, 75 bp, Artificial Sequence
  Synthetic
cagaggcggaagaagaggcggctatgccgacttatgtgaatgaaaatgaaaatgagctggtgctggactgtccag

SEQ ID NO: 242451 - DNA, 75 bp, Artificial Sequence
  Synthetic
cctggaggatagaccgccagggtgcggtggcgaacaacccccggttcgagaccggctggatccgccactcccgac

SEQ ID NO: 242452 - DNA, 75 bp, Artificial Sequence
  Synthetic
agaaccctgggcgaggttgtcgggcttgtgatttccatcggggcactagtggcaatcctgaagctatgtgtgctt

SEQ ID NO: 242453 - DNA, 75 bp, Artificial Sequence
  Synthetic
gcgccggccccgtgtccacgacggaaaccccgccgagacctagccgcggtccccggatctccagatacggagggg

SEQ ID NO: 242454 - DNA, 75 bp, Artificial Sequence
  Synthetic
tgtgttatatgcgtttaactggacactgtatctacagtaagtaaaaaagtttttatttgtttggtggtgttggtt

SEQ ID NO: 242455 - DNA, 75 bp, Artificial Sequence
  Synthetic
agtctttttgtcgttttttgtagatgcatccggtgttgcgacagatgcgtccgacgcagccaacgctcccgcccc

SEQ ID NO: 242456 - DNA, 75 bp, Artificial Sequence
  Synthetic
aatatgaacaagagttaacgactttttgttattttaggtccaatttcagatgcggaaggggagtctgagtcgggg

SEQ ID NO: 242457 - DNA, 75 bp, Artificial Sequence
  Synthetic
ccactagcgcccaggccgccgtggctctttccggagccggcggtggcgaccctgacgaggaggccatgctggatt

SEQ ID NO: 242458 - DNA, 75 bp, Artificial Sequence
  Synthetic
tcgcctgaggacactgattttccccaccctttaaccgccacgccgccacatggaattgtgagaaccatcccgtgc

SEQ ID NO: 242459 - DNA, 75 bp, Artificial Sequence
  Synthetic
tggaagagggcgagggtttggctcgcctgggagcaccctcccccgagcatcatccccgcgtacaacttaaaaggg

SEQ ID NO: 242460 - DNA, 75 bp, Artificial Sequence
  Synthetic
agagtttcttgtagacgacgcccagctgttgagtgcatagaagatttacttgaggaagatccaacagatgaacct

SEQ ID NO: 242461 - DNA, 75 bp, Artificial Sequence
  Synthetic
acgcacgtcaggcctacgtgccgccgcagaacctgtttagggatcgcagcggacaggaacccgaagagatgaggg

SEQ ID NO: 242462 - DNA, 75 bp, Artificial Sequence
  Synthetic
ttgaacctgtccttaaagcgccccaagtgctcctgagatcatagtaataaagttattgacccttaccctgtgttt

SEQ ID NO: 242463 - DNA, 75 bp, Artificial Sequence
  Synthetic
accgcaggtttcatgcgggaaaggaactgcgggccggtttcaacagccaaagggtgctgcgcgccgaagactttg

SEQ ID NO: 242464 - DNA, 75 bp, Artificial Sequence
  Synthetic
atttcttgggcgtgtttgtgggtatataagcaggtagaatggttttagtgttagtttattctgatggagttgtgg

SEQ ID NO: 242465 - DNA, 75 bp, Artificial Sequence
  Synthetic
agcccgacaagcgtagtggagtaagtccggcacgggctcacgtgtcggcggccgatctggtgactgcgtacgagc

SEQ ID NO: 242466 - DNA, 75 bp, Artificial Sequence
  Synthetic
agtgagttacaaagttatcagaacctccgacgcttgctggagttggcttctgccagaacttccagctgttggaga

SEQ ID NO: 242467 - DNA, 75 bp, Artificial Sequence
  Synthetic
aaactgtaaacgaggagcgcaactttcaaaaaacctttaacaatcacgtgcgcaccttagtagcgcgagaagagg

SEQ ID NO: 242468 - DNA, 75 bp, Artificial Sequence
  Synthetic
atcctttttggctcaactttaactaatgtaatctatagagctaaggaggagtactcttcgcggtttgctgacctt

SEQ ID NO: 242469 - DNA, 75 bp, Artificial Sequence
  Synthetic
tggccataggcctgatgcatctgtgggactttatggaagcgtacgtgcagaatccggcaagcaaaccgctgacgg

SEQ ID NO: 242470 - DNA, 75 bp, Artificial Sequence
  Synthetic
ttgtcgcataaccctggaatttttgcttctttgaatttggggcatcactcattttttcaagaaattgtgatcaga

SEQ ID NO: 242471 - DNA, 75 bp, Artificial Sequence
  Synthetic
cacagctgtttttgattgtacaacacagccgcgataatgaaacttttcgagaagctatgcttaacattgctgagc

SEQ ID NO: 242472 - DNA, 75 bp, Artificial Sequence
  Synthetic
gcttagtattaacgcgggcagaggcttagttataactaacaatgccgtagcggttaatcctaccggagcgctagg

SEQ ID NO: 242473 - DNA, 75 bp, Artificial Sequence
  Synthetic
aatttagatttttcttctcctggccgtacggtttctgggcttgcttttatttgttttatattggatcaatggagc

SEQ ID NO: 242474 - DNA, 75 bp, Artificial Sequence
  Synthetic
ccgaggggcgctggcttttagacctagtcaacatcctgcagagcatagtggtgcaagagcgcagcttgagcctgg

SEQ ID NO: 242475 - DNA, 75 bp, Artificial Sequence
  Synthetic
gcccaaactcatctgtcgcagggttatactctggattacatggcaatggctctgtggagaaccttgctacggagg

SEQ ID NO: 242476 - DNA, 75 bp, Artificial Sequence
  Synthetic
ccgacaaggtggcggccattaattacagcatgctcagtctcggcaagttttacgcccgcaagatctacaaaactc

SEQ ID NO: 242477 - DNA, 75 bp, Artificial Sequence
  Synthetic
tggacggtgccaacttaattcttcatgtagcatatccctttgaagcagtcaaccaactaacactgcgattagaaa

SEQ ID NO: 242478 - DNA, 75 bp, Artificial Sequence
  Synthetic
aagagggtcttaggttgcttgccggcgcagcgtccgcacggtttggatccagtgcaggaagaggaggaggaggag

SEQ ID NO: 242479 - DNA, 75 bp, Artificial Sequence
  Synthetic
cttacgtgcccatagacaaggaggtgaaaattgatagtttttacatgcgtatggcgctgaaggtgttgacgctga

SEQ ID NO: 242480 - DNA, 75 bp, Artificial Sequence
  Synthetic
gagaacctgagggccggcctggacccttcaacggaattgtaactgagcctgatcccgaagagggtactagcagtg

SEQ ID NO: 242481 - DNA, 75 bp, Artificial Sequence
  Synthetic
gcgacgatctgggggtttaccgcaacgaccgcattcataaggccgtgagtgccagccgccgccgcgaactgagcg

SEQ ID NO: 242482 - DNA, 75 bp, Artificial Sequence
  Synthetic
ggcaaagggggggcattaatgggcaaagggggacaaagagaaagatggaaaacgagggggaggactttttaaagg

SEQ ID NO: 242483 - DNA, 75 bp, Artificial Sequence
  Synthetic
accgcgagttgatgcacagcctgcgtcgagcattgacgggggccggcggggatgccaatgccgagtcttactttg

SEQ ID NO: 242484 - DNA, 75 bp, Artificial Sequence
  Synthetic
agttaaccttgagtttaatgtctcgtcgccatcatgagtctgtttggtgggctgatttggaagatgagtttaaaa

SEQ ID NO: 242485 - DNA, 75 bp, Artificial Sequence
  Synthetic
gccaagtgcccgggctctagaggcggttggataccgcaacgcaatgcaggaggaggatgaggaggaggactacga

SEQ ID NO: 242486 - DNA, 75 bp, Artificial Sequence
  Synthetic
acggtgaaatgaatttgttatacaagtatacatttgaacagctgaagacacattggctggaggcttgggaggatt

SEQ ID NO: 242487 - DNA, 75 bp, Artificial Sequence
  Synthetic
aacgctctatctctaaaacttccctttgacaatcagggaaatttacttaactgtgccttggaatcatcaacctgg

SEQ ID NO: 242488 - DNA, 75 bp, Artificial Sequence
  Synthetic
ggacgagccctgatcggccaggtggtgtttttgtagatgcagcggtcgacggcggtggtggacgggtcgcagcag

SEQ ID NO: 242489 - DNA, 75 bp, Artificial Sequence
  Synthetic
ttgagttagctctgaacacttttgccaaagtggctcttcgcccggacactatttataccattaagaagactgtta

SEQ ID NO: 242490 - DNA, 75 bp, Artificial Sequence
  Synthetic
gtggatcctgccatgttggcagcactgcaaagccaaccctcgggcgtgaccccctcagacgactgggcggcggcc

SEQ ID NO: 242491 - DNA, 75 bp, Artificial Sequence
  Synthetic
atatacgtaaatgtgcctatgtgctggggaatggagctgtggtgcggtttcaaacatgtgaccgtgtagccttta

SEQ ID NO: 242492 - DNA, 75 bp, Artificial Sequence
  Synthetic
atggaccgtattctagctttgaccacccgcaatcctgaagccttcaggcagcagccccaggccaacaggttttcg

SEQ ID NO: 242493 - DNA, 75 bp, Artificial Sequence
  Synthetic
actgcgcaatgcagagcttgggccctgggcttattggcatgagtggggtaacttttatgaatgtgagatttgtag

SEQ ID NO: 242494 - DNA, 75 bp, Artificial Sequence
  Synthetic
gccattttggaagccgtggtaccctctcgtactaacccaacccacgagaaggtgctggctatcgtgaacgcccta

SEQ ID NO: 242495 - DNA, 75 bp, Artificial Sequence
  Synthetic
ttttcacccacccaccgctgtattttgctacataactgaacaataaaatcattgcaggcacaatcttcgcatttc

SEQ ID NO: 242496 - DNA, 75 bp, Artificial Sequence
  Synthetic
tggagggatttaatggcacagtgtttgcttctaccactcaattaaccttgcatggtgtgttttttcaaaattgca

SEQ ID NO: 242497 - DNA, 75 bp, Artificial Sequence
  Synthetic
acagaaagcaaagcaattcgcaaggacgaagcgggactgatttacaatgctctgctggaaagggtggcccgatac

SEQ ID NO: 242498 - DNA, 75 bp, Artificial Sequence
  Synthetic
gcggtatctgcgtggattcctggggtagggtgtctgccagagggtgtacgtttgttgcatgttggaaaggggtgg

SEQ ID NO: 242499 - DNA, 75 bp, Artificial Sequence
  Synthetic
aacagtaccaacgtacaagccaatcttgaccgccttaccactgacgtgagggaggcggtagcacagcgggagcgc

SEQ ID NO: 242500 - DNA, 75 bp, Artificial Sequence
  Synthetic
tggggcgaaacaaaagtcaaatgtctgtaaagaagtgtgtgtttgaacgttgcattatggccatggtggtagaag

SEQ ID NO: 242501 - DNA, 75 bp, Artificial Sequence
  Synthetic
tttatgcatgacactaacttgggttcccaggtggcgctaaatgcttttctgagcacgctcccggctaacgttccg

SEQ ID NO: 242502 - DNA, 75 bp, Artificial Sequence
  Synthetic
gtcaggcgcggattcgccataatgcgggctctgataatgtgtgttttttactgctaaagggaactgccagtgtaa

SEQ ID NO: 242503 - DNA, 75 bp, Artificial Sequence
  Synthetic
cccaggtggcgctaaatgcttttctgagcacgctcccggctaacgttccgcgcggacaggaggattacgttagct

SEQ ID NO: 242504 - DNA, 75 bp, Artificial Sequence
  Synthetic
aaaatggagatctttcttcagatgctagcgtggaagttagcgcccctattactaaaaccaacaaaatcgtaggtt

SEQ ID NO: 242505 - DNA, 75 bp, Artificial Sequence
  Synthetic
cgcggacaggaggattacgttagctttatcagcgcattgcgcctcctggtggcagaagtacctcaaagcgaggtt

SEQ ID NO: 242506 - DNA, 75 bp, Artificial Sequence
  Synthetic
ttatcagcgcattgcgcctcctggtggcagaagtacctcaaagcgaggtttaccagtccggtcccgattactttt

SEQ ID NO: 242507 - DNA, 75 bp, Artificial Sequence
  Synthetic
agcataacatgatttgtggcggtggtcactctcagctgctaacctgtgcagatggaaactgtcaggctctgagag

SEQ ID NO: 242508 - DNA, 75 bp, Artificial Sequence
  Synthetic
tccaaacttcgcggcagggactgcagacggttaacttgacacaggccttcaaaaacttgcagggcatgtggggtg

SEQ ID NO: 242509 - DNA, 75 bp, Artificial Sequence
  Synthetic
tgtttcacgtagtatctcatccccgccgcccctggcctgtttttgagcacaacatgcttatgcgctgtactgtgc

SEQ ID NO: 242510 - DNA, 75 bp, Artificial Sequence
  Synthetic
tgcgggcccccgttggtgaccgcgccaccatttccagtttgctgacgcccaatacccggctgttgttgctgctga

SEQ ID NO: 242511 - DNA, 75 bp, Artificial Sequence
  Synthetic
atttgggagctcgtcgtggcatgttttctccataccagagtaacttttgccacactaaagttttaatggaaactg

SEQ ID NO: 242512 - DNA, 75 bp, Artificial Sequence
  Synthetic
ttgccccatttacaaatagtagtaccatcagccgggactcataccttggccatctgatcactttgtaccgcgagg

SEQ ID NO: 242513 - DNA, 75 bp, Artificial Sequence
  Synthetic
atgctttttctcgggtatggtggaacggggtatttgatttaaccatggagctatttaaagtggtgaggtatgatg

SEQ ID NO: 242514 - DNA, 75 bp, Artificial Sequence
  Synthetic
ctatcggtcagacacaggtagacgaacaaaccttccaggaaatcaccagtgtgagccgtgcgttaggacagcaag

SEQ ID NO: 242515 - DNA, 75 bp, Artificial Sequence
  Synthetic
gccattgaacgcccgctagctctatccagtaacagagcagtgacccttaagtattcaccacctttaaaaatagaa

SEQ ID NO: 242516 - DNA, 75 bp, Artificial Sequence
  Synthetic
acaaaccttccaggaaatcaccagtgtgagccgtgcgttaggacagcaagacaccgggagtctggaagccacttt

SEQ ID NO: 242517 - DNA, 75 bp, Artificial Sequence
  Synthetic
agtcaaaggttcgttgtcgcccctgtgagtgtggagctaatcatattaggttatatccagcaactctgaacgtga

SEQ ID NO: 242518 - DNA, 75 bp, Artificial Sequence
  Synthetic
gaacttcctgctcaccaaccggcaacagaaaattccctcgcaattcacactgagtaccgaggaagagcgtatctt

SEQ ID NO: 242519 - DNA, 75 bp, Artificial Sequence
  Synthetic
ccgagcagctgcgtacggaccaccagatgatgtcgtgtctgcgtactgactacgaatccagcgatgaggattaag

SEQ ID NO: 242520 - DNA, 75 bp, Artificial Sequence
  Synthetic
ggtaaggggcggagcctattacaggtataaaggttggggtagagtaaaaaaaagggaagttacaaaatgagtggc

SEQ ID NO: 242521 - DNA, 75 bp, Artificial Sequence
  Synthetic
gcgttacgtgcaacagtctgtcagtttatacttaatgcgcgaggggatgaccccatcctcggctctggatatgac

SEQ ID NO: 242522 - DNA, 75 bp, Artificial Sequence
  Synthetic
ttcacggaaggaaacgctgtgagttttgagggtggggtgtttagcccatatctgacaacccgtcttccctcttgg

SEQ ID NO: 242523 - DNA, 75 bp, Artificial Sequence
  Synthetic
ggcccgcaacatggaaccgtcgctgtattcgtccaatcggcctttcattaaccgcctaatggactacctgcatcg

SEQ ID NO: 242524 - DNA, 75 bp, Artificial Sequence
  Synthetic
tcactgactctggattagctatggacttaggagacggtcttgcactaggtggctctaagttaataatcaatcttg

SEQ ID NO: 242525 - DNA, 75 bp, Artificial Sequence
  Synthetic
gcaggagtgcgtcagaatgtggtggggtccaacgttgatggtcgtcctgtcgcccctgccaactcgacaaccctt

SEQ ID NO: 242526 - DNA, 75 bp, Artificial Sequence
  Synthetic
cgcggcagccatgaacagcgagtactttactaatgccattttgaacccccattggatgcccccctctggttttta

SEQ ID NO: 242527 - DNA, 75 bp, Artificial Sequence
  Synthetic
acctacgccactattggatcgtcggtggataccgctgcagctgctgccgcgtctgctgctgcctctactgctcgt

SEQ ID NO: 242528 - DNA, 75 bp, Artificial Sequence
  Synthetic
tacgggagaatttgacatgcccgagggagatgacggcttcttgtgggacgacgtgtccgacagcatttttgtccc

SEQ ID NO: 242529 - DNA, 75 bp, Artificial Sequence
  Synthetic
ggcatggcagcagattttggactgtacaatcaactggccgcgtctcggttaagagaagaagatgccctgtccgtg

SEQ ID NO: 242530 - DNA, 75 bp, Artificial Sequence
  Synthetic
tgcgcgttaccgcaagaaggaaggcggtgatgagctgcctttgcccttggtggaagcggcttccaggggccagag

SEQ ID NO: 242531 - DNA, 75 bp, Artificial Sequence
  Synthetic
gtgttgacccgcttggaggagctgtctcagcagttgcaagatatgtctgccaaaatggctctgcttaaccctccc

SEQ ID NO: 242532 - DNA, 75 bp, Artificial Sequence
  Synthetic
ccctttcccaagcctcccatcgcttgttagcagcagcaacagcggacgggtgttgcgtccccggcttccagggga

SEQ ID NO: 242533 - DNA, 75 bp, Artificial Sequence
  Synthetic
tactaccactacccctaccaccctatggaccaccgcagacccgtctcctaacgccactttttatgaatcactaga

SEQ ID NO: 242534 - DNA, 75 bp, Artificial Sequence
  Synthetic
gacggactacctaaacgatcccctgttgcaacccgttcgtaataagaactttcctaacaacggggtggaaagttt

SEQ ID NO: 242535 - DNA, 75 bp, Artificial Sequence
  Synthetic
gctaatacttcttaataaagacacaattggttggaaaagtcaaaagtgtttatttatttcttttgcggtaggccc

SEQ ID NO: 242536 - DNA, 75 bp, Artificial Sequence
  Synthetic
tagaccacctgtcgcggtcgtttaaaactttatggatgttttccaagacccggtacaggtgggcttggatgttca

SEQ ID NO: 242537 - DNA, 75 bp, Artificial Sequence
  Synthetic
ggtagataaaatgaatcgctggaagacctacgctcaggagcagcgggagtgggaggagagccagtcccgcccttt

SEQ ID NO: 242538 - DNA, 75 bp, Artificial Sequence
  Synthetic
aatacataggcattaggccgtccctgggatgcaggtaggaccactggagggcgtcatgctctggggtggtgttgt

SEQ ID NO: 242539 - DNA, 75 bp, Artificial Sequence
  Synthetic
ggccggccctttcagccgttggcgccggcgagaagacgaccaggatgactccgccgatgacaatagcgttctgga

SEQ ID NO: 242540 - DNA, 75 bp, Artificial Sequence
  Synthetic
aaataatccaatcgtagcagggtttttgagcatgaaactggaagatgtccttaaggaggaggctaatggccagag

SEQ ID NO: 242541 - DNA, 75 bp, Artificial Sequence
  Synthetic
cttggggggaactggtgcttcttccaaccccttcgcccacctacgtcctcagggccgcttgggcagattgtatta

SEQ ID NO: 242542 - DNA, 75 bp, Artificial Sequence
  Synthetic
aaccccttcgcccacctacgtcctcagggccgcttgggcagattgtattaaaaaaaaataaaaaaaaaaaaacca

SEQ ID NO: 242543 - DNA, 75 bp, Artificial Sequence
  Synthetic
gtagccccttggtgaaggtattaacaaatcgattaagttgggagggatgcatgcgaggggaaatcagatgcattt

SEQ ID NO: 242544 - DNA, 75 bp, Artificial Sequence
  Synthetic
cttaccagagccatggcaacagcgtcggtccctttgtgtgttttttccctcttcccagtagcaaaatgagacgag

SEQ ID NO: 242545 - DNA, 75 bp, Artificial Sequence
  Synthetic
tggcctgaatttttaggttggcaatgttgccaccgagatcacgtctggggttcatgttgtgcagaaccactagca

SEQ ID NO: 242546 - DNA, 75 bp, Artificial Sequence
  Synthetic
cggtgggagtgccacccgtgatggcatacgcagagggtcctcctccttcttacgaaagcgtgatgggatcagcgg

SEQ ID NO: 242547 - DNA, 75 bp, Artificial Sequence
  Synthetic
cggtatagccggtgcacttggggaatttgtcatgcaacttggaagggaaggcgtggaaaaacttggaaacccctt

SEQ ID NO: 242548 - DNA, 75 bp, Artificial Sequence
  Synthetic
attcgccggcaacgctggaggcgctctacgttcctccccgctacctggggcctacggaagggcgaaacagcattc

SEQ ID NO: 242549 - DNA, 75 bp, Artificial Sequence
  Synthetic
tgtgccctcccaaattttccatgcactcatccataatgatggcgatggggccttgggatgcagccttagcaaaaa

SEQ ID NO: 242550 - DNA, 75 bp, Artificial Sequence
  Synthetic
gttactcagagttggcgccgctatatgacaccacccgggtttatctagtggataacaaatcggcagacattgcct

SEQ ID NO: 242551 - DNA, 75 bp, Artificial Sequence
  Synthetic
tgttatcggggtgggaaacatcgtagttttgctccagggtaagctcgtcataggccattttgatgaagcgtggta

SEQ ID NO: 242552 - DNA, 75 bp, Artificial Sequence
  Synthetic
ccttgaactaccaaaatgaccacagcaactttcaaaccacggtggtgcagaacaatgacttcacaccagcggagg

SEQ ID NO: 242553 - DNA, 75 bp, Artificial Sequence
  Synthetic
aaagggtgcccgactggggtataatggtcccttctggacctggggcgtagttaccctcgcagatttgcatctccc

SEQ ID NO: 242554 - DNA, 75 bp, Artificial Sequence
  Synthetic
cggggacgcaaaccattaactttgacgagcgctcgcggtggggtgctgacctaaaaacaatcctgcgcacaaaca

SEQ ID NO: 242555 - DNA, 75 bp, Artificial Sequence
  Synthetic
aagccttaatttctgagggggggatcatgtccacctgaggggcaataaaaaaaacggtttcgggtggagggttaa

SEQ ID NO: 242556 - DNA, 75 bp, Artificial Sequence
  Synthetic
atcgtccaacagcacggtggagtccaaagcagagctctgcaaaaacacaatacagtcaagctctccacgggtttt

SEQ ID NO: 242557 - DNA, 75 bp, Artificial Sequence
  Synthetic
tgcccaacataaacgagtttatgtctaccaacaagtttaaagctcggctaatggtagaaaaaaaaaacaaggaaa

SEQ ID NO: 242558 - DNA, 75 bp, Artificial Sequence
  Synthetic
taagctgggtggaaagcaagtttcgcaaaagctgggatttgccgcagccagtgggaccgtaaatgaccccaatga

SEQ ID NO: 242559 - DNA, 75 bp, Artificial Sequence
  Synthetic
cgcctctgttgtagtctgccaacgtaaacgggcagtaccgttccattaagccccgcagtaatccctgtctccggg

SEQ ID NO: 242560 - DNA, 75 bp, Artificial Sequence
  Synthetic
ctggtttaccgcgctacgagtggtttgagtttaccttgcccgaaggaaactactcggaaactatgaccattgatc

SEQ ID NO: 242561 - DNA, 75 bp, Artificial Sequence
  Synthetic
caggctgtagttgatagtttaaggagatgcaactgccatcttcccgcaaaagcggagtgacttcgttcatcatgc

SEQ ID NO: 242562 - DNA, 75 bp, Artificial Sequence
  Synthetic
gttccaccaagcttttcagaagtgacctaacggtgaagcttcccaaaactttcaccgccttggcgagcaaccgcc

SEQ ID NO: 242563 - DNA, 75 bp, Artificial Sequence
  Synthetic
ttatgaataacgccattgtagacaactacttggaagtgggaagacaaaacggcgtgctagaaagcgacatagggg

SEQ ID NO: 242564 - DNA, 75 bp, Artificial Sequence
  Synthetic
ttcaccgccttggcgagcaaccgccgcgtccgacgggcacagcatcgcacagaaagctcatccaagtttttacaa

SEQ ID NO: 242565 - DNA, 75 bp, Artificial Sequence
  Synthetic
ttctgacatgctggttttctttaaccaagtcttgcaagagacgctcaccgcccagggaaagtagctcttccaagc

SEQ ID NO: 242566 - DNA, 75 bp, Artificial Sequence
  Synthetic
tgaagtttgacacgcgcaatttccgtttgggttgggacccggtaaccaagcttgtcatgccaggcgtgtacacca

SEQ ID NO: 242567 - DNA, 75 bp, Artificial Sequence
  Synthetic
tgcggaaatgctttagtggttttaggccatcggccatggtcattttttcaagggattgacgcagcaaatagagcc

SEQ ID NO: 242568 - DNA, 75 bp, Artificial Sequence
  Synthetic
atgaagcgtttcatccggatattgttctattgccggggtgcggagtggattttacgcagagtcgtcttagtaatc

SEQ ID NO: 242569 - DNA, 75 bp, Artificial Sequence
  Synthetic
actccacccaaatgacatgcgctccaacactatagccgcatgcccatcatacagcaagcgaatatacataatatg

SEQ ID NO: 242570 - DNA, 75 bp, Artificial Sequence
  Synthetic
tctattgccggggtgcggagtggattttacgcagagtcgtcttagtaatctgttgggaatccgtaagcggctgcc

SEQ ID NO: 242571 - DNA, 75 bp, Artificial Sequence
  Synthetic
gatcccagagctcggtaatatggtctatggcatctcgatccaacaaacttcttggttgcgggggttgggacggct

SEQ ID NO: 242572 - DNA, 75 bp, Artificial Sequence
  Synthetic
gtttcaagaaggttttcaaatcatgtatgaggatttggagggaggtaacattccggccttgttagacgttgcaaa

SEQ ID NO: 242573 - DNA, 75 bp, Artificial Sequence
  Synthetic
ttggctgtacggtaccagtcggtgggcgtccagtggagcaagggtaatgtctttccagggtcgcagggttcgcgt

SEQ ID NO: 242574 - DNA, 75 bp, Artificial Sequence
  Synthetic
agggaatctcaagttatacagtgaaccataaatcatcattttaaaccagtttgctaacactacaccgcccgcctt

SEQ ID NO: 242575 - DNA, 75 bp, Artificial Sequence
  Synthetic
gtatgaagctagcattcagaaagccaaagaggagggaaaagaaattggcgacgatacttttgcaacccgccccca

SEQ ID NO: 242576 - DNA, 75 bp, Artificial Sequence
  Synthetic
taggttggtttcggtgacggtaaaggggcgcgctccgggttgggcgcttgccagggttctcttcaggctcatcct

SEQ ID NO: 242577 - DNA, 75 bp, Artificial Sequence
  Synthetic
acattgaagagacccaggtttattacagtgacagtgtatagtccagcgctcaaaacctcttacaatttgattaaa

SEQ ID NO: 242578 - DNA, 75 bp, Artificial Sequence
  Synthetic
agatctggtaatcgaaccagtggcaaaagatagcaaaaatcgcagctacaatttgctgcctaatgatcaaaacaa

SEQ ID NO: 242579 - DNA, 75 bp, Artificial Sequence
  Synthetic
gctggtgtgaaaacgcgcgtcttcgccctgaaagtcggccaagtagcattttaacatgagatcatagttgagggt

SEQ ID NO: 242580 - DNA, 75 bp, Artificial Sequence
  Synthetic
atcaacattaagagtggcacaacaaacacaaacacgcatgtaaattctacacacatgcttttcccatttagacag

SEQ ID NO: 242581 - DNA, 75 bp, Artificial Sequence
  Synthetic
caccgcatatcgcagctggtttttagcctacaactatggagaccccaagaagggagtgcaatcctggactttatt

SEQ ID NO: 242582 - DNA, 75 bp, Artificial Sequence
  Synthetic
acacatgcttttcccatttagacagtatcatgtcccaccacattggccattcctgcaatactataaagggagcac

SEQ ID NO: 242583 - DNA, 75 bp, Artificial Sequence
  Synthetic
ttcggcagcgtgtcctttggcgcgaagcttgcccttggaaatttgctgacagctgggacagcggaggcattttag

SEQ ID NO: 242584 - DNA, 75 bp, Artificial Sequence
  Synthetic
gaccacagcggacgtcacgtgcgggtcgcagcaggtgtactggtctttacccgacatgatgcaagacccagtaac

SEQ ID NO: 242585 - DNA, 75 bp, Artificial Sequence
  Synthetic
aagatggaatagacctcacctcgctcacataatgcatattcaaatgttcacactctaaaagtccaggagtccttt

SEQ ID NO: 242586 - DNA, 75 bp, Artificial Sequence
  Synthetic
ggcgtagagtttgggagccaggaagacggactctggtgaataagcgtcggcgccacactgtgcacacacggtttc

SEQ ID NO: 242587 - DNA, 75 bp, Artificial Sequence
  Synthetic
ttttcgcccgtctacgcaagtcagcaactacccagtagtgggggttgaattgctgccagtacacgccaaaagttt

SEQ ID NO: 242588 - DNA, 75 bp, Artificial Sequence
  Synthetic
ccattgtggcaatgggcacaaaatcctcagagggaggtggaaggcggtgggtttggtacgaactcagtttgtagc

SEQ ID NO: 242589 - DNA, 75 bp, Artificial Sequence
  Synthetic
gcactccactaaccaggcgagctcagggtgttttgggtcaaaaaccagattgcctccgtgttttttgatgcgttt

SEQ ID NO: 242590 - DNA, 75 bp, Artificial Sequence
  Synthetic
ctacaatgagcaggccgtttactctcagcttatccgccagtccaccgcgcttacacacgtcttcaatcgctttcc

SEQ ID NO: 242591 - DNA, 75 bp, Artificial Sequence
  Synthetic
gaaaccatctgtcgcgttgcatcataaattaaaagctcgcgcacagcttcgtacttctgttttaaaaagcgaaca

SEQ ID NO: 242592 - DNA, 75 bp, Artificial Sequence
  Synthetic
cttacctcgtgtttccatgaggcggtatccggcttcggtgacaaacaagctgtctgtgtctccgtaaactgattt

SEQ ID NO: 242593 - DNA, 75 bp, Artificial Sequence
  Synthetic
tgagaatcagatactggtgcgtccgcccgctccgaccattaccaccgtcagtgaaaacgttcccgccctcacaga

SEQ ID NO: 242594 - DNA, 75 bp, Artificial Sequence
  Synthetic
cgctgccaacaaatgttcgcaaaccgacggtttcgttggcgcgctctttcagttttcagggcagtgttcagccac

SEQ ID NO: 242595 - DNA, 75 bp, Artificial Sequence
  Synthetic
gagggtacgctgttccaacggtgtgcctctgtcctctgcgtacaagatctcggaccattctgagacaaaagcccg

SEQ ID NO: 242596 - DNA, 75 bp, Artificial Sequence
  Synthetic
tcacggaaccctgccgctgcgcagcagtatcagtggagtccagcgcgtgaccatcactgacgcccgccgtcggac

SEQ ID NO: 242597 - DNA, 75 bp, Artificial Sequence
  Synthetic
ggtccaggctaaaacaaaggaggcgatttgggagggataacggttgttttccaccagggggtcgaccttttctag

SEQ ID NO: 242598 - DNA, 75 bp, Artificial Sequence
  Synthetic
gacggtttcgttggcgcgctctttcagttttcagggcagtgttcagccactcctgcagtccacttaacagctcct

SEQ ID NO: 242599 - DNA, 75 bp, Artificial Sequence
  Synthetic
ctgtccctacgtgcacaaagccctgggcatagttgctccaaaagtgctttctagccgcaccttttaacatgtcta

SEQ ID NO: 242600 - DNA, 75 bp, Artificial Sequence
  Synthetic
ttcaaacagcaggttaaagccaactccaaccaagcaatacaaaggccttgatcccgactcactggaggtggaggg

SEQ ID NO: 242601 - DNA, 75 bp, Artificial Sequence
  Synthetic
ggtgtgaaggcaaaggtcatcttcttctgcatccataaaggtaattggtttgtaagtgtaggtcacgtggtcatt

SEQ ID NO: 242602 - DNA, 75 bp, Artificial Sequence
  Synthetic
ttctaatctcgcccgataataacaccggctgggggttgcactctgccggcatgtatggcggtgccaaaaggcgtt

SEQ ID NO: 242603 - DNA, 75 bp, Artificial Sequence
  Synthetic
agagacggaagaggcataattattccagacggttgtaaagccagccaaagtgcaagtcacgaagatcacacctct

SEQ ID NO: 242604 - DNA, 75 bp, Artificial Sequence
  Synthetic
gggcttgtgcgtgggtgtataaaagggggcgtgtccgggctcttcatcactttcttccgcatcgctgtggacgac

SEQ ID NO: 242605 - DNA, 75 bp, Artificial Sequence
  Synthetic
ccagccagcatcctgttcgtgtgcgagggcattaccgcgctccctggggggcccacacccggggcataatttccg

SEQ ID NO: 242606 - DNA, 75 bp, Artificial Sequence
  Synthetic
agccagctgttcgggtgagtatgcgcgttgaaaggtgggcataacttcagcacttagagtgtcagtttccacaaa

SEQ ID NO: 242607 - DNA, 75 bp, Artificial Sequence
  Synthetic
tgcaagtcacgaagatcacacctctccccaccgctgcgttggtaaaaaattacagccaagtcaaaaaagatgcga

SEQ ID NO: 242608 - DNA, 75 bp, Artificial Sequence
  Synthetic
gccgcaccaccgttgatgacgtgattgactctgtagtagccgacgctagacggtatcagcgacccacgtccacgg

SEQ ID NO: 242609 - DNA, 75 bp, Artificial Sequence
  Synthetic
cgaggtggatttgatatttatctgccctgcggcaatgcttttgatggtggctgaatccatttggtcagaaaatac

SEQ ID NO: 242610 - DNA, 75 bp, Artificial Sequence
  Synthetic
tggattccgtgattgacagcgtggtagcagatgccaggcgctatgcgcagcgcaaaagccgtttgcggcgtcgcc

SEQ ID NO: 242611 - DNA, 75 bp, Artificial Sequence
  Synthetic
aatttttttgttatcaagtttggtagcaaaggatccatagagggcgttggagagcagtttggcaatggaacgcag

SEQ ID NO: 242612 - DNA, 75 bp, Artificial Sequence
  Synthetic
ggcgacgacccacgactgccatgattgccgctcgagcggtgttaaggcgtgcgcgtcggataggacggcgagcca

SEQ ID NO: 242613 - DNA, 75 bp, Artificial Sequence
  Synthetic
tgtttggtttttttcgcggtcggcacgctccttggcggtgatattaagatgaacgtactcttttgccacgcagcg

SEQ ID NO: 242614 - DNA, 75 bp, Artificial Sequence
  Synthetic
tgcgccgagccgctgccgctgccagtgctggtcgagcccgccgtcaggccgctcgccaggctgccgcggccattg

SEQ ID NO: 242615 - DNA, 75 bp, Artificial Sequence
  Synthetic
tgctggtcgagcccgccgtcaggccgctcgccaggctgccgcggccattgccagcatggcccagccccggcgagg

SEQ ID NO: 242616 - DNA, 75 bp, Artificial Sequence
  Synthetic
ccactcgggaaagacagtggcgcgctcgtcgggaagcaaccgcacatgccagccccggttgtgcagtgttataag

SEQ ID NO: 242617 - DNA, 75 bp, Artificial Sequence
  Synthetic
gtccacactggtaactacctcgccgcgcaggggctcattggtccagcaaaggcgccctcctttgcgcgaacagag

SEQ ID NO: 242618 - DNA, 75 bp, Artificial Sequence
  Synthetic
gaatgtctactgggtaagagacgcatcgggtgtgcgggtgccggtgcgaactcgaccccctcgaagttagaagac

SEQ ID NO: 242619 - DNA, 75 bp, Artificial Sequence
  Synthetic
tgggggcaaaacatctagtaggttttcaggtggggggtcggcgtcgatggtaaaaatgccaggcagcagggtgcg

SEQ ID NO: 242620 - DNA, 75 bp, Artificial Sequence
  Synthetic
gattcaaaacgatggacgaagactgagtttccctatcgttgccagcatgagcaagcgcaagttcaaagaagagct

SEQ ID NO: 242621 - DNA, 75 bp, Artificial Sequence
  Synthetic
attgaaataatcaatgggggtaccaacttgcaaaagagcgtgttcccaatctcggaccgctagggcgcgctcgta

SEQ ID NO: 242622 - DNA, 75 bp, Artificial Sequence
  Synthetic
gctggaggcccttgtgcccgaaatctatggccctgcggcggacgtcaagcccgacattaagccccgtgccctgaa

SEQ ID NO: 242623 - DNA, 75 bp, Artificial Sequence
  Synthetic
gggattgagtgggaagccccacggcatgggatgggtaagtgcagaggcgtacatgccacagatgtcataaacgta

SEQ ID NO: 242624 - DNA, 75 bp, Artificial Sequence
  Synthetic
gcgtgttaaaaagcgggaaaaaaaagaggaaactgggttgttagatgatgatgtggagttcgttaggacctttgc

SEQ ID NO: 242625 - DNA, 75 bp, Artificial Sequence
  Synthetic
aagtggttcgcgtagcaccccaatgtaagttggataacagcgtcctccgcgaatgctagcccgaacatagtcata

SEQ ID NO: 242626 - DNA, 75 bp, Artificial Sequence
  Synthetic
tcctcggcgacaggtgcagtggcgtggacgcaaagtgaagcgcgtgctccgacctggcaccactgtggtgttcac

SEQ ID NO: 242627 - DNA, 75 bp, Artificial Sequence
  Synthetic
catttcgtgggaaggggccagcaagctgccgcctaggtccgaccgctggggttttactgtccggtacaagatttg

SEQ ID NO: 242628 - DNA, 75 bp, Artificial Sequence
  Synthetic
tcctggcgagcggtctgccacacgggcattaaagcgggaatacgatgaggtttatgccgacgaagatattctgga

SEQ ID NO: 242629 - DNA, 75 bp, Artificial Sequence
  Synthetic
tacccgctgccccgtcttaccgcgacaaagcacacagaacaaaacacactacacagacgcacacaatatttatac

SEQ ID NO: 242630 - DNA, 75 bp, Artificial Sequence
  Synthetic
gcattaaagcgggaatacgatgaggtttatgccgacgaagatattctggagcaggcagcccagcaaattggcgag

SEQ ID NO: 242631 - DNA, 75 bp, Artificial Sequence
  Synthetic
acgaaagatggcgtgggagttggaggagatggtgggccgctgaaagacgttaaagctggcttcgggtagacctac

SEQ ID NO: 242632 - DNA, 75 bp, Artificial Sequence
  Synthetic
ttcgcctatggcaaacgcggtcgttacggagaggtggggctgttgctggatcaaagtaacccgactccaagcctg

SEQ ID NO: 242633 - DNA, 75 bp, Artificial Sequence
  Synthetic
cgcgtcgcggataaactgagcgtaggattcgcgcaacttttgcaccagggcggcggtaacaagcacatccagggc

SEQ ID NO: 242634 - DNA, 75 bp, Artificial Sequence
  Synthetic
aagcccgcaacgcagcagcagattcttccagtaacggaaaccaaacggggcgtcaaaagggaaaacaaagacgaa

SEQ ID NO: 242635 - DNA, 75 bp, Artificial Sequence
  Synthetic
acagtaatcaagggtttcacgcaccaggtcgtaatgaggacattgctttttttcccagagttcgcggttcaggag

SEQ ID NO: 242636 - DNA, 75 bp, Artificial Sequence
  Synthetic
ttgcagcctacaatgcaacttatggtgcccaagcggcagaagctggaggaagtgctggaaaatatgaaagtggac

SEQ ID NO: 242637 - DNA, 75 bp, Artificial Sequence
  Synthetic
gtactcctcgcgatccttccagtaatcttcggcaggaaagccacgctcgtctgcgcggtaagaacccagcatgta

SEQ ID NO: 242638 - DNA, 75 bp, Artificial Sequence
  Synthetic
tcacttcgcaccacccctagcccctcctcactcattatcatattggctcgtttccagctttaaggtatattattg

SEQ ID NO: 242639 - DNA, 75 bp, Artificial Sequence
  Synthetic
ccaagcgttgagccggaagtaaaagtgcgccccattaaggaaataggtccaggtctgggagtgcaaacggtggat

SEQ ID NO: 242640 - DNA, 75 bp, Artificial Sequence
  Synthetic
aaactcgtttacggccttgtatgggcagcatcctttttctaccggaagggtataggcttgtgcggcttttcgcag

SEQ ID NO: 242641 - DNA, 75 bp, Artificial Sequence
  Synthetic
agacgtgtgtgtgagggcaaaagtgtcgcgcaccataaccttgaggaattgatacttaaaatcagagtcgtcgca

SEQ ID NO: 242642 - DNA, 75 bp, Artificial Sequence
  Synthetic
ggaaacgcagacagatcagcctgctgctgtgactacccgggaaataggtttgcaaacggacccacggtacgagtc

SEQ ID NO: 242643 - DNA, 75 bp, Artificial Sequence
  Synthetic
ggcgccctgctcccataggcgatagtcggtgcgtttttttgagcttggattaggaagggcaaaggtgatatcatt

SEQ ID NO: 242644 - DNA, 75 bp, Artificial Sequence
  Synthetic
ctatcctaccggagtatgccttacatccgtcaattacgccgacgcctggctatcgcggtacaatcttcagaccca

SEQ ID NO: 242645 - DNA, 75 bp, Artificial Sequence
  Synthetic
tccgtcaattacgccgacgcctggctatcgcggtacaatcttcagacccagccgccctcgaaccacccgccgtcg

SEQ ID NO: 242646 - DNA, 75 bp, Artificial Sequence
  Synthetic
aaaaaggattttgccggctctaggcataaagttgcgggtgattttgaaaggcccgggcacatcagaacggttgtt

SEQ ID NO: 242647 - DNA, 75 bp, Artificial Sequence
  Synthetic
aataacctgagctgcaagtacgatttcatcgaagccgttgatgttatgccccacaatgtaaagttctaaaaagcg

SEQ ID NO: 242648 - DNA, 75 bp, Artificial Sequence
  Synthetic
tcgcactacccggcgtcgatcgcgtcgcattacacctatctccgtgcaccgtgtaacccgccggggccgcacaat

SEQ ID NO: 242649 - DNA, 75 bp, Artificial Sequence
  Synthetic
ggggcgtccctggagtttgggggccttttgtaactcttcataggtaaggtaatcaggagaaaaaagacccatttc

SEQ ID NO: 242650 - DNA, 75 bp, Artificial Sequence
  Synthetic
taccctgcctaatgcgcgttaccaccccagcattctcatttaattcgtccgctgccgtttttccagatggctctg

SEQ ID NO: 242651 - DNA, 75 bp, Artificial Sequence
  Synthetic
caagcaagcccattctgccagttggggattggcggctagaaaaccgcgccatagctggagggcaaaatgggcttg

SEQ ID NO: 242652 - DNA, 75 bp, Artificial Sequence
  Synthetic
acttgccggtttcgcatcccagtttcgtcctaccgaggaagatctcgccgtaggagaggcatgttgggcagcggg

SEQ ID NO: 242653 - DNA, 75 bp, Artificial Sequence
  Synthetic
caagcggttgcggtactctcgaaactttttgcccaccgccaatttttcgggggtcaccacgtaaaaggtacgttc

SEQ ID NO: 242654 - DNA, 75 bp, Artificial Sequence
  Synthetic
cgccgacgcgctttgcgcaggcgtatgaaaggcggatttttgcccgcgctgattcccattatcgccgccgccatt

SEQ ID NO: 242655 - DNA, 75 bp, Artificial Sequence
  Synthetic
gtcgtttccccaagtgtcccactgcaactcgcaggccagtcggcaggcttccttaacaagggcttcctcccccga

SEQ ID NO: 242656 - DNA, 75 bp, Artificial Sequence
  Synthetic
ggcgcaatcccaggcattgcctctgtggcgttgcaagcacgcaaacaataaaagaagcttgacactgactccctg

SEQ ID NO: 242657 - DNA, 75 bp, Artificial Sequence
  Synthetic
gagatgcataactagcataaaggggaccagctgtttaccaaaggctcccatccacgtgtaggtttcgacgtcgta

SEQ ID NO: 242658 - DNA, 75 bp, Artificial Sequence
  Synthetic
gtcctgactattttatacagacaagacatggaagacatcaattttgcgtcgctggcgccgcgtcacggctcgcgg

SEQ ID NO: 242659 - DNA, 75 bp, Artificial Sequence
  Synthetic
gctggcgccgcgtcacggctcgcggccgttcatgggcacctggaacgagatcgggaccagccagctcaacggggg

SEQ ID NO: 242660 - DNA, 75 bp, Artificial Sequence
  Synthetic
ggtgacaaagaggcgttcgacgcgaggatgagagccgatcggaaagaaattgattttctgccaccagccggagga

SEQ ID NO: 242661 - DNA, 75 bp, Artificial Sequence
  Synthetic
ggatgagagccgatcggaaagaaattgattttctgccaccagccggaggagtgggcgttgatatgatgaaagtag

SEQ ID NO: 242662 - DNA, 75 bp, Artificial Sequence
  Synthetic
cgctttcagttggagtagcctgtggagtggcattaaaaactttgggtcctccattaagtcctttggcaacaaggc

SEQ ID NO: 242663 - DNA, 75 bp, Artificial Sequence
  Synthetic
aagtctctccggcggaccgtgcattcgtgctgatatttgtaaaagcgggcgcaatactcgcagcgttgcacgctc

SEQ ID NO: 242664 - DNA, 75 bp, Artificial Sequence
  Synthetic
ctggaacagtaacactggtcagatgctgcgagataagttgaaggaccagaacttccaacaaaaagtggtggacgg

SEQ ID NO: 242665 - DNA, 75 bp, Artificial Sequence
  Synthetic
tgcatctcttgaatgaggtgtacctgtcgcccacgtacgagaaatcggagagggaagttgagaaaatcctcagtg

SEQ ID NO: 242666 - DNA, 75 bp, Artificial Sequence
  Synthetic
tctggcctcgggtataaatggcgtggtggatattgctaaccaggccttacaaaaccaaatcaatcagaggctgga

SEQ ID NO: 242667 - DNA, 75 bp, Artificial Sequence
  Synthetic
tcttgcctttcaccctcgtcgccctcttctgcacctgcacgctcttgctgtgggtggatgatggagggaacgaca

SEQ ID NO: 242668 - DNA, 75 bp, Artificial Sequence
  Synthetic
gaatagccgtcaacctccagtagctctgaagcagcgaccaactcccgaaccagaagaggtggaagtggaagaaaa

SEQ ID NO: 242669 - DNA, 75 bp, Artificial Sequence
  Synthetic
acgccccgcgagccacaggtccagacctcaacgcggggcaccttcagcttgagagcaagagtgcggatttgggaa

SEQ ID NO: 242670 - DNA, 75 bp, Artificial Sequence
  Synthetic
attacccccgttggaaacggcacctcccttgcctagcaagggtgagaaacggccgcgtcccgagctggaggaaac

SEQ ID NO: 242671 - DNA, 75 bp, Artificial Sequence
  Synthetic
ctgtccagggagtccaggaaggcctcgttcagatcagcgggcacagatcgaaggttgacttgcaggagacgggta

SEQ ID NO: 242672 - DNA, 75 bp, Artificial Sequence
  Synthetic
tctggttgtggaatcccgcgagcccccctcgtacgagcaggctttgaaagaaggagcttcgtatcccatgaccag

SEQ ID NO: 242673 - DNA, 75 bp, Artificial Sequence
  Synthetic
agggccgatgccaggcggcgatgaaacttgatttccattggtgagttggtagcagtgtcaatagcatacagaaga

SEQ ID NO: 242674 - DNA, 75 bp, Artificial Sequence
  Synthetic
acccattggctccatggccagaccggtttatgggaaagaaaaaactcccgtaacgttagaattgccaccacccgc

SEQ ID NO: 242675 - DNA, 75 bp, Artificial Sequence
  Synthetic
ccttgtccgcggggagctacaatggtaccacgcaggcgagagttgggggtaaggcttacattgttcgctgcgggc

SEQ ID NO: 242676 - DNA, 75 bp, Artificial Sequence
  Synthetic
gtttatgggaaagaaaaaactcccgtaacgttagaattgccaccacccgcgcccaccgtaccgcctatgccaact

SEQ ID NO: 242677 - DNA, 75 bp, Artificial Sequence
  Synthetic
cccaccctgggtaccaacgttccccgccttgcggccccaaccgttgccgtggccactccggctcgcagagttcgc

SEQ ID NO: 242678 - DNA, 75 bp, Artificial Sequence
  Synthetic
gggcgtccggaggcagtggtggatgggggttcgcctggagaggcggtagcggcacgtcggcgtggagctcgggta

SEQ ID NO: 242679 - DNA, 75 bp, Artificial Sequence
  Synthetic
ggtgccaattggcagagcactttgaacagcattgtgggtttgggagtgaaaagcctaaaacgccgccggtgctat

SEQ ID NO: 242680 - DNA, 75 bp, Artificial Sequence
  Synthetic
gcggttggtgctgcgcccgcagttgactggcgtacgcgacgacgcggcggttgaggtcctgaatgtgtctccgct

SEQ ID NO: 242681 - DNA, 75 bp, Artificial Sequence
  Synthetic
taaagtggaaccaagctaaatacccttattgtatgcgcctcctgtgttacgccagacagccgagtgacgggtcac

SEQ ID NO: 242682 - DNA, 75 bp, Artificial Sequence
  Synthetic
gggagaaaaccaccggccctcggactcggaacctgaaagagagttcaacagaatcaatatcggcatcgttgaccg

SEQ ID NO: 242683 - DNA, 75 bp, Artificial Sequence
  Synthetic
cgccaagagcgccgcttgcaagatggccaccccctcgatgatgccgcaatggtcttacatgcacatcgccgggca

SEQ ID NO: 242684 - DNA, 75 bp, Artificial Sequence
  Synthetic
cggcttgtcgcagaatctcctgcacgtcgccagagttgtcttggtaggcaatctccgacataaactggtcaatct

SEQ ID NO: 242685 - DNA, 75 bp, Artificial Sequence
  Synthetic
ggtcttacatgcacatcgccgggcaggacgcctcggagtatctgagcccgggcctggtgcaatttgcccgcgcca

SEQ ID NO: 242686 - DNA, 75 bp, Artificial Sequence
  Synthetic
cttcgtcctggagttctccgtgtcctgcgcgctccaccgtggctgcaaggtcattagagatgcgcctcatgagct

SEQ ID NO: 242687 - DNA, 75 bp, Artificial Sequence
  Synthetic
gccaccccctcgatgatgccgcaatggtcttacatgcacatcgccgggcaggacgcctcggagtatctgagcccg

SEQ ID NO: 242688 - DNA, 75 bp, Artificial Sequence
  Synthetic
ccgatacgtacttcagcctggggaacaagttcagaaatcccactgtggctccgacccacgatgtaaccacagaca

SEQ ID NO: 242689 - DNA, 75 bp, Artificial Sequence
  Synthetic
gggagaaagcgttaagaccgttttcgttccacacgcggctgtagaccacgtcgccaacagtgtttcgggcgcgca

SEQ ID NO: 242690 - DNA, 75 bp, Artificial Sequence
  Synthetic
ggtcacagcgactgacgctgcgattcgtgccagtcgaccgcgaggacaccgcttattcttacaaagtgcgcttta

SEQ ID NO: 242691 - DNA, 75 bp, Artificial Sequence
  Synthetic
tcaccacttgtgcaatgttcagttctacgtgtcttgcaaagacggcgtagttgcgtagacgctggaagaggtagt

SEQ ID NO: 242692 - DNA, 75 bp, Artificial Sequence
  Synthetic
cgctggccgtgggcgacaaccgggtgttggacatggccagcacctactttgacatccgcggcgtgctggatcgtg

SEQ ID NO: 242693 - DNA, 75 bp, Artificial Sequence
  Synthetic
tgagcgtggtggcaatgtgctcgcaaacaaagaagtacatgacccagcgccgaagcgtcatttcgttaatatctc

SEQ ID NO: 242694 - DNA, 75 bp, Artificial Sequence
  Synthetic
gccccagctttaaaccctactccggaaccgcctataactccctggctcctaaaacagcacccaatccatgcgaat

SEQ ID NO: 242695 - DNA, 75 bp, Artificial Sequence
  Synthetic
cgagggcttccaagcggtccattgcctcgtagaagtcaaccgcgaagttgaagaactgggagttgcgcgccgcaa

SEQ ID NO: 242696 - DNA, 75 bp, Artificial Sequence
  Synthetic
acgtcaactcctcttgcaggagccgaattgcctcggctacagtttcgcgcacctcttgttcgaaggctgccggcg

SEQ ID NO: 242697 - DNA, 75 bp, Artificial Sequence
  Synthetic
ttcagataggaacagatacaacaaatcagcctatttatgccgacaaaacctatcaaccagagcctcaagtgggtc

SEQ ID NO: 242698 - DNA, 75 bp, Artificial Sequence
  Synthetic
tttcctcgatttccataaactcctcttcctccacagcgggaccctcggggctgaccggcgctgggacgggttgtc

SEQ ID NO: 242699 - DNA, 75 bp, Artificial Sequence
  Synthetic
aaacacagtggaacagtgaagttggcgccgctcaaaaggtagcgggtagggtgctgaaagataccacgccaatgt

SEQ ID NO: 242700 - DNA, 75 bp, Artificial Sequence
  Synthetic
tgttacttccacccgccgctcgcgcgtaagaaagtatacagccgccaactctatcctaccggagtatgccttaca

SEQ ID NO: 242701 - DNA, 75 bp, Artificial Sequence
  Synthetic
gtcgacgacggcgccggacgggcagccggtcaatgaaacgttgaatcatttctccgcgacggcgacgcatggttt

SEQ ID NO: 242702 - DNA, 75 bp, Artificial Sequence
  Synthetic
cgccgctcaaaaggtagcgggtagggtgctgaaagataccacgccaatgttaccatgctacgggtcttacgccaa

SEQ ID NO: 242703 - DNA, 75 bp, Artificial Sequence
  Synthetic
cggtgacggcgcgcccgttttctcgggggcgaagttcaaagacgccgccttgcatgcccgagccggagaggggag

SEQ ID NO: 242704 - DNA, 75 bp, Artificial Sequence
  Synthetic
gctagtctcataacgaacggaaccgatcaaactctaacaagcgacgttaacttacagttctttgccttgccaagc

SEQ ID NO: 242705 - DNA, 75 bp, Artificial Sequence
  Synthetic
gtgctgaaagataccacgccaatgttaccatgctacgggtcttacgccaaaccaacaaatgaaaagggcggtcag

SEQ ID NO: 242706 - DNA, 75 bp, Artificial Sequence
  Synthetic
cttacagttctttgccttgccaagcactcctaatgagccaaaagccgttctttacgctgaaaacgtgtccattga

SEQ ID NO: 242707 - DNA, 75 bp, Artificial Sequence
  Synthetic
gaagtaggtggggcccctgaggcagcgacagggcgctaactgtgcatcttatcatctgttgcataggtagagact

SEQ ID NO: 242708 - DNA, 75 bp, Artificial Sequence
  Synthetic
gccaagcctcattgagcgagtccagttggacgggatcagagaatttttcgaggaaagcttccagccaatcgcagt

SEQ ID NO: 242709 - DNA, 75 bp, Artificial Sequence
  Synthetic
gcaggcagcgcccaacagaccgaactacattggctttagggataactttatcggcctgatgtactacaactccac

SEQ ID NO: 242710 - DNA, 75 bp, Artificial Sequence
  Synthetic
cgcaaggtaagctaaggacggtggcatgagggattctaagggaggcagcagaggaggtgatgctgctgatgagga

SEQ ID NO: 242711 - DNA, 75 bp, Artificial Sequence
  Synthetic
aggcaatatgggtgtattggctgggcaagcttcacagctaaatgctgtagtggacttgcaagacaggaacactga

SEQ ID NO: 242712 - DNA, 75 bp, Artificial Sequence
  Synthetic
aattgaagtaggcggtcttcaaacggcggatggtggcaaggagagtgacgtcttttggtccggcctgttgaattc

SEQ ID NO: 242713 - DNA, 75 bp, Artificial Sequence
  Synthetic
gttatcataccaacttatgctggacgcacttggcgatcggagcagatatttttctatgtggaatcaggctgttga

SEQ ID NO: 242714 - DNA, 75 bp, Artificial Sequence
  Synthetic
gcaggcggtctgccatgccccaagcttcgttctgacatcggcgcaggtccttgtaataatcttgcatgagacttt

SEQ ID NO: 242715 - DNA, 75 bp, Artificial Sequence
  Synthetic
gcacttggcgatcggagcagatatttttctatgtggaatcaggctgttgacagttacgaccccgacgtaaggatc

SEQ ID NO: 242716 - DNA, 75 bp, Artificial Sequence
  Synthetic
ctacgggtatttccaattcccctcggtcggccatgcgtgtggaaccaaacccgcgcaggggctgcagcagggcca

SEQ ID NO: 242717 - DNA, 75 bp, Artificial Sequence
  Synthetic
attgagaaccacggagtggaggacgaactgccaaattactgctttccgctgggagggtctgcagctacagacacg

SEQ ID NO: 242718 - DNA, 75 bp, Artificial Sequence
  Synthetic
agtcggcaactacgcgttcggcgagcacagcctgctgtatctgagttaaagtgttttggaaatcatccaagtcca

SEQ ID NO: 242719 - DNA, 75 bp, Artificial Sequence
  Synthetic
tactctggcataaaggccaatggccaaacctggactgcagacgacaattatgccgacagaggggcagaaattgaa

SEQ ID NO: 242720 - DNA, 75 bp, Artificial Sequence
  Synthetic
caaagcggtggtaggaaccggtgttgatggtgtacgtgcagttggccatgacggaccagttgactacttgcatcc

SEQ ID NO: 242721 - DNA, 75 bp, Artificial Sequence
  Synthetic
tctgggaacatttttgccatggaaatcaatttggcggccaatctctggcgcagcttcttatactccaatgtagct

SEQ ID NO: 242722 - DNA, 75 bp, Artificial Sequence
  Synthetic
tcaatttggcggccaatctctggcgcagcttcttatactccaatgtagctttgtacttgcctgactcatacaaga

SEQ ID NO: 242723 - DNA, 75 bp, Artificial Sequence
  Synthetic
acaaacatagacaaagacaatgggattcagataggaacagacgcaacgacgaagcctatttatgccgacaaaaca

SEQ ID NO: 242724 - DNA, 75 bp, Artificial Sequence
  Synthetic
cgggctgtgtaatctcggtatacctaaggcgcgagtaggctctggattcaaaaacgtagtcgttgcaggtgcgaa

SEQ ID NO: 242725 - DNA, 75 bp, Artificial Sequence
  Synthetic
ttacgccagacaacattacactgcccgaaaacaagaacacctatgcctacatgaacggtcgggtggcggttccta

SEQ ID NO: 242726 - DNA, 75 bp, Artificial Sequence
  Synthetic
ccaagtactggtagccaacaaggaagtggggcggcggctcgcggtaaaggggccagcgaagtgtggcgggcgtac

SEQ ID NO: 242727 - DNA, 75 bp, Artificial Sequence
  Synthetic
gcgccctcgatacctacgtaaacatcggggcacggtggtctccagatcccatggacaatgttaaccccttcaatc

SEQ ID NO: 242728 - DNA, 75 bp, Artificial Sequence
  Synthetic
cgggggccaggtcctccagcataaggcgatggtagtggtaaacatatcgagagagccaggtgatgccggcggcgg

SEQ ID NO: 242729 - DNA, 75 bp, Artificial Sequence
  Synthetic
accaccgtaacgccggtctgcgctatcgatccatgctcttgggcaacgggcgttacgtacccttccacattcaag

SEQ ID NO: 242730 - DNA, 75 bp, Artificial Sequence
  Synthetic
tagtggcggcgcgggcgtattcgcgaacgcggttccagatgttacgcaacggggagaagcgttccatggcgggca

SEQ ID NO: 242731 - DNA, 75 bp, Artificial Sequence
  Synthetic
cgctttgaccagtcagacgggcgcaatcttgtacgctctagatgaaaaaacagagagcggtcacggactttcctc

SEQ ID NO: 242732 - DNA, 75 bp, Artificial Sequence
  Synthetic
tacacctacgagtggaacttcaggaaggacgttaacatgatcctccagagcagtctgggtaacgacctgcgggtc

SEQ ID NO: 242733 - DNA, 75 bp, Artificial Sequence
  Synthetic
agcgcccgacacccatttggtgtacaagccagatgtagctcagggaaccgtaagttcggcagatcttttaacgca

SEQ ID NO: 242734 - DNA, 75 bp, Artificial Sequence
  Synthetic
cgtagcctggaggacagaccgccagggtgcagtggcaaacaacccccggttcgagaccggctggatctgccactc

SEQ ID NO: 242735 - DNA, 75 bp, Artificial Sequence
  Synthetic
gacggagccagcgtcaggttcgatagcattaatctgtacgccaacttttttcccatggctcacaacaccgcctcc

SEQ ID NO: 242736 - DNA, 75 bp, Artificial Sequence
  Synthetic
ccgacgcgccggccgtgcgtccacgacggaaaccccgccgagacctagccgcggtccctggatctccagatacgg

SEQ ID NO: 242737 - DNA, 75 bp, Artificial Sequence
  Synthetic
accttggaagctatgctgcgcaatgacaccaacgaccaatcgtttaacgactacctctgcgctgcaaacatgctt

SEQ ID NO: 242738 - DNA, 75 bp, Artificial Sequence
  Synthetic
aggggagtctttttgttgttttttgtagatgcatccggtgttgcgacagatgcgtccgacggcgcctccaacaca

SEQ ID NO: 242739 - DNA, 75 bp, Artificial Sequence
  Synthetic
tatcccattccttctaatgctactagcgttccaatttctattccttcgcggaactgggccgcttttcggggctgg

SEQ ID NO: 242740 - DNA, 75 bp, Artificial Sequence
  Synthetic
gccgccgctcccgccccccactagcgcccctgcagccgttgctctctccggagccggcggtggcaaccctgagga

SEQ ID NO: 242741 - DNA, 75 bp, Artificial Sequence
  Synthetic
agttttactcgactgaaaaccaaagaaaccccctctttgggttcgggatttgatccctacttcacctactctggc

SEQ ID NO: 242742 - DNA, 75 bp, Artificial Sequence
  Synthetic
ggaggccatcctggacctggaagagggcgaggggctggcccgcttgggggcgccatcccccgagcgccatccccg

SEQ ID NO: 242743 - DNA, 75 bp, Artificial Sequence
  Synthetic
tccgttccatacttggatggtaccttttacctcaaccacacttttaaaaaggtgtccatcatgtttgactcctct

SEQ ID NO: 242744 - DNA, 75 bp, Artificial Sequence
  Synthetic
tattctggcataaaagcaaacagcggaaactggactgcggacgacacttatgccgacagaggggcagaaattgag

SEQ ID NO: 242745 - DNA, 75 bp, Artificial Sequence
  Synthetic
gtgagttggcctggcaatgaccgactgcttacccccaatgagtttgaaatcaaacgcaccgtggatggggaaggg

SEQ ID NO: 242746 - DNA, 75 bp, Artificial Sequence
  Synthetic
cgtgcaacttaaaaaggactcacgccaggcgtacgtaccgcctcagaatttattcagggatcgcagcgggcagga

SEQ ID NO: 242747 - DNA, 75 bp, Artificial Sequence
  Synthetic
gcccgaagagatgagggatcgcaggttttacgcggggcaggagctgcgggccggttttaaccgccaacgggtgct

SEQ ID NO: 242748 - DNA, 75 bp, Artificial Sequence
  Synthetic
tacaacgtggctcaatgtaacatgaccaaagactggtttctgattcagatgcttagtcattacaacattggatat

SEQ ID NO: 242749 - DNA, 75 bp, Artificial Sequence
  Synthetic
acgcgccgaagattttgaacccgacgaacatagcggaataagtccggcacgggcgcacgtgtcggcggccgattt

SEQ ID NO: 242750 - DNA, 75 bp, Artificial Sequence
  Synthetic
cagggtttttatgtacccgaaagctacaaagatagaatgtattcctttttccgaaacttccagccaatgagtcgt

SEQ ID NO: 242751 - DNA, 75 bp, Artificial Sequence
  Synthetic
ggtaaccgcgtacgagcaaacggtgaacgaggagcgcaactttcagaaaagttttaacaatcacgtgcgcaccct

SEQ ID NO: 242752 - DNA, 75 bp, Artificial Sequence
  Synthetic
caggtggtaaacactaccacctacaaggaatatcagaatgttacccttcctttccagcataataactcaggcttt

SEQ ID NO: 242753 - DNA, 75 bp, Artificial Sequence
  Synthetic
ggtggcgcgcgaggaggtggccattgggctgatgcatttgtgggactttatggaggcgtacgtgcaaaatccttc

SEQ ID NO: 242754 - DNA, 75 bp, Artificial Sequence
  Synthetic
gtgggatacatgggacccaccatgcgggagggacaagcttaccccgctaactacccttacccccttattggtcaa

SEQ ID NO: 242755 - DNA, 75 bp, Artificial Sequence
  Synthetic
gagcaagccgctgacggcgcagctgtttttgattgtgcaacacagccgggacaacgaggctttccgcgaggccat

SEQ ID NO: 242756 - DNA, 75 bp, Artificial Sequence
  Synthetic
acggccgtgccaagcctgacacagaaaaaattcctgtgcgatcgcaccatgtggcgcattccgttttccagcaac

SEQ ID NO: 242757 - DNA, 75 bp, Artificial Sequence
  Synthetic
gctgaatattgcggagcctgagggtcgctggcttttggacctggttaatatccttcagagcattgtggtacagga

SEQ ID NO: 242758 - DNA, 75 bp, Artificial Sequence
  Synthetic
ttcatgtctatgggggcactgaccgacctggggcagaacatgctgtacgccaattccgcccacgccctcgacatg

SEQ ID NO: 242759 - DNA, 75 bp, Artificial Sequence
  Synthetic
gcgcagtctaagcctggccgacaaggtggcggccattaattacagcatgcttagcctcggcaagttttacgcccg

SEQ ID NO: 242760 - DNA, 75 bp, Artificial Sequence
  Synthetic
acttttgaggtcgatcccatggatgagcccacacttctttatgttttgtttgaagttttcgacgtcgtgcgcatc

SEQ ID NO: 242761 - DNA, 75 bp, Artificial Sequence
  Synthetic
caagatttacaaaaccccctatgtgcccatagacaaggaggttaaaatagatagcttttacatgcgcatggcgct

SEQ ID NO: 242762 - DNA, 75 bp, Artificial Sequence
  Synthetic
caccagccccaccgcggcgtcatcgaggccgtctacctccgtacgccgttctcggccggtaacgccaccacataa

SEQ ID NO: 242763 - DNA, 75 bp, Artificial Sequence
  Synthetic
aaaggtgttaacgctgagtgacgatctgggggtgtaccgcaacgaccgtattcacaaagctgtgagcgccagccg

SEQ ID NO: 242764 - DNA, 75 bp, Artificial Sequence
  Synthetic
gaagctggccaatgggctccagcgagcaggagctggtcgccatcgcgcgtgacctgggctgcggatcctactttc

SEQ ID NO: 242765 - DNA, 75 bp, Artificial Sequence
  Synthetic
ccgtcgcgagcttagcgaccgcgaactaatgcacagcctgcgtcgggctctaacgggcaccggcactgatgccga

SEQ ID NO: 242766 - DNA, 75 bp, Artificial Sequence
  Synthetic
taggcacctttgacaagcgtttcccgggctttatggctccgaacaagctggcctgcgctattgtgaacacggccg

SEQ ID NO: 242767 - DNA, 75 bp, Artificial Sequence
  Synthetic
aactgaatcttactttgacatgggggcggacctgcaatggcagcccagcgcccgggccctggaggcggctggtta

SEQ ID NO: 242768 - DNA, 75 bp, Artificial Sequence
  Synthetic
ggcgtgaaacagggggcgttcactggttggccctggcctggaaccccaagagccatacctgttacctctttgacc

SEQ ID NO: 242769 - DNA, 75 bp, Artificial Sequence
  Synthetic
tgttggcgcggaagaagatgaggaggactatgaggacgagccctgatcagccaggtggtgtttttgtagatgctg

SEQ ID NO: 242770 - DNA, 75 bp, Artificial Sequence
  Synthetic
cgtttggcttttcagacgagcggctcaaacaaatttaccagtttgaatatgagggcctactaaagcgaagcgctt

SEQ ID NO: 242771 - DNA, 75 bp, Artificial Sequence
  Synthetic
aacactatagccgcatgcccatcatacagcaagcgaatatacataatatgtctacctctgacaaacacgctcccc

SEQ ID NO: 242772 - DNA, 75 bp, Artificial Sequence
  Synthetic
cgttcgacggcggtggcggacgggtcgcagcaggtgaatcccgctatgttggcggccctgcaaagccaaccttcg

SEQ ID NO: 242773 - DNA, 75 bp, Artificial Sequence
  Synthetic
gagggcctactaaagcgaagcgctttggcctccacgcctgaccactgcattacccttgtgaaatccacccagacc

SEQ ID NO: 242774 - DNA, 75 bp, Artificial Sequence
  Synthetic
gttcaggggcctttttctgccgcctgtggtcttttctgctgcatgtttttgcatgcttttatacactggcccagt

SEQ ID NO: 242775 - DNA, 75 bp, Artificial Sequence
  Synthetic
ggcgtgacaccctcagacgactgggcggcggccatggatcgcatcctggccctaaccacccgcaatcccgaagcc

SEQ ID NO: 242776 - DNA, 75 bp, Artificial Sequence
  Synthetic
gtggtcttttctgctgcatgtttttgcatgcttttatacactggcccagtaatccaatggagcaaaatcccacaa

SEQ ID NO: 242777 - DNA, 75 bp, Artificial Sequence
  Synthetic
ttcaggcagcagccccaggccaaccgcttttcggccattttggaagccgtggttccttctcgcactaaccctacc

SEQ ID NO: 242778 - DNA, 75 bp, Artificial Sequence
  Synthetic
gaacccaccctgcgtcggaatcaggaacgattgtatcgttttctgacccaacactctccctactttcgtcgtcac

SEQ ID NO: 242779 - DNA, 75 bp, Artificial Sequence
  Synthetic
cacgaaaaggtgttggcgattgtaaacgctctggtagaaagcaaagccatccgcaaggatgaggcgggactgata

SEQ ID NO: 242780 - DNA, 75 bp, Artificial Sequence
  Synthetic
cgcgagcgaattgaaaaagctacagcttttgatcaaatgaaaaatgctcaagtgttgtttcataataaaattttt

SEQ ID NO: 242781 - DNA, 75 bp, Artificial Sequence
  Synthetic
tataatgccttactggagcgggtagcgcgctataatagcaccaacgtgcaggccaacctagaccgactgacaacg

SEQ ID NO: 242782 - DNA, 75 bp, Artificial Sequence
  Synthetic
gacgtgagagaggcggtggcgcagcgggaacgctttatgcatgacgttaacctaggatcccaagtggcccttaat

SEQ ID NO: 242783 - DNA, 75 bp, Artificial Sequence
  Synthetic
ttttttttatttaaaagggctcaacctccgcatcgccgtgaccggtgggaagggccacgttgcgatattgcaaac

SEQ ID NO: 242784 - DNA, 75 bp, Artificial Sequence
  Synthetic
gcttttctgagcacattgccagctaatgtgccgcgcgggcaggaggactatgtcagctttatcagcgcgcttcgc

SEQ ID NO: 242785 - DNA, 75 bp, Artificial Sequence
  Synthetic
gggtgctccacttgaattcgggaataatcaacttgggcaaagggtcttcgacgttttccttccaaaattgtcgta

SEQ ID NO: 242786 - DNA, 75 bp, Artificial Sequence
  Synthetic
ctcctggtggcggaggtgccccagagtgaggtgtaccagtccgggccagactactttttccaaacttcacggcag

SEQ ID NO: 242787 - DNA, 75 bp, Artificial Sequence
  Synthetic
ccagctgcagggcgcttataacatcaggcgcagaaattttaaaatcacaattggggccagcgctaccgcgcgaat

SEQ ID NO: 242788 - DNA, 75 bp, Artificial Sequence
  Synthetic
ggtttgcaaactgtaaacctaacacaggcgtttaaaaacttgcaaggaatgtggggcgtgcgagcccccgtgggg

SEQ ID NO: 242789 - DNA, 75 bp, Artificial Sequence
  Synthetic
tgcggtatacgggattagcacactggaacactagcacacaggggtggagtatgctggcaagagccgacttgtcgg

SEQ ID NO: 242790 - DNA, 75 bp, Artificial Sequence
  Synthetic
gaccgagccaccatctccagcttattgacgccgaacactcggttgttgctgttgttgatagcgccatttaccaat

SEQ ID NO: 242791 - DNA, 75 bp, Artificial Sequence
  Synthetic
taacttcgctggtcttcagatcttccgcgccgctcaaagcaaatggggttaccttacacatctgccgacccaatt

SEQ ID NO: 242792 - DNA, 75 bp, Artificial Sequence
  Synthetic
cgcgccgctcaaagcaaatggggttaccttacacatctgccgacccaattggggtacaagatctttcttgttaag

SEQ ID NO: 242793 - DNA, 75 bp, Artificial Sequence
  Synthetic
agcagcaccattagccgtgactcgtaccttggtcatctaatcacgctgtaccaggaggctattggccagacgcag

SEQ ID NO: 242794 - DNA, 75 bp, Artificial Sequence
  Synthetic
acactcacagcgcaaagggactaatatgcgttgctgaccgcgttgcatctgcgggtattcggcttgcagaaacgc

SEQ ID NO: 242795 - DNA, 75 bp, Artificial Sequence
  Synthetic
gtggacgaacagaccttccaggaaatcaccagcgtgagtcgggctcttggtcagcaagacaccagtagcttggaa

SEQ ID NO: 242796 - DNA, 75 bp, Artificial Sequence
  Synthetic
ttgcatttgtttaaatgctatttgggctttaagcccctccgaaaaaaacagcccgcaggacttgctagaaaacat

SEQ ID NO: 242797 - DNA, 75 bp, Artificial Sequence
  Synthetic
gccacgctgaactttttgctaaccaaccgccggcaaaaaattccatcgcaatttactttaaattctgaagaggaa

SEQ ID NO: 242798 - DNA, 75 bp, Artificial Sequence
  Synthetic
gttgttgccacagctcacatcttccgcgcagcaccgcgcgtcgtcattcttgatttggaccacgctgcgacccca

SEQ ID NO: 242799 - DNA, 75 bp, Artificial Sequence
  Synthetic
cgtattttgcgctatgtgcagcagtccgtcagcttgtatttaatgcgcgagggggctactgcgtcgtcggctctg

SEQ ID NO: 242800 - DNA, 75 bp, Artificial Sequence
  Synthetic
gcggttctgaacaactttggttttgctaggttgctccttgagggcgcgctggccattctcgctgccaacatctac

SEQ ID NO: 242801 - DNA, 75 bp, Artificial Sequence
  Synthetic
gacatgacggcacgtaacatggaaccgtcgctatactcgtccaaccggccttttattaaccgcctgatggactat

SEQ ID NO: 242802 - DNA, 75 bp, Artificial Sequence
  Synthetic
ctccacaacttgctccttctgtatcatttctcgcccgtggaagcatctcaacacgccttcctcccgggtacagcc

SEQ ID NO: 242803 - DNA, 75 bp, Artificial Sequence
  Synthetic
ctgcaccgcgcggcggccatgaacagcgagtacttcaccaatgccattcttaacccgcactggatgccaccgtcc

SEQ ID NO: 242804 - DNA, 75 bp, Artificial Sequence
  Synthetic
atgagcccaaacagcgcagccggttgtatcccagttgtggtgcttcaccccagcgtaggtttccacgtaggcagc

SEQ ID NO: 242805 - DNA, 75 bp, Artificial Sequence
  Synthetic
gttgaaagccagccgtagatgggacaccgtttccatcgcaggatctccaccagccccagttggtaagcagccccc

SEQ ID NO: 242806 - DNA, 75 bp, Artificial Sequence
  Synthetic
ggtttttacacgggcgagtttgacgtgcctgagggcgacgacggatttttgtgggatgacgtgtccgaaagcatt

SEQ ID NO: 242807 - DNA, 75 bp, Artificial Sequence
  Synthetic
caggaatcgacccatgagctctgtaaaggttttctgggtggtgaatgtcaaagacaacccgcggcgttcctcatt

SEQ ID NO: 242808 - DNA, 75 bp, Artificial Sequence
  Synthetic
ttcgaaccaatgcgttcccgtaaaaaggagggcggagacgagctgccgctgtcgttagtggaggcagcttctcga

SEQ ID NO: 242809 - DNA, 75 bp, Artificial Sequence
  Synthetic
caaccaggtctgacatatcttgcgataaacggcgttttgttcaggaagaaacttaaaagctgttttttcgtcatt

SEQ ID NO: 242810 - DNA, 75 bp, Artificial Sequence
  Synthetic
taaacggcgttttgttcaggaagaaacttaaaagctgttttttcgtcattttccacgtgatatttctccatcagg

SEQ ID NO: 242811 - DNA, 75 bp, Artificial Sequence
  Synthetic
ggccaaacccccgttcccagtctgccatcgctgaccagcagcagcagcggacgggtgtttcgaccccgtttgccc

SEQ ID NO: 242812 - DNA, 75 bp, Artificial Sequence
  Synthetic
acgttcatgagctccatgcccttctcccaagccgaaaccaatgggtcaacctgggggtttgttatcagcatggtc

SEQ ID NO: 242813 - DNA, 75 bp, Artificial Sequence
  Synthetic
ggggagttggactacctcagcgatcccctattgcgaccggcccggaaaaaaaattttcccaacaacggggtggaa

SEQ ID NO: 242814 - DNA, 75 bp, Artificial Sequence
  Synthetic
actgccttggaagagccggattgattattttcttcctcttctggtggcgttagatccctggggataacggttttc

SEQ ID NO: 242815 - DNA, 75 bp, Artificial Sequence
  Synthetic
agcctggtagataagatgaatcgctggaaaacctacgcccaggagcagcgggaagagaggcagccccgcccactg

SEQ ID NO: 242816 - DNA, 75 bp, Artificial Sequence
  Synthetic
tccaaacgcctaatttgtcgcttgccattgcccttttgtactacttctacgcctggatagctgaacccgtggtac

SEQ ID NO: 242817 - DNA, 75 bp, Artificial Sequence
  Synthetic
accggcaccttcagtcgttggcgccggcgggaagaggacgcttacgactcggccgatgatagtagcgtgttggac

SEQ ID NO: 242818 - DNA, 75 bp, Artificial Sequence
  Synthetic
agcacctcttcgtcctcctcgctgtccggaaccacttcgggcgacaaggccggagcgtgtacttgctccggtact

SEQ ID NO: 242819 - DNA, 75 bp, Artificial Sequence
  Synthetic
ttggggggaaccggcgccgcttctgatccctttgctcatctgcggcctcagggtcaactgggtcgtttgtattaa

SEQ ID NO: 242820 - DNA, 75 bp, Artificial Sequence
  Synthetic
tgcaagtttttgcgcagcttcttcttgggaggcaatggcggagggcgctccgggctcgtctcctggaggtaggga

SEQ ID NO: 242821 - DNA, 75 bp, Artificial Sequence
  Synthetic
tgggaggcaatggcggagggcgctccgggctcgtctcctggaggtagggagtaacggtggggtgctctcgctgac

SEQ ID NO: 242822 - DNA, 75 bp, Artificial Sequence
  Synthetic
aaaaataaaataaaaagaaatccacttaccagagccatagcaacagcgtccgtccctttgtctgttttttccctc

SEQ ID NO: 242823 - DNA, 75 bp, Artificial Sequence
  Synthetic
ttcccggtagtcaaaatgagacgtgcggtgggagtgccgccggtgatggcgtacgccgagggtcctcctccttct

SEQ ID NO: 242824 - DNA, 75 bp, Artificial Sequence
  Synthetic
ggccagccatgctttactcctaggcgagaaaaagatggaggaggatcttatacagccgcagccagactccgaaac

SEQ ID NO: 242825 - DNA, 75 bp, Artificial Sequence
  Synthetic
tacgaaagcgtgatggaaacagcggatttgccggcaacgctgcaggcgctccacgtccctccccgttacctgggg

SEQ ID NO: 242826 - DNA, 75 bp, Artificial Sequence
  Synthetic
cttaaccagccccacctctgaggtcggcgccgttgaactagtggaacatgaggatgatgagcgagtggagcaaga

SEQ ID NO: 242827 - DNA, 75 bp, Artificial Sequence
  Synthetic
cctacggaagggcggaacagcatacgttactcggagctggcgcctctatacgacaccacccgggtttacctggtg

SEQ ID NO: 242828 - DNA, 75 bp, Artificial Sequence
  Synthetic
cccgggctatgtgacgccgcccaaggacggcaaggaatcggtgccggtgtcgccgctcaccgaagcagactacct

SEQ ID NO: 242829 - DNA, 75 bp, Artificial Sequence
  Synthetic
gacaacaagtcggcggacattgcctccctgaactaccagaacgaccatagtaactttcaaaccacggtggtacaa

SEQ ID NO: 242830 - DNA, 75 bp, Artificial Sequence
  Synthetic
gggaggggaggacgacgtgcttctaaaacatgtgttgcggcagagcaccattgtgcaggaggccttcaaggatta

SEQ ID NO: 242831 - DNA, 75 bp, Artificial Sequence
  Synthetic
aataatgactttaccccgacagaggccggtacccagaccatcaattttgacgatcgctccaggtggggcggcgac

SEQ ID NO: 242832 - DNA, 75 bp, Artificial Sequence
  Synthetic
ctctgggtttccgctgacggtggaggagttgagtcggacctacgaagctaatcttttttcaccgcgtgtgccccc

SEQ ID NO: 242833 - DNA, 75 bp, Artificial Sequence
  Synthetic
ctgaaaaccattttgcgcaccaatatgcccaacatcaatgagtttatgtctaccaacaagtttcgggcgcgggtg

SEQ ID NO: 242834 - DNA, 75 bp, Artificial Sequence
  Synthetic
aaaaaagcaagccaatggaacctgcgagcccaatccgcgcctcaacttttatccagtttttgcagtccccgaagc

SEQ ID NO: 242835 - DNA, 75 bp, Artificial Sequence
  Synthetic
atggtagaaaaagtgaaccggaaaaccaacgctcctcgttacgagtggttcgagttcactttgccagagggcaac

SEQ ID NO: 242836 - DNA, 75 bp, Artificial Sequence
  Synthetic
gttggctacctatcacattttttttaagaaccaacgcatccccctatcatgtcgtgccaaccgcacccaaggaga

SEQ ID NO: 242837 - DNA, 75 bp, Artificial Sequence
  Synthetic
tattcggaaactatgactatagaccttatgaataacgcgatcgtagacaactacttagcagtaggacgtcagaac

SEQ ID NO: 242838 - DNA, 75 bp, Artificial Sequence
  Synthetic
ccgcattttgcatctcaaagccggcgctcacatacctgagattgtttccttggaggaagttcccaagatatttga

SEQ ID NO: 242839 - DNA, 75 bp, Artificial Sequence
  Synthetic
ggcgtgctggaaagcgacattggggtgaagtttgacacgcgcaacttccggttgggttgggatcccgtaaccaag

SEQ ID NO: 242840 - DNA, 75 bp, Artificial Sequence
  Synthetic
aggtcttggcaaagatgaaaaacgggcagcaaacgctctgcaaaaaagtgaaaccgaaaatcagaacgttctggt

SEQ ID NO: 242841 - DNA, 75 bp, Artificial Sequence
  Synthetic
taggtactataacaatcaaaggtcttaaaggagcactgcgggaaatgcacgataacgctctatctctaaaacttc

SEQ ID NO: 242842 - DNA, 75 bp, Artificial Sequence
  Synthetic
ggaactggatggcgataacgcgcgtctcgccgtgctcaaacgcaccatcgaagtttcccactttgcctaccctgc

SEQ ID NO: 242843 - DNA, 75 bp, Artificial Sequence
  Synthetic
ttggtgatgcccggcgtgtacaccaacgaggcctttcacccagacattgttttgctacctggttgcggcgtggat

SEQ ID NO: 242844 - DNA, 75 bp, Artificial Sequence
  Synthetic
ttcacgcaaagtcgtctgaacaacttgctaggaatacgcaagcgaatgccctttcaaaaaggtttccaaatcatg

SEQ ID NO: 242845 - DNA, 75 bp, Artificial Sequence
  Synthetic
tcttaaccttccccccaaagttatgcgttcagtcatggatcatctccttatcaagcgggtcgaacctttagattc

SEQ ID NO: 242846 - DNA, 75 bp, Artificial Sequence
  Synthetic
tatgaggatttggagggcggcaacattcctgctctattagatgtggaaaagtacgaagctagcataaaagaagca

SEQ ID NO: 242847 - DNA, 75 bp, Artificial Sequence
  Synthetic
agatcagcccgaacaaaactccgaggatggccagcccgtggtttctgacgacgatcttgcacgctggcttgacag

SEQ ID NO: 242848 - DNA, 75 bp, Artificial Sequence
  Synthetic
aacaaaaccgctgacccaggcaacatgctcatccaaatctcgcctaacatcaccttcagtgtcgtctacaacgag

SEQ ID NO: 242849 - DNA, 75 bp, Artificial Sequence
  Synthetic
caggagatccgtggagccgacttcaagcccaatcctcaagacttggaaatcgtgcccgtggaaaaagacagcaag

SEQ ID NO: 242850 - DNA, 75 bp, Artificial Sequence
  Synthetic
ccatgaccccaccactttgcaagaacggcgcaaaatgatgatggcggtcattttggttaccgttgagctcgagtg

SEQ ID NO: 242851 - DNA, 75 bp, Artificial Sequence
  Synthetic
gaaagaagttacaatctcctagagggagataaaaataacactgcctaccgcagctggtttttggcctacaactac

SEQ ID NO: 242852 - DNA, 75 bp, Artificial Sequence
  Synthetic
cttgcaacgcttctttgccaatccccagacgctgcgcaagattgaggaatccctccattatgctttccgtcatgg

SEQ ID NO: 242853 - DNA, 75 bp, Artificial Sequence
  Synthetic
ggagatgcagagaaaggagtaaagtcttggaccttgttaacaaccacggatgtgacctgtgggtcgcagcaggtg

SEQ ID NO: 242854 - DNA, 75 bp, Artificial Sequence
  Synthetic
tttcctacatgggaattttacacgaaaaccgcctggggcaaaacgttcttcattgcactttgcaaggtgaggccc

SEQ ID NO: 242855 - DNA, 75 bp, Artificial Sequence
  Synthetic
tactggtcccttcccgacatgatgcaagatccagtaacgtttcgaccgtccacgcaagtcagcaactaccctgta

SEQ ID NO: 242856 - DNA, 75 bp, Artificial Sequence
  Synthetic
gccgcgactacgttcgcgactgcatttatcttttcctaatcctaacctggcaaaccgcaatgggtgtctggcaac

SEQ ID NO: 242857 - DNA, 75 bp, Artificial Sequence
  Synthetic
gtgggggtggaattactgccagtacatgccaagagtttttacaacgagcaggccgtgtattctcagcttattcgc

SEQ ID NO: 242858 - DNA, 75 bp, Artificial Sequence
  Synthetic
ggccgtgtattctcagcttattcgccagtccaccgcgcttacgcacatcttcaatcgttttcctgagaatcagat

SEQ ID NO: 242859 - DNA, 75 bp, Artificial Sequence
  Synthetic
aatgtctagaggagcgtaacctccgcgagcttgaaaaactgctggtccgaaatcgccgcgagctttggacagctt

SEQ ID NO: 242860 - DNA, 75 bp, Artificial Sequence
  Synthetic
ttagcgaacgcacggccgcttgccagctggccgatctgatttttcccgaacgactcatgcaaacactgcaaaacg

SEQ ID NO: 242861 - DNA, 75 bp, Artificial Sequence
  Synthetic
gggaaatctaaacttaacaacatcggcacccctctccgtgcaaaacaactctctctccttattcattacttctcc

SEQ ID NO: 242862 - DNA, 75 bp, Artificial Sequence
  Synthetic
gccgctgcgcagcagtatcagtggagttcagcgcgtgaccatcactgacgcccgccgtcggacctgcccctacgt

SEQ ID NO: 242863 - DNA, 75 bp, Artificial Sequence
  Synthetic
cattttgcaaaacttccgctcttttatcctcgagcgatccggtatcttaccggctatgagctgcgccctaccctc

SEQ ID NO: 242864 - DNA, 75 bp, Artificial Sequence
  Synthetic
gcacaaagctctgggcatagttgctcccaaagtgctgtctagccgcacgttttaacatgtccattcttatttcgc

SEQ ID NO: 242865 - DNA, 75 bp, Artificial Sequence
  Synthetic
cgatttcgttccactttgctaccgcgaatgcccgccgcctctctggagtcattgctacctcctccgcctggcaaa

SEQ ID NO: 242866 - DNA, 75 bp, Artificial Sequence
  Synthetic
ccgacaacaataccggctggggactttgctccgccggcatgtacggcggcgccaaacggcgttctagccaacacc

SEQ ID NO: 242867 - DNA, 75 bp, Artificial Sequence
  Synthetic
ctacctagcccaccactccgacctcatggaaaattccagcggcgaaggattgctagaatgccactgccgctgcaa

SEQ ID NO: 242868 - DNA, 75 bp, Artificial Sequence
  Synthetic
ctgttcgcgtgcgcggacattaccgcgccccctggggggcttacacccgcggtgttatctcaagacgtaccaccg

SEQ ID NO: 242869 - DNA, 75 bp, Artificial Sequence
  Synthetic
cctctgcacaccccaccgctctttggtctgcaataccgagctgctcagcgaaacccaagtgatcggtacctttga

SEQ ID NO: 242870 - DNA, 75 bp, Artificial Sequence
  Synthetic
ttgatgacgtcattgactccgtggtagccgatgcccaacgctacacgcggcccgttgccacgtccaccgtggatt

SEQ ID NO: 242871 - DNA, 75 bp, Artificial Sequence
  Synthetic
aatccaaggaccagagcggcaagagggtgcttccaatcttaagcttactccggcgctctggacttcagcctattt

SEQ ID NO: 242872 - DNA, 75 bp, Artificial Sequence
  Synthetic
ccgtgattgatagtgtggtggccaacgccaggcgttacgcgcaacgcaagagacgtttgcaacgtcgccgtcgtc

SEQ ID NO: 242873 - DNA, 75 bp, Artificial Sequence
  Synthetic
gcgcaaatttattccagaggactatcacgcccaccaaattaagttctacgaagaccaatcccgacctcccaaagc

SEQ ID NO: 242874 - DNA, 75 bp, Artificial Sequence
  Synthetic
ggcctactgccgccatgactgccgctcgggcggtactaaggcgggcacaaaggataggacgtcgggccatgcgcc

SEQ ID NO: 242875 - DNA, 75 bp, Artificial Sequence
  Synthetic
cacgcccaccaaattaagttctacgaagaccaatcccgacctcccaaagcccccctcacagcctgtgtcatcacc

SEQ ID NO: 242876 - DNA, 75 bp, Artificial Sequence
  Synthetic
cagagccaaattttggcccaattgcaagccatccagcaggcgcgacaggagtttctgctaaaaaaaggtcacggg

SEQ ID NO: 242877 - DNA, 75 bp, Artificial Sequence
  Synthetic
gagcggctgcttctgccagtgcaggtcgggcccgtcgtcaggccgcccgtcaggccgcggcggctattgccagca

SEQ ID NO: 242878 - DNA, 75 bp, Artificial Sequence
  Synthetic
gtttacttggatccccagaccggtgaggaactgaataccccgtcaccctccgccgccgcttcgtgccgcccgcag

SEQ ID NO: 242879 - DNA, 75 bp, Artificial Sequence
  Synthetic
tggctcagccccgccgggggaatatctactgggtgcgagatgcgtcgggcgtgcgggtgccggtgcgaagccgtc

SEQ ID NO: 242880 - DNA, 75 bp, Artificial Sequence
  Synthetic
aaacatgccgcccaaagggaacaagcaagccattgcggatcggcggtcccaaaagcaacagaaactgcaagagca

SEQ ID NO: 242881 - DNA, 75 bp, Artificial Sequence
  Synthetic
cccctcggagttagaagacgcgttcacaaaatggacgaagactgagtttccctgtcgttgccagccggtccccgt

SEQ ID NO: 242882 - DNA, 75 bp, Artificial Sequence
  Synthetic
cagcatgagcaagcgcaagttcaaagaagagctgctggaggcccttgtgcctgaaatctatggccctgccgcgga

SEQ ID NO: 242883 - DNA, 75 bp, Artificial Sequence
  Synthetic
gacgacagccaggcagaggaagtttcagacgaggaggaaatggagagctgggaaagtctagacgaggagctggag

SEQ ID NO: 242884 - DNA, 75 bp, Artificial Sequence
  Synthetic
ggaaagtctagacgaggagctggaggacaaaccccccaaggacgaggaggaagaaatcatcgccagcgccgcggc

SEQ ID NO: 242885 - DNA, 75 bp, Artificial Sequence
  Synthetic
cgtcaagcccgacattaagcctcgcgtgctcaagcgggttaaaaagcgagaaaaaaaagaggaaaaggaggaagc

SEQ ID NO: 242886 - DNA, 75 bp, Artificial Sequence
  Synthetic
accgtcttccaaagaacccgctcggagccagcctccgacggggaaagtcggaccgtccccgccgcggccaggctt

SEQ ID NO: 242887 - DNA, 75 bp, Artificial Sequence
  Synthetic
agggttgctagacgacggtgttgagtttgtgcggtcctttgccccccggcggcgggtgcagtggcggggacgtaa

SEQ ID NO: 242888 - DNA, 75 bp, Artificial Sequence
  Synthetic
agtccagcgcgtgcttagacccggcactactgtagtatttactcccggagagcggtccgtcacgcgggccttaaa

SEQ ID NO: 242889 - DNA, 75 bp, Artificial Sequence
  Synthetic
gcaaactcggcgggggtattgttcctggcggccctacaaaagcaatattgtcgcctgcctccagcactgccgggg

SEQ ID NO: 242890 - DNA, 75 bp, Artificial Sequence
  Synthetic
acgggattacgatgaggtttacgctgacgaagacattcttgagcaggccgcccaacaggttggggaattcgccta

SEQ ID NO: 242891 - DNA, 75 bp, Artificial Sequence
  Synthetic
caacatctcctttgcgcgacgatacttgctattccatgacggggtggcggtccctcgcaacgttctctactatta

SEQ ID NO: 242892 - DNA, 75 bp, Artificial Sequence
  Synthetic
cggcaagcgcggccgctacggagagttgggactcttgctggaccaaagcaaccccacgccaagcctgaagcccgc

SEQ ID NO: 242893 - DNA, 75 bp, Artificial Sequence
  Synthetic
ccgtcatctctacagcccctacgaaacgctcggagaaaacaactcggccgcgtaaggaaaagacttccgccattg

SEQ ID NO: 242894 - DNA, 75 bp, Artificial Sequence
  Synthetic
aacggcgcagcagatccttcccgtgacagaaatcaagcggggcgtcaagagggaaaacaaagacgaattgcagcc

SEQ ID NO: 242895 - DNA, 75 bp, Artificial Sequence
  Synthetic
ctactcgtcaggatacaccagtcgcgcaggaactaagaaaacgcatctttcccacgctgtatgctattttccagc

SEQ ID NO: 242896 - DNA, 75 bp, Artificial Sequence
  Synthetic
caccatgcaactcatggtgccaaagcggcaaaagcttgaggaggtgttggagaacatgaaagtggatcccagcgt

SEQ ID NO: 242897 - DNA, 75 bp, Artificial Sequence
  Synthetic
agagtcgcggccagcagctggaactgaaagtaaaaaaccgctccctgcgttcgctcacccgcagctgcttgtatc

SEQ ID NO: 242898 - DNA, 75 bp, Artificial Sequence
  Synthetic
tgagccggaagttaaagtgcgccccattaaagaaatagggcccggacttggcgtgcagacggtggatatccaaat

SEQ ID NO: 242899 - DNA, 75 bp, Artificial Sequence
  Synthetic
ccccgtgcgtgcgtcttcgtccaccgttagcactgcggtggaggccatggaaacgcagcctgagctgccagaggc

SEQ ID NO: 242900 - DNA, 75 bp, Artificial Sequence
  Synthetic
cacgctggaagacgccgaggcactgttcaataaatactgctcggtgtctcttaaggactgaaaagcccgcgcttt

SEQ ID NO: 242901 - DNA, 75 bp, Artificial Sequence
  Synthetic
cgtagcccgtgcggttgcggccacgcgagagatgggtttgcaaacggatccgtggtacgaattcgtggcccctac

SEQ ID NO: 242902 - DNA, 75 bp, Artificial Sequence
  Synthetic
tttaagaaccagattgcgtcatcaccatgagtaaggaaattcccacgccttacatgtggagctatcagccacaga

SEQ ID NO: 242903 - DNA, 75 bp, Artificial Sequence
  Synthetic
cagccgtccacgctcccggaaatacacaaccgctaattcgattttaccggagtatgccttgcatccatccatcac

SEQ ID NO: 242904 - DNA, 75 bp, Artificial Sequence
  Synthetic
tgggcttggcagctggagcatctcaggactactctagtcgcatgaactggctaagtgccggcccccatatgattg

SEQ ID NO: 242905 - DNA, 75 bp, Artificial Sequence
  Synthetic
gccaacgcccggttaccgcggaacaaccttcaaacccagccgcactcgctccacccgccgtcgtcgctctgtccg

SEQ ID NO: 242906 - DNA, 75 bp, Artificial Sequence
  Synthetic
ggcgcgtaaatggaattcgcgccactcgaaaccaaattttgctggagcaagctgccctgacctccaccccgcgaa

SEQ ID NO: 242907 - DNA, 75 bp, Artificial Sequence
  Synthetic
gctgccctgacctccaccccgcgaagtcaattgaacccgcccaattggcccgctgtccaggtgtatcaggaaaac

SEQ ID NO: 242908 - DNA, 75 bp, Artificial Sequence
  Synthetic
ccgccgctcaaggcgcacggcccccatctctgtgcgtcgcgtaacccgccgtggacgcacgctgacccttcccaa

SEQ ID NO: 242909 - DNA, 75 bp, Artificial Sequence
  Synthetic
cccgctccgaccacagttctcctgccacgcgacgctgaggccgaagtccaaatgactaactccggagcgcaatta

SEQ ID NO: 242910 - DNA, 75 bp, Artificial Sequence
  Synthetic
cgcgcgttaccaccctagcattctcgtttaatccgtgcgctgccgttttttcagatggctttgacttgccggttt

SEQ ID NO: 242911 - DNA, 75 bp, Artificial Sequence
  Synthetic
gcgggcggatccagacacgtcaggttcagaggtcggtcctcgccctactctccaggtcctataaagaggctgatt

SEQ ID NO: 242912 - DNA, 75 bp, Artificial Sequence
  Synthetic
cgcattcccgttccgtcctaccgaggaagatctcgccgtaggagaggcatggcgggcagtggccgccgacgcgct

SEQ ID NO: 242913 - DNA, 75 bp, Artificial Sequence
  Synthetic
tccaggtcctataaagaggctgattatccgaggccggggtatccagctcaacgacgaagtggtgagctccttaac

SEQ ID NO: 242914 - DNA, 75 bp, Artificial Sequence
  Synthetic
ttgcgcaggcgaataaaaggcggatttttgcccgcgttgattcccatcatcgccgccgccataggcgcaatccca

SEQ ID NO: 242915 - DNA, 75 bp, Artificial Sequence
  Synthetic
atccgaggccggggtatccagctcaacgacgaagtggtgagctccttaaccggtctccgacctgacggagttttc

SEQ ID NO: 242916 - DNA, 75 bp, Artificial Sequence
  Synthetic
cggtctccgacctgacggagttttccagcttggaggtgccggccgctcctccttcactcctcgccaggcgtacct

SEQ ID NO: 242917 - DNA, 75 bp, Artificial Sequence
  Synthetic
ggcgtggcctccgtggccttgcaagcagctcgcaaacaataaaagaaggcttaacactgacttcctggtcctgac

SEQ ID NO: 242918 - DNA, 75 bp, Artificial Sequence
  Synthetic
ccttcactcctcgccaggcgtacctgacactccagagctcttcttcccagcctcgctccggcggcattggaaccc

SEQ ID NO: 242919 - DNA, 75 bp, Artificial Sequence
  Synthetic
tattttatgcagacaagacatggaagacatcaattttgcgtcgctggctccgcggcacggctcgcggccgtttat

SEQ ID NO: 242920 - DNA, 75 bp, Artificial Sequence
  Synthetic
tccagtttgtggaggagtttgtaccctccgtttacttcaacccattctcgggcgctcctggtctttacccagacg

SEQ ID NO: 242921 - DNA, 75 bp, Artificial Sequence
  Synthetic
gacatcaattttgcgtcgctggctccgcggcacggctcgcggccgtttatgggcacctggaacgagatcggcacc

SEQ ID NO: 242922 - DNA, 75 bp, Artificial Sequence
  Synthetic
ggcgctcctggtctttacccagacgacttcatcccaaactacgacgcggtgagcgaatctgtggacggctacgac

SEQ ID NO: 242923 - DNA, 75 bp, Artificial Sequence
  Synthetic
agccagctcaacgggggcgctttcagttggagcagcctgtggagtggcattaaaaactttgggtcctccattaag

SEQ ID NO: 242924 - DNA, 75 bp, Artificial Sequence
  Synthetic
acttcatcccaaactacgacgcggtgagcgaatctgtggacggctacgactgaatcccaatggtgcgtccgtgac

SEQ ID NO: 242925 - DNA, 75 bp, Artificial Sequence
  Synthetic
catcatcaataatataccttaaagctggaaacgagccaatatgataatgagtgaggaggggttaggggaggtgcg

SEQ ID NO: 242926 - DNA, 75 bp, Artificial Sequence
  Synthetic
tcatttggtaacaaggcctggaacagtaacacaggtcaaatgctccgggataagctaaaggaccaaaactttcaa

SEQ ID NO: 242927 - DNA, 75 bp, Artificial Sequence
  Synthetic
cgccgtaatccttgctactttgtctgaaaagtctgtgatttttacttaccgctccagcgcttggattacatgaag

SEQ ID NO: 242928 - DNA, 75 bp, Artificial Sequence
  Synthetic
caaaaagtcgtggacgggctggcttccggcattaacggcgtggtggatatagccaaccaggccttgcaaaaccaa

SEQ ID NO: 242929 - DNA, 75 bp, Artificial Sequence
  Synthetic
gtgaggaggggttaggggaggtgcgatgtgacgtagaggtaggcggggtgggaaagggtggaggcgaatgacgtc

SEQ ID NO: 242930 - DNA, 75 bp, Artificial Sequence
  Synthetic
gtttaacaagtagcctaaggacttcacctacaaccgttggttccttacgtcagctacaagattccaccaaaggta

SEQ ID NO: 242931 - DNA, 75 bp, Artificial Sequence
  Synthetic
atcaatcagcggctggaaaatagccgccagcctccggtggctctgcagcagcgcccgcctcccaaagtcgaggag

SEQ ID NO: 242932 - DNA, 75 bp, Artificial Sequence
  Synthetic
cacaccaaactctttatttttctgagtctaccacttctattgcacttaactgttcttgtcgtaaccaactcgttc

SEQ ID NO: 242933 - DNA, 75 bp, Artificial Sequence
  Synthetic
gtagaagtggaggaaaaactaccgcctttggaggtggcaccccccctgcctagtaaaggcgaaaagcggccgcga

SEQ ID NO: 242934 - DNA, 75 bp, Artificial Sequence
  Synthetic
tgcggaagttgaacgaactctggactttttatgactagggagggaaaactgctgatcattgctgaactttgggac

SEQ ID NO: 242935 - DNA, 75 bp, Artificial Sequence
  Synthetic
agtggcgcgctaacagacaattttgcaaactattttgggacgctcttattgttcaaggaaacaacagcctttgta

SEQ ID NO: 242936 - DNA, 75 bp, Artificial Sequence
  Synthetic
ccggatctggaggaaaccctagttgtggaatcccgcgagcccccctcgtacgagcaggctttgaaagagggcgct

SEQ ID NO: 242937 - DNA, 75 bp, Artificial Sequence
  Synthetic
acaactgtactgctactactttaactcttacacctccttttgttcccggtccatacttgtgcattggcacaggaa

SEQ ID NO: 242938 - DNA, 75 bp, Artificial Sequence
  Synthetic
gttgctgccgagatgagaatgctgccagacttcttcaccggtaactgggatgacatgttccaggggctgctggag

SEQ ID NO: 242939 - DNA, 75 bp, Artificial Sequence
  Synthetic
tcaccttatcccatgaccaaacctattggttccatggcccgacctgtatacgggaaggaaagcaaacccgtgacc

SEQ ID NO: 242940 - DNA, 75 bp, Artificial Sequence
  Synthetic
gagggcctagctgctttaatcgctggactttacaaaaagagaacctaaccactaccaccctccttccccttacta

SEQ ID NO: 242941 - DNA, 75 bp, Artificial Sequence
  Synthetic
gactttacaaaaagagaacctaaccactaccaccctccttccccttactacttatactttttcccaaaaaaaaat

SEQ ID NO: 242942 - DNA, 75 bp, Artificial Sequence
  Synthetic
ttagaactacctccacccgtgcccaccgttccgcccatgccggctccgacgcttggcaccgccgtttctcgcccc

SEQ ID NO: 242943 - DNA, 75 bp, Artificial Sequence
  Synthetic
tgacatgttccaggggctgctggaggctgagcatccgtttgatttccctgaaccttctcaggcttttgaagaaat

SEQ ID NO: 242944 - DNA, 75 bp, Artificial Sequence
  Synthetic
ttactttttgcccattattgcacttttggcctttgtctgtgttattaccgctaattacattttaattttcaatct

SEQ ID NO: 242945 - DNA, 75 bp, Artificial Sequence
  Synthetic
accgcccccactgttgccgtggctacccccgcccgccgccctcgcggggctaactggcagagcactcttaacagc

SEQ ID NO: 242946 - DNA, 75 bp, Artificial Sequence
  Synthetic
tgataatttttactaatcatgctgctgtttttactttgccttcttttctgctctgcctatgccgccgtgccagaa

SEQ ID NO: 242947 - DNA, 75 bp, Artificial Sequence
  Synthetic
tgtttttactttgccttcttttctgctctgcctatgccgccgtgccagaaaaaactcttaacaacctcgttcggg

SEQ ID NO: 242948 - DNA, 75 bp, Artificial Sequence
  Synthetic
attgtgggtctgggagtaaaaagcctgaaacgccgccggtgctattaaaatggaaccaagctaaatgccattatt

SEQ ID NO: 242949 - DNA, 75 bp, Artificial Sequence
  Synthetic
tggaaccaagctaaatgccattattgtgtacgcctcctgtgttacgccagagagccgagtgacacgtcaccgcca

SEQ ID NO: 242950 - DNA, 75 bp, Artificial Sequence
  Synthetic
tgtatgccttagttggtaccaatctatcccttgattctatgaaaactcctcagattgacgaacttactagtctta

SEQ ID NO: 242951 - DNA, 75 bp, Artificial Sequence
  Synthetic
gctggattaaacaggaagacaatcctaacaaaaacttacaatcatttttttttattggtcaaaaactctgtgaag

SEQ ID NO: 242952 - DNA, 75 bp, Artificial Sequence
  Synthetic
cctcggagtacctgagcccgggcctggtgcagttcgcccgtgccaccgatacctacttcagcctggggaacaagt

SEQ ID NO: 242953 - DNA, 75 bp, Artificial Sequence
  Synthetic
ttaccaaagacaaaatcactgtttttaactattatccgttggaattttcctgcgctaacgtaaccttgtatttgt

SEQ ID NO: 242954 - DNA, 75 bp, Artificial Sequence
  Synthetic
tcagaaaccccaccgtggctcccacccacgatgtaaccacagacaggtcgcagcgactgacgctgcgcttcgtgc

SEQ ID NO: 242955 - DNA, 75 bp, Artificial Sequence
  Synthetic
ataatcttaaaactgacgattctggcctctataatggaaaggcccataccaaagagcttgaacataacacctatg

SEQ ID NO: 242956 - DNA, 75 bp, Artificial Sequence
  Synthetic
cagcgactgacgctgcgcttcgtgcccgtcgaccgcgaggaaaccgcctactcttacaaagtgcgctttacgctg

SEQ ID NO: 242957 - DNA, 75 bp, Artificial Sequence
  Synthetic
ttaggctttatgttattgacattcctccgcctaagtgtgacattacttcacgttacttaggcatacaggctactg

SEQ ID NO: 242958 - DNA, 75 bp, Artificial Sequence
  Synthetic
gccgtgggcgacaaccgggttttggacatggccagcacctactttgacatccgcggcgtgctggatcgtggtccc

SEQ ID NO: 242959 - DNA, 75 bp, Artificial Sequence
  Synthetic
gggaagattattgtttaattgaaatcaattgcactaactccaaatacccagctgtggttaaatttaatggcaggc

SEQ ID NO: 242960 - DNA, 75 bp, Artificial Sequence
  Synthetic
agctttaaaccctattcgggcactgcatacaactccctggcccccaaaggtgctcccaatcctagccagtggaca

SEQ ID NO: 242961 - DNA, 75 bp, Artificial Sequence
  Synthetic
aaagcaacttctaccattatgttagcgaaaacggaaacaaagaacttccaaatttttatgaaacacacatcactg

SEQ ID NO: 242962 - DNA, 75 bp, Artificial Sequence
  Synthetic
aaccaaaacaaaacaaactcctttggacaagctccctatataggacaaaaaatcaccaatcagggcgtgcaagtg

SEQ ID NO: 242963 - DNA, 75 bp, Artificial Sequence
  Synthetic
ttaatggtacccacaaaagctttcactttaattacccttttaacgacctttgtcaaacaaccagcgctctacaat

SEQ ID NO: 242964 - DNA, 75 bp, Artificial Sequence
  Synthetic
ctttaattacccttttaacgacctttgtcaaacaaccagcgctctacaatataatgacaatgtccaggtagtcct

SEQ ID NO: 242965 - DNA, 75 bp, Artificial Sequence
  Synthetic
ggctcagactccaacaatcgcgatgtgtttgccgataaaacgtaccaaccggagcctcaagtggggcagacgcaa

SEQ ID NO: 242966 - DNA, 75 bp, Artificial Sequence
  Synthetic
tggaacattaatccaatgcaaaacgctgcgggaagaatactaaaacaaaccacgcccatgcagccatgttatggg

SEQ ID NO: 242967 - DNA, 75 bp, Artificial Sequence
  Synthetic
cattcttctcatagtagttggcttaataataatttccgctagtttaatattgctttattgccaccgcaaaaaaat

SEQ ID NO: 242968 - DNA, 75 bp, Artificial Sequence
  Synthetic
tcatacgctagaccaacaaacgaaaaaggaggtcaagccaagctggtaaaaaatgacgacaatcagaccacaaca

SEQ ID NO: 242969 - DNA, 75 bp, Artificial Sequence
  Synthetic
atttttttcttttcagtatggtaactcctcttctcctgcttgtctgtctgccaattatctacgcctccaccacct

SEQ ID NO: 242970 - DNA, 75 bp, Artificial Sequence
  Synthetic
aggaggaggaggaggaggaggaggagaacctgagggccggtctggatcctcaaacggaattgtaactgaacctga

SEQ ID NO: 242971 - DNA, 75 bp, Artificial Sequence
  Synthetic
acaaacgtaggtttaaacttttttaccactgccactgaaaccgctaatttttcaccaaaggtggttctgtacagc

SEQ ID NO: 242972 - DNA, 75 bp, Artificial Sequence
  Synthetic
tcgccgcagtctcccaccttgatacggattgtcttcccgccttgctgacttatctcatcttcacctctgtttgct

SEQ ID NO: 242973 - DNA, 75 bp, Artificial Sequence
  Synthetic
gaagatgttaacttagaagcgcccgatacccaccttgtgtttaagccagatgtcaacggcacaagtgccgagctt

SEQ ID NO: 242974 - DNA, 75 bp, Artificial Sequence
  Synthetic
gcactgccatctgcagcattgccactttttttgtggccattttccaaactgcggactacctatacgttagagtgg

SEQ ID NO: 242975 - DNA, 75 bp, Artificial Sequence
  Synthetic
ttactgggacagcaggccgctcccaatcgacctaattacattggttttagggacaacttcattggtttgatgtac

SEQ ID NO: 242976 - DNA, 75 bp, Artificial Sequence
  Synthetic
gcggactacctatacgttagagtggcatactatcgtcatcatccccaatataggaaccacgaggtggccgccctt

SEQ ID NO: 242977 - DNA, 75 bp, Artificial Sequence
  Synthetic
tacaattccactggcaacatgggagtgctggccgggcaagcttctcagctcaacgcagtggtggacttacaagat

SEQ ID NO: 242978 - DNA, 75 bp, Artificial Sequence
  Synthetic
ctgtgcctgtcatgaaagttcctcttctctgtcttatcctccttcacaaagtcctggccaactgccacctccacc

SEQ ID NO: 242979 - DNA, 75 bp, Artificial Sequence
  Synthetic
agaaacacggagctgtcttaccagttaatgcttgacgctttaggggatcggagtcgatacttctccatgtggaac

SEQ ID NO: 242980 - DNA, 75 bp, Artificial Sequence
  Synthetic
ggcccaccgagttcctgcgctgctactcaacagaaacctcttccttttggctgtactccattatttttattttga

SEQ ID NO: 242981 - DNA, 75 bp, Artificial Sequence
  Synthetic
caggcagtggacagctatgacccagacgtgagaattattgaaaatcatggcgtggaagacgagctccccaactat

SEQ ID NO: 242982 - DNA, 75 bp, Artificial Sequence
  Synthetic
ttttctttgccacctttttgggattacaaatttacggctgccttcacctgggctggatgcatcctcccaacaacc

SEQ ID NO: 242983 - DNA, 75 bp, Artificial Sequence
  Synthetic
tgctttcctcttaatgggcaaggaatatctaacagttaccaaggcgtaaagactgacaatggaactaactggtct

SEQ ID NO: 242984 - DNA, 75 bp, Artificial Sequence
  Synthetic
ggctggatgcatcctcccaacaacctacccagatttcctggtttcttattacagcccccgccgcccccaccagct

SEQ ID NO: 242985 - DNA, 75 bp, Artificial Sequence
  Synthetic
cagaataatacagacgtctcaagcaacaacgaaatttccattggcaatgtgtttgccatggagattaatctggcg

SEQ ID NO: 242986 - DNA, 75 bp, Artificial Sequence
  Synthetic
cctgtacagcgcgctccatcagttattagctactttcatcttaactctgaagatgtctgaccaactagaaatcga

SEQ ID NO: 242987 - DNA, 75 bp, Artificial Sequence
  Synthetic
gctaacttgtggagaagcttcttgtactcaaatgtagccctgtacttgcctgactcttacaaaataacccccgat

SEQ ID NO: 242988 - DNA, 75 bp, Artificial Sequence
  Synthetic
cgggcagcgcactgagcagctgatccttgctcggcgaaaactcaaacaacaaaaccaggaattgttcaaccttca

SEQ ID NO: 242989 - DNA, 75 bp, Artificial Sequence
  Synthetic
aacattactttacccgacaacaaaaatacatatgcctacatgaacggtcgggttgccgtccccagcgccctggat

SEQ ID NO: 242990 - DNA, 75 bp, Artificial Sequence
  Synthetic
agccttacaccaatgcaaaaagggtcttttctgcctggttaaacaagctgaactttgctatgatgtaacccaaca

SEQ ID NO: 242991 - DNA, 75 bp, Artificial Sequence
  Synthetic
cttttctgcctggttaaacaagctgaactttgctatgatgtaacccaacaggggcatgagctatcatacacttta

SEQ ID NO: 242992 - DNA, 75 bp, Artificial Sequence
  Synthetic
acatacgtgaacattggggcgcggtggtctccagaccccatggacaacgttaatccctttaaccaccaccgcaat

SEQ ID NO: 242993 - DNA, 75 bp, Artificial Sequence
  Synthetic
aacaagcaaagacagagctttatgactatggtgggggttaagcccattaaggttactcagcaatccggcccagtt

SEQ ID NO: 242994 - DNA, 75 bp, Artificial Sequence
  Synthetic
gctggtctgcgctaccgttctatgctcctgggtaacggccgctacgtgccttttcacatccaagtgccccagaaa

SEQ ID NO: 242995 - DNA, 75 bp, Artificial Sequence
  Synthetic
ctatggtgggggttaagcccattaaggttactcagcaatccggcccagttgagggaagcattctttgtcagtgca

SEQ ID NO: 242996 - DNA, 75 bp, Artificial Sequence
  Synthetic
gagggaagcattctttgtcagtgcaccaattctgaatgcatgtacactatggtaaaaaccctgtgtggtctcagg

SEQ ID NO: 242997 - DNA, 75 bp, Artificial Sequence
  Synthetic
ccaattctgaatgcatgtacactatggtaaaaaccctgtgtggtctcagggaacttctcccctttaattaaagtt

SEQ ID NO: 242998 - DNA, 75 bp, Artificial Sequence
  Synthetic
tttttcgccattaaaaatctcctgctcctgcccgggtcctacacctatgagtggaacttccggaaggatgttaac

SEQ ID NO: 242999 - DNA, 75 bp, Artificial Sequence
  Synthetic
atctgattaataaagcttaccttaaatttgatatcagttgtttgtcaagtttttccagcagcaccacctgccctt

SEQ ID NO: 243000 - DNA, 75 bp, Artificial Sequence
  Synthetic
atgattctccaaagcagtctcggtaacgacctcagggtcgatggagccagcgtcaggtttgacagcattaacctg

SEQ ID NO: 243001 - DNA, 75 bp, Artificial Sequence
  Synthetic
ttttccagcagcaccacctgcccttcctcccaactttcgtaggggatgtgccaacgggcagcaaactttctccac

SEQ ID NO: 243002 - DNA, 75 bp, Artificial Sequence
  Synthetic
tatgccaactttttccccatggctcacaacaccgcttccaccttggaagcaatgcttcgtaatgataccaacgat

SEQ ID NO: 243003 - DNA, 75 bp, Artificial Sequence
  Synthetic
gtcctaaagggtatatcggtgttcacctttttaccctgacccacgatcttcatcttgcagatgaaaagaaccaga

SEQ ID NO: 243004 - DNA, 75 bp, Artificial Sequence
  Synthetic
cagtctttcaacgactacctctgcgctgcaaacatgctttaccccatacccgccaacgctactagcgtgcccatt

SEQ ID NO: 243005 - DNA, 75 bp, Artificial Sequence
  Synthetic
cctttttaccctgacccacgatcttcatcttgcagatgaaaagaaccagaattgaagacgacttcaaccccgtct

SEQ ID NO: 243006 - DNA, 75 bp, Artificial Sequence
  Synthetic
attgaagacgacttcaaccccgtctacccctatgacaccttctcaactcccagcatcccctatgtagctccgccc

SEQ ID NO: 243007 - DNA, 75 bp, Artificial Sequence
  Synthetic
tctattccttcgcgaaattgggctgcttttcgggggtggagttttactagactaaaaactaaagaaaccccctct

SEQ ID NO: 243008 - DNA, 75 bp, Artificial Sequence
  Synthetic
ttcgtttcttctgacgggttacaggaaaaacccccaggagttttagcactcaagtacactgaccccattactacc

SEQ ID NO: 243009 - DNA, 75 bp, Artificial Sequence
  Synthetic
ttggggtccgggtttgatccatatttcacctactctggctccgtcccatacttggatggcaccttttacctgaac

SEQ ID NO: 243010 - DNA, 75 bp, Artificial Sequence
  Synthetic
aatgctaagcatgagcttactttaaaacttggaagcaacataactttagaaaatgggttactttcggccacagtt

SEQ ID NO: 243011 - DNA, 75 bp, Artificial Sequence
  Synthetic
cacacttttaaaaaggtgtccgttatgttcgactcctctgtgagctggcctggtaacgaccgactacttactccc

SEQ ID NO: 243012 - DNA, 75 bp, Artificial Sequence
  Synthetic
cccactgtttctcctccccttacaaacagtaacaactccctgggtttagccacatccgctcccatagctgtatca

SEQ ID NO: 243013 - DNA, 75 bp, Artificial Sequence
  Synthetic
aacgagtttgaaatcaaacgaaccgtggatggggaaggatacaacgtggctcaatgtaacatgaccaaggactgg

SEQ ID NO: 243014 - DNA, 75 bp, Artificial Sequence
  Synthetic
gctaactctctcacattggccaccgccgcaccactgacagtaagcaacaaccagcttagtattaacgcgggcaga

SEQ ID NO: 243015 - DNA, 75 bp, Artificial Sequence
  Synthetic
ttcctcatacaaatgctcagtcactacaatattggctaccagggtttccacgtaccagaaagctacaaggacagg

SEQ ID NO: 243016 - DNA, 75 bp, Artificial Sequence
  Synthetic
ccagcttagtattaacgcgggcagaggtttagttataactaacaatgccttaacagttaatcctaccggagcgct

SEQ ID NO: 243017 - DNA, 75 bp, Artificial Sequence
  Synthetic
atgtactcctttttccgaaacttccaacccatgagccgccaggtggtagacactaccacctacacggagtatcag

SEQ ID NO: 243018 - DNA, 75 bp, Artificial Sequence
  Synthetic
aggtttcaataacacaggagctttacaattaaatgctgcaggaggaatgagagtggacggtgccaacttaattct

SEQ ID NO: 243019 - DNA, 75 bp, Artificial Sequence
  Synthetic
gagtggacggtgccaacttaattcttcatgtagcatatccctttgaagcaatcaaccagctaacactgcgattag

SEQ ID NO: 243020 - DNA, 75 bp, Artificial Sequence
  Synthetic
aatgtaactctccctttccagcataataactctggctttgtaggatacatgggacctgccatacgggagggacaa

SEQ ID NO: 243021 - DNA, 75 bp, Artificial Sequence
  Synthetic
aaaacgggttagaagtaaccagcggaggaaagcttaacgttaagttgggatcaggcctccaatttgacagtaacg

SEQ ID NO: 243022 - DNA, 75 bp, Artificial Sequence
  Synthetic
gcttaccccgccaactatccatacccccttattggtcagacggccgtaccaagcctgactcagaaaaaatttctt

SEQ ID NO: 243023 - DNA, 75 bp, Artificial Sequence
  Synthetic
gacgcattgctattagtaatagcaaccgaactcgaagtgtaccatccctcactaccatttggtctatctcgccta

SEQ ID NO: 243024 - DNA, 75 bp, Artificial Sequence
  Synthetic
tgcgatcgtaccatgtggcgcattcccttttccagcaactttatgtctatgggggccctgaccgacctggggcaa

SEQ ID NO: 243025 - DNA, 75 bp, Artificial Sequence
  Synthetic
cgcctaactgctccatttatgaaacccaagatgcaaacctatttctttgtctaactaaaaacggagctcacgtat

SEQ ID NO: 243026 - DNA, 75 bp, Artificial Sequence
  Synthetic
aacatgctgtacgccaactccgcccacgcgctcgacatgacttttgaggtggaccccatggatgagcccacactt

SEQ ID NO: 243027 - DNA, 75 bp, Artificial Sequence
  Synthetic
ctctatgttctgttcgaagttttcgacgttgtgcgcatccaccagccgcaccgcggcgtcatcgaggccgtctac

SEQ ID NO: 243028 - DNA, 75 bp, Artificial Sequence
  Synthetic
cctttgacaatcagggaaatttacttaactgtgccttggaatcatccacctggcgttaccaggaaaccaacgcag

SEQ ID NO: 243029 - DNA, 75 bp, Artificial Sequence
  Synthetic
ctgcgtacgccgttctcggccggtaacgccaccacataagaagccagccaatgggctccagcgagcaggagttgg

SEQ ID NO: 243030 - DNA, 75 bp, Artificial Sequence
  Synthetic
tggcgttaccaggaaaccaacgcagtggcctctaatgccttaacatttatgcccaacagtacagtgtatccacga

SEQ ID NO: 243031 - DNA, 75 bp, Artificial Sequence
  Synthetic
tcgccatcgtgcgcgaactgggctgcggaccttactttctgggcacgtttgacaaacgctttccgggttttatgg

SEQ ID NO: 243032 - DNA, 75 bp, Artificial Sequence
  Synthetic
tggcctctaatgccttaacatttatgcccaacagtacagtgtatccacgaaacaaaaccgctcacccgggcaaca

SEQ ID NO: 243033 - DNA, 75 bp, Artificial Sequence
  Synthetic
tgctcatccaaatctcgcctaacatcaccttcagtgtcgtctacaacgagataaacagtgggtatgcttttactt

SEQ ID NO: 243034 - DNA, 75 bp, Artificial Sequence
  Synthetic
caccgcataagctggcgtgtgccattgttaacacggcgggccgcgaaaccggcggcgtacactggctggccctgg

SEQ ID NO: 243035 - DNA, 75 bp, Artificial Sequence
  Synthetic
ttaaatggtcagccgaaccgggaaaaccttttcacccacctaccgctgtattttgctacataactgaacaataaa

SEQ ID NO: 243036 - DNA, 75 bp, Artificial Sequence
  Synthetic
cctggaacccaaagaaccgtacctgctacctcttcgacccatttggcttttcggacgagcgcctcaaacagattt

SEQ ID NO: 243037 - DNA, 75 bp, Artificial Sequence
  Synthetic
ttttgctacataactgaacaataaaatcattgcaggcacaatcttcgcatttctttttttccagatgaaacgagc

SEQ ID NO: 243038 - DNA, 75 bp, Artificial Sequence
  Synthetic
accagtttgagtatgaaggtctcctaaagcgtagtgcgttggcctcaaccccggaccattgtatcaccctaatta

SEQ ID NO: 243039 - DNA, 75 bp, Artificial Sequence
  Synthetic
gtctacccttacgaacactacaatccccttgacatcccatttattacacccccgtttgcctcctccaacggcttg

SEQ ID NO: 243040 - DNA, 75 bp, Artificial Sequence
  Synthetic
agtccacccaaactgttcaaggaccgttttcggcggcctgcggccttttctgctgcatgtttttacatgcttttg

SEQ ID NO: 243041 - DNA, 75 bp, Artificial Sequence
  Synthetic
caagaaaaaccaccgggagtcctcagcctgaaatacactgatccacttacaaccaaaaacggggctttaacctta

SEQ ID NO: 243042 - DNA, 75 bp, Artificial Sequence
  Synthetic
gcctgaaatacactgatccacttacaaccaaaaacggggctttaaccttaaaactgggcacgggactaaacattg

SEQ ID NO: 243043 - DNA, 75 bp, Artificial Sequence
  Synthetic
taaactggcccaccagtcccatggagcgcaaccccaccatggaccttcttaccggcgttccaaacagcatgcttc

SEQ ID NO: 243044 - DNA, 75 bp, Artificial Sequence
  Synthetic
aaagcccccaggttgtacccaccctgcgtcacaaccaggagcggttgtaccgtttcctggcgcaacgttctccct

SEQ ID NO: 243045 - DNA, 75 bp, Artificial Sequence
  Synthetic
aaccaaaaacggggctttaaccttaaaactgggcacgggactaaacattgatgaaaatggagatctttcttcaga

SEQ ID NO: 243046 - DNA, 75 bp, Artificial Sequence
  Synthetic
actttcagcgtcattgcgagcgtatcaaaaaagccaccgcgtttgaccaaatgaaaaacaacatgtaacggttca

SEQ ID NO: 243047 - DNA, 75 bp, Artificial Sequence
  Synthetic
gtttaaattacactaaacctctcgccctgcgaagtaacgcgctcactctttcttacaacgcacccttaaacgtag

SEQ ID NO: 243048 - DNA, 75 bp, Artificial Sequence
  Synthetic
ataaaagcttttattgattcaaaaaattcatgcatgcagactttttattttaaaatggttctttctccccatcgc

SEQ ID NO: 243049 - DNA, 75 bp, Artificial Sequence
  Synthetic
taaataacaatttagctttaaatatctcacaacctgtcactgttaatgcaaacaacgaactttctctcttaatag

SEQ ID NO: 243050 - DNA, 75 bp, Artificial Sequence
  Synthetic
cgtggctggcgggcaaagctacgttgcgatactgcaaacgagaggaccacttaaattctggaatcagcatcttag

SEQ ID NO: 243051 - DNA, 75 bp, Artificial Sequence
  Synthetic
acgccccacttaatgctgacacgggcactcttcgccttcaaagtgctgcacctcttggactagtggacaaaacac

SEQ ID NO: 243052 - DNA, 75 bp, Artificial Sequence
  Synthetic
gaagggggccatcgacgttctctccccacagccgtcgtacaagttgcaaagctcccaaaaggtcaggtgcagaaa

SEQ ID NO: 243053 - DNA, 75 bp, Artificial Sequence
  Synthetic
taaaagttttgttttctagccccctctatctagataataactttcttacactagccattgaacgcccgctagctc

SEQ ID NO: 243054 - DNA, 75 bp, Artificial Sequence
  Synthetic
ttttgaaatcacagttgggaccttggccaccacgggagttgcggtatacggggttagcgcactggtaaaccagca

SEQ ID NO: 243055 - DNA, 75 bp, Artificial Sequence
  Synthetic
taagtattcaccacctttaaaaatagaaaacgaaaacttaaccctaagcacaggcgggccttttactgtaagcgg

SEQ ID NO: 243056 - DNA, 75 bp, Artificial Sequence
  Synthetic
cacagggatactggatactggcaagagccaccttgtcggttacttcttcagctctaagactgtcaacattgctta

SEQ ID NO: 243057 - DNA, 75 bp, Artificial Sequence
  Synthetic
gggaaatctaaacttaacaacatcggcacctctctccgtgcaaaacaactctctctccttagtcattacttctcc

SEQ ID NO: 243058 - DNA, 75 bp, Artificial Sequence
  Synthetic
gagcgaaaggggtggctttacacatttgccgacccaattggggcacaccggtgggcttgtacaggcagtcgcagc

SEQ ID NO: 243059 - DNA, 75 bp, Artificial Sequence
  Synthetic
tttaaaagttattaattctatgttagccgttggggttaacccgccttttaccatcactgactctggattagctat

SEQ ID NO: 243060 - DNA, 75 bp, Artificial Sequence
  Synthetic
gcatcaccattaataggcgttttagcccgttttgcatttttggatattcggcttgcataaaagcttctatctgca

SEQ ID NO: 243061 - DNA, 75 bp, Artificial Sequence
  Synthetic
ggacttaggagacggtcttgcactaggtggctctaagttaataatcaatcttggtccaggtttacaaatgtctaa

SEQ ID NO: 243062 - DNA, 75 bp, Artificial Sequence
  Synthetic
aaaaagccgtctgagcctttgttccttccgagaaaaacagaccgcaggacttggcagaaaacacattggtggcac

SEQ ID NO: 243063 - DNA, 75 bp, Artificial Sequence
  Synthetic
ggtggctctaagttaataatcaatcttggtccaggtttacaaatgtctaatggagctattactttagcactagat

SEQ ID NO: 243064 - DNA, 75 bp, Artificial Sequence
  Synthetic
tggagctattactttagcactagatgcagcgctgcctttgcaatatagagacaaccaacttcaactcagaattgg

SEQ ID NO: 243065 - DNA, 75 bp, Artificial Sequence
  Synthetic
agctcacgtcttctacacaacaacgggcatcgtcattcttcagttgaaccacgctgcgcccccaccggttttgta

SEQ ID NO: 243066 - DNA, 75 bp, Artificial Sequence
  Synthetic
ctcaacatctggcttaattatgagcggagtaacacaaacattaaacgtcaatgccaataccggcaaaggtcttgc

SEQ ID NO: 243067 - DNA, 75 bp, Artificial Sequence
  Synthetic
ccaccttggctcgactcgggtgctcctttaacgcccgctgagcgttctcgctcgctacatccatttccaccaact

SEQ ID NO: 243068 - DNA, 75 bp, Artificial Sequence
  Synthetic
tgttgaaaacaactcactagttgttaagcttgggaacggtcttcgctttgatagctggggaagcataactgtctc

SEQ ID NO: 243069 - DNA, 75 bp, Artificial Sequence
  Synthetic
gctctttttgaatcatttccaggccatgataacagcgtagcactccctcttgctcggtgcagccgtgaagccaaa

SEQ ID NO: 243070 - DNA, 75 bp, Artificial Sequence
  Synthetic
atagctggggaagcataactgtctcgcctactaccactacccctaccaccctatggaccaccgcagacccatcac

SEQ ID NO: 243071 - DNA, 75 bp, Artificial Sequence
  Synthetic
aagcttgggaacggtcttcgctttgatagctggggaagcataactgtctcgcctactaccactacccctaccacc

SEQ ID NO: 243072 - DNA, 75 bp, Artificial Sequence
  Synthetic
tcgcgcaaccagtgggctcccattcattgttttttaccccggcgtacgactccacgtaggctctcaaaaaacgtc

SEQ ID NO: 243073 - DNA, 75 bp, Artificial Sequence
  Synthetic
ctaacgccactttttatgaatcactagacgccaaagtgtggctagttttagtaaaatgcaacggcatggttaacg

SEQ ID NO: 243074 - DNA, 75 bp, Artificial Sequence
  Synthetic
agacgccaaagtgtggctagttttagtaaaatgcaacggcatggttaacgggaccatatccattaaagctcagaa

SEQ ID NO: 243075 - DNA, 75 bp, Artificial Sequence
  Synthetic
ccatcatttccacaaatgtcttgtggctggtgaaggtgagagggaggccgcgatgctcctcgttaagccacgttt

SEQ ID NO: 243076 - DNA, 75 bp, Artificial Sequence
  Synthetic
ggaccatatccattaaagctcagaaaggcattttacttagacctacagctagttttatttcctttgtcatgtatt

SEQ ID NO: 243077 - DNA, 75 bp, Artificial Sequence
  Synthetic
aggcattttacttagacctacagctagttttatttcctttgtcatgtatttctacagcgatggaacatggagaaa

SEQ ID NO: 243078 - DNA, 75 bp, Artificial Sequence
  Synthetic
ggcaaattttgcgataaacgttgctttgttcgggtaggaacttgaagccattcttctcttcggcctccacatgat

SEQ ID NO: 243079 - DNA, 75 bp, Artificial Sequence
  Synthetic
aaactatcccgtgtttgacaacgaagggatactagcaaacagtgccacgtggggttatcgacaaggacagtctgc

SEQ ID NO: 243080 - DNA, 75 bp, Artificial Sequence
  Synthetic
acttttccattagctttatcattaaatccatgcctttctcccaggcggaaaccaagggctctgcctgcggattaa

SEQ ID NO: 243081 - DNA, 75 bp, Artificial Sequence
  Synthetic
caacactaacgtttctaatgctgtagaatttatgcctagctctaaaagatatcccaatcaaaaaggttctgaagt

SEQ ID NO: 243082 - DNA, 75 bp, Artificial Sequence
  Synthetic
gaaccactgatgtaacagctttggaagtgctaggctcttcttcctcgttgttttcctctgacgggggaggcacac

SEQ ID NO: 243083 - DNA, 75 bp, Artificial Sequence
  Synthetic
tcagaacatggctcttacctacacttttttgcaaggtgatcctaacatggccatatcctttcagagtatttataa

SEQ ID NO: 243084 - DNA, 75 bp, Artificial Sequence
  Synthetic
ctttgggctccaagcgtcttacatatcgcttgccactggccttttgaacgacctgcacgccggggtgactgaacc

SEQ ID NO: 243085 - DNA, 75 bp, Artificial Sequence
  Synthetic
ccatatcctttcagagtatttataatcatgcattagaaggctactcattaaaatttacctggcgcgttcgaaata

SEQ ID NO: 243086 - DNA, 75 bp, Artificial Sequence
  Synthetic
cggtgtacaccacctcttcttcttcctcctcgctgtctggaaccacttcgggagacggaggcaaaactggaacgc

SEQ ID NO: 243087 - DNA, 75 bp, Artificial Sequence
  Synthetic
atgaacgttttgacatcccctgctgctcattttcttatgtaacagaacaataaaatattgttgtttttgttttta

SEQ ID NO: 243088 - DNA, 75 bp, Artificial Sequence
  Synthetic
gatccggcacttgaacattcttgcgcaacttctttttgggaggaagtgacggggcccgttctggactcgtctcct

SEQ ID NO: 243089 - DNA, 75 bp, Artificial Sequence
  Synthetic
taactttattgatacttttacagaattctaaccgttaatccccctccccccttccactttatcttatacacctcc

SEQ ID NO: 243090 - DNA, 75 bp, Artificial Sequence
  Synthetic
gcaagtagggagtgatggtggggagttcttgctgacggccggccatgctttactcctaggcgagaaaatatggag

SEQ ID NO: 243091 - DNA, 75 bp, Artificial Sequence
  Synthetic
ctctccccctgtaccgccgcaaacaactgcaatttagaatttacacaacaattcttttgtgacaaaattaacaca

SEQ ID NO: 243092 - DNA, 75 bp, Artificial Sequence
  Synthetic
gaggatcttaagctgcagccagactccgaaaccttaaccacccccaactctgaggtcggcgccgtcgagctagtg

SEQ ID NO: 243093 - DNA, 75 bp, Artificial Sequence
  Synthetic
ggttctttgctggcaaagcgctgatccgtaatggaaatgaaaccttcggaaacatcgtccaacagcacggtggag

SEQ ID NO: 243094 - DNA, 75 bp, Artificial Sequence
  Synthetic
aacatcgtccaacagcacggtggagtccaaagcagagctctgtaaaaacacaatacagtcaagctctccacgggt

SEQ ID NO: 243095 - DNA, 75 bp, Artificial Sequence
  Synthetic
aaacatgaggaggaaaatgagcaagtggagcaagatccgggctatgtaacgccccccgaggacggcaaggaacca

SEQ ID NO: 243096 - DNA, 75 bp, Artificial Sequence
  Synthetic
gtggccgcactcagcgaacccaactatttgggaggggaggacgacgtgctcctgaagcacatagcgcgacagagc

SEQ ID NO: 243097 - DNA, 75 bp, Artificial Sequence
  Synthetic
tctcgcctttgttgtagtctgccaacgtaaacgggcagtaccgctccatcaagccccgcaataattcctgtctcc

SEQ ID NO: 243098 - DNA, 75 bp, Artificial Sequence
  Synthetic
ggggttccaccaagctcctcagaagtgacctaacggtgaagtttcccaacactttcaccgccttggctagcagcc

SEQ ID NO: 243099 - DNA, 75 bp, Artificial Sequence
  Synthetic
accattgtacgagaagccctcaaggaatgcacacagactccgctgacggtggaggaattaagccgcgcgtatgaa

SEQ ID NO: 243100 - DNA, 75 bp, Artificial Sequence
  Synthetic
actttcaccgccttggctagcagccgccgtgtccgacgggcgcagcaacgcacagaaagctcatccaagttttta

SEQ ID NO: 243101 - DNA, 75 bp, Artificial Sequence
  Synthetic
gctaacctgttttcgccgcgtgtaccgccaaaaaagcagcctaacggcacctgcgaaacaaacccgcgcctcaat

SEQ ID NO: 243102 - DNA, 75 bp, Artificial Sequence
  Synthetic
ttttatcccgtctttgcggtgcctgaagcactggctacttatcacatctttttcaagaaccaacgcattcccctc

SEQ ID NO: 243103 - DNA, 75 bp, Artificial Sequence
  Synthetic
aaaactccacccaaatgacatgcgctccaacactatagccgcgtgcccatcatacagcaggcgaatatatataaa

SEQ ID NO: 243104 - DNA, 75 bp, Artificial Sequence
  Synthetic
tccaacactatagccgcgtgcccatcatacagcaggcgaatatatataaaatgcctacctctaacaaacacgctc

SEQ ID NO: 243105 - DNA, 75 bp, Artificial Sequence
  Synthetic
tcttgccgcgccaaccgtacacgcggtgacggccttttgcatctcaaagctggagctcacatacctgagatcgtt

SEQ ID NO: 243106 - DNA, 75 bp, Artificial Sequence
  Synthetic
tctttagaagaagtacccaagatttttgaaggtcttggcaaggacgaaaaacgggcggcaaatgctctgcaaaaa

SEQ ID NO: 243107 - DNA, 75 bp, Artificial Sequence
  Synthetic
ccaagggaatctcaagttatataatgaaccataaatcatcattttaaaccaatgtgctaacactacaccgcctgc

SEQ ID NO: 243108 - DNA, 75 bp, Artificial Sequence
  Synthetic
aacgaaaccgagaatcagaacgtgttggtagagctggagggtgacaacgcgcgtttggccgtactcaaacgcacc

SEQ ID NO: 243109 - DNA, 75 bp, Artificial Sequence
  Synthetic
cttacattgaagagacccaggtttattacagtgacagtgtatagtccagcgctcaaaacctcttacaatttgatt

SEQ ID NO: 243110 - DNA, 75 bp, Artificial Sequence
  Synthetic
attgaagtttcacactttgcttatcccgcgctaaatcttcctcccaaagtaatgcgttctgttatggatcaagtg

SEQ ID NO: 243111 - DNA, 75 bp, Artificial Sequence
  Synthetic
aaaatcaacattaatagtggcacagcaaacacaaacacgcatgtaaattttgcacacatgcttttcccattcaga

SEQ ID NO: 243112 - DNA, 75 bp, Artificial Sequence
  Synthetic
cttattaagcgagcagagcccattgatccccaacaacccgacctaaactctgaggacggacaacccgtagtctca

SEQ ID NO: 243113 - DNA, 75 bp, Artificial Sequence
  Synthetic
caataccatgtcccaccacattggccactcctgcaatactacaaaaggtgcacaagatggaatacacctcacctc

SEQ ID NO: 243114 - DNA, 75 bp, Artificial Sequence
  Synthetic
gacgacgagcttgctcgctggctaggtacccaggatccctcagagctgcaagagcggcgaaaaatgatgatggca

SEQ ID NO: 243115 - DNA, 75 bp, Artificial Sequence
  Synthetic
actcacataatgcatattcaaatgttcacactctaaaagtccaggagtcttttccattgtagcaataggcacaaa

SEQ ID NO: 243116 - DNA, 75 bp, Artificial Sequence
  Synthetic
gcagttttggttacagtggaattggaatgcctgcagcgcttctttgctaaccctcaaacactgcgcaaagtcgag

SEQ ID NO: 243117 - DNA, 75 bp, Artificial Sequence
  Synthetic
atcctcagagggaggtggaaggtggtgggcttggtacgaactcagtttgcagcgaaaccatctgtcgcgttgcat

SEQ ID NO: 243118 - DNA, 75 bp, Artificial Sequence
  Synthetic
gagtccctgcactatgccttccgtcatggctacgttcgtcaggcctgcaagatctccaacgtagagctcagcaat

SEQ ID NO: 243119 - DNA, 75 bp, Artificial Sequence
  Synthetic
cataaatcaaaagcttgcgcacagcttcgtacttttgttttaaaaagcgaacacgctgccaacaaatgttcgcaa

SEQ ID NO: 243120 - DNA, 75 bp, Artificial Sequence
  Synthetic
ctgatctcttacatgggcattctacacgaaaaccggctggggcagaacgttcttcactgcaccttgcaaggggag

SEQ ID NO: 243121 - DNA, 75 bp, Artificial Sequence
  Synthetic
accgatggtttcgttgtcgcgctctttcagttttcagggcaatgtttagccactcctgcagtccacttaacagct

SEQ ID NO: 243122 - DNA, 75 bp, Artificial Sequence
  Synthetic
gcccgccgagactacgtccgcgactgcatctatcttttccttattctcacctggcaaaccgctatgggagtctgg

SEQ ID NO: 243123 - DNA, 75 bp, Artificial Sequence
  Synthetic
cagcagtgcttggaagagcaaaacctccaggagcttaataaattgctagtacgagcccgtcgcgaactctggacg

SEQ ID NO: 243124 - DNA, 75 bp, Artificial Sequence
  Synthetic
tcttttgacgagcgtacggttgcccgccagctggcaaacctcatttttcccgagcggcttatgcaaacattgcaa

SEQ ID NO: 243125 - DNA, 75 bp, Artificial Sequence
  Synthetic
tctccccaccgctgcgttggtaaaaaattacagccaagtcaaaaaaaatgcgattttccaaattaccaatcaccg

SEQ ID NO: 243126 - DNA, 75 bp, Artificial Sequence
  Synthetic
aatggtttgccagactttgtcagccaaagtatcttgcaaaactttcgctcctttgtactcgagcgttccggcatc

SEQ ID NO: 243127 - DNA, 75 bp, Artificial Sequence
  Synthetic
cttccactaaggctgacacacgcacttcaagaaacacaaacatagcaaaagcattttcctcaaaatcttcaaaca

SEQ ID NO: 243128 - DNA, 75 bp, Artificial Sequence
  Synthetic
ttgccggctatgagttgtgctttgccctccgattttgtccccctctgctaccgcgaatgccccccaccgttgtgg

SEQ ID NO: 243129 - DNA, 75 bp, Artificial Sequence
  Synthetic
ttcaagaaacacaaacatagcaaaagcattttcctcaaaatcttcaaacattaagctgcaatcttgaataactcc

SEQ ID NO: 243130 - DNA, 75 bp, Artificial Sequence
  Synthetic
ttaagctgcaatcttgaataactcccaaataattttctgcttgccacccgcgcaacacatccattaaaatttctt

SEQ ID NO: 243131 - DNA, 75 bp, Artificial Sequence
  Synthetic
agtcactgctacctcctccgtctagccaactatttggcccaccactctgatcttatggaagactctagcggcgac

SEQ ID NO: 243132 - DNA, 75 bp, Artificial Sequence
  Synthetic
cgcaacacatccattaaaatttcttgtagactggcaccatgcaattcaaaaagcttgttgagagcgccctctact

SEQ ID NO: 243133 - DNA, 75 bp, Artificial Sequence
  Synthetic
ggactgctagaatgtcactgccgttgcaacctctgcacccctcatcgctcactggtctgtaacaccgagcttctt

SEQ ID NO: 243134 - DNA, 75 bp, Artificial Sequence
  Synthetic
gtcatacgcaggcacaccttcatggttgaaaaagatcaggttcccgtgtcacctgcagttcatttaaaagatcaa

SEQ ID NO: 243135 - DNA, 75 bp, Artificial Sequence
  Synthetic
agcgaaacccaagtaatcggtacctttgagattcaagggccagagcaacaagaaggtgcttccagcctcaaactc

SEQ ID NO: 243136 - DNA, 75 bp, Artificial Sequence
  Synthetic
acctgcagttcatttaaaagatcaacatcaggctcaaaaccccgatcccgaatctccgtgcgtagcattaattgt

SEQ ID NO: 243137 - DNA, 75 bp, Artificial Sequence
  Synthetic
acgccggcgttgtggacttccgcctacctacgcaaatttattcccgaagactatcacgcccaccaaattaaattt

SEQ ID NO: 243138 - DNA, 75 bp, Artificial Sequence
  Synthetic
acaaagtcatccaaatcattgcatataagctctgtcagttcgctatcaggaagcagctcaggtgatgctacacaa

SEQ ID NO: 243139 - DNA, 75 bp, Artificial Sequence
  Synthetic
tatgaagaccaatcacgacctcccaaagtcccccttacagcctgtgttatcacccaaagccaaattctggcccaa

SEQ ID NO: 243140 - DNA, 75 bp, Artificial Sequence
  Synthetic
caaatcatttctagcgtgggagctaaagacgttaaggtaaagccacaataagcagcttgaaaaactggagtaaca

SEQ ID NO: 243141 - DNA, 75 bp, Artificial Sequence
  Synthetic
ttacaagctattcagcaggcgcgtcaggaatttcttttaaaaaaaggacacggggtctatttggacccccaaacc

SEQ ID NO: 243142 - DNA, 75 bp, Artificial Sequence
  Synthetic
caatgtaaaatgtgcagcaaaaactccgacatgtttgtctttaaaaaatctaccacagaaatgtccatattattt

SEQ ID NO: 243143 - DNA, 75 bp, Artificial Sequence
  Synthetic
ccgacatgtttgtctttaaaaaatctaccacagaaatgtccatattatttaaataaaacatcaggggctgaggaa

SEQ ID NO: 243144 - DNA, 75 bp, Artificial Sequence
  Synthetic
ggtgaagaacttaataccccgtcactctccgccgccgcttcgtgccgttcgcagaaacatgccacccaagggaaa

SEQ ID NO: 243145 - DNA, 75 bp, Artificial Sequence
  Synthetic
aaataaaacatcaggggctgaggaaccaccaccgaaataaaaataggtcgtaataaaaacattgtgtcctgcaac

SEQ ID NO: 243146 - DNA, 75 bp, Artificial Sequence
  Synthetic
caagcatcccatcgcgcaacggcaatcccagcagaaactacaaaagcagtgggacgaggaggagacgtgggacga

SEQ ID NO: 243147 - DNA, 75 bp, Artificial Sequence
  Synthetic
aaaaaaaaatattaatgcccaaagcacctaggaaaaccttatgcctccctttatacccgctgccccgtcttaccg

SEQ ID NO: 243148 - DNA, 75 bp, Artificial Sequence
  Synthetic
cagccaggcagaggaagtttcagacgaggaggcggaggagcagatggagagctgggacagcctagacgaggagga

SEQ ID NO: 243149 - DNA, 75 bp, Artificial Sequence
  Synthetic
cgacaaagcacacagaacaaaacacactacgcaaacgcacacaatatttatacactccctttatcgtcaaaagtc

SEQ ID NO: 243150 - DNA, 75 bp, Artificial Sequence
  Synthetic
actacgcaaacgcacacaatatttatacactccctttatcgtcaaaagtccacaaaaactccaaaggtcacaaaa

SEQ ID NO: 243151 - DNA, 75 bp, Artificial Sequence
  Synthetic
tacactccctttatcgtcaaaagtccacaaaaactccaaaggtcacaaaaacccgcgcaaaaaacaccgccaacg

SEQ ID NO: 243152 - DNA, 75 bp, Artificial Sequence
  Synthetic
cctagaggacgtggaggaagaaaccatcgccagcgacaaggcaccatctttcaaaaaacccgttcggagccaacc

SEQ ID NO: 243153 - DNA, 75 bp, Artificial Sequence
  Synthetic
taacacttccgccgcgccactccccaaccttcgaccccaacgtcattcacctccaccctttcccaccccgcctac

SEQ ID NO: 243154 - DNA, 75 bp, Artificial Sequence
  Synthetic
tccgaaaactatcccgcccctgccaccgcaaccatgttcactgaaagccagccgtaggtgggacaccgtctccat

SEQ ID NO: 243155 - DNA, 75 bp, Artificial Sequence
  Synthetic
ctatacgtcacttcgcaccacccctagcccctcctcactcattatcatattggctcgtttccagctttaaggtat

SEQ ID NO: 243156 - DNA, 75 bp, Artificial Sequence
  Synthetic
cgccggatcgccaacagccccagctggtaagcagcctaagcgcgcacgacggggatactgctcctggcgagccca

SEQ ID NO: 243157 - DNA, 75 bp, Artificial Sequence
  Synthetic
cgcaccacccctagcccctcctcactcattatcatattggctcgtttccagctttaaggtatattattgatgatg

SEQ ID NO: 243158 - DNA, 75 bp, Artificial Sequence
  Synthetic
taaaagcaatattgtcgcatgcctccagcactgccggggcaatatctcattcgcacggcgttacttgctttttca

SEQ ID NO: 243159 - DNA, 75 bp, Artificial Sequence
  Synthetic
aataatataccttaaagctggaaacgagccaatatgataatgagtgaggaggggctaggggtggtgcgaagtgac

SEQ ID NO: 243160 - DNA, 75 bp, Artificial Sequence
  Synthetic
cgacggggtggcggttcctcgcaacgtcctctactattaccgtcatctctacagcccctacgaaacgtttggaga

SEQ ID NO: 243161 - DNA, 75 bp, Artificial Sequence
  Synthetic
aaacacctcgagtgcgtaagacctcatccgccattgccacccgccaggattcgcccgccacgcaggagctcagaa

SEQ ID NO: 243162 - DNA, 75 bp, Artificial Sequence
  Synthetic
aacgcatctttccgacgctgtatgctattttccagcagagccgcggtcaacagctggaactcaaagtaaaaaacc

SEQ ID NO: 243163 - DNA, 75 bp, Artificial Sequence
  Synthetic
gatcactccgttcgctcacccgcagctgcttgtatcacagaagtgaagaccaactgcagcgcacgctggaggacg

SEQ ID NO: 243164 - DNA, 75 bp, Artificial Sequence
  Synthetic
ccgaggcactgttcaataaatattgctcggtgtctcttaaggactaaacacccgcgctttttttaggcgccaaat

SEQ ID NO: 243165 - DNA, 75 bp, Artificial Sequence
  Synthetic
tacgtcattgacattatgagcaaagacattcccacgccttacatgtggagctatcagccgcaaatgggcctggca

SEQ ID NO: 243166 - DNA, 75 bp, Artificial Sequence
  Synthetic
gctggagcttctcaggattactccagtcgcatgaattggcttagtgccggcccccacatgattgggcgggtaaat

SEQ ID NO: 243167 - DNA, 75 bp, Artificial Sequence
  Synthetic
ggaattcgtgccactcgaaaccaaattctgctagaacaggccgccctaacctctaccccgcgacgtcagctgaac

SEQ ID NO: 243168 - DNA, 75 bp, Artificial Sequence
  Synthetic
ccaccctcttggcctgccgcccaggtttatcaggaaaaccccgccccgaccacagtccttctgccacgcgacgcg

SEQ ID NO: 243169 - DNA, 75 bp, Artificial Sequence
  Synthetic
gaagccgaagtccaaatgactaactccggagcgcaattagcgggcggcgccagacacgtcaggttcagagatcga

SEQ ID NO: 243170 - DNA, 75 bp, Artificial Sequence
  Synthetic
ccctcgccctattcctccggctctataaaaaggctaatcattcgaggccgaggtatccagctcaacgacgaggta

SEQ ID NO: 243171 - DNA, 75 bp, Artificial Sequence
  Synthetic
gtgagctcttccaccggtcctagacctgacggagtctttcagcttggaggcgccgggcggtcttccttcactcct

SEQ ID NO: 243172 - DNA, 75 bp, Artificial Sequence
  Synthetic
cgccaggcgtacttaacgcttcagagctcttcatcccagcctcgctccggcggcatcggaaccctccagtttgtg

SEQ ID NO: 243173 - DNA, 75 bp, Artificial Sequence
  Synthetic
aactacgacgcggtgagcgaatctgtggacggctacgactgaagaccgatagtacggccgtgactgcgcggctgt

SEQ ID NO: 243174 - DNA, 75 bp, Artificial Sequence
  Synthetic
aacatctgcatcggtgccgtaaccttcgctgctttacttaaaaagcctgtgatttcatttaccaccccagcactt

SEQ ID NO: 243175 - DNA, 75 bp, Artificial Sequence
  Synthetic
agagaatctaaccactaccaccctccttccccttactacttatactttttcccaaaaaaagaattactttttgcc

SEQ ID NO: 243176 - DNA, 75 bp, Artificial Sequence
  Synthetic
ctagtcaacatcctgcagagcatagtggtgcaagagcgcagcctgagcttggccgacaaggtggcggccattaat

SEQ ID NO: 243177 - DNA, 75 bp, Artificial Sequence
  Synthetic
atacgttagagtggcatactatcgtcatcatccccaatataggaaccacgaggtggctacccttctgtgcctgtc

SEQ ID NO: 243178 - DNA, 75 bp, Artificial Sequence
  Synthetic
caaccaagtgcccgggctctagaggcggttggataccgcaatgcaatgcaggaggaggatgaggaggactacgag

SEQ ID NO: 243179 - DNA, 75 bp, Artificial Sequence
  Synthetic
tcctcccaacaacctacccagatttcctggtttcctattacagcccccaccgcccccaccggctcctgtgcagcg

SEQ ID NO: 243180 - DNA, 75 bp, Artificial Sequence
  Synthetic
cgctccatcagttattagctactttcatcttaactctgaagatgtctgaccaactagaaatcgacgggcagtgca

SEQ ID NO: 243181 - DNA, 75 bp, Artificial Sequence
  Synthetic
cagaaagcaaagcgattcgcaaggacgaagcgggactgatttacaatgctctgctggaaagggtggctcgatata

SEQ ID NO: 243182 - DNA, 75 bp, Artificial Sequence
  Synthetic
ctgagcagcttatccttgctcggcgaaaactcaaacaacaaaatcaggaactgttcaaccttcaagccctacacc

SEQ ID NO: 243183 - DNA, 75 bp, Artificial Sequence
  Synthetic
aatgcaaaaagggtcttttttgtctggttaaacaagctgaactttgttatgatgtaacccaacagggacacgagc

SEQ ID NO: 243184 - DNA, 75 bp, Artificial Sequence
  Synthetic
ggttaaacaagctgaactttgttatgatgtaacccaacagggacacgagctgtcatatactttaaacaagcaaag

SEQ ID NO: 243185 - DNA, 75 bp, Artificial Sequence
  Synthetic
gcgggcaggaggattacgttagctttattagcgcattgcgcctcctggtggcagaagtacctcaaagcgaggttt

SEQ ID NO: 243186 - DNA, 75 bp, Artificial Sequence
  Synthetic
tattagcgcattgcgcctcctggtggcagaagtacctcaaagcgaggtttaccagtccggtcccgattatttttt

SEQ ID NO: 243187 - DNA, 75 bp, Artificial Sequence
  Synthetic
tctttgtcagtgtaccaatcctgaatgcatgtacactatggtaaaaaccctgtgtggtctaagggaacttctccc

SEQ ID NO: 243188 - DNA, 75 bp, Artificial Sequence
  Synthetic
tgcatgtacactatggtaaaaaccctgtgtggtctaagggaacttctcccctttaattaaagttattctgattaa

SEQ ID NO: 243189 - DNA, 75 bp, Artificial Sequence
  Synthetic
gcaccacctgcccttcctcccaactttcgtacgggatgtgccaacgggcggcaaactttctccacgtcctaaagg

SEQ ID NO: 243190 - DNA, 75 bp, Artificial Sequence
  Synthetic
acttcaaccccgtctacccctatgacacctcctcaactcccagcattccctatgtagctccgcccttcgtttctt

SEQ ID NO: 243191 - DNA, 75 bp, Artificial Sequence
  Synthetic
ccgacgggttacaggaaaaccccccgggagttttagcactcaagtacactgaccccattactaccaatgctaaac

SEQ ID NO: 243192 - DNA, 75 bp, Artificial Sequence
  Synthetic
atgagcttactttaaaacttggcagcaacataactttacaaaatgggttactttcggccaccgttcccactgttt

SEQ ID NO: 243193 - DNA, 75 bp, Artificial Sequence
  Synthetic
ctcctccccttacaaacagtaacaactccttgggtttagccacatccgctcctatagctgtgtcagctaactctc

SEQ ID NO: 243194 - DNA, 75 bp, Artificial Sequence
  Synthetic
ttacattggccaccgccgcaccactgacagtaagcaacaaccagcttagtattaacactggcagaggcttagtta

SEQ ID NO: 243195 - DNA, 75 bp, Artificial Sequence
  Synthetic
taactaacaatgccgtagcagttaatcctaccggagcgttaggctttaacaacacaggagctttacaattaaacg

SEQ ID NO: 243196 - DNA, 75 bp, Artificial Sequence
  Synthetic
ctgcgggaggaatgagagtggacggcgccaacttaattcttcatgtagcatacccctttgaagcaatcaaccaac

SEQ ID NO: 243197 - DNA, 75 bp, Artificial Sequence
  Synthetic
taacactgcgattagaaaacgggttagaagtaaccaacggaggaaaactcaacgttaagttgggatcaggcctcc

SEQ ID NO: 243198 - DNA, 75 bp, Artificial Sequence
  Synthetic
aatttgacaataacggacgcattaccattagtaatcgcatccagactcgaggtgtaacatccctcactaccattt

SEQ ID NO: 243199 - DNA, 75 bp, Artificial Sequence
  Synthetic
ggtctatctcgcctacgcctaactgctccatctatgaaacccaagatgcaaatctatttctttgtctaactaaaa

SEQ ID NO: 243200 - DNA, 75 bp, Artificial Sequence
  Synthetic
acggagctcacgtgttaggtactataacaattaaaggtcttaaaggagcactgcgggaaatgaacgataacgctt

SEQ ID NO: 243201 - DNA, 75 bp, Artificial Sequence
  Synthetic
aacaattaaaggtcttaaaggagcactgcgggaaatgaacgataacgctttatctgtaaaacttccctttgacaa

SEQ ID NO: 243202 - DNA, 75 bp, Artificial Sequence
  Synthetic
accccttcgcccacctgcgtcctcagggccgcttgggcagattgtattaaaaaataaaaaaccacttaccagagc

SEQ ID NO: 243203 - DNA, 75 bp, Artificial Sequence
  Synthetic
ccacccaccgctgtattttgctacataactgaacaataaaatcattgcaggcgcaatcttcgcatttcttttttc

SEQ ID NO: 243204 - DNA, 75 bp, Artificial Sequence
  Synthetic
cgaacactacaatccccttgacattccatttattacacccccgtttgcttcctccaacggcttgcaagaaaaacc

SEQ ID NO: 243205 - DNA, 75 bp, Artificial Sequence
  Synthetic
actgatccacttacaaccaaaaacggggctttaaccttaaaattgggcacgggactaaacattgataaaaatgga

SEQ ID NO: 243206 - DNA, 75 bp, Artificial Sequence
  Synthetic
gatctttcttcagatgctagcgtggaagttagcgcccctatcactaaaaccaacaaaatcgtaggtttaaattac

SEQ ID NO: 243207 - DNA, 75 bp, Artificial Sequence
  Synthetic
actaagcctctcgctctgcaaaataacgcgcttactctttcttacaacgcgccctttaacgtagtaaataataat

SEQ ID NO: 243208 - DNA, 75 bp, Artificial Sequence
  Synthetic
ttagctctaaatatgtcacagcctgttactattaatgcaaacaacgaactttctctcttaatagacgccccactt

SEQ ID NO: 243209 - DNA, 75 bp, Artificial Sequence
  Synthetic
aatgctgacacgggcactcttcgccttcgaagtgatgcacctcttggactagtagacaaaacactaaaggttttg

SEQ ID NO: 243210 - DNA, 75 bp, Artificial Sequence
  Synthetic
cacctttaaaaatagaaaacgaaaacttaaccctaagcacaggcggaccttttactgtaagcgggggaaatttaa

SEQ ID NO: 243211 - DNA, 75 bp, Artificial Sequence
  Synthetic
acctggcaacatcggcacccctctccgtgcaaaacaattctctctccttaggggttaacccgccttttctcatca

SEQ ID NO: 243212 - DNA, 75 bp, Artificial Sequence
  Synthetic
tattactttagcactagatgcagcgctgcctttgcaatataaaaacaaccaacttcaactcagaattggctccgc

SEQ ID NO: 243213 - DNA, 75 bp, Artificial Sequence
  Synthetic
gtctgctttaattatgagcggagtaacacaaacattaaacgtcaatgccaataccagcaaaggtcttgctattga

SEQ ID NO: 243214 - DNA, 75 bp, Artificial Sequence
  Synthetic
aaataactcactagttgttaagctaggaaacggtcttcgctttgatagctggggaagcatagctgtctcacctac

SEQ ID NO: 243215 - DNA, 75 bp, Artificial Sequence
  Synthetic
tatccattaaagctcaaaaaggcactttacttaaacccacagctagctttatttcctttgtcatgtatttttaca

SEQ ID NO: 243216 - DNA, 75 bp, Artificial Sequence
  Synthetic
tttacttaaacccacagctagctttatttcctttgtcatgtatttttacagcgacggaacgtggaggaaaaacta

SEQ ID NO: 243217 - DNA, 75 bp, Artificial Sequence
  Synthetic
tcccgtgtttgacaacgaagggatactagcaaacagtgccacatggggttatcgacaaggacagtctgccaacac

SEQ ID NO: 243218 - DNA, 75 bp, Artificial Sequence
  Synthetic
taacgtttccaatgctgtagaatttatgcctagctctaaaaggtatcccaatgaaaaaggttctgaagttcagaa

SEQ ID NO: 243219 - DNA, 75 bp, Artificial Sequence
  Synthetic
catggctcttacctacacttttttgcaaggtgaccctaacatggccatatcttttcagagcatttataatcatgc

SEQ ID NO: 243220 - DNA, 75 bp, Artificial Sequence
  Synthetic
caaggtgaccctaacatggccatatcttttcagagcatttataatcatgcaatagaaggctactcattaaaattc

SEQ ID NO: 243221 - DNA, 75 bp, Artificial Sequence
  Synthetic
acctggcgcgttcgaaataatgaacgttttgacatcccctgttgctcattttcttatgtaacagaacaataaaat

SEQ ID NO: 243222 - DNA, 75 bp, Artificial Sequence
  Synthetic
attgttattttgtattttcaactttattgatacttttacagaattctaaccgttaatctccctccccccttccac

SEQ ID NO: 243223 - DNA, 75 bp, Artificial Sequence
  Synthetic
tttaccttatacacctccctttccccctgtaccaccgcaaacaactgcaatttaggatttacacaacgattcttc

SEQ ID NO: 243224 - DNA, 75 bp, Artificial Sequence
  Synthetic
cctgtaccaccgcaaacaactgcaatttaggatttacacaacgattcttctgtgacaaaatcaacacaggttctt

SEQ ID NO: 243225 - DNA, 75 bp, Artificial Sequence
  Synthetic
ggaaatgaaaccttcagaaacatcgtccaacagcacggtggagtccaaagcagagctctgcaaaaacaaatacag

SEQ ID NO: 243226 - DNA, 75 bp, Artificial Sequence
  Synthetic
tcaagctctccacgggttctcgcctctgttgtagtctgccaacgtaaacgggcagtaccgctccatcaagccccg

SEQ ID NO: 243227 - DNA, 75 bp, Artificial Sequence
  Synthetic
cagtaatccctgtctccggggttccaccaagctcctcatgagtgacctaacggtgaagcttcccaacactttcac

SEQ ID NO: 243228 - DNA, 75 bp, Artificial Sequence
  Synthetic
cggtgaagcttcccaacactttcaccgccttggccagcagccgccgcgtccgacgagcgcagcaccgcacagaaa

SEQ ID NO: 243229 - DNA, 75 bp, Artificial Sequence
  Synthetic
gctcatccaagtttttacaataggtacagcccaacaccaccatattattcataattccataactaaaaaaactcc

SEQ ID NO: 243230 - DNA, 75 bp, Artificial Sequence
  Synthetic
ctctgacaaacacgctccccataaataacacttccttgggcatgccacaatttacaatttctcgataccaaggga

SEQ ID NO: 243231 - DNA, 75 bp, Artificial Sequence
  Synthetic
atcttaagttatacagtgaaccataaatcatcattttaaaccaatttgctaacactacaccccccgccttacatt

SEQ ID NO: 243232 - DNA, 75 bp, Artificial Sequence
  Synthetic
gaagagacccaggtttaatacagtgacagtgtatagtccagcgttcaaaacctcttacaatttgattaaaatcaa

SEQ ID NO: 243233 - DNA, 75 bp, Artificial Sequence
  Synthetic
tgcttttcccatttagacaatatcatgtcccaccacattggccactcctgcaatactacaaaaggcgcacaagat

SEQ ID NO: 243234 - DNA, 75 bp, Artificial Sequence
  Synthetic
ggaatagacctcacctcgctcacataatgcatattcaaatgttcacactctaaaagtccaggagtcctttccatt

SEQ ID NO: 243235 - DNA, 75 bp, Artificial Sequence
  Synthetic
gtggcaataggcacagaatcctcagagggaggtggaagacggtgggtttggtacgaactcagtctgcagcgaaac

SEQ ID NO: 243236 - DNA, 75 bp, Artificial Sequence
  Synthetic
catctgtcgcgttgcatcataaattaaaagctcgcgcacagcttcgtacttctgttttaagaaacgaacacgctg

SEQ ID NO: 243237 - DNA, 75 bp, Artificial Sequence
  Synthetic
ccaacaaatgttcgcaaatcgacggtttcgttgtcgcgctctttcagttttcagggcaacgttcagccactcctg

SEQ ID NO: 243238 - DNA, 75 bp, Artificial Sequence
  Synthetic
cagtccacttaacagctcctcagcccgtggagatatgctgacattataccttattatgtccccataaacgttcaa

SEQ ID NO: 243239 - DNA, 75 bp, Artificial Sequence
  Synthetic
ccgctgcgttggtgaaaaattacagccaagtcaaaaaagatgcgattttccaaattaccaatcacggcttccact

SEQ ID NO: 243240 - DNA, 75 bp, Artificial Sequence
  Synthetic
caatcttgaataattcccaaataattttccgcttgccacccgcgcaacacatccattaaaatttcttgtaaactg

SEQ ID NO: 243241 - DNA, 75 bp, Artificial Sequence
  Synthetic
atccattaaaatttcttgtaaactggcgccatgtaattcaaaaagtttgttaagagcaccctctactgtcatacg

SEQ ID NO: 243242 - DNA, 75 bp, Artificial Sequence
  Synthetic
ttcatttaaaagattaacattaggctcaaaaccccgatcccgaatctccatgcgtagcattagttgtacaaagtc

SEQ ID NO: 243243 - DNA, 75 bp, Artificial Sequence
  Synthetic
atccaaatcattgcatataagctctgtcagttcgctatcaggaagcagctcaggtgatgctacacaacaaatcat

SEQ ID NO: 243244 - DNA, 75 bp, Artificial Sequence
  Synthetic
ctctagcgtaggagctaaagacgttaaggtaaagccacaataagcagcttgaagaactggagtaacacaatgcaa

SEQ ID NO: 243245 - DNA, 75 bp, Artificial Sequence
  Synthetic
catcaggggctcaggaaccaccaccgaaataaaaaccggtcgtaacaaatacattgtgtcctgcaacaaaaaaaa

SEQ ID NO: 243246 - DNA, 75 bp, Artificial Sequence
  Synthetic
aatattaatgcccacacctgggaaaacctgttctaaaaccaaacaggtataagtattacaaatgcctccctttgc

SEQ ID NO: 243247 - DNA, 75 bp, Artificial Sequence
  Synthetic
cccccaatccaaaccaaataagctgccccgtcttaccgcgacaaagcacacagaacaaaacacactccgcagacg

SEQ ID NO: 243248 - DNA, 75 bp, Artificial Sequence
  Synthetic
aacacaatatttatacactccctttgccgtcaaaagtccacaaaaactccaaaggtcagaaaaaccgccacatga

SEQ ID NO: 243249 - DNA, 75 bp, Artificial Sequence
  Synthetic
acacttccgcatactgtttcacatatcgtcacttccgccgcaccgcgcccgtcctccgaccccacacgtcatccg

SEQ ID NO: 243250 - DNA, 75 bp, Artificial Sequence
  Synthetic
cctccaccctttcccaccccgcccgcctctacgtcaccttacaccacccctagtccctcctccctcattatcata

SEQ ID NO: 243251 - DNA, 75 bp, Artificial Sequence
  Synthetic
tacaccacccctagtccctcctccctcattatcatattggctcgtttccagttttaaggtatattattgatgatg

SEQ ID NO: 243252 - DNA, 75 bp, Artificial Sequence
  Synthetic
actccctggctcctaaaacagcacccaatccatgcgaatggaaggacaacaacaaaataaaagttagagggcaag

SEQ ID NO: 243253 - DNA, 75 bp, Artificial Sequence
  Synthetic
caatccatgcgaatggaaggacaacaacaaaataaaagttagagggcaagctccctttataggaacaaacataga

SEQ ID NO: 243254 - DNA, 75 bp, Artificial Sequence
  Synthetic
taaagacaaggggattcagataggaacagatacaacaaatcagcctatttatgccgacaaaacctatcaaccaga

SEQ ID NO: 243255 - DNA, 75 bp, Artificial Sequence
  Synthetic
aggtagcgggtagggtgctgaaagataccacgccaatgttaccgtgctacgggtcttacgccaaaccaactaatg

SEQ ID NO: 243256 - DNA, 75 bp, Artificial Sequence
  Synthetic
aaaagggtggtcaggctagtctcataacgaacggaaccgatcaaactctaacaagcgacgttaacttacagttct

SEQ ID NO: 243257 - DNA, 75 bp, Artificial Sequence
  Synthetic
cttccacattcaagtcccccagaagttttttgccattaaaaatctcctcctgttaccgggttcctacacctacga

SEQ ID NO: 243258 - DNA, 75 bp, Artificial Sequence
  Synthetic
acattgctgagcccgaggggcgctggcttttagacctagtcaacatcctgcagagcatagtggtgcaagagcgca

SEQ ID NO: 243259 - DNA, 75 bp, Artificial Sequence
  Synthetic
agtcttactttgacatgggggcagatttgcaatggcagccaagtgcccgggctctagaggcggttggataccgca

SEQ ID NO: 243260 - DNA, 75 bp, Artificial Sequence
  Synthetic
gtgaacgccctaacagaaagcaaagcaattcgcaaggacgaagcgggactgatttacaatgctctgctggaaagg

SEQ ID NO: 243261 - DNA, 75 bp, Artificial Sequence
  Synthetic
atgggctccagcgagcaggagctggccgccatcgtgcgtgacctgggttgcggaccatactttctaggcaccttt

SEQ ID NO: 243262 - DNA, 75 bp, Artificial Sequence
  Synthetic
gcaaaatcccacaatggatcttctcacgggcgtacctaacagcatgcttcaaagcccccaggttgaacccaccct

SEQ ID NO: 243263 - DNA, 75 bp, Artificial Sequence
  Synthetic
atgaaaaatgctcaagtgttgtttcataataaaattttttattgatttcacgctggcagactttttttttttttt

SEQ ID NO: 243264 - DNA, 75 bp, Artificial Sequence
  Synthetic
ggtgcttcttccaaccccttcgcccacctacgtcctcagggccgcttgggcagattgtattaaaaaaaaataaaa

SEQ ID NO: 243265 - DNA, 75 bp, Artificial Sequence
  Synthetic
aaaaaaaaccacttaccagagccatggcaacagcgtcggtccctttgtgtgttttctcccctcttcccagtagca

SEQ ID NO: 243266 - DNA, 75 bp, Artificial Sequence
  Synthetic
aaatgagacgagcggtgggagtgccacccgtgatggcatacgcagagggtcctcctccttcttacgaaagcgtga

SEQ ID NO: 243267 - DNA, 75 bp, Artificial Sequence
  Synthetic
tgcgcacaaacatgcccaacataaatgagtttatgtctaccaacaagtttaaagctcggctaatggtagaaaaaa

SEQ ID NO: 243268 - DNA, 75 bp, Artificial Sequence
  Synthetic
tgagtttatgtctaccaacaagtttaaagctcggctaatggtagaaaaaaaaaataaggagactggtttaccgcg

SEQ ID NO: 243269 - DNA, 75 bp, Artificial Sequence
  Synthetic
caatggcggagggcgctccgggctcgtctcctggaggtagggagtacgggtggggtgcttccgctgacggccagc

SEQ ID NO: 243270 - DNA, 75 bp, Artificial Sequence
  Synthetic
caaacggtggatattcagatccccgtacgtaccactccagcagtggcaatggcagaagccatggaaacgcagaca

SEQ ID NO: 243271 - DNA, 75 bp, Artificial Sequence
  Synthetic
gatcagcctgcgcctgtgactacccgggaaataggtttgcaaacggacccaaggtacgagtctgttacttccacc

SEQ ID NO: 243272 - DNA, 75 bp, Artificial Sequence
  Synthetic
ccgcccaaagggaacaagcaagccattgcggatcggcggtcccaaaagcaacagaaactgcaagagcagtgggac

SEQ ID NO: 243273 - DNA, 75 bp, Artificial Sequence
  Synthetic
gaggaggaggaggaatcctgggacgacagccaggcagaggaagtttcagacgaggaggaaatggagagctgggaa

SEQ ID NO: 243274 - DNA, 75 bp, Artificial Sequence
  Synthetic
tcacccgcagctgcttgtatcacagaagggaagaccaactgcagcgcacgctggaagacgccgaggcactgttca

SEQ ID NO: 243275 - DNA, 75 bp, Artificial Sequence
  Synthetic
aagggaagaccaactgcagcgcacgctggaagacgccgaggcactgttcaataaatattgctcggtgtctcttaa

SEQ ID NO: 243276 - DNA, 75 bp, Artificial Sequence
  Synthetic
ctggaagacgccgaggcactgttcaataaatattgctcggtgtctcttaaggactgaaagcccgcgcttttttaa

SEQ ID NO: 243277 - DNA, 75 bp, Artificial Sequence
  Synthetic
catcatcaataatataccttattctggaaacgtgccaatatgataatgagcggggaggagcgaggcggggccggg

SEQ ID NO: 243278 - DNA, 75 bp, Artificial Sequence
  Synthetic
gtgacgtgcggtgacgtggggtgacgcggggtggcgcgagggcggggcgggagtggggaggcgcttagtttttac

SEQ ID NO: 243279 - DNA, 75 bp, Artificial Sequence
  Synthetic
gtatgcggaaggaggttttataccggaagttgggtaatttgggcgtatacttgtaagttttgtgtaatttggcgc

SEQ ID NO: 243280 - DNA, 75 bp, Artificial Sequence
  Synthetic
gaaaaccgggtaatgaggaagttgaggttaatatgtactttttatgactgggcggaatttctgctgatcagcagt

SEQ ID NO: 243281 - DNA, 75 bp, Artificial Sequence
  Synthetic
caccggcagcgcatcgaacgggccacggccttcgaaagcatgagccaaagagtgtaatcaataaaaaccattttt

SEQ ID NO: 243282 - DNA, 75 bp, Artificial Sequence
  Synthetic
gaactttgggcgctgacggggaggtttcgctacgtggcagtaccacgagaaggctcaaaggtcccatttattgta

SEQ ID NO: 243283 - DNA, 75 bp, Artificial Sequence
  Synthetic
agtgtaatcaataaaaaccatttttatttgacatgctacgagcttctggcgtttttattaaaaatcgaagggttc

SEQ ID NO: 243284 - DNA, 75 bp, Artificial Sequence
  Synthetic
ctcctcagcgttttcgctgggtatttaaacgctgtcagatcatcaagaggccactcttgagtgccggcgagtaga

SEQ ID NO: 243285 - DNA, 75 bp, Artificial Sequence
  Synthetic
ccactcttgagtgccggcgagtagagttttctcctccgcgctgccgcgatgaggctggttcccgagatgtacggt

SEQ ID NO: 243286 - DNA, 75 bp, Artificial Sequence
  Synthetic
gttttctgcagcgagacggcccggaactcagatgagctgcttaatacagatctgctggatgttcccaactcgcct

SEQ ID NO: 243287 - DNA, 75 bp, Artificial Sequence
  Synthetic
gtggcttcgcctccgtcgcttcatgatcttttcgatgtggaagtggatccaccgcaagatcccaacgaggacgcg

SEQ ID NO: 243288 - DNA, 75 bp, Artificial Sequence
  Synthetic
ggctgttgcggaacacggggttggcacactggaacaccatcacgctggggttgtgaatactagccagggccgttg

SEQ ID NO: 243289 - DNA, 75 bp, Artificial Sequence
  Synthetic
gtaaacagtatgttccctgaatgtctgtttgaggcggctgaggagggttctcacagcagtgaagagagcagacgg

SEQ ID NO: 243290 - DNA, 75 bp, Artificial Sequence
  Synthetic
ggtcggtcacctccgacgcatccagatcctcggcgttgctcagggcgaacggggtcagcttgcacatctgccgcc

SEQ ID NO: 243291 - DNA, 75 bp, Artificial Sequence
  Synthetic
ggagaggaactggacttgaaatgctacgaggaatgtctgccttctagcgattctgaaacggaacagacaggggga

SEQ ID NO: 243292 - DNA, 75 bp, Artificial Sequence
  Synthetic
cgatctggggcaccaggtcgggtttgttgaggcaatcgcagcgcagagggatcaggatgcgacgctgcccgcgtt

SEQ ID NO: 243293 - DNA, 75 bp, Artificial Sequence
  Synthetic
gacggctgtgagtcggcaatgaaaaatgaacttgtattagactgtccagaacatcctggtcatggctgccgtgcc

SEQ ID NO: 243294 - DNA, 75 bp, Artificial Sequence
  Synthetic
gcatgatagggtaactcgctgccaggaactcctccatctgacggaaggccatctgggccttcgtgccctcggtga

SEQ ID NO: 243295 - DNA, 75 bp, Artificial Sequence
  Synthetic
tgtgcttttcatagaaatgccagcggaaatcctgagactctatgtgctctgtgttatctgcgccttaccagcgat

SEQ ID NO: 243296 - DNA, 75 bp, Artificial Sequence
  Synthetic
aaaagagcccacaggacttgctagagaatacgttattgccgcagttgatgtcttccgagcagcagcgggcgtctt

SEQ ID NO: 243297 - DNA, 75 bp, Artificial Sequence
  Synthetic
tttgtatacagtaagtaaagtgttttcattggcgtacggtaggggattcgttgaagtgctttgtgacttattatg

SEQ ID NO: 243298 - DNA, 75 bp, Artificial Sequence
  Synthetic
cattcttcagctgaaccacgttgcgaccccagcggttctggaccaccttggctttcgtaggatgctccttcaacg

SEQ ID NO: 243299 - DNA, 75 bp, Artificial Sequence
  Synthetic
tgtcattatttctaggtgacgtgtccgacgtggaaggggaaggagatagatcaggggctgctaattctccttgca

SEQ ID NO: 243300 - DNA, 75 bp, Artificial Sequence
  Synthetic
cccgctgaccgttctcgctggtcacatccatttccaccacgtgctccttgcagaccatctccactccgtggaagc

SEQ ID NO: 243301 - DNA, 75 bp, Artificial Sequence
  Synthetic
ctttgggggctgtggttccagttggcatttttaaacccgtggcggtcagagtctcaggcagacggtgcgcagttg

SEQ ID NO: 243302 - DNA, 75 bp, Artificial Sequence
  Synthetic
agaacaggacgccctcctgccgggtattgcgatgctcccacacggcgcacccggtgggctcccagctcttgcgtt

SEQ ID NO: 243303 - DNA, 75 bp, Artificial Sequence
  Synthetic
ccggtgggctcccagctcttgcgtttcacccccgcgtatgcttccatgtaagccatgaggaatctgcccatcagc

SEQ ID NO: 243304 - DNA, 75 bp, Artificial Sequence
  Synthetic
aacaaattgaagacttgctgcaggaagaacagacgcaacctttggacctgtccatgaaacgccctaagctgactt

SEQ ID NO: 243305 - DNA, 75 bp, Artificial Sequence
  Synthetic
agaacagacgcaacctttggacctgtccatgaaacgccctaagctgacttaagtgtgtttattgtatgcaataaa

SEQ ID NO: 243306 - DNA, 75 bp, Artificial Sequence
  Synthetic
tcggtgaaggtcttctggttggtgaaggtcagcggcaggccgcggtgctcctcgttcaaccaagtttgacagatc

SEQ ID NO: 243307 - DNA, 75 bp, Artificial Sequence
  Synthetic
agtgttgatctttgaactgtgtttatgtgttgggtgtgtctgtgggtatataagcaggtggatgggaagtgagag

SEQ ID NO: 243308 - DNA, 75 bp, Artificial Sequence
  Synthetic
ttgcggtacacggctccctggtcgggcagaaacttaaaagcccctctgctctcgttgtccacgtggaacttctcc

SEQ ID NO: 243309 - DNA, 75 bp, Artificial Sequence
  Synthetic
cacagctgcttcagatggatctgctaggagacctaagagaatttggcgtggttcggcgcttgctggagttggcct

SEQ ID NO: 243310 - DNA, 75 bp, Artificial Sequence
  Synthetic
atcaacaccgtcatgacttccatgcccttctcccaggcagtcaccagcggcgcgctctcggggttcttcaccaac

SEQ ID NO: 243311 - DNA, 75 bp, Artificial Sequence
  Synthetic
ctgacagaacttccaagttttggaggttttgttttggctcaacgcttagcaacgtgctatatagggtcaagaagg

SEQ ID NO: 243312 - DNA, 75 bp, Artificial Sequence
  Synthetic
acggcggtggaggggccctcgccggccccgacgtccttcatggtcattctttgaaactccacggtgccgtccgcg

SEQ ID NO: 243313 - DNA, 75 bp, Artificial Sequence
  Synthetic
ccccgacgtccttcatggtcattctttgaaactccacggtgccgtccgcgcggcgtactctgcgcatcggagggt

SEQ ID NO: 243314 - DNA, 75 bp, Artificial Sequence
  Synthetic
agcaggagacgcagtttgctaggctgttggccgatactcctggagtttttgtggctctggatctaggccatcact

SEQ ID NO: 243315 - DNA, 75 bp, Artificial Sequence
  Synthetic
gttggccgatactcctggagtttttgtggctctggatctaggccatcactctcttttccaagagaaaattatcaa

SEQ ID NO: 243316 - DNA, 75 bp, Artificial Sequence
  Synthetic
aaacctaacttttacgtctcctggtcgcacggttgcttccgctgcctttattacctatattttggatcaatggag

SEQ ID NO: 243317 - DNA, 75 bp, Artificial Sequence
  Synthetic
atctccggggatggcggcggcgcaagtgttgccttgcgagccttcttcttgggagggagcggaggcacctcctgc

SEQ ID NO: 243318 - DNA, 75 bp, Artificial Sequence
  Synthetic
caacagcgacagccacctgtcgtgggagtacatgctggattacatggcgatggctctgtggagggccatgctgcg

SEQ ID NO: 243319 - DNA, 75 bp, Artificial Sequence
  Synthetic
gaggagggtttgcatttacttgcgggcgcagcctccgcggctggaccgagtggtggaggagaacgagccggagga

SEQ ID NO: 243320 - DNA, 75 bp, Artificial Sequence
  Synthetic
gaccgagaatctgagagccggcctggaccctccagtggaagactaggtgctgaggatgatcctgaagaggggact

SEQ ID NO: 243321 - DNA, 75 bp, Artificial Sequence
  Synthetic
agtgggggtgctaggaaaaagcaaaaaactgagcctgaacctagaaactttttgaatgagttgactgtaagccta

SEQ ID NO: 243322 - DNA, 75 bp, Artificial Sequence
  Synthetic
gcggcaggaaaatgagaaagagaaggcacagggctgctaccttctggacggcgacgttttgctaaagcatttcgc

SEQ ID NO: 243323 - DNA, 75 bp, Artificial Sequence
  Synthetic
atgaatcggcagcgtcctgagacggtgttttggactgagttggaggatgagttcaagaagggggaattaaacctc

SEQ ID NO: 243324 - DNA, 75 bp, Artificial Sequence
  Synthetic
tgttttggactgagttggaggatgagttcaagaagggggaattaaacctcttgtacaagtatgggtttgagcagt

SEQ ID NO: 243325 - DNA, 75 bp, Artificial Sequence
  Synthetic
gttcaagaagggggaattaaacctcttgtacaagtatgggtttgagcagttcgaaactcactggttggagccgtg

SEQ ID NO: 243326 - DNA, 75 bp, Artificial Sequence
  Synthetic
ggaggatatggaaatggctctagacacctttgctaaagtggctctgcggccggataaagtttacactattcgccg

SEQ ID NO: 243327 - DNA, 75 bp, Artificial Sequence
  Synthetic
acctttgctaaagtggctctgcggccggataaagtttacactattcgccgcactgttaatataaaaaagagtgtt

SEQ ID NO: 243328 - DNA, 75 bp, Artificial Sequence
  Synthetic
cggataaagtttacactattcgccgcactgttaatataaaaaagagtgtttatgttatcggccatggagctctgg

SEQ ID NO: 243329 - DNA, 75 bp, Artificial Sequence
  Synthetic
atcacatctttttcaaaaaccagcgcatccccctctcgtgccgggccaaccgcaccgcggccgataggaagctca

SEQ ID NO: 243330 - DNA, 75 bp, Artificial Sequence
  Synthetic
ccaacggcacctgcgagcccaacccgcgactcaacttctaccccgtattcgccgtgcccgaggcgctggccacct

SEQ ID NO: 243331 - DNA, 75 bp, Artificial Sequence
  Synthetic
tgcaggtgcagaccccagaccgggtggctttcaattgcggcatgcagagtttgggccccggggtgataggtttga

SEQ ID NO: 243332 - DNA, 75 bp, Artificial Sequence
  Synthetic
ggctttcaattgcggcatgcagagtttgggccccggggtgataggtttgaatggagttacatttcaaaatgtcag

SEQ ID NO: 243333 - DNA, 75 bp, Artificial Sequence
  Synthetic
ttgggccccggggtgataggtttgaatggagttacatttcaaaatgtcaggtttactggtgatgattttaatggc

SEQ ID NO: 243334 - DNA, 75 bp, Artificial Sequence
  Synthetic
catccccctctcgtgccgggccaaccgcaccgcggccgataggaagctcaggcttaaaaacggagccgacatacc

SEQ ID NO: 243335 - DNA, 75 bp, Artificial Sequence
  Synthetic
tctgtgtttgtgactagcacccagctaaccctccacggtgtttacttttttaactttaacaatacatgtgtggag

SEQ ID NO: 243336 - DNA, 75 bp, Artificial Sequence
  Synthetic
tcatggggtagggtgtctctgaggggctgcagttttcatggttgctggaaggcggtggtgggaagaattaaaagt

SEQ ID NO: 243337 - DNA, 75 bp, Artificial Sequence
  Synthetic
gtcatgtctgtgaagaaatgcatatttgaacgctgtgtgatagctctagcagtagaggggtacggacggatcagg

SEQ ID NO: 243338 - DNA, 75 bp, Artificial Sequence
  Synthetic
aataacgccgcatctgagaatggatgttttcttttgctgaaaggtacggccagcgttaagcataatatgatttgc

SEQ ID NO: 243339 - DNA, 75 bp, Artificial Sequence
  Synthetic
ggcagcggcctgtgcccctcgcagctcttaacttgcgcagatggaaactgtcacaccttgcgcaccgtgcacata

SEQ ID NO: 243340 - DNA, 75 bp, Artificial Sequence
  Synthetic
gtgtcccactcgcgccgcacctggccaacatttgagcacaatatgctcatgcgttgcgccgttcacctaggtgct

SEQ ID NO: 243341 - DNA, 75 bp, Artificial Sequence
  Synthetic
gcgttgcgccgttcacctaggtgctagacgcggcgtgtttatgccttatcaatgtaactttagtcatactaagat

SEQ ID NO: 243342 - DNA, 75 bp, Artificial Sequence
  Synthetic
tttgctggaaactgattccttccctcgagtatgtttcaatggggtgtttgacatgtcaatggaactttttaaagt

SEQ ID NO: 243343 - DNA, 75 bp, Artificial Sequence
  Synthetic
gataagatatgatgaaaccaagtctcgttgtcgctcatgtgaatgcggagctaatcatttgaggttgtatcctgt

SEQ ID NO: 243344 - DNA, 75 bp, Artificial Sequence
  Synthetic
aaccctgaacgttaccgaggagctgaggacggaccaccacatgctgtcttgcctgcgtaccgactatgaatccag

SEQ ID NO: 243345 - DNA, 75 bp, Artificial Sequence
  Synthetic
cgatgaggagtgaggtgaggggcggagccacaaagggtataaaggggcatgaggggtgggcgcggtgtttcaaaa

SEQ ID NO: 243346 - DNA, 75 bp, Artificial Sequence
  Synthetic
agccacaaagggtataaaggggcatgaggggtgggcgcggtgtttcaaaatgagcgggacgacggacggcaatgc

SEQ ID NO: 243347 - DNA, 75 bp, Artificial Sequence
  Synthetic
gtttgaggggggagtgttcagcccatatctgacatctcgtcttccttcctgggcaggagttcgtcagaatgtagt

SEQ ID NO: 243348 - DNA, 75 bp, Artificial Sequence
  Synthetic
tatctgacatctcgtcttccttcctgggcaggagttcgtcagaatgtagtgggctccaccgtggacggacggccg

SEQ ID NO: 243349 - DNA, 75 bp, Artificial Sequence
  Synthetic
gtcgcccctgcaaattccgccaccctcacctatgccaccgtgggatcatcgttggacactgccgcggcagctgcc

SEQ ID NO: 243350 - DNA, 75 bp, Artificial Sequence
  Synthetic
gttggacactgccgcggcagctgccgcttctgctgccgcttctactgctcgcggcatggcggctgattttggact

SEQ ID NO: 243351 - DNA, 75 bp, Artificial Sequence
  Synthetic
atataaccaactggccactgcagctgtggcgtctcggtctctggttcaagaagatgccctgaatgtgatcttgac

SEQ ID NO: 243352 - DNA, 75 bp, Artificial Sequence
  Synthetic
tcgcctggagatcatgtcacgtcgcctggacgaactggctgcgcagatatcccaagctaaccccgataccgcttc

SEQ ID NO: 243353 - DNA, 75 bp, Artificial Sequence
  Synthetic
agaatcttaaaataaagacaaacaaatttgttgaaaagtaaaatggctttatttgttttttttggctcggtaggc

SEQ ID NO: 243354 - DNA, 75 bp, Artificial Sequence
  Synthetic
tcgggtccacctgtctcggtcgttaaggactttgtgtatgttttccaaaacacggtacagatgggcttggatgtt

SEQ ID NO: 243355 - DNA, 75 bp, Artificial Sequence
  Synthetic
aaccaagcgcgccgagatttccttttgaaaaagggtcggggggtgtacttagacccccagaccggcgaggaactc

SEQ ID NO: 243356 - DNA, 75 bp, Artificial Sequence
  Synthetic
caagtacatgggcatgaggccatctttggggtggagataggaccactgaagagcgtcatgttccggggtggtatt

SEQ ID NO: 243357 - DNA, 75 bp, Artificial Sequence
  Synthetic
gtaaatcacccagtcgtagcagggtttttgagcgtggaactggaatatgtccttcaggagcaggctaatggccaa

SEQ ID NO: 243358 - DNA, 75 bp, Artificial Sequence
  Synthetic
gggtagacccttagtgtaggtgtttacaaagcggttgagctgggagggatgcatgcggggggagatgatatgcat

SEQ ID NO: 243359 - DNA, 75 bp, Artificial Sequence
  Synthetic
cttggcttggattttgaggttagctatgttaccacccaggtctctgcgggggttcatgttatgaaggaccaccag

SEQ ID NO: 243360 - DNA, 75 bp, Artificial Sequence
  Synthetic
cacggtatagccagtgcatttggggaacttgtcatgcagtttggaggggaaggcgtggaagaatttagatacccc

SEQ ID NO: 243361 - DNA, 75 bp, Artificial Sequence
  Synthetic
aggcgtggaagaatttagatacccccttgtgcccccctaggttttccatgcactcatccataataatggcaatgg

SEQ ID NO: 243362 - DNA, 75 bp, Artificial Sequence
  Synthetic
gatctccagcggcagcggcagcgggtaaggccaaacgcgagcggcgggggtattgctcatggcgggcccacaaaa

SEQ ID NO: 243363 - DNA, 75 bp, Artificial Sequence
  Synthetic
gacccctggcggccgctttagcaaacacgttttgggggttggaaacatcatagttttgctctagagtgagctcat

SEQ ID NO: 243364 - DNA, 75 bp, Artificial Sequence
  Synthetic
tagttttgctctagagtgagctcatcataggccatctttacaaagcggggtaggagggtgcccgactgggggatg

SEQ ID NO: 243365 - DNA, 75 bp, Artificial Sequence
  Synthetic
atagttccatctgggcctggagcgtagttgccctcacagatctgcatctcccaggccttaatttccgaggggggg

SEQ ID NO: 243366 - DNA, 75 bp, Artificial Sequence
  Synthetic
ctattattaccgtcatctctacagcccctacgaaacgctcggagaaaaaagctaaggcctcctctgccgcgagga

SEQ ID NO: 243367 - DNA, 75 bp, Artificial Sequence
  Synthetic
ccctacgaaacgctcggagaaaaaagctaaggcctcctctgccgcgaggaaaaactccgccgccgctgccgccaa

SEQ ID NO: 243368 - DNA, 75 bp, Artificial Sequence
  Synthetic
atcatgtccacctggggggcgataaaaaacacggtttctggcggggggttaatgagctgggtggaaagcaagtta

SEQ ID NO: 243369 - DNA, 75 bp, Artificial Sequence
  Synthetic
aaaacacggtttctggcggggggttaatgagctgggtggaaagcaagttacgcaacagctgggatttgccgcaac

SEQ ID NO: 243370 - DNA, 75 bp, Artificial Sequence
  Synthetic
cggtgggaccgtagatgaccccgatgacgggttgcagctggtagttcagagaggaacagctgccgtcggggcgca

SEQ ID NO: 243371 - DNA, 75 bp, Artificial Sequence
  Synthetic
gacgggttgcagctggtagttcagagaggaacagctgccgtcggggcgcaggaggggagctacctcattcatcat

SEQ ID NO: 243372 - DNA, 75 bp, Artificial Sequence
  Synthetic
gcttctgacatgtttattttcactcactaagttttgcaagagcctctccccacccagggataagagttcttccag

SEQ ID NO: 243373 - DNA, 75 bp, Artificial Sequence
  Synthetic
gctgttgaagtgtttcagcggtttcaggccgtcggccatgggcatcttttcaagcgactgacgaagcaagtacag

SEQ ID NO: 243374 - DNA, 75 bp, Artificial Sequence
  Synthetic
tcggtcccagagctcggtgacgtgctctatggaatctcgatccagcagacttcttggtttcgggggttgggccga

SEQ ID NO: 243375 - DNA, 75 bp, Artificial Sequence
  Synthetic
ctttcgctgtagggcaccagccggtgggcgtccagggccgcgagggttctgtccttccagggtctcagcgttcgg

SEQ ID NO: 243376 - DNA, 75 bp, Artificial Sequence
  Synthetic
gtgagggtggtctcggtgacggtgaagggatgagccccgggctgggcgcttgcgagggtgcgcttcaggctcatc

SEQ ID NO: 243377 - DNA, 75 bp, Artificial Sequence
  Synthetic
ctgctggtgctgaagcgggcgtcgtctccctgtgagtcggccagatagcaacgaagcatgaggtcgtagctgagg

SEQ ID NO: 243378 - DNA, 75 bp, Artificial Sequence
  Synthetic
gactcggccgcgtgtcccttggcgcgcagctttcccttggaaacgtgctgacatttggtgcagtgcagacacttg

SEQ ID NO: 243379 - DNA, 75 bp, Artificial Sequence
  Synthetic
agggcgtagagttttggggccaggaagaccgactcgggcgagtaggcgtcggctccgcactgagcgcagacggtc

SEQ ID NO: 243380 - DNA, 75 bp, Artificial Sequence
  Synthetic
tcgcactccaccagccacgtgagctcgggtttagcgggatcaaaaaccaagttgcctccattttttttgatgcgt

SEQ ID NO: 243381 - DNA, 75 bp, Artificial Sequence
  Synthetic
ctcgcagccgcgctccgggggaatcggcactctccagttcgtggaagagttcgttccctccgtctacttcaaccc

SEQ ID NO: 243382 - DNA, 75 bp, Artificial Sequence
  Synthetic
gttgcctccattttttttgatgcgtttcttaccttgcgtctccatgagtctgtgtcccgcttccgtgacaaaaag

SEQ ID NO: 243383 - DNA, 75 bp, Artificial Sequence
  Synthetic
ttcttaccttgcgtctccatgagtctgtgtcccgcttccgtgacaaaaaggctgtcggtatccccgtagaccgac

SEQ ID NO: 243384 - DNA, 75 bp, Artificial Sequence
  Synthetic
ggcactctccagttcgtggaagagttcgttccctccgtctacttcaacccgttctccggctcacctggacgctac

SEQ ID NO: 243385 - DNA, 75 bp, Artificial Sequence
  Synthetic
ttgagggggcgatcttccaaaggtgttccgaggtcttccgcgtacaggaactgggaccactccgagacaaaggct

SEQ ID NO: 243386 - DNA, 75 bp, Artificial Sequence
  Synthetic
cgggtccaggctaacacgaaggaggcgatctgcgaggggtatctgtcgttttcaatgagggggtccaccttttcc

SEQ ID NO: 243387 - DNA, 75 bp, Artificial Sequence
  Synthetic
agggtgtgcagacacaggtcgtcctcctccgcgtccacgaaggtgattggcttgtaagtgtaggtcacgtgaccc

SEQ ID NO: 243388 - DNA, 75 bp, Artificial Sequence
  Synthetic
cctccgcgtccacgaaggtgattggcttgtaagtgtaggtcacgtgacccgcacccccccaaggggtataaaagg

SEQ ID NO: 243389 - DNA, 75 bp, Artificial Sequence
  Synthetic
gctactttgagctgccggacgagcaccctcagggaccggctcacgggttgaaactcgagatcgagaacgcgctcg

SEQ ID NO: 243390 - DNA, 75 bp, Artificial Sequence
  Synthetic
agtctcgcctcatcgacgccttcgccgcccggcctctcctggtagaaaccgaacgcgggaccactaccatcaccc

SEQ ID NO: 243391 - DNA, 75 bp, Artificial Sequence
  Synthetic
gggcgtgcccactctccccgtcactttcttccgcatcgctgtggaccagagccagctgttcgggtgagtaggccc

SEQ ID NO: 243392 - DNA, 75 bp, Artificial Sequence
  Synthetic
tctcaaaagccggcatgatttcggcgctcaagttgtcagtttctacaaacgaggtggatttgatattcacgtgcc

SEQ ID NO: 243393 - DNA, 75 bp, Artificial Sequence
  Synthetic
ccgcggcgatgcttttgatggtggaggggtccatctgatcagaaaacacgatctttttattgtcaagtttggtgg

SEQ ID NO: 243394 - DNA, 75 bp, Artificial Sequence
  Synthetic
cgaaagacccgtagagggcgttggaaagcaacttggcgatggagcgcagggtctgatttttctcccgatcggccc

SEQ ID NO: 243395 - DNA, 75 bp, Artificial Sequence
  Synthetic
tctccttggcggcgatgttgagttgcacgtactcgcgggccacgcaccgccactcggggaacacggcggtgcgct

SEQ ID NO: 243396 - DNA, 75 bp, Artificial Sequence
  Synthetic
cgtcgggcaggatgcgcacgcgccagccgcggttgtgcagggtgatgaggtccacgctggtggccacctccccgc

SEQ ID NO: 243397 - DNA, 75 bp, Artificial Sequence
  Synthetic
cgttggctccggtttaaatcctagttgctttcataagtggtttctacaaaaagagacccttcccaacaattctgt

SEQ ID NO: 243398 - DNA, 75 bp, Artificial Sequence
  Synthetic
tgctttcataagtggtttctacaaaaagagacccttcccaacaattctgtttctttttccaccctgtcctactgc

SEQ ID NO: 243399 - DNA, 75 bp, Artificial Sequence
  Synthetic
ggaggggctcgttggtccaacacaatcgccccccttttctggagcagaacggaggcaggggatctagcaagttgg

SEQ ID NO: 243400 - DNA, 75 bp, Artificial Sequence
  Synthetic
cgggcggggggtcggcgtcgatggtaaatatgccgggtagcagaattttattaaaataatcgatttcggtgtccg

SEQ ID NO: 243401 - DNA, 75 bp, Artificial Sequence
  Synthetic
gatactgataatctttattaactttataataattaacaccttacagtaaacatgcttgttatcctcctgctcgcc

SEQ ID NO: 243402 - DNA, 75 bp, Artificial Sequence
  Synthetic
aaatatgccgggtagcagaattttattaaaataatcgatttcggtgtccgtgtcttgcaacgcgtcttcccactt

SEQ ID NO: 243403 - DNA, 75 bp, Artificial Sequence
  Synthetic
cttcaccgccagggccctttcgtagggattcaggggcggtccccagggcatggggtgggtcagggccgaggcgta

SEQ ID NO: 243404 - DNA, 75 bp, Artificial Sequence
  Synthetic
catgccgcagatgtcgtacacgtacaggggctccctcaacaccccgatgtaagtggggtaacagcgccccccgcg

SEQ ID NO: 243405 - DNA, 75 bp, Artificial Sequence
  Synthetic
gatgctggctcgcacgtagtcgtacatctcgtgagagggagccatgagcccgtctcccaagtgggtcttgtgggg

SEQ ID NO: 243406 - DNA, 75 bp, Artificial Sequence
  Synthetic
tttttcggcccggtagaggatctgcctgaagatggcgtgggagttggaagagatagtggggcgttggaagacgtt

SEQ ID NO: 243407 - DNA, 75 bp, Artificial Sequence
  Synthetic
aaagttggctccgggcagtcccacggagtcttggatgaactgggcgtaggattcccggagcttgtccaccagggc

SEQ ID NO: 243408 - DNA, 75 bp, Artificial Sequence
  Synthetic
tgcggttaccagcacgtcgagagcgcagtagtccaacgtctcgcggaccaggttgtaggccgtctcttgtttttt

SEQ ID NO: 243409 - DNA, 75 bp, Artificial Sequence
  Synthetic
ctcccacagttcgcgattgaggaggtattcctcgcggtctttccagtactcttcggcgggaaatcctttttcgtc

SEQ ID NO: 243410 - DNA, 75 bp, Artificial Sequence
  Synthetic
cgctcggtaagaacctaacatgtaaaattcgttcacggctttgtatggacaacagcctttttctaccggcagggc

SEQ ID NO: 243411 - DNA, 75 bp, Artificial Sequence
  Synthetic
gtacgcttgagcggcctttctgagagaggtgtgggtgagggcgaaggtgtcccgcaccatcactttcaggtactg

SEQ ID NO: 243412 - DNA, 75 bp, Artificial Sequence
  Synthetic
ttttactccaattttcattgctgccattgttgtgagcttaattaccattattgtcagcctagcattttactgctt

SEQ ID NO: 243413 - DNA, 75 bp, Artificial Sequence
  Synthetic
atgtttgaagtccgtgtcgtcgcaggcgccctgttcccacagcgtgaagtcggtgcgctttttctgcctgggatt

SEQ ID NO: 243414 - DNA, 75 bp, Artificial Sequence
  Synthetic
attgttgtgagcttaattaccattattgtcagcctagcattttactgcttttgcaagcccaaaaaacctaagttt

SEQ ID NO: 243415 - DNA, 75 bp, Artificial Sequence
  Synthetic
cggtgcgctttttctgcctgggattggggagggcgaatgtgacgtcgttaaagaggattttcccggcgcggggca

SEQ ID NO: 243416 - DNA, 75 bp, Artificial Sequence
  Synthetic
tgaagttgcgagagatcctgaagggtccgggcacgtccgagcggttgttgatgacttgcgccgccaggacgatct

SEQ ID NO: 243417 - DNA, 75 bp, Artificial Sequence
  Synthetic
cgtcgaagccgttgatgttgtggcccacgatgtaaagttcgataaagcgcggctgtcccttgagggccggcgctt

SEQ ID NO: 243418 - DNA, 75 bp, Artificial Sequence
  Synthetic
ttttcaactcctcgtaggtgagacagtccggcgaggagagacccagctccgcccgggcccagtcggagagctgag

SEQ ID NO: 243419 - DNA, 75 bp, Artificial Sequence
  Synthetic
gcccgggcccagtcggagagctgagggttagccgcgaggaaagagctccacaggtcaagggctagcagagtttgc

SEQ ID NO: 243420 - DNA, 75 bp, Artificial Sequence
  Synthetic
aagcggtcgcggaactcgcgaaactttttccccacggccattttctccggcgtcaccacgtagaaagtgcagggg

SEQ ID NO: 243421 - DNA, 75 bp, Artificial Sequence
  Synthetic
cggtcgttccagacgtcccatcggagctctagggccagctcgcaggcttgacgaacgagggtctcctcgcccgag

SEQ ID NO: 243422 - DNA, 75 bp, Artificial Sequence
  Synthetic
acgtgcatgaccagcatgaagggtaccaactgtttcccgaacgagcccatccatgtgtaggtttctacgtcgtag

SEQ ID NO: 243423 - DNA, 75 bp, Artificial Sequence
  Synthetic
gtgacaaagagccgctgggtgcgcgcgtgggagccgatcgggaagaagctgatctcctgccaccagttggaggaa

SEQ ID NO: 243424 - DNA, 75 bp, Artificial Sequence
  Synthetic
tgggtgttgatgtggtgaaagtagaagtcccgccggcgcacagagcattcgtgctgatgtttgtaaaagcgaccg

SEQ ID NO: 243425 - DNA, 75 bp, Artificial Sequence
  Synthetic
cagtagtcgcagcgctgcacgctctgtatctcctgaatgagatgcgcttttcgcccgcgcaccagaaaccggagg

SEQ ID NO: 243426 - DNA, 75 bp, Artificial Sequence
  Synthetic
gggaagttgagacgggggcttggtggggcggcatccccttcgccttggcggtgggagtctgcgtctgcgccctcc

SEQ ID NO: 243427 - DNA, 75 bp, Artificial Sequence
  Synthetic
agtgctgtgccatgttaagcaggcagccctttcttacgatgtcagccttcagggacatgaactgtcttacacttt

SEQ ID NO: 243428 - DNA, 75 bp, Artificial Sequence
  Synthetic
ttctctgggtggacgacggtggggacgacgacgccccgggtgccgcaagtccagatctccgccacggaggggcgc

SEQ ID NO: 243429 - DNA, 75 bp, Artificial Sequence
  Synthetic
gccttcgcaaaaacaaaccttctgcaccatgatgggctctacctccatcacaatcacccaacaaaccggacctgt

SEQ ID NO: 243430 - DNA, 75 bp, Artificial Sequence
  Synthetic
cgacgacgccccgggtgccgcaagtccagatctccgccacggaggggcgcaggcgttgcaggaggggacgcagct

SEQ ID NO: 243431 - DNA, 75 bp, Artificial Sequence
  Synthetic
tgagggagctatcctgtgtcactgtcacgcgcctgattgtatgcccaagctaatcaaaactctctgtgctttagg

SEQ ID NO: 243432 - DNA, 75 bp, Artificial Sequence
  Synthetic
gcccgctgtccagggagtcgagggcggccgcgctgaggtcggcgggaagcgtttgcaagttcactttcagaagac

SEQ ID NO: 243433 - DNA, 75 bp, Artificial Sequence
  Synthetic
tgatatatttaaaatgtaagccagtatcaataaacttaccttaaatttgacagcaattttttggtattatcattc

SEQ ID NO: 243434 - DNA, 75 bp, Artificial Sequence
  Synthetic
cggtaagagcgtgagccaggtgcacatggtacttgatttccaggggggtgttggaagaggcgtccacggcgtaga

SEQ ID NO: 243435 - DNA, 75 bp, Artificial Sequence
  Synthetic
agcagcaccactttaccctcttcccaactctcatatgggatatgatggtgggcggcaaacttcctccaaaccctg

SEQ ID NO: 243436 - DNA, 75 bp, Artificial Sequence
  Synthetic
ggaggccgtgtccgcgcggggccaccaccgtgccccgaggaggttttatctcactcgtcgagggcgagcgccggg

SEQ ID NO: 243437 - DNA, 75 bp, Artificial Sequence
  Synthetic
aactctcatatgggatatgatggtgggcggcaaacttcctccaaaccctgaaagaaatatcggtatccacttcct

SEQ ID NO: 243438 - DNA, 75 bp, Artificial Sequence
  Synthetic
tcactcgtcgagggcgagcgccggggggtagaggcggctctgcgccggggggcagcggaggcagtggcacgtttt

SEQ ID NO: 243439 - DNA, 75 bp, Artificial Sequence
  Synthetic
tgtcctcacccacaattttcatcttttcatagatgaaaagaacccgagttgatgaagacttcaaccccgtctacc

SEQ ID NO: 243440 - DNA, 75 bp, Artificial Sequence
  Synthetic
cgtgaggattcggcagcggttgatgacgagcccggagactgctggcgtgggcgacgacgcggcggttgaggtcct

SEQ ID NO: 243441 - DNA, 75 bp, Artificial Sequence
  Synthetic
cttatgacaccacaaccactccagccgttcctttcatatcacccccgtttgtaaacagtgacggtcttcaggaaa

SEQ ID NO: 243442 - DNA, 75 bp, Artificial Sequence
  Synthetic
acgagcccggagactgctggcgtgggcgacgacgcggcggttgaggtcctggatgtgccgtctctgcgtgaagac

SEQ ID NO: 243443 - DNA, 75 bp, Artificial Sequence
  Synthetic
caccggcccccgggtcctgaacctgaaagagagttccacagaatcaatgtctgcatcgttaacggcggcctgcct

SEQ ID NO: 243444 - DNA, 75 bp, Artificial Sequence
  Synthetic
acccccccggagttttaagcctgcgaatagctaaacccctgtattttgacatggagagaaaactagccctttcac

SEQ ID NO: 243445 - DNA, 75 bp, Artificial Sequence
  Synthetic
gaggatctcctgtacgtcgcccgagttgtcttgataggcgatctcggccatgaactgctccacttcttcctcgcg

SEQ ID NO: 243446 - DNA, 75 bp, Artificial Sequence
  Synthetic
ttggaagagggctaacaattaccgcgaacggacagttagaaagcacccagagcgtgcagactaacccgccgttaa

SEQ ID NO: 243447 - DNA, 75 bp, Artificial Sequence
  Synthetic
gaggtcgccgtggcccgctcgctccacggtggcggccaggtcgttggagatgcgacgcatgagttgagagaaggc

SEQ ID NO: 243448 - DNA, 75 bp, Artificial Sequence
  Synthetic
ctgtcaccaataacaacacacttatcctacgctactcctcccctttaatcctaactgacaataatttaaccgtag

SEQ ID NO: 243449 - DNA, 75 bp, Artificial Sequence
  Synthetic
gttgaggccgttctcgttccacacgcggctgtacaccacgtttccgaaggagtcgcgcgctcgcatgaccacctg

SEQ ID NO: 243450 - DNA, 75 bp, Artificial Sequence
  Synthetic
gcttctcaagtcctctccgtgttatagacaacaaactgacattcacttttacctcacctctccgttatgaaaacg

SEQ ID NO: 243451 - DNA, 75 bp, Artificial Sequence
  Synthetic
agtcgcgcgctcgcatgaccacctgggccacgttgagttccacgtggcgggcgaagacggcgtagtttctgaggc

SEQ ID NO: 243452 - DNA, 75 bp, Artificial Sequence
  Synthetic
aaacccttaccttcaattacacagagccccttacacttatgaacagcaaccttgcgcttaacgtaaactcctcta

SEQ ID NO: 243453 - DNA, 75 bp, Artificial Sequence
  Synthetic
gcgaagacggcgtagtttctgaggcgctggaagaggtagttgagcgtggtggcgatgtgctcgcagacgaagaag

SEQ ID NO: 243454 - DNA, 75 bp, Artificial Sequence
  Synthetic
aaggccttagggttgacgggggctcactaggtacaaacctaagtcctgacttaaggtttaacagcagtggagcca

SEQ ID NO: 243455 - DNA, 75 bp, Artificial Sequence
  Synthetic
tacatgatccagcgccgcagggtcatctcgttgatgtctccgatggcttcgagacgctccatggcctcgtagaag

SEQ ID NO: 243456 - DNA, 75 bp, Artificial Sequence
  Synthetic
tagcttttggtatacaaaccctatggacacccccgacctcaaatcctaactgcaccgtttacaccgaaagcgatt

SEQ ID NO: 243457 - DNA, 75 bp, Artificial Sequence
  Synthetic
tcgacggcgaagttgaaaaattgggagttgcgggcggccaccgtgagttcttcttgcaggaggcggatgagatcg

SEQ ID NO: 243458 - DNA, 75 bp, Artificial Sequence
  Synthetic
ccttacttagtctctgtttaactaaatgcggagctcacgttttaggaagtgtaagcttaaccggggtagcaggta

SEQ ID NO: 243459 - DNA, 75 bp, Artificial Sequence
  Synthetic
gcgaccgtgtcgcgcacctcctgctcgaaagcgccccgaggcgcctctgcttcttcctccggctcctcctcttcc

SEQ ID NO: 243460 - DNA, 75 bp, Artificial Sequence
  Synthetic
cgaaagcgccccgaggcgcctctgcttcttcctccggctcctcctcttccaggggcacgggttcctccggcagct

SEQ ID NO: 243461 - DNA, 75 bp, Artificial Sequence
  Synthetic
ccatgacaaacatggctgaaacttcgcttgctattgaatttacgtttgacgacactggaaaactacttcactcac

SEQ ID NO: 243462 - DNA, 75 bp, Artificial Sequence
  Synthetic
ctgcgacggggacggggcggcgacgtcgtcgtctgaccggcaggcggtccacgaagcgctcgatcatttcgccgc

SEQ ID NO: 243463 - DNA, 75 bp, Artificial Sequence
  Synthetic
cacttgttaacaacacttttagcattcgtcagggcgacagccccgcctcaaatcctacctacaatgctctagcat

SEQ ID NO: 243464 - DNA, 75 bp, Artificial Sequence
  Synthetic
gccggcgacgcatggtctcggtgacggcgcgtccgttttcgcgaggtcgcagttcgaagacgccgccgcgcagag

SEQ ID NO: 243465 - DNA, 75 bp, Artificial Sequence
  Synthetic
ttatgccaaacagtaccctctacgctagaggaggaagtggtgaaccccgaaacaattactacgtccaaacatacc

SEQ ID NO: 243466 - DNA, 75 bp, Artificial Sequence
  Synthetic
cgcccccgtgcagggagggtaagtggttagggccgtcgggcagggacacggcgctgacgatgcattttatcaatt

SEQ ID NO: 243467 - DNA, 75 bp, Artificial Sequence
  Synthetic
tcaggggaaatgttcagagaccgattaccctcactgttactttcaactcagccgccacggggtattccttatctt

SEQ ID NO: 243468 - DNA, 75 bp, Artificial Sequence
  Synthetic
gctgcgtaggcactccgtgcagggatctgagaacgtcgaggtcgacgggatccgagaacttctctaggaaagcgt

SEQ ID NO: 243469 - DNA, 75 bp, Artificial Sequence
  Synthetic
ttaagtggactgctgttgtacgtgaaaaatttgcagctcctgcaacttcattttgctacattaccgaacaataaa

SEQ ID NO: 243470 - DNA, 75 bp, Artificial Sequence
  Synthetic
ctatccaatcgcagtcgcaaggtaagctgaggacggtgggccgctggggggcgtccgcgggcagttgggaggtga

SEQ ID NO: 243471 - DNA, 75 bp, Artificial Sequence
  Synthetic
accctgtgttcccaccgtttcgttttttccagatgaaacgggccagagttgatgaagacttcaacccagtgtacc

SEQ ID NO: 243472 - DNA, 75 bp, Artificial Sequence
  Synthetic
tgctgctgatgatgtaattaaagtaggcggtcttcaggcggcggatggtggcgaggaggaccacgtctttgggcc

SEQ ID NO: 243473 - DNA, 75 bp, Artificial Sequence
  Synthetic
cggcctgttgaatgcgcaggcgctcggccatgccccaggcctcgctctgacagcgacgcaggtctttgtagtagt

SEQ ID NO: 243474 - DNA, 75 bp, Artificial Sequence
  Synthetic
cttgcatcagtctctccaccggaacctctgcttctcccctgtctgccatgcgagtcgagccgaacccccgcaggg

SEQ ID NO: 243475 - DNA, 75 bp, Artificial Sequence
  Synthetic
gctgcagcaacgctaggtcggccacgaccctctcggccagcacggcctgttggatctgcgtgagggtggtctgga

SEQ ID NO: 243476 - DNA, 75 bp, Artificial Sequence
  Synthetic
ctaacaacaaacttgcactggtctatagggaacctttagcagtaaagcgcaacagcctaaccttatcgcacaccg

SEQ ID NO: 243477 - DNA, 75 bp, Artificial Sequence
  Synthetic
agtcgtccaggtccacgaagcggtgataggcccccgtgttgatggtgtaggtgcagttggccatgacggaccagt

SEQ ID NO: 243478 - DNA, 75 bp, Artificial Sequence
  Synthetic
gtgcagttggccatgacggaccagttgacgacttgcatgccgggttgggtgatctccgtgtacttgaggcgcgag

SEQ ID NO: 243479 - DNA, 75 bp, Artificial Sequence
  Synthetic
taggcgcgggactcgaacacgtagtcgttgcatgtgcgtaccagatactggtagccaaccaggaagtggggaggc

SEQ ID NO: 243480 - DNA, 75 bp, Artificial Sequence
  Synthetic
cgttgcatgtgcgtaccagatactggtagccaaccaggaagtggggaggcggttctcggtacaggggccagccga

SEQ ID NO: 243481 - DNA, 75 bp, Artificial Sequence
  Synthetic
ctgtggcgggggcgccgggggacaggtcgtccagcatgaggcgatggtagtggtagatgtagcgggagagccagg

SEQ ID NO: 243482 - DNA, 75 bp, Artificial Sequence
  Synthetic
tgatgccggccgaggtggtcgcggccctggtgaattcgcggacgcggttccagatgttgcgcagggggcgaaagc

SEQ ID NO: 243483 - DNA, 75 bp, Artificial Sequence
  Synthetic
cagatgttgcgcagggggcgaaagcgctccatggtgggcacgctctgccccgtgaggcgggcgcaatcttgtacg

SEQ ID NO: 243484 - DNA, 75 bp, Artificial Sequence
  Synthetic
ctctagatggaaaaaagacagggcggtcatcgactcccttccgtagctcggggggtaaagtcgcaagggtgcggc

SEQ ID NO: 243485 - DNA, 75 bp, Artificial Sequence
  Synthetic
ttcaacagcgaccccgtactagggcttaacttttacacccctcttgcagtgcgcgatgaggcgctcactgttaac

SEQ ID NO: 243486 - DNA, 75 bp, Artificial Sequence
  Synthetic
ggcggggaaccccggttcgagaccggccggatccgccgctcccgatgcgcctggccccgcatccacgacgtccgc

SEQ ID NO: 243487 - DNA, 75 bp, Artificial Sequence
  Synthetic
gtcgagacccagccgcgacgctccgccccaatacggaggggagtcttttggtgttttttcgtagatgcatccggt

SEQ ID NO: 243488 - DNA, 75 bp, Artificial Sequence
  Synthetic
gctgcggcagatgcgacctcagacgcccaccaccaccgccgcggcggcagtaaacctgagcggaggcggtgacag

SEQ ID NO: 243489 - DNA, 75 bp, Artificial Sequence
  Synthetic
ggaggaggaggagctggctttagacctggaagagggagaggggctggcccggctgggagcgccgtccccagagag

SEQ ID NO: 243490 - DNA, 75 bp, Artificial Sequence
  Synthetic
acaccctagggttcagctcgtgagggacgccaggcaggcttttgtgccgaagcagaacctgtttagggaccgcag

SEQ ID NO: 243491 - DNA, 75 bp, Artificial Sequence
  Synthetic
cggtcaggaggcggaggagatgcgcgattgcaggtttcgggcgggtagagagctgagggcgggcttcgatcggga

SEQ ID NO: 243492 - DNA, 75 bp, Artificial Sequence
  Synthetic
gcggctcctgagggcggaggatttcgagcccgacgagcgttctggggtgagcccggcccgcgctcacgtctcggc

SEQ ID NO: 243493 - DNA, 75 bp, Artificial Sequence
  Synthetic
ggccaacctggtgagcgcgtacgagcagacggtgaacgaggagcgcaacttccaaaagagctttaacaatcacgt

SEQ ID NO: 243494 - DNA, 75 bp, Artificial Sequence
  Synthetic
gaggaccctgatcgcgagggaggaggtgaccatcgggctgatgcatctgtgggacttcgtggaggcctacgtgca

SEQ ID NO: 243495 - DNA, 75 bp, Artificial Sequence
  Synthetic
gaacccggccagcaaacctctgacggcccagctgttcctgatcgtgcagcacagccgcgacaacgagacgttccg

SEQ ID NO: 243496 - DNA, 75 bp, Artificial Sequence
  Synthetic
cgacgccatgttgaacatcgcggagcccgagggtcgctggctcttggatctgattaacatcctgcagagcatcgt

SEQ ID NO: 243497 - DNA, 75 bp, Artificial Sequence
  Synthetic
cccgagggtcgctggctcttggatctgattaacatcctgcagagcatcgtggtgcaggagaggggcctcagctta

SEQ ID NO: 243498 - DNA, 75 bp, Artificial Sequence
  Synthetic
gcggacaaggtggcggccattaactattcgatgcagagcctggggaagttctacgctcgcaagatctacaagagc

SEQ ID NO: 243499 - DNA, 75 bp, Artificial Sequence
  Synthetic
attacggaagaataaaacaacttttcctttttattttctttttattttacacgcacagtaaggcttcctccgccc

SEQ ID NO: 243500 - DNA, 75 bp, Artificial Sequence
  Synthetic
ccttacgtgcccatagacaaggaggtgaagatagacagcttttacatgcgcatggcgctgaaggtgctgacgctg

SEQ ID NO: 243501 - DNA, 75 bp, Artificial Sequence
  Synthetic
ttccatttgacagcatacaccagcctctctcccttcatggcagtaaactgctgcgagccagtccggtatttggga

SEQ ID NO: 243502 - DNA, 75 bp, Artificial Sequence
  Synthetic
agcgacgacctcggcgtgtaccgtaacgacaagatccacaaggcggtgagcgccagccgccggcgggagctgagc

SEQ ID NO: 243503 - DNA, 75 bp, Artificial Sequence
  Synthetic
gttaagatccaaacagtctctttggtaatcagatgtcgatccgtgatggacacaaatccctggggcaggttctcc

SEQ ID NO: 243504 - DNA, 75 bp, Artificial Sequence
  Synthetic
cacaaatccctggggcaggttctccaacgtttcggtgaaaaactgcatgccgtcctacaaaacaaacaggttcag

SEQ ID NO: 243505 - DNA, 75 bp, Artificial Sequence
  Synthetic
gacagggagctgatgcacagcctgcagagggcgctggcgggcgccggggacgaggagcgcgaggcttacttcgac

SEQ ID NO: 243506 - DNA, 75 bp, Artificial Sequence
  Synthetic
atgggagccgatctgcagtggcgtcccagcgcgcgcgccttggaggcggcgggctaccccgacgaggaggatcgg

SEQ ID NO: 243507 - DNA, 75 bp, Artificial Sequence
  Synthetic
gacgatttggaggaggcaggcgagtacgaggacgaagcctgaccgggcaggtgttgttttagatgcagcggccgg

SEQ ID NO: 243508 - DNA, 75 bp, Artificial Sequence
  Synthetic
cggacggggccaccgcggatcccgcacttttggcatccatgcagagtcaaccttcgggcgtgaccgcctccgatg

SEQ ID NO: 243509 - DNA, 75 bp, Artificial Sequence
  Synthetic
actgggcggcggccatggaccgcattatggcgctgactacccgcaaccccgaggcttttagacagcaaccccagg

SEQ ID NO: 243510 - DNA, 75 bp, Artificial Sequence
  Synthetic
ccaaccgtttttcggccatcttggaagcggtggtgccctcccgcaccaaccccacacacgagaaagtcctgacta

SEQ ID NO: 243511 - DNA, 75 bp, Artificial Sequence
  Synthetic
tacaaacatgctacccgcatacagaacctcccggggcagtcccctgttcaccacctgcctgtaccagggaaacct

SEQ ID NO: 243512 - DNA, 75 bp, Artificial Sequence
  Synthetic
tcgtgaacgccctggtagacagcaaggccatccgccgcgacgaggcgggcttgatttacaacgctctgctggaac

SEQ ID NO: 243513 - DNA, 75 bp, Artificial Sequence
  Synthetic
gggtggcgcgctacaacagcactaacgttcagaccaatctggatcgcctcaccaccgacgtgaaggaggcgctgg

SEQ ID NO: 243514 - DNA, 75 bp, Artificial Sequence
  Synthetic
ctcagaaggagcggtttctgagggacagcaatctgggctctctggtggcactcaacgccttcctgagcacgcagc

SEQ ID NO: 243515 - DNA, 75 bp, Artificial Sequence
  Synthetic
cggccaacgtgccccgcgggcaggaggactacgtgagcttcatcagcgctctgaggctgctggtgtccgaggtgc

SEQ ID NO: 243516 - DNA, 75 bp, Artificial Sequence
  Synthetic
ggactacgtgagcttcatcagcgctctgaggctgctggtgtccgaggtgccccagagcgaggtgtatcagtctgg

SEQ ID NO: 243517 - DNA, 75 bp, Artificial Sequence
  Synthetic
gccggattacttcttccagacgtcccgacagggcttgcaaacggtgaacctgactcaggcctttaaaaacttgca

SEQ ID NO: 243518 - DNA, 75 bp, Artificial Sequence
  Synthetic
tgactcaggcctttaaaaacttgcaaggcatgtggggcgttaaggccccggtgggcgatcgagccaccatctcca

SEQ ID NO: 243519 - DNA, 75 bp, Artificial Sequence
  Synthetic
gtctgctgacccccaacactcgcctgctgctgctcttgatcgcgccgttcaccaacagtagcactatcagccgtg

SEQ ID NO: 243520 - DNA, 75 bp, Artificial Sequence
  Synthetic
gaaccacgtccgccgccaacaggtctccacgtaacgccggtccctgcgtcgctcgcgctctctcctcagtgcaaa

SEQ ID NO: 243521 - DNA, 75 bp, Artificial Sequence
  Synthetic
actcgtacctgggtcatctcatcactttgtaccgcgaggccatcggtcaggctcagatcgacgagcacacatatc

SEQ ID NO: 243522 - DNA, 75 bp, Artificial Sequence
  Synthetic
tccacgtaacgccggtccctgcgtcgctcgcgctctctcctcagtgcaaagtgcaaccactcttgtaatccacac

SEQ ID NO: 243523 - DNA, 75 bp, Artificial Sequence
  Synthetic
aggagatcactaacgtgagccgggccctgggtcaggaagataccggcagcctggaagccacgttgaactttttgc

SEQ ID NO: 243524 - DNA, 75 bp, Artificial Sequence
  Synthetic
taaccaaccggaggcaaaaaataccctcccagtttacgttaagcgccgaggaggagaggattctgcgatacgtgc

SEQ ID NO: 243525 - DNA, 75 bp, Artificial Sequence
  Synthetic
agcagtccgtgagtctgtacttgatgcgggagggcgccaccgcttccacggctttagacatgacggctcggaaca

SEQ ID NO: 243526 - DNA, 75 bp, Artificial Sequence
  Synthetic
tggaaccgtccttttactccgcccaccggccgttcattaaccgtctgatggactacttccatcgcgcggccgcca

SEQ ID NO: 243527 - DNA, 75 bp, Artificial Sequence
  Synthetic
ccggccgttcattaaccgtctgatggactacttccatcgcgcggccgccatgaacggggagtacttcaccaatgc

SEQ ID NO: 243528 - DNA, 75 bp, Artificial Sequence
  Synthetic
catcctgaatccgcattggatgcccccgtccggcttctacaccggcgagtttgacctgcccgaagccgacgacgg

SEQ ID NO: 243529 - DNA, 75 bp, Artificial Sequence
  Synthetic
ctttctttgggacgacgtgtccgacagcattttcacgccgggcaatcgccgattccagaagaaggagggcggaga

SEQ ID NO: 243530 - DNA, 75 bp, Artificial Sequence
  Synthetic
cgagctccccctctccagcgtggaggcggcctctaggggagagagtccctttcccagtctgtcttccgccagcag

SEQ ID NO: 243531 - DNA, 75 bp, Artificial Sequence
  Synthetic
gcggcctctaggggagagagtccctttcccagtctgtcttccgccagcagtggtcgggtaacgcgcccgcggttg

SEQ ID NO: 243532 - DNA, 75 bp, Artificial Sequence
  Synthetic
ccgggggagagcgactacctgaacgaccccttgctgcggccggctaggaagaaaaatttccccaacaacggggtg

SEQ ID NO: 243533 - DNA, 75 bp, Artificial Sequence
  Synthetic
gaaagcttggtggataaaatgaatcgttggaagacctacgcccaggagcagcgggagtgggaggacagtcagccg

SEQ ID NO: 243534 - DNA, 75 bp, Artificial Sequence
  Synthetic
cgaccgctggttccgccgcactggcgtcgtcagagagaagacccggacgactccgcagacgatagtagcgtgttg

SEQ ID NO: 243535 - DNA, 75 bp, Artificial Sequence
  Synthetic
ctccgcagacgatagtagcgtgttggacctgggagggagcggagccaacccctttgctcacttgcaacccaaggg

SEQ ID NO: 243536 - DNA, 75 bp, Artificial Sequence
  Synthetic
gacctgggagggagcggagccaacccctttgctcacttgcaacccaaggggcgttccagtcgcctctactaataa

SEQ ID NO: 243537 - DNA, 75 bp, Artificial Sequence
  Synthetic
aaaagacgcggaaacttaccagagccatggccacagcgtgtgtcctttcttcctctctttcttcctcggcgcggc

SEQ ID NO: 243538 - DNA, 75 bp, Artificial Sequence
  Synthetic
agggcggctcagatacatgttgacctaaaataaaaataaacattaaactaaagaagcttggcgaacggtgggata

SEQ ID NO: 243539 - DNA, 75 bp, Artificial Sequence
  Synthetic
agaatgagaagagcggtgagagtcacgccggcggcgtatgagggtccgcccccttcttacgaaagcgtgatggga

SEQ ID NO: 243540 - DNA, 75 bp, Artificial Sequence
  Synthetic
ggtaaaattcatccgaatgattaaaaagaacaacagaaacttcccaccatgtactcggttggatctcctgagcac

SEQ ID NO: 243541 - DNA, 75 bp, Artificial Sequence
  Synthetic
tcagcgaacgtgccggccacgctggaggcgccttacgttcctcccagatacctgggacctacggagggcagaaac

SEQ ID NO: 243542 - DNA, 75 bp, Artificial Sequence
  Synthetic
acagcaatacccccctcacattcatatccgccacagaaaaaaaacgtcccagatacccagtgggaatatccaacg

SEQ ID NO: 243543 - DNA, 75 bp, Artificial Sequence
  Synthetic
agcatccgttactccgagctggcacccctgtacgataccaccaaggtgtacctggtggacaacaagtcggcggac

SEQ ID NO: 243544 - DNA, 75 bp, Artificial Sequence
  Synthetic
ccctgtacgataccaccaaggtgtacctggtggacaacaagtcggcggacatcgcctccctgaattatcaaaacg

SEQ ID NO: 243545 - DNA, 75 bp, Artificial Sequence
  Synthetic
acagctgcaaagacagcaaaataatccctctgggagcaagcacaaaatcctccggtgaaaaaagaacatacatat

SEQ ID NO: 243546 - DNA, 75 bp, Artificial Sequence
  Synthetic
atcacagcaattttctgactaccgtggtgcagaacaatgacttcaccccgacggaggcgggcacgcagaccatta

SEQ ID NO: 243547 - DNA, 75 bp, Artificial Sequence
  Synthetic
tagaataaccctgttgctggggcaaaaaggcccgacgtcccagcaaatgcacatatatatgttgatcagccattg

SEQ ID NO: 243548 - DNA, 75 bp, Artificial Sequence
  Synthetic
actttgacgagcgttcccgctggggcggtcagctgaaaaccatcctgcacaccaacatgcccaacatcaacgagt

SEQ ID NO: 243549 - DNA, 75 bp, Artificial Sequence
  Synthetic
ccccgtcttaccgcgtataaagccacgaaaaagtcgagctaaaatccacccaacagcctatagctatatatacac

SEQ ID NO: 243550 - DNA, 75 bp, Artificial Sequence
  Synthetic
tcatgtccaccaacaagttcagggccaggctgatggttaaaaaggctgaaaaccagcctcccgagtacgaatggt

SEQ ID NO: 243551 - DNA, 75 bp, Artificial Sequence
  Synthetic
caacagcctatagctatatatacactccgcccaatgacgctaacaccgcaccacccacgaccaaagttcacccac

SEQ ID NO: 243552 - DNA, 75 bp, Artificial Sequence
  Synthetic
ttgagttcaccattcccgagggcaactattccgagaccatgactatcgatctgatgaacaatgcgatcgtggaca

SEQ ID NO: 243553 - DNA, 75 bp, Artificial Sequence
  Synthetic
ctattccgagaccatgactatcgatctgatgaacaatgcgatcgtggacaattacctgcaagtggggaggcagaa

SEQ ID NO: 243554 - DNA, 75 bp, Artificial Sequence
  Synthetic
ctgatgaacaatgcgatcgtggacaattacctgcaagtggggaggcagaacggggtattggaaagcgatatcggc

SEQ ID NO: 243555 - DNA, 75 bp, Artificial Sequence
  Synthetic
gtctcacaacgtcacttccgcgcgccttttcactttcccacacacgcccttcgcccgccctcgcgccaccccgcg

SEQ ID NO: 243556 - DNA, 75 bp, Artificial Sequence
  Synthetic
gtaaaatttgataccagaaacttccgactggggtgggatcccgtgaccaagctggtgatgccaggcgtgtacacc

SEQ ID NO: 243557 - DNA, 75 bp, Artificial Sequence
  Synthetic
ccggccccgcctcgctcctccccgctcattatcatattggcacgtttccagttttaaggtatattattgatgatg

SEQ ID NO: 243558 - DNA, 75 bp, Artificial Sequence
  Synthetic
aacgaggcttttcaccccgacatcgtgctgctgccggggtgcggtgtggacttcactcagagccgtttgagtaac

SEQ ID NO: 243559 - DNA, 75 bp, Artificial Sequence
  Synthetic
ctgttagggatcagaaagcgccgccccttccaagagggctttcagatcatgtatgaggacctggaaggaggtaac

SEQ ID NO: 243560 - DNA, 75 bp, Artificial Sequence
  Synthetic
gtatgaggacctggaaggaggtaacattccaggtttgctagacgtgccggcgtatgaagagagtgttaaacaggc

SEQ ID NO: 243561 - DNA, 75 bp, Artificial Sequence
  Synthetic
ggaggcgcagggacgagagattcgaggcgacacctttgccacggaacctcacgaactggtaataaaacctctgga

SEQ ID NO: 243562 - DNA, 75 bp, Artificial Sequence
  Synthetic
acaagacagtaaaaaacggagttacaacattatatccggcactatgaataccttgtaccggagctggtttctggc

SEQ ID NO: 243563 - DNA, 75 bp, Artificial Sequence
  Synthetic
aacattatatccggcactatgaataccttgtaccggagctggtttctggcttacaactacggggatcccgaaaag

SEQ ID NO: 243564 - DNA, 75 bp, Artificial Sequence
  Synthetic
ggagtgagatcatggaccatactcaccaccacggacgtgacctgcggctcgcagcaagtgtactggtccctgccg

SEQ ID NO: 243565 - DNA, 75 bp, Artificial Sequence
  Synthetic
gcagcaagtgtactggtccctgccggatatgatgcaagacccggtcaccttccgcccctccacccaagtcagcaa

SEQ ID NO: 243566 - DNA, 75 bp, Artificial Sequence
  Synthetic
cttcccggtggtgggcaccgagctgctgcccgtccatgccaagagcttctacaacgaacaggccgtctactcgca

SEQ ID NO: 243567 - DNA, 75 bp, Artificial Sequence
  Synthetic
actcattcgccagtccaccgcgcttacccacgtgttcaatcgctttcccgagaaccagattctggtgcgccctcc

SEQ ID NO: 243568 - DNA, 75 bp, Artificial Sequence
  Synthetic
cgctcctaccattaccaccgtcagtgaaaacgttcccgccctcacagatcacggaaccctgccgctgcgcagcag

SEQ ID NO: 243569 - DNA, 75 bp, Artificial Sequence
  Synthetic
tatcagtggagttcagcgcgtgaccatcaccgacgccagacgtcgaacctgtccctacgtttacaaagctcttgg

SEQ ID NO: 243570 - DNA, 75 bp, Artificial Sequence
  Synthetic
agtcgcaccttctaaacatgtccatcctcatctctcccgataacaacaccggctggggactgggctccggcaaga

SEQ ID NO: 243571 - DNA, 75 bp, Artificial Sequence
  Synthetic
tgtacggcggagccaaaaggcgctccagtcagcacccagttcgagttcggggccacttccgtgctccctggggag

SEQ ID NO: 243572 - DNA, 75 bp, Artificial Sequence
  Synthetic
cagtcagcacccagttcgagttcggggccacttccgtgctccctggggagcttacaagcgaggactctcgggccg

SEQ ID NO: 243573 - DNA, 75 bp, Artificial Sequence
  Synthetic
aacggcggtagacgataccatagatgccgtgattgccgacgcccgccggtacaaccccggaccggtcgctagcgc

SEQ ID NO: 243574 - DNA, 75 bp, Artificial Sequence
  Synthetic
gccgtgattgccgacgcccgccggtacaaccccggaccggtcgctagcgccgcctccaccgtggattccgtgatc

SEQ ID NO: 243575 - DNA, 75 bp, Artificial Sequence
  Synthetic
cgcctccaccgtggattccgtgatcgacagcgtggtagctggcgctcgggcctatgctcgccgcaagaggcggct

SEQ ID NO: 243576 - DNA, 75 bp, Artificial Sequence
  Synthetic
gcatcggagacgtcgccccaccgccgccatgctggcagccagggccgtgctgaggcgggcccggagggtaggcag

SEQ ID NO: 243577 - DNA, 75 bp, Artificial Sequence
  Synthetic
aagggctatgcgccgcgctgccgccaacgccgccgccgggagggcccgccgacaggctgcccgccaggctgctgc

SEQ ID NO: 243578 - DNA, 75 bp, Artificial Sequence
  Synthetic
gacaggctgcccgccaggctgctgccgccatcgctagcatggccagacccaggagagggaacgtgtactgggtgc

SEQ ID NO: 243579 - DNA, 75 bp, Artificial Sequence
  Synthetic
gcgattctgtgacgggagtccgagtgccggtgcgcagccgacctccccgaagttagaagatccaagctgcgaaga

SEQ ID NO: 243580 - DNA, 75 bp, Artificial Sequence
  Synthetic
cggcggtactgagtctccctgttgttatcagcccaacatgagcaagcgcaagtttaaagaagaactgctgcagac

SEQ ID NO: 243581 - DNA, 75 bp, Artificial Sequence
  Synthetic
gctggtgcctgagatctatggccctccggacgtgaagcctgacattaagccccgcgatatcaagcgtgttaaaaa

SEQ ID NO: 243582 - DNA, 75 bp, Artificial Sequence
  Synthetic
gtggtagacgatggcggagtggaatttattaggagtttcgccccgcgacgcagggttcaatggaaagggcggcgg

SEQ ID NO: 243583 - DNA, 75 bp, Artificial Sequence
  Synthetic
gtacaacgcgttttgaggccgggcaccgcggtagtttttaccccgggagagcggtcggccgttaggggtttcaaa

SEQ ID NO: 243584 - DNA, 75 bp, Artificial Sequence
  Synthetic
aggcagtacgacgaggtgtacggcgacgaggacatattggaacaggcggctcaacagatcggagaatttgcctac

SEQ ID NO: 243585 - DNA, 75 bp, Artificial Sequence
  Synthetic
ggaaagcgttcgcgtcgcgaagacctggccatcgctttagacagcggcaaccccacgcccagcctcaaacctgtg

SEQ ID NO: 243586 - DNA, 75 bp, Artificial Sequence
  Synthetic
tggccatcgctttagacagcggcaaccccacgcccagcctcaaacctgtgacgctgcagcaggtgctccccgtga

SEQ ID NO: 243587 - DNA, 75 bp, Artificial Sequence
  Synthetic
cagcccaccatccagctcatggtccctaaacggcagaggctggaagaggtcctggagaaaatgaaagtggaccca

SEQ ID NO: 243588 - DNA, 75 bp, Artificial Sequence
  Synthetic
agcatagagccggacgtcaaagtcaggccgatcaaagaagtggcccctggtctcggggtgcagacggtggatatc

SEQ ID NO: 243589 - DNA, 75 bp, Artificial Sequence
  Synthetic
cagatccccgtcacgtcagcttcgaccgccgtggaagccatggaaacgcaaacggaaacccctgccgcgatcggt

SEQ ID NO: 243590 - DNA, 75 bp, Artificial Sequence
  Synthetic
accagggaagtggcgttgcaaaccgacccctggtacgaatacgccgcccctcggcgtcagaggcgacccgctcgt

SEQ ID NO: 243591 - DNA, 75 bp, Artificial Sequence
  Synthetic
tacggccccgccaacgccatcatgccagaatatgcgctgcatccgtctatcctgcccacccccggctaccgggga

SEQ ID NO: 243592 - DNA, 75 bp, Artificial Sequence
  Synthetic
cctgcccacccccggctaccggggagtgacgtatcgcccgtcaggaacccgccgccgaacccgtcgccgccgccg

SEQ ID NO: 243593 - DNA, 75 bp, Artificial Sequence
  Synthetic
gccgccgaacccgtcgccgccgccgctcccgtcgtgctctggcccccgtgtcggtgcgccgcgtaacacgccggg

SEQ ID NO: 243594 - DNA, 75 bp, Artificial Sequence
  Synthetic
gaaagacagttaccattcccaacccgcgctaccaccctagcatcctttaatgactctgccgttttgcagatggct

SEQ ID NO: 243595 - DNA, 75 bp, Artificial Sequence
  Synthetic
ctgacttgccgcgtgcgccttcccgttccgcactatcgaggaagatctcgtcgtaggagaggcatggcgggtagt

SEQ ID NO: 243596 - DNA, 75 bp, Artificial Sequence
  Synthetic
ggtcgccggcgggctttgcgcaggcgcatgaaaggcggaattttacccgctctgatacccataatcgccgccgcc

SEQ ID NO: 243597 - DNA, 75 bp, Artificial Sequence
  Synthetic
atcggtgccatacccggcgtcgcttcagtggccttgcaagcagctcgtaataaataaacgaaggcttttgcactt

SEQ ID NO: 243598 - DNA, 75 bp, Artificial Sequence
  Synthetic
atgtcctggtcctgactattttatgcagaaagagcatggaagacatcaattttacgtcgctggctccgcggcacg

SEQ ID NO: 243599 - DNA, 75 bp, Artificial Sequence
  Synthetic
gctcgcggccgctcatgggcacctggaacgacatcggcaccagtcagctcaacgggggcgctttcaattggggga

SEQ ID NO: 243600 - DNA, 75 bp, Artificial Sequence
  Synthetic
gcctttggagcggcattaaaaactttggctccacgattaaatcctacggcagcaaagcctggaacagtagtgctg

SEQ ID NO: 243601 - DNA, 75 bp, Artificial Sequence
  Synthetic
tggctccacgattaaatcctacggcagcaaagcctggaacagtagtgctggtcagatgctccgagataaactgaa

SEQ ID NO: 243602 - DNA, 75 bp, Artificial Sequence
  Synthetic
gtcagatgctccgagataaactgaaggacaccaacttccaagaaaaagtggtcaatggggtggtgaccggcatcc

SEQ ID NO: 243603 - DNA, 75 bp, Artificial Sequence
  Synthetic
acggcgcggtagatctcgccaaccaagcggtgcagaaagagattgacaggcgtttggaaagctcgcgggtgccgc

SEQ ID NO: 243604 - DNA, 75 bp, Artificial Sequence
  Synthetic
cgcagagaggggatgaggtggaggtcgaggaagtagaagtagaggaaaagctgcccccgctggagaaagttcccg

SEQ ID NO: 243605 - DNA, 75 bp, Artificial Sequence
  Synthetic
cgaggaagtagaagtagaggaaaagctgcccccgctggagaaagttcccggtgcgcctccgagaccgcagaagcg

SEQ ID NO: 243606 - DNA, 75 bp, Artificial Sequence
  Synthetic
acccaggccagaactagaagaaactctggtgacggagagcaaggagcctccctcgtacgagcaagccttgaaaga

SEQ ID NO: 243607 - DNA, 75 bp, Artificial Sequence
  Synthetic
gggcgcctctccaccctacccaatgacaaaaccgatcgcgcctatggctcggccggtgtacgggaaggactacaa

SEQ ID NO: 243608 - DNA, 75 bp, Artificial Sequence
  Synthetic
gcctgtcacgctagagctccccccgccgccaccgccgccccccacgcgcccgaccgttccccccctgccggctcc

SEQ ID NO: 243609 - DNA, 75 bp, Artificial Sequence
  Synthetic
gtcggcgggacccgtgtccgcacccgtcgccgtgcctctgccagccgcccgcccagtggccgtggccactgccag

SEQ ID NO: 243610 - DNA, 75 bp, Artificial Sequence
  Synthetic
aaaccccagaggccagagaggagccaactggcaaagcacgctgaacagcatcgtgggcctgggagtgaaaagcct

SEQ ID NO: 243611 - DNA, 75 bp, Artificial Sequence
  Synthetic
aactggcaaagcacgctgaacagcatcgtgggcctgggagtgaaaagcctgaaacgccgccgttgctattattaa

SEQ ID NO: 243612 - DNA, 75 bp, Artificial Sequence
  Synthetic
aagtgtagctaaaaaatttcccgttgtatacgcctcctatgttaccgccagagacgcgtgactgtcgccgcgagc

SEQ ID NO: 243613 - DNA, 75 bp, Artificial Sequence
  Synthetic
gagacgcgtgactgtcgccgcgagcgccgctttcaagatggccaccccatcgatgatgccgcagtggtcttacat

SEQ ID NO: 243614 - DNA, 75 bp, Artificial Sequence
  Synthetic
cgatgatgccgcagtggtcttacatgcacatcgccgggcaggacgcctcggagtacctgagccccggtctcgtgc

SEQ ID NO: 243615 - DNA, 75 bp, Artificial Sequence
  Synthetic
agttcgcccgcgccaccgacacctacttcagcttgggaaacaagtttagaaaccccaccgtggcccccacccacg

SEQ ID NO: 243616 - DNA, 75 bp, Artificial Sequence
  Synthetic
aaccccaccgtggcccccacccacgatgtaaccacggaccgctcgcaaaggctgaccctgcgttttgtgcccgta

SEQ ID NO: 243617 - DNA, 75 bp, Artificial Sequence
  Synthetic
gaccgggaggacaccgcgtactcttacaaagtgcgctacacgctggccgtaggggacaaccgagtgctggacatg

SEQ ID NO: 243618 - DNA, 75 bp, Artificial Sequence
  Synthetic
acaaagtgcgctacacgctggccgtaggggacaaccgagtgctggacatggccagcacctactttgacatccggg

SEQ ID NO: 243619 - DNA, 75 bp, Artificial Sequence
  Synthetic
gccagcacctactttgacatccggggagtgctggatcgcggtcccagttttaagccctactcgggtaccgcgtac

SEQ ID NO: 243620 - DNA, 75 bp, Artificial Sequence
  Synthetic
aattccctggctcccaagggcgctcccaaccctgcagaatggacgaattcagacagcaaagttaaagtgagggca

SEQ ID NO: 243621 - DNA, 75 bp, Artificial Sequence
  Synthetic
caggcgccttttgttagctcgtatggtgctacagcgattacaaaagagggtattcaggtgggagtaaccttaaca

SEQ ID NO: 243622 - DNA, 75 bp, Artificial Sequence
  Synthetic
gactccggatcaacaccacagtatgcagataaaacgtatcagcctgagccgcaaattggagaactacagtggaac

SEQ ID NO: 243623 - DNA, 75 bp, Artificial Sequence
  Synthetic
agcgatgttggaaccgatgacaaaatagcaggaagagtgctaaagaaaacaacgcccatgttcccttgttacggc

SEQ ID NO: 243624 - DNA, 75 bp, Artificial Sequence
  Synthetic
tcatatgccaggcccactaatgaaaaaggaggacaggcaacaccgtccgctagtcaagacgtgcaaaatcccgaa

SEQ ID NO: 243625 - DNA, 75 bp, Artificial Sequence
  Synthetic
ttacaattttttgcctctactaatgtcgccaatacaccaaaagcagttctatatgcggaggacgtgtcaattgaa

SEQ ID NO: 243626 - DNA, 75 bp, Artificial Sequence
  Synthetic
gcgccagacactcacttggtgttcaaaccaacagtcactgaaggcattacaagttcagaggctctactgacccaa

SEQ ID NO: 243627 - DNA, 75 bp, Artificial Sequence
  Synthetic
caagctgctcccaaccgtccaaactacatagcctttagagataattttattggtctcatgtactacaatagcaca

SEQ ID NO: 243628 - DNA, 75 bp, Artificial Sequence
  Synthetic
ggtaacatgggagtactggcaggccaggcttctcagctaaatgcagttgttgacctgcaagacagaaatactgag

SEQ ID NO: 243629 - DNA, 75 bp, Artificial Sequence
  Synthetic
ctgtcctaccaactcatgttggacgccctcggagaccgcagtcggtacttttctatgtggaaccaagctgtggat

SEQ ID NO: 243630 - DNA, 75 bp, Artificial Sequence
  Synthetic
agttacgatcctgatgtaagaatcatagaaaaccatggcgtagaagatgaattgcctaattattgctttcctttg

SEQ ID NO: 243631 - DNA, 75 bp, Artificial Sequence
  Synthetic
ggaggcatggcagtaaccgacacctactcgcctataaaggttaatggaggaggcaatggatgggaagccaataac

SEQ ID NO: 243632 - DNA, 75 bp, Artificial Sequence
  Synthetic
ggcgttttcaccgaaagaggagtggaaataggttcagggaacatgtttgccatggagattaacctgcaagccaac

SEQ ID NO: 243633 - DNA, 75 bp, Artificial Sequence
  Synthetic
ctatggcgtagctttctgtactccaatattgggctgtacctgccagactctctcaaaatcactcctgacaacatc

SEQ ID NO: 243634 - DNA, 75 bp, Artificial Sequence
  Synthetic
acactcccagagaacaaaaacacctatcagtatatgaacggtcgcgtgacgccacccgggctggttgacacctac

SEQ ID NO: 243635 - DNA, 75 bp, Artificial Sequence
  Synthetic
gttaacgtgggcgcgcgctggtcccccgatgtcatggacagtattaacccttttaatcaccaccgcaacgccgga

SEQ ID NO: 243636 - DNA, 75 bp, Artificial Sequence
  Synthetic
ctccgctaccgttccatgctcctgggaaacggacgctacgtgcccttccacatccaggtgccccagaaattcttt

SEQ ID NO: 243637 - DNA, 75 bp, Artificial Sequence
  Synthetic
gcaattaaaaacctgctgctgctccccggttcctacacctacgagtggaacttccgcaaggacgtgaacatgatc

SEQ ID NO: 243638 - DNA, 75 bp, Artificial Sequence
  Synthetic
ttgcagagctcgctgggcaatgacctgcgagtggacggggccagcatccgcttcgacagcatcaacctgtacgcc

SEQ ID NO: 243639 - DNA, 75 bp, Artificial Sequence
  Synthetic
aactttttccccatggcccacaacacggcctccaccctggaagccatgctgcgcaacgacaccaacgaccaatct

SEQ ID NO: 243640 - DNA, 75 bp, Artificial Sequence
  Synthetic
ttcaacgactacctgtgcgcggccaacatgctgtaccccatccccgccaacgccaccagcgtgcccatctccatt

SEQ ID NO: 243641 - DNA, 75 bp, Artificial Sequence
  Synthetic
ccctctcgcaactgggcagccttcaggggctggagtttcacccgcctcaaaaccaaggagaccccctcgctgggc

SEQ ID NO: 243642 - DNA, 75 bp, Artificial Sequence
  Synthetic
tccgggttcgacccctacttcgtctactccggctccatcccctacctggacggcaccttctacctcaaccatact

SEQ ID NO: 243643 - DNA, 75 bp, Artificial Sequence
  Synthetic
ttcaaaaaggtgtcaatcatgttcgactcctccgtcagctggcccggcaacgaccgtctgctgacgcccaacgag

SEQ ID NO: 243644 - DNA, 75 bp, Artificial Sequence
  Synthetic
ttcgaaatcaagcgttcggtggacggtgaagggtacaacgtggctcagagcaacatgaccaaggactggttcctg

SEQ ID NO: 243645 - DNA, 75 bp, Artificial Sequence
  Synthetic
attcagatgctcagccactacaacatcggctaccagggcttctacgtgcccgaaaattacaaggaccgcatgtac

SEQ ID NO: 243646 - DNA, 75 bp, Artificial Sequence
  Synthetic
tctttcttcagaaacttccaacccatgagccgccaaattgtagattcaacggcttacactaattatcaggatgtg

SEQ ID NO: 243647 - DNA, 75 bp, Artificial Sequence
  Synthetic
aaactgccataccagcataacaactcagggttcgtgggctacatgggacccaccatgcgagaggggcaggcctac

SEQ ID NO: 243648 - DNA, 75 bp, Artificial Sequence
  Synthetic
ccggccaactatccctatcccctgattggggccaccgccgtgcccagcctcacgcagaaaaagttcctctgcgac

SEQ ID NO: 243649 - DNA, 75 bp, Artificial Sequence
  Synthetic
cgggtgatgtggaggatccccttctctagcaacttcatgtctatgggctccctcaccgacctggggcagaacatg

SEQ ID NO: 243650 - DNA, 75 bp, Artificial Sequence
  Synthetic
ctgtacgccaactccgctcacgccttggatatgacctttgaggtggatcccatggatgagcccacgcttctctat

SEQ ID NO: 243651 - DNA, 75 bp, Artificial Sequence
  Synthetic
gttctgtttgaagtcttcgacgtggtgcgcatccaccagccgcaccgcggcgtcatcgaggccgtctacctgcgc

SEQ ID NO: 243652 - DNA, 75 bp, Artificial Sequence
  Synthetic
acacctttctctgccggtaacgccaccacctaaagaagccgatgggctccagcgaacaggagctgcaggccattg

SEQ ID NO: 243653 - DNA, 75 bp, Artificial Sequence
  Synthetic
ccacctaaagaagccgatgggctccagcgaacaggagctgcaggccattgttcgcgacctgggctgcgggcccta

SEQ ID NO: 243654 - DNA, 75 bp, Artificial Sequence
  Synthetic
ttcgcgacctgggctgcgggccctactttttgggcaccttcgacaagcgttttcccggcttcatgtccccccaca

SEQ ID NO: 243655 - DNA, 75 bp, Artificial Sequence
  Synthetic
tttcccggcttcatgtccccccacaagccggcctgtgccatcgttaacacggccggacgggagaccgggggggtc

SEQ ID NO: 243656 - DNA, 75 bp, Artificial Sequence
  Synthetic
cactggctcgccttcgcctggaacccgcgtaaccgcacctgctacctgttcgacccttttggtttctccgacgaa

SEQ ID NO: 243657 - DNA, 75 bp, Artificial Sequence
  Synthetic
aggctgaagcagatctaccagttcgagtacgaggggctcctcaagcgcagcgctctggcctccacgcccgaccac

SEQ ID NO: 243658 - DNA, 75 bp, Artificial Sequence
  Synthetic
cgctctggcctccacgcccgaccactgcgtcaccctggaaaagtccacccaaacggtccaggggcccctctcggc

SEQ ID NO: 243659 - DNA, 75 bp, Artificial Sequence
  Synthetic
cgcctgcgggctcttctgttgcatgtttttgcacgccttcgtgcactggcctcacacccccatggatcacaaccc

SEQ ID NO: 243660 - DNA, 75 bp, Artificial Sequence
  Synthetic
caccatggatctgctcaccggagtgcccaacagcatgcttcacagcccccaggtcgcccccaccctgcgccgtaa

SEQ ID NO: 243661 - DNA, 75 bp, Artificial Sequence
  Synthetic
ccaggaacacctgtatcgctttctggggaaacactctgcctattttcgccgccaccggcagcgcatcgaacgggc

SEQ ID NO: 243662 - DNA, 75 bp, Artificial Sequence
  Synthetic
agagtgtaatcaataaaaaacatttttatttgacatgatacgcgcttctggcgttttattaaaaatcgaagggtt

SEQ ID NO: 243663 - DNA, 75 bp, Artificial Sequence
  Synthetic
cgagggaggggtcctcgtgcccgctggggagggacacgttgcgatactggaaacgggcgctccaacgaaactcgg

SEQ ID NO: 243664 - DNA, 75 bp, Artificial Sequence
  Synthetic
ggatcaccagccgcggcaggggcacgtcttctaggttctgcttccaaaactgccgcaccagctgcagggctccca

SEQ ID NO: 243665 - DNA, 75 bp, Artificial Sequence
  Synthetic
tgacgtcgggcgccgatatcttgaagtcgcagttagggccggagctcccgcggctgttgcggaacacggggttgg

SEQ ID NO: 243666 - DNA, 75 bp, Artificial Sequence
  Synthetic
cggctgttgcggaacacggggttggcacactggaacaccagcacgccggggttgtggatactggccagggccgtc

SEQ ID NO: 243667 - DNA, 75 bp, Artificial Sequence
  Synthetic
gggtcggtcacctccgacgcatccagatcctcggcgttgctcagggcaaacggggtcagcttgcacatctgccgc

SEQ ID NO: 243668 - DNA, 75 bp, Artificial Sequence
  Synthetic
ccaatctggggtactaggtcgcgcttgttgaggcagtcgcagcgcagagggatcaggatgcgtcgctgcccgcgt

SEQ ID NO: 243669 - DNA, 75 bp, Artificial Sequence
  Synthetic
tgcatgatagggtaactcgccgccaggaactcctccatttgacggaaggccatctgggctttgccgccctcggtg

SEQ ID NO: 243670 - DNA, 75 bp, Artificial Sequence
  Synthetic
tagaatagcccgcaggacttgctagagaatacgttatgaccgcagttgacgtcctccgcgcagcagcgggcgtct

SEQ ID NO: 243671 - DNA, 75 bp, Artificial Sequence
  Synthetic
tcgttcttcagctgaaccacgttgcggccccaacggttctggaccaccttggctctagtggggtgctccttcagc

SEQ ID NO: 243672 - DNA, 75 bp, Artificial Sequence
  Synthetic
gcccgctgtccgttctcgctggttacatccatttccaacacgtgctccttgcagaccatctccactccgtggaag

SEQ ID NO: 243673 - DNA, 75 bp, Artificial Sequence
  Synthetic
caaaacaggacgccctcctgctgggtactgcgatgctcccatacggcgcatccggtgggctcccagctcttgtgt

SEQ ID NO: 243674 - DNA, 75 bp, Artificial Sequence
  Synthetic
tccggtgggctcccagctcttgtgttttacccccgcgtaggcttccatgtaagccataaggaatctgcccatcag

SEQ ID NO: 243675 - DNA, 75 bp, Artificial Sequence
  Synthetic
ctcggtgaaggtcttctggttggtgaaggttagcggcaggccgcggtgctcctcgttcaaccaagtttgacagat

SEQ ID NO: 243676 - DNA, 75 bp, Artificial Sequence
  Synthetic
cttgcggtacaccgctccctggtcgggcagaaacttaaaagccgctctgctgtcgttgtctacgtggaacttctc

SEQ ID NO: 243677 - DNA, 75 bp, Artificial Sequence
  Synthetic
cattaacatcatcatggtttccatacccttctcccacgctgtcaccagtggtttgctgtcggggttcttcaccaa

SEQ ID NO: 243678 - DNA, 75 bp, Artificial Sequence
  Synthetic
cacggcggtagaggggccctcgccggccccgacgtccttcatggtcattctttgaaactccacggagccgtccgc

SEQ ID NO: 243679 - DNA, 75 bp, Artificial Sequence
  Synthetic
gccccgacgtccttcatggtcattctttgaaactccacggagccgtccgcgcgacgtactctgcgcaccggaggg

SEQ ID NO: 243680 - DNA, 75 bp, Artificial Sequence
  Synthetic
tagctgaagcccacctccaccacggtgccttcgccctcgctgtcggagacaatctccggggatggcggcggcgcg

SEQ ID NO: 243681 - DNA, 75 bp, Artificial Sequence
  Synthetic
aatctccggggatggcggcggcgcgggtgtcgccttgcgagccttcttcttgggagggagctgaggcgcctcctg

SEQ ID NO: 243682 - DNA, 75 bp, Artificial Sequence
  Synthetic
ctcgcgctcggggctcatctcccgcaagtagggggtaatggagctgcctgcttggttctgacggttggccattgt

SEQ ID NO: 243683 - DNA, 75 bp, Artificial Sequence
  Synthetic
atcctaggcagaaagacatggagcttatgcgcgaggaaactttaaccgccccgtcccccgtcagcgacgaagatg

SEQ ID NO: 243684 - DNA, 75 bp, Artificial Sequence
  Synthetic
tcatcgtcgaacaggacccgggctacgttacgccgcccgaggatctggaggggcctgaccggcgcgacgctagtg

SEQ ID NO: 243685 - DNA, 75 bp, Artificial Sequence
  Synthetic
cgttacgccgcccgaggatctggaggggcctgaccggcgcgacgctagtgagcggcaggaaaatgagaaagagga

SEQ ID NO: 243686 - DNA, 75 bp, Artificial Sequence
  Synthetic
gggcctgaccggcgcgacgctagtgagcggcaggaaaatgagaaagaggaggcctgctacctcctggaaggcgac

SEQ ID NO: 243687 - DNA, 75 bp, Artificial Sequence
  Synthetic
gttttgctaaagcatttcgccaggcagagcaccatagttaaggaggccttgcaagaccgctccgaggtgcccttg

SEQ ID NO: 243688 - DNA, 75 bp, Artificial Sequence
  Synthetic
gacgtcgccgcgctctcccaggcctacgaggcgaaccttttctcgcctcgagtgcctccgaagagacagcccaac

SEQ ID NO: 243689 - DNA, 75 bp, Artificial Sequence
  Synthetic
agtgcctccgaagagacagcccaacggcacctgcgagcccaacccgcgactcaacttctaccccgtgttcgccgt

SEQ ID NO: 243690 - DNA, 75 bp, Artificial Sequence
  Synthetic
accagaggcgctggccacctatcacatttttttcaaaaaccaacgcatccccctatcgtgccgggccaaccgcac

SEQ ID NO: 243691 - DNA, 75 bp, Artificial Sequence
  Synthetic
atttttttcaaaaaccaacgcatccccctatcgtgccgggccaaccgcaccgcggccgataggaatctcaggctt

SEQ ID NO: 243692 - DNA, 75 bp, Artificial Sequence
  Synthetic
aaaaacggagccaacatacctgatatcacgtcgctggaggaagtgcccaagattttcgagggtctgggtcgagat

SEQ ID NO: 243693 - DNA, 75 bp, Artificial Sequence
  Synthetic
gagaagcgggcggcgaacgctctgcagaaagaacagaaagagagtcagaacgtgctggtggagctggagggggac

SEQ ID NO: 243694 - DNA, 75 bp, Artificial Sequence
  Synthetic
aacgcgcgtctggccgtcctcaaacgctgcatagaagtctcccacttcgcctaccccgccctcaacttgccaccc

SEQ ID NO: 243695 - DNA, 75 bp, Artificial Sequence
  Synthetic
aaagttatgaaatcggtcatggatcagctgctcatcaagagagctgagcccctggatcccgaccaccccgaggcg

SEQ ID NO: 243696 - DNA, 75 bp, Artificial Sequence
  Synthetic
gaaaactcagaggacggaaagcccgtcgtcagcgacgaggagctcgagcggtggctggaaaccagggacccccaa

SEQ ID NO: 243697 - DNA, 75 bp, Artificial Sequence
  Synthetic
cagttgcaagagaggcgcaagatgatgatggcggccgtgctggtcaccgtggagctggaatgcctgcaacggttt

SEQ ID NO: 243698 - DNA, 75 bp, Artificial Sequence
  Synthetic
ttcagcgacgtggagacgctacgcaaaatcggggaatccctgcactacaccttccgccagggctacgtccgccag

SEQ ID NO: 243699 - DNA, 75 bp, Artificial Sequence
  Synthetic
gcctgcaagatctccaacgtggagctcagcaacctggtctcctacatgggcatcctccacgagaaccggctgggg

SEQ ID NO: 243700 - DNA, 75 bp, Artificial Sequence
  Synthetic
cagagcgtgctgcactgcaccttgcaaggcgaggcgcggcgggactacgtgcgagactgcatctacctcttcctc

SEQ ID NO: 243701 - DNA, 75 bp, Artificial Sequence
  Synthetic
accctcacctggcagaccgccatgggcgtctggcagcagtgcttggaagagagaaacctcaaagagctagacaaa

SEQ ID NO: 243702 - DNA, 75 bp, Artificial Sequence
  Synthetic
ctcctctgccgccagcggcgcgccctgtggtccggtttcagcgagcgcacggtcgccagcgctctggcggacatc

SEQ ID NO: 243703 - DNA, 75 bp, Artificial Sequence
  Synthetic
atcttcccggagcgcctgatgaaaaccttgcaaaacggcctgccggatttcatcagtcaaagcattttgcaaaac

SEQ ID NO: 243704 - DNA, 75 bp, Artificial Sequence
  Synthetic
catcagtcaaagcattttgcaaaacttccgctcttttgtcctggaacgctccgggatcttgcccgccatgagctg

SEQ ID NO: 243705 - DNA, 75 bp, Artificial Sequence
  Synthetic
cgcgctaccttctgactttgtccccctctcctaccgcgagtgccctcccccactgtggagccactgctacctctt

SEQ ID NO: 243706 - DNA, 75 bp, Artificial Sequence
  Synthetic
ccaactggccaactttctggcctaccactccgacctcatggaagacgtaagcggagagggtttactggagtgcca

SEQ ID NO: 243707 - DNA, 75 bp, Artificial Sequence
  Synthetic
ctgccgctgcaacctgtgcaccccccacagatcgctggcctgcaacaccgagctactcagcgaaacccaggtcat

SEQ ID NO: 243708 - DNA, 75 bp, Artificial Sequence
  Synthetic
aggtaccttcgagatccaggggccccagcagcaagagggtgcttccggcttgaagctcactccggcgctgtggac

SEQ ID NO: 243709 - DNA, 75 bp, Artificial Sequence
  Synthetic
ctcggcttacttacgcaaatttgtagccgaggactaccacgcccacaaaattcagttttacgaagaccaatctcg

SEQ ID NO: 243710 - DNA, 75 bp, Artificial Sequence
  Synthetic
accaccgaaagcccccctcacggcctgcgtcatcacccagagcaagatcctggcccaattgcaatccatcaacca

SEQ ID NO: 243711 - DNA, 75 bp, Artificial Sequence
  Synthetic
tgcgtcatcacccagagcaagatcctggcccaattgcaatccatcaaccaagcgcgccgcgatttccttttgaaa

SEQ ID NO: 243712 - DNA, 75 bp, Artificial Sequence
  Synthetic
tggcccaattgcaatccatcaaccaagcgcgccgcgatttccttttgaaaaagggtcggggggtgtacctggacc

SEQ ID NO: 243713 - DNA, 75 bp, Artificial Sequence
  Synthetic
cccagaccggcgaggaactcaacccgtccacactctccgtcgaagcagcccccccgagacatgccgcccaaggga

SEQ ID NO: 243714 - DNA, 75 bp, Artificial Sequence
  Synthetic
accgccaagcagctgatcgctcggcagagagcgaagaagcaagagctgctccagcagcaggtggaggacgaggaa

SEQ ID NO: 243715 - DNA, 75 bp, Artificial Sequence
  Synthetic
agagagcgaagaagcaagagctgctccagcagcaggtggaggacgaggaagagatgtgggacagccaggcagagg

SEQ ID NO: 243716 - DNA, 75 bp, Artificial Sequence
  Synthetic
aggtgtcagaggacgaggaggagatggaaagctgggacagcctagacgaggaggaggacgagctttcagaggaag

SEQ ID NO: 243717 - DNA, 75 bp, Artificial Sequence
  Synthetic
aggcgaccgaagaaaaaccacctgcatccagcgcgccttctctgagccgacagccgaagccccggcccccgacgc

SEQ ID NO: 243718 - DNA, 75 bp, Artificial Sequence
  Synthetic
cagccgaagccccggcccccgacgcccccggccggctcactcaaagccagccgtaggtgggacgccaccgaatct

SEQ ID NO: 243719 - DNA, 75 bp, Artificial Sequence
  Synthetic
ccagcggcagcggcaacggcagcgggtaaggccaaacgcgagcggcgggggtattgctcctggcgggcccacaaa

SEQ ID NO: 243720 - DNA, 75 bp, Artificial Sequence
  Synthetic
agcagtattgtgaactgcttgcaacactgcgggggaaacatctcctttgcccgacgctacctcctcttccatcac

SEQ ID NO: 243721 - DNA, 75 bp, Artificial Sequence
  Synthetic
ggtgtggccttccctcgcaacgttctctattattaccgtcatctctacagcccctacgaaacgctcggagaaaaa

SEQ ID NO: 243722 - DNA, 75 bp, Artificial Sequence
  Synthetic
cccctacgaaacgctcggagaaaaaagctaaggcctcctccgccgcgaggaaaaactccgccgccgctgccgccg

SEQ ID NO: 243723 - DNA, 75 bp, Artificial Sequence
  Synthetic
ccaaggatccaccggccaccgaagagctgagaaagcgcatctttcccactctgtatgctatctttcagcaaagcc

SEQ ID NO: 243724 - DNA, 75 bp, Artificial Sequence
  Synthetic
gcgggcagcaccctcagcgcgaactgaaaataaaaaaccgctccttccgctcgctcacccgcagctgtctgtacc

SEQ ID NO: 243725 - DNA, 75 bp, Artificial Sequence
  Synthetic
acaagagagaagaccagctgcagcgcaccctggacgacgccgaagcactgttcagcaaatactgctcagcgtctc

SEQ ID NO: 243726 - DNA, 75 bp, Artificial Sequence
  Synthetic
ttaaagactaaaagacccgcgctttttccccctcggccgccaaaacccacgtcatcgccagcatgagcaaggaga

SEQ ID NO: 243727 - DNA, 75 bp, Artificial Sequence
  Synthetic
ttccccctcggccgccaaaacccacgtcatcgccagcatgagcaaggagattcccaccccctacatgtggagcta

SEQ ID NO: 243728 - DNA, 75 bp, Artificial Sequence
  Synthetic
tcagccccagatgggcctggccgcgggggccgcccaggactactccagcaagatgaactggctcagcgccggccc

SEQ ID NO: 243729 - DNA, 75 bp, Artificial Sequence
  Synthetic
ccacatgatctcacgagttaacggcatccgagcccaccgaaaccagattctcttagaacaggcggcaatcaccgc

SEQ ID NO: 243730 - DNA, 75 bp, Artificial Sequence
  Synthetic
tcttagaacaggcggcaatcaccgccacaccccggcgccaactcaacccgcctagttggcccgccgcccaggtgt

SEQ ID NO: 243731 - DNA, 75 bp, Artificial Sequence
  Synthetic
atcaggaaaatccccgcccgaccacagtcctcctgccacgcgacgcggaggccgaagtcctcatgactaactctg

SEQ ID NO: 243732 - DNA, 75 bp, Artificial Sequence
  Synthetic
gggtacaattagcgggcgggtccaggtacgccaggtacagaggtcgggccgctccttactctcccgggagtataa

SEQ ID NO: 243733 - DNA, 75 bp, Artificial Sequence
  Synthetic
gtacgccaggtacagaggtcgggccgctccttactctcccgggagtataaagagggtgatcattcgaggccgagg

SEQ ID NO: 243734 - DNA, 75 bp, Artificial Sequence
  Synthetic
tatccagctcaacgacgagacggtgagctcctcaaccggtctcagacctgacggagtcttccagctcggaggagc

SEQ ID NO: 243735 - DNA, 75 bp, Artificial Sequence
  Synthetic
gggccgctcttccttcaccactcgccaggcctacctgaccctgcagagctcttcctcgcagccgcgctccggggg

SEQ ID NO: 243736 - DNA, 75 bp, Artificial Sequence
  Synthetic
aatcggcactctccagttcgtggaagagttcgttccctccgtctacttcaaccccttctccggctcgcctggacg

SEQ ID NO: 243737 - DNA, 75 bp, Artificial Sequence
  Synthetic
ctacccggacgccttcattcccaactttgacgcagtgagtgaatccgtggacggctacgactgatgacagatggt

SEQ ID NO: 243738 - DNA, 75 bp, Artificial Sequence
  Synthetic
gcggccgtgagagctcggctgcgacatctgcatcactgccgtcagcctcgctgctacgctcgggaggcgatcgtc

SEQ ID NO: 243739 - DNA, 75 bp, Artificial Sequence
  Synthetic
ttcagctactttgagctgccggacgagcaccctcagggtccggctcacgggttgaaactcgagatcgagaacgcg

SEQ ID NO: 243740 - DNA, 75 bp, Artificial Sequence
  Synthetic
ctcgagtctcgcctcatcgacaccttcaccgcccgacctctcctggtagaaatccaacgggggatcactaccatc

SEQ ID NO: 243741 - DNA, 75 bp, Artificial Sequence
  Synthetic
accctgttctgcatctgccccacgcccggattacatgaagatctgtgttgtcatctttgcgctcagtttaataaa

SEQ ID NO: 243742 - DNA, 75 bp, Artificial Sequence
  Synthetic
aactgaactttttgccgcaccttcaacgccatctgtgatttctacaacaaaaagttcttctggcaaaggtacaca

SEQ ID NO: 243743 - DNA, 75 bp, Artificial Sequence
  Synthetic
aactgtattttattctaattctacctcatctatcgtgctgaactgcgcctgcactaacgaacttatccagtggat

SEQ ID NO: 243744 - DNA, 75 bp, Artificial Sequence
  Synthetic
tgcaaacggtagtgtgtgcaagtacttttgggggaacgatatagttagtagaaataacagcctttgcgagcactg

SEQ ID NO: 243745 - DNA, 75 bp, Artificial Sequence
  Synthetic
caactcctccacactaatcctttatcccccatttgttactggatggtatatgtgcgttggctccggtttaaatcc

SEQ ID NO: 243746 - DNA, 75 bp, Artificial Sequence
  Synthetic
tagttgctttcataagtggtttctacaaaaagagacccttcccaacaattctgtttcttttttcgccctatccta

SEQ ID NO: 243747 - DNA, 75 bp, Artificial Sequence
  Synthetic
ctgctgttctccctctggttactctttcaaacctctaattggtattttagctttgatactcataatctttattaa

SEQ ID NO: 243748 - DNA, 75 bp, Artificial Sequence
  Synthetic
ctttgatactcataatctttattaactttataataattaacaacttacagtaaacatgcttgttctactgctcgc

SEQ ID NO: 243749 - DNA, 75 bp, Artificial Sequence
  Synthetic
cacatctttcgctctctctcacgccagaacaagtattgttggcgcaggttacaatgcaactcttcaatctgctta

SEQ ID NO: 243750 - DNA, 75 bp, Artificial Sequence
  Synthetic
catgccagattccgaccagataccccatattacgtggtacttacaaacctccaaacctaattcttcattttatga

SEQ ID NO: 243751 - DNA, 75 bp, Artificial Sequence
  Synthetic
aggaaacaaactctgcgatgactccgacaacagaacgcacacatttccccacccttcactacaattcgaatgcgt

SEQ ID NO: 243752 - DNA, 75 bp, Artificial Sequence
  Synthetic
aaacaaaagcttgaagctttacaacttaaagccttcagattctggcttgtaccatgctgtagttgaaaaaagtaa

SEQ ID NO: 243753 - DNA, 75 bp, Artificial Sequence
  Synthetic
tttagaagtccacagtgattacattgaattgacggttgtggacctgccacctccaaaatgtgaggtttcctcctc

SEQ ID NO: 243754 - DNA, 75 bp, Artificial Sequence
  Synthetic
ttaccttgaagttcaaggcgtggatgcctactgcctcatacacattaactgcagcaactctaaatatccagctag

SEQ ID NO: 243755 - DNA, 75 bp, Artificial Sequence
  Synthetic
aatttactataatggacaggaaagtaatcttttttattatttaacaacaagcgctggtaacggtaaacagttacc

SEQ ID NO: 243756 - DNA, 75 bp, Artificial Sequence
  Synthetic
tgactattttactgctgttgttgaattttccacctacagagaaacgtatgccaagcggccttacaatttctcata

SEQ ID NO: 243757 - DNA, 75 bp, Artificial Sequence
  Synthetic
cccgtttaacgacctttgcaatgaaatacaagcgctcgaaactggaactgattttactccaattttcattgctgc

SEQ ID NO: 243758 - DNA, 75 bp, Artificial Sequence
  Synthetic
cattgttgtaagcttaattaccattattgtcagcctagcattttactgcttttacaagcccaaaaaccctaagtt

SEQ ID NO: 243759 - DNA, 75 bp, Artificial Sequence
  Synthetic
tgaaaaacttaaactaaaacctgtcattcaacaagtgtgattttgttttccagcatggtagctgcatttctactt

SEQ ID NO: 243760 - DNA, 75 bp, Artificial Sequence
  Synthetic
ctcctctgtctacccatcattttcgtctcttcaactttcgccgcagtttcccacctggaaccagagtgcctaccg

SEQ ID NO: 243761 - DNA, 75 bp, Artificial Sequence
  Synthetic
ccttttgacgtgtatctgattctcacctttgtttgttgtatatccatttgcagtatagcctgcttttttataaca

SEQ ID NO: 243762 - DNA, 75 bp, Artificial Sequence
  Synthetic
atctttcaagccgccgactatttttacgtgcgaattgcttactttagacaccatcctgaatacagaaatcaaaac

SEQ ID NO: 243763 - DNA, 75 bp, Artificial Sequence
  Synthetic
gttgcctccttactttgtttggcatgattaagttattgctgatacttaattatttacccctaatcaactgtaatt

SEQ ID NO: 243764 - DNA, 75 bp, Artificial Sequence
  Synthetic
gtccattcaccaaaccctggtcattctacacctgttatgataaaatccccgacactcctgttgcttggctttacg

SEQ ID NO: 243765 - DNA, 75 bp, Artificial Sequence
  Synthetic
ctacacctgttatgataaaatccccgacactcctgttgcttggctttacgcagccaccgccgctttggtatttat

SEQ ID NO: 243766 - DNA, 75 bp, Artificial Sequence
  Synthetic
atctacttgccttggagtaaaattgtattttattttacacactgggtggctacatcccagagaagatttacctag

SEQ ID NO: 243767 - DNA, 75 bp, Artificial Sequence
  Synthetic
atatcctcttgtaaacgcttttcaattacagcctctgcctcctcctgatcttcttcctcgagctccctctattgt

SEQ ID NO: 243768 - DNA, 75 bp, Artificial Sequence
  Synthetic
gagctactttcaactcaccggtggagatgactgactctcaggacattaatattagtgtggaaagaatagctgctc

SEQ ID NO: 243769 - DNA, 75 bp, Artificial Sequence
  Synthetic
agcgtcagcgagaaacgcgagtgttggaatacctggaactacagcaacttaaagagtcccactggtgtgagaaag

SEQ ID NO: 243770 - DNA, 75 bp, Artificial Sequence
  Synthetic
ggaatacctggaactacagcaacttaaagagtcccactggtgtgagaaaggagtgctgtgccatgttaagcaggc

SEQ ID NO: 243771 - DNA, 75 bp, Artificial Sequence
  Synthetic
gagtgctgtgccatgttaagcaggcagccctttcctacgatgtcagcgttcagggacatgaactgtcttacactt

SEQ ID NO: 243772 - DNA, 75 bp, Artificial Sequence
  Synthetic
tgcctttgcagaaacaaaccttctgcaccatgatgggctctacctccatcacaatcacccaacaagccgggcctg

SEQ ID NO: 243773 - DNA, 75 bp, Artificial Sequence
  Synthetic
tagagggggctatcctctgtcactgtcacgcacctgattgcatgtccaaactaatcaaaactctctgtgctttag

SEQ ID NO: 243774 - DNA, 75 bp, Artificial Sequence
  Synthetic
gtgatatttttaaggtgtaaatcaataataaacttaccttaaatttgacaacaaatttctggtgacatcattcag

SEQ ID NO: 243775 - DNA, 75 bp, Artificial Sequence
  Synthetic
cagcaccactttaccctcttcccagctctcgtatgggatgcgatagtgggtggcaaacttcctccaaaccctaaa

SEQ ID NO: 243776 - DNA, 75 bp, Artificial Sequence
  Synthetic
ctctcgtatgggatgcgatagtgggtggcaaacttcctccaaaccctaaaagaaatattggtatccacttccttg

SEQ ID NO: 243777 - DNA, 75 bp, Artificial Sequence
  Synthetic
tcctcacccacaattttcatcttttcatagatgaaaagaaccagagttgatgaagacttcaaccccgtctacccc

SEQ ID NO: 243778 - DNA, 75 bp, Artificial Sequence
  Synthetic
tatgacaccacaaccactcctgcagttccctttatatcacccccctttgtaaacagcgatggtcttcaggaaaac

SEQ ID NO: 243779 - DNA, 75 bp, Artificial Sequence
  Synthetic
cccccaggtgttttaagtctgcgaatagctaaacccctatatttcgacatggagagaaaactagccctttcactt

SEQ ID NO: 243780 - DNA, 75 bp, Artificial Sequence
  Synthetic
ggaagagggttgacaattaccgccgccggacaattagaaagtacgcagagcgtacaaaccaacccaccgttgata

SEQ ID NO: 243781 - DNA, 75 bp, Artificial Sequence
  Synthetic
attaccaacaacaacacactgaccctacgtcattctccccccttaaacctaactgacaatagcttagtgctaggc

SEQ ID NO: 243782 - DNA, 75 bp, Artificial Sequence
  Synthetic
tactcgagtcctctccgcgtcacagacaacaaacttacatttaacttcacatcaccactccgttatgaaaatgaa

SEQ ID NO: 243783 - DNA, 75 bp, Artificial Sequence
  Synthetic
aaccttacttttaactatacagagcctcttaaacttataaataacagccttgccattgacatcaattcctcaaaa

SEQ ID NO: 243784 - DNA, 75 bp, Artificial Sequence
  Synthetic
ggccttagtagcgtcggaggctcactagctgtaaacctgagttcagacttaaagtttgacagcaacggatccata

SEQ ID NO: 243785 - DNA, 75 bp, Artificial Sequence
  Synthetic
gcttttggcatacaaaccctgtggaccgctccgacctcgactggcaactgcaccgtctacagcgagggcgattcc

SEQ ID NO: 243786 - DNA, 75 bp, Artificial Sequence
  Synthetic
ctacttagtctctgtttaaccaaatgcggagctcacgtcttaggaagtgtaagtttaaccggtttaacaggaacc

SEQ ID NO: 243787 - DNA, 75 bp, Artificial Sequence
  Synthetic
ataacccaaatgactgatatttctgtcaccattcaatttacatttgacaacaatggtaagctactaagctctcca

SEQ ID NO: 243788 - DNA, 75 bp, Artificial Sequence
  Synthetic
cttataaacaacgcctttagtattcgacagaatgacagtacggcctcaaaccctacctacaacgccctggcgttt

SEQ ID NO: 243789 - DNA, 75 bp, Artificial Sequence
  Synthetic
atgcctaacagtaccatatatgcaagagggggaggtggtgaaccacgaaacaactactacgtccaaacgtatctt

SEQ ID NO: 243790 - DNA, 75 bp, Artificial Sequence
  Synthetic
aggggaaatgttcaaaaaccaatcattcttactgtaacctacaactcagtcgccacaggatattccttatctttt

SEQ ID NO: 243791 - DNA, 75 bp, Artificial Sequence
  Synthetic
aagtggactgctcttgcacgtgaaaagtttgcaaccccaacaacctcgttttgctacattacagaacaataaaac

SEQ ID NO: 243792 - DNA, 75 bp, Artificial Sequence
  Synthetic
ttgctacattacagaacaataaaaccgtgtaccccaccgtttcgtttttttcagatgaaacgggcgagagttgat

SEQ ID NO: 243793 - DNA, 75 bp, Artificial Sequence
  Synthetic
gaagacttcaacccagtgtacccttatgaccccccacatgctcctgttatgcccttcattactccaccttttacc

SEQ ID NO: 243794 - DNA, 75 bp, Artificial Sequence
  Synthetic
tcctcggatgggttgcaggaaaaaccacttggagtgttaagtttaaactacagagatcccattactacgcaaaat

SEQ ID NO: 243795 - DNA, 75 bp, Artificial Sequence
  Synthetic
cacttggagtgttaagtttaaactacagagatcccattactacgcaaaatgagtctcttacaattaaactaggaa

SEQ ID NO: 243796 - DNA, 75 bp, Artificial Sequence
  Synthetic
acggcctcactctagacaaccagggacaactaacatcaaccgctggcgaagtagaacctccactcactaacgcta

SEQ ID NO: 243797 - DNA, 75 bp, Artificial Sequence
  Synthetic
acaactaacatcaaccgctggcgaagtagaacctccactcactaacgctaacaacaaacttgcactggtctatag

SEQ ID NO: 243798 - DNA, 75 bp, Artificial Sequence
  Synthetic
gtagaacctccactcactaacgctaacaacaaacttgcactggtctatagcgatcctttagcagtaaagcgcaac

SEQ ID NO: 243799 - DNA, 75 bp, Artificial Sequence
  Synthetic
agcctaaccttatcgcacaccgctccccttgttattgctgataactctttagcattgcaagtttcagagcctatt

SEQ ID NO: 243800 - DNA, 75 bp, Artificial Sequence
  Synthetic
tttataaatgacaaggacaaactagccctgcaaacagccgcgccccttgtaactaacgctggcacccttcgctta

SEQ ID NO: 243801 - DNA, 75 bp, Artificial Sequence
  Synthetic
caaagcgccgcccctttaggcattgcagaccaaaccctaaaactcctgtttaccaaccctttgtacttgcagaat

SEQ ID NO: 243802 - DNA, 75 bp, Artificial Sequence
  Synthetic
aactttctcacgttagccattgaacgaccccttgccattaccaatactggaaagctggctctacagctctcccca

SEQ ID NO: 243803 - DNA, 75 bp, Artificial Sequence
  Synthetic
ccgctacaaacagcagacacaggcttgactttgcaaaccaacgtgccattaactgtaagcaacgggaccctaggc

SEQ ID NO: 243804 - DNA, 75 bp, Artificial Sequence
  Synthetic
ttagccataaagcgcccacttattattcaggacaacaacttgtttttggacttcagagctcccctgcgtcttttc

SEQ ID NO: 243805 - DNA, 75 bp, Artificial Sequence
  Synthetic
ttcaggacaacaacttgtttttggacttcagagctcccctgcgtcttttcaacagcgacccagtactagggctta

SEQ ID NO: 243806 - DNA, 75 bp, Artificial Sequence
  Synthetic
cttcagagctcccctgcgtcttttcaacagcgacccagtactagggcttaacttttacacccctcttgcggtacg

SEQ ID NO: 243807 - DNA, 75 bp, Artificial Sequence
  Synthetic
cgatgaggcgctcactgttaacacaggccgcggcctcacagtgagttacgatggtttaattttaaatcttggtaa

SEQ ID NO: 243808 - DNA, 75 bp, Artificial Sequence
  Synthetic
ggatcttcgctttgacaacaacaccgtttctgtcgctcttagtgctgctttgcctttacaatacactgatcagct

SEQ ID NO: 243809 - DNA, 75 bp, Artificial Sequence
  Synthetic
tgcctttacaatacactgatcagcttcgccttaacgtgggcgctgggctgcgttacaatccagtgagtaagaaat

SEQ ID NO: 243810 - DNA, 75 bp, Artificial Sequence
  Synthetic
tggacgtgaaccccaatcaaaacaagggtttaacctgggaaaatgactacctcattgtaaagctaggaaatggat

SEQ ID NO: 243811 - DNA, 75 bp, Artificial Sequence
  Synthetic
taggttttgatggcgatggaaacatagctgtttctcctcaagttacatcgcctgacaccttatggaccactgccg

SEQ ID NO: 243812 - DNA, 75 bp, Artificial Sequence
  Synthetic
agctgtttctcctcaagttacatcgcctgacaccttatggaccactgccgacccatcccccaattgttccatcta

SEQ ID NO: 243813 - DNA, 75 bp, Artificial Sequence
  Synthetic
cactgatttagatgccaaaatgtggctctcgttggtaaaacaagggggtgtggttcacggttctgttgctttaaa

SEQ ID NO: 243814 - DNA, 75 bp, Artificial Sequence
  Synthetic
agcattgaaaggaaccctattgagtcctacggaaagcgccattgttattatactacattttgacaattatggagt

SEQ ID NO: 243815 - DNA, 75 bp, Artificial Sequence
  Synthetic
gcgaattctcaattatcccactttgggcactcaaggcacgttgggaaataatgcaacttggggttataggcaggg

SEQ ID NO: 243816 - DNA, 75 bp, Artificial Sequence
  Synthetic
agaatctgcagacactaatgtactcaatgcactagcatttatgcccagttcaaaaaggtacccaagagggcgtgg

SEQ ID NO: 243817 - DNA, 75 bp, Artificial Sequence
  Synthetic
aatgcactagcatttatgcccagttcaaaaaggtacccaagagggcgtggaagcgaagttcagaatcaaactgtg

SEQ ID NO: 243818 - DNA, 75 bp, Artificial Sequence
  Synthetic
ggctacacttgtatacagggtgacttttctatgcccgtaccgtaccaaatacagtacaactatggaccaactggc

SEQ ID NO: 243819 - DNA, 75 bp, Artificial Sequence
  Synthetic
tactcctttaaatttatttggagaactgtttcaagacaaccatttgacatcccatgctgttttttctcttacatt

SEQ ID NO: 243820 - DNA, 75 bp, Artificial Sequence
  Synthetic
cccatgctgttttttctcttacattacggaagaataaaacaactttttctttttattttctttttattttacacg

SEQ ID NO: 243821 - DNA, 75 bp, Artificial Sequence
  Synthetic
cacagtaaggcttcctccacccttccatctcacagcatacaccagcctctcccccttcatggcagtaaactgttg

SEQ ID NO: 243822 - DNA, 75 bp, Artificial Sequence
  Synthetic
tgagtcagtccggtatttgggagttaagatccaaacagtctctttggtgatgaaacatggatccgtgatggacac

SEQ ID NO: 243823 - DNA, 75 bp, Artificial Sequence
  Synthetic
tgaaacatggatccgtgatggacacaaatccctgggacaggttctccaacgtttcggtaaaaaactgcatgccgc

SEQ ID NO: 243824 - DNA, 75 bp, Artificial Sequence
  Synthetic
cctacaaaacaaacaggttcaggctctccacgggttatctccccgatcaaactcagacagagtaaaggtgcgatg

SEQ ID NO: 243825 - DNA, 75 bp, Artificial Sequence
  Synthetic
atgttccactaaaccacgcaggtggcgctgtctgaacctctcggtgcgactcctgtgaggctggtaagaagttag

SEQ ID NO: 243826 - DNA, 75 bp, Artificial Sequence
  Synthetic
attgtccagcagcctcacagcatggatcatcagtctacgagtgcgtctggcgcagcagcgcatctgaatctcact

SEQ ID NO: 243827 - DNA, 75 bp, Artificial Sequence
  Synthetic
gagattccggcaagaatcgcacaccatcacaatcaggttgttcatgatcccatagctgaacacgctccagccaaa

SEQ ID NO: 243828 - DNA, 75 bp, Artificial Sequence
  Synthetic
gctcattcgctccaacagcgccaccgcgtgtccgtccaaccttactttaacataaatcaggtgtctgccgcgtac

SEQ ID NO: 243829 - DNA, 75 bp, Artificial Sequence
  Synthetic
gcgtgtccgtccaaccttactttaacataaatcaggtgtctgccgcgtacaaacatgctacccgcatacagaacc

SEQ ID NO: 243830 - DNA, 75 bp, Artificial Sequence
  Synthetic
cataaatcaggtgtctgccgcgtacaaacatgctacccgcatacagaacctcccggggcaaacccctgttcacca

SEQ ID NO: 243831 - DNA, 75 bp, Artificial Sequence
  Synthetic
cctgcctgtaccagggaaacctcacatttatcagggagccatagatagccattttaaaccaattagctaacaccg

SEQ ID NO: 243832 - DNA, 75 bp, Artificial Sequence
  Synthetic
ccccaccagctctacactgaagagaaccgggagagttacaatgacagtgaataatccatctctcataacccctaa

SEQ ID NO: 243833 - DNA, 75 bp, Artificial Sequence
  Synthetic
tggtctgatggaaatccagatctaacgtggcacagcagatacacactttcatatacattttcatcacatgttttt

SEQ ID NO: 243834 - DNA, 75 bp, Artificial Sequence
  Synthetic
cccaggccgttaaaatacaatcccaatacacgggccactcctgcagtacaataaagctaatacaagatggtatac

SEQ ID NO: 243835 - DNA, 75 bp, Artificial Sequence
  Synthetic
tcctcacctcactaacattgtgcatgttcatattttcacattctaagtaccgagagttctcctctacaacagcac

SEQ ID NO: 243836 - DNA, 75 bp, Artificial Sequence
  Synthetic
tgccgcggtcctcacaaggtggtagctggtgacgattgtaaggagccagtctgcagcgataccgtctgtcgcgtt

SEQ ID NO: 243837 - DNA, 75 bp, Artificial Sequence
  Synthetic
ctgcagcgataccgtctgtcgcgttgcatcgtagaccagggaccgacgcacttcctcgtacttgtagtagcagaa

SEQ ID NO: 243838 - DNA, 75 bp, Artificial Sequence
  Synthetic
ccacgtccgctgccagcacgtctccaagtaacgccggtccctgcgtcgctcacgctccctcctcaacgcaaagtg

SEQ ID NO: 243839 - DNA, 75 bp, Artificial Sequence
  Synthetic
caaccactcttgtaatccacacagatccctctcggcctccggggcgatgcacacctcaaacctacagatgtctcg

SEQ ID NO: 243840 - DNA, 75 bp, Artificial Sequence
  Synthetic
gtacagttccaaacacgtagtgagggcgagttccaaccaagacagacagcctgatctatcccgacacactggagg

SEQ ID NO: 243841 - DNA, 75 bp, Artificial Sequence
  Synthetic
tggaggaagacacggaagaggcatgttattccaagcgattcaccaacgggtcgaaatgaagatcccgaagatgac

SEQ ID NO: 243842 - DNA, 75 bp, Artificial Sequence
  Synthetic
aacggtcgcctccggagccctgatggaatttaacagccagatcaaacattatgcgattttccaggctatcaatcg

SEQ ID NO: 243843 - DNA, 75 bp, Artificial Sequence
  Synthetic
cggcctccaaaagagcctggacccgcacttccacaaacaccagcaaagcaaaagcgttattatcaaactcttcga

SEQ ID NO: 243844 - DNA, 75 bp, Artificial Sequence
  Synthetic
tcatcaagctgcaggactgtacaatgcccaagtaattttcatttctccactcgcgaatgatgtcgcggcaaatag

SEQ ID NO: 243845 - DNA, 75 bp, Artificial Sequence
  Synthetic
tctgaaggttcatgccgtgcatattaaaaagctccgaaagggcgccctctatagccatgcgtagacacaccatca

SEQ ID NO: 243846 - DNA, 75 bp, Artificial Sequence
  Synthetic
tgactgcaagatatcgggctcctgagacacctgcagcagatttaacagacccaggtcaggttgctctccgcgatc

SEQ ID NO: 243847 - DNA, 75 bp, Artificial Sequence
  Synthetic
gcgaatctccatccgcaaagtcatttgcaaataattaaatagatctgcgccgactaaatctgttaactccgcgct

SEQ ID NO: 243848 - DNA, 75 bp, Artificial Sequence
  Synthetic
aggaactaaatcaggtgtggctacgcagcacaaaagttccagggatggcgccaaactcactagaaccgctcccga

SEQ ID NO: 243849 - DNA, 75 bp, Artificial Sequence
  Synthetic
gtagcaaaactgatgaatgggagtaacacagtgtaaaatgttcagccaaaaatcactaagctgctcctttaaaaa

SEQ ID NO: 243850 - DNA, 75 bp, Artificial Sequence
  Synthetic
gtccagtacttctatattcagttcgtgcaagtactgaagcaactgtgcgggaatatgcacagcaaaaaaaatagg

SEQ ID NO: 243851 - DNA, 75 bp, Artificial Sequence
  Synthetic
tgcaagtactgaagcaactgtgcgggaatatgcacagcaaaaaaaatagggcggctcagatacatgttgacctaa

SEQ ID NO: 243852 - DNA, 75 bp, Artificial Sequence
  Synthetic
gaatatgcacagcaaaaaaaatagggcggctcagatacatgttgacctaaaataaaaagaatcattaaactaaag

SEQ ID NO: 243853 - DNA, 75 bp, Artificial Sequence
  Synthetic
aagcctggcgaacggtgggatatatgacacgctccagcagcaggcaagcaaccggctgtccccgggaaccgcggt

SEQ ID NO: 243854 - DNA, 75 bp, Artificial Sequence
  Synthetic
aaaattcatccgaatgattaaaaagaacaacagagacttcccaccatgtactcggttggatctcctgagcacaga

SEQ ID NO: 243855 - DNA, 75 bp, Artificial Sequence
  Synthetic
gcaatacccccctcacattcatatccgctacagaaaaaaaacgtcccagatacccagcgggaatatccaacgaca

SEQ ID NO: 243856 - DNA, 75 bp, Artificial Sequence
  Synthetic
gctgcaaagacagcaaaacaatccctctgggagcaatcacaaaatcctccggtgaaaaaagcacatacatattag

SEQ ID NO: 243857 - DNA, 75 bp, Artificial Sequence
  Synthetic
aataaccctgttgctggggcaaaaaggcccgtcgtcccagcaaatgcacataaatatgttcatcagccattgccc

SEQ ID NO: 243858 - DNA, 75 bp, Artificial Sequence
  Synthetic
cgtcttaccgcgtaaacagccacgaaaaaatcgagctaaaatccacccaacagcctatagctatatatacactcc

SEQ ID NO: 243859 - DNA, 75 bp, Artificial Sequence
  Synthetic
aaaaatcgagctaaaatccacccaacagcctatagctatatatacactccacccaatgacgctaataccgcacca

SEQ ID NO: 243860 - DNA, 75 bp, Artificial Sequence
  Synthetic
cccacgaccaaagttcacccacacccacaaaacccgcgaaaatccagcgccgtcagcacttccgcaatttcagtc

SEQ ID NO: 243861 - DNA, 75 bp, Artificial Sequence
  Synthetic
cgtcagcacttccgcaatttcagtctcacaacgtcacttccgcgcgccttttcactttcccacacacgcccttcg

SEQ ID NO: 243862 - DNA, 75 bp, Artificial Sequence
  Synthetic
tcacaacgtcacttccgcgcgccttttcactttcccacacacgcccttcgcccgcccgccctcgcgccaccccgc

SEQ ID NO: 243863 - DNA, 75 bp, Artificial Sequence
  Synthetic
gtcaccccacgtcaccgcacgtcaccccggccccgcctcgctcctccccgctcattatcatattggcacgtttcc

SEQ ID NO: 243864 - DNA, 75 bp, Artificial Sequence
  Synthetic
cccggccccgcctcgctcctccccgctcattatcatattggcacgtttccagaataaggtatattattgatgatg

SEQ ID NO: 243865 - DNA, 75 bp, Artificial Sequence
  Synthetic
catcatcaataatataccttaaaactggaaacgtgccaatatgataatgagcggggaggagcgaggcggggccgg

SEQ ID NO: 243866 - DNA, 75 bp, Artificial Sequence
  Synthetic
ggtgacgtgggaatggggagaggggcggggcggggcgaggttcgcaggcgggcgtggggaggcgcttagctttta

SEQ ID NO: 243867 - DNA, 75 bp, Artificial Sequence
  Synthetic
cgtatgcggaaggaggttttatgccggaagttgggtaatttgggcgtatacttgtaagttttgtgtaaattggcg

SEQ ID NO: 243868 - DNA, 75 bp, Artificial Sequence
  Synthetic
ggaagttgggtaatttgggcgtatacttgtaagttttgtgtaaattggcgcgaaaactgggtaatgaggaagttg

SEQ ID NO: 243869 - DNA, 75 bp, Artificial Sequence
  Synthetic
tacgaggaatgtctgccttctagcgattctgaaacggaacaaacagggggagacggctgtactgagccggtagtg

SEQ ID NO: 243870 - DNA, 75 bp, Artificial Sequence
  Synthetic
aaaaatgaacctgtattagaccgtcctgatcaacctggtcatggctgccgtgcctgtgcttttcatagaaatgcc

SEQ ID NO: 243871 - DNA, 75 bp, Artificial Sequence
  Synthetic
agcggaaatcctgaaactctatgtgctctgtgttacctgcgtcttaccagcgattttgtatacagtaagtaggag

SEQ ID NO: 243872 - DNA, 75 bp, Artificial Sequence
  Synthetic
ctttttcgatttgcgcatggtggtgggattgttaaagtgtgttgggcttattgcttgtgtaatgttttacaggtg

SEQ ID NO: 243873 - DNA, 75 bp, Artificial Sequence
  Synthetic
acgtgtctgacgcggaaggggacggagatagatcagggtctgctaattctccttgcactttgggggctgtggttc

SEQ ID NO: 243874 - DNA, 75 bp, Artificial Sequence
  Synthetic
cagttggcattattaaacccgtggcggtcagagtctcaggcagacggtgtgcagttgaaaaattggaagacttgc

SEQ ID NO: 243875 - DNA, 75 bp, Artificial Sequence
  Synthetic
tacaggaagaacagacggaacctttggacctatccatgaaacgccctaagctgacctaagtgtgtttattgcatg

SEQ ID NO: 243876 - DNA, 75 bp, Artificial Sequence
  Synthetic
ggacctatccatgaaacgccctaagctgacctaagtgtgtttattgcatgtaataaaagtgttgatctttgaact

SEQ ID NO: 243877 - DNA, 75 bp, Artificial Sequence
  Synthetic
gtgtttatgtgttgggtgtgtctgtgggtatataagcaggtgaatgggaagtgagagcacagctgccttaatgga

SEQ ID NO: 243878 - DNA, 75 bp, Artificial Sequence
  Synthetic
tctcttggggaacttgagggaatttgacgtggttcgccgcttgctggagttggcctctgacaaaacttccaggct

SEQ ID NO: 243879 - DNA, 75 bp, Artificial Sequence
  Synthetic
ttggaggttttggtttggctcaacgcttagcagcgtagtttatagggtaaaaagagagcaggaggcgcagtttgc

SEQ ID NO: 243880 - DNA, 75 bp, Artificial Sequence
  Synthetic
aacctcttgtacaagtatgggtttgagcagttgaaaactcactggttggagccgtgggaggatatggaaatggct

SEQ ID NO: 243881 - DNA, 75 bp, Artificial Sequence
  Synthetic
tcgccgcactgttaatataaaaaagagtgtttatgttattggtcatggagctctggtgcaggtgcagaccccaga

SEQ ID NO: 243882 - DNA, 75 bp, Artificial Sequence
  Synthetic
gtttgaatggagttacatttcaaaatgtcagatttactggtgataattttaatggctctgtgtttgtgactagca

SEQ ID NO: 243883 - DNA, 75 bp, Artificial Sequence
  Synthetic
ggtgctagacgcggcgtgtttatgccttaccaatgtaactttagccatactaagattttgctggaaactgattcc

SEQ ID NO: 243884 - DNA, 75 bp, Artificial Sequence
  Synthetic
gggcggagccacaaagggtataaagtggcatgaggggtgggcgcggtgtttcaaaatgagcgggacgacggacgg

SEQ ID NO: 243885 - DNA, 75 bp, Artificial Sequence
  Synthetic
tggcatgaggggtgggcgcggtgtttcaaaatgagcgggacgacggacggcaacgcgtttgaggggggagtgttc

SEQ ID NO: 243886 - DNA, 75 bp, Artificial Sequence
  Synthetic
gctgccgcttctgctgccgcttctactgctcgcggcatggcggctgattttggactgtataaccaattggccact

SEQ ID NO: 243887 - DNA, 75 bp, Artificial Sequence
  Synthetic
gcagctgtggcatctcggtctctggttcaagaagatgccctgaatgtggtgctgcttcggctggaggatctgtct

SEQ ID NO: 243888 - DNA, 75 bp, Artificial Sequence
  Synthetic
cggcgcttggatcaactagctgcgcagatatccccatctaactccgattctacagaatcttaaataaagacaaat

SEQ ID NO: 243889 - DNA, 75 bp, Artificial Sequence
  Synthetic
aaatttgttgaaaataaacggctttatttgttttttttggctcggtaggctcgggtccacctgtcccggtcgtta

SEQ ID NO: 243890 - DNA, 75 bp, Artificial Sequence
  Synthetic
aggaccttgtgtatgttttccaagacccggtacagatgggcttggatgttcaagtacatgggcatgaggccatcc

SEQ ID NO: 243891 - DNA, 75 bp, Artificial Sequence
  Synthetic
cgggggtggagataggaccattgcagagcgtcatgctccggggtggtgttgtaaataacccagtcgtagcagggt

SEQ ID NO: 243892 - DNA, 75 bp, Artificial Sequence
  Synthetic
ttctgagcgtggaactggaagatgtcctttaggagcaggctgatggccaagggcagccccttagtgtaggtgtta

SEQ ID NO: 243893 - DNA, 75 bp, Artificial Sequence
  Synthetic
acaaagcggttaagctgggagggatgcatgcggggggagatgatatgcatcttggcttgaattttgaggttagct

SEQ ID NO: 243894 - DNA, 75 bp, Artificial Sequence
  Synthetic
atgttaccacctaggtccctgcgggggttcatgttatgaaggaccaccagcacggtgtagccggtgcacttgggg

SEQ ID NO: 243895 - DNA, 75 bp, Artificial Sequence
  Synthetic
aacttgtcatgcagtttggaggggaaggcgtggaagaatttagagacccccttgtggcctcctaggttttccatg

SEQ ID NO: 243896 - DNA, 75 bp, Artificial Sequence
  Synthetic
aggcgtggaagaatttagagacccccttgtggcctcctaggttttccatgcactcatccataatgatggcaatgg

SEQ ID NO: 243897 - DNA, 75 bp, Artificial Sequence
  Synthetic
atagttccatctgggcctggggcgtagttgccctcacaaatctgcatttcccaggccttaatttccgaggggggt

SEQ ID NO: 243898 - DNA, 75 bp, Artificial Sequence
  Synthetic
atcatgtccacctggggggcgataaagaacacggtttctggcgggggattgatgagctgggtggaaagcaagtta

SEQ ID NO: 243899 - DNA, 75 bp, Artificial Sequence
  Synthetic
agaacacggtttctggcgggggattgatgagctgggtggaaagcaagttacgcaacagttgggatttgccgcagc

SEQ ID NO: 243900 - DNA, 75 bp, Artificial Sequence
  Synthetic
gacgggttgcagctggtagttgagagaggaacagctgccgtcggggcgcaggaggggggctacatcgttcatcat

SEQ ID NO: 243901 - DNA, 75 bp, Artificial Sequence
  Synthetic
ttcttaccttgcgtctccatgagtctgtgtccagcttccgtgacaaaaaggctgtcggtgtccccgtagaccgac

SEQ ID NO: 243902 - DNA, 75 bp, Artificial Sequence
  Synthetic
tctcaaaagccggcatgatctcggcgctcaagttgtcagtttctacgaaagaggaggatttgatattcacgtgcc

SEQ ID NO: 243903 - DNA, 75 bp, Artificial Sequence
  Synthetic
cgggcggggggtcggcgtcgatggtgaagatgccgggtagcaaaacctgattaaaataatcgatttgtgtgtccg

SEQ ID NO: 243904 - DNA, 75 bp, Artificial Sequence
  Synthetic
gaagatgccgggtagcaaaacctgattaaaataatcgatttgtgtgtccgtgtcttgcaacgcctcgtcccactt

SEQ ID NO: 243905 - DNA, 75 bp, Artificial Sequence
  Synthetic
cggtgcgctttttctgcctgggattggggagggcgaaggtgacgtcgttaaagaggattttcccggcacggggca

SEQ ID NO: 243906 - DNA, 75 bp, Artificial Sequence
  Synthetic
cgacgacgccccgtgtgccgcaagtccagatctccgccacggaggggcgcaggcgctgcaggagggggcgcagct

SEQ ID NO: 243907 - DNA, 75 bp, Artificial Sequence
  Synthetic
ggaggccgtgtccgcgcggggctaccaccgtgccccgaggagactttatctcactcgtcgagggcgagcgccggg

SEQ ID NO: 243908 - DNA, 75 bp, Artificial Sequence
  Synthetic
tcactcgtcgagggcgagcgccggggggcagaggcggctctgcgccggggggcgatggaggcagaggcacgtttt

SEQ ID NO: 243909 - DNA, 75 bp, Artificial Sequence
  Synthetic
gcgaccgtgtcgcgtacctcctgttcgaaagcgccccgaggcgcctctgcttcttcctccggctcctcctcttcc

SEQ ID NO: 243910 - DNA, 75 bp, Artificial Sequence
  Synthetic
cgaaagcgccccgaggcgcctctgcttcttcctccggctcctcctcttccaggggcacaggttcctccgccagct

SEQ ID NO: 243911 - DNA, 75 bp, Artificial Sequence
  Synthetic
taggccctggactcgaacacgtagtcgttgcatgtgcgcaccagatactggtagccgaccaggaagtgaggaggc

SEQ ID NO: 243912 - DNA, 75 bp, Artificial Sequence
  Synthetic
cgttgcatgtgcgcaccagatactggtagccgaccaggaagtgaggaggcggctctcggtacaggggccagccga

SEQ ID NO: 243913 - DNA, 75 bp, Artificial Sequence
  Synthetic
cagatgttgcgcagggggcgaaagcgttccatggtgggcacgctctgccccgtgaggcgggcgcagtcctgtacg

SEQ ID NO: 243914 - DNA, 75 bp, Artificial Sequence
  Synthetic
cccgagggtcgctggctcttggatctgattaacatcctgcagagcatcgtggtgcaggagaggggcctgagttta

SEQ ID NO: 243915 - DNA, 75 bp, Artificial Sequence
  Synthetic
cggacggggccaccgcggatcccgcaattttggcatccctgcaaagtcaaccttcgggcgtgaccgcctccgatg

SEQ ID NO: 243916 - DNA, 75 bp, Artificial Sequence
  Synthetic
actgggcggcggccatggaccgcatcatggcgctgaccacccgcaaccccgaggcttttaggcagcaaccccagg

SEQ ID NO: 243917 - DNA, 75 bp, Artificial Sequence
  Synthetic
ccaaccgtttttcggccatcttggaagcggtggtaccgtcgcgcaccaacccgacgcacgagaaagtcctgacta

SEQ ID NO: 243918 - DNA, 75 bp, Artificial Sequence
  Synthetic
tcgtaaacgccctggtagacagcaaagctatccgccgcgacgaggcggggctgatctacaacgctctgttggaac

SEQ ID NO: 243919 - DNA, 75 bp, Artificial Sequence
  Synthetic
ggactacgtgagcttcatcagcgctctgaggctgctggtgtccgaggtgccacagagcgaggtgtaccagtctgg

SEQ ID NO: 243920 - DNA, 75 bp, Artificial Sequence
  Synthetic
tgactcaggcctttaaaaatttgcaaggcatgtggggcgtcaaggccccggtgggcgatcgcgccactatctcca

SEQ ID NO: 243921 - DNA, 75 bp, Artificial Sequence
  Synthetic
actcgtacctgggtcatctcatcactctgtaccgcgaggccatcggccaggctcagatcgacgagcatacgtatc

SEQ ID NO: 243922 - DNA, 75 bp, Artificial Sequence
  Synthetic
tggaaccgtccttttactccgcccaccgaccgttcattaaccgtttgatggactacttccatcgcgcggccgcca

SEQ ID NO: 243923 - DNA, 75 bp, Artificial Sequence
  Synthetic
ccgaccgttcattaaccgtttgatggactacttccatcgcgcggccgccatggacggggagtattttaccaatgc

SEQ ID NO: 243924 - DNA, 75 bp, Artificial Sequence
  Synthetic
ctttctgtgggacgacgtgtccgatagcattttcacgccggccaatcgccgattccagaagaaggagggcggaga

SEQ ID NO: 243925 - DNA, 75 bp, Artificial Sequence
  Synthetic
cgagctccccctctccagcgtggaagctgcctctaggggagagagcccctttcccagtctgtcttccgccagcag

SEQ ID NO: 243926 - DNA, 75 bp, Artificial Sequence
  Synthetic
gctgcctctaggggagagagcccctttcccagtctgtcttccgccagcagtggtcgtgtcacgcgcccacggttg

SEQ ID NO: 243927 - DNA, 75 bp, Artificial Sequence
  Synthetic
cctttgctcacttgcaacccaaagggcgttcgagtcgcctgtactaataaaaaaagacgcggaaacttaccagag

SEQ ID NO: 243928 - DNA, 75 bp, Artificial Sequence
  Synthetic
aattacctgcaagtggggaggcagaacggggtgctggagagcgatatcggcgtaaaatttgataccagaaacttc

SEQ ID NO: 243929 - DNA, 75 bp, Artificial Sequence
  Synthetic
cattccaggtttgctagacgtgccggcgtatgaagagagtgttgagagtgttaaacaggcggaggcgcagggacg

SEQ ID NO: 243930 - DNA, 75 bp, Artificial Sequence
  Synthetic
acggagttacaacattatatccggcactatgaataccttgtaccggagctggtttctggcttacaactacggcga

SEQ ID NO: 243931 - DNA, 75 bp, Artificial Sequence
  Synthetic
actatgaataccttgtaccggagctggtttctggcttacaactacggcgatcccgagaagggagtgagatcatgg

SEQ ID NO: 243932 - DNA, 75 bp, Artificial Sequence
  Synthetic
aggtcagcaactttccggtggtgggcaccgagctgctgcccgtccatgccaagagcttctacaacgagcaggccg

SEQ ID NO: 243933 - DNA, 75 bp, Artificial Sequence
  Synthetic
caccgagctgctgcccgtccatgccaagagcttctacaacgagcaggccgtttactcgcaactcattcgccagtc

SEQ ID NO: 243934 - DNA, 75 bp, Artificial Sequence
  Synthetic
gcgcgtgaccatcaccgacgccagacgtcgaacctgtccctacgtttacaaagctcttggcgtagtggctcccaa

SEQ ID NO: 243935 - DNA, 75 bp, Artificial Sequence
  Synthetic
agttctctctagtcgcaccttctaaacatgtccatcctcatctctcccgataacaacaccggctggggactgggc

SEQ ID NO: 243936 - DNA, 75 bp, Artificial Sequence
  Synthetic
aaaggcgctccagtcagcacccagttcgagttcggggccacttccgcgctccctggggagcttacaagcgaggac

SEQ ID NO: 243937 - DNA, 75 bp, Artificial Sequence
  Synthetic
tcgagttcggggccacttccgcgctccctggggagcttacaagcgaggactctctggccgaacggctgtagacga

SEQ ID NO: 243938 - DNA, 75 bp, Artificial Sequence
  Synthetic
ttccgtgatcgacagcgtggtggccggcgctcgggcctatgctcgccgcaagaggcggctgcatagagggaacgt

SEQ ID NO: 243939 - DNA, 75 bp, Artificial Sequence
  Synthetic
ggcgctcgggcctatgctcgccgcaagaggcggctgcatagagggaacgtgtactgggtgcgcgattctgtaacg

SEQ ID NO: 243940 - DNA, 75 bp, Artificial Sequence
  Synthetic
cgtgttaaaaagcgggaaaagaaagaggaactcgcggtggtagacgatggcggagtggaatttattaggagtttt

SEQ ID NO: 243941 - DNA, 75 bp, Artificial Sequence
  Synthetic
cggagtggaatttattaggagttttgccccgcggcgcagggttcagtggaaagggcgacgggtacaacgcgtttt

SEQ ID NO: 243942 - DNA, 75 bp, Artificial Sequence
  Synthetic
ggggtttcaaaaggcagtacgacgaggtgtacggcgacgaggacatattggaacaggcggctcaacagattggag

SEQ ID NO: 243943 - DNA, 75 bp, Artificial Sequence
  Synthetic
aattcgcctatggaaagcgctcgcgtcgcggagacttggccatcgctttagacagcggcaatcccacacccagcc

SEQ ID NO: 243944 - DNA, 75 bp, Artificial Sequence
  Synthetic
tcgcggagacttggccatcgctttagacagcggcaatcccacacccagcctcaaacccgtgacactgcaacaagt

SEQ ID NO: 243945 - DNA, 75 bp, Artificial Sequence
  Synthetic
gctccccgtgagcgccagcacggacagcaagaggggaataaaaagagaaatggaagatctgcagcctaccatcca

SEQ ID NO: 243946 - DNA, 75 bp, Artificial Sequence
  Synthetic
gctcatggttcctaaacggcagaggctggaagaggtcctggagaagatgaaagtggaccccagcatagagccgga

SEQ ID NO: 243947 - DNA, 75 bp, Artificial Sequence
  Synthetic
cgtcaaagtcaggccgatcaaagaagtggcccctggactcggggtgcagacggtggatatccagatccccgtcac

SEQ ID NO: 243948 - DNA, 75 bp, Artificial Sequence
  Synthetic
gtcagcttcaaccgccgtggaagccatggaaacgcaaaccgaaacccccgccgcggttggtaccaaagaagtggc

SEQ ID NO: 243949 - DNA, 75 bp, Artificial Sequence
  Synthetic
gttgcaaaccgacccctggtacgaatttgccgccccccggcgtcagaggcgacccgctcgttacggccccgccaa

SEQ ID NO: 243950 - DNA, 75 bp, Artificial Sequence
  Synthetic
cgccgccgccgctcccgtcgcgctctggcccccgtgtcggtgcgccgcgtgacccgccggggaaagacagtcacc

SEQ ID NO: 243951 - DNA, 75 bp, Artificial Sequence
  Synthetic
gataagctgaaggacaccaactttcaagaaaaagtggtcaacggggtggtgaccggcatccacggcgcggtagat

SEQ ID NO: 243952 - DNA, 75 bp, Artificial Sequence
  Synthetic
ctcgccaatcaagcggtgcagaaagagattgataggcgtttggaaaattcgcgggtaccgccgcagaggggggat

SEQ ID NO: 243953 - DNA, 75 bp, Artificial Sequence
  Synthetic
tagaagaaactctggtgacggagagcaaggagcctccctcgtacgagcaagccttgaaagagggcgcctctccac

SEQ ID NO: 243954 - DNA, 75 bp, Artificial Sequence
  Synthetic
cctcctacccgatgactaagccgatcgcacccatggctcgaccggtgtacggcaaggattacaagcccgtcacgc

SEQ ID NO: 243955 - DNA, 75 bp, Artificial Sequence
  Synthetic
tagagctgcccccaccgcccccttcgcgtccgacagtgcctccactgcctgccccgtcggcgggtcccgtgtctg

SEQ ID NO: 243956 - DNA, 75 bp, Artificial Sequence
  Synthetic
caccatccgctgtgcctctgccagccgcccgtcccgtggccgtggccactgccaggaaccccagaggccagagag

SEQ ID NO: 243957 - DNA, 75 bp, Artificial Sequence
  Synthetic
gagccaactggcaaaacacgctgaacagcatcgtgggcctgggggtgaaaagcctgaaacgccgccgttgctatt

SEQ ID NO: 243958 - DNA, 75 bp, Artificial Sequence
  Synthetic
cagcatcgtgggcctgggggtgaaaagcctgaaacgccgccgttgctattattaaaaagtgtagctaaaaaattt

SEQ ID NO: 243959 - DNA, 75 bp, Artificial Sequence
  Synthetic
ttacatgcacatcgccggccaggacgcctcggagtacctgagtcccggcctcgtgcagtttgcccgcgccaccga

SEQ ID NO: 243960 - DNA, 75 bp, Artificial Sequence
  Synthetic
cccacgatgtgaccacggaccgctcgcagaggctcaccctgcgctttgtgcccgtagaccgggaggacaccgcgt

SEQ ID NO: 243961 - DNA, 75 bp, Artificial Sequence
  Synthetic
tccggggggtgctggatcggggtcctagcttcaagccctactccggcaccgcttacaactccctggctcccaagg

SEQ ID NO: 243962 - DNA, 75 bp, Artificial Sequence
  Synthetic
gagctccaaactccgtagagtggccggataatactaaaacaaaagtgagagcccaagcaccgtttgtaagcgacg

SEQ ID NO: 243963 - DNA, 75 bp, Artificial Sequence
  Synthetic
aaatcactaaagacggcataaaggttggaacagataccgcaaccacccaacaaagcatttacgccgataaaacgt

SEQ ID NO: 243964 - DNA, 75 bp, Artificial Sequence
  Synthetic
atcaacctgaaccacaagtaggggaaacacagtggaacagcgatgtaggcactaatgataaagtggcaggaagag

SEQ ID NO: 243965 - DNA, 75 bp, Artificial Sequence
  Synthetic
ttttaaagaaaacgaccccaatgtatccttgttatggttcttacgcacgacccacgaacgaaaaaggagggcagg

SEQ ID NO: 243966 - DNA, 75 bp, Artificial Sequence
  Synthetic
cgaaggctgacacccaagtggatatgcagttttttgccaccactgcagccaatacaacaccaaaagctgttcttt

SEQ ID NO: 243967 - DNA, 75 bp, Artificial Sequence
  Synthetic
atgctgaagatgttaacttagaaggtcccgatacgcacttggtgtttaaacccactgtgacagagggaacgacaa

SEQ ID NO: 243968 - DNA, 75 bp, Artificial Sequence
  Synthetic
gtgccgaagctttgctagcgcaacaagccgctccaaaccgtccaaattacattgcttttagggacaattttattg

SEQ ID NO: 243969 - DNA, 75 bp, Artificial Sequence
  Synthetic
gactaatgtattacaacagcacgggaaacatgggggtgcttgccggtcaggcttcgcagctaaatgcggtagtag

SEQ ID NO: 243970 - DNA, 75 bp, Artificial Sequence
  Synthetic
atttgcaagatagaaatacggaactatcctaccagctgatgttggatgcactgggagacagaagtcgctactttt

SEQ ID NO: 243971 - DNA, 75 bp, Artificial Sequence
  Synthetic
ctatgtggaatcaagccgtagatagttatgatccagatgttagaattgtggaaaatcacggagtagaggacgaac

SEQ ID NO: 243972 - DNA, 75 bp, Artificial Sequence
  Synthetic
taccaaactattgtttcccattgggaggaatggcggtcacagacacctactcccccataaaatccaataatggaa

SEQ ID NO: 243973 - DNA, 75 bp, Artificial Sequence
  Synthetic
gcggttggcaagtagacaacgatacgtttgccgacaggggggtggaaataggctcgggaaacatgttcgccatgg

SEQ ID NO: 243974 - DNA, 75 bp, Artificial Sequence
  Synthetic
agatcaatttgcaagccaacctgtggcgcagttttttgtattctaacattgggctatacctcccggactctttaa

SEQ ID NO: 243975 - DNA, 75 bp, Artificial Sequence
  Synthetic
aattaacccctgacaacatcacactcccagaaaacaaaaacacctaccagtacatgaacgggcgtgtgacaccac

SEQ ID NO: 243976 - DNA, 75 bp, Artificial Sequence
  Synthetic
ccgggcttgtggacacatacgtcaatgtgggagcccgctggtcccccgatgttatggacagcatcaaccccttca

SEQ ID NO: 243977 - DNA, 75 bp, Artificial Sequence
  Synthetic
accaccaccgcaatgctggccttcgctaccgttccatgctcctgggcaacggtcgctacgtaccattccacattc

SEQ ID NO: 243978 - DNA, 75 bp, Artificial Sequence
  Synthetic
aggtgccccagaaattttttgccattaagaatcttttgctgctccccggttcctacacctacgagtggaacttcc

SEQ ID NO: 243979 - DNA, 75 bp, Artificial Sequence
  Synthetic
gcaaggacgtgaacatgattttgcaaagctcgctgggtaacgacctgcgagttgacggggccagcatacgcttcg

SEQ ID NO: 243980 - DNA, 75 bp, Artificial Sequence
  Synthetic
acagcatcaacctgtatgctaactttttccccatggcccacaacacagcttccaccctggaagccatgctgcgca

SEQ ID NO: 243981 - DNA, 75 bp, Artificial Sequence
  Synthetic
acgacaccaatgaccagtccttcaacgactacctgtgcgcggccaacatgctgtatcccatccccgccaatgcca

SEQ ID NO: 243982 - DNA, 75 bp, Artificial Sequence
  Synthetic
ccagcgtgcccatctccatcccgtctcgcaactgggccgccttcaggggctggagttttacccgcctcaaaacca

SEQ ID NO: 243983 - DNA, 75 bp, Artificial Sequence
  Synthetic
aggagaccccctcgctgggctccgggttcgacccctactttgtctactccggctccattccctacctggacggta

SEQ ID NO: 243984 - DNA, 75 bp, Artificial Sequence
  Synthetic
ccttctacctcaaccatacttttaagaaggtgtccatcatgtttgactcgtcggtcagctggcccggcaacgacc

SEQ ID NO: 243985 - DNA, 75 bp, Artificial Sequence
  Synthetic
gcctgctaactccaaatgagtttgaaatcaagcgttcggtggacggtgaagggtacaacgtggcccagagcaaca

SEQ ID NO: 243986 - DNA, 75 bp, Artificial Sequence
  Synthetic
tgaccaaggactggttcctaattcagatgctcagccattacaacatcggctaccagggtttctacgtgcccgaga

SEQ ID NO: 243987 - DNA, 75 bp, Artificial Sequence
  Synthetic
attacaaagaccgcatgtactccttctttagaaacttccaacctatgagccgtcaagtagtagatactgtggctt

SEQ ID NO: 243988 - DNA, 75 bp, Artificial Sequence
  Synthetic
ataaggactactatcaggacgttaagctcccctaccagcacaacaactcagggttcgtgggctacatgggtccca

SEQ ID NO: 243989 - DNA, 75 bp, Artificial Sequence
  Synthetic
ccatgcgagaggggcaagcgtaccccgccaactacccctatcccctgattggggccaccgccgtacccagcctga

SEQ ID NO: 243990 - DNA, 75 bp, Artificial Sequence
  Synthetic
cgccaactacccctatcccctgattggggccaccgccgtacccagcctgacgcagaaaaagttcctctgtgaccg

SEQ ID NO: 243991 - DNA, 75 bp, Artificial Sequence
  Synthetic
cacgacctgggctgcgggccctactttttgggcaccttcgacaagcggttccccggcttcatgtccccccacaag

SEQ ID NO: 243992 - DNA, 75 bp, Artificial Sequence
  Synthetic
ccccggcttcatgtccccccacaagccggcctgtgccatcgttaacacggccggacgggaaaccgggggggtcca

SEQ ID NO: 243993 - DNA, 75 bp, Artificial Sequence
  Synthetic
tacgaggggctcctcaagcgcagcgctctggcctccacgcccgaccactgcgtcaccctggaaaagtccacccag

SEQ ID NO: 243994 - DNA, 75 bp, Artificial Sequence
  Synthetic
ctctggcctccacgcccgaccactgcgtcaccctggaaaagtccacccagacggtccaggggcccttctcggccg

SEQ ID NO: 243995 - DNA, 75 bp, Artificial Sequence
  Synthetic
atggcgggcaagtgacacttgttccgccggtcgtctctaagctcttcctctgcattgcaagagtttaccactcat

SEQ ID NO: 243996 - DNA, 75 bp, Artificial Sequence
  Synthetic
catgtcgaaagtctttgtagacatcgaggccgagagcccgtttttaaaatcactacaaagagcatttccagcatt

SEQ ID NO: 243997 - DNA, 75 bp, Artificial Sequence
  Synthetic
tgaagtggaagcacagcaggtcacgccgaacgaccatgctaatgctagagcattctcgcatctggctacgaaatt

SEQ ID NO: 243998 - DNA, 75 bp, Artificial Sequence
  Synthetic
gatagagcaagagacagaaaaagacacgctcatcctggatatcggcagtgcaccagccaggagaatgatgtctga

SEQ ID NO: 243999 - DNA, 75 bp, Artificial Sequence
  Synthetic
gcacacataccattgtgtgtgcccaatgcgcagcgctgaggacccagagcgtctgctgtattatgctaggaagtt

SEQ ID NO: 244000 - DNA, 75 bp, Artificial Sequence
  Synthetic
ggctaaggcatcaggcgaagtcgttgacagaaacatcgcagcgaagatagacgacctgcagtcagtgatggcaac

SEQ ID NO: 244001 - DNA, 75 bp, Artificial Sequence
  Synthetic
cccggataacgagtcacggaccttttgccttcacacagatcagacatgcaggactcaagcagaggtggcagtcta

SEQ ID NO: 244002 - DNA, 75 bp, Artificial Sequence
  Synthetic
tcaggacgtctatgcggtccatgcaccgacttctttgtacttccaggcaatgaaaggagtacgcacagcgtattg

SEQ ID NO: 244003 - DNA, 75 bp, Artificial Sequence
  Synthetic
gattgggttcgacaccaccccattcatgtttgatacaatggctggggcctatccaacatatgcaaccaattgggc

SEQ ID NO: 244004 - DNA, 75 bp, Artificial Sequence
  Synthetic
tgacgaacaggtattgaaagccaggaacataggattatgttccgcatcactgacggaggggcaccttggcaagct

SEQ ID NO: 244005 - DNA, 75 bp, Artificial Sequence
  Synthetic
gtcaataatgaggaaaaagaagatgacaccgagcgatcaaataatgttctcggtaggctctacactgtacataga

SEQ ID NO: 244006 - DNA, 75 bp, Artificial Sequence
  Synthetic
aagccgtcgcctgctaaagagttggcatttaccatcagtgttccacctgaaaggacgacaatcgtatacgtgccg

SEQ ID NO: 244007 - DNA, 75 bp, Artificial Sequence
  Synthetic
ttgtgatacaattgtgtcatgtgagggctacgtcgttaagaagataacgatgagcccaggggtttttggaaaaac

SEQ ID NO: 244008 - DNA, 75 bp, Artificial Sequence
  Synthetic
atcaggttacgccgttacacaccatgctgaaggattcctggtgtgtaaaaccacagacacaattgctggtgagcg

SEQ ID NO: 244009 - DNA, 75 bp, Artificial Sequence
  Synthetic
ggtttcgttccccatctgcacgtatgtaccatcaacaatctgtgaccagatgactggcattttagcgacggaggt

SEQ ID NO: 244010 - DNA, 75 bp, Artificial Sequence
  Synthetic
tacacctgaggacgcgcaaaaattgcttgtcgggttaaatcagaggattgtcgtaaatggaagaactcagaggaa

SEQ ID NO: 244011 - DNA, 75 bp, Artificial Sequence
  Synthetic
caccaatacaatgaagaattatttgctaccggtggtgtcgcaggcattcagcaagtgggcaaaagagtatcgact

SEQ ID NO: 244012 - DNA, 75 bp, Artificial Sequence
  Synthetic
tgaccaggaagacgagaaaaacatgggtatgcgtgaacgtaccctgacttgctgttgcctgtgggcctttaagac

SEQ ID NO: 244013 - DNA, 75 bp, Artificial Sequence
  Synthetic
tcacaagaaccacaccatgtacaagaaaccggacacgcaaacaattgtcaaggtcccgtcggagttcaactcctt

SEQ ID NO: 244014 - DNA, 75 bp, Artificial Sequence
  Synthetic
tgtaattcccagcctatggtccgcagggttgtcgataggaatcagacaccgaattaggcttcttctgcagtcaag

SEQ ID NO: 244015 - DNA, 75 bp, Artificial Sequence
  Synthetic
acgagtcgagccactcgttccatccatggacgtaggcgaggccagagcagcagagagggaagctgctgaagctaa

SEQ ID NO: 244016 - DNA, 75 bp, Artificial Sequence
  Synthetic
ggaagcagaagataccctagcagccttaccaccgctgattccgaccgctccagtactcgatgacatacccgaggt

SEQ ID NO: 244017 - DNA, 75 bp, Artificial Sequence
  Synthetic
ggatgtggaagagttggagtttcgagcgggagccggtgttgtcgagacacccaggaacgcccttaaagtcacacc

SEQ ID NO: 244018 - DNA, 75 bp, Artificial Sequence
  Synthetic
ccaagacagagacaccatggttggtagttatcttgtcctgtctcctcagactgtccttaaaagtgttaaactgca

SEQ ID NO: 244019 - DNA, 75 bp, Artificial Sequence
  Synthetic
ggcattgcatcctttagcggagagcgtaaaaatcattacccacaaaggtcgtgcagggcgataccaagtggatgc

SEQ ID NO: 244020 - DNA, 75 bp, Artificial Sequence
  Synthetic
ctatgatggccgtgttctactccccacgggggccgcgattccggtgcccgatttccaggctttgagtgagagcgc

SEQ ID NO: 244021 - DNA, 75 bp, Artificial Sequence
  Synthetic
aacgatggtgtacaacgagcgcgagtttatcaaccgcaagctgtaccacatagccgtgcatggggcagcactgaa

SEQ ID NO: 244022 - DNA, 75 bp, Artificial Sequence
  Synthetic
caccgatgaggagggctatgagaaagtccgggccgaaagtacagacgccgaatacgtttatgatgtggaccgcaa

SEQ ID NO: 244023 - DNA, 75 bp, Artificial Sequence
  Synthetic
acagtgcgttaaaagggaggaggccgaaggtctcgtaatgatcggagacctgatcaatcctcccttccacgaatt

SEQ ID NO: 244024 - DNA, 75 bp, Artificial Sequence
  Synthetic
tgcgtatgagggactgaaacgaagaccggcagccccgtacaagaccaccgtggtcggggtctttggcgtgcccgg

SEQ ID NO: 244025 - DNA, 75 bp, Artificial Sequence
  Synthetic
atctggaaaatcaggtataatcaagagcctggtcacacggggggacttggtcgccagcggaaagaaagaaaactg

SEQ ID NO: 244026 - DNA, 75 bp, Artificial Sequence
  Synthetic
tcaggagatcatgcttgatgttaagagatatagagacctggatatgaccgcaaaaacagtggattccgtactgct

SEQ ID NO: 244027 - DNA, 75 bp, Artificial Sequence
  Synthetic
gaacggcgttaagcagactgttgacgtcttgtacgtcgatgaggctttcgcatgccatgcggggacactgctggc

SEQ ID NO: 244028 - DNA, 75 bp, Artificial Sequence
  Synthetic
acttatcgccacggtacgaccacgcaagaaagtggtactatgtggcgacccaaagcagtgcggattctttaattt

SEQ ID NO: 244029 - DNA, 75 bp, Artificial Sequence
  Synthetic
gatgcagttacaggtcaatttcaatcataatatctgcaccgaagtcgaccataagagtatctccagaagatgtac

SEQ ID NO: 244030 - DNA, 75 bp, Artificial Sequence
  Synthetic
gctgccgatcaccgccattgtctcgacattacattatgagggcaggatgcgtactaccaacccatacaataagcc

SEQ ID NO: 244031 - DNA, 75 bp, Artificial Sequence
  Synthetic
agtcattattgataccacaggccagaccaagccgaaccgcgaagacatcgtgttaacgtgtttccgaggttgggt

SEQ ID NO: 244032 - DNA, 75 bp, Artificial Sequence
  Synthetic
taagcagttacaacttgactatcgtggacacgaggtcatgacagctgctgcatcacaggggttgacccgaaaggg

SEQ ID NO: 244033 - DNA, 75 bp, Artificial Sequence
  Synthetic
cgtgtatgccgtccgaatgaaggtcaacgaaaacccgctgtacgcgcaatcttcagaacacgtcaatgtcctatt

SEQ ID NO: 244034 - DNA, 75 bp, Artificial Sequence
  Synthetic
gacgcgtacagagggccgacttgtgtggaagacgctgtcgggtgatccctggattaagaccttgagcaacatacc

SEQ ID NO: 244035 - DNA, 75 bp, Artificial Sequence
  Synthetic
aaaagggaattttacagcaaccttggaggactggcaacgagagcatgacaccatcatgagggcaataacgcagga

SEQ ID NO: 244036 - DNA, 75 bp, Artificial Sequence
  Synthetic
agcagctcctttggatgtgttccagaataaagctaaagtgtgctgggccaaatgcctggtacccgttttggaaac

SEQ ID NO: 244037 - DNA, 75 bp, Artificial Sequence
  Synthetic
agcagggatcaaactgtcagccactgattggagtgcgattatcttggcctttaaagaagacagagcttattcgcc

SEQ ID NO: 244038 - DNA, 75 bp, Artificial Sequence
  Synthetic
agaagtcgcgctgaatgagatctgcacaaaaatctacggagtggacttagacagtggtctgttctcggctccgcg

SEQ ID NO: 244039 - DNA, 75 bp, Artificial Sequence
  Synthetic
tgtgtcgctgcattatactacgaatcactgggataactcaccaggaggaagaatgtacggattctctgttgaggc

SEQ ID NO: 244040 - DNA, 75 bp, Artificial Sequence
  Synthetic
tgccaaccgtctggaacaacaacacccattctataggggacggtgggcttcagggcaggtgctggtcgcggaacg

SEQ ID NO: 244041 - DNA, 75 bp, Artificial Sequence
  Synthetic
gaaaacacagccgatcgacgtcacctgcaatctaatcccttttaacaggagactaccgcacacgctggtcacgga

SEQ ID NO: 244042 - DNA, 75 bp, Artificial Sequence
  Synthetic
gtaccatccaatcaaaggtgaaagagtagagtggcttgtgaacaagatcccgggttaccacgtgctgttggttag

SEQ ID NO: 244043 - DNA, 75 bp, Artificial Sequence
  Synthetic
tgagtacaacctcatcttgccgaggagaaaggtgacgtggatcgctccgccgactgtaacaggagctgacctaac

SEQ ID NO: 244044 - DNA, 75 bp, Artificial Sequence
  Synthetic
atatgacttagatctaggactgccacctaacgctggcaggtacgacctggtcttcgtcaacatgcacacaccgta

SEQ ID NO: 244045 - DNA, 75 bp, Artificial Sequence
  Synthetic
taggctacaccactaccaacaatgtgtcgaccacgccatgaaattacaaatgctgggcggtgatgcactttacct

SEQ ID NO: 244046 - DNA, 75 bp, Artificial Sequence
  Synthetic
attgaaacctgggggaagcctccttttgagcacctacgcgtacgctgacagaacgagcgaggcagtggtaacggc

SEQ ID NO: 244047 - DNA, 75 bp, Artificial Sequence
  Synthetic
cctcgcccgtcggttctcgtcatttagagccgtcacggtccggtgtgtaactagcaacaccgaagtgttcttgct

SEQ ID NO: 244048 - DNA, 75 bp, Artificial Sequence
  Synthetic
gttcacgaactttgacaatggtagaaggacagtaaccctgcatcaaacaaatggtaagttgtcatcaatctatgc

SEQ ID NO: 244049 - DNA, 75 bp, Artificial Sequence
  Synthetic
ggggacggtgctgcaggcagctggttgcgctccagcgtatgccgttaaaagggccgacattgcaaccgctattga

SEQ ID NO: 244050 - DNA, 75 bp, Artificial Sequence
  Synthetic
ggacgcggtggtcaacgcggccaaccaccgcggacaagtgggcgacggtgtctgcagagctgtagcacggaagtg

SEQ ID NO: 244051 - DNA, 75 bp, Artificial Sequence
  Synthetic
gcctcaagccttccgcaacgcagcgacaccggtcggaaccgcaaaaaccgtcaagtgcgacgagacctacatcat

SEQ ID NO: 244052 - DNA, 75 bp, Artificial Sequence
  Synthetic
ccatgcggtggggccgaactttaacaatacatccgaggccgagggagatcgtgacttggcagcggcataccgagc

SEQ ID NO: 244053 - DNA, 75 bp, Artificial Sequence
  Synthetic
cgtggcagcagagatcaaccgactgtccataagtagtgtggcaatcccactgctttctacaggtatatttagtgc

SEQ ID NO: 244054 - DNA, 75 bp, Artificial Sequence
  Synthetic
tgggaaagacagagtgcatcaatcactctcgcatctgttggcagcaatggataccactgaggcacgggtcactat

SEQ ID NO: 244055 - DNA, 75 bp, Artificial Sequence
  Synthetic
ctactgccgcgataaaacgtgggagcaaaagattaaaaccgtcctgcaaaaccgcagtgccactgaactggtgtc

SEQ ID NO: 244056 - DNA, 75 bp, Artificial Sequence
  Synthetic
agatgaattacagtttgaagtcaacctgactagagtccatccggacagtagcctggtgggacgtccagggtacag

SEQ ID NO: 244057 - DNA, 75 bp, Artificial Sequence
  Synthetic
cactaccgatgggactctgtactcctacatggaaggtactaagttccaccaggcggctcttgacatggctgagat

SEQ ID NO: 244058 - DNA, 75 bp, Artificial Sequence
  Synthetic
cacgactttgtggccaagagtccaggatgcaaatgaacatatttgtttgtatgcgctgggcgagaccatggacaa

SEQ ID NO: 244059 - DNA, 75 bp, Artificial Sequence
  Synthetic
tattcgtgccaggtgcccagtggaagacagtgattcatcgactccacccaagacggtcccatgcctatgccgata

SEQ ID NO: 244060 - DNA, 75 bp, Artificial Sequence
  Synthetic
tgccatgacaccggagagagtcacaagactacggatgcaccacacaaaagatttcgtggtttgctcgtcttttca

SEQ ID NO: 244061 - DNA, 75 bp, Artificial Sequence
  Synthetic
gctgccaaagtatcgtatacctggcgtgcaacgagtgaagtgtgagaaagtaatgctttttgatgcagctccacc

SEQ ID NO: 244062 - DNA, 75 bp, Artificial Sequence
  Synthetic
agcctccgtcagtccagtgcagtacctgacaaaccaaagtgaaactaccataagtttgagttcattttcaattac

SEQ ID NO: 244063 - DNA, 75 bp, Artificial Sequence
  Synthetic
gtctgacagcagctccctcagcacttttcctgatctggagtcagcggaagaacttgaccatgactctcagtccgt

SEQ ID NO: 244064 - DNA, 75 bp, Artificial Sequence
  Synthetic
gcggccagcgctgaatgaacccgatgaccatcaacctacgccaacggcagaacttgccactcatcccgtaccacc

SEQ ID NO: 244065 - DNA, 75 bp, Artificial Sequence
  Synthetic
gcctcgccctaaccgtgcaaggcggttggcggccgctcgtgtgcaagtccaggtggaagtacatcaaccaccttc

SEQ ID NO: 244066 - DNA, 75 bp, Artificial Sequence
  Synthetic
caaccaaccaacgaagccaatcccagcaccacgtaccagcctacgccccgtcccagctcctagaagatacgtgcc

SEQ ID NO: 244067 - DNA, 75 bp, Artificial Sequence
  Synthetic
aagaccggtggtcgagttaccctggccgctggagaccatcgatgtagagttcggggcaccgactgaagaggagag

SEQ ID NO: 244068 - DNA, 75 bp, Artificial Sequence
  Synthetic
cgatatcactttcggtgacttctccgcctcggagtgggaaaccattagtaattcatcttgactaggccgtgcggg

SEQ ID NO: 244069 - DNA, 75 bp, Artificial Sequence
  Synthetic
ggcctatattttctcatccgacgtcggtccagggcacctgcaacagaaatcagtgaggcagcatgacttagaggt

SEQ ID NO: 244070 - DNA, 75 bp, Artificial Sequence
  Synthetic
gccgattatggatcgtgtgattgaggaaaaggtctacccgcctaaattagatgaggcaaaagagaaacagctact

SEQ ID NO: 244071 - DNA, 75 bp, Artificial Sequence
  Synthetic
tttgaaattgcagatgcatgcaacagatgccaaccggagcagataccaatcaaggaaggttgagaacatgaaggc

SEQ ID NO: 244072 - DNA, 75 bp, Artificial Sequence
  Synthetic
aacgatcattgatcggctaaaacagggcagcgcatattacgtctctgctgcggctgacaaggcagtcacttacca

SEQ ID NO: 244073 - DNA, 75 bp, Artificial Sequence
  Synthetic
tgtcaggtatgctaagcctcggtattctgtgccggtgatgcaaagacttagcagcgcaaccattgcggttgcaac

SEQ ID NO: 244074 - DNA, 75 bp, Artificial Sequence
  Synthetic
ttgtaacgagttcctggcccgcaactaccctacagtggcgtcctaccagattacggatgaatatgacgcatactt

SEQ ID NO: 244075 - DNA, 75 bp, Artificial Sequence
  Synthetic
ggatatggtagacgggtccgagagctgcttggacagagcaaatttttgtccagcgaagctgcgctgctacccaaa

SEQ ID NO: 244076 - DNA, 75 bp, Artificial Sequence
  Synthetic
acatcatgcatatcacatgcctcagatcagaagtgctgttccctcgccattccaaaatacactgcagaacgtctt

SEQ ID NO: 244077 - DNA, 75 bp, Artificial Sequence
  Synthetic
ggcagctgccaccaagcgtaactgtaatgttacgcagatgcgtgaattaccaactctggactcagccgtgtacaa

SEQ ID NO: 244078 - DNA, 75 bp, Artificial Sequence
  Synthetic
tgtagaatgcttccgtaagtacgcttgcaacaacgaatattgggaagagtttgctaaaaaacctattaggatcac

SEQ ID NO: 244079 - DNA, 75 bp, Artificial Sequence
  Synthetic
aacagaaaacctgactacctacgtgactaaattaaaagggggaaaggcggctgctttgtttgcaaagacccacaa

SEQ ID NO: 244080 - DNA, 75 bp, Artificial Sequence
  Synthetic
cttggttccactacaggaagtcccgatggatagattcatcatggacatgaagcgggacgtgaaggtcacacccgg

SEQ ID NO: 244081 - DNA, 75 bp, Artificial Sequence
  Synthetic
gacaaagcatacggaggagcgacctaaagtccaagtgattcaagctgccgagcctctggccaccgcttacttatg

SEQ ID NO: 244082 - DNA, 75 bp, Artificial Sequence
  Synthetic
cggaattcacagagagctggttcgccgcctcaatgctgtgttgcttccgaacatccataccctgtttgacatgtc

SEQ ID NO: 244083 - DNA, 75 bp, Artificial Sequence
  Synthetic
tgccgaagacttcgatgctatcatatcggagcacttcaagcctggggaccacgtcctggagacggacattgcttc

SEQ ID NO: 244084 - DNA, 75 bp, Artificial Sequence
  Synthetic
ttttgataaaagccaagatgactcgctggcactaacagggttgatgatattggaggacctgggtgtcgataacca

SEQ ID NO: 244085 - DNA, 75 bp, Artificial Sequence
  Synthetic
gctattggaccttatcgaggcagcgtttggtcagatcaccagctgccaccttcctacaggaaccaggtttaaatt

SEQ ID NO: 244086 - DNA, 75 bp, Artificial Sequence
  Synthetic
tggggccatgatgaagtcgggcatgttccttacactttttatcaacaccgttttgaacatcaccattgccagtag

SEQ ID NO: 244087 - DNA, 75 bp, Artificial Sequence
  Synthetic
ggtactagaagccagattgactaactcggcctgtgccgcgttcatcggcgacgacaacgtggttcacggagtcgt

SEQ ID NO: 244088 - DNA, 75 bp, Artificial Sequence
  Synthetic
ctccgataaactgatggcagacagatgtgccacttgggtcaacatggaagtcaaaataattgatgcagttatgtg

SEQ ID NO: 244089 - DNA, 75 bp, Artificial Sequence
  Synthetic
cataaaaccaccctacttttgtggaggtttcctggtttatgaccatgttacaaggacagcatgccgcatagcaga

SEQ ID NO: 244090 - DNA, 75 bp, Artificial Sequence
  Synthetic
cccgttaaaaaggctattcaaactgggaaagcctctaccagcggatgactgtcaagatgaagaccgccgtagggc

SEQ ID NO: 244091 - DNA, 75 bp, Artificial Sequence
  Synthetic
tttgtatgacgaagtcaaaaaatggtctagatcgggcttaggttctgagattgaggtcgccctagcctccagata

SEQ ID NO: 244092 - DNA, 75 bp, Artificial Sequence
  Synthetic
taggttggagggcagctataatctgttattggcaatgtccacttttgcacatagtatgaagaacttttctgcact

SEQ ID NO: 244093 - DNA, 75 bp, Artificial Sequence
  Synthetic
gaggggacccgtcatacatctgtacggcggtcctaaataggtgctctacacgacacctattccaccatggacttc

SEQ ID NO: 244094 - DNA, 75 bp, Artificial Sequence
  Synthetic
ctaccaactcaagtgttctatggcagacgctggagaccacgaatgccgccacgcccttggagaccacgcatgcct

SEQ ID NO: 244095 - DNA, 75 bp, Artificial Sequence
  Synthetic
acaatgcagagaccagaccaacaggcccgacaaatgcagcaattgattgcagcggttagcacgcttgccctgagg

SEQ ID NO: 244096 - DNA, 75 bp, Artificial Sequence
  Synthetic
cagaatgcagccgcccctcagcgtggaaagaagaagcagccacgcagaaagaaaccaaaaccgcagcccgagaaa

SEQ ID NO: 244097 - DNA, 75 bp, Artificial Sequence
  Synthetic
ccaaagaagcaagaacagaagccgaagcaaaagaaggcccctaaacgaaagccagggagaagagaacgcatgtgc

SEQ ID NO: 244098 - DNA, 75 bp, Artificial Sequence
  Synthetic
atgaagattgagcatgattgcatcttcgaggttaagcacgaaggtaaagtcacgggttacgcctgccttgtcggt

SEQ ID NO: 244099 - DNA, 75 bp, Artificial Sequence
  Synthetic
gacaaggtaatgaagccagcacacgttcccggggtgatagacaatgcagatcttgcacgcctgtcgtacaagaaa

SEQ ID NO: 244100 - DNA, 75 bp, Artificial Sequence
  Synthetic
tccagtaagtacgatctggaatgtgcacaaatacccgtggctatgaagtcagatgcttcgaagtacacccatgag

SEQ ID NO: 244101 - DNA, 75 bp, Artificial Sequence
  Synthetic
aaacccgagggtcattacaactggcactacggcgccgtccagtacacgggaggaagattcacggtgcccacagga

SEQ ID NO: 244102 - DNA, 75 bp, Artificial Sequence
  Synthetic
gtgggtaagcctggcgacagcggtcggcccatctttgacaacaaagggccggttgtcgcaatagtgctgggagga

SEQ ID NO: 244103 - DNA, 75 bp, Artificial Sequence
  Synthetic
gccaacgaaggtaccagaaccgccctttccgttgtgacatggaataaagacatggtcacgaagattacacctgaa

SEQ ID NO: 244104 - DNA, 75 bp, Artificial Sequence
  Synthetic
ggcactgtggagtgggcagcctcgacagtgacagccatgtgtcttttgacaaatatatccttcccatgtttccaa

SEQ ID NO: 244105 - DNA, 75 bp, Artificial Sequence
  Synthetic
ccgagctgtgcaccgtgctgctatgaaaaggggcctgagccgacgctgaggatgctggaggagaacgtaaattca

SEQ ID NO: 244106 - DNA, 75 bp, Artificial Sequence
  Synthetic
gaaggatattacgacctgctgcacgctgccgtgtactgtagaaacagttcaaggtcgaagagaagcactgcaaat

SEQ ID NO: 244107 - DNA, 75 bp, Artificial Sequence
  Synthetic
cattttaatgcgtataagttgacccgtccatatgtggcttactgcgcagactgcggtatgggtcattcttgccac

SEQ ID NO: 244108 - DNA, 75 bp, Artificial Sequence
  Synthetic
agcccagccatgatcgaaaatattcaggcggatgcaacagatggcacgctaaaaattcagtttgcttcccaaatt

SEQ ID NO: 244109 - DNA, 75 bp, Artificial Sequence
  Synthetic
ggcctgaccaaaacggacacgcacgatcacacaaagattagatatgctgaaggacacgacattgcagaggctgcc

SEQ ID NO: 244110 - DNA, 75 bp, Artificial Sequence
  Synthetic
agatcaacccttaaggtacacagtagcagtgagtgcacggtaaccggcacaatgggacactttatcctggccaaa

SEQ ID NO: 244111 - DNA, 75 bp, Artificial Sequence
  Synthetic
tgtccacctggcgaacgaatcagtgtctcatttgttgattcgaaaaacgaacaccggacctgccggatagcctac

SEQ ID NO: 244112 - DNA, 75 bp, Artificial Sequence
  Synthetic
caccatgaacagaggttaatagggcgagaaagattcacggtgcgaccgcatcatggaattgagctaccttgcacc

SEQ ID NO: 244113 - DNA, 75 bp, Artificial Sequence
  Synthetic
acttatcaattgactaccgccgaaacctctgaagaaattgatatgcacatgccgccggacattccggatagaact

SEQ ID NO: 244114 - DNA, 75 bp, Artificial Sequence
  Synthetic
atcctttcccaacaatcaggaaatgttaagataacggtgaatggacgaaccgtcaggtacagctcttcttgcggt

SEQ ID NO: 244115 - DNA, 75 bp, Artificial Sequence
  Synthetic
tcccaagccgtcgggacaacaaccacagacaagaccattaatagctgtaccgttgacaaatgtcaggcttacgtc

SEQ ID NO: 244116 - DNA, 75 bp, Artificial Sequence
  Synthetic
acgagccacacaaaatggcaattcaattcaccttttgtcccacgtcggatgcaagcagagcgcaagggcaaagtg

SEQ ID NO: 244117 - DNA, 75 bp, Artificial Sequence
  Synthetic
catatcccctttccccttattaacaccacctgccgtgtaccgctggctcccgaggcccttgttaggagcggtaaa

SEQ ID NO: 244118 - DNA, 75 bp, Artificial Sequence
  Synthetic
cgcgaagctacactttcattgcaccctatccaccccacattgctaagttacagaacatttggagcggagcgggtc

SEQ ID NO: 244119 - DNA, 75 bp, Artificial Sequence
  Synthetic
tttgacgagcagtggatcaccgcccagacggaggtaacgatcccggtacctgtggagggagtggagtaccagtgg

SEQ ID NO: 244120 - DNA, 75 bp, Artificial Sequence
  Synthetic
ggcaaccataaacctcaacgttttgtggtcgcactgacgactgaaggcaaagcacatggatggcctcatgaaatt

SEQ ID NO: 244121 - DNA, 75 bp, Artificial Sequence
  Synthetic
attgaatactactacggactgcatcctacgacaaccattgtcgtggtgattcgtgtctcagtggtggtgcttctg

SEQ ID NO: 244122 - DNA, 75 bp, Artificial Sequence
  Synthetic
tcattcgccgcctcggtctacatgtgcgtggtagcacgaaccaaatgtctgacaccatatgcactcacgccggga

SEQ ID NO: 244123 - DNA, 75 bp, Artificial Sequence
  Synthetic
gctgttgttcctgttaccattggggtgctgtgttgcgcaccgaaagcacatgcagccagtttcgcagaaggtatg

SEQ ID NO: 244124 - DNA, 75 bp, Artificial Sequence
  Synthetic
gcctatctgtgggataacaatcagtcgatgttctggatggagctgaccggaccattggccctccttattctggct

SEQ ID NO: 244125 - DNA, 75 bp, Artificial Sequence
  Synthetic
acatgctgcgcccgatcactgctttcctgctgcaaggggtcttttttagtcgcaatgagcatcgggagtgccgtt

SEQ ID NO: 244126 - DNA, 75 bp, Artificial Sequence
  Synthetic
gccagtgcttacgagcacacggcaattattccgaaccaagtgggattcccgtataaggctcatgttgcgcgtgaa

SEQ ID NO: 244127 - DNA, 75 bp, Artificial Sequence
  Synthetic
ggttacagtcctttgaccctgcagatgcaggtgatagagaccagccttgagccaacactcaacctggagtatatc

SEQ ID NO: 244128 - DNA, 75 bp, Artificial Sequence
  Synthetic
acttgcgattacaaaacaaaagttccatcaccatacgtaaagtgctgcggcacggcagaatgccgcacacaggac

SEQ ID NO: 244129 - DNA, 75 bp, Artificial Sequence
  Synthetic
aagcctgagtacaaatgtgcagtgttcacaggtgtgtatccttttatgtggggaggtgcatactgtttttgtgat

SEQ ID NO: 244130 - DNA, 75 bp, Artificial Sequence
  Synthetic
tcggagaacacacagatgagcgaagcctacgtggagcgcgctgacgtgtgtaaacacgaccacgcagctgcctac

SEQ ID NO: 244131 - DNA, 75 bp, Artificial Sequence
  Synthetic
cgtgcccacaccgcatcccttagagcaaaaattaaggtgacatacggtactgtgaaccagacagttgaggcgtat

SEQ ID NO: 244132 - DNA, 75 bp, Artificial Sequence
  Synthetic
gtgaacggtgaccatgccgtaacgattgccggaacaaaatttatttttgggccagtgtcaacgccttggacaccg

SEQ ID NO: 244133 - DNA, 75 bp, Artificial Sequence
  Synthetic
ttcgatacaaaaattctggtttacaaaggggagttatacaatcaggacttcccacggtatggtgccgggcagcct

SEQ ID NO: 244134 - DNA, 75 bp, Artificial Sequence
  Synthetic
ggaagatttggggacattcagagccggacgctggatagtcgagacctatatgccaacacgggcctcaagctggca

SEQ ID NO: 244135 - DNA, 75 bp, Artificial Sequence
  Synthetic
cgaccggcagccggcaacattcacgtcccctatacccagactccatctggctttaaaacatggcaaaaagacagg

SEQ ID NO: 244136 - DNA, 75 bp, Artificial Sequence
  Synthetic
gactcaccgcttaacgccaaggcgccttttggatgcataatccagacaaatccggtccgagccatgaactgcgcc

SEQ ID NO: 244137 - DNA, 75 bp, Artificial Sequence
  Synthetic
gtcggcaacatacccgtttcgatggatatcgccgacagcgccttcacaagattgaccgacgcgcctgtaatctct

SEQ ID NO: 244138 - DNA, 75 bp, Artificial Sequence
  Synthetic
gagttgacgtgcactgtgtctacatgcacgcactcatcggattttggcgggatcgctgtactttcctacaaggtg

SEQ ID NO: 244139 - DNA, 75 bp, Artificial Sequence
  Synthetic
gaaaaatcaggcaggtgcgacatccattcacattcaaacgtcgcggtactccaggaagtttccatcgagacagaa

SEQ ID NO: 244140 - DNA, 75 bp, Artificial Sequence
  Synthetic
ggtcgatcagtgatccacttctcaaccgcatcagcctccccttccttcgtagtttctgtttgtagttcgcgtgct

SEQ ID NO: 244141 - DNA, 75 bp, Artificial Sequence
  Synthetic
acgtgcacagcgaaatgtgaaccaccgaaagaccacgttgttacatatccagcaaatcataacggggtaactttg

SEQ ID NO: 244142 - DNA, 75 bp, Artificial Sequence
  Synthetic
ccagacttatctagcactgccatgacgtgggcacaacatcttgccggcggagttgggttgctgatagctctggcc

SEQ ID NO: 244143 - DNA, 75 bp, Artificial Sequence
  Synthetic
gtgctaattctggtaatagttacttgtgtgactttgagaaggtaaatcaaaagtaccgtgcataatgcggacaac

SEQ ID NO: 244144 - DNA, 75 bp, Artificial Sequence
  Synthetic
tatattattatccttatacttaaccatcatcatacatattaaccagcccaatactatgttacacaatattaacaa

SEQ ID NO: 244145 - DNA, 75 bp, Artificial Sequence
  Synthetic
tattaatatatactaatatcaattatattattacatattacttatatgagctcgttaacgacgcatatacaattt

SEQ ID NO: 244146 - DNA, 75 bp, Artificial Sequence
  Synthetic
attatatttttctttattttctttattcatgccactataaggcacttactaaccttaaaagtaattcattttgtt

SEQ ID NO: 244147 - DNA, 75 bp, Artificial Sequence
  Synthetic
ctttattttctttattcatgccactataaggcacttactaaccttaaaagtaattcattttgtttttaatatttc

SEQ ID NO: 244148 - DNA, 75 bp, Artificial Sequence
  Synthetic
ttccgccggacgtctctaagctcttcctctgcattgcaagagtttaccactcagtatgtcgaaagtctttgtaga

SEQ ID NO: 244149 - DNA, 75 bp, Artificial Sequence
  Synthetic
cctctgcattgcaagagtttaccactcagtatgtcgaaagtctttgtagatatcgaggccgagagcccgttttta

SEQ ID NO: 244150 - DNA, 75 bp, Artificial Sequence
  Synthetic
aaatcactacagagagcgtttccagcatttgaagtggaagcacagcaggtcacaccaaatgaccatgctaacgcc

SEQ ID NO: 244151 - DNA, 75 bp, Artificial Sequence
  Synthetic
agagcattctcgcatctggctactaaattgatagagcaagagaccgaaaaagacacactcatcctggatatcggc

SEQ ID NO: 244152 - DNA, 75 bp, Artificial Sequence
  Synthetic
aattgatagagcaagagaccgaaaaagacacactcatcctggatatcggcagtgcgcctgccaggagaatgctgt

SEQ ID NO: 244153 - DNA, 75 bp, Artificial Sequence
  Synthetic
ctgagcacacgtaccattgtgtgtgcccaatgcgcagcgctgaggacccagagcgtctgctgtattatgctagga

SEQ ID NO: 244154 - DNA, 75 bp, Artificial Sequence
  Synthetic
agttagccaaggcatcaggtgaagtcgttgacagaaatattgcagcaaagatagacgacctgcagtcagtgatgg

SEQ ID NO: 244155 - DNA, 75 bp, Artificial Sequence
  Synthetic
cgaccccggacaatgagtcacggacattttgccttcacacagatcagacatgcaggactccagcagaggtggcag

SEQ ID NO: 244156 - DNA, 75 bp, Artificial Sequence
  Synthetic
tctatcaggatgtttatgcagttcatgcaccgacttctttgtacttccaggcaataaaaggagtacgcacagcgt

SEQ ID NO: 244157 - DNA, 75 bp, Artificial Sequence
  Synthetic
actggattgggtttgacactaccccattcatgttcgatacaatggccggggcttatccaacatatgcaaccaact

SEQ ID NO: 244158 - DNA, 75 bp, Artificial Sequence
  Synthetic
gggccgacgaacaggtgttgaaagccaggaacataggactatgctccgcggcactgactgagggacaccttggca

SEQ ID NO: 244159 - DNA, 75 bp, Artificial Sequence
  Synthetic
agctatcaataatgaggaagaagagaatgaaaccgagtgaccagataatgttctcggtaggttccacattgtata

SEQ ID NO: 244160 - DNA, 75 bp, Artificial Sequence
  Synthetic
ttctcggtaggttccacattgtatacggaaagccgacgtctgttaaagagttggcatttaccgtcagtgtttcat

SEQ ID NO: 244161 - DNA, 75 bp, Artificial Sequence
  Synthetic
ctgaaaggacgacaatcatatacgtgtcggtgcgatacaatagtgtcatgtgagggctacgttgttaagaagata

SEQ ID NO: 244162 - DNA, 75 bp, Artificial Sequence
  Synthetic
acgatgagcccaggggtattcggaaaaacgtcagggtacgccgtcacacatcacgcagaaggatttctggtatgt

SEQ ID NO: 244163 - DNA, 75 bp, Artificial Sequence
  Synthetic
gtatgtgccatcgacgatctgtgaccaaatgacaggcattctagcgaccgaggtcacgcccgaggacgcgcaaaa

SEQ ID NO: 244164 - DNA, 75 bp, Artificial Sequence
  Synthetic
attgcttgtcggattaaatcagaggatcgtcgtgaatgggaggacccagagaaacactaatacaatgaagaacta

SEQ ID NO: 244165 - DNA, 75 bp, Artificial Sequence
  Synthetic
cctgctcccagtggtgtcacaagcatttagtaagtgggcgaaagagtatcggcttgaccaagacgatgagaaaaa

SEQ ID NO: 244166 - DNA, 75 bp, Artificial Sequence
  Synthetic
catgggtatgcgtgaacgcaccctgacttgctgctgcctgtgggcctttaagacccataagaatcacaccatgta

SEQ ID NO: 244167 - DNA, 75 bp, Artificial Sequence
  Synthetic
taagaagccagacacacagacgatcgtcagggtcccgtcggagttcaactccttcgtgatccctagcctgtggtc

SEQ ID NO: 244168 - DNA, 75 bp, Artificial Sequence
  Synthetic
agcggggttgtcgattggaattagacacaggatcaggcttcttttgcagtcaagacgtgccgagccgctcgttcc

SEQ ID NO: 244169 - DNA, 75 bp, Artificial Sequence
  Synthetic
atctatggatgctggtgaagccagagcagcagagaaggaggctgcagaagttaaggaggcagaagagactctggc

SEQ ID NO: 244170 - DNA, 75 bp, Artificial Sequence
  Synthetic
agccctgccacctttgatcccgaccgccccgctgctcgatgacatccctgaagttgatgtagaggagctggagtt

SEQ ID NO: 244171 - DNA, 75 bp, Artificial Sequence
  Synthetic
caccacaagacagagacaccatggtaggtagctatctcgttctgtctccccagacagtcctgaaaagtgttaaac

SEQ ID NO: 244172 - DNA, 75 bp, Artificial Sequence
  Synthetic
tgcaggtactgcactccttggcagagcaagtaaaaatcattacccacaaaggccgtgcagggcgctaccaagtgg

SEQ ID NO: 244173 - DNA, 75 bp, Artificial Sequence
  Synthetic
ggccgtgcagggcgctaccaagtggatgcctatgacggccgtgttttaatccccacaggcgctgctatcccggta

SEQ ID NO: 244174 - DNA, 75 bp, Artificial Sequence
  Synthetic
cccgatttccaggctctaagtgagagtgcgactatggtgtacaacgaacgtgagtttatcaatcgcaaattgtac

SEQ ID NO: 244175 - DNA, 75 bp, Artificial Sequence
  Synthetic
gaaagtgcgggccgaaaggacagatgccgagtacgtctttgacgtggatcgcaaacagtgcgttaagagggagga

SEQ ID NO: 244176 - DNA, 75 bp, Artificial Sequence
  Synthetic
tgccgagggtctcgtgatgatcggagacctggtcaaccctccattccacgaatttgcgtatgaaggactgaaacg

SEQ ID NO: 244177 - DNA, 75 bp, Artificial Sequence
  Synthetic
aagaccagcggctccgtacaaaacaactgtggtcggagtcttcggcgtgcctggatctggaaaatcgggtataat

SEQ ID NO: 244178 - DNA, 75 bp, Artificial Sequence
  Synthetic
actgtggtcggagtcttcggcgtgcctggatctggaaaatcgggtataatcaaaagcctggtcacacgtgcggac

SEQ ID NO: 244179 - DNA, 75 bp, Artificial Sequence
  Synthetic
ttggtcaccagtggaaagagagagaactgtcaggagatcatgcacgacgtcaagagatacagagacctggacatc

SEQ ID NO: 244180 - DNA, 75 bp, Artificial Sequence
  Synthetic
actgcaaaaacggtggattccgtactgttgaatggcgttaagcagactgtcgatgtcttgtacgtcgatgaggct

SEQ ID NO: 244181 - DNA, 75 bp, Artificial Sequence
  Synthetic
ttcgcttgccatgcagggacattgctagcgcttatcgccacggtgcgaccacgtaagaaggttgtgctttgcggc

SEQ ID NO: 244182 - DNA, 75 bp, Artificial Sequence
  Synthetic
acgtaagaaggttgtgctttgcggcgacccaaaacagtgcggtttcttcaacttgatgcaattacaggttaactt

SEQ ID NO: 244183 - DNA, 75 bp, Artificial Sequence
  Synthetic
taaccacaacatctgcaccgaggtgcaccataagagcattcccagaagatgcacgctaccagtcacccccattgt

SEQ ID NO: 244184 - DNA, 75 bp, Artificial Sequence
  Synthetic
ctcaacactacactatgagggtaaaatgcgcaccactaacccatacaacaaacccgttatcattgacaccacagg

SEQ ID NO: 244185 - DNA, 75 bp, Artificial Sequence
  Synthetic
cctgactaaaccaaaccgcgaggacattgtgttaacatgtttccgcggttgggttaagcagctgcaacttgacta

SEQ ID NO: 244186 - DNA, 75 bp, Artificial Sequence
  Synthetic
gggttaagcagctgcaacttgactatcgtggacacgaagtcatgacagccgctgcatcccaggggttgacccgaa

SEQ ID NO: 244187 - DNA, 75 bp, Artificial Sequence
  Synthetic
agggcgtgtacgccgtccgaatgaaggtcaacgaaaacccactgtacgcacaatcatcggagcatgttaatgttc

SEQ ID NO: 244188 - DNA, 75 bp, Artificial Sequence
  Synthetic
tttggaagattggcaacaagagcatgacgccattatgagggcaataacacaagaagcagcccctttggacgtgtt

SEQ ID NO: 244189 - DNA, 75 bp, Artificial Sequence
  Synthetic
ccaaaataaggctaaggtgtgttgggccaagtgtttggtacccgttttggaaaccgcggggatcaagttgtcagc

SEQ ID NO: 244190 - DNA, 75 bp, Artificial Sequence
  Synthetic
gccaagtgtttggtacccgttttggaaaccgcggggatcaagttgtcagccgctgattggagctcaatcatcttg

SEQ ID NO: 244191 - DNA, 75 bp, Artificial Sequence
  Synthetic
gccttcaaagaagacagagcttattcaccagaggttgcactgaatgagatttgtactaaaatctacggggtggat

SEQ ID NO: 244192 - DNA, 75 bp, Artificial Sequence
  Synthetic
ttagacagcggcctgttttcggctccacgcgtgtcgctacactatactacaaatcattgggataactcgcctgga

SEQ ID NO: 244193 - DNA, 75 bp, Artificial Sequence
  Synthetic
aaatcattgggataactcgcctggaggaaggatgtacgggttttccgtcgaggccgccaaccgcctagaacaacg

SEQ ID NO: 244194 - DNA, 75 bp, Artificial Sequence
  Synthetic
gcacccgttctacaggggacggggggcttctgggcaggtgctggtcgcagaacgaagaactcagccgattgacat

SEQ ID NO: 244195 - DNA, 75 bp, Artificial Sequence
  Synthetic
cacttgcaacctaacccccttcaaccggagactcccacacgcgttggtcacggaatatcgtccagtcaagggaga

SEQ ID NO: 244196 - DNA, 75 bp, Artificial Sequence
  Synthetic
aagagtggagtggcttgtgaataagatcccaggctatcacttgctactggttagcgagtataaccttatactgcc

SEQ ID NO: 244197 - DNA, 75 bp, Artificial Sequence
  Synthetic
cagaaggaaggtaacgtggattgccccgccgacagtgacaggagccgatttaacccatgacttggatttaggact

SEQ ID NO: 244198 - DNA, 75 bp, Artificial Sequence
  Synthetic
accgcctaatgcaggcaggtatgacctagtcttcgtcaacatgcatacaccgtataggctccatcactaccaaca

SEQ ID NO: 244199 - DNA, 75 bp, Artificial Sequence
  Synthetic
atgcgtcgatcacgccatgaaattacagatgctgggcggcgacgcactctacctgttgaaacccgggggaagcct

SEQ ID NO: 244200 - DNA, 75 bp, Artificial Sequence
  Synthetic
ccttttgagagcctacggttatgccgatagaacgagcgaggctgtggtgacggctctcgctcgtcggttctcgtc

SEQ ID NO: 244201 - DNA, 75 bp, Artificial Sequence
  Synthetic
cttcagagcggtcagacctccatgtgtgactagtaacaccgaggtgttcttactgttcacgaactttgacaacgg

SEQ ID NO: 244202 - DNA, 75 bp, Artificial Sequence
  Synthetic
tagaagaacagtaaccctgcatcctacaaatggtaaactatcatcaatttatgcaggtacagtgctgcaggcggc

SEQ ID NO: 244203 - DNA, 75 bp, Artificial Sequence
  Synthetic
aaaagggcagacatcgcgaccgccattgaggatgcggtggtcaatgcagctaaccaccgtggacaagtgggcgac

SEQ ID NO: 244204 - DNA, 75 bp, Artificial Sequence
  Synthetic
ggagtctgcagggcagtagcacggaaatggcctcaagccttccgtaacgcagcgacacctgtcggaaccgcaaaa

SEQ ID NO: 244205 - DNA, 75 bp, Artificial Sequence
  Synthetic
accgtcaagtgcgacgagacttacatcatccacgcggtgggtccaaattttaacaatacatctgaggctgaaggg

SEQ ID NO: 244206 - DNA, 75 bp, Artificial Sequence
  Synthetic
tcatccacgcggtgggtccaaattttaacaatacatctgaggctgaaggggaccgtgacttggcggcggcatata

SEQ ID NO: 244207 - DNA, 75 bp, Artificial Sequence
  Synthetic
ccactgctttccacaggtatattcagtgcaggaaaagatagagtgcatcagtcgctttcgcacctgctagcggca

SEQ ID NO: 244208 - DNA, 75 bp, Artificial Sequence
  Synthetic
atggacaccactgaagcacgggttaccatctactgccgcgataaaacgtgggagcaaaagatcaaaacagttctg

SEQ ID NO: 244209 - DNA, 75 bp, Artificial Sequence
  Synthetic
agcagcctggtgggacgtccagggtacagcaccactgatgggaccttatattcctatatggaaggtactaagttc

SEQ ID NO: 244210 - DNA, 75 bp, Artificial Sequence
  Synthetic
agatcacgaccttgtggccaagagttcaggatgcaaatgaacacatctgcatgtatgcactgggcgagacgatgg

SEQ ID NO: 244211 - DNA, 75 bp, Artificial Sequence
  Synthetic
ataacatccgctctagatgcccagttgaggatagtgactcatcgactccaccgaagacagtcccatgcctatgtc

SEQ ID NO: 244212 - DNA, 75 bp, Artificial Sequence
  Synthetic
ggtacgctatgacaccagagagagtcacaagactacgaatgcatcacacaaaagattttgtggtctgctcgtctt

SEQ ID NO: 244213 - DNA, 75 bp, Artificial Sequence
  Synthetic
tccagctaccgaagtaccgcatagctggtgtgcagcgagtaaagtgcgaaaaagtgatgctttttgatgcaactc

SEQ ID NO: 244214 - DNA, 75 bp, Artificial Sequence
  Synthetic
aaagtgatgctttttgatgcaactccaccggcctctgttagtcctgtgcagtacctgacgagtcacagcgaaact

SEQ ID NO: 244215 - DNA, 75 bp, Artificial Sequence
  Synthetic
actgtaagcttgagctcgttctcaattacatctgacagtagctccctaagcaccttcccggatctggagtcacta

SEQ ID NO: 244216 - DNA, 75 bp, Artificial Sequence
  Synthetic
caccttcccggatctggagtcactagaagaactgggcaatgatccacagtccatgcggatggacgagtctgacaa

SEQ ID NO: 244217 - DNA, 75 bp, Artificial Sequence
  Synthetic
gaagaactgggcaatgatccacagtccatgcggatggacgagtctgacaaccaacaacccatatcaatggcagaa

SEQ ID NO: 244218 - DNA, 75 bp, Artificial Sequence
  Synthetic
ccggttgttcaacccgtaccacctccgcgtcctaaacgtgccaggcgactagcggctgcacgtatgcaggtccag

SEQ ID NO: 244219 - DNA, 75 bp, Artificial Sequence
  Synthetic
cgcgtcctaaacgtgccaggcgactagcggctgcacgtatgcaggtccaggcggaagtgcaccgcccacccgtcg

SEQ ID NO: 244220 - DNA, 75 bp, Artificial Sequence
  Synthetic
tccaaaggacgaaaccggtcccagcaccgcgcaccagtttgcgtcccgtccctgcgcccagaaggtgtatgccaa

SEQ ID NO: 244221 - DNA, 75 bp, Artificial Sequence
  Synthetic
gaccagcagttgagctgccctggccgcaggaggccgtcgacatagagttcggggcgccgaccgaagaggagagtg

SEQ ID NO: 244222 - DNA, 75 bp, Artificial Sequence
  Synthetic
gcaggaggccgtcgacatagagttcggggcgccgaccgaagaggagagtgaaatcacattcggagacttttctgc

SEQ ID NO: 244223 - DNA, 75 bp, Artificial Sequence
  Synthetic
ttcggagtgggagaccatcagcaactcatcctgactaggccgagcgggggcttatatcttctcatcagacgtcgg

SEQ ID NO: 244224 - DNA, 75 bp, Artificial Sequence
  Synthetic
tcatcctgactaggccgagcgggggcttatatcttctcatcagacgtcggtccagggcatctacaacagaaatca

SEQ ID NO: 244225 - DNA, 75 bp, Artificial Sequence
  Synthetic
tccagggcatctacaacagaaatcagtgagacaacacgatctagaggtgccgattatggatcgcgtagttgagga

SEQ ID NO: 244226 - DNA, 75 bp, Artificial Sequence
  Synthetic
gaaagtctacccgccgaaactagatgaggcaaaagagaaacagctgctcttaaaactgcagatgcatgccacaga

SEQ ID NO: 244227 - DNA, 75 bp, Artificial Sequence
  Synthetic
tgccaaccggagccggtaccaatcaaggaaagttgagaacataaaagcaacgatcattgaccggctgaaacaagg

SEQ ID NO: 244228 - DNA, 75 bp, Artificial Sequence
  Synthetic
cgatcattgaccggctgaaacaaggcagcgcatcctacatctcggctgaggccgataaagcagtcacataccatg

SEQ ID NO: 244229 - DNA, 75 bp, Artificial Sequence
  Synthetic
ttaaatatgctaagcctcggtactctgtgccggtgatacaaagacttagcagtgcaaccaccgcagtcgcagctt

SEQ ID NO: 244230 - DNA, 75 bp, Artificial Sequence
  Synthetic
gcaatgaattcctggcccggaactaccctacagtggcgtcatatcagatcaccgatgagtacgacgcttatttag

SEQ ID NO: 244231 - DNA, 75 bp, Artificial Sequence
  Synthetic
ccctacagtggcgtcatatcagatcaccgatgagtacgacgcttatttagatatggtggacgggtcagaaagctg

SEQ ID NO: 244232 - DNA, 75 bp, Artificial Sequence
  Synthetic
cctagacagggcaaacttctgtccggcaaagctgcgctgctatccaaaacatcatgcataccatgtaccccagat

SEQ ID NO: 244233 - DNA, 75 bp, Artificial Sequence
  Synthetic
atcatgcataccatgtaccccagattagaagtgctgttccttcaccattccaaaatacgttgcagaatgtattag

SEQ ID NO: 244234 - DNA, 75 bp, Artificial Sequence
  Synthetic
tggaatgtttccgcaagtacgcctgtaacaacgaatattgggaagagtttgctgctaaacctatcagaattacaa

SEQ ID NO: 244235 - DNA, 75 bp, Artificial Sequence
  Synthetic
cagagaatttgaccacttatgtgaccaaactaaaaggtggaaaggcagccgccctgtttgctaagacgcataact

SEQ ID NO: 244236 - DNA, 75 bp, Artificial Sequence
  Synthetic
tagttccactgcaggaagttccaatggatagattcgtcatggacatgaagcgcgatgtgaaggttacaccaggga

SEQ ID NO: 244237 - DNA, 75 bp, Artificial Sequence
  Synthetic
cgaagcacacagaggaacgaccaaaggtccaagtgattcaagctgccgagcctctggctaccgcctatctgtgtg

SEQ ID NO: 244238 - DNA, 75 bp, Artificial Sequence
  Synthetic
cctctggctaccgcctatctgtgtgggattcacagagaactggttcgccggctcaatgctgtgttgttacctaac

SEQ ID NO: 244239 - DNA, 75 bp, Artificial Sequence
  Synthetic
atccataccctgtttgacatgtctgcggaagattttgatgccatcatatcagagcacttcaagccaggggaccat

SEQ ID NO: 244240 - DNA, 75 bp, Artificial Sequence
  Synthetic
agagcacttcaagccaggggaccatgtcttggaaacggacatcgcttcttttgacaaaagccaggacgattcact

SEQ ID NO: 244241 - DNA, 75 bp, Artificial Sequence
  Synthetic
ggcactaacagggctaatgatactggaagacttgggcgtcgataaccagttattggatcttatcgaggctgcatt

SEQ ID NO: 244242 - DNA, 75 bp, Artificial Sequence
  Synthetic
tggtcagattaccagctgccacctgcctacagggactaggtttaaatttggggctatgatgaagtcaggcatgtt

SEQ ID NO: 244243 - DNA, 75 bp, Artificial Sequence
  Synthetic
ccttacattgttcattaacaccgtcttgaacattaccattgccagtagagtgctggaagccagattaactaactc

SEQ ID NO: 244244 - DNA, 75 bp, Artificial Sequence
  Synthetic
aacctgtgcagcatttatcggcgacgacaacgtggttcacggagtcgtctccgataaactgatggccgatagatg

SEQ ID NO: 244245 - DNA, 75 bp, Artificial Sequence
  Synthetic
gacaacgtggttcacggagtcgtctccgataaactgatggccgatagatgcgccacttgggttaacatggaggtt

SEQ ID NO: 244246 - DNA, 75 bp, Artificial Sequence
  Synthetic
aaaataatagatgcagtcatgtgtgcaaagccaccgtacttctgtggaggctttttggtctatgatcatgtcaca

SEQ ID NO: 244247 - DNA, 75 bp, Artificial Sequence
  Synthetic
caaagccaccgtacttctgtggaggctttttggtctatgatcatgtcacaaggacgtcttgtcgaatagcagatc

SEQ ID NO: 244248 - DNA, 75 bp, Artificial Sequence
  Synthetic
cattaaaaaggttattcaaattgggcaaacctctgccggcagatgactgccaagatgaagaccgccgtagggcat

SEQ ID NO: 244249 - DNA, 75 bp, Artificial Sequence
  Synthetic
caaacctctgccggcagatgactgccaagatgaagaccgccgtagggcattgcacgacgaagttaaaaaatggtt

SEQ ID NO: 244250 - DNA, 75 bp, Artificial Sequence
  Synthetic
tgcacgacgaagttaaaaaatggtttagatcgggcttgggttcggagatcgaggtcgccctcgccaccagatacg

SEQ ID NO: 244251 - DNA, 75 bp, Artificial Sequence
  Synthetic
aggtggaaggggttcacaacctattgctggctatgtccacctttgcacacagtatgaaaaatttttctgcattga

SEQ ID NO: 244252 - DNA, 75 bp, Artificial Sequence
  Synthetic
gctggctatgtccacctttgcacacagtatgaaaaatttttctgcattgaggggacccgttatacacttgtacgg

SEQ ID NO: 244253 - DNA, 75 bp, Artificial Sequence
  Synthetic
cgacaaatgcagcagctgattgctgcggtcagtacgcttgcccttaggcaaaacgctgctgcccctcagcgtgga

SEQ ID NO: 244254 - DNA, 75 bp, Artificial Sequence
  Synthetic
aaccaaaaccacaacccgagaaacctaagaagcaagagcagaaaccgaagcaaaagaagacccctaagaagaagc

SEQ ID NO: 244255 - DNA, 75 bp, Artificial Sequence
  Synthetic
ccgggagaagggagcgcatgtgcatgaagattgagcacgattgcatctttgaggtcaagcacgaaggaaaggtca

SEQ ID NO: 244256 - DNA, 75 bp, Artificial Sequence
  Synthetic
caggctatgcctgccttgtcggtgacaaagtaatgaagccggcacacgtccctggagtgatagacaacatcgatc

SEQ ID NO: 244257 - DNA, 75 bp, Artificial Sequence
  Synthetic
cctggagtgatagacaacatcgatctcgcacgtctatcgtataagaaatctagtaagtatgacctggaatgtgca

SEQ ID NO: 244258 - DNA, 75 bp, Artificial Sequence
  Synthetic
acccgaaggtcactataactggcactatggggccgtccagtacacaggaggcagattcacggtgcccacaggagt

SEQ ID NO: 244259 - DNA, 75 bp, Artificial Sequence
  Synthetic
gggtaagcctggcgacagcggccggcccatctttgacaacaagggccgcgttgtcgcaatagtgctaggaggagc

SEQ ID NO: 244260 - DNA, 75 bp, Artificial Sequence
  Synthetic
taacgaaggtgccagaaccgcgctctctgttgtgacttggaataaagacatggtcaccaagatcacaccggaagg

SEQ ID NO: 244261 - DNA, 75 bp, Artificial Sequence
  Synthetic
cacagaggagtgggcagctccgacagtgacagctatgtgccttctggcaaatgtatccttcccttgtttccaacc

SEQ ID NO: 244262 - DNA, 75 bp, Artificial Sequence
  Synthetic
gagctgttctccatgctgttatgaaaaggggcctgagccgacgctgagaatgctggaagagaacgtaaactcaga

SEQ ID NO: 244263 - DNA, 75 bp, Artificial Sequence
  Synthetic
gccgtgtactgcaaaaacagctcgaggtcgaagaggagcactgcaaaccactttaacgcatacaagttgactcgt

SEQ ID NO: 244264 - DNA, 75 bp, Artificial Sequence
  Synthetic
ctttaacgcatacaagttgactcgtccatacgtagcctactgtgcagactgtggcatgggccattcttgccacag

SEQ ID NO: 244265 - DNA, 75 bp, Artificial Sequence
  Synthetic
tcccgccatgattgaaaatgtgcaggcggatgctacagacggcacgttaaagattcagtttgcttctcaaattgg

SEQ ID NO: 244266 - DNA, 75 bp, Artificial Sequence
  Synthetic
agattcagtttgcttctcaaattggcctaacgaaaacggacacgcatgatcacacaaaaattagatatgcagaag

SEQ ID NO: 244267 - DNA, 75 bp, Artificial Sequence
  Synthetic
ggcatgatatagcggaggctgccaggtcaactcttaaggtccatagcagcagtgagtgcgcggtgacaggaacga

SEQ ID NO: 244268 - DNA, 75 bp, Artificial Sequence
  Synthetic
agtgagtgcgcggtgacaggaacgatgggacacttcatcttggccaaatgtccaccaggcgaagtcattagtgtc

SEQ ID NO: 244269 - DNA, 75 bp, Artificial Sequence
  Synthetic
tcatttgttgattcaaaaaatgaacagcggacctgtcggatagcctaccaccatgaacagaggctaatagggcgt

SEQ ID NO: 244270 - DNA, 75 bp, Artificial Sequence
  Synthetic
agcggacctgtcggatagcctaccaccatgaacagaggctaatagggcgtgaaagattcacggtgcgaccacatc

SEQ ID NO: 244271 - DNA, 75 bp, Artificial Sequence
  Synthetic
acgggattgagctaccctgcaccacttaccagctaacgaccgccgaaacctctgaagagatagacatgcacatgc

SEQ ID NO: 244272 - DNA, 75 bp, Artificial Sequence
  Synthetic
cgccggacattccggacagaactatcctttcccagcaatcaggaaatgtcaagataacggtcaacgggcggaccg

SEQ ID NO: 244273 - DNA, 75 bp, Artificial Sequence
  Synthetic
cctttcccagcaatcaggaaatgtcaagataacggtcaacgggcggaccgtcaagtatagctgctcatgtggttc

SEQ ID NO: 244274 - DNA, 75 bp, Artificial Sequence
  Synthetic
tcaagtatagctgctcatgtggttctaaaccatcaggcacaacaactacagacaagactatcaacagctgcaccg

SEQ ID NO: 244275 - DNA, 75 bp, Artificial Sequence
  Synthetic
taaaccatcaggcacaacaactacagacaagactatcaacagctgcaccgttgacaaatgccaggcatatgtcac

SEQ ID NO: 244276 - DNA, 75 bp, Artificial Sequence
  Synthetic
ttgacaaatgccaggcatatgtcacgagccatacgaaatggcaatttaactcacctttcgttccacgcgcggagc

SEQ ID NO: 244277 - DNA, 75 bp, Artificial Sequence
  Synthetic
aagcggagcgtaagggcaaggtgcacattccctttccacttattaacactacctgccgagtaccattggctcccg

SEQ ID NO: 244278 - DNA, 75 bp, Artificial Sequence
  Synthetic
acctgccgagtaccattggctcccgaagccctagtcaggagcggtaaacgagaagctacgctctcactgcacccg

SEQ ID NO: 244279 - DNA, 75 bp, Artificial Sequence
  Synthetic
agaagctacgctctcactgcacccgatacatcccacattgctaagttacagaacactgggacgcgagccagtttt

SEQ ID NO: 244280 - DNA, 75 bp, Artificial Sequence
  Synthetic
tgatgaacagtggatcaccacccagacggaggtaacaatcccagtaccagtggagggagtggagtatcggtgggg

SEQ ID NO: 244281 - DNA, 75 bp, Artificial Sequence
  Synthetic
tggagggagtggagtatcggtggggcaaccataaaccgcaacgcttgtggtcacagctaacaactgaaggcagag

SEQ ID NO: 244282 - DNA, 75 bp, Artificial Sequence
  Synthetic
cacatggctggccccatgagattatcgagtactactacgggctgcatcctacgacaaccattgtcgtggtggttg

SEQ ID NO: 244283 - DNA, 75 bp, Artificial Sequence
  Synthetic
acgacaaccattgtcgtggtggttgcggtcacagtagtggtgctcttgtcagttgctgcctctgtttatatgtgt

SEQ ID NO: 244284 - DNA, 75 bp, Artificial Sequence
  Synthetic
gtagtggcacgcaacaagtgcctgacaccatacgcactcaccccgggggctgttgtccctgttactatcggggtg

SEQ ID NO: 244285 - DNA, 75 bp, Artificial Sequence
  Synthetic
caccatacgcactcaccccgggggctgttgtccctgttactatcggggtgttatgctgtgcaccgaaagcgcatg

SEQ ID NO: 244286 - DNA, 75 bp, Artificial Sequence
  Synthetic
ctacctgtgggacaataaccagtcaatgttctggatggagttaactggacctttggctcttcttatcctgactac

SEQ ID NO: 244287 - DNA, 75 bp, Artificial Sequence
  Synthetic
tgctgcaagggatcttttttagtcgcagtgagcgtcgggagtgccgttgccagtgcttacgagcacacggcagtt

SEQ ID NO: 244288 - DNA, 75 bp, Artificial Sequence
  Synthetic
attccaaatcaagtgggattcccgtataaggctcatgttgcacgtgaaggatacagcccgctgacactgcagatg

SEQ ID NO: 244289 - DNA, 75 bp, Artificial Sequence
  Synthetic
atacagcccgctgacactgcagatgcaggtggttgaaaccagtcttgagccaacgctcaacctggagtatatcac

SEQ ID NO: 244290 - DNA, 75 bp, Artificial Sequence
  Synthetic
caacgctcaacctggagtatatcacttgtgactacaagacaaaggttccgtcaccgtacgtaaagtgctgtggca

SEQ ID NO: 244291 - DNA, 75 bp, Artificial Sequence
  Synthetic
tacgtggagcgtgctgacgtgtgcaaacacgactacgcagccgcctaccgcgcccacactgcttccctcagagcc

SEQ ID NO: 244292 - DNA, 75 bp, Artificial Sequence
  Synthetic
aacacgactacgcagccgcctaccgcgcccacactgcttccctcagagccaaaatcaaggtaacatatggcactg

SEQ ID NO: 244293 - DNA, 75 bp, Artificial Sequence
  Synthetic
taaatcagactgtcgaggcgtatgtgaacggtgaccatgccgtaacgattgccgggacgaagtttatctttggtc

SEQ ID NO: 244294 - DNA, 75 bp, Artificial Sequence
  Synthetic
cggtgtcaacggcctggacaccgttcgatactaaaatcgtggtctataaaggggaggtatacaaccaggactttc

SEQ ID NO: 244295 - DNA, 75 bp, Artificial Sequence
  Synthetic
cgatactaaaatcgtggtctataaaggggaggtatacaaccaggactttcccccgtatggtgccgggcagcctgg

SEQ ID NO: 244296 - DNA, 75 bp, Artificial Sequence
  Synthetic
aagatttggagacatccagagtaggacgttggacagtaaggacctatatgcaaacacgggccttaagctggcaag

SEQ ID NO: 244297 - DNA, 75 bp, Artificial Sequence
  Synthetic
accagcagccggcaacatccacgtcccctatacccagacaccatctggttttaaaacatggcaaaaagacaggga

SEQ ID NO: 244298 - DNA, 75 bp, Artificial Sequence
  Synthetic
ctcaccgttaaacgctaaggcacccttcggatgcacaatccagacaaatccggtcagagcgatgaattgcgctgt

SEQ ID NO: 244299 - DNA, 75 bp, Artificial Sequence
  Synthetic
cggtcagagcgatgaattgcgctgtcggcaacatacccgtttcgatggatatcgccgacagcgcgttcactagac

SEQ ID NO: 244300 - DNA, 75 bp, Artificial Sequence
  Synthetic
tgactgatgcgcctataatatctgagctgctgtgcactgtatctacatgcacgcattcttcagacttcggtggag

SEQ ID NO: 244301 - DNA, 75 bp, Artificial Sequence
  Synthetic
aggaagtttccatcgaggcagaaggtcgatcagtgatccacttctcgaccgcatcagccgccccttccttcatag

SEQ ID NO: 244302 - DNA, 75 bp, Artificial Sequence
  Synthetic
tatccgtctgcagctcgcgtgccacgtgcacagcgaaatgtgaaccaccgaaagaccatgtggtcacctatccgg

SEQ ID NO: 244303 - DNA, 75 bp, Artificial Sequence
  Synthetic
caaatcacaacgggataactttgccggacttatccagcactgcaatgacctgggcgcaacatcttgccggtggag

SEQ ID NO: 244304 - DNA, 75 bp, Artificial Sequence
  Synthetic
ttgggctattgatagctctggcagtgctaattctagtaatagttacttgcataactttgagaaggtgaaccataa

SEQ ID NO: 244305 - DNA, 75 bp, Artificial Sequence
  Synthetic
gtaccgtgtataatgcgggctggtatatatgtaaccattattatatattttaaccatattaatattcaattatca

SEQ ID NO: 244306 - DNA, 75 bp, Artificial Sequence
  Synthetic
aattcggtaccgtgcatgatgcggaccgatttattattcacatatataacccttattatatcacatcatatattc

SEQ ID NO: 244307 - DNA, 75 bp, Artificial Sequence
  Synthetic
ccgatttattattcacatatataacccttattatatcacatcatatattcaatttaaaatttctatacgcgtctc

SEQ ID NO: 244308 - DNA, 75 bp, Artificial Sequence
  Synthetic
taatggcgcatataataaccacctacaatttttttcattttctttatttgtgccactatagggcacttactaacc

SEQ ID NO: 244309 - DNA, 75 bp, Artificial Sequence
  Synthetic
aatggcgcatataataaccacctacaatttttttcattttctttatttgtgccactatagggcacttactaacca

SEQ ID NO: 244310 - DNA, 75 bp, Artificial Sequence
  Synthetic
atggcgggcaagtgacacttgttccgccggacgtctctaagctcttcctctgcattgcaagagtttaccactcag

SEQ ID NO: 244311 - DNA, 75 bp, Artificial Sequence
  Synthetic
tgccttcacacagatcagacatgcaggactccagctgaggtggcagtctatcaggatgtctatgcagttcacgca

SEQ ID NO: 244312 - DNA, 75 bp, Artificial Sequence
  Synthetic
gcagaaggatttctggtatgtaaaaccactgacactatcgcaggagaacgagtttcgttccccgtttgcacgtat

SEQ ID NO: 244313 - DNA, 75 bp, Artificial Sequence
  Synthetic
gtgccgtcgacgatctgtgaccaaatgacaggcattctggcgactgaggtcacgcccgaggatgcgcaaaaattg

SEQ ID NO: 244314 - DNA, 75 bp, Artificial Sequence
  Synthetic
gggttgtcgatcggaattagacacaggatcaggcttcttttgcagtcaagacgtgccgagccgctcgttccattt

SEQ ID NO: 244315 - DNA, 75 bp, Artificial Sequence
  Synthetic
atggatgctagtgaagccagagcagcagagaaggaggctgcagaagctaaggaggcagaagagacactggcagcc

SEQ ID NO: 244316 - DNA, 75 bp, Artificial Sequence
  Synthetic
cagagaaggaggctgcagaagctaaggaggcagaagagacactggcagccctaccacctctgatcccgaccgctc

SEQ ID NO: 244317 - DNA, 75 bp, Artificial Sequence
  Synthetic
cgctgctcgatgacatccctgaagttgatgtagaggagctggagtttcgagcaggagccggtgttgtcgaaacgc

SEQ ID NO: 244318 - DNA, 75 bp, Artificial Sequence
  Synthetic
tgatgtagaggagctggagtttcgagcaggagccggtgttgtcgaaacgcctcggaacgccctcaaagttacacc

SEQ ID NO: 244319 - DNA, 75 bp, Artificial Sequence
  Synthetic
gtgcagggcgctaccaagtggatgcctatgacggccgtgttttaatcccgacaggcgcggctatcccggtacccg

SEQ ID NO: 244320 - DNA, 75 bp, Artificial Sequence
  Synthetic
tttatcaatcgcaaattgtaccacatagccgtacatggggcagccctgaacaccgatgaggagggttacgagaaa

SEQ ID NO: 244321 - DNA, 75 bp, Artificial Sequence
  Synthetic
tggtcaacccaccattccacgaatttgcgtatgaaggactgaaacgaagaccagcggctccatacaaaacaactg

SEQ ID NO: 244322 - DNA, 75 bp, Artificial Sequence
  Synthetic
gatgcaactacaggttaactttaaccacaacatctgcaccgaggtacaccataagagcatttccagaagatgcac

SEQ ID NO: 244323 - DNA, 75 bp, Artificial Sequence
  Synthetic
gctaccagtcaccgccattgtctcaacactacactatgagggcaaaatgcgcaccactaacccatacaataaacc

SEQ ID NO: 244324 - DNA, 75 bp, Artificial Sequence
  Synthetic
acactacactatgagggcaaaatgcgcaccactaacccatacaataaacccgttgtcattgacaccacaggccag

SEQ ID NO: 244325 - DNA, 75 bp, Artificial Sequence
  Synthetic
aacgaaaacccactgtacgcacaatcatcggagcatgttaatgttctactgacacgcacagagggcagactagtg

SEQ ID NO: 244326 - DNA, 75 bp, Artificial Sequence
  Synthetic
tggaagacactgtcaggagatccctggatcaaaactttgagcaacatcccaaaagggaatttcacagcaactttg

SEQ ID NO: 244327 - DNA, 75 bp, Artificial Sequence
  Synthetic
agtgcttggtacccgttttggaaaccgcggggatcaagttgtcagccgccgattggagctcaatcattttggctt

SEQ ID NO: 244328 - DNA, 75 bp, Artificial Sequence
  Synthetic
tcaaagaagacagagcttattcaccagaggttgcactgaatgagatttgcactaaaatctacggggcggatttgg

SEQ ID NO: 244329 - DNA, 75 bp, Artificial Sequence
  Synthetic
cattgggataactcgcctggaggaaggatgtacgggttttccgtcgaggccgccaaccgcctagaacaacggcac

SEQ ID NO: 244330 - DNA, 75 bp, Artificial Sequence
  Synthetic
ccgttctacaggggacggtgggcttctgggcaggtgttggtcgcagaacgaagaactcagccgattgacatcact

SEQ ID NO: 244331 - DNA, 75 bp, Artificial Sequence
  Synthetic
tgcaacctaatccccttcaaccggagactcccacacgcgctggtcacggaatatcatccagttaagggagaaaga

SEQ ID NO: 244332 - DNA, 75 bp, Artificial Sequence
  Synthetic
aggaaggtaacgtggattgccccgccgactgtgacaggagccgatttaacccacgacttggatttaggactaccg

SEQ ID NO: 244333 - DNA, 75 bp, Artificial Sequence
  Synthetic
gtgacttggcggcggcatacagggccgtagcagcggagattaaccgactgtctataagtagtgtggcgattccac

SEQ ID NO: 244334 - DNA, 75 bp, Artificial Sequence
  Synthetic
ctactgccgcgataaaacgtgggagcaaaagatcaaaacagttctgcagaatcgctgcgccactgaactggtgtc

SEQ ID NO: 244335 - DNA, 75 bp, Artificial Sequence
  Synthetic
atcgctgcgccactgaactggtgtctgatgtgctacagcttgaagtcaatttgaccagagtccatccggacagca

SEQ ID NO: 244336 - DNA, 75 bp, Artificial Sequence
  Synthetic
caccactgatgggaccttatattcctatatggaaggtactaagttccaccaagcggctcttgacatggctgagat

SEQ ID NO: 244337 - DNA, 75 bp, Artificial Sequence
  Synthetic
atgcactgggcgagacgatggacaacatccgctctagatgcccagttgaggatagtgactcatcgactccaccga

SEQ ID NO: 244338 - DNA, 75 bp, Artificial Sequence
  Synthetic
catccgctctagatgcccagttgaggatagtgactcatcgactccaccgaagacagtcccatgtctctgtcggta

SEQ ID NO: 244339 - DNA, 75 bp, Artificial Sequence
  Synthetic
tgatgctttttgatgcaactccaccggcctctgttagtcctgtgcaatacctgacgagtcacagtgaaactactg

SEQ ID NO: 244340 - DNA, 75 bp, Artificial Sequence
  Synthetic
aactgggcaatgatccacagtccatgcggatggacgagtctgacaaccggcaacccatatcaacggtagaaccgg

SEQ ID NO: 244341 - DNA, 75 bp, Artificial Sequence
  Synthetic
gggcatctgcaacagaaatcagtgagacagcacgatctagaggtgccgattatggatcgcgtagtcgaggagaaa

SEQ ID NO: 244342 - DNA, 75 bp, Artificial Sequence
  Synthetic
cattgaccggctgaaacaaggcagcgcatcctacatctcggctgaggccaataaagcaatcacataccatgtcaa

SEQ ID NO: 244343 - DNA, 75 bp, Artificial Sequence
  Synthetic
atatgctaagcctcggtactctgtgccggtgatgcaaagacttagcagtgcaaccaccgcagttgccgcttgcaa

SEQ ID NO: 244344 - DNA, 75 bp, Artificial Sequence
  Synthetic
acagtggcgtcatatcagatcaccgatgagtacgacgcttatttagatatggtggacgggtcagaaagctgccta

SEQ ID NO: 244345 - DNA, 75 bp, Artificial Sequence
  Synthetic
gacagagcaaacttctgcccggcgaagttgcgctgctatccaaaacaccatgcataccatgtaccccagattaga

SEQ ID NO: 244346 - DNA, 75 bp, Artificial Sequence
  Synthetic
agtgctgttccttcgccattccaaaacacgttgcagaatgtattagcggccgccactaagcgtaattgcaacgtc

SEQ ID NO: 244347 - DNA, 75 bp, Artificial Sequence
  Synthetic
acccagatgcgtgaactaccaaccctggattcagccgtgtacaacgtggaatgtttccgcaagtacgcctgtaac

SEQ ID NO: 244348 - DNA, 75 bp, Artificial Sequence
  Synthetic
ctaaacctatcagaattacaacagagaatttgaccacttatgtgaccaaattaaaaggtggaaaggcagccgccc

SEQ ID NO: 244349 - DNA, 75 bp, Artificial Sequence
  Synthetic
gaatttgaccacttatgtgaccaaattaaaaggtggaaaggcagccgccctgtttgcaaagacgcataacttagt

SEQ ID NO: 244350 - DNA, 75 bp, Artificial Sequence
  Synthetic
tggctaccgcctacctgtgtggaattcacagagaactggttcgccggctcaatgctgtgttgctacctaacatcc

SEQ ID NO: 244351 - DNA, 75 bp, Artificial Sequence
  Synthetic
cagattaccagctgccacctgcctacagggactaggtttaaatttggggctatgatgaagtcaggcatgtttctt

SEQ ID NO: 244352 - DNA, 75 bp, Artificial Sequence
  Synthetic
acattgttcattaacaccgttttgaacattaccattgccagtagagtgctggaagccagattaactaactcagcc

SEQ ID NO: 244353 - DNA, 75 bp, Artificial Sequence
  Synthetic
tgtgccgcatttatcggcgacgacaacgtggttcacggagtcgtctccgataaactgatggcagatagatgtgcc

SEQ ID NO: 244354 - DNA, 75 bp, Artificial Sequence
  Synthetic
acttgggttaacatggaggttaaaataatagatgcagtcatgtgtgcaaagccaccgtatttctgtggaggcttt

SEQ ID NO: 244355 - DNA, 75 bp, Artificial Sequence
  Synthetic
taatagatgcagtcatgtgtgcaaagccaccgtatttctgtggaggctttttggtctatgatcatgtcacaagga

SEQ ID NO: 244356 - DNA, 75 bp, Artificial Sequence
  Synthetic
cgtcatgtcgaatagcggatccattaaaaaggttattcaaattgggcaaacccctgccggcagacgactgccaag

SEQ ID NO: 244357 - DNA, 75 bp, Artificial Sequence
  Synthetic
atgaagaccgccgtagggcattgcacgacgaggttaaaaaatggtttagatcaggcttgggttcggagattgagg

SEQ ID NO: 244358 - DNA, 75 bp, Artificial Sequence
  Synthetic
tcaggcttgggttcggagattgaggtcgccctcgccaccagatacgaggtggaagggggtcacaacctactgctg

SEQ ID NO: 244359 - DNA, 75 bp, Artificial Sequence
  Synthetic
gctatgtccacctttgcacacagcatgaagaatttttctgcattgaggggacccgtcatacacttgtacggcggt

SEQ ID NO: 244360 - DNA, 75 bp, Artificial Sequence
  Synthetic
cagtacgcttgcccttaggcaaaacgctgctgcccctcagcgtggaagaaagaagcaaccacgtagaaagaaacc

SEQ ID NO: 244361 - DNA, 75 bp, Artificial Sequence
  Synthetic
aagtatgacctggaatgtgcacagataccggtggctatgaagtcagatgcatcgaaatacacccatgaaaaaccc

SEQ ID NO: 244362 - DNA, 75 bp, Artificial Sequence
  Synthetic
gaaggtgccagaaccgcgctctctgtcgtgacgtggaataaagacatggtcaccaagatcacaccggagggcaca

SEQ ID NO: 244363 - DNA, 75 bp, Artificial Sequence
  Synthetic
gaggagtgggcagctccgacagtgacagctatgtgccttctggcgaatgtatccttcccatgtttccaaccgagc

SEQ ID NO: 244364 - DNA, 75 bp, Artificial Sequence
  Synthetic
ggaagagaacgtaaactcagagggatactatgaattgttgcatgctgccgtgtactgcaaaaacagctcgaggtc

SEQ ID NO: 244365 - DNA, 75 bp, Artificial Sequence
  Synthetic
tactatgaattgttgcatgctgccgtgtactgcaaaaacagctcgaggtcgaagaggagcactgcaaatcacttt

SEQ ID NO: 244366 - DNA, 75 bp, Artificial Sequence
  Synthetic
catgggccattcttgccacagtcccgccatgattgaaaatgtgcaggcggatgctacagatggcacgttaaagat

SEQ ID NO: 244367 - DNA, 75 bp, Artificial Sequence
  Synthetic
gccatgattgaaaatgtgcaggcggatgctacagatggcacgttaaagattcaattcgcttctcaaattggccta

SEQ ID NO: 244368 - DNA, 75 bp, Artificial Sequence
  Synthetic
caaatgccaggcatatgtcacgagccatacgaaatggcaatttaattcacctttcgttccgcgcgcggagcaagc

SEQ ID NO: 244369 - DNA, 75 bp, Artificial Sequence
  Synthetic
ggagcgtaagggcaaggtgcacattccctttccacttatcaacaccacctgccgagtaccattggctcccgaagc

SEQ ID NO: 244370 - DNA, 75 bp, Artificial Sequence
  Synthetic
gggagtggagtatcggtggggcaaccacaaaccacaacgcttgtggtcacagctaacaactgatggcagagcaca

SEQ ID NO: 244371 - DNA, 75 bp, Artificial Sequence
  Synthetic
tggctggccccatgaaattatcgagtactactacgggctgcatcctacgacaaccattgtcgtggtggttgctgt

SEQ ID NO: 244372 - DNA, 75 bp, Artificial Sequence
  Synthetic
ctcagtagtggtgctcttgtcagttgctgcatctgtttatatgtgtgtagtggcacgcaacaagtgcctgacacc

SEQ ID NO: 244373 - DNA, 75 bp, Artificial Sequence
  Synthetic
atatgcactcaccccgggggccgttgtccctgttactatcggggtattatgctgtgcaccgaaagcgcacgcagc

SEQ ID NO: 244374 - DNA, 75 bp, Artificial Sequence
  Synthetic
tagctttgctgaaggcatggcctacctgtgggataataaccagtcaatgttctggatggagttgactggaccttt

SEQ ID NO: 244375 - DNA, 75 bp, Artificial Sequence
  Synthetic
ggctcttcttatcctgactacatgttgcgcccgatcactactttcctgctgcaagggatcttttttagtcgcagt

SEQ ID NO: 244376 - DNA, 75 bp, Artificial Sequence
  Synthetic
tggttgaaaccagtctagagccaacgctcaacctggagtatatcacttgcgactacaaaacaaaggttccatccc

SEQ ID NO: 244377 - DNA, 75 bp, Artificial Sequence
  Synthetic
cgtacgtaaagtgctgtggcacagctgaatgccgcacgcaggacaagcccgaatacaagtgtgcggtgttcacgg

SEQ ID NO: 244378 - DNA, 75 bp, Artificial Sequence
  Synthetic
tgaatgccgcacgcaggacaagcccgaatacaagtgtgcggtgttcacgggcgtgtacccttttatgtggggagg

SEQ ID NO: 244379 - DNA, 75 bp, Artificial Sequence
  Synthetic
gcgtgtacccttttatgtggggaggtgcatactgtttttgtgactcggaaaacacacagatgagtgaggcctacg

SEQ ID NO: 244380 - DNA, 75 bp, Artificial Sequence
  Synthetic
cgtctgcagctcgcgtgccacgtgcacagctaaatgtgaaccaccgaaagaccatgtggtcacttacccggcaaa

SEQ ID NO: 244381 - DNA, 75 bp, Artificial Sequence
  Synthetic
tcacaacgggataactttgccggacttatccagcactgcaatgacttgggcgcaacatcttgccggtggagtcgg

SEQ ID NO: 244382 - DNA, 75 bp, Artificial Sequence
  Synthetic
gctattgatagcactggcagtgctaattctagtaatagttacttgcataactttgagaaggtgaatcataagtac

SEQ ID NO: 244383 - DNA, 75 bp, Artificial Sequence
  Synthetic
catgtataatgcgggctggcatatatgtaaccattattatatattttaaccatattaacattcgaatatcaaatt

SEQ ID NO: 244384 - DNA, 75 bp, Artificial Sequence
  Synthetic
aggtgccgtgcatgatgcggaccgatttattattcacatatgtaacctttatcatattacatcatatattcaatt

SEQ ID NO: 244385 - DNA, 75 bp, Artificial Sequence
  Synthetic
ttaaaatttctatacgcgtctctaatggcgcatataataaccacctacaattttcttcattttctttatttgtgc

SEQ ID NO: 244386 - DNA, 75 bp, Artificial Sequence
  Synthetic
cttcattttctttatttgtgccactatagggcacttactaaccatagaagtaattcattttgtttttaatatttc

SEQ ID NO: 244387 - DNA, 75 bp, Artificial Sequence
  Synthetic
gctcttcctctgcattgcaagagtttaccactcagaatgtcgaaagtctttgtagatatcgaggccgagagcccg

SEQ ID NO: 244388 - DNA, 75 bp, Artificial Sequence
  Synthetic
acggacattttgccttcacacagatcagacatgcaggactccagcagaggtggcggtctatcaagatgtctatgc

SEQ ID NO: 244389 - DNA, 75 bp, Artificial Sequence
  Synthetic
agttcatgcaccgacttctttgtacttccaggcaatgaaaggagtacgcacagcgtactggattgggttcgacac

SEQ ID NO: 244390 - DNA, 75 bp, Artificial Sequence
  Synthetic
ataatgttctcggtaggttccacattgtatacggaaagccgacgtctgctaaagagttggcatctaccgtcagtg

SEQ ID NO: 244391 - DNA, 75 bp, Artificial Sequence
  Synthetic
ttccatctgaaaggacgacaatcatatacgtgccggtgcgatacaatagtgtcatgtgagggctacgttgttaag

SEQ ID NO: 244392 - DNA, 75 bp, Artificial Sequence
  Synthetic
cacacatcacgcagaaggatttctggtatgcaaaaccactgacactatcgcaggagaacgtgtctcgttccccgt

SEQ ID NO: 244393 - DNA, 75 bp, Artificial Sequence
  Synthetic
ttgcacgtatgtgccatcgacgatctgtgaccaaatgacaggcattctggcgactgaggtcacgcccgaggatgc

SEQ ID NO: 244394 - DNA, 75 bp, Artificial Sequence
  Synthetic
gtcgaaacgcctcggaatgccctcaaagttacaccacaagacagagacaccatggtaggtagctatctcgttctg

SEQ ID NO: 244395 - DNA, 75 bp, Artificial Sequence
  Synthetic
cgaacgtgagtttatcaatcgcaaattgtaccacatagccgtacatggggcggccctgaacacagatgaggaggg

SEQ ID NO: 244396 - DNA, 75 bp, Artificial Sequence
  Synthetic
ttacgagaaagtgcgggccgaaaggacagatgccgagtacgtctttgacgtggatcgcaaacagtgcgttaagag

SEQ ID NO: 244397 - DNA, 75 bp, Artificial Sequence
  Synthetic
gcgaccacgtaagaaggttgtgctttgcggcgacccaaaacagtgcggtttcttcaacttgatgcaactacaggt

SEQ ID NO: 244398 - DNA, 75 bp, Artificial Sequence
  Synthetic
taactttaatcacaacatctgcaccgaggtgcaccataagagcatctccagaagatgcacgctaccaatcaccgc

SEQ ID NO: 244399 - DNA, 75 bp, Artificial Sequence
  Synthetic
acaataaacctgttatcattgacaccacaggccagactaaaccaaaccgcgaggacattgtgttaacgtgtttcc

SEQ ID NO: 244400 - DNA, 75 bp, Artificial Sequence
  Synthetic
cacaggccagactaaaccaaaccgcgaggacattgtgttaacgtgtttccgcggttgggttaagcagctgcagct

SEQ ID NO: 244401 - DNA, 75 bp, Artificial Sequence
  Synthetic
tgttgggccaagtgtttggtacccgttttggaaaccgcggggatcaagttgtcagccgccgattggagcgcaatc

SEQ ID NO: 244402 - DNA, 75 bp, Artificial Sequence
  Synthetic
attttggccttcaaagaagacagagcttattcaccagaggttgcactgaatgagatttgcactaaaatctacggg

SEQ ID NO: 244403 - DNA, 75 bp, Artificial Sequence
  Synthetic
gtggatttagatagcggcctgttttcggctccacgtgtgtcgctacactacactacaaatcattgggataactcg

SEQ ID NO: 244404 - DNA, 75 bp, Artificial Sequence
  Synthetic
cggtgggcttctgggcaggtgttggtcgcagaacgaaaaactcagccgattgacatcacttgcaacctaattccc

SEQ ID NO: 244405 - DNA, 75 bp, Artificial Sequence
  Synthetic
ttcaaccggagactcccacatgcgttggtcacggaatatcatccagttaagggagaaagagtggagtggctggtg

SEQ ID NO: 244406 - DNA, 75 bp, Artificial Sequence
  Synthetic
gggagaaagagtggagtggctggtgaataagatctcaggctatcacttgctactggttagcgagtataacctcat

SEQ ID NO: 244407 - DNA, 75 bp, Artificial Sequence
  Synthetic
actgcctagaaggaaggtaacgtggattgccccgccgactgtgacaggagccgatttaacccacgacttggattt

SEQ ID NO: 244408 - DNA, 75 bp, Artificial Sequence
  Synthetic
caatttatgcaggtacagtgctgcaggcggccggctgcgctcccgcttacactgtcaaaagggcagacatcgcga

SEQ ID NO: 244409 - DNA, 75 bp, Artificial Sequence
  Synthetic
taacgcagcgacacctgtcggaaccgcaaaaaccgtcaagtgcgacgagacttacatcattcacgcggtgggccc

SEQ ID NO: 244410 - DNA, 75 bp, Artificial Sequence
  Synthetic
aaattttaacaatacatctgaggctgaaggggatcgtgacttggcggcggcatacagagccgtagcagcggagat

SEQ ID NO: 244411 - DNA, 75 bp, Artificial Sequence
  Synthetic
catacagagccgtagcagcggagattaaccgattgtctataagcagtgtggcgattccactgctttccacaggta

SEQ ID NO: 244412 - DNA, 75 bp, Artificial Sequence
  Synthetic
aactggtgtccgatgagctacagcttgaagtcaatttgaccagagtccatccggatagcagcctggtgggacgtc

SEQ ID NO: 244413 - DNA, 75 bp, Artificial Sequence
  Synthetic
tcactagaagaactagaccatgagtccatgcggatggacgagtctgacaaccaacccataacaacggcagaaccg

SEQ ID NO: 244414 - DNA, 75 bp, Artificial Sequence
  Synthetic
gtcctaaacgtgccaggcgactagcggccgcacgtatgcaggtccaggtggaagtacaccgcccacccgtcgtcc

SEQ ID NO: 244415 - DNA, 75 bp, Artificial Sequence
  Synthetic
gcgcccagaaggtgtatgccaagaccagcgtgccaagacacggtagttgagctaccctggccgcaggaggccgtc

SEQ ID NO: 244416 - DNA, 75 bp, Artificial Sequence
  Synthetic
acataaaagcaacgatcattgaccggctgaaacaaggcagcgcatcctacatctcggctgaggccaataaagcag

SEQ ID NO: 244417 - DNA, 75 bp, Artificial Sequence
  Synthetic
tcacatatcatgtcaaatatgccaagcctcggtactctgtgccggtgatgcaaagacttagcagtgcaaccaccg

SEQ ID NO: 244418 - DNA, 75 bp, Artificial Sequence
  Synthetic
caaagacttagcagtgcaaccaccgcagttgcagcttgcaatgaatttctggcccggaactaccctacagtggcg

SEQ ID NO: 244419 - DNA, 75 bp, Artificial Sequence
  Synthetic
gctatccaaaacaccatgcataccatgtaccccagattagaagtgctgttccttcgccattccaaaacacgctgc

SEQ ID NO: 244420 - DNA, 75 bp, Artificial Sequence
  Synthetic
agaatgtattagctgccgccactaaacgtaattgcaacgtcacccagatgcgtgaactaccaaccctggattcag

SEQ ID NO: 244421 - DNA, 75 bp, Artificial Sequence
  Synthetic
cacttatgtgaccaaattaaaaggtggaaaggcagctgccctgtttgcaaagacgcataacctagttccactgca

SEQ ID NO: 244422 - DNA, 75 bp, Artificial Sequence
  Synthetic
ccaggggaccatgtcttggaaacggatatcgcttcttttgacaaaagtcaggacgactcattggcactaacaggg

SEQ ID NO: 244423 - DNA, 75 bp, Artificial Sequence
  Synthetic
tttctgtggaggctttttggtctatgatcatgtcacagggacgtcgtgtcgaatagcagatccattaaaaaggtt

SEQ ID NO: 244424 - DNA, 75 bp, Artificial Sequence
  Synthetic
taaaaaatggtttagaacaggcttgggttcggagatcgaggtcgccctcgccaccagatacgaggtggaaggggg

SEQ ID NO: 244425 - DNA, 75 bp, Artificial Sequence
  Synthetic
ggttcggagatcgaggtcgccctcgccaccagatacgaggtggaagggggtcacaatctattgctggctatgtcc

SEQ ID NO: 244426 - DNA, 75 bp, Artificial Sequence
  Synthetic
acacttgtacggcggtcctaaataggtgctctacacgacacctataccaccatggatttcctaccaacacaagtg

SEQ ID NO: 244427 - DNA, 75 bp, Artificial Sequence
  Synthetic
gtgctctacacgacacctataccaccatggatttcctaccaacacaagtgttttacggcaggcgatggagaccac

SEQ ID NO: 244428 - DNA, 75 bp, Artificial Sequence
  Synthetic
gaatgccgccacgcccttggaggccacgcccgcctacaattcaaagaccagatcaacaggcccgacaaatgcagc

SEQ ID NO: 244429 - DNA, 75 bp, Artificial Sequence
  Synthetic
ccggcacacgtccctggagtgatagacaacattgatctcgcacgtctatcgtacaagaaatctagtaagtatgac

SEQ ID NO: 244430 - DNA, 75 bp, Artificial Sequence
  Synthetic
gctaggaggagctaatgaaggtgccagaaccgcgctctctgtcgtgacgtggaataaagacatggtcaccaagat

SEQ ID NO: 244431 - DNA, 75 bp, Artificial Sequence
  Synthetic
agaaccgcgctctctgtcgtgacgtggaataaagacatggtcaccaagatcacacccgaaggcacagaggagtgg

SEQ ID NO: 244432 - DNA, 75 bp, Artificial Sequence
  Synthetic
gcagctccgacagtgacagctatgtgccttctggcgaatgtatccttcccttgtttccaaccgagctgctcccca

SEQ ID NO: 244433 - DNA, 75 bp, Artificial Sequence
  Synthetic
tgctgttatgaaaaggggcccgagccgacgctgagaatgctggaagagaacgtaaactcagaggggtactatgaa

SEQ ID NO: 244434 - DNA, 75 bp, Artificial Sequence
  Synthetic
cgacgctgagaatgctggaagagaacgtaaactcagaggggtactatgaactgttacatgctgccgtgtattgca

SEQ ID NO: 244435 - DNA, 75 bp, Artificial Sequence
  Synthetic
ttctcaaattggcctaacgaaaacggacacgcatgatcatacaaagattagatatgcagaagggcatgatatagc

SEQ ID NO: 244436 - DNA, 75 bp, Artificial Sequence
  Synthetic
ctcatgtggttctaaaccatcaggcacaacaaccacagacaagattatcaatagctgcaccgttgacaaatgcca

SEQ ID NO: 244437 - DNA, 75 bp, Artificial Sequence
  Synthetic
cttatcaacaccacctgccgagtgccattggctcccgaagcccttgtcagaagcggtaaacgagaagctacgctc

SEQ ID NO: 244438 - DNA, 75 bp, Artificial Sequence
  Synthetic
cgagccagtttttgatgaacagtggatcactacccagacagaggtaacaatcccagtaccagtggagggagtgga

SEQ ID NO: 244439 - DNA, 75 bp, Artificial Sequence
  Synthetic
tcgtggtggttgctgtctcagtagtggtgctcttgtcagttgctgcctccgtttatatgtgtgtagtggcacgca

SEQ ID NO: 244440 - DNA, 75 bp, Artificial Sequence
  Synthetic
cgaaagcgcatgcagctagctttgctgaaggcatggcctacctgtgggataataaccagtcaatgttctggatgg

SEQ ID NO: 244441 - DNA, 75 bp, Artificial Sequence
  Synthetic
cttttatgtggggaggtgcatactgtttttgtgattcggaaaacacacagatgagtgaagcctacgtagagcgcg

SEQ ID NO: 244442 - DNA, 75 bp, Artificial Sequence
  Synthetic
tttttgtgattcggaaaacacacagatgagtgaagcctacgtagagcgcgctgacgtgtgcaaacacgattacgc

SEQ ID NO: 244443 - DNA, 75 bp, Artificial Sequence
  Synthetic
catatggcactgtaaatcagactgtcgaggcgtatgtgaacggtgaccatgccgtaacgattgccgggacgaagt

SEQ ID NO: 244444 - DNA, 75 bp, Artificial Sequence
  Synthetic
cgaggcgtatgtgaacggtgaccatgccgtaacgattgccgggacgaagttcatctttggcccggtgtcaacggc

SEQ ID NO: 244445 - DNA, 75 bp, Artificial Sequence
  Synthetic
acttcggtggagtcgctgtactttcttacaaggtggaaaaagcaggcaggtgcgacgtccattcgcactcgaatg

SEQ ID NO: 244446 - DNA, 75 bp, Artificial Sequence
  Synthetic
ttacaaggtggaaaaagcaggcaggtgcgacgtccattcgcactcgaatgttgcggtactccaggaagtttccat

SEQ ID NO: 244447 - DNA, 75 bp, Artificial Sequence
  Synthetic
cttccttcatagtatccgtctgcagctcgcgtgccacgtgcacagcgaaatgtgaaccaccgaaagaccatgtgg

SEQ ID NO: 244448 - DNA, 75 bp, Artificial Sequence
  Synthetic
ttgccggtggagttgggctattgatagccctggcagtgctaattctagtaatagttacttgcataactttgagaa

SEQ ID NO: 244449 - DNA, 75 bp, Artificial Sequence
  Synthetic
ggtgatcataagtaccgtgtataatgcgggctggaatatatgtaaccattattatatactttaaccatattaata

SEQ ID NO: 244450 - DNA, 75 bp, Artificial Sequence
  Synthetic
ttcaattatcaaattcggtgccgtgcatgatgcggaccgatttattattcatatatgtcacccttattatatcac

SEQ ID NO: 244451 - DNA, 75 bp, Artificial Sequence
  Synthetic
tgcatgatgcggaccgatttattattcatatatgtcacccttattatatcacatcacatattcaattttaaaatt

SEQ ID NO: 244452 - DNA, 75 bp, Artificial Sequence
  Synthetic
cttgtctatatgcagaaggagtttgcagaaagagcagaggagcaaatgagctacctcactaaggagtggttttta

SEQ ID NO: 244453 - DNA, 75 bp, Artificial Sequence
  Synthetic
cagaaagagcagaggagcaaatgagctacctcactaaggagtggtttttatactgcagtttcccgcccttgggat

SEQ ID NO: 244454 - DNA, 75 bp, Artificial Sequence
  Synthetic
tactgcagtttcccgcccttgggatctgcccttagatactgccttttttgctaattaagcctcttaagcctcaga

SEQ ID NO: 244455 - DNA, 75 bp, Artificial Sequence
  Synthetic
ctaattaagcctcttaagcctcagaggcctctctcttttttttccagaggcctcggaggctaggagccccaagcc

SEQ ID NO: 244456 - DNA, 75 bp, Artificial Sequence
  Synthetic
gaggcggagtttgactgataaacaaaactttttttctttctgtttgggagggagacggaagactcttaacttttt

SEQ ID NO: 244457 - DNA, 75 bp, Artificial Sequence
  Synthetic
cctcggaggctaggagccccaagcctctgccaacttgaaaaaaaaaagtcacctaggcagccaagttgtggttac

SEQ ID NO: 244458 - DNA, 75 bp, Artificial Sequence
  Synthetic
acctaggcagccaagttgtggttacatgattgaacttttattgctgcagggtttctggcattgactcatttcctg

SEQ ID NO: 244459 - DNA, 75 bp, Artificial Sequence
  Synthetic
gagaggcggagtttgactgataaacaaaactttttttctttctgtttgggagggagacggaagactcttaactca

SEQ ID NO: 244460 - DNA, 75 bp, Artificial Sequence
  Synthetic
tgggaaagtacagaaaatcagtcataaataacctttctttgatattttgccttatagacttttccatatctaata

SEQ ID NO: 244461 - DNA, 75 bp, Artificial Sequence
  Synthetic
actttttttcaacaagggaggcccggaggcttttttttctcttacaaagggaggaggacattaaaagagtaagta

SEQ ID NO: 244462 - DNA, 75 bp, Artificial Sequence
  Synthetic
gaggcttttttttctcttacaaagggaggaggacattaaaagagtaagtatccttatttatttttcaggatgggg

SEQ ID NO: 244463 - DNA, 75 bp, Artificial Sequence
  Synthetic
accaaagctaaaaaacaacagagaaactcctgttcctactaattttcctattgatgtttctgattatcttagcca

SEQ ID NO: 244464 - DNA, 75 bp, Artificial Sequence
  Synthetic
ggcatcatcacactgctggccaatattggtgaaattgctactgaactaagtgccaccacaggagtaactttggaa

SEQ ID NO: 244465 - DNA, 75 bp, Artificial Sequence
  Synthetic
ttggtgaaattgctactgaactaagtgccaccacaggagtaactttggaagctatacttacaggagaagctttag

SEQ ID NO: 244466 - DNA, 75 bp, Artificial Sequence
  Synthetic
cagctttggaagcagagatctccagtttaatgacaattgagggtatttctggcattgaggctttagctcaacttg

SEQ ID NO: 244467 - DNA, 75 bp, Artificial Sequence
  Synthetic
tttctcattagtggcttctttggttaaccaaggtttaacttatggcttcattctccaaactgttagtggtatagg

SEQ ID NO: 244468 - DNA, 75 bp, Artificial Sequence
  Synthetic
tagtaatgaggttttgaggcatgcacttatggcctttagcctagatcctctgcagtgggaaaatagcttgctgca

SEQ ID NO: 244469 - DNA, 75 bp, Artificial Sequence
  Synthetic
cagacaactgcttctcagaatcagggccttttatcaggagaggctatattaattcctgaacatataggaggaact

SEQ ID NO: 244470 - DNA, 75 bp, Artificial Sequence
  Synthetic
gccttttatcaggagaggctatattaattcctgaacatataggaggaactctgcagcagcaaactccagattggc

SEQ ID NO: 244471 - DNA, 75 bp, Artificial Sequence
  Synthetic
ttcttcctctggtactaggccttagtggatatatttctcctgaattacaagtaattgaagatggcaccaaaaaga

SEQ ID NO: 244472 - DNA, 75 bp, Artificial Sequence
  Synthetic
gaggaaggaagtaggagtctagaaaaggtgcagatgcagtaagcagtagtcagtttcttctaaagttttttgcca

SEQ ID NO: 244473 - DNA, 75 bp, Artificial Sequence
  Synthetic
gtaattgaagatggcaccaaaaagaaaagcatcatccacctgtaaaacacccaaaaggcaatgtatacctaagcc

SEQ ID NO: 244474 - DNA, 75 bp, Artificial Sequence
  Synthetic
gggatgctgccctaatgttgcctcagttccaaaactgcttgttaaaggaggagtggaagtattatctgtggttac

SEQ ID NO: 244475 - DNA, 75 bp, Artificial Sequence
  Synthetic
gttccaaaactgcttgttaaaggaggagtggaagtattatctgtggttactggagaagatagcattacccaaatt

SEQ ID NO: 244476 - DNA, 75 bp, Artificial Sequence
  Synthetic
tatgacctgcagccaaagggatcatctccagatcagcccatcaaggaaaatttgccagcttacagtgtggcaaga

SEQ ID NO: 244477 - DNA, 75 bp, Artificial Sequence
  Synthetic
ttaatgttcattattgggacatgaaaagagttcatgattatggtgctggtattcctgtgtcaggggtaaattacc

SEQ ID NO: 244478 - DNA, 75 bp, Artificial Sequence
  Synthetic
agggagacggaagactcttaactcaactttttttcaacaaaagggaggcccggaggcttttttttctcttacaaa

SEQ ID NO: 244479 - DNA, 75 bp, Artificial Sequence
  Synthetic
ctacaaatggtgggcctattacaattgaaactgtattgggaagaaaaatgacacctaaaaatcagggcctagatc

SEQ ID NO: 244480 - DNA, 75 bp, Artificial Sequence
  Synthetic
tgaaactgtattgggaagaaaaatgacacctaaaaatcagggcctagatccacaagctaaagcaaaattagataa

SEQ ID NO: 244481 - DNA, 75 bp, Artificial Sequence
  Synthetic
agatggaaattatcctatagaagtatggtgtcctgatccttctaaaaatgaaaacagtagatactatgggtctat

SEQ ID NO: 244482 - DNA, 75 bp, Artificial Sequence
  Synthetic
tgtcaggccaacctatggaaggaaaagataatcaggtagaagaggttagaatatatgaggggtcagaacaattac

SEQ ID NO: 244483 - DNA, 75 bp, Artificial Sequence
  Synthetic
agataatcaggtagaagaggttagaatatatgaggggtcagaacaattacctggtgatcctgatattgtcagatt

SEQ ID NO: 244484 - DNA, 75 bp, Artificial Sequence
  Synthetic
tttagataaatttgggcaggagaaaactgtttacccaaagccctctgttgccccagcagcagtaacattccaaag

SEQ ID NO: 244485 - DNA, 75 bp, Artificial Sequence
  Synthetic
actgtttacccaaagccctctgttgccccagcagcagtaacattccaaagtaatcagcaggataagggcaaggcg

SEQ ID NO: 244486 - DNA, 75 bp, Artificial Sequence
  Synthetic
ccactgaaaggacctcaaaaggcctctcaaaaagaaagccaaacacaagaattatgagaattatttcatgcattc

SEQ ID NO: 244487 - DNA, 75 bp, Artificial Sequence
  Synthetic
aaacaaacacaggaaatatgaagcagatgtctttattgagaaaaagtaccagaatcttgggtttcttcagtttcc

SEQ ID NO: 244488 - DNA, 75 bp, Artificial Sequence
  Synthetic
tcagggccctcttcctcaataagaatattgagcagagggtcctgaccagcttctacattttctatcatttgacaa

SEQ ID NO: 244489 - DNA, 75 bp, Artificial Sequence
  Synthetic
aatttaccatatgatatttcactctgtaaaatttgcttccagtttttaatttcttcttgtaagcaaggcttaaag

SEQ ID NO: 244490 - DNA, 75 bp, Artificial Sequence
  Synthetic
ttgagttgtatttgaatccaagaatgggagttaattcccctgatcttcctactacttcaaactggtatacttata

SEQ ID NO: 244491 - DNA, 75 bp, Artificial Sequence
  Synthetic
gtaaaatttgcttccagtttttaatttcttcttgtaagcaaggcttaaaggttgtatcaggcaagcaccaaataa

SEQ ID NO: 244492 - DNA, 75 bp, Artificial Sequence
  Synthetic
actcctgttcctactgattttcctattgatctttctgattatcttagccatgctgtatataagctatagagttat

SEQ ID NO: 244493 - DNA, 75 bp, Artificial Sequence
  Synthetic
gacaaagcaataaagtggttccactttgaagaattcttctttttcttatttccatgttctgatccagggaatctc

SEQ ID NO: 244494 - DNA, 75 bp, Artificial Sequence
  Synthetic
ttgaagaattcttctttttcttatttccatgttctgatccagggaatctcttagatttgcctttggggaaaagtg

SEQ ID NO: 244495 - DNA, 75 bp, Artificial Sequence
  Synthetic
ttttgaactaggttgtgctttggataaatttatggttgtttttgaggatgtgaaagggcaaaatagcctaactaa

SEQ ID NO: 244496 - DNA, 75 bp, Artificial Sequence
  Synthetic
taaagtataactaaatcttgctattaatgttttgggaataaaataatcattagcagtaacaatacaaggaggaaa

SEQ ID NO: 244497 - DNA, 75 bp, Artificial Sequence
  Synthetic
aatgttttgggaataaaataatcattagcagtaacaatacaaggaggaaaaatctgatgctttttattcacatgc

SEQ ID NO: 244498 - DNA, 75 bp, Artificial Sequence
  Synthetic
aaatttatggttgtttttgaggatgtgaaagggcaaaatagcctaactaaagatctgcaacccgggcaaggaata

SEQ ID NO: 244499 - DNA, 75 bp, Artificial Sequence
  Synthetic
ttcttctctaagcttacagctacagcaccatctagatgatctcttaagttatcaaggttatttattccttgccct

SEQ ID NO: 244500 - DNA, 75 bp, Artificial Sequence
  Synthetic
ggggctcctagcctccgaggcctctggaaaaaaaagagagaggcctctgaggcttaagaggcttaattagcaaaa

SEQ ID NO: 244501 - DNA, 75 bp, Artificial Sequence
  Synthetic
caccatctagatgatctcttaagttatcaaggttatttattccttgccctggttgcagatctttatttaggctat

SEQ ID NO: 244502 - DNA, 75 bp, Artificial Sequence
  Synthetic
ggcttaagaggcttaattagcaaaaaaggcagtatctaagggcagatcccaagggcgggaaactgcagtataaaa

SEQ ID NO: 244503 - DNA, 75 bp, Artificial Sequence
  Synthetic
aaggcagtatctaagggcagatcccaagggcgggaaactgcagtataaaaaccactccttagtgaggtagctcat

SEQ ID NO: 244504 - DNA, 75 bp, Artificial Sequence
  Synthetic
ttgctcctctgctctttctgcaaactccttctgcatatagacaagatggatttagtcctaaataggaaagaaaga

SEQ ID NO: 244505 - DNA, 75 bp, Artificial Sequence
  Synthetic
tccttctgcatatagacaagatggatttagtcctaaataggaaagaaagagaggctctctgcaagcttttagaga

SEQ ID NO: 244506 - DNA, 75 bp, Artificial Sequence
  Synthetic
gcagcaaagcttgtttttccactgttaataggccctttaaaccaaatgtttctatacttaggtatattctctgtt

SEQ ID NO: 244507 - DNA, 75 bp, Artificial Sequence
  Synthetic
ttgctcctaattgttatggcaacatccctctgatgaaagctgctttcaaaagaagctgcttaaagcatcaccctg

SEQ ID NO: 244508 - DNA, 75 bp, Artificial Sequence
  Synthetic
ccctctgatgaaagctgctttcaaaagaagctgcttaaagcatcaccctgataaagggggaaatcctgttataat

SEQ ID NO: 244509 - DNA, 75 bp, Artificial Sequence
  Synthetic
gatggaattgaacaccctttggagcaaattccagcaaaatatccacaagctcagaagtgacttctctatgtttga

SEQ ID NO: 244510 - DNA, 75 bp, Artificial Sequence
  Synthetic
aaattccagcaaaatatccacaagctcagaagtgacttctctatgtttgatgaggtcagtacaaaatttccttgg

SEQ ID NO: 244511 - DNA, 75 bp, Artificial Sequence
  Synthetic
cttaaacttcttacatagcatttctgtcctggtcatttccagcatctctaacctccttttggctagaacagtgtc

SEQ ID NO: 244512 - DNA, 75 bp, Artificial Sequence
  Synthetic
gtcctggtcatttccagcatctctaacctccttttggctagaacagtgtctgcggcttgttggcaaatggttttc

SEQ ID NO: 244513 - DNA, 75 bp, Artificial Sequence
  Synthetic
gaagaatatggaactttaaaggattatatgcaaagtggatataatgctagattttgcagaggtcctgggtgcatg

SEQ ID NO: 244514 - DNA, 75 bp, Artificial Sequence
  Synthetic
tgcctagatattttaatgttactttgagaaaaagatgggtgaaaaatccctacccagtagttaatttaataaact

SEQ ID NO: 244515 - DNA, 75 bp, Artificial Sequence
  Synthetic
tgagatttagattcataaaatagcttagcattagaatgatgagcctcatgagccttgtgaggtttgaggcgagat

SEQ ID NO: 244516 - DNA, 75 bp, Artificial Sequence
  Synthetic
aaacaagctttgctgcagccttaatagatttgctagaagggaaggccttgaatataaactgtccatctgataaac

SEQ ID NO: 244517 - DNA, 75 bp, Artificial Sequence
  Synthetic
gcgcttgtattagctgtaagttgtctcgccagcattgtagtctaaaaactttaaagcaaaaaaactgtctgacgt

SEQ ID NO: 244518 - DNA, 75 bp, Artificial Sequence
  Synthetic
atatgcaaagtggatataatgctagattttgcagaggtcctgggtgcatgcttaagcaacttagagattctaagt

SEQ ID NO: 244519 - DNA, 75 bp, Artificial Sequence
  Synthetic
atggttttgcaaagtctagataatgggctaagataataaagtggtcgtctagctcatattcacaagcaaattcag

SEQ ID NO: 244520 - DNA, 75 bp, Artificial Sequence
  Synthetic
ggataaatttatggttgtttttgaggatgtgaaagggcaaaatagcctaaataaagatctgcaaccagggcaagg

SEQ ID NO: 244521 - DNA, 75 bp, Artificial Sequence
  Synthetic
ctttattctttggtttggatttcctcctacttgggaaagttttgactggtggcaaaaaactttagaagaaactga

SEQ ID NO: 244522 - DNA, 75 bp, Artificial Sequence
  Synthetic
tcgccagcattgtagtctaaaaactttaaagcaaaaaaactgtctgacgtggggagagtgtttttgctatcagtg

SEQ ID NO: 244523 - DNA, 75 bp, Artificial Sequence
  Synthetic
ctctttttctttttcttgaaattcataattgagcagtggcttattctcttgcagtaatttgtaagggggcttgca

SEQ ID NO: 244524 - DNA, 75 bp, Artificial Sequence
  Synthetic
ggcaaaaaactttagaagaaactgactactgcttactgcatctgcaccttttctagactcctacttccttcctct

SEQ ID NO: 244525 - DNA, 75 bp, Artificial Sequence
  Synthetic
tagcattagaatgatgagcctcatgagccttgtgaggtttgaggcgagatctgttttcacacttttggcaaggaa

SEQ ID NO: 244526 - DNA, 75 bp, Artificial Sequence
  Synthetic
gtaagtattagatatggaaaagtctataaggcaaaatatcaaagaaaggttatttatgacagattttctgtactt

SEQ ID NO: 244527 - DNA, 75 bp, Artificial Sequence
  Synthetic
ataaggcaaaatatcaaagaaaggttatttatgacagattttctgtactttcccatctaggttgacgaggcccct

SEQ ID NO: 244528 - DNA, 75 bp, Artificial Sequence
  Synthetic
agcttatagtgcagaaggtagagcaaaaattcttaatagcagatactctatgctttgataaagttataaacaata

SEQ ID NO: 244529 - DNA, 75 bp, Artificial Sequence
  Synthetic
ggctaagataataaagtggtcgtctagctcatattcacaagcaaattcagcaactaaattccaattgcagctggc

SEQ ID NO: 244530 - DNA, 75 bp, Artificial Sequence
  Synthetic
atatatgggaccactaaattcaaagaatggtggagatcaggaggattcagcttcgggaaggcatacgaatatggg

SEQ ID NO: 244531 - DNA, 75 bp, Artificial Sequence
  Synthetic
aatggtggagatcaggaggattcagcttcgggaaggcatacgaatatgggcccaatccacacgggaccaactcaa

SEQ ID NO: 244532 - DNA, 75 bp, Artificial Sequence
  Synthetic
cctgcttttaaaatcaactttaaatttctcaatcttatcatataactctatagctttatcagaagtagtataaat

SEQ ID NO: 244533 - DNA, 75 bp, Artificial Sequence
  Synthetic
aaaattcttaatagcagatactctatgctttgataaagttataaacaataaaatacatcctaattcacaggcatg

SEQ ID NO: 244534 - DNA, 75 bp, Artificial Sequence
  Synthetic
gatccagaaagccttcctccaatgcatccaggggagcccccagtggaagctcaccaccccacagccagagctctt

SEQ ID NO: 244535 - DNA, 75 bp, Artificial Sequence
  Synthetic
atccaggggagcccccagtggaagctcaccaccccacagccagagctcttcctctgggtatgggtccttctcagc

SEQ ID NO: 244536 - DNA, 75 bp, Artificial Sequence
  Synthetic
ctatatacagcatggctaagataatcagaaagatcaataggaaaatcagtaggaacaggagtttctctgttcttt

SEQ ID NO: 244537 - DNA, 75 bp, Artificial Sequence
  Synthetic
ttctcaatcttatcatataactctatagctttatcagaagtagtataaatggcaaaacaacttactgttttatta

SEQ ID NO: 244538 - DNA, 75 bp, Artificial Sequence
  Synthetic
gtcccaggcttcagactcccagtccagaggacccgatatacctcccgaacaccatgaggaacccacctcatcctc

SEQ ID NO: 244539 - DNA, 75 bp, Artificial Sequence
  Synthetic
cagaaagatcaataggaaaatcagtaggaacaggagtttctctgttcttttttggctttggtggagtgcttgtaa

SEQ ID NO: 244540 - DNA, 75 bp, Artificial Sequence
  Synthetic
aacttgctgaactagcagagcttgcagagcttcgggaccccccaaattttcgctttcttgagaatggaggagggg

SEQ ID NO: 244541 - DNA, 75 bp, Artificial Sequence
  Synthetic
agagcttcgggaccccccaaattttcgctttcttgagaatggaggaggggtcttcggggtggtgaaggaggagga

SEQ ID NO: 244542 - DNA, 75 bp, Artificial Sequence
  Synthetic
tggatgcagtagcagagaggagaccaccaattcaggaagagaatcgagcacacccaatggaactagtgtacctag

SEQ ID NO: 244543 - DNA, 75 bp, Artificial Sequence
  Synthetic
tttcctgtgtttgtttttctggggcctacttaactgaataggaatgcatgaaataattctcataattcttgtgtt

SEQ ID NO: 244544 - DNA, 75 bp, Artificial Sequence
  Synthetic
tctgtattcctcatctgtaaactgagatgacgaggcctcctcggcagaggaagacgggggctgccggggcgagct

SEQ ID NO: 244545 - DNA, 75 bp, Artificial Sequence
  Synthetic
tgggaggatctcttttgcgatgaatcactttcctcccctgagcctccctcgtcctctgaggagcctgaggagccc

SEQ ID NO: 244546 - DNA, 75 bp, Artificial Sequence
  Synthetic
gatgacgaggcctcctcggcagaggaagacgggggctgccggggcgagcttcttgaggaggggggctcctcaggc

SEQ ID NO: 244547 - DNA, 75 bp, Artificial Sequence
  Synthetic
gtcctctgaggagcctgaggagcccctctcctcaagaagctcgccccggcagcccccgtcttcctctgcggagga

SEQ ID NO: 244548 - DNA, 75 bp, Artificial Sequence
  Synthetic
tcctcagaggacgagggaggctcaggggaggaaagtgattcatcgcagaagagatcctcccaggtgccatcagtt

SEQ ID NO: 244549 - DNA, 75 bp, Artificial Sequence
  Synthetic
gggaggaaagtgattcatcgcagaagagatcctcccaggtgccatcagttctggaagaatttctaggtacactgg

SEQ ID NO: 244550 - DNA, 75 bp, Artificial Sequence
  Synthetic
attttgccctttcacatcctcaaaaacaaccataaatttatccaaagcacatcctagttcaaaaggtagtttatc

SEQ ID NO: 244551 - DNA, 75 bp, Artificial Sequence
  Synthetic
ttccattgggtgtgctggattctcttcctgaattggtggtctcctctctgctactggatccagaggatgaggtgg

SEQ ID NO: 244552 - DNA, 75 bp, Artificial Sequence
  Synthetic
tcctgaattggtggtctcctctctgctactggatccagaggatgaggtgggttcctcatggtgttcgggaggtat

SEQ ID NO: 244553 - DNA, 75 bp, Artificial Sequence
  Synthetic
accaaagccaaaaaagaacagagaaactcctgttcctactgattttcctattgatctttctgattatcttagcca

SEQ ID NO: 244554 - DNA, 75 bp, Artificial Sequence
  Synthetic
atcgggtcctctggactgggagtctgaagcctgggacgctgagaaggacccatacccagaggaagagctctggct

SEQ ID NO: 244555 - DNA, 75 bp, Artificial Sequence
  Synthetic
gaagcctgggacgctgagaaggacccatacccagaggaagagctctggctgtggggtggtgagcttccactgggg

SEQ ID NO: 244556 - DNA, 75 bp, Artificial Sequence
  Synthetic
ttaataattgaataattttctgcagcttcttttcaaactcttcaaataaacaacaataccaagccacaccaccca

SEQ ID NO: 244557 - DNA, 75 bp, Artificial Sequence
  Synthetic
gctcccctggatgcattggaggaaggctttctggatcttgagttggtcccgtgtggattgggcccatattcgtat

SEQ ID NO: 244558 - DNA, 75 bp, Artificial Sequence
  Synthetic
gctttctggatcttgagttggtcccgtgtggattgggcccatattcgtatgccttcccgaagctgaatcctcctg

SEQ ID NO: 244559 - DNA, 75 bp, Artificial Sequence
  Synthetic
taagattgagaaatttaaagttgattttaaaagcaggcatgcctgtgaattaggatgtattttattgtttataac

SEQ ID NO: 244560 - DNA, 75 bp, Artificial Sequence
  Synthetic
agttgttttgccatttatactacttgtgataaagctatagagttatatgataagattgagaaatttaaagttgat

SEQ ID NO: 244561 - DNA, 75 bp, Artificial Sequence
  Synthetic
atctccaccattctttgaatttagtggtcccatatataggggcctcgtcaacctagatgggaaagtacagaaaat

SEQ ID NO: 244562 - DNA, 75 bp, Artificial Sequence
  Synthetic
tttatgaaagcatagagtatttgctattaagaatttttgctttaccttttgcactataagctttttaatttgtaa

SEQ ID NO: 244563 - DNA, 75 bp, Artificial Sequence
  Synthetic
tactaaattgaagaactgtaggagtctgagagcctgtctgaatagacccatagtatctactgttttcatttttag

SEQ ID NO: 244564 - DNA, 75 bp, Artificial Sequence
  Synthetic
aggagtgaataagatgcctgaaatgtataataatttatgcaagcccccttacaaattactgcaagagaataagcc

SEQ ID NO: 244565 - DNA, 75 bp, Artificial Sequence
  Synthetic
attttgccttatagacttttccatatctaatacttacagaggaaggaagtaggagtctagaaaaggtgcagatgc

SEQ ID NO: 244566 - DNA, 75 bp, Artificial Sequence
  Synthetic
aaagaaaaagaggccagctgtaattggaatttagttgctgaatttgcttgtgaatatgagctagacgaccacttt

SEQ ID NO: 244567 - DNA, 75 bp, Artificial Sequence
  Synthetic
ttcccaagtaggaggaaatccaaaccaaagaataaagcactgatagcaaaaacactctccccacgtcagacagtt

SEQ ID NO: 244568 - DNA, 75 bp, Artificial Sequence
  Synthetic
ggaatttagttgctgaatttgcttgtgaatatgagctagacgaccactttattattttagcccattatctagact

SEQ ID NO: 244569 - DNA, 75 bp, Artificial Sequence
  Synthetic
caaagaataaagcactgatagcaaaaacactctccccacgtcagacagtttttttgctttaaagtttttagacta

SEQ ID NO: 244570 - DNA, 75 bp, Artificial Sequence
  Synthetic
ttgcaaaaccatttccttgccaaaagtgtgaaaacagatctcgcctcaaacctcacaaggctcatgaggctcatc

SEQ ID NO: 244571 - DNA, 75 bp, Artificial Sequence
  Synthetic
caatgctggcgagacaacttacagctaatacaagcgcacttagaatctctaagttgcttaagcatgcacccagga

SEQ ID NO: 244572 - DNA, 75 bp, Artificial Sequence
  Synthetic
taatacaagcgcacttagaatctctaagttgcttaagcatgcacccaggacctctgcaaaatctagcattatatc

SEQ ID NO: 244573 - DNA, 75 bp, Artificial Sequence
  Synthetic
cactttgcatataatcctttaaagttccatattcttcccaaggaaattttgtactgacctcatcaaacatagaga

SEQ ID NO: 244574 - DNA, 75 bp, Artificial Sequence
  Synthetic
tccatattcttcccaaggaaattttgtactgacctcatcaaacatagagaagtcacttctgagcttgtggatatt

SEQ ID NO: 244575 - DNA, 75 bp, Artificial Sequence
  Synthetic
aatgaccaggacagaaatgctatgtaagaagtttaagaagcacctagagagattaagagatttagatacaataga

SEQ ID NO: 244576 - DNA, 75 bp, Artificial Sequence
  Synthetic
ttgctggaatttgctccaaagggtgttcaattccatcattataacaggatttccccctttatcagggtgatgctt

SEQ ID NO: 244577 - DNA, 75 bp, Artificial Sequence
  Synthetic
tttcttcccaatacagtttcaattgtaataggcccaccatttgtagtttttggatactgagtctggtaatctaaa

SEQ ID NO: 244578 - DNA, 75 bp, Artificial Sequence
  Synthetic
ttcatcagagggatgttgccataacaattaggagcaatctctaaaagcttgcagagagcctctctttctttccta

SEQ ID NO: 244579 - DNA, 75 bp, Artificial Sequence
  Synthetic
cctaagtatagaaacatttggtttaaagggcctattaacagtggaaaaacaagctttgctgcagccttaatagat

SEQ ID NO: 244580 - DNA, 75 bp, Artificial Sequence
  Synthetic
gccataacaattaggagcaatctctaaaagcttgcagagagcctctctttctttcctatttaggactaaatccat

SEQ ID NO: 244581 - DNA, 75 bp, Artificial Sequence
  Synthetic
ctgcccttagatactgccttttttgctaattaagcctcttaagcctcagaggcctctctctttttttccagaggc

SEQ ID NO: 244582 - DNA, 75 bp, Artificial Sequence
  Synthetic
ttttgaactaggatgtgctttggataaatttatggttgtttttgaggatgtgaaagggcaaaatagcctaaataa

SEQ ID NO: 244583 - DNA, 75 bp, Artificial Sequence
  Synthetic
aataaccttgataacttaagagatcatctagatggtgctgtagctgtaagcttagagaagaagcatgtgaataaa

SEQ ID NO: 244584 - DNA, 75 bp, Artificial Sequence
  Synthetic
aagcatcagatttttcctccttgtattgttactgctaatgattattttattcccaaaacattaatagcaagattt

SEQ ID NO: 244585 - DNA, 75 bp, Artificial Sequence
  Synthetic
tttcaacaagggaggcccggaggcttttttttctcttacaaagggaggaggacattaaaagagtaagtatcctta

SEQ ID NO: 244586 - DNA, 75 bp, Artificial Sequence
  Synthetic
agttatactttacacttttccccaaaggcaaatctaagagattccctggatcagaacatggaaataagaaaaaga

SEQ ID NO: 244587 - DNA, 75 bp, Artificial Sequence
  Synthetic
aggcaaatctaagagattccctggatcagaacatggaaataagaaaaagaagaattcttcaaagtggaaccactt

SEQ ID NO: 244588 - DNA, 75 bp, Artificial Sequence
  Synthetic
tattgctttgtcttatttggtgcttgcctgatacaacctttaagccttgcttacaagaagaaattaaaaactgga

SEQ ID NO: 244589 - DNA, 75 bp, Artificial Sequence
  Synthetic
gcctgatacaacctttaagccttgcttacaagaagaaattaaaaactggaagcaaattttacagagtgaaatatc

SEQ ID NO: 244590 - DNA, 75 bp, Artificial Sequence
  Synthetic
atatggtaaattttgtcaaatgatagaaaatgtagaagctggtcaggaccctctgctcaatattcttattgagga

SEQ ID NO: 244591 - DNA, 75 bp, Artificial Sequence
  Synthetic
cagctgaacagttttcaaatttctcattagtggcttctttggttaaccaaggtttaacttatggcttcattctcc

SEQ ID NO: 244592 - DNA, 75 bp, Artificial Sequence
  Synthetic
aaactgttagtggtataggctctctaataactgtgggggtgaggttgtcacgcgagcaagtgtcacttgtaaaga

SEQ ID NO: 244593 - DNA, 75 bp, Artificial Sequence
  Synthetic
tgttcagctgtgaacccaagttgagctaaagcctcaatgccagaaataccctcaattgtcattaaactggagatc

SEQ ID NO: 244594 - DNA, 75 bp, Artificial Sequence
  Synthetic
ctgtgtttgtttttctggggcctacttaactgaataggaatgcatgaaataattctcataattcttgtgtttggc

SEQ ID NO: 244595 - DNA, 75 bp, Artificial Sequence
  Synthetic
ttaactgaataggaatgcatgaaataattctcataattcttgtgtttggctttctttttgagaggccttttgagg

SEQ ID NO: 244596 - DNA, 75 bp, Artificial Sequence
  Synthetic
tgctgtatatagtaataaaacagtaagttgttttgccatttatactacttctgataaagctatagagttatatga

SEQ ID NO: 244597 - DNA, 75 bp, Artificial Sequence
  Synthetic
gttcagcaagttttacaagcactccaccaaagccaaaaaagaacagagaaactcctgttcctactgattttccta

SEQ ID NO: 244598 - DNA, 75 bp, Artificial Sequence
  Synthetic
tcctttcagtggcgccttgcccttatcctgctgattactttggaatgttactgctgctggggcaacagagggctt

SEQ ID NO: 244599 - DNA, 75 bp, Artificial Sequence
  Synthetic
ggggcaagatatttttaattctttatctcctacctctaggctgcagatacaatcaaacctagtgaatctgatact

SEQ ID NO: 244600 - DNA, 75 bp, Artificial Sequence
  Synthetic
tgggtaaacagttttctcctgcccaaatttatctaaaaatctgacaatatcaggatcaccaggtaattgttctga

SEQ ID NO: 244601 - DNA, 75 bp, Artificial Sequence
  Synthetic
cttgttgaaaaaaagttaagagtcttccgtctccctcccaaacagaaagaaaaaaagttttgtttatcagtcaaa

SEQ ID NO: 244602 - DNA, 75 bp, Artificial Sequence
  Synthetic
cccctcatatattctaacctcttctacctgattatcttttccttccataggttggcctgacacttttggcattaa

SEQ ID NO: 244603 - DNA, 75 bp, Artificial Sequence
  Synthetic
aaaactttttttctttctgtttgggagggagacggaagactcttaacttttttcaacaagggaggcccggaggct

SEQ ID NO: 244604 - DNA, 75 bp, Artificial Sequence
  Synthetic
cccatctttttctcaaagtaacattaaaatatctaggcaacccatgaagagccatttttccactggttttaaaca

SEQ ID NO: 244605 - DNA, 75 bp, Artificial Sequence
  Synthetic
gccatttttccactggttttaaacagaaaccccactatgtctgcacagctaataaataggccatctcctttgcat

SEQ ID NO: 244606 - DNA, 75 bp, Artificial Sequence
  Synthetic
ctgccctaatgttgcctcagttccaaaactgcttgttaaaggaggagtggaagtattatctgtggttactggaga

SEQ ID NO: 244607 - DNA, 75 bp, Artificial Sequence
  Synthetic
agatagcattacccaaattgagttgtatttgaatccaagaatgggagttaattcccctgatcttcctactacttc

SEQ ID NO: 244608 - DNA, 75 bp, Artificial Sequence
  Synthetic
ttaagagtcttccgtctccctcccaaacagaaagaaaaaaagttttgtttatcagtcaaactccgcctctccagg

SEQ ID NO: 244609 - DNA, 75 bp, Artificial Sequence
  Synthetic
gagcctgtctgaatagacccatagtatctactgttttcatttttagaaggatcaggacaccatacttctatagga

SEQ ID NO: 244610 - DNA, 75 bp, Artificial Sequence
  Synthetic
atctactgttttcatttttagaaggatcaggacaccatacttctataggataatttccatctttatctaattttg

SEQ ID NO: 244611 - DNA, 75 bp, Artificial Sequence
  Synthetic
agtttgaaaagaagctgcagaaaattattcaattattaacagagaatatacctaagtatagaaacatttggttta

SEQ ID NO: 244612 - DNA, 75 bp, Artificial Sequence
  Synthetic
aataaataggccatctcctttgcatagagggcccactccattctcatctaaaaggacagtagttagagtattact

SEQ ID NO: 244613 - DNA, 75 bp, Artificial Sequence
  Synthetic
ctttagcttgtggatctaggccctgatttttaggtgtcatttttcttcccaatacagtttcaattgtaataggcc

SEQ ID NO: 244614 - DNA, 75 bp, Artificial Sequence
  Synthetic
ctgccaatgctaaatgaggatattacctgtgacacattgcagatgtgggaggcaatatctgttaaaacagaagta

SEQ ID NO: 244615 - DNA, 75 bp, Artificial Sequence
  Synthetic
ccccctttatcagggtgatgctttaagcagcttcttttgaaagcagctttcatcagagggatgttcccataacaa

SEQ ID NO: 244616 - DNA, 75 bp, Artificial Sequence
  Synthetic
caccatttgtagtttttggatactcagtctggtaatctaaaactaggccttgcaaatccagaggttctcccccaa

SEQ ID NO: 244617 - DNA, 75 bp, Artificial Sequence
  Synthetic
tggggcaagatatttttaattctttatctcctatctccaggctgcagatacaatcaaacctagtgaatctgatac

SEQ ID NO: 244618 - DNA, 75 bp, Artificial Sequence
  Synthetic
tgcaaatccagaggttctcccccaatggcaaacatatggtaatttacccctgacacaggaataccagcaccataa

SEQ ID NO: 244619 - DNA, 75 bp, Artificial Sequence
  Synthetic
gtgtcaggggtaaattaccatatgtttgccattgggggagaacctctggatttgcaaggcctagttttagattac

SEQ ID NO: 244620 - DNA, 75 bp, Artificial Sequence
  Synthetic
tggcaaacatatggtaatttacccctgacacaggaataccagcaccataatcatgaactcttttcatgtcccaat

SEQ ID NO: 244621 - DNA, 75 bp, Artificial Sequence
  Synthetic
aagcatagagtatctgctattaagaatttttgctctaccttctgcactataagctttttaatttgtaaaggagtg

SEQ ID NO: 244622 - DNA, 75 bp, Artificial Sequence
  Synthetic
aatgaacattaattaaagaacttattccaactacttctgttttaacagatattgcctcccacatctgcaatgtgt

SEQ ID NO: 244623 - DNA, 75 bp, Artificial Sequence
  Synthetic
tccaactacttctgttttaacagatattgcctcccacatctgcaatgtgtcacaggtaatatcctcatttagcat

SEQ ID NO: 244624 - DNA, 75 bp, Artificial Sequence
  Synthetic
tgaagatggcacccaaaagaaaagcatcatccacttgtaaaacaaccaaaaggcaatgtatacctaagcctggat

SEQ ID NO: 244625 - DNA, 75 bp, Artificial Sequence
  Synthetic
aaagaaaaagaggccagctgcaattggaatttagttgctgaatttgcttgtgaatatgagctagacgaggttaga

SEQ ID NO: 244626 - DNA, 75 bp, Artificial Sequence
  Synthetic
tggcagagacactcttgccacactgtaagctggcaaattttccttgatgggctgatctggagatgatccctttgg

SEQ ID NO: 244627 - DNA, 75 bp, Artificial Sequence
  Synthetic
aattatgaatttcaagaaaaagaaaaagaggccagctgtaattggaatttagttgctgaatttgcttgtgaatat

SEQ ID NO: 244628 - DNA, 75 bp, Artificial Sequence
  Synthetic
taagctggcaaattttccttgatgggctgatctggagatgatccctttggctgcaggtcataagtataagtatac

SEQ ID NO: 244629 - DNA, 75 bp, Artificial Sequence
  Synthetic
cagtttgaagtagtaggaagatcaggggaattaactcccattcttggattcaaatacaactcaatttgggtaatg

SEQ ID NO: 244630 - DNA, 75 bp, Artificial Sequence
  Synthetic
gcaataaaagttcaatcatgtaaccacaacttggctgcctaggtgactttttttttttcaagttggcagaggctt

SEQ ID NO: 244631 - DNA, 75 bp, Artificial Sequence
  Synthetic
tgctaagctattttatgaatctaaatctcagaaaaccatttgccaacaagccgcagacactgttctagccaaaag

SEQ ID NO: 244632 - DNA, 75 bp, Artificial Sequence
  Synthetic
attgccttttgggtgttttacaggtggatgatgcttttctttttggtgccatcttcaattacttgtaattcagga

SEQ ID NO: 244633 - DNA, 75 bp, Artificial Sequence
  Synthetic
ggatgatgcttttctttttggtgccatcttcaattacttgtaattcaggagaaatatatccactaaggcctagta

SEQ ID NO: 244634 - DNA, 75 bp, Artificial Sequence
  Synthetic
ggcctcgtcatctcagtttacagatgaggaatacagatcctcctccttcaccaccccgaagacccctcctccatt

SEQ ID NO: 244635 - DNA, 75 bp, Artificial Sequence
  Synthetic
agttaatttaataaactcactcttcagcaacttaatgccaaaagtgtcaggccaacctatggaaggaaaagataa

SEQ ID NO: 244636 - DNA, 75 bp, Artificial Sequence
  Synthetic
ccagaggaagaagccaatctggagtttgctgctgcagagttcctcctatatgttcaggaattaatattgcctctc

SEQ ID NO: 244637 - DNA, 75 bp, Artificial Sequence
  Synthetic
tattatatgggtggtgtggcctggtactgctgcttatttgaagagtttgaaaagaagctgcagaaaattattcaa

SEQ ID NO: 244638 - DNA, 75 bp, Artificial Sequence
  Synthetic
ctcaagaaagtgaaaatttggggggtcccgaagctctgcaagctctgctagttcagcaagttttacaagcactcc

SEQ ID NO: 244639 - DNA, 75 bp, Artificial Sequence
  Synthetic
ctgataaaaggccctgattctgagaagcagttgtctgaaagacccaccggctatttagtatcagattcactaggt

SEQ ID NO: 244640 - DNA, 75 bp, Artificial Sequence
  Synthetic
gggtttctgtttaaaaccagtggaaaaatggctcttcatgggctgcctagatattttaatgttactttgagaaaa

SEQ ID NO: 244641 - DNA, 75 bp, Artificial Sequence
  Synthetic
ctatttagtatcagattcactaggtttgattgtatctgcagcctagaggtaggagataaagaattaaaaatatct

SEQ ID NO: 244642 - DNA, 75 bp, Artificial Sequence
  Synthetic
gatccagtagcagagaggagaccaccaattcaggaagagaatccagcacaccaaatggaaccagtgtacctagaa

SEQ ID NO: 244643 - DNA, 75 bp, Artificial Sequence
  Synthetic
ttgattgtatctgcagcctagaggtaggagataaagaattaaaaatatcttgccccacagaatgcagcaagctat

SEQ ID NO: 244644 - DNA, 75 bp, Artificial Sequence
  Synthetic
aaaggacctcaaaaggcctctcaaaaagaaagccaaacacaagaattatgagaattatttcatgcattcctattc

SEQ ID NO: 244645 - DNA, 75 bp, Artificial Sequence
  Synthetic
tttcccactgcagaggatctaggctaaaggccataagtgcatgcctcaaaacctcattactacctacccacgaaa

SEQ ID NO: 244646 - DNA, 75 bp, Artificial Sequence
  Synthetic
aaaggccataagtgcatgcctcaaaacctcattactacctacccacgaaacatccctctttacaagtgacacttg

SEQ ID NO: 244647 - DNA, 75 bp, Artificial Sequence
  Synthetic
cctctgaggagcctgaggagcccccctcctcaagaagctcgccccggcagcccccgtcttcctctgccgaggagg

SEQ ID NO: 244648 - DNA, 75 bp, Artificial Sequence
  Synthetic
ctcgcgtgacaacctcacccccacagttattagagagcctataccactaacagtttggagaatgaagccataagt

SEQ ID NO: 244649 - DNA, 75 bp, Artificial Sequence
  Synthetic
gttattagagagcctataccactaacagtttggagaatgaagccataagttaaaccttggttaaccaaagaagcc

SEQ ID NO: 244650 - DNA, 75 bp, Artificial Sequence
  Synthetic
actaatgagaaatttgaaaactgttcagctgtgaacccaagttgagctaaagcctcaatgccagaaataccctca

SEQ ID NO: 244651 - DNA, 75 bp, Artificial Sequence
  Synthetic
caagaaagcgaaaatttgggggggtcccgaagctctgcaagctctgctagttcagcaagttttacaagcactcca

SEQ ID NO: 244652 - DNA, 75 bp, Artificial Sequence
  Synthetic
cttccaaagctgctaaagcttctcctgtaagaatagcttccaaagttactcctgtggtggcacttagttcagtag

SEQ ID NO: 244653 - DNA, 75 bp, Artificial Sequence
  Synthetic
tgtaagaatagcttccaaagttactcctgtggtggcacttagttcagtagcaatttcaccaatattggccagcag

SEQ ID NO: 244654 - DNA, 75 bp, Artificial Sequence
  Synthetic
tgtgatgatgccccccatcctgaaaaataaataaggatacttactcttttaatgtcctcctccctttgtaagaga

SEQ ID NO: 244655 - DNA, 75 bp, Artificial Sequence
  Synthetic
aataaataaggatacttactcttttaatgtcctcctccctttgtaagagaaaaaaaagcctccgggcctcccttg

SEQ ID NO: 244656 - DNA, 75 bp, Artificial Sequence
  Synthetic
ggcctcgtcatctcagtttacagattaggaatacagatcctcctccttcaccaccccgaagacccctcctccatt

SEQ ID NO: 244657 - DNA, 75 bp, Artificial Sequence
  Synthetic
ccaccccgaagacccctcctccattctcaagaaagcgaaaatttggggggtcccgaagctctgcaagctctgcta

SEQ ID NO: 244658 - DNA, 75 bp, Artificial Sequence
  Synthetic
cagcaataaaagttcaatcatgtaaccacaacttggctgcctaggtgactttttttttcaagttggcagaggctt

SEQ ID NO: 244659 - DNA, 75 bp, Artificial Sequence
  Synthetic
agcaataaaagttcaatcatgtaaccacaacttggctgcctaggtgacttttttttttcaagttggcagaggctt

SEQ ID NO: 244660 - DNA, 75 bp, Artificial Sequence
  Synthetic
cttggctatatgcagaaggagtttgaagaaagagcagagaagcaaatgagctacctcactaaggagtggttttta

SEQ ID NO: 244661 - DNA, 75 bp, Artificial Sequence
  Synthetic
agtttatattcaaggccttcccttctagcaaatctattaaggctgcagcaaagcttgtttttccactgttaatag

SEQ ID NO: 244662 - DNA, 75 bp, Artificial Sequence
  Synthetic
tttctcttacaaagggaggaggacattaaaagagtaagtatccctatttatttttcaggatggggggcatcatca

SEQ ID NO: 244663 - DNA, 75 bp, Artificial Sequence
  Synthetic
aagagtgagtttattaaattaactactgggtaggggtttttcacccatctttttctcaaagtaacattaaaatat

SEQ ID NO: 244664 - DNA, 75 bp, Artificial Sequence
  Synthetic
ggggctcttagcctccgagacctctagaaaaaaaagagagaggcctctgaggattaagaggcttaattagcaaaa

SEQ ID NO: 244665 - DNA, 75 bp, Artificial Sequence
  Synthetic
cccataacaactaggagcaatttctaaaagcttgcagagagcctctctttctttcctatttaggactaaatccat

SEQ ID NO: 244666 - DNA, 75 bp, Artificial Sequence
  Synthetic
agctttgctgcagccttaatagatttgctagaagggaaggccttgaatataaactgtccatcagataaactacct

SEQ ID NO: 244667 - DNA, 75 bp, Artificial Sequence
  Synthetic
ggcctcgttatcttagtttacagatgaggaatacagatcttcctccttcactaccccgaagacccctcctgcatt

SEQ ID NO: 244668 - DNA, 75 bp, Artificial Sequence
  Synthetic
gcctcttaagcctcagaggcctctctcttttttttccagaggcctcggaggctaggagccccaagcctctgccaa

SEQ ID NO: 244669 - DNA, 75 bp, Artificial Sequence
  Synthetic
tctgctcaatattcttattgaggaagagggccctgaggaaactgaagaaacccaagattctggtactttttctca

SEQ ID NO: 244670 - DNA, 75 bp, Artificial Sequence
  Synthetic
ctccagtaaccacagataatacttccactcctcctttaacaagcagttttggaactgaggcaacattagggcagc

SEQ ID NO: 244671 - DNA, 75 bp, Artificial Sequence
  Synthetic
cattgactcatttcctggagaggcggagtttgactgataaacaaaactttttttctttctgtttgggagggagac

SEQ ID NO: 244672 - DNA, 75 bp, Artificial Sequence
  Synthetic
catccacctgtaaaacacccaaaaggcaatgtatacctaagcctggatgctgccctaatgttgcctcagttccaa

SEQ ID NO: 244673 - DNA, 75 bp, Artificial Sequence
  Synthetic
atccttctaaaaatgaaaacagtagatactatgggtctattcagacaggctctcagactcctacagttcttcaat

SEQ ID NO: 244674 - DNA, 75 bp, Artificial Sequence
  Synthetic
aaatgagtcaatgccagaaaccctgcagcaataaaagttcaatcatgtaaccacaacttggctgcctaggtgact

SEQ ID NO: 244675 - DNA, 75 bp, Artificial Sequence
  Synthetic
acttacagaggaaggaagtaggagtctagaaaaggtgcagatgcagtaagcagtagtcagtttcttctaaagttt

SEQ ID NO: 244676 - DNA, 75 bp, Artificial Sequence
  Synthetic
aattgaagaactgtaggagtctgagaacctgtctgaatagacccatagtatctactgttttcatttttagaagga

SEQ ID NO: 244677 - DNA, 75 bp, Artificial Sequence
  Synthetic
cccataacaattaggagtaatttctaaaagcttgcagagagcctctctttctttcctatttaggactaaatccat

SEQ ID NO: 244678 - DNA, 75 bp, Artificial Sequence
  Synthetic
tcttcaaataagcagcagtaccaagccacaccacccatataatacaatagatctattgtatctaaatctcttaat

SEQ ID NO: 244679 - DNA, 75 bp, Artificial Sequence
  Synthetic
atgtcctcctccctttgtaagagaaatgtcctcctccctttgtaagagaaaaaaaagcctccgggcctccctttt

SEQ ID NO: 244680 - DNA, 75 bp, Artificial Sequence
  Synthetic
gaataattttctgcagcttcttttcaaactcttcaaataagcagcagtaccaagccacaccacccatataataca

SEQ ID NO: 244681 - DNA, 75 bp, Artificial Sequence
  Synthetic
caatgccagaaaccctgcagcaataaaagttcaatcatgtaaccacaacttggcagcctaggtgacttttttttt

SEQ ID NO: 244682 - DNA, 75 bp, Artificial Sequence
  Synthetic
acatttcaggcatcttattcactcctttacagattaaaaagcttatagtgcagaaggtagagcaaaaattcttaa

SEQ ID NO: 244683 - DNA, 75 bp, Artificial Sequence
  Synthetic
aaattcttccagaacggatggcacctgggaggatctcttctgcgatgaatcactttcctcccctgagcctccctc

SEQ ID NO: 244684 - DNA, 75 bp, Artificial Sequence
  Synthetic
ttattgtattatatgggtggtgtggcttggtattgttgtttatttgaagagtttgaaaagaagctgcagaaaatt

SEQ ID NO: 244685 - DNA, 75 bp, Artificial Sequence
  Synthetic
tgtccttttagatgagaatggagtgggccctctatgcaaaggagatggcctatttattagctgtgcagacatagt

SEQ ID NO: 244686 - DNA, 75 bp, Artificial Sequence
  Synthetic
ctattgtatctaaatctcttaatctctctaggtgcttcttaaacttcttacatagcatttctgtcctggtcattt

SEQ ID NO: 244687 - DNA, 75 bp, Artificial Sequence
  Synthetic
tccttctgcatatagacaagatggatttagtcctaaataggaaagaaagagaggctctgtgcaagcttttggaga

SEQ ID NO: 244688 - DNA, 75 bp, Artificial Sequence
  Synthetic
accaaacaaagttgggtaaggatagatcaatcaatgatcatattctagtacacttaggattcaagatcctattat

SEQ ID NO: 244689 - DNA, 75 bp, Artificial Sequence
  Synthetic
ccaagttccacaatgacagagatctacgacttcgataagtctgcatgggatatcaaagggtcaatcgctccgata

SEQ ID NO: 244690 - DNA, 75 bp, Artificial Sequence
  Synthetic
tcgctgtactctaaagtcagtaataaggttttccaatgcttgagggacactaattcacggcttggtctaggctcc

SEQ ID NO: 244691 - DNA, 75 bp, Artificial Sequence
  Synthetic
taatctccaagctagaatcactgctgttattgaagggagaagttgagtcaattaagaagcagatcaacaagcaaa

SEQ ID NO: 244692 - DNA, 75 bp, Artificial Sequence
  Synthetic
agcttagcattgttcaaaagaaacaaggacaaaccacccatcacatctggatccggtggggccatcagaggaatc

SEQ ID NO: 244693 - DNA, 75 bp, Artificial Sequence
  Synthetic
atccggtggggccatcagaggaatcaaacacattattatagtgccaatccctggagattcctcaattaccacccg

SEQ ID NO: 244694 - DNA, 75 bp, Artificial Sequence
  Synthetic
gatgaatgctttatgtacatgtttctgctgggggttgtggaggacagtgatcccctagggcttccaatcgggcga

SEQ ID NO: 244695 - DNA, 75 bp, Artificial Sequence
  Synthetic
atccagactactggaccggttggtcaggttaattggaaacccggatgtgagcgggcccaaactaacaggggcact

SEQ ID NO: 244696 - DNA, 75 bp, Artificial Sequence
  Synthetic
aggttaattggaaacccggatgtgagcgggcccaaactaacaggggcactaataggtatattatccttatttgtg

SEQ ID NO: 244697 - DNA, 75 bp, Artificial Sequence
  Synthetic
gcgggcccaaactaacaggggcactaataggtatattatccttatttgtggagtctccaggtcaattgattcaga

SEQ ID NO: 244698 - DNA, 75 bp, Artificial Sequence
  Synthetic
gagtctccaggtcaattgattcagaggatcaccgatgaccctgacgttagtatccggctgttggaggttgtccag

SEQ ID NO: 244699 - DNA, 75 bp, Artificial Sequence
  Synthetic
accgttcctagaagaatgatagaattcagatcggtcaatgcagtggccttcaacctgcttgtgactcttaggatt

SEQ ID NO: 244700 - DNA, 75 bp, Artificial Sequence
  Synthetic
agtgaccagtcacaatctggccttaccttcgcatcaagaggtaccaacatggaggatgaggcggaccaatacttt

SEQ ID NO: 244701 - DNA, 75 bp, Artificial Sequence
  Synthetic
aacttaggagcaaagtgattgcctcccaagttccgcaatgacagagatctacgacttcgacaagtcggcatggga

SEQ ID NO: 244702 - DNA, 75 bp, Artificial Sequence
  Synthetic
ataccgctggacaccccgcagaggttccgcgttgtctatatgagcatcacccgtctttcagacaacggatattac

SEQ ID NO: 244703 - DNA, 75 bp, Artificial Sequence
  Synthetic
atcaatccaggtccggatggttcgagaacaaggaaatctcagatattgaagtgcaagaccctgagggattcaaca

SEQ ID NO: 244704 - DNA, 75 bp, Artificial Sequence
  Synthetic
tccgcgttgtctatatgagcatcacccgtctttcagacaacggatattacactgttcctcgaagaatgctagaat

SEQ ID NO: 244705 - DNA, 75 bp, Artificial Sequence
  Synthetic
gtacacccaacaaagaagggtagttggtgaatttagattggagagaaaatggttggatgtggtgaggaacaggat

SEQ ID NO: 244706 - DNA, 75 bp, Artificial Sequence
  Synthetic
tcccttagggcccccaatcgggcgagcatttgggtccctgcctttaggtgttggcagatccacagcaaaacccga

SEQ ID NO: 244707 - DNA, 75 bp, Artificial Sequence
  Synthetic
agcgcccagcaatgcccgaaaacaacccccctcataatgacagccagaagacccggacagaaaagccccctccaa

SEQ ID NO: 244708 - DNA, 75 bp, Artificial Sequence
  Synthetic
aatgaaaattgaaaagatgggcctggtttttgcgcttggcgggatagggggcaccagtcttcacatcagaagtac

SEQ ID NO: 244709 - DNA, 75 bp, Artificial Sequence
  Synthetic
aagactccacggaccaagcgagaggccaaccagcagttgacggcaagcacgaacaccaggcggctcaagaacaga

SEQ ID NO: 244710 - DNA, 75 bp, Artificial Sequence
  Synthetic
aagatctcaaagaaagtcacagaggggggccagtcctaaaaacctactcccgaagcccagcccacacaaatacca

SEQ ID NO: 244711 - DNA, 75 bp, Artificial Sequence
  Synthetic
gccatgccccaacatacctacctgcggaagtggacggtgatgtcaaactcagttccaacctggtgatcctacctg

SEQ ID NO: 244712 - DNA, 75 bp, Artificial Sequence
  Synthetic
acagcctcgacacaaggccaccacccgccaccccaatccgcgtccccttcgtgggacccccgaggaccaaccccc

SEQ ID NO: 244713 - DNA, 75 bp, Artificial Sequence
  Synthetic
ggaacgtgagggcagcaaaagggtttatagggttccctcagataattcggcaggaccaagacactaatcatccgg

SEQ ID NO: 244714 - DNA, 75 bp, Artificial Sequence
  Synthetic
tcagatcggtcaatgcagtggccttcaacctgctggtgacccttaggattgacaaggcgattggccctgggaaga

SEQ ID NO: 244715 - DNA, 75 bp, Artificial Sequence
  Synthetic
aaggtcgcccccgacccagaccaccggccgcacacccacagcccccgggaaagaaacccccagcaactggaaggc

SEQ ID NO: 244716 - DNA, 75 bp, Artificial Sequence
  Synthetic
gactattcaaggtcctgtagactgcaatgcccagcaatgcccaaaaacgacccccctcacaatgacaaccagaag

SEQ ID NO: 244717 - DNA, 75 bp, Artificial Sequence
  Synthetic
ggccgcacacccacagcccccgggaaagaaacccccagcaactggaaggccccctcccccctcccccaacgcaag

SEQ ID NO: 244718 - DNA, 75 bp, Artificial Sequence
  Synthetic
gcccggacaaacaagccctctccgaaagactctacggaccaagtgagcgaccagccagcagccaacggcaagcat

SEQ ID NO: 244719 - DNA, 75 bp, Artificial Sequence
  Synthetic
tccgactccccagacagatcctctccccccggcaaactaaacaaaacttagggccaaggaacatacacacccgac

SEQ ID NO: 244720 - DNA, 75 bp, Artificial Sequence
  Synthetic
ggacaccaggtagccccagcgcagaacagctctgacgcaaggccttcaccagccatcccaatccgcatcctcctc

SEQ ID NO: 244721 - DNA, 75 bp, Artificial Sequence
  Synthetic
gttgggcccccgaggaccgaccccaaaggtcgcccccgacccagaccaccaaccgcatccccacaacccccggga

SEQ ID NO: 244722 - DNA, 75 bp, Artificial Sequence
  Synthetic
tctgaactcggtatcactgccgaggatgcgaggcttgtttcagagattgcaatgcatactactgaggacaggatc

SEQ ID NO: 244723 - DNA, 75 bp, Artificial Sequence
  Synthetic
tccaggcagttttgcagccatcagttcctcaagaattccgcatctacgacgacgtgatcataaatgatgaccaag

SEQ ID NO: 244724 - DNA, 75 bp, Artificial Sequence
  Synthetic
tcctcaagaattccgcatctacgacgacgtgatcataaatgatgaccaaggactattcaaagttctgtagaccgc

SEQ ID NO: 244725 - DNA, 75 bp, Artificial Sequence
  Synthetic
aagaaacccccagcaaccagaaggccccctctcatctcccccaacacaagaactccacaaccggaccgcacaagc

SEQ ID NO: 244726 - DNA, 75 bp, Artificial Sequence
  Synthetic
cccaagtgtcatttctacacggtgatcaaagtgagaatgagctaccaggattggggggcaaggaagataggaggg

SEQ ID NO: 244727 - DNA, 75 bp, Artificial Sequence
  Synthetic
agtgccccgcaatgcccgaaaacgaccctcctcataatgatagccagaaggcccggacaaaaaagctccccccaa

SEQ ID NO: 244728 - DNA, 75 bp, Artificial Sequence
  Synthetic
gaccgaggcgacccaaccgcgagcatccaactcctcagacagatccccctcccccggcaaactaaacaaaactta

SEQ ID NO: 244729 - DNA, 75 bp, Artificial Sequence
  Synthetic
cacaccaaccctcgaacaggcccagcacccagccgtcgacgatccaagacggggggccccccccaaaaaaaggcc

SEQ ID NO: 244730 - DNA, 75 bp, Artificial Sequence
  Synthetic
aaaaattccacggaccaaacgagaggccagccagcagccgacggcaagcgcgaacatcaggcggccccagcacag

SEQ ID NO: 244731 - DNA, 75 bp, Artificial Sequence
  Synthetic
gggccaaggagcatacacacccaacagaacccagacccccgcccacggcaccgcaccccaaccccccgacaacca

SEQ ID NO: 244732 - DNA, 75 bp, Artificial Sequence
  Synthetic
cccaggggccgacggccagcaccgcgaggaagcccacccgccccgcacacggccacggcaaccgaaccagaatcc

SEQ ID NO: 244733 - DNA, 75 bp, Artificial Sequence
  Synthetic
aacagccccgacacaaggcctccaccaaccatcccaatccgcatcctcctcgtgggacccccgaggaccaacccc

SEQ ID NO: 244734 - DNA, 75 bp, Artificial Sequence
  Synthetic
gagggagccccagaccaactccgccggcgccccaggtgcccacaggcaggcacaccaacccccgagcacacccag

SEQ ID NO: 244735 - DNA, 75 bp, Artificial Sequence
  Synthetic
agacccccccggagcaccgggtcccagactcggccatcaccccgcagaaagagaaggccacagcccgcgcacccc

SEQ ID NO: 244736 - DNA, 75 bp, Artificial Sequence
  Synthetic
caaggtcgccccagaccaaaaccaccaaccgcatctccacagttcccgggaaagaaacccccagcaactggaagg

SEQ ID NO: 244737 - DNA, 75 bp, Artificial Sequence
  Synthetic
cacccagccaccgacgatccaagacgggggggccccccccaaaaaaggcccccaggggccgacagccggcaccac

SEQ ID NO: 244738 - DNA, 75 bp, Artificial Sequence
  Synthetic
agccccgatccggtgggcagccacccaacccgaaccagcacccaagagtgatccctgaagggcccccggaccgca

SEQ ID NO: 244739 - DNA, 75 bp, Artificial Sequence
  Synthetic
gaggaagcccacccactccacacaagaccacggcaaccaaaccagagcccagaccactccgggccaccagctccc

SEQ ID NO: 244740 - DNA, 75 bp, Artificial Sequence
  Synthetic
aaagacatcagtatcccacagcctctccaagtcccccggtctcctcctctcctcaaagggatcaagagatcaatc

SEQ ID NO: 244741 - DNA, 75 bp, Artificial Sequence
  Synthetic
ccatcattgttataaaaaacttaggaaccaggtccacacagccgccagccaaccaaccatccactcccacgattg

SEQ ID NO: 244742 - DNA, 75 bp, Artificial Sequence
  Synthetic
aaactcgaccatcgccctgcagacaggaaaggccacaacccgcgcaccccagccccgacccggtgggcagccacc

SEQ ID NO: 244743 - DNA, 75 bp, Artificial Sequence
  Synthetic
aacataactgcaaggtttgtcctaatccacagtccaaacccaatgttaaagggattattccatgatgacagtaaa

SEQ ID NO: 244744 - DNA, 75 bp, Artificial Sequence
  Synthetic
agggccaaggaacatacacacccaacagaactcagaccccgacccacggcaccgcgcccccaccccccgacaacc

SEQ ID NO: 244745 - DNA, 75 bp, Artificial Sequence
  Synthetic
agacccgaatcagcacccaagaacgatccccgaaggacccccaaatcgcaaaggacatcagtctcccacagccct

SEQ ID NO: 244746 - DNA, 75 bp, Artificial Sequence
  Synthetic
gagccgatggcagaagagcaggcacgccatgtcaaaaacggactggaatgtatccgggctctcaaggccgagcct

SEQ ID NO: 244747 - DNA, 75 bp, Artificial Sequence
  Synthetic
cccctccccctctcccccaacgcaagaactccacaaccgaaccgcacaagcgaccgaggtgacccaacctcaggc

SEQ ID NO: 244748 - DNA, 75 bp, Artificial Sequence
  Synthetic
tccaagtcccccggccttcccccctccccgaagagaccaaaagatcaatccaccaaatccgacgacaatcaactc

SEQ ID NO: 244749 - DNA, 75 bp, Artificial Sequence
  Synthetic
agacaacccaggacaggaccgagccacctgcaaggaagagaaggcaggcagttcgggtctcagcaaaccatgcct

SEQ ID NO: 244750 - DNA, 75 bp, Artificial Sequence
  Synthetic
acctgcaaggaagagaaggcaggcagttcgggtctcagcaaaccatgcctctcagcaattggatcaactgaaggc

SEQ ID NO: 244751 - DNA, 75 bp, Artificial Sequence
  Synthetic
gttcgggtctcagcaaaccatgcctctcagcaattggatcaactgaaggcggtgcacctcgcatccgcggtcagg

SEQ ID NO: 244752 - DNA, 75 bp, Artificial Sequence
  Synthetic
cccaccgccaaaggagacaccgggattcccagaatcaagacccatccaatctctatcatgggtctcaaggtgaac

SEQ ID NO: 244753 - DNA, 75 bp, Artificial Sequence
  Synthetic
gaggaagcccacccaccccacacacgaccacggcaaccgaaccagaatccagaccaccctgggccaccagctccc

SEQ ID NO: 244754 - DNA, 75 bp, Artificial Sequence
  Synthetic
gaccacggcaaccgaaccagaatccagaccaccctgggccaccagctcccagactcggccatcaacccggaaaaa

SEQ ID NO: 244755 - DNA, 75 bp, Artificial Sequence
  Synthetic
gtctctgccatattcatggtagtactgttggctctccaaacacccactggtcaaatccactggggcaatctctcc

SEQ ID NO: 244756 - DNA, 75 bp, Artificial Sequence
  Synthetic
tgaaactttgggaatcccctcaagaaatctccaggcatcaagcactgggctacagtgttatcatgtttatgatca

SEQ ID NO: 244757 - DNA, 75 bp, Artificial Sequence
  Synthetic
tacagtgttatcatgtttatgatcacagcggtgaagcggttaagggaatccaagatgctgactctatcatggttc

SEQ ID NO: 244758 - DNA, 75 bp, Artificial Sequence
  Synthetic
gggaaggggacaactcgcgcaccccagccccgacccggcgggcagccacccaacccgaaccagcacccaagagcg

SEQ ID NO: 244759 - DNA, 75 bp, Artificial Sequence
  Synthetic
aaccccgaaggacccccgaaccgcaaaagacatcagcaccctacagcctctccaagtttcctggtctcctcctcc

SEQ ID NO: 244760 - DNA, 75 bp, Artificial Sequence
  Synthetic
tgcagaatatagaagactactaagaacagttttggaaccaatcagagatgcactcgatgcaatgacccagaacat

SEQ ID NO: 244761 - DNA, 75 bp, Artificial Sequence
  Synthetic
gaaaacagcgatgtggatattggcgaacctgataccgagggatatgctatcactgaccggggatctgctcccatc

SEQ ID NO: 244762 - DNA, 75 bp, Artificial Sequence
  Synthetic
aatcaggccttgatggtgatagcaccctctcaggaggagacgatgaatctgaaaacagcgatgtggatattggcg

SEQ ID NO: 244763 - DNA, 75 bp, Artificial Sequence
  Synthetic
cactgaccggggatctgctcccatctctatggggttcagggcttctgatgttgaaactgcagaaggaggggagat

SEQ ID NO: 244764 - DNA, 75 bp, Artificial Sequence
  Synthetic
acagttttggaaccaatcagagatgcactcgatgcaatgacccagaacataagaccggtccaaagtgtagcttca

SEQ ID NO: 244765 - DNA, 75 bp, Artificial Sequence
  Synthetic
atcccagaatcaagactcatccaatgtccatcatgggtctcaaggtgaacgtctctgtcatattcatggcaatac

SEQ ID NO: 244766 - DNA, 75 bp, Artificial Sequence
  Synthetic
catccaggcaaaacacttgtgtgttctggcagatttgtactgtcaaccagggacctgcccaccaattcgaggtct

SEQ ID NO: 244767 - DNA, 75 bp, Artificial Sequence
  Synthetic
tccgagacacccattaaaaagggcacagacgcgagattagcctcatttggaacggagatcgcgtctttattgaca

SEQ ID NO: 244768 - DNA, 75 bp, Artificial Sequence
  Synthetic
aagataggggtggtagggataggaagtgcaagctacaaagttatgactcgttccagccatcaatcattagtcata

SEQ ID NO: 244769 - DNA, 75 bp, Artificial Sequence
  Synthetic
acagttttggaaccaattagagatgcacttaatgcaatgacccaaaatataagaccagttcagagtgtaacttca

SEQ ID NO: 244770 - DNA, 75 bp, Artificial Sequence
  Synthetic
gagtgtgtgagcaatgccgcactgatacaggagtggacacccgaatctggtaccacaatctccccgagatcccag

SEQ ID NO: 244771 - DNA, 75 bp, Artificial Sequence
  Synthetic
tacaaagctgttgagatatcaacattaattaggagatgccttgagccaggggaagacggcttattcttgggtgag

SEQ ID NO: 244772 - DNA, 75 bp, Artificial Sequence
  Synthetic
taccacaatctccccgagatcccagaataatgaagaagggggagactattatgatgatgagctgttctccgatgt

SEQ ID NO: 244773 - DNA, 75 bp, Artificial Sequence
  Synthetic
aaagggagaacaagttggtatgtcaagaccaggcctaaagcctgatcttacaggaacatcaaaatcctatgtaag

SEQ ID NO: 244774 - DNA, 75 bp, Artificial Sequence
  Synthetic
agaccaggcctaaagcctgatcttacaggaacatcaaaatcctatgtaaggtcgctctgatcctctacaactctt

SEQ ID NO: 244775 - DNA, 75 bp, Artificial Sequence
  Synthetic
ccaagacatcaaaacagccttggccaaaatacacgaggataatcagaagataatctccaagctagaatcactgct

SEQ ID NO: 244776 - DNA, 75 bp, Artificial Sequence
  Synthetic
aaaatacacgaggataatcagaagataatctccaagctagaatcactgctgttattgaagggagaagttgagtca

SEQ ID NO: 244777 - DNA, 75 bp, Artificial Sequence
  Synthetic
tgcccaagtatgtcgcaacccaaggataccttatttcgaattttgatgagtcatcgtgtactttcatgccagagg

SEQ ID NO: 244778 - DNA, 75 bp, Artificial Sequence
  Synthetic
gttattgaagggagaagttgagtcaattaagaagcagatcaacaggcaaaatatcagcatatccaccctggaagg

SEQ ID NO: 244779 - DNA, 75 bp, Artificial Sequence
  Synthetic
attaagaagcagatcaacaggcaaaatatcagcatatccaccctggaaggacacctctcaagcatcatgatcgcc

SEQ ID NO: 244780 - DNA, 75 bp, Artificial Sequence
  Synthetic
atgatgatgagctgttctccgatgtccaagacatcaaaacagccttggccaaaatacacgaggataatcagaaga

SEQ ID NO: 244781 - DNA, 75 bp, Artificial Sequence
  Synthetic
caggaacatcaaaatcctatgtaaggtcgctctgatcctctacaactcttgaaacacaaatatcccactagtccg

SEQ ID NO: 244782 - DNA, 75 bp, Artificial Sequence
  Synthetic
ccccatatctgcggagatatctatccaggctttgagctatgcgcttggaggagatatcaataaggtgttagaaaa

SEQ ID NO: 244783 - DNA, 75 bp, Artificial Sequence
  Synthetic
acgaccccactgcagatgtcgaactcaatcccgacctgaaacccatcataggcagagattcaggccgagcactgg

SEQ ID NO: 244784 - DNA, 75 bp, Artificial Sequence
  Synthetic
ttatgtagggtctcattatagagaagtgaaccttgtataccccagatacagcaacttcatatctactgaatctta

SEQ ID NO: 244785 - DNA, 75 bp, Artificial Sequence
  Synthetic
agaatagcaacagtgtactcatgggcttacggtgatgatgatagctcttggaacgaagcttggttgttggcaaaa

SEQ ID NO: 244786 - DNA, 75 bp, Artificial Sequence
  Synthetic
gccctgcatcacgcagtgtaatccgctccattataaaatccagccggctagaggaggatcggaagcgttacctga

SEQ ID NO: 244787 - DNA, 75 bp, Artificial Sequence
  Synthetic
atctcaagtccggttatctgatactagacttacaccagaatatcttcgttaagaatctatccaagtcagagaaac

SEQ ID NO: 244788 - DNA, 75 bp, Artificial Sequence
  Synthetic
gaatgcctccgagggtccaccaagtcctgtgctcgtacactcgtatccgggtcttttggtaaccggttcatttta

SEQ ID NO: 244789 - DNA, 75 bp, Artificial Sequence
  Synthetic
tgactctccttgatgatatcaaaggagccaacgatcttgccaagttccaccagatgctgatgaagataataatga

SEQ ID NO: 244790 - DNA, 75 bp, Artificial Sequence
  Synthetic
gaccctgacaagatcctaacatacattgctgccgatcactgcccggtggtcgaggtgaacggcgtgaccatccaa

SEQ ID NO: 244791 - DNA, 75 bp, Artificial Sequence
  Synthetic
agccaacgatcttgccaagttccaccagatgctgatgaagataataatgaagtagctacagctcaacttacctgc

SEQ ID NO: 244792 - DNA, 75 bp, Artificial Sequence
  Synthetic
tatcaagcaccagcatagtctacatcctgattgcagtgtgtcttggtgggttgatagggatccctgttctaatat

SEQ ID NO: 244793 - DNA, 75 bp, Artificial Sequence
  Synthetic
gttgctgcagggggcgttgtaacaaaaagggagaacaggttggcatgtcaaggccaggcctaaagcctgatctca

SEQ ID NO: 244794 - DNA, 75 bp, Artificial Sequence
  Synthetic
caggaacatcaaaatcctatgtaaggtcgctctgatcctccacaactctcgaagcacaagtgtccaacaggttct

SEQ ID NO: 244795 - DNA, 75 bp, Artificial Sequence
  Synthetic
ccaagttccacaatgacagaggtctacgacttcgacaagtcggcatgggatatcaaagggtcgatcgctccgata

SEQ ID NO: 244796 - DNA, 75 bp, Artificial Sequence
  Synthetic
cagatattgaggagtatgaaaggtttatcgagcactagcatagtttacatcctgattgcagtgtgtcttggaggg

SEQ ID NO: 244797 - DNA, 75 bp, Artificial Sequence
  Synthetic
cgctccatcatcaagcaaccactgcacccagcatcaagcccacccgaaattatctcaggcttccctccggccgaa

SEQ ID NO: 244798 - DNA, 75 bp, Artificial Sequence
  Synthetic
gaaggataacaggattccttcatatggggtcttatccgttaatctgagtctgacagttgagcttaaaatcaaaat

SEQ ID NO: 244799 - DNA, 75 bp, Artificial Sequence
  Synthetic
ggctggtgccccaggtcagagtcatagatcctggtctaggtgacaggaaggatgaatgctttatgtacatgtttc

SEQ ID NO: 244800 - DNA, 75 bp, Artificial Sequence
  Synthetic
ctcttcgtcatcaagcaaccaccgcatccagcatcaagcccacctgaaattgtctccggcttccctctggccgag

SEQ ID NO: 244801 - DNA, 75 bp, Artificial Sequence
  Synthetic
ttggtagatccacagcaaaacccgaggaactcctcaaagaggccactgagcttgacatagttgttagacgtacag

SEQ ID NO: 244802 - DNA, 75 bp, Artificial Sequence
  Synthetic
tcatgtttctgagcttgatcgggctgctagccattgcaggcattagattgcatcgggcagccatctacaccgcgg

SEQ ID NO: 244803 - DNA, 75 bp, Artificial Sequence
  Synthetic
catcaggtcaaggacgtgctgacaccactcttcaaaatcatcggtgatgaagtgggcctgagaacacctcagaga

SEQ ID NO: 244804 - DNA, 75 bp, Artificial Sequence
  Synthetic
accgttcccagaagaatgctggaattcagatcggtcaatgcagtggccttcaacctgctagtgacccttaggatt

SEQ ID NO: 244805 - DNA, 75 bp, Artificial Sequence
  Synthetic
gacaaggcgattggccctgggaggatcatcgacagtgcagagcaacttcctgaggcaacatttatggtccacatt

SEQ ID NO: 244806 - DNA, 75 bp, Artificial Sequence
  Synthetic
ataagatagtagctatcctggagtatgctagagtccctcacgcttacaacttggaggaccctacgctgtgtcaga

SEQ ID NO: 244807 - DNA, 75 bp, Artificial Sequence
  Synthetic
gtacgggggaacttacctagtggaaaagcctaatctgaacagcaaggggtcagagttgtcacaactgagcatgta

SEQ ID NO: 244808 - DNA, 75 bp, Artificial Sequence
  Synthetic
cagagttgtcacaactgagcatgtatcgagtgtttgaagtaggtgttataagaaatccgggtttgggggctccgg

SEQ ID NO: 244809 - DNA, 75 bp, Artificial Sequence
  Synthetic
gtttttgcacttggtgggatagggggcaccagtcttcacattagaagcacaggcaagatgagcaagactctccat

SEQ ID NO: 244810 - DNA, 75 bp, Artificial Sequence
  Synthetic
tgtttcatatgacaaactatcttgaacaaccagtcagtaatgatctcagcaactgtatggtagctttaggggagc

SEQ ID NO: 244811 - DNA, 75 bp, Artificial Sequence
  Synthetic
atctcaagtccggttatctgatactggacttacaccagaataccttcgttaagaatttatctaagtcagagaaac

SEQ ID NO: 244812 - DNA, 75 bp, Artificial Sequence
  Synthetic
tatgttacccactgatggatatcaatgaagaccttaatcggttactctggaggagcagatgcaagatagtaagaa

SEQ ID NO: 244813 - DNA, 75 bp, Artificial Sequence
  Synthetic
cagagttgccacaaccaagcatgcaccgagtgtttgaagtaggtgtcatcagaaatccgggtttgggggctccag

SEQ ID NO: 244814 - DNA, 75 bp, Artificial Sequence
  Synthetic
agaaatccgggtttgggggctccagtgttccatatgacaaactattttgagcagccagtcagcaatgatttcagc

SEQ ID NO: 244815 - DNA, 75 bp, Artificial Sequence
  Synthetic
cccccctcatagtgacagccagaaggccctgacaaaaaagccccctccaaaagactccacggaccaagcgagagg

SEQ ID NO: 244816 - DNA, 75 bp, Artificial Sequence
  Synthetic
aagactccacggaccaagcgagaggccagccagcagccaacggcaagtgtggacaccaggcagcccaagcacaga

SEQ ID NO: 244817 - DNA, 75 bp, Artificial Sequence
  Synthetic
aatgcatactactgaggacaggatcagtagagcggttggacccagacaagcccaagtgtcatttctacacggtga

SEQ ID NO: 244818 - DNA, 75 bp, Artificial Sequence
  Synthetic
ttggggggcaaggaagataggagggtcaaacagagtcggggagaagccagggagagctacagagaaaccgggtcc

SEQ ID NO: 244819 - DNA, 75 bp, Artificial Sequence
  Synthetic
aatcaagcaaaatgggctgtcccgacaacacgaacagatgacaagttgcgaatggagacatgcttccagcaggcg

SEQ ID NO: 244820 - DNA, 75 bp, Artificial Sequence
  Synthetic
agccatcccaatctgcgtcctcctcgtgggacccccgaggaccaacccccaaggtcaccccggacacagaccacc

SEQ ID NO: 244821 - DNA, 75 bp, Artificial Sequence
  Synthetic
ggctgcatccctacagcctccgggaaaggaacccccagcaactggaagggccctcccccattcccccaacgcagg

SEQ ID NO: 244822 - DNA, 75 bp, Artificial Sequence
  Synthetic
ctacatgctgcagacacaatccggaatgctcaagcttcaggtgaagggttaacacatgagcagtgcgttgataac

SEQ ID NO: 244823 - DNA, 75 bp, Artificial Sequence
  Synthetic
ggggtcttgtctgttgatctgagtctgacagttgagcttaaaatcaaaattgcttcaggattcgggccattgatc

SEQ ID NO: 244824 - DNA, 75 bp, Artificial Sequence
  Synthetic
cattggagtggataccgagattcaaggttagtcccaacctctttactgtcccaattaaggaagcaggcgaggact

SEQ ID NO: 244825 - DNA, 75 bp, Artificial Sequence
  Synthetic
cattggagtggataccgagactcaaggttagtcccagcctattcactgtcccaatcaaggaggcaggtgaggact

SEQ ID NO: 244826 - DNA, 75 bp, Artificial Sequence
  Synthetic
agaggcaacaactttccgaagcttgggaaaactctcaatgttcctccgcccccgaaccccggtagggccagcact

SEQ ID NO: 244827 - DNA, 75 bp, Artificial Sequence
  Synthetic
agaacccaggccccagcccacggcaccgcgcccccaccccccgaaaaccagagggagcccccaaccaatcccgcc

SEQ ID NO: 244828 - DNA, 75 bp, Artificial Sequence
  Synthetic
ccgcgcccccaccccccgaaaaccagagggagcccccaaccaatcccgccggcccccccggcacccacagccagg

SEQ ID NO: 244829 - DNA, 75 bp, Artificial Sequence
  Synthetic
cacaccaacccccgaccagacccagcacccagccaccgacaatccaagacggggggccccccccaaaaaaaggcc

SEQ ID NO: 244830 - DNA, 75 bp, Artificial Sequence
  Synthetic
cccaggggccggcagccagcctcgcgaggaagcccacccacctcacacacgaccacggcaaccgaaccggagtcc

SEQ ID NO: 244831 - DNA, 75 bp, Artificial Sequence
  Synthetic
gctgccagtgaaccaatcacatgatgtcacccagacatcaggcatacccgctagtgtaaaatggacattagcatt

SEQ ID NO: 244832 - DNA, 75 bp, Artificial Sequence
  Synthetic
ggggccagtcccaaaaccctactcccgaagcccagtccatacaagtaccaggagcgtgaaagcagaaaaagggtt

SEQ ID NO: 244833 - DNA, 75 bp, Artificial Sequence
  Synthetic
gaggaagcccacccacctcacacacgaccacggcaaccgaaccggagtccagaccaccctgggccaccagctccc

SEQ ID NO: 244834 - DNA, 75 bp, Artificial Sequence
  Synthetic
agactcggccatcatccggcaaaaaagaaaggccacaacccgcgcaccccagccccgatccggcgggcagccact

SEQ ID NO: 244835 - DNA, 75 bp, Artificial Sequence
  Synthetic
tcactcactctgggatggtgggcatgggagtcagctgcacagtcactcgggaagatggaacaaaccgcagatagg

SEQ ID NO: 244836 - DNA, 75 bp, Artificial Sequence
  Synthetic
acatcaagcaccgcctaaagaacggattttccaaccaaatgattataaacaatgtggaagttgggaatgtcatca

SEQ ID NO: 244837 - DNA, 75 bp, Artificial Sequence
  Synthetic
ccaaattgtaatcaggatttatttaacatagaagacaaagagtcaacaaggaagatccgtgagctcctcaaaaag

SEQ ID NO: 244838 - DNA, 75 bp, Artificial Sequence
  Synthetic
caccacacccgacgacactcagctccccacccctaaaggagacaccgggaaccccagaatcaagactcatccagt

SEQ ID NO: 244839 - DNA, 75 bp, Artificial Sequence
  Synthetic
acgactttgacaagtcggcacgggacatcaaagggtcgatcgctccgacacaacccaccacccacagcgacggca

SEQ ID NO: 244840 - DNA, 75 bp, Artificial Sequence
  Synthetic
ggctggtgccccaggccagaaccacagatcctggtccaggcgacaggaaggatgaacgctccatgcacacgcctc

SEQ ID NO: 244841 - DNA, 75 bp, Artificial Sequence
  Synthetic
aggttttccaatgcctgagggacactaactcacggcttggcctaggctctgaattgagagaggacatcaaggaga

SEQ ID NO: 244842 - DNA, 75 bp, Artificial Sequence
  Synthetic
tgtaatcaggatttatttaacatagaagacaaagagtcaacaaggaagatccgcgaactcctcaagaagggaaat

SEQ ID NO: 244843 - DNA, 75 bp, Artificial Sequence
  Synthetic
tgctgggggttgccgaggacagcgatcccccagggcccccaatcgggcgagcacccgggtccccgcccctaggtg

SEQ ID NO: 244844 - DNA, 75 bp, Artificial Sequence
  Synthetic
ttggcagatccacagcaaaacccgaagaactcctcaaagaggccaccgagcccgacacagtcgtcagacggacag

SEQ ID NO: 244845 - DNA, 75 bp, Artificial Sequence
  Synthetic
tgcagaatacaggagactactgagaacagttttggaaccaattagagatgcacttaatgcaatgacccagaatat

SEQ ID NO: 244846 - DNA, 75 bp, Artificial Sequence
  Synthetic
cagggctcaacgaaaaaccggcaccctacaacaacaccccaccaactctcctcacaccctggagaaaggtcccga

SEQ ID NO: 244847 - DNA, 75 bp, Artificial Sequence
  Synthetic
acagttttggaaccaattagagatgcacttaatgcaatgacccagaatataagaccggttcagagtgtagcttca

SEQ ID NO: 244848 - DNA, 75 bp, Artificial Sequence
  Synthetic
caacagggagtgtccccaacgcaaaccaagtgtgcaacgcggtcaatccgacaccgctggataccccgcagaggc

SEQ ID NO: 244849 - DNA, 75 bp, Artificial Sequence
  Synthetic
ggaatccaacttatcaaattgtagccatgctggagccactttcacttgcttacctgcagctgagggatataacag

SEQ ID NO: 244850 - DNA, 75 bp, Artificial Sequence
  Synthetic
aagagtcagatacatgtggaaactaatagatggtttcttccctgcactcgggaatccaacttatcaaattgtagc

SEQ ID NO: 244851 - DNA, 75 bp, Artificial Sequence
  Synthetic
aggcgttgccacagctgctcagataacagccggcattgcacttcaccagtccatgctgaactctcaagccatcga

SEQ ID NO: 244852 - DNA, 75 bp, Artificial Sequence
  Synthetic
tccgcgccattcacacgagcatcacccgtccctcggacaacgggcaccacaccgctcccagaagaatgctggaat

SEQ ID NO: 244853 - DNA, 75 bp, Artificial Sequence
  Synthetic
gtccttgaccaaaacgggttttctgatgaaggtacttatcatgagctaactgaagctctagattacattttcata

SEQ ID NO: 244854 - DNA, 75 bp, Artificial Sequence
  Synthetic
tcagaccggtcaacgcagtggccttcaacccgctggcgaccctcaggattgacaaggcaattggccctgggaaga

SEQ ID NO: 244855 - DNA, 75 bp, Artificial Sequence
  Synthetic
acagccggcattgcacttcaccagtccatgctgaactctcaagccatcgataatctgagagcaagcctggaaacc

SEQ ID NO: 244856 - DNA, 75 bp, Artificial Sequence
  Synthetic
tcaccgacaatgcagagcaacctcccgaggcgacatctatggtccacatcgggaacctcaggagaaagaagagtg

SEQ ID NO: 244857 - DNA, 75 bp, Artificial Sequence
  Synthetic
gtgcaagatcctgagggattcaacatgattctaggtactatcctagctcaaatttgggtcttgcttgcaaaggcg

SEQ ID NO: 244858 - DNA, 75 bp, Artificial Sequence
  Synthetic
atcaataatgagctgataccgtctatgaaccaactatcttgtgatttaatcggccagaagctagggctcaaattg

SEQ ID NO: 244859 - DNA, 75 bp, Artificial Sequence
  Synthetic
tggaagtcttttgctggagtgaaatttggctgctttatgcctcttagcctggacagtgatctgacaatgtaccta

SEQ ID NO: 244860 - DNA, 75 bp, Artificial Sequence
  Synthetic
ctcagatactatacagaaatcctgtcattatttggccccagcttacgggaccccatatctgcggagatatccatc

SEQ ID NO: 244861 - DNA, 75 bp, Artificial Sequence
  Synthetic
caggctttgagctatgcgcttggaggagatatcaataaggtgttagaaaagctcggatacagtggaggtgattta

SEQ ID NO: 244862 - DNA, 75 bp, Artificial Sequence
  Synthetic
aatactcaggcacatcccttgtccgagtggcaaggtataccacaatctccaacgacaatctctcatttgtcatat

SEQ ID NO: 244863 - DNA, 75 bp, Artificial Sequence
  Synthetic
ctgggcatcttagagagcagaggaataaaggcccggataactcacgtcgacacagagtcctacttcattgtactc

SEQ ID NO: 244864 - DNA, 75 bp, Artificial Sequence
  Synthetic
gccatattctgtggaatcataatcaacggctatcgtgacagacacggaggcagttggccaccgctgacccttccc

SEQ ID NO: 244865 - DNA, 75 bp, Artificial Sequence
  Synthetic
tccccaagaattccgcatttacgacgacgtgatcataaatgatgaccaaggaccactcaaagttccgtagaccgc

SEQ ID NO: 244866 - DNA, 75 bp, Artificial Sequence
  Synthetic
aagatctcaaagaaagtcacagaggggggccagtctcaaaaacccactcccgaagcccagcccactcaagtacca

SEQ ID NO: 244867 - DNA, 75 bp, Artificial Sequence
  Synthetic
gcccggacaaaaaagccccctccaaaagactccacggaccacgcgagaggccagccagcagctgacggcaagagt

SEQ ID NO: 244868 - DNA, 75 bp, Artificial Sequence
  Synthetic
gtacctcatctcgaattttgatgagtcatcgtgtactttcatgccagaggggactgtgtgcagccaaaatgcctt

SEQ ID NO: 244869 - DNA, 75 bp, Artificial Sequence
  Synthetic
aggcttgaactttggtcgatcttactttgatccagcatattttagattaggacaagagatggttagaaggtcagc

SEQ ID NO: 244870 - DNA, 75 bp, Artificial Sequence
  Synthetic
caggaccaagacactgatcacccagagaatatggaagcttacgagacagtcagtgcatttatcacgactgatctc

SEQ ID NO: 244871 - DNA, 75 bp, Artificial Sequence
  Synthetic
gaggctaaatgagatttacggattaccctcatttttccagtggctgcataagaggcttgaaacctctgtcctgta

SEQ ID NO: 244872 - DNA, 75 bp, Artificial Sequence
  Synthetic
aggacaatgggatggccaaggatgagcacgatttgactaaggcactccatactttagctgtctcaggggtcccga

SEQ ID NO: 244873 - DNA, 75 bp, Artificial Sequence
  Synthetic
aaccccacaaccgaaccgcacaagcgaccgaggtgacccaaccgcaggcatccgactccctagacagatcctctc

SEQ ID NO: 244874 - DNA, 75 bp, Artificial Sequence
  Synthetic
ttgctgccgatcactgcccggtggtcgaggtgaacggtgtgaccatccaagtcgggagcaggaggtatccggacg

SEQ ID NO: 244875 - DNA, 75 bp, Artificial Sequence
  Synthetic
ccgcgcccccatcccccgacaaccagagggagcccccaaccaatcccgccggctcccccggtgcccacaggcagg

SEQ ID NO: 244876 - DNA, 75 bp, Artificial Sequence
  Synthetic
ccatcagcaccattccctatttatacctggctgcctatgagagcggagtaaggattgcttcgttagtgcaagggg

SEQ ID NO: 244877 - DNA, 75 bp, Artificial Sequence
  Synthetic
aagacctcaaagaaagtcacaggggggggccagtcttaaaaacctacccccgaagcccagtccgcaaaaatacca

SEQ ID NO: 244878 - DNA, 75 bp, Artificial Sequence
  Synthetic
gaaacgtgagagcagcaaaagagttcgtagggttccctcaagtaattcagcagaaccaagacactgatcatccgg

SEQ ID NO: 244879 - DNA, 75 bp, Artificial Sequence
  Synthetic
agccaagacccacaggacagtcgaaggtcagctgacgccctactcaggctgcaagccatggcagggatcctggaa

SEQ ID NO: 244880 - DNA, 75 bp, Artificial Sequence
  Synthetic
gaccacggcaaccgaaccagaatccagaccaccctgggccaccagctcccagactcggccatcaccccgcagaaa

SEQ ID NO: 244881 - DNA, 75 bp, Artificial Sequence
  Synthetic
cggtccacccatatcattggagaggttggacgtagggacaaatctggggaatgcagttgctaagttagaggatgc

SEQ ID NO: 244882 - DNA, 75 bp, Artificial Sequence
  Synthetic
cgtagggttccctcaagtaattcagcagaaccaagacactgatcatccggaaaatgtggaggcttacgagacagt

SEQ ID NO: 244883 - DNA, 75 bp, Artificial Sequence
  Synthetic
gccatgtcaaaaacggactggaatgtatccgggctctcaaggccgagcccatcaacccactggccatcggggaag

SEQ ID NO: 244884 - DNA, 75 bp, Artificial Sequence
  Synthetic
gaggctaaatgagatttacggattaccctcattctttcagtggctgcacaagaggcttgagacctctgtcctgta

SEQ ID NO: 244885 - DNA, 75 bp, Artificial Sequence
  Synthetic
agccccgatccggcgggcagccacccaacccgaaccagcacccaagagcgatccctgagggacccccgaaccgca

SEQ ID NO: 244886 - DNA, 75 bp, Artificial Sequence
  Synthetic
ttgatagggatccccgctttaatatgttgctgcagggggcgttgtaacagaaagggagaacaagttggtatgtca

SEQ ID NO: 244887 - DNA, 75 bp, Artificial Sequence
  Synthetic
tctcgaagggaccaaaagatcaatccaccacatccgacgacactcaattccccacccctaaaggagacaccggga

SEQ ID NO: 244888 - DNA, 75 bp, Artificial Sequence
  Synthetic
gaaaaacaaatgtcccacaagtctcctcttcgtcatcaagcagccaccgcatccggcatcaagcccacctgaaac

SEQ ID NO: 244889 - DNA, 75 bp, Artificial Sequence
  Synthetic
cccacccctaaaggagacaccgggaatcccagaatcaagactcatccagtgtccatcatgggtctcaaggtgaac

SEQ ID NO: 244890 - DNA, 75 bp, Artificial Sequence
  Synthetic
tgtctccggcttccctctggccgaacaatatcggtagttaattaaaacttagggtgcaagatcatccacaatgtc

SEQ ID NO: 244891 - DNA, 75 bp, Artificial Sequence
  Synthetic
caatatcggtagttaattaaaacttagggtgcaagatcatccacaatgtcaccacaacgagaccgaataaatgcc

SEQ ID NO: 244892 - DNA, 75 bp, Artificial Sequence
  Synthetic
agggtgcaagatcatccacaatgtcaccacaacgagaccgaataaatgccttttacaaagacaacccccacccca

SEQ ID NO: 244893 - DNA, 75 bp, Artificial Sequence
  Synthetic
ccccatatctgcggagatatccatccaggctttgagttatgcgcttggaggagataccaataaggtgtttaaaaa

SEQ ID NO: 244894 - DNA, 75 bp, Artificial Sequence
  Synthetic
cagacgcgaggttagcctcatttggaacggagatcgcgtctttattgacaggtggtgcaacccaatgtgctcgaa

SEQ ID NO: 244895 - DNA, 75 bp, Artificial Sequence
  Synthetic
ggtggtgcaacccaatgtgctcgaaggtcaccctcggaaccattagggccaggtgcacctgcggggaatgtcccc

SEQ ID NO: 244896 - DNA, 75 bp, Artificial Sequence
  Synthetic
accaaagaagtcaacaagggatgttccacgcttaccctgtattggtaagtagcaggcaacgagaacttatatcta

SEQ ID NO: 244897 - DNA, 75 bp, Artificial Sequence
  Synthetic
agaatagcaacagtgtactcatgggcttacggtgatgatgacagctcttggaacgaagcctggttgttagcaagg

SEQ ID NO: 244898 - DNA, 75 bp, Artificial Sequence
  Synthetic
gtactgcgcagatgtggctgctgaagaactcatgaatgcattggtgaacgcaactctgctggaggccagggcaac

SEQ ID NO: 244899 - DNA, 75 bp, Artificial Sequence
  Synthetic
caaagggccaatgtgagcctggaggagctaagggtaatcactcccatctcaacttcgaccaacttagcacacagg

SEQ ID NO: 244900 - DNA, 75 bp, Artificial Sequence
  Synthetic
agtctatcgcaggcatgctggataccacaaaaggccttattcgagccagcatgagaaaggggggattaacttctc

SEQ ID NO: 244901 - DNA, 75 bp, Artificial Sequence
  Synthetic
caatcagttcctagctgtttcaaagggaaactgctcagggcccactacaatcagaggtcaattctcaaacatgtc

SEQ ID NO: 244902 - DNA, 75 bp, Artificial Sequence
  Synthetic
ggaaactgctcagggcccactacaatcagaggtcaattctcaaacatgtcgctgtccctgttggacttgtattta

SEQ ID NO: 244903 - DNA, 75 bp, Artificial Sequence
  Synthetic
tatataccaacaaggaatgcttctagggttgggtgttttagaaacattgtttcgactcgagaaagacacaggatc

SEQ ID NO: 244904 - DNA, 75 bp, Artificial Sequence
  Synthetic
agtcgaggttacaatgtgtcatctatagtcactatgacatcccagggaatgtacgggggaacttacctagtggaa

SEQ ID NO: 244905 - DNA, 75 bp, Artificial Sequence
  Synthetic
gctgtccctgttggacttgtatttaagtcgaggttacaatgtgtcatctatagtcactatgacatcccagggaat

SEQ ID NO: 244906 - DNA, 75 bp, Artificial Sequence
  Synthetic
aagcctaatctgagcagtaaagggtcagagttgtcacaactgagcatgcaccgagtgtttgaagtaggtgtgatc

SEQ ID NO: 244907 - DNA, 75 bp, Artificial Sequence
  Synthetic
ctaagaagccatatgtgggcgaggctggctcgaggacggcctatttacggccttgaagtccctgatgtactagaa

SEQ ID NO: 244908 - DNA, 75 bp, Artificial Sequence
  Synthetic
gtgaccccactgcagatgtcgaaatcaatcccgacctgaaactcatcataggcagagactcaggccgagcactgg

SEQ ID NO: 244909 - DNA, 75 bp, Artificial Sequence
  Synthetic
aaacacattattatagtaccaatccctggagattcctcaattaccactcgatccagactactggaccggttggtc

SEQ ID NO: 244910 - DNA, 75 bp, Artificial Sequence
  Synthetic
tggctcgaggacggcctatttacggccttgaagtccctgatgtactagaatccatgcgaggccaccttatccggc

SEQ ID NO: 244911 - DNA, 75 bp, Artificial Sequence
  Synthetic
aactgcatggtggccttgggggagctcaaactcgcagccctctgtcacagggaagactctatcacaattccctat

SEQ ID NO: 244912 - DNA, 75 bp, Artificial Sequence
  Synthetic
tcaaactcgcagccctctgtcacagggaagactctatcacaattccctatcaggggtcagggaaaggtgtcatct

SEQ ID NO: 244913 - DNA, 75 bp, Artificial Sequence
  Synthetic
ctccattataaaatccagccggctagatgaggatcggaagcgttacctgatgactctccttgatgatatcaaagg

SEQ ID NO: 244914 - DNA, 75 bp, Artificial Sequence
  Synthetic
cttacggtgatgatgatagatcttggaacgaagcctggttgttagcaaggcaaagggccaatgtaagcctggagg

SEQ ID NO: 244915 - DNA, 75 bp, Artificial Sequence
  Synthetic
tcctcgtttctttctagaatgagcaaaggagtgtttaaggtgcttgtcaatgctctaagccacccaaagatctac

SEQ ID NO: 244916 - DNA, 75 bp, Artificial Sequence
  Synthetic
aaggagtgtttaaggtgcttgtcaatgctctaagccacccaaagatctacaagaaattctggcattgcggtatta

SEQ ID NO: 244917 - DNA, 75 bp, Artificial Sequence
  Synthetic
gaaatccccaaccgacatgcaatcctgggtccccctatcaacggatgacccagtgatagacaggctttacctctc

SEQ ID NO: 244918 - DNA, 75 bp, Artificial Sequence
  Synthetic
gaaggataacaggattccttcatacggggtcttgtctgttaatctgagtctgacagttgagcttaaaatcaaaat

SEQ ID NO: 244919 - DNA, 75 bp, Artificial Sequence
  Synthetic
ggtttgggtgttttagaaacactgtttcgactcgagaaagataccgggtcatctaacacggtattacatcttcac

SEQ ID NO: 244920 - DNA, 75 bp, Artificial Sequence
  Synthetic
tttcttctgtgtgaaagcgacgaggatgtagtaccggacagatttgacaacatccaggcaaaacacttgtgtgtt

SEQ ID NO: 244921 - DNA, 75 bp, Artificial Sequence
  Synthetic
tgacagttgagcttaaaatcaaaattgcttcaggattcgggccattgatcacacacggttcagggatggacctat

SEQ ID NO: 244922 - DNA, 75 bp, Artificial Sequence
  Synthetic
ctggcagatctgtactgtcaaccagggacctgcccaccaattcgaggtcttaggccggtagagaaatgtgcagtt

SEQ ID NO: 244923 - DNA, 75 bp, Artificial Sequence
  Synthetic
gcagagctatgtaccaacccgttgatatatgacaatgcacctttgatcgacagggatgcaacaaggctatacacc

SEQ ID NO: 244924 - DNA, 75 bp, Artificial Sequence
  Synthetic
acaaatccaaccacaacaatgtgtattggctgactatcccgccaatgaagaacctagccttaggtgtaatcaaca

SEQ ID NO: 244925 - DNA, 75 bp, Artificial Sequence
  Synthetic
gaccattactcatgctctctgacctatctccggcgaggatcgatcaaacagataagattgagagttgatccagga

SEQ ID NO: 244926 - DNA, 75 bp, Artificial Sequence
  Synthetic
gccatgccccaacatacctacctgcggaggtggatggtgatgtcaaactcagttccaatctggtgattctacctg

SEQ ID NO: 244927 - DNA, 75 bp, Artificial Sequence
  Synthetic
gataagattgagagttgatccaggattcatttttgacgccctcgctgaggtaaatgtcagtcagccaaagatcgg

SEQ ID NO: 244928 - DNA, 75 bp, Artificial Sequence
  Synthetic
agttccaatctggtgattctacctggtcaagatctccaatatgttttggcaacctacgatacttccagggttgaa

SEQ ID NO: 244929 - DNA, 75 bp, Artificial Sequence
  Synthetic
gtcaagatctccaatatgttttggcaacctacgatacttccagggttgaacatgctgtggtttattacgtttaca

SEQ ID NO: 244930 - DNA, 75 bp, Artificial Sequence
  Synthetic
aacctacgatacttccagggttgaacatgctgtggtttattacgtttacagcccaagccgctcattttcttactt

SEQ ID NO: 244931 - DNA, 75 bp, Artificial Sequence
  Synthetic
catgctgtggtttattacgtttacagcccaagccgctcattttcttacttttatccttttaggttgcctataaag

SEQ ID NO: 244932 - DNA, 75 bp, Artificial Sequence
  Synthetic
gcccaagccgctcattttcttacttttatccttttaggttgcctataaagggggtccccatcgaattacaagtgg

SEQ ID NO: 244933 - DNA, 75 bp, Artificial Sequence
  Synthetic
cacaccaacccccgaacagacccagcacccagccaccgacaatccaagacgggggggctcctccaaaaaaagccc

SEQ ID NO: 244934 - DNA, 75 bp, Artificial Sequence
  Synthetic
cccaggggctgacagccagcaccacgaagaggcccacccacctcacacacgaccacggcaaccaaactagagccc

SEQ ID NO: 244935 - DNA, 75 bp, Artificial Sequence
  Synthetic
aatgcttcacatgggaccaaaaactctggtgccgtcacttctgtgtgcttgcggactcagaatctggtggacata

SEQ ID NO: 244936 - DNA, 75 bp, Artificial Sequence
  Synthetic
ggaccgccctgggccaccagcccccagattcggccatcacccagaaggcagaaaaggccacaaccctcacacccc

SEQ ID NO: 244937 - DNA, 75 bp, Artificial Sequence
  Synthetic
ggccccgatccggcggacagccacccaacccgaaccagcacccaagagcgatctccgaagggccctcaaaccaca

SEQ ID NO: 244938 - DNA, 75 bp, Artificial Sequence
  Synthetic
tcactcactctgggatggtgggcatgggagtcagctgcacagtcactcgggaagatggaaccaatcgcagatagg

SEQ ID NO: 244939 - DNA, 75 bp, Artificial Sequence
  Synthetic
gggagtcagctgcacagtcactcgggaagatggaaccaatcgcagatagggctgccagtgaaccgatcacatgat

SEQ ID NO: 244940 - DNA, 75 bp, Artificial Sequence
  Synthetic
ttgagcctatccatggtccctcacttgatgctcaaaacctgcacacaactgtgtgcaacatgatttacacatgct

SEQ ID NO: 244941 - DNA, 75 bp, Artificial Sequence
  Synthetic
gctgccagtgaaccgatcacatgatgtcacccagacatcaggcatacccactagtgtgaaatagacatcagaatt

SEQ ID NO: 244942 - DNA, 75 bp, Artificial Sequence
  Synthetic
gtcacccagacatcaggcatacccactagtgtgaaatagacatcagaattaagaaaaacgtagggtccaagtggt

SEQ ID NO: 244943 - DNA, 75 bp, Artificial Sequence
  Synthetic
tatagagaccttacctaacaaagatactatagagaagctagaggaattggcagccatcttatcgatggctctgct

SEQ ID NO: 244944 - DNA, 75 bp, Artificial Sequence
  Synthetic
gatctggagagagcgatgacaacgctgaaactttgggaatcccctcaagaaatctccaggcatcaagcactgggt

SEQ ID NO: 244945 - DNA, 75 bp, Artificial Sequence
  Synthetic
aagaacaccaacgtcccacagcccctccaagtcccccgatctcatcttctcctcggagggaccaaaagatcaatc

SEQ ID NO: 244946 - DNA, 75 bp, Artificial Sequence
  Synthetic
taccacacccgactacactcaactccccaccccaaaaggagacaccgggaatcccagaatcaagactcacctaat

SEQ ID NO: 244947 - DNA, 75 bp, Artificial Sequence
  Synthetic
gtgtgcaacatgatttacacatgctatatgacttacctcgacctgttgttgaatgaggagttagaagagtttacc

SEQ ID NO: 244948 - DNA, 75 bp, Artificial Sequence
  Synthetic
actatagagaagctagaggaattggcagccatcttatcgatggctctgctcttgggcaaaataggatcaatactg

SEQ ID NO: 244949 - DNA, 75 bp, Artificial Sequence
  Synthetic
agacgcagttagtagaggtgatatcaaccctattctgaaaaaacttacacctatagagcaggtgctgatcaattg

SEQ ID NO: 244950 - DNA, 75 bp, Artificial Sequence
  Synthetic
ggggccagtcttaaaaacctactcccgaagcccagtccacacaagtaccaggaacgtgaaagcagcaaaagggtt

SEQ ID NO: 244951 - DNA, 75 bp, Artificial Sequence
  Synthetic
atgatgttgcaaaattactcaaagatatcaatacaagcaagcacaatcttccaatttcagggggcaatctcgtca

SEQ ID NO: 244952 - DNA, 75 bp, Artificial Sequence
  Synthetic
ggatcacccgcaaattttgggggcatattcttctttattccgggaacagaaagttgataaatcggtttgtccaga

SEQ ID NO: 244953 - DNA, 75 bp, Artificial Sequence
  Synthetic
tataggattccctcatgtaattcggcaggaccaagacactgatcatccggagaatatggaagcttacgagacagt

SEQ ID NO: 244954 - DNA, 75 bp, Artificial Sequence
  Synthetic
aggttttccaatgcctgagggacactaactcacggcttggcctaggctctgaattgagggaggacatcaaggaga

SEQ ID NO: 244955 - DNA, 75 bp, Artificial Sequence
  Synthetic
aaattattaacttgggagtttacatgcacagctcccaatggtttgagccctttctgttttggtttacagtcaaga

SEQ ID NO: 244956 - DNA, 75 bp, Artificial Sequence
  Synthetic
actgttgcccgctcctattggagggatgaattatctgaatatgagcaggctgtttgtcagaaacatcggtgatcc

SEQ ID NO: 244957 - DNA, 75 bp, Artificial Sequence
  Synthetic
gtagttcagttgagctgttaatctctcgtgaccttgttgctataatcagtaaagagtctcaacatgtatattacc

SEQ ID NO: 244958 - DNA, 75 bp, Artificial Sequence
  Synthetic
gcatttgggtccctgcccttaggtgttggtagatccacagcaaaacccgaagaactcctcaaagaggccactgag

SEQ ID NO: 244959 - DNA, 75 bp, Artificial Sequence
  Synthetic
aattagcaccctatccctccgaagttggccttgttgaacacagaatgggggtgagtaatattgtcaaggtgctct

SEQ ID NO: 244960 - DNA, 75 bp, Artificial Sequence
  Synthetic
accaaacaaagttgggtaaggatagatcaataaatgatcgtattctagcacacttaggattcaagatcctattat

SEQ ID NO: 244961 - DNA, 75 bp, Artificial Sequence
  Synthetic
tgacgtttgaactggtcttgatgtattgcgatgtcatagagggaaggttaatgacagagaccgccatgaccattg

SEQ ID NO: 244962 - DNA, 75 bp, Artificial Sequence
  Synthetic
ttaacgggaggcccgaagtcacatgggtaggcagtgtagattgcttcaatttcatagtcagtaatatccctacct

SEQ ID NO: 244963 - DNA, 75 bp, Artificial Sequence
  Synthetic
cacttaggattcaagatcctattatcagggacaagagcaggattagggtaatccgagatggccacacttttaaag

SEQ ID NO: 244964 - DNA, 75 bp, Artificial Sequence
  Synthetic
ttgcgatgtcatagagggaaggttaatgacagagaccgccatgaccattgatgctaggtatgcggaacttctggg

SEQ ID NO: 244965 - DNA, 75 bp, Artificial Sequence
  Synthetic
agttagtcggatacagtgccctgattaaggattaattggttgaactccggaaccctaatcctaccccaggtggtt

SEQ ID NO: 244966 - DNA, 75 bp, Artificial Sequence
  Synthetic
tcgtgaccttgttgctataatcagtaaagagtctcaacatgtatattacctgacgtttgaactggtcttgatgta

SEQ ID NO: 244967 - DNA, 75 bp, Artificial Sequence
  Synthetic
ctggggattcctcaattaccactcgatctagacttctggaccgattggttaggttgattggaaacccggatgtaa

SEQ ID NO: 244968 - DNA, 75 bp, Artificial Sequence
  Synthetic
tgaggcaacatttatggtccacatcgggaacttcaggagaaagaagagtgaagtctactctgctgattattgcaa

SEQ ID NO: 244969 - DNA, 75 bp, Artificial Sequence
  Synthetic
gtggttaaactgatgcctttcagcggggattttgttcagggatttatgagctatgtagggtcccattatagagaa

SEQ ID NO: 244970 - DNA, 75 bp, Artificial Sequence
  Synthetic
aagtctactctgctgattattgcaaaatgaaaatcgaaaagatgggcctggtttttgcacttggtgggatagggg

SEQ ID NO: 244971 - DNA, 75 bp, Artificial Sequence
  Synthetic
gtcgctctgatcctctacaactcccgaaacacaaatctcccacaagtctcctcttcgtaatcaagcaaccactgc

SEQ ID NO: 244972 - DNA, 75 bp, Artificial Sequence
  Synthetic
gagtctccaggccaattgattcagaggatcaccgatgacccagatgttagcataaggctattagaagttgtccag

SEQ ID NO: 244973 - DNA, 75 bp, Artificial Sequence
  Synthetic
actgatgacatacatctgacaggggagattttctcatttttcagaagtttcggccaccccagacttgaagcagta

SEQ ID NO: 244974 - DNA, 75 bp, Artificial Sequence
  Synthetic
aggagcagatgcaagatagtaagaatccaggcagttttgcagccatcagttccccaagaattccgcatttacgac

SEQ ID NO: 244975 - DNA, 75 bp, Artificial Sequence
  Synthetic
agtgaccaatcacaatccggcctaaccttcgcgtcaagaggtaccaacatggaggatgaggcagaccaatacttt

SEQ ID NO: 244976 - DNA, 75 bp, Artificial Sequence
  Synthetic
aggttgattggaaacccggatgtaagcgggcccaaactaacaggggcactaataggtatattgtccttatttgtg

SEQ ID NO: 244977 - DNA, 75 bp, Artificial Sequence
  Synthetic
gggattttgttcagggatttatgagctatgtagggtcccattatagagaagtgaatattgtataccccagataca

SEQ ID NO: 244978 - DNA, 75 bp, Artificial Sequence
  Synthetic
agtgcccagcaatacccgaaaacgacccccctcataatgacagccagaaggcccggacaaaaaagccccctccaa

SEQ ID NO: 244979 - DNA, 75 bp, Artificial Sequence
  Synthetic
atcaatccagattcggatggttcgagaacaaggaaatctcagatattgaagtgcaagatcccgagggattcaaca

SEQ ID NO: 244980 - DNA, 75 bp, Artificial Sequence
  Synthetic
aagactccacggaccaagtgagaggccagccagcagctgacggcaagcgtgaacaccaggcggcctgggcacaga

SEQ ID NO: 244981 - DNA, 75 bp, Artificial Sequence
  Synthetic
ctgcatgctgcagacacaatccggaatgctcaagcttcaggtgaagggttaacacatgagcagtgcgttgataac

SEQ ID NO: 244982 - DNA, 75 bp, Artificial Sequence
  Synthetic
ggatcacccgcaaattttgggggcatattcttctttactccgggaacagaaaattaataaatcggtttatccaga

SEQ ID NO: 244983 - DNA, 75 bp, Artificial Sequence
  Synthetic
gttactgccccagacacggcagctgattcggagctaagaaggtggataaagtacacccaacaaagaagggtagtc

SEQ ID NO: 244984 - DNA, 75 bp, Artificial Sequence
  Synthetic
tggaaatcatttgctggagtgagattcggctgttttatgcctcttagcctggacagtgatctgacaatgtaccta

SEQ ID NO: 244985 - DNA, 75 bp, Artificial Sequence
  Synthetic
aaggtcgcccccgacccagaccaccaaccgcatccccacagcccccgggaaagagacccccagcaactggaaggc

SEQ ID NO: 244986 - DNA, 75 bp, Artificial Sequence
  Synthetic
ggtgaatttagattggagagaaaatggttggatgtggtgaggaataggattgctgaggacctctccttacgtcga

SEQ ID NO: 244987 - DNA, 75 bp, Artificial Sequence
  Synthetic
aaccgcatccccacagcccccgggaaagagacccccagcaactggaaggcccctccccctttccctcaacgcaag

SEQ ID NO: 244988 - DNA, 75 bp, Artificial Sequence
  Synthetic
ttcatggtcgctctaatcctggacatcaagagaacacctgggaacaaacccaggattgctgaaatgatatgtgac

SEQ ID NO: 244989 - DNA, 75 bp, Artificial Sequence
  Synthetic
caggattgctgaaatgatatgtgacattgacacatatatcgtagaagcaggattagccagttttattctgactat

SEQ ID NO: 244990 - DNA, 75 bp, Artificial Sequence
  Synthetic
taagtttgggatagaaaccatgtatcctgctcttggactgcatgaatttgctggtgagttatccacacttgagtc

SEQ ID NO: 244991 - DNA, 75 bp, Artificial Sequence
  Synthetic
gtacgggggaacttacctagttgaaaagcccaatctgagcagcaaaggattaggattatcacaactgagcatata

SEQ ID NO: 244992 - DNA, 75 bp, Artificial Sequence
  Synthetic
ttacagcctgaaagagaaggagatcaaggaaacaggtagactttttgctaaaatgacttacaaaatgagggcatg

SEQ ID NO: 244993 - DNA, 75 bp, Artificial Sequence
  Synthetic
ggggaaactgcaccttacatggtaattctggagaactcaattcagaacaaattcagtgcaggatcgtaccctctg

SEQ ID NO: 244994 - DNA, 75 bp, Artificial Sequence
  Synthetic
ggggggccccccccaaaaaaaggcccccaggggccgacagccagcaccgcgaggaagcccacccaccccacacac

SEQ ID NO: 244995 - DNA, 75 bp, Artificial Sequence
  Synthetic
acaaccgatcagtaatgatctcagcaattgcatggtagctttgggggagttcaaactcgcagccctttgtcacgg

SEQ ID NO: 244996 - DNA, 75 bp, Artificial Sequence
  Synthetic
tcaaacgggattggaaaatattttaaggacaatgggatggccaaggatgagcacgatttgaccaaggcactccac

SEQ ID NO: 244997 - DNA, 75 bp, Artificial Sequence
  Synthetic
tttgatccagcatattttagattaggacaagagatggttaggagatcagctggaaaggtcagttccacactggca

SEQ ID NO: 244998 - DNA, 75 bp, Artificial Sequence
  Synthetic
aagatctcaaagaaagtcacagggggggaccagtcttgaaaacccactcccgaagcccagtcaacacaagtacca

SEQ ID NO: 244999 - DNA, 75 bp, Artificial Sequence
  Synthetic
ttctggagaactcaattcagaacaaattcagtgcaggatcgtaccctctgctctggagctatgccatgggagtag

SEQ ID NO: 245000 - DNA, 75 bp, Artificial Sequence
  Synthetic
tgccctgatccggtgggcggccacccaacccgaaccagcacccaagagcgatccccgaagggcccccgaaccgca

SEQ ID NO: 245001 - DNA, 75 bp, Artificial Sequence
  Synthetic
catccgggctctcaaagccgagcccatcggctcactggccatcgaggaagctatggcagcatggtcagaaatatc

SEQ ID NO: 245002 - DNA, 75 bp, Artificial Sequence
  Synthetic
agaatatagaagcctacgagacagtcagcgcatttatcacgactgatctcaagaagtactgccttaattggagat

SEQ ID NO: 245003 - DNA, 75 bp, Artificial Sequence
  Synthetic
cccaagtctcatttttacacagtgatcaaagtgagaatgagctaccgggattggggggcaaggaagatagaaggg

SEQ ID NO: 245004 - DNA, 75 bp, Artificial Sequence
  Synthetic
ttggggggcaaggaagatagaagggtcaaacagagtcgaggggaaaccagggagaactccagagaaaccgggccc

SEQ ID NO: 245005 - DNA, 75 bp, Artificial Sequence
  Synthetic
gatctccaggcatcaagcactgggttacagtgttgttatgtttatgatcacagcggtgaagcggttgagggaatc

SEQ ID NO: 245006 - DNA, 75 bp, Artificial Sequence
  Synthetic
gaaggataacaggattccttcatacggggttttgtctgttgacctgagcctggcagttgagcttaaaatcaaaat

SEQ ID NO: 245007 - DNA, 75 bp, Artificial Sequence
  Synthetic
ggcagagcaagtgatgcgagagctgcccatctcccaaccagcacacccccagacattgacactgcatcggagtac

SEQ ID NO: 245008 - DNA, 75 bp, Artificial Sequence
  Synthetic
agccaagaaccacaggacagtcgaaggtcagctgatgccctgctcaagctgcaagccatggcagggatcctggaa

SEQ ID NO: 245009 - DNA, 75 bp, Artificial Sequence
  Synthetic
gaacaaggctcagacacggacacccctagagtgtacaacgatagagatcttctagactaggtacaagaggccggg

SEQ ID NO: 245010 - DNA, 75 bp, Artificial Sequence
  Synthetic
ccatcagcaccattccctacttatacctggctgcttatgagagcggagtaagaattgcttcgttagtacaagggg

SEQ ID NO: 245011 - DNA, 75 bp, Artificial Sequence
  Synthetic
gaccagaacaacatccgcctaccctccatcattgttataaaaaacttaggaaccaggtccacacagccatcagcc

SEQ ID NO: 245012 - DNA, 75 bp, Artificial Sequence
  Synthetic
ttcactcagacatcaagaatacccaccagggtgaaatagacatcagaattaagaaaaacgtagggtccaagcggt

SEQ ID NO: 245013 - DNA, 75 bp, Artificial Sequence
  Synthetic
gagtaactagagattactttgtaattcttaggcaaaggctacatgacattggccatcacctcaaggcaaatgaga

SEQ ID NO: 245014 - DNA, 75 bp, Artificial Sequence
  Synthetic
tcttaggcaaaggctacatgacattggccatcacctcaaggcaaatgagacaattgtttcatcacatttttttgt

SEQ ID NO: 245015 - DNA, 75 bp, Artificial Sequence
  Synthetic
catccgggctctcaaggccgagcccatcagctcactggccatcggggaagccatggcagcatggtcagaaatatc

SEQ ID NO: 245016 - DNA, 75 bp, Artificial Sequence
  Synthetic
ggccatcacctcaaggcaaatgagacaattgtttcatcacatttttttgtctattcaaagggaatatattatgat

SEQ ID NO: 245017 - DNA, 75 bp, Artificial Sequence
  Synthetic
gttcgggtctcagcaaaccatgcttcacagcaattggatcagctgaaggcggtgcacctcgcatccgcggtcagg

SEQ ID NO: 245018 - DNA, 75 bp, Artificial Sequence
  Synthetic
gtcagagactatagttgatgaaacaagggcggcatgcagtaatattgctacaacaatggctaaaagcatcgagag

SEQ ID NO: 245019 - DNA, 75 bp, Artificial Sequence
  Synthetic
caacaatggctaaaagcatcgagagaggttatgaccgttatcttgcatattccctgaacgtcctaaaagtgatac

SEQ ID NO: 245020 - DNA, 75 bp, Artificial Sequence
  Synthetic
gatctggagagagcgatgacaacactgaagttttgggaatcccctcaagaaatccccaggcatcaagcactgggt

SEQ ID NO: 245021 - DNA, 75 bp, Artificial Sequence
  Synthetic
cacaatcaattcaaccatgacccgggatgtagtcatacccctcctcacaaacaacgatctcttaataaggatggc

SEQ ID NO: 245022 - DNA, 75 bp, Artificial Sequence
  Synthetic
caagatgctgactctatcatggttcgatcaggccttgatgatgatagcgccttctcaggaggagacaatgaatct

SEQ ID NO: 245023 - DNA, 75 bp, Artificial Sequence
  Synthetic
atgaattatctgaatatgagcaggctgtttgtcagaaacatcggtgatccagtaacatcatcaattgctgatctc

SEQ ID NO: 245024 - DNA, 75 bp, Artificial Sequence
  Synthetic
agtaacatcatcaattgctgatctcaagagaatgattctcgcatcactaatgcctgaagagaccctccatcaagt

SEQ ID NO: 245025 - DNA, 75 bp, Artificial Sequence
  Synthetic
tgcctgaagagaccctccatcaagtaatgacacaacaaccgggagactcttcattcctagactgggctagcgacc

SEQ ID NO: 245026 - DNA, 75 bp, Artificial Sequence
  Synthetic
ggaaaactctcaatgttcctccgcctccggaccccagtagggccagcacttccggaacacccattaaaaagggca

SEQ ID NO: 245027 - DNA, 75 bp, Artificial Sequence
  Synthetic
agtgcccagcaatacccgaaaacgacccccctcataatgacaaccagaaggcccggacaaaaaagtcccctctag

SEQ ID NO: 245028 - DNA, 75 bp, Artificial Sequence
  Synthetic
ccgagtgtttgaagtaggtgttatcagaaatccgggtttgggggctccggtgttccatatgacaaactattttga

SEQ ID NO: 245029 - DNA, 75 bp, Artificial Sequence
  Synthetic
aagatctcaaagagagtcacaggggggggccagtcccaaaaacccactcccgaagcccagctcacacaagtacca

SEQ ID NO: 245030 - DNA, 75 bp, Artificial Sequence
  Synthetic
acctagggcagctcatgaaatcctggatcacagtgtcacaggggcaagagagtctattgcaggcatgctagatac

SEQ ID NO: 245031 - DNA, 75 bp, Artificial Sequence
  Synthetic
aggtgcacctgcggggaatgtccccgagtttgtgagcaatgccgcactgataccggagtggacacccgaatctgg

SEQ ID NO: 245032 - DNA, 75 bp, Artificial Sequence
  Synthetic
cccccggcatactaaacaaaacttagggccaaggaacacacacacccgacagaacccagaccccggcccgcggca

SEQ ID NO: 245033 - DNA, 75 bp, Artificial Sequence
  Synthetic
taccacagtctcccagagatcccagaataatgaggaagggggagactattatgatgatgagctgttttccgatgt

SEQ ID NO: 245034 - DNA, 75 bp, Artificial Sequence
  Synthetic
gagtgataaccagattgtccaattatgactatgaacaatttagagcagggatggtgctattgacaggaagaaaga

SEQ ID NO: 245035 - DNA, 75 bp, Artificial Sequence
  Synthetic
ccaagatatcaagacagctttggccaaaatacacgaggataatcagaaaataatctccaaactggaatcactgct

SEQ ID NO: 245036 - DNA, 75 bp, Artificial Sequence
  Synthetic
caaagagccaatgtgagcctggaggagctaagggtgatcactcccatctcaacttcgaccaatttagcgcataga

SEQ ID NO: 245037 - DNA, 75 bp, Artificial Sequence
  Synthetic
tgtgagtgaccctcattgcccccccggccttgacgcccatgtcccattatgcaaagtccccaatgaccaaatctt

SEQ ID NO: 245038 - DNA, 75 bp, Artificial Sequence
  Synthetic
acaatcagaccatagccgtaacaaaaagggtgcccagcacatggccttacaaccttaagaaacgggaagctgcta

SEQ ID NO: 245039 - DNA, 75 bp, Artificial Sequence
  Synthetic
gtgaccccactgcagatgtcgaaatcaatcctgacttgaaacccatcataggcagagattcaggccgagcactgg

SEQ ID NO: 245040 - DNA, 75 bp, Artificial Sequence
  Synthetic
atccttgagagtcccatatattggttctaccactgatgagagaacagacatgaagctcgccttcgtaagagcccc

SEQ ID NO: 245041 - DNA, 75 bp, Artificial Sequence
  Synthetic
tctaccactgatgagagaacagacatgaagctcgccttcgtaagagccccaagtcgatccttgcgatctgctgtt

SEQ ID NO: 245042 - DNA, 75 bp, Artificial Sequence
  Synthetic
agctgctgaaggaattccagctaaagccgatcgggaaaaaggtgagctcggctgtcgggtttgttcccgacacca

SEQ ID NO: 245043 - DNA, 75 bp, Artificial Sequence
  Synthetic
aagtcgatccttgcgatctgctgttagaatagcaacagtgtactcatgggcttacggtgatgatgatagctcttg

SEQ ID NO: 245044 - DNA, 75 bp, Artificial Sequence
  Synthetic
gccgatcgggaaaaaggtgagctcggctgtcgggtttgttcccgacaccagccctacatcacgcagtgtaatccg

SEQ ID NO: 245045 - DNA, 75 bp, Artificial Sequence
  Synthetic
aatactcaggtacatcccttgtccgagtggcaaggtataccacaatctccaacgacaatctctcatttgttatat

SEQ ID NO: 245046 - DNA, 75 bp, Artificial Sequence
  Synthetic
gaacgaagcctggttgttggcaaggcaaagggccaatgtgagcctggaggagctaagggtgatcactcccatctc

SEQ ID NO: 245047 - DNA, 75 bp, Artificial Sequence
  Synthetic
caaagggccaatgtgagcctggaggagctaagggtgatcactcccatctcaacttcgactaatttagcgcatagg

SEQ ID NO: 245048 - DNA, 75 bp, Artificial Sequence
  Synthetic
agctaagggtgatcactcccatctcaacttcgactaatttagcgcataggttgagggatcgtagcactcaagtga

SEQ ID NO: 245049 - DNA, 75 bp, Artificial Sequence
  Synthetic
tccaagtcccccggtctcctcctctcctcaaagggatcaagagatcaatccaccacacccgacgacactcaactc

SEQ ID NO: 245050 - DNA, 75 bp, Artificial Sequence
  Synthetic
ttgagggatcgtagcactcaagtgaaatactcaggtacatcccttgtccgagtggcaaggtataccacaatctcc

SEQ ID NO: 245051 - DNA, 75 bp, Artificial Sequence
  Synthetic
cagatgctgatgaagataataatgaagtagctacagctcaactcacctgccaaccccatgccagttgacccaacc

SEQ ID NO: 245052 - DNA, 75 bp, Artificial Sequence
  Synthetic
caaccccatgccagttgacccaaccagcacgacctaaatctattataaaaaacttaggagcaaagtgattgcctc

SEQ ID NO: 245053 - DNA, 75 bp, Artificial Sequence
  Synthetic
gaagaagatgagagattggctgcattcctcatggacaggcatattatagtacctagggcagctcatgaaatcctg

SEQ ID NO: 245054 - DNA, 75 bp, Artificial Sequence
  Synthetic
aatactcaggtacatcccttgtccgagtggcaaggtataccacaatctccaacgacaatctctcatttgtcatat

SEQ ID NO: 245055 - DNA, 75 bp, Artificial Sequence
  Synthetic
ccaagttccaacatgacagagatctacgatttcgacaagtcggcatgggacgtcaaagggtcgatcgctccgata

SEQ ID NO: 245056 - DNA, 75 bp, Artificial Sequence
  Synthetic
cgtcaaagggtcgatcgctccgatacaacccaccacctacaatgatggcaggctggtgcctcaggtcagagtcat

SEQ ID NO: 245057 - DNA, 75 bp, Artificial Sequence
  Synthetic
gtcgaaacagattgttgcgtgatcccgatgatagatcatcccaggatacccagctcccgcaagctagagctgagg

SEQ ID NO: 245058 - DNA, 75 bp, Artificial Sequence
  Synthetic
cagagccataggaggcaccttgtggaatttgttacatggtccacaccccaactatatcatattctagctaagtcc

SEQ ID NO: 245059 - DNA, 75 bp, Artificial Sequence
  Synthetic
cagtgcatttatcacgactgatctcaagaagtactgccttaattggagatatgagaccatcagcttatttgcaca

SEQ ID NO: 245060 - DNA, 75 bp, Artificial Sequence
  Synthetic
actatatcatattctagctaagtccacagcactatctatgattgacctggtaacaaaatttgagaaggaccatat

SEQ ID NO: 245061 - DNA, 75 bp, Artificial Sequence
  Synthetic
ctcacaccttggagaaaagtcctaacaacagggagtgtcttcaacgcaaaccaagtatgcaatgcagttaatctg

SEQ ID NO: 245062 - DNA, 75 bp, Artificial Sequence
  Synthetic
taacaaaatttgagaaggaccatatgaatgaaatttcagctctcataggggatgacgatatcaatagtttcataa

SEQ ID NO: 245063 - DNA, 75 bp, Artificial Sequence
  Synthetic
gatgacgatatcaatagtttcataactgagtttctgcttatagagccaagattattcactatctacttgggccag

SEQ ID NO: 245064 - DNA, 75 bp, Artificial Sequence
  Synthetic
tacataccaacaaagaatgcttctagggttgggtgttttagaaacactatttcgactcaagaaagataccgggtc

SEQ ID NO: 245065 - DNA, 75 bp, Artificial Sequence
  Synthetic
caacctactggtgacccttaggattgacaaggcgattggccctggaaagatcatcgacaatgcagtgcagcttcc

SEQ ID NO: 245066 - DNA, 75 bp, Artificial Sequence
  Synthetic
tagagcctatccatggtccttcacttgatgctcaaaacttgcacacaactgtgtgcaacatggtttacacatgct

SEQ ID NO: 245067 - DNA, 75 bp, Artificial Sequence
  Synthetic
tgatgctcaaaacttgcacacaactgtgtgcaacatggtttacacatgctatatgacctacctcgacctgttgtt

SEQ ID NO: 245068 - DNA, 75 bp, Artificial Sequence
  Synthetic
gtgtgcaacatggtttacacatgctatatgacctacctcgacctgttgttgaatgaagagttagaagagttcaca

SEQ ID NO: 245069 - DNA, 75 bp, Artificial Sequence
  Synthetic
aatgaaaattgaaaagatgggcctagtttttgcacttggtgggatagggggcaccagtcttcacattagaagtac

SEQ ID NO: 245070 - DNA, 75 bp, Artificial Sequence
  Synthetic
gaatgaagagttagaagagttcacatttcttttgtgtgaaagcgacgaggatgtagtaccggacagattcgacaa

SEQ ID NO: 245071 - DNA, 75 bp, Artificial Sequence
  Synthetic
gacgtgatcataaatgatgaccaaggactgttcaaggttctgtagaccgcagtgcccagcaatgccaaaaaatga

SEQ ID NO: 245072 - DNA, 75 bp, Artificial Sequence
  Synthetic
tcaagaggacacccgggaacaagcctaggattgctgaaatgatatgtgacattgatacatatatcgtagaagcag

SEQ ID NO: 245073 - DNA, 75 bp, Artificial Sequence
  Synthetic
cccccttcacaatgacaaccagaaggcccggacaaaagagccccccaggaaagactccatggaccaagcagtcaa

SEQ ID NO: 245074 - DNA, 75 bp, Artificial Sequence
  Synthetic
ttcatttttgacgccctcactgaggtgaatgtcagtcaaccaaaaatcggcagcaacaacatctcaaatatgagc

SEQ ID NO: 245075 - DNA, 75 bp, Artificial Sequence
  Synthetic
ccagccagcagccgacggcaagcacgaataccagccggcccaagcgcagaacagccccgacacaaggccatcacc

SEQ ID NO: 245076 - DNA, 75 bp, Artificial Sequence
  Synthetic
gaataccagccggcccaagcgcagaacagccccgacacaaggccatcaccagccatcccaacccgcgtcctcctc

SEQ ID NO: 245077 - DNA, 75 bp, Artificial Sequence
  Synthetic
ggagagctacagagaaaccgagtccagcagagcaagtgatgcgagagctgcccatcctccaaccagcatgcccct

SEQ ID NO: 245078 - DNA, 75 bp, Artificial Sequence
  Synthetic
gcgggacccccgaggaccagctccaaaggtcgcccccgacccaaaccaccgatcccgtccccgcactccccgagg

SEQ ID NO: 245079 - DNA, 75 bp, Artificial Sequence
  Synthetic
gataaggttgagagtcgatccaggattcattttcgatgccctcgctgaggtaaatgtcagtcagccaaagattgg

SEQ ID NO: 245080 - DNA, 75 bp, Artificial Sequence
  Synthetic
attatgaaatccatgctttccgcagaatcgggttaaactcatctgcttgctacaaagctgttgagatatcaacat

SEQ ID NO: 245081 - DNA, 75 bp, Artificial Sequence
  Synthetic
cccctcccccctctcccgacacaacaactccacaaccggaccgcacaagcgaccgaggtgacccaaccacaggca

SEQ ID NO: 245082 - DNA, 75 bp, Artificial Sequence
  Synthetic
aactccacaaccggaccgcacaagcgaccgaggtgacccaaccacaggcatccgaccccccagacagatcctctc

SEQ ID NO: 245083 - DNA, 75 bp, Artificial Sequence
  Synthetic
ccctcggcagactaaacaaaactcagggccaaggaacacacacacccaacagaacccgaactcccgcccactgcg

SEQ ID NO: 245084 - DNA, 75 bp, Artificial Sequence
  Synthetic
attatgaaatccatgctttccgcagaatcggattgaactcatctgcttgctacaaagctgttgagatatcaacat

SEQ ID NO: 245085 - DNA, 75 bp, Artificial Sequence
  Synthetic
gtgcttctataatagtggggtttccgccaattctagatctggtcaaagggaattagcaccctatccctccgaagt

SEQ ID NO: 245086 - DNA, 75 bp, Artificial Sequence
  Synthetic
aattagcaccctatccctccgaagttggccttgtcgaacacagaatgggagtaggtaatattgtcaaggtgctct

SEQ ID NO: 245087 - DNA, 75 bp, Artificial Sequence
  Synthetic
tggccttgtcgaacacagaatgggagtaggtaatattgtcaaggtgctctttaacgggaggcccgaagtcacgtg

SEQ ID NO: 245088 - DNA, 75 bp, Artificial Sequence
  Synthetic
gttcgggtctcagcaaaccatgcttctcagcaattggatcaactgaaggcggtgcacctcgcatccgcggtcagg

SEQ ID NO: 245089 - DNA, 75 bp, Artificial Sequence
  Synthetic
ccgcgcccccaccccccgacaacaagagggggcccccaaccaatcccgccagcatccccggcgcccgcaggcaga

SEQ ID NO: 245090 - DNA, 75 bp, Artificial Sequence
  Synthetic
cacaccaacccccgaacagacccagcacccagccaccggtaatccaagacgggggggcttctccaaaaaaaggcc

SEQ ID NO: 245091 - DNA, 75 bp, Artificial Sequence
  Synthetic
cccaggggccgacagccagcaccacgaggaggcccacccaccccacacacgaccacggcaaccaaactagagccc

SEQ ID NO: 245092 - DNA, 75 bp, Artificial Sequence
  Synthetic
ggaccaccctgggccaccagcccctagactcggccatcacccagaaggcagaaaaggccacaacccgcacaccct

SEQ ID NO: 245093 - DNA, 75 bp, Artificial Sequence
  Synthetic
ccttggcaaaataggatcaatactggtgattaagcttatgcctttcagcggggattttgttcagggatttataag

SEQ ID NO: 245094 - DNA, 75 bp, Artificial Sequence
  Synthetic
agccccgatccggcggacagctccccaacccgaaccggcacccaagagcgatccccgaaggacccccaaatcaca

SEQ ID NO: 245095 - DNA, 75 bp, Artificial Sequence
  Synthetic
ctatgtagggtctcattatagagaagtgaaccttgtctaccctaggtacagcaacttcatatctactgaatctta

SEQ ID NO: 245096 - DNA, 75 bp, Artificial Sequence
  Synthetic
caacccgaaccggcacccaagagcgatccccgaaggacccccaaatcacaaaggacaccaacatcccacagcccc

SEQ ID NO: 245097 - DNA, 75 bp, Artificial Sequence
  Synthetic
tccaagtcccccgatcttatcctctcctcgaagggaccaaaaaattaatccaccacacctaacgacactcaactc

SEQ ID NO: 245098 - DNA, 75 bp, Artificial Sequence
  Synthetic
cccacccttcaaggagacaccgggaatcccagaatcaagactcacctaatgtccatcatgggcctcaaggcgagc

SEQ ID NO: 245099 - DNA, 75 bp, Artificial Sequence
  Synthetic
aaccctactctgaaaaaacttacacctatagagcaggtgctggtcaattgtgggctggcaattaacggacctaaa

SEQ ID NO: 245100 - DNA, 75 bp, Artificial Sequence
  Synthetic
tgtgcggacttcacctggacttataggtcacatcctatccattaagcaactaagctgcatacaagcaattgtggg

SEQ ID NO: 245101 - DNA, 75 bp, Artificial Sequence
  Synthetic
aggcgcggttagtagaggtgatatcaaccctaccctgagaaagcttacacctatagagcaggtgctgatcagttg

SEQ ID NO: 245102 - DNA, 75 bp, Artificial Sequence
  Synthetic
atcccagaatcaagactcacctaatgtccatcatgggcctcaaggcgagcgtctctgccatattcatgacagtac

SEQ ID NO: 245103 - DNA, 75 bp, Artificial Sequence
  Synthetic
ctccagccaccaatcattagtcataaaattaatgcccaatataaccctcctcaacaactgcacgagggtagagat

SEQ ID NO: 245104 - DNA, 75 bp, Artificial Sequence
  Synthetic
tgcagaatacaggagactactgagaacagttctggaaccaattagagatgcacttaacgcaatgacccagaacat

SEQ ID NO: 245105 - DNA, 75 bp, Artificial Sequence
  Synthetic
aagaccagtccagagtgtaacctcaagtaggagacacaagagatttgcaggagtggtcctggcaggtgctgccct

SEQ ID NO: 245106 - DNA, 75 bp, Artificial Sequence
  Synthetic
ggatcacccgcaaattttgggggcatattcttctttactccgggaacaggaagttgataaatcggtttatccaga

SEQ ID NO: 245107 - DNA, 75 bp, Artificial Sequence
  Synthetic
taggattgctgaaatgatatgtgacattgatacatatatcgtagaggcaggactagccagtttcatcttgaccat

SEQ ID NO: 245108 - DNA, 75 bp, Artificial Sequence
  Synthetic
aggcgttgccacggccgcccagataacagccggcattgcacttcaccagtccatgctgaattctcaagccattga

SEQ ID NO: 245109 - DNA, 75 bp, Artificial Sequence
  Synthetic
gagtggtcctggcaggtgctgccctaggcgttgccacggccgcccagataacagccggcattgcacttcaccagt

SEQ ID NO: 245110 - DNA, 75 bp, Artificial Sequence
  Synthetic
ccgtgaacttctaaaaaagggaaattcgctgtattccaaagtcagtgataaggttttccaatgcttgagggacat

SEQ ID NO: 245111 - DNA, 75 bp, Artificial Sequence
  Synthetic
gcccggacaaaaaagccccctccaaaagacttcacgaaccaagcgagaggcccgccagcagccaacagcaagtgt

SEQ ID NO: 245112 - DNA, 75 bp, Artificial Sequence
  Synthetic
acagccccgacacaaggccaccaccagccatcccaatctgcgtcctcctcgtaggacccccgaggaccaaccccc

SEQ ID NO: 245113 - DNA, 75 bp, Artificial Sequence
  Synthetic
cacttaggattcaagatcctattatcagggacaagagcaggattagggatatccgagatggccacacttttaagg

SEQ ID NO: 245114 - DNA, 75 bp, Artificial Sequence
  Synthetic
aaggtcgctccggacacagaccaccagcagcatctccacagctcccgggaaaggaacccccagcgactggaaggc

SEQ ID NO: 245115 - DNA, 75 bp, Artificial Sequence
  Synthetic
atccgagatggccacacttttaaggagcttagcattgttcaaaagaaacaaggacaaaccacccattacatcagg

SEQ ID NO: 245116 - DNA, 75 bp, Artificial Sequence
  Synthetic
tcaaacagggtcggggggaagccagggagagctacagagaaaccggatccagtagagcaagtgatgtgagagctg

SEQ ID NO: 245117 - DNA, 75 bp, Artificial Sequence
  Synthetic
agcagcatctccacagctcccgggaaaggaacccccagcgactggaaggcccctcccccccttccccaacgcaag

SEQ ID NO: 245118 - DNA, 75 bp, Artificial Sequence
  Synthetic
atccggtggagccatcagaggaatcaaacacattattatagtaccaatccctggagattcctcaattaccactcg

SEQ ID NO: 245119 - DNA, 75 bp, Artificial Sequence
  Synthetic
cccatcttccaatcagcactcccctagacgttgacactgcatcagagtcaggccaagatccgcaggacagtcgaa

SEQ ID NO: 245120 - DNA, 75 bp, Artificial Sequence
  Synthetic
agtatagcttatccgacactgtccgagattaagggggtcattgtccaccggctagagggggtctcgtacaacata

SEQ ID NO: 245121 - DNA, 75 bp, Artificial Sequence
  Synthetic
agcttagcattgttcaaaagaaacaaggacaaaccacccattacatcaggatccggtggagccatcagaggaatc

SEQ ID NO: 245122 - DNA, 75 bp, Artificial Sequence
  Synthetic
gagtctccaggtcaattgattcagaggatcaccgatgaccctgacgttagcataaggctgttagaggttgtccag

SEQ ID NO: 245123 - DNA, 75 bp, Artificial Sequence
  Synthetic
gcaggccatggcaggaatcttggaagaacaaggctcagatacagacatctctcgggtgtacaatgacaaagatct

SEQ ID NO: 245124 - DNA, 75 bp, Artificial Sequence
  Synthetic
ggctctcaagaatggtacaccactgtgcctaagtatgttgcaacccaagggtaccttatctcaaattttgatgag

SEQ ID NO: 245125 - DNA, 75 bp, Artificial Sequence
  Synthetic
aaggaaacccccagcaactggaaggcccctccccctctcccccaatgcaagaactccacaaccgaaccgcacaag

SEQ ID NO: 245126 - DNA, 75 bp, Artificial Sequence
  Synthetic
ggactgtgtgcagccaaaatgccttgtacccgatgagtcctctgcttcaagaatgcctccgggggtccaccaagt

SEQ ID NO: 245127 - DNA, 75 bp, Artificial Sequence
  Synthetic
ccgcgcccccaccccccgaaaaccagagggagcccccaaccaaacccaccggcccccccggtgcccacgggcagg

SEQ ID NO: 245128 - DNA, 75 bp, Artificial Sequence
  Synthetic
accgcgcccccaccccccgacaaccagcaggagccctcaacccatcccgccggctcccccggtgcccacaggcag

SEQ ID NO: 245129 - DNA, 75 bp, Artificial Sequence
  Synthetic
gaacaaggaaatctcagatattgaagtgcaagaccctgagggattcaacatgattctgggtaccatcctagccca

SEQ ID NO: 245130 - DNA, 75 bp, Artificial Sequence
  Synthetic
agactcggccaccaccccgcaaaaaagaaaggccacaacccgtgcaccccagccccgatccggcgggcagccatc

SEQ ID NO: 245131 - DNA, 75 bp, Artificial Sequence
  Synthetic
cacaacaggaacgatcatcaatcaagaccctgacaagatcctgacatacattgctgccgactactgcccggtagt

SEQ ID NO: 245132 - DNA, 75 bp, Artificial Sequence
  Synthetic
aatttgggtcttgctcgcaaaggcggttacggccccagacacggcagctgattcggagctaagaaggtggataaa

SEQ ID NO: 245133 - DNA, 75 bp, Artificial Sequence
  Synthetic
gcacaccaacccccgaacagacccagcacccagccatcgacaatccaagacggggggccccccccaaaaaaagcc

SEQ ID NO: 245134 - DNA, 75 bp, Artificial Sequence
  Synthetic
ggttggatgtggtgaggaacaggattgccgaggacctctccttacgccgattcatggtcgctctaatcctggata

SEQ ID NO: 245135 - DNA, 75 bp, Artificial Sequence
  Synthetic
tccaagtcccccagtctcctcttcgtctcgaagggaccaaaagatcaatccaccacatccgacgatactcaattc

SEQ ID NO: 245136 - DNA, 75 bp, Artificial Sequence
  Synthetic
caccacatccgacgatactcaattccccgccccctaaggggacaccgggaatcccagaatcaagactcatccagt

SEQ ID NO: 245137 - DNA, 75 bp, Artificial Sequence
  Synthetic
caggattgctgaaatgatatgtgacattgatacatatatcgtagaggcaggattagccagttttatcctgactat

SEQ ID NO: 245138 - DNA, 75 bp, Artificial Sequence
  Synthetic
caaggaattgttagagtcatcggaccagatattgaggagtatgaaaggtttgtcgagcactaacatagtctacat

SEQ ID NO: 245139 - DNA, 75 bp, Artificial Sequence
  Synthetic
taagtttgggatagaaactatgtatcctgctcttggactgcatgaatttgctggtgagttatccacacttgagtc

SEQ ID NO: 245140 - DNA, 75 bp, Artificial Sequence
  Synthetic
ctggtgagttatccacacttgagtccttgatgaacctttaccagcaaatgggggaaactgcaccctacatggtaa

SEQ ID NO: 245141 - DNA, 75 bp, Artificial Sequence
  Synthetic
aaaaggaggacaggttggtatgtcaagaccaggcctaaagcctgatctgacaggaacatcaaaatcctatgtaag

SEQ ID NO: 245142 - DNA, 75 bp, Artificial Sequence
  Synthetic
gttcagtgcaggatcataccctctgctctggagctatgccatgggagtaggagtggaacttgaaaactccatggg

SEQ ID NO: 245143 - DNA, 75 bp, Artificial Sequence
  Synthetic
tcctggagaactcaattcagaacaagttcagtgcaggatcataccctctgctctggagctatgccatgggagtag

SEQ ID NO: 245144 - DNA, 75 bp, Artificial Sequence
  Synthetic
gtcgctctgatcctccacaactcctgaaacacaaatgccccacaagtcttctctttgtcatcaagcaaccactgc

SEQ ID NO: 245145 - DNA, 75 bp, Artificial Sequence
  Synthetic
agattaagggggtgattgtccaccggcttgagggggtctcgtacaatataggctctcaagagtggtataccactg

SEQ ID NO: 245146 - DNA, 75 bp, Artificial Sequence
  Synthetic
atccagcatcaatcccacctgaaattatctctggcttccttctggccgaatacgatcggtcattaacaaaaactt

SEQ ID NO: 245147 - DNA, 75 bp, Artificial Sequence
  Synthetic
tggaaaggtcagttccacattggcatctgaactcggtatcactgccgaggatgcaaggcttgtttcagagattgc

SEQ ID NO: 245148 - DNA, 75 bp, Artificial Sequence
  Synthetic
caccacatccgacgacactcaactccccacccctaaaagatacaccgggagtcccataatcaagactcatccaat

SEQ ID NO: 245149 - DNA, 75 bp, Artificial Sequence
  Synthetic
gtcgggagcaggaggtatccggacgcggtgtacctgcacagaattgacctcggtcctcccatatcattggagaag

SEQ ID NO: 245150 - DNA, 75 bp, Artificial Sequence
  Synthetic
agggtgcaagatcatccacaatgtcaccacaacgagaccggataaatgccttctacaaagataaccctcattcca

SEQ ID NO: 245151 - DNA, 75 bp, Artificial Sequence
  Synthetic
aatgcatactactgaggacaagatcagtagagcggttggacccagacaagcccaagtatcatttctacacggtga

SEQ ID NO: 245152 - DNA, 75 bp, Artificial Sequence
  Synthetic
tatgttttgctggctgttctgttcgtcatgtttctgagcttgatcgggttgctggccattgcaggcattaggctt

SEQ ID NO: 245153 - DNA, 75 bp, Artificial Sequence
  Synthetic
ggagagctacagagaaaccgggcccagcagagcaagtgatgcgagagctgcccatcttccaaccggcacacccct

SEQ ID NO: 245154 - DNA, 75 bp, Artificial Sequence
  Synthetic
agacattgacactgcatcggagtccagccaagatccgcaggacagtcgaaggtcagctgacgccctgcttaggct

SEQ ID NO: 245155 - DNA, 75 bp, Artificial Sequence
  Synthetic
gactattcaaagttctgtaaaccgcagtgcccagcaatctccaaaaacgacccctcttatcatgacagcaagaag

SEQ ID NO: 245156 - DNA, 75 bp, Artificial Sequence
  Synthetic
ttcactgacctagtgaaattcatctctgacaagatcaaattccttaatccggatagggagtatgacttcagagat

SEQ ID NO: 245157 - DNA, 75 bp, Artificial Sequence
  Synthetic
gaacaaggctcagacacggacacccctatagtgtacaatgacagaaatcttctagactaggtgcgagaggccgag

SEQ ID NO: 245158 - DNA, 75 bp, Artificial Sequence
  Synthetic
gcccggacaaaaaagccccccccaaaagactccacggaccaggcgagaggccagccagcagccgatagaaagcgc

SEQ ID NO: 245159 - DNA, 75 bp, Artificial Sequence
  Synthetic
gaccagaacaacatccgcctaccctccatcattgttataaaaaacttaggaaccaggtccacacagccgccagcc

SEQ ID NO: 245160 - DNA, 75 bp, Artificial Sequence
  Synthetic
gaacaccaggcggcccaggcgcagaacagccccaacacaaggccaccaccagctatcccaatctgcgtcatcccc

SEQ ID NO: 245161 - DNA, 75 bp, Artificial Sequence
  Synthetic
gaggctaaatgagatttacggattaccctcattttttcagtggctgcataagaggcttgaaacctctgtcctgta

SEQ ID NO: 245162 - DNA, 75 bp, Artificial Sequence
  Synthetic
caactctactggagaccagaacaaccaatcagttcctagctgtctcaaagggaaactgctcagggcccactacca

SEQ ID NO: 245163 - DNA, 75 bp, Artificial Sequence
  Synthetic
gagccgatggcagaagagcaggcacgccatgtcaaaaacggactggaatgcatccgggctctcaaggccgagccc

SEQ ID NO: 245164 - DNA, 75 bp, Artificial Sequence
  Synthetic
gtgggacccccgaggatcaacccccaaggtcgcccccgacccagaccaccaaccgcacccccacagcccccaggg

SEQ ID NO: 245165 - DNA, 75 bp, Artificial Sequence
  Synthetic
atcggctcactggccatcgaggaagctatggcagcatggtcagaaatatcagacaacccaggacaggagcgagcc

SEQ ID NO: 245166 - DNA, 75 bp, Artificial Sequence
  Synthetic
aagaagcccccaacaaccggaaggcctcctcccccctccccccccccccaacgcaagaactccacaaccgaaccg

SEQ ID NO: 245167 - DNA, 75 bp, Artificial Sequence
  Synthetic
tagtcactatgacgtcccagggaatgtatgggggaacttacctagttgaaaagcccaatctgaacagcaaaggat

SEQ ID NO: 245168 - DNA, 75 bp, Artificial Sequence
  Synthetic
gaaacataaatgtcccacaagtctccccttcatcatcaagcaaccgccgcatccagcaccaagcccacctgaaat

SEQ ID NO: 245169 - DNA, 75 bp, Artificial Sequence
  Synthetic
aagcccaatctgaacagcaaaggatcagaattatcacaaccgagcatgtaccgagtgtttgaagtaggtgttata

SEQ ID NO: 245170 - DNA, 75 bp, Artificial Sequence
  Synthetic
gacctggagagagcgatgacgacgctgaaactttgggaatccccccaagaaatctccaggcatcaagcactgggt

SEQ ID NO: 245171 - DNA, 75 bp, Artificial Sequence
  Synthetic
aggaatccaggcttgggggccccggtgttccatatgacaaactattttgaacaaccaatcagcaaggatctcagc

SEQ ID NO: 245172 - DNA, 75 bp, Artificial Sequence
  Synthetic
agggaagtaggatagttattaacagagaacatcttatgattgatagaccttatgttttgctggctgttctgttcg

SEQ ID NO: 245173 - DNA, 75 bp, Artificial Sequence
  Synthetic
aaacttagggccaaggaacatacacacccgacaaagcccggaccccggcccacggcgccgcgcccccatcccccg

SEQ ID NO: 245174 - DNA, 75 bp, Artificial Sequence
  Synthetic
aactgcatggtggctttgggggagctcaggttcgcagccctctgtcacagggaagattctgtcacggttccctat

SEQ ID NO: 245175 - DNA, 75 bp, Artificial Sequence
  Synthetic
aactgcatggtagctttgggggagctcaaactcgcagccctttgtcacgggggagattccatcacaattccctat

SEQ ID NO: 245176 - DNA, 75 bp, Artificial Sequence
  Synthetic
aggtaggcacaccaacccccagacagacccagcacccagccatcgacaatccaagacggggggcccccccaaaaa

SEQ ID NO: 245177 - DNA, 75 bp, Artificial Sequence
  Synthetic
tctatggggttcagggcttctgatgttgaaactgcagaaggaggggagatccacgagctcctgagactccaatcc

SEQ ID NO: 245178 - DNA, 75 bp, Artificial Sequence
  Synthetic
aggccccccaggggccgacagccagcaccgcggggaagcccacccaccccacacacgaccacggcaaccgaacca

SEQ ID NO: 245179 - DNA, 75 bp, Artificial Sequence
  Synthetic
ttgaaactgcagaaggaggggagatccacgagctcctgagactccaatccagaggcaacaactttccgaagcttg

SEQ ID NO: 245180 - DNA, 75 bp, Artificial Sequence
  Synthetic
agaaatccgggtttgggggctccggtgttccatatgacaaactattttgagcaaccagttagtaatgatttcagc

SEQ ID NO: 245181 - DNA, 75 bp, Artificial Sequence
  Synthetic
gaacccagaccaccctgggccaccggctcacaggctcggcaatcaccccgcagaaaggaaaggccacaacccgcg

SEQ ID NO: 245182 - DNA, 75 bp, Artificial Sequence
  Synthetic
atctcacagaggtgtcatcactgacaatcaagcaaattgggctgttccgacaacacgaacagatgataagttgcg

SEQ ID NO: 245183 - DNA, 75 bp, Artificial Sequence
  Synthetic
ccacgagctcctgagactccaatccagaggcaacaactttccgaagcttgggaaaactctcaatgttcctccgcc

SEQ ID NO: 245184 - DNA, 75 bp, Artificial Sequence
  Synthetic
gatggagacatgcttccagcaggcgtgcaagggcaaaatccaagcactctgtgaaaatcccgagtgggcaccgtt

SEQ ID NO: 245185 - DNA, 75 bp, Artificial Sequence
  Synthetic
agagcgacccctgagggacccccgaatcgcaaaggacatcagtatcccatagcctctccaagtcccccggtctcc

SEQ ID NO: 245186 - DNA, 75 bp, Artificial Sequence
  Synthetic
atcgcaaaggacatcagtatcccatagcctctccaagtcccccggtctcccccacctctcgaagggaccaaaaga

SEQ ID NO: 245187 - DNA, 75 bp, Artificial Sequence
  Synthetic
gaaggacagcaggattccttcatacggggtcttgtctgtcgacctgagtctggcagctgagcccaaaatcaaaat

SEQ ID NO: 245188 - DNA, 75 bp, Artificial Sequence
  Synthetic
ggggtcttgtctgtcgacctgagtctggcagctgagcccaaaatcaaaattgcttcgggattcggtccattgatc

SEQ ID NO: 245189 - DNA, 75 bp, Artificial Sequence
  Synthetic
atatcagcatatccaccctggaaggacacctctcaagcatcatgatcgccattcctggacttgggaaggatccca

SEQ ID NO: 245190 - DNA, 75 bp, Artificial Sequence
  Synthetic
ttggctgactatcccgccaatgaagaacttagccttaggtgtaatcaacacattggagtggataccgagactcaa

SEQ ID NO: 245191 - DNA, 75 bp, Artificial Sequence
  Synthetic
attcctggacttgggaaggatcccaacgaccccactgcagatgtcgaaatcaatcccgacttgaaacccatcata

SEQ ID NO: 245192 - DNA, 75 bp, Artificial Sequence
  Synthetic
caatcccgacttgaaacccatcataggcagagattcaggccgagcactggccgaagttctcaagaaacccgttgc

SEQ ID NO: 245193 - DNA, 75 bp, Artificial Sequence
  Synthetic
agctgctgaaggaatttcagctaaagccgatcgggaaaaagatgagctcagccgtcgggtttgttcctgacaccg

SEQ ID NO: 245194 - DNA, 75 bp, Artificial Sequence
  Synthetic
aacctacgatacttccagagttgaacatgctgtggtttattacgtttacagcccaagccgctcattctcttactt

SEQ ID NO: 245195 - DNA, 75 bp, Artificial Sequence
  Synthetic
ttatccctttaggttacctataaaggggacccccatcgaattacaagtggaatgcttcacatgggaccaaagact

SEQ ID NO: 245196 - DNA, 75 bp, Artificial Sequence
  Synthetic
agtagctacagctcaacttacctgccaaccccatgccagtcgacccaactagtacaacctaaatccattataaaa

SEQ ID NO: 245197 - DNA, 75 bp, Artificial Sequence
  Synthetic
ctggtgccgtcacttctgtgtgcttgctgactcggaatctggtggacatatcacccactctgggatggtgggcat

SEQ ID NO: 245198 - DNA, 75 bp, Artificial Sequence
  Synthetic
agtacaacctaaatccattataaaaaacttaggagcaaagtgattgcctcccaagttccacaatgacagagatct

SEQ ID NO: 245199 - DNA, 75 bp, Artificial Sequence
  Synthetic
gctgactcggaatctggtggacatatcacccactctgggatggtgggcatgggagtcagctgcacagtcaaccgg

SEQ ID NO: 245200 - DNA, 75 bp, Artificial Sequence
  Synthetic
caacccaccacctacagtgatggcaggctggtgccccaggtcagagtcatagatcctggtctaggcgacaggaag

SEQ ID NO: 245201 - DNA, 75 bp, Artificial Sequence
  Synthetic
ttcactcagacatcaagaatacccaccagtgtggaatagacatcagaattaagaaaaacgtagggtccaagtgat

SEQ ID NO: 245202 - DNA, 75 bp, Artificial Sequence
  Synthetic
tccccgttatggactcgctgtctgtcaaccagatcctataccctgaggttcacctagatagcccgatagttacca

SEQ ID NO: 245203 - DNA, 75 bp, Artificial Sequence
  Synthetic
tgctgggggttgttgaggacagcgatcccctagggcctccaatcgggcgagcatttgggtccctgcccttaggtg

SEQ ID NO: 245204 - DNA, 75 bp, Artificial Sequence
  Synthetic
cttgacatagttgttagacgtacagcagggctcaatgaaaaactggtgttctacaacaacaccccactaactctc

SEQ ID NO: 245205 - DNA, 75 bp, Artificial Sequence
  Synthetic
acatcaagcaccgcctggaaaccggattttccaaccaaatgatcataaacaatgtggaagttgggaatgtcatca

SEQ ID NO: 245206 - DNA, 75 bp, Artificial Sequence
  Synthetic
ggaatccaacttatcaaattgtagccatgctggagccacttttacttgcttacctgcagttgaggggtataacag

SEQ ID NO: 245207 - DNA, 75 bp, Artificial Sequence
  Synthetic
ctcacaccttggagaaaggtcctaacaacagggagtgtcttcaacgcaaaccaagtgtgcaatgcggttaatctg

SEQ ID NO: 245208 - DNA, 75 bp, Artificial Sequence
  Synthetic
tgtaatcaggatttatttaacatagaagacaaggagtcaacgaggaagatccgtgaactcctcaagaaggggaat

SEQ ID NO: 245209 - DNA, 75 bp, Artificial Sequence
  Synthetic
ccgtctttcggataacgggtattacaccgttcctagaagaatgctggaattcagatcggtcaatgcagtggcctt

SEQ ID NO: 245210 - DNA, 75 bp, Artificial Sequence
  Synthetic
gaattgagagaggacatcaaggagagagttattaacttgggagtttacatgcagagctctcgatggtttgagccc

SEQ ID NO: 245211 - DNA, 75 bp, Artificial Sequence
  Synthetic
ccaagtcttgtgctcgtacactcgtatctgggtcttttgggaaccggttcattttatcacaagggaacctaatag

SEQ ID NO: 245212 - DNA, 75 bp, Artificial Sequence
  Synthetic
tcatcgacaatacagagcaacttcctgaggcaacatttatggtccacatcgggaacttcaggagaaagaagagtg

SEQ ID NO: 245213 - DNA, 75 bp, Artificial Sequence
  Synthetic
gggaacttcaggagaaagaagagtgaagtctactctgccgattattgcaaaatgaaaatcgaaaagatgggcctg

SEQ ID NO: 245214 - DNA, 75 bp, Artificial Sequence
  Synthetic
tgaggcaacatttatggtccacatcgggaacttcaggagaaagaagagtgaagtctactctgccgattattgcaa

SEQ ID NO: 245215 - DNA, 75 bp, Artificial Sequence
  Synthetic
agacacacacctgtattcttcactggtagttcagttgagctgctaatttctcgtgatcttgttgctataattagt

SEQ ID NO: 245216 - DNA, 75 bp, Artificial Sequence
  Synthetic
aggcaaaatgagcaagactctccatgcacaactcgggttcaagaagaccttatgttacccgctgatggatatcaa

SEQ ID NO: 245217 - DNA, 75 bp, Artificial Sequence
  Synthetic
gcacaactcgggttcaagaagaccttatgttacccgctgatggatatcaatgaagaccttaatcgattactctgg

SEQ ID NO: 245218 - DNA, 75 bp, Artificial Sequence
  Synthetic
atccaagtcgggagcaggaggtatccggacgctgtgtacttgcacagaattgacctcggtcctcccatatcattg

SEQ ID NO: 245219 - DNA, 75 bp, Artificial Sequence
  Synthetic
tgaagaccttaatcgattactctggaggagcagatgcaagatagtaagaatccaggcagttttgcagccatcagt

SEQ ID NO: 245220 - DNA, 75 bp, Artificial Sequence
  Synthetic
gtgggacccccgaggaccaacccccaaggctgcccccgatccaaaccaccaaccgcatccccaccacccccggga

SEQ ID NO: 245221 - DNA, 75 bp, Artificial Sequence
  Synthetic
aagactccacggaccaagtgagaggccagccagcagccgacagcaagcgtggacaccaggcggcccaagcacgga

SEQ ID NO: 245222 - DNA, 75 bp, Artificial Sequence
  Synthetic
aactccacaaccgaaccgcacaagcgaccgaggtgacccaaccgcaggcatccgactccctagacagatcctctc

SEQ ID NO: 245223 - DNA, 75 bp, Artificial Sequence
  Synthetic
gaccgaggtgacccaaccgcaggcatccgactccctagacagatcctctctccccggcaaactaaacaaaactta

SEQ ID NO: 245224 - DNA, 75 bp, Artificial Sequence
  Synthetic
aaggtcgctccggacacagaccaccagccgcatccccacagctcccgggaaaggaacccccagcaactggaaggc

SEQ ID NO: 245225 - DNA, 75 bp, Artificial Sequence
  Synthetic
tggaaatcctttgctggaatgaaatttggttgctttatgcctcttagcctggatagtgatttaacaatgtactta

SEQ ID NO: 245226 - DNA, 75 bp, Artificial Sequence
  Synthetic
agaacccagaccccggcccacggcgccgcgcccccaacccccgacaaccagagggagcccccaaccaatcccgcc

SEQ ID NO: 245227 - DNA, 75 bp, Artificial Sequence
  Synthetic
ggctcccccggtgcccacaggcagggacaccaacccccgaacagacccagcacccaaccatcgacaatccaagac

SEQ ID NO: 245228 - DNA, 75 bp, Artificial Sequence
  Synthetic
ttgtagatgttttccttaatgattcgagctttgacccatatgatatgataatgtatgttgtaagtggagcttacc

SEQ ID NO: 245229 - DNA, 75 bp, Artificial Sequence
  Synthetic
cccaggggccgacagccagcaccgcgaggaagcccacccaccccacacacgaccacggcaaccaaaccagaaccc

SEQ ID NO: 245230 - DNA, 75 bp, Artificial Sequence
  Synthetic
agaccaccctgggccaccagctcccagactcggccatcaccccgcagaaaggaaaggccacaacccgcgcacccc

SEQ ID NO: 245231 - DNA, 75 bp, Artificial Sequence
  Synthetic
aaatgacttacaaaatgagagcatgccaggtgattgctgaaaatctaatctcaaatgggattggcaaatatttta

SEQ ID NO: 245232 - DNA, 75 bp, Artificial Sequence
  Synthetic
atccccgaaggacccccgaaccgcaaaggacatcagtatcccacagcctctccaagtcccccggtctcctcctct

SEQ ID NO: 245233 - DNA, 75 bp, Artificial Sequence
  Synthetic
aagatctcaaagagagtcacaggggggggccagtcccaaaaacccactcccgaaaccccgcccacacaattacca

SEQ ID NO: 245234 - DNA, 75 bp, Artificial Sequence
  Synthetic
cccacccctaaaggagacaccgggaatcccagaatcaagactcatccaatgtccatcatgggtctcaaggtgaac

SEQ ID NO: 245235 - DNA, 75 bp, Artificial Sequence
  Synthetic
gaaacatgagatcagcaaaagagtttgtagggttccctcaagtaattcggcaggaccaagacactaatcatccgg

SEQ ID NO: 245236 - DNA, 75 bp, Artificial Sequence
  Synthetic
gtccatcatgggtctcaaggtgaacgtctctgccatattcatggcagtactgttaactctccaaacacccaccgg

SEQ ID NO: 245237 - DNA, 75 bp, Artificial Sequence
  Synthetic
catctatagtcactatgacatcccagggaatgtacgggggaacttacctagtggaaaagcctaatctgaacagca

SEQ ID NO: 245238 - DNA, 75 bp, Artificial Sequence
  Synthetic
atcccagaatcaagactcatccaatgtccatcatgggtctcaaggtgaacgtctctgccatattcatggcagtac

SEQ ID NO: 245239 - DNA, 75 bp, Artificial Sequence
  Synthetic
tcaaatccattggggcaatctctctaagataggggtggtaggaataggaagtgcaagctacaaagttatgactcg

SEQ ID NO: 245240 - DNA, 75 bp, Artificial Sequence
  Synthetic
tgtagggttccctcaagtaattcggcaggaccaagacactaatcatccggagaacacggaaacttacgagacagt

SEQ ID NO: 245241 - DNA, 75 bp, Artificial Sequence
  Synthetic
ttccagccatcaatcattagtcataaaattaatgcccaatataactctcctcaataactgcacgagggtagagat

SEQ ID NO: 245242 - DNA, 75 bp, Artificial Sequence
  Synthetic
aagaccggttcagagtgtagcttcaagtaggagacacaagagatttgcgggagtagtcctggcaggtgcggccct

SEQ ID NO: 245243 - DNA, 75 bp, Artificial Sequence
  Synthetic
gaggttaaatgagatttatggattaccctcattctttcagtggctgcataagaggcttgagacctctgtcctgta

SEQ ID NO: 245244 - DNA, 75 bp, Artificial Sequence
  Synthetic
gggagctcaaattcgcagccctttgtcacaggggggattctatcacaattccctatcaaggatcagggaaagctg

SEQ ID NO: 245245 - DNA, 75 bp, Artificial Sequence
  Synthetic
acagccggcattgcacttcaccagtccatgctgaactctcaagccatcgacaatctgagagcgagcctggaaact

SEQ ID NO: 245246 - DNA, 75 bp, Artificial Sequence
  Synthetic
gcaaagtccccaatgatcaaatcttcattaagtaccctatgggaggtatagaagggtattgtcagaagctgtgga

SEQ ID NO: 245247 - DNA, 75 bp, Artificial Sequence
  Synthetic
cattaagtaccctatgggaggtatagaagggtattgtcagaagctgtggaccatcagcaccattccctatttata

SEQ ID NO: 245248 - DNA, 75 bp, Artificial Sequence
  Synthetic
gaagggtattgtcagaagctgtggaccatcagcaccattccctatttatacctggctgcttatgagagcggagta

SEQ ID NO: 245249 - DNA, 75 bp, Artificial Sequence
  Synthetic
actaatcaggcaattgaggcaatcagacaagcagggcaggagatgatattggctgttcagggtgtccaagactac

SEQ ID NO: 245250 - DNA, 75 bp, Artificial Sequence
  Synthetic
ccatcagcaccattccctatttatacctggctgcttatgagagcggagtaaggattgcctcgttagtgcaggggg

SEQ ID NO: 245251 - DNA, 75 bp, Artificial Sequence
  Synthetic
cggccagaagctcgggctcaaattgctcagatactatacagaaatcctgtcattatttggccccagcttacggga

SEQ ID NO: 245252 - DNA, 75 bp, Artificial Sequence
  Synthetic
ctcagatactatacagaaatcctgtcattatttggccccagcttacgggaccccatatctgcggagatatctatc

SEQ ID NO: 245253 - DNA, 75 bp, Artificial Sequence
  Synthetic
cattatttggccccagcttacgggaccccatatctgcggagatatctatccaggctttgagctatgcgcttggag

SEQ ID NO: 245254 - DNA, 75 bp, Artificial Sequence
  Synthetic
gttgcgaatggagacatgcttccagcaggcgtgtaagggtaaaatccaagcactctgcgagaatcccgagtgggc

SEQ ID NO: 245255 - DNA, 75 bp, Artificial Sequence
  Synthetic
aagaaattctggcattgtggtattatagagcctgtctatggtccttcacttgacgctcaaaacttgcacacaact

SEQ ID NO: 245256 - DNA, 75 bp, Artificial Sequence
  Synthetic
gagtaactagaaactactttgtaattcttaggcaaaggctacatgacattggccatcacctcaaggcaaatgaga

SEQ ID NO: 245257 - DNA, 75 bp, Artificial Sequence
  Synthetic
caggcgtgtaagggtaaaatccaagcactctgcgagaatcccgagtgggcaccattgaaggataacaggattcct

SEQ ID NO: 245258 - DNA, 75 bp, Artificial Sequence
  Synthetic
ctagattatctccagcaggatcttcgtggaacataaatccaattattgtagaccattactcatgctctctgactt

SEQ ID NO: 245259 - DNA, 75 bp, Artificial Sequence
  Synthetic
agtatagcctatccgacgctgtccgagattaagggggtgattgtccaccggctagagggggtctcgtacaacata

SEQ ID NO: 245260 - DNA, 75 bp, Artificial Sequence
  Synthetic
agattaagggggtgattgtccaccggctagagggggtctcgtacaacataggctctcaagagtggtataccactg

SEQ ID NO: 245261 - DNA, 75 bp, Artificial Sequence
  Synthetic
caaaattgcgtcaggattcgggccattgatcacacacggctcagggatggacctgtacaagtccaaccacaacaa

SEQ ID NO: 245262 - DNA, 75 bp, Artificial Sequence
  Synthetic
agagcattgcaaggtgtgtattttggtcagagactatagttgatgaaacaagggcagcatgcagtaatattgcta

SEQ ID NO: 245263 - DNA, 75 bp, Artificial Sequence
  Synthetic
tgcccaagtatgttgcaacccaagggtaccttatctcgaattttgatgagtcatcgtgtactttcatgccagagg

SEQ ID NO: 245264 - DNA, 75 bp, Artificial Sequence
  Synthetic
agtaacatcatcaattgctgatctcaagagaatgattcatgcatcactaatgcctgaagagaccctccaacaggt

SEQ ID NO: 245265 - DNA, 75 bp, Artificial Sequence
  Synthetic
agctcggatacagtggaggtgatttactgggcatcttagagagcagaggaataaaggcccggataactcacgtcg

SEQ ID NO: 245266 - DNA, 75 bp, Artificial Sequence
  Synthetic
tcacaagggaacctaatagccaattgtgcatcaatcctttgcaagtgttacacaacaggaacgatcattaatcaa

SEQ ID NO: 245267 - DNA, 75 bp, Artificial Sequence
  Synthetic
aatgacacagcaaccaggggactcttcattcctggactgggctagtgacccttactcagcaaatcttgtatgtgt

SEQ ID NO: 245268 - DNA, 75 bp, Artificial Sequence
  Synthetic
aaactcagttccaatctggtgattctacctggtcaagaccttcaatacgttttggcaacctacgatacttccaga

SEQ ID NO: 245269 - DNA, 75 bp, Artificial Sequence
  Synthetic
cagccatcttatcaatggctctactccttggcaaaataggatcaatactggtgattaagcttatgcctttcagcg

SEQ ID NO: 245270 - DNA, 75 bp, Artificial Sequence
  Synthetic
gtcttttgggaaccggttcattttatcacaagggaacctaatagccaattgtgcatcaatcctttgcaagtgtta

SEQ ID NO: 245271 - DNA, 75 bp, Artificial Sequence
  Synthetic
cacaacaggaacgatcattaatcaagaccctgacaagatcctaacatacattgctgccgatcactgcccggtagt

SEQ ID NO: 245272 - DNA, 75 bp, Artificial Sequence
  Synthetic
ctagtgtgggatttatccattcagatatagagaccttacccaacaaagataccatagagaagctagaggaattgg

SEQ ID NO: 245273 - DNA, 75 bp, Artificial Sequence
  Synthetic
ttggacgtagggacaaatctggggaatgcaattgctaagttggaggatgccaaggaattgttggagtcatcggac

SEQ ID NO: 245274 - DNA, 75 bp, Artificial Sequence
  Synthetic
atgcaattgctaagttggaggatgccaaggaattgttggagtcatcggaccagatattgaggagtatgaaaggtt

SEQ ID NO: 245275 - DNA, 75 bp, Artificial Sequence
  Synthetic
gatcacagtgtcacaggggcaagagagtccattgcaggcatgctggacaccacaaaaggcctgattcgagccagc

SEQ ID NO: 245276 - DNA, 75 bp, Artificial Sequence
  Synthetic
gaactccggaaccctaatcctgccctgggtggttaggcattatttgtaatatattaaagaatactttgaaaatac

SEQ ID NO: 245277 - DNA, 75 bp, Artificial Sequence
  Synthetic
ccaccacatccgacgacactcaactccccacccctaaaagatacaccgggagtcccataatcaagactcatccaa

SEQ ID NO: 245278 - DNA, 75 bp, Artificial Sequence
  Synthetic
ttgatagggatccccgctttaatatgttgctgcagggggcgttgtaacaaaaagggagaacaagttggtatgtca

SEQ ID NO: 245279 - DNA, 75 bp, Artificial Sequence
  Synthetic
gaaatgtcctcattgataaggagtcatgctcagtgcagctagcgagagccctaagaagccatatgtgggcgagac

SEQ ID NO: 245280 - DNA, 75 bp, Artificial Sequence
  Synthetic
cgtctctgccatattcatggcagtactgttaactctccaaacacccaccggtcaaatccattggggcaatctctc

SEQ ID NO: 245281 - DNA, 75 bp, Artificial Sequence
  Synthetic
tagctcgaggaaggccaatttacggccttgaagtccctgacgtactagaatctatgcgaggccaccttattcgac

SEQ ID NO: 245282 - DNA, 75 bp, Artificial Sequence
  Synthetic
gtcgctctgatcctctacaactcttgaaacacaaatgtcccacaagtctcctcttcgtcatcaagcaaccaccgc

SEQ ID NO: 245283 - DNA, 75 bp, Artificial Sequence
  Synthetic
gtcagaacatcaagcaccgcctaaaaaacggattttccaaccaaatgattataaacaatgtggaagttgggaatg

SEQ ID NO: 245284 - DNA, 75 bp, Artificial Sequence
  Synthetic
gcggtgtacctgcacagaactgatctcggccctcccatatcattggagaagttggacgtagggacaaatctgggg

SEQ ID NO: 245285 - DNA, 75 bp, Artificial Sequence
  Synthetic
tatctccggcttccctctggccgaacaatatcggtagttaattaaaacttagggtgcaagatcatccacaatgtc

SEQ ID NO: 245286 - DNA, 75 bp, Artificial Sequence
  Synthetic
aatgcaattgccaagttggaggatgccaaggaattgttggagtcatcggaccagatattgaggagtatgaaaggt

SEQ ID NO: 245287 - DNA, 75 bp, Artificial Sequence
  Synthetic
agggtgcaagatcatccacaatgtcaccacaacgagaccggataaatgccttctacaaagataacccccatccca

SEQ ID NO: 245288 - DNA, 75 bp, Artificial Sequence
  Synthetic
atccttgagagtcccgtatattggttccaccactgatgagagaacagatatgaagcttgctttcgtaagagctcc

SEQ ID NO: 245289 - DNA, 75 bp, Artificial Sequence
  Synthetic
tccaccactgatgagagaacagatatgaagcttgctttcgtaagagctccaagtcgatccttgcgatctgccgtt

SEQ ID NO: 245290 - DNA, 75 bp, Artificial Sequence
  Synthetic
aagtcgatccttgcgatctgccgttaggatagcaacagtgtactcatgggcttacggtgatgatgatagctcttg

SEQ ID NO: 245291 - DNA, 75 bp, Artificial Sequence
  Synthetic
tcatgtttctgagcttgatcgggttgctagccattgcaggcattagacttcatcgggcagccatctacaccgcag

SEQ ID NO: 245292 - DNA, 75 bp, Artificial Sequence
  Synthetic
ggctccgaattgagggaggacatcaaggagaaaattattaacttgggagtttacatgcacagctcccaatggttt

SEQ ID NO: 245293 - DNA, 75 bp, Artificial Sequence
  Synthetic
catcgggcagccatctacaccgcagagatccataaaagcctcagcaccaatctagatgtaactaactcaatcgag

SEQ ID NO: 245294 - DNA, 75 bp, Artificial Sequence
  Synthetic
agatccataaaagcctcagcaccaatctagatgtaactaactcaatcgagcatcaggtcaaggacgtgctgacac

SEQ ID NO: 245295 - DNA, 75 bp, Artificial Sequence
  Synthetic
gagccctttctgttttggtttacagtcaagactgagatgaggtcagtgattaaatcacaaacccatacttgccat

SEQ ID NO: 245296 - DNA, 75 bp, Artificial Sequence
  Synthetic
gaacgaagcctggttgctagcaaggcaaagagccaatgtgagcctggaggagctaagggtgatcactcccatctc

SEQ ID NO: 245297 - DNA, 75 bp, Artificial Sequence
  Synthetic
aggagaaaattattaacttgggagtttacatgcacagctcccaatggtttgagccctttctgttttggtttacag

SEQ ID NO: 245298 - DNA, 75 bp, Artificial Sequence
  Synthetic
agtgggcctgaggacacctcagagattcactgacctagtgaaattcatctctgacaagattaaattccttaatcc

SEQ ID NO: 245299 - DNA, 75 bp, Artificial Sequence
  Synthetic
ggagagtaatagagaaatcgggtccagcagattaagtgatgcgagagctgcccatcttccaaccagcacacccct

SEQ ID NO: 245300 - DNA, 75 bp, Artificial Sequence
  Synthetic
tcactggcagttcagttgagttgctaatctctcgtgaccttgtggccataatcagtaaagagtctcaacatgtat

SEQ ID NO: 245301 - DNA, 75 bp, Artificial Sequence
  Synthetic
ggatagggagtacgacttcagagatctcacttggtgtatcaacccgccagagagaatcaaattggattatgatca

SEQ ID NO: 245302 - DNA, 75 bp, Artificial Sequence
  Synthetic
gaacaaggctcagacacggacacccccagggtgtacaatgacagagatcttctagactaggtgcaagaggccgag

SEQ ID NO: 245303 - DNA, 75 bp, Artificial Sequence
  Synthetic
ctcacttggtgtatcaacccgccagagagaatcaaattggattatgatcaatactgtgcagatgtggctgctgaa

SEQ ID NO: 245304 - DNA, 75 bp, Artificial Sequence
  Synthetic
atactgtgcagatgtggctgctgaagagctcatgaatgcattggtgaactcaactctactggagaccagaacaac

SEQ ID NO: 245305 - DNA, 75 bp, Artificial Sequence
  Synthetic
ggtcagctgacgccctgctcaggctgcaagctatggcaggaatcctggaagaacaaggctcagacacggacaccc

SEQ ID NO: 245306 - DNA, 75 bp, Artificial Sequence
  Synthetic
tatataccaacaaggaatgcttctagggttgggtgttttagaaacactatttcgacttgagaaagacaccgggtc

SEQ ID NO: 245307 - DNA, 75 bp, Artificial Sequence
  Synthetic
caatcagttcctagctgtctcaaagggaaactgctcagggcccactacaatcagaggtcaattctcaaacatgtc

SEQ ID NO: 245308 - DNA, 75 bp, Artificial Sequence
  Synthetic
ctgacaagattaaattccttaatccggatagggagtacgacttcagagatctcacttggtgtatcaacccgccag

SEQ ID NO: 245309 - DNA, 75 bp, Artificial Sequence
  Synthetic
agagaatcaaattggattatgatcaatactgtgcagatgtggctgctgaagagctcatgaatgcattggtgaact

SEQ ID NO: 245310 - DNA, 75 bp, Artificial Sequence
  Synthetic
ggtcgaggttacaatgtgtcatctatagtcactatgacatcccagggaatgtatgggggaacttacctagtggaa

SEQ ID NO: 245311 - DNA, 75 bp, Artificial Sequence
  Synthetic
tttctgatgaaggtacttatcatgagttaattgaagccctagattacattttcataactgatgacatacatctga

SEQ ID NO: 245312 - DNA, 75 bp, Artificial Sequence
  Synthetic
actcttcactatctacttgggccagtgtgcggccatcaattgggcatttgatatacattatcacagaccatcagg

SEQ ID NO: 245313 - DNA, 75 bp, Artificial Sequence
  Synthetic
gaaatatcagatgggtgagctgctgtcatcattcctttctagaatgagcaaaggagtgtttaaagtgcttgtcaa

SEQ ID NO: 245314 - DNA, 75 bp, Artificial Sequence
  Synthetic
tcatcattcctttctagaatgagcaaaggagtgtttaaagtgcttgtcaatgctttaagccacccaaagatctat

SEQ ID NO: 245315 - DNA, 75 bp, Artificial Sequence
  Synthetic
ggaagattctatcacaattccctatcagggatcagggaaaggtgtcagcttccagctcgtcaagctaggtgtctg

SEQ ID NO: 245316 - DNA, 75 bp, Artificial Sequence
  Synthetic
cagggatcagggaaaggtgtcagcttccagctcgtcaagctaggtgtctggaaatccccaaccgacatgcaatcc

SEQ ID NO: 245317 - DNA, 75 bp, Artificial Sequence
  Synthetic
ccagccaacagctgacggcaagcgtgaacaccaggcggcccaagcacagaacagccccgacacaaggccatcacc

SEQ ID NO: 245318 - DNA, 75 bp, Artificial Sequence
  Synthetic
tgatgctcaaaacttgcacacaactgtgtgcaacatgatctacacatgctatatgacctacctcgatctgctgtt

SEQ ID NO: 245319 - DNA, 75 bp, Artificial Sequence
  Synthetic
cagtgatagacaggctttacctctcatctcacagaggtgttatcgctgacaatcaagcaaaatgggctgtcccga

SEQ ID NO: 245320 - DNA, 75 bp, Artificial Sequence
  Synthetic
gaatgaagaattagaagaatttacatttcttttgtgtgaaagcgacgaggatgtagtagcggaccgattcgacaa

SEQ ID NO: 245321 - DNA, 75 bp, Artificial Sequence
  Synthetic
catccaagcaaaacacttatgtgttttggcagatttgtactgtcaaccagggacctgcccaccaatccgaggtct

SEQ ID NO: 245322 - DNA, 75 bp, Artificial Sequence
  Synthetic
ttggcagatttgtactgtcaaccagggacctgcccaccaatccgaggtctaagaccggtagagaaatgtgcagtt

SEQ ID NO: 245323 - DNA, 75 bp, Artificial Sequence
  Synthetic
cccccggcaaactaaacaaaacttagggccaaggaacacacacacccgacagaatccagaccccggcccacgacg

SEQ ID NO: 245324 - DNA, 75 bp, Artificial Sequence
  Synthetic
ggggtcttgtctgttgatctgagtctgacagttgagcttaaaatcaaaattgcttcgggattcgggccattgatc

SEQ ID NO: 245325 - DNA, 75 bp, Artificial Sequence
  Synthetic
tgcttcgggattcgggccattgatcacacacggttcagggatggacctatacaaatccaaccacaacaatgtgta

SEQ ID NO: 245326 - DNA, 75 bp, Artificial Sequence
  Synthetic
ttcattttcgacgccctcgctgaggtaaatgtcagtcagccaaagattggcagaaacaacagttcaaatatgagc

SEQ ID NO: 245327 - DNA, 75 bp, Artificial Sequence
  Synthetic
gcggactcagaatctggtggacatatcactcactctgggatggtgggcatgggagtcagctgcacagtcacccgg

SEQ ID NO: 245328 - DNA, 75 bp, Artificial Sequence
  Synthetic
gtaccaggaacgtgaaagcagcaaaagggtttataggattccctcatgtaattcggcaggaccaagacactgatc

SEQ ID NO: 245329 - DNA, 75 bp, Artificial Sequence
  Synthetic
ctagtgtgaaatagacatcagaattaagaaaaacgtagggtccaagtggttccccgttatggactcgctatctgt

SEQ ID NO: 245330 - DNA, 75 bp, Artificial Sequence
  Synthetic
aagaaaaacgtagggtccaagtggttccccgttatggactcgctatctgtcaaccagatcttataccctgaagtt

SEQ ID NO: 245331 - DNA, 75 bp, Artificial Sequence
  Synthetic
cacctagatagcccgatagttaccaataagatagtagccatcctggagtatgctcgagtccctcacgcttacagc

SEQ ID NO: 245332 - DNA, 75 bp, Artificial Sequence
  Synthetic
ataagatagtagccatcctggagtatgctcgagtccctcacgcttacagcctggaggaccctacactgtgtcaga

SEQ ID NO: 245333 - DNA, 75 bp, Artificial Sequence
  Synthetic
atcccagaatcaagactcatccagtgtccatcatgggtctcaaggtgaacgtctctgtcatattcatggcagtac

SEQ ID NO: 245334 - DNA, 75 bp, Artificial Sequence
  Synthetic
ctggaggaccctacactgtgtcagaacatcaagcaccgcctaaaaaacggattttccaaccaaatgattataaac

SEQ ID NO: 245335 - DNA, 75 bp, Artificial Sequence
  Synthetic
aagttaatgcccaatataactctcctcaacaactgcacgagggtagagattgcagaatacaggagactactgaga

SEQ ID NO: 245336 - DNA, 75 bp, Artificial Sequence
  Synthetic
ggtaggcagtgtagattgcttcaatttcatagtcagtaatatccctacttctagtgtggggtttatccactctga

SEQ ID NO: 245337 - DNA, 75 bp, Artificial Sequence
  Synthetic
agtccaagcttaggagttatccggcccactctcatattccatatccaaattgtaatcaggatttatttaacatag

SEQ ID NO: 245338 - DNA, 75 bp, Artificial Sequence
  Synthetic
gggaaactgctcagggcccactacaatcagaggtcaattctcaaacatgtcgctgtccctgttggacttgtattt

SEQ ID NO: 245339 - DNA, 75 bp, Artificial Sequence
  Synthetic
tgtaatcaggatttatttaacatagaagacaaagagtcaacgaggaagatccgtgaactcctcaaaaaggggaat

SEQ ID NO: 245340 - DNA, 75 bp, Artificial Sequence
  Synthetic
ccactctcatattccatatccaaattgtaatcaggatttatttaacatagaagacaaagagtcaacgaggaagat

SEQ ID NO: 245341 - DNA, 75 bp, Artificial Sequence
  Synthetic
actatagagaagctagaggaattggcagctatcttatcgatggctctgctcctgggcaaaatagggtcaatactg

SEQ ID NO: 245342 - DNA, 75 bp, Artificial Sequence
  Synthetic
aaagcctaatctgagcagcaaagggtcagagttgtcacaactgagcatgtaccgagtgtttgaagtaggtgttat

SEQ ID NO: 245343 - DNA, 75 bp, Artificial Sequence
  Synthetic
tgtaagtgatcctcattgcccccccgaccttgacgcccatatcccgttatgcaaagtccccaatgaccaaatctt

SEQ ID NO: 245344 - DNA, 75 bp, Artificial Sequence
  Synthetic
tttctgttttggtttacagtcaagactgagatgaggtcagtgattaaatcacaaacccatacttgccataggagg

SEQ ID NO: 245345 - DNA, 75 bp, Artificial Sequence
  Synthetic
ctgagatgaggtcagtgattaaatcacaaacccatacttgccataggaggagacacacacctgtattcttcactg

SEQ ID NO: 245346 - DNA, 75 bp, Artificial Sequence
  Synthetic
agacacacacctgtattcttcactggtagttcagttgagttgctaatctctcgtgaccttgttgctataatcagt

SEQ ID NO: 245347 - DNA, 75 bp, Artificial Sequence
  Synthetic
gggctacttgtgtcccaatcactcaagagcattgcaagatgtgtattctggtcagagactatagttgatgaaaca

SEQ ID NO: 245348 - DNA, 75 bp, Artificial Sequence
  Synthetic
tgagctgcatacaggcaattgtgggagatgcagttagtagaggtgatatcaaccctactctgaaaaaacttacac

SEQ ID NO: 245349 - DNA, 75 bp, Artificial Sequence
  Synthetic
attctggtcagagactatagttgatgaaacaagggcagcatgcagtaatattgctacaacaatggctaaaagcat

SEQ ID NO: 245350 - DNA, 75 bp, Artificial Sequence
  Synthetic
aaagagtctcaacatgtatattacctgacatttgaactggttttgatgtattgtgatgtcatagaggggaggtta

SEQ ID NO: 245351 - DNA, 75 bp, Artificial Sequence
  Synthetic
aaccctactctgaaaaaacttacacctatagagcaggtgctggtcaactgcgggttggcaattaacggacctaaa

SEQ ID NO: 245352 - DNA, 75 bp, Artificial Sequence
  Synthetic
ctgtgtaaagaattgattcaccatgatgttgcctcggggcgagatggattgcttaactctatactcatcctctac

SEQ ID NO: 245353 - DNA, 75 bp, Artificial Sequence
  Synthetic
aagagtcagatacatgtggaaactgatagatggtttcttccctgcactcgggaatccaacttatcaaattgtagc

SEQ ID NO: 245354 - DNA, 75 bp, Artificial Sequence
  Synthetic
agggagttggcaagattcaaagacaatcaaagaagtcaacaagggatgtttcacgcttaccccgtattggtgagt

SEQ ID NO: 245355 - DNA, 75 bp, Artificial Sequence
  Synthetic
atcaaagaagtcaacaagggatgtttcacgcttaccccgtattggtgagtagtaggcaacgggaacttatatcta

SEQ ID NO: 245356 - DNA, 75 bp, Artificial Sequence
  Synthetic
tacctgcagctgagggatataacagtagaactcagaggtgctttccttaaccactgctttactgaaatacatgat

SEQ ID NO: 245357 - DNA, 75 bp, Artificial Sequence
  Synthetic
tagaactcagaggtgctttccttaaccactgctttactgaaatacatgatgttcttgaccaaaacgggttttctg

SEQ ID NO: 245358 - DNA, 75 bp, Artificial Sequence
  Synthetic
gatggcactgttgcccgctcctattgggggaatgaattatctgaatatgagcaggctgtttgtcagaaacatcgg

SEQ ID NO: 245359 - DNA, 75 bp, Artificial Sequence
  Synthetic
tgatccagtaacatcatcaattgctgatctcaagagaatgattctcgcatcactaatgcctgaagagaccctcca

SEQ ID NO: 245360 - DNA, 75 bp, Artificial Sequence
  Synthetic
atgaaggtacttatcatgagttaattgaagctctagattacattttcataactgatgacatacatctgacagggg

SEQ ID NO: 245361 - DNA, 75 bp, Artificial Sequence
  Synthetic
cacacacggttcagggatggacctatacaaatccaaccacaacaatgtgtattggctgactatcccgccaatgaa

SEQ ID NO: 245362 - DNA, 75 bp, Artificial Sequence
  Synthetic
cggccaccccagacttgaagcagtaacggctgctgaaaatgttaggaaatacatgaatcagcctaaagtcattgt

SEQ ID NO: 245363 - DNA, 75 bp, Artificial Sequence
  Synthetic
gttcttgaccaaaacgggttttctgatgaaggtacttatcatgagttaattgaagctctagattacattttcata

SEQ ID NO: 245364 - DNA, 75 bp, Artificial Sequence
  Synthetic
gtatgagactctgatgaaaggtcatgccatattttgtggaatcataatcaacggctatcgtgacaggcacggagg

SEQ ID NO: 245365 - DNA, 75 bp, Artificial Sequence
  Synthetic
gccatattttgtggaatcataatcaacggctatcgtgacaggcacggaggcagttggccaccgctgaccctcccc

SEQ ID NO: 245366 - DNA, 75 bp, Artificial Sequence
  Synthetic
agttagtcggatacagtgccctgattaaggattaattggttgggttccggaaccctaatcctgccctggatagtt

SEQ ID NO: 245367 - DNA, 75 bp, Artificial Sequence
  Synthetic
atgctcaagcttcaggtgaagggttaacacatgagcagtgcgttgataactggaaatcttttgctggagtgaaat

SEQ ID NO: 245368 - DNA, 75 bp, Artificial Sequence
  Synthetic
gaagatggaaccaaccgcagatagggctgccagtgaaccaatcacatgatgtcacccagacatcaggcatcccca

SEQ ID NO: 245369 - DNA, 75 bp, Artificial Sequence
  Synthetic
aaggacaaggcacttgctgctctccaaagggaatgggattcagtttacccgaaagagttcctgcgttacgaccct

SEQ ID NO: 245370 - DNA, 75 bp, Artificial Sequence
  Synthetic
aaagggaatgggattcagtttacccgaaagagttcctgcgttacgaccctcccaagggaaccgggtcacggaggc

SEQ ID NO: 245371 - DNA, 75 bp, Artificial Sequence
  Synthetic
aatgtggaagttgggaatgtcatcaagtccaagcttaggagttatccgacccactctcatattccatatccaaat

SEQ ID NO: 245372 - DNA, 75 bp, Artificial Sequence
  Synthetic
tgattctgggtaccatcctagctcaaatttgggtcttgctcgcaaaggcggttacggccccagacacggcagctg

SEQ ID NO: 245373 - DNA, 75 bp, Artificial Sequence
  Synthetic
gaaagagaaatgtcctcattgacaaagagtcatgttcagtgcagctggctagagccctaagaagccatatgtggg

SEQ ID NO: 245374 - DNA, 75 bp, Artificial Sequence
  Synthetic
aaattattaacttgggagtttacatgcatagctcccaatggtttgagcccttcctgttttggtttacagtcaaga

SEQ ID NO: 245375 - DNA, 75 bp, Artificial Sequence
  Synthetic
tccatgaccctgagttcaacctgtcttacagcctgaaagaaaaggagatcaaggaaacaggtagactttttgcta

SEQ ID NO: 245376 - DNA, 75 bp, Artificial Sequence
  Synthetic
atgtatgttgtaagtggagcttacctccatgaccctgagttcaacctgtcttacagcctgaaagaaaaggagatc

SEQ ID NO: 245377 - DNA, 75 bp, Artificial Sequence
  Synthetic
agaggcaacaactttccgaagcttgggaaaactctcaatgttcctccgcctccggaccccggtagggccagcact

SEQ ID NO: 245378 - DNA, 75 bp, Artificial Sequence
  Synthetic
aaatgacttacaaaatgagggcatgccaagtgattgctgaaaatctaatctcaaacgggattggcaaatatttta

SEQ ID NO: 245379 - DNA, 75 bp, Artificial Sequence
  Synthetic
ttccccgttatggactcgctatctgtcaaccagatcttataccctgaagttcacctagatagcccgatagttacc

SEQ ID NO: 245380 - DNA, 75 bp, Artificial Sequence
  Synthetic
aggacaatgggatggccaaggatgagcacgatttgactaaggcactccacactctagctgtctcaggagtcccca

SEQ ID NO: 245381 - DNA, 75 bp, Artificial Sequence
  Synthetic
gcacgatttgactaaggcactccacactctagctgtctcaggagtccccaaagatctcaaagaaagtcacagggg

SEQ ID NO: 245382 - DNA, 75 bp, Artificial Sequence
  Synthetic
aacatcatccttgagagtcccatatattggttctaccactgatgagagaacagacatgaagcttgccttcgtaag

SEQ ID NO: 245383 - DNA, 75 bp, Artificial Sequence
  Synthetic
aagatctcaaagaaagtcacaggggggggccagtcttaaaaacctactcccgaagcccagtccacacaagtacca

SEQ ID NO: 245384 - DNA, 75 bp, Artificial Sequence
  Synthetic
ggaacgtgagagcagcaaaagggtttatagggttccctcaagtaattcggcaggaccaagacactgatcatccgg

SEQ ID NO: 245385 - DNA, 75 bp, Artificial Sequence
  Synthetic
gattttccaaccaaatgattataaacaatgtggaagttgggaatgtcatcaagtccaagcttaggagttatccgg

SEQ ID NO: 245386 - DNA, 75 bp, Artificial Sequence
  Synthetic
cgaggtgaacggcgtgaccatccaagtcgggagcaggaggtatccagatgctgtgtacttgcacagaattgacct

SEQ ID NO: 245387 - DNA, 75 bp, Artificial Sequence
  Synthetic
cagtgcatttatcacgactgatctcaagaagtactgccttaattggagatatgagaccatcagcttgtttgcaca

SEQ ID NO: 245388 - DNA, 75 bp, Artificial Sequence
  Synthetic
atgagaccatcagcttgtttgcacagaggctaaatgagatttacggattgccctcatttttccagtggctgcata

SEQ ID NO: 245389 - DNA, 75 bp, Artificial Sequence
  Synthetic
tgtccgagtggcaaggtataccacaatctccaacgacaatctctcatttgtcatatcagataagaaggttgatac

SEQ ID NO: 245390 - DNA, 75 bp, Artificial Sequence
  Synthetic
agaggcttgagacctctgtcctgtatgtaagtgaccctcattgcccccccgaccttgacgcccatatcccgttat

SEQ ID NO: 245391 - DNA, 75 bp, Artificial Sequence
  Synthetic
atgtatgttgtaagtggagcttatctccatgaccctgagttcaacctatcttacagcctgaaagaaaaggagatc

SEQ ID NO: 245392 - DNA, 75 bp, Artificial Sequence
  Synthetic
cttcacgtcgaaacagattgttgcgtgatcccgatgatagatcatcccaggatacccagctcccgcaagctagag

SEQ ID NO: 245393 - DNA, 75 bp, Artificial Sequence
  Synthetic
cctggctgcttatgagagcggagtaaggattgcttcgttagtgcaaggggacaatcagaccatagccgtaacaaa

SEQ ID NO: 245394 - DNA, 75 bp, Artificial Sequence
  Synthetic
ctgagggcagagctatgtaccaacccattgatatatgataatgcacctttaattgacagagatgcaacaaggcta

SEQ ID NO: 245395 - DNA, 75 bp, Artificial Sequence
  Synthetic
tacacccagagccataggaggcaccttgtggaatttgttacatggtccacaccccaactatatcacattctagct

SEQ ID NO: 245396 - DNA, 75 bp, Artificial Sequence
  Synthetic
gatgctaggtatacagagcttctaggaagagtcagatacatgtggaaactgatagatggtttcttccctgcactc

SEQ ID NO: 245397 - DNA, 75 bp, Artificial Sequence
  Synthetic
caattgtttcatcacatttttttgtctattcaaaaggaatatattatgatgggctacttgtgtcccaatcactca

SEQ ID NO: 245398 - DNA, 75 bp, Artificial Sequence
  Synthetic
ccccacccccaaaggagacaccgggaatcccagaatcaagactcatccagtgtccatcatggatctcaaggtgaa

SEQ ID NO: 245399 - DNA, 75 bp, Artificial Sequence
  Synthetic
caacaatggctaaaagcatcgagagaggttatgaccgttaccttgcatattccctgaacgtcctaaaagtgatac

SEQ ID NO: 245400 - DNA, 75 bp, Artificial Sequence
  Synthetic
aggttatgaccgttaccttgcatattccctgaacgtcctaaaagtgatacagcaaattctgatctctcttggctt

SEQ ID NO: 245401 - DNA, 75 bp, Artificial Sequence
  Synthetic
catttgatatacattatcatagaccatcggggaaatatcagatgggtgagcttttgtcttcattcctttctcgga

SEQ ID NO: 245402 - DNA, 75 bp, Artificial Sequence
  Synthetic
tgagcaaaggagtgtttaaggtgcttgtcaatgctctaagccacccaaagatctacaagaaattctggcattgtg

SEQ ID NO: 245403 - DNA, 75 bp, Artificial Sequence
  Synthetic
gatgtagtcatacccctcctcacaaacaacgacctcttaataaggatggcactgttgcccgctcctattgggggg

SEQ ID NO: 245404 - DNA, 75 bp, Artificial Sequence
  Synthetic
tcacatgacgatccaagcagtggtgatcaatccaggttcggatggttcgagaacaaggaaatctcagatattgaa

SEQ ID NO: 245405 - DNA, 75 bp, Artificial Sequence
  Synthetic
actgttgcccgctcctattggggggatgaattatctgaatatgagcaggctgtttgtcagaaacatcggtgatcc

SEQ ID NO: 245406 - DNA, 75 bp, Artificial Sequence
  Synthetic
agtaacatcatcaattgctgatctcaagagaatgattctcgcctcactaatgcctgaagagaccctccatcaagt

SEQ ID NO: 245407 - DNA, 75 bp, Artificial Sequence
  Synthetic
tgtttgtcagaaacatcggtgatccagtaacatcatcaattgctgatctcaagagaatgattctcgcctcactaa

SEQ ID NO: 245408 - DNA, 75 bp, Artificial Sequence
  Synthetic
aatgacacaacaaccgggggactcttcattcctagactgggctagcgacccttactcagcaaatcttgtatgtgt

SEQ ID NO: 245409 - DNA, 75 bp, Artificial Sequence
  Synthetic
tcattcctagactgggctagcgacccttactcagcaaatcttgtatgtgtccagagcatcactagactcctcaag

SEQ ID NO: 245410 - DNA, 75 bp, Artificial Sequence
  Synthetic
ccagagcatcactagactcctcaagaacataactgcaaggtttgtcctgatccatagtccaaacccaatgttaaa

SEQ ID NO: 245411 - DNA, 75 bp, Artificial Sequence
  Synthetic
gaatgaaatttcagctctcataggggatgacgatatcaatagtttcataactgagttcctgcttatagagccaag

SEQ ID NO: 245412 - DNA, 75 bp, Artificial Sequence
  Synthetic
aacataactgcaaggtttgtcctgatccatagtccaaacccaatgttaaaaggattattccatgatgacagtaaa

SEQ ID NO: 245413 - DNA, 75 bp, Artificial Sequence
  Synthetic
tttggctgctttatgcctcttagcctggatagtgatctgacaatgtacctaaaggacaaggcacttgctgctctc

SEQ ID NO: 245414 - DNA, 75 bp, Artificial Sequence
  Synthetic
gaagaggacgagggactggcggcattcctcatggacaggcatattatagtacctagggcagctcatgaaatcctg

SEQ ID NO: 245415 - DNA, 75 bp, Artificial Sequence
  Synthetic
tcctcatggacaggcatattatagtacctagggcagctcatgaaatcctggatcatagtgtcacaggggcaagag

SEQ ID NO: 245416 - DNA, 75 bp, Artificial Sequence
  Synthetic
gcagttctaaccgatcatatcaaggcagaggctaggttatctccagcagggtcttcgtggaacataaatccaatt

SEQ ID NO: 245417 - DNA, 75 bp, Artificial Sequence
  Synthetic
gatcatagtgtcacaggggcaagagagtctattgcaggcatgctggataccacaaaaggcctgattcgagccagc

SEQ ID NO: 245418 - DNA, 75 bp, Artificial Sequence
  Synthetic
agtctattgcaggcatgctggataccacaaaaggcctgattcgagccagcatgaggaagggggggttaacctctc

SEQ ID NO: 245419 - DNA, 75 bp, Artificial Sequence
  Synthetic
tccatagtccaaacccaatgttaaaaggattattccatgatgacagtaaagaagaggacgagggactggcggcat

SEQ ID NO: 245420 - DNA, 75 bp, Artificial Sequence
  Synthetic
atgaggaagggggggttaacctctcgagtgataaccagattgtccaattatgactatgaacaattcagagcaggg

SEQ ID NO: 245421 - DNA, 75 bp, Artificial Sequence
  Synthetic
tgatgctcaaaatttgcacacaactgtgtgcaacatggtttacacatgttatatgacctacctcgacctgttgtt

SEQ ID NO: 245422 - DNA, 75 bp, Artificial Sequence
  Synthetic
atggtgctattgacaggaagaaagagaaatgtcctcattgacaaagagtcatgttcagtgcagctggcgagagct

SEQ ID NO: 245423 - DNA, 75 bp, Artificial Sequence
  Synthetic
tagctcgaggacggcctatttacggccttgaggtccctgatgtactagaatctatgcgaggccaccttattcggc

SEQ ID NO: 245424 - DNA, 75 bp, Artificial Sequence
  Synthetic
gtcatgagacatgtgtcatctgcgagtgtggatcagtcaactacggatggttttttgtcccctcgggttgccaac

SEQ ID NO: 245425 - DNA, 75 bp, Artificial Sequence
  Synthetic
gtgtggatcagtcaactacggatggttttttgtcccctcgggttgccaactggatgatattgacaaggaaacatc

SEQ ID NO: 245426 - DNA, 75 bp, Artificial Sequence
  Synthetic
accaaacaaagttgggtaaggatagatcaatcaatgatcatattctagtgcacttaggattcaagatcctatcat

SEQ ID NO: 245427 - DNA, 75 bp, Artificial Sequence
  Synthetic
atctcaagtccggttatctaatactagacttacaccagaatatcttcgttaagaatctatctaagtcagagaaac

SEQ ID NO: 245428 - DNA, 75 bp, Artificial Sequence
  Synthetic
agacttacaccagaatatcttcgttaagaatctatctaagtcagagaaacagattattatgacggggggtttaaa

SEQ ID NO: 245429 - DNA, 75 bp, Artificial Sequence
  Synthetic
aacgacaatctctcatttgtcatatcagataagaaggttgatactaactttatataccaacaaggaatgcttcta

SEQ ID NO: 245430 - DNA, 75 bp, Artificial Sequence
  Synthetic
tatataccaacaaggaatgcttctagggttgggtgttttagaaacattgtttcgactcgagaaagataccggatc

SEQ ID NO: 245431 - DNA, 75 bp, Artificial Sequence
  Synthetic
cataaggctgttagaggttgtccagagcgaccagtcacaatctggccttaccttcgcatcgagaggtactaatat

SEQ ID NO: 245432 - DNA, 75 bp, Artificial Sequence
  Synthetic
gcagagctatgtaccaacccattgatatatgataatgcacctttaattgacagagatacaacaaggctatacacc

SEQ ID NO: 245433 - DNA, 75 bp, Artificial Sequence
  Synthetic
agagaagtgaaccttgtctaccctagatacagcaacttcatatctactgaatcttatttagttatgacagatctc

SEQ ID NO: 245434 - DNA, 75 bp, Artificial Sequence
  Synthetic
gaatgaaatttcagctctcataggggatgacgatatcaatagtttcataactgagtttctgctcatagagccaag

SEQ ID NO: 245435 - DNA, 75 bp, Artificial Sequence
  Synthetic
attcggagctaagaaggtggatcaaatacacccaacaaagaagagtagttggtgaatttagattggagagaaaat

SEQ ID NO: 245436 - DNA, 75 bp, Artificial Sequence
  Synthetic
attattcactatctacttgggccagtgtgcggccatcaattgggcatttgatgtacattatcatagaccatcagg

SEQ ID NO: 245437 - DNA, 75 bp, Artificial Sequence
  Synthetic
gatatcaaccctactctgaaaaaacttacacctatagagcaggtgctgatcaattgcgggttggcaattaacgga

SEQ ID NO: 245438 - DNA, 75 bp, Artificial Sequence
  Synthetic
ttacacctatagagcaggtgctgatcaattgcgggttggcaattaacggacctaaactgtgcaaagaattgatcc

SEQ ID NO: 245439 - DNA, 75 bp, Artificial Sequence
  Synthetic
aactccacaaccggatcgcacaagcgaccgaggtgacccaaccacaggcatccgactccttagacagatcctctc

SEQ ID NO: 245440 - DNA, 75 bp, Artificial Sequence
  Synthetic
ggggaaactgcaccctatatggtaatcctggagaactcaattcagaacaagtttagtgcaggatcataccccctt

SEQ ID NO: 245441 - DNA, 75 bp, Artificial Sequence
  Synthetic
aagaaattctggcattgtggtattatagagcctatccatggtccttcacttgatgctcaaaacttgcacacaact

SEQ ID NO: 245442 - DNA, 75 bp, Artificial Sequence
  Synthetic
cagcaaattctgatctctcttggcttcacaatcaattcaaccatgacccgggatgtagtcatacccctcctcaca

SEQ ID NO: 245443 - DNA, 75 bp, Artificial Sequence
  Synthetic
ctaaccgaccatatcaaggcagaggctaggttatctccagcaggatcttcgtggaacataaatccaattattgta

SEQ ID NO: 245444 - DNA, 75 bp, Artificial Sequence
  Synthetic
tcaaagtgagaatgagctgccgagattggggagcaaggaggacaggagggtcaaacagagccgaggagaagccgg

SEQ ID NO: 245445 - DNA, 75 bp, Artificial Sequence
  Synthetic
gtggaacataaatccaattattgtagaccattactcatgctctctgacttatctccggcgaggatcgatcaaaca

SEQ ID NO: 245446 - DNA, 75 bp, Artificial Sequence
  Synthetic
ttggggagcaaggaggacaggagggtcaaacagagccgaggagaagccggggagagccacagagaaaccgggccc

SEQ ID NO: 245447 - DNA, 75 bp, Artificial Sequence
  Synthetic
caacccgaaccggcacccaagagcgatccccgaaggacccccaaatcacaaaggacatcagtatcccacagcctc

SEQ ID NO: 245448 - DNA, 75 bp, Artificial Sequence
  Synthetic
agcagagcaagtgatgcgagagccgcccatcctccaaccggcacacccctagacattgacactgcatcggagttc

SEQ ID NO: 245449 - DNA, 75 bp, Artificial Sequence
  Synthetic
ggtataagttagtcggatacagtgccctgattaaggattaattggttgaactccggaaccctaatcctgccctag

SEQ ID NO: 245450 - DNA, 75 bp, Artificial Sequence
  Synthetic
tatcaacacaagcaagcacaatcttcccatttcagggggcaatctcgccaattatgaaatccatgctttccgcag

SEQ ID NO: 245451 - DNA, 75 bp, Artificial Sequence
  Synthetic
gaacaagactcagacacggacacccctagagtgtacaatgatagagaccttctagactaggtgcgaggggccgag

SEQ ID NO: 245452 - DNA, 75 bp, Artificial Sequence
  Synthetic
ccacaaaaggcctgattcgagccagcatgaggaagggggggttaacctctcgagtgataaccagattgtccaatt

SEQ ID NO: 245453 - DNA, 75 bp, Artificial Sequence
  Synthetic
ggatcgggttctatgttgatcacttataaggagatacttaaactaaacaagtgcttctataatagtggggtttcc

SEQ ID NO: 245454 - DNA, 75 bp, Artificial Sequence
  Synthetic
ataaggagatacttaaactaaacaagtgcttctataatagtggggtttccgccaattctagatctggtcaaaggg

SEQ ID NO: 245455 - DNA, 75 bp, Artificial Sequence
  Synthetic
ctgggcatcttagagagcagagggataagggctcggataactcacgtcgacacagagtcctacttcattgtccta

SEQ ID NO: 245456 - DNA, 75 bp, Artificial Sequence
  Synthetic
cataaaccatccactcccacgatcggagccgatggcagaggagcaggcacgccatgtcaagaacggactggaatg

SEQ ID NO: 245457 - DNA, 75 bp, Artificial Sequence
  Synthetic
gacctggagagagcgatgacgacgctgaaactttgggagccccctcaggaaatctccaggcatcaagcgctgggt

SEQ ID NO: 245458 - DNA, 75 bp, Artificial Sequence
  Synthetic
ctgtgtacttgcacagaattgaccttggtcctcccatatcattggagaagttggacgtagggacaaacttgggga

SEQ ID NO: 245459 - DNA, 75 bp, Artificial Sequence
  Synthetic
tttggttatgacagatctcaaggctaaccggctaatgaatcctgaaaagattaagcagcagataattgaatcatc

SEQ ID NO: 245460 - DNA, 75 bp, Artificial Sequence
  Synthetic
agaggcaacaactttctgaagcctgggaaaactctcaatgttcccccgcccccggaccccggtagagccaacact

SEQ ID NO: 245461 - DNA, 75 bp, Artificial Sequence
  Synthetic
ggtcacatcctatccattaagcaactaagctgcatacaagcaattgtgggagacgcagttagtagaggtgatatc

SEQ ID NO: 245462 - DNA, 75 bp, Artificial Sequence
  Synthetic
tcaaagtgagaatgagctaccaggattggggggcaaggaagataggagggtcagacagagtcggggagaagccag

SEQ ID NO: 245463 - DNA, 75 bp, Artificial Sequence
  Synthetic
taagctgcatacaagcaattgtgggagacgcagttagtagaggtgatatcaatcctactctgaaaaaacttacac

SEQ ID NO: 245464 - DNA, 75 bp, Artificial Sequence
  Synthetic
ttggggggcaaggaagataggagggtcagacagagtcggggagaagccagagagagcaacagagaaaccgggtcc

SEQ ID NO: 245465 - DNA, 75 bp, Artificial Sequence
  Synthetic
aaacacattattatagtaccaatccctggagattcctcaattaccactcgatccagacttctggaccggttggtc

SEQ ID NO: 245466 - DNA, 75 bp, Artificial Sequence
  Synthetic
ccgagtgtttgaagtaggtgttataagaaatccaggcttgggggctccggtgttccatatgacaaactattttga

SEQ ID NO: 245467 - DNA, 75 bp, Artificial Sequence
  Synthetic
atgatgatgagctgttctctgatgtccaagatatcaaaacagccctggccaaaatacacgaggacaaccagaaga

SEQ ID NO: 245468 - DNA, 75 bp, Artificial Sequence
  Synthetic
accaaagaagtcaacaagggatgttccacgcttaccccgtattggtaagtagcaggcaacgagaacttatatcta

SEQ ID NO: 245469 - DNA, 75 bp, Artificial Sequence
  Synthetic
acgacttcgacaagtcggcatgggacatcaaagggtcgatcgctccgatacaacctaccacctacagtgatggca

SEQ ID NO: 245470 - DNA, 75 bp, Artificial Sequence
  Synthetic
catctaacacggtattacatcttcacgtcgaaacagattgttgcgtgatcccgatgatagatcatcccaggatac

SEQ ID NO: 245471 - DNA, 75 bp, Artificial Sequence
  Synthetic
agacttacaccagaatatcttcgttaagaatctatccaagtcagagaaacagattattatgacggggggtttgaa

SEQ ID NO: 245472 - DNA, 75 bp, Artificial Sequence
  Synthetic
agattattatgacggggggtttgaaacgtgagtgggtttttaaggtaacagtcaaggagaccaaagaatggtata

SEQ ID NO: 245473 - DNA, 75 bp, Artificial Sequence
  Synthetic
acgtgagtgggtttttaaggtaacagtcaaggagaccaaagaatggtataagttagtcggatacagtgccctgat

SEQ ID NO: 245474 - DNA, 75 bp, Artificial Sequence
  Synthetic
cacagcactatctatgattgacctggtaacaaaatttgagaaggaccatatgaatgaaatttcagctctcatagg

SEQ ID NO: 245475 - DNA, 75 bp, Artificial Sequence
  Synthetic
tatgttacccactgatggatatcaatgaagacctcaatcggttactctggaggagcagatgcaagatagtaagaa

SEQ ID NO: 245476 - DNA, 75 bp, Artificial Sequence
  Synthetic
gaagacgaagccaatcgcagatagggcagccagtgaactaacaacatgatttcactcagacatcaagaataccca

SEQ ID NO: 245477 - DNA, 75 bp, Artificial Sequence
  Synthetic
gtggttaggcattatttgcaatatattaaagaaaactttgaaaatacgaagtttctattcccagctttgtctggt

SEQ ID NO: 245478 - DNA, 75 bp, Artificial Sequence
  Synthetic
agccaacgatcttgccaagttccaccagatgctgatgaaaataataatgaagtagctacagctcaacttacctgc

SEQ ID NO: 245479 - DNA, 75 bp, Artificial Sequence
  Synthetic
aagattccacggaccaagcgagaggccagccagcagccgacggcaagcgtggacactgggcggcccaagcacaga

SEQ ID NO: 245480 - DNA, 75 bp, Artificial Sequence
  Synthetic
gatgtacattatcatagaccatcagggaaatatcagatgggtgagctgttgtcatcgttcctttctagaatgagc

SEQ ID NO: 245481 - DNA, 75 bp, Artificial Sequence
  Synthetic
acaagatagtagccatcctggagtatgctcgagtccctcatgcttacagtctagaggaccctacactgtgtcaga

SEQ ID NO: 245482 - DNA, 75 bp, Artificial Sequence
  Synthetic
acagccccgatacaaggccaccaccagccatcccaatccgcgtcctcctcgtgggacccccgaggaccaaccccc

SEQ ID NO: 245483 - DNA, 75 bp, Artificial Sequence
  Synthetic
caactccatgccagtcgacccaaccagtacaatctaagtccattataaaaaacttaggagcaaagtgattgcctc

SEQ ID NO: 245484 - DNA, 75 bp, Artificial Sequence
  Synthetic
acgacttcgacaagtcagcatgggacatcaaagggtcgattgctccgattcaacccaccacctacagtgatggga

SEQ ID NO: 245485 - DNA, 75 bp, Artificial Sequence
  Synthetic
aaccgcatccctccagccctcgggaaaggaacccccagcaactggaagggccctccccccttcccccaacgcaag

SEQ ID NO: 245486 - DNA, 75 bp, Artificial Sequence
  Synthetic
gcgctgtactccaaagtcagtgataaggttttccaatgcttgagggacactaactcacggcttggtctaggctcg

SEQ ID NO: 245487 - DNA, 75 bp, Artificial Sequence
  Synthetic
gaccgaggtgacccaaccgcaggcatccgactccctagacagatcctctccccccggcaaactaaacaaaactta

SEQ ID NO: 245488 - DNA, 75 bp, Artificial Sequence
  Synthetic
tgattctgggtaccattctagcccagatctgggtcttgctcgcaaaggcggttacggccccagacacggcagctg

SEQ ID NO: 245489 - DNA, 75 bp, Artificial Sequence
  Synthetic
ccccccccataatgacagccaaaaggcccggacaaaaaagccccctccaaaagactccacagacctagcgagagg

SEQ ID NO: 245490 - DNA, 75 bp, Artificial Sequence
  Synthetic
tgccgaggacctctctttacgccgattcatggtggctctaatcctggatatcaagaggacacccgggaacaaacc

SEQ ID NO: 245491 - DNA, 75 bp, Artificial Sequence
  Synthetic
gaccacggcaaccgaaccagagtccagaccaccctgggccaccagcccccggactcggccatcaccccggaaaaa

SEQ ID NO: 245492 - DNA, 75 bp, Artificial Sequence
  Synthetic
cctgctcttggactgcatgaatttgctggtgagttatccacacttgagtccttgatgaatctttaccagcaaatg

SEQ ID NO: 245493 - DNA, 75 bp, Artificial Sequence
  Synthetic
ggaaaggccacaacccgcgcaccccagccccgatccggcgggcagccacccaacccgaaccagcacccaagagcg

SEQ ID NO: 245494 - DNA, 75 bp, Artificial Sequence
  Synthetic
gggaacttcaggagaaagaagagtgaagtctactctgccgattattgcaaaatgaagatcgaaaagatgggtcta

SEQ ID NO: 245495 - DNA, 75 bp, Artificial Sequence
  Synthetic
ctctggagctatgccatgggagtaggagtggaacttgaaaactccatgggaggtttgaactttggtcgatcttac

SEQ ID NO: 245496 - DNA, 75 bp, Artificial Sequence
  Synthetic
gagtggaacttgaaaactccatgggaggtttgaactttggtcgatcttactttgatccagcatattttagattag

SEQ ID NO: 245497 - DNA, 75 bp, Artificial Sequence
  Synthetic
aggtttgaactttggtcgatcttactttgatccagcatattttagattagggcaagagatggtgaggaggtcagc

SEQ ID NO: 245498 - DNA, 75 bp, Artificial Sequence
  Synthetic
tttgatccagcatattttagattagggcaagagatggtgaggaggtcagctggaaaggtcagttccacattggca

SEQ ID NO: 245499 - DNA, 75 bp, Artificial Sequence
  Synthetic
atccctgggggacccctaaaccgcaaaagacaccagcatcccacggcctctccaagtcccccggtctcctcctct

SEQ ID NO: 245500 - DNA, 75 bp, Artificial Sequence
  Synthetic
aagaaacccccagcaactggaaggtccctccccctctctctcaacgcaaaagccccgcaaccgaatcgcacaagc

SEQ ID NO: 245501 - DNA, 75 bp, Artificial Sequence
  Synthetic
tcctcaagaattccgcatttacgatgacgtgatcataaatgatgaccaaggactcttcaaagttctgtagaccgt

SEQ ID NO: 245502 - DNA, 75 bp, Artificial Sequence
  Synthetic
aaagacaccagcatcccacggcctctccaagtcccccggtctcctcctcttctcgaaggggccaaaagatcaatc

SEQ ID NO: 245503 - DNA, 75 bp, Artificial Sequence
  Synthetic
agtgctcagcagtgcccgaaaacaaccccccttacaatgacagccagaagacccggacaaaaaagccccctccta

SEQ ID NO: 245504 - DNA, 75 bp, Artificial Sequence
  Synthetic
acccggacaaaaaagccccctcctagagactccacggactaagcgagaggccggccagcagccgacggcaagcgc

SEQ ID NO: 245505 - DNA, 75 bp, Artificial Sequence
  Synthetic
agattcggccactaccccgcagaaaggaaaggccacaatccgcacaccccagccccgatccggcggacagccacc

SEQ ID NO: 245506 - DNA, 75 bp, Artificial Sequence
  Synthetic
gaacaccaggtggccccagcacaggacagtcccgacccagggccaccaccagccatcccaatccgcatcatcctc

SEQ ID NO: 245507 - DNA, 75 bp, Artificial Sequence
  Synthetic
acagtcccgacccagggccaccaccagccatcccaatccgcatcatcctcgtgttacccccgaggaccaacctcc

SEQ ID NO: 245508 - DNA, 75 bp, Artificial Sequence
  Synthetic
agacattgacactgcatcagagtcaggccaagatccgcaggacagtcgaaggtcagctgacgccctgctcaggct

SEQ ID NO: 245509 - DNA, 75 bp, Artificial Sequence
  Synthetic
ggccaagatccgcaggacagtcgaaggtcagctgacgccctgctcaggctgcaagccatggcaggaatcttggaa

SEQ ID NO: 245510 - DNA, 75 bp, Artificial Sequence
  Synthetic
aaggttgcccccgacccaaaccaccaaccgcatccccaccacccccgggaaagaaacccccaacagctggaaggc

SEQ ID NO: 245511 - DNA, 75 bp, Artificial Sequence
  Synthetic
tactatagagaagctagaggaattggcagccatcttatcgatggctctgctcctgggcaaaataggatcaatact

SEQ ID NO: 245512 - DNA, 75 bp, Artificial Sequence
  Synthetic
ccctctccccctcccccaacacaagaaccccacaactgaaccgcacaagcgaccgaggtgacccaaccgcaggca

SEQ ID NO: 245513 - DNA, 75 bp, Artificial Sequence
  Synthetic
aaccccacaactgaaccgcacaagcgaccgaggtgacccaaccgcaggcatccgactccccaggcagatcctctc

SEQ ID NO: 245514 - DNA, 75 bp, Artificial Sequence
  Synthetic
gcagagctatgtaccaacccattgatatatgataatgcccctttaattgacagggacgcaacaaggctatacacc

SEQ ID NO: 245515 - DNA, 75 bp, Artificial Sequence
  Synthetic
catccgggctctcaaggccgagcccatcggctcactggccgtcgaggaagccatggcagcatggtcagaaatatc

SEQ ID NO: 245516 - DNA, 75 bp, Artificial Sequence
  Synthetic
atcggctcactggccgtcgaggaagccatggcagcatggtcagaaatatcagacaacccaggacaggaccgagcc

SEQ ID NO: 245517 - DNA, 75 bp, Artificial Sequence
  Synthetic
gaaacacaaatgtcccacaagtctcctcttcgtcatcaagcaaccaccgcatccagcatcaagcccacctgaaat

SEQ ID NO: 245518 - DNA, 75 bp, Artificial Sequence
  Synthetic
ccatggcagcatggtcagaaatatcagacaacccaggacaggaccgagccacctgcaaggaagaggaggcaggca

SEQ ID NO: 245519 - DNA, 75 bp, Artificial Sequence
  Synthetic
ccgcgctcccaacccccgacaaccagagggaatccccaaccaatcccgccggctcccccagtgcccacaggcagg

SEQ ID NO: 245520 - DNA, 75 bp, Artificial Sequence
  Synthetic
cacaccaacccccgaacagatccagcacccagccaccgacaatccaagacggggggacccccccaaaaaagggcc

SEQ ID NO: 245521 - DNA, 75 bp, Artificial Sequence
  Synthetic
cccaggggccgacaaccaggacagcgaggaagcccacccacaccacacaccaccacggcaaccaaaccagaaccc

SEQ ID NO: 245522 - DNA, 75 bp, Artificial Sequence
  Synthetic
aaaccatcctgggccaccaactcccagacctggccaccaccccgcggacagggacggccacaacccgcacacccc

SEQ ID NO: 245523 - DNA, 75 bp, Artificial Sequence
  Synthetic
ccacgagctcctgaaactccaatccagaggcaacaactttccgaagcttgggaaaactctcaatgttcctccgcc

SEQ ID NO: 245524 - DNA, 75 bp, Artificial Sequence
  Synthetic
agccccgactcggcgggcagccacccaaccagaaccagcacccaagatcgacccccgaaggacccccaaaccgca

SEQ ID NO: 245525 - DNA, 75 bp, Artificial Sequence
  Synthetic
tagcaggcaacgagaacttatatctaggatcacccgcaaattttgggggcacattcttctttactccgggaacag

SEQ ID NO: 245526 - DNA, 75 bp, Artificial Sequence
  Synthetic
aaggacatcagcatcccacagcccctccaagtcccccggtctccccctcttctcgaagggaccaaaagatcaacc

SEQ ID NO: 245527 - DNA, 75 bp, Artificial Sequence
  Synthetic
aggatcacccgcaaattttgggggcacattcttctttactccgggaacagaaagttgataaataagtttatccag

SEQ ID NO: 245528 - DNA, 75 bp, Artificial Sequence
  Synthetic
tccaagtcccccggtctccccctcttctcgaagggaccaaaagatcaacccactatatccgacgtcactcaactc

SEQ ID NO: 245529 - DNA, 75 bp, Artificial Sequence
  Synthetic
cccactcctaaaggagacaccagggatcccagaatcaagacccatccaatatccatcatgggtctcaaggtgaac

SEQ ID NO: 245530 - DNA, 75 bp, Artificial Sequence
  Synthetic
atccatcatgggtctcaaggtgaacgtctctgccgcattcatggcagtactgttaattctccaaacacccgccgg

SEQ ID NO: 245531 - DNA, 75 bp, Artificial Sequence
  Synthetic
atatcagcatatccaccctggaaggacacctctcaagcatcatgattgccattcctggacttgggaaggatccca

SEQ ID NO: 245532 - DNA, 75 bp, Artificial Sequence
  Synthetic
cagatgctgatgaagataataatgaagtagctacagctcaacttacctgccaaccccatgccagtcgacctaatt

SEQ ID NO: 245533 - DNA, 75 bp, Artificial Sequence
  Synthetic
gagtagtcctggcaggtgcggccctaggtgttgccacagctgctcagataacagccggcattgcacttcaccggt

SEQ ID NO: 245534 - DNA, 75 bp, Artificial Sequence
  Synthetic
caaccagatcctataccctgaagttcacctagatagcccgatagttaccaataagatagtagctatcctggagta

SEQ ID NO: 245535 - DNA, 75 bp, Artificial Sequence
  Synthetic
gatgaatgctttatgtacatgtttctgctgggggttgttgaggacagcgatcccctagggcctccaatcgggcga

SEQ ID NO: 245536 - DNA, 75 bp, Artificial Sequence
  Synthetic
caggctctgagctatgcacttggaggagatatcaataaggtgttagaaaagcttggatacagtggaggcgattta

SEQ ID NO: 245537 - DNA, 75 bp, Artificial Sequence
  Synthetic
ctaggcatcttagagagcagaggaataaaggctcggataactcacgtcgacacagagtcctacttcattgtcctc

SEQ ID NO: 245538 - DNA, 75 bp, Artificial Sequence
  Synthetic
ctgcatgctgcagacacaatccggaatgcccaagcctcaggcgaagggttaacacatgagcagtgcgttgataac

SEQ ID NO: 245539 - DNA, 75 bp, Artificial Sequence
  Synthetic
aagactccacggaccaagcgagaggccagccagcagccgacagcaagtgtggacaccaggcggcccaagcacaga

SEQ ID NO: 245540 - DNA, 75 bp, Artificial Sequence
  Synthetic
cctgattgcagtgtgtcttggagggttgatagggatccccactttaatatgttgctgcagggggcgttgtaacaa

SEQ ID NO: 245541 - DNA, 75 bp, Artificial Sequence
  Synthetic
agaccaggcctaaagcctgaccttacaggaacatcaaaatcctatgtaaggtcgctttgatcctctataactctt

SEQ ID NO: 245542 - DNA, 75 bp, Artificial Sequence
  Synthetic
gaaacacaagtgtcccagaattctcctcttggtcatcaagcaaccaccgtgtccgacatcaagccagcctgaaac

SEQ ID NO: 245543 - DNA, 75 bp, Artificial Sequence
  Synthetic
aaccccacaaccgaaccgcacaagcgaccgaggtgacccaaccgcaggcatccgactccccagacagatcctctc

SEQ ID NO: 245544 - DNA, 75 bp, Artificial Sequence
  Synthetic
agacattgacactgcatcggagtcaggccaagatccgcaggacagtcgaaggtcagctgacgccctgctcaggct

SEQ ID NO: 245545 - DNA, 75 bp, Artificial Sequence
  Synthetic
ttcctgttttggttcacagtcaagactgagatgaggtcagtgattaaatcgcaaacccatacttgccataggaga

SEQ ID NO: 245546 - DNA, 75 bp, Artificial Sequence
  Synthetic
gaacaaggctcagacacggacacccctagggtatacaatgacagagatcttctagactaggtgcgagaggccgag

SEQ ID NO: 245547 - DNA, 75 bp, Artificial Sequence
  Synthetic
accgcaacgagaccggataaatgccttctacaaagataacccttatcccaagggaagtaggatagttattaacag

SEQ ID NO: 245548 - DNA, 75 bp, Artificial Sequence
  Synthetic
agaacccagaccccggcccgcggcaccgcgcccccaccccccgaaaaccagagggagcccccaaccaaacccgcc

SEQ ID NO: 245549 - DNA, 75 bp, Artificial Sequence
  Synthetic
agggaagtaggatagttattaacagagaacatcttatgattgacagaccctatgttctgctggctgttctgttcg

SEQ ID NO: 245550 - DNA, 75 bp, Artificial Sequence
  Synthetic
tccgactccccagacagatcctctccccccggcatactaaacaaaacttagggccaaggaacacacacactcgac

SEQ ID NO: 245551 - DNA, 75 bp, Artificial Sequence
  Synthetic
tcatgtttctgagcttgatcggattgctggcaattgcaggcattagacttcatcgggcagccatctacaccgcgg

SEQ ID NO: 245552 - DNA, 75 bp, Artificial Sequence
  Synthetic
ggaaaactctcaatgttcctccgcccccgaaccccagtagggccagcacttccgagacacccattaaaaagggca

SEQ ID NO: 245553 - DNA, 75 bp, Artificial Sequence
  Synthetic
catcgggcagccatctacaccgcggagatccataaaagcctcagtaccaatctagatgtgactaactcaatcgag

SEQ ID NO: 245554 - DNA, 75 bp, Artificial Sequence
  Synthetic
cccaggggccgacagccagcatcgcgaggaagcacacccaccccacacacgaccacggcaaccgaaccagagtcc

SEQ ID NO: 245555 - DNA, 75 bp, Artificial Sequence
  Synthetic
ccatcattgttataaaaaacttaggaaccaggtccacacagccgccagccaaccaaccatccactcccacgactg

SEQ ID NO: 245556 - DNA, 75 bp, Artificial Sequence
  Synthetic
gaccacggcaaccgaaccagagtccagaccaccctgggccaccagctcccagactcggccatcaccccgcaaaaa

SEQ ID NO: 245557 - DNA, 75 bp, Artificial Sequence
  Synthetic
tctagatgtgactaactcaatcgagcatcaggtcaaggacgtgctgacaccactctttaaaatcatcggggatga

SEQ ID NO: 245558 - DNA, 75 bp, Artificial Sequence
  Synthetic
caacctaccacctacagtgatggcaggctggtgccccaggtcagagtcatagatcctggtctaggtgataggaag

SEQ ID NO: 245559 - DNA, 75 bp, Artificial Sequence
  Synthetic
ggatagggagtacgacttcagagatctcacttggtgcatcaacccgccagagaggatcaaactagattatgatca

SEQ ID NO: 245560 - DNA, 75 bp, Artificial Sequence
  Synthetic
atgaggaaaggggggttaacctctcgagtgataaccagattgtccaattatgactatgaacaatttagagcaggg

SEQ ID NO: 245561 - DNA, 75 bp, Artificial Sequence
  Synthetic
caacctgctagtgacccttaggattgacaaggcgattggccctgggaagatcatcgacaatgcagagcaacttcc

SEQ ID NO: 245562 - DNA, 75 bp, Artificial Sequence
  Synthetic
gacaaggcgattggccctgggaagatcatcgacaatgcagagcaacttcctgaggcaacatttatggtccacatc

SEQ ID NO: 245563 - DNA, 75 bp, Artificial Sequence
  Synthetic
gacgtgatcataaatgatgaccaaggactattcaaagttctgtagaccgcagtgcccagcaatacccgaaaacga

SEQ ID NO: 245564 - DNA, 75 bp, Artificial Sequence
  Synthetic
agaatagcaacagtgtactcatgggcttacggtgatgatgatagttcttggaacgaagcctggttgttggcaagg

SEQ ID NO: 245565 - DNA, 75 bp, Artificial Sequence
  Synthetic
tgtgcagccatcaattgggcatttgatatacattatcatagaccatcagggaaatatcagatgggtgagctgttg

SEQ ID NO: 245566 - DNA, 75 bp, Artificial Sequence
  Synthetic
gtccatcatgggtctcaaggtgaacgtctttgccatattcatggcagtactgttaactctccaaacacccaccgg

SEQ ID NO: 245567 - DNA, 75 bp, Artificial Sequence
  Synthetic
tagtcactatgacatctcagggaatgtatgggggaacctacctagtggaaaagcctaacctgaacagtaaagggt

SEQ ID NO: 245568 - DNA, 75 bp, Artificial Sequence
  Synthetic
ggacaccaggcggcccaagcacagaacagccccgacacaaggccaccaccagccatcccaatctgcgtcctcctc

SEQ ID NO: 245569 - DNA, 75 bp, Artificial Sequence
  Synthetic
acagccccgacacaaggccaccaccagccatcccaatctgcgtcctcctcgtgggacccccgaggaccaaccccg

SEQ ID NO: 245570 - DNA, 75 bp, Artificial Sequence
  Synthetic
gcaaccagtcagtaatggtctcggaaactgtatggtggctttgggggagctcagactcgcagccctttgtcacgg

SEQ ID NO: 245571 - DNA, 75 bp, Artificial Sequence
  Synthetic
agtaggagacacaagagatttgcgggagttgtcctggcaggtgcggccctaggcgttgccacagctgctcagata

SEQ ID NO: 245572 - DNA, 75 bp, Artificial Sequence
  Synthetic
gagttgtcctggcaggtgcggccctaggcgttgccacagctgctcagataacagccggcattgcacttcaccagt

SEQ ID NO: 245573 - DNA, 75 bp, Artificial Sequence
  Synthetic
acagccggcattgcacttcaccagtccatgctgaactctcaagccatcgacaatctgagagcaagcctggaaact

SEQ ID NO: 245574 - DNA, 75 bp, Artificial Sequence
  Synthetic
ccctccccccctcccccaacgcaagaaccccacaaccgaaccgcacaagcgaccgaggtgacccaaccgcaggca

SEQ ID NO: 245575 - DNA, 75 bp, Artificial Sequence
  Synthetic
tgggtccccttatcaacggatgatccagtggtagacaggctttacctctcatctcacagaggtgtcatcgctgac

SEQ ID NO: 245576 - DNA, 75 bp, Artificial Sequence
  Synthetic
aggttatgaccgttaccttgcatattccctgaatgtcctaaaagtgatacagcaaattctgatctctcttggctt

SEQ ID NO: 245577 - DNA, 75 bp, Artificial Sequence
  Synthetic
ggcccccccggtgcccacaggtaggcacaccaacccccgaccagacccagcacccagccaccgacaatccaagac

SEQ ID NO: 245578 - DNA, 75 bp, Artificial Sequence
  Synthetic
ggactgtgtgcagccaaaatgccttgtacccgatgagtcctctgctccaagaatgcctccgggggtccaccaagt

SEQ ID NO: 245579 - DNA, 75 bp, Artificial Sequence
  Synthetic
caacccgaaccagcacccaagagcgatccctgggggacccccaaaccgcaaaagacatcagtatcccacagcctc

SEQ ID NO: 245580 - DNA, 75 bp, Artificial Sequence
  Synthetic
gaatgcctccgggggtccaccaagtcctgtgctcgtacactcgtatccgggtcttttgggaaccggttcatttta

SEQ ID NO: 245581 - DNA, 75 bp, Artificial Sequence
  Synthetic
tccaagtcccccggtctcctcctcttctcgaagggaccaaaagatcaatccaccacatccgacgacactcaattc

SEQ ID NO: 245582 - DNA, 75 bp, Artificial Sequence
  Synthetic
aaagacatcagtatcccacagcctctccaagtcccccggtctcctcctcttctcgaagggaccaaaagatcaatc

SEQ ID NO: 245583 - DNA, 75 bp, Artificial Sequence
  Synthetic
acacacggctcagggatggacctatacaaatccaaccgcaacaatgtgtattggctgactatcccgccaatgaga

SEQ ID NO: 245584 - DNA, 75 bp, Artificial Sequence
  Synthetic
gtacccgatgagtcctctgctccaagaatgcctccgggggtccaccaagtcctgtgctcgtacactcgtatccgg

SEQ ID NO: 245585 - DNA, 75 bp, Artificial Sequence
  Synthetic
cattggagtggataccgagattcaaggttagtcccaacctcttcactgtcccaattaaggaagcaggcgaagact

SEQ ID NO: 245586 - DNA, 75 bp, Artificial Sequence
  Synthetic
ttggctgactatcccgccaatgagaaatctagccttaggcgtaatcaacacattggagtggataccgagattcaa

SEQ ID NO: 245587 - DNA, 75 bp, Artificial Sequence
  Synthetic
cggtcctcccatatcattggagaggttggacgtagggacaaatctggggaatgcaattgctaagttggaggatgc

SEQ ID NO: 245588 - DNA, 75 bp, Artificial Sequence
  Synthetic
caggctttgagctatgcgcttggaggagatatcaataaggtattagaaaagctcggatacagtggaggtgattta

SEQ ID NO: 245589 - DNA, 75 bp, Artificial Sequence
  Synthetic
gcccaagccgctcattttcttacttttatcctttcaggttgcctataaagggggtcccaatcgagctacaagtag

SEQ ID NO: 245590 - DNA, 75 bp, Artificial Sequence
  Synthetic
gtcgctctgatcctctacaactcttgaaacacagatttcccacaagtctcctcttcgtcatcaagcaaccaccgc

SEQ ID NO: 245591 - DNA, 75 bp, Artificial Sequence
  Synthetic
ggatcacccgcaaattttgggggcatattcttctttactccgggaacagaaagttgataaatcggtttatccaga

SEQ ID NO: 245592 - DNA, 75 bp, Artificial Sequence
  Synthetic
ctggtgccgtcacttctgtgtgcttgcggactcagaatccggtggacatatcactcactctgggatggtgggcat

SEQ ID NO: 245593 - DNA, 75 bp, Artificial Sequence
  Synthetic
ctcttcgtcatcaagcaaccaccgcatccagcatcaagcccacctgaaattgtctccggcttccctctggccgaa

SEQ ID NO: 245594 - DNA, 75 bp, Artificial Sequence
  Synthetic
atccagcatcaagcccacctgaaattgtctccggcttccctctggccgaacgatatcggtagttaattaaaactt

SEQ ID NO: 245595 - DNA, 75 bp, Artificial Sequence
  Synthetic
gggagtcagctgcacagccacccgggaagatggaaccaatcgcagatagggccgttagtgaaccaatcacatgat

SEQ ID NO: 245596 - DNA, 75 bp, Artificial Sequence
  Synthetic
ggacctgcccaccaattcgaggtctaagaccggtagagaaatgtgcagttctaaccgatcatatcaaggcagagg

SEQ ID NO: 245597 - DNA, 75 bp, Artificial Sequence
  Synthetic
accacaacgagaccgaataaatgccttctacaaagacaacccccatcctaagggaagtaggatagttattaacag

SEQ ID NO: 245598 - DNA, 75 bp, Artificial Sequence
  Synthetic
agaacatcttatgattgatagaccttatgttttgctggctgttctattcgtcatgtttctgagcttgatcgggtt

SEQ ID NO: 245599 - DNA, 75 bp, Artificial Sequence
  Synthetic
gtcgcccagacatcaggcatacccactagtgtgaaatagacatcagaattaagaaaaacgtagggtccaagtggt

SEQ ID NO: 245600 - DNA, 75 bp, Artificial Sequence
  Synthetic
cacctggatagtccgatagtcaccaataagatagtagccatcctggagtatgctcgagtccctcacgcttacagc

SEQ ID NO: 245601 - DNA, 75 bp, Artificial Sequence
  Synthetic
catcaggtcaaggacgtgctgacaccactcttcaagatcatcggtgatgaagtgggcctgaggacacctcagaga

SEQ ID NO: 245602 - DNA, 75 bp, Artificial Sequence
  Synthetic
atactgtgcagatgtggctgctgaagaactcatgaatgcattggtgaactcaactctactggaggccagggcaac

SEQ ID NO: 245603 - DNA, 75 bp, Artificial Sequence
  Synthetic
tgacgtttgaactggttttgatgtattgtgatgtcatagaggggaggttaatgacagagaccgctatgaccattg

SEQ ID NO: 245604 - DNA, 75 bp, Artificial Sequence
  Synthetic
aaatgacttacaaaatgagggcatgccaagtgatcgctgaaaatctaatctcaaacgggattggcaagtatttta

SEQ ID NO: 245605 - DNA, 75 bp, Artificial Sequence
  Synthetic
agaaatccgggtttgggggctccggtgttccatatgacaaactattttgagcaaccagtcagtaatgatttcagc

SEQ ID NO: 245606 - DNA, 75 bp, Artificial Sequence
  Synthetic
tgtaagtgaccctcattgcccccccgaccttgacgcccatgtcccgttatgcaaagtccccaatgaccaaatctt

SEQ ID NO: 245607 - DNA, 75 bp, Artificial Sequence
  Synthetic
gcaaccagtcagtaatgatttcagcaactgcatggtggctttgggggagctcaaattcgcagccctctgtcacag

SEQ ID NO: 245608 - DNA, 75 bp, Artificial Sequence
  Synthetic
accaaacaaagttgggtaaggatagttcaaatcaatgatcatcttctagtgcacttaggattcaagatcctatta

SEQ ID NO: 245609 - DNA, 75 bp, Artificial Sequence
  Synthetic
tcagggacaagagcaggattagggatatccgagatggccacacttttaaggagcttagcattgttcaaaagaaac

SEQ ID NO: 245610 - DNA, 75 bp, Artificial Sequence
  Synthetic
ctagtgtggggtttatccattcagatatagagaccttacctaacaaagatactatagagaagctagaggaattgg

SEQ ID NO: 245611 - DNA, 75 bp, Artificial Sequence
  Synthetic
tccagctcgtcaagctaggtgtctggaaatccccaaccgacatgcaatcctgggtccccctatcaacggatgatc

SEQ ID NO: 245612 - DNA, 75 bp, Artificial Sequence
  Synthetic
tatagagaccttacctaacaaagatactatagagaagctagaggaattggcagccatcttatcgatggctctact

SEQ ID NO: 245613 - DNA, 75 bp, Artificial Sequence
  Synthetic
gagcttagcattgttcaaaagaaacaaggacaaaccacccattacatcaggatccggtggagccatcagaggaat

SEQ ID NO: 245614 - DNA, 75 bp, Artificial Sequence
  Synthetic
caaacacattattatagtaccaatccctggagattcctcaattaccactcgatccagacttctggaccggttggt

SEQ ID NO: 245615 - DNA, 75 bp, Artificial Sequence
  Synthetic
cccggaccccggtagggccagcacttccgggacacccattaaaaagggcacagagcgcagattagcctcatttgg

SEQ ID NO: 245616 - DNA, 75 bp, Artificial Sequence
  Synthetic
ccctccccctcttcctcaacacaagaactccacaaccgaaccgcacaagcgaccgaggtgacccaaccgcgcggc

SEQ ID NO: 245617 - DNA, 75 bp, Artificial Sequence
  Synthetic
gcgagaatcccgagtgggcaccattgaaggataacaggattccttcatacggggtcttgtctgttaatctgagtc

SEQ ID NO: 245618 - DNA, 75 bp, Artificial Sequence
  Synthetic
atccgactccctagacagatcctctctccccggcaaactaaacaaaacttagggccaaggaacatacacacccaa

SEQ ID NO: 245619 - DNA, 75 bp, Artificial Sequence
  Synthetic
ttggctgactatcccgccaatgaagaacctagccttaggtgtaatcaacacattggagtggataccgagattcaa

SEQ ID NO: 245620 - DNA, 75 bp, Artificial Sequence
  Synthetic
cagaacccagaccccggcccacggcgccgcgcccccaacccccgacaaccagagggagcccccaaccaatcccgc

SEQ ID NO: 245621 - DNA, 75 bp, Artificial Sequence
  Synthetic
ggttagtcccaacctcttcactgttccaatcaaggaagcaggcgaggactgccatgccccaacatacctacctgc

SEQ ID NO: 245622 - DNA, 75 bp, Artificial Sequence
  Synthetic
gtagttaggcattatttgcaatatattaaagaaaactttgaaaatacgaagtttctattcccagctttgtctggt

SEQ ID NO: 245623 - DNA, 75 bp, Artificial Sequence
  Synthetic
atcaatcaatgatcatattctagtacacttaggattcaagatcctattatcagggacaggggcaggattagagat

SEQ ID NO: 245624 - DNA, 75 bp, Artificial Sequence
  Synthetic
cgaccacggcaaccaaaccagaacccagaccaccctggccaccagctcccagactcggccatcaccccgcagaaa

SEQ ID NO: 245625 - DNA, 75 bp, Artificial Sequence
  Synthetic
gattcggagctaagaaggtggataaagtacacccaacaaagaagggtagttggtgaatttagattggagagaaaa

SEQ ID NO: 245626 - DNA, 75 bp, Artificial Sequence
  Synthetic
aggttaattgggaacccagatgtgagcggacccaaactaacaggggcactaataggtatattatctttgtttgtg

SEQ ID NO: 245627 - DNA, 75 bp, Artificial Sequence
  Synthetic
ggggtcccaatcgaattacaagtggaatgcttcacatgggaccaaaaactctggtgccgtcacttctgtgtgctt

SEQ ID NO: 245628 - DNA, 75 bp, Artificial Sequence
  Synthetic
gaatctccaggtcaattaattcagaggatcaccgatgaccctgacgttagcatcaggctgttggaggttgtccag

SEQ ID NO: 245629 - DNA, 75 bp, Artificial Sequence
  Synthetic
tccatgaccctgagttcaacctgtcctacagtctgaaggagaaagagatcaaggaaacaggtagactttttgcta

SEQ ID NO: 245630 - DNA, 75 bp, Artificial Sequence
  Synthetic
ccttcgcatcaagaggtaccaacatggaggatgaggcggaccaatacttttcacatgatgatccaagtagtagtg

SEQ ID NO: 245631 - DNA, 75 bp, Artificial Sequence
  Synthetic
ggattagccagttttatcctgactattaagtttgggatagaaactatgtatcctgctcttggactgcatgaattt

SEQ ID NO: 245632 - DNA, 75 bp, Artificial Sequence
  Synthetic
atcaatccaggtctggatggttcgagaacaaggaaatctcagatatcgaagtgcaagaccctgagggatttaata

SEQ ID NO: 245633 - DNA, 75 bp, Artificial Sequence
  Synthetic
ccgtgagctcctaaaaaagggaaattcgctgtactccaaagtcagtgataaggttttccaatgcctgagggacac

SEQ ID NO: 245634 - DNA, 75 bp, Artificial Sequence
  Synthetic
tcgctgtactccaaagtcagtgataaggttttccaatgcctgagggacactaactcacggcttggcctaggctcc

SEQ ID NO: 245635 - DNA, 75 bp, Artificial Sequence
  Synthetic
aagatctcaaagaaagtcacaggggggggccagtcttaaaaacctactcccgaaactcagttcacacaagtacca

SEQ ID NO: 245636 - DNA, 75 bp, Artificial Sequence
  Synthetic
taactcacggcttggcctaggctccgaattgagggaggacatcaaggagaaaattattaacttgggagtttacat

SEQ ID NO: 245637 - DNA, 75 bp, Artificial Sequence
  Synthetic
tgccgaggacctctccttacgccgattcatggtcgctctaatcctggatatcaagaggacacccgggaacaaacc

SEQ ID NO: 245638 - DNA, 75 bp, Artificial Sequence
  Synthetic
cttgatgaatctttaccagcaaatgggagaaactgcaccctacatggtaatcctggagaactcaattcagaacaa

SEQ ID NO: 245639 - DNA, 75 bp, Artificial Sequence
  Synthetic
ggagaaactgcaccctacatggtaatcctggagaactcaattcagaacaagttcagtgcaggatcataccctctg

SEQ ID NO: 245640 - DNA, 75 bp, Artificial Sequence
  Synthetic
ggaggatgaggcggaccaatacttttcacatgatgatccaagtagtagtgatcaatccaggttcggatggtttga

SEQ ID NO: 245641 - DNA, 75 bp, Artificial Sequence
  Synthetic
atagatggtttcttccctgcactcgggaatccaacttatcaaattgtagccatgctggagccactttcacttgct

SEQ ID NO: 245642 - DNA, 75 bp, Artificial Sequence
  Synthetic
ggaatccaacttatcaaattgtagccatgctggagccactttcacttgcttacctgcaactgagggatataacag

SEQ ID NO: 245643 - DNA, 75 bp, Artificial Sequence
  Synthetic
gtcagagactatagttgatgagacaagggcagcatgcagcaatattgccacgacgatggctaagagcatcgagag

SEQ ID NO: 245644 - DNA, 75 bp, Artificial Sequence
  Synthetic
cagcagagcaagtgatgcgagagctgcccatcttccaaccggcacacccctagacattgacactgcatcggagtc

SEQ ID NO: 245645 - DNA, 75 bp, Artificial Sequence
  Synthetic
tttgatccagcatattttagattagggcaagagatggtgaggaggtcagctgggaaggtcagttccacattggca

SEQ ID NO: 245646 - DNA, 75 bp, Artificial Sequence
  Synthetic
tctgaactcggtatcactgccgaggatgcaaggcttgtttcagagattgcaatgcatactactgaggacaggacc

SEQ ID NO: 245647 - DNA, 75 bp, Artificial Sequence
  Synthetic
acggctgctgaaaatgtcaggaaatacatgaatcagcctaaagtcattgtgtatgagactctgatgaaaggtcat

SEQ ID NO: 245648 - DNA, 75 bp, Artificial Sequence
  Synthetic
agaacaaggctcagacacggacacccctacagtgtacaatgacagaaatcttctagactaggtgcgagaggccga

SEQ ID NO: 245649 - DNA, 75 bp, Artificial Sequence
  Synthetic
acggctatcgtgacaggcacggaggcagttggccacccctgaccctccccctgcatgctgcagacacaatccgga

SEQ ID NO: 245650 - DNA, 75 bp, Artificial Sequence
  Synthetic
gagcaaggctcagacacagacacccccagagtgtataatgacagagatcttctagactaggtgcgagaggccgaa

SEQ ID NO: 245651 - DNA, 75 bp, Artificial Sequence
  Synthetic
ggagagtagtggagaaatcgggtccagcagattgagtgacgcgagagctgcccatcttccgaccagcacacccct

SEQ ID NO: 245652 - DNA, 75 bp, Artificial Sequence
  Synthetic
cccaagggaaccgggtcacggaggcttgtagatgttttccttaatgattcgagctttgacccatatgatatgata

SEQ ID NO: 245653 - DNA, 75 bp, Artificial Sequence
  Synthetic
gagctttgacccatatgatatgataatgtatgtcgtaagtggagcctacctccatgaccctgagttcaacctgtc

SEQ ID NO: 245654 - DNA, 75 bp, Artificial Sequence
  Synthetic
agtctatcgctggcatgctggacaccacaaagggcctgattcgagccagcatgaggaagggggggttaacctctc

SEQ ID NO: 245655 - DNA, 75 bp, Artificial Sequence
  Synthetic
acagcggtgaagcggttaagggaatccaagatgctgactctatcatggttcaatcaggccttgatggtgatagca

SEQ ID NO: 245656 - DNA, 75 bp, Artificial Sequence
  Synthetic
ggaacgttaaagcagaaaaagggtttgtaggattccctcatgtaattcggcagaatcaagacactgatcatccgg

SEQ ID NO: 245657 - DNA, 75 bp, Artificial Sequence
  Synthetic
ccctcattttttcagtggctgcataagaggcttgaaacctctgtcctctatgtaagtgaccctcattgccccccc

SEQ ID NO: 245658 - DNA, 75 bp, Artificial Sequence
  Synthetic
catcaagtaccctatgggaggtatagaagggtattgtcagaagctgtggaccatcagcaccattccctacttata

SEQ ID NO: 245659 - DNA, 75 bp, Artificial Sequence
  Synthetic
agaatagcaacagtgtactcatgggcttatggtgatgatgatagctcttggaacgaagcttggttgctggcaaaa

SEQ ID NO: 245660 - DNA, 75 bp, Artificial Sequence
  Synthetic
gaacggagatcgcgtctttattgacaggtggtgcaacccaatgtgctcgaaagtcaccctcggaaccatcagggc

SEQ ID NO: 245661 - DNA, 75 bp, Artificial Sequence
  Synthetic
acaatcagaccatagccgtaacaaaaagggtacccagcacatggccttacaaccttaagaaacgggaagctgcta

SEQ ID NO: 245662 - DNA, 75 bp, Artificial Sequence
  Synthetic
caggtgcacctgcggggaatgtccccgagtgtgtgagcaatgccgcactgatacaggagtggacacccgaatctg

SEQ ID NO: 245663 - DNA, 75 bp, Artificial Sequence
  Synthetic
tatataccaacaaggaatgcttctagggttgggtgttttagaaacattgttccgacttgagaaaagcaccggacc

SEQ ID NO: 245664 - DNA, 75 bp, Artificial Sequence
  Synthetic
tacagtgttattatgtttatgatcacagcggtgaagcggttaagggaatccaagatgctgactctatcatggttc

SEQ ID NO: 245665 - DNA, 75 bp, Artificial Sequence
  Synthetic
atccaacacggtactacaccttcacgtcgaaacagattgttgcgtgatcccgatgatagatcatcccagaatacc

SEQ ID NO: 245666 - DNA, 75 bp, Artificial Sequence
  Synthetic
gccgatcgggaaaaaggtgagctcagccgtcgggtttgtccctgacaccgggcctgtatcacgcagtgtaatccg

SEQ ID NO: 245667 - DNA, 75 bp, Artificial Sequence
  Synthetic
cacaatcaattcaaccatgacccgagatgtagtcatacccctcctcacaaacaacgatctcttaataaggatggc

SEQ ID NO: 245668 - DNA, 75 bp, Artificial Sequence
  Synthetic
gccgtcgggtttgtccctgacaccgggcctgtatcacgcagtgtaatccgctccattataaaatccagtcggcta

SEQ ID NO: 245669 - DNA, 75 bp, Artificial Sequence
  Synthetic
cagatgctgatgaagataataatgaagtagctacagctcaacttacctgccaacctcatgccagtcgacctaatt

SEQ ID NO: 245670 - DNA, 75 bp, Artificial Sequence
  Synthetic
tcattcctagactgggctagcgacccttactcagcaaatcttgtatgcgtccagagcatcactagactcctcaag

SEQ ID NO: 245671 - DNA, 75 bp, Artificial Sequence
  Synthetic
ctcacaccttgaagaaaggtcccaacaacagggagtgtcctcaacgcaaaccaagtgtgcaatgcggttaatctg

SEQ ID NO: 245672 - DNA, 75 bp, Artificial Sequence
  Synthetic
ccaagtgtgcaatgcggttaatctgacaccgctggataccccgcagaggcttcgtgttgtttacatgagcatcac

SEQ ID NO: 245673 - DNA, 75 bp, Artificial Sequence
  Synthetic
agggttattccatgatgacagtaaagaagaggacgagagactggcggcattcctcatggacaggcatattatagt

SEQ ID NO: 245674 - DNA, 75 bp, Artificial Sequence
  Synthetic
gaatgaaatttcagctctcataggggatgatgatattaatagtttcataactgaatttctgcttatagagccaag

SEQ ID NO: 245675 - DNA, 75 bp, Artificial Sequence
  Synthetic
gcatttgggtctctgcccctaggtgttggtagatccacagcaaaacccgaagagctcctcaaagaggccactgag

SEQ ID NO: 245676 - DNA, 75 bp, Artificial Sequence
  Synthetic
gaaatgtcctcattgacaaagagtcatgttcagtgcagctggctagagccctaagaagccatatgtgggcaagac

SEQ ID NO: 245677 - DNA, 75 bp, Artificial Sequence
  Synthetic
ataccgctggataccccgcagaggttccgtgttgtttatatgagcatcacccgtctttcggataacgggtattac

SEQ ID NO: 245678 - DNA, 75 bp, Artificial Sequence
  Synthetic
gcaccagtcttcacattagaagcacaggcaagatgagcaagactctccatgcacaactcgggttcaagaagacct

SEQ ID NO: 245679 - DNA, 75 bp, Artificial Sequence
  Synthetic
gggttgggtgttttagaaacattgtttcgactcgagaaagatactggatcatctaacacggtattacatcttcac

SEQ ID NO: 245680 - DNA, 75 bp, Artificial Sequence
  Synthetic
tatgttacccactgatggatatcaatgaagaccttaatcgattactctggaggagcagatgcaagatagtaagaa

SEQ ID NO: 245681 - DNA, 75 bp, Artificial Sequence
  Synthetic
gaccattactcatgctctctgacttatctccggcgagggtcgatcaaacagataagattgagagttgatccagga

SEQ ID NO: 245682 - DNA, 75 bp, Artificial Sequence
  Synthetic
gatgacgatatcaatagtttcataactgagtttctgcttatagagccaagattattcaccatctacttgggccag

SEQ ID NO: 245683 - DNA, 75 bp, Artificial Sequence
  Synthetic
gataagattgagagttgatccaggattcatctttgacgccctcgctgaggcaaatgtcagtcagccaaaaatagg

SEQ ID NO: 245684 - DNA, 75 bp, Artificial Sequence
  Synthetic
cccccctcataatgacagccagaaggcccggacaagaaagccccctccaaaagactccacaggccaagcaagagg

SEQ ID NO: 245685 - DNA, 75 bp, Artificial Sequence
  Synthetic
agcgggagcccccaacccatcccgccggctcccccggcgctcacaggcagccacaccaacccccgaacagaccca

SEQ ID NO: 245686 - DNA, 75 bp, Artificial Sequence
  Synthetic
gcacccagccatcgacaatccaagacaggggggccccccccaaaaaaagcccccaggggctgacagccagcaccg

SEQ ID NO: 245687 - DNA, 75 bp, Artificial Sequence
  Synthetic
gaacaccaggcggcccaagcacagaacagccccgacacaaggccatcaccagccatcccaacctgagtcctcctc

SEQ ID NO: 245688 - DNA, 75 bp, Artificial Sequence
  Synthetic
gtgggacccccgaggaccaacccccaaggtcgcccccgacccagaccaccaaccgcatccccatagcccccggga

SEQ ID NO: 245689 - DNA, 75 bp, Artificial Sequence
  Synthetic
aagaaacccccagcaactggaaggtccctccccccttctctcaatgcaaaagccccacaaccgaatcgcacaagc

SEQ ID NO: 245690 - DNA, 75 bp, Artificial Sequence
  Synthetic
aattagcaccctacccctccgaagtcggccttgtcgaacacagaatgggagtgggcaatattgtcaaggtgctct

SEQ ID NO: 245691 - DNA, 75 bp, Artificial Sequence
  Synthetic
ccgcgcccccatcccccgacaaccagagggagcccccaaccaatcccgccggcccccccggcgcccacaggcagg

SEQ ID NO: 245692 - DNA, 75 bp, Artificial Sequence
  Synthetic
atcaaggatttcagacctccacacgatgatgttgcaaaattgctcaaagatatcaacacaagcaagcacaatctt

SEQ ID NO: 245693 - DNA, 75 bp, Artificial Sequence
  Synthetic
cacaccaacctccgaacagacccggcacccagccaccgacagtccaagacggggggccccccccaaaaaagggcc

SEQ ID NO: 245694 - DNA, 75 bp, Artificial Sequence
  Synthetic
ctgttaactctccaaacacccaccggtcaaattcattggggcaatctctctaagataggggtggtagggatagga

SEQ ID NO: 245695 - DNA, 75 bp, Artificial Sequence
  Synthetic
agaccaccctgggccaccagctcccagattcggccatcaccccgcagaaaggaaaggccacaacctgcgcacccc

SEQ ID NO: 245696 - DNA, 75 bp, Artificial Sequence
  Synthetic
ggaagacggcttgttcttgggtgaggggtcgggttctatgttgatcacttataaggagatactaaaactaaacaa

SEQ ID NO: 245697 - DNA, 75 bp, Artificial Sequence
  Synthetic
gtaggtaatattgtcaaggtgctctttaacgggaggcccgaagtcacgtgggtaggcagtatagattgcttcaat

SEQ ID NO: 245698 - DNA, 75 bp, Artificial Sequence
  Synthetic
aacagttttggaaccaattagagatgcacttaatgcaatgacccagaatataagaccagttcagagtgtaacttc

SEQ ID NO: 245699 - DNA, 75 bp, Artificial Sequence
  Synthetic
ggtaggcagtatagattgcttcaatttcatagtcagtaatatccctacctctagtgtggggtttatccattcaga

SEQ ID NO: 245700 - DNA, 75 bp, Artificial Sequence
  Synthetic
caacccgaaccagcacccaagagcgatccctgaaggacccctgaaccgcaaacgacatcagcatcccacagcctc

SEQ ID NO: 245701 - DNA, 75 bp, Artificial Sequence
  Synthetic
aacgacatcagcatcccacagcctccccgagtccctcgatctcctcctcttcttgaagggaccaaaagatcaatc

SEQ ID NO: 245702 - DNA, 75 bp, Artificial Sequence
  Synthetic
agctccgatctggcggacagccaaccaacccgaaccagcacccaagagcgatccctgaaggacccctgaaccgca

SEQ ID NO: 245703 - DNA, 75 bp, Artificial Sequence
  Synthetic
tcttgaagggaccaaaagatcaatccaccacacccgacgacaatcaattacccacccctaaaggagacaccgaga

SEQ ID NO: 245704 - DNA, 75 bp, Artificial Sequence
  Synthetic
aaaatttaatgccaatacaactctcctcaataactgcacaagggtagagattgcagaatacaggagactactgag

SEQ ID NO: 245705 - DNA, 75 bp, Artificial Sequence
  Synthetic
tccatgctgaactctcaagccatcgacaatctgagagcgagcctggaaactactaatcaggcaattgaggcaatc

SEQ ID NO: 245706 - DNA, 75 bp, Artificial Sequence
  Synthetic
cattcttctttactccgggaacagaaagttgataaataagtttatccagaatctcaagtccggttatctgatact

SEQ ID NO: 245707 - DNA, 75 bp, Artificial Sequence
  Synthetic
gcaacttcatatctactgaatcttatttagttatgacagatctcaaagctaaccggctaatgaatcctgaaaaga

SEQ ID NO: 245708 - DNA, 75 bp, Artificial Sequence
  Synthetic
tttagttatgacagatctcaaagctaaccggctaatgaatcctgaaaagattaagcagcagataattgaatcatc

SEQ ID NO: 245709 - DNA, 75 bp, Artificial Sequence
  Synthetic
catcaataatgagctgataccgtctatgaaccaactatcttgtgatttaatcggccagaagctcgggctcaaatt

SEQ ID NO: 245710 - DNA, 75 bp, Artificial Sequence
  Synthetic
ttaagcagcagataattgaatcatctgtgcggacttcacctggacttataggtcacatcctatccattaagcaac

SEQ ID NO: 245711 - DNA, 75 bp, Artificial Sequence
  Synthetic
ggtcacatcctatccattaagcaactaagctgcatacaagcaattgtgggaggcgcagttagtagaggtgatatc

SEQ ID NO: 245712 - DNA, 75 bp, Artificial Sequence
  Synthetic
aaccggctaatgaatcctgaaaagattaagcagcagataattgaatcatctgtgcggacttcacctggacttata

SEQ ID NO: 245713 - DNA, 75 bp, Artificial Sequence
  Synthetic
ggacttacaccagaatatcttcgttaagaatctatccaagtcagagaaacagattattctgtcggggggtctgaa

SEQ ID NO: 245714 - DNA, 75 bp, Artificial Sequence
  Synthetic
agttactcggatacagtgctctgattaaggactagttggttgaactccggaaccctaaacctgcccaaggtagtt

SEQ ID NO: 245715 - DNA, 75 bp, Artificial Sequence
  Synthetic
cgggttggcaattaacggacctaaactgtgcaaagaattaatccaccatgatgttgcctcagggcaagatggatt

SEQ ID NO: 245716 - DNA, 75 bp, Artificial Sequence
  Synthetic
atgttgcctcagggcaagatggattgcttaactctatactcatcctctacagggagttggcaagattcaaagaca

SEQ ID NO: 245717 - DNA, 75 bp, Artificial Sequence
  Synthetic
aagaaacccccaccaattgggaggccccctcccccctctcccgacacaacaactccacaaccggatcgcacaagc

SEQ ID NO: 245718 - DNA, 75 bp, Artificial Sequence
  Synthetic
agttagtcggatacagcgctctgattaaggattaattggttgaactccggaaccctaatcctgccctaggtagtt

SEQ ID NO: 245719 - DNA, 75 bp, Artificial Sequence
  Synthetic
ccaaggaattgttggagtcatcggaccagatattgaggagtatgaaaggtttatcgagcactagcatagtttaca

SEQ ID NO: 245720 - DNA, 75 bp, Artificial Sequence
  Synthetic
tcctgattgcagtgtgtcttggagggttgatagggatccccgctttaatatgttgctgcagggggcgttgtaaca

SEQ ID NO: 245721 - DNA, 75 bp, Artificial Sequence
  Synthetic
aagaccaggcctaaagcctgatcttacaggaacatcaaatcctatgtaaggtcgctctgaccctctacaactctt

SEQ ID NO: 245722 - DNA, 75 bp, Artificial Sequence
  Synthetic
ggaacacaaatgtccaacaagtctcctcttcgtcatcaagcaaccaccggagccagcatcaagcccatctgaaat

SEQ ID NO: 245723 - DNA, 75 bp, Artificial Sequence
  Synthetic
agtagctacagctcaacttacctgccaaccccatgccagtcgacctaactagtacaacctaaatccaccacaaaa

SEQ ID NO: 245724 - DNA, 75 bp, Artificial Sequence
  Synthetic
aataatgaaaaagggggagactattatgatgatgagctgttctctgatgtccaagatattaaaacagccttggcc

SEQ ID NO: 245725 - DNA, 75 bp, Artificial Sequence
  Synthetic
agccagcatcaagcccatctgaaattgtctccggcttccctctggccgaacaatattggtagttaattaaaactt

SEQ ID NO: 245726 - DNA, 75 bp, Artificial Sequence
  Synthetic
agatcctggtctaggcgacaggaaggatgaatgctttatgtacatgtttctgctgggggttgttgaggacagcga

SEQ ID NO: 245727 - DNA, 75 bp, Artificial Sequence
  Synthetic
agggtgcaagatcatccacaatgtcaccacaacgagaccggataaatgccttctacaaagacaacccccatccta

SEQ ID NO: 245728 - DNA, 75 bp, Artificial Sequence
  Synthetic
ggctggtgccccaggtcagagtcatagatcctggtctaggcgacaggaaggatgaatgctttatgtacatgtttc

SEQ ID NO: 245729 - DNA, 75 bp, Artificial Sequence
  Synthetic
tatgttttgctggctgttctattcgtcatgtttctgagcttgatcgggttgctagccattgcaggcattagactt

SEQ ID NO: 245730 - DNA, 75 bp, Artificial Sequence
  Synthetic
ttcactgacctagtgaagttcatctctgacaagattaaattccttaatccggacagggaatacgacttcagagat

SEQ ID NO: 245731 - DNA, 75 bp, Artificial Sequence
  Synthetic
agtgccccgcaatgcccgaaaacgaccctcctcataatgacagccagaaggcccggacaaaaaaaactccccccc

SEQ ID NO: 245732 - DNA, 75 bp, Artificial Sequence
  Synthetic
ccctcctcataatgacagccagaaggcccggacaaaaaaaactcccccccaaaaaattcaacggaccaaacgaga

SEQ ID NO: 245733 - DNA, 75 bp, Artificial Sequence
  Synthetic
aagaaacccccagcaactggaaggcccctccccctctccctcaacacaagaactccacaaccgaaccgcacaagc

SEQ ID NO: 245734 - DNA, 75 bp, Artificial Sequence
  Synthetic
tagtcactatgacatcccagggaatgtacgggggaacttacctagtggaaaagcctaatctgagcagcaaagggt

SEQ ID NO: 245735 - DNA, 75 bp, Artificial Sequence
  Synthetic
cagagttgtcacaactgagcatgcaccgagtgtttgaagtaggtgttatcagaaatccgggtttgggggctccgg

SEQ ID NO: 245736 - DNA, 75 bp, Artificial Sequence
  Synthetic
gcccctccccctctcccccaacgcaagaactccacaaccggaccgcacaagcgaccaaggtgatccaaccgcagg

SEQ ID NO: 245737 - DNA, 75 bp, Artificial Sequence
  Synthetic
cagataagaaggttgatactaattttatataccaacaaggaatgcttctagggttgggtgttttagaaacactat

SEQ ID NO: 245738 - DNA, 75 bp, Artificial Sequence
  Synthetic
ctgtgtacttgcacagaattgacctcggtcctcccatatcattggagaggttggacgtagggacaaatctgggga

SEQ ID NO: 245739 - DNA, 75 bp, Artificial Sequence
  Synthetic
cacctgactccctagacagaccctctccccccgacaaactaaacaaaacttagggccaaggaacatacacaccca

SEQ ID NO: 245740 - DNA, 75 bp, Artificial Sequence
  Synthetic
cccaggggccgacagccagcaccgcgaggaagcccacccaccccacacacgaccacggcaaccgaaccagaatcc

SEQ ID NO: 245741 - DNA, 75 bp, Artificial Sequence
  Synthetic
gcaaccagtcagtaatgatctcagcaactgtatggtggctttgggggagctcaaactcgcagccctttgtcacgg

SEQ ID NO: 245742 - DNA, 75 bp, Artificial Sequence
  Synthetic
aactgtatggtggctttgggggagctcaaactcgcagccctttgtcacggggaagattctatcacaattccctat

SEQ ID NO: 245743 - DNA, 75 bp, Artificial Sequence
  Synthetic
gctgccagtgaaccaatcacatgatgtcacccagacatcaggcatatccgctagtgttaaatggacatcagcatt

SEQ ID NO: 245744 - DNA, 75 bp, Artificial Sequence
  Synthetic
catgctgtagtttattacgtttacagcccaagccgctcattttcttacttttatccttttaggttgcctgtaagg

SEQ ID NO: 245745 - DNA, 75 bp, Artificial Sequence
  Synthetic
cgacggcaagcacgaataccagccggcccaagcgcagaacagccccgacacaaggccatcaccagccatcccaac

SEQ ID NO: 245746 - DNA, 75 bp, Artificial Sequence
  Synthetic
gcatcatcctcgtgggacccccgaggaccagctccaaaggtcgcccccgacccaaaccaccgatcccgtccccgc

SEQ ID NO: 245747 - DNA, 75 bp, Artificial Sequence
  Synthetic
gcatcttcctcgtgggacccccgaggaccagctccaaaggtcgcccccgacccaaaccaccgatcccgtccccgc

SEQ ID NO: 245748 - DNA, 75 bp, Artificial Sequence
  Synthetic
gcatcctcctcgtgggacccccgaggaccagctccaaaggtcgcccccgacccaaaccaccgatcccgtccccgc

SEQ ID NO: 245749 - DNA, 75 bp, Artificial Sequence
  Synthetic
gcatcgtcctcgtgggacccccgaggaccagctccaaaggtcgcccccgacccaaaccaccgatcccgtccccgc

SEQ ID NO: 245750 - DNA, 75 bp, Artificial Sequence
  Synthetic
gcttcatcctcgtgggacccccgaggaccagctccaaaggtcgcccccgacccaaaccaccgatcccgtccccgc

SEQ ID NO: 245751 - DNA, 75 bp, Artificial Sequence
  Synthetic
gcttcttcctcgtgggacccccgaggaccagctccaaaggtcgcccccgacccaaaccaccgatcccgtccccgc

SEQ ID NO: 245752 - DNA, 75 bp, Artificial Sequence
  Synthetic
gcttcctcctcgtgggacccccgaggaccagctccaaaggtcgcccccgacccaaaccaccgatcccgtccccgc

SEQ ID NO: 245753 - DNA, 75 bp, Artificial Sequence
  Synthetic
gcttcgtcctcgtgggacccccgaggaccagctccaaaggtcgcccccgacccaaaccaccgatcccgtccccgc

SEQ ID NO: 245754 - DNA, 75 bp, Artificial Sequence
  Synthetic
gcctcatcctcgtgggacccccgaggaccagctccaaaggtcgcccccgacccaaaccaccgatcccgtccccgc

SEQ ID NO: 245755 - DNA, 75 bp, Artificial Sequence
  Synthetic
gcctcttcctcgtgggacccccgaggaccagctccaaaggtcgcccccgacccaaaccaccgatcccgtccccgc

SEQ ID NO: 245756 - DNA, 75 bp, Artificial Sequence
  Synthetic
gcctcctcctcgtgggacccccgaggaccagctccaaaggtcgcccccgacccaaaccaccgatcccgtccccgc

SEQ ID NO: 245757 - DNA, 75 bp, Artificial Sequence
  Synthetic
gcctcgtcctcgtgggacccccgaggaccagctccaaaggtcgcccccgacccaaaccaccgatcccgtccccgc

SEQ ID NO: 245758 - DNA, 75 bp, Artificial Sequence
  Synthetic
gcgtcatcctcgtgggacccccgaggaccagctccaaaggtcgcccccgacccaaaccaccgatcccgtccccgc

SEQ ID NO: 245759 - DNA, 75 bp, Artificial Sequence
  Synthetic
gcgtcttcctcgtgggacccccgaggaccagctccaaaggtcgcccccgacccaaaccaccgatcccgtccccgc

SEQ ID NO: 245760 - DNA, 75 bp, Artificial Sequence
  Synthetic
gcgtcctcctcgtgggacccccgaggaccagctccaaaggtcgcccccgacccaaaccaccgatcccgtccccgc

SEQ ID NO: 245761 - DNA, 75 bp, Artificial Sequence
  Synthetic
gcgtcgtcctcgtgggacccccgaggaccagctccaaaggtcgcccccgacccaaaccaccgatcccgtccccgc

SEQ ID NO: 245762 - DNA, 75 bp, Artificial Sequence
  Synthetic
gcggactcagaatctggtggacatatcactcactctgggatggtgggcatgggagtcagctgcacagccactcgg

SEQ ID NO: 245763 - DNA, 75 bp, Artificial Sequence
  Synthetic
ggacctgcccaccaattcgaggtctaagaccggtagagaaatgtgcagttctaaccgaccatatcaaggcagagg

SEQ ID NO: 245764 - DNA, 75 bp, Artificial Sequence
  Synthetic
gtgattaagcttatgcctttcagcggggattttgttcagggatttataagttatgtagggtctcattatagagaa

SEQ ID NO: 245765 - DNA, 75 bp, Artificial Sequence
  Synthetic
tcaaagtgagaatgagctaccgagattggggggcaaggaagacaggagggtcaaacagagtcgaggagaagccag

SEQ ID NO: 245766 - DNA, 75 bp, Artificial Sequence
  Synthetic
gcaagccatggcaggaatctcggaagaacaaggctcagacacggacacccccacagtgcacaatgacagaaatct

SEQ ID NO: 245767 - DNA, 75 bp, Artificial Sequence
  Synthetic
cccccctcataatgacagccagaaggcccggacaaaaaagccccctccaaaagacttcacggaccaagcgagagg

SEQ ID NO: 245768 - DNA, 75 bp, Artificial Sequence
  Synthetic
ttgtgatgtcatagaggggaggttaatgacagagaccgctatgaccattgatgctaggtatacagagcttctagg

SEQ ID NO: 245769 - DNA, 75 bp, Artificial Sequence
  Synthetic
atgacagagaccgctatgaccattgatgctaggtatacagagcttctaggaagagtcagatacatgtggaaactg

SEQ ID NO: 245770 - DNA, 75 bp, Artificial Sequence
  Synthetic
agaacatggaagcttacgagacagtcagtgcatttatcacgactgatctcaagaagtactgccttaattggagat

SEQ ID NO: 245771 - DNA, 75 bp, Artificial Sequence
  Synthetic
caagatgctgactctatcatggttcaatcaggccttgatggtgatagcaccctctcaggaggagacaatgaatct

SEQ ID NO: 245772 - DNA, 75 bp, Artificial Sequence
  Synthetic
tagaactcagaggtgctttccttaaccactgctttaccgaaatacatgatgttcttaaccaaaacgggtgttctg

SEQ ID NO: 245773 - DNA, 75 bp, Artificial Sequence
  Synthetic
cccccctcacaatgacagccagaaggcccggacaaaaaagccccctccgaaagactccacggaccaagcgagagg

SEQ ID NO: 245774 - DNA, 75 bp, Artificial Sequence
  Synthetic
gcccggacaaaaaagccccctccgaaagactccacggaccaagcgagaggccagccagcagccgacggcaagcgc

SEQ ID NO: 245775 - DNA, 75 bp, Artificial Sequence
  Synthetic
cggccaccccagacttgaagcggtaacagctgctgaaaatgttagaaaatacatgaatcagcctaaagtaattgt

SEQ ID NO: 245776 - DNA, 75 bp, Artificial Sequence
  Synthetic
gaacaccaggcggccccagcacagaacagccctgacacaaggccaccaccagccaccccaatctgcatcctcctc

SEQ ID NO: 245777 - DNA, 75 bp, Artificial Sequence
  Synthetic
ggaggtggatggtgatgtcaaactcagttccaatctggtgattctacctggtcaagatctccaatatgttttggc

SEQ ID NO: 245778 - DNA, 75 bp, Artificial Sequence
  Synthetic
ctgcatgctgcagacacaatccggaatgctcaagcttcaggtgaggggttaacacatgagcagtgcgttgacaac

SEQ ID NO: 245779 - DNA, 75 bp, Artificial Sequence
  Synthetic
tggaaatcttttgctggagtgagatttggctgctttatgcctcttagcctggacagtgatctgacaatgtaccta

SEQ ID NO: 245780 - DNA, 75 bp, Artificial Sequence
  Synthetic
actctagctgtctcaggagtccccaaagatctcaaagaaagtcacaggggggggccagtctcaaaaacccactcc

SEQ ID NO: 245781 - DNA, 75 bp, Artificial Sequence
  Synthetic
aagatctcaaagaaagtcacaggggggggccagtctcaaaaacccactcccgaagcccagtccacgcaagtacca

SEQ ID NO: 245782 - DNA, 75 bp, Artificial Sequence
  Synthetic
aactgtatggtagctttgggggagctcaaactcgcagccctttgtcacggggaagattctatcacaattccctat

SEQ ID NO: 245783 - DNA, 75 bp, Artificial Sequence
  Synthetic
accaaacaaagttgggtaaggatagatcaatcaatgatcatattctagtgcacttaggattcaagatcctattat

SEQ ID NO: 245784 - DNA, 75 bp, Artificial Sequence
  Synthetic
gaccttgacgcccatgtcccgttatgcaaagtccccaatgaccaaatcttcattaagtaccctatgggaggtata

SEQ ID NO: 245785 - DNA, 75 bp, Artificial Sequence
  Synthetic
ggaaaactctcaatgttcctccgcccccggaccccggtagggccagcacttccgagacacccattaaaaagggca

SEQ ID NO: 245786 - DNA, 75 bp, Artificial Sequence
  Synthetic
gcatttgggtccctgcccttaggtgttggcagatccacagcaaagcccgaagaactcctcaaagaggccactgag

SEQ ID NO: 245787 - DNA, 75 bp, Artificial Sequence
  Synthetic
gaccagaacaacatctgcctaccctccatcattgttataaaaaacttaggaaccaggtccacacagccgccagcc

SEQ ID NO: 245788 - DNA, 75 bp, Artificial Sequence
  Synthetic
gagtaactagagattattttgtaattcttaggcaaaggctacacgacattggccatcacctcaaggcaaatgaga

SEQ ID NO: 245789 - DNA, 75 bp, Artificial Sequence
  Synthetic
ggggtccccatcgaattacaagtggaatgcttcacatgggaccaaaaactctggtgccgtcacttctgtgtgctt

SEQ ID NO: 245790 - DNA, 75 bp, Artificial Sequence
  Synthetic
tctagactaggtgcaagaggccgaggaccagaacaacatccgcctaccctccatcattgttataaaaaacttagg

SEQ ID NO: 245791 - DNA, 75 bp, Artificial Sequence
  Synthetic
tcagaggtcaattctcaaacatgtcgctgtccctgttagacttgtatttaagtcgaggttacaatgtgtcatcta

SEQ ID NO: 245792 - DNA, 75 bp, Artificial Sequence
  Synthetic
gaaatgtcctcattgacaaagagtcatgttcagtgcagctggcgagagctctaagaagccatatgtgggcaaggc

SEQ ID NO: 245793 - DNA, 75 bp, Artificial Sequence
  Synthetic
aacataactgcaaggtttgtcctgatccatagtccaaatccaatgctaaaagggttattccatgatggcagtaaa

SEQ ID NO: 245794 - DNA, 75 bp, Artificial Sequence
  Synthetic
cagcaacaacatctcaaatatgagcatcaaggatttcagacccccacacgatgatgttgcaaaattgctcaaaga

SEQ ID NO: 245795 - DNA, 75 bp, Artificial Sequence
  Synthetic
ttcatttttgacgccctcgctgaggtaaatgtcagtcagccaaagatcggcagcaacaacatctcaaatatgagc

SEQ ID NO: 245796 - DNA, 75 bp, Artificial Sequence
  Synthetic
aggtttgaactttggccgatcttacttcgatccagcatatttcagactagggcaagagatggtgaggaggtcagc

SEQ ID NO: 245797 - DNA, 75 bp, Artificial Sequence
  Synthetic
cagataagaaagttgatactaactttatataccaacaaggaatgcttctagggttgggtgttttagaaacattgt

SEQ ID NO: 245798 - DNA, 75 bp, Artificial Sequence
  Synthetic
aatgcatactacagaggacaggatcagtagagcggttggacccagacaatcccaagtgtcattcctacacggtga

SEQ ID NO: 245799 - DNA, 75 bp, Artificial Sequence
  Synthetic
tatataccaacaaggaatgcttctagggttaggtgtcttagaaacattgtttcgactcgagaaagataccggatc

SEQ ID NO: 245800 - DNA, 75 bp, Artificial Sequence
  Synthetic
tcaaaatgaaaatgagctaccgagatgggggggtaaggaagatatgagggtcaaacagagtcggggagaagccag

SEQ ID NO: 245801 - DNA, 75 bp, Artificial Sequence
  Synthetic
agagagctacagagaaaccaggcccagcagagcaagtgacgcgagagctacccatcctccaaccgacacaccctt

SEQ ID NO: 245802 - DNA, 75 bp, Artificial Sequence
  Synthetic
tgcagaatacaggagactactgagaacagttctggaaccaattagagatgcacttaatgcaatgacccagaatat

SEQ ID NO: 245803 - DNA, 75 bp, Artificial Sequence
  Synthetic
caatctgagagcgagcctggaaactactaatcaggcaattgagacaatcagacaagcagggcaggagatgatatt

SEQ ID NO: 245804 - DNA, 75 bp, Artificial Sequence
  Synthetic
taaaggcccggataactcacgtcgacacagagtcctacttcattgtactcagtatagcctatccgacgctatccg

SEQ ID NO: 245805 - DNA, 75 bp, Artificial Sequence
  Synthetic
actaatcaggcaattgagacaatcagacaagcagggcaggagatgatattggctgttcagggtgtccaagactac

SEQ ID NO: 245806 - DNA, 75 bp, Artificial Sequence
  Synthetic
aagaaattctggcattgtggcattatagagcctatccatggtccttcgctcgatgctcaaaatttgcacacaact

SEQ ID NO: 245807 - DNA, 75 bp, Artificial Sequence
  Synthetic
atgtagtaccggacagattcgacaatatccaggcaaaacacctgtgtgttctagcagatttgtactgtcaaccag

SEQ ID NO: 245808 - DNA, 75 bp, Artificial Sequence
  Synthetic
gaagatggaaccaatcgcagatagggctgctagtgaaccaatcacatgatgtcacccagacatcaggcataccca

SEQ ID NO: 245809 - DNA, 75 bp, Artificial Sequence
  Synthetic
ggttagtcccaacctcttcactgtcccaattaaggaagcaggcgaggactgccatgccccaacatacctacctgc

SEQ ID NO: 245810 - DNA, 75 bp, Artificial Sequence
  Synthetic
cagcaacaacttcccgaatatgagcattaaggatttcaggcctcctcacgatgatgttgcaaaattgctcaaaga

SEQ ID NO: 245811 - DNA, 75 bp, Artificial Sequence
  Synthetic
attaaggatttcaggcctcctcacgatgatgttgcaaaattgctcaaagatatcaacacaagcaaacacaatctt

SEQ ID NO: 245812 - DNA, 75 bp, Artificial Sequence
  Synthetic
cccatttcagggggtaatctcgccaattatgaaatccatgctttccgcagaatcgggttaaactcatctgcttgc

SEQ ID NO: 245813 - DNA, 75 bp, Artificial Sequence
  Synthetic
ttggcagatccacagcaaaacccgaagaactcctcaaagaggccactgagcttgacatagttgttagacgtacag

SEQ ID NO: 245814 - DNA, 75 bp, Artificial Sequence
  Synthetic
cagccgacaactccaaggaatgacaaatggacggaccagttccagaggacagctgctgaaggaatttcaactaaa

SEQ ID NO: 245815 - DNA, 75 bp, Artificial Sequence
  Synthetic
ccgaagttctcaagaagcccgttgccagccgacaactccaaggaatgacaaatggacggaccagttccagaggac

SEQ ID NO: 245816 - DNA, 75 bp, Artificial Sequence
  Synthetic
agccaagatccgcaggacagtcgaaggtcagccgatgccctgcttaggctgcaagccatggcaggaatctcggaa

SEQ ID NO: 245817 - DNA, 75 bp, Artificial Sequence
  Synthetic
ggatcacccgcaaattttgggggcatattcttctttactctgggaacagaaagttgataaatcggtttatccaaa

SEQ ID NO: 245818 - DNA, 75 bp, Artificial Sequence
  Synthetic
gattattcaaagttctgtagaccgtagtgcccagcaatgcccgaagacgaccctcctcacaatgacagccagaag

SEQ ID NO: 245819 - DNA, 75 bp, Artificial Sequence
  Synthetic
gcccggaaaaaaaggccccctccgaaagactccacagaccaaatgagaggccagccagcagctgacggcaagcac

SEQ ID NO: 245820 - DNA, 75 bp, Artificial Sequence
  Synthetic
gtaggacccccgaggaccaacccccaaggttgccccccacccaaaccaccaaccgcatccctaccacccccggga

SEQ ID NO: 245821 - DNA, 75 bp, Artificial Sequence
  Synthetic
cccggcacccagccaccgacagtccaagacggggggccccccccaaaaaaaggcccccaggggctgacagccaga

SEQ ID NO: 245822 - DNA, 75 bp, Artificial Sequence
  Synthetic
aaccgcatccctaccacccccgggaaagaaacccccagcaactggaagagcccttcccctttccctcaacacaag

SEQ ID NO: 245823 - DNA, 75 bp, Artificial Sequence
  Synthetic
cccacccaccccacacacgaccacggcaaccgaaccagaatccagaccacctagggccaccagctcccagactcg

SEQ ID NO: 245824 - DNA, 75 bp, Artificial Sequence
  Synthetic
cccacccaccccacacacgaccacggcaaccgaaccagaatccagaccaccttgggccaccagctcccagactcg

SEQ ID NO: 245825 - DNA, 75 bp, Artificial Sequence
  Synthetic
cccacccaccccacacacgaccacggcaaccgaaccagaatccagaccacctcgggccaccagctcccagactcg

SEQ ID NO: 245826 - DNA, 75 bp, Artificial Sequence
  Synthetic
cccacccaccccacacacgaccacggcaaccgaaccagaatccagaccacctggggccaccagctcccagactcg

SEQ ID NO: 245827 - DNA, 75 bp, Artificial Sequence
  Synthetic
gaaccagaatccagaccacctagggccaccagctcccagactcggccatcaccccgcagaaaggaaagggcacaa

SEQ ID NO: 245828 - DNA, 75 bp, Artificial Sequence
  Synthetic
gaaccagaatccagaccaccttgggccaccagctcccagactcggccatcaccccgcagaaaggaaagggcacaa

SEQ ID NO: 245829 - DNA, 75 bp, Artificial Sequence
  Synthetic
gaaccagaatccagaccacctcgggccaccagctcccagactcggccatcaccccgcagaaaggaaagggcacaa

SEQ ID NO: 245830 - DNA, 75 bp, Artificial Sequence
  Synthetic
gaaccagaatccagaccacctggggccaccagctcccagactcggccatcaccccgcagaaaggaaagggcacaa

SEQ ID NO: 245831 - DNA, 75 bp, Artificial Sequence
  Synthetic
ccaacccgaaccagcacccaagagcgatccccgaaggacccccgaaccgcaaacgacatcagcatcccacagcct

SEQ ID NO: 245832 - DNA, 75 bp, Artificial Sequence
  Synthetic
ggctcccccggtgcccacaggcaggcacaccaacccccgaacagacccagcacccagccatcgacaatccaagac

SEQ ID NO: 245833 - DNA, 75 bp, Artificial Sequence
  Synthetic
cacaccaacccccgaacagacccagcacccagccatcgacaatccaagacgggggggcccccccaaaaaaaggcc

SEQ ID NO: 245834 - DNA, 75 bp, Artificial Sequence
  Synthetic
aggctaattggaaactcggatgtgagtgggcccaaattgacaggggcactaataggcatattgtccttatttgtg

SEQ ID NO: 245835 - DNA, 75 bp, Artificial Sequence
  Synthetic
aatttgttacatggtccacaccccaactatatcacattctagctaagtccacagcactatctatgattgacctgg

SEQ ID NO: 245836 - DNA, 75 bp, Artificial Sequence
  Synthetic
cctttgcatcaagaggtaccaacatggaggatgaggcggaccaatactttttacatgatgattcaagtagtggtg

SEQ ID NO: 245837 - DNA, 75 bp, Artificial Sequence
  Synthetic
tctcgaagggactaaaagatcaatccaccacatccgacgacactcaactccccgtccctaaaggagacaccggga

SEQ ID NO: 245838 - DNA, 75 bp, Artificial Sequence
  Synthetic
atacacccaacaaagaagggtcgtcggcgaatttagattggagagaaaatggttggatgtagtgaggaacaggat

SEQ ID NO: 245839 - DNA, 75 bp, Artificial Sequence
  Synthetic
ggcgaatttagattggagagaaaatggttggatgtagtgaggaacaggattgccgaggatctctccttacgccgg

SEQ ID NO: 245840 - DNA, 75 bp, Artificial Sequence
  Synthetic
gactcttcaaagttctgtagaccgtagtgctcagcagtgcccgaaaacaacccccctcacaatggcacccagaag

SEQ ID NO: 245841 - DNA, 75 bp, Artificial Sequence
  Synthetic
aaacacattattatagtaccaatccctggagattcctcaatcaccactcgatccagacttctggaccggttggtc

SEQ ID NO: 245842 - DNA, 75 bp, Artificial Sequence
  Synthetic
acagtcccgacccagggccaccaccagccatcccaatccgcatcatcctcttgggacccccgaggaccaacctcc

SEQ ID NO: 245843 - DNA, 75 bp, Artificial Sequence
  Synthetic
tttgatccagcatattttagattaggacaagagatggttaggaggtcagctgggaaggtaagttccacattggca

SEQ ID NO: 245844 - DNA, 75 bp, Artificial Sequence
  Synthetic
gaacaaggaaatctcagatattgaagtgcaagaccctgagggattcaacatgattctaggcaccattctagccca

SEQ ID NO: 245845 - DNA, 75 bp, Artificial Sequence
  Synthetic
atgcaaggcttgtttcagagattgcaatgcatactactgaggacaggaccagtagagcggttggacccaggcaag

SEQ ID NO: 245846 - DNA, 75 bp, Artificial Sequence
  Synthetic
agtagagcggttggacccagacaggcccaagtgtcatttctgcacggtgatcaaagtgggagtgagctaccagga

SEQ ID NO: 245847 - DNA, 75 bp, Artificial Sequence
  Synthetic
cccccggcaaactaaacaaaacttagggccaaggaacacacacacccaacagaacccagaccccggcccacggcg

SEQ ID NO: 245848 - DNA, 75 bp, Artificial Sequence
  Synthetic
ctcaagtgtcatttctacacggtgatcaaagtgagaatgagctaccgggattgggaggtaaggaagataagaagg

SEQ ID NO: 245849 - DNA, 75 bp, Artificial Sequence
  Synthetic
ttggggggcagggaggacaggagggtcgggcagagtcggggagaagccagggagagctacagagagaccgggtcc

SEQ ID NO: 245850 - DNA, 75 bp, Artificial Sequence
  Synthetic
tcaaacagagtcgaggagaacccagggagagctatagagaaaccgggcccagcagagcaaatgatgcgagagctg

SEQ ID NO: 245851 - DNA, 75 bp, Artificial Sequence
  Synthetic
agcagagcaagtgatgcgagagctgcccatcttccaaccagcacacccctagacattgacactgcatcggagtca

SEQ ID NO: 245852 - DNA, 75 bp, Artificial Sequence
  Synthetic
cccatcttccaaccagcacacccctagacattgacactgcatcggagtcaggccaagatctgcaggacagccgac

SEQ ID NO: 245853 - DNA, 75 bp, Artificial Sequence
  Synthetic
cccaccttccaaccggcacacccctagacattgacactgcatcggagttcagccaagacccgcaagacagtcgaa

SEQ ID NO: 245854 - DNA, 75 bp, Artificial Sequence
  Synthetic
tcaagagaacacccgggaacaaacctaggattgctgaaatgatatgtgacattgatacatatatcgtagaggcag

SEQ ID NO: 245855 - DNA, 75 bp, Artificial Sequence
  Synthetic
gggggggcccccccaaggaagggcccccaggggccgacagccaggacagcgaggagacccacccacaccacacac

SEQ ID NO: 245856 - DNA, 75 bp, Artificial Sequence
  Synthetic
caccacggcaaccaaaccagaacccaggctatcctgggccaccaactcccagacccggccaccaccccgaggaaa

SEQ ID NO: 245857 - DNA, 75 bp, Artificial Sequence
  Synthetic
ctctggagctatgccatgggagtaggcgtggagcttgaaaactccatgggagggttgaactttggccgatcttac

SEQ ID NO: 245858 - DNA, 75 bp, Artificial Sequence
  Synthetic
gaacaaggctcagacatggacacccctagagtgtacaatgacagagatcttctagactaggtgcgagaggctgag

SEQ ID NO: 245859 - DNA, 75 bp, Artificial Sequence
  Synthetic
gggacggccacagcccgtgcacctcagccccgatccggcgggcagccacccaacccgagccagcacccaggagcg

SEQ ID NO: 245860 - DNA, 75 bp, Artificial Sequence
  Synthetic
acccccgaaggacccccaggccgcggaggacatcggcatcccacagcccctccaggtcccccggtctccccctcc

SEQ ID NO: 245861 - DNA, 75 bp, Artificial Sequence
  Synthetic
tccaggtcccccggtctccccctcctctcgaggggaccaaaagatcaacccaccatatccgacgacactcaactc

SEQ ID NO: 245862 - DNA, 75 bp, Artificial Sequence
  Synthetic
agacagcccaggacgggagcaagccacctgcaatgaagagaaggcaggcagttcgggtctcaacaaaccatgcct

SEQ ID NO: 245863 - DNA, 75 bp, Artificial Sequence
  Synthetic
ccaaacagagccgaggagaagccagggagagctacagagagactgggtccagcagagcaagtgatgcaagagctg

SEQ ID NO: 245864 - DNA, 75 bp, Artificial Sequence
  Synthetic
ctcagcagttggatcaactgaaggcggtgcaccttgcgtctgcggtcagggatctagagagggcgatgacgacgc

SEQ ID NO: 245865 - DNA, 75 bp, Artificial Sequence
  Synthetic
cccatcttccaaccagcacacccctagacattgacactgcatcggagacaagccaagatctgcaagacagtcgaa

SEQ ID NO: 245866 - DNA, 75 bp, Artificial Sequence
  Synthetic
gatctagagagggcgatgacgacgctggaactctgggaatcccctcgagaaatctccaggcatcaagcattgggt

SEQ ID NO: 245867 - DNA, 75 bp, Artificial Sequence
  Synthetic
aggggcaacaactttccgaagcttgggaaaattctcaatgttcctccgcccccgagccccggtagggccagcact

SEQ ID NO: 245868 - DNA, 75 bp, Artificial Sequence
  Synthetic
ggtcagctgacgccctgctcaggctgcaagccatggcaggaatctcggaagagcaaggctcagacacggacaccc

SEQ ID NO: 245869 - DNA, 75 bp, Artificial Sequence
  Synthetic
ccagagtgtacaatgacagagatcttctagactaggtgcgagaggccgaggatcagaacaacatccgcctgccct

SEQ ID NO: 245870 - DNA, 75 bp, Artificial Sequence
  Synthetic
aatcaaccatccactcccacgattggagccgatggcagaagagcaggcacgccatgtcaaaaacggactggaatg

SEQ ID NO: 245871 - DNA, 75 bp, Artificial Sequence
  Synthetic
acctgcaaggaagagaaggcaagcagttcgggtctcagcaaaccatgcctctcagcaattggatcaactgaaggc

SEQ ID NO: 245872 - DNA, 75 bp, Artificial Sequence
  Synthetic
aggtgcacctgcggggaatgtccccgagtttgtgagcagtgccgcactgatacaggagtggacaccagaatctgg

SEQ ID NO: 245873 - DNA, 75 bp, Artificial Sequence
  Synthetic
gatctggagagagcgatgacgacgctgaaactttgggaatcccctcaagaaatctccaggcatcaagcactgggt

SEQ ID NO: 245874 - DNA, 75 bp, Artificial Sequence
  Synthetic
agctgctgaaggaatttcaactaaagccgatcgggaaaaagatgagctcagccgtcgggtttgttcctgacaccg

SEQ ID NO: 245875 - DNA, 75 bp, Artificial Sequence
  Synthetic
cagatgctgatgaagataataatgaagtagctacagctcaacttacctgccagcctcacgccagtcaacccaatc

SEQ ID NO: 245876 - DNA, 75 bp, Artificial Sequence
  Synthetic
tacaggagtggacacccgaatctggtaccacaacctccccgagatcccagaataatgaagaagggggagactatt

SEQ ID NO: 245877 - DNA, 75 bp, Artificial Sequence
  Synthetic
taccacaacctccccgagatcccagaataatgaagaagggggagactattatgatgatgagctgttctctgatgt

SEQ ID NO: 245878 - DNA, 75 bp, Artificial Sequence
  Synthetic
accaaggggaaaatcaagaaggatgtctaacttacgaagtcataatagataaatcgagcccagaagtggcaaaga

SEQ ID NO: 245879 - DNA, 75 bp, Artificial Sequence
  Synthetic
tctaacttacgaagtcataatagataaatcgagcccagaagtggcaaagatcgctgtcgaatccgatagtgagat

SEQ ID NO: 245880 - DNA, 75 bp, Artificial Sequence
  Synthetic
tccgcttctgggcacttgcacaggttgtctgtcctctctttcgcaatttcacactgtgcaaggatgtcttccgtg

SEQ ID NO: 245881 - DNA, 75 bp, Artificial Sequence
  Synthetic
acactgtgcaaggatgtcttccgtgttcagggcgtttgagctcttcaccttagagcaagagcagaatgagcatgg

SEQ ID NO: 245882 - DNA, 75 bp, Artificial Sequence
  Synthetic
ttcagggcgtttgagctcttcaccttagagcaagagcagaatgagcatggaaatgacattgaattgcctcctgag

SEQ ID NO: 245883 - DNA, 75 bp, Artificial Sequence
  Synthetic
accttgaggactaatataaaggtatgcactctcaacaatcaggagcctcaagcacgtcatgatatgatgtgcttc

SEQ ID NO: 245884 - DNA, 75 bp, Artificial Sequence
  Synthetic
tgtttgcgcttaattgctagtaattctgcccgtgctgcccataaaacaggggcaattcttactctattgagcttg

SEQ ID NO: 245885 - DNA, 75 bp, Artificial Sequence
  Synthetic
ctgcccgtgctgcccataaaacaggggcaattcttactctattgagcttgcccaccgctatgatgcaaaatcacc

SEQ ID NO: 245886 - DNA, 75 bp, Artificial Sequence
  Synthetic
ttcggattgcagacaggtctccggatgcagacatagagaggctagagattgacggatttgagcctggtacgttcc

SEQ ID NO: 245887 - DNA, 75 bp, Artificial Sequence
  Synthetic
ggctaagggcaaatgcgagaactccgatgacaaatggagaggtaacagcactcaatcttatggcccaggatctcc

SEQ ID NO: 245888 - DNA, 75 bp, Artificial Sequence
  Synthetic
ctgacacttactctaatgataccccgttcctcaatccaaacaccgagactgaacaatgtgatgagatggaacagt

SEQ ID NO: 245889 - DNA, 75 bp, Artificial Sequence
  Synthetic
gaacaatgtgatgagatggaacagttcctaaatgcaatatacagtgtactagttcaagtctgggtcacagtgtgc

SEQ ID NO: 245890 - DNA, 75 bp, Artificial Sequence
  Synthetic
aaatgtatgacagctcatgatcagcccactgggtctgatgaaagaagactggcaaaatatcagcagcaagggaga

SEQ ID NO: 245891 - DNA, 75 bp, Artificial Sequence
  Synthetic
ctggatcagaggtatgcactgcaacctgagctaagaaggcagatacagacctgcattcggtcaagcctcacaata

SEQ ID NO: 245892 - DNA, 75 bp, Artificial Sequence
  Synthetic
agacagtttctgacccatgagctgcagacggcacggaaacagggtgctataactggaaaatactacgccatggtc

SEQ ID NO: 245893 - DNA, 75 bp, Artificial Sequence
  Synthetic
ggagatatcgggaagtacattgataatgccggaatgagtgcatttttcatgacaatgagatttgcgctcggaaca

SEQ ID NO: 245894 - DNA, 75 bp, Artificial Sequence
  Synthetic
aagtggcccccgttagctcttgctgcattctcaggagaactccttaagcttaaatcattgatgcaactatacagg

SEQ ID NO: 245895 - DNA, 75 bp, Artificial Sequence
  Synthetic
agtttaggagatcgggctcgctatatggcccttctggaaatgtctgagatgatggagtttgcaccagctaactac

SEQ ID NO: 245896 - DNA, 75 bp, Artificial Sequence
  Synthetic
cctctttgctacagttacgcaatggggattgggagtgtccaagatccgatgatgaggaactatacatttgctaga

SEQ ID NO: 245897 - DNA, 75 bp, Artificial Sequence
  Synthetic
ccatttttgaaccctgcatacttccaacttggagtagaaactgccaaccgtcaacagggatcagtggacaaagca

SEQ ID NO: 245898 - DNA, 75 bp, Artificial Sequence
  Synthetic
atggcagcagagctaggcctcacagaagatgagaagcgggatatgtcagcagcagtcaccagactcacaacaggg

SEQ ID NO: 245899 - DNA, 75 bp, Artificial Sequence
  Synthetic
aggggaggcaatcaagcacaagagttaatcaatgtgatgggtgctcgacagggaagagaccagggaagaaggggg

SEQ ID NO: 245900 - DNA, 75 bp, Artificial Sequence
  Synthetic
aatcgtgactatgatgtagtagaggaaaatgaggaaaccgagagtgacagtgacaatgatgaggagcaagaaatc

SEQ ID NO: 245901 - DNA, 75 bp, Artificial Sequence
  Synthetic
caaaatcgtccgttacccccaatcccgcagatgccccagaacatagattgggaagtgaggctggcagagattgaa

SEQ ID NO: 245902 - DNA, 75 bp, Artificial Sequence
  Synthetic
aggagaaaccagcagatggcagcccgagatcggcctcaggcagttgtaactgcagatgtccatcaagaaccagca

SEQ ID NO: 245903 - DNA, 75 bp, Artificial Sequence
  Synthetic
gatgccagagtggacgagcaagacatgctacttgatcttgacatgtaacgaactggcaattttccatctactgaa

SEQ ID NO: 245904 - DNA, 75 bp, Artificial Sequence
  Synthetic
taagctgttctcacttaattttaccctatcaactctactaggagctttgcttgtagtttgctattagttgttaag

SEQ ID NO: 245905 - DNA, 75 bp, Artificial Sequence
  Synthetic
aagtattttaaagaaaacttagaaaaaagacagatgagcccgaacagggtaaaagcgtgggcatttccctagttc

SEQ ID NO: 245906 - DNA, 75 bp, Artificial Sequence
  Synthetic
gggtagtctagtgctctacaccagattataaaagttgtttctattgctcctgcatctgcacgtctatctaaaaac

SEQ ID NO: 245907 - DNA, 75 bp, Artificial Sequence
  Synthetic
tgcatctgcacgtctatctaaaaaccttaaaagctatggataacccaccctctgacgctgaaatatctgcctgga

SEQ ID NO: 245908 - DNA, 75 bp, Artificial Sequence
  Synthetic
ttgacaagggacttgatactgtggagcatttcttgagcgttgcaacagaccctgccaggagcctcgggaagtcaa

SEQ ID NO: 245909 - DNA, 75 bp, Artificial Sequence
  Synthetic
cctgccaggagcctcgggaagtcaacaatcaagcctgggaagacccaagaattgatcagatctgcagagaagctt

SEQ ID NO: 245910 - DNA, 75 bp, Artificial Sequence
  Synthetic
gctggcgccgtggtacaaggtggggagaagggggacagagacaatgcaaagaaagaagtcaccaccgcagcaccc

SEQ ID NO: 245911 - DNA, 75 bp, Artificial Sequence
  Synthetic
gagcctgcagtccgtgggaaagtccgtcccattgatgtggagccaagtgataacacatatgaagaggtaattcct

SEQ ID NO: 245912 - DNA, 75 bp, Artificial Sequence
  Synthetic
tctgaaaattccaaactaatcccaccggtgactccaaagaagcctcctcgtcataaagacagaataatgtctatg

SEQ ID NO: 245913 - DNA, 75 bp, Artificial Sequence
  Synthetic
atgccgctccaatcagataagcagttgactgaaagtatggagagtcaagtatttaagagggggaaaggatttgag

SEQ ID NO: 245914 - DNA, 75 bp, Artificial Sequence
  Synthetic
tgactgaaagtatggagagtcaagtatttaagagggggaaaggatttgagacatggcccaagcgacatcggaccg

SEQ ID NO: 245915 - DNA, 75 bp, Artificial Sequence
  Synthetic
atttaagagggggaaaggatttgagacatggcccaagcgacatcggaccgggggccataggagggagatcgcaat

SEQ ID NO: 245916 - DNA, 75 bp, Artificial Sequence
  Synthetic
tgactggattggcgggaggccgagagtcacagagtggtgcaacccaatatgtcacccaatctcccagtcaacctt

SEQ ID NO: 245917 - DNA, 75 bp, Artificial Sequence
  Synthetic
gtcacagagtggtgcaacccaatatgtcacccaatctcccagtcaaccttccgaggtagctgccgatgtggaaac

SEQ ID NO: 245918 - DNA, 75 bp, Artificial Sequence
  Synthetic
tgccccggcatctgctccttatgtgaaagagattatacattacttacagactctggagactcggattaacaatct

SEQ ID NO: 245919 - DNA, 75 bp, Artificial Sequence
  Synthetic
tgactggaaagtggataaaattctctctcagcagtctgttattacccaaatcaaacacgagcaacatgcaatcaa

SEQ ID NO: 245920 - DNA, 75 bp, Artificial Sequence
  Synthetic
agcaggaatagccactttggaaggtcttatcaccaccatcaagatcatggaccctggagtaggtgatggcgccac

SEQ ID NO: 245921 - DNA, 75 bp, Artificial Sequence
  Synthetic
tgcggccaaatcaaagagattatttaaagaagcccctgtggttgtgagtggaccggtcattggagacaaccccat

SEQ ID NO: 245922 - DNA, 75 bp, Artificial Sequence
  Synthetic
tgttgatgctgacaccattcaactggacgagttggcccgcccatctcttcccaaaacaaaatctcagaagtccag

SEQ ID NO: 245923 - DNA, 75 bp, Artificial Sequence
  Synthetic
cgctgcctcaccagcggccctatccggctataagatgacattattggctcttatcaaggaatgcattcccaatca

SEQ ID NO: 245924 - DNA, 75 bp, Artificial Sequence
  Synthetic
ggcaaaacgccaaaagtttgaaatgcaagttggcggaatccgaaatgagcaagatttcaagaatctccgccgaga

SEQ ID NO: 245925 - DNA, 75 bp, Artificial Sequence
  Synthetic
gataatccgcagtgctgcccaataatcattttgtacgctactacatcctgccaattcagcacaatttgattaatc

SEQ ID NO: 245926 - DNA, 75 bp, Artificial Sequence
  Synthetic
accgcaattaattagcaactattaatctcttcttatgccaggctttgcttatctgcgactcttctttgagcttta

SEQ ID NO: 245927 - DNA, 75 bp, Artificial Sequence
  Synthetic
agaaaaaataagtgagcccgaaccagttaagaagggcacactccgaccatggcgctcagacaagcaaccatacct

SEQ ID NO: 245928 - DNA, 75 bp, Artificial Sequence
  Synthetic
ggcgctcagacaagcaaccatacctgttgatgtggacaaagacagtgagaagaacaatctcaacccattccccat

SEQ ID NO: 245929 - DNA, 75 bp, Artificial Sequence
  Synthetic
aattcctgttaccagggatgacggatcctcaaccggtagattggtcaaacaactgagggtgaaaaatctcacacc

SEQ ID NO: 245930 - DNA, 75 bp, Artificial Sequence
  Synthetic
aaaaggatctaccgagcttccgctttcctttgtgaacacgtatggattcatcaagccgttgctcacatactcaga

SEQ ID NO: 245931 - DNA, 75 bp, Artificial Sequence
  Synthetic
attttattctgaagtccatcaccaggcatccactccctgcctcactgcatgcatgatcccgttcggcgcaggccc

SEQ ID NO: 245932 - DNA, 75 bp, Artificial Sequence
  Synthetic
gtacattgagaacccccacaggattctagatgaatgtgacaaagtcaacatcatcgtcagaaagagtgcaagctt

SEQ ID NO: 245933 - DNA, 75 bp, Artificial Sequence
  Synthetic
aaaagaagaaatagtctttgatgtcaggaggctaccccccatcttcaacaagcaccaaatatctggaaacagatt

SEQ ID NO: 245934 - DNA, 75 bp, Artificial Sequence
  Synthetic
gatctgcgttccctcagaaaaatatgtaaagtctccagggaaaatggttgctggaacagattatgcttaccaaat

SEQ ID NO: 245935 - DNA, 75 bp, Artificial Sequence
  Synthetic
tgcatttgtctcacttacattttgcccggaaagtcaaaagttcagggttgcaaggcccttacaaaccattcgatc

SEQ ID NO: 245936 - DNA, 75 bp, Artificial Sequence
  Synthetic
acccatcatgaggagtgtccaattggaagtgatgctgcgaattgactgtgctgccgactcaccgctgaaaagatt

SEQ ID NO: 245937 - DNA, 75 bp, Artificial Sequence
  Synthetic
gctgattgtaaatcctggctccactgattactatgcttctgtatggtttcacatttgcaacctttacagaggtaa

SEQ ID NO: 245938 - DNA, 75 bp, Artificial Sequence
  Synthetic
caagccattcaagtcttatgatgatacctatttcagccagaaatgcagagctatgcagcttgagtgcgggattgt

SEQ ID NO: 245939 - DNA, 75 bp, Artificial Sequence
  Synthetic
ggatatgtggggtcccacactggttgtgaaggcacatgggaaaatccctaagatggcaaagccttttttcagtgc

SEQ ID NO: 245940 - DNA, 75 bp, Artificial Sequence
  Synthetic
aaaagggtgggcctgtcatgcattttcagatgcagccccaacactggcaaaagctttgtggtcagtaggagcaaa

SEQ ID NO: 245941 - DNA, 75 bp, Artificial Sequence
  Synthetic
gatcacccaagtgaacgcaatcctgcaaccatccgagctgagccaaatggtccaagtgagtgatgtgatatggcc

SEQ ID NO: 245942 - DNA, 75 bp, Artificial Sequence
  Synthetic
aaaagtcaagctggacaaccggatccaagactactctgctgcaaaatggaatcctttcaagaagccttgactcag

SEQ ID NO: 245943 - DNA, 75 bp, Artificial Sequence
  Synthetic
aattatctgaacatctacatcaccaacttctaacccaataaatttactgtgtggtcatcctgcaggactcacttg

SEQ ID NO: 245944 - DNA, 75 bp, Artificial Sequence
  Synthetic
ctattgccaccctacaagtaaaagccaattcaacaaatgcattgctttaccgcacatcaactgacctggcacttc

SEQ ID NO: 245945 - DNA, 75 bp, Artificial Sequence
  Synthetic
aaattcaaggaccccgccacagcgcatgacagcagccccgaggcaaccccctccccacaacccactacacaattc

SEQ ID NO: 245946 - DNA, 75 bp, Artificial Sequence
  Synthetic
ctctcccatcacccaatcccctgctagtttaataaaaaattagagaggtgaaatgcacacacacaacgaccggaa

SEQ ID NO: 245947 - DNA, 75 bp, Artificial Sequence
  Synthetic
aggagcacgaacaggtgcacccacacaccaccccacagcgaccaacccgccagccatccaaagcatcatgatgcc

SEQ ID NO: 245948 - DNA, 75 bp, Artificial Sequence
  Synthetic
ccgtgttttggggatgatcgtgctttatctaacccactctcagatattgtgcattaacagaaataccctttacca

SEQ ID NO: 245949 - DNA, 75 bp, Artificial Sequence
  Synthetic
gattggcctgatacacaggtccgtcaaaaaggtcaatttttacagccaagggtccccttcttatatagttgttaa

SEQ ID NO: 245950 - DNA, 75 bp, Artificial Sequence
  Synthetic
attggtgcctactcttgctgcaatcccgccaaactgcagtatcaaaagtctgcaaagatataaagaaactgtaac

SEQ ID NO: 245951 - DNA, 75 bp, Artificial Sequence
  Synthetic
ctccttagttcagcctatatcggataacttaggatacttacaggataagcttgttacaggccaatcaagaaggcg

SEQ ID NO: 245952 - DNA, 75 bp, Artificial Sequence
  Synthetic
cagacgatttgcaggtgtggctatagggttagcagccctaggagtagctgctgcagctcaagcaactgctgccgt

SEQ ID NO: 245953 - DNA, 75 bp, Artificial Sequence
  Synthetic
tgcactggtagagactagagagaatgcaggcaagatccaggcattatcagagtctatccagaatactaaccaagc

SEQ ID NO: 245954 - DNA, 75 bp, Artificial Sequence
  Synthetic
agtacacagcttgaagacagcactgggtttctcggcaacagcaattcaagcaatccaaaatcaagtcaatgaggt

SEQ ID NO: 245955 - DNA, 75 bp, Artificial Sequence
  Synthetic
cattaatccagcaattaacaagctgagttgtgaagtactggattctcagctagcttctatgcttaacttatattt

SEQ ID NO: 245956 - DNA, 75 bp, Artificial Sequence
  Synthetic
gatccacttaactacagtcttccagacacaactaaccaatcctgctctcacaccgctgagcattcaagcactgac

SEQ ID NO: 245957 - DNA, 75 bp, Artificial Sequence
  Synthetic
aagtgtgctccaagggacatcgggggtattaatgaattcaaccaattccaccctaacccaaccaatagatttact

SEQ ID NO: 245958 - DNA, 75 bp, Artificial Sequence
  Synthetic
gtattaatgaattcaaccaattccaccctaacccaaccaatagatttacttgccacaggattgattacgggacaa

SEQ ID NO: 245959 - DNA, 75 bp, Artificial Sequence
  Synthetic
ataattagcgtcaatatgacaagtctacaattaatcattgctacattcatgccttctattgcagagcttccgaat

SEQ ID NO: 245960 - DNA, 75 bp, Artificial Sequence
  Synthetic
gcagtgcttcattccttctttagaattactacatcagtcaacttgactgaggtgatgatccaatcgccagagttt

SEQ ID NO: 245961 - DNA, 75 bp, Artificial Sequence
  Synthetic
ataatggagcaaaatggggtattctatgacttcaatacagctcactgccaattaggtgacaataatgtttattgt

SEQ ID NO: 245962 - DNA, 75 bp, Artificial Sequence
  Synthetic
ccgtatattgatgcggctcgcttatcaagcatgatgacaaattgtatcaacggcaatttaggtgagtgcgtattt

SEQ ID NO: 245963 - DNA, 75 bp, Artificial Sequence
  Synthetic
tctagggtaattggatctttcccatcacggtttgtgtctcttaatggagcgattttggcaaattgtaaattcatg

SEQ ID NO: 245964 - DNA, 75 bp, Artificial Sequence
  Synthetic
agatgcaattgtctttcaccggaaaaaattataacccccttggatggtgaaatgatctcgttgatagatttgagg

SEQ ID NO: 245965 - DNA, 75 bp, Artificial Sequence
  Synthetic
gtgtgccaaaaattaacattaggaacaattacattcgagatatcccagcctgtcaatgtgtcctttcaagggggc

SEQ ID NO: 245966 - DNA, 75 bp, Artificial Sequence
  Synthetic
tttgttgcaaacgcaggtcaaataatagtgacaaacccttttgacatttcagctgagttggggcaaattaacaac

SEQ ID NO: 245967 - DNA, 75 bp, Artificial Sequence
  Synthetic
tagtgacaaacccttttgacatttcagctgagttggggcaaattaacaactctctcaatgatgcacagggattcc

SEQ ID NO: 245968 - DNA, 75 bp, Artificial Sequence
  Synthetic
ttgaccaaagcaataactggctaaaagtcagtgggtggataaacaactcagggagcctatttatagccgggatag

SEQ ID NO: 245969 - DNA, 75 bp, Artificial Sequence
  Synthetic
tagtcataggattgattgtactttgcatagtaatcattatctatatcaatgttcaaattatccgagaggtaaatc

SEQ ID NO: 245970 - DNA, 75 bp, Artificial Sequence
  Synthetic
gcctaagaagctttatctatagggactatgtcctagatcacgataaagctccgtacagtcctgagtcaagttcac

SEQ ID NO: 245971 - DNA, 75 bp, Artificial Sequence
  Synthetic
cccacaggaaatcattgaagactgtcagttaagctgatagagccgtaccatccgatcttcagagaacttgacata

SEQ ID NO: 245972 - DNA, 75 bp, Artificial Sequence
  Synthetic
aaaagactttctgatgagattcaagaaaaaacaaatatgagctagaaaactgcttaccctaaagattaactccat

SEQ ID NO: 245973 - DNA, 75 bp, Artificial Sequence
  Synthetic
aaacactatgactgccttcagatggatattcgcagtgaagtgagcccgaataaatatcacatcaggctattaaag

SEQ ID NO: 245974 - DNA, 75 bp, Artificial Sequence
  Synthetic
gttgcaggattgaacatgtggaacagtattcctcaacttgtctcagatcatgaagaggcgaaaggcaagtttacg

SEQ ID NO: 245975 - DNA, 75 bp, Artificial Sequence
  Synthetic
gatataccattacaggatgatactgactctcaacatccatcaggctccaaaagcacatgcaggactttattccgg

SEQ ID NO: 245976 - DNA, 75 bp, Artificial Sequence
  Synthetic
acagtatcaattattttatccctcgtcattcttgttcttggggttacaagtaccatgttttctgcaaagtactcg

SEQ ID NO: 245977 - DNA, 75 bp, Artificial Sequence
  Synthetic
taccatgttttctgcaaagtactcgggaggttgtgcaactaatagtcaactgctaggggtaagtaatttgatcaa

SEQ ID NO: 245978 - DNA, 75 bp, Artificial Sequence
  Synthetic
tcagatccaaaaatcaattgattccttaatctctgaagtgaatcaagtcagcattactactgctgtaaccctacc

SEQ ID NO: 245979 - DNA, 75 bp, Artificial Sequence
  Synthetic
cattaagattatggattttggtaagtcggtcactgatcaggtcactcaaatgattcgccaatgcaatacagtctg

SEQ ID NO: 245980 - DNA, 75 bp, Artificial Sequence
  Synthetic
caagggtccaggacagaagccaggaagccagaatgtcagaattatgccatcaaataatttgtcaacatttcagaa

SEQ ID NO: 245981 - DNA, 75 bp, Artificial Sequence
  Synthetic
tattaatatgagcgcaaggggaattgcttatcaagatgtccccctcacctttgtacggcctattaaaaaccccca

SEQ ID NO: 245982 - DNA, 75 bp, Artificial Sequence
  Synthetic
ttgtacggcctattaaaaacccccagagctgctctcgatttcccagctatagtgtatcctttggtgttcactgct

SEQ ID NO: 245983 - DNA, 75 bp, Artificial Sequence
  Synthetic
ttgcaaatgctgtcactgatcagacttgtgagttgaaccagaatacgttttaccgggtggttttaagtgtgagta

SEQ ID NO: 245984 - DNA, 75 bp, Artificial Sequence
  Synthetic
aggggaatatatctgacccttcaagcctcgaaaccaaagccgagactaggaccccaaagggaactccggtaagaa

SEQ ID NO: 245985 - DNA, 75 bp, Artificial Sequence
  Synthetic
cctgctcgataattagctcagtatatggatgttacttgctatgctccaaggccactgtccctgaatcggaagaga

SEQ ID NO: 245986 - DNA, 75 bp, Artificial Sequence
  Synthetic
tgaaaacaataggcttttctcaaatgttcatactctatctatcaatggattcaaaacgcataatatacgacaaca

SEQ ID NO: 245987 - DNA, 75 bp, Artificial Sequence
  Synthetic
ttgtctcatccaccagtgccatttggagtggactgtatccaggagagggtgcaggaatttggcatatgggacaat

SEQ ID NO: 245988 - DNA, 75 bp, Artificial Sequence
  Synthetic
tattctttccactttgggggggaattccttttttgaccccactaggacaaaaaatattaaattccacattggata

SEQ ID NO: 245989 - DNA, 75 bp, Artificial Sequence
  Synthetic
tacctgaggtaggatccaaatgtaagagtgatcttacctccaaccctgctaagaccaaagacatgttattcagtc

SEQ ID NO: 245990 - DNA, 75 bp, Artificial Sequence
  Synthetic
cgtattatggggagaatgtaatggtgttcgggttcctaacatgctacttgttatctaatgttcctacaaattgcc

SEQ ID NO: 245991 - DNA, 75 bp, Artificial Sequence
  Synthetic
atgctgattaccttaattctactgtactcggatttggatcaaaggctcagttctatgattacagaggaatagtct

SEQ ID NO: 245992 - DNA, 75 bp, Artificial Sequence
  Synthetic
atatgtatatccagagtgctgggtggtatcccttcactcaaatctttcgcattacattgcaactcaagcaaaatc

SEQ ID NO: 245993 - DNA, 75 bp, Artificial Sequence
  Synthetic
gattgcaggccaaatcaatcaagcggatagaagtaacgagcactacaagaccgggaaaccgcgaatgtagtgtgt

SEQ ID NO: 245994 - DNA, 75 bp, Artificial Sequence
  Synthetic
tgcggaactgtccatacatttgtgccactggactctttcaggtaccatggattgtgaatagtgatgccatcacat

SEQ ID NO: 245995 - DNA, 75 bp, Artificial Sequence
  Synthetic
caaaggaagttgataacatggtgtttgtccaggcatgggcagctgatttcactgaattcagaaagggcatacttt

SEQ ID NO: 245996 - DNA, 75 bp, Artificial Sequence
  Synthetic
cgttatgcagtcaagtatcctgtccaattaatgacctactaagcaaggataatagttatatgcgtgacactacta

SEQ ID NO: 245997 - DNA, 75 bp, Artificial Sequence
  Synthetic
cttactgttttccgcagacagtgcccaacattctttcatgtacatcatttgtagagtggggtggagatagtggaa

SEQ ID NO: 245998 - DNA, 75 bp, Artificial Sequence
  Synthetic
acccgataaatattttagaaatacattatgaagttatttttgtggcatcataggattcctggcactctccgctag

SEQ ID NO: 245999 - DNA, 75 bp, Artificial Sequence
  Synthetic
agcacatgtcatcttctttctttaaactgatttactggcacaaagactaatcatttaagaaaaaagaaaatcaag

SEQ ID NO: 246000 - DNA, 75 bp, Artificial Sequence
  Synthetic
attgctagcatattatagatcgacagcagtcatggacatgccatggggagaaaaaggtgggccagaatggcgtgc

SEQ ID NO: 246001 - DNA, 75 bp, Artificial Sequence
  Synthetic
cccgagcagatcatcctccctgaggttcatcttgattcaccgattgtgagaaacaaacttctatattatatcaaa

SEQ ID NO: 246002 - DNA, 75 bp, Artificial Sequence
  Synthetic
gtcggcctgctgccaggctatcatgatacaatatggaattcagtcttcccagatatggactggaagcgggtcagg

SEQ ID NO: 246003 - DNA, 75 bp, Artificial Sequence
  Synthetic
agatatggactggaagcgggtcagggccgaggagtcacgtttatgtgatagattaacttgtgtcaaaaaaatact

SEQ ID NO: 246004 - DNA, 75 bp, Artificial Sequence
  Synthetic
gacaaagagtactctatgtcatgcccacaggagtaatggcagcctgtcgcaaatggtcctccgtgcagtagaatg

SEQ ID NO: 246005 - DNA, 75 bp, Artificial Sequence
  Synthetic
gcctgcaattataccagagcttaagtcatattgcatcccaaagtatctaagcagattctctgaagccaacagggt

SEQ ID NO: 246006 - DNA, 75 bp, Artificial Sequence
  Synthetic
tctaactgccgtgctgtcgtcattagtatctggtacagaaactcttttacagaatgtcagcttaaaattatgcgg

SEQ ID NO: 246007 - DNA, 75 bp, Artificial Sequence
  Synthetic
agaatgtcagcttaaaattatgcggaaaaccagatcttttacaccataatgaacgatattgcaggaaccatcatg

SEQ ID NO: 246008 - DNA, 75 bp, Artificial Sequence
  Synthetic
ctcatacacggccaaaatcagcccttgaacttagtcatctgtaccaatctaaccaatataccactctgttcaata

SEQ ID NO: 246009 - DNA, 75 bp, Artificial Sequence
  Synthetic
tgaacttagtcatctgtaccaatctaaccaatataccactctgttcaatacttggtttattatacgacaccagat

SEQ ID NO: 246010 - DNA, 75 bp, Artificial Sequence
  Synthetic
gaggtccctgataatgaaagtcaaaaacaacatcacgactgatttattagtgcatattgatgaccgaaattacgg

SEQ ID NO: 246011 - DNA, 75 bp, Artificial Sequence
  Synthetic
aacaacatcacgactgatttattagtgcatattgatgaccgaaattacggttatatcataacacctgaaatagtt

SEQ ID NO: 246012 - DNA, 75 bp, Artificial Sequence
  Synthetic
gttctctatgatagagaaaatgggattgtgtcctattttacttttgaaatggttctaatggtgactgacatgctg

SEQ ID NO: 246013 - DNA, 75 bp, Artificial Sequence
  Synthetic
gagggccgtatgaacatcttagtgattgctgactctagttgctaccttcatcctcttgttccccgcttgagctac

SEQ ID NO: 246014 - DNA, 75 bp, Artificial Sequence
  Synthetic
ctatttgaactagtagacaacctatgcccgattttgaagcagaacgtatattctctcatatcaaacttagagagc

SEQ ID NO: 246015 - DNA, 75 bp, Artificial Sequence
  Synthetic
ttgtcttatgctattctccagttatctgatcccgttcccgagttgaggggtgagttcctatcttttattaatggt

SEQ ID NO: 246016 - DNA, 75 bp, Artificial Sequence
  Synthetic
gagatcatagcaatcctgttagcaagtgattcttttactctggaggagtgtgaagttgttctacaaaaaatcttg

SEQ ID NO: 246017 - DNA, 75 bp, Artificial Sequence
  Synthetic
gactgttataccgggctcaaacctgatctagttgctgagatgctatgcgtgatgagactctggggacatccaatg

SEQ ID NO: 246018 - DNA, 75 bp, Artificial Sequence
  Synthetic
ttatcatcagcaactgctgcacgaaaagtccgtgaatccatgtgtgctccaaaagtgattgacctaactaccaat

SEQ ID NO: 246019 - DNA, 75 bp, Artificial Sequence
  Synthetic
ctcaagacattggcctttttcaatgggataattataaatggctatcggagaaaacataatggaatgtggccaaat

SEQ ID NO: 246020 - DNA, 75 bp, Artificial Sequence
  Synthetic
tgcagactcccgccgttctcatccgtgagtattcaggaattgaagcatgacaacatggaattatcttaccaatat

SEQ ID NO: 246021 - DNA, 75 bp, Artificial Sequence
  Synthetic
atactgtcgcactggaaagaagttgcaatgattgaatttgagaagagcatcgatgcagatccaggtgatgattta

SEQ ID NO: 246022 - DNA, 75 bp, Artificial Sequence
  Synthetic
caatgattgaatttgagaagagcatcgatgcagatccaggtgatgatttaagtattttcatgaaggataaagcaa

SEQ ID NO: 246023 - DNA, 75 bp, Artificial Sequence
  Synthetic
ttagtgctcccaaaaaagaatggatgagtgtgtttaggaaagtcttcacaaaacaaatatgtgaaaaatgccatg

SEQ ID NO: 246024 - DNA, 75 bp, Artificial Sequence
  Synthetic
aaacaaatatgtgaaaaatgccatgaaccaatccccaatgcattcaataggcgtcttctgcttaattttcttgca

SEQ ID NO: 246025 - DNA, 75 bp, Artificial Sequence
  Synthetic
gacgagacatttgatcctgcagtcgagctgcagtatgtaactactggtgcttacctcgatgatgaagaattctgt

SEQ ID NO: 246026 - DNA, 75 bp, Artificial Sequence
  Synthetic
gcctcatactcactcaaagagaaagaaatcaaagagactggaagaatttttgcaaaactaacaaagaagatgaga

SEQ ID NO: 246027 - DNA, 75 bp, Artificial Sequence
  Synthetic
tcatgccaagttatagctgaatcactactagcatcacacgcagggaagtttttcaaagagaacggtgtagtgttg

SEQ ID NO: 246028 - DNA, 75 bp, Artificial Sequence
  Synthetic
tactagcatcacacgcagggaagtttttcaaagagaacggtgtagtgttggatcaaatcagcataactaaaacac

SEQ ID NO: 246029 - DNA, 75 bp, Artificial Sequence
  Synthetic
tgctgactatgtctcagattggtttgatttcgaagaattctaggaggaatgtgagagacaatgtaaacattatga

SEQ ID NO: 246030 - DNA, 75 bp, Artificial Sequence
  Synthetic
ccccagccgattccaatactgaaactggttccacgaaaatgaaggacccgttcaactccagagagaagaaacctg

SEQ ID NO: 246031 - DNA, 75 bp, Artificial Sequence
  Synthetic
ttcaactccagagagaagaaacctgatgagattactgagcttgctgcatgctttctaaccactgatctgagtaaa

SEQ ID NO: 246032 - DNA, 75 bp, Artificial Sequence
  Synthetic
tactgtctaaattggcgctatcaatccataattatgtttgctaccaaccttaataagctgtacggttacgatcac

SEQ ID NO: 246033 - DNA, 75 bp, Artificial Sequence
  Synthetic
ttatttgagtggatccatttaaggctgatgagatctacattgtatgtaggtgatccattcaacccaccaaaaaac

SEQ ID NO: 246034 - DNA, 75 bp, Artificial Sequence
  Synthetic
atcacaactacagatctcgatgaaatggaaaacggagacatctttatcgtctctcctagaggagggattgaaggg

SEQ ID NO: 246035 - DNA, 75 bp, Artificial Sequence
  Synthetic
ttatgccaaaaaatgtggacaatgatatccatcgcagtaatagtcttatcagctacagaagccaagactagagtt

SEQ ID NO: 246036 - DNA, 75 bp, Artificial Sequence
  Synthetic
agctacagaagccaagactagagttatgagcttagtacaaggggacaatcaagcaatggcaataaccacattagt

SEQ ID NO: 246037 - DNA, 75 bp, Artificial Sequence
  Synthetic
tcctagatccctctcccatagcaccaaaaagaccattgcgtaccaaaatagtatggaatttgtgaatagactcag

SEQ ID NO: 246038 - DNA, 75 bp, Artificial Sequence
  Synthetic
actcaacaattttggtatgggtcatcatttgaaagaacaggagactatcattagttctgagtttattgtgtacag

SEQ ID NO: 246039 - DNA, 75 bp, Artificial Sequence
  Synthetic
caaaagaatcatatacaatggtagaatcctaaatcaagccctcaagaatgtgagcaaattgtgtcttatagccga

SEQ ID NO: 246040 - DNA, 75 bp, Artificial Sequence
  Synthetic
tgagcaaattgtgtcttatagccgacgtgatgggtgagagcactcaaacttcctgctcaaacctttccacaacta

SEQ ID NO: 246041 - DNA, 75 bp, Artificial Sequence
  Synthetic
taatgagactcacagaaaatggtgtggaaaaggatgtatgtttctttttaaatcagtatctaactgcaaaacagc

SEQ ID NO: 246042 - DNA, 75 bp, Artificial Sequence
  Synthetic
ttgtatatgatctcttgttcccaatgacgaaactatgtgaggatgaaactacagaatgctatctaaacaatccaa

SEQ ID NO: 246043 - DNA, 75 bp, Artificial Sequence
  Synthetic
tacttatatcaaggattataactatccctgctcaactaggtggcctaaacttttatgcattaactagactcttta

SEQ ID NO: 246044 - DNA, 75 bp, Artificial Sequence
  Synthetic
accgaaacattggggatcctctcacatccgccattgcagatgttaaaagatatgtacttgcaaagatgttaccaa

SEQ ID NO: 246045 - DNA, 75 bp, Artificial Sequence
  Synthetic
aatgggtcttgaagaacctgctttctagaagccctggagatggtgattggaatactcttgcctcagatccttatg

SEQ ID NO: 246046 - DNA, 75 bp, Artificial Sequence
  Synthetic
ctttaaacatcaactatctgtaccccccaacaacattccttaagaaacacacacagagggtcctcatagaaggga

SEQ ID NO: 246047 - DNA, 75 bp, Artificial Sequence
  Synthetic
gtgtaaatccaatgcttcgtggaatattcggagattcgaatctattagaggagaacaatctttccagatttttac

SEQ ID NO: 246048 - DNA, 75 bp, Artificial Sequence
  Synthetic
tggatagggaagttgtaatgccaagagttgcgcacatcataatggagcagtctgtgtgtgggaggaagaagcaaa

SEQ ID NO: 246049 - DNA, 75 bp, Artificial Sequence
  Synthetic
tacaagggtacttggataccacaaggactattatcagatatgcactctctaaacagcctcttggcttccataagc

SEQ ID NO: 246050 - DNA, 75 bp, Artificial Sequence
  Synthetic
taaataagattctagattacaataccctatttctgtcttacaatcttgattcaatcctgaagcccgtagtgaata

SEQ ID NO: 246051 - DNA, 75 bp, Artificial Sequence
  Synthetic
ctcagatcaaattgacaacatctctacttatacaaacctgcagtatagatcttgcaaagatggtgcgaaggctat

SEQ ID NO: 246052 - DNA, 75 bp, Artificial Sequence
  Synthetic
catggtcatcactacttgggggacgacaactggatgggcttgaaacccccgacccaattgaactcttatatggta

SEQ ID NO: 246053 - DNA, 75 bp, Artificial Sequence
  Synthetic
gtatgataacatcaggacagatttgtgatcactgtatggcaggtgataataagtatacatggctatttatacctg

SEQ ID NO: 246054 - DNA, 75 bp, Artificial Sequence
  Synthetic
cagggattgatatagctgcagatccagcagataatccaccaattagagttccttatatagggtccagaacagatg

SEQ ID NO: 246055 - DNA, 75 bp, Artificial Sequence
  Synthetic
ccttatatagggtccagaacagatgagagaagagtggcttctatgagttatgtgaaaggatcttccaattcactt

SEQ ID NO: 246056 - DNA, 75 bp, Artificial Sequence
  Synthetic
agagaagagtggcttctatgagttatgtgaaaggatcttccaattcacttaaatctgctctacggttatgcgggg

SEQ ID NO: 246057 - DNA, 75 bp, Artificial Sequence
  Synthetic
tatatatttgggcttttggggacacagaccaaaactggcaggatgcagttgaattggcacaaactcgtacagaga

SEQ ID NO: 246058 - DNA, 75 bp, Artificial Sequence
  Synthetic
taactgaggatcagatgagagtactcacacctttgcctactacagcaaatttaacgcatcgtctagatgatggat

SEQ ID NO: 246059 - DNA, 75 bp, Artificial Sequence
  Synthetic
ttaacgcatcgtctagatgatggattaacacagcaaaaattcactccagcaagctcctatatgttttcctcattt

SEQ ID NO: 246060 - DNA, 75 bp, Artificial Sequence
  Synthetic
gtgcatatatccaatgatagtcaaaatctagaagtcatggacaaaacgcttgactccaatctaatatatcaacaa

SEQ ID NO: 246061 - DNA, 75 bp, Artificial Sequence
  Synthetic
attatgttactcggattgggaataatcgaaacatggctccagctcccaaatgaacttaatagagaggatctaacc

SEQ ID NO: 246062 - DNA, 75 bp, Artificial Sequence
  Synthetic
atacatctacacacagcttcttcatgttgcatcaagccggttgatccatgtataattaatgaggccttaatccct

SEQ ID NO: 246063 - DNA, 75 bp, Artificial Sequence
  Synthetic
attccgcacttgagtgtcccaaaatttaacaagtttgtctttgatgcggctcctttgcaggacattgataagatc

SEQ ID NO: 246064 - DNA, 75 bp, Artificial Sequence
  Synthetic
actatcgagaacattcaatttgaagccgacatcagcgggattgatacgataccacaggcagataggctcaaggta

SEQ ID NO: 246065 - DNA, 75 bp, Artificial Sequence
  Synthetic
tttagccatttggtaggtatccagctaagcagaactcttactggattagatgaaattacatctcttgtcaatgat

SEQ ID NO: 246066 - DNA, 75 bp, Artificial Sequence
  Synthetic
gctgtggtagaggcagactactcagcaaactggattagtgaatgccttaatgctagattagatgaggtctttatc

SEQ ID NO: 246067 - DNA, 75 bp, Artificial Sequence
  Synthetic
tttgttgcatggaatttcctcctagatctttcttaccagttatattatttgaggatattagggtataattctatc

SEQ ID NO: 246068 - DNA, 75 bp, Artificial Sequence
  Synthetic
cttgattacctgtctgtcacactcagtcgaattcctggtttagcattgtcggggatttcgtcaactatcagtcat

SEQ ID NO: 246069 - DNA, 75 bp, Artificial Sequence
  Synthetic
ccaaaaatattgaggcggatgataaacttagagataatcaggccctataattccccttacctagcgacactgaat

SEQ ID NO: 246070 - DNA, 75 bp, Artificial Sequence
  Synthetic
tatacaaagatgtcatgcgatgcaatattatggggtgctaggcatgtcctcagtatgttgatgagtggcatagat

SEQ ID NO: 246071 - DNA, 75 bp, Artificial Sequence
  Synthetic
attgaaatcatcatcccgtctgagagttcatctgagataggtgatcggattttaaatcttgtcgcaagaaaattg

SEQ ID NO: 246072 - DNA, 75 bp, Artificial Sequence
  Synthetic
tctttaattgcatgcctatttgcaaaccaccatgacttgcccatagtgcgtggtatgacagctgaccaaaaatgc

SEQ ID NO: 246073 - DNA, 75 bp, Artificial Sequence
  Synthetic
ttggcactgactaacttcttagtgacacatatacagacaagtgccggggaactaagcggagagacaaaccttctc

SEQ ID NO: 246074 - DNA, 75 bp, Artificial Sequence
  Synthetic
cacatatacagacaagtgccggggaactaagcggagagacaaaccttctcaaggcaatacatgaaccgaagctga

SEQ ID NO: 246075 - DNA, 75 bp, Artificial Sequence
  Synthetic
ctgctttcccctgcaatttgttttatctgtcgagaaaattactaaattatattagagatagtcaatgggtccaac

SEQ ID NO: 246076 - DNA, 75 bp, Artificial Sequence
  Synthetic
aacagatactaaattattatgacagcaaaggatttgtggagcaccacgactcccccttaaacgttgacaatggag

SEQ ID NO: 246077 - DNA, 75 bp, Artificial Sequence
  Synthetic
tagacaacacaaccaagactgcaactctgacggcattggattgggcagtagaaatcttcaatctatcattccctc

SEQ ID NO: 246078 - DNA, 75 bp, Artificial Sequence
  Synthetic
aaaagaagaatcacacacctttatttgaggaggaaggattttccagtctcagagagagcgcagctcctcccactc

SEQ ID NO: 246079 - DNA, 75 bp, Artificial Sequence
  Synthetic
atcatatacttaggccagttggtttatcatctacatcatggtataaaggtctgagtgttgtggcctttctaagaa

SEQ ID NO: 246080 - DNA, 75 bp, Artificial Sequence
  Synthetic
acttaccaatacctgaaggtggacacctatacttggcagagggtagtggatcgatgatgacagtcattgaatcac

SEQ ID NO: 246081 - DNA, 75 bp, Artificial Sequence
  Synthetic
atttcccagcccaaagaatatattacaacagcctattttctagtggccagaatccgccacagagaaattttcagc

SEQ ID NO: 246082 - DNA, 75 bp, Artificial Sequence
  Synthetic
aatccgccacagagaaattttcagcctatgcccactcaatttgtagaaagtattgtgtaccaaaatatccaagat

SEQ ID NO: 246083 - DNA, 75 bp, Artificial Sequence
  Synthetic
tctgagtcagtgagtgatgatcaaatcttttatcctctatggagcggtgatggttgtcaaaccgatctcacaaag

SEQ ID NO: 246084 - DNA, 75 bp, Artificial Sequence
  Synthetic
actgagtgtacaaattttatcctgtctaaaattatatcatatagccttagcctgataaacatcgatttcgaggat

SEQ ID NO: 246085 - DNA, 75 bp, Artificial Sequence
  Synthetic
actagatctctaatgtcttctgaagtccataaggctcacataaataccctgatattagcaggtatgctcctcaaa

SEQ ID NO: 246086 - DNA, 75 bp, Artificial Sequence
  Synthetic
ccgaacgggatattgatagttaagacctacttaacaccattctgtagattcaaccacctgatcagaatgactcaa

SEQ ID NO: 246087 - DNA, 75 bp, Artificial Sequence
  Synthetic
cacatctttggattttgtcatgctcttagatcgtcttactctgatccgaattccgatgagatattcctgatattg

SEQ ID NO: 246088 - DNA, 75 bp, Artificial Sequence
  Synthetic
aggagatcagataatatcttatcacccctttcaagtgatgacttggctgcattttatgttaacaagacagagcag

SEQ ID NO: 246089 - DNA, 75 bp, Artificial Sequence
  Synthetic
tctacaatcttgaccactgctatcatgacatacatcaatgagaacctgcaatcccaacaaaaaagagtctcacaa

SEQ ID NO: 246090 - DNA, 75 bp, Artificial Sequence
  Synthetic
atcatacatgatcaaattctctatggaagatgtgatataaatgtagatgaccacataaatctcagtagattagga

SEQ ID NO: 246091 - DNA, 75 bp, Artificial Sequence
  Synthetic
tctagatcacagaccgccaagatacttgatatagataaatctgccaattacaatatatttctagacagaatcacg

SEQ ID NO: 246092 - DNA, 75 bp, Artificial Sequence
  Synthetic
cagctgataaccactttcttcaaggagctgatatcattgtatgaagacactcaaacagatagacagagtataatc

SEQ ID NO: 246093 - DNA, 75 bp, Artificial Sequence
  Synthetic
tattctgcttataatgtcagcactcaagggaagatctcaactggtatagacgtgatgactaaacagacactggat

SEQ ID NO: 246094 - DNA, 75 bp, Artificial Sequence
  Synthetic
atctcgatcaggaactggtgtctcataccaagaagctccgtaatccacttggtaaatgatttagaattggggatc

SEQ ID NO: 246095 - DNA, 75 bp, Artificial Sequence
  Synthetic
tataagatatcatctatactccctgtcaatttgttcatggatactacacctattaggaagcatttgattaggaaa

SEQ ID NO: 246096 - DNA, 75 bp, Artificial Sequence
  Synthetic
ctagggtacagccatatccagcagatgtacgatactaattttatgatcttccttgatcgtcccacacagaagcga

SEQ ID NO: 246097 - DNA, 75 bp, Artificial Sequence
  Synthetic
tgtacgatactaattttatgatcttccttgatcgtcccacacagaagcgaatctggaaatcagtgggttccgtga

SEQ ID NO: 246098 - DNA, 75 bp, Artificial Sequence
  Synthetic
ttttggagtacacccttaatgaagatacaccactcgatggtgacatactcttccctgatcaagatgacattgaac

SEQ ID NO: 246099 - DNA, 75 bp, Artificial Sequence
  Synthetic
tacaccactcgatggtgacatactcttccctgatcaagatgacattgaactcgatatctttggcgatgaaatata

SEQ ID NO: 246100 - DNA, 75 bp, Artificial Sequence
  Synthetic
tgaaatataatcagaacaaattttaaaatgttttttaagaaaaacattaaaatttttgtttattttccccttggt

SEQ ID NO: 246101 - DNA, 75 bp, Artificial Sequence
  Synthetic
ttcagggcgtttgagctcttcaccttggagcaagagcagaatgagcatggaaatgacattgaattacctcctgag

SEQ ID NO: 246102 - DNA, 75 bp, Artificial Sequence
  Synthetic
tgtttgcgcttaatcgctagtaattctgcccgtgctgcccataaaacgggggcaattcttactctattaagcttg

SEQ ID NO: 246103 - DNA, 75 bp, Artificial Sequence
  Synthetic
ctgcccgtgctgcccataaaacgggggcaattcttactctattaagcttgcccactgcgatgatgcaaaatcacc

SEQ ID NO: 246104 - DNA, 75 bp, Artificial Sequence
  Synthetic
ggctaagggcaaatgcaagaacccctatgacaaatggagaggtaacagcactcaaccttatggctcaggatctcc

SEQ ID NO: 246105 - DNA, 75 bp, Artificial Sequence
  Synthetic
aaatgcatgacagctcatgatcagcccactggatctgatgaaagaagactggcaaaatatcagcagcaagggaga

SEQ ID NO: 246106 - DNA, 75 bp, Artificial Sequence
  Synthetic
ctggatcagagatatgcactgcaacctgaactgagaaggcagatacagacctgcattcggtcaagcctcacaata

SEQ ID NO: 246107 - DNA, 75 bp, Artificial Sequence
  Synthetic
agacagttcctgacccatgagctgcagacagcacggaagcagggtgctataactggaaagtactacgccatggtc

SEQ ID NO: 246108 - DNA, 75 bp, Artificial Sequence
  Synthetic
ggagatattgggaggtacattgacaatgccggaatgagtgcatttttcatgacaatgagatttgcactcggaaca

SEQ ID NO: 246109 - DNA, 75 bp, Artificial Sequence
  Synthetic
aagtggcccccattagctcttgctgcattctcaggagaactccttaagcttaagtcattgatgcaactatacagg

SEQ ID NO: 246110 - DNA, 75 bp, Artificial Sequence
  Synthetic
agcttaggagatagggctcgctatatggcccttctggaaatgtctgagatgatggagtttgcaccggctaactac

SEQ ID NO: 246111 - DNA, 75 bp, Artificial Sequence
  Synthetic
cctctttgctacagttatgcaatggggattgggagtgtccaagatccgatgatgaggaactatacatttgccaga

SEQ ID NO: 246112 - DNA, 75 bp, Artificial Sequence
  Synthetic
ccattcttgaaccctgcatatttccaacttggagtggaaactgctaaccgccaacagggatcagtggacaaggca

SEQ ID NO: 246113 - DNA, 75 bp, Artificial Sequence
  Synthetic
agaggaggcaatcaagcacaagagttgatcaatgtgatgggtgctcgacagggaagagaccagagaggaagggga

SEQ ID NO: 246114 - DNA, 75 bp, Artificial Sequence
  Synthetic
aatcgcgactatgttgtagtagaggaagatgaggaaactgagagtgacagtgacaacgatgaagaccaggagatc

SEQ ID NO: 246115 - DNA, 75 bp, Artificial Sequence
  Synthetic
caaaatcgtccgctacccccaattccgcagatgccgcagaacatagattgggaagtgagactggcagagattgaa

SEQ ID NO: 246116 - DNA, 75 bp, Artificial Sequence
  Synthetic
aggagaaaccagcagatagctgcccgagatcggcctcaggcagttgtaactgcagatgtccaccaagaaccagca

SEQ ID NO: 246117 - DNA, 75 bp, Artificial Sequence
  Synthetic
ggtgccagagtagacgagcaagacatgctactcgatcttgacatgtaacaagctggcaatctttcatctactgaa

SEQ ID NO: 246118 - DNA, 75 bp, Artificial Sequence
  Synthetic
taagctgttcccacttaatttaaccctatcaactccactaggagctttgcttgtagtttgctattagttgttaag

SEQ ID NO: 246119 - DNA, 75 bp, Artificial Sequence
  Synthetic
aagtgttttaaagaaaacttaggaaaaggacaaatgagcccgaacagggtaaaagcgtgggcctttccctagttc

SEQ ID NO: 246120 - DNA, 75 bp, Artificial Sequence
  Synthetic
gggtagtctagtgctctacaccagactataaaagttgtttctattgctcctgcatctgcacgtccatcttaaaac

SEQ ID NO: 246121 - DNA, 75 bp, Artificial Sequence
  Synthetic
tgcatctgcacgtccatcttaaaaccttgaaagctatggataacccaccctctgacgctgaaatctctgcctgga

SEQ ID NO: 246122 - DNA, 75 bp, Artificial Sequence
  Synthetic
gctggcgccgtggcacaaagtggagagaagggggacagagacaaagcaaagaaggaagtaaccaccgcggcacca

SEQ ID NO: 246123 - DNA, 75 bp, Artificial Sequence
  Synthetic
gagcctgcagtccgtgagaaagtccgtcccattgatgtggagccaagtgatgacatatacgaagaagtaattcct

SEQ ID NO: 246124 - DNA, 75 bp, Artificial Sequence
  Synthetic
atttaagagggggaaaggatttgagacatggcccaagcgacatcggaccgggggccacaggagggaaatcgcaat

SEQ ID NO: 246125 - DNA, 75 bp, Artificial Sequence
  Synthetic
gtcacagagtggtgcaacccaatatgtcacccaatctcccagtcaaccttccgaggtaactgccgatgtggaaat

SEQ ID NO: 246126 - DNA, 75 bp, Artificial Sequence
  Synthetic
tgactggaaagtggataaaattctctctcagcagtctgtcattactcaaatcaaacatgagcaacatgcaatcaa

SEQ ID NO: 246127 - DNA, 75 bp, Artificial Sequence
  Synthetic
agcaggaatagccactttagagggtctcatcaccaccatcaagattatggaccctggagtaggtgatggcgccac

SEQ ID NO: 246128 - DNA, 75 bp, Artificial Sequence
  Synthetic
cgcagccaaatcaaagaggttatttaaagaagctcctgtagttgtgagtggaccggtcattggagagaaccccat

SEQ ID NO: 246129 - DNA, 75 bp, Artificial Sequence
  Synthetic
tgttgatgctgacaccattcaattggatgagctggcccgcccgtctcttcccaaaacaaaatctcagaagactgg

SEQ ID NO: 246130 - DNA, 75 bp, Artificial Sequence
  Synthetic
agcagcctcaccagcagccttatccggctataagatgacattactggctcttatcaaggaatgcattcccaatca

SEQ ID NO: 246131 - DNA, 75 bp, Artificial Sequence
  Synthetic
ggcacaacgccaaaagtttgaaatgcaagtcggaggaatacgaaatgagcaagatttcaagaatctccgccgaga

SEQ ID NO: 246132 - DNA, 75 bp, Artificial Sequence
  Synthetic
gataatccgcagtgctgcccaataatcaccttatactatactgcatcctgctaattcagcacagtttgatcaatc

SEQ ID NO: 246133 - DNA, 75 bp, Artificial Sequence
  Synthetic
accgcaattaattagcaactattaactgcttcttatgccaggctttgcttatctgcgactcttttttgagcttta

SEQ ID NO: 246134 - DNA, 75 bp, Artificial Sequence
  Synthetic
agaaaaaataagtgagcccgaaccagttaagaagggctcactccgaccatggcgcttagacaagcaaccatacct

SEQ ID NO: 246135 - DNA, 75 bp, Artificial Sequence
  Synthetic
ggcgcttagacaagcaaccatacctgttgatgtggacaaagacagtgaaaagaataatctcaacccattccctat

SEQ ID NO: 246136 - DNA, 75 bp, Artificial Sequence
  Synthetic
aaaaggatccaccgagcttccgctttcctttgtgaacacttatggattcatcaagccgttgctcacatactcaga

SEQ ID NO: 246137 - DNA, 75 bp, Artificial Sequence
  Synthetic
gttttattctgaagtccaccaccaggcatctactccctgcctcactgcatgcatgatcccgttcggtgcgggccc

SEQ ID NO: 246138 - DNA, 75 bp, Artificial Sequence
  Synthetic
gtacatcgagaacccccacaggattctagatgaatgtgacaaagtcaacatcatcgtgagaaagagtgcaagctt

SEQ ID NO: 246139 - DNA, 75 bp, Artificial Sequence
  Synthetic
aaaggaagaaatagtctttgatgtcaggaggctaccccccatcttcaacaagcaccaaatatctgggaacagatt

SEQ ID NO: 246140 - DNA, 75 bp, Artificial Sequence
  Synthetic
gatctgtgttccctcagaaaagtatgtgaagtctccggggaaaatggttgctggaacagattacgcttaccaaat

SEQ ID NO: 246141 - DNA, 75 bp, Artificial Sequence
  Synthetic
tgcatttgtctcacttacattttgtccggaaagtcaaaagttcagagttgcaaggcccttacagaccattcgatc

SEQ ID NO: 246142 - DNA, 75 bp, Artificial Sequence
  Synthetic
accaatcatgagaagtgtccaattggaagtgatgctgcgaattgactgtgctgccaactcaccgctgaaaagatt

SEQ ID NO: 246143 - DNA, 75 bp, Artificial Sequence
  Synthetic
gctgattgtaaatcctggctctactgattactatgcctctgtatggtttcacatttgcaacctttacaggggtaa

SEQ ID NO: 246144 - DNA, 75 bp, Artificial Sequence
  Synthetic
caagccattcaaatcttatgatgatacctatttcagccaaaaatgcagagctatgcagcttgagtgcggaattgt

SEQ ID NO: 246145 - DNA, 75 bp, Artificial Sequence
  Synthetic
tgatatgtggggtcccacactggttgtgaaggcacatgggaaaatccctaagatggcaaagcctttcttcagtgc

SEQ ID NO: 246146 - DNA, 75 bp, Artificial Sequence
  Synthetic
aaaagggtgggcttgccatgcgttttcagatgcagccccaacactggcaaaagctctgtggtcagtaggagctaa

SEQ ID NO: 246147 - DNA, 75 bp, Artificial Sequence
  Synthetic
gatcacccaagtgaatgcaatcctgcaaccatccgagctgagccaaatggtccaagtaagtgatgtgatatggcc

SEQ ID NO: 246148 - DNA, 75 bp, Artificial Sequence
  Synthetic
aaaggtcaaactggacaaccggattcaagactattctgctgcaaaatggaacccttttaagaagccttgactcag

SEQ ID NO: 246149 - DNA, 75 bp, Artificial Sequence
  Synthetic
aatcgtctgaatatctctattaccaacttataacccaataagtttactgtatgatcatcttgcaggacccacttg

SEQ ID NO: 246150 - DNA, 75 bp, Artificial Sequence
  Synthetic
ctattgccaccctacaattaaaagctaattcaacgaatgcattgctttaccgcacatcaactgacatggtatttc

SEQ ID NO: 246151 - DNA, 75 bp, Artificial Sequence
  Synthetic
aaatttaaggactccgccacagcatatgacagcagctcaaaggcaactccctctacacaactcaccgcacaattc

SEQ ID NO: 246152 - DNA, 75 bp, Artificial Sequence
  Synthetic
ctcttccatcgcctaaccttctgctagtttaataaaaaatttgagaagtgaaatgcacacacacaacaaccggaa

SEQ ID NO: 246153 - DNA, 75 bp, Artificial Sequence
  Synthetic
aagagcacgaacaggtgcacccacacatcaccccacagcaaccaacctgcctgtcatccaaagcatcatgatacc

SEQ ID NO: 246154 - DNA, 75 bp, Artificial Sequence
  Synthetic
ccgtgttttagggataatcgtgctttatttaacccattctcagatactatgcattaacagaaatactctttacca

SEQ ID NO: 246155 - DNA, 75 bp, Artificial Sequence
  Synthetic
gatcggcctaatacacaggtccgtcaaaaaggtcaatttttacagccagggatccccttcttatatagttgttaa

SEQ ID NO: 246156 - DNA, 75 bp, Artificial Sequence
  Synthetic
attggtgcccactcttgctgcaatcccgcctaactgcagtatcaaaagcctgcaaagatataaagaaactgtaac

SEQ ID NO: 246157 - DNA, 75 bp, Artificial Sequence
  Synthetic
ttccttagttcagcctatctcggataacctaggatacttgcaggataagcttgttacaggccaatcaagaaggcg

SEQ ID NO: 246158 - DNA, 75 bp, Artificial Sequence
  Synthetic
cagacgatttgcaggtgtggccatagggctagcagccctaggagtagctgctgcagctcaagcaaccgctgccgt

SEQ ID NO: 246159 - DNA, 75 bp, Artificial Sequence
  Synthetic
tgcactggtggagactagagagaatgcaggtaagatccaggcattatcagaatccatccagaatactaatcaagc

SEQ ID NO: 246160 - DNA, 75 bp, Artificial Sequence
  Synthetic
agtacacagcctgaagacagcattaggcttctcggcaacagcaattcaagcaatccaaaatcaagttaatgaggt

SEQ ID NO: 246161 - DNA, 75 bp, Artificial Sequence
  Synthetic
cattaatccagcaattaacaagctgagttgtgaagtactggattctcagttagcttcaatgcttaatttatattt

SEQ ID NO: 246162 - DNA, 75 bp, Artificial Sequence
  Synthetic
gatccacttaactacggtcttccagacacagctgaccaatcctgctctcacaccactgagcatccaagcactgac

SEQ ID NO: 246163 - DNA, 75 bp, Artificial Sequence
  Synthetic
aagtgtgctccaagggacgtcaggggtattgatgaattcaaccaactccaccttaacccaaccaatggacttact

SEQ ID NO: 246164 - DNA, 75 bp, Artificial Sequence
  Synthetic
gtattgatgaattcaaccaactccaccttaacccaaccaatggacttacttgccacagggttgattacggggcaa

SEQ ID NO: 246165 - DNA, 75 bp, Artificial Sequence
  Synthetic
gcagtgctccattccttctttagaattaccacatcagtcaatttaactgaggtgatgatccaatcgccagaattt

SEQ ID NO: 246166 - DNA, 75 bp, Artificial Sequence
  Synthetic
ataatggagcaaaatggggtattctatgactttaatacagcccattgtcaattaggtgacaataatgtttattgt

SEQ ID NO: 246167 - DNA, 75 bp, Artificial Sequence
  Synthetic
ccgtatattgatgcggctcgcttatcaagcacgatgacaaattgtattaacggcaagttaggtgattgcgtattt

SEQ ID NO: 246168 - DNA, 75 bp, Artificial Sequence
  Synthetic
tctagggtaattggatctttcccatcgcggtttgtatctctcaatggagcaattttggcaaattgtaaattcatg

SEQ ID NO: 246169 - DNA, 75 bp, Artificial Sequence
  Synthetic
aggtgcaattgtcttgcaccggaaaaaattataacccccttggatggtgaaatgatctcgttgatagatttgagg

SEQ ID NO: 246170 - DNA, 75 bp, Artificial Sequence
  Synthetic
gtatgccaaaaattaacattagggacaattacattcgagatatcccagcctgttaatgtgtcttttcaagggggc

SEQ ID NO: 246171 - DNA, 75 bp, Artificial Sequence
  Synthetic
tttgttgcaaatgcaggtcagataatagtgacgaacccttttgacatttcagctgagttggggcaaatcaataac

SEQ ID NO: 246172 - DNA, 75 bp, Artificial Sequence
  Synthetic
tagtgacgaacccttttgacatttcagctgagttggggcaaatcaataactccctcaatgatgcacagggatttc

SEQ ID NO: 246173 - DNA, 75 bp, Artificial Sequence
  Synthetic
tagtcataggattgattgtgctttgtatagtaatcattatctatatcaatgttcaaattattcgagaagtaaatc

SEQ ID NO: 246174 - DNA, 75 bp, Artificial Sequence
  Synthetic
gcctaaggagctttatctatagggactatgtcctagatcatgataaagctccgtacagtcctgagctaagttcac

SEQ ID NO: 246175 - DNA, 75 bp, Artificial Sequence
  Synthetic
ctcataggaaatcattgaagactgtcagttaagctgactgagccatatcatccgatctccagagaatttaacata

SEQ ID NO: 246176 - DNA, 75 bp, Artificial Sequence
  Synthetic
aaaagattttctaacgagattcaagaaaaaacgaatataagctagaaaactgtttaccataaagattaactccct

SEQ ID NO: 246177 - DNA, 75 bp, Artificial Sequence
  Synthetic
acatactataactgccctcagacggatattagcagtgaagtgagcccgaacaaatatcacatcaggcaatcaaag

SEQ ID NO: 246178 - DNA, 75 bp, Artificial Sequence
  Synthetic
gctacaggattgaacatgtggaatagtattcctcaacttgtctcagatcatgatggggcaaaaggcaagtttacg

SEQ ID NO: 246179 - DNA, 75 bp, Artificial Sequence
  Synthetic
gatatacccttacaggatgatactgactctcaacagccaccaggctccaaaagcacatgcaggactttgttccgg

SEQ ID NO: 246180 - DNA, 75 bp, Artificial Sequence
  Synthetic
acagtattaataattttatccctcatcattcttgttcttggggttacaagtactatgttttctgcaaagtactcg

SEQ ID NO: 246181 - DNA, 75 bp, Artificial Sequence
  Synthetic
tactatgttttctgcaaagtactcgggaagttgtgcaactaatagtcaactgctaggggtaagtaatttgattaa

SEQ ID NO: 246182 - DNA, 75 bp, Artificial Sequence
  Synthetic
caagggtccggggcagaagccaggaagccagaatgtcagaataatgccatcaaataatctgtcgacatttcagaa

SEQ ID NO: 246183 - DNA, 75 bp, Artificial Sequence
  Synthetic
tattaatatgagcgcaaggggaattgcttatcaagatgtccccctcacctttgtacggcctattaaaaacccaaa

SEQ ID NO: 246184 - DNA, 75 bp, Artificial Sequence
  Synthetic
ttgtacggcctattaaaaacccaaagagctgctcccgatttcccagctatagtgtatcttttggtgttcattgct

SEQ ID NO: 246185 - DNA, 75 bp, Artificial Sequence
  Synthetic
aggggaatatatctgacccttcaagcctcgaaaccaaagcagagactagaaccccaaaaggaactccagtaagaa

SEQ ID NO: 246186 - DNA, 75 bp, Artificial Sequence
  Synthetic
cctgctcaataatcagctcagtatatggatgttacttgctatgctccaaggctactatccccgaatcggaagaga

SEQ ID NO: 246187 - DNA, 75 bp, Artificial Sequence
  Synthetic
tgaaaacagtaggcttttctcaaatgtttatactctatctggcaatggattcaaaacgcatactatatgacaaca

SEQ ID NO: 246188 - DNA, 75 bp, Artificial Sequence
  Synthetic
tgttctttccactttgggggggaatcccttttttaacccctctaggacaaaaaatactaaattccacattggata

SEQ ID NO: 246189 - DNA, 75 bp, Artificial Sequence
  Synthetic
tacctgaggtaggatccaaatgtaagagtgctcttaccaccagccctgctaagaccaaagatatgttattcagtc

SEQ ID NO: 246190 - DNA, 75 bp, Artificial Sequence
  Synthetic
cgtattatggggagaatgtaatggtgttcgggtttctaacatgttacctattatctaatgttccaacaaactgcc

SEQ ID NO: 246191 - DNA, 75 bp, Artificial Sequence
  Synthetic
atgctgattatcttaattctactgtactcggattcggatcaaaggctcagttctatgattatagaggaatagtat

SEQ ID NO: 246192 - DNA, 75 bp, Artificial Sequence
  Synthetic
atatgtatatacagagtgctgggtggtatccctacactcaaatcttccgcattacattgcaactcaagcaaaatc

SEQ ID NO: 246193 - DNA, 75 bp, Artificial Sequence
  Synthetic
gattgcaggccaaatcaatcaagcggatagaagtgacaagcactacaagaccaggaaacctcgaatgtagtgtgt

SEQ ID NO: 246194 - DNA, 75 bp, Artificial Sequence
  Synthetic
tgtggaactgtccatacatttgtgccactggactctttcaggcaccatggattgtaaatagtgatgccatcacac

SEQ ID NO: 246195 - DNA, 75 bp, Artificial Sequence
  Synthetic
caaaagaagttgataacatggtgtttgtacaggcatggtcagctgatttcactgaattcaggaagggcatacttt

SEQ ID NO: 246196 - DNA, 75 bp, Artificial Sequence
  Synthetic
cgttatgcagtcaagtatcctgcccgattaatgacctgctaagcaaggataatagttatatgcgtgacactacta

SEQ ID NO: 246197 - DNA, 75 bp, Artificial Sequence
  Synthetic
cttactgttttccacagacagtgcccaacactcttccatgtacatcatttgtagaatggggtggggatagtggaa

SEQ ID NO: 246198 - DNA, 75 bp, Artificial Sequence
  Synthetic
acccaataaatattttagaaatacattatgaagttatttttgtggcatcataatattcctggcactctccgctag

SEQ ID NO: 246199 - DNA, 75 bp, Artificial Sequence
  Synthetic
agcacatgttatattctttcttttaactgattcactggcacaaagactaatcatttaagaaaaaagaaaatcaag

SEQ ID NO: 246200 - DNA, 75 bp, Artificial Sequence
  Synthetic
actgctagcacattataaatcaacagcagttatggacataccatggggagaaaaggctgggccagaatggcgtgc

SEQ ID NO: 246201 - DNA, 75 bp, Artificial Sequence
  Synthetic
cccgagcagatcatcctccccgaggttcatctcgactcaccaattgtgaaaaataaactcctatattatatcaaa

SEQ ID NO: 246202 - DNA, 75 bp, Artificial Sequence
  Synthetic
gtcggcctgctgccaggctatcatgatacaatatggaactcagtcttcccagatacagattggaagcgggtcagg

SEQ ID NO: 246203 - DNA, 75 bp, Artificial Sequence
  Synthetic
agatacagattggaagcgggtcagggccgaggagtcgcgtttatgtgataggttaactcgtgttaagaaaatact

SEQ ID NO: 246204 - DNA, 75 bp, Artificial Sequence
  Synthetic
tctaactgccgtgctatcgtcattagtatctggtacagaaactcttttacagaatgtcagcttaaaattgtgtgg

SEQ ID NO: 246205 - DNA, 75 bp, Artificial Sequence
  Synthetic
agaatgtcagcttaaaattgtgtggaagaccagatcttttaaaccataatgaacaatattgtagaaaccatcatg

SEQ ID NO: 246206 - DNA, 75 bp, Artificial Sequence
  Synthetic
gagggtcgtatgaatatcctagtaattgctgactctagttgctacctccatcctcttgttccccgcctgagttac

SEQ ID NO: 246207 - DNA, 75 bp, Artificial Sequence
  Synthetic
ctctttgaactagtagacaacctatgcccgattttgaagcagaacgtatattctcttatatcaaacctagagagc

SEQ ID NO: 246208 - DNA, 75 bp, Artificial Sequence
  Synthetic
ttgtcttatgccattctccagttatctgatcccgttcccgagttgagaggtgagtttctatcttttattaatggt

SEQ ID NO: 246209 - DNA, 75 bp, Artificial Sequence
  Synthetic
gagatcatagcaatcctgttagcaagtgattcttttactctggaagagtgtgaagttgtcctaaaaaaaatcctg

SEQ ID NO: 246210 - DNA, 75 bp, Artificial Sequence
  Synthetic
gactgttataccgggctaaaacctgatctagttgctgaaatgctatgtgtaatgagactctggggacatccaatg

SEQ ID NO: 246211 - DNA, 75 bp, Artificial Sequence
  Synthetic
ttatcatcagcaaccgctgcacgaaaagtccgtgagtccatgtgtgctccaaaagtgattgacctaaccaccaat

SEQ ID NO: 246212 - DNA, 75 bp, Artificial Sequence
  Synthetic
ctcaagacattggcatttttcaatgggataattataaatggctatcggagaaaacacaatggaatgtggccaaat

SEQ ID NO: 246213 - DNA, 75 bp, Artificial Sequence
  Synthetic
tgcaaactcccgccgttctcatctgtgagtattcaggaattaaagcatgacaacatggaattatcttaccaatat

SEQ ID NO: 246214 - DNA, 75 bp, Artificial Sequence
  Synthetic
atactatcacactggaaagaagttgcaatgattgaatttgagaaaagcatcgacgcagatccaggtgatgatttg

SEQ ID NO: 246215 - DNA, 75 bp, Artificial Sequence
  Synthetic
caatgattgaatttgagaaaagcatcgacgcagatccaggtgatgatttgagtattttcatgaaagataaagcaa

SEQ ID NO: 246216 - DNA, 75 bp, Artificial Sequence
  Synthetic
gacgaaacatttgaccccgcagtcgagctacagtatgtaaccactggtgcttaccttgatgatgaagaattctgt

SEQ ID NO: 246217 - DNA, 75 bp, Artificial Sequence
  Synthetic
gcctcatattcactcaaagagaaagaaataaaagaaactggaagaatctttgcaaaattaacaaagaagatgagg

SEQ ID NO: 246218 - DNA, 75 bp, Artificial Sequence
  Synthetic
tcatgccaagttatagctgaatcactactagcatcacacgcagggaagtttttcaaagagaatggtgtcgtgttg

SEQ ID NO: 246219 - DNA, 75 bp, Artificial Sequence
  Synthetic
tactagcatcacacgcagggaagtttttcaaagagaatggtgtcgtgttggatcagatcagtataactaagacac

SEQ ID NO: 246220 - DNA, 75 bp, Artificial Sequence
  Synthetic
ctccggccaattctaatactgaaactggctccacaagaacgagggacccgttccactccagagagaagaaacctg

SEQ ID NO: 246221 - DNA, 75 bp, Artificial Sequence
  Synthetic
ttccactccagagagaagaaacctgatgagattactgagcttgctgcatgcttcctaaccaccgatctgagtaaa

SEQ ID NO: 246222 - DNA, 75 bp, Artificial Sequence
  Synthetic
ttatttgagtggattcatttaaggctaatgagatctacattgtatgtaggcgatccattcaacccaccaaaaaac

SEQ ID NO: 246223 - DNA, 75 bp, Artificial Sequence
  Synthetic
atcacaaccacggatctcgatgaaatggaaaacggagacatctttattgtctcccctagaggagggattgaaggg

SEQ ID NO: 246224 - DNA, 75 bp, Artificial Sequence
  Synthetic
ttatgccaaaaaatgtggacaatgatatctatagcagtaatagttttatcagctacagaagccaagactagagtt

SEQ ID NO: 246225 - DNA, 75 bp, Artificial Sequence
  Synthetic
agctacagaagccaagactagagttatgagcttagtgcaaggggacaatcaagcaatggcaatcaccacattagt

SEQ ID NO: 246226 - DNA, 75 bp, Artificial Sequence
  Synthetic
caaaaggatcatatataatggtagaatcctaaatcaagccctcaagaatgtgagcaaattgtgccttatagctga

SEQ ID NO: 246227 - DNA, 75 bp, Artificial Sequence
  Synthetic
tgagcaaattgtgccttatagctgatgtgatgggcgagagcactcaaacttcctgctcaaatctttccacaacca

SEQ ID NO: 246228 - DNA, 75 bp, Artificial Sequence
  Synthetic
ttgtatatgatctcttgtttcccatgacaaaactatgtgaagatgaaactacagaatgctatctaaataatccaa

SEQ ID NO: 246229 - DNA, 75 bp, Artificial Sequence
  Synthetic
tacttatatcaaggatcattactatccctgctcaactaggtggcctaaacttttatgcattaactagactcttta

SEQ ID NO: 246230 - DNA, 75 bp, Artificial Sequence
  Synthetic
atcgaaacattggagatcctctcacatccgctattgcagatgttaaaagatatgtacttgcaaagatgttgccaa

SEQ ID NO: 246231 - DNA, 75 bp, Artificial Sequence
  Synthetic
aatgggtcttgaagaacctgctttctaggagccctggagatggtgattggaacactcttgcttcagatccctatg

SEQ ID NO: 246232 - DNA, 75 bp, Artificial Sequence
  Synthetic
ctttaaacatcaattatctgtaccccccaacaaccttccttaagaagcacacacagagagtcctcatggaaggga

SEQ ID NO: 246233 - DNA, 75 bp, Artificial Sequence
  Synthetic
tggacagggaagttgtaatgccaagagttgcacacatcataatggagcagtctgtatgtgggaggaagaagcaaa

SEQ ID NO: 246234 - DNA, 75 bp, Artificial Sequence
  Synthetic
tacaagggtacctggataccacaagaactattattagatatgcactctctaaacaacctctcggcttccataagc

SEQ ID NO: 246235 - DNA, 75 bp, Artificial Sequence
  Synthetic
ttaataagatcctagattacaataccctatttctgtcttacaatcttgattcaatcttgaagcctgcagtgaaca

SEQ ID NO: 246236 - DNA, 75 bp, Artificial Sequence
  Synthetic
ctcagatcaaattaacaacatctctacttatacaaacctgcagtatagatcttgcaaagatggtacgacggctat

SEQ ID NO: 246237 - DNA, 75 bp, Artificial Sequence
  Synthetic
catggtcatcattactgggaggacgacaactggatgggcttgaaacccccgacccaattgaacttttgtatggaa

SEQ ID NO: 246238 - DNA, 75 bp, Artificial Sequence
  Synthetic
agagaagagtggcttctatgagttatgtgaaaggatcttccaactcacttaaatctgctctacggctatgtgggg

SEQ ID NO: 246239 - DNA, 75 bp, Artificial Sequence
  Synthetic
gtgcatatatccaatgatagtcagaatctagaagtcatggacaaaacacttgactccaatctaatataccagcaa

SEQ ID NO: 246240 - DNA, 75 bp, Artificial Sequence
  Synthetic
atcatgttactcggattgggaataattgaaacatggctccagctcccaaatgaacttaatagagaggacataact

SEQ ID NO: 246241 - DNA, 75 bp, Artificial Sequence
  Synthetic
attccgcatttaagtgtcccaaaattcaacaaatttgtcttcgatgcggttcctttacaggacattgataagatc

SEQ ID NO: 246242 - DNA, 75 bp, Artificial Sequence
  Synthetic
actattgagaacattcaatttgaagctgatatcagcgggattgatacgataccacaagcagataggctcaaggta

SEQ ID NO: 246243 - DNA, 75 bp, Artificial Sequence
  Synthetic
ttcagccatttggtaggtattcagctaagcagaactcttactggattagatgaaattacatctcttgtcaatgat

SEQ ID NO: 246244 - DNA, 75 bp, Artificial Sequence
  Synthetic
gctgtggtagaggcagattattcagcaaattggattagtgagtgtctaaatgctaggttagatgaggtctttatc

SEQ ID NO: 246245 - DNA, 75 bp, Artificial Sequence
  Synthetic
ttcgttgcatggaatttcctattagatctgtcttaccagttatactatttgaggatattagggtataattctatc

SEQ ID NO: 246246 - DNA, 75 bp, Artificial Sequence
  Synthetic
cttgactacctgtctgttacactcagtcgaattcctggtttagcactgtcagggatttcgtcaactattagtcat

SEQ ID NO: 246247 - DNA, 75 bp, Artificial Sequence
  Synthetic
cccaaaatattgaggcggatgataaacttagagataatcaggccctacaattccccttacctagcaacattgaat

SEQ ID NO: 246248 - DNA, 75 bp, Artificial Sequence
  Synthetic
tatacaaggatgtcatgcgatgcaatattatggggtgccaggcatgtcctcagcatgttgatgagtggtatagat

SEQ ID NO: 246249 - DNA, 75 bp, Artificial Sequence
  Synthetic
atcgaaattatcatcccatctgagagctcagctgaaataggtgatcggattttaaatcttgttgcaagaaaattg

SEQ ID NO: 246250 - DNA, 75 bp, Artificial Sequence
  Synthetic
tctttaattgcatgcctgtttgcgaaccaccatgacttgcccatagtgcgtggtatgacagctgaccaaaaatgc

SEQ ID NO: 246251 - DNA, 75 bp, Artificial Sequence
  Synthetic
ttggcactgactaactttttagtaacatatatacagacaagtgccggagaactaagcggagagacaaacctcctc

SEQ ID NO: 246252 - DNA, 75 bp, Artificial Sequence
  Synthetic
catatatacagacaagtgccggagaactaagcggagagacaaacctcctcaaagcaatacatgaaccgaagctga

SEQ ID NO: 246253 - DNA, 75 bp, Artificial Sequence
  Synthetic
aacagatactgaattattatgacagcaaaggattcgtggagcaccacgactctctcttaaacgtcaataatgaag

SEQ ID NO: 246254 - DNA, 75 bp, Artificial Sequence
  Synthetic
tagacaacacagccaagattgcaactctaacggtattggattgggcagttgaaatcttcaatctatcattccctc

SEQ ID NO: 246255 - DNA, 75 bp, Artificial Sequence
  Synthetic
aaaagaagaatcacacacctttacttgaggaagaagggttccccagtctcagagagagtgcagctccacccactc

SEQ ID NO: 246256 - DNA, 75 bp, Artificial Sequence
  Synthetic
atcatatacttaggccagtaggtttatcatccacatcatggtacaaaggtctgagtgttgtggcctttctaagaa

SEQ ID NO: 246257 - DNA, 75 bp, Artificial Sequence
  Synthetic
aattaccaatacctgaaggtggacacctgtacttggcagagggtagtggatccatgatgacagtcattgaatctc

SEQ ID NO: 246258 - DNA, 75 bp, Artificial Sequence
  Synthetic
atttcccagctcaaagaatatattacaacagcctgttttctagtggccagaatccgccacagagaaattttcaac

SEQ ID NO: 246259 - DNA, 75 bp, Artificial Sequence
  Synthetic
aatccgccacagagaaattttcaacctatgcccactcaattcgtagaaagtattgtgtaccaaaacattcaagat

SEQ ID NO: 246260 - DNA, 75 bp, Artificial Sequence
  Synthetic
actgagtgtataaattttatcctatctaaaatcatgtcatatagccttagcctgataaacatcgatttcgaggat

SEQ ID NO: 246261 - DNA, 75 bp, Artificial Sequence
  Synthetic
accagatctctaatgtcttctgaagtccataaggctcacataaatactctgatattggcaggtatgcttctcaaa

SEQ ID NO: 246262 - DNA, 75 bp, Artificial Sequence
  Synthetic
ccgaacgggatattgatagttaagacctacttaacaccattctgtaggttcaaccacttgattagaatgactcag

SEQ ID NO: 246263 - DNA, 75 bp, Artificial Sequence
  Synthetic
cacatctttggattttgtcatgctcttagatcgtcttactctgatccaaattcggatgagatattcttgatactg

SEQ ID NO: 246264 - DNA, 75 bp, Artificial Sequence
  Synthetic
aggagatctgataatatcttgtcacccctttcaagtgatgatttggcggcattttatgttaacaagacagagcaa

SEQ ID NO: 246265 - DNA, 75 bp, Artificial Sequence
  Synthetic
tctacaatcctgaccactgctatcatgacatacatcaatgagaacctgcaatcccaacaaaaaagagtctcgcaa

SEQ ID NO: 246266 - DNA, 75 bp, Artificial Sequence
  Synthetic
atcatacatgatcaaattctttatggacgatgtgatatcaatgtagatgaccacataaatcttagtagattagga

SEQ ID NO: 246267 - DNA, 75 bp, Artificial Sequence
  Synthetic
tctagatcacaaaccgccaagatacttgatatagaaaaatctgccaattataatatatttctagacagaatcaca

SEQ ID NO: 246268 - DNA, 75 bp, Artificial Sequence
  Synthetic
cagctgataaccactttcttcaaggagctgatatcattgtacgaagacactcaaacagatagacagagtataatt

SEQ ID NO: 246269 - DNA, 75 bp, Artificial Sequence
  Synthetic
tattcagcttataatgtcagcactcaagggaagatatcaactggtatagacgtgatgaccaaacagacactggat

SEQ ID NO: 246270 - DNA, 75 bp, Artificial Sequence
  Synthetic
atctcaatcaggaactggtgtctcatgccaagaagctccataatccacttagtaaatgacttagaattggggatc

SEQ ID NO: 246271 - DNA, 75 bp, Artificial Sequence
  Synthetic
tataagatatcatctatactccccgtcaatttgttcatggataccacacctattaggaaacacttgattaagaaa

SEQ ID NO: 246272 - DNA, 75 bp, Artificial Sequence
  Synthetic
ctagggtacagccatattcagcagatgtatgatactaattttatgatcttccttgatcgccccacacaaaagcga

SEQ ID NO: 246273 - DNA, 75 bp, Artificial Sequence
  Synthetic
tgtatgatactaattttatgatcttccttgatcgccccacacaaaagcgaatctggaagtcagtgggctccgtga

SEQ ID NO: 246274 - DNA, 75 bp, Artificial Sequence
  Synthetic
tacaccactcgatggtgacatactcttcccagatcaagatgacattgaactcgatatcttcggcgatgaaatatg

SEQ ID NO: 246275 - DNA, 75 bp, Artificial Sequence
  Synthetic
agttttaaaaagctgacccgtggttcataaccaatttgttataacctttagacgtttgtcacggaatagcttgag

SEQ ID NO: 246276 - DNA, 75 bp, Artificial Sequence
  Synthetic
aagaagcttacttatgtcaagtaaggaagcactgaagaagaagggaatttccctgggaggaggaggaaaacgggg

SEQ ID NO: 246277 - DNA, 75 bp, Artificial Sequence
  Synthetic
ccaaggtttgtcaaaaatcagtggcttttcagtacgacttcaccggctttagacgtcgcctttgggggtcctcgc

SEQ ID NO: 246278 - DNA, 75 bp, Artificial Sequence
  Synthetic
ctttgagatgaaaaaggccccacaacataacaacagtaatagacaacttcggcggtcactgttcaggatggatgt

SEQ ID NO: 246279 - DNA, 75 bp, Artificial Sequence
  Synthetic
cggacgagcccttgagctaatgttggcatcaattgtcaacgcgatcaggggtctcattcagcgagtgtctcgtct

SEQ ID NO: 246280 - DNA, 75 bp, Artificial Sequence
  Synthetic
ctcgactggactgacaagcgcttgtttgttccaccagcgtggggatcacccctgtctgctgccaaccacgttcct

SEQ ID NO: 246281 - DNA, 75 bp, Artificial Sequence
  Synthetic
tgagacgcgcgttggactcctagaacggaaaaagacacgatcgatctactacagcttgccaatgttcacactatt

SEQ ID NO: 246282 - DNA, 75 bp, Artificial Sequence
  Synthetic
ggaggctaccgccttcagcaagtggtgctgcaagacttgcctggaggagggaaacgtgttccacttcagagtcgg

SEQ ID NO: 246283 - DNA, 75 bp, Artificial Sequence
  Synthetic
gtcattggcttgttgtctgaccctgactttctctcccggaaagagtggaaatcaactcatcgggggaggacggaa

SEQ ID NO: 246284 - DNA, 75 bp, Artificial Sequence
  Synthetic
ctacactggactgatgaacttgttcaagctgccagaggacatgtgcccacgaggaatccatgtggagaaacggtg

SEQ ID NO: 246285 - DNA, 75 bp, Artificial Sequence
  Synthetic
atccggacgtatgaccagccagaaagcgcaaagacagaaaagaaaactgttttggtcgaggaggaggtcgtggct

SEQ ID NO: 246286 - DNA, 75 bp, Artificial Sequence
  Synthetic
gaggaatccatgtggagaaacggtgccccaaagtagaggacttgagcaccgttgatggcattgactgtgcctcaa

SEQ ID NO: 246287 - DNA, 75 bp, Artificial Sequence
  Synthetic
cgtacattgagttcacactcgcgtacacacgatgcgaagagagggtgcgacgtaggcgggacactccaaaggcca

SEQ ID NO: 246288 - DNA, 75 bp, Artificial Sequence
  Synthetic
cgtaggcgggacactccaaaggccacggaaaccgtgaaggataggctgaaagagaacatggctgaccttgaggcc

SEQ ID NO: 246289 - DNA, 75 bp, Artificial Sequence
  Synthetic
tccgccttcacctggttgaagaaaaacacgttcacaacaatggttttcatcatcgttgtcggaattgcactgaaa

SEQ ID NO: 246290 - DNA, 75 bp, Artificial Sequence
  Synthetic
tggcccctctggatcgtcgccctgctggtggcagcgtgttggagtaccgtgttggctgaccatactgaaccattc

SEQ ID NO: 246291 - DNA, 75 bp, Artificial Sequence
  Synthetic
atgacaatggatgggagggtccagacgttgatcaaaacccaagtgtacccccatggttcggtttccatcatgacg

SEQ ID NO: 246292 - DNA, 75 bp, Artificial Sequence
  Synthetic
cgagcgggacttcttgatatcagagccggtgcattctttgtctccgagggacagggagtgaaatcattgctctct

SEQ ID NO: 246293 - DNA, 75 bp, Artificial Sequence
  Synthetic
ccggtgcattctttgtctccgagggacagggagtgaaatcattgctctctgattgtcacgtgaacgcgtcgtatt

SEQ ID NO: 246294 - DNA, 75 bp, Artificial Sequence
  Synthetic
caacggactgctgccctatgggatgtgacattgacatggatgcgctgaatgccgttggaagagtgtgtgttgaac

SEQ ID NO: 246295 - DNA, 75 bp, Artificial Sequence
  Synthetic
gccgttggaagagtgtgtgttgaacgcacgcttcaacgtggctgggcatctggatgcctggaatttggaatggga

SEQ ID NO: 246296 - DNA, 75 bp, Artificial Sequence
  Synthetic
gagacgaaacaattttctcccgaaagacgattgacaggaacgcgaggacaccatggagttgaggtccacagtgag

SEQ ID NO: 246297 - DNA, 75 bp, Artificial Sequence
  Synthetic
tggatgcctggaatttggaatgggagctgtggctacatgtatcgaagtatcatgctctcgtgaactccgagtatc

SEQ ID NO: 246298 - DNA, 75 bp, Artificial Sequence
  Synthetic
gagctttggcgagaagaacatcaaggttaacgtgactggaagctttcacagtgaaaccacgaacttgaccctgat

SEQ ID NO: 246299 - DNA, 75 bp, Artificial Sequence
  Synthetic
atgtgttcagtggatccaacaagttcattcccgcgctggcaaacgcggtgtttcggtggaatttgagatctgagg

SEQ ID NO: 246300 - DNA, 75 bp, Artificial Sequence
  Synthetic
tccagccgcagttcgaaccctctcttttggagacctcggatacgccacaatttcttgtggacttggattgtctga

SEQ ID NO: 246301 - DNA, 75 bp, Artificial Sequence
  Synthetic
tttcttgtggacttggattgtctgatgctctcaacatgtacatcgtggctggagagaagcataaagttcttctcc

SEQ ID NO: 246302 - DNA, 75 bp, Artificial Sequence
  Synthetic
cgtgcctgacggatgggactgtccaatttgacacgtacgaaaggcaaacgatcaacatcgatggggaagaagtac

SEQ ID NO: 246303 - DNA, 75 bp, Artificial Sequence
  Synthetic
cgaaaggcactattgacgtgtggactggtttgttcaaggttggtgccgtcatacacggggctgacacggctgttc

SEQ ID NO: 246304 - DNA, 75 bp, Artificial Sequence
  Synthetic
cattgattcccactgactatggcaatgggtcgtctggatcaccggttttttcccggagtggagaggcagttgggc

SEQ ID NO: 246305 - DNA, 75 bp, Artificial Sequence
  Synthetic
tctgggggaagaccactcccactgaagtcaaggttaaggcgatcattgacccgtctgtggcctgggaagaaggca

SEQ ID NO: 246306 - DNA, 75 bp, Artificial Sequence
  Synthetic
ccgtctgtggcctgggaagaaggcataaacatcgagaaggggttgtcagatggaatgttccttaaatgcgacatc

SEQ ID NO: 246307 - DNA, 75 bp, Artificial Sequence
  Synthetic
tgtatggtttcggattttatgtctcgggacagtactactcgcttgtctcaacggaccaggttctccgagatgatg

SEQ ID NO: 246308 - DNA, 75 bp, Artificial Sequence
  Synthetic
taaacatcgagaaggggttgtcagatggaatgttccttaaatgcgacatcgtggtggacaaactcttggttgaga

SEQ ID NO: 246309 - DNA, 75 bp, Artificial Sequence
  Synthetic
aaatgccacaaatactggactcaacgggcagggtgttcattgattggcatcctggaaaggggaaaactcgcggtg

SEQ ID NO: 246310 - DNA, 75 bp, Artificial Sequence
  Synthetic
caactcgcaattgtgataaagttggtgagctgatcttcacccaagaccagattggaactagtggacgcgtgcaag

SEQ ID NO: 246311 - DNA, 75 bp, Artificial Sequence
  Synthetic
tgagctgatcttcacccaagaccagattggaactagtggacgcgtgcaagtcacgctgtctgcccctgctggggc

SEQ ID NO: 246312 - DNA, 75 bp, Artificial Sequence
  Synthetic
agattgcgtggtcgttctcacatgcgagggttgtagcctgccggctgcaagtgtgttctttgccaagggaacgca

SEQ ID NO: 246313 - DNA, 75 bp, Artificial Sequence
  Synthetic
gatctcgtccacctcagttgtttgtgacgaaacgtctgcaaagatttcggctggaaaaaaggtcgtttacgtgaa

SEQ ID NO: 246314 - DNA, 75 bp, Artificial Sequence
  Synthetic
caaccataatcatggacgaatgtcacttcttggaccccatgtcgatagctgccagaggaatcatggaatcgttgt

SEQ ID NO: 246315 - DNA, 75 bp, Artificial Sequence
  Synthetic
atgtaaggtctccagaatgatttcggcttggaacatcgtgctgaacactgctgatcgttatcaacgccatggtgt

SEQ ID NO: 246316 - DNA, 75 bp, Artificial Sequence
  Synthetic
gccagaggaatcatggaatcgttgttgcaacgaaacacacgcttagtttacatgagtgccacgattcctggacgt

SEQ ID NO: 246317 - DNA, 75 bp, Artificial Sequence
  Synthetic
tgaaggcatcaaacattcgttctttgatctaactggcggttggggactccacctattttcagggtggtgggtcca

SEQ ID NO: 246318 - DNA, 75 bp, Artificial Sequence
  Synthetic
aatcgccattgtcttaatcggcttgacgctgctcgttgacaaacgcgtgcttgttctgttggttctcgttggata

SEQ ID NO: 246319 - DNA, 75 bp, Artificial Sequence
  Synthetic
ttgttctgttggttctcgttggatacatcgtgtatgtcaaggctgactacggatgcggcgtcgacacccagcgca

SEQ ID NO: 246320 - DNA, 75 bp, Artificial Sequence
  Synthetic
agacgtttacctgtggtgatgggttgtttgtcttccgcagtttgttcaactggcccacggccgaagagcaggtcg

SEQ ID NO: 246321 - DNA, 75 bp, Artificial Sequence
  Synthetic
gtttgtcttccgcagtttgttcaactggcccacggccgaagagcaggtcgagatcgataactacggattgttcga

SEQ ID NO: 246322 - DNA, 75 bp, Artificial Sequence
  Synthetic
tggcccacggccgaagagcaggtcgagatcgataactacggattgttcgaaggttatgtcgataacatgttcaaa

SEQ ID NO: 246323 - DNA, 75 bp, Artificial Sequence
  Synthetic
cctgtcacgtactggctcgcttggcactgggtaagcaacctgcatgacctcgatggaatactattccagggggac

SEQ ID NO: 246324 - DNA, 75 bp, Artificial Sequence
  Synthetic
aagtacaacaaagtgtgcgtcttgtgcgaggatgttctgcaatgtgcagccgctcgagccgccgctgagtactac

SEQ ID NO: 246325 - DNA, 75 bp, Artificial Sequence
  Synthetic
gtgtacaaccatgctggcgtccattacaacttgtccttgtcgcaccataggcactttccaagcgtggagaagtcg

SEQ ID NO: 246326 - DNA, 75 bp, Artificial Sequence
  Synthetic
attgtgagggtaaaaattggtgatgttgagacccaattggccgttagagaacaagatcgtgaggtggatgcggaa

SEQ ID NO: 246327 - DNA, 75 bp, Artificial Sequence
  Synthetic
atgacattccaaccatgaaaaaagacaaaatgatctcggtcctcatggcgatctggatgggtgggattttcgtcg

SEQ ID NO: 246328 - DNA, 75 bp, Artificial Sequence
  Synthetic
ttgagacccaattggccgttagagaacaagatcgtgaggtggatgcggaacagctagggttcttgaagaaaccgc

SEQ ID NO: 246329 - DNA, 75 bp, Artificial Sequence
  Synthetic
tgtggcaatacggacataaaccagagaatgtctctgacaaggtaatccgtgttgtgtccagcggaaaggcacgaa

SEQ ID NO: 246330 - DNA, 75 bp, Artificial Sequence
  Synthetic
gttgtgtccagcggaaaggcacgaaccaaggtttgtcagaaatcagtggcttttcagtacgacttcaccggcttt

SEQ ID NO: 246331 - DNA, 75 bp, Artificial Sequence
  Synthetic
ccaaggtttgtcagaaatcagtggcttttcagtacgacttcaccggctttagacgccgcctttgggggtcttcgc

SEQ ID NO: 246332 - DNA, 75 bp, Artificial Sequence
  Synthetic
ggcatggggcacttgttgggctctcttgagctaccacatgggtgtcccctttgctatgattttcgttatcggcgg

SEQ ID NO: 246333 - DNA, 75 bp, Artificial Sequence
  Synthetic
taggagtgtcgatttcgtccaccatgagacggacttgccccatgtatttggcaggcttggtcgtgaagaacaacc

SEQ ID NO: 246334 - DNA, 75 bp, Artificial Sequence
  Synthetic
aaaccatctacacggatggaagcatgtggatgcgtagcgagttcaacaaaacgtacaccattactgagttgagca

SEQ ID NO: 246335 - DNA, 75 bp, Artificial Sequence
  Synthetic
cattgtgacgggaatgatcgttattctaggattgatctgctgggagaaagaactgaccccaaatataaaacgaga

SEQ ID NO: 246336 - DNA, 75 bp, Artificial Sequence
  Synthetic
ctaggattgatctgctgggagaaagaactgaccccaaatataaaacgagacctcacccacatgctggctaccgtt

SEQ ID NO: 246337 - DNA, 75 bp, Artificial Sequence
  Synthetic
tgcagcaatcccactcatgcatctggccaccaaggttcacggctgaaccgctcgactggactgacaagcgcttgt

SEQ ID NO: 246338 - DNA, 75 bp, Artificial Sequence
  Synthetic
gccaccaaggttcacggctgaaccgctcgactggactgacaagcgcttgtttgttccaccagcgtggggatcacc

SEQ ID NO: 246339 - DNA, 75 bp, Artificial Sequence
  Synthetic
ctcgactggactgacaagcgcttgtttgttccaccagcgtggggatcacccctatcagccgccaaccacgttcct

SEQ ID NO: 246340 - DNA, 75 bp, Artificial Sequence
  Synthetic
gggtaccttacccaaacggacttcccgtgggacaaatatcccatcgagatgatcaaaggagctgtgcctggcacc

SEQ ID NO: 246341 - DNA, 75 bp, Artificial Sequence
  Synthetic
atcaacgtgtacgccgttgttgttggactaaaccaagtagtgatcactcttacggagcacgatgtggcgaaaaag

SEQ ID NO: 246342 - DNA, 75 bp, Artificial Sequence
  Synthetic
tacggagcacgatgtggcgaaaaagtacattgctgatgctgcacgctcagctgctgtgggtggaatgcggttgtc

SEQ ID NO: 246343 - DNA, 75 bp, Artificial Sequence
  Synthetic
acggttgagatgacgagcaaatgcaaaggccgcgggaaggcgttgaaagtggaggctaacgccttcagcaagtgg

SEQ ID NO: 246344 - DNA, 75 bp, Artificial Sequence
  Synthetic
ggaggctaacgccttcagcaagtggtgctgcaagacttgcctggaggaaggaaacgtgttccacttcagaatcgg

SEQ ID NO: 246345 - DNA, 75 bp, Artificial Sequence
  Synthetic
aactgatttgtactatccaatggagatccggacctatgaccagccagaaagcgcaaagacagaaaagaaaactgt

SEQ ID NO: 246346 - DNA, 75 bp, Artificial Sequence
  Synthetic
atccggacctatgaccagccagaaagcgcaaagacagaaaagaaaactgtattggtcgaggaggaggtcgtagct

SEQ ID NO: 246347 - DNA, 75 bp, Artificial Sequence
  Synthetic
cttgctctcttctcggccgagcacaagtacaacttgactgacaaggtgctgaacaacttcaatgccgaaaaacaa

SEQ ID NO: 246348 - DNA, 75 bp, Artificial Sequence
  Synthetic
actgtgagtcaggatgacatccaaacggagttgccaaagacctgggacgctggtttctctcagacgtatgctgaa

SEQ ID NO: 246349 - DNA, 75 bp, Artificial Sequence
  Synthetic
gccagccctctgaaaatgtcaaaccaggattttcggcttggccgcgtcgatcatataagccgcatgttagtgttg

SEQ ID NO: 246350 - DNA, 75 bp, Artificial Sequence
  Synthetic
tcaatagcgctcatgtgcatcacggcacgcacgagacggaagtggctcttccgagctgtcggtacatggttggct

SEQ ID NO: 246351 - DNA, 75 bp, Artificial Sequence
  Synthetic
agagaattgaacaagaagagtttgtctgagttcaatgactaccgatcacgaggcgtcaatgagacagaaagaggc

SEQ ID NO: 246352 - DNA, 75 bp, Artificial Sequence
  Synthetic
ttccttttaattggtatgcctttgctatcggattggcaatcatggggttggctcatcttgtcacaagggattgcg

SEQ ID NO: 246353 - DNA, 75 bp, Artificial Sequence
  Synthetic
ggacacaaagggtacaccatgtggatgtgccacctttggatggccattcacaccgggaccggtcacatatggttt

SEQ ID NO: 246354 - DNA, 75 bp, Artificial Sequence
  Synthetic
tgtgccacctttggatggccattcacaccgggaccggtcacatatggtttctcgcgatgatgtggagacgccaga

SEQ ID NO: 246355 - DNA, 75 bp, Artificial Sequence
  Synthetic
tgtgggctccgctggatgtcaaatgcttcgtgttgattctccaatgggcgtatgcgataatagcacacaaacttg

SEQ ID NO: 246356 - DNA, 75 bp, Artificial Sequence
  Synthetic
ccggcgagtcacgaaagtcaatgcttacactcttgggggagccgaacgtgaaaacccacaaaagttcacgacgac

SEQ ID NO: 246357 - DNA, 75 bp, Artificial Sequence
  Synthetic
gtcaatttggctccctcttggatgctgggctcatgattgcggccgggatgggtctatcgacggcagccgcgaaca

SEQ ID NO: 246358 - DNA, 75 bp, Artificial Sequence
  Synthetic
accggagtcaacgtctatgcgatggatccacagagtgcgaacaccatagtgtgcgacatcggggaaagtgacccc

SEQ ID NO: 246359 - DNA, 75 bp, Artificial Sequence
  Synthetic
tgggatttcacgaatggctgatctcgtccactctcttggttgcatcttggcaaaccgcgatcttttctgtagcaa

SEQ ID NO: 246360 - DNA, 75 bp, Artificial Sequence
  Synthetic
tcatattggcagtgatcacagtgagagcgttaaaagtctcctatcaagcgcactcatccgcgtggagaaatggac

SEQ ID NO: 246361 - DNA, 75 bp, Artificial Sequence
  Synthetic
gcggcgtttgtgtgcaaggtattggcgccatatcatctcgatgtgttgcggaagattgagggcttgcaacacaag

SEQ ID NO: 246362 - DNA, 75 bp, Artificial Sequence
  Synthetic
tgaggagtgccacgaccctatgtgggctgctgcgggccctgcaacgcaatacccgcatgctcctgctgaatggcc

SEQ ID NO: 246363 - DNA, 75 bp, Artificial Sequence
  Synthetic
tttgacggccgcttggttaggttgtcacacagtcgaaactcgaccgccgagatgtactatatctctggaacccgc

SEQ ID NO: 246364 - DNA, 75 bp, Artificial Sequence
  Synthetic
cttggctagtacttggatgcttgttggtgctgtcacgggactggtcactagcggcgaacggtttgatgactcaac

SEQ ID NO: 246365 - DNA, 75 bp, Artificial Sequence
  Synthetic
gatgtactatatctctggaacccgccaaaatccagttgccgccgtctacgcagtgttggcagttctgtgtcgacg

SEQ ID NO: 246366 - DNA, 75 bp, Artificial Sequence
  Synthetic
gctatgttcccactttcgcaatgacatgcttggccttcttggcgagaccactgtcgtgttgcgttcgtgggtcga

SEQ ID NO: 246367 - DNA, 75 bp, Artificial Sequence
  Synthetic
atgcttggccttcttggcgagaccactgtcgtgttgcgttcgtgggtcgatcgattggatatatcaatgcaaatt

SEQ ID NO: 246368 - DNA, 75 bp, Artificial Sequence
  Synthetic
cgtcgcaggatctggaatcgttatagccgccgtttggctgctagaagaagctcagcgccctgaactcgccatggc

SEQ ID NO: 246369 - DNA, 75 bp, Artificial Sequence
  Synthetic
tattcttgttctggccactgctgtctggttttattttagcatgactgccaaggtaagcctggagctggtgcaaat

SEQ ID NO: 246370 - DNA, 75 bp, Artificial Sequence
  Synthetic
aggtaagcctggagctggtgcaaatacccggagattcttgtaccatcggtgaaacgaaacaattttctcccgaaa

SEQ ID NO: 246371 - DNA, 75 bp, Artificial Sequence
  Synthetic
gaaacgaaacaattttctcccgaaagacgattgacaggaacacgaggacaccatggggttgaggtccacagtgag

SEQ ID NO: 246372 - DNA, 75 bp, Artificial Sequence
  Synthetic
ttggctgatagtgaattctggaacatggtggatcgcgaacgggccaaacatctggcgggagactgcgaaatgtgc

SEQ ID NO: 246373 - DNA, 75 bp, Artificial Sequence
  Synthetic
caagagaagaacggcgttataatgaacatctgcgttggcgtcgtgcttttgctcgtgttttgcttcaactggcag

SEQ ID NO: 246374 - DNA, 75 bp, Artificial Sequence
  Synthetic
gttggaatagtgggagccctttggtatgtgttcagtggatccaacaagtttattcccgcgctggcaaacgcggtg

SEQ ID NO: 246375 - DNA, 75 bp, Artificial Sequence
  Synthetic
atgtgttcagtggatccaacaagtttattcccgcgctggcaaacgcggtgttccggtggaatttgagatctgagg

SEQ ID NO: 246376 - DNA, 75 bp, Artificial Sequence
  Synthetic
atttctttctctcgaactcgtttgaagaagaacagttgcaggtgcacaccacgtttgactatctgccccaaggag

SEQ ID NO: 246377 - DNA, 75 bp, Artificial Sequence
  Synthetic
gggaagtatctcgtggcggatgacgtcgctggatgggacacgcggataacccaggctgacttggatgacgaggag

SEQ ID NO: 246378 - DNA, 75 bp, Artificial Sequence
  Synthetic
catactacatcaagagtgtgactcctttttcatcggtcatctgcgggtccggttttgccaaagaaggagtgtttc

SEQ ID NO: 246379 - DNA, 75 bp, Artificial Sequence
  Synthetic
acacactctttcacgtcacaaagggcaatcctgtgaaatggcgtgggaggtatgttagtttgtcgggtggatcag

SEQ ID NO: 246380 - DNA, 75 bp, Artificial Sequence
  Synthetic
tcacctattcgatgaacaccataacaaacgggaaaaccctggtgggccgtgagcttgaagcttgtgggctcctgg

SEQ ID NO: 246381 - DNA, 75 bp, Artificial Sequence
  Synthetic
tcacacgtgacacggcttgttatggtggaccttggaaactcaagtttgaggagtccgatgtttacaccatcaagg

SEQ ID NO: 246382 - DNA, 75 bp, Artificial Sequence
  Synthetic
cgtgcctgacggatgggactgtccaatttgacacttacgaaaggcaaacaatcaacatcgacggggaagaagtac

SEQ ID NO: 246383 - DNA, 75 bp, Artificial Sequence
  Synthetic
cattgattcctactgactatggcaatggatcgtctggatcaccggttttttctcggagtggagaggcagttgggc

SEQ ID NO: 246384 - DNA, 75 bp, Artificial Sequence
  Synthetic
tccggaaggacatcgacttggaaaccccgtctaggttctcaaccaattgggaagaggttgaattctgctcgcacc

SEQ ID NO: 246385 - DNA, 75 bp, Artificial Sequence
  Synthetic
tgtatggtttcggattctatgtctcaggacagtactactcgcttgtctcaacggaccaggttcttcgagacgatg

SEQ ID NO: 246386 - DNA, 75 bp, Artificial Sequence
  Synthetic
aaatgccacaaatactggactcaacgagcagggtgttcattgattggcatcctggaaaggggaaaacccgtggtg

SEQ ID NO: 246387 - DNA, 75 bp, Artificial Sequence
  Synthetic
tgatctgcggttaggctttgctgccataacatcctgcgtgcctaaggattgggttccaaccggacgcactacgtg

SEQ ID NO: 246388 - DNA, 75 bp, Artificial Sequence
  Synthetic
tggttgttgatgaagcaaagaaggctgtgcttggcaatcataggatcctcgttctcacgcccacacgggtggtaa

SEQ ID NO: 246389 - DNA, 75 bp, Artificial Sequence
  Synthetic
tttggaacagagtttggatcgaaaacaacaagtggatgtcagacaagactccggtgtgccgctggaatgaggttc

SEQ ID NO: 246390 - DNA, 75 bp, Artificial Sequence
  Synthetic
agaacgaggtcatcaaagtgctcaaagaaaggcttccagatctcaaagttggcgatgtgattgggcatccgatga

SEQ ID NO: 246391 - DNA, 75 bp, Artificial Sequence
  Synthetic
acattgtaaccgttgcttgccatgccacttttgcacaacatgccttctcggatggactgaagaagtttaagtatt

SEQ ID NO: 246392 - DNA, 75 bp, Artificial Sequence
  Synthetic
agcttgtggaagccagatcgggtctcatgcacgctctgtctggtctcgggacatggagtcgcacgttgaaaggat

SEQ ID NO: 246393 - DNA, 75 bp, Artificial Sequence
  Synthetic
caaccataatcatggacgaatgtcacttcctggaccccatgtcaatagctgcaagaggaatcatggaatcgttgt

SEQ ID NO: 246394 - DNA, 75 bp, Artificial Sequence
  Synthetic
ggacaccaggagtttccgaacgctcttggaatgttcgcgcgatacgcaaagccggaagtgtcattgtttagataa

SEQ ID NO: 246395 - DNA, 75 bp, Artificial Sequence
  Synthetic
gcaagaggaatcatggaatcgttgttgcaacgaaacacacgcttagtttacatgagtgctacgattcctggacgt

SEQ ID NO: 246396 - DNA, 75 bp, Artificial Sequence
  Synthetic
tcaccagcaattggcaataactacgcgattgatgtcgaccatgtgaacttcccccgtgagatgacctcgcagttc

SEQ ID NO: 246397 - DNA, 75 bp, Artificial Sequence
  Synthetic
gtcatggagcacgctggagcaaaaacggttgtttttgttcccacaaggaaggattgtgacagattgcaccatgcc

SEQ ID NO: 246398 - DNA, 75 bp, Artificial Sequence
  Synthetic
actccgaacagcatctcgctacacagcgactccttcgaggagaacgctccgaaagcagtgaacgacgatgtgaaa

SEQ ID NO: 246399 - DNA, 75 bp, Artificial Sequence
  Synthetic
gtcatctacacaacggacatcagcgagatgggagcaaacttcaacgttgacactgtcattgacacacgaaccacc

SEQ ID NO: 246400 - DNA, 75 bp, Artificial Sequence
  Synthetic
atcaaaccggtcctggcccgaatcaactttgttgatctcgaaaaagtcggagcacccctatcttctcgtattcaa

SEQ ID NO: 246401 - DNA, 75 bp, Artificial Sequence
  Synthetic
cgacgtgggcgcactggtcgccgtgacaaaggtaggtatgtgattccgatcgatgatccggtgccgtcagattgt

SEQ ID NO: 246402 - DNA, 75 bp, Artificial Sequence
  Synthetic
ttgaagtggatctgctggactgaggcacaaatgatcctagatcaggttggctgcgggccaatgccggaggaggct

SEQ ID NO: 246403 - DNA, 75 bp, Artificial Sequence
  Synthetic
acctattttaatgtgccgggatcatacacgttgccagaaaaacaacgacgtttgtttctggagctttccgagaag

SEQ ID NO: 246404 - DNA, 75 bp, Artificial Sequence
  Synthetic
tttgtttctggagctttccgagaagcctgtcacgtactggctcgcttggcactgggtaagcaacctgcatgacct

SEQ ID NO: 246405 - DNA, 75 bp, Artificial Sequence
  Synthetic
cctgtcacgtactggctcgcttggcactgggtaagcaacctgcatgacctcgatggaatactcttccaaggagac

SEQ ID NO: 246406 - DNA, 75 bp, Artificial Sequence
  Synthetic
actgatggagtgttgaaaatacccacgagccacggaatccagcggtaccgacccaagtttgttgacaggcggttc

SEQ ID NO: 246407 - DNA, 75 bp, Artificial Sequence
  Synthetic
gaggatgctccagatgacatgaagattgcatccataacaaaactgttgaaatgccgtagtgtgacagtcgtggac

SEQ ID NO: 246408 - DNA, 75 bp, Artificial Sequence
  Synthetic
tttgtcatggccgtgcagcacttcatagtctctggggctttcaagcaaaagttttttgaggttcttgagagtgcg

SEQ ID NO: 246409 - DNA, 75 bp, Artificial Sequence
  Synthetic
gttttttgaggttcttgagagtgcgtacatcgcaacaaggctaggagatgatgacattccaactatgaaaaaaga

SEQ ID NO: 246410 - DNA, 75 bp, Artificial Sequence
  Synthetic
atgacattccaactatgaaaaaagacaaaatgatctcggccctcatggcgatctggatgggtgggattttcgccg

SEQ ID NO: 246411 - DNA, 75 bp, Artificial Sequence
  Synthetic
tgatcctgtatttggtcatccttttgtttctgtctcttggaaagtacataacacgcgacaagaatccgcaagtga

SEQ ID NO: 246412 - DNA, 75 bp, Artificial Sequence
  Synthetic
acacgcgacaagaatccgcaagtgatcaaccagtacgacgaaattcctaaggcatggggcacttgttgggctctc

SEQ ID NO: 246413 - DNA, 75 bp, Artificial Sequence
  Synthetic
ggcatggggcacttgttgggctctcttaagctaccacatgggtgtcccctttgccatgattttcgttattggcgg

SEQ ID NO: 246414 - DNA, 75 bp, Artificial Sequence
  Synthetic
agcaatcactctgataaagatcatagctggaaacaatacaacgagaagtattgagtacgttgtgataactaggtt

SEQ ID NO: 246415 - DNA, 75 bp, Artificial Sequence
  Synthetic
catcgtgacgggaatgatcgtgattctaggattgatctgctgggagaaagaactgaccccaaatatcaaacgaga

SEQ ID NO: 246416 - DNA, 75 bp, Artificial Sequence
  Synthetic
ctaggattgatctgctgggagaaagaactgaccccaaatatcaaacgagatctcacccacatgctggctaccgtt

SEQ ID NO: 246417 - DNA, 75 bp, Artificial Sequence
  Synthetic
tctggaggctcgttgccgataagcccgaccgctaaaccagcatggaatctccctacctggagtcacgagtttttg

SEQ ID NO: 246418 - DNA, 75 bp, Artificial Sequence
  Synthetic
atcaacgtgtatgccgttgttgttggactaaaccaagtggtgatcactctcacggagcacgatgtggcgaaaaag

SEQ ID NO: 246419 - DNA, 75 bp, Artificial Sequence
  Synthetic
cacggagcacgatgtggcgaaaaagtacattgctgatgctgcacgctcagctgctgtgggtggaatgcggttatc

SEQ ID NO: 246420 - DNA, 75 bp, Artificial Sequence
  Synthetic
caacataccattctatgcggttgtccctctgcttccggctgtgttctacggaaccactttgatctctcaggttgt

SEQ ID NO: 246421 - DNA, 75 bp, Artificial Sequence
  Synthetic
cggatgggtaacgggattttttgttcttgccctcttctcggccgagcacaagtacaacttgactgacaaggtgct

SEQ ID NO: 246422 - DNA, 75 bp, Artificial Sequence
  Synthetic
cttgccctcttctcggccgagcacaagtacaacttgactgacaaggtgctgaacaactttaatgccgaaaaacaa

SEQ ID NO: 246423 - DNA, 75 bp, Artificial Sequence
  Synthetic
aagcgtgaggttgaggccttaatcggccgtgatcagcgtgacaggcgacggaacatgtttgccgctgtgatggca

SEQ ID NO: 246424 - DNA, 75 bp, Artificial Sequence
  Synthetic
ggcctagcagtcatttgggcattcttggttcaggacctggcttctctttttgtttgcattgccgtttgcattcac

SEQ ID NO: 246425 - DNA, 75 bp, Artificial Sequence
  Synthetic
tccttgtgggtcgttcttgatcccaggaatcccaaccacccggacatggaactaggtcacatcctgctgttcttt

SEQ ID NO: 246426 - DNA, 75 bp, Artificial Sequence
  Synthetic
ggagtcataaggatggagcaaaccaccttgtacgtggcttgccttctcctccgaattctcctcggtggattggaa

SEQ ID NO: 246427 - DNA, 75 bp, Artificial Sequence
  Synthetic
aagagcatgaggactggaggcggtttgaactccattaacaaagctcctgttggtggtatgggatacaggtggaaa

SEQ ID NO: 246428 - DNA, 75 bp, Artificial Sequence
  Synthetic
tggtggtatgggatacaggtggaaaagagaattgaacaagaagagcttgtctgagttcaatgactaccgatcacg

SEQ ID NO: 246429 - DNA, 75 bp, Artificial Sequence
  Synthetic
agagaattgaacaagaagagcttgtctgagttcaatgactaccgatcacgaggcgttaatgagacagaaagaggc

SEQ ID NO: 246430 - DNA, 75 bp, Artificial Sequence
  Synthetic
gattacgtttcccgaggcggcttgaaaatggatgagctgataacgaaatttgggtgggaacccaaaggacgtgtc

SEQ ID NO: 246431 - DNA, 75 bp, Artificial Sequence
  Synthetic
tgggtgggaacccaaaggacgtgtcgttgatctagggtgtggacgaggaggctgggcgcaacgtttggtagccga

SEQ ID NO: 246432 - DNA, 75 bp, Artificial Sequence
  Synthetic
tcggcgagtcacgaaagtcaatgcttacactcttgggggagcggaacgtgagaacccacaaaagttcacgacgac

SEQ ID NO: 246433 - DNA, 75 bp, Artificial Sequence
  Synthetic
tggatacaacttggcgaccttcaagaccggagtcaacgtctatgcgatgaatccacagagtgcgaacaccatagt

SEQ ID NO: 246434 - DNA, 75 bp, Artificial Sequence
  Synthetic
accggagtcaacgtctatgcgatgaatccacagagtgcgaacaccatagtgtgcgacatcggagaaagtgatccc

SEQ ID NO: 246435 - DNA, 75 bp, Artificial Sequence
  Synthetic
aaaccagaagttgagttcagtcggaccatgaaagttctgaacctgctggaagactggttggacaagaaccctcaa

SEQ ID NO: 246436 - DNA, 75 bp, Artificial Sequence
  Synthetic
gcggcgtttgtgtgcaaggtactggcgccatatcatcttgatgtgttgcggaagattgagggcttgcagcacaag

SEQ ID NO: 246437 - DNA, 75 bp, Artificial Sequence
  Synthetic
tttgacggccgtttggttaggttgtcacacagtcgaaattcgaccgctgagatgtactatatctctggaacccgc

SEQ ID NO: 246438 - DNA, 75 bp, Artificial Sequence
  Synthetic
gatgtactatatctctggaacccgccaaaatcccgttgccgccgtctacgctgtgttggcagttctgtgtcgacg

SEQ ID NO: 246439 - DNA, 75 bp, Artificial Sequence
  Synthetic
attcacgatcaacgaccctgaatttcgcattgacccaccgaaattgtcccaaggaacacgttgtgatccttcgtc

SEQ ID NO: 246440 - DNA, 75 bp, Artificial Sequence
  Synthetic
aaaagtcaaggaactcgatgaggacaaagtgagcactcgcatccgacggcttaaagacgagaatgctcggacctg

SEQ ID NO: 246441 - DNA, 75 bp, Artificial Sequence
  Synthetic
gttttacgacgaggaacatccctacaatagcttcaagtactatggatcattcgctgcggacacgcggtcaggtgg

SEQ ID NO: 246442 - DNA, 75 bp, Artificial Sequence
  Synthetic
tggacagacggtaaatcccatgatccgacgtgtcatgtggccatgggaagaacagaaaagaacgacctcctatat

SEQ ID NO: 246443 - DNA, 75 bp, Artificial Sequence
  Synthetic
gatgacagatgtctccacgtacgcccagcagaagatcctccgtgagaaggttgacacgttgacggaagaaccccc

SEQ ID NO: 246444 - DNA, 75 bp, Artificial Sequence
  Synthetic
ggcgaacataaaacgggttaacagactcatcatgaagtattttgtgcgcatgttcaaggaccgcggtttgaaacc

SEQ ID NO: 246445 - DNA, 75 bp, Artificial Sequence
  Synthetic
acgtatcctcacagccgcagactatgccagaaacgtgcaaagccatgccgccattggggcgtggagcaaggaaat

SEQ ID NO: 246446 - DNA, 75 bp, Artificial Sequence
  Synthetic
tccgtggaccagcgtgaatgaagcgttggctgatagtgaattctggaacatggtggatcgcgaacgggccaaaca

SEQ ID NO: 246447 - DNA, 75 bp, Artificial Sequence
  Synthetic
ttggctgatagtgaattctggaacatggtggatcgcgaacgggccaaacatctggcgggggattgcgaaatgtgc

SEQ ID NO: 246448 - DNA, 75 bp, Artificial Sequence
  Synthetic
atctataacacaatgggaaagaaggaaaagaaacccactgtggccggattggcaaaaggatctcgcacgatttgg

SEQ ID NO: 246449 - DNA, 75 bp, Artificial Sequence
  Synthetic
tacatgtggctcggcagtcgtttccttgagtatgaggcattgggattcttgaatgaggaccactgggttgcccgt

SEQ ID NO: 246450 - DNA, 75 bp, Artificial Sequence
  Synthetic
gaaaactttcctggtggagttggaggtgagggagtcaactacttcggatactaccttgaggagattgctaagaaa

SEQ ID NO: 246451 - DNA, 75 bp, Artificial Sequence
  Synthetic
ctaccttgaggagattgctaagaaagggaagtatctcgtggcggatgatgtcgctggatgggacacgcggataac

SEQ ID NO: 246452 - DNA, 75 bp, Artificial Sequence
  Synthetic
gggaagtatctcgtggcggatgatgtcgctggatgggacacgcggataacccaggccgacttggatgacgaggag

SEQ ID NO: 246453 - DNA, 75 bp, Artificial Sequence
  Synthetic
tacttcatactcgaacagataaccgatccataccaccggaaattggtgaaggcgctgttcatgttcgcatacaag

SEQ ID NO: 246454 - DNA, 75 bp, Artificial Sequence
  Synthetic
cacatcgtcgccctgtttccgagagaccatccccgctttgctagcaacacagtcatggacgttgtggttcgcaca

SEQ ID NO: 246455 - DNA, 75 bp, Artificial Sequence
  Synthetic
agtcatggacgttgtggttcgcacagaccagagaggctcaggtcaggtggtcacctattcgatgaacaccataac

SEQ ID NO: 246456 - DNA, 75 bp, Artificial Sequence
  Synthetic
tcacctattcgatgaacaccataacaaacggaaaaaccctggtgggccgtgagcttgaagcttgtgggcttctgg

SEQ ID NO: 246457 - DNA, 75 bp, Artificial Sequence
  Synthetic
aagcaagcgatgaggagatctggcgatggctgttgttgtattgtgttgcgttcttgagccgatccgttgtggctg

SEQ ID NO: 246458 - DNA, 75 bp, Artificial Sequence
  Synthetic
gcgacgatgcagttgtcgcgacagacaatccacagttcatgtcatccctcaagtacatcacactggcaggaaaaa

SEQ ID NO: 246459 - DNA, 75 bp, Artificial Sequence
  Synthetic
aagtacatcacactggcaggaaaaattcggaaggacatcgacttggaaaccccgtctaggttctcaaccaattgg

SEQ ID NO: 246460 - DNA, 75 bp, Artificial Sequence
  Synthetic
ttcggaaggacatcgacttggaaaccccgtctaggttctcaaccaattgggaagaggttgagttctgctcgcacc

SEQ ID NO: 246461 - DNA, 75 bp, Artificial Sequence
  Synthetic
actaccaccggctgcacatgaaggatggaagggaaataatagcgccttgtcgtgatcaattcgaaatcatcggaa

SEQ ID NO: 246462 - DNA, 75 bp, Artificial Sequence
  Synthetic
gaagcagaatccagaaaggaggcgttgtttcccttggagacagcgggtgtctcgccaaagcgtatgcgcaaatgt

SEQ ID NO: 246463 - DNA, 75 bp, Artificial Sequence
  Synthetic
ctcgccaaagcgtatgcgcaaatgtgggctttgtatttcttccatcgtcgtgatctgcggttaggctttgctgcc

SEQ ID NO: 246464 - DNA, 75 bp, Artificial Sequence
  Synthetic
tgatctgcggttaggctttgctgccataacatcatgcgtgcccaaggattgggttccaaccggacgcaccacgtg

SEQ ID NO: 246465 - DNA, 75 bp, Artificial Sequence
  Synthetic
gtctgtacaccacgggagtgagtggatgacgactgaggacatgctatccgtttggaacagagtttggatcgaaaa

SEQ ID NO: 246466 - DNA, 75 bp, Artificial Sequence
  Synthetic
atgacgactgaggacatgctatccgtttggaacagagtttggatcgaaaacaacaagtggatgtcagacaagact

SEQ ID NO: 246467 - DNA, 75 bp, Artificial Sequence
  Synthetic
tttggaacagagtttggatcgaaaacaacaagtggatgtcagacaagactccggtgtgccactggggtgaggttc

SEQ ID NO: 246468 - DNA, 75 bp, Artificial Sequence
  Synthetic
cgtacctgcacaagaaacaggacatagcttgtggaagccagatcgggtctcatgcacgctctgtctggtctcggg

SEQ ID NO: 246469 - DNA, 75 bp, Artificial Sequence
  Synthetic
agcttgtggaagccagatcgggtctcatgcacgctctgtctggtctcgggacatggagtcgcatgttgaaagggt

SEQ ID NO: 246470 - DNA, 75 bp, Artificial Sequence
  Synthetic
tagaaaaacggtggtgctagagaagggacaccaggagtttccgaacgctcttggaatgttcgcgcgatacgcaaa

SEQ ID NO: 246471 - DNA, 75 bp, Artificial Sequence
  Synthetic
ggacaccaggagtttccgaacgctcttggaatgttcgcgcgatacgcaaagccggaagtgtcattgttcagatga

SEQ ID NO: 246472 - DNA, 75 bp, Artificial Sequence
  Synthetic
gcaccacaaggtgtttatttgaacgcaagtaacaaatgtctgaaaactcatagaggtaaggacatccaagtagct

SEQ ID NO: 246473 - DNA, 75 bp, Artificial Sequence
  Synthetic
atagttggaaaattcatagaagtaacaactgtggcttgctcagaaaactcgtagaggtaatgggcaataaaaatc

SEQ ID NO: 246474 - DNA, 75 bp, Artificial Sequence
  Synthetic
gcataacagatgcctgaaaactcacagaggtaaggacatccaaacagccatggttggaaaattcatagaagtaac

SEQ ID NO: 246475 - DNA, 75 bp, Artificial Sequence
  Synthetic
gaccatggcctgctcagaaaactcgcagaggtaatgggcttctaaaaaccgtaaaatacgaacaaagtcagaccg

SEQ ID NO: 246476 - DNA, 75 bp, Artificial Sequence
  Synthetic
aaaagccactcaatggttgtaaagagtgctgtctgtgacaacccaaatagtcgatggaaagacgaaagaggtagg

SEQ ID NO: 246477 - DNA, 75 bp, Artificial Sequence
  Synthetic
ggaatgggaaccccatccaacgaaagttaccggtttatccaccccctggaatgtcgatatattccaggtaggagg

SEQ ID NO: 246478 - DNA, 75 bp, Artificial Sequence
  Synthetic
cacgggctccgtcctccgaacccgaaagggcaaaaaccaagatggtgaaaggccatccacgcagggcaacaggaa

SEQ ID NO: 246479 - DNA, 75 bp, Artificial Sequence
  Synthetic
gaaattccgggtgattagccacaccccccgaaacgtgatttatatgatgacaagaatcagatggaagatccccac

SEQ ID NO: 246480 - DNA, 75 bp, Artificial Sequence
  Synthetic
tttatatgatgacaagaatcagatggaagatccccaccgttaggggatccatccagcattcttggaatcatggct

SEQ ID NO: 246481 - DNA, 75 bp, Artificial Sequence
  Synthetic
cgtacattgagttcacacttgcgtacacacgatgtgaagagagggtgcgacgtaggcgagacactccaaaggcca

SEQ ID NO: 246482 - DNA, 75 bp, Artificial Sequence
  Synthetic
cgtaggcgagacactccaaaggccacggaaaccgtgaaggataggctgaaagagaatatggctgaccttgaggcc

SEQ ID NO: 246483 - DNA, 75 bp, Artificial Sequence
  Synthetic
atgacaatggatgggagggttcagacgttgatcaaaactcaagtgtacccccatggttcggtttccatcgtgacg

SEQ ID NO: 246484 - DNA, 75 bp, Artificial Sequence
  Synthetic
ccggtgcattctttgtctccgagggacagggagtgaaatcattgctctctgattgtcatgtgaacgcgtcgtact

SEQ ID NO: 246485 - DNA, 75 bp, Artificial Sequence
  Synthetic
tggatgcctggaatttggaatgggagctgtggcgacatgtatcgaagtctcatgttcccgtgaactccgagtatc

SEQ ID NO: 246486 - DNA, 75 bp, Artificial Sequence
  Synthetic
tttcttgtggacttggattgtctgacgctctcaacatgtacatcgtggctggagagaagcacaaagttcttctcc

SEQ ID NO: 246487 - DNA, 75 bp, Artificial Sequence
  Synthetic
taaacatcgagaaggggttgtcagatggaatgttccttaaatgcgacatcgtggtggataagctcttggttgaga

SEQ ID NO: 246488 - DNA, 75 bp, Artificial Sequence
  Synthetic
tgagctgatcttcacccaagaccagatcggaactagtggacgcgtgcaagtcacgctgtctgccccttctggggc

SEQ ID NO: 246489 - DNA, 75 bp, Artificial Sequence
  Synthetic
tggcccacggccgaagagcaggtcgagatcgataactacggattgttcgaaggttacgtcgacaacatgttcaaa

SEQ ID NO: 246490 - DNA, 75 bp, Artificial Sequence
  Synthetic
ttgagacccaattggccgttagagaacaagatcgtgaggtggacgcggaacagctaggattcttgaagaaaccgc

SEQ ID NO: 246491 - DNA, 75 bp, Artificial Sequence
  Synthetic
actttgattttaacgaacttaaataaaagccctgttgtttagcgtattgttgcacttgtctggtgggattgtggc

SEQ ID NO: 246492 - DNA, 75 bp, Artificial Sequence
  Synthetic
gtggacatatgctcaacactgggtataattctaattgaatactatttttcagttagagcgtcgtgtctcttgtac

SEQ ID NO: 246493 - DNA, 75 bp, Artificial Sequence
  Synthetic
gtctcggtcacaatacacggtttcgtccggtgcgtggcaattcggggcacatcatgtctttcgtggctggtgtga

SEQ ID NO: 246494 - DNA, 75 bp, Artificial Sequence
  Synthetic
ccgcgcaaggtgcgcgcggtacgtatcgagcagcgctcaactctgaaaaacatcaagaccatgtgtctctaactg

SEQ ID NO: 246495 - DNA, 75 bp, Artificial Sequence
  Synthetic
ggttgaaaaactttcaccatggttcatggatggcgaaaatgcctatgaagtggtgaaggccatgttacttaaaaa

SEQ ID NO: 246496 - DNA, 75 bp, Artificial Sequence
  Synthetic
atggatggcgaaaatgcctatgaagtggtgaaggccatgttacttaaaaaggagccacttctctatgtgcccatc

SEQ ID NO: 246497 - DNA, 75 bp, Artificial Sequence
  Synthetic
tgagaggctcattgcttgtgaaaatccattcatggttaaccaattggcttatagctctagtgcaaatggcagctt

SEQ ID NO: 246498 - DNA, 75 bp, Artificial Sequence
  Synthetic
ggttggcacaactttgcagggcaagcctattggtatgttcttcccttatgacatcgaacttgtcacaggaaagca

SEQ ID NO: 246499 - DNA, 75 bp, Artificial Sequence
  Synthetic
tccactatgagcgagacaacacctcttgccctgagtggatggacgattttgaggcggatcctaaaggcaaatatg

SEQ ID NO: 246500 - DNA, 75 bp, Artificial Sequence
  Synthetic
ttgccctgagtggatggacgattttgaggcggatcctaaaggcaaatatgcccagaatctgcttaagaagttgat

SEQ ID NO: 246501 - DNA, 75 bp, Artificial Sequence
  Synthetic
caatacatgtgtggcgttgatggaaaacccattagtgcctacgcatttttaatggccaaggatggaataaccaaa

SEQ ID NO: 246502 - DNA, 75 bp, Artificial Sequence
  Synthetic
cagcacgtgctgatgacgaaggcttcatcacattaaagaacaatctatatagattggtttggcatgttgagcgta

SEQ ID NO: 246503 - DNA, 75 bp, Artificial Sequence
  Synthetic
catcacattaaagaacaatctatatagattggtttggcatgttgagcgtaaagacgttccatatcctaagcaatc

SEQ ID NO: 246504 - DNA, 75 bp, Artificial Sequence
  Synthetic
agattggtttggcatgttgagcgtaaagacgttccatatcctaagcaatctatttttactattaatagtgtggtc

SEQ ID NO: 246505 - DNA, 75 bp, Artificial Sequence
  Synthetic
gagaacccaacctacatttaccactccgcattcattgagtgtggaagttgtggtaatgattcctggcttacaggg

SEQ ID NO: 246506 - DNA, 75 bp, Artificial Sequence
  Synthetic
ccgcattcattgagtgtggaagttgtggtaatgattcctggcttacagggaatgctatccaagggtttgcctgtg

SEQ ID NO: 246507 - DNA, 75 bp, Artificial Sequence
  Synthetic
tgatgtcgaagtccaatcatctggcatgattaagccaaatgctcttctttgtgctacttgcccctttgctaaggg

SEQ ID NO: 246508 - DNA, 75 bp, Artificial Sequence
  Synthetic
gtgctacttgcccctttgctaagggtgatagctgttcttctaattgcaaacattcagttgctcagttggttagtt

SEQ ID NO: 246509 - DNA, 75 bp, Artificial Sequence
  Synthetic
tgctgattctaagtccttcacacttatctttggtggcgtagcttacgcctactttggatgtgaggaaggtactat

SEQ ID NO: 246510 - DNA, 75 bp, Artificial Sequence
  Synthetic
gaacaaggtcactcaaattgctaacatgttcttggaacagactcagcattcccttaactttgtgggagagttcgt

SEQ ID NO: 246511 - DNA, 75 bp, Artificial Sequence
  Synthetic
atgttcttggaacagactcagcattcccttaactttgtgggagagttcgttgtcaacgatgttgtcctcgcaatt

SEQ ID NO: 246512 - DNA, 75 bp, Artificial Sequence
  Synthetic
tgagtcctttaagaaagttgcaaccataccgtacaaggtttgcaactctgttaaggatactctgacttattatgc

SEQ ID NO: 246513 - DNA, 75 bp, Artificial Sequence
  Synthetic
ttaaggatactctgacttattatgctcacagcgtgttgtacagagtttttccttatgacatggattctggtgtgt

SEQ ID NO: 246514 - DNA, 75 bp, Artificial Sequence
  Synthetic
gctgttagtaagcttctagatacatgttttgaagctacagaagcaacatttaacttcttgttagatttggcagga

SEQ ID NO: 246515 - DNA, 75 bp, Artificial Sequence
  Synthetic
cctatgtgtacacttcacaagggtttgtggtggtcaatggcaaagtttctacacttgtcaaacaagtgttagact

SEQ ID NO: 246516 - DNA, 75 bp, Artificial Sequence
  Synthetic
tgtggtggtcaatggcaaagtttctacacttgtcaaacaagtgttagacttgcttaataagggtatgcaactttt

SEQ ID NO: 246517 - DNA, 75 bp, Artificial Sequence
  Synthetic
gttttccaagaagcagttaggactgctccaacctactgacaattctacaactgttagtgttactgtatccagtaa

SEQ ID NO: 246518 - DNA, 75 bp, Artificial Sequence
  Synthetic
ctccaacctactgacaattctacaactgttagtgttactgtatccagtaacatggttgaaactgttgtgggtcaa

SEQ ID NO: 246519 - DNA, 75 bp, Artificial Sequence
  Synthetic
ctgttagtgttactgtatccagtaacatggttgaaactgttgtgggtcaacttgagcaaactaatatgcatagtc

SEQ ID NO: 246520 - DNA, 75 bp, Artificial Sequence
  Synthetic
cattattagtgaaaaattgtttgtgcgtagtaaggaagaagacggatttgccttctaccctgcttgcactaatgg

SEQ ID NO: 246521 - DNA, 75 bp, Artificial Sequence
  Synthetic
cgtagtaaggaagaagacggatttgccttctaccctgcttgcactaatggtcatgctgtaccgactctctttaga

SEQ ID NO: 246522 - DNA, 75 bp, Artificial Sequence
  Synthetic
aagtagcctttggcggtgatcaagtacatgaggttgctgctgtaagaagtgttactgtcgagtacaacattcatg

SEQ ID NO: 246523 - DNA, 75 bp, Artificial Sequence
  Synthetic
ctgtattagacacactacttgcttcttctagtcttagaacctttgttgtagataagtctttgtcaattgaggagt

SEQ ID NO: 246524 - DNA, 75 bp, Artificial Sequence
  Synthetic
gataagtctttgtcaattgaggagtttgctgacgtagtaaaggaacaagtctcagacttgcttgttaaattactg

SEQ ID NO: 246525 - DNA, 75 bp, Artificial Sequence
  Synthetic
ttgctgacgtagtaaaggaacaagtctcagacttgcttgttaaattactgcgtggaatgccgattccagattttg

SEQ ID NO: 246526 - DNA, 75 bp, Artificial Sequence
  Synthetic
atgctattgctttaacgctgagggtgatgcatcttggtcttctactatgatcttctctcttcaccccgtcgagtg

SEQ ID NO: 246527 - DNA, 75 bp, Artificial Sequence
  Synthetic
tgaagcagaagatgttactgaatctgtgcaagaagaagcacaaccagtagaagtacctgttgaagatattgcgca

SEQ ID NO: 246528 - DNA, 75 bp, Artificial Sequence
  Synthetic
agggagtctctaatattcccatcgggaacctattactgtgtcaccactaaggctaagtccgttcaacaagatctt

SEQ ID NO: 246529 - DNA, 75 bp, Artificial Sequence
  Synthetic
ctgtctatgaggctgataccgaacagacacagagtgttactgttaaacctaagaggttacgcaaaaagcgtaatg

SEQ ID NO: 246530 - DNA, 75 bp, Artificial Sequence
  Synthetic
gacacagagtgttactgttaaacctaagaggttacgcaaaaagcgtaatgttgaccctttgtccaattttgaaca

SEQ ID NO: 246531 - DNA, 75 bp, Artificial Sequence
  Synthetic
atagttttaggtgacgcaattcaagtagccaagtgctatggggagtctgtgttagttaatgctgctaacacacat

SEQ ID NO: 246532 - DNA, 75 bp, Artificial Sequence
  Synthetic
gttagttaatgctgctaacacacatcttaagcatggcggtggtatcgctggtgctattaatgcggcttcaaaagg

SEQ ID NO: 246533 - DNA, 75 bp, Artificial Sequence
  Synthetic
tatattctggctaaagggccgttacaagtaggagattcagttctcttgcaaggccattctctagctaagaatatc

SEQ ID NO: 246534 - DNA, 75 bp, Artificial Sequence
  Synthetic
aagtaggagattcagttctcttgcaaggccattctctagctaagaatatcctgcatgtcgtaggcccagatgccc

SEQ ID NO: 246535 - DNA, 75 bp, Artificial Sequence
  Synthetic
tagtaagtgctataaggctatgaatgcatatcctcttgtagtcactcctcttgtttcagcaggcatatttggtgt

SEQ ID NO: 246536 - DNA, 75 bp, Artificial Sequence
  Synthetic
gcatatcctcttgtagtcactcctcttgtttcagcaggcatatttggtgtaaaaccagctgtgtcttttgattat

SEQ ID NO: 246537 - DNA, 75 bp, Artificial Sequence
  Synthetic
ttttagtcgtcgttaattcccaagatgtctataagagtcttaccatagttgacattccacagagtttgacttttt

SEQ ID NO: 246538 - DNA, 75 bp, Artificial Sequence
  Synthetic
tgtctataagagtcttaccatagttgacattccacagagtttgactttttcatatgatgggttacgtggcgcaat

SEQ ID NO: 246539 - DNA, 75 bp, Artificial Sequence
  Synthetic
attattgctacacgtctaaggacactttagatgatatcttacaacaggctaataagtctgttggtattatatcta

SEQ ID NO: 246540 - DNA, 75 bp, Artificial Sequence
  Synthetic
aataagtctgttggtattatatctatgcctttgggatatgtgtctcatggtttagacttaattcaagcagggagt

SEQ ID NO: 246541 - DNA, 75 bp, Artificial Sequence
  Synthetic
gtcgtgcgtagagttaacgtgccctacgtgtgtctcctagctaataaagagcaagaagctattttgatgtctgaa

SEQ ID NO: 246542 - DNA, 75 bp, Artificial Sequence
  Synthetic
tggtggttacaattcttggcatttagtcgagggtgaactattggtgcaagacttacgcttaaataagctcctgca

SEQ ID NO: 246543 - DNA, 75 bp, Artificial Sequence
  Synthetic
gtcgagggtgaactattggtgcaagacttacgcttaaataagctcctgcattggtctgatcaaaccatatgctac

SEQ ID NO: 246544 - DNA, 75 bp, Artificial Sequence
  Synthetic
agaatagtacagcttttccatttgaaacactttcagcatgtcgtgcgtatttggattcacgcacgacacagcagt

SEQ ID NO: 246545 - DNA, 75 bp, Artificial Sequence
  Synthetic
aacactttcagcatgtcgtgcgtatttggattcacgcacgacacagcagttaacaatcgaagtcttagtgactgt

SEQ ID NO: 246546 - DNA, 75 bp, Artificial Sequence
  Synthetic
gttctaaataataagaacacttatagatcacagcttggatgcgttttctttaatggtgctgatatttctgatacc

SEQ ID NO: 246547 - DNA, 75 bp, Artificial Sequence
  Synthetic
gatcacagcttggatgcgttttctttaatggtgctgatatttctgataccattcctgatgagaaacagaatggtc

SEQ ID NO: 246548 - DNA, 75 bp, Artificial Sequence
  Synthetic
gactgctgatgaaacaaaggcgcttaaagagttatatggccccgttgatcctactttcttacacagattctattc

SEQ ID NO: 246549 - DNA, 75 bp, Artificial Sequence
  Synthetic
acacttgatttattgaaggacattaaatttgttatacctgctctacagcatgcatttatgaaacataagggcggt

SEQ ID NO: 246550 - DNA, 75 bp, Artificial Sequence
  Synthetic
aatttgttatacctgctctacagcatgcatttatgaaacataagggcggtgattcaactgacttcatagccctca

SEQ ID NO: 246551 - DNA, 75 bp, Artificial Sequence
  Synthetic
tggtgctccagatgatgcctctcggttacttcataccgtgcttgcaaaggctgagttatgctgttctgcacgcat

SEQ ID NO: 246552 - DNA, 75 bp, Artificial Sequence
  Synthetic
tgtggcataaaagatgttgttctacaaggcttaaaagcttgttgttacgtgggtgtgcaaactgttgaagatctg

SEQ ID NO: 246553 - DNA, 75 bp, Artificial Sequence
  Synthetic
agtgtggtggtgaacgtcatcggcaaatagtcgaacacaccaccccctggttgctgctctcaggcacaccaaatg

SEQ ID NO: 246554 - DNA, 75 bp, Artificial Sequence
  Synthetic
ttgctgctctcaggcacaccaaatgaaaaattggtgacaacctccacggcgcctgattttgtagcgtttaatgtc

SEQ ID NO: 246555 - DNA, 75 bp, Artificial Sequence
  Synthetic
gccattatgttcatgctcgcctgaagggtggtcttattttaaagtttgactctggcaccgttagcaagacttcag

SEQ ID NO: 246556 - DNA, 75 bp, Artificial Sequence
  Synthetic
gggtggtcttattttaaagtttgactctggcaccgttagcaagacttcagactggaagtgcaaggtgacagatgt

SEQ ID NO: 246557 - DNA, 75 bp, Artificial Sequence
  Synthetic
agcgattgtaatgtcgtacggtattctttggacggtaatttcagaacagaggttgatcccgacctatctgctttc

SEQ ID NO: 246558 - DNA, 75 bp, Artificial Sequence
  Synthetic
ctttggacggtaatttcagaacagaggttgatcccgacctatctgctttctatgttaaggatggtaaatacttta

SEQ ID NO: 246559 - DNA, 75 bp, Artificial Sequence
  Synthetic
accagctacaattttagctggtagtgtctacactaatagctgccttgtatcgtctgatggacaacctggcggtga

SEQ ID NO: 246560 - DNA, 75 bp, Artificial Sequence
  Synthetic
gtctacactaatagctgccttgtatcgtctgatggacaacctggcggtgatgctattagtttgagttttaataac

SEQ ID NO: 246561 - DNA, 75 bp, Artificial Sequence
  Synthetic
cagtcactaagaaatacacttactccttcttgcctaaagaagacggcgatgtgttgttggctgagtttgacactt

SEQ ID NO: 246562 - DNA, 75 bp, Artificial Sequence
  Synthetic
accagttgaacctccaactgtagatgtggtagcacttcaacaggaaatgacaattgtcaaatgtaagggtttaaa

SEQ ID NO: 246563 - DNA, 75 bp, Artificial Sequence
  Synthetic
gtggtagcacttcaacaggaaatgacaattgtcaaatgtaagggtttaaataaacctttcgtgaaggacaatgtc

SEQ ID NO: 246564 - DNA, 75 bp, Artificial Sequence
  Synthetic
agaagatctacatacattgtatgtagaccctaagtatcaagtcattgtcttaaaagacaatgtactttcttctat

SEQ ID NO: 246565 - DNA, 75 bp, Artificial Sequence
  Synthetic
ggtgatattaacgttgttgcagcttccggatctttgacacgtaaagtgaaattactatttagggcttcattttat

SEQ ID NO: 246566 - DNA, 75 bp, Artificial Sequence
  Synthetic
ttcaaagaatttgctacccgcactttcactgctaccactgctgtaggtagttgtataaagagtgtagtgcggcat

SEQ ID NO: 246567 - DNA, 75 bp, Artificial Sequence
  Synthetic
ttgtataaagagtgtagtgcggcatctaggtgttactaaaggcatattgacaggctgttttagttttgtcaagat

SEQ ID NO: 246568 - DNA, 75 bp, Artificial Sequence
  Synthetic
tttagtgattcaaaactcggcaccacagaggttaaagtgagtgctttgaaaacagctggcgttgtgacaggtaat

SEQ ID NO: 246569 - DNA, 75 bp, Artificial Sequence
  Synthetic
ctgttgatttaagtatggataagttgcgccgtgtggattggaaatcaaccctacggttgttacttatgttatgca

SEQ ID NO: 246570 - DNA, 75 bp, Artificial Sequence
  Synthetic
gcgccgtgtggattggaaatcaaccctacggttgttacttatgttatgcacaactatggtattgttgtcttctgt

SEQ ID NO: 246571 - DNA, 75 bp, Artificial Sequence
  Synthetic
gtcttatcaagtgatgttatgtttgaagatgcccaaggtttgaaaaagttctacaaagaagttagagcttaccta

SEQ ID NO: 246572 - DNA, 75 bp, Artificial Sequence
  Synthetic
ctacaaagaagttagagcttacctaggaatctcttctgcttgtgacggtcttgcttcagcttatagggcgaattc

SEQ ID NO: 246573 - DNA, 75 bp, Artificial Sequence
  Synthetic
ctttgatgtacctacattctgcgcaaaccgttctgcaatgtgtaattggtgcttgattagccaagattccataac

SEQ ID NO: 246574 - DNA, 75 bp, Artificial Sequence
  Synthetic
ttaacatagattggttgtggtttgcatttgagactggtttggcatacatgctctatacctcggccttcaactggt

SEQ ID NO: 246575 - DNA, 75 bp, Artificial Sequence
  Synthetic
atttgagactggtttggcatacatgctctatacctcggccttcaactggttgttgttggcaggtacattgcatta

SEQ ID NO: 246576 - DNA, 75 bp, Artificial Sequence
  Synthetic
tcagcatgtaatcaatggttgcaaagatacggcatgcttgctctgctataagaggaaccgacttactagagttga

SEQ ID NO: 246577 - DNA, 75 bp, Artificial Sequence
  Synthetic
gatacggcatgcttgctctgctataagaggaaccgacttactagagttgaagcttctaccgttgtctgtggtgga

SEQ ID NO: 246578 - DNA, 75 bp, Artificial Sequence
  Synthetic
gacaatgtactttcttctatgcttagattgcacaccgttgagtcaggtgatattaacgttgttgcagcttccgga

SEQ ID NO: 246579 - DNA, 75 bp, Artificial Sequence
  Synthetic
atggcggtatttcattctgtcgtaggcataattggaattgtgtggattgtgacactgcaggtgtggggaatacct

SEQ ID NO: 246580 - DNA, 75 bp, Artificial Sequence
  Synthetic
gcatgtgaacacatttcttctaccatgtctcaatactcccgttctacgcgatcaatgcttaaacggcgagattct

SEQ ID NO: 246581 - DNA, 75 bp, Artificial Sequence
  Synthetic
gcataattggaattgtgtggattgtgacactgcaggtgtggggaataccttcatctgtgaagaagtcgcaaatga

SEQ ID NO: 246582 - DNA, 75 bp, Artificial Sequence
  Synthetic
attaacgctacggatagatcacattattatgtggattccgttacagttaaagagactgttgttcagtttaattat

SEQ ID NO: 246583 - DNA, 75 bp, Artificial Sequence
  Synthetic
attatgtggattccgttacagttaaagagactgttgttcagtttaattatcgtagagacggtcaaccattctacg

SEQ ID NO: 246584 - DNA, 75 bp, Artificial Sequence
  Synthetic
aaatctagataagttgaagttcaaagaggtctgtaaaactactactggtatacctgaatacaactttatcatcta

SEQ ID NO: 246585 - DNA, 75 bp, Artificial Sequence
  Synthetic
gaggtctgtaaaactactactggtatacctgaatacaactttatcatctacgactcatcagatcgtggccaggaa

SEQ ID NO: 246586 - DNA, 75 bp, Artificial Sequence
  Synthetic
attattctcaagtcttgtgtaaatcaattcttttggttgactcaagtttggttacttctgttggtgattctagtg

SEQ ID NO: 246587 - DNA, 75 bp, Artificial Sequence
  Synthetic
aattcttttggttgactcaagtttggttacttctgttggtgattctagtgaaatcgccactaaaatgtttgattc

SEQ ID NO: 246588 - DNA, 75 bp, Artificial Sequence
  Synthetic
tataatgtcacacgcgataagttggaaaaacttatctctactgctcgtgatggcgtaaggcgaggcgataacttc

SEQ ID NO: 246589 - DNA, 75 bp, Artificial Sequence
  Synthetic
ggagtctgatgttgagaccaatgaaattgttgactctgtgcagtatgctcataaacatgacatacaaattactaa

SEQ ID NO: 246590 - DNA, 75 bp, Artificial Sequence
  Synthetic
tgattgtaatgcggcttcagttaaccaaattgtcttgcgtaattctaatggtgcttgtatttggaacgctgctgc

SEQ ID NO: 246591 - DNA, 75 bp, Artificial Sequence
  Synthetic
aaacgacagattcgcattgcatgccgtaagtgtaatttagctttccggttaaccacctcaaagctacgcgctaat

SEQ ID NO: 246592 - DNA, 75 bp, Artificial Sequence
  Synthetic
aaccacctcaaagctacgcgctaatgataatatcttatcagttagattcactgctaacaaaattgttggtggtgc

SEQ ID NO: 246593 - DNA, 75 bp, Artificial Sequence
  Synthetic
gataatatcttatcagttagattcactgctaacaaaattgttggtggtgctcctacatggtttaatgcgttgcgt

SEQ ID NO: 246594 - DNA, 75 bp, Artificial Sequence
  Synthetic
ttgctaccattattgtgtttctgtgtgctgtactgatgtatttgtgtttacctacattttctatggtacctgttg

SEQ ID NO: 246595 - DNA, 75 bp, Artificial Sequence
  Synthetic
aattttatgaagaccgcatcttggactttaaagttcttgataatggtatcattagggatgtaaatcctgatgata

SEQ ID NO: 246596 - DNA, 75 bp, Artificial Sequence
  Synthetic
cttcacacaatggtatcatgagcatgttggtggtgtctatgacaactctatcacatgcccattgacagttgcagt

SEQ ID NO: 246597 - DNA, 75 bp, Artificial Sequence
  Synthetic
tcacatgcccattgacagttgcagtaattgctggagttgctggtgctcgcattccagacgtacctactacattgg

SEQ ID NO: 246598 - DNA, 75 bp, Artificial Sequence
  Synthetic
ctttgtttctcgagtctttgctaatacaggcagtgtttgctacactcctatagatgagataccctataagagttt

SEQ ID NO: 246599 - DNA, 75 bp, Artificial Sequence
  Synthetic
tagatgagataccctataagagtttctctgatagtggttgcattcttccatctgagtgcactatgtttagggatg

SEQ ID NO: 246600 - DNA, 75 bp, Artificial Sequence
  Synthetic
cagagggccgtatgacaccatactgccatgatcctactgttttgcctggggcttttgcgtacagtcagatgaggc

SEQ ID NO: 246601 - DNA, 75 bp, Artificial Sequence
  Synthetic
tggtaacatgtttattaaatttcctgaagtagtatttgaaagtacacttaggattactagaactctgtcaactca

SEQ ID NO: 246602 - DNA, 75 bp, Artificial Sequence
  Synthetic
gaagtagtatttgaaagtacacttaggattactagaactctgtcaactcagtactgccggttcggtagttgtgag

SEQ ID NO: 246603 - DNA, 75 bp, Artificial Sequence
  Synthetic
ggattactagaactctgtcaactcagtactgccggttcggtagttgtgagtatgcacaagagggtgtttgtatta

SEQ ID NO: 246604 - DNA, 75 bp, Artificial Sequence
  Synthetic
taatgaccaccatcttaatagacctggtgtctattgtggctctgattttattgacattgtcaggcggttagcagt

SEQ ID NO: 246605 - DNA, 75 bp, Artificial Sequence
  Synthetic
ggtgtctattgtggctctgattttattgacattgtcaggcggttagcagtatcactgttccagcctattacttat

SEQ ID NO: 246606 - DNA, 75 bp, Artificial Sequence
  Synthetic
tgggtataggtttgtgtgcgttcctgactttgctcttctattatattaataaagtaaaacgtgcttttgcagatt

SEQ ID NO: 246607 - DNA, 75 bp, Artificial Sequence
  Synthetic
gactttgctcttctattatattaataaagtaaaacgtgcttttgcagattacacccagtgtgctgtaattgctgt

SEQ ID NO: 246608 - DNA, 75 bp, Artificial Sequence
  Synthetic
tgcatctgctttgttgcctctataccattgtgtatagtaccttacactgcattgtactattatgctacattctat

SEQ ID NO: 246609 - DNA, 75 bp, Artificial Sequence
  Synthetic
cattgtgtatagtaccttacactgcattgtactattatgctacattctattttactaatgagcctgcatttatta

SEQ ID NO: 246610 - DNA, 75 bp, Artificial Sequence
  Synthetic
cgggcctatcgttcccatatggatgacctgcgtctatacagttgcaatgtgctttagacacttcttctgggtttt

SEQ ID NO: 246611 - DNA, 75 bp, Artificial Sequence
  Synthetic
acctgcgtctatacagttgcaatgtgctttagacacttcttctgggttttagcttattttagtaagaaacatgta

SEQ ID NO: 246612 - DNA, 75 bp, Artificial Sequence
  Synthetic
attgtagtttccaggacgctgcctctaatatctttgttattaacaaggacacttatgcagctcttagaaactctt

SEQ ID NO: 246613 - DNA, 75 bp, Artificial Sequence
  Synthetic
tttggggttgtttaacaagtataagtacttctctggtgctatggaaacagccgcttatcgtgaagctgcagcatg

SEQ ID NO: 246614 - DNA, 75 bp, Artificial Sequence
  Synthetic
tacagcgagactggtagtgatcttctttaccaaccacccaactgtagcataacctctggcgtgttgcaaagcggt

SEQ ID NO: 246615 - DNA, 75 bp, Artificial Sequence
  Synthetic
tttaccaaccacccaactgtagcataacctctggcgtgttgcaaagcggtttggtgaaaatgtcacatcccagtg

SEQ ID NO: 246616 - DNA, 75 bp, Artificial Sequence
  Synthetic
ggttacctgcggtagcatgactcttaatggtctttggcttgacaacacagtctggtgcccacgacacgtaatgtg

SEQ ID NO: 246617 - DNA, 75 bp, Artificial Sequence
  Synthetic
aattatgatgccttgttgatttctatgactaatcatagtttcagtgtgcaaaaacacattggcgctccagcaaac

SEQ ID NO: 246618 - DNA, 75 bp, Artificial Sequence
  Synthetic
ttgcgtgttgttggtcatgccatgcaaggcactcttttgaagttgactgtcgatgttgctaaccctagcactcca

SEQ ID NO: 246619 - DNA, 75 bp, Artificial Sequence
  Synthetic
aaggcactcttttgaagttgactgtcgatgttgctaaccctagcactccagcctacacttttacaacagtgaaac

SEQ ID NO: 246620 - DNA, 75 bp, Artificial Sequence
  Synthetic
atgctataatggtcgtccgactggtacattcactgttgtaatgcgccctaactacacaattaagggttcctttct

SEQ ID NO: 246621 - DNA, 75 bp, Artificial Sequence
  Synthetic
atttttgttacatgcatcaaatggaacttgctaatggtacacataccggttcagcatttgatggtactatgtatg

SEQ ID NO: 246622 - DNA, 75 bp, Artificial Sequence
  Synthetic
tcagcatttgatggtactatgtatggtgcctttatggataaacaagtgcaccaagttcagttaacagacaaatac

SEQ ID NO: 246623 - DNA, 75 bp, Artificial Sequence
  Synthetic
tgcagtgttaatgtagtagcttggctttacgcagcaatacttaatggttgcgcttggtttgtaaaacctaatcgc

SEQ ID NO: 246624 - DNA, 75 bp, Artificial Sequence
  Synthetic
tttacgcagcaatacttaatggttgcgcttggtttgtaaaacctaatcgcactagtgttgtttcttttaatgaat

SEQ ID NO: 246625 - DNA, 75 bp, Artificial Sequence
  Synthetic
atttgttggcactcaatccgttgacatgttagctgtcaaaacaggcgttgctattgaacagctgctttatgcgat

SEQ ID NO: 246626 - DNA, 75 bp, Artificial Sequence
  Synthetic
ggaaagcaaatccttggcagtactatgttggaagatgaattcacacctgaggatgttaatatgcagattatgggt

SEQ ID NO: 246627 - DNA, 75 bp, Artificial Sequence
  Synthetic
tgttggaagatgaattcacacctgaggatgttaatatgcagattatgggtgtggttatgcagagtggtgtgagaa

SEQ ID NO: 246628 - DNA, 75 bp, Artificial Sequence
  Synthetic
aagttacatatggtactgcgcattggttgttcgcgacccttgtctcaacctatgtgataatcttacaagccacta

SEQ ID NO: 246629 - DNA, 75 bp, Artificial Sequence
  Synthetic
aatttactttgtggaactacttgtttgagactattcccacacagttgttcccactcttatttgtgactatggcct

SEQ ID NO: 246630 - DNA, 75 bp, Artificial Sequence
  Synthetic
tgagactattcccacacagttgttcccactcttatttgtgactatggccttcgttatgttgttggttaaacacaa

SEQ ID NO: 246631 - DNA, 75 bp, Artificial Sequence
  Synthetic
tcgttatgttgttggttaaacacaaacacacctttttgacacttttcttgttgcctgtggctatttgtttgactt

SEQ ID NO: 246632 - DNA, 75 bp, Artificial Sequence
  Synthetic
atgcaaacatagtctacgagcccactactcccatttcgtcagcgctgattgcagttgcaaattggcttgccccca

SEQ ID NO: 246633 - DNA, 75 bp, Artificial Sequence
  Synthetic
tactcccatttcgtcagcgctgattgcagttgcaaattggcttgcccccactaatgcttatatgcgcactacaca

SEQ ID NO: 246634 - DNA, 75 bp, Artificial Sequence
  Synthetic
atgtcacttgtattagtcattgtagtgaagagattgtacaacccatcactttctaactttgcgttagcattgtgc

SEQ ID NO: 246635 - DNA, 75 bp, Artificial Sequence
  Synthetic
ttctaactttgcgttagcattgtgcagtggtgtaatgtggttgtacacttatagcattggagaagcctcaagccc

SEQ ID NO: 246636 - DNA, 75 bp, Artificial Sequence
  Synthetic
acactcactagtgattatacgattacagtctttgttactgtcaaccttgcaaaagtttgcacttatgccatcttt

SEQ ID NO: 246637 - DNA, 75 bp, Artificial Sequence
  Synthetic
tgtttccggaagtgaagatgatacttttattatacacatgtttaggtttcatgtgtacttgctattttggtgtct

SEQ ID NO: 246638 - DNA, 75 bp, Artificial Sequence
  Synthetic
agcacctatgggtgtctatgactttaaggtctcaacacaagagttcagattcatgactgctaacaatctaactgc

SEQ ID NO: 246639 - DNA, 75 bp, Artificial Sequence
  Synthetic
tcatgactgctaacaatctaactgcacctagaaattcttgggaggctatggctctgaactttaagttaataggta

SEQ ID NO: 246640 - DNA, 75 bp, Artificial Sequence
  Synthetic
tgctgctatgcagtctaaacttacagatcttaaatgcacatctgtggttctcctctctgtgctccaacagttaca

SEQ ID NO: 246641 - DNA, 75 bp, Artificial Sequence
  Synthetic
gatcttaaatgcacatctgtggttctcctctctgtgctccaacagttacacttagaggctaatagtagggcctgg

SEQ ID NO: 246642 - DNA, 75 bp, Artificial Sequence
  Synthetic
atatattggcagcaacagaccccagtgaggctttcgagaaattcgtaagtctctttgccactttaatgacttttt

SEQ ID NO: 246643 - DNA, 75 bp, Artificial Sequence
  Synthetic
tgaggctttcgagaaattcgtaagtctctttgccactttaatgactttttctggtaatgtagatcttgatgcgtt

SEQ ID NO: 246644 - DNA, 75 bp, Artificial Sequence
  Synthetic
agttttcacacttagctacctttgctgagttggaagctgcgcagaaagcctatcaggaagctatggactctggtg

SEQ ID NO: 246645 - DNA, 75 bp, Artificial Sequence
  Synthetic
tttgcagaaggctgttaatatagctaaaaacgcctatgagaaggataaggcagtggcccgtaagttagaacgtat

SEQ ID NO: 246646 - DNA, 75 bp, Artificial Sequence
  Synthetic
cagtggcccgtaagttagaacgtatggctgatcaggctatgacttctatgtataagcaagcacgtgctgaagaca

SEQ ID NO: 246647 - DNA, 75 bp, Artificial Sequence
  Synthetic
tataagcaagcacgtgctgaagacaagaaagcaaaaattgtcagtgctatgcaaactatgttgtttggtatgatt

SEQ ID NO: 246648 - DNA, 75 bp, Artificial Sequence
  Synthetic
agaaagcaaaaattgtcagtgctatgcaaactatgttgtttggtatgattaagaagctcgacaacgatgttctta

SEQ ID NO: 246649 - DNA, 75 bp, Artificial Sequence
  Synthetic
ctggaatcaggtagtcacatatccctcgcttaactacgctggggctttgtgggacattacagttataaacaatgt

SEQ ID NO: 246650 - DNA, 75 bp, Artificial Sequence
  Synthetic
tcgcttaactacgctggggctttgtgggacattacagttataaacaatgtggacaatgaaattgttaagtcttca

SEQ ID NO: 246651 - DNA, 75 bp, Artificial Sequence
  Synthetic
taacatggccacttgttttagaatgcactagggcatccacttctgccgttaagttgcaaaataatgagatcaaac

SEQ ID NO: 246652 - DNA, 75 bp, Artificial Sequence
  Synthetic
cactagggcatccacttctgccgttaagttgcaaaataatgagatcaaaccttcaggtttaaaaaccatggttgt

SEQ ID NO: 246653 - DNA, 75 bp, Artificial Sequence
  Synthetic
tgtaatactagttccttagcttattacgaacctgtgcagggtcgtaaaatgctgatggctcttctttctgataat

SEQ ID NO: 246654 - DNA, 75 bp, Artificial Sequence
  Synthetic
agagctacaacctccttgcaaattcttgattgcgggaccaaaaggacctgaaatccgatatctctattttgttaa

SEQ ID NO: 246655 - DNA, 75 bp, Artificial Sequence
  Synthetic
aaatccgatatctctattttgttaaaaatcttaacaaccttcatcgcgggcaagtgttagggcacattgctgcga

SEQ ID NO: 246656 - DNA, 75 bp, Artificial Sequence
  Synthetic
ctgttagattgcaagctggttctaacaccgagtttgcctctaattcttcggtgttgtcacttgttaacttcaccg

SEQ ID NO: 246657 - DNA, 75 bp, Artificial Sequence
  Synthetic
ttgacaaattgtgttaagatgcttactcctaaaactggtacaggtatagctatatctgttaaaccagagagtaca

SEQ ID NO: 246658 - DNA, 75 bp, Artificial Sequence
  Synthetic
tcaaataccccctgtaatgtctgtcaatattggattggatatgggtgcaattgtgactcgcttaggcaagcagca

SEQ ID NO: 246659 - DNA, 75 bp, Artificial Sequence
  Synthetic
ttttaaacgagtccggggttctattgtaaatgcccgaatagaaccctgttcaagtggtttgtccactgatgtcgt

SEQ ID NO: 246660 - DNA, 75 bp, Artificial Sequence
  Synthetic
gtaaatgcccgaatagaaccctgttcaagtggtttgtccactgatgtcgtctttagggcatttgacatctgcaac

SEQ ID NO: 246661 - DNA, 75 bp, Artificial Sequence
  Synthetic
taggtttgtagaattagatgaccaagggcatcatttagactcctattttgtcgttaagaggcatactatggagaa

SEQ ID NO: 246662 - DNA, 75 bp, Artificial Sequence
  Synthetic
tagctccccatgatttcttcatctttgatgtagacaaagttaaaacacctcatattgtacgtcagcgtttaactg

SEQ ID NO: 246663 - DNA, 75 bp, Artificial Sequence
  Synthetic
tccaagtgttcagcctggtccaatgattgatgttaacactgattagtgtcactcaaagtaacaagatcgcggcaa

SEQ ID NO: 246664 - DNA, 75 bp, Artificial Sequence
  Synthetic
agtacactatgatggatcttgtatatgccctgaggcactttgatcaaaatagcgaagtgcttaaggctatcttag

SEQ ID NO: 246665 - DNA, 75 bp, Artificial Sequence
  Synthetic
gattttgttgaaaatcccagtgttattggtgtttatcataaacttggagaacgtgtacgccaagctatcttaaac

SEQ ID NO: 246666 - DNA, 75 bp, Artificial Sequence
  Synthetic
tcaaggctggtttagtcggtgtgctcacactagacaaccaggaccttaatggcaagtggtatgattttggtgact

SEQ ID NO: 246667 - DNA, 75 bp, Artificial Sequence
  Synthetic
acatagggattgtgattttaataaaccactcattgagtggccacttactgagtatgattttactgattataaggt

SEQ ID NO: 246668 - DNA, 75 bp, Artificial Sequence
  Synthetic
tattgggatcagacgtatcacgcaaattgcgttaattgtactgatgaccgttgtgtgttacattgtgctaatttc

SEQ ID NO: 246669 - DNA, 75 bp, Artificial Sequence
  Synthetic
ctaagacttgtttcggacccatagtccgaaagatctttgttgatggcgtgccatttgtagtatcttgtggttatc

SEQ ID NO: 246670 - DNA, 75 bp, Artificial Sequence
  Synthetic
ccatttgtagtatcttgtggttatcactacaaagaattaggtttagtcatgaatatggatgttagtctccataga

SEQ ID NO: 246671 - DNA, 75 bp, Artificial Sequence
  Synthetic
gaatatggatgttagtctccatagacataggctctctcttaaggagttgatgatgtatgccgctgatccagccat

SEQ ID NO: 246672 - DNA, 75 bp, Artificial Sequence
  Synthetic
cataggctctctcttaaggagttgatgatgtatgccgctgatccagccatgcacattgcctcctctaacgctttt

SEQ ID NO: 246673 - DNA, 75 bp, Artificial Sequence
  Synthetic
cttgatttgaggacatcatgttttagtgtcgctgcacttacaactggtttgacttttcaaactgtgcggcctggc

SEQ ID NO: 246674 - DNA, 75 bp, Artificial Sequence
  Synthetic
tcgtggtatctaaaggtttctttaaggagggctcttcagtgacgctcaaacattttttctttgctcaagatggta

SEQ ID NO: 246675 - DNA, 75 bp, Artificial Sequence
  Synthetic
tgtgacatcaaacaaatgttgttctgcatggaagttgtaaacaagtacttcgaaatctatgacggtggttgtctt

SEQ ID NO: 246676 - DNA, 75 bp, Artificial Sequence
  Synthetic
gcatggaagttgtaaacaagtacttcgaaatctatgacggtggttgtcttaatgcttctgaagtggttgttaata

SEQ ID NO: 246677 - DNA, 75 bp, Artificial Sequence
  Synthetic
ttttaataagtttggcaaagctcgtgtctattatgagagcatgtcttaccaggagcaagatgaactctttgccat

SEQ ID NO: 246678 - DNA, 75 bp, Artificial Sequence
  Synthetic
atgactcaaatgaatctaaaatatgctattagtgctaagaatagagctcgcactgttgcaggcgtgtccatactt

SEQ ID NO: 246679 - DNA, 75 bp, Artificial Sequence
  Synthetic
gggaagagctctacagtgtgaaatgtaaataaaaatagctattattcaattagattaggctaattagatgatttg

SEQ ID NO: 246680 - DNA, 75 bp, Artificial Sequence
  Synthetic
atcagaaaatgcttaagtccatggctgcaactcgtggagcgacttgcgtcattggtactacaaagttctatggtg

SEQ ID NO: 246681 - DNA, 75 bp, Artificial Sequence
  Synthetic
gtacaaagatgttgataatccgcatcttatgggttgggattaccctaagtgtgatagagctatgcctaatatgtg

SEQ ID NO: 246682 - DNA, 75 bp, Artificial Sequence
  Synthetic
cttatgggttgggattaccctaagtgtgatagagctatgcctaatatgtgtagaatcttcgcttcactcatatta

SEQ ID NO: 246683 - DNA, 75 bp, Artificial Sequence
  Synthetic
gtgatagagctatgcctaatatgtgtagaatcttcgcttcactcatattagctcgtaaacatggcacttgttgta

SEQ ID NO: 246684 - DNA, 75 bp, Artificial Sequence
  Synthetic
gaagaaggtgaatcagagtgcatttctgagacttcaactgaacaagttgacgtttctcatgagatttctgacgac

SEQ ID NO: 246685 - DNA, 75 bp, Artificial Sequence
  Synthetic
ggcaaatgagtgtgctcaggtgctaagcgaatatgttctatgtggtggtggttactacgtcaaacctggaggtac

SEQ ID NO: 246686 - DNA, 75 bp, Artificial Sequence
  Synthetic
gttactacgtcaaacctggaggtaccagtagcggagatgccaccactgcatatgccaatagtgtctttaacattt

SEQ ID NO: 246687 - DNA, 75 bp, Artificial Sequence
  Synthetic
cttttcttaataagcacttttctatgatgatactgtctgatgacggtgtcgtttgctataatagtgattatgcag

SEQ ID NO: 246688 - DNA, 75 bp, Artificial Sequence
  Synthetic
gatgatactgtctgatgacggtgtcgtttgctataatagtgattatgcagctaagggttacattgctggaataca

SEQ ID NO: 246689 - DNA, 75 bp, Artificial Sequence
  Synthetic
cagaacaatgtctttatgtctgaagctaaatgctgggtggaaaccgatctgaagaaagggccacatgaattctgt

SEQ ID NO: 246690 - DNA, 75 bp, Artificial Sequence
  Synthetic
atggcgacgatggttacttccttccttatccagacccttcaagaattttgtctgccggttgctttgtagatgata

SEQ ID NO: 246691 - DNA, 75 bp, Artificial Sequence
  Synthetic
atgaagatatagaataccagaatgtattctgggtctacttacagtatatagaaaaactgtataaagaccttacag

SEQ ID NO: 246692 - DNA, 75 bp, Artificial Sequence
  Synthetic
tttgcaggctgtcggttcatgcgttgtatgccattcacagacttccctacgctgtgggacatgcatccgtagacc

SEQ ID NO: 246693 - DNA, 75 bp, Artificial Sequence
  Synthetic
atttctctgctgtaaatgctgctatgatcatgttatagcaactccacataagatggttttgtctgtttctcctta

SEQ ID NO: 246694 - DNA, 75 bp, Artificial Sequence
  Synthetic
cgtttgtaatgcccctggttgtggcgtttcagacgttactaagctatatttaggtggtatgagctacttttgtgt

SEQ ID NO: 246695 - DNA, 75 bp, Artificial Sequence
  Synthetic
gtttcagacgttactaagctatatttaggtggtatgagctacttttgtgtagatcatagacctgtgtgtagtttt

SEQ ID NO: 246696 - DNA, 75 bp, Artificial Sequence
  Synthetic
tcggcttatacaagaatatgtgcacaggtagtccttctatagttgaatttaataggttggctacctgtgactgga

SEQ ID NO: 246697 - DNA, 75 bp, Artificial Sequence
  Synthetic
aggtagtccttctatagttgaatttaataggttggctacctgtgactggactgaaagtggtgattacacccttgc

SEQ ID NO: 246698 - DNA, 75 bp, Artificial Sequence
  Synthetic
accaccactcaatcgtaattatgtttttactggttatcatataaccaaaaatagtaaagtgcagctcggtgagta

SEQ ID NO: 246699 - DNA, 75 bp, Artificial Sequence
  Synthetic
tttactggttatcatataaccaaaaatagtaaagtgcagctcggtgagtacatcttcgagcgcattgattatagt

SEQ ID NO: 246700 - DNA, 75 bp, Artificial Sequence
  Synthetic
catcttcgagcgcattgattatagtgatgctgtatcctacaagtctagtacaacgtataaactgactgtaggtga

SEQ ID NO: 246701 - DNA, 75 bp, Artificial Sequence
  Synthetic
gtggctaccttgacggcgcccacaattgtgaatcaagagaggtatgttaaaattactgggttgtacccaaccatt

SEQ ID NO: 246702 - DNA, 75 bp, Artificial Sequence
  Synthetic
aattactgggttgtacccaaccattacggtacctgaagagttcgcaagtcatgttgccaacttccaaaaatcagg

SEQ ID NO: 246703 - DNA, 75 bp, Artificial Sequence
  Synthetic
ttatagtaaatatgtcactgttcagggaccacctggcactggcaaaagtcattttgctatagggttagcgattta

SEQ ID NO: 246704 - DNA, 75 bp, Artificial Sequence
  Synthetic
ggaccacctggcactggcaaaagtcattttgctatagggttagcgatttactaccctacagcacgtgttgtttat

SEQ ID NO: 246705 - DNA, 75 bp, Artificial Sequence
  Synthetic
atgctttgtgtgaaaaagcttttaaatatttgaacattgctaaatgttcccgtatcattcctgcaaaggcacgtg

SEQ ID NO: 246706 - DNA, 75 bp, Artificial Sequence
  Synthetic
atatttgaacattgctaaatgttcccgtatcattcctgcaaaggcacgtgttgagtgctatgacaggtttaaagt

SEQ ID NO: 246707 - DNA, 75 bp, Artificial Sequence
  Synthetic
tttagtactattaatgctctaccagaaacttctgccgatattctggtggttgatgaggttagtatgtgcactaat

SEQ ID NO: 246708 - DNA, 75 bp, Artificial Sequence
  Synthetic
tgatgaggttagtatgtgcactaattatgatctttcaattattaatgcacgtattaaagctaagcacattgtcta

SEQ ID NO: 246709 - DNA, 75 bp, Artificial Sequence
  Synthetic
gctcctaggactttgttgactagaggcacattggaaccagaaaatttcaatagtgtcactagattgatgtgtaac

SEQ ID NO: 246710 - DNA, 75 bp, Artificial Sequence
  Synthetic
ttaggtcctgacatatttttaagtatgtgctacaggtgtcctaaggaaatagtaagcactgtgagcgctcttgtc

SEQ ID NO: 246711 - DNA, 75 bp, Artificial Sequence
  Synthetic
tacaataataaattgttagccaagaaggagctttcaggccagtgctttaaaatactctataagggcaatgtgacg

SEQ ID NO: 246712 - DNA, 75 bp, Artificial Sequence
  Synthetic
ataattcacagaatgctgtggctcgttcaatgctgggccttactactcagactgttgattcctcacagggttcag

SEQ ID NO: 246713 - DNA, 75 bp, Artificial Sequence
  Synthetic
actgttgattcctcacagggttcagaataccagtacgttatcttctgtcaaacagcagatacggcacatgctaac

SEQ ID NO: 246714 - DNA, 75 bp, Artificial Sequence
  Synthetic
aataccagtacgttatcttctgtcaaacagcagatacggcacatgctaacaacattaacagatttaatgttgcaa

SEQ ID NO: 246715 - DNA, 75 bp, Artificial Sequence
  Synthetic
tttgagtccttagagtttactgaattgtcttttactaattacaagcttcagtctcagattgtaactggccttttt

SEQ ID NO: 246716 - DNA, 75 bp, Artificial Sequence
  Synthetic
gcctctcacctgcttatgcaccaacatacgttagtgttgatgacaagtataagacgagtgatgagctttgcgtga

SEQ ID NO: 246717 - DNA, 75 bp, Artificial Sequence
  Synthetic
ttatggttttactgtttttgtgtgcacagacaactctgctaacactaaagttcttaggaacaagggtgttgatta

SEQ ID NO: 246718 - DNA, 75 bp, Artificial Sequence
  Synthetic
atactctcgtgttatttccaggatgggctttaaactcgatgcaacagttcctggatatcctaagcttttcattac

SEQ ID NO: 246719 - DNA, 75 bp, Artificial Sequence
  Synthetic
tcgtgaagaggctgtaaggcaagttcgaagctggataggcttcgatgttgagggtgctcatgcttcccgtaatgc

SEQ ID NO: 246720 - DNA, 75 bp, Artificial Sequence
  Synthetic
taagcaactggctcccaggtggtacttctactacactggaaccggacccgaagcagcactcccattccgggctgt

SEQ ID NO: 246721 - DNA, 75 bp, Artificial Sequence
  Synthetic
ttaggattttcaactggtgtgaactttgttgttcagccagttggtgttgtagacactgagtggggtaacatgtta

SEQ ID NO: 246722 - DNA, 75 bp, Artificial Sequence
  Synthetic
tggcctattgttagacgacgtatagtgcaaatgttgtcagacactttagacaaattgtctgattactgtacgttt

SEQ ID NO: 246723 - DNA, 75 bp, Artificial Sequence
  Synthetic
acttaaataaaagccctgttgtttagcgtattgttgcacttgtctggtgggattgtggcattaatttgcctgctc

SEQ ID NO: 246724 - DNA, 75 bp, Artificial Sequence
  Synthetic
taacgtctgcatcatacttttgcaagataggtaaggaacagaagtgttgcatgtgcaatagacgcgctgcagcgt

SEQ ID NO: 246725 - DNA, 75 bp, Artificial Sequence
  Synthetic
actcttcacctctgcaatcttatgcctgctggactcattcctgcggttatgattatgtctacaaccctttctttg

SEQ ID NO: 246726 - DNA, 75 bp, Artificial Sequence
  Synthetic
ctcatgtggcttctaatgatgcaataatgactcgttgtttagctattcattcttgttttatagaacgtgtggatt

SEQ ID NO: 246727 - DNA, 75 bp, Artificial Sequence
  Synthetic
aatgactcgttgtttagctattcattcttgttttatagaacgtgtggattgggatatagagtatccttatatctc

SEQ ID NO: 246728 - DNA, 75 bp, Artificial Sequence
  Synthetic
tgtagaatcgttgagcgcaacgtcgtacgtgctgctcttcttgccggttcatttgacaaagtctatgatattggc

SEQ ID NO: 246729 - DNA, 75 bp, Artificial Sequence
  Synthetic
atttgacaaagtctatgatattggcaatcctaaaggaattcctattgttgatgaccctgtggttgattggcatta

SEQ ID NO: 246730 - DNA, 75 bp, Artificial Sequence
  Synthetic
atgacatggattctggtgtgtcatcctttagtgaactactttttgattgcgttgatctttcagtagcttctacct

SEQ ID NO: 246731 - DNA, 75 bp, Artificial Sequence
  Synthetic
aaggtacaacagcttttctatacagaggacatggcctcaagatttgctgatgggctctgcttattttggaactgt

SEQ ID NO: 246732 - DNA, 75 bp, Artificial Sequence
  Synthetic
gttgatctttcagtagcttctacctattttttagtccgcctcttgcaagataagactggcgactttatgtctaca

SEQ ID NO: 246733 - DNA, 75 bp, Artificial Sequence
  Synthetic
tgggctctgcttattttggaactgtaatgtaccaaaatatcctaataatgcaattgtatgcaggtttgacacacg

SEQ ID NO: 246734 - DNA, 75 bp, Artificial Sequence
  Synthetic
tgtgcattctgagttcaatttgccaggttgtgatggcggtagtttgtatgttaacaagcacgcttttcatacacc

SEQ ID NO: 246735 - DNA, 75 bp, Artificial Sequence
  Synthetic
ggttgtgatggcggtagtttgtatgttaacaagcacgcttttcatacaccagcatatgatgtgagtgcattccgt

SEQ ID NO: 246736 - DNA, 75 bp, Artificial Sequence
  Synthetic
gatattgattatgtacccctaaaatctgcagtctgtattacaacttgtaatttagggggcgctgtttgtaggaag

SEQ ID NO: 246737 - DNA, 75 bp, Artificial Sequence
  Synthetic
ctgcagtctgtattacaacttgtaatttagggggcgctgtttgtaggaagcatgctacagagtacagagagtata

SEQ ID NO: 246738 - DNA, 75 bp, Artificial Sequence
  Synthetic
tttggaaaacattgcttttaatgttgttaaacaaggccattttattggtgttgagggtgaactacctgtagctgt

SEQ ID NO: 246739 - DNA, 75 bp, Artificial Sequence
  Synthetic
ttgagggtgaactacctgtagctgtagtcaatgataagatcttcaccaagagtggcgttaatgacatttgtatgt

SEQ ID NO: 246740 - DNA, 75 bp, Artificial Sequence
  Synthetic
agtcaatgataagatcttcaccaagagtggcgttaatgacatttgtatgtttgagaataaaaccactttgcctac

SEQ ID NO: 246741 - DNA, 75 bp, Artificial Sequence
  Synthetic
aagcgtgctgtacgctcgcatcccgatttcaaattgctacacaatttacaagcagacatttgctacaagttcgtc

SEQ ID NO: 246742 - DNA, 75 bp, Artificial Sequence
  Synthetic
ctttgggattatgaacgtagcaatatttatggtactgctactattggtgtatgtaagtacactgatattgatgtt

SEQ ID NO: 246743 - DNA, 75 bp, Artificial Sequence
  Synthetic
atgtaagtacactgatattgatgttaattcagctttgaatatatgttttgacatacgcgataatggttcattgga

SEQ ID NO: 246744 - DNA, 75 bp, Artificial Sequence
  Synthetic
gaagttcatgtctactcccaatgccatctttatttctgatagaaaaatcaagaaatacccttgtatggtaggtcc

SEQ ID NO: 246745 - DNA, 75 bp, Artificial Sequence
  Synthetic
agaaatacccttgtatggtaggtcctgattatgcttacttcaatggtgctatcatccgtgatagtgatgttgtta

SEQ ID NO: 246746 - DNA, 75 bp, Artificial Sequence
  Synthetic
agagtcgctcttgtagtgacttcctacccctgtctgacatggagaaagactttctatcttttgatagtgatgttt

SEQ ID NO: 246747 - DNA, 75 bp, Artificial Sequence
  Synthetic
acccctgtctgacatggagaaagactttctatcttttgatagtgatgttttcattaagaagtatggcttggaaaa

SEQ ID NO: 246748 - DNA, 75 bp, Artificial Sequence
  Synthetic
ggagacttctctcatactacgttaggcggtcttcacttgcttattggtttatacaagaagcaacaggaaggtcat

SEQ ID NO: 246749 - DNA, 75 bp, Artificial Sequence
  Synthetic
atacaagaagcaacaggaaggtcatattattatggaagaaatgctaaaaggtagctcaactattcataactattt

SEQ ID NO: 246750 - DNA, 75 bp, Artificial Sequence
  Synthetic
gtagtatccaaggttgtcaaggttcctattgacttaacaatgattgagtttatgttatggtgtaaggatggacag

SEQ ID NO: 246751 - DNA, 75 bp, Artificial Sequence
  Synthetic
tcatgcaatgccatccctctttaaagttcaaaatgtaaaccttgaacgttgtgagcttgctaattacaagcaatc

SEQ ID NO: 246752 - DNA, 75 bp, Artificial Sequence
  Synthetic
gtgagcttgctaattacaagcaatctattcctatgcctcgcggtgtgcacatgaacatcgctaaatatatgcaat

SEQ ID NO: 246753 - DNA, 75 bp, Artificial Sequence
  Synthetic
tattcctatgcctcgcggtgtgcacatgaacatcgctaaatatatgcaattgtgccagtatttaaatacttgcac

SEQ ID NO: 246754 - DNA, 75 bp, Artificial Sequence
  Synthetic
attagccgtgcctgccaatatgcgtgttatacattttggcgctggttctgataaaggtatcgctcctggtacctc

SEQ ID NO: 246755 - DNA, 75 bp, Artificial Sequence
  Synthetic
agttttacgacagtggcttcctacagatgccattattatagataatgatttaaatgagttcgtgtcagatgctga

SEQ ID NO: 246756 - DNA, 75 bp, Artificial Sequence
  Synthetic
gatgccattattatagataatgatttaaatgagttcgtgtcagatgctgacataactttatttggagattgtgta

SEQ ID NO: 246757 - DNA, 75 bp, Artificial Sequence
  Synthetic
atcttgttatttccgacatgtatgatcctactactaagaatgtaacaggtagtaatgagtcaaaggctttattct

SEQ ID NO: 246758 - DNA, 75 bp, Artificial Sequence
  Synthetic
gttgctattaaaataacagaacactcttggagcgttgaactttatgaacttatgggaaaatttgcttggtggact

SEQ ID NO: 246759 - DNA, 75 bp, Artificial Sequence
  Synthetic
gataaaacttggcctaggccaattgatgtttctaaggctgacggtattatataccctcaaggccgtacatattct

SEQ ID NO: 246760 - DNA, 75 bp, Artificial Sequence
  Synthetic
atgtttctaaggctgacggtattatataccctcaaggccgtacatattctaacataactatcacttatcaaggtc

SEQ ID NO: 246761 - DNA, 75 bp, Artificial Sequence
  Synthetic
tgatatgtatgtttactctgcaggacatgctacaggcacaactccacaaaagttgtttgtagctaactattctca

SEQ ID NO: 246762 - DNA, 75 bp, Artificial Sequence
  Synthetic
tttgtcgtccgtataggagcagctgccaattccactggcactgttattattagcccatctaccagcgctactata

SEQ ID NO: 246763 - DNA, 75 bp, Artificial Sequence
  Synthetic
ccaattccactggcactgttattattagcccatctaccagcgctactatacgaaaaatttaccctgcttttatgc

SEQ ID NO: 246764 - DNA, 75 bp, Artificial Sequence
  Synthetic
tagcccatctaccagcgctactatacgaaaaatttaccctgcttttatgctgggttcttcagttggtaatttctc

SEQ ID NO: 246765 - DNA, 75 bp, Artificial Sequence
  Synthetic
aatcatactctagttcttttgcccgatggatgtggcactttacttagagctttttattgtattctagagcctcgc

SEQ ID NO: 246766 - DNA, 75 bp, Artificial Sequence
  Synthetic
attcctatacttcttttgccacttatcacactcctgcaacagattgttctgatggcaattacaatcgtaatgcca

SEQ ID NO: 246767 - DNA, 75 bp, Artificial Sequence
  Synthetic
tcacactcctgcaacagattgttctgatggcaattacaatcgtaatgccagtctgaactcttttaaggagtattt

SEQ ID NO: 246768 - DNA, 75 bp, Artificial Sequence
  Synthetic
agattttagagtggtttggcattacacaaactgctcaaggtgttcacctcttctcatctcggtatgttgatttgt

SEQ ID NO: 246769 - DNA, 75 bp, Artificial Sequence
  Synthetic
gtattcgttctatccaaagtgatagaaaagcttgggctgccttctacgtatataaacttcaaccgttaactttcc

SEQ ID NO: 246770 - DNA, 75 bp, Artificial Sequence
  Synthetic
tttaatgatttgtcacaactccactgctcatatgaatccttcgatgttgaatctggagtttattcagtttcgtct

SEQ ID NO: 246771 - DNA, 75 bp, Artificial Sequence
  Synthetic
gctcatatgaatccttcgatgttgaatctggagtttattcagtttcgtctttcgaagcaaaaccttctggctcag

SEQ ID NO: 246772 - DNA, 75 bp, Artificial Sequence
  Synthetic
atgtgatttttcacctcttctgtctggcacacctcctcaggtttataatttcaagcgtttggtttttaccaattg

SEQ ID NO: 246773 - DNA, 75 bp, Artificial Sequence
  Synthetic
ctgattttggattatttttcatacccacttagtatgaaatccgatctcagtgttagttctgctggtccaatatcc

SEQ ID NO: 246774 - DNA, 75 bp, Artificial Sequence
  Synthetic
cacttagtatgaaatccgatctcagtgttagttctgctggtccaatatcccagtttaattataaacagtcctttt

SEQ ID NO: 246775 - DNA, 75 bp, Artificial Sequence
  Synthetic
cagtttaattataaacagtccttttctaatcccacatgtttgattttagcgactgttcctcataaccttactact

SEQ ID NO: 246776 - DNA, 75 bp, Artificial Sequence
  Synthetic
attactaagcctcttaagtacagctatattaacaagtgctctcgtcttctttctgatgatcgtactgaagtacct

SEQ ID NO: 246777 - DNA, 75 bp, Artificial Sequence
  Synthetic
cactgtgtgggaagacggtgattattataggaaacaactatctccacttgaaggtggtggctggcttgttgctag

SEQ ID NO: 246778 - DNA, 75 bp, Artificial Sequence
  Synthetic
tataggaaacaactatctccacttgaaggtggtggctggcttgttgctagtggctcaactgttgccatgactgag

SEQ ID NO: 246779 - DNA, 75 bp, Artificial Sequence
  Synthetic
cagttcaatatggtacagacaccaatagtgtttgccccaagcttgaatttgctaatgacacaaaaattgcctctc

SEQ ID NO: 246780 - DNA, 75 bp, Artificial Sequence
  Synthetic
tagtgtttgccccaagcttgaatttgctaatgacacaaaaattgcctctcaattaggcaattgcgtggaatattc

SEQ ID NO: 246781 - DNA, 75 bp, Artificial Sequence
  Synthetic
gtttttcagaattgcacagctgtaggtgttcgacagcagcgctttgtttatgatgcgtaccagaatttagttggc

SEQ ID NO: 246782 - DNA, 75 bp, Artificial Sequence
  Synthetic
tattattctgatgatggcaactactactgtttgcgtgcttgtgttagtgttcctgtttctgtcatctatgataaa

SEQ ID NO: 246783 - DNA, 75 bp, Artificial Sequence
  Synthetic
tcctgtttctgtcatctatgataaagaaactaaaacccacgctactctatttggtagtgttgcatgtgaacacat

SEQ ID NO: 246784 - DNA, 75 bp, Artificial Sequence
  Synthetic
ggacttgttaattcctctttgttcgtagaggactgcaagttgcctctcggtcaatctctctgtgctcttcctgac

SEQ ID NO: 246785 - DNA, 75 bp, Artificial Sequence
  Synthetic
atagtagttattttaaattaagtatacccactaatttttcctttggtgtgactcaggagtacattcagacaacca

SEQ ID NO: 246786 - DNA, 75 bp, Artificial Sequence
  Synthetic
actcaggagtacattcagacaaccattcagaaagttactgttgattgtaaacagtacgtttgcaatggtttccag

SEQ ID NO: 246787 - DNA, 75 bp, Artificial Sequence
  Synthetic
ttcagaaagttactgttgattgtaaacagtacgtttgcaatggtttccagaagtgtgagcaattactgcgcgagt

SEQ ID NO: 246788 - DNA, 75 bp, Artificial Sequence
  Synthetic
ccaggctctccatggtgccaatttacgccaggatgattctgtacgtaatttgtttgcgagcgtgaaaagctctca

SEQ ID NO: 246789 - DNA, 75 bp, Artificial Sequence
  Synthetic
tgtttgcgagcgtgaaaagctctcaatcatctcctatcataccaggttttggaggtgactttaatttgacacttc

SEQ ID NO: 246790 - DNA, 75 bp, Artificial Sequence
  Synthetic
gttaatatggaagccgcgtatacttcatctttgcttggcagcatagcaggtgttggctggactgctggcttatcc

SEQ ID NO: 246791 - DNA, 75 bp, Artificial Sequence
  Synthetic
tgttggcattactcaacaggttctttcagagaaccaaaagcttattgccaataagtttaatcaggctctgggagc

SEQ ID NO: 246792 - DNA, 75 bp, Artificial Sequence
  Synthetic
tcagagaaccaaaagcttattgccaataagtttaatcaggctctgggagctatgcaaacaggcttcactacaact

SEQ ID NO: 246793 - DNA, 75 bp, Artificial Sequence
  Synthetic
atgctgtgaacaacaatgcacaggctctatccaaattagctagcgagctatctaatacttttggtgctatttccg

SEQ ID NO: 246794 - DNA, 75 bp, Artificial Sequence
  Synthetic
tcagctgctctttccgctcaattggctaaagataaagtcaatgagtgtgtcaaggcacaatccaagcgttctgga

SEQ ID NO: 246795 - DNA, 75 bp, Artificial Sequence
  Synthetic
tggcctttacttcatgcatgttggttattaccctagcaaccacattgaggttgtttctgcttatggtctttgcga

SEQ ID NO: 246796 - DNA, 75 bp, Artificial Sequence
  Synthetic
gcccctgttaatggctactttattaaaactaataacactaggattgttgatgagtggtcatatactggctcgtcc

SEQ ID NO: 246797 - DNA, 75 bp, Artificial Sequence
  Synthetic
agatgagttggatgagtttttcaaaaatgttagcaccagtatacctaattttggttctctaacacagattaatac

SEQ ID NO: 246798 - DNA, 75 bp, Artificial Sequence
  Synthetic
atgttgtctcttcaacaagttgttaaagcccttaatgagtcttacatagaccttaaagagcttggcaattatact

SEQ ID NO: 246799 - DNA, 75 bp, Artificial Sequence
  Synthetic
tttggcttggtttcattgctgggcttgttgccttagctctatgcgtcttcttcatactgtgctgcactggttgtg

SEQ ID NO: 246800 - DNA, 75 bp, Artificial Sequence
  Synthetic
tgttgccttagctctatgcgtcttcttcatactgtgctgcactggttgtggcacaaactgtatgggaaaacttaa

SEQ ID NO: 246801 - DNA, 75 bp, Artificial Sequence
  Synthetic
gaggaatacgacctcgagccgcataaggttcatgttcactaattaacgaactatcaatgagagttcaaagaccac

SEQ ID NO: 246802 - DNA, 75 bp, Artificial Sequence
  Synthetic
ccactctcttgttagtgttctcactctctcttttggtcactgcattctcaaaacctctctatgtacctgagcatt

SEQ ID NO: 246803 - DNA, 75 bp, Artificial Sequence
  Synthetic
aaacctctctatgtacctgagcattgtcagaattattctggttgcatgcttagggcttgtattaaaactgcccaa

SEQ ID NO: 246804 - DNA, 75 bp, Artificial Sequence
  Synthetic
gtcagaattattctggttgcatgcttagggcttgtattaaaactgcccaagctgatacagctggtctttatacaa

SEQ ID NO: 246805 - DNA, 75 bp, Artificial Sequence
  Synthetic
tccatatttgtagactggcggtcatacaattatgctgtgtctagtgccttctggttattcacccacattccaatg

SEQ ID NO: 246806 - DNA, 75 bp, Artificial Sequence
  Synthetic
ggttactcagttaattaacgaactctatggattacgtgtctctgcttaatcaaatttggcagaagtaccttaatt

SEQ ID NO: 246807 - DNA, 75 bp, Artificial Sequence
  Synthetic
tcctaaacccacagctaagtatacacctttagttggcacttcattgcaccctgtgctgtggaactgtcagctatc

SEQ ID NO: 246808 - DNA, 75 bp, Artificial Sequence
  Synthetic
cctttagttggcacttcattgcaccctgtgctgtggaactgtcagctatcctttgctggttatactgaatctgct

SEQ ID NO: 246809 - DNA, 75 bp, Artificial Sequence
  Synthetic
tgacactcctagcgtacttcaagctactctttctgagttttcacacttagctacctttgctgagttggaagctgc

SEQ ID NO: 246810 - DNA, 75 bp, Artificial Sequence
  Synthetic
ttggttgctacataaggatggaggaatccctgatggatgttccctctacctccggcactcaagtttattcgcgca

SEQ ID NO: 246811 - DNA, 75 bp, Artificial Sequence
  Synthetic
cgtagattttctcttctgcgccctgaagaccttagtgttattgtccaaccaacacactatgtcagggttacattt

SEQ ID NO: 246812 - DNA, 75 bp, Artificial Sequence
  Synthetic
tcagaccccaacatgtggtatctacgttcgggtcatcatttacactcagttcacaattggcttaaaccttatggc

SEQ ID NO: 246813 - DNA, 75 bp, Artificial Sequence
  Synthetic
gttcgggtcatcatttacactcagttcacaattggcttaaaccttatggcggccaacctgtttctgagtaccata

SEQ ID NO: 246814 - DNA, 75 bp, Artificial Sequence
  Synthetic
ggccaacctgtttctgagtaccatattactctagctttgctaaatctcactgatgaagatttagctagagatttt

SEQ ID NO: 246815 - DNA, 75 bp, Artificial Sequence
  Synthetic
atgtcagatttgagctacatgagttcgccttgctgcgcaaaactcttgttcttaatgcatcagagatctactgtg

SEQ ID NO: 246816 - DNA, 75 bp, Artificial Sequence
  Synthetic
agggattttccctttaccatagtggcctccctttacatatgtcaatctctaaattgcatgcactggatgatgtta

SEQ ID NO: 246817 - DNA, 75 bp, Artificial Sequence
  Synthetic
cctccctttacatatgtcaatctctaaattgcatgcactggatgatgttactcgcaattacatcattacaatgcc

SEQ ID NO: 246818 - DNA, 75 bp, Artificial Sequence
  Synthetic
atgtttgttactcctttggccgtagatgttgtctccatacggtcttccaatcagggtaataaacaaattgttcat

SEQ ID NO: 246819 - DNA, 75 bp, Artificial Sequence
  Synthetic
atcgcattgagtctactgactctattgttttcacatacattcctgctagcggctatgtagctgctttagctgtca

SEQ ID NO: 246820 - DNA, 75 bp, Artificial Sequence
  Synthetic
actgctacgtcaagatacttgtcgtcgcagcattatcagaactatggttctctatttccttgttctgtataactt

SEQ ID NO: 246821 - DNA, 75 bp, Artificial Sequence
  Synthetic
ggtgtacattatccaactggaagttgcctgatagccttcttagttatcctcataatactttggtttgtagataga

SEQ ID NO: 246822 - DNA, 75 bp, Artificial Sequence
  Synthetic
gtttcttctcatggtatggtccctgtcatacacaccaaaccattatttattagaaacttcgatcagcgttgcagc

SEQ ID NO: 246823 - DNA, 75 bp, Artificial Sequence
  Synthetic
tcatacacaccaaaccattatttattagaaacttcgatcagcgttgcagctgttctcgttgtttttatttgcact

SEQ ID NO: 246824 - DNA, 75 bp, Artificial Sequence
  Synthetic
tattagccgttttagtaagattagcctagtttctgtaactgacttctccttaaacggcaatgtttccactgtttt

SEQ ID NO: 246825 - DNA, 75 bp, Artificial Sequence
  Synthetic
taaacggcaatgtttccactgttttcgtgcctgcaacgcgcgattcagttcctcttcacataatcgccccgagct

SEQ ID NO: 246826 - DNA, 75 bp, Artificial Sequence
  Synthetic
agattatgtgtgcaatgtatgacaggcttcaataccctgttagttcagcccgcattatacttgtataatactgga

SEQ ID NO: 246827 - DNA, 75 bp, Artificial Sequence
  Synthetic
cgcattatacttgtataatactggacgttcagtctatgtaaaattccaggatagtaaaccccctctaccacctga

SEQ ID NO: 246828 - DNA, 75 bp, Artificial Sequence
  Synthetic
tgaggcgcagattattgccattattaaagactggaactttgcatggtccctgatctttctcttaattactatcgt

SEQ ID NO: 246829 - DNA, 75 bp, Artificial Sequence
  Synthetic
cttcccagataatctctggcattgtagcagctgtttcagctatgatgtggatttcctactttgtgcagagtatcc

SEQ ID NO: 246830 - DNA, 75 bp, Artificial Sequence
  Synthetic
agcagctgtttcagctatgatgtggatttcctactttgtgcagagtatccggctgtttatgagaactggatcatg

SEQ ID NO: 246831 - DNA, 75 bp, Artificial Sequence
  Synthetic
atttcctactttgtgcagagtatccggctgtttatgagaactggatcatggtggtcattcaatcctgagactaat

SEQ ID NO: 246832 - DNA, 75 bp, Artificial Sequence
  Synthetic
gttgtaaccaatggccacctcaaaatggctggcatgcatttcggtgcttgtgactacgacagacttcctaatgaa

SEQ ID NO: 246833 - DNA, 75 bp, Artificial Sequence
  Synthetic
tgactacgacagacttcctaatgaagtcaccgtggccaaacccaatgtgctgattgctttaaaaatggtgaagcg

SEQ ID NO: 246834 - DNA, 75 bp, Artificial Sequence
  Synthetic
gttgccatttaccatagatataaggcaggtaattacaggagtccgcctattacggcggatattgaacttgcattg

SEQ ID NO: 246835 - DNA, 75 bp, Artificial Sequence
  Synthetic
ctgctgcacctcgtgctgtttcctttgccgataacaatgatataacaaatacaaacctgtctcgaggtagaggac

SEQ ID NO: 246836 - DNA, 75 bp, Artificial Sequence
  Synthetic
acaaacctgtctcgaggtagaggacgtaatccaaaaccacgagctgcaccaaataacactgtctcttggtacact

SEQ ID NO: 246837 - DNA, 75 bp, Artificial Sequence
  Synthetic
ctcttacctttccacctgggcagggtgtacctcttaatgccaattccacccctgcgcaaaatgctgggtattggc

SEQ ID NO: 246838 - DNA, 75 bp, Artificial Sequence
  Synthetic
ctgatgctccttcaacttttgggacgcggaaccctaacaatgattcagctattgttacacaattcgcgcccggta

SEQ ID NO: 246839 - DNA, 75 bp, Artificial Sequence
  Synthetic
tcatcttcaagagcctctagcgtaagcagaaactcttccagatctagttcacaaggttcaagatcaggaaactct

SEQ ID NO: 246840 - DNA, 75 bp, Artificial Sequence
  Synthetic
gcagaaactcttccagatctagttcacaaggttcaagatcaggaaactctacccgcggcacttctccaggtccat

SEQ ID NO: 246841 - DNA, 75 bp, Artificial Sequence
  Synthetic
acccgcggcacttctccaggtccatctggaatcggagcagtaggaggtgatctactttaccttgatcttctgaac

SEQ ID NO: 246842 - DNA, 75 bp, Artificial Sequence
  Synthetic
aagtaaagcaatcgcagccaaaagtaatcactaagaaagatgctgctgctgctaaaaataagatgcgccacaagc

SEQ ID NO: 246843 - DNA, 75 bp, Artificial Sequence
  Synthetic
gctaaaaataagatgcgccacaagcgcacttccaccaaaagtttcaacatggtgcaagcttttggtcttcgcgga

SEQ ID NO: 246844 - DNA, 75 bp, Artificial Sequence
  Synthetic
ccaggagacctccagggaaactttggtgatcttcaattgaataaactcggcactgaggacccacgttggccccaa

SEQ ID NO: 246845 - DNA, 75 bp, Artificial Sequence
  Synthetic
gtgcttttatgggtatgtcgcaatttaaacttacccatcagaacaatgatgatcatggcaaccctgtgtacttcc

SEQ ID NO: 246846 - DNA, 75 bp, Artificial Sequence
  Synthetic
tgacccaaagaatcccaactacaataagtggttggagcttcttgagcaaaatattgatgcctacaaaaccttccc

SEQ ID NO: 246847 - DNA, 75 bp, Artificial Sequence
  Synthetic
tgtgcaaggtagcatcactcagcgcactcgcacccgtccaagtgttcagcctggtccaatgattgatgttaacac

SEQ ID NO: 246848 - DNA, 75 bp, Artificial Sequence
  Synthetic
ctggtccaatgattgatgttaacactgattagtgtcactcaaagtaacaagatcgcggcaatcgtttgtgtttgg

SEQ ID NO: 246849 - DNA, 75 bp, Artificial Sequence
  Synthetic
ttgtaattacagtgcaataaggtaattataacccatttaattgatagctatgctttattaaagtgtgtagctgta

SEQ ID NO: 246850 - DNA, 75 bp, Artificial Sequence
  Synthetic
tgctttattaaagtgtgtagctgtagagagaatgttaaagactgtcacctctgcgtgattgcaagtgaacagtgc

SEQ ID NO: 246851 - DNA, 75 bp, Artificial Sequence
  Synthetic
tgaaatgtaaataaaaatagctattattcaattagattaggctaattagatgatttgcaaaaaaaaaaaaaaaaa

SEQ ID NO: 246852 - DNA, 75 bp, Artificial Sequence
  Synthetic
gaatagcttggctatctcacttcccctcgttctcttgcagaactttgattttaacgaacttaaataaaagccctg

SEQ ID NO: 246853 - DNA, 75 bp, Artificial Sequence
  Synthetic
ctggtgggattgtggcattaatttgcctgctcatctaggcagtggacatatgctcaacactgggtataattctaa

SEQ ID NO: 246854 - DNA, 75 bp, Artificial Sequence
  Synthetic
tagcttattacgaacctgtgcagggtcgtaaaatgctgatggctcttctttctgataatgcctatctcaaatggg

SEQ ID NO: 246855 - DNA, 75 bp, Artificial Sequence
  Synthetic
gcctagagctaagtctgttgtctcaaggattggagactccatctttacaggctgtactggctcttggaacaaggt

SEQ ID NO: 246856 - DNA, 75 bp, Artificial Sequence
  Synthetic
tgacaagttgcgtgattatttagctgactatgacgtagcagtcactgccggcccattcatggataatgctattaa

SEQ ID NO: 246857 - DNA, 75 bp, Artificial Sequence
  Synthetic
ttctcactggcttaggtgagtcctttaagaaagttgcaaccataccgtacaaggtttgcaactctgttaaggata

SEQ ID NO: 246858 - DNA, 75 bp, Artificial Sequence
  Synthetic
ctattactgtgtcaccactaaggctaagtccgttcaacaagatcttgacgttattttgcctggtgagttttccaa

SEQ ID NO: 246859 - DNA, 75 bp, Artificial Sequence
  Synthetic
ccattcttttattattctactacaccatgtgaagtgcatggtaatggtagtatgatagaggatattgattatgta

SEQ ID NO: 246860 - DNA, 75 bp, Artificial Sequence
  Synthetic
gtaaaagaagttgcacctgtctatgaggctgataccgaacagacacagagtgttactgttaaacctaagaggtta

SEQ ID NO: 246861 - DNA, 75 bp, Artificial Sequence
  Synthetic
atatgttttgacatacgcgataatggttcattggagaagttcatgtctactcccaatgccatctttatttctgat

SEQ ID NO: 246862 - DNA, 75 bp, Artificial Sequence
  Synthetic
ctaaagttcttaggaacaagggtgttgattatactaagaagtttcttacagttgacggtgtgcaatattattgct

SEQ ID NO: 246863 - DNA, 75 bp, Artificial Sequence
  Synthetic
gtgtgtgataaggtacgttctctcaaattgagtgataataattgttatcttaatgcagttattatgacacttgat

SEQ ID NO: 246864 - DNA, 75 bp, Artificial Sequence
  Synthetic
taaggctaaggttgctggtattggaaaatactacaagactaatacttgtaggtttgtagaattagatgaccaagg

SEQ ID NO: 246865 - DNA, 75 bp, Artificial Sequence
  Synthetic
taaagaagacggcgatgtgttgttggctgagtttgacacttatgaccctatttataagaatggtgccatgtataa

SEQ ID NO: 246866 - DNA, 75 bp, Artificial Sequence
  Synthetic
aaagcatcttatgatactaatcttaataagttcaatagagctagtttgcgtcaaatttttgacgtagcccccatt

SEQ ID NO: 246867 - DNA, 75 bp, Artificial Sequence
  Synthetic
tgagtgtggagtctacaccagttgaacctccaactgtagatgtggtagcacttcaacaggaaatgacaattgtca

SEQ ID NO: 246868 - DNA, 75 bp, Artificial Sequence
  Synthetic
tgatactattaagtattattctatcattcctcacagtattcgttctatccaaagtgatagaaaagcttgggctgc

SEQ ID NO: 246869 - DNA, 75 bp, Artificial Sequence
  Synthetic
ttgagtatctgtctaaagaagatctacatacattgtatgtagaccctaagtatcaagtcattgtcttaaaagaca

SEQ ID NO: 246870 - DNA, 75 bp, Artificial Sequence
  Synthetic
cgttgtgacaggtaatgttgtaaaacagtgttgcactgctgctgttgatttaagtatggataagttgcgccgtgt

SEQ ID NO: 246871 - DNA, 75 bp, Artificial Sequence
  Synthetic
agctcttaagatggttcaaacacatcttagccactatgttcttaacatagattggttgtggtttgcatttgagac

SEQ ID NO: 246872 - DNA, 75 bp, Artificial Sequence
  Synthetic
tcatagctgacaccttacaggaaactcctgttgtgcctgatactgttggagtcccaccgcaagtggtggaacttc

SEQ ID NO: 246873 - DNA, 75 bp, Artificial Sequence
  Synthetic
ttgcgtaattctaatggtgcttgtatttggaacgctgctgcatatatgaaactctcggatgcacttaaacgacag

SEQ ID NO: 246874 - DNA, 75 bp, Artificial Sequence
  Synthetic
tttggaacgctgctgcatatatgaaactctcggatgcacttaaacgacagattcgcattgcatgccgtaagtgta

SEQ ID NO: 246875 - DNA, 75 bp, Artificial Sequence
  Synthetic
gaaaacttaagtgtaatcgttgttgtgatagatacgaggaatacgacctcgagccgcataaggttcatgttcact

SEQ ID NO: 246876 - DNA, 75 bp, Artificial Sequence
  Synthetic
ctgatgttgagaccaatgaaattgttgactctgtgcagtatgctcataaacatgacatacaacttactaatgaga

SEQ ID NO: 246877 - DNA, 75 bp, Artificial Sequence
  Synthetic
tggtcgtccgactggtacattcactgttgtaatgcgccctaactacacaattaagggttcctttctgtgtggttc

SEQ ID NO: 246878 - DNA, 75 bp, Artificial Sequence
  Synthetic
ttcagttaacagacaaatactgcagtgttaatgtagtagcttggctttatgcagcaatacttaatggttgcgctt

SEQ ID NO: 246879 - DNA, 75 bp, Artificial Sequence
  Synthetic
gcttcaaataaacttcgcgttgtaattcctgacttcaccgtctggaatcaggtagtcacatatccctcgcttaac

SEQ ID NO: 246880 - DNA, 75 bp, Artificial Sequence
  Synthetic
tgcctctaattcttcggtgttgtcacttgttaacttcaccgttgatcctcaaaaagcttatctcgatttcgtcaa

SEQ ID NO: 246881 - DNA, 75 bp, Artificial Sequence
  Synthetic
agttgatagctactattcttatttgatgcctgtgctctcaatgaccgattgtctggccgctgagacacataggga

SEQ ID NO: 246882 - DNA, 75 bp, Artificial Sequence
  Synthetic
cgaacatgttactagtgtgaatctttttgacgttggttactcagttaattaacgaactctatggattacgtgtct

SEQ ID NO: 246883 - DNA, 75 bp, Artificial Sequence
  Synthetic
gtctacaccagttgaacctccaactgtagatgtggtagcacttcaacaggaaatgacaattgtcaaatgtaaggg

SEQ ID NO: 246884 - DNA, 75 bp, Artificial Sequence
  Synthetic
gggtgctaatggcaacaagattgttgacaaagaagttaaagacatgcagtttgatttgtatgtcaatgtttacag

SEQ ID NO: 246885 - DNA, 75 bp, Artificial Sequence
  Synthetic
gtttgtgtctttggctatagatgcttaccctctcacaaagcatgaagatatagaataccagaatgtattctgggt

SEQ ID NO: 246886 - DNA, 75 bp, Artificial Sequence
  Synthetic
cttaatactaagtatgttgcaccacaggtgacataccaaaacatttctactaacctccctcctcctcttctcggc

SEQ ID NO: 246887 - DNA, 75 bp, Artificial Sequence
  Synthetic
ttagagtttactgaattgtcttttactaattacaagctccagtctcagattgtaactggcctttttaaagattgc

SEQ ID NO: 246888 - DNA, 75 bp, Artificial Sequence
  Synthetic
tcattcctgcggttatgattatgtctacaaccctttctttgtcgatgttcaacagtggggttatgtaggcaatct

SEQ ID NO: 246889 - DNA, 75 bp, Artificial Sequence
  Synthetic
gtgtgttctgttatagatttaaagcttgacgactttgttatgattttaaagagtcaagaccttggcgtagtatcc

SEQ ID NO: 246890 - DNA, 75 bp, Artificial Sequence
  Synthetic
tgctcttggtgggtctgttgctattaaaataacagaacactcttggagcgttgaactttatgaacttatgggaaa

SEQ ID NO: 246891 - DNA, 75 bp, Artificial Sequence
  Synthetic
aaggattcctcttaggtattaattacttgggtactattaaagaaaatatagatggtggtgctatgcacgccaact

SEQ ID NO: 246892 - DNA, 75 bp, Artificial Sequence
  Synthetic
tatgaatctgagtacttactcactttttgatttatccaagtttcaattaaaattaaaaggaacaccagttcttca

SEQ ID NO: 246893 - DNA, 75 bp, Artificial Sequence
  Synthetic
cttttaaggagtattttaatttacgtaactgcacctttatgtacacttataacattaccgaagatgagattttag

SEQ ID NO: 246894 - DNA, 75 bp, Artificial Sequence
  Synthetic
cgatcaatgcttaaacggcgagattctacatatggcccccttcagacacctgttggttgtgtcctaggacttgtt

SEQ ID NO: 246895 - DNA, 75 bp, Artificial Sequence
  Synthetic
aattcctctttgttcgtagaggactgcaagttgcctctcggtcaatctctctgtgctcttcctgacacacctagt

SEQ ID NO: 246896 - DNA, 75 bp, Artificial Sequence
  Synthetic
gctattccatttgcacagagtatcttttataggttaaacggtgttggcattactcaacaggttctttcagagaac

SEQ ID NO: 246897 - DNA, 75 bp, Artificial Sequence
  Synthetic
cttcccttatgacatcgaacttgtcacaggaaagcaaaatattctcctgcgcaagtatggccgtggtggttatca

SEQ ID NO: 246898 - DNA, 75 bp, Artificial Sequence
  Synthetic
atgagtcttacatagaccttaaagagcttggcaattatacttattacaacaaatggccgtggtacatttggcttg

SEQ ID NO: 246899 - DNA, 75 bp, Artificial Sequence
  Synthetic
ttgacgtcccatctgcagaatcaactggtactcaatcagtttctgtcgatcgtgagtcaacttcaactcatgatg

SEQ ID NO: 246900 - DNA, 75 bp, Artificial Sequence
  Synthetic
cagctcagcgaatcgcttggttgctacataaggatggaggaatccctgatggatgttccctctacctccggcact

SEQ ID NO: 246901 - DNA, 75 bp, Artificial Sequence
  Synthetic
taacacggcaatccctactattaaggattggcttctcgttcagggattttccctttaccatagtggcctcccttt

SEQ ID NO: 246902 - DNA, 75 bp, Artificial Sequence
  Synthetic
ccatacggtcttccaatcagggtaataaacaaattgttcattcttaccccattttacatcatccaggattttaac

SEQ ID NO: 246903 - DNA, 75 bp, Artificial Sequence
  Synthetic
tctagatacatgttttgaagctacagaagcaacatttaacttcttgttagatttggcaggattgttcagaatctt

SEQ ID NO: 246904 - DNA, 75 bp, Artificial Sequence
  Synthetic
ttatacaaattttcgaattgacgtcccatctgcagaatcaactggtactcaatcagtttctgtcgatcgtgagtc

SEQ ID NO: 246905 - DNA, 75 bp, Artificial Sequence
  Synthetic
tgtctcatgctgaattcctacattccactgtttgacatgcgttcccactttattcgtgttagtacagtttcttct

SEQ ID NO: 246906 - DNA, 75 bp, Artificial Sequence
  Synthetic
ttaacgaactccttcataatgtctaatatgacgcaactcactgaggcgcagattattgccattattaaagactgg

SEQ ID NO: 246907 - DNA, 75 bp, Artificial Sequence
  Synthetic
attgattttaacgaatctcaatttcattgttatggcatcccctgctgcacctcgtgctgtttcctttgccgataa

SEQ ID NO: 246908 - DNA, 75 bp, Artificial Sequence
  Synthetic
tgcaagtgaacagtgccccccgggaagagctctacagtgtgaaatgtaaataaaaatagctattattcaattaga

SEQ ID NO: 246909 - DNA, 75 bp, Artificial Sequence
  Synthetic
acaattattacttcctgccaaactgctgttagtaagtttctagatacatgttttgaagctacagaagcaacattt

SEQ ID NO: 246910 - DNA, 75 bp, Artificial Sequence
  Synthetic
ctgcaccttatgtagttctcactggcttaggtgagtcctttaagaaagttgcaaccataccgtacaaggtttgca

SEQ ID NO: 246911 - DNA, 75 bp, Artificial Sequence
  Synthetic
ataacttccatagtgtcttaacaacattcattgacgcagcacgaggccccgcaggtgtggagtctgatgttgaga

SEQ ID NO: 246912 - DNA, 75 bp, Artificial Sequence
  Synthetic
tatgtctacaattattacttcctgccaaactgctgttagtaagcttctagatacatgttttgaagctacagaagc

SEQ ID NO: 246913 - DNA, 75 bp, Artificial Sequence
  Synthetic
attatgtaccctcatatgttaaacctgatagtgtgtctaccagtgatttaggtagtctcattgattgtaatgcgg

SEQ ID NO: 246914 - DNA, 75 bp, Artificial Sequence
  Synthetic
tattgacttaacaatgattgagtttatgttatggtgtaaggatggacaggttcaaaccttctacccgcgactcca

SEQ ID NO: 246915 - DNA, 75 bp, Artificial Sequence
  Synthetic
aattataatcttaccaaattgctttcacttttttctgtgaatgatttcacttgtagtcaaatatctccaacagca

SEQ ID NO: 246916 - DNA, 75 bp, Artificial Sequence
  Synthetic
atgctcataaacatgacatacaaattactaatgagagttacaataattatgtaccctcatatgttaaacctgata

SEQ ID NO: 246917 - DNA, 75 bp, Artificial Sequence
  Synthetic
gttcctattgacttaacaatgattgagtttatgttatggtgtaaggatggacaggttcaaaccttctaccctcga

SEQ ID NO: 246918 - DNA, 75 bp, Artificial Sequence
  Synthetic
cctcttctcatctcggtatgttgatttgtacggcggcaatatgtttcaatttgccaccttgcctgtttatgatac

SEQ ID NO: 246919 - DNA, 75 bp, Artificial Sequence
  Synthetic
ccatcaaggagctcatgtggcttctaatgatgcaataatgactcgttgtttagctattcattcttgttttataga

SEQ ID NO: 246920 - DNA, 75 bp, Artificial Sequence
  Synthetic
gtgacttcgtaatcactcaacctggttcaggagtagctatagttgatagctactattcttatttgatgcctgtgc

SEQ ID NO: 246921 - DNA, 75 bp, Artificial Sequence
  Synthetic
gcttttcttgatttgaggacatcatgttttagtgtcgctgcacttacaactggtttgacttttcaaactgtgcgg

SEQ ID NO: 246922 - DNA, 75 bp, Artificial Sequence
  Synthetic
ttacaggacacatgcttgacagttattctgtcatgctatgtggtgataattctgctaagttttgggaagaggcat

SEQ ID NO: 246923 - DNA, 75 bp, Artificial Sequence
  Synthetic
caatcagtttctgtcgatcgtgagtcaacttcaactcatgatggtcctaacgaacatgttactagtgtgaatctt

SEQ ID NO: 246924 - DNA, 75 bp, Artificial Sequence
  Synthetic
gcagtcttatgctattgccaccatcaaagaaattgttggtgagcgccaactattacttgtgtgggaggctggcaa

SEQ ID NO: 246925 - DNA, 75 bp, Artificial Sequence
  Synthetic
tatgtttttactggttatcatataaccaaaaatagtaaagtgcagctcggtgagtacatcttcgagcgcattgat

SEQ ID NO: 246926 - DNA, 75 bp, Artificial Sequence
  Synthetic
gaagaattttattactgccaatccggcatggagtaaggcagtctttatttcgccttataattcacagaatgctgt

SEQ ID NO: 246927 - DNA, 75 bp, Artificial Sequence
  Synthetic
tattctttgtgttatgacatctcaggcactctttgagtccttagagtttactgaattgtcttttactaattacaa

SEQ ID NO: 246928 - DNA, 75 bp, Artificial Sequence
  Synthetic
ctctgcatcaggtttccgcctttggtgttataagacctttgatatttataatctctggtctacttttacaaaagt

SEQ ID NO: 246929 - DNA, 75 bp, Artificial Sequence
  Synthetic
caaaaccttccctaagaaggaaaagaaacaaaaggcaccaaaagaagaatcaacagaccaaatgtctgaacctcc

SEQ ID NO: 246930 - DNA, 75 bp, Artificial Sequence
  Synthetic
cattctccaactaagaaactgcgctacgttaagcgtagattttctcttctgcgccctgaagaccttagtgttatt

SEQ ID NO: 246931 - DNA, 75 bp, Artificial Sequence
  Synthetic
tgagtttatgttatggtgtaaggatggacaggttcaaaccttctaccctcgactccaggcttctgcagattggaa

SEQ ID NO: 246932 - DNA, 75 bp, Artificial Sequence
  Synthetic
ttctttgataaaacttggcctaggccaattgatgtttctaaggctgacggtattatataccctcaaggccgtaca

SEQ ID NO: 246933 - DNA, 75 bp, Artificial Sequence
  Synthetic
tgttctgatggcaattacaatcgtaatgccagtctgaactcttttaaggagtattttaatttacgtaactgcacc

SEQ ID NO: 246934 - DNA, 75 bp, Artificial Sequence
  Synthetic
atctcacttcccctcgttctcttgcagaactttgattttaacgaacttaaataaaagccctgttgtttagcgtat

SEQ ID NO: 246935 - DNA, 75 bp, Artificial Sequence
  Synthetic
ttattaaaactaataacactaggattgttgatgagtggtcatatactggctcgtccttctatgcacctgagccca

SEQ ID NO: 246936 - DNA, 75 bp, Artificial Sequence
  Synthetic
taacccatttaattgatagctatgctttattaaagtgtgtagctgtagagagaatgttaaagactgtcacctctg

SEQ ID NO: 246937 - DNA, 75 bp, Artificial Sequence
  Synthetic
aagatttgctgatgggctctgcttattttggaactgtaatgtaccaaaatatcctaataatgcaattgtatgcag

SEQ ID NO: 246938 - DNA, 75 bp, Artificial Sequence
  Synthetic
gatttaagtgaatagcctagctatctcacgctccccccgttctcttgaagaactttgatcttaacgaacttaaat

SEQ ID NO: 246939 - DNA, 75 bp, Artificial Sequence
  Synthetic
tcacgctccccccgttctcttgaagaactttgatcttaacgaacttaaataaaagccctgttgtttaacgtattg

SEQ ID NO: 246940 - DNA, 75 bp, Artificial Sequence
  Synthetic
aaaagccctgttgtttaacgtattgttgcgcattcctggtgagattgtggcattaagttgcctgctcatcttggg

SEQ ID NO: 246941 - DNA, 75 bp, Artificial Sequence
  Synthetic
tatcgagcagcgctcaactctgaaaaacatcaagaccatgtgtctctaactgtcccactttgtggtgcaggagac

SEQ ID NO: 246942 - DNA, 75 bp, Artificial Sequence
  Synthetic
tcatggatggctatgaagcctgtgaagcggtgaaggtcatgttatctaacaatgagcaattgctctttgtgccca

SEQ ID NO: 246943 - DNA, 75 bp, Artificial Sequence
  Synthetic
agcggtgaaggtcatgttatctaacaatgagcaattgctctttgtgcccatccatctggttgggtatactaagca

SEQ ID NO: 246944 - DNA, 75 bp, Artificial Sequence
  Synthetic
gttgagaggctgatcaagtgtgttgatccattcatggttaaccagttggcttatagctctagtgcaaatgatggc

SEQ ID NO: 246945 - DNA, 75 bp, Artificial Sequence
  Synthetic
atccattcatggttaaccagttggcttatagctctagtgcaaatgatggccttgttggcacaactttgcagggta

SEQ ID NO: 246946 - DNA, 75 bp, Artificial Sequence
  Synthetic
tgacgctgaacttgctacaggagaagaaaccatcttactccgtaagtatggccgtggtggttaccactacaagag

SEQ ID NO: 246947 - DNA, 75 bp, Artificial Sequence
  Synthetic
gaaaccatcttactccgtaagtatggccgtggtggttaccactacaagagagtgccttaccagcgtaataacacc

SEQ ID NO: 246948 - DNA, 75 bp, Artificial Sequence
  Synthetic
ttgaagctgatccaaagggcaagtttgcccagaatctgcttaagaagttgactggtggtgatgtaacacctgtcg

SEQ ID NO: 246949 - DNA, 75 bp, Artificial Sequence
  Synthetic
tgcccagaatctgcttaagaagttgactggtggtgatgtaacacctgtcgaccaatacatgtgtggtgttgatgg

SEQ ID NO: 246950 - DNA, 75 bp, Artificial Sequence
  Synthetic
ttaatagccaaggaaggaataaccaaattggctgatgttgaagctgacgttgcatcacgtgttgatgacgaaggc

SEQ ID NO: 246951 - DNA, 75 bp, Artificial Sequence
  Synthetic
aattggctgatgttgaagctgacgttgcatcacgtgttgatgacgaaggcttcatcatgttaaagaacaaactgt

SEQ ID NO: 246952 - DNA, 75 bp, Artificial Sequence
  Synthetic
tagagacgttccgtattccaaacagtcaatctttactattaatagtgtggttcaaaaggatagtgttgaagacac

SEQ ID NO: 246953 - DNA, 75 bp, Artificial Sequence
  Synthetic
tcaatctttactattaatagtgtggttcaaaaggatagtgttgaagacactcctcctcactattttactcttggt

SEQ ID NO: 246954 - DNA, 75 bp, Artificial Sequence
  Synthetic
gcaacaagtggagtggtatagctaaaatgcctctcaaacaaagaattctttacacattctatggtaaagagtctc

SEQ ID NO: 246955 - DNA, 75 bp, Artificial Sequence
  Synthetic
aatgcctctcaaacaaagaattctttacacattctatggtaaagagtctcttcaagatccttcttacatctacca

SEQ ID NO: 246956 - DNA, 75 bp, Artificial Sequence
  Synthetic
tgcggtaatggttcatggcttacagggaatgctattcaagggtttgcctgtggttgtggggcatcatacacagct

SEQ ID NO: 246957 - DNA, 75 bp, Artificial Sequence
  Synthetic
ggaatgctattcaagggtttgcctgtggttgtggggcatcatacacagctaatgatgtcgaagttcaatcatctg

SEQ ID NO: 246958 - DNA, 75 bp, Artificial Sequence
  Synthetic
ttgtgctacttgtccttttgctaagggcgatagctgttcatcaagctgcaaacattcagtggcccagttggtaag

SEQ ID NO: 246959 - DNA, 75 bp, Artificial Sequence
  Synthetic
ggcgatagctgttcatcaagctgcaaacattcagtggcccagttggtaagttacctttctgagcgctgtaatgtt

SEQ ID NO: 246960 - DNA, 75 bp, Artificial Sequence
  Synthetic
tcgtctttggaggtgttgcttacgcctattttggatgcgcggaaggtactatgtattttgtcccaagagctaaat

SEQ ID NO: 246961 - DNA, 75 bp, Artificial Sequence
  Synthetic
ctattttggatgcgcggaaggtactatgtattttgtcccaagagctaaatctgtggtttcgaagataggagattc

SEQ ID NO: 246962 - DNA, 75 bp, Artificial Sequence
  Synthetic
tggcgcaaagttattcagattgctaatctgtttttggaacagacccagcgttccctcaattttgtgggagaattc

SEQ ID NO: 246963 - DNA, 75 bp, Artificial Sequence
  Synthetic
atctgtttttggaacagacccagcgttccctcaattttgtgggagaattcgttgtcaacgatgttgtactcgcaa

SEQ ID NO: 246964 - DNA, 75 bp, Artificial Sequence
  Synthetic
ggacaaaatacggcaacttctgaaggatgctactcttgagaagttacgtgattacttagctgactatgacgtagc

SEQ ID NO: 246965 - DNA, 75 bp, Artificial Sequence
  Synthetic
gatgctactcttgagaagttacgtgattacttagctgactatgacgtagcagtcacagctggcccttttatggat

SEQ ID NO: 246966 - DNA, 75 bp, Artificial Sequence
  Synthetic
gtttacaatacgccgccattacagcaccttttgtagttctcaatggattaggtgagtcctttaagaaaattgcag

SEQ ID NO: 246967 - DNA, 75 bp, Artificial Sequence
  Synthetic
accttttgtagttctcaatggattaggtgagtcctttaagaaaattgcagtcattccgtataaggtctgcaagtc

SEQ ID NO: 246968 - DNA, 75 bp, Artificial Sequence
  Synthetic
gctcatagcatattgtacagagtgtttccttatgatattgaatctgacaatgtcgatgctgtgtcatcttttact

SEQ ID NO: 246969 - DNA, 75 bp, Artificial Sequence
  Synthetic
ttccttatgatattgaatctgacaatgtcgatgctgtgtcatcttttactgagctactttttgactgtgttggtc

SEQ ID NO: 246970 - DNA, 75 bp, Artificial Sequence
  Synthetic
aattcgactgttagaagataaaactggcgattttatgtccactattattacttcctgtcaaaatgctgtcagtaa

SEQ ID NO: 246971 - DNA, 75 bp, Artificial Sequence
  Synthetic
ggcgattttatgtccactattattacttcctgtcaaaatgctgtcagtaagcttctagacacttgttttgaggct

SEQ ID NO: 246972 - DNA, 75 bp, Artificial Sequence
  Synthetic
tggatttggcaggattgttcaaagttttcatccgcggagcatatgtgtacacttcacagggctttgtggttcttc

SEQ ID NO: 246973 - DNA, 75 bp, Artificial Sequence
  Synthetic
tttcatccgcggagcatatgtgtacacttcacagggctttgtggttcttcaaggtaaagtttctacacttgttaa

SEQ ID NO: 246974 - DNA, 75 bp, Artificial Sequence
  Synthetic
ggtatgcagcttttgcacactaaaatctcatgggctggttctaaaattaatgcagtcatctttaacggtagagag

SEQ ID NO: 246975 - DNA, 75 bp, Artificial Sequence
  Synthetic
tctcatgggctggttctaaaattaatgcagtcatctttaacggtagagagtctttgattttctctactggtacct

SEQ ID NO: 246976 - DNA, 75 bp, Artificial Sequence
  Synthetic
gtctgttcaacaagattttgatgtggttttgccaggtgagtgtttaaagaagcagctaggactgcttcaacctac

SEQ ID NO: 246977 - DNA, 75 bp, Artificial Sequence
  Synthetic
gttttgccaggtgagtgtttaaagaagcagctaggactgcttcaacctactgacaattcaacaacagttagtgtt

SEQ ID NO: 246978 - DNA, 75 bp, Artificial Sequence
  Synthetic
ctgttgttggtcaattggaacagactaatatgcatggccctgatgttatagtaggagactatgttattattagtg

SEQ ID NO: 246979 - DNA, 75 bp, Artificial Sequence
  Synthetic
taatatgcatggccctgatgttatagtaggagactatgttattattagtgaaaaattgtttgtacgtagtaagga

SEQ ID NO: 246980 - DNA, 75 bp, Artificial Sequence
  Synthetic
gcttgtacaaatggttgtgctgtacctaccttatttaaacttaagggtggtgcacctgttagagagctgaccttt

SEQ ID NO: 246981 - DNA, 75 bp, Artificial Sequence
  Synthetic
ctaccttatttaaacttaagggtggtgcacctgttagagagctgacctttggtgacgatgaagtacatgaggtag

SEQ ID NO: 246982 - DNA, 75 bp, Artificial Sequence
  Synthetic
gtacaacattcatgttgtattagacgcacttttggcttcttctagtcttagaacctttgttgtagacaagtcttt

SEQ ID NO: 246983 - DNA, 75 bp, Artificial Sequence
  Synthetic
gcacttttggcttcttctagtcttagaacctttgttgtagacaagtctttatcagtcgatgaatttgtccatgtg

SEQ ID NO: 246984 - DNA, 75 bp, Artificial Sequence
  Synthetic
ttgctaaattgctacgtggtaagcaaattcccgattttgatttagacgactttattgacacaccatgttattgtt

SEQ ID NO: 246985 - DNA, 75 bp, Artificial Sequence
  Synthetic
aattcccgattttgatttagacgactttattgacacaccatgttattgttttaatagtgatggtgatttatcttg

SEQ ID NO: 246986 - DNA, 75 bp, Artificial Sequence
  Synthetic
catcctgtggaatgtgaagatgattatgttgaagaagaagctgatggtgtcgaggaagaagtcaccgttgatact

SEQ ID NO: 246987 - DNA, 75 bp, Artificial Sequence
  Synthetic
atgttgaagaagaagctgatggtgtcgaggaagaagtcaccgttgatactactgttgagtcagctgtacaggctg

SEQ ID NO: 246988 - DNA, 75 bp, Artificial Sequence
  Synthetic
tgatggttgggctgcagctgttgaagaagcatttcctcttgatgaatctgaagaattttctgctgaagttgtgtg

SEQ ID NO: 246989 - DNA, 75 bp, Artificial Sequence
  Synthetic
gaagcatttcctcttgatgaatctgaagaattttctgctgaagttgtgtgtgaagatctcacccaacttgtagag

SEQ ID NO: 246990 - DNA, 75 bp, Artificial Sequence
  Synthetic
aggtctctttggtttctgtacaggaattagtgccgaatactatggatgaagttgtacctgagcaggtaacacttc

SEQ ID NO: 246991 - DNA, 75 bp, Artificial Sequence
  Synthetic
attagtgccgaatactatggatgaagttgtacctgagcaggtaacacttcctaaagaacctcaagttattcaacc

SEQ ID NO: 246992 - DNA, 75 bp, Artificial Sequence
  Synthetic
tacgaggctgacaccgaacagacacagagtgccattgtaaagcctaagagattacgcaagaagcgtaatgtcgac

SEQ ID NO: 246993 - DNA, 75 bp, Artificial Sequence
  Synthetic
agagtgccattgtaaagcctaagagattacgcaagaagcgtaatgtcgaccctttgtccaactttgaacataagg

SEQ ID NO: 246994 - DNA, 75 bp, Artificial Sequence
  Synthetic
tttaggagacgcaattcaagtagcaaaatgctatgaacaatctgtgttagttaatgctgctaacacacatcttaa

SEQ ID NO: 246995 - DNA, 75 bp, Artificial Sequence
  Synthetic
aaatgctatgaacaatctgtgttagttaatgctgctaacacacatcttaagcatggcggcggtatagctgctgct

SEQ ID NO: 246996 - DNA, 75 bp, Artificial Sequence
  Synthetic
ttcaacaagagtcagatgagtatattctgactagaggtcccttgcaagtaggagaatcagctctcctgcaaggtc

SEQ ID NO: 246997 - DNA, 75 bp, Artificial Sequence
  Synthetic
tctgactagaggtcccttgcaagtaggagaatcagctctcctgcaaggtcattctcttgctaaaaacatcttgca

SEQ ID NO: 246998 - DNA, 75 bp, Artificial Sequence
  Synthetic
aagcaagatgtttctcttcttagtaagtgctacagagctatgaatgcatatcctctcgtagtaactcctcttgta

SEQ ID NO: 246999 - DNA, 75 bp, Artificial Sequence
  Synthetic
agtgctacagagctatgaatgcatatcctctcgtagtaactcctcttgtatctgcgggcatatttggtgttaagc

SEQ ID NO: 247000 - DNA, 75 bp, Artificial Sequence
  Synthetic
tagagaagttgaaactagagtactagttgttgtcaactctcatgatgtttataagagtcttacaactgtgagcgt

SEQ ID NO: 247001 - DNA, 75 bp, Artificial Sequence
  Synthetic
gttgttgtcaactctcatgatgtttataagagtcttacaactgtgagcgtgcctcagggtttgactttctcctat

SEQ ID NO: 247002 - DNA, 75 bp, Artificial Sequence
  Synthetic
aagctaaagattatggttttacggtttttgtgtgcactgacaattcagttaacaccaaaattcttaggaataagg

SEQ ID NO: 247003 - DNA, 75 bp, Artificial Sequence
  Synthetic
ttttgtgtgcactgacaattcagttaacaccaaaattcttaggaataagggtgttgattatactaagaaatccct

SEQ ID NO: 247004 - DNA, 75 bp, Artificial Sequence
  Synthetic
tgttacacgtctagggattctttagatacaattttacaagaggctaataagtctattggtattgtatctatgcct

SEQ ID NO: 247005 - DNA, 75 bp, Artificial Sequence
  Synthetic
atacaattttacaagaggctaataagtctattggtattgtatctatgcctttggggtatgtttcccatggcttag

SEQ ID NO: 247006 - DNA, 75 bp, Artificial Sequence
  Synthetic
acgtaaggtcaaagtaccttatgtgtgccttctagctaataaggagcaacaagccattttgatgtctgaagatgt

SEQ ID NO: 247007 - DNA, 75 bp, Artificial Sequence
  Synthetic
tgccttctagctaataaggagcaacaagccattttgatgtctgaagatgttaagttaagcccttcagccgatttt

SEQ ID NO: 247008 - DNA, 75 bp, Artificial Sequence
  Synthetic
gttacaattcttggcatttagtcgagggtgaactattggtacagaaacagagctttaacaagctccttcattggt

SEQ ID NO: 247009 - DNA, 75 bp, Artificial Sequence
  Synthetic
gggtgaactattggtacagaaacagagctttaacaagctccttcattggtcagatcaaaccatatgttataagga

SEQ ID NO: 247010 - DNA, 75 bp, Artificial Sequence
  Synthetic
aatgttactttgccatttgaaactgttgaggcttgtcgcacttatcttgattcacgtacgacacagcaattaaca

SEQ ID NO: 247011 - DNA, 75 bp, Artificial Sequence
  Synthetic
ttgaggcttgtcgcacttatcttgattcacgtacgacacagcaattaacaatcgaagtgttggttactgtcgatg

SEQ ID NO: 247012 - DNA, 75 bp, Artificial Sequence
  Synthetic
aaataataagaactcctataggtcacagttgggatgtgtcttctttaacggagctgatatttctgataccattcc

SEQ ID NO: 247013 - DNA, 75 bp, Artificial Sequence
  Synthetic
cagttgggatgtgtcttctttaacggagctgatatttctgataccattcctgatgaaaaacagcatggttgcagt

SEQ ID NO: 247014 - DNA, 75 bp, Artificial Sequence
  Synthetic
ctgatgaaacaaaagcgcttaaagagttatatggcgctgttgatgctactttcctacacagattctattcactaa

SEQ ID NO: 247015 - DNA, 75 bp, Artificial Sequence
  Synthetic
gttatatggcgctgttgatgctactttcctacacagattctattcactaaaggctgcggtccagaagtggaagat

SEQ ID NO: 247016 - DNA, 75 bp, Artificial Sequence
  Synthetic
cttaaattaagtgataataattgctaccttaacggggttattatgacacttgatttattgaaggacattaagttt

SEQ ID NO: 247017 - DNA, 75 bp, Artificial Sequence
  Synthetic
accttaacggggttattatgacacttgatttattgaaggacattaagtttgttgtacctgctttacagcatgctt

SEQ ID NO: 247018 - DNA, 75 bp, Artificial Sequence
  Synthetic
tactgatttcattgctctcattatgacttatggaaattgtacatttggtgctccagacgatgcttctcggttact

SEQ ID NO: 247019 - DNA, 75 bp, Artificial Sequence
  Synthetic
acttatggaaattgtacatttggtgctccagacgatgcttctcggttacttcataccgtgcttgccaaggctgag

SEQ ID NO: 247020 - DNA, 75 bp, Artificial Sequence
  Synthetic
ggagagagtggtgcaacgtgtgtggcataaaagatgttgttatacaaggccttaaggcatgttgttacgttggta

SEQ ID NO: 247021 - DNA, 75 bp, Artificial Sequence
  Synthetic
cataaaagatgttgttatacaaggccttaaggcatgttgttacgttggtatgcaaactttagacgatctgcatgc

SEQ ID NO: 247022 - DNA, 75 bp, Artificial Sequence
  Synthetic
ggtagtgagcgttatcgtcaattagtcgaacacacaaccccttggctgttactctcaggcacaccaaaggagaaa

SEQ ID NO: 247023 - DNA, 75 bp, Artificial Sequence
  Synthetic
tcgaacacacaaccccttggctgttactctcaggcacaccaaaggagaaattggtgagttcacctgattttgtag

SEQ ID NO: 247024 - DNA, 75 bp, Artificial Sequence
  Synthetic
aacggctgttggccattatgtccatgcccgtttgaaggatggtcttattttaaaatttgactctggcactttaag

SEQ ID NO: 247025 - DNA, 75 bp, Artificial Sequence
  Synthetic
gcccgtttgaaggatggtcttattttaaaatttgactctggcactttaagtaaagcttcagactggaagtgtaaa

SEQ ID NO: 247026 - DNA, 75 bp, Artificial Sequence
  Synthetic
agaagtacagtagtgactgtaatgtcgtgcggtattctcttgatggtatttttaagacagaggttgatcctgacc

SEQ ID NO: 247027 - DNA, 75 bp, Artificial Sequence
  Synthetic
cgtgcggtattctcttgatggtatttttaagacagaggttgatcctgacctatctgggttttatgttaaggatgg

SEQ ID NO: 247028 - DNA, 75 bp, Artificial Sequence
  Synthetic
ataacttattcaccagctacaattctaactggtagtgtttatactaatagttgcctagtatcttcagatggagaa

SEQ ID NO: 247029 - DNA, 75 bp, Artificial Sequence
  Synthetic
taactggtagtgtttatactaatagttgcctagtatcttcagatggagaaccaggcggtgatgctattagtttaa

SEQ ID NO: 247030 - DNA, 75 bp, Artificial Sequence
  Synthetic
ttctagcaaaccagtcactaagaagtatacatactcttttctccctaaggaagatggtgatgttttgttggctga

SEQ ID NO: 247031 - DNA, 75 bp, Artificial Sequence
  Synthetic
tatacatactcttttctccctaaggaagatggtgatgttttgttggctgagtttgctacatatgaccctatttat

SEQ ID NO: 247032 - DNA, 75 bp, Artificial Sequence
  Synthetic
ggcttttacgcaagttttatcagcatgtaatcaatggttgcaaagatacggcatgcttgctctgctataagagga

SEQ ID NO: 247033 - DNA, 75 bp, Artificial Sequence
  Synthetic
aacctattctttgggtcactaaagcatcttatgatgctaatcttaataagttcaacagggctagtcttcgtcaaa

SEQ ID NO: 247034 - DNA, 75 bp, Artificial Sequence
  Synthetic
atcttatgatgctaatcttaataagttcaacagggctagtcttcgtcaaatttttgatgttgctcctgttgaaat

SEQ ID NO: 247035 - DNA, 75 bp, Artificial Sequence
  Synthetic
gttgaacctacacctgtagagccaccaactgtacaggtgtcaccacctcaatcagaaatgactattgtcaaatgc

SEQ ID NO: 247036 - DNA, 75 bp, Artificial Sequence
  Synthetic
caactgtacaggtgtcaccacctcaatcagaaatgactattgtcaaatgcaagggcttgaacaagccttttgtta

SEQ ID NO: 247037 - DNA, 75 bp, Artificial Sequence
  Synthetic
tgatttaggtattcctgttgttgagtacctatctaaggatgatctacatgcactttatgtagatcctaagtatca

SEQ ID NO: 247038 - DNA, 75 bp, Artificial Sequence
  Synthetic
tacctatctaaggatgatctacatgcactttatgtagatcctaagtatcaagtcattgtcttaaaggataatgta

SEQ ID NO: 247039 - DNA, 75 bp, Artificial Sequence
  Synthetic
ctgttgaatctggtgatataaacgttgttgcagcatcgggatctttaacgtgtaaggtgaaactattgtttagag

SEQ ID NO: 247040 - DNA, 75 bp, Artificial Sequence
  Synthetic
tgttgcagcatcgggatctttaacgtgtaaggtgaaactattgtttagagcttcattttactttaaagagtttgc

SEQ ID NO: 247041 - DNA, 75 bp, Artificial Sequence
  Synthetic
gtagtaggtagttgtataaaaagtgttgtgcgacatttaggttttactaaaggtatcatggcaaactgttttagt

SEQ ID NO: 247042 - DNA, 75 bp, Artificial Sequence
  Synthetic
ttgtgcgacatttaggttttactaaaggtatcatggcaaactgttttagttttgttaagatgctatttatgctac

SEQ ID NO: 247043 - DNA, 75 bp, Artificial Sequence
  Synthetic
acctagcactacagaagttaaagtaagtgctttaaaaacagcgggtattgtaacaggtaatgttgtaaaacaatg

SEQ ID NO: 247044 - DNA, 75 bp, Artificial Sequence
  Synthetic
agtgctttaaaaacagcgggtattgtaacaggtaatgttgtaaaacaatgctgcattgctgctgttgatcttagt

SEQ ID NO: 247045 - DNA, 75 bp, Artificial Sequence
  Synthetic
ggaaagcgaccttacgattgttacttatgctaagcacaactatggttttgttgtcttccgtatatcaactgtatg

SEQ ID NO: 247046 - DNA, 75 bp, Artificial Sequence
  Synthetic
tatgctaagcacaactatggttttgttgtcttccgtatatcaactgtatgtctttaatcaagtcttgtcaagtga

SEQ ID NO: 247047 - DNA, 75 bp, Artificial Sequence
  Synthetic
ttgaaaaagttctacaaagatgttagagcttacctaggtgtttcttcttcttgtgatggtcttgctgcggcttat

SEQ ID NO: 247048 - DNA, 75 bp, Artificial Sequence
  Synthetic
gagcttacctaggtgtttcttcttcttgtgatggtcttgctgcggcttatagggctaactcatttgatgtaccta

SEQ ID NO: 247049 - DNA, 75 bp, Artificial Sequence
  Synthetic
gtgtaactggtgtttgataagccaggattctataacgcattatacagccctcaagatgattcaaacacattttag

SEQ ID NO: 247050 - DNA, 75 bp, Artificial Sequence
  Synthetic
gattctataacgcattatacagccctcaagatgattcaaacacattttagccactatgttcttaacgtagattgg

SEQ ID NO: 247051 - DNA, 75 bp, Artificial Sequence
  Synthetic
tagcatacatactttatacctcggcctttaactggttgttgctggcaggtacattgcagtatttctttgcacaga

SEQ ID NO: 247052 - DNA, 75 bp, Artificial Sequence
  Synthetic
ctttaactggttgttgctggcaggtacattgcagtatttctttgcacagacatccgtatttgtggattggcgttc

SEQ ID NO: 247053 - DNA, 75 bp, Artificial Sequence
  Synthetic
ttttggttatttacccacattcccatgttgggtttggttagaatttacaacttattagcatgcctttggctttta

SEQ ID NO: 247054 - DNA, 75 bp, Artificial Sequence
  Synthetic
tgttgggtttggttagaatttacaacttattagcatgcctttggcttttacgtaagttctatcaacacgttatta

SEQ ID NO: 247055 - DNA, 75 bp, Artificial Sequence
  Synthetic
tctttgttataaaaggaatcgtcttaccagagttgaagcttctaccgttgtctgtggtggaaaacgtacgtttta

SEQ ID NO: 247056 - DNA, 75 bp, Artificial Sequence
  Synthetic
accagagttgaagcttctaccgttgtctgtggtggaaaacgtacgttttacattgcagctaatggcggtatctca

SEQ ID NO: 247057 - DNA, 75 bp, Artificial Sequence
  Synthetic
gtgttgattgcgacaccgcaggtgtagggaataccttcatctgtgaagaagttgcaagtgacctcactacctctc

SEQ ID NO: 247058 - DNA, 75 bp, Artificial Sequence
  Synthetic
agggaataccttcatctgtgaagaagttgcaagtgacctcactacctctctacgcaggcctgtaaaccctacaga

SEQ ID NO: 247059 - DNA, 75 bp, Artificial Sequence
  Synthetic
gttgaggttaaagaaactgtagtacagtttaactatcgcagagacggccaaccatgctatgagcggtttcccctc

SEQ ID NO: 247060 - DNA, 75 bp, Artificial Sequence
  Synthetic
agtttaactatcgcagagacggccaaccatgctatgagcggtttcccctctgtgcttttactaatttagataagt

SEQ ID NO: 247061 - DNA, 75 bp, Artificial Sequence
  Synthetic
taccactggtgtacctgaatacaactttatcatctatgactcatcagaccgtggccaggaaagtttagctaggtc

SEQ ID NO: 247062 - DNA, 75 bp, Artificial Sequence
  Synthetic
tttatcatctatgactcatcagaccgtggccaggaaagtttagctaggtctgcatgtgtgtattattcccaagta

SEQ ID NO: 247063 - DNA, 75 bp, Artificial Sequence
  Synthetic
attcaagcttggttacttctgttggcaacactagtgaaattgccatcaagatgtttgattcctttgttaatagtt

SEQ ID NO: 247064 - DNA, 75 bp, Artificial Sequence
  Synthetic
tgataagttggagaaacttattaatactgctcgtgatggcgttagaagaggcgacaacttccatagtgtcttaac

SEQ ID NO: 247065 - DNA, 75 bp, Artificial Sequence
  Synthetic
actgctcgtgatggcgttagaagaggcgacaacttccatagtgtcttaacaacattcattgatgctgctcgtgga

SEQ ID NO: 247066 - DNA, 75 bp, Artificial Sequence
  Synthetic
tcagtatgctcataaacatgacatacaacttactaatgagagctacaataattatgtgccctcatatgtcaaacc

SEQ ID NO: 247067 - DNA, 75 bp, Artificial Sequence
  Synthetic
ggtagtctcatagattgtaatgcggcttctgtaaaccaaactagcatgcgcaacgctaatggcgcatgcatttgg

SEQ ID NO: 247068 - DNA, 75 bp, Artificial Sequence
  Synthetic
cttctgtaaaccaaactagcatgcgcaacgctaatggcgcatgcatttggaacgcttctgcatacatgaaacttt

SEQ ID NO: 247069 - DNA, 75 bp, Artificial Sequence
  Synthetic
tatagcatgccgtaagtgtaatttagctttccgtcttaccacctcaaagcttcgtgctaatgataatattttgtc

SEQ ID NO: 247070 - DNA, 75 bp, Artificial Sequence
  Synthetic
aaaatagtaaagtgcagctcggtgagtacatcttcgagcgcattgattatagtgatgctgtatcctacaagtcta

SEQ ID NO: 247071 - DNA, 75 bp, Artificial Sequence
  Synthetic
gctttccgtcttaccacctcaaagcttcgtgctaatgataatattttgtcagttagattcactgctactaagatt

SEQ ID NO: 247072 - DNA, 75 bp, Artificial Sequence
  Synthetic
atacattgcgtgactttacgttgaagagttacgtctttgttaccattatagtcttactgtgtgctgtgttaatgt

SEQ ID NO: 247073 - DNA, 75 bp, Artificial Sequence
  Synthetic
gagttacgtctttgttaccattatagtcttactgtgtgctgtgttaatgtatttttgtttacctacattctccat

SEQ ID NO: 247074 - DNA, 75 bp, Artificial Sequence
  Synthetic
cgcattctagaatttaaaattctagacaatggtatcattagggatattaaccctgatgataagtgctttgctaat

SEQ ID NO: 247075 - DNA, 75 bp, Artificial Sequence
  Synthetic
cagggaccacctggcactggcaaaagtcactttgctatagggttagcgatttactaccctacagcacgtgttgtt

SEQ ID NO: 247076 - DNA, 75 bp, Artificial Sequence
  Synthetic
acaatggtatcattagggatattaaccctgatgataagtgctttgctaataagtaccggtcttttactcaatggt

SEQ ID NO: 247077 - DNA, 75 bp, Artificial Sequence
  Synthetic
cgataattctatcacatgtcccctgacagttgcagtaatagctggagtagcaggtgctagaattccagatgtacc

SEQ ID NO: 247078 - DNA, 75 bp, Artificial Sequence
  Synthetic
acagttgcagtaatagctggagtagcaggtgctagaattccagatgtacctactacattggcttgggtaaacaat

SEQ ID NO: 247079 - DNA, 75 bp, Artificial Sequence
  Synthetic
tctttgctaatactggtagtgtttgttacacgcctatagatgagataccttataaaggcttctctgatagtggtt

SEQ ID NO: 247080 - DNA, 75 bp, Artificial Sequence
  Synthetic
ttacacgcctatagatgagataccttataaaggcttctctgatagtggttgcattctctcttctgagtgcacgat

SEQ ID NO: 247081 - DNA, 75 bp, Artificial Sequence
  Synthetic
acaccatactgccatgatcctactgttttacctggggctttcgcgtatagtcagatgaagccccatgtccgctat

SEQ ID NO: 247082 - DNA, 75 bp, Artificial Sequence
  Synthetic
ttttacctggggctttcgcgtatagtcagatgaagccccatgtccgctatgacttgtatgatggtaacatgttta

SEQ ID NO: 247083 - DNA, 75 bp, Artificial Sequence
  Synthetic
aagtactcttaggattactaaaactctgactactcagtactgccggtttggtagttgtgagtatgcgcaagaggg

SEQ ID NO: 247084 - DNA, 75 bp, Artificial Sequence
  Synthetic
ctgactactcagtactgccggtttggtagttgtgagtatgcgcaagagggtgtttgtattactacaaatggctca

SEQ ID NO: 247085 - DNA, 75 bp, Artificial Sequence
  Synthetic
ttaatagacctggtgtctattgtggttcagattatgttgacattgtcaggcgtttagcaatttcgctgtttcaac

SEQ ID NO: 247086 - DNA, 75 bp, Artificial Sequence
  Synthetic
ttcagattatgttgacattgtcaggcgtttagcaatttcgctgtttcaacctattacctacttccaattaactac

SEQ ID NO: 247087 - DNA, 75 bp, Artificial Sequence
  Synthetic
tgtgcgtttctgactttgctcttctattatattaataaagtaaaacgtgcatttgcggactatactcagtgtgcc

SEQ ID NO: 247088 - DNA, 75 bp, Artificial Sequence
  Synthetic
attatattaataaagtaaaacgtgcatttgcggactatactcagtgtgccgtgattgccgtatgtgctgccattc

SEQ ID NO: 247089 - DNA, 75 bp, Artificial Sequence
  Synthetic
tgcttctatacccctttgtatagttccatacactgcattgtactactatgctacattttattttaccaatgaacc

SEQ ID NO: 247090 - DNA, 75 bp, Artificial Sequence
  Synthetic
ccatacactgcattgtactactatgctacattttattttaccaatgaaccagcatttattatgcatgtctcttgg

SEQ ID NO: 247091 - DNA, 75 bp, Artificial Sequence
  Synthetic
ctatttggatgacctgtgtctatacagttgcaatgtgttttagacatttcttctgggttttggcctatttcagta

SEQ ID NO: 247092 - DNA, 75 bp, Artificial Sequence
  Synthetic
agttgcaatgtgttttagacatttcttctgggttttggcctatttcagtaaaaagcatgtagaagtttttactga

SEQ ID NO: 247093 - DNA, 75 bp, Artificial Sequence
  Synthetic
gatgcagcttctaatatctttgtcgttaacaaggatacttatgctgctctcagaaattctataactaatgatgcg

SEQ ID NO: 247094 - DNA, 75 bp, Artificial Sequence
  Synthetic
ttaacaaggatacttatgctgctctcagaaattctataactaatgatgcgtattctcgatacttaggtctgttta

SEQ ID NO: 247095 - DNA, 75 bp, Artificial Sequence
  Synthetic
tatggaaacagccgcgtatcgtgaagctgcagcatgtcatcttgctagagccttacaaacttacagtgaaactgg

SEQ ID NO: 247096 - DNA, 75 bp, Artificial Sequence
  Synthetic
gctgcagcatgtcatcttgctagagccttacaaacttacagtgaaactggtagtgacttgctttaccagccacct

SEQ ID NO: 247097 - DNA, 75 bp, Artificial Sequence
  Synthetic
tacagagtggtttggtaaaaatgtcacatcctagtggtgatgttgaggcttgtatggttcaggttacctgtggta

SEQ ID NO: 247098 - DNA, 75 bp, Artificial Sequence
  Synthetic
acatcctagtggtgatgttgaggcttgtatggttcaggttacctgtggtagcatgactcttaatgggctgtggct

SEQ ID NO: 247099 - DNA, 75 bp, Artificial Sequence
  Synthetic
catgttatgtgcccagcagatcagttgtctgatcctaactatgatgccttgcttgtttctatgactaaccatagt

SEQ ID NO: 247100 - DNA, 75 bp, Artificial Sequence
  Synthetic
tgtctgatcctaactatgatgccttgcttgtttctatgactaaccatagttttagtgtacaaaagcatgttggtg

SEQ ID NO: 247101 - DNA, 75 bp, Artificial Sequence
  Synthetic
tcactctatgcaaggcactcttttgaagttgactgtcgatgtagctaaccctagcactccagcctacacttttac

SEQ ID NO: 247102 - DNA, 75 bp, Artificial Sequence
  Synthetic
aagttgactgtcgatgtagctaaccctagcactccagcctacacttttactacagtgaaacctggtgcatcattt

SEQ ID NO: 247103 - DNA, 75 bp, Artificial Sequence
  Synthetic
gtcctactggtacttttactgttataatgcgccctaactacacaattaagggttcctttttgtgtggttcttgcg

SEQ ID NO: 247104 - DNA, 75 bp, Artificial Sequence
  Synthetic
taatgtgattaacttttgttatatgcatcaaatggagcttgctaatggtactcatacaggctcagcatttgacgg

SEQ ID NO: 247105 - DNA, 75 bp, Artificial Sequence
  Synthetic
catcaaatggagcttgctaatggtactcatacaggctcagcatttgacggtactatgtatggtgcctttatggac

SEQ ID NO: 247106 - DNA, 75 bp, Artificial Sequence
  Synthetic
agtagcttggctttatgcagcaatacttaatggttgtgcttggtttgttaaacccaatcgcactagtgttgtctc

SEQ ID NO: 247107 - DNA, 75 bp, Artificial Sequence
  Synthetic
caattcactgaatttgttggcactcagtccattgatatgttagctgttaagacaggtgttgctattgaacagctt

SEQ ID NO: 247108 - DNA, 75 bp, Artificial Sequence
  Synthetic
agtccattgatatgttagctgttaagacaggtgttgctattgaacagcttctttatgcgatccaacaattgtata

SEQ ID NO: 247109 - DNA, 75 bp, Artificial Sequence
  Synthetic
tggcagtactatgttggaagatgagtttacacctgaagatgttaatatgcagattatgggtgtaattatgcagag

SEQ ID NO: 247110 - DNA, 75 bp, Artificial Sequence
  Synthetic
tttacacctgaagatgttaatatgcagattatgggtgtaattatgcagagtggagctagaaaagtcacatatggt

SEQ ID NO: 247111 - DNA, 75 bp, Artificial Sequence
  Synthetic
ttgcgctaacttatgtgatattcttgcagactactaaacttactttgtggaactacttgtttgaaactataccta

SEQ ID NO: 247112 - DNA, 75 bp, Artificial Sequence
  Synthetic
gcagactactaaacttactttgtggaactacttgtttgaaactatacctacacagttgtttccacttttatttgt

SEQ ID NO: 247113 - DNA, 75 bp, Artificial Sequence
  Synthetic
gtgaagcataaacacacctttttgacattatttttgttgcccgtagcaatttgtttgacttatgcaaacattgta

SEQ ID NO: 247114 - DNA, 75 bp, Artificial Sequence
  Synthetic
cattatttttgttgcccgtagcaatttgtttgacttatgcaaacattgtatacgagccttctactcccatttctt

SEQ ID NO: 247115 - DNA, 75 bp, Artificial Sequence
  Synthetic
gttagctcctactaatgtttatatgcgcaccacacatgctgatattggtatgtacgttagtatgtcacttgtatt

SEQ ID NO: 247116 - DNA, 75 bp, Artificial Sequence
  Synthetic
cgcaccacacatgctgatattggtatgtacgttagtatgtcacttgtattagctatagtggtgaaaagattgtat

SEQ ID NO: 247117 - DNA, 75 bp, Artificial Sequence
  Synthetic
tggcattgtgtagcggtgtaatgtggttgtatacttatagcattggagagacttctagccccattgcctaccttg

SEQ ID NO: 247118 - DNA, 75 bp, Artificial Sequence
  Synthetic
gttgtatacttatagcattggagagacttctagccccattgcctaccttgtctttgttactacacttactagtga

SEQ ID NO: 247119 - DNA, 75 bp, Artificial Sequence
  Synthetic
gttaatcttgcaaaaatgtgcacttatatcatctttgcttatgctccacaactaactcttgtgcttccagaagtg

SEQ ID NO: 247120 - DNA, 75 bp, Artificial Sequence
  Synthetic
atatcatctttgcttatgctccacaactaactcttgtgcttccagaagtgaagatggttcttttattatacacat

SEQ ID NO: 247121 - DNA, 75 bp, Artificial Sequence
  Synthetic
ttttggtgtcttttctttactgaacctcaaacttagagctccaatgggtgtctatgattttaaggtttcgacaca

SEQ ID NO: 247122 - DNA, 75 bp, Artificial Sequence
  Synthetic
ctcaaacttagagctccaatgggtgtctatgattttaaggtttcgacacaagagttcagattcatgactgctaac

SEQ ID NO: 247123 - DNA, 75 bp, Artificial Sequence
  Synthetic
gggaagccatgtctttgaactttaagttgctaggtattggtggtacaccttgtataaaagttgctgccatacagt

SEQ ID NO: 247124 - DNA, 75 bp, Artificial Sequence
  Synthetic
gttgctaggtattggtggtacaccttgtataaaagttgctgccatacagtcaaaacttactgacattaagtgcac

SEQ ID NO: 247125 - DNA, 75 bp, Artificial Sequence
  Synthetic
cagcagttgcacttagaggctaatagcaaggcttgggctttctgtgtcaagtgccataatgacatattggcggct

SEQ ID NO: 247126 - DNA, 75 bp, Artificial Sequence
  Synthetic
gcaaggcttgggctttctgtgtcaagtgccataatgacatattggcggctacagaccctagtgaggctttcgaaa

SEQ ID NO: 247127 - DNA, 75 bp, Artificial Sequence
  Synthetic
aatgaccttttctggtaatgtagatcttgatgcgttggctagtgacatctttgacactcccagtgtgcttcaagc

SEQ ID NO: 247128 - DNA, 75 bp, Artificial Sequence
  Synthetic
cttgatgcgttggctagtgacatctttgacactcccagtgtgcttcaagctactctttctgaattttctcactta

SEQ ID NO: 247129 - DNA, 75 bp, Artificial Sequence
  Synthetic
cacagaaagcctatcaggaagccttagactctggtgatgcgtcacctcaagttcttaaggctttacagaaggctg

SEQ ID NO: 247130 - DNA, 75 bp, Artificial Sequence
  Synthetic
agactctggtgatgcgtcacctcaagttcttaaggctttacagaaggctgttaacgttgctaaaaatgcttatga

SEQ ID NO: 247131 - DNA, 75 bp, Artificial Sequence
  Synthetic
ttagagcgtatggctgaacaggccatgacgtctatgtataagcaagcacgtgctgaagacaagaaggcaaaaatt

SEQ ID NO: 247132 - DNA, 75 bp, Artificial Sequence
  Synthetic
tgacgtctatgtataagcaagcacgtgctgaagacaagaaggcaaaaattgtcagtgctatgcaaactatgcttt

SEQ ID NO: 247133 - DNA, 75 bp, Artificial Sequence
  Synthetic
tgatgttcttaatggtatcatttctaacgctaggaatggttgtataccacttagtgttgttccactgtgtgcttc

SEQ ID NO: 247134 - DNA, 75 bp, Artificial Sequence
  Synthetic
aacgctaggaatggttgtataccacttagtgttgttccactgtgtgcttcaaacaaattacgtgtagtaattcca

SEQ ID NO: 247135 - DNA, 75 bp, Artificial Sequence
  Synthetic
taacatatccctcgcttaattatgctggggctttgtgggacattacagttataaacaatgtggataatgagattg

SEQ ID NO: 247136 - DNA, 75 bp, Artificial Sequence
  Synthetic
tggggctttgtgggacattacagttataaacaatgtggataatgagattgttaaatcttcagatgttgttgaaac

SEQ ID NO: 247137 - DNA, 75 bp, Artificial Sequence
  Synthetic
gtcttagaatgcactagggctgctacctctgcagttaagttgcaaaataatgagatcaaaccttctggtcttaag

SEQ ID NO: 247138 - DNA, 75 bp, Artificial Sequence
  Synthetic
cctctgcagttaagttgcaaaataatgagatcaaaccttctggtcttaagactatggtagtgtctgcaggtcaag

SEQ ID NO: 247139 - DNA, 75 bp, Artificial Sequence
  Synthetic
tttagcttattacgaacctgttcagggccgtaaaatgctgatggcacttctctcagataatgcctatcttaaatg

SEQ ID NO: 247140 - DNA, 75 bp, Artificial Sequence
  Synthetic
ggccgtaaaatgctgatggcacttctctcagataatgcctatcttaaatgggcccgggttgaaggccaggatggg

SEQ ID NO: 247141 - DNA, 75 bp, Artificial Sequence
  Synthetic
cttgcaagtttttgattgcaggacctaagggacctgagatccgatacctctattttgttaagaatcttaacaacc

SEQ ID NO: 247142 - DNA, 75 bp, Artificial Sequence
  Synthetic
taagggacctgagatccgatacctctattttgttaagaatcttaacaaccttcatcgcgggcaagtgcttggtca

SEQ ID NO: 247143 - DNA, 75 bp, Artificial Sequence
  Synthetic
gccggttctaatactgagtttgcttctaattcttcggtgttgtcacttgtcaattttaccgtagaacctcaaaaa

SEQ ID NO: 247144 - DNA, 75 bp, Artificial Sequence
  Synthetic
tattgccgcgcgcatatagaacatcctgatgtttctggcgtttgtaaatataagggtaagtttgtccaaattcca

SEQ ID NO: 247145 - DNA, 75 bp, Artificial Sequence
  Synthetic
actaatacttgtaggtttgtagaattagatgatcaaggtcatcatttagactcctattttgtcgttaagcggcat

SEQ ID NO: 247146 - DNA, 75 bp, Artificial Sequence
  Synthetic
aacactgttacgaattgttacgtgactgtgatgctgtagctcctcatgattttttcgtctttgacgtggataaaa

SEQ ID NO: 247147 - DNA, 75 bp, Artificial Sequence
  Synthetic
gcgtttaactgagtacactatgatggatttagtttacgctttgagacattttgaccaaaataactgtgaggttct

SEQ ID NO: 247148 - DNA, 75 bp, Artificial Sequence
  Synthetic
aaatcccagtgttattggtgtttatcataaacttggagaacgtattcgacaggctgttttaaacactgttaaatt

SEQ ID NO: 247149 - DNA, 75 bp, Artificial Sequence
  Synthetic
ttagtcggtgttctcacacttgacaaccaggaccttaacggcaagtggtatgattttggtgactttgtagtcaca

SEQ ID NO: 247150 - DNA, 75 bp, Artificial Sequence
  Synthetic
accaggaccttaacggcaagtggtatgattttggtgactttgtagtcacacaacctggttcaggagtggctatag

SEQ ID NO: 247151 - DNA, 75 bp, Artificial Sequence
  Synthetic
gcctgtgctttcaatgaccaactgtttggccgctgagacacacagggattgtgattttaataaaccacttatcga

SEQ ID NO: 247152 - DNA, 75 bp, Artificial Sequence
  Synthetic
ttggccgctgagacacacagggattgtgattttaataaaccacttatcgagtggccacttactgagtatgatttt

SEQ ID NO: 247153 - DNA, 75 bp, Artificial Sequence
  Synthetic
aaaagtactttaagtattgggatcagacgtatcacgctaattgcgttaattgtactgatgatcgttgtgtattac

SEQ ID NO: 247154 - DNA, 75 bp, Artificial Sequence
  Synthetic
tgtactgatgatcgttgtgtattacattgtgctaatttcaatgtattgtttgctatgactatgcctaagacttgt

SEQ ID NO: 247155 - DNA, 75 bp, Artificial Sequence
  Synthetic
ttaggtttagtcatgaatatggatgttagtctccatagacatcgactctcccttaaggaattaatgatgtatgct

SEQ ID NO: 247156 - DNA, 75 bp, Artificial Sequence
  Synthetic
aaaggtttctttaaagagggctcttcagtgacgctcaaacattttttctttgcccaagatggcaatgctgctatt

SEQ ID NO: 247157 - DNA, 75 bp, Artificial Sequence
  Synthetic
cagtgacgctcaaacattttttctttgcccaagatggcaatgctgctattacagattataattattattcttata

SEQ ID NO: 247158 - DNA, 75 bp, Artificial Sequence
  Synthetic
gcaaatgttattttgcatggaggttgtaaacaagtacttcgagatttatgacggtggttgtcttaatgcctccga

SEQ ID NO: 247159 - DNA, 75 bp, Artificial Sequence
  Synthetic
gtaaacaagtacttcgagatttatgacggtggttgtcttaatgcctccgaagttgttgttaataatttagacaag

SEQ ID NO: 247160 - DNA, 75 bp, Artificial Sequence
  Synthetic
ttggcaaagcccgcgtctattatgagagcatgtcttatcaggagcaagatgaactctttgctatgacaaagcgta

SEQ ID NO: 247161 - DNA, 75 bp, Artificial Sequence
  Synthetic
acgtcattcctaccatgactcaaatgaatataaaatatactattagtgctaagaatagggctcgcaccgttgccg

SEQ ID NO: 247162 - DNA, 75 bp, Artificial Sequence
  Synthetic
acgtcattcctaccatgactcaaatgaatataaaatatactattagtgctatgaatagggctcgcaccgttgccg

SEQ ID NO: 247163 - DNA, 75 bp, Artificial Sequence
  Synthetic
acgtcattcctaccatgactcaaatgaatataaaatatactattagtgctacgaatagggctcgcaccgttgccg

SEQ ID NO: 247164 - DNA, 75 bp, Artificial Sequence
  Synthetic
acgtcattcctaccatgactcaaatgaatataaaatatactattagtgctaggaatagggctcgcaccgttgccg

SEQ ID NO: 247165 - DNA, 75 bp, Artificial Sequence
  Synthetic
acgtcattcctaccatgactcaaatgaatataaaatattctattagtgctaagaatagggctcgcaccgttgccg

SEQ ID NO: 247166 - DNA, 75 bp, Artificial Sequence
  Synthetic
acgtcattcctaccatgactcaaatgaatataaaatattctattagtgctatgaatagggctcgcaccgttgccg

SEQ ID NO: 247167 - DNA, 75 bp, Artificial Sequence
  Synthetic
acgtcattcctaccatgactcaaatgaatataaaatattctattagtgctacgaatagggctcgcaccgttgccg

SEQ ID NO: 247168 - DNA, 75 bp, Artificial Sequence
  Synthetic
acgtcattcctaccatgactcaaatgaatataaaatattctattagtgctaggaatagggctcgcaccgttgccg

SEQ ID NO: 247169 - DNA, 75 bp, Artificial Sequence
  Synthetic
acgtcattcctaccatgactcaaatgaatataaaatatcctattagtgctaagaatagggctcgcaccgttgccg

SEQ ID NO: 247170 - DNA, 75 bp, Artificial Sequence
  Synthetic
acgtcattcctaccatgactcaaatgaatataaaatatcctattagtgctatgaatagggctcgcaccgttgccg

SEQ ID NO: 247171 - DNA, 75 bp, Artificial Sequence
  Synthetic
acgtcattcctaccatgactcaaatgaatataaaatatcctattagtgctacgaatagggctcgcaccgttgccg

SEQ ID NO: 247172 - DNA, 75 bp, Artificial Sequence
  Synthetic
acgtcattcctaccatgactcaaatgaatataaaatatcctattagtgctaggaatagggctcgcaccgttgccg

SEQ ID NO: 247173 - DNA, 75 bp, Artificial Sequence
  Synthetic
acgtcattcctaccatgactcaaatgaatataaaatatgctattagtgctaagaatagggctcgcaccgttgccg

SEQ ID NO: 247174 - DNA, 75 bp, Artificial Sequence
  Synthetic
acgtcattcctaccatgactcaaatgaatataaaatatgctattagtgctatgaatagggctcgcaccgttgccg

SEQ ID NO: 247175 - DNA, 75 bp, Artificial Sequence
  Synthetic
acgtcattcctaccatgactcaaatgaatataaaatatgctattagtgctacgaatagggctcgcaccgttgccg

SEQ ID NO: 247176 - DNA, 75 bp, Artificial Sequence
  Synthetic
acgtcattcctaccatgactcaaatgaatataaaatatgctattagtgctaggaatagggctcgcaccgttgccg

SEQ ID NO: 247177 - DNA, 75 bp, Artificial Sequence
  Synthetic
acgtcattcctaccatgactcaaatgaatttaaaatatactattagtgctaagaatagggctcgcaccgttgccg

SEQ ID NO: 247178 - DNA, 75 bp, Artificial Sequence
  Synthetic
acgtcattcctaccatgactcaaatgaatttaaaatatactattagtgctatgaatagggctcgcaccgttgccg

SEQ ID NO: 247179 - DNA, 75 bp, Artificial Sequence
  Synthetic
acgtcattcctaccatgactcaaatgaatttaaaatatactattagtgctacgaatagggctcgcaccgttgccg

SEQ ID NO: 247180 - DNA, 75 bp, Artificial Sequence
  Synthetic
acgtcattcctaccatgactcaaatgaatttaaaatatactattagtgctaggaatagggctcgcaccgttgccg

SEQ ID NO: 247181 - DNA, 75 bp, Artificial Sequence
  Synthetic
acgtcattcctaccatgactcaaatgaatttaaaatattctattagtgctaagaatagggctcgcaccgttgccg

SEQ ID NO: 247182 - DNA, 75 bp, Artificial Sequence
  Synthetic
acgtcattcctaccatgactcaaatgaatttaaaatattctattagtgctatgaatagggctcgcaccgttgccg

SEQ ID NO: 247183 - DNA, 75 bp, Artificial Sequence
  Synthetic
acgtcattcctaccatgactcaaatgaatttaaaatattctattagtgctacgaatagggctcgcaccgttgccg

SEQ ID NO: 247184 - DNA, 75 bp, Artificial Sequence
  Synthetic
acgtcattcctaccatgactcaaatgaatttaaaatattctattagtgctaggaatagggctcgcaccgttgccg

SEQ ID NO: 247185 - DNA, 75 bp, Artificial Sequence
  Synthetic
acgtcattcctaccatgactcaaatgaatttaaaatatcctattagtgctaagaatagggctcgcaccgttgccg

SEQ ID NO: 247186 - DNA, 75 bp, Artificial Sequence
  Synthetic
acgtcattcctaccatgactcaaatgaatttaaaatatcctattagtgctatgaatagggctcgcaccgttgccg

SEQ ID NO: 247187 - DNA, 75 bp, Artificial Sequence
  Synthetic
acgtcattcctaccatgactcaaatgaatttaaaatatcctattagtgctacgaatagggctcgcaccgttgccg

SEQ ID NO: 247188 - DNA, 75 bp, Artificial Sequence
  Synthetic
acgtcattcctaccatgactcaaatgaatttaaaatatcctattagtgctaggaatagggctcgcaccgttgccg

SEQ ID NO: 247189 - DNA, 75 bp, Artificial Sequence
  Synthetic
acgtcattcctaccatgactcaaatgaatttaaaatatgctattagtgctaagaatagggctcgcaccgttgccg

SEQ ID NO: 247190 - DNA, 75 bp, Artificial Sequence
  Synthetic
acgtcattcctaccatgactcaaatgaatttaaaatatgctattagtgctatgaatagggctcgcaccgttgccg

SEQ ID NO: 247191 - DNA, 75 bp, Artificial Sequence
  Synthetic
acgtcattcctaccatgactcaaatgaatttaaaatatgctattagtgctacgaatagggctcgcaccgttgccg

SEQ ID NO: 247192 - DNA, 75 bp, Artificial Sequence
  Synthetic
acgtcattcctaccatgactcaaatgaatttaaaatatgctattagtgctaggaatagggctcgcaccgttgccg

SEQ ID NO: 247193 - DNA, 75 bp, Artificial Sequence
  Synthetic
acgtcattcctaccatgactcaaatgaatctaaaatatactattagtgctaagaatagggctcgcaccgttgccg

SEQ ID NO: 247194 - DNA, 75 bp, Artificial Sequence
  Synthetic
acgtcattcctaccatgactcaaatgaatctaaaatatactattagtgctatgaatagggctcgcaccgttgccg

SEQ ID NO: 247195 - DNA, 75 bp, Artificial Sequence
  Synthetic
acgtcattcctaccatgactcaaatgaatctaaaatatactattagtgctacgaatagggctcgcaccgttgccg

SEQ ID NO: 247196 - DNA, 75 bp, Artificial Sequence
  Synthetic
acgtcattcctaccatgactcaaatgaatctaaaatatactattagtgctaggaatagggctcgcaccgttgccg

SEQ ID NO: 247197 - DNA, 75 bp, Artificial Sequence
  Synthetic
acgtcattcctaccatgactcaaatgaatctaaaatattctattagtgctaagaatagggctcgcaccgttgccg

SEQ ID NO: 247198 - DNA, 75 bp, Artificial Sequence
  Synthetic
acgtcattcctaccatgactcaaatgaatctaaaatattctattagtgctatgaatagggctcgcaccgttgccg

SEQ ID NO: 247199 - DNA, 75 bp, Artificial Sequence
  Synthetic
acgtcattcctaccatgactcaaatgaatctaaaatattctattagtgctacgaatagggctcgcaccgttgccg

SEQ ID NO: 247200 - DNA, 75 bp, Artificial Sequence
  Synthetic
acgtcattcctaccatgactcaaatgaatctaaaatattctattagtgctaggaatagggctcgcaccgttgccg

SEQ ID NO: 247201 - DNA, 75 bp, Artificial Sequence
  Synthetic
acgtcattcctaccatgactcaaatgaatctaaaatatcctattagtgctaagaatagggctcgcaccgttgccg

SEQ ID NO: 247202 - DNA, 75 bp, Artificial Sequence
  Synthetic
acgtcattcctaccatgactcaaatgaatctaaaatatcctattagtgctatgaatagggctcgcaccgttgccg

SEQ ID NO: 247203 - DNA, 75 bp, Artificial Sequence
  Synthetic
acgtcattcctaccatgactcaaatgaatctaaaatatcctattagtgctacgaatagggctcgcaccgttgccg

SEQ ID NO: 247204 - DNA, 75 bp, Artificial Sequence
  Synthetic
acgtcattcctaccatgactcaaatgaatctaaaatatcctattagtgctaggaatagggctcgcaccgttgccg

SEQ ID NO: 247205 - DNA, 75 bp, Artificial Sequence
  Synthetic
acgtcattcctaccatgactcaaatgaatctaaaatatgctattagtgctaagaatagggctcgcaccgttgccg

SEQ ID NO: 247206 - DNA, 75 bp, Artificial Sequence
  Synthetic
acgtcattcctaccatgactcaaatgaatctaaaatatgctattagtgctatgaatagggctcgcaccgttgccg

SEQ ID NO: 247207 - DNA, 75 bp, Artificial Sequence
  Synthetic
acgtcattcctaccatgactcaaatgaatctaaaatatgctattagtgctacgaatagggctcgcaccgttgccg

SEQ ID NO: 247208 - DNA, 75 bp, Artificial Sequence
  Synthetic
acgtcattcctaccatgactcaaatgaatctaaaatatgctattagtgctaggaatagggctcgcaccgttgccg

SEQ ID NO: 247209 - DNA, 75 bp, Artificial Sequence
  Synthetic
acgtcattcctaccatgactcaaatgaatgtaaaatatactattagtgctaagaatagggctcgcaccgttgccg

SEQ ID NO: 247210 - DNA, 75 bp, Artificial Sequence
  Synthetic
acgtcattcctaccatgactcaaatgaatgtaaaatatactattagtgctatgaatagggctcgcaccgttgccg

SEQ ID NO: 247211 - DNA, 75 bp, Artificial Sequence
  Synthetic
acgtcattcctaccatgactcaaatgaatgtaaaatatactattagtgctacgaatagggctcgcaccgttgccg

SEQ ID NO: 247212 - DNA, 75 bp, Artificial Sequence
  Synthetic
acgtcattcctaccatgactcaaatgaatgtaaaatatactattagtgctaggaatagggctcgcaccgttgccg

SEQ ID NO: 247213 - DNA, 75 bp, Artificial Sequence
  Synthetic
acgtcattcctaccatgactcaaatgaatgtaaaatattctattagtgctaagaatagggctcgcaccgttgccg

SEQ ID NO: 247214 - DNA, 75 bp, Artificial Sequence
  Synthetic
acgtcattcctaccatgactcaaatgaatgtaaaatattctattagtgctatgaatagggctcgcaccgttgccg

SEQ ID NO: 247215 - DNA, 75 bp, Artificial Sequence
  Synthetic
acgtcattcctaccatgactcaaatgaatgtaaaatattctattagtgctacgaatagggctcgcaccgttgccg

SEQ ID NO: 247216 - DNA, 75 bp, Artificial Sequence
  Synthetic
acgtcattcctaccatgactcaaatgaatgtaaaatattctattagtgctaggaatagggctcgcaccgttgccg

SEQ ID NO: 247217 - DNA, 75 bp, Artificial Sequence
  Synthetic
acgtcattcctaccatgactcaaatgaatgtaaaatatcctattagtgctaagaatagggctcgcaccgttgccg

SEQ ID NO: 247218 - DNA, 75 bp, Artificial Sequence
  Synthetic
acgtcattcctaccatgactcaaatgaatgtaaaatatcctattagtgctatgaatagggctcgcaccgttgccg

SEQ ID NO: 247219 - DNA, 75 bp, Artificial Sequence
  Synthetic
acgtcattcctaccatgactcaaatgaatgtaaaatatcctattagtgctacgaatagggctcgcaccgttgccg

SEQ ID NO: 247220 - DNA, 75 bp, Artificial Sequence
  Synthetic
acgtcattcctaccatgactcaaatgaatgtaaaatatcctattagtgctaggaatagggctcgcaccgttgccg

SEQ ID NO: 247221 - DNA, 75 bp, Artificial Sequence
  Synthetic
acgtcattcctaccatgactcaaatgaatgtaaaatatgctattagtgctaagaatagggctcgcaccgttgccg

SEQ ID NO: 247222 - DNA, 75 bp, Artificial Sequence
  Synthetic
acgtcattcctaccatgactcaaatgaatgtaaaatatgctattagtgctatgaatagggctcgcaccgttgccg

SEQ ID NO: 247223 - DNA, 75 bp, Artificial Sequence
  Synthetic
acgtcattcctaccatgactcaaatgaatgtaaaatatgctattagtgctacgaatagggctcgcaccgttgccg

SEQ ID NO: 247224 - DNA, 75 bp, Artificial Sequence
  Synthetic
acgtcattcctaccatgactcaaatgaatgtaaaatatgctattagtgctaggaatagggctcgcaccgttgccg

SEQ ID NO: 247225 - DNA, 75 bp, Artificial Sequence
  Synthetic
aaagttctatggtggctgggattttatgcttaaaacattgtacaaagatgttgataacccacatcttatgggttg

SEQ ID NO: 247226 - DNA, 75 bp, Artificial Sequence
  Synthetic
atgcccaatatgtgcagaatttttgcttctctcatattggctcgcaaacatggcacttgttgtaccacaagagac

SEQ ID NO: 247227 - DNA, 75 bp, Artificial Sequence
  Synthetic
cttctctcatattggctcgcaaacatggcacttgttgtaccacaagagacagattttatcgcttggcaaatgagt

SEQ ID NO: 247228 - DNA, 75 bp, Artificial Sequence
  Synthetic
tctatgcggtggtggttactacgttaaacctggaggtaccagtagcggagacgctactactgcatacgccaatag

SEQ ID NO: 247229 - DNA, 75 bp, Artificial Sequence
  Synthetic
taaagaagttaaagacatgcagtttgatttgtatgtcaatgtttacaggagtactaaccctgaccctaaatttgt

SEQ ID NO: 247230 - DNA, 75 bp, Artificial Sequence
  Synthetic
aagcatttttctatgatgatactgtctgatgatggtgttgtttgctataatagcgactatgcagctaaaggttac

SEQ ID NO: 247231 - DNA, 75 bp, Artificial Sequence
  Synthetic
ctgatgatggtgttgtttgctataatagcgactatgcagctaaaggttacattgctggtatacagaattttaagg

SEQ ID NO: 247232 - DNA, 75 bp, Artificial Sequence
  Synthetic
ctttatgtctgaagctaaatgctgggtggaaaccgatctgaagaaaggtccacatgaattttgttcgcagcatac

SEQ ID NO: 247233 - DNA, 75 bp, Artificial Sequence
  Synthetic
ggttacttcctgccttatccagacccttctaggatattgtctgctggttgctttgtagatgatatcgtcaagact

SEQ ID NO: 247234 - DNA, 75 bp, Artificial Sequence
  Synthetic
ccctcttacaaagcatgaagatatagaataccagaatgtattctgggtctatttgcagtatattgaaaaactgta

SEQ ID NO: 247235 - DNA, 75 bp, Artificial Sequence
  Synthetic
gacagttattctgtaatgttatgtggtgataattctgctaagttttgggaagaggcattctatagagagctctat

SEQ ID NO: 247236 - DNA, 75 bp, Artificial Sequence
  Synthetic
gtgataattctgctaagttttgggaagaggcattctatagagagctctatagttcacctaccactttgcaggcag

SEQ ID NO: 247237 - DNA, 75 bp, Artificial Sequence
  Synthetic
acaaacgtcattacgttgtgggacatgcatccgtagaccatttctttgttgtaaatgctgctacgaccatgttat

SEQ ID NO: 247238 - DNA, 75 bp, Artificial Sequence
  Synthetic
tgcatccgtagaccatttctttgttgtaaatgctgctacgaccatgttatagcaactcctcataaaatggttctg

SEQ ID NO: 247239 - DNA, 75 bp, Artificial Sequence
  Synthetic
tttcaggccagtgctttaaaatactctataagggcaatgtgacgcatgatgctagctctgccattaatagaccac

SEQ ID NO: 247240 - DNA, 75 bp, Artificial Sequence
  Synthetic
caccaggctgtgacgttgcagatgttactaagctatatttgggtggtatgagctacttttgtgtagatcatagac

SEQ ID NO: 247241 - DNA, 75 bp, Artificial Sequence
  Synthetic
tactaagctatatttgggtggtatgagctacttttgtgtagatcatagacctgtatgtagttttcctctttgtac

SEQ ID NO: 247242 - DNA, 75 bp, Artificial Sequence
  Synthetic
aagaatatgtgcacaggtagtccttctatagttgaatttaatagattggctacttgtgactggactgaaagtggt

SEQ ID NO: 247243 - DNA, 75 bp, Artificial Sequence
  Synthetic
ctatagttgaatttaatagattggctacttgtgactggactgaaagtggtgattacacccttgctaatactacta

SEQ ID NO: 247244 - DNA, 75 bp, Artificial Sequence
  Synthetic
tgagacattacgtgccactgaggaggcatctaagcagtcctatgctatagccaccatcaaggaaattgttggtga

SEQ ID NO: 247245 - DNA, 75 bp, Artificial Sequence
  Synthetic
agtgatgagctttgcgtgaatcttaatttacccgcaaatgtcccatactctcgtgttatttccaggatgggcttt

SEQ ID NO: 247246 - DNA, 75 bp, Artificial Sequence
  Synthetic
ttacttctcattcggtggctaccctgacggcacccacaattgtgaatcaagagaggtatgttaaaattactgggt

SEQ ID NO: 247247 - DNA, 75 bp, Artificial Sequence
  Synthetic
gagaggtatgttaaaattactgggttgtacccaacaattactgtgcctgaggagtttgcaaaccatgttgctaac

SEQ ID NO: 247248 - DNA, 75 bp, Artificial Sequence
  Synthetic
cagaacactcttggagcgttgaactttatgaacttatgggaaaatttgcttggtggactgttttctgcaccaaaa

SEQ ID NO: 247249 - DNA, 75 bp, Artificial Sequence
  Synthetic
gggttggcgatttactaccctacagcacgtgttgtttatacagcctgttcacatgcagctgtagatgcattgtgc

SEQ ID NO: 247250 - DNA, 75 bp, Artificial Sequence
  Synthetic
ttgcaaaatgttcccgtatcattcctgctaaggcgcgtgttgagtgctatgacaggtttaaggttaatgaaacaa

SEQ ID NO: 247251 - DNA, 75 bp, Artificial Sequence
  Synthetic
tgctaaggcgcgtgttgagtgctatgacaggtttaaggttaatgaaacaaattctcaatatttgtttagtactat

SEQ ID NO: 247252 - DNA, 75 bp, Artificial Sequence
  Synthetic
attgttagacgacgtatagtgcaaatgttgtcagacactttagacaaattgtctgattactgtacgtttgtttgt

SEQ ID NO: 247253 - DNA, 75 bp, Artificial Sequence
  Synthetic
gacattttggtagttgatgaggttagtatgtgcactaattatgatctttctattattaatgcacgtatcaaagct

SEQ ID NO: 247254 - DNA, 75 bp, Artificial Sequence
  Synthetic
gtatgtgcactaattatgatctttctattattaatgcacgtatcaaagctaagcacattgtttatgtaggagacc

SEQ ID NO: 247255 - DNA, 75 bp, Artificial Sequence
  Synthetic
tttgttaactagaggcactttagagcctgaaaactttaatagtgtcactagacttatgtgtaacttaggtcctga

SEQ ID NO: 247256 - DNA, 75 bp, Artificial Sequence
  Synthetic
cctgaaaactttaatagtgtcactagacttatgtgtaacttaggtcctgacatatttttaagtatgtgttacagg

SEQ ID NO: 247257 - DNA, 75 bp, Artificial Sequence
  Synthetic
ttagcgctcttgtctacaataacaaattgttagccaagaaggagctttcaggccagtgctttaaaatactctata

SEQ ID NO: 247258 - DNA, 75 bp, Artificial Sequence
  Synthetic
ggccagtgctttaaaatactctataaaggcaatgttacacatgatgctagctctgccattaatagacctcaactt

SEQ ID NO: 247259 - DNA, 75 bp, Artificial Sequence
  Synthetic
gtcatcttctgtcagacagcagatactgcacatgctaacaacattaatagatttaatgttgctatcactcgtgca

SEQ ID NO: 247260 - DNA, 75 bp, Artificial Sequence
  Synthetic
ctgcacatgctaacaacattaatagatttaatgttgctatcactcgtgcacaaaaaggtattctttgtgttatga

SEQ ID NO: 247261 - DNA, 75 bp, Artificial Sequence
  Synthetic
agagtttactgagttgtcttttactaattataaactccagtctcagattgtaactggactttttaaggattgttc

SEQ ID NO: 247262 - DNA, 75 bp, Artificial Sequence
  Synthetic
aattataaactccagtctcagattgtaactggactttttaaggattgttccagagagacatctggcctttctcct

SEQ ID NO: 247263 - DNA, 75 bp, Artificial Sequence
  Synthetic
ttgatgataagtataagacgagtgatgagctttgcgtgaatctaaatttacccgcaaatgttccatactctcgtg

SEQ ID NO: 247264 - DNA, 75 bp, Artificial Sequence
  Synthetic
tgagctttgcgtgaatctaaatttacccgcaaatgttccatactctcgtgttatatccagaatgggctttaaatt

SEQ ID NO: 247265 - DNA, 75 bp, Artificial Sequence
  Synthetic
aagctcttcataactcgtgaagaggctgtaaggcaagttcgtagctggataggcttcgatgttgaaggtgcacat

SEQ ID NO: 247266 - DNA, 75 bp, Artificial Sequence
  Synthetic
ctgtaaggcaagttcgtagctggataggcttcgatgttgaaggtgcacatgcttcacgtaatgcatgtggaacca

SEQ ID NO: 247267 - DNA, 75 bp, Artificial Sequence
  Synthetic
tactggtgtgaactttgttgttcaaccagtgggtgttgtagacactgagtgggggaatatgttaacgggaatatc

SEQ ID NO: 247268 - DNA, 75 bp, Artificial Sequence
  Synthetic
agcccgtccccctccaggtgagcagtttaagcaccttgttcctctaatgcataaaggggcagcatggcctatcgt

SEQ ID NO: 247269 - DNA, 75 bp, Artificial Sequence
  Synthetic
attactgtacgtttgtttgttgggctcatggctttgaattaacatctgcatcttatttttgcaagataggtaaag

SEQ ID NO: 247270 - DNA, 75 bp, Artificial Sequence
  Synthetic
acgcgctgcagcgtactcttcacctctgcaatcatatgcctgctggactcattcctgtggttatgattatgtcta

SEQ ID NO: 247271 - DNA, 75 bp, Artificial Sequence
  Synthetic
ctgcaatcatatgcctgctggactcattcctgtggttatgattatgtctacaaccccttctttgttgacgttcag

SEQ ID NO: 247272 - DNA, 75 bp, Artificial Sequence
  Synthetic
ctactaatcacgatcgttattgctctgtccaccagggagcacatgtagcttctaatgacgcaataatgactcgtt

SEQ ID NO: 247273 - DNA, 75 bp, Artificial Sequence
  Synthetic
tgtccaccagggagcacatgtagcttctaatgacgcaataatgactcgttgtttagctattcactcttgttttat

SEQ ID NO: 247274 - DNA, 75 bp, Artificial Sequence
  Synthetic
ggtgttggctggactgctggcttatcctcctttgctgctattccatttgcacagagtatcttttataggttaaac

SEQ ID NO: 247275 - DNA, 75 bp, Artificial Sequence
  Synthetic
tatccttatatatcacatgaaaagaagttgaattcctgttgtcgcattgtcgaacgcaatgtcgtacgtgctgct

SEQ ID NO: 247276 - DNA, 75 bp, Artificial Sequence
  Synthetic
agttgaattcctgttgtcgcattgtcgaacgcaatgtcgtacgtgctgctctcttagcaggttcttttgatagaa

SEQ ID NO: 247277 - DNA, 75 bp, Artificial Sequence
  Synthetic
aattcctattgttgatgaccctgtggttgattggcattattttgacgcacagcccttgaataagaaggtacaaca

SEQ ID NO: 247278 - DNA, 75 bp, Artificial Sequence
  Synthetic
gttgattggcattattttgacgcacagcccttgaataagaaggtacaacagcttttctacactgaggatttagcc

SEQ ID NO: 247279 - DNA, 75 bp, Artificial Sequence
  Synthetic
tgttttggaactgtaatgttccaaaatatcctaataatgcaattgtgtgtaggtttgacacacgtgtgcactctg

SEQ ID NO: 247280 - DNA, 75 bp, Artificial Sequence
  Synthetic
atatcctaataatgcaattgtgtgtaggtttgacacacgtgtgcactctgagttcaatttgccaggttgtgatgg

SEQ ID NO: 247281 - DNA, 75 bp, Artificial Sequence
  Synthetic
gcttttcacacaccagcatatgacgtgagtgcatttcgtgatctgaaacctttacctttcttttattattctact

SEQ ID NO: 247282 - DNA, 75 bp, Artificial Sequence
  Synthetic
tgagtgcatttcgtgatctgaaacctttacctttcttttattattctactactccatgcgaagttcatggtaatg

SEQ ID NO: 247283 - DNA, 75 bp, Artificial Sequence
  Synthetic
tgtaccccttaaatctgcagtctgtattacagcgtgcaatttaggtggggctgtttgtaggaagcatgctacaga

SEQ ID NO: 247284 - DNA, 75 bp, Artificial Sequence
  Synthetic
attacagcgtgcaatttaggtggggctgtttgtaggaagcatgctacagagtacagagattatatggaagcatat

SEQ ID NO: 247285 - DNA, 75 bp, Artificial Sequence
  Synthetic
gattttggtgctataagacctttgacatttacaacctttggtcaacatttacaaaagttcaaggtttagagaaca

SEQ ID NO: 247286 - DNA, 75 bp, Artificial Sequence
  Synthetic
catttacaacctttggtcaacatttacaaaagttcaaggtttagagaacattgcttttaacgttgttaaacaagg

SEQ ID NO: 247287 - DNA, 75 bp, Artificial Sequence
  Synthetic
ctacctgtagctgtagtcaatgataaaatcttcactaagagtggtactaatgacatttgtttgtttgaaaataaa

SEQ ID NO: 247288 - DNA, 75 bp, Artificial Sequence
  Synthetic
aaatcttcactaagagtggtactaatgacatttgtttgtttgaaaataaaaccactttgcctactaatatagcat

SEQ ID NO: 247289 - DNA, 75 bp, Artificial Sequence
  Synthetic
tcgttcgcatccagatttcaagctgctacacaatttacaagcagacatttgctacaagttcgtcctgtgggacta

SEQ ID NO: 247290 - DNA, 75 bp, Artificial Sequence
  Synthetic
ctacacaatttacaagcagacatttgctacaagttcgtcctgtgggactatgaacgtagcaatatctatggtact

SEQ ID NO: 247291 - DNA, 75 bp, Artificial Sequence
  Synthetic
ctgatattgatgtcaactcagctttgaatatatgttttgacattcgtgataatggtgcattagagcagttcatgt

SEQ ID NO: 247292 - DNA, 75 bp, Artificial Sequence
  Synthetic
gaatatatgttttgacattcgtgataatggtgcattagagcagttcatgtcaactcctaatgccattcttatttc

SEQ ID NO: 247293 - DNA, 75 bp, Artificial Sequence
  Synthetic
tgtatggtaggtcctgattatgcttatttcaatggtgctatcatccgtaatagtgatgttgttaagcaaccagtg

SEQ ID NO: 247294 - DNA, 75 bp, Artificial Sequence
  Synthetic
atttcaatggtgctatcatccgtaatagtgatgttgttaagcaaccagtgaaattttacatgtacaagaaagtca

SEQ ID NO: 247295 - DNA, 75 bp, Artificial Sequence
  Synthetic
gtgtgtctacactcagggtcgctcttgtagtgactttgaacccatgtctgacatggagaatgactttctaaattt

SEQ ID NO: 247296 - DNA, 75 bp, Artificial Sequence
  Synthetic
tgtagtgactttgaacccatgtctgacatggagaatgactttctaaattttgatagtgatgttttcattaagaag

SEQ ID NO: 247297 - DNA, 75 bp, Artificial Sequence
  Synthetic
tgatacactcagtgtttctactgatgttcttgttaacacctacagaaagttacgttgatgtagggccagattctg

SEQ ID NO: 247298 - DNA, 75 bp, Artificial Sequence
  Synthetic
agcacgtagtgtatggagacttttctcatactacgttaggcggccttcatctacttataggtttgtataagaagc

SEQ ID NO: 247299 - DNA, 75 bp, Artificial Sequence
  Synthetic
tcatactacgttaggcggccttcatctacttataggtttgtataagaagcaaaaggaaggtcatattattatgga

SEQ ID NO: 247300 - DNA, 75 bp, Artificial Sequence
  Synthetic
atccataactattttatcactgaaactaacacagcatcatttaaggcggtgtgttcagttattgatttaaagctt

SEQ ID NO: 247301 - DNA, 75 bp, Artificial Sequence
  Synthetic
ctaacacagcatcatttaaggcggtgtgttcagttattgatttaaagcttgacgactttgtaatgatattaaaaa

SEQ ID NO: 247302 - DNA, 75 bp, Artificial Sequence
  Synthetic
ggtagtcaaagttcctattgacttaacaatgattgagtttatgttatggtgtaaggatggacgggttcaaacctt

SEQ ID NO: 247303 - DNA, 75 bp, Artificial Sequence
  Synthetic
gtaaggatggacgggttcaaaccttctatccaagacttcaggcttctgcagattggaaatctggtcaagctatgc

SEQ ID NO: 247304 - DNA, 75 bp, Artificial Sequence
  Synthetic
gtactaagcttcctaaaaacttccacattgaggggactggaggcaatagtcaatcatcttcaagagcctctagcg

SEQ ID NO: 247305 - DNA, 75 bp, Artificial Sequence
  Synthetic
tggtgctggttctgataaaggtgtcgctcctggtacctctgttttaagacaatggcttcctacagatgccattat

SEQ ID NO: 247306 - DNA, 75 bp, Artificial Sequence
  Synthetic
gctcctggtacctctgttttaagacaatggcttcctacagatgccattataatagataatgacttaaatgagttt

SEQ ID NO: 247307 - DNA, 75 bp, Artificial Sequence
  Synthetic
ttggagactgtgtaactgtacgtgttggacaacaagtggatcttgttatatccgacatgtatgatcctactacta

SEQ ID NO: 247308 - DNA, 75 bp, Artificial Sequence
  Synthetic
tggacaacaagtggatcttgttatatccgacatgtatgatcctactactaagaatttaacaggtagtaatgagtc

SEQ ID NO: 247309 - DNA, 75 bp, Artificial Sequence
  Synthetic
tgtaacttcattaataataatcttgctcttggtggttctgttgctataaaaataacagaacactcttggagcgtt

SEQ ID NO: 247310 - DNA, 75 bp, Artificial Sequence
  Synthetic
ctcttggtggttctgttgctataaaaataacagaacactcttggagcgttgaactttatgaactcatgggaaaat

SEQ ID NO: 247311 - DNA, 75 bp, Artificial Sequence
  Synthetic
taatgcaaatgcatcctcatccgaaggatttctcataggtattaattacttgggtactattaaagaaaatataga

SEQ ID NO: 247312 - DNA, 75 bp, Artificial Sequence
  Synthetic
ggatttctcataggtattaattacttgggtactattaaagaaaatatagatggcggtgctatgcatgccaattat

SEQ ID NO: 247313 - DNA, 75 bp, Artificial Sequence
  Synthetic
cagagctatagactgtggttttaatgatttgtcacaactccactgctcatatgaatccttcgatgttgaatctgg

SEQ ID NO: 247314 - DNA, 75 bp, Artificial Sequence
  Synthetic
ttaaaaggaacacctgttcttcaattaaaggagagtcagattaacgaacttgtaatatctctcctgtcacagggt

SEQ ID NO: 247315 - DNA, 75 bp, Artificial Sequence
  Synthetic
tactcagtgtttccactgatgtgcttgttaacttttataggggcaaacgctaaaatcgttaccttgcctggtaac

SEQ ID NO: 247316 - DNA, 75 bp, Artificial Sequence
  Synthetic
tgttaacttttataggggcaaacgctaaaatcgttaccttgcctggtaacgatgcaactggctattgtccatctg

SEQ ID NO: 247317 - DNA, 75 bp, Artificial Sequence
  Synthetic
acaacataactggcctgaaccaattgatatgaataaagcagacggtgtcatttatccaaacggccgtacttattc

SEQ ID NO: 247318 - DNA, 75 bp, Artificial Sequence
  Synthetic
gatatgaataaagcagacggtgtcatttatccaaacggccgtacttattctaatattacattacagacaacaaat

SEQ ID NO: 247319 - DNA, 75 bp, Artificial Sequence
  Synthetic
gcactcaatatgtctattcagcgtccaatcataaaagcactgctaatgatgcttttattagtaattattcatact

SEQ ID NO: 247320 - DNA, 75 bp, Artificial Sequence
  Synthetic
caatcataaaagcactgctaatgatgcttttattagtaattattcatactatggcaatccatttggtgatggaat

SEQ ID NO: 247321 - DNA, 75 bp, Artificial Sequence
  Synthetic
aataagactggcagtgtaattgtaggacaagcacagactactatgaaaaagatctaccctgcacttatgttgggt

SEQ ID NO: 247322 - DNA, 75 bp, Artificial Sequence
  Synthetic
gacaagcacagactactatgaaaaagatctaccctgcacttatgttgggtagttcttttggtaatttttctgcta

SEQ ID NO: 247323 - DNA, 75 bp, Artificial Sequence
  Synthetic
tcacactcttcttatcttacctagcaagtgtggaactgtcttccaagttgcctattgtttacttcagcctcgcac

SEQ ID NO: 247324 - DNA, 75 bp, Artificial Sequence
  Synthetic
aagtgtggaactgtcttccaagttgcctattgtttacttcagcctcgcactgagtctaagtgtccaggcaatagt

SEQ ID NO: 247325 - DNA, 75 bp, Artificial Sequence
  Synthetic
attcacccagtgattgttcttccacttctgatgaaatacgcagaaatgggttacgagacattagaaaattcttca

SEQ ID NO: 247326 - DNA, 75 bp, Artificial Sequence
  Synthetic
ttctgatgaaatacgcagaaatgggttacgagacattagaaaattcttcaacttggtcaattgcacttattttga

SEQ ID NO: 247327 - DNA, 75 bp, Artificial Sequence
  Synthetic
gacacactagacacctcccaggtcctcgtgtatacctggttgagaggctcattgcttgtgaaaatccattcatgg

SEQ ID NO: 247328 - DNA, 75 bp, Artificial Sequence
  Synthetic
agggcagagtggtttggcatcgtgcaggatgctcaaggtgtccacctgtacacttcgcgtaaaaatggtttcaat

SEQ ID NO: 247329 - DNA, 75 bp, Artificial Sequence
  Synthetic
aggatgctcaaggtgtccacctgtacacttcgcgtaaaaatggtttcaattcaaacaatttatttttgtttgcca

SEQ ID NO: 247330 - DNA, 75 bp, Artificial Sequence
  Synthetic
ttactacacggtaatacctcgttccgttattacaccgtctaaccaacgtgatgcttgggcggcgttttacatata

SEQ ID NO: 247331 - DNA, 75 bp, Artificial Sequence
  Synthetic
gttattacaccgtctaaccaacgtgatgcttgggcggcgttttacatatatccactacatcaacttagctacttg

SEQ ID NO: 247332 - DNA, 75 bp, Artificial Sequence
  Synthetic
ttacccaggctgcagattgtgggtataatgattacacccagcttatctgttcgtatggtgattttaatatgaagt

SEQ ID NO: 247333 - DNA, 75 bp, Artificial Sequence
  Synthetic
taatgattacacccagcttatctgttcgtatggtgattttaatatgaagtctggtgtatactcaacctcatacta

SEQ ID NO: 247334 - DNA, 75 bp, Artificial Sequence
  Synthetic
tatgaggctcatgtgtaccccgattgcaattttactgaattgtttagggaaagagcccctacaatcatgcagtat

SEQ ID NO: 247335 - DNA, 75 bp, Artificial Sequence
  Synthetic
gcaattttactgaattgtttagggaaagagcccctacaatcatgcagtataagcgtgaagtttttacgcgttgta

SEQ ID NO: 247336 - DNA, 75 bp, Artificial Sequence
  Synthetic
tctagtgcaagtggatgagtttgtatgtgataagattacacccgaagctctggcaactgggtgctattcttctct

SEQ ID NO: 247337 - DNA, 75 bp, Artificial Sequence
  Synthetic
tgtgataagattacacccgaagctctggcaactgggtgctattcttctctaacagtcgattggtttgcttttcct

SEQ ID NO: 247338 - DNA, 75 bp, Artificial Sequence
  Synthetic
ttttactcttggatgcaaaattttaacgctcaccccacgcaacaagtggagtggcgtttctgacttgtccctcaa

SEQ ID NO: 247339 - DNA, 75 bp, Artificial Sequence
  Synthetic
taggttctgctgaccgtatcgtacgttttaattataaccaggactatagtaatccctcttgtcgaattcattcta

SEQ ID NO: 247340 - DNA, 75 bp, Artificial Sequence
  Synthetic
ttttaattataaccaggactatagtaatccctcttgtcgaattcattctaaagtgaattcttcgataggaatttc

SEQ ID NO: 247341 - DNA, 75 bp, Artificial Sequence
  Synthetic
actaactgcaattatggagccacaaataaagacgatgttgttaaaccgggagggcgcgccagtcaacaatgtatt

SEQ ID NO: 247342 - DNA, 75 bp, Artificial Sequence
  Synthetic
ataaagacgatgttgttaaaccgggagggcgcgccagtcaacaatgtattactggtgctcttaactctcctacaa

SEQ ID NO: 247343 - DNA, 75 bp, Artificial Sequence
  Synthetic
gcatcagctcgtgatcttatttgtgctcaatatgtggctggttacaaagtattacctcctcttatggatgttaat

SEQ ID NO: 247344 - DNA, 75 bp, Artificial Sequence
  Synthetic
tgggggcgttccttacagagtgtcacgccttacttatacggaccatcttagtgatccactagatatggtctatgt

SEQ ID NO: 247345 - DNA, 75 bp, Artificial Sequence
  Synthetic
cgccttacttatacggaccatcttagtgatccactagatatggtctatgttattacagttaaatatgaaccagga

SEQ ID NO: 247346 - DNA, 75 bp, Artificial Sequence
  Synthetic
tacgccctgattatagtaccaacattactcatttgttaggttcatgtattagctatgacatttatggcataacag

SEQ ID NO: 247347 - DNA, 75 bp, Artificial Sequence
  Synthetic
tactcatttgttaggttcatgtattagctatgacatttatggcataacaggcacgggtgtttttcagctatgcaa

SEQ ID NO: 247348 - DNA, 75 bp, Artificial Sequence
  Synthetic
tttgtctatgacaaatttgataatataattggttttcactctgatgacggcaattactactgtgtagcaccctgt

SEQ ID NO: 247349 - DNA, 75 bp, Artificial Sequence
  Synthetic
taattggttttcactctgatgacggcaattactactgtgtagcaccctgtgttagtgtgcctgtttcagtgatat

SEQ ID NO: 247350 - DNA, 75 bp, Artificial Sequence
  Synthetic
taccttgtttggtagtgttgcttgtcaacatatatctacaatggctgctcagttttctcgtgaaactagagcttc

SEQ ID NO: 247351 - DNA, 75 bp, Artificial Sequence
  Synthetic
caacatatatctacaatggctgctcagttttctcgtgaaactagagcttctcttgtttcaagaaacatgcaaaat

SEQ ID NO: 247352 - DNA, 75 bp, Artificial Sequence
  Synthetic
tcatgggttttcatgaaacaaatgacactgttgaagaatgccatctttctttgggacaatcactctgtgctatac

SEQ ID NO: 247353 - DNA, 75 bp, Artificial Sequence
  Synthetic
ggtcaaggcacacatatagtgtcctttgttgtaaatgcccctaatggcctttacttcatgcatgttggttattac

SEQ ID NO: 247354 - DNA, 75 bp, Artificial Sequence
  Synthetic
cactgttgaagaatgccatctttctttgggacaatcactctgtgctatacccccaaacaccaacttgcgttcagg

SEQ ID NO: 247355 - DNA, 75 bp, Artificial Sequence
  Synthetic
ctagcttataatagtcctttgcgtgttgatgcccttaactcctcggagtttaaggtgtccttgccgcttaatttt

SEQ ID NO: 247356 - DNA, 75 bp, Artificial Sequence
  Synthetic
ttgatgcccttaactcctcggagtttaaggtgtccttgccgcttaattttacatttggtgttacacaagaatata

SEQ ID NO: 247357 - DNA, 75 bp, Artificial Sequence
  Synthetic
agttgactgtaagcagtatgtatgtaatggttttgctaagtgtgagaaactgcttgaacaatatggccagttttg

SEQ ID NO: 247358 - DNA, 75 bp, Artificial Sequence
  Synthetic
aatggttttgctaagtgtgagaaactgcttgaacaatatggccagttttgctcaaaaattaatcaagctcttcat

SEQ ID NO: 247359 - DNA, 75 bp, Artificial Sequence
  Synthetic
cagttcgtaacttgtttgagagtgttaaaacacctcagacagttcctcttactacgggctttggtggtgaattca

SEQ ID NO: 247360 - DNA, 75 bp, Artificial Sequence
  Synthetic
taaaacacctcagacagttcctcttactacgggctttggtggtgaattcaacctcaccctccttgagccgctttc

SEQ ID NO: 247361 - DNA, 75 bp, Artificial Sequence
  Synthetic
aacaagtgttagacttgcttaataagggtatgcaacttttgcatacaaaggtctcctgggctggttctaatatca

SEQ ID NO: 247362 - DNA, 75 bp, Artificial Sequence
  Synthetic
cggagcgctttggaggaattattatttgatagtgtcacaatagctgacccaggttacatgcaaggttatgacgac

SEQ ID NO: 247363 - DNA, 75 bp, Artificial Sequence
  Synthetic
ttgatagtgtcacaatagctgacccaggttacatgcaaggttatgacgactgcatgcaacaagggcctgcgtctg

SEQ ID NO: 247364 - DNA, 75 bp, Artificial Sequence
  Synthetic
tgtagctggttataaagtgttacctcctcttatggatgttaacatggaggctgcatacacatcttctttgcttgg

SEQ ID NO: 247365 - DNA, 75 bp, Artificial Sequence
  Synthetic
cctcttatggatgttaacatggaggctgcatacacatcttctttgcttggtagtattgcaggtgcgggctggaca

SEQ ID NO: 247366 - DNA, 75 bp, Artificial Sequence
  Synthetic
cactcagcgcactcgcacccgtccaagtgttcagcctggtccaatgattgatgttaacactgattagtgtcactc

SEQ ID NO: 247367 - DNA, 75 bp, Artificial Sequence
  Synthetic
ttccttttgcacagagtatattttacaggttgaatggtgttggcataacacaacaggttttatctgaaaaccaaa

SEQ ID NO: 247368 - DNA, 75 bp, Artificial Sequence
  Synthetic
caggttgaatggtgttggcataacacaacaggttttatctgaaaaccaaaagattattgccaacaagtttaatca

SEQ ID NO: 247369 - DNA, 75 bp, Artificial Sequence
  Synthetic
ttcacaacaactaatgaggctttccagaaagtccaagatgctgtgaatacaaatgctcaggctttagctaaatta

SEQ ID NO: 247370 - DNA, 75 bp, Artificial Sequence
  Synthetic
agaaagtccaagatgctgtgaatacaaatgctcaggctttagctaaattagctagtgaactatctaatacttttg

SEQ ID NO: 247371 - DNA, 75 bp, Artificial Sequence
  Synthetic
catcattcaacgtcttgatgttctcgaacaggaggttcaaatagacagacttattaatggccggttaacaaccct

SEQ ID NO: 247372 - DNA, 75 bp, Artificial Sequence
  Synthetic
gaacaggaggttcaaatagacagacttattaatggccggttaacaacccttaatgccttcgttgctcagcagctt

SEQ ID NO: 247373 - DNA, 75 bp, Artificial Sequence
  Synthetic
cggcacagttggctaaggataaagtcaacgagtgcgttaaatcccagtccactaggtctggcttttgtggtcaag

SEQ ID NO: 247374 - DNA, 75 bp, Artificial Sequence
  Synthetic
caacgagtgcgttaaatcccagtccactaggtctggcttttgtggtcaaggcactcatatagtgtcttttgttat

SEQ ID NO: 247375 - DNA, 75 bp, Artificial Sequence
  Synthetic
atgcatgttggttatcatcctagccaacatattgaggttgtagctgcttatggtctttgtgactcagccaaccct

SEQ ID NO: 247376 - DNA, 75 bp, Artificial Sequence
  Synthetic
aacatattgaggttgtagctgcttatggtctttgtgactcagccaaccctactaattgtatagccccagttaacg

SEQ ID NO: 247377 - DNA, 75 bp, Artificial Sequence
  Synthetic
taggagtgctgatgaatggtcttacacaggttcttctttttatgcacctgagcccatcaccactcttaatacaag

SEQ ID NO: 247378 - DNA, 75 bp, Artificial Sequence
  Synthetic
acaggttcttctttttatgcacctgagcccatcaccactcttaatacaaggtatgttgcacctcaagtaacattc

SEQ ID NO: 247379 - DNA, 75 bp, Artificial Sequence
  Synthetic
gctgacaccttacaggaaactcctgttgtgtctgatactgttgaagtcccaccgcaagtggtgaaacttccgtct

SEQ ID NO: 247380 - DNA, 75 bp, Artificial Sequence
  Synthetic
ctcctttgcttagtaattctactggcacagatttcaaggatgagttggacgagtttttcaaaaatgttagcacca

SEQ ID NO: 247381 - DNA, 75 bp, Artificial Sequence
  Synthetic
atataccaaattttggtgctttaacacagattaatactaccctacttgatcttagtggtgagatgttagctcttc

SEQ ID NO: 247382 - DNA, 75 bp, Artificial Sequence
  Synthetic
ggcaactatacttattacaacaaatggccgtggtacatttggcttggttttattgctggactcttagctctagct

SEQ ID NO: 247383 - DNA, 75 bp, Artificial Sequence
  Synthetic
ctttttgctgctgagactttacgtgccactgaagaggcgtctaagcagtcttatgctatagccaccatcaaagaa

SEQ ID NO: 247384 - DNA, 75 bp, Artificial Sequence
  Synthetic
ccactgaagaggcgtctaagcagtcttatgctatagccaccatcaaagaaattgttggtgagcgccaactattac

SEQ ID NO: 247385 - DNA, 75 bp, Artificial Sequence
  Synthetic
gcacaggttgtggcacaagttgcttgggaaaacttaaatgtaaccgttgttgtgataaatatgaagaatacgacc

SEQ ID NO: 247386 - DNA, 75 bp, Artificial Sequence
  Synthetic
gggaaaacttaaatgtaaccgttgttgtgataaatatgaagaatacgacctcgagccgcataagattcatgttca

SEQ ID NO: 247387 - DNA, 75 bp, Artificial Sequence
  Synthetic
tccaaagaccacctactcttttgttagtggtaacactctcgcttttggccaatgctttttcaaaacccttttatg

SEQ ID NO: 247388 - DNA, 75 bp, Artificial Sequence
  Synthetic
agtggtaacactctcgcttttggccaatgctttttcaaaacccttttatgtacctgaacattgccagaattattc

SEQ ID NO: 247389 - DNA, 75 bp, Artificial Sequence
  Synthetic
aggactgcccaaactgatactgttggtttgtacacaaatcttagaattgatttcccatctacagaatctactgac

SEQ ID NO: 247390 - DNA, 75 bp, Artificial Sequence
  Synthetic
gtttgtacacaaatcttagaattgatttcccatctacagaatctactgacacagagtcagttactgttgatcgtg

SEQ ID NO: 247391 - DNA, 75 bp, Artificial Sequence
  Synthetic
tagtgagtttgtcactagtgtgaatctttttgacgttggttacacagttaattaacgaactctatggattacgtg

SEQ ID NO: 247392 - DNA, 75 bp, Artificial Sequence
  Synthetic
ctttttgacgttggttacacagttaattaacgaactctatggattacgtgtctctgctcaatcagatttggcaga

SEQ ID NO: 247393 - DNA, 75 bp, Artificial Sequence
  Synthetic
ttgtttgtatatccctaaacctacagctaagtatacacctgcacctggcacttcattgcaccctgtgcagtggaa

SEQ ID NO: 247394 - DNA, 75 bp, Artificial Sequence
  Synthetic
gctaagtatacacctgcacctggcacttcattgcaccctgtgcagtggaactgtcagctgtcttttgctggttat

SEQ ID NO: 247395 - DNA, 75 bp, Artificial Sequence
  Synthetic
aagctttggccaaacaggatgcagcacagcgaatcgcctggctgctccatagagatggaggaatacccgatggat

SEQ ID NO: 247396 - DNA, 75 bp, Artificial Sequence
  Synthetic
acagcgaatcgcctggctgctccatagagatggaggaatacccgatggatgttccctctacttacggcactcaag

SEQ ID NO: 247397 - DNA, 75 bp, Artificial Sequence
  Synthetic
gcgccattcaccaggtaaaaaccttcgatacgttaaacgtaggttttcttctttacgccctgaagatattagtgt

SEQ ID NO: 247398 - DNA, 75 bp, Artificial Sequence
  Synthetic
cgatacgttaaacgtaggttttcttctttacgccctgaagatattagtgtggttacacaacccacacattatatc

SEQ ID NO: 247399 - DNA, 75 bp, Artificial Sequence
  Synthetic
tgtggtatctacgttctggtcatcacttacactcagttcataattggcttaaaccttatggtggtcaaccagttt

SEQ ID NO: 247400 - DNA, 75 bp, Artificial Sequence
  Synthetic
cttacactcagttcataattggcttaaaccttatggtggtcaaccagtttctgagtaccatataaccttagcttt

SEQ ID NO: 247401 - DNA, 75 bp, Artificial Sequence
  Synthetic
tgggtcccgtgtagaggctaatccattagtctctctttggacatatggaaaacgaactatgttaccctttgtcca

SEQ ID NO: 247402 - DNA, 75 bp, Artificial Sequence
  Synthetic
gctagggatatttctcccattgctgtatttttgcgtaatgtcagatttgagttacatgaatttgcactactacgc

SEQ ID NO: 247403 - DNA, 75 bp, Artificial Sequence
  Synthetic
tatttttgcgtaatgtcagatttgagttacatgaatttgcactactacgcaaaactcttgttctcaatgtttcag

SEQ ID NO: 247404 - DNA, 75 bp, Artificial Sequence
  Synthetic
atttaaacctgtgtatagagttaacatggcagttcctactattagggaatggcttcgtgtacagggtttttctct

SEQ ID NO: 247405 - DNA, 75 bp, Artificial Sequence
  Synthetic
atggcagttcctactattagggaatggcttcgtgtacagggtttttctctttacaacagccaccttcctttacat

SEQ ID NO: 247406 - DNA, 75 bp, Artificial Sequence
  Synthetic
tggatgatgttacacgtaattacattatcacaatgccttgctttagaacataccctcaacaaatgtttgtcacac

SEQ ID NO: 247407 - DNA, 75 bp, Artificial Sequence
  Synthetic
tatcacaatgccttgctttagaacataccctcaacaaatgtttgtcacacctatggctgtggaactcgtttctat

SEQ ID NO: 247408 - DNA, 75 bp, Artificial Sequence
  Synthetic
caaattattcagtcacaccccattttacatgatccaggattttaacgaactatggccttttctgcggccttgttt

SEQ ID NO: 247409 - DNA, 75 bp, Artificial Sequence
  Synthetic
tacatgatccaggattttaacgaactatggccttttctgcggccttgtttaaacctgtacaactggttcctgttt

SEQ ID NO: 247410 - DNA, 75 bp, Artificial Sequence
  Synthetic
taatgattctgttgtttttacatacattccagctggcggttatgtagctgctttagctgtcaatgtttgtctcat

SEQ ID NO: 247411 - DNA, 75 bp, Artificial Sequence
  Synthetic
attccagctggcggttatgtagctgctttagctgtcaatgtttgtctcatacctttattattactgctacgtcag

SEQ ID NO: 247412 - DNA, 75 bp, Artificial Sequence
  Synthetic
ggacaatggtcttgtacctgttagttctttataatctcttattagccattatactagttaatggcatacattatc

SEQ ID NO: 247413 - DNA, 75 bp, Artificial Sequence
  Synthetic
tctttataatctcttattagccattatactagttaatggcatacattatccaactggaggctttcttatagcctt

SEQ ID NO: 247414 - DNA, 75 bp, Artificial Sequence
  Synthetic
tttgcagacagaattcgcttctgcctcatgctgagttcttatattccactgtttgacatgcgttctcattttatt

SEQ ID NO: 247415 - DNA, 75 bp, Artificial Sequence
  Synthetic
tcatgctgagttcttatattccactgtttgacatgcgttctcattttattcgcgtcagtacagtctcttctcacg

SEQ ID NO: 247416 - DNA, 75 bp, Artificial Sequence
  Synthetic
accagtgtttattagaaactttgaccagcgttgccgctgtgctcgttgtttttatttgcattcttcaacttatat

SEQ ID NO: 247417 - DNA, 75 bp, Artificial Sequence
  Synthetic
cagcgttgccgctgtgctcgttgtttttatttgcattcttcaacttatatagagtgcacttatattaaccgtttt

SEQ ID NO: 247418 - DNA, 75 bp, Artificial Sequence
  Synthetic
ctgacttttcattaaacggcaatgtttcgactgttttcgtgcctgcaacgcgcgattcagttcctcttcacataa

SEQ ID NO: 247419 - DNA, 75 bp, Artificial Sequence
  Synthetic
ctctttggacatatggaaaacgaactatgttaccctttgtccaacaacaaattgggtcattcatagtaaactttt

SEQ ID NO: 247420 - DNA, 75 bp, Artificial Sequence
  Synthetic
taccctcttggtgtgtatggctttccttacggctactagattatgtgtgcaatgcataacaggtgttaacaccct

SEQ ID NO: 247421 - DNA, 75 bp, Artificial Sequence
  Synthetic
cttacggctactagattatgtgtgcaatgcataacaggtgttaacaccctgttagttcagcccgcagtttatatg

SEQ ID NO: 247422 - DNA, 75 bp, Artificial Sequence
  Synthetic
taaaattccaggagagtaaaccccctctacctcccgaagagtgggtttaacgaactcctttattatgtcaaacat

SEQ ID NO: 247423 - DNA, 75 bp, Artificial Sequence
  Synthetic
tctacctcccgaagagtgggtttaacgaactcctttattatgtcaaacatgacgcagctcagtgagcagcagatt

SEQ ID NO: 247424 - DNA, 75 bp, Artificial Sequence
  Synthetic
ttgcatggtccattgtctttcttttaattactatcgtactacagtatggctatccatctcgtagtatgactgtct

SEQ ID NO: 247425 - DNA, 75 bp, Artificial Sequence
  Synthetic
aattactatcgtactacagtatggctatccatctcgtagtatgactgtctatgtctttaaaatgtttgttttgtg

SEQ ID NO: 247426 - DNA, 75 bp, Artificial Sequence
  Synthetic
ctatccatttttagtgctgtctatccaatagacctagcttcccagattatttctggtattatagcagccatctca

SEQ ID NO: 247427 - DNA, 75 bp, Artificial Sequence
  Synthetic
caatagacctagcttcccagattatttctggtattatagcagccatctcaggaatgatgtggatttcctactttg

SEQ ID NO: 247428 - DNA, 75 bp, Artificial Sequence
  Synthetic
aactggctcttggtggtcatttaacccagagacaaactgcctcttgaatgtgccacttggtggaacaacagttgt

SEQ ID NO: 247429 - DNA, 75 bp, Artificial Sequence
  Synthetic
ccagagacaaactgcctcttgaatgtgccacttggtggaacaacagttgtgcgcccacttgtagaggattctact

SEQ ID NO: 247430 - DNA, 75 bp, Artificial Sequence
  Synthetic
gttacctcaaagtggctggtatgcatttcggtgcatgtgactacgatagacttcctaatgaaatcaccgtagcca

SEQ ID NO: 247431 - DNA, 75 bp, Artificial Sequence
  Synthetic
tttcggtgcatgtgactacgatagacttcctaatgaaatcaccgtagccaaacccaatgtgctgattgctttaaa

SEQ ID NO: 247432 - DNA, 75 bp, Artificial Sequence
  Synthetic
actaattcaggcgttgcaatttatcatagatataaggcaggtaattacagaagtccgcctatcacggcggatagt

SEQ ID NO: 247433 - DNA, 75 bp, Artificial Sequence
  Synthetic
atagatataaggcaggtaattacagaagtccgcctatcacggcggatagtgaacttgcattgcttcgagcttagg

SEQ ID NO: 247434 - DNA, 75 bp, Artificial Sequence
  Synthetic
ttgatcttaacgaatcttaattttcattgttatggcaactccagcagcacctcgtgccgtctcttttgcagataa

SEQ ID NO: 247435 - DNA, 75 bp, Artificial Sequence
  Synthetic
attgttatggcaactccagcagcacctcgtgccgtctcttttgcagataacaatgacacaacaacaaaccagcct

SEQ ID NO: 247436 - DNA, 75 bp, Artificial Sequence
  Synthetic
ccagagctgcaccaaataccactgtctcatggtacactgggcttacccaacacggtaaagtccctctttccttcc

SEQ ID NO: 247437 - DNA, 75 bp, Artificial Sequence
  Synthetic
ctcatggtacactgggcttacccaacacggtaaagtccctctttccttcccacctggacagggtgtacctcttaa

SEQ ID NO: 247438 - DNA, 75 bp, Artificial Sequence
  Synthetic
gctgggtattggcggagacaggacagaaaggttaacacaggaaatggagttaagcaactggctcccagatggtat

SEQ ID NO: 247439 - DNA, 75 bp, Artificial Sequence
  Synthetic
taagcaactggctcccagatggtatttctactatactggaaccggacctgaagctgcactccccttccgtgctgt

SEQ ID NO: 247440 - DNA, 75 bp, Artificial Sequence
  Synthetic
gtggctggtgtgaccgcgcaaggtgcgcgcggtacgtatcgagcagcgctcaactctgaaaaacatcaagaccat

SEQ ID NO: 247441 - DNA, 75 bp, Artificial Sequence
  Synthetic
atcaggtaactcctcccgcggtgcttccccaggtccatctggagtcggagctcccggaggagacttgctctacct

SEQ ID NO: 247442 - DNA, 75 bp, Artificial Sequence
  Synthetic
tccccaggtccatctggagtcggagctcccggaggagacttgctctacctagatttgctgaacagacttcaagct

SEQ ID NO: 247443 - DNA, 75 bp, Artificial Sequence
  Synthetic
cacagcctaaagtcattactaaaaaggatgctgctgctgctaaaaataagatgcgccataagcgtgtcgccacca

SEQ ID NO: 247444 - DNA, 75 bp, Artificial Sequence
  Synthetic
ggatgctgctgctgctaaaaataagatgcgccataagcgtgtcgccaccaaaagtttcaacatggttcaagcctt

SEQ ID NO: 247445 - DNA, 75 bp, Artificial Sequence
  Synthetic
cagggaaactttggtgacttacaacttaacaaactcggcacagaggaccctcgttggcctcagatagctgagctt

SEQ ID NO: 247446 - DNA, 75 bp, Artificial Sequence
  Synthetic
ttaacaaactcggcacagaggaccctcgttggcctcagatagctgagcttgctccctctgccagtgcttttatgg

SEQ ID NO: 247447 - DNA, 75 bp, Artificial Sequence
  Synthetic
tcagaacaatgatgatgctggcaacccagtgtactttcttcggtacagtggtgctattaaacttgacccaaagaa

SEQ ID NO: 247448 - DNA, 75 bp, Artificial Sequence
  Synthetic
ccagtgtactttcttcggtacagtggtgctattaaacttgacccaaagaatcccaactacaacaaatggttggaa

SEQ ID NO: 247449 - DNA, 75 bp, Artificial Sequence
  Synthetic
acaagaattttcctaagaaggaaaagaaacaaaaggcacctaaagaagaatcaaatgaccaggaaatggcaacac

SEQ ID NO: 247450 - DNA, 75 bp, Artificial Sequence
  Synthetic
gaaacaaaaggcacctaaagaagaatcaaatgaccaggaaatggcaacacctccgccaaaagagcagcgtgtgca

SEQ ID NO: 247451 - DNA, 75 bp, Artificial Sequence
  Synthetic
tctcggcctagtgtggcacctggtccaatgactgatgttaacactgagtagtgttattcaaagtaacaagagcga

SEQ ID NO: 247452 - DNA, 75 bp, Artificial Sequence
  Synthetic
gaagaaggtgaatcagagtgcatttctgagacttcaactgaacaagttgacgtttctcatgaggtttctgacgac

SEQ ID NO: 247453 - DNA, 75 bp, Artificial Sequence
  Synthetic
agtgcacttatattagccgttttagtaagattagcctagtttctgtaactgacttctccttaaacggcaatgttt

SEQ ID NO: 247454 - DNA, 75 bp, Artificial Sequence
  Synthetic
ctctgggagctatgcaaacaggcttcactacaactaatgaagcttttcagaaggttcaggatgctgtgaacaaca

SEQ ID NO: 247455 - DNA, 75 bp, Artificial Sequence
  Synthetic
taccacctgacgagtgggtttaacgaactccttcataatgtctaatatgacgcaactcactgaggcgcagattat

SEQ ID NO: 247456 - DNA, 75 bp, Artificial Sequence
  Synthetic
gcatactatggagaattatgaactagagaagcactgttacgatttgttacgtgactgtgatgctgtagctcccca

SEQ ID NO: 247457 - DNA, 75 bp, Artificial Sequence
  Synthetic
actgtcacctctgcgtgattgcaagtgaacagtgccccccgggaagagctctacagtgtgaaatgtaaataaaaa

SEQ ID NO: 247458 - DNA, 75 bp, Artificial Sequence
  Synthetic
cgtccgcactaatggtggttacaattcttggcatttagtcgagggtgaactattggtgcaagacttacgcttaaa

SEQ ID NO: 247459 - DNA, 75 bp, Artificial Sequence
  Synthetic
tcgatgcaacagttcctggatatcctaagcttttcattactcgtgaagaggctgtaaggcaagttcgaagctgga

SEQ ID NO: 247460 - DNA, 75 bp, Artificial Sequence
  Synthetic
aataaaagccctgttgtttagcgtattgttgcacttgtctggtgggattgtggcattaatttgcctgctcatcta

SEQ ID NO: 247461 - DNA, 75 bp, Artificial Sequence
  Synthetic
ctaacgctaggaatggttgtatacctcttagtgtcattccactgtgtgcttcaaataaacttcgcgttgtaattc

SEQ ID NO: 247462 - DNA, 75 bp, Artificial Sequence
  Synthetic
tctattgccgtgcgcatatagaacatcctgatgtctctggtgtttgtaaatataagggtaagtttgtccaaatcc

SEQ ID NO: 247463 - DNA, 75 bp, Artificial Sequence
  Synthetic
gtactgatgaccgttgtgtgttacattgtgctaatttcaatgtattgtttgctatgactatgcctaagacttgtt

SEQ ID NO: 247464 - DNA, 75 bp, Artificial Sequence
  Synthetic
tgctaatggcaacaagattgttgacaaagaagttaaagacatgcagtttgatttgtatgtcaatgtttacaggag

SEQ ID NO: 247465 - DNA, 75 bp, Artificial Sequence
  Synthetic
atggagtaaggcagtctttatttcgccttataattcacagaatgctgtggctcgttcaatgctgggtcttaccac

SEQ ID NO: 247466 - DNA, 75 bp, Artificial Sequence
  Synthetic
aaatgcgcttggcatccattgcttttaatcatcctattcaggttgatcaacttaatagtagttattttaaattaa

SEQ ID NO: 247467 - DNA, 75 bp, Artificial Sequence
  Synthetic
gaaaactatgcttttgagcacgtagtctatggagacttctctcatactacgttaggcggtcttcacttgcttatt

SEQ ID NO: 247468 - DNA, 75 bp, Artificial Sequence
  Synthetic
acctcgagccgcataaggttcatgttcactaattaacgaactatcaatgagagttcaaagaccacccactctctt

SEQ ID NO: 247469 - DNA, 75 bp, Artificial Sequence
  Synthetic
aaacaaattgttcattcttaccccattttacatcatccaggattttaacgaactatggctttctcggcgtcttta

SEQ ID NO: 247470 - DNA, 75 bp, Artificial Sequence
  Synthetic
taatgagtttattgatcctactgagtgtatttacactcagagtcgctcttgtagtgacttcctacccctgtctga

SEQ ID NO: 247471 - DNA, 75 bp, Artificial Sequence
  Synthetic
ctttgattttaacgaacttaaataaaagccctgttgtttagcgtattgtcgcacttgtctggtgggattgtggca

SEQ ID NO: 247472 - DNA, 75 bp, Artificial Sequence
  Synthetic
aaatatatgcaattgtgccagtatttaaatacttgcacattagccgtgcctgccaatatgcgtgttatacatttt

SEQ ID NO: 247473 - DNA, 75 bp, Artificial Sequence
  Synthetic
tgtccactcttgcacagaatggaatcatgttgtaattacagtgcaataaggtaattataacccatttaattgata

SEQ ID NO: 247474 - DNA, 75 bp, Artificial Sequence
  Synthetic
gatttaagtgaatagcctagctatctcacgcccccctctcgttctcttgaagaactttgattttaacgaacttaa

SEQ ID NO: 247475 - DNA, 75 bp, Artificial Sequence
  Synthetic
cttaagtacagctatattaacaagtgctctcgtcttctttctgatgatcgtactgaagtacctcagttagtgaac

SEQ ID NO: 247476 - DNA, 75 bp, Artificial Sequence
  Synthetic
tcacgcccccctctcgttctcttgaagaactttgattttaacgaacttaaataaaagccctgttgcaaagtgtac

SEQ ID NO: 247477 - DNA, 75 bp, Artificial Sequence
  Synthetic
agaactttgattttaacgaacttaaataaaagccctgttgcaaagtgtactgtcgtggttcgccagacatatgcg

SEQ ID NO: 247478 - DNA, 75 bp, Artificial Sequence
  Synthetic
atactatttttcattctgagcggcgtgtctcttgtacatcccggtcacaatacccagttccgtctggtgcgtgac

SEQ ID NO: 247479 - DNA, 75 bp, Artificial Sequence
  Synthetic
tgtctcttgtacatcccggtcacaatacccagttccgtctggtgcgtgacaatccggggcacaccatgtcttccg

SEQ ID NO: 247480 - DNA, 75 bp, Artificial Sequence
  Synthetic
gcgcgacatgtatcgagcagcgctcaacaatgaaaaacgtcaagaccacgtgtctcaaactgtgtcattctgtgg

SEQ ID NO: 247481 - DNA, 75 bp, Artificial Sequence
  Synthetic
aacaatgaaaaacgtcaagaccacgtgtctcaaactgtgtcattctgtggcgcaggagacctggctatgaaactc

SEQ ID NO: 247482 - DNA, 75 bp, Artificial Sequence
  Synthetic
cagcctgcaatacggtgaaagcaactcttaagaacaaagggaaaattctctttgtgccggtcaaattggccagct

SEQ ID NO: 247483 - DNA, 75 bp, Artificial Sequence
  Synthetic
tcttaagaacaaagggaaaattctctttgtgccggtcaaattggccagctttgttaagcatctcccaggccctcg

SEQ ID NO: 247484 - DNA, 75 bp, Artificial Sequence
  Synthetic
ggtgggaactattccgacccattcatggttagccaactggcgtatagctctagtgcacgcgatgccattgtcggc

SEQ ID NO: 247485 - DNA, 75 bp, Artificial Sequence
  Synthetic
tggttagccaactggcgtatagctctagtgcacgcgatgccattgtcggcactaccctgcagggcaagccagttg

SEQ ID NO: 247486 - DNA, 75 bp, Artificial Sequence
  Synthetic
acttgagactggtgactacacctttctcctgcgcaaggatggattcggaggtaattacttccgcaaacctcgtcc

SEQ ID NO: 247487 - DNA, 75 bp, Artificial Sequence
  Synthetic
ttccaggtgaaatgcgcttggcatccattgcttttaatcatcccattcaggttgatcaacttaatagtagttatt

SEQ ID NO: 247488 - DNA, 75 bp, Artificial Sequence
  Synthetic
ctcctgcgcaaggatggattcggaggtaattacttccgcaaacctcgtcctaacccggatgaggaaattcctttt

SEQ ID NO: 247489 - DNA, 75 bp, Artificial Sequence
  Synthetic
accctaaggggaagtatgccaagggcctgcttaagaagttggttggtggggattttattcctattgaccagttca

SEQ ID NO: 247490 - DNA, 75 bp, Artificial Sequence
  Synthetic
cctgcttaagaagttggttggtggggattttattcctattgaccagttcatgtgtggtaaggatggtgcacctgt

SEQ ID NO: 247491 - DNA, 75 bp, Artificial Sequence
  Synthetic
agtgagaatttaatctcactggctgacgttgcaaccgatgtttcagcccgcgctgattctgatggttacatcgat

SEQ ID NO: 247492 - DNA, 75 bp, Artificial Sequence
  Synthetic
acgttgcaaccgatgtttcagcccgcgctgattctgatggttacatcgatttcaagagcaaactttacaggattg

SEQ ID NO: 247493 - DNA, 75 bp, Artificial Sequence
  Synthetic
tccgtatgccaagcaaaccatctttactattaacagtgtggttcaatgtgatggcattcaagatgtgccacccca

SEQ ID NO: 247494 - DNA, 75 bp, Artificial Sequence
  Synthetic
actattaacagtgtggttcaatgtgatggcattcaagatgtgccaccccacacgtttaccctaggaggtaaggtt

SEQ ID NO: 247495 - DNA, 75 bp, Artificial Sequence
  Synthetic
acgtagtgctattgaggatttgctatttgacaaagtcactatagctgatcctggttatatgcaaggttacgatga

SEQ ID NO: 247496 - DNA, 75 bp, Artificial Sequence
  Synthetic
ggacaggcaagacagcgcttaacctcaaacagaagatcctttacaccttttatggaaaggatgctcttgataacc

SEQ ID NO: 247497 - DNA, 75 bp, Artificial Sequence
  Synthetic
caaacagaagatcctttacaccttttatggaaaggatgctcttgataaccattcttacatctaccattccgccta

SEQ ID NO: 247498 - DNA, 75 bp, Artificial Sequence
  Synthetic
ggtagttggctcacaggtaatgctgtgcaaggctttgcatgcgattgtggtgcacaatactcggcaaatgatgtc

SEQ ID NO: 247499 - DNA, 75 bp, Artificial Sequence
  Synthetic
tgcaaggctttgcatgcgattgtggtgcacaatactcggcaaatgatgtcgagcttcagtcttctggagttgtta

SEQ ID NO: 247500 - DNA, 75 bp, Artificial Sequence
  Synthetic
ctgcccattcgcaaagggtgatagctgctcttcttcgtgcaaacacactttggctcaaatggttagtcaactgtc

SEQ ID NO: 247501 - DNA, 75 bp, Artificial Sequence
  Synthetic
tgctcttcttcgtgcaaacacactttggctcaaatggttagtcaactgtctgagaagtgtgatgttgcacctgat

SEQ ID NO: 247502 - DNA, 75 bp, Artificial Sequence
  Synthetic
gtggcgtcgtttacgcatacctggggtgtcttgaaggtactatgtactttattcctcgtgctaaatccattgtct

SEQ ID NO: 247503 - DNA, 75 bp, Artificial Sequence
  Synthetic
gtgtcttgaaggtactatgtactttattcctcgtgctaaatccattgtctcaaaggtgggtgatgccatcttcac

SEQ ID NO: 247504 - DNA, 75 bp, Artificial Sequence
  Synthetic
acatcatacaacgtcttgatgttctcgaacaggacgcccaaatagacagacttattaatggccgtttgacaacac

SEQ ID NO: 247505 - DNA, 75 bp, Artificial Sequence
  Synthetic
gttgctactatcgcaagccttttcttggagcaaacacagcgttccttgaattttgttggagagtttgtgcttaac

SEQ ID NO: 247506 - DNA, 75 bp, Artificial Sequence
  Synthetic
tggagcaaacacagcgttccttgaattttgttggagagtttgtgcttaacgatgtcgttcttgctattctctctg

SEQ ID NO: 247507 - DNA, 75 bp, Artificial Sequence
  Synthetic
ccgtaatcttgttaagcatttagatgttgacaagttacgtgagtatcttgctgactatgacattgctgtcacagt

SEQ ID NO: 247508 - DNA, 75 bp, Artificial Sequence
  Synthetic
gttgacaagttacgtgagtatcttgctgactatgacattgctgtcacagttggaccctaccttgatggtgccatt

SEQ ID NO: 247509 - DNA, 75 bp, Artificial Sequence
  Synthetic
ttgctgccattacagcaccttttgttgttctcactggtcttggtgagtcctttaagaaagttgcagccattccgt

SEQ ID NO: 247510 - DNA, 75 bp, Artificial Sequence
  Synthetic
tgttctcactggtcttggtgagtcctttaagaaagttgcagccattccgtacaaggcatgcaaatctattaaaga

SEQ ID NO: 247511 - DNA, 75 bp, Artificial Sequence
  Synthetic
attttatacagagtttttccgtatgagatctcgtctgatgtctctactttttctgaactgctgttagactgtgtt

SEQ ID NO: 247512 - DNA, 75 bp, Artificial Sequence
  Synthetic
agatctcgtctgatgtctctactttttctgaactgctgttagactgtgttggttttacagcagcatcatgctatt

SEQ ID NO: 247513 - DNA, 75 bp, Artificial Sequence
  Synthetic
agccgaagcacttttgtccactgtattctcttcttgtcaggctgcagtttcgaagtttcttaatggatgcttcga

SEQ ID NO: 247514 - DNA, 75 bp, Artificial Sequence
  Synthetic
ttctcttcttgtcaggctgcagtttcgaagtttcttaatggatgcttcgaggctacaactgcaactgtcaacttt

SEQ ID NO: 247515 - DNA, 75 bp, Artificial Sequence
  Synthetic
agatctttcttacgcaggcctatgtctacacgacaactggctttgttgctgtaggttgcaaggtttcaaatctta

SEQ ID NO: 247516 - DNA, 75 bp, Artificial Sequence
  Synthetic
ctacacgacaactggctttgttgctgtaggttgcaaggtttcaaatcttactaagcagctcttggagattctgtc

SEQ ID NO: 247517 - DNA, 75 bp, Artificial Sequence
  Synthetic
aaggtctcctgggctggtgctaaagttaaggctgttgtttacaacagtagggaatcacttgttttcccttcaggt

SEQ ID NO: 247518 - DNA, 75 bp, Artificial Sequence
  Synthetic
ttaaggctgttgtttacaacagtagggaatcacttgttttcccttcaggtacttactattgtgtggctgctcgtg

SEQ ID NO: 247519 - DNA, 75 bp, Artificial Sequence
  Synthetic
cgcagtattgcctggggagcttgcaaagaagcaattaggtttgcttgaacctgttcgccatgctaccaccgtgga

SEQ ID NO: 247520 - DNA, 75 bp, Artificial Sequence
  Synthetic
aagaagcaattaggtttgcttgaacctgttcgccatgctaccaccgtggatgtgcaagtccaaaataaagtggtg

SEQ ID NO: 247521 - DNA, 75 bp, Artificial Sequence
  Synthetic
taatttgcctgctcatctaggcagtggacatatgctcaacactgggtataattctaattgaatactatttttcag

SEQ ID NO: 247522 - DNA, 75 bp, Artificial Sequence
  Synthetic
aaactaatatgcatagcccagacctcattgtaggcgactatgttgttattagtgataagctttttgtgcgttgtg

SEQ ID NO: 247523 - DNA, 75 bp, Artificial Sequence
  Synthetic
cattgtaggcgactatgttgttattagtgataagctttttgtgcgttgtgaagaggatggtcagactgtcttcta

SEQ ID NO: 247524 - DNA, 75 bp, Artificial Sequence
  Synthetic
gttcctaccttattcagacttaagggcggagcacctattaagaaagtcacttttggcgatgaggaagtacacgaa

SEQ ID NO: 247525 - DNA, 75 bp, Artificial Sequence
  Synthetic
gcggagcacctattaagaaagtcacttttggcgatgaggaagtacacgaagtggctgcaacaagaagtgttacag

SEQ ID NO: 247526 - DNA, 75 bp, Artificial Sequence
  Synthetic
agacgcgctgctttcaaattctaatcttagaactttctctgttgacaagtctcttactgtcgaggattttgttga

SEQ ID NO: 247527 - DNA, 75 bp, Artificial Sequence
  Synthetic
cttagaactttctctgttgacaagtctcttactgtcgaggattttgttgatgtcgtgaaggacgaggtttgtgag

SEQ ID NO: 247528 - DNA, 75 bp, Artificial Sequence
  Synthetic
ttgcattagatgactttgacttggagacttttattgatactccatgctactgttttaaccaggatggtgatgtac

SEQ ID NO: 247529 - DNA, 75 bp, Artificial Sequence
  Synthetic
gacttttattgatactccatgctactgttttaaccaggatggtgatgtacagtggagttctactatgttcttttc

SEQ ID NO: 247530 - DNA, 75 bp, Artificial Sequence
  Synthetic
gagaatgaggaagagcctgcagatgatgatgcggaggattttgacgagtgttcaggtgacgaagcctgggctagt

SEQ ID NO: 247531 - DNA, 75 bp, Artificial Sequence
  Synthetic
atgatgcggaggattttgacgagtgttcaggtgacgaagcctgggctagtcttgttgatgaggcatttcctatgg

SEQ ID NO: 247532 - DNA, 75 bp, Artificial Sequence
  Synthetic
tgagcctaagcctattcagctctgtactgctacagagcaacaaattactgtacaggtgtttgaggctaaagcctt

SEQ ID NO: 247533 - DNA, 75 bp, Artificial Sequence
  Synthetic
actgctacagagcaacaaattactgtacaggtgtttgaggctaaagcctttgaaacaccggcagtcaatttttgt

SEQ ID NO: 247534 - DNA, 75 bp, Artificial Sequence
  Synthetic
cacatactgccgatgttatagttcgggatgtaaaaattgcacctgagccaccaaagctggaacaaccgcaagtgt

SEQ ID NO: 247535 - DNA, 75 bp, Artificial Sequence
  Synthetic
ggatgtaaaaattgcacctgagccaccaaagctggaacaaccgcaagtgtcagctgtgcaggttgagggcgacgc

SEQ ID NO: 247536 - DNA, 75 bp, Artificial Sequence
  Synthetic
gaacctggacaggccgctctacctgagcctgttatggttgaggatggtgttacagcagttactaagcctaaagag

SEQ ID NO: 247537 - DNA, 75 bp, Artificial Sequence
  Synthetic
agcctgttatggttgaggatggtgttacagcagttactaagcctaaagagtcgcaagagcttgccatgcggtctc

SEQ ID NO: 247538 - DNA, 75 bp, Artificial Sequence
  Synthetic
ggctcagcctcaatctgttgctgctgcacaacctgaggtacctgtgggagccgtgactccagcagctactgctaa

SEQ ID NO: 247539 - DNA, 75 bp, Artificial Sequence
  Synthetic
gcacaacctgaggtacctgtgggagccgtgactccagcagctactgctaaaccggaaattccggcttctagcaac

SEQ ID NO: 247540 - DNA, 75 bp, Artificial Sequence
  Synthetic
aaccagttgtgcgacctaaggtaaagacacctaaaaagcgcaatactaaaagtgtttcggccgctgctagtgata

SEQ ID NO: 247541 - DNA, 75 bp, Artificial Sequence
  Synthetic
ctatggctttctcggcgtctttatttaaacccgtccagctagccccagtttctcctgcatttcatcgcattgagt

SEQ ID NO: 247542 - DNA, 75 bp, Artificial Sequence
  Synthetic
gacacctaaaaagcgcaatactaaaagtgtttcggccgctgctagtgatagcgacacgtcagttgatcctttagt

SEQ ID NO: 247543 - DNA, 75 bp, Artificial Sequence
  Synthetic
gatagtgttacacttgttttgtgtgacgctattaagctagccaagtgctttaaagattgtgtgttggttaatgct

SEQ ID NO: 247544 - DNA, 75 bp, Artificial Sequence
  Synthetic
acgctattaagctagccaagtgctttaaagattgtgtgttggttaatgctgctaacacacatcttaaacatggtg

SEQ ID NO: 247545 - DNA, 75 bp, Artificial Sequence
  Synthetic
ggcatctcatggctcagtacaaatggagtctgatgagtatgttaactcaaaaggcccattgcaggttggtgatgc

SEQ ID NO: 247546 - DNA, 75 bp, Artificial Sequence
  Synthetic
gagtctgatgagtatgttaactcaaaaggcccattgcaggttggtgatgctgtattattaaaggggcatggttta

SEQ ID NO: 247547 - DNA, 75 bp, Artificial Sequence
  Synthetic
gaccggatatgcgttctaaacaagatgtttctttgcttactaagtgttacaaggctatgaattcataccctttaa

SEQ ID NO: 247548 - DNA, 75 bp, Artificial Sequence
  Synthetic
tgtttgacatgcgttcccactttattcgtgttagtacagtttcttctcatggtatggtccctgtcatacacacca

SEQ ID NO: 247549 - DNA, 75 bp, Artificial Sequence
  Synthetic
ggcttggaaaactatgcttttgagcacgtagtctatggagacttctctcatactacgttaggcggtcttcacttg

SEQ ID NO: 247550 - DNA, 75 bp, Artificial Sequence
  Synthetic
tgtttctttgcttactaagtgttacaaggctatgaattcataccctttaattgtgacaccacttgtatctgcagg

SEQ ID NO: 247551 - DNA, 75 bp, Artificial Sequence
  Synthetic
tcatttgagtatcttcagcgtgaggctaagacgagaattctggtcgccaccaattctgaagatgtctttaacaag

SEQ ID NO: 247552 - DNA, 75 bp, Artificial Sequence
  Synthetic
ctaagacgagaattctggtcgccaccaattctgaagatgtctttaacaagcttacagaagttaaagtgccagttg

SEQ ID NO: 247553 - DNA, 75 bp, Artificial Sequence
  Synthetic
taaaggcggtatacgtaaggctaaagattatggctttacggtatttgtctgtattgataattctgctaataccaa

SEQ ID NO: 247554 - DNA, 75 bp, Artificial Sequence
  Synthetic
gattatggctttacggtatttgtctgtattgataattctgctaataccaagatcctgcgtagtaagggtgttgat

SEQ ID NO: 247555 - DNA, 75 bp, Artificial Sequence
  Synthetic
gcggagtccattactattgttatagttcaaaggactttctgcctgaacttgtttctgcagctaatagtactagag

SEQ ID NO: 247556 - DNA, 75 bp, Artificial Sequence
  Synthetic
ttcaaaggactttctgcctgaacttgtttctgcagctaatagtactagaggaataatagctcatccattgggata

SEQ ID NO: 247557 - DNA, 75 bp, Artificial Sequence
  Synthetic
caggctagagcttttgttaaaatggtacgtgtaccatatgtctgcctgcttactaataaagagcaagctctagtt

SEQ ID NO: 247558 - DNA, 75 bp, Artificial Sequence
  Synthetic
tacgtgtaccatatgtctgcctgcttactaataaagagcaagctctagttcttacatccactggtgagcgtctct

SEQ ID NO: 247559 - DNA, 75 bp, Artificial Sequence
  Synthetic
tgttcaagaggagggctcttttcatcattggcatcttgtcaagggtgaaatcctccttaacaatgctatatataa

SEQ ID NO: 247560 - DNA, 75 bp, Artificial Sequence
  Synthetic
cattggcatcttgtcaagggtgaaatcctccttaacaatgctatatataacaagttgttgcattggtctgatcaa

SEQ ID NO: 247561 - DNA, 75 bp, Artificial Sequence
  Synthetic
tcttcgtgttaaagaacggttgtgctttaccatttgaagaccttaataagtgtcggacctatttgacttcaagga

SEQ ID NO: 247562 - DNA, 75 bp, Artificial Sequence
  Synthetic
tttaccatttgaagaccttaataagtgtcggacctatttgacttcaaggacggctcagcaattaacaatcgaagt

SEQ ID NO: 247563 - DNA, 75 bp, Artificial Sequence
  Synthetic
tatgtctttaaaatgtttgttttatggctcctatggccatcttccatggcgctatcaatatttagcgccgtttat

SEQ ID NO: 247564 - DNA, 75 bp, Artificial Sequence
  Synthetic
tttcggacatgtgtccttaataatcaaagcacgtacagagcacaagtcggttgtgtttttcttgatggtgccgat

SEQ ID NO: 247565 - DNA, 75 bp, Artificial Sequence
  Synthetic
aaagcacgtacagagcacaagtcggttgtgtttttcttgatggtgccgatatatccgataccattccggatgaaa

SEQ ID NO: 247566 - DNA, 75 bp, Artificial Sequence
  Synthetic
agccgacaatttgtctgcagctgagaaggatgtgcttaaacagttatatggtactcctgatgatacgttcctata

SEQ ID NO: 247567 - DNA, 75 bp, Artificial Sequence
  Synthetic
gttccatttggtggtacaactgtcgtacgtccactcgtagaggactctaccagtgtaactgctgttgtaaccaat

SEQ ID NO: 247568 - DNA, 75 bp, Artificial Sequence
  Synthetic
aaggatgtgcttaaacagttatatggtactcctgatgatacgttcctatacaggtattattccctaaaggctaag

SEQ ID NO: 247569 - DNA, 75 bp, Artificial Sequence
  Synthetic
gtgataaggcccgctctttgaggttgagtgatgctaattgctacatgaatgtagtgattatgatgcttgatcttc

SEQ ID NO: 247570 - DNA, 75 bp, Artificial Sequence
  Synthetic
gagtgatgctaattgctacatgaatgtagtgattatgatgcttgatcttcttagagacattcggtttaccgtacc

SEQ ID NO: 247571 - DNA, 75 bp, Artificial Sequence
  Synthetic
catagatataaggcaggtaattacaggagtccgcctattacggcggatattgaacttgcattgcttcgagcttag

SEQ ID NO: 247572 - DNA, 75 bp, Artificial Sequence
  Synthetic
cataagggcggtgattctaccgatttcattgccctcattatgacttatggcaattgtacatttggtgccccagat

SEQ ID NO: 247573 - DNA, 75 bp, Artificial Sequence
  Synthetic
tcattgccctcattatgacttatggcaattgtacatttggtgccccagatgatgccactcgactactccacatcg

SEQ ID NO: 247574 - DNA, 75 bp, Artificial Sequence
  Synthetic
tactgcgcgcatggtatggagagagtggtgcaacgtctgtggcacgaaagatgttacttttcaaggccttaaggc

SEQ ID NO: 247575 - DNA, 75 bp, Artificial Sequence
  Synthetic
tggtgcaacgtctgtggcacgaaagatgttacttttcaaggccttaaggcatgttgctatgttggcatgcaaact

SEQ ID NO: 247576 - DNA, 75 bp, Artificial Sequence
  Synthetic
cttatacctgccaatgtggtggtgagcgtcatagacaactcattgagcacaacacaccttggctgcttctttcag

SEQ ID NO: 247577 - DNA, 75 bp, Artificial Sequence
  Synthetic
gcgtcatagacaactcattgagcacaacacaccttggctgcttctttcaggcaaacctagtgagcagatcgtttc

SEQ ID NO: 247578 - DNA, 75 bp, Artificial Sequence
  Synthetic
taagcaactggctcccaggtggtacttctactacactggaactggacccgaagcagcactcccattccgggctgt

SEQ ID NO: 247579 - DNA, 75 bp, Artificial Sequence
  Synthetic
gcctttaatgtctttctgggctctgaaacatccgtaggtcactacgttcatgtgcgcgtgaaggactctttattg

SEQ ID NO: 247580 - DNA, 75 bp, Artificial Sequence
  Synthetic
aaacatccgtaggtcactacgttcatgtgcgcgtgaaggactctttattgtataagtatgattcaggttccttga

SEQ ID NO: 247581 - DNA, 75 bp, Artificial Sequence
  Synthetic
ggttactgacattttgtacccaggacaaaagtataccagcgattgtaatgtagtggtatactctttggatggtaa

SEQ ID NO: 247582 - DNA, 75 bp, Artificial Sequence
  Synthetic
caaaagtataccagcgattgtaatgtagtggtatactctttggatggtaataccaaggcagaagtcaatccagac

SEQ ID NO: 247583 - DNA, 75 bp, Artificial Sequence
  Synthetic
gtaagtactttacaagtacaccacctgtgtcatattcacctgctactgttatagcaggtagtgtttatactaata

SEQ ID NO: 247584 - DNA, 75 bp, Artificial Sequence
  Synthetic
tgtgtcatattcacctgctactgttatagcaggtagtgtttatactaatagttgcctaattgctgctgatggcca

SEQ ID NO: 247585 - DNA, 75 bp, Artificial Sequence
  Synthetic
gcttttaataatatgctaggctatgatcctagtaagcctacttctaagaagtatacttactcagtcctaccagat

SEQ ID NO: 247586 - DNA, 75 bp, Artificial Sequence
  Synthetic
atcctagtaagcctacttctaagaagtatacttactcagtcctaccagatgaaaatggtgatatccttatggctg

SEQ ID NO: 247587 - DNA, 75 bp, Artificial Sequence
  Synthetic
caagaatggtgccatgcttaatggtaaaccagtgttgtgggtttctaatggtttgtttgacgcagctctgtcaag

SEQ ID NO: 247588 - DNA, 75 bp, Artificial Sequence
  Synthetic
aaaccagtgttgtgggtttctaatggtttgtttgacgcagctctgtcaagatttaatagggcttctatacgtcaa

SEQ ID NO: 247589 - DNA, 75 bp, Artificial Sequence
  Synthetic
ttgagaacaagttcacaccgcttgtagtagaggacctgcctcccattgttaaggatgtaaaacctattatagtaa

SEQ ID NO: 247590 - DNA, 75 bp, Artificial Sequence
  Synthetic
agtagaggacctgcctcccattgttaaggatgtaaaacctattatagtaaatcctccagagctaaagttagttaa

SEQ ID NO: 247591 - DNA, 75 bp, Artificial Sequence
  Synthetic
gttaaggataactttagctttgttgatgatagtgctggtgttacagttgtagaatacctcactcgtgatgacatg

SEQ ID NO: 247592 - DNA, 75 bp, Artificial Sequence
  Synthetic
atgatagtgctggtgttacagttgtagaatacctcactcgtgatgacatgcatcaattgtatgtcgatcctaagc

SEQ ID NO: 247593 - DNA, 75 bp, Artificial Sequence
  Synthetic
tttcttatcgttgctctttggactgcataccgttcagagtggagatctcagcgttattgcagctaatgggtcttt

SEQ ID NO: 247594 - DNA, 75 bp, Artificial Sequence
  Synthetic
gaatgattttacttgtagtcaaatatctccagcagcaattgctagcaactgttattcttcactgattttggatta

SEQ ID NO: 247595 - DNA, 75 bp, Artificial Sequence
  Synthetic
ctcaaagtaacaagatcgcggcaatcgtttgtgtttggcaatcccatctcaccatcgcttgtccactcttgcaca

SEQ ID NO: 247596 - DNA, 75 bp, Artificial Sequence
  Synthetic
cataccgttcagagtggagatctcagcgttattgcagctaatgggtctttgacaaagaaagtccgtgcgcttttt

SEQ ID NO: 247597 - DNA, 75 bp, Artificial Sequence
  Synthetic
ttgctagccgtaccttccaagctgcatccctggtcgggagagctgttaggtttacggctcgtcattgtggtactg

SEQ ID NO: 247598 - DNA, 75 bp, Artificial Sequence
  Synthetic
atccctggtcgggagagctgttaggtttacggctcgtcattgtggtactgttgctagtgtcttctatagttgtta

SEQ ID NO: 247599 - DNA, 75 bp, Artificial Sequence
  Synthetic
atacctcttaattattttaaatcgagagggcctgttggtactgaggttgaagttagcgccttacgtactgcaggt

SEQ ID NO: 247600 - DNA, 75 bp, Artificial Sequence
  Synthetic
gagggcctgttggtactgaggttgaagttagcgccttacgtactgcaggtatagtaacaggcaatgttgtcaagc

SEQ ID NO: 247601 - DNA, 75 bp, Artificial Sequence
  Synthetic
aacgggcattgctgcccgtcctccaccaggtgaacagtttaagcacctcgtgcctcttatgcataagggggctgc

SEQ ID NO: 247602 - DNA, 75 bp, Artificial Sequence
  Synthetic
gactattaccaaattgcaacgtattgattggaaagcatctttacggttgctacttgtactatgcacaactgggct

SEQ ID NO: 247603 - DNA, 75 bp, Artificial Sequence
  Synthetic
acaactaatgttgacaaaatacgccagcttctcaaaggtgtcacccttgacaagttgcgtgattatttagctgac

SEQ ID NO: 247604 - DNA, 75 bp, Artificial Sequence
  Synthetic
gattggaaagcatctttacggttgctacttgtactatgcacaactgggctgttgttgtcttccctttatcacttg

SEQ ID NO: 247605 - DNA, 75 bp, Artificial Sequence
  Synthetic
gtgatgcattgttagaggatgccactggagttacagcactctataaagaggctcgtagctatcttggtatcactt

SEQ ID NO: 247606 - DNA, 75 bp, Artificial Sequence
  Synthetic
tggagttacagcactctataaagaggctcgtagctatcttggtatcacttctgcctgtgatggtgttgcacgtga

SEQ ID NO: 247607 - DNA, 75 bp, Artificial Sequence
  Synthetic
tctaattattgtgcgaaccgctctgtactatgtaagtggtgcctattaggtcaagactccattacacattattct

SEQ ID NO: 247608 - DNA, 75 bp, Artificial Sequence
  Synthetic
tactatgtaagtggtgcctattaggtcaagactccattacacattattctgctctcaagatggtacaaacacatt

SEQ ID NO: 247609 - DNA, 75 bp, Artificial Sequence
  Synthetic
ttggatgtggtttgtacttgagctccttgttgcatatgcattgtacacagcagcattcaattgggtgttgctggc

SEQ ID NO: 247610 - DNA, 75 bp, Artificial Sequence
  Synthetic
cttgttgcatatgcattgtacacagcagcattcaattgggtgttgctggcatgtacattgcagtacttttttagt

SEQ ID NO: 247611 - DNA, 75 bp, Artificial Sequence
  Synthetic
gttcctataactatgtggtctcatgcatttacttgttcttcacgcatattccacttgatggtcttgttagaatct

SEQ ID NO: 247612 - DNA, 75 bp, Artificial Sequence
  Synthetic
catttacttgttcttcacgcatattccacttgatggtcttgttagaatctacaatgttctagcttgcctttggtt

SEQ ID NO: 247613 - DNA, 75 bp, Artificial Sequence
  Synthetic
attaatggatgtaaggatacagcatgtctcctttgttataagaggaatcgtttgactcgtgttgaagcctctacc

SEQ ID NO: 247614 - DNA, 75 bp, Artificial Sequence
  Synthetic
gtctcctttgttataagaggaatcgtttgactcgtgttgaagcctctaccgttgtatgtggtgcaaaacgtacgt

SEQ ID NO: 247615 - DNA, 75 bp, Artificial Sequence
  Synthetic
ctcattctgtcgcaagcataattggaattgtgtggagtgcgatgtagcaggtatagggagtacctttatctgcga

SEQ ID NO: 247616 - DNA, 75 bp, Artificial Sequence
  Synthetic
aattgtgtggagtgcgatgtagcaggtatagggagtacctttatctgcgaagaagtcgccaacgacctcactacc

SEQ ID NO: 247617 - DNA, 75 bp, Artificial Sequence
  Synthetic
cagataagtcgcattactatgtggagtctgttttggttaaggacactgcggtgcagtttacttatgatagagacg

SEQ ID NO: 247618 - DNA, 75 bp, Artificial Sequence
  Synthetic
gtctgttttggttaaggacactgcggtgcagtttacttatgatagagacggtcaaacctgctatgagcggttccc

SEQ ID NO: 247619 - DNA, 75 bp, Artificial Sequence
  Synthetic
aaactgaagttcaaagaggtttgtaaatctaccacgggtatacctgagcataactttatcatttatgacgctagt

SEQ ID NO: 247620 - DNA, 75 bp, Artificial Sequence
  Synthetic
aatctaccacgggtatacctgagcataactttatcatttatgacgctagtgatcgtggccaggagaatttggcca

SEQ ID NO: 247621 - DNA, 75 bp, Artificial Sequence
  Synthetic
agttctgtgtaaaccaattttgttggttgattcaaacttggttacatctgttggtgactcttgtgaaattgccac

SEQ ID NO: 247622 - DNA, 75 bp, Artificial Sequence
  Synthetic
gttgattcaaacttggttacatctgttggtgactcttgtgaaattgccactaaaatgtttgattcctttgttaat

SEQ ID NO: 247623 - DNA, 75 bp, Artificial Sequence
  Synthetic
ctcgtgatcgccttgagaagttaatctcaactgcgcgcgacggcattaagcgaggcgaaaatttgcaacctgttc

SEQ ID NO: 247624 - DNA, 75 bp, Artificial Sequence
  Synthetic
ctcaactgcgcgcgacggcattaagcgaggcgaaaatttgcaacctgttcttaagaccttcattgatgctgccag

SEQ ID NO: 247625 - DNA, 75 bp, Artificial Sequence
  Synthetic
gtagaaactggtgaaatagtggatgctgttcagtatgcacacaaacatgacatccagttgactaatgaggggtac

SEQ ID NO: 247626 - DNA, 75 bp, Artificial Sequence
  Synthetic
ctgttcagtatgcacacaaacatgacatccagttgactaatgaggggtacaataattatgtaccatcttatgtta

SEQ ID NO: 247627 - DNA, 75 bp, Artificial Sequence
  Synthetic
tttaggtagcttaatagattgtaatgcagcctctgttaatccagctaacatgcgcaatgctaatggtgcttgtat

SEQ ID NO: 247628 - DNA, 75 bp, Artificial Sequence
  Synthetic
gcagcctctgttaatccagctaacatgcgcaatgctaatggtgcttgtatttggaacgctgctgcatattttaaa

SEQ ID NO: 247629 - DNA, 75 bp, Artificial Sequence
  Synthetic
tacgaatagcttgtcggaagtgtaatcttaactttaggctaactacgtctaaattgcgtgcgcatgacaatttat

SEQ ID NO: 247630 - DNA, 75 bp, Artificial Sequence
  Synthetic
tcttaactttaggctaactacgtctaaattgcgtgcgcatgacaatttattgtcagttcgttttagtgccactaa

SEQ ID NO: 247631 - DNA, 75 bp, Artificial Sequence
  Synthetic
ctgacgagtttgtatagctttacgttaaagagctatgtgtgtttgactttgctgcttgtcttatgtgctgtattg

SEQ ID NO: 247632 - DNA, 75 bp, Artificial Sequence
  Synthetic
taaagagctatgtgtgtttgactttgctgcttgtcttatgtgctgtattgatgtatttcaccttgcctactttca

SEQ ID NO: 247633 - DNA, 75 bp, Artificial Sequence
  Synthetic
agaccgcactctggaatataaagttctggacaatggtgtcattagagatataacctctggtgataagtgctttgc

SEQ ID NO: 247634 - DNA, 75 bp, Artificial Sequence
  Synthetic
ctggacaatggtgtcattagagatataacctctggtgataagtgctttgctaataagtaccggtcttttgctcaa

SEQ ID NO: 247635 - DNA, 75 bp, Artificial Sequence
  Synthetic
gttttgataacgatatcgcatgccctgtgactgttgctgttattgcaggtgtagctggtgctagagtaccaggtg

SEQ ID NO: 247636 - DNA, 75 bp, Artificial Sequence
  Synthetic
tgtgactgttgctgttattgcaggtgtagctggtgctagagtaccaggtgtgcctaccacattggcttgggttaa

SEQ ID NO: 247637 - DNA, 75 bp, Artificial Sequence
  Synthetic
agagtctttgccaattctcctaatgtctgctacacgccgcgtagtgagataccttataagagtttctcggacagt

SEQ ID NO: 247638 - DNA, 75 bp, Artificial Sequence
  Synthetic
tctgctacacgccgcgtagtgagataccttataagagtttctcggacagtggttgcattctaccttcggaatgta

SEQ ID NO: 247639 - DNA, 75 bp, Artificial Sequence
  Synthetic
aatggtgccttactgctatgaccctactgtattaccaggtgctcatgcatatgcaaacatgaaacctcatgtgcg

SEQ ID NO: 247640 - DNA, 75 bp, Artificial Sequence
  Synthetic
actgtattaccaggtgctcatgcatatgcaaacatgaaacctcatgtgcgttatgacatgttcgaaggaaacatg

SEQ ID NO: 247641 - DNA, 75 bp, Artificial Sequence
  Synthetic
taattgaatactatttttcagttagagcgtcgtgtctcttgtacgtctcggtcacaatatacggtttcgtccggt

SEQ ID NO: 247642 - DNA, 75 bp, Artificial Sequence
  Synthetic
ttgaaagcactatcagggttactaaaactcttagcacacagtactgccgttttggtagttgcgagtatgctcaag

SEQ ID NO: 247643 - DNA, 75 bp, Artificial Sequence
  Synthetic
aactcttagcacacagtactgccgttttggtagttgcgagtatgctcaagagggtgtttgtattactactaatgg

SEQ ID NO: 247644 - DNA, 75 bp, Artificial Sequence
  Synthetic
catgccaataggccgggtgtctattgtggatttgattatcttgacattgtcaggaggcttgcattgggtgtattc

SEQ ID NO: 247645 - DNA, 75 bp, Artificial Sequence
  Synthetic
gtggatttgattatcttgacattgtcaggaggcttgcattgggtgtattccaacctattacctacttccagttga

SEQ ID NO: 247646 - DNA, 75 bp, Artificial Sequence
  Synthetic
tttgtgtgcctttatgactttagtcttttattacattaataaagttaagcgtgcattggccgactatactcagtg

SEQ ID NO: 247647 - DNA, 75 bp, Artificial Sequence
  Synthetic
ttttattacattaataaagttaagcgtgcattggccgactatactcagtgtgcagttatagctgtctgtgcaact

SEQ ID NO: 247648 - DNA, 75 bp, Artificial Sequence
  Synthetic
ttgtggttgcatgcccgttgtgcgttgtaccctacaccgcattgtattattatgctactttctacttcacaaacg

SEQ ID NO: 247649 - DNA, 75 bp, Artificial Sequence
  Synthetic
tgtaccctacaccgcattgtattattatgctactttctacttcacaaacgagcctgcatttataatgcatttgtc

SEQ ID NO: 247650 - DNA, 75 bp, Artificial Sequence
  Synthetic
gttccagtatggacgacgtgtctttatgtagtggctatgtgttttagacacttcttttgggttcttgcatatttt

SEQ ID NO: 247651 - DNA, 75 bp, Artificial Sequence
  Synthetic
attccactcctatgaatctgagtacttactcactttttgatttatccaagtttcaattaaaattaaaaggaacac

SEQ ID NO: 247652 - DNA, 75 bp, Artificial Sequence
  Synthetic
ttactcactttttgatttatccaagtttcaattaaaattaaaaggaacaccagttcttcaattaaaggagagtca

SEQ ID NO: 247653 - DNA, 75 bp, Artificial Sequence
  Synthetic
atgtagtggctatgtgttttagacacttcttttgggttcttgcatattttagtcgaaagcatgttgatgttttca

SEQ ID NO: 247654 - DNA, 75 bp, Artificial Sequence
  Synthetic
ccaggaggctgctgctaatatttttgttgtaaacaaagatacttatgtggctcttaggaattctattaatgcaga

SEQ ID NO: 247655 - DNA, 75 bp, Artificial Sequence
  Synthetic
gttgtaaacaaagatacttatgtggctcttaggaattctattaatgcagatgtgtatgcgaggtatctagccatg

SEQ ID NO: 247656 - DNA, 75 bp, Artificial Sequence
  Synthetic
gtgctatggatactgccgcatatagagaggctgctgcgtcccatctggctaaggctttacagacctatagtgaaa

SEQ ID NO: 247657 - DNA, 75 bp, Artificial Sequence
  Synthetic
agaggctgctgcgtcccatctggctaaggctttacagacctatagtgaaactggtagcgaccttctttatcagcc

SEQ ID NO: 247658 - DNA, 75 bp, Artificial Sequence
  Synthetic
gtgttgcagagtggcttggttaagatgtctcatccaagtggggctgtagaggcttgtatggttcaagttacatgt

SEQ ID NO: 247659 - DNA, 75 bp, Artificial Sequence
  Synthetic
tgtctcatccaagtggggctgtagaggcttgtatggttcaagttacatgtggtagcatgaccttgaatggcttat

SEQ ID NO: 247660 - DNA, 75 bp, Artificial Sequence
  Synthetic
acgacatgttatgtgtcccgcagaccagcttaatgatccaaattatgatggtttgttgatttctatgactaacca

SEQ ID NO: 247661 - DNA, 75 bp, Artificial Sequence
  Synthetic
cagcttaatgatccaaattatgatggtttgttgatttctatgactaaccatagttttactgtgcaaaagcatgtt

SEQ ID NO: 247662 - DNA, 75 bp, Artificial Sequence
  Synthetic
ttggtcacgccatgcaaggcacacttctgaagttgacggtggattctcctaatccgaatacacctgcctacactt

SEQ ID NO: 247663 - DNA, 75 bp, Artificial Sequence
  Synthetic
tctgaagttgacggtggattctcctaatccgaatacacctgcctacacttttactactgttaaaccaggcgcatc

SEQ ID NO: 247664 - DNA, 75 bp, Artificial Sequence
  Synthetic
ggcaggccaactggtacatttacagttgttatgaggccgaaccacacaattaagggttctttcttgtgtggatcg

SEQ ID NO: 247665 - DNA, 75 bp, Artificial Sequence
  Synthetic
ttgttatgaggccgaaccacacaattaagggttctttcttgtgtggatcgtgtggtagtgttggttacacaaagg

SEQ ID NO: 247666 - DNA, 75 bp, Artificial Sequence
  Synthetic
tatgcatcaaatggaattggcaaatggtacacataccggctcttcatttgacggtaatatgtatggtgcattcca

SEQ ID NO: 247667 - DNA, 75 bp, Artificial Sequence
  Synthetic
ggtacacataccggctcttcatttgacggtaatatgtatggtgcattccaagatagacaagtgcaccaggcacag

SEQ ID NO: 247668 - DNA, 75 bp, Artificial Sequence
  Synthetic
atatagttgcttggctttatgcggctatactaaatggttgcacatggtttgttaaacctagtcgcactagtgtag

SEQ ID NO: 247669 - DNA, 75 bp, Artificial Sequence
  Synthetic
tatactaaatggttgcacatggtttgttaaacctagtcgcactagtgtagtctcttttaatgaatgggccatggc

SEQ ID NO: 247670 - DNA, 75 bp, Artificial Sequence
  Synthetic
actcatgcgcttgatatgttagctgttaagaccggtgttagtgttgaacagctcctttctgctatccagcaactt

SEQ ID NO: 247671 - DNA, 75 bp, Artificial Sequence
  Synthetic
ttaagaccggtgttagtgttgaacagctcctttctgctatccagcaacttaatcagggctttcaaggcaaacaaa

SEQ ID NO: 247672 - DNA, 75 bp, Artificial Sequence
  Synthetic
tgaattcacccctgaagatgttaacatgcagatcatgggtgttgtaatgcaaagtggtgttaagaaagtgacgta

SEQ ID NO: 247673 - DNA, 75 bp, Artificial Sequence
  Synthetic
atgcagatcatgggtgttgtaatgcaaagtggtgttaagaaagtgacgtatggtacctttcactggcttttagct

SEQ ID NO: 247674 - DNA, 75 bp, Artificial Sequence
  Synthetic
tcttgcaatgcaccaagtttacattgtggaattatctgtttcagaccataccgactcagctaactccactaatga

SEQ ID NO: 247675 - DNA, 75 bp, Artificial Sequence
  Synthetic
gtggaattatctgtttcagaccataccgactcagctaactccactaatgattattgtggctgcgtgtgttatgct

SEQ ID NO: 247676 - DNA, 75 bp, Artificial Sequence
  Synthetic
ctaactctcttcttgttgcccacagcactttgtttgacttatgcgaacatagtctatgagccttctacacctgtt

SEQ ID NO: 247677 - DNA, 75 bp, Artificial Sequence
  Synthetic
cactttgtttgacttatgcgaacatagtctatgagccttctacacctgtttcttcagcccttatagcagttgcta

SEQ ID NO: 247678 - DNA, 75 bp, Artificial Sequence
  Synthetic
tatgaggacaacgcatacagatttaggcctttatttaagtctaagtttggcattggctgttgttgttaagcgttt

SEQ ID NO: 247679 - DNA, 75 bp, Artificial Sequence
  Synthetic
ggcctttatttaagtctaagtttggcattggctgttgttgttaagcgtttgtacactccatctctgtctaatctt

SEQ ID NO: 247680 - DNA, 75 bp, Artificial Sequence
  Synthetic
tagggttgttcatagtaaactttttcatttttaccgtagtatgtgctataacactcttggtgtgtatggctttcc

SEQ ID NO: 247681 - DNA, 75 bp, Artificial Sequence
  Synthetic
tgtgggtttacacttatagtatcggtgagcattcttcacctgtggcttacctggtctttgttaccacactgacca

SEQ ID NO: 247682 - DNA, 75 bp, Artificial Sequence
  Synthetic
tgagcattcttcacctgtggcttacctggtctttgttaccacactgaccagtgattatacagtcactgttttcac

SEQ ID NO: 247683 - DNA, 75 bp, Artificial Sequence
  Synthetic
acttacctcatctactcctactcgcctcagacgatgttggtgtttccagaggttaagatgattttattgatgtac

SEQ ID NO: 247684 - DNA, 75 bp, Artificial Sequence
  Synthetic
ctcagacgatgttggtgtttccagaggttaagatgattttattgatgtacacattcattggttatgtgtgtacct

SEQ ID NO: 247685 - DNA, 75 bp, Artificial Sequence
  Synthetic
aaactttaagttacgctcgcccatgggtgtgtatgactttaaagtttcaactcaagagttcagatacatgaccgc

SEQ ID NO: 247686 - DNA, 75 bp, Artificial Sequence
  Synthetic
ggtgtgtatgactttaaagtttcaactcaagagttcagatacatgaccgctaacggcctgcacgcacctcgtaat

SEQ ID NO: 247687 - DNA, 75 bp, Artificial Sequence
  Synthetic
ttaagcttattggtattggcggtactccttgtataaaggtagctagcgttcaatccaaattgactgatttgaaat

SEQ ID NO: 247688 - DNA, 75 bp, Artificial Sequence
  Synthetic
tccttgtataaaggtagctagcgttcaatccaaattgactgatttgaaatgcacatctgtggttttactctcagt

SEQ ID NO: 247689 - DNA, 75 bp, Artificial Sequence
  Synthetic
aatagtaaggcgtgggcctactgtgttaagtgtcataatgacattttgactgctgttgatcccactgaggctttc

SEQ ID NO: 247690 - DNA, 75 bp, Artificial Sequence
  Synthetic
ttaagtgtcataatgacattttgactgctgttgatcccactgaggctttcgagaaattcgtttgcctctttgcca

SEQ ID NO: 247691 - DNA, 75 bp, Artificial Sequence
  Synthetic
agacttggatggtcttgctagtgatctgtttgaaaattcagcagttttacaggctactcttaatgagttctccca

SEQ ID NO: 247692 - DNA, 75 bp, Artificial Sequence
  Synthetic
ctgtttgaaaattcagcagttttacaggctactcttaatgagttctcccacttagcaagttttgctgagttggag

SEQ ID NO: 247693 - DNA, 75 bp, Artificial Sequence
  Synthetic
atggtgaagcggcaaagctacggaactaattccggcgttgccatttaccatagatataaggcaggtaattacagg

SEQ ID NO: 247694 - DNA, 75 bp, Artificial Sequence
  Synthetic
ccctggattctggtgatgcgtcacctcaggtccttaaggctttacaaaaagctgttaacgtggctaaaaatgctt

SEQ ID NO: 247695 - DNA, 75 bp, Artificial Sequence
  Synthetic
tcaggtccttaaggctttacaaaaagctgttaacgtggctaaaaatgcttatgagaaagataagtctgtagcccg

SEQ ID NO: 247696 - DNA, 75 bp, Artificial Sequence
  Synthetic
gctatgacgtcaatgtacaagcaggcacgtgctgaggacaagaagtctaaaatagttagtgctatgcaaactatg

SEQ ID NO: 247697 - DNA, 75 bp, Artificial Sequence
  Synthetic
cacgtgctgaggacaagaagtctaaaatagttagtgctatgcaaactatgttgtttggtatgattaagaagttgg

SEQ ID NO: 247698 - DNA, 75 bp, Artificial Sequence
  Synthetic
agctaatgctaggaatggttgtataccacttagtattgtgccactgtgtgcatctaacaagcttagagttgttat

SEQ ID NO: 247699 - DNA, 75 bp, Artificial Sequence
  Synthetic
ccacttagtattgtgccactgtgtgcatctaacaagcttagagttgttattccagacttcaccgtttggaatcaa

SEQ ID NO: 247700 - DNA, 75 bp, Artificial Sequence
  Synthetic
atgcaggtgcgctctgggatattgcatctattaacaatgtggataatgaaattatcaaatcctcagatgtttcag

SEQ ID NO: 247701 - DNA, 75 bp, Artificial Sequence
  Synthetic
atctattaacaatgtggataatgaaattatcaaatcctcagatgtttcagaaaacaatgagcatttgacatggcc

SEQ ID NO: 247702 - DNA, 75 bp, Artificial Sequence
  Synthetic
gcagcttctgcagttaaattgcaaaataatgagattaggccgacggggcttaaaactatggttgtaacggctggt

SEQ ID NO: 247703 - DNA, 75 bp, Artificial Sequence
  Synthetic
ataatgagattaggccgacggggcttaaaactatggttgtaacggctggtttagatcagacgtcgtttaatataa

SEQ ID NO: 247704 - DNA, 75 bp, Artificial Sequence
  Synthetic
tcaaggtcgtaagatgctaatgggtcttttgtctgaaaatgcataccttaagtatgctaaagttgaaagtcagga

SEQ ID NO: 247705 - DNA, 75 bp, Artificial Sequence
  Synthetic
cttttgtctgaaaatgcataccttaagtatgctaaagttgaaagtcaggacgggtttgttaccattgagttgcaa

SEQ ID NO: 247706 - DNA, 75 bp, Artificial Sequence
  Synthetic
gtcctaagggtcctgagatccgatatctctattttgttaaaaatctcaacaaccttcatagaggtcagcttttag

SEQ ID NO: 247707 - DNA, 75 bp, Artificial Sequence
  Synthetic
tctctattttgttaaaaatctcaacaaccttcatagaggtcagcttttaggtcatattgctgccactgttaaatt

SEQ ID NO: 247708 - DNA, 75 bp, Artificial Sequence
  Synthetic
gcttctaattcatcagtgttgtctcttgttaccttcactgttgaccctaagaaagcttacatggattttgttaac

SEQ ID NO: 247709 - DNA, 75 bp, Artificial Sequence
  Synthetic
ttgttaccttcactgttgaccctaagaaagcttacatggattttgttaacgctggcggtgccccgttaactaact

SEQ ID NO: 247710 - DNA, 75 bp, Artificial Sequence
  Synthetic
tggtacgggtattgcgatatctgtcaagcctgagagtaatgcagatcaagaaacttacggtggtgcttcagtatg

SEQ ID NO: 247711 - DNA, 75 bp, Artificial Sequence
  Synthetic
aagcctgagagtaatgcagatcaagaaacttacggtggtgcttcagtatgtctttattgccgtgcgcatatagag

SEQ ID NO: 247712 - DNA, 75 bp, Artificial Sequence
  Synthetic
agtttaagggtagatttgtacagatcccgtcgcaatgtactcgcgaccctgttggtttctgtttgacaaatgacc

SEQ ID NO: 247713 - DNA, 75 bp, Artificial Sequence
  Synthetic
cccgtcgcaatgtactcgcgaccctgttggtttctgtttgacaaatgacccatgcccactttgtcaatattggaa

SEQ ID NO: 247714 - DNA, 75 bp, Artificial Sequence
  Synthetic
cttagagaagcagcgctcccacaatccaaggattccaattttttaaacgagtccggggttctattgtaaatgccc

SEQ ID NO: 247715 - DNA, 75 bp, Artificial Sequence
  Synthetic
aaggagcagcgtgtgcaaggtagcatcactcagcgcactcgcacccgtccaagtgttcagcctggtccaatgatt

SEQ ID NO: 247716 - DNA, 75 bp, Artificial Sequence
  Synthetic
ccaaggattccaattttttaaacgagtccggggttctattgtaaatgcccgaatagaaccctgtgctagtggact

SEQ ID NO: 247717 - DNA, 75 bp, Artificial Sequence
  Synthetic
tttgacatctgcaactacaaggctaaagttgctggtatagggaaatactacaagactaatacttgtaggtttgtt

SEQ ID NO: 247718 - DNA, 75 bp, Artificial Sequence
  Synthetic
aagttgctggtatagggaaatactacaagactaatacttgtaggtttgttgagaaggatgaccaaggtcaccagt

SEQ ID NO: 247719 - DNA, 75 bp, Artificial Sequence
  Synthetic
ccacactatggagaattatgaacttgagaagaagtgctatgatcttcttaaagactgtgatgctgttgcgcgtca

SEQ ID NO: 247720 - DNA, 75 bp, Artificial Sequence
  Synthetic
gagaagaagtgctatgatcttcttaaagactgtgatgctgttgcgcgtcatgacttctttgtgtttgacgttgat

SEQ ID NO: 247721 - DNA, 75 bp, Artificial Sequence
  Synthetic
gtcaaaggcttactgagtatactatgatggatcttgtctatgcattacggcacttcgatcagaataactgcgaag

SEQ ID NO: 247722 - DNA, 75 bp, Artificial Sequence
  Synthetic
gatggatcttgtctatgcattacggcacttcgatcagaataactgcgaagtgcttaaaagcatacttgttaagta

SEQ ID NO: 247723 - DNA, 75 bp, Artificial Sequence
  Synthetic
gataataaactctggtttgattttgttgaaaatccagggattattggtgtttatcacaagcttggcgagcgtatt

SEQ ID NO: 247724 - DNA, 75 bp, Artificial Sequence
  Synthetic
ttgaaaatccagggattattggtgtttatcacaagcttggcgagcgtattcgcaaagctgttttaaacactgtaa

SEQ ID NO: 247725 - DNA, 75 bp, Artificial Sequence
  Synthetic
aggtcttgtaggagttctaacactcgacaatcaagacttaaacggcctctggtatgattttggtgattttgttat

SEQ ID NO: 247726 - DNA, 75 bp, Artificial Sequence
  Synthetic
gacaatcaagacttaaacggcctctggtatgattttggtgattttgttatcacacaacctggttctggagtagct

SEQ ID NO: 247727 - DNA, 75 bp, Artificial Sequence
  Synthetic
tgatgcctgtgttgtcgatgactgactgtttagcagctgaaacacacagggattgtgatcttaataaaccgctca

SEQ ID NO: 247728 - DNA, 75 bp, Artificial Sequence
  Synthetic
ctgtttagcagctgaaacacacagggattgtgatcttaataaaccgctcattgagtggcctcttactgagtatga

SEQ ID NO: 247729 - DNA, 75 bp, Artificial Sequence
  Synthetic
ctatggattacgtgtctctgcttaatcaaatttggcagaagtaccttaattcaccgtatactacttgtttgtata

SEQ ID NO: 247730 - DNA, 75 bp, Artificial Sequence
  Synthetic
tttgagaagtactttaagcactgggatcagccataccatgctaattgtgtggcgtgtgctgatgatcgttgtgtt

SEQ ID NO: 247731 - DNA, 75 bp, Artificial Sequence
  Synthetic
atcagccataccatgctaattgtgtggcgtgtgctgatgatcgttgtgttttacattgtgctaatttcaatgtac

SEQ ID NO: 247732 - DNA, 75 bp, Artificial Sequence
  Synthetic
atgcttcggaccgattgtccgtaagatttttgtcgatggtgttccttttgtagtatcctgtggttaccactacaa

SEQ ID NO: 247733 - DNA, 75 bp, Artificial Sequence
  Synthetic
atttttgtcgatggtgttccttttgtagtatcctgtggttaccactacaaggaattaggtttggtcatgaatatg

SEQ ID NO: 247734 - DNA, 75 bp, Artificial Sequence
  Synthetic
tgtctcttaaggagttaatgatgtatgcagcagatcctgctatgcacattgcctcctctaatgctttattagatt

SEQ ID NO: 247735 - DNA, 75 bp, Artificial Sequence
  Synthetic
tgcagcagatcctgctatgcacattgcctcctctaatgctttattagatttgaggacatcatgttttagtgtcgc

SEQ ID NO: 247736 - DNA, 75 bp, Artificial Sequence
  Synthetic
cagactgtgcggcccggcaactttaatcaagacttctatgactttgtagtgtcaaagggcttctttaaggagggt

SEQ ID NO: 247737 - DNA, 75 bp, Artificial Sequence
  Synthetic
atcaagacttctatgactttgtagtgtcaaagggcttctttaaggagggttcatctgtgactcttaaacattttt

SEQ ID NO: 247738 - DNA, 75 bp, Artificial Sequence
  Synthetic
tattacagattataactattattcttataatctgcctactatgtgtgacatcaagcagatgttattctgtatgga

SEQ ID NO: 247739 - DNA, 75 bp, Artificial Sequence
  Synthetic
tataatctgcctactatgtgtgacatcaagcagatgttattctgtatggaggttgttaacaaatacttcgaaatc

SEQ ID NO: 247740 - DNA, 75 bp, Artificial Sequence
  Synthetic
ccgaagttgtagttaacaatttagataaaagcgctggctatccttttaacaagtttggtaaggcccgcgtttatt

SEQ ID NO: 247741 - DNA, 75 bp, Artificial Sequence
  Synthetic
taaaagcgctggctatccttttaacaagtttggtaaggcccgcgtttattatgagagtatgtcatatcaggagca

SEQ ID NO: 247742 - DNA, 75 bp, Artificial Sequence
  Synthetic
cgcaacgtcattcctaccattactcagatgaatttaaaatatgctattagtgctaaaaatcgtgctcgcactgtt

SEQ ID NO: 247743 - DNA, 75 bp, Artificial Sequence
  Synthetic
agatgaatttaaaatatgctattagtgctaaaaatcgtgctcgcactgttgcaggcgtctctattcttagcacca

SEQ ID NO: 247744 - DNA, 75 bp, Artificial Sequence
  Synthetic
gatgctcaagtctatggctgccactcgtggcgccacttgtgtcatagggactactaagttctatggtggttggga

SEQ ID NO: 247745 - DNA, 75 bp, Artificial Sequence
  Synthetic
cgtggcgccacttgtgtcatagggactactaagttctatggtggttgggattttatgttaaggacattgtacaaa

SEQ ID NO: 247746 - DNA, 75 bp, Artificial Sequence
  Synthetic
gttgggattaccctaagtgtgatcgtgctatgcctaacatgtgtaggatttttgcatctctgattttggcacgca

SEQ ID NO: 247747 - DNA, 75 bp, Artificial Sequence
  Synthetic
tgctatgcctaacatgtgtaggatttttgcatctctgattttggcacgcaaacatggcacttgctgcactaccag

SEQ ID NO: 247748 - DNA, 75 bp, Artificial Sequence
  Synthetic
gagtgcgctcaggttttaagtgagtatgtgttatgcggtggtggctactacgtcaagccaggaggtacgagtagt

SEQ ID NO: 247749 - DNA, 75 bp, Artificial Sequence
  Synthetic
atgtgttatgcggtggtggctactacgtcaagccaggaggtacgagtagtggtgatgccacaaccgcatatgcca

SEQ ID NO: 247750 - DNA, 75 bp, Artificial Sequence
  Synthetic
gacaactgctaatgtgagcgcacttatgggtgctaatggcaacaagattgttgataaagaaattagagacatgca

SEQ ID NO: 247751 - DNA, 75 bp, Artificial Sequence
  Synthetic
atgggtgctaatggcaacaagattgttgataaagaaattagagacatgcagtttgatctgtatgttaatgtttat

SEQ ID NO: 247752 - DNA, 75 bp, Artificial Sequence
  Synthetic
ttgttgacaggtactatgcatttcttaataagaatttctctatgatgatactgtcagacgacggtgttgtttgct

SEQ ID NO: 247753 - DNA, 75 bp, Artificial Sequence
  Synthetic
taataagaatttctctatgatgatactgtcagacgacggtgttgtttgctataacagtgattatgcagctaaagg

SEQ ID NO: 247754 - DNA, 75 bp, Artificial Sequence
  Synthetic
aaggaaactctgtactaccagaacaacgtatttatgtctgaagctaaatgctgggtggagccggatttgaaaaag

SEQ ID NO: 247755 - DNA, 75 bp, Artificial Sequence
  Synthetic
acgtatttatgtctgaagctaaatgctgggtggagccggatttgaaaaagggcccccatgaattttgttctcagc

SEQ ID NO: 247756 - DNA, 75 bp, Artificial Sequence
  Synthetic
agagaatgttaaagactgtcacctctgcgtgattgcaagtgaacagtgccccctgggaagagctctacagtgtga

SEQ ID NO: 247757 - DNA, 75 bp, Artificial Sequence
  Synthetic
cgacggttacttcctgccttatccagacccttctagaattttgtctgccggttgctttgtagatgatatcgtcaa

SEQ ID NO: 247758 - DNA, 75 bp, Artificial Sequence
  Synthetic
gacccttctagaattttgtctgccggttgctttgtagatgatatcgtcaagactgacggtacactcatggttgag

SEQ ID NO: 247759 - DNA, 75 bp, Artificial Sequence
  Synthetic
cttaccctctcacaaagcatgaagatttagaataccaaaatgtattctgggtctatttacagtatatagaaaaac

SEQ ID NO: 247760 - DNA, 75 bp, Artificial Sequence
  Synthetic
tttagaataccaaaatgtattctgggtctatttacagtatatagaaaaactgtataaggaccttacagggcacat

SEQ ID NO: 247761 - DNA, 75 bp, Artificial Sequence
  Synthetic
tgtggcgataattctgctaagttttgggaagagagcttctatagagaactctatgaagctcctacaactttgcaa

SEQ ID NO: 247762 - DNA, 75 bp, Artificial Sequence
  Synthetic
gggaagagagcttctatagagaactctatgaagctcctacaactttgcaagccgttggttcttgtgtggtgtgtc

SEQ ID NO: 247763 - DNA, 75 bp, Artificial Sequence
  Synthetic
cacgtgcatacgtagacctttcctttgctgcaagtgttgttatgaccacgttatagcaactcctcataagatggt

SEQ ID NO: 247764 - DNA, 75 bp, Artificial Sequence
  Synthetic
tgctgcaagtgttgttatgaccacgttatagcaactcctcataagatggttctgtctgtttctccatatgtctgc

SEQ ID NO: 247765 - DNA, 75 bp, Artificial Sequence
  Synthetic
atgttactaagctgtacctgggtggtatgagctacttttgtgtagatcatagacctgtgtgtagctttccgttat

SEQ ID NO: 247766 - DNA, 75 bp, Artificial Sequence
  Synthetic
tatgagctacttttgtgtagatcatagacctgtgtgtagctttccgttatgcgccaatggcttagtctttggtct

SEQ ID NO: 247767 - DNA, 75 bp, Artificial Sequence
  Synthetic
ccatctgtagtcgagtttaacaggttggctacttgtgactggactgagagcggcgactacacgcttgctaatact

SEQ ID NO: 247768 - DNA, 75 bp, Artificial Sequence
  Synthetic
tggctacttgtgactggactgagagcggcgactacacgcttgctaatactacaacagaaccccttaaactatttg

SEQ ID NO: 247769 - DNA, 75 bp, Artificial Sequence
  Synthetic
ggaggcgtctaagcagtcttatgcaatcgccacgatcaaagagattgttggtgaacgtgaacttattcttgtgtg

SEQ ID NO: 247770 - DNA, 75 bp, Artificial Sequence
  Synthetic
gttcttacctctcactcagtggcaaccctgacggcgccaacaatagtgaatcaagagaggtatgtaaaaataact

SEQ ID NO: 247771 - DNA, 75 bp, Artificial Sequence
  Synthetic
ccctgacggcgccaacaatagtgaatcaagagaggtatgtaaaaataactggattgtatccaactattactgtgc

SEQ ID NO: 247772 - DNA, 75 bp, Artificial Sequence
  Synthetic
taacttccaaaaagcaggttatagtaagtatgttaccgtgcagggaccacctggcactggtaagagtcactttgc

SEQ ID NO: 247773 - DNA, 75 bp, Artificial Sequence
  Synthetic
aagtatgttaccgtgcagggaccacctggcactggtaagagtcactttgctatagggttggcgatatactaccct

SEQ ID NO: 247774 - DNA, 75 bp, Artificial Sequence
  Synthetic
gttcgcatgctgctgttgatgcattatgcgaaaaagcttttaagtatttgaacattggtaaatgttctcgtatta

SEQ ID NO: 247775 - DNA, 75 bp, Artificial Sequence
  Synthetic
atgcgaaaaagcttttaagtatttgaacattggtaaatgttctcgtattatacctgccaaagcacgtgtagagtg

SEQ ID NO: 247776 - DNA, 75 bp, Artificial Sequence
  Synthetic
acaaattctcagtatttgtttagtactattaatgcattaccagaaacatctgctgatattctggttgttgatgaa

SEQ ID NO: 247777 - DNA, 75 bp, Artificial Sequence
  Synthetic
ctattaatgcattaccagaaacatctgctgatattctggttgttgatgaagttagtatgtgcactaattatgatc

SEQ ID NO: 247778 - DNA, 75 bp, Artificial Sequence
  Synthetic
agctaaacacatagtctatgtaggtgaccctgcacagttgccggcacctaggactttgttgactaggggcacgtt

SEQ ID NO: 247779 - DNA, 75 bp, Artificial Sequence
  Synthetic
gaccctgcacagttgccggcacctaggactttgttgactaggggcacgttggaacccgaaaatttcaatagtgtc

SEQ ID NO: 247780 - DNA, 75 bp, Artificial Sequence
  Synthetic
ctgacatattcttgagtatgtgctacaggtgccctagagaaattgttaacactgttagtgcccttgtctacaaca

SEQ ID NO: 247781 - DNA, 75 bp, Artificial Sequence
  Synthetic
caggtgccctagagaaattgttaacactgttagtgcccttgtctacaacaataaattgttggcaaagaaggagcc

SEQ ID NO: 247782 - DNA, 75 bp, Artificial Sequence
  Synthetic
tataaaggcagtgttacgcatgatgctagctctgccattaatagacctcaattaacttttgtcaagagtttcata

SEQ ID NO: 247783 - DNA, 75 bp, Artificial Sequence
  Synthetic
ctagctctgccattaatagacctcaattaacttttgtcaagagtttcatagctgccaaccccgcttggagtaagg

SEQ ID NO: 247784 - DNA, 75 bp, Artificial Sequence
  Synthetic
acagaatgctgtggctcgttctatgctcggtttgtccactcagaccgtagattcttcgcagggttctgagtaccc

SEQ ID NO: 247785 - DNA, 75 bp, Artificial Sequence
  Synthetic
ctcggtttgtccactcagaccgtagattcttcgcagggttctgagtacccttatgtcatcttctgccagacagca

SEQ ID NO: 247786 - DNA, 75 bp, Artificial Sequence
  Synthetic
ataagactggcgactttatgtctacaattattacttcctgccaaactgctgttagtaagcttctagatacatgtt

SEQ ID NO: 247787 - DNA, 75 bp, Artificial Sequence
  Synthetic
ataggtttaatgttgctgtgactcgagcacagaagggtattctttgtgttatgacttcgcagtcgctgtttgaat

SEQ ID NO: 247788 - DNA, 75 bp, Artificial Sequence
  Synthetic
agcacagaagggtattctttgtgttatgacttcgcagtcgctgtttgaatctttacagtttgctgagttgtctac

SEQ ID NO: 247789 - DNA, 75 bp, Artificial Sequence
  Synthetic
attgtaactggtttgtttaaagattgctccagagaaccgtctggattgcctcctgcttatgcaccaacatatgtt

SEQ ID NO: 247790 - DNA, 75 bp, Artificial Sequence
  Synthetic
gctccagagaaccgtctggattgcctcctgcttatgcaccaacatatgttagtgttgatgataagtataagacta

SEQ ID NO: 247791 - DNA, 75 bp, Artificial Sequence
  Synthetic
tcttcccgcaaatgttccttattcgcgtgttatatcaaggatggggtttaagcttgatgcgacaatccctggtta

SEQ ID NO: 247792 - DNA, 75 bp, Artificial Sequence
  Synthetic
cgtgttatatcaaggatggggtttaagcttgatgcgacaatccctggttatccgaagctcttcataactcgtgag

SEQ ID NO: 247793 - DNA, 75 bp, Artificial Sequence
  Synthetic
ggattggctttgatgttgagggtgcacatgcgtcgcgtaacgcatgcggtaccaatgtgcctttgcagttgggat

SEQ ID NO: 247794 - DNA, 75 bp, Artificial Sequence
  Synthetic
acatgcgtcgcgtaacgcatgcggtaccaatgtgcctttgcagttgggattctctactggcgtgaacttcgttgt

SEQ ID NO: 247795 - DNA, 75 bp, Artificial Sequence
  Synthetic
gagtgggggaatatgttaactggcattgctgctaggccccctccaggtgaacaatttaagcatttagtccccctc

SEQ ID NO: 247796 - DNA, 75 bp, Artificial Sequence
  Synthetic
ttgctgctaggccccctccaggtgaacaatttaagcatttagtccccctcatgcataaaggggcggcatggccaa

SEQ ID NO: 247797 - DNA, 75 bp, Artificial Sequence
  Synthetic
gctatctgacactttggataagctttctgattattgtacgtttgtttgttgggcccatggttttgagcttacatc

SEQ ID NO: 247798 - DNA, 75 bp, Artificial Sequence
  Synthetic
tctgattattgtacgtttgtttgttgggcccatggttttgagcttacatctgcatcttacttttgtaagataggt

SEQ ID NO: 247799 - DNA, 75 bp, Artificial Sequence
  Synthetic
atagacgcgctggtgcttattcttcccctctgcaatcgtatgcctgttgggcacactcttgcgggtatgattatg

SEQ ID NO: 247800 - DNA, 75 bp, Artificial Sequence
  Synthetic
ccctctgcaatcgtatgcctgttgggcacactcttgcgggtatgattatgtctacaacccattctttgttgatgt

SEQ ID NO: 247801 - DNA, 75 bp, Artificial Sequence
  Synthetic
cttactaccaaccatgatcgttattgttcggtacaccagggagcccatgttgcatctggtgacgcaataatgact

SEQ ID NO: 247802 - DNA, 75 bp, Artificial Sequence
  Synthetic
gttcggtacaccagggagcccatgttgcatctggtgacgcaataatgactcgttgtttagctattcatgcttgtt

SEQ ID NO: 247803 - DNA, 75 bp, Artificial Sequence
  Synthetic
agagtacccttacatctcccatgaaaagaaattgaattcctgttgtaggattgtcgagcgcaatgtagtgcgtgc

SEQ ID NO: 247804 - DNA, 75 bp, Artificial Sequence
  Synthetic
aagaaattgaattcctgttgtaggattgtcgagcgcaatgtagtgcgtgctgcattacttgctggcgcatttgaa

SEQ ID NO: 247805 - DNA, 75 bp, Artificial Sequence
  Synthetic
agggaattcctattgttgatgaccctgcggtcgactggcattattatgatgctcagcccttgcgtaagaatgtac

SEQ ID NO: 247806 - DNA, 75 bp, Artificial Sequence
  Synthetic
tgcggtcgactggcattattatgatgctcagcccttgcgtaagaatgtacaacagcttttctacacagaggacat

SEQ ID NO: 247807 - DNA, 75 bp, Artificial Sequence
  Synthetic
tgcttgttctggaactgtaatgttccacgttaccctaataatgccattgtttgtaggtttgatactcgtgtgcac

SEQ ID NO: 247808 - DNA, 75 bp, Artificial Sequence
  Synthetic
cacgttaccctaataatgccattgtttgtaggtttgatactcgtgtgcactctgagttcaatttgccaggttgtg

SEQ ID NO: 247809 - DNA, 75 bp, Artificial Sequence
  Synthetic
gcacgcctttcacacaccagcttatgatgtgagtgcatttagagatctgaaacctttaccattcttctattattc

SEQ ID NO: 247810 - DNA, 75 bp, Artificial Sequence
  Synthetic
gatgtgagtgcatttagagatctgaaacctttaccattcttctattattctaccacaccatgtgaagtgcatggt

SEQ ID NO: 247811 - DNA, 75 bp, Artificial Sequence
  Synthetic
attatgtacccctcaagtcagctgtctgtgtgacagcatgtaaccttggtggggctgtttgtagaaaacatgctg

SEQ ID NO: 247812 - DNA, 75 bp, Artificial Sequence
  Synthetic
ctgtgtgacagcatgtaaccttggtggggctgtttgtagaaaacatgctgcagaatatagggattatatggaagc

SEQ ID NO: 247813 - DNA, 75 bp, Artificial Sequence
  Synthetic
ttccgcttatggtgttataagacctttgatatttataatctttggtctacctttactaaggttcaaggtcttgag

SEQ ID NO: 247814 - DNA, 75 bp, Artificial Sequence
  Synthetic
ttgatatttataatctttggtctacctttactaaggttcaaggtcttgagaacatcgcttataatgttgttaaac

SEQ ID NO: 247815 - DNA, 75 bp, Artificial Sequence
  Synthetic
tgaactgcctgtagcggtagtcaatgacaagatcttcaccaagagtggtgtcaatgacatttgtgtcttcgagaa

SEQ ID NO: 247816 - DNA, 75 bp, Artificial Sequence
  Synthetic
gacaagatcttcaccaagagtggtgtcaatgacatttgtgtcttcgagaataagacatctctgcctactaatata

SEQ ID NO: 247817 - DNA, 75 bp, Artificial Sequence
  Synthetic
ctgttcgctcgcatcctgatttcaaattgctccataatttacaagctgacatatgttacaagttcgtcctttggg

SEQ ID NO: 247818 - DNA, 75 bp, Artificial Sequence
  Synthetic
attgctccataatttacaagctgacatatgttacaagttcgtcctttgggattatgagcgtagtaacatttatgg

SEQ ID NO: 247819 - DNA, 75 bp, Artificial Sequence
  Synthetic
tacaccgatattgatgtcaatgcagctttgaatgtctgctttgacattcgtgataatggttcattagaggtgttc

SEQ ID NO: 247820 - DNA, 75 bp, Artificial Sequence
  Synthetic
ctttgaatgtctgctttgacattcgtgataatggttcattagaggtgttcatgaacacacctaatgctatattaa

SEQ ID NO: 247821 - DNA, 75 bp, Artificial Sequence
  Synthetic
cccatgtatggttggtcctgattatgcttacttcaatggagccatcattcgtgatggtaatgctaagcagccagt

SEQ ID NO: 247822 - DNA, 75 bp, Artificial Sequence
  Synthetic
gcttacttcaatggagccatcattcgtgatggtaatgctaagcagccagtgaagttttatatatataaaagggtt

SEQ ID NO: 247823 - DNA, 75 bp, Artificial Sequence
  Synthetic
gttccttctacacccaaggacgctcaaatgaagattttgcgccgatgtccgatatggagaaggactttctttctt

SEQ ID NO: 247824 - DNA, 75 bp, Artificial Sequence
  Synthetic
aaatgaagattttgcgccgatgtccgatatggagaaggactttctttctttggaaagcgatgttttcattaagaa

SEQ ID NO: 247825 - DNA, 75 bp, Artificial Sequence
  Synthetic
gaacatgtagtttatggtgatttttcacatactacattgggtggtctacacttgcttattggcttacacaagaag

SEQ ID NO: 247826 - DNA, 75 bp, Artificial Sequence
  Synthetic
cacatactacattgggtggtctacacttgcttattggcttacacaagaagtcagtggaaggtcatattattatgg

SEQ ID NO: 247827 - DNA, 75 bp, Artificial Sequence
  Synthetic
tatccataactattttattactgaaactaacacagcgtcttttaaggcggtgtgttctgttatagatttaaagct

SEQ ID NO: 247828 - DNA, 75 bp, Artificial Sequence
  Synthetic
actaacacagcgtcttttaaggcggtgtgttctgttatagatttaaagcttgacgactttgtagaaataataaag

SEQ ID NO: 247829 - DNA, 75 bp, Artificial Sequence
  Synthetic
aggttgtcaaggtccctattgatttaactttggttgaatttatgttgtggtgcaaggatggccaagttcaaactt

SEQ ID NO: 247830 - DNA, 75 bp, Artificial Sequence
  Synthetic
aactttggttgaatttatgttgtggtgcaaggatggccaagttcaaactttctatcctagactacaggcttccaa

SEQ ID NO: 247831 - DNA, 75 bp, Artificial Sequence
  Synthetic
ccttcactctttaaagttcaaaatgtaaatcttgaaccctgtcagcttgctaattacaagcagtcaatacccatg

SEQ ID NO: 247832 - DNA, 75 bp, Artificial Sequence
  Synthetic
taaatcttgaaccctgtcagcttgctaattacaagcagtcaatacccatgccacggggtgttcacatgaacgtgg

SEQ ID NO: 247833 - DNA, 75 bp, Artificial Sequence
  Synthetic
tttgaatacgtgctcaattgctgtacctgccaatatgcgtgtcatgcattttggtgctggttccgataagggtat

SEQ ID NO: 247834 - DNA, 75 bp, Artificial Sequence
  Synthetic
cctgccaatatgcgtgtcatgcattttggtgctggttccgataagggtattgctcccggtacctctgttttaagg

SEQ ID NO: 247835 - DNA, 75 bp, Artificial Sequence
  Synthetic
ttattgataatgacctgaacgagtatgtgtcagatgctgacattagcttgtttggtgattgtgtgactgtacgtg

SEQ ID NO: 247836 - DNA, 75 bp, Artificial Sequence
  Synthetic
tgtgtcagatgctgacattagcttgtttggtgattgtgtgactgtacgtgtcgggcaacaagtcgatcttgttat

SEQ ID NO: 247837 - DNA, 75 bp, Artificial Sequence
  Synthetic
aagaatgtcaagggtactaatgaagctaaggccttattctttacttacctttgtaattttattaataataatctt

SEQ ID NO: 247838 - DNA, 75 bp, Artificial Sequence
  Synthetic
ctaaggccttattctttacttacctttgtaattttattaataataatcttgctctcggcggcactgttgcaatta

SEQ ID NO: 247839 - DNA, 75 bp, Artificial Sequence
  Synthetic
tgatctttatgagttgatgggaaaatttgcttggtggactgttttctgcaccaatgccaatgcatcctcttctga

SEQ ID NO: 247840 - DNA, 75 bp, Artificial Sequence
  Synthetic
tttgcttggtggactgttttctgcaccaatgccaatgcatcctcttctgaaggatttctcatcggtgttaattac

SEQ ID NO: 247841 - DNA, 75 bp, Artificial Sequence
  Synthetic
atggcaacgccatgcacgctaattatatattctggagaaattccactcctatgaatttgagtacttactcacttt

SEQ ID NO: 247842 - DNA, 75 bp, Artificial Sequence
  Synthetic
tatattctggagaaattccactcctatgaatttgagtacttactcactttttgatctatccaagttttcaataaa

SEQ ID NO: 247843 - DNA, 75 bp, Artificial Sequence
  Synthetic
ttaaaagagggtcagattaacgaactcgttatatcactcttgtcgcaaggaaagttacttatacgcgacaatgac

SEQ ID NO: 247844 - DNA, 75 bp, Artificial Sequence
  Synthetic
tcgttatatcactcttgtcgcaaggaaagttacttatacgcgacaatgacccgcttaatgtttctactgatgtgc

SEQ ID NO: 247845 - DNA, 75 bp, Artificial Sequence
  Synthetic
ttgatcctggtctcccttccaattcctcttcttgtatggaagttgacatgcgtcctgagtttttcaacaagaatt

SEQ ID NO: 247846 - DNA, 75 bp, Artificial Sequence
  Synthetic
ctcttcttgtatggaagttgacatgcgtcctgagtttttcaacaagaattggcccatgcctatcgacgctcttaa

SEQ ID NO: 247847 - DNA, 75 bp, Artificial Sequence
  Synthetic
gggcgttcttattctaacatatcacttgcataccagggtctttttcccaagcagggagaccttgggcagcagtat

SEQ ID NO: 247848 - DNA, 75 bp, Artificial Sequence
  Synthetic
ttgcataccagggtctttttcccaagcagggagaccttgggcagcagtatgtctattctgtggcacatgctgatg

SEQ ID NO: 247849 - DNA, 75 bp, Artificial Sequence
  Synthetic
cctgggcaaactttttgtttccgactatgccactaaagctgaaacatttggtgatggctttgttgttcgtatcgg

SEQ ID NO: 247850 - DNA, 75 bp, Artificial Sequence
  Synthetic
tatgccactaaagctgaaacatttggtgatggctttgttgttcgtatcggtgctgcttctaactccactggctct

SEQ ID NO: 247851 - DNA, 75 bp, Artificial Sequence
  Synthetic
ccatcaagaaaatttacccagctttcatgcttggaactgctgtgggcaacttttctaatggtgtgtttgggctct

SEQ ID NO: 247852 - DNA, 75 bp, Artificial Sequence
  Synthetic
catgcttggaactgctgtgggcaacttttctaatggtgtgtttgggctctatttgaatcatactttagtgatttt

SEQ ID NO: 247853 - DNA, 75 bp, Artificial Sequence
  Synthetic
tgggtcttctattgtgtgcttgagccgcgcaacggtactaagtgccccaataatggtgattatgttacatacgcc

SEQ ID NO: 247854 - DNA, 75 bp, Artificial Sequence
  Synthetic
cgcgcaacggtactaagtgccccaataatggtgattatgttacatacgccacatgggacactccctatattgatt

SEQ ID NO: 247855 - DNA, 75 bp, Artificial Sequence
  Synthetic
tgcctcccttaattcttttaaggagtactttaacttacaccagtgtaagtttatgacttcatataatattactga

SEQ ID NO: 247856 - DNA, 75 bp, Artificial Sequence
  Synthetic
tactttaacttacaccagtgtaagtttatgacttcatataatattactgaagatgagcacgacgagtggtttggt

SEQ ID NO: 247857 - DNA, 75 bp, Artificial Sequence
  Synthetic
acctttattcttctagaaaaggtgacttgtacggcggcaacatgttcctctttgctacattaccagtgtatgaaa

SEQ ID NO: 247858 - DNA, 75 bp, Artificial Sequence
  Synthetic
cttgtacggcggcaacatgttcctctttgctacattaccagtgtatgaaactcttaagtattacactgttatacc

SEQ ID NO: 247859 - DNA, 75 bp, Artificial Sequence
  Synthetic
gagcgcgaggcctgggctgctttttatgtgtataagcttcatagtctgacttacttgttagatttttcagtcgat

SEQ ID NO: 247860 - DNA, 75 bp, Artificial Sequence
  Synthetic
atgtgtataagcttcatagtctgacttacttgttagatttttcagtcgatggctatatacgtagggcaatagact

SEQ ID NO: 247861 - DNA, 75 bp, Artificial Sequence
  Synthetic
tcgttgctcttatgagtcttttgatgtagatactggagtctactcagtttcttcattcgaagctcagccgcgtgg

SEQ ID NO: 247862 - DNA, 75 bp, Artificial Sequence
  Synthetic
gtagatactggagtctactcagtttcttcattcgaagctcagccgcgtggttcatttattgagcaagctcaaggc

SEQ ID NO: 247863 - DNA, 75 bp, Artificial Sequence
  Synthetic
tcaaagatgaaccacctcaggtttataattttagtaggttggtttttaccaactgcaactataacttaacaaaac

SEQ ID NO: 247864 - DNA, 75 bp, Artificial Sequence
  Synthetic
taattttagtaggttggtttttaccaactgcaactataacttaacaaaactactcgccttgtttcaggtgagtca

SEQ ID NO: 247865 - DNA, 75 bp, Artificial Sequence
  Synthetic
agtgcactagcatctggctgctactcttctcttactgtagactactttgcataccctacgtatatgtcttcgtat

SEQ ID NO: 247866 - DNA, 75 bp, Artificial Sequence
  Synthetic
cttctcttactgtagactactttgcataccctacgtatatgtcttcgtatctacagcagggttcaactggtgaaa

SEQ ID NO: 247867 - DNA, 75 bp, Artificial Sequence
  Synthetic
ttttagtaatcctacttgtaggatactcgctactgtgcctgctaatcttagtgcttctgggctcttacccaaacc

SEQ ID NO: 247868 - DNA, 75 bp, Artificial Sequence
  Synthetic
ctcgctactgtgcctgctaatcttagtgcttctgggctcttacccaaacctagtaattatgtttggttgtctgag

SEQ ID NO: 247869 - DNA, 75 bp, Artificial Sequence
  Synthetic
aaaattttcagtatgttaaggctggccaatacactccttgtcttggccttgccgctaatggatttgagaagagct

SEQ ID NO: 247870 - DNA, 75 bp, Artificial Sequence
  Synthetic
ccaatacactccttgtcttggccttgccgctaatggatttgagaagagctatcaaacccatcgcgaccctgtgtc

SEQ ID NO: 247871 - DNA, 75 bp, Artificial Sequence
  Synthetic
acacctatgacatcagctctccagatggcttttatcatttcagtgcaatatggcactgactctaatagcgtttgc

SEQ ID NO: 247872 - DNA, 75 bp, Artificial Sequence
  Synthetic
tggcttttatcatttcagtgcaatatggcactgactctaatagcgtttgccccatgcaagctgttcgtaatgaca

SEQ ID NO: 247873 - DNA, 75 bp, Artificial Sequence
  Synthetic
gtgtattgattactccctctatggcattactgggagaggcgtttttcagaattgcactgctgttggtattaggca

SEQ ID NO: 247874 - DNA, 75 bp, Artificial Sequence
  Synthetic
attactgggagaggcgtttttcagaattgcactgctgttggtattaggcagcagcgctttgtttatgatagtttt

SEQ ID NO: 247875 - DNA, 75 bp, Artificial Sequence
  Synthetic
ataatggtaactactattgtgtccgcccctgtgtgagtgtgcctgtttctgttgtttttgacaggtccactaata

SEQ ID NO: 247876 - DNA, 75 bp, Artificial Sequence
  Synthetic
cccctgtgtgagtgtgcctgtttctgttgtttttgacaggtccactaatactcatgcaaccttgtttggcagtgt

SEQ ID NO: 247877 - DNA, 75 bp, Artificial Sequence
  Synthetic
atgcaacaattttcacgtatgacacagtcccgactgcgcatgcgtatttctgatgattctggtcctttgcaaaca

SEQ ID NO: 247878 - DNA, 75 bp, Artificial Sequence
  Synthetic
agtcccgactgcgcatgcgtatttctgatgattctggtcctttgcaaacagccgtgggttgtgccatcggtcttg

SEQ ID NO: 247879 - DNA, 75 bp, Artificial Sequence
  Synthetic
ttgtcgacttcctcttggtcaatcgctctgtgctgtcccctctcctaatatacgtgttgtgagtggtgacccaca

SEQ ID NO: 247880 - DNA, 75 bp, Artificial Sequence
  Synthetic
ctctgtgctgtcccctctcctaatatacgtgttgtgagtggtgacccacaacctatgcaacttgctactatcaat

SEQ ID NO: 247881 - DNA, 75 bp, Artificial Sequence
  Synthetic
ctctcaactctagtggctttgttgttgaaattcccaccaatttttcgtttggtgttacacaggagtacattcaga

SEQ ID NO: 247882 - DNA, 75 bp, Artificial Sequence
  Synthetic
tgaaattcccaccaatttttcgtttggtgttacacaggagtacattcagacgaccattcagaaggttactgttga

SEQ ID NO: 247883 - DNA, 75 bp, Artificial Sequence
  Synthetic
ttcgctaagtgcgaacaactgctccgagaatatgggcagttttgtgctaaaataaaccaagctttgcatggtgct

SEQ ID NO: 247884 - DNA, 75 bp, Artificial Sequence
  Synthetic
gagaatatgggcagttttgtgctaaaataaaccaagctttgcatggtgctaatcttaggcaggatgaatccattg

SEQ ID NO: 247885 - DNA, 75 bp, Artificial Sequence
  Synthetic
agaggccacccaaccacttgatgctggtttgaatggcgactttaatttgacacttttgcaagtacccaaagttgt

SEQ ID NO: 247886 - DNA, 75 bp, Artificial Sequence
  Synthetic
ggtttgaatggcgactttaatttgacacttttgcaagtacccaaagttgttaccagtgagtacagctacaggagt

SEQ ID NO: 247887 - DNA, 75 bp, Artificial Sequence
  Synthetic
aggtcactattgctgaccctggttacatgcaaggttatgatgagtgcatgaagcaaggacccccttctgctaggg

SEQ ID NO: 247888 - DNA, 75 bp, Artificial Sequence
  Synthetic
catgcaaggttatgatgagtgcatgaagcaaggacccccttctgctagggacctcatttgtgcgcagtttgtagc

SEQ ID NO: 247889 - DNA, 75 bp, Artificial Sequence
  Synthetic
tatgaccctaacatggaagctgcatacacttcctctcttgttgggtctattctaggcgctggttggactgctgga

SEQ ID NO: 247890 - DNA, 75 bp, Artificial Sequence
  Synthetic
acacttcctctcttgttgggtctattctaggcgctggttggactgctggagcatcctcctttgctgctatacctt

SEQ ID NO: 247891 - DNA, 75 bp, Artificial Sequence
  Synthetic
gaacgggattggcatcactcagcaagttctctccgagaaccagaagcagattgccaacaagttcaatcaagctct

SEQ ID NO: 247892 - DNA, 75 bp, Artificial Sequence
  Synthetic
gttctctccgagaaccagaagcagattgccaacaagttcaatcaagctctgggagctatgcagactggcttcacc

SEQ ID NO: 247893 - DNA, 75 bp, Artificial Sequence
  Synthetic
tgcaagatgccgtgaatgccaatgcacaagctctatctaagttagcatcggagttatctaataccttcggtgcta

SEQ ID NO: 247894 - DNA, 75 bp, Artificial Sequence
  Synthetic
acaagctctatctaagttagcatcggagttatctaataccttcggtgctatatcttcgtccatcagtgacattct

SEQ ID NO: 247895 - DNA, 75 bp, Artificial Sequence
  Synthetic
gaggctcaaattgaccgtttgatcaatggtcgcctcacatccttgaacgcatttgttgctcaacaactcgtgcgt

SEQ ID NO: 247896 - DNA, 75 bp, Artificial Sequence
  Synthetic
atggtcgcctcacatccttgaacgcatttgttgctcaacaactcgtgcgttctgagacagctgccagatctgcac

SEQ ID NO: 247897 - DNA, 75 bp, Artificial Sequence
  Synthetic
atgcgtaaaatcgcagtccaagcgtaatggcttttgcggatctggtactcatattgtctcgtttgtcataaatgc

SEQ ID NO: 247898 - DNA, 75 bp, Artificial Sequence
  Synthetic
aatggcttttgcggatctggtactcatattgtctcgtttgtcataaatgcgccaaacgggctctacttcttccat

SEQ ID NO: 247899 - DNA, 75 bp, Artificial Sequence
  Synthetic
taaatgcaaccgctgcttatgggttgtgtaatacggagaatccgcctaggtgcattgctcctattgacggctact

SEQ ID NO: 247900 - DNA, 75 bp, Artificial Sequence
  Synthetic
gtgtaatacggagaatccgcctaggtgcattgctcctattgacggctacttcgttcttaattctacaactactcg

SEQ ID NO: 247901 - DNA, 75 bp, Artificial Sequence
  Synthetic
actggtagttctttctttagccctgagcctattacgatggcgaatgctcgttatgtttcgccagatactaagtac

SEQ ID NO: 247902 - DNA, 75 bp, Artificial Sequence
  Synthetic
agcctattacgatggcgaatgctcgttatgtttcgccagatactaagtacgagcaactcgataataaacttccac

SEQ ID NO: 247903 - DNA, 75 bp, Artificial Sequence
  Synthetic
tcaagatttcaaagaagagctggaggagttctttaagaatgtttcttctcaaggtcctaactttcaggagatatc

SEQ ID NO: 247904 - DNA, 75 bp, Artificial Sequence
  Synthetic
gagttctttaagaatgtttcttctcaaggtcctaactttcaggagatatcaaaaataaatgctaccttgctggat

SEQ ID NO: 247905 - DNA, 75 bp, Artificial Sequence
  Synthetic
acgaggttgtcaagcaacttaatgagtcatacattgaccttaaggagcttggtaattatacctattaccagaaat

SEQ ID NO: 247906 - DNA, 75 bp, Artificial Sequence
  Synthetic
gtcatacattgaccttaaggagcttggtaattatacctattaccagaaatggccttggtacatctggttgggttt

SEQ ID NO: 247907 - DNA, 75 bp, Artificial Sequence
  Synthetic
ctgtgtgtcttcttcttgctttgctgtactggctgtggtaccaactgcatgggcaagcttaagtgtaatcgttgc

SEQ ID NO: 247908 - DNA, 75 bp, Artificial Sequence
  Synthetic
gtactggctgtggtaccaactgcatgggcaagcttaagtgtaatcgttgctgtgacaagtacgatgattatgatg

SEQ ID NO: 247909 - DNA, 75 bp, Artificial Sequence
  Synthetic
ttaacgaacttagttatgagagtgcagagacctccaactttgttgttgttaatcgcactttcactctttgctaat

SEQ ID NO: 247910 - DNA, 75 bp, Artificial Sequence
  Synthetic
agagacctccaactttgttgttgttaatcgcactttcactctttgctaatgcattctccagacctactgttgctt

SEQ ID NO: 247911 - DNA, 75 bp, Artificial Sequence
  Synthetic
tactggcaaaatgctcaaggcttgcatcgcacagaccaagtttgacactgctggcatgtacaccaaccgtgtcat

SEQ ID NO: 247912 - DNA, 75 bp, Artificial Sequence
  Synthetic
atcgcacagaccaagtttgacactgctggcatgtacaccaaccgtgtcatctcagttcctgtcgctactggtgct

SEQ ID NO: 247913 - DNA, 75 bp, Artificial Sequence
  Synthetic
cacaaactggccatggtgatttttatgatcagtctgttgccacgactctggtgaacgttgatcctgaccgggatt

SEQ ID NO: 247914 - DNA, 75 bp, Artificial Sequence
  Synthetic
tgatcagtctgttgccacgactctggtgaacgttgatcctgaccgggattaacgaactttatggattacgtgtct

SEQ ID NO: 247915 - DNA, 75 bp, Artificial Sequence
  Synthetic
acactaattctgcagttattactggtacctacgttccaccaccagctgttgctttcacacctgtcactggtactt

SEQ ID NO: 247916 - DNA, 75 bp, Artificial Sequence
  Synthetic
tacctacgttccaccaccagctgttgctttcacacctgtcactggtacttcattgcaccccgtgcagtggcagtg

SEQ ID NO: 247917 - DNA, 75 bp, Artificial Sequence
  Synthetic
ggactggctgtgaatagcactaaggcattagcaaagcaggatgcagcacaacaggttgcctggcaattgcatcgc

SEQ ID NO: 247918 - DNA, 75 bp, Artificial Sequence
  Synthetic
cattagcaaagcaggatgcagcacaacaggttgcctggcaattgcatcgccacggcaaactgtcaggcttcagcc

SEQ ID NO: 247919 - DNA, 75 bp, Artificial Sequence
  Synthetic
aacgccatcacaatactgattcgaaactacgttatgctaaacgtagattctctcctcttaaaccatcagatgtaa

SEQ ID NO: 247920 - DNA, 75 bp, Artificial Sequence
  Synthetic
actacgttatgctaaacgtagattctctcctcttaaaccatcagatgtaatggacatcgacccgcatccgggccc

SEQ ID NO: 247921 - DNA, 75 bp, Artificial Sequence
  Synthetic
gacccttctcacacttggcatgtgagttctggtcatatgcttgatgatgttcagaagtggctgcaaccttatggt

SEQ ID NO: 247922 - DNA, 75 bp, Artificial Sequence
  Synthetic
gttctggtcatatgcttgatgatgttcagaagtggctgcaaccttatggtgctaagcctattactgagtatcata

SEQ ID NO: 247923 - DNA, 75 bp, Artificial Sequence
  Synthetic
accagacgagcaatttcatgatctcactccagtcgcaaacatgctcaaagatgtgctttttgagctgagtgattt

SEQ ID NO: 247924 - DNA, 75 bp, Artificial Sequence
  Synthetic
actccagtcgcaaacatgctcaaagatgtgctttttgagctgagtgatttcaatgtcttgggcagaacattagtt

SEQ ID NO: 247925 - DNA, 75 bp, Artificial Sequence
  Synthetic
atggcatgaccaggcctgttaacatggcagtcccccatattaaggagtggcttaaaattcatgggtacaccattt

SEQ ID NO: 247926 - DNA, 75 bp, Artificial Sequence
  Synthetic
ggcagtcccccatattaaggagtggcttaaaattcatgggtacaccatttataatagtcaccttcctctacatct

SEQ ID NO: 247927 - DNA, 75 bp, Artificial Sequence
  Synthetic
gatgaggccacacgctcttatataggtacccgtgcatatttcaagcagtatgtcacccgcattatagtggcaccc

SEQ ID NO: 247928 - DNA, 75 bp, Artificial Sequence
  Synthetic
gtacccgtgcatatttcaagcagtatgtcacccgcattatagtggcaccccgctctttagagcttgtcactatac

SEQ ID NO: 247929 - DNA, 75 bp, Artificial Sequence
  Synthetic
gattgtcaagtctttaccaataccatctagtgtttggtaacgaactatggctttctctgcttctttgtttcggcc

SEQ ID NO: 247930 - DNA, 75 bp, Artificial Sequence
  Synthetic
tctagtgtttggtaacgaactatggctttctctgcttctttgtttcggcctattcaacttgtgtctgcttttcct

SEQ ID NO: 247931 - DNA, 75 bp, Artificial Sequence
  Synthetic
taggacggcaagctgaggagcctcaagtcatattatcatgcattcccactgtaggttacagtgcagctttggctg

SEQ ID NO: 247932 - DNA, 75 bp, Artificial Sequence
  Synthetic
agtcatattatcatgcattcccactgtaggttacagtgcagctttggctgttaatgcatgccttattccactcat

SEQ ID NO: 247933 - DNA, 75 bp, Artificial Sequence
  Synthetic
atgcgtagtatagttaagaccctaattctttatggtcttatgctttataattttatcctatcggccattttggtc

SEQ ID NO: 247934 - DNA, 75 bp, Artificial Sequence
  Synthetic
ttctttatggtcttatgctttataattttatcctatcggccattttggtcagtgggactcatatgccactaggta

SEQ ID NO: 247935 - DNA, 75 bp, Artificial Sequence
  Synthetic
actatccatactttggtttgttgacagagttcgtttctgtctcatgctgaggtcctatattccacttattgacat

SEQ ID NO: 247936 - DNA, 75 bp, Artificial Sequence
  Synthetic
agagttcgtttctgtctcatgctgaggtcctatattccacttattgacatgcgctctcattttgtgcgtgtcact

SEQ ID NO: 247937 - DNA, 75 bp, Artificial Sequence
  Synthetic
ctgttaataacagcaaaccctatttcatacgaaactttgaacagcaatgtcgctgttctcgttgtttctacgtgc

SEQ ID NO: 247938 - DNA, 75 bp, Artificial Sequence
  Synthetic
catacgaaactttgaacagcaatgtcgctgttctcgttgtttctacgtgcattctgttgcttacattgagtgcac

SEQ ID NO: 247939 - DNA, 75 bp, Artificial Sequence
  Synthetic
cagcttgtgtctgtaactgaattttcgctgaacaaccaccgatctactgtcttcgtgcctgctgtgcgcgactca

SEQ ID NO: 247940 - DNA, 75 bp, Artificial Sequence
  Synthetic
cgctgaacaaccaccgatctactgtcttcgtgcctgctgtgcgcgactcagtacctctccacataatcgcaccaa

SEQ ID NO: 247941 - DNA, 75 bp, Artificial Sequence
  Synthetic
agcgcttctatggtcccatgtagaggctaatccatttagtctctccttggacatttggaaaacgaactatgttac

SEQ ID NO: 247942 - DNA, 75 bp, Artificial Sequence
  Synthetic
gctaatccatttagtctctccttggacatttggaaaacgaactatgttaccctttgtccaagaacaaatagggtc

SEQ ID NO: 247943 - DNA, 75 bp, Artificial Sequence
  Synthetic
accgtagcttgtgctattatacttttagtttgtatggcattccttacggccacgcgattatgtgtgcagtgtgca

SEQ ID NO: 247944 - DNA, 75 bp, Artificial Sequence
  Synthetic
tagtttgtatggcattccttacggccacgcgattatgtgtgcagtgtgcaatagggctcaatgctctgttagttc

SEQ ID NO: 247945 - DNA, 75 bp, Artificial Sequence
  Synthetic
tggacgttcagtctatgtgaagtttcaagagagtaagcccccactaccccctgatgagtgggtttaacgaactct

SEQ ID NO: 247946 - DNA, 75 bp, Artificial Sequence
  Synthetic
caagagagtaagcccccactaccccctgatgagtgggtttaacgaactctctaatcatgtctaactcttcgctct

SEQ ID NO: 247947 - DNA, 75 bp, Artificial Sequence
  Synthetic
taaagactggaactttgcatggtccattatctttctcttaataactatcgtgctacaatatggttacccatctcg

SEQ ID NO: 247948 - DNA, 75 bp, Artificial Sequence
  Synthetic
attatctttctcttaataactatcgtgctacaatatggttacccatctcgtagcatgacagtatatgttttcaaa

SEQ ID NO: 247949 - DNA, 75 bp, Artificial Sequence
  Synthetic
cagcttcaatggcgctctccattttttgcgccgtctaccctatagacttgtcaacccagatcatctctggcataa

SEQ ID NO: 247950 - DNA, 75 bp, Artificial Sequence
  Synthetic
ttgcgccgtctaccctatagacttgtcaacccagatcatctctggcataatagctttcatctctgcatgcatgtg

SEQ ID NO: 247951 - DNA, 75 bp, Artificial Sequence
  Synthetic
aggctgtttatgcggacaggctcttggtggtccttcaaccccgaaactaattgcctcttgaatgttccaattggc

SEQ ID NO: 247952 - DNA, 75 bp, Artificial Sequence
  Synthetic
ggtggtccttcaaccccgaaactaattgcctcttgaatgttccaattggcggcactaccgttgtcagacccctcg

SEQ ID NO: 247953 - DNA, 75 bp, Artificial Sequence
  Synthetic
tgttgtcaccaatggctacctcaagatcgcagggatgcactttggccagtgcgactaccgctcgcttcccaacga

SEQ ID NO: 247954 - DNA, 75 bp, Artificial Sequence
  Synthetic
atcgcagggatgcactttggccagtgcgactaccgctcgcttcccaacgaagtgaccgtcgccaaacccaatgta

SEQ ID NO: 247955 - DNA, 75 bp, Artificial Sequence
  Synthetic
gacaagactacggaacaaactccggtgtggctatttaccacagatacaaggctggtaactacagacgtccggcaa

SEQ ID NO: 247956 - DNA, 75 bp, Artificial Sequence
  Synthetic
tgtggctatttaccacagatacaaggctggtaactacagacgtccggcaattgtgcctgacgccgaacttgcact

SEQ ID NO: 247957 - DNA, 75 bp, Artificial Sequence
  Synthetic
gagtatgatttaaaatcattaacgaatcttaattttcattgttatggccacccctgcagcgccccgtgctgtgac

SEQ ID NO: 247958 - DNA, 75 bp, Artificial Sequence
  Synthetic
atcttaattttcattgttatggccacccctgcagcgccccgtgctgtgacctttggtgacaacaatgacaacaat

SEQ ID NO: 247959 - DNA, 75 bp, Artificial Sequence
  Synthetic
gaggaagaactcctaagcctagaccagctcccaataacaccgtctcctggtacactggccttacccaacacggga

SEQ ID NO: 247960 - DNA, 75 bp, Artificial Sequence
  Synthetic
agctcccaataacaccgtctcctggtacactggccttacccaacacgggaaggtccctctttcctttccacctgg

SEQ ID NO: 247961 - DNA, 75 bp, Artificial Sequence
  Synthetic
tcaacccctgcacaaaatgctgggtattggcggagacaggaccgaaagattaatacaggaaatggaacaaagcag

SEQ ID NO: 247962 - DNA, 75 bp, Artificial Sequence
  Synthetic
attggcggagacaggaccgaaagattaatacaggaaatggaacaaagcagctggctcccaggtggttcttctact

SEQ ID NO: 247963 - DNA, 75 bp, Artificial Sequence
  Synthetic
tactttgaaaataaactctggtttgattttgttgaaaatcccagtgttattggtgtttatcataaacttggagaa

SEQ ID NO: 247964 - DNA, 75 bp, Artificial Sequence
  Synthetic
cctccctttcagagctgtcaaggatggaatcgtctgggtacatgaagaaggtgctacagacgctccctccagttt

SEQ ID NO: 247965 - DNA, 75 bp, Artificial Sequence
  Synthetic
ggaatcgtctgggtacatgaagaaggtgctacagacgctccctccagttttgggacgcgtaaccctaacaacgat

SEQ ID NO: 247966 - DNA, 75 bp, Artificial Sequence
  Synthetic
caggtactaggcttcctaaaaacttccacattgagggcactggaggcaacagtcagtcatcttcaagagcatcta

SEQ ID NO: 247967 - DNA, 75 bp, Artificial Sequence
  Synthetic
ccacattgagggcactggaggcaacagtcagtcatcttcaagagcatctagcgccagcagaggctcttcaagatc

SEQ ID NO: 247968 - DNA, 75 bp, Artificial Sequence
  Synthetic
aactcatccagaagtgcttccccaggtccagctggaatcggagctgtaggtggcgacgcttccagtattctctac

SEQ ID NO: 247969 - DNA, 75 bp, Artificial Sequence
  Synthetic
gtccagctggaatcggagctgtaggtggcgacgcttccagtattctctacctgagtttgctgaagaggctcgaag

SEQ ID NO: 247970 - DNA, 75 bp, Artificial Sequence
  Synthetic
agcacctaaggttgtcaccaagaaggatgctgctgctgctaaaaacaagatgcgccacaagcgcgtcgccaccaa

SEQ ID NO: 247971 - DNA, 75 bp, Artificial Sequence
  Synthetic
gatgctgctgctgctaaaaacaagatgcgccacaagcgcgtcgccaccaaaagtttcaacatggttcaggcgttt

SEQ ID NO: 247972 - DNA, 75 bp, Artificial Sequence
  Synthetic
agggaaactttggtgacctacagttgaacaagctcggcacagaagaccctcgctggcctcagattgctgaactcg

SEQ ID NO: 247973 - DNA, 75 bp, Artificial Sequence
  Synthetic
gaacaagctcggcacagaagaccctcgctggcctcagattgctgaactcgctccctcagccagcgctttcatggg

SEQ ID NO: 247974 - DNA, 75 bp, Artificial Sequence
  Synthetic
caaagcaatgatgctgatggttcccccgtgtactttcttagatacagtggagccataaaacttgatcccaagaac

SEQ ID NO: 247975 - DNA, 75 bp, Artificial Sequence
  Synthetic
ccgtgtactttcttagatacagtggagccataaaacttgatcccaagaaccccaactaccagaagtggatggagc

SEQ ID NO: 247976 - DNA, 75 bp, Artificial Sequence
  Synthetic
caaatctttcccagttaaggagaagaaacaaaaggctgatgataacaaacaggattccactgaagacagtggtga

SEQ ID NO: 247977 - DNA, 75 bp, Artificial Sequence
  Synthetic
aaacaaaaggctgatgataacaaacaggattccactgaagacagtggtgacctctttgccgaagccgttgcttct

SEQ ID NO: 247978 - DNA, 75 bp, Artificial Sequence
  Synthetic
agcgagcgcctaagggttctatcacccagcgctctcgtgctcccagagctcctgtgagtcagatggaagacgtga

SEQ ID NO: 247979 - DNA, 75 bp, Artificial Sequence
  Synthetic
cctgtgagtcagatggaagacgtgaatcagaccgatgaccgtcagtaaacgtaacaagagtaaggcaaccgctag

SEQ ID NO: 247980 - DNA, 75 bp, Artificial Sequence
  Synthetic
gtcacctctgcgtgattgcaagtgaacagtgccccctgggaagagctctacagtgtgaagtgtaaataaaaatag

SEQ ID NO: 247981 - DNA, 75 bp, Artificial Sequence
  Synthetic
tacagtgtgaagtgtaaataaaaatagctgttattcaattagattagctaattagatgattaacaaaaaaaaaaa

SEQ ID NO: 247982 - DNA, 75 bp, Artificial Sequence
  Synthetic
tcactgttgtaatgcgccctaactacacaattaagggttcctttctgtgtggttcttgtggtagtgttggttaca

SEQ ID NO: 247983 - DNA, 75 bp, Artificial Sequence
  Synthetic
gcacttatgggtgctaatggcaacaagattgttgacaaagaagttaaagacatgcagtttgatttgtatgtcaat

SEQ ID NO: 247984 - DNA, 75 bp, Artificial Sequence
  Synthetic
ttgcgtcattggtactacaaagttctatggtggctgggatttcatgcttaaaacattgtacaaagatgttgataa

SEQ ID NO: 247985 - DNA, 75 bp, Artificial Sequence
  Synthetic
tgcgtaccagaatttagttggctattattctgatgatggcaactactactgtttgcgtgcttgtgttagtgttcc

SEQ ID NO: 247986 - DNA, 75 bp, Artificial Sequence
  Synthetic
tccaagtttcaattaaaattaaaaggaacaccagttcttcaattaaaggagagtcaaattaacgaactcgtaata

SEQ ID NO: 247987 - DNA, 75 bp, Artificial Sequence
  Synthetic
ctatgggtcccgtgtagaggctaatccattagtctctctttggacatatggaaaacgaactatgttaccctttgt

SEQ ID NO: 247988 - DNA, 75 bp, Artificial Sequence
  Synthetic
actcttgcacagaatggaatcatgttgtaattacagtgcaataaggtaattataacccatttaattgatagctat

SEQ ID NO: 247989 - DNA, 75 bp, Artificial Sequence
  Synthetic
tttgcgatgcagctaaccctactaattgtatagcccctgttaatggctactttattaaaactaataacactagga

SEQ ID NO: 247990 - DNA, 75 bp, Artificial Sequence
  Synthetic
cagacactttagataaattgtctgattactgtacgtttgtttgttgggctcatggctttgaattaacgtctgcat

SEQ ID NO: 247991 - DNA, 75 bp, Artificial Sequence
  Synthetic
cccccgggaagagctctacagtgtgaaatgtaaataaaaaatagctattattcaattagattaggctaattagat

SEQ ID NO: 247992 - DNA, 75 bp, Artificial Sequence
  Synthetic
tctttgctcaagatggtaatgctgctattacagattataattactattcttataatctgcctactatgtgtgaca

SEQ ID NO: 247993 - DNA, 75 bp, Artificial Sequence
  Synthetic
acgcgaaaaaaacgcgtataaattaagttacaaaaaaacatgggacaagtgaaaatgtctcttcaagggattcac

SEQ ID NO: 247994 - DNA, 75 bp, Artificial Sequence
  Synthetic
gattacaaatatgctgcagaaataggaatacaatatattagcacagctctaggatcagagagagtacagcagatt

SEQ ID NO: 247995 - DNA, 75 bp, Artificial Sequence
  Synthetic
tctgatcataaactacacaatacaaaaaactacatctgaatcagaacaccacactagctcaccacccacagaatc

SEQ ID NO: 247996 - DNA, 75 bp, Artificial Sequence
  Synthetic
aggatcagagagagtacagcagattctaagaaactcaggcagtgaagtccaagtggttttaaccagaacgtactc

SEQ ID NO: 247997 - DNA, 75 bp, Artificial Sequence
  Synthetic
taacaaagaaacttcaacaatccctatagacaacccagacatcactccaaactcacagcatccaactcaacagtc

SEQ ID NO: 247998 - DNA, 75 bp, Artificial Sequence
  Synthetic
aacaaaattctaaacagtgcagaaaaaggaaacactggtttcattattgtaataattttggttgctgttcttggt

SEQ ID NO: 247999 - DNA, 75 bp, Artificial Sequence
  Synthetic
tcaatgcaagtgacagtcaaagaacaaggagagtcttagaattttacttaaaagattgcaaatttgatcaaaaag

SEQ ID NO: 248000 - DNA, 75 bp, Artificial Sequence
  Synthetic
aatcatcaggcaatattccacaaaatcagaggccttcagcaccagacacacctataatcttattatgtgtaggtg

SEQ ID NO: 248001 - DNA, 75 bp, Artificial Sequence
  Synthetic
aaccgcccgtcctctgtagacagattcacaacacaaccaagtggaagcagaacaaagacaaacccgacagtccac

SEQ ID NO: 248002 - DNA, 75 bp, Artificial Sequence
  Synthetic
agtttttaacaaggagtaaaaacattagcactctcaaattaaatatgatatgtgattggctgcaattaaagtcta

SEQ ID NO: 248003 - DNA, 75 bp, Artificial Sequence
  Synthetic
gcttattctgttggttacatcttattgttcccatgactacaatgatatgtgcatacagacatgcaccaccagaaa

SEQ ID NO: 248004 - DNA, 75 bp, Artificial Sequence
  Synthetic
atgctgaggtggggagtcattgccaggtcatctaacaatataatgttaggacatgtatctgtccaagctgagtta

SEQ ID NO: 248005 - DNA, 75 bp, Artificial Sequence
  Synthetic
tggtgcgagaaatgggccctgaatctgggctcctacatttaaggcaaagcccaaaagctggactgttatcactag

SEQ ID NO: 248006 - DNA, 75 bp, Artificial Sequence
  Synthetic
gaggatcaattcaatgttgcgcttgatcaagtctttgaaagcattgaaaacagtcaagcactagtggaccagtca

SEQ ID NO: 248007 - DNA, 75 bp, Artificial Sequence
  Synthetic
aatctgcaaggtatgttaactaataaactatatgaaactgtagattatatgctaagtttatgttgcaatgaaggt

SEQ ID NO: 248008 - DNA, 75 bp, Artificial Sequence
  Synthetic
aatcaatcaatagatgtcagtaaaccagtaaagttgtctgaaagtacagatgaagtaaaagcagattatagctta

SEQ ID NO: 248009 - DNA, 75 bp, Artificial Sequence
  Synthetic
tatctgatgggatagtaaaatcacacaccaatatttatagttgttacttagaaaacatagaaataatatatgtta

SEQ ID NO: 248010 - DNA, 75 bp, Artificial Sequence
  Synthetic
tgcaaattcaaccacaattactggagttggcctgatagatatttattgttaagatcaaattatctcttgaatcag

SEQ ID NO: 248011 - DNA, 75 bp, Artificial Sequence
  Synthetic
caaaaaattcgaagtaaatgcaactgtagcacttgatgaatacagtaaacttgattttgacaagctgacggtttg

SEQ ID NO: 248012 - DNA, 75 bp, Artificial Sequence
  Synthetic
taaaactgatattggctttactgacatttttcacagtaacaattactgttaactatataaaagtagaaaacaatt

SEQ ID NO: 248013 - DNA, 75 bp, Artificial Sequence
  Synthetic
tataggagaaaaagtgaacactgtatctgaaacattggaattacctactatcagtagacctaccaaaccgaccat

SEQ ID NO: 248014 - DNA, 75 bp, Artificial Sequence
  Synthetic
ccatacctgatctaactgtagtacattatttgaaaagactgattcagagacacaccaactttgtcataaaagaca

SEQ ID NO: 248015 - DNA, 75 bp, Artificial Sequence
  Synthetic
tatggatcctattgaagaagaagagtttactgagaaaagggtgctgccctccagtgatgggaaaactcctgcaga

SEQ ID NO: 248016 - DNA, 75 bp, Artificial Sequence
  Synthetic
aattaattatttgattatacaattatatagtagttaattaaaattaaaaattaaaaatcaaaagttaaaatttaa

SEQ ID NO: 248017 - DNA, 75 bp, Artificial Sequence
  Synthetic
actaaaaagaaggtctcatttacaccaaatgaaccaggaaaatacacaaagttggagaaagatgctctagacttg

SEQ ID NO: 248018 - DNA, 75 bp, Artificial Sequence
  Synthetic
attaaaaattaaaaatcaaaagttaaaatttaaaacctatcattaagtttattaaaaataagaaattataattga

SEQ ID NO: 248019 - DNA, 75 bp, Artificial Sequence
  Synthetic
atgtctcttcaagggattcacctgagtgatctatcatacaagcatgctatattaaaagagtctcagtacacaata

SEQ ID NO: 248020 - DNA, 75 bp, Artificial Sequence
  Synthetic
tgtctgatgggatagtaaaatcacacaccaatatttacagttgttatttagaaaatatagaaataatatatgtta

SEQ ID NO: 248021 - DNA, 75 bp, Artificial Sequence
  Synthetic
ataatatgcaacaatcaatagtcaaaccactgctgcaaactcatccataatataatcactgagtaatacaaaaca

SEQ ID NO: 248022 - DNA, 75 bp, Artificial Sequence
  Synthetic
accactgctgcaaactcatccataatataatcactgagtaatacaaaacaagaaaatgggacaagtggctatgga

SEQ ID NO: 248023 - DNA, 75 bp, Artificial Sequence
  Synthetic
atggatcctcaaaaacatgtaatcaactcaaaaaaataataaaaaaccattcaggtaaattgcttattgcattaa

SEQ ID NO: 248024 - DNA, 75 bp, Artificial Sequence
  Synthetic
tgccacctttattatgcaaggtagtaaactgtcaggctcggaatgctacatactcttaacactaggccaccacaa

SEQ ID NO: 248025 - DNA, 75 bp, Artificial Sequence
  Synthetic
gaagaagaagaagaactaaaagacacacaggaaaataatcaagaagatgacatttaccagttaattatgtagttt

SEQ ID NO: 248026 - DNA, 75 bp, Artificial Sequence
  Synthetic
aaaacagtctctgctgatcagttagcgagagaggagcaaattgaaaatcccagacaatcaagatttgtcctaggt

SEQ ID NO: 248027 - DNA, 75 bp, Artificial Sequence
  Synthetic
cctatgactacaatgatatgtgcttatagacatgcaccaccagaaacaaaaggtgaatatgatatagataagata

SEQ ID NO: 248028 - DNA, 75 bp, Artificial Sequence
  Synthetic
aaaggacctgttacctgcaagcctaacaatatggttccccctgtttcaggccaatacaccaccagcagttctgct

SEQ ID NO: 248029 - DNA, 75 bp, Artificial Sequence
  Synthetic
tcacagcatccaactcaacagtccacagaaagcctcacactctaccccgcatcctcggtgagctcatcagaaaca

SEQ ID NO: 248030 - DNA, 75 bp, Artificial Sequence
  Synthetic
ggccatccatacacagggacaactcaaacaccagacacaacagctccccagcaaaccacagacaaacacacagca

SEQ ID NO: 248031 - DNA, 75 bp, Artificial Sequence
  Synthetic
agtattgtaacatgtatggatgttgtgtatgcaactagttctcatttaaaaggaataattattgaaaaattcagt

SEQ ID NO: 248032 - DNA, 75 bp, Artificial Sequence
  Synthetic
tgatcagctaaagactctgactataactactctgtatgctgcatcacaaagtggtccaatactaaaagtgaatgc

SEQ ID NO: 248033 - DNA, 75 bp, Artificial Sequence
  Synthetic
caaaccgcctgtcctccgtagacagatccacaacacaaccaagtaaaagcagaacaaatacaactccgacagtcc

SEQ ID NO: 248034 - DNA, 75 bp, Artificial Sequence
  Synthetic
aaaatcagaacaaatcatatctagatctattaatataatagtttagttatttaaaaactctaaatattgtctaga

SEQ ID NO: 248035 - DNA, 75 bp, Artificial Sequence
  Synthetic
tctattaatataatagtttagttatttaaaaactctaaatattgtctagacttcacaacactttgcggtcatatg

SEQ ID NO: 248036 - DNA, 75 bp, Artificial Sequence
  Synthetic
acagatttatgcagaaacaaatcaaactcagcagttgaagcatatcacacagtagaatgccattgtatatacaca

SEQ ID NO: 248037 - DNA, 75 bp, Artificial Sequence
  Synthetic
cctagggaatgcagagattaaaaaactgatcaaagtaactggatatatgcttgtaagtaaaaaatgaaaaatgat

SEQ ID NO: 248038 - DNA, 75 bp, Artificial Sequence
  Synthetic
aaaaatcaacagttgtgacagactgacagatttatgcagaaacaaatcaaactcagcagttgaagcatatcacac

SEQ ID NO: 248039 - DNA, 75 bp, Artificial Sequence
  Synthetic
atcagcactaagtatggcacttaatatttttttaatcattgattatgcaacatcaaaaaacatgaccagagtgga

SEQ ID NO: 248040 - DNA, 75 bp, Artificial Sequence
  Synthetic
acataggttatctgttagtagcagacccatggaattcccagcttctgttccagcttataggacaacaaattacca

SEQ ID NO: 248041 - DNA, 75 bp, Artificial Sequence
  Synthetic
tgcaggacccaggtgaacgcaacacacaggtatctcatccaagtagttaacaaaaaaccacaaaataaccttgaa

SEQ ID NO: 248042 - DNA, 75 bp, Artificial Sequence
  Synthetic
ggaatcctaataggggtctacggaagctctgtgatttacatggttcaattgccgatctttggtgtcatagataca

SEQ ID NO: 248043 - DNA, 75 bp, Artificial Sequence
  Synthetic
agatggtattaaatgataaagcaatatcacctccaaaaaagctaatatggtctgtatatccaaaaaactacctgc

SEQ ID NO: 248044 - DNA, 75 bp, Artificial Sequence
  Synthetic
aaaaatatgggacaagtgaaaatgtctcttcaagggattcacctgagtgatctatcatacaagcatgctatatta

SEQ ID NO: 248045 - DNA, 75 bp, Artificial Sequence
  Synthetic
agtgaagcagaccaagctctaacacaagccaaaattgcaccttatgcgggactgatcatgattatgaccatgaac

SEQ ID NO: 248046 - DNA, 75 bp, Artificial Sequence
  Synthetic
gattaacagcattaagtatggcacttaatatttttttaatcattgattatgcaacattaaaaaacatgaccaaag

SEQ ID NO: 248047 - DNA, 75 bp, Artificial Sequence
  Synthetic
aacaacaatcagacccattcctgatctaaatgcagtacagtacttgaaaaggctgattcagaaacataccaactt

SEQ ID NO: 248048 - DNA, 75 bp, Artificial Sequence
  Synthetic
tggagaatacacacgaatcaatgcacaaatataaaaatatataagttcttatgttttgggtttatgaattcaaca

SEQ ID NO: 248049 - DNA, 75 bp, Artificial Sequence
  Synthetic
acaaagaccacattgtctcattaactgggaaggaaagagaattaagtgtaggtaggatgtttgcaatgcaaccag

SEQ ID NO: 248050 - DNA, 75 bp, Artificial Sequence
  Synthetic
tttacagatgttagacatacacggagtagaaaaaagctgggtggaagagatagacaaagaagcaagaaaaacaat

SEQ ID NO: 248051 - DNA, 75 bp, Artificial Sequence
  Synthetic
gatcatgtcttttgaaaagaccctatctaaaaaatgataacactgctaaagttgctgtagaaaaccctgttgttg

SEQ ID NO: 248052 - DNA, 75 bp, Artificial Sequence
  Synthetic
tctctagcagcaacctcagagaatcatctacacacagggacaactccaacatcagatgcaacaatctctcagcaa

SEQ ID NO: 248053 - DNA, 75 bp, Artificial Sequence
  Synthetic
aatcatcaaacaattacctaaaggctgctcatacataactaaccaggatgcagacactgtaacaattgacaatac

SEQ ID NO: 248054 - DNA, 75 bp, Artificial Sequence
  Synthetic
gattgtcaatgctgaaggagagttagttgaaattaaatcaatcaaaatttatctgcagttaatagaacaaagtct

SEQ ID NO: 248055 - DNA, 75 bp, Artificial Sequence
  Synthetic
gcgagcccaccagaaacagaaccagcatcaacatcagacacaacaaatcgtctgtcctctgtagacagatccaca

SEQ ID NO: 248056 - DNA, 75 bp, Artificial Sequence
  Synthetic
agacaaaacgagcagtccacaaaagaagcatcccaagtacagtatccagaacacaatccccatcacgggcaacaa

SEQ ID NO: 248057 - DNA, 75 bp, Artificial Sequence
  Synthetic
aagcatcccaagtacagtatccagaacacaatccccatcacgggcaacaacgaaggcggtccccagagccaccac

SEQ ID NO: 248058 - DNA, 75 bp, Artificial Sequence
  Synthetic
gaaccaactgcaactccagtccagcctgacagcagcatcacagctcaaaatcatgaagaaacaggttcagcgaac

SEQ ID NO: 248059 - DNA, 75 bp, Artificial Sequence
  Synthetic
aaagcaaagatgaaaaaccgtataagaagtagcaagtgctatagaaatgctacactgatccttattggattaaca

SEQ ID NO: 248060 - DNA, 75 bp, Artificial Sequence
  Synthetic
tacacagataagcacaacaacagcacacaacacagacacatcttctctaagtagttaacaaaaaatatataaaat

SEQ ID NO: 248061 - DNA, 75 bp, Artificial Sequence
  Synthetic
ttaggactcacagatgaagaaaaagaggctgcagaacacttcctaaatgtgagtgacgacagtcaaaatgattat

SEQ ID NO: 248062 - DNA, 75 bp, Artificial Sequence
  Synthetic
actagactattttcctaggataatatttgagaggttaaaaagttatgataccagttcagactacaacaaagggaa

SEQ ID NO: 248063 - DNA, 75 bp, Artificial Sequence
  Synthetic
gcattaagtatggcacttaatatttttttaatcattgattatgcaacattaaaaaacatgaccaaagtggaacac

SEQ ID NO: 248064 - DNA, 75 bp, Artificial Sequence
  Synthetic
gttctaggagcaatagcactcggtgttgcaacagcagctgcagtcacagcaggtgttgcaattgccaaaaccatc

SEQ ID NO: 248065 - DNA, 75 bp, Artificial Sequence
  Synthetic
aaattaaaccaatcaaaatttatttgcagttaatagaacaaagtctatctttaagaataactgttttgaattata

SEQ ID NO: 248066 - DNA, 75 bp, Artificial Sequence
  Synthetic
aagagatctcaatctattataggagaaaaagtgaacactgtatctgaaacattggaattacctactatcagtaga

SEQ ID NO: 248067 - DNA, 75 bp, Artificial Sequence
  Synthetic
cagagggagtgattgcaaattcaatcacaattactggagttggcctgatagatatttattgttaagatcaaatta

SEQ ID NO: 248068 - DNA, 75 bp, Artificial Sequence
  Synthetic
gtgcggcaattttcagacaatgctggaataacaccagcaatatctttggacttaatgacagatgctgaactagcc

SEQ ID NO: 248069 - DNA, 75 bp, Artificial Sequence
  Synthetic
tgtttatcttcctgactcatatctcaaaggagtaatatctttcagtgaaaccaatgcaattggctcatgcctttt

SEQ ID NO: 248070 - DNA, 75 bp, Artificial Sequence
  Synthetic
aaactaatgcaattggttcatgtctcttaaaaagaccttacttaaaaaatgacaacactgcaaaagttgccatag

SEQ ID NO: 248071 - DNA, 75 bp, Artificial Sequence
  Synthetic
gataaatacaatactagatgatattaaaaccagtgcagaatcaatagggagtctatgtcaagaactagagttcag

SEQ ID NO: 248072 - DNA, 75 bp, Artificial Sequence
  Synthetic
aaggggttcggaatcctgataggggtctacgggagctccgtaatttacatggtgcagctgccaatctttggcgtt

SEQ ID NO: 248073 - DNA, 75 bp, Artificial Sequence
  Synthetic
cacagaaaaaccagcaaccaaaacaacagatcctgctgaagaagaggaattcagtgaaaagaaagcattgccttc

SEQ ID NO: 248074 - DNA, 75 bp, Artificial Sequence
  Synthetic
atattaaggaatttctggctgtataacttgtacatgtatgagtcaaaacagcacccgttagctgggaagcaacta

SEQ ID NO: 248075 - DNA, 75 bp, Artificial Sequence
  Synthetic
gaggcaaccacaacatccgccagatccagaaacggtgccacaactcaaaacagtgatcaaacaatccaggcagca

SEQ ID NO: 248076 - DNA, 75 bp, Artificial Sequence
  Synthetic
aaagggaaactatgcttgcctcttaagagaagaccaagggtggtattgtcagaatgcagggtcaactgtttacta

SEQ ID NO: 248077 - DNA, 75 bp, Artificial Sequence
  Synthetic
gacccaagctccaaaccataccatacacagacaaacacaacaacagcacacaacacagacacatcttctctaagt

SEQ ID NO: 248078 - DNA, 75 bp, Artificial Sequence
  Synthetic
cagcagcgggaattaatgttgctgagcaatcaaaggagtgcaacatcaacatatccactacaaattacccatgca

SEQ ID NO: 248079 - DNA, 75 bp, Artificial Sequence
  Synthetic
gtttaggcattagttacaagtgtgtaaaacctttattacctagatttatgagtgtaaatttcttacatagattat

SEQ ID NO: 248080 - DNA, 75 bp, Artificial Sequence
  Synthetic
atgcaagtgatagtctcaaaacaagaagagtgctagagtactatttgaaagacaataaatttgatcaaaaggaac

SEQ ID NO: 248081 - DNA, 75 bp, Artificial Sequence
  Synthetic
aactaggagcatatgtccaggctgaaagcataagtaaaatatgcaagacttggagccatcaagggacaagatatg

SEQ ID NO: 248082 - DNA, 75 bp, Artificial Sequence
  Synthetic
ggaatactggcttcatcattgtaataattctaattgctgtccttggctctagcatgatcctagtgagcatcttca

SEQ ID NO: 248083 - DNA, 75 bp, Artificial Sequence
  Synthetic
aatgaacagatcaaccagacaaccacagagaaaaagacaaccagagcaacaacccaaaaaagggaaaaggaaaag

SEQ ID NO: 248084 - DNA, 75 bp, Artificial Sequence
  Synthetic
ggtgtcacaaacaatggcttcataccacacagttagttaattaaaaataaaataaaatttgggacaaatcataat

SEQ ID NO: 248085 - DNA, 75 bp, Artificial Sequence
  Synthetic
attcagaatttttggacaccctatggtagatgagagagaagcaatggatgctgttaaattaaataatgagattac

SEQ ID NO: 248086 - DNA, 75 bp, Artificial Sequence
  Synthetic
gaagtgcggggcaaatgcaacagaggaagtgagtgtaagtttaaccacaattactggagttggccagatagatac

SEQ ID NO: 248087 - DNA, 75 bp, Artificial Sequence
  Synthetic
tacagattgtgaggaactaacaaccttatgcgacaaaaagttaaaaaccatggtagaaaaacatagaaaggcaga

SEQ ID NO: 248088 - DNA, 75 bp, Artificial Sequence
  Synthetic
taagaattataaaagggtttgtagataataataaaagatggcctaaaattaagaatttaaaagtgctcagtaaaa

SEQ ID NO: 248089 - DNA, 75 bp, Artificial Sequence
  Synthetic
aaataaaaatgtcttggaaagtggtgatcattttttcattgctaataacacctcaacacggtcttaaagagagct

SEQ ID NO: 248090 - DNA, 75 bp, Artificial Sequence
  Synthetic
taatcaacaatctcaaaagactgccgagagaaaaactgaaaaaattagcaaagctgataattgacttatcagcag

SEQ ID NO: 248091 - DNA, 75 bp, Artificial Sequence
  Synthetic
tcaatagatgttagtaaaccagtaaaattgtctgaaggtatagatgaagtaaaagcagactatagcttagcaatt

SEQ ID NO: 248092 - DNA, 75 bp, Artificial Sequence
  Synthetic
gtcctaaaatccagataaaaataactatcttaatcaataattgcttatataactccaaagattaataagcttatt

SEQ ID NO: 248093 - DNA, 75 bp, Artificial Sequence
  Synthetic
tgatatggactcaaaaagaattaaaagaagctttgtccgatgggatagtgaagtctcacaccaacatttacaatt

SEQ ID NO: 248094 - DNA, 75 bp, Artificial Sequence
  Synthetic
atccacagcaagcaacacagtggaccacagagaactcaacatctccggcagcaaccctagagggccatccataca

SEQ ID NO: 248095 - DNA, 75 bp, Artificial Sequence
  Synthetic
agagtaggtccttggataaatacaatactagatgatattaaaaccagtgcagaatcaatagggagtctatgtcaa

SEQ ID NO: 248096 - DNA, 75 bp, Artificial Sequence
  Synthetic
atatgtcaaggcttacttaagttagtaaaaacacatcagagtgggataagtgacaatgataacattagatgtcat

SEQ ID NO: 248097 - DNA, 75 bp, Artificial Sequence
  Synthetic
tgacagcaagcatgtggcactccataacttaatcttatcttacatggagatgagcaaaactcctgcatctttaat

SEQ ID NO: 248098 - DNA, 75 bp, Artificial Sequence
  Synthetic
atatgtgctgaagtccagataacagccaaacaacctggccaagaactaccaactctattctatagactaaaaagt

SEQ ID NO: 248099 - DNA, 75 bp, Artificial Sequence
  Synthetic
cacagcatccaactcaacagtccacagaaagcctcacactctacccagcatcctcggtgagcccatcagaaacag

SEQ ID NO: 248100 - DNA, 75 bp, Artificial Sequence
  Synthetic
ctaacatttttcacaataacaatcactataaattacataaaagtagaaaacaatctacaaatatgccagtcaaaa

SEQ ID NO: 248101 - DNA, 75 bp, Artificial Sequence
  Synthetic
caaggacacatgctggaaaataagcagaaatcaatgcacaaatataacaacatataaatttttatgctttaaacc

SEQ ID NO: 248102 - DNA, 75 bp, Artificial Sequence
  Synthetic
agaaatcaatgcacaaatataacaacatataaatttttatgctttaaacctgaggactcaaaaatcaacagttgt

SEQ ID NO: 248103 - DNA, 75 bp, Artificial Sequence
  Synthetic
tatgtaattaaacaagagtatctaaatgacaaagaccacattgtctcattaactgggaaagaaagagaattaagt

SEQ ID NO: 248104 - DNA, 75 bp, Artificial Sequence
  Synthetic
caaaggttgctcttatataaccaaccaagatgcagacacagtgacaatagacaacactgtatatcagctaagcaa

SEQ ID NO: 248105 - DNA, 75 bp, Artificial Sequence
  Synthetic
acaaatcaaaatcagcagctgaagcatatcatacagtagaatgccattgcatatacacaattgagtggaagtgct

SEQ ID NO: 248106 - DNA, 75 bp, Artificial Sequence
  Synthetic
ccacaacacaaccaagtgaaagcagaacaaagacaaactcgacagtccacaaaaaaaacaaaaaaaacatctcaa

SEQ ID NO: 248107 - DNA, 75 bp, Artificial Sequence
  Synthetic
accaacattgtaaaaccaaattagttaacaaaaaatatgaaatagctctaaagtaaaacatgtaggtgctaacaa

SEQ ID NO: 248108 - DNA, 75 bp, Artificial Sequence
  Synthetic
cgagaagcaaaaacattagctctctaaaattaaatatgatatgtgattggttacagttaaaatccacttcagata

SEQ ID NO: 248109 - DNA, 75 bp, Artificial Sequence
  Synthetic
ttacccattagaatatcaaagggtaataggtgatctaaatagagtgatagatagtggtgaaggattatcaatgga

SEQ ID NO: 248110 - DNA, 75 bp, Artificial Sequence
  Synthetic
atgtcaactttgctcaaatctccctgggagaaactttcgcccccatactgacaacatcacaatcatctcaagaaa

SEQ ID NO: 248111 - DNA, 75 bp, Artificial Sequence
  Synthetic
agcaattggttcagtaactggtataatctcaataaattaatcttagagtttagaagagaagaagtaataagaact

SEQ ID NO: 248112 - DNA, 75 bp, Artificial Sequence
  Synthetic
gagacaaataacaatggatcctcttaatgaatccactgttaatgtctatctccctgattcgtaccttaaaggagt

SEQ ID NO: 248113 - DNA, 75 bp, Artificial Sequence
  Synthetic
cttccagtacacaatccccaccacgggcaacaacgaaggcaatccgcagagccaccactttccgcatgagcagca

SEQ ID NO: 248114 - DNA, 75 bp, Artificial Sequence
  Synthetic
gaaaaagacaaccagagcaacaacccaaaaaaggaaaaaaggaaaagaaaacacaaaccaaaccacaagcacagc

SEQ ID NO: 248115 - DNA, 75 bp, Artificial Sequence
  Synthetic
aagttgctgtagaaaaccccgttgttgaacatgtaaggcttagaaatgcagtcatgaccaaaatgaagatatcag

SEQ ID NO: 248116 - DNA, 75 bp, Artificial Sequence
  Synthetic
caggaaaaagaccaaccacaacatcagtccagtccgacagcagcaccacaacccaaaatcatgaagaaacaggtt

SEQ ID NO: 248117 - DNA, 75 bp, Artificial Sequence
  Synthetic
aatatgccagtcaaaaactgagtcagacaaagaagactcaccatcaaataccacatctgtcacaaccaagaccac

SEQ ID NO: 248118 - DNA, 75 bp, Artificial Sequence
  Synthetic
gacaaagaagactcaccatcaaataccacatctgtcacaaccaagaccactctagaccatgatataacacagtat

SEQ ID NO: 248119 - DNA, 75 bp, Artificial Sequence
  Synthetic
gatcctattgaagaagaagagttcactgagaaaagagtgctgccctccagtgatgggaaaactcctgcagaaaag

SEQ ID NO: 248120 - DNA, 75 bp, Artificial Sequence
  Synthetic
tgcacaaatataacaacatataaatttttatgttttaaacctgaagactcaaaaatcaacagttgtgatagactg

SEQ ID NO: 248121 - DNA, 75 bp, Artificial Sequence
  Synthetic
aacttttgcccacatactaacaacatcacaaccatctcaagaaaagaaactgggcaaaacagcatccaagagaca

SEQ ID NO: 248122 - DNA, 75 bp, Artificial Sequence
  Synthetic
catagttagttaattaaaaaatgggacaaatcatcatgtctcgtaaagctccatgcaaatatgaagtgcggggca

SEQ ID NO: 248123 - DNA, 75 bp, Artificial Sequence
  Synthetic
atcatggaataatatggaaatagttggagtaacatctcctagcatcactacatgcatggatgtcatatatgcaac

SEQ ID NO: 248124 - DNA, 75 bp, Artificial Sequence
  Synthetic
catgccttcatggatttcaaggtatttctatgtgtatttaaaaccaaacttttatgtagttggggatctcaagga

SEQ ID NO: 248125 - DNA, 75 bp, Artificial Sequence
  Synthetic
tagttaattaaaaattaaaattaaaaatcaaaagttaaaatttaaaacctatcattaagtttattaaaaataaga

SEQ ID NO: 248126 - DNA, 75 bp, Artificial Sequence
  Synthetic
aagactcaaaaatcaacagctgtgatagactgacagatttatgcagaaacaaatcaaactcagcagctgaagcat

SEQ ID NO: 248127 - DNA, 75 bp, Artificial Sequence
  Synthetic
agacaaaccgggcagtctacaaaaaaaccatctcaagtacagtttctagaacacagcccccaccacggacaacag

SEQ ID NO: 248128 - DNA, 75 bp, Artificial Sequence
  Synthetic
gcttatggtgctggtcaaacaatgctgaggtggggagtcatcgccaggtcatctaacaatataatgttaggacat

SEQ ID NO: 248129 - DNA, 75 bp, Artificial Sequence
  Synthetic
gtttagttatttaaaaatattttgaaaacaggtaagtttctatgacacttcacagcaataggttataattaatag

SEQ ID NO: 248130 - DNA, 75 bp, Artificial Sequence
  Synthetic
aaacaggtaagtttctatgacacttcacagcaataggttataattaatagcttaattataattaaaacattattt

SEQ ID NO: 248131 - DNA, 75 bp, Artificial Sequence
  Synthetic
attgtatcatcatatggatgtatcgtcaagagcaacaaaagcaaaagagtgagcttcttcacatacaatcaactg

SEQ ID NO: 248132 - DNA, 75 bp, Artificial Sequence
  Synthetic
tcaagagcaacaaaagcaaaagagtgagcttcttcacatacaatcaactgttaacatggaaagatgtgatgttaa

SEQ ID NO: 248133 - DNA, 75 bp, Artificial Sequence
  Synthetic
attagctctctaaaattaaatatgatatgtgattggttacagttaaaatccacttcagataacacatcaattctc

SEQ ID NO: 248134 - DNA, 75 bp, Artificial Sequence
  Synthetic
tttaatcctcataggaataactactctgagtatagccctcaatatctatctgatcataaattacacaatacaaaa

SEQ ID NO: 248135 - DNA, 75 bp, Artificial Sequence
  Synthetic
gtttctcacttgtgaaagagttcgaaggttttattatgagtgagatccttaggattactgaacatgctcaattca

SEQ ID NO: 248136 - DNA, 75 bp, Artificial Sequence
  Synthetic
actagctcaccacccacagaatccaacaaagaaacttcaacaatccctatagacaacccagacatcaatccaaac

SEQ ID NO: 248137 - DNA, 75 bp, Artificial Sequence
  Synthetic
gtacttaaattattaggagatactttgagatgtatcaaattattaatcaataaaaacttagagaatgctgcagaa

SEQ ID NO: 248138 - DNA, 75 bp, Artificial Sequence
  Synthetic
aatactttttggagaatgttcagcaaggttatgtttgaaccaaaagttaagaaaaggataatgttatatgatgta

SEQ ID NO: 248139 - DNA, 75 bp, Artificial Sequence
  Synthetic
acaaagaaaacatctcaagtacagtctctagaacacactctccaacacggacaacagcaaaggcggccaccagag

SEQ ID NO: 248140 - DNA, 75 bp, Artificial Sequence
  Synthetic
aacagccttatgcaacaaaaagttaaaaactatggcaggaaaacatagaaaggcagaatgtcactgtctacatac

SEQ ID NO: 248141 - DNA, 75 bp, Artificial Sequence
  Synthetic
ccaccgtccttcgcatgagcagcacaagagaaagaccaaccacaacatcagttcagtccgacagcagcaccacaa

SEQ ID NO: 248142 - DNA, 75 bp, Artificial Sequence
  Synthetic
aatgaaatcacaaaaatcctaaggttggagagcttgacagaactaagaggggcattcatattaaggattatcaaa

SEQ ID NO: 248143 - DNA, 75 bp, Artificial Sequence
  Synthetic
gttcagtccgacagcagcaccacaacccaaaatcatgaggaaacaggttcagcaaacccgcaggcatctgcaagc

SEQ ID NO: 248144 - DNA, 75 bp, Artificial Sequence
  Synthetic
aaaactatggcaggaaaacatagaaaggcagaatgtcactgtctacatacaaccgagtgggggtgctattatctt

SEQ ID NO: 248145 - DNA, 75 bp, Artificial Sequence
  Synthetic
gcttagcaaaagatggactatgtacttcaaagctaaaaattaccccagtcaactcgaattaagtgaacaagactt

SEQ ID NO: 248146 - DNA, 75 bp, Artificial Sequence
  Synthetic
aaatcagaacaaattctacccaggtctattaatacagtggtttagttatttaaaaactaaatattgtctaggctg

SEQ ID NO: 248147 - DNA, 75 bp, Artificial Sequence
  Synthetic
tgacaaagccatatcacctcctaaaagattaatatggtctgtgtatccaaagaattacttacctgagacgataaa

SEQ ID NO: 248148 - DNA, 75 bp, Artificial Sequence
  Synthetic
gcaacagtctgaatgaaaatcaggaagggctagggttgagaagtaatctgcaaggtatgttaactaataaactat

SEQ ID NO: 248149 - DNA, 75 bp, Artificial Sequence
  Synthetic
cagcatcaacaccagatacaacaaaccgcctgtcctccgtagacaggtccacgacacaaccaagtgaaaacagaa

SEQ ID NO: 248150 - DNA, 75 bp, Artificial Sequence
  Synthetic
gaagagtactagagtactatttaaaagataataaatttgatcaaaaggaacttaaaagttatgtagttagacaag

SEQ ID NO: 248151 - DNA, 75 bp, Artificial Sequence
  Synthetic
cttaaaagttatgtagttagacaagaatatttaaacgataaggagcacattgtctcattaactggaaaagaaaga

SEQ ID NO: 248152 - DNA, 75 bp, Artificial Sequence
  Synthetic
aattcctatcattagtaggttatataggatttaaaaactggtttatagagcagttaagagtagtagaattgcatg

SEQ ID NO: 248153 - DNA, 75 bp, Artificial Sequence
  Synthetic
taacagatcaattaacaaaattaaaaaataaaaacaggctcagagttcatggtaccgtattagaaaataatgatt

SEQ ID NO: 248154 - DNA, 75 bp, Artificial Sequence
  Synthetic
ctatgcaaccaggaaaacagcgacaaatacaaatattggcagaaaaattgttagctgataacattgtacctttct

SEQ ID NO: 248155 - DNA, 75 bp, Artificial Sequence
  Synthetic
taatcgtctaacagtttagttgatcattagttatttaaaattataaattagtaactaactgataaaaaatcagaa

SEQ ID NO: 248156 - DNA, 75 bp, Artificial Sequence
  Synthetic
cgatccacagcaagcaacacagtggactacagagaactcaacatccctagcagcaacctcagaaggctatctata

SEQ ID NO: 248157 - DNA, 75 bp, Artificial Sequence
  Synthetic
acaacagctccccagcaaaccacagacaaatacacagcactgctgaaatcaaccaacgaacagatcacccagaca

SEQ ID NO: 248158 - DNA, 75 bp, Artificial Sequence
  Synthetic
tcaacttttcagtgatagtgctatacactacagcagaaatgaagaagaagtaggaatcattgcagaaaacataac

SEQ ID NO: 248159 - DNA, 75 bp, Artificial Sequence
  Synthetic
gaattacatggaacacaaagcttattctgttggttacatcttatcgttcctatgactacaatgatatgtgcctat

SEQ ID NO: 248160 - DNA, 75 bp, Artificial Sequence
  Synthetic
acaccaccaaccaaaccagaaatgcaaatgagacaatcacaacatccgacagacccagaaccgacatcacaaccc

SEQ ID NO: 248161 - DNA, 75 bp, Artificial Sequence
  Synthetic
agacatgcaccaccagaaacaaaaggtgaatatgatatagataagatagaagagcaaagtggtctatatagatat

SEQ ID NO: 248162 - DNA, 75 bp, Artificial Sequence
  Synthetic
aacagacccaagctccccaccacactatgcgcagagaggcgcacaactcaaacaaacacaacacacaaacatccc

SEQ ID NO: 248163 - DNA, 75 bp, Artificial Sequence
  Synthetic
tatgcgcagagaggcgcacaactcaaacaaacacaacacacaaacatcccatccaagtagttaacaaaaaaccac

SEQ ID NO: 248164 - DNA, 75 bp, Artificial Sequence
  Synthetic
ctttattaaacggtgacaaccaatcaatagatgtaagtaaaccagtcaagttatctgaaggtttagatgaagtga

SEQ ID NO: 248165 - DNA, 75 bp, Artificial Sequence
  Synthetic
caaaatgtaaatttaaacccagaaaaacataaacactatatggatggtttgagcatatacaccaatgaaatagca

SEQ ID NO: 248166 - DNA, 75 bp, Artificial Sequence
  Synthetic
acaacactaatgagagatcctcaagctgttggatcagaacgacaagcaaaagtaacaagtgatatcaatagaaca

SEQ ID NO: 248167 - DNA, 75 bp, Artificial Sequence
  Synthetic
ccattacccgttagaatatcaaagggtaataggtgatttaaatagggtaatagatggtggtgaaggactatcaat

SEQ ID NO: 248168 - DNA, 75 bp, Artificial Sequence
  Synthetic
caaccctatgcgacaaaaagttaaaaaccatggtagaaaaacatagaaaggcagaatgtcactgtctaggtacaa

SEQ ID NO: 248169 - DNA, 75 bp, Artificial Sequence
  Synthetic
aaaaattcaagggataaatgacaatggatcccttttgtgaatctactgttaatgtttatctccctgattcatatc

SEQ ID NO: 248170 - DNA, 75 bp, Artificial Sequence
  Synthetic
agcaattggaaaaatgagatgggtgtataaagggacaccaggcttgcggcgattactcaacaagatctgtcttgg

SEQ ID NO: 248171 - DNA, 75 bp, Artificial Sequence
  Synthetic
aagaaataagagatgcatacagaaatataggccataaacttaaagaaggggaaacatatatatcaagggatcttc

SEQ ID NO: 248172 - DNA, 75 bp, Artificial Sequence
  Synthetic
gaaccaagcaaagagaccccaatgacctccacagcaagcccaagcaccaaacccaatccacagcaagcaacacag

SEQ ID NO: 248173 - DNA, 75 bp, Artificial Sequence
  Synthetic
caggtcacaagagaactcaatctattgtaggggaaaaagtaagcactatatcagaaactctagaactacccacca

SEQ ID NO: 248174 - DNA, 75 bp, Artificial Sequence
  Synthetic
agtattatatgaatcattgccctttcacaaagctgaaaaagttgtaaacatgatatcagggacaaaatctataac

SEQ ID NO: 248175 - DNA, 75 bp, Artificial Sequence
  Synthetic
aaacgcgtataaattagattccaaacaaaacgggacaaataaaaatgtctcttcaagggattcacctaagtgatc

SEQ ID NO: 248176 - DNA, 75 bp, Artificial Sequence
  Synthetic
tatgagtgaaattctaaaaattactgagcatgctcaattcagtactaggtttaggaatactttattgaatgggtt

SEQ ID NO: 248177 - DNA, 75 bp, Artificial Sequence
  Synthetic
agaaaatgctgcagaattatattatatattcagaatttttggacaccctatggtagatgagagggaagcaatgga

SEQ ID NO: 248178 - DNA, 75 bp, Artificial Sequence
  Synthetic
gaagaagaagaagaactaaaagacatacaggaaaataatcaagaagatgacatttaccagttaattatgtagttt

SEQ ID NO: 248179 - DNA, 75 bp, Artificial Sequence
  Synthetic
acctgtttataacagacaaattctctcaaaacaacaaagagaacagctagaagcaattggaaaaatgagatgggt

SEQ ID NO: 248180 - DNA, 75 bp, Artificial Sequence
  Synthetic
aacatgtggcacttcacaacttgatattatcctatatggagatgagcaaaactcctgcatccctgattaataacc

SEQ ID NO: 248181 - DNA, 75 bp, Artificial Sequence
  Synthetic
ctagtcctattaatcaagcactaagtgagagatttgggaatgaagatattaacttggtcttccaaaatgcaatca

SEQ ID NO: 248182 - DNA, 75 bp, Artificial Sequence
  Synthetic
gagtgaatcagccactgttgaagctgcaataagcagtgaagcagaccaagctctaacacaagccaaaattgcacc

SEQ ID NO: 248183 - DNA, 75 bp, Artificial Sequence
  Synthetic
actgatcatgattatgaccatgaacaatcccaaaggcatattcaagaagcttggagctgggactcaagttatagt

SEQ ID NO: 248184 - DNA, 75 bp, Artificial Sequence
  Synthetic
ctcaagttattgatcccacaacacaattagattacttccctaagataacattcgaaaggctaaaaaattatgaca

SEQ ID NO: 248185 - DNA, 75 bp, Artificial Sequence
  Synthetic
aaataagagagaaaattatttccatggaaacaatcttattgagtctttatcagcagcattagcatgtcattggtg

SEQ ID NO: 248186 - DNA, 75 bp, Artificial Sequence
  Synthetic
aatagatgaaacccaatcctaaatgttaacactaggttaggatccatccaagtctgttagttcaacaacccagcc

SEQ ID NO: 248187 - DNA, 75 bp, Artificial Sequence
  Synthetic
gcgtcaccaatggtggcttcataccacatagttagttaattaaaaaaatgggacaaatcatcatgtctcgtaagg

SEQ ID NO: 248188 - DNA, 75 bp, Artificial Sequence
  Synthetic
gaaaataatattttcaagaaagactggggtgacgggtttatatcagatcatgcttttatggacttcaaaatattc

SEQ ID NO: 248189 - DNA, 75 bp, Artificial Sequence
  Synthetic
tatgtagttggggatctcaagggaaaaacattaaagatgaagatatagtagatgaatcaatagataaattgttaa

SEQ ID NO: 248190 - DNA, 75 bp, Artificial Sequence
  Synthetic
tgccacagcagcagcagtcacagcaggcattgcaatagccaaaaccataaggcttgagagtgaagtgaatgcaat

SEQ ID NO: 248191 - DNA, 75 bp, Artificial Sequence
  Synthetic
cggattatacagatatcatatgggagggattgaagggtggtgccagaagttatggacaatggaagcaatatcctt

SEQ ID NO: 248192 - DNA, 75 bp, Artificial Sequence
  Synthetic
aagaacccagtctattgtaggggaaaaagtaaacactatatcagaaactctagagctacctaccatcagcaaacc

SEQ ID NO: 248193 - DNA, 75 bp, Artificial Sequence
  Synthetic
aaaacatgtattatcatgcagaatttgcactacttatgggacagacctctatttattcgcaaagtatcatgctaa

SEQ ID NO: 248194 - DNA, 75 bp, Artificial Sequence
  Synthetic
attggtcataaactcaaagaaggtgaaacatatatatcaagggatctccaatttataagtaaggtgattcaatct

SEQ ID NO: 248195 - DNA, 75 bp, Artificial Sequence
  Synthetic
caccaccaagtgcaagcagaacaaagacaagtccggcagtccacacaaaaaacaacccaaggacaagctccagaa

SEQ ID NO: 248196 - DNA, 75 bp, Artificial Sequence
  Synthetic
aaggacggtccgcagaaccaccactctccgcacaagcagcacaagaaaaagatcgtccacagcatcagtccaacc

SEQ ID NO: 248197 - DNA, 75 bp, Artificial Sequence
  Synthetic
cacgaagaagcaagtccagtgagcccacaaacatctgcaagcacaacaagaccacaaaggaaaagcatggaggcc

SEQ ID NO: 248198 - DNA, 75 bp, Artificial Sequence
  Synthetic
tggcagcatgttaatagatataactttgtctttagttctactggatgtaaagttagtctgaaaacatgtattgga

SEQ ID NO: 248199 - DNA, 75 bp, Artificial Sequence
  Synthetic
aagcaaagggaaaagcagctgaaatgatggaagaggaaatgaatcaaaggtcaaaaataggtaatggcagtgtaa

SEQ ID NO: 248200 - DNA, 75 bp, Artificial Sequence
  Synthetic
aaaagggagaccagtttcaagcagttttgatccaatcaggtttcctgaggatcagttcaatgttgcgcttgatca

SEQ ID NO: 248201 - DNA, 75 bp, Artificial Sequence
  Synthetic
actcaaaaaactcattgggatttgatacacagggtaagcaaagatgctttattaataactttatgtgatgcagaa

SEQ ID NO: 248202 - DNA, 75 bp, Artificial Sequence
  Synthetic
ttaatcatgtagtttaataaaaataaacaatgggacaagtcaagatggagtcctatctagtggacacttatcaag

SEQ ID NO: 248203 - DNA, 75 bp, Artificial Sequence
  Synthetic
cacaagccaagattgcaccctatgcaggactaattatgatcatgaccatgaacaatccaaaaggtatattcaaga

SEQ ID NO: 248204 - DNA, 75 bp, Artificial Sequence
  Synthetic
cttttgcgacacagcagcaggaattaatgttgctgagcaatcaaaggagtgcaacatcaacatatccactacaaa

SEQ ID NO: 248205 - DNA, 75 bp, Artificial Sequence
  Synthetic
taaagtaattgtttgattatgcaattatttgatagttaattaaaaattaaaattaaaaatcaaaagttaaaattt

SEQ ID NO: 248206 - DNA, 75 bp, Artificial Sequence
  Synthetic
taaaaaccatggtagaaaaacatagaaaggcagaatgtcactgtctacatataaccgagtgggggtgctattatc

SEQ ID NO: 248207 - DNA, 75 bp, Artificial Sequence
  Synthetic
ccctcaaaaagaccaatgaagcagtatctacattggggaatggcgttcgagtgttggcaactgcagtgagagagc

SEQ ID NO: 248208 - DNA, 75 bp, Artificial Sequence
  Synthetic
tgtctcctcttggggctctggttgcttgctacaaaggagtaagctgttccattggcagcaacagagtagggatca

SEQ ID NO: 248209 - DNA, 75 bp, Artificial Sequence
  Synthetic
gagaaatacaaaattctaagatgaaaatagcagtgtgtaatgatttttatgctgcaaaaaaactcgacaataaat

SEQ ID NO: 248210 - DNA, 75 bp, Artificial Sequence
  Synthetic
caattgaagctaattgtaaatcacttttgtcagggctaagaatacctataaataagaaggaactagatagacaga

SEQ ID NO: 248211 - DNA, 75 bp, Artificial Sequence
  Synthetic
tcatggaacaatatggaaatagtaggagtgacatctcctagtattgtaacatgtatggatgttgtgtatgcaact

SEQ ID NO: 248212 - DNA, 75 bp, Artificial Sequence
  Synthetic
atcaatcaaacagaatcctaagcagtgcagagaaagggaatactggcttcatcattgtaataattctaattgctg

SEQ ID NO: 248213 - DNA, 75 bp, Artificial Sequence
  Synthetic
ccacagacaaacacacagcactgccaaaatcaaccaatgaacagatcacccagacaaccacagagaaaaagacaa

SEQ ID NO: 248214 - DNA, 75 bp, Artificial Sequence
  Synthetic
ttacttaagttagtaaaaaataaatagaatgggataaatgacaatgaaaacattagatgtcataaaaagtgatgg

SEQ ID NO: 248215 - DNA, 75 bp, Artificial Sequence
  Synthetic
gaacaaagacaaacccgacagtccacaaagaaaacatctcaaatacagtttccagaacacagtccccaacacgga

SEQ ID NO: 248216 - DNA, 75 bp, Artificial Sequence
  Synthetic
aaaggaaaagaaaacacaaaccaaaccacaagtacagctgcaacccaaacaaccaacaccaccaaccaaatcaga

SEQ ID NO: 248217 - DNA, 75 bp, Artificial Sequence
  Synthetic
ttaaaaaactgatcaaagtaacaggatacatgcttgtaagtaaaaaatgaaaaatgatgaagatgacaaaataga

SEQ ID NO: 248218 - DNA, 75 bp, Artificial Sequence
  Synthetic
aaatcaaaagttaaaatttaaaacctatcattaagtttattaaaaataagaaattataattgaatgtatacggtt

SEQ ID NO: 248219 - DNA, 75 bp, Artificial Sequence
  Synthetic
aggaacactgatagagctgatggcctatcaataatatcaggcgcaggcagagaagacagaacgcaagattttgtt

SEQ ID NO: 248220 - DNA, 75 bp, Artificial Sequence
  Synthetic
gctatattaaaagagtctcagtacacaataaagagagatgtaggcacaacaacagcagtgacaccctcatcattg

SEQ ID NO: 248221 - DNA, 75 bp, Artificial Sequence
  Synthetic
ccagatcagaaatgcaagcgagacaatcacaacatccgacagacccagaactgacaccaccacccaaatcagcga

SEQ ID NO: 248222 - DNA, 75 bp, Artificial Sequence
  Synthetic
atttcaaggaaaattcaattataaactagttgataagataacctccgatcaacacatcttcagtcctgacaaaat

SEQ ID NO: 248223 - DNA, 75 bp, Artificial Sequence
  Synthetic
caacacacaggtatctcatccaagtagttaacaaaaaaaccacaaaataaccttgaaaaccaaaaaactaaaata

SEQ ID NO: 248224 - DNA, 75 bp, Artificial Sequence
  Synthetic
atgcaataatcaatagtcaaaccactgctgcaaactcatccataatataatcactgagtaatacaaaacaagaaa

SEQ ID NO: 248225 - DNA, 75 bp, Artificial Sequence
  Synthetic
accgagtggcggtgccattatcttcaagagaaaactcggctctcaacatcaaaaccagaacaaatcccatccaga

SEQ ID NO: 248226 - DNA, 75 bp, Artificial Sequence
  Synthetic
tatcacacagtagaatgccattgtatatacacaattgaatggaagtgctatcattattcaataggtaagacccaa

SEQ ID NO: 248227 - DNA, 75 bp, Artificial Sequence
  Synthetic
cttcacaacactttgcggtcatatgcaacaatcaatggtcaaaccactgctgcaaactcacccataatataatca

SEQ ID NO: 248228 - DNA, 75 bp, Artificial Sequence
  Synthetic
aaccatagaagtgggactagaaaccacagtcagaagggctaaccgtgtactaagtgatgcactcaagagataccc

SEQ ID NO: 248229 - DNA, 75 bp, Artificial Sequence
  Synthetic
ataagaagtagcaagtgccacagaaatgctacactgatccccattggatcaacagcattaagtatggcacttaat

SEQ ID NO: 248230 - DNA, 75 bp, Artificial Sequence
  Synthetic
atataaatttttatgttttaaacctgaagactcaaaaatcaacagctgtgatagactaaaagatttgtgcagaaa

SEQ ID NO: 248231 - DNA, 75 bp, Artificial Sequence
  Synthetic
tatcatacagtagaatgccattgtatatacacaattgaatggaaatgctatcattactcaatagatgaaacctaa

SEQ ID NO: 248232 - DNA, 75 bp, Artificial Sequence
  Synthetic
aaaatcaaccaatgaacagatcacccagacaaccacagagaaaaagacaaccagagcaacaacccaaaaaaggaa

SEQ ID NO: 248233 - DNA, 75 bp, Artificial Sequence
  Synthetic
atttttttaatcattgattatgcaatattaaaaaacatgaccaaagtggaacactgtgtcaatatgccgccggca

SEQ ID NO: 248234 - DNA, 75 bp, Artificial Sequence
  Synthetic
aaaacaggtaagtttctatgacacttcatagcaatagataataattaatagcttaattataattaaaacattatt

SEQ ID NO: 248235 - DNA, 75 bp, Artificial Sequence
  Synthetic
attaaaagagtctcaatacacaataaaaagagatgtaggcaccacaactgcagtgacaccttcatcattgcaaca

SEQ ID NO: 248236 - DNA, 75 bp, Artificial Sequence
  Synthetic
ggaaaataagcagaaatcaatgcacaaatataacaacatataaatttctatgctttaaacctgaggactcaaaaa

SEQ ID NO: 248237 - DNA, 75 bp, Artificial Sequence
  Synthetic
cagacgagcacacaacactgctgagatcaatcaacagacagaccacccaaacaaccacagagaaaaagccaaccg

SEQ ID NO: 248238 - DNA, 75 bp, Artificial Sequence
  Synthetic
acaaccacagagaaaaagccaaccggagcaacaaccaaaaaagaaaaggaaaccacaactcgaactacaagcaca

SEQ ID NO: 248239 - DNA, 75 bp, Artificial Sequence
  Synthetic
cctcgatgagcccttcagaaacagaaccagcatcaacaccaggcataacaaaacgcctgtcctttgtagacagat

SEQ ID NO: 248240 - DNA, 75 bp, Artificial Sequence
  Synthetic
actgagtatagccctcaatatctatctgatcgtaaattacacaatacaaaaaaccacatccgaatcagaacacca

SEQ ID NO: 248241 - DNA, 75 bp, Artificial Sequence
  Synthetic
cctaaatgtgagtgacgacagtcaaaatgattatgagtaattaaaaaagtgggacaagtcaaaatgtcgttccct

SEQ ID NO: 248242 - DNA, 75 bp, Artificial Sequence
  Synthetic
gggacaagtcaaaatgtcgttccctgaaggaaaagatattcttttcatgggtaatgaagcagcaaaattggcaga

SEQ ID NO: 248243 - DNA, 75 bp, Artificial Sequence
  Synthetic
gaaggaaaagatattcttttcatgggtaatgaagcagcaaaattggcagaagctttccagaaatcattaagaaaa

SEQ ID NO: 248244 - DNA, 75 bp, Artificial Sequence
  Synthetic
gaaatagacaaagaggcaagaaagacaatggtgactttgcttaaggagtcatcaggtaacatcccacaaaaccag

SEQ ID NO: 248245 - DNA, 75 bp, Artificial Sequence
  Synthetic
acagaaagccccacactcaacaccgcagcctcggcgagcccaccagaaacagaaccagcatcaacaccagacaca

SEQ ID NO: 248246 - DNA, 75 bp, Artificial Sequence
  Synthetic
tttaatttacaaagtaaaaacaaaaatatgggacaagtagttatggaggtgaaagtagagaacattcgagcaata

SEQ ID NO: 248247 - DNA, 75 bp, Artificial Sequence
  Synthetic
catatctcaaaggagtaatatcttttagtgaaaccaacgcaattggctcatgcctcttgaaaagaccctatctaa

SEQ ID NO: 248248 - DNA, 75 bp, Artificial Sequence
  Synthetic
cagcctcggcgagcccaccagaaacagaaccagcatcaacaccagacacaacaaaccgcctgtcctccgcagaca

SEQ ID NO: 248249 - DNA, 75 bp, Artificial Sequence
  Synthetic
tgtagaaaaccctgttgttgaacatgtaaggcttagaaatgcagtcatgaccaaaatgaagatatcagattataa

SEQ ID NO: 248250 - DNA, 75 bp, Artificial Sequence
  Synthetic
cagaacaaagacaaaactgacagtccacacaaaaaacaacccaagcacagcctccagaacacaatctccaccacg

SEQ ID NO: 248251 - DNA, 75 bp, Artificial Sequence
  Synthetic
cacacaaaaaacaacccaagcacagcctccagaacacaatctccaccacgggcaacaacgaaggcggtccccaga

SEQ ID NO: 248252 - DNA, 75 bp, Artificial Sequence
  Synthetic
ccttttatgaactatttgaacaaaaagtgtactacagaagtttattcattgagtacggaaaagctttaggctcat

SEQ ID NO: 248253 - DNA, 75 bp, Artificial Sequence
  Synthetic
ctacaacaaagggaagttaacaaggaattacatgacattattaccatggcagcacgtaaacaggtacaattttgt

SEQ ID NO: 248254 - DNA, 75 bp, Artificial Sequence
  Synthetic
aaaagaagttgaaaccatcaaccaacacaaaaaagaaagtttcatttacaccgaatgaaccaggaaaatatacaa

SEQ ID NO: 248255 - DNA, 75 bp, Artificial Sequence
  Synthetic
aacaatctccacagacaacccagacatcaatccaaactcacagcatccaactcaacagtccacagaaaaccccac

SEQ ID NO: 248256 - DNA, 75 bp, Artificial Sequence
  Synthetic
atcaatccaaactcacagcatccaactcaacagtccacagaaaaccccacactcaaccccgcagcatcagcgagc

SEQ ID NO: 248257 - DNA, 75 bp, Artificial Sequence
  Synthetic
ctatgtcaggaattagaatttaagggggaaagcataatagttagtctgatattaaggaatttttggctgtataat

SEQ ID NO: 248258 - DNA, 75 bp, Artificial Sequence
  Synthetic
gctttcagacaatgaagaggaagatgcagaatcctcaatcttaaccttcgaagaaagagatacttcatcattaag

SEQ ID NO: 248259 - DNA, 75 bp, Artificial Sequence
  Synthetic
acagttgtgagctcacactattgaaacagtttttaacaaggagtaaaaacattagcactctcaaattaaatatga

SEQ ID NO: 248260 - DNA, 75 bp, Artificial Sequence
  Synthetic
aatacaaaacaaaattagttaacaaaaaatacaagatagctccaaagtaaaacatgtaggcaccaacagtaaaga

SEQ ID NO: 248261 - DNA, 75 bp, Artificial Sequence
  Synthetic
agtccagtccgacagcagcaccacaacccaaaatcacgaagaaacaagcccatcgaacccacaggcatccgcaag

SEQ ID NO: 248262 - DNA, 75 bp, Artificial Sequence
  Synthetic
ccaagacagcaacaacatcatgtcagcttcactcaaatctccctaggagaaactctcgcccacatactaacaaca

SEQ ID NO: 248263 - DNA, 75 bp, Artificial Sequence
  Synthetic
cttttacatctaagacaaagtccaaaggcagggctgttatcattggccaattgccccaattttgccagtgttgtt

SEQ ID NO: 248264 - DNA, 75 bp, Artificial Sequence
  Synthetic
cccaagcacagcctccagcacacaatccccaccacgggcaacaacaaaggcaatccgcagagccaccaccttccg

SEQ ID NO: 248265 - DNA, 75 bp, Artificial Sequence
  Synthetic
gcttcactcaaatctccctaggagaaactctcgcccacatactaacaacatcacaactatctcaagaaaagaaac

SEQ ID NO: 248266 - DNA, 75 bp, Artificial Sequence
  Synthetic
taatcggaatgtacagagggagagtgccaaacacagagctattttctgcagcagaaagttatgccagaagcttaa

SEQ ID NO: 248267 - DNA, 75 bp, Artificial Sequence
  Synthetic
caaactgcaaatctcttctatcaggattgagaatacctataaacaaaaaggaattaaatagacaaaagaaattgt

SEQ ID NO: 248268 - DNA, 75 bp, Artificial Sequence
  Synthetic
gcagcagaaatgatggaagaggaaatgaaccaacggacaaaaataggaaacggtagtgtaaaattaactgaaaag

SEQ ID NO: 248269 - DNA, 75 bp, Artificial Sequence
  Synthetic
caattttatgtagatcactaggcaagttagttttcattgtatcatcttatgggtgtgtagtaaaaagcaacaaaa

SEQ ID NO: 248270 - DNA, 75 bp, Artificial Sequence
  Synthetic
gcaaaggagctcaacaaaattgttgaagatgaaagcacaagtggagaatctgaagaagaagaagaactaaaagac

SEQ ID NO: 248271 - DNA, 75 bp, Artificial Sequence
  Synthetic
acatttaccagttaattatgtagtttaataaaaataaacaatgggacaagtaaaaatggagtcctatctggtaga

SEQ ID NO: 248272 - DNA, 75 bp, Artificial Sequence
  Synthetic
aacaatcaagaaaccaaaagataactcacaatctccctaaaacagcaacgacaccatgtcagctttgctcaaatc

SEQ ID NO: 248273 - DNA, 75 bp, Artificial Sequence
  Synthetic
gagactaagatacgatttttcaaagccttattatctatagaaaagaatgaacgtgctacattaacaacactaatg

SEQ ID NO: 248274 - DNA, 75 bp, Artificial Sequence
  Synthetic
tgttaaccaataaattatatgaaactgttgattatatgttaagtctatgtagtaatgaagggttctcactagtga

SEQ ID NO: 248275 - DNA, 75 bp, Artificial Sequence
  Synthetic
actgagaaaataatcatctaacagtttagttgatcattagttaattaaaaattataaattagtaactaactgata

SEQ ID NO: 248276 - DNA, 75 bp, Artificial Sequence
  Synthetic
ttaaaaattataaattagtaactaactgataaaaaatcagaaattgaaattgaatgtatacggtttttttgccgt

SEQ ID NO: 248277 - DNA, 75 bp, Artificial Sequence
  Synthetic
atgtctcttcaagggattcacctaagtgatctgtcatataaacatgctatattaaaagagtctcaatacacaata

SEQ ID NO: 248278 - DNA, 75 bp, Artificial Sequence
  Synthetic
ggagtaatttcttttagtgaaactaatgcaattggttcatgtctcttaaaaagaccttacttaaaaaatgacaac

SEQ ID NO: 248279 - DNA, 75 bp, Artificial Sequence
  Synthetic
tgatgggaagactcccgcagagaaaaaatcaaagttttcaaccagtgtaaaaaagaaagtttcctttacatcaaa

SEQ ID NO: 248280 - DNA, 75 bp, Artificial Sequence
  Synthetic
cagacaatgaggaagaagacgcagaatcctcaatcttaacctttgaggagaaagacacatcatcactaagcattg

SEQ ID NO: 248281 - DNA, 75 bp, Artificial Sequence
  Synthetic
agccaaatcagttggcaaaaaaacacatgatctaatcgcattgtgtgattttatggatctagaaaagaacacacc

SEQ ID NO: 248282 - DNA, 75 bp, Artificial Sequence
  Synthetic
tattgcattaaaactgatattggccttattgacgtttttcacagtaacaattactgttaactatataaaagtaga

SEQ ID NO: 248283 - DNA, 75 bp, Artificial Sequence
  Synthetic
ttactgttaactatataaaagtagaaaataatttgcaggcatgtcaattaaaaaatgaatcagacaaaaaggaca

SEQ ID NO: 248284 - DNA, 75 bp, Artificial Sequence
  Synthetic
aaataatttgcaggcatgtcaattaaaaaatgaatcagacaaaaaggacacaaagctaaatactacatcaacaac

SEQ ID NO: 248285 - DNA, 75 bp, Artificial Sequence
  Synthetic
aaagacacatcatcactaagcattgaagctagattagaatctatagaagagaagttgagcatgatattaggactg

SEQ ID NO: 248286 - DNA, 75 bp, Artificial Sequence
  Synthetic
agaatttatacctagttgggtaagcaactggtttagtaattggtacaatctcaataagttaattttggaattcag

SEQ ID NO: 248287 - DNA, 75 bp, Artificial Sequence
  Synthetic
ttcagaaacacaccaactttgtcataaaagacagagatacctgttggagagtacacacgaatcaatgcacaaata

SEQ ID NO: 248288 - DNA, 75 bp, Artificial Sequence
  Synthetic
agtacaattcgaacaggaattttctgtccctgaaaaaaccaaccttgagatggtattaaatgataaagcaatatc

SEQ ID NO: 248289 - DNA, 75 bp, Artificial Sequence
  Synthetic
gcgacaaaaagtcaaaaaccatgacagaaaaacataggaaagcagagtgtcactgtctacatacaaccgagtggt

SEQ ID NO: 248290 - DNA, 75 bp, Artificial Sequence
  Synthetic
atgtgctgaagtccagataacagccaagcaacctggccaagaactaccaactctattctatagactaaaaagtcg

SEQ ID NO: 248291 - DNA, 75 bp, Artificial Sequence
  Synthetic
agaaaaacataggaaagcagagtgtcactgtctacatacaaccgagtggtggtgttattatctttaagagaaaac

SEQ ID NO: 248292 - DNA, 75 bp, Artificial Sequence
  Synthetic
ccgttttagttatataaaaatcaagttagagtaagaattaaatcaatcaagagtgggacaaataaaaatgtcttg

SEQ ID NO: 248293 - DNA, 75 bp, Artificial Sequence
  Synthetic
ggggaaaaagtaaacactatatcagaaactctagaactacccaccatcagcaaacctgcacgatcatctacactg

SEQ ID NO: 248294 - DNA, 75 bp, Artificial Sequence
  Synthetic
tgttcaagttgacctggtagaaaaagatttactgccagcaagtttgacaatatggtttcctttatttcaggccaa

SEQ ID NO: 248295 - DNA, 75 bp, Artificial Sequence
  Synthetic
ctaataacacctcaacacggtcttaaagagagctacttagaagaatcatgtagcactataactgagggatatctc

SEQ ID NO: 248296 - DNA, 75 bp, Artificial Sequence
  Synthetic
atcaattaacaaaattaaaaaataaaaacagactcagagttcatggtaccgtattagaaaataatgattatccaa

SEQ ID NO: 248297 - DNA, 75 bp, Artificial Sequence
  Synthetic
tgatgtagaaaacctcacatgtgctgatggacctagcctaataaaaacagaattagatctgaccaaaagtgcact

SEQ ID NO: 248298 - DNA, 75 bp, Artificial Sequence
  Synthetic
aatgcaagtgatagtctcaaaacaagaagagtactagagtactatttgaaagataataaatttgatcaaaaagaa

SEQ ID NO: 248299 - DNA, 75 bp, Artificial Sequence
  Synthetic
taatggtgaagatattgacagggctgtatctatgatgttggagaatctaggattattgtctagaatattgtcagt

SEQ ID NO: 248300 - DNA, 75 bp, Artificial Sequence
  Synthetic
aactgtagcacttgatgaatacagtaaacttgattttgacaagctgacggtttgtgatgttaaaacagtttattt

SEQ ID NO: 248301 - DNA, 75 bp, Artificial Sequence
  Synthetic
aagtaacgggatacatgcttgtaagtaaaaaatgaaaaatgatgaagatgataaaatagatgacaacttcatacc

SEQ ID NO: 248302 - DNA, 75 bp, Artificial Sequence
  Synthetic
atgctgcagaattatactatatattcagaatttttggtcatccaatggtagatgaaagagatgcaatggatgctg

SEQ ID NO: 248303 - DNA, 75 bp, Artificial Sequence
  Synthetic
aataaaaagagatgtaggcaccacaactgcagtgacaccttcatcattgcagcaagagataacacttttgtgtgg

SEQ ID NO: 248304 - DNA, 75 bp, Artificial Sequence
  Synthetic
ctctgtatgctgcatcacagaatggtccaatactcaaggtaaatgcatctgcccaaggtgctgccatgtctgtac

SEQ ID NO: 248305 - DNA, 75 bp, Artificial Sequence
  Synthetic
caataccagcattcataaagtcagtttcaatcagagagagtgagtcagccactgttgaagctgcaataagcagcg

SEQ ID NO: 248306 - DNA, 75 bp, Artificial Sequence
  Synthetic
tgattacaaatatgctgcagaaataggaatacaatatattagcacagctttaggatcagagagagtgcagcagat

SEQ ID NO: 248307 - DNA, 75 bp, Artificial Sequence
  Synthetic
atacagatatcatatgggagggattgaagggtggtgtcagaagttatggacaatggaagcgatatccttgttaga

SEQ ID NO: 248308 - DNA, 75 bp, Artificial Sequence
  Synthetic
taggatcagagagagtgcagcagattctgaggaactcaggcagtgaagtccaagtggtcttaaccagaacgtact

SEQ ID NO: 248309 - DNA, 75 bp, Artificial Sequence
  Synthetic
aatcatcaggtaacatcccacaaaaccagaggccttcagcaccagacacaccaataattttattatgtgtaggtg

SEQ ID NO: 248310 - DNA, 75 bp, Artificial Sequence
  Synthetic
acttaatgacagatgctgaactagccagggccgtttccaacatgccgacatctgcaggacaaataaaattgatgt

SEQ ID NO: 248311 - DNA, 75 bp, Artificial Sequence
  Synthetic
gagatcagctgagttgcatgaggtaccttggattgtcaatgccgaaggtgatctggttgagatcaagtcaattaa

SEQ ID NO: 248312 - DNA, 75 bp, Artificial Sequence
  Synthetic
ctgggggcatatgttcaggctgagagcatcagtagaatctgcaagagctggagtcaccaaggaacaagatacgtg

SEQ ID NO: 248313 - DNA, 75 bp, Artificial Sequence
  Synthetic
aattataagggcatcaatagaaagcgggacaaataaaaatgtcttggaaagtgatgatcatcatttcgttactca

SEQ ID NO: 248314 - DNA, 75 bp, Artificial Sequence
  Synthetic
tagggtagatataccaaagattgctagatctttctatgaactatttgagcagaaagtgtattacaggagtctatt

SEQ ID NO: 248315 - DNA, 75 bp, Artificial Sequence
  Synthetic
gggaagcagttattcaaacaactaaataaaacattaacatcagtgcagagattttttgaaattaaaaaggaaaat

SEQ ID NO: 248316 - DNA, 75 bp, Artificial Sequence
  Synthetic
cattgagtatgggaaagctttaggctcatcttcaacaggaagcaaagcagaaagtttgtttgtaaatatatttat

SEQ ID NO: 248317 - DNA, 75 bp, Artificial Sequence
  Synthetic
tcatcttcaacaggaagcaaagcagaaagtttgtttgtaaatatatttatgcaagcttatggagccggtcaaaca

SEQ ID NO: 248318 - DNA, 75 bp, Artificial Sequence
  Synthetic
ttttgaactgaagaaagaaaatgatgtggttgacctatggatgaatataccaatgcagtttggagggggagatcc

SEQ ID NO: 248319 - DNA, 75 bp, Artificial Sequence
  Synthetic
aaaagggaaactatgcttgcctcttaagagaagaccaaggatggtattgtcagaatgcagggtcaactgtttact

SEQ ID NO: 248320 - DNA, 75 bp, Artificial Sequence
  Synthetic
tgtcttcacattagaagttggtgatgttgaaaatcttacatgtactgatggacctagcttaatcaaaacagaact

SEQ ID NO: 248321 - DNA, 75 bp, Artificial Sequence
  Synthetic
actgaatcagacaaaaaggactcatcatcaaataccacatcagtcacaaccaagaccactctaaatcatgatata

SEQ ID NO: 248322 - DNA, 75 bp, Artificial Sequence
  Synthetic
catctgtttgtgcatcaataataccatcattatttaagaattaagaaggaactaaaattcaagggacaaataaca

SEQ ID NO: 248323 - DNA, 75 bp, Artificial Sequence
  Synthetic
gcaagcttatggagccggtcaaacaatgctaaggtggggtgtcattgccagatcatctaacaacataatgctagg

SEQ ID NO: 248324 - DNA, 75 bp, Artificial Sequence
  Synthetic
ggtgagcaattggtttagtaactggtataatctcaataaattaatcttagagtttagaagagaggaagtaataag

SEQ ID NO: 248325 - DNA, 75 bp, Artificial Sequence
  Synthetic
ctaggtgcaatagctctcggagttgctacagcagcagcagtcacagcaggcattgcaatagctaaaaccataagg

SEQ ID NO: 248326 - DNA, 75 bp, Artificial Sequence
  Synthetic
atcaacttttcagtgatagtgctatacactatagcagaaatgaagaagaagtgggaatcattgcagaaaacataa

SEQ ID NO: 248327 - DNA, 75 bp, Artificial Sequence
  Synthetic
ggttccaccaatgtggttcaaggttatattgatgataaccaaagcataacaaaagctgcagcctgttacagtcta

SEQ ID NO: 248328 - DNA, 75 bp, Artificial Sequence
  Synthetic
gggaaaggcaaaaacagtaaaggggaagagctgcagatgttagatatacatggagtagaaaagagttgggtagaa

SEQ ID NO: 248329 - DNA, 75 bp, Artificial Sequence
  Synthetic
cccaaaagctggactgttatcactagccaactgtcccaactttgcaagtgttgttctcggaaatgcctcaggctt

SEQ ID NO: 248330 - DNA, 75 bp, Artificial Sequence
  Synthetic
ttaaaagaaagcaacaaaatcaacttctcctcattagggctcacagacgaagaaaaagaagctgcagaacacttc

SEQ ID NO: 248331 - DNA, 75 bp, Artificial Sequence
  Synthetic
aaatctgactagtgcaatcaacaggaacaaatgtgacattgctgatctgaagatggctgtcagcttcagtcaatt

SEQ ID NO: 248332 - DNA, 75 bp, Artificial Sequence
  Synthetic
aatgactgatgctgaattggccagagctgtatcatacatgccaacatctgcaggacagataaaactgatgttgga

SEQ ID NO: 248333 - DNA, 75 bp, Artificial Sequence
  Synthetic
agttatggaggtgaaagtggagaacattcgagcaatagacatgctcaaagcaagagtgaaaaatcgtgtggcacg

SEQ ID NO: 248334 - DNA, 75 bp, Artificial Sequence
  Synthetic
attataatcaagaaaacaaagaaaccaacaggagcacctccagagctgagtggtgtcacaaacaatggcttcata

SEQ ID NO: 248335 - DNA, 75 bp, Artificial Sequence
  Synthetic
gcagacagcagcggagccaccaaaaccacagagaaacaaacaaccaaaacaacagatcctgttgaagaagaggaa

SEQ ID NO: 248336 - DNA, 75 bp, Artificial Sequence
  Synthetic
acggaagctctgtgatttacatggttcaattgccgatctttggtgtcatagatacaccttgttggataatcaagg

SEQ ID NO: 248337 - DNA, 75 bp, Artificial Sequence
  Synthetic
gggataaatgacaatgataacattagatgtcattaaaagtgatgggtcttcaaaaacatgtactcacctcaaaaa

SEQ ID NO: 248338 - DNA, 75 bp, Artificial Sequence
  Synthetic
caaatgaaccagggaaatataccaaactagaaaaagatgccctagatttgctctcagacaatgaggaagaagacg

SEQ ID NO: 248339 - DNA, 75 bp, Artificial Sequence
  Synthetic
ggtgatcatgttttttgtgacacagcagcagggatcaatgttgctgagcaatcaagagaatgcaacatcaacata

SEQ ID NO: 248340 - DNA, 75 bp, Artificial Sequence
  Synthetic
aaaccgcctgtcctccgcagacagatccacaacacaaccaagcaaaagcagaacaaagacaactccgacagtcca

SEQ ID NO: 248341 - DNA, 75 bp, Artificial Sequence
  Synthetic
tgggtaggatcaagcactcaagagaaaaaattagttcctgtttataacagacaaattctttcaaaacaacaaaaa

SEQ ID NO: 248342 - DNA, 75 bp, Artificial Sequence
  Synthetic
taagctgctcgattggcagcaatcgggttggaatcatcaaacaattacctaaaggctgctcatacataactaacc

SEQ ID NO: 248343 - DNA, 75 bp, Artificial Sequence
  Synthetic
ttaatcaacaatcttaaaagactgccgagagaaaaactgaaaaaattagcaaagctgataattgacttatcagca

SEQ ID NO: 248344 - DNA, 75 bp, Artificial Sequence
  Synthetic
atgatatggactcaaaaagaattaaaagaagctttatccgatgggatagtgaagtctcacactaacatttacaat

SEQ ID NO: 248345 - DNA, 75 bp, Artificial Sequence
  Synthetic
tcattgcagacaacataacacctgtttatcctcatggattgagagtgctctatgaatcactaccttttcataagg

SEQ ID NO: 248346 - DNA, 75 bp, Artificial Sequence
  Synthetic
ctgctgttcaagttgatctggtagaaaaagacttactaccagcaagtttgacaatatggtttcctctattccaag

SEQ ID NO: 248347 - DNA, 75 bp, Artificial Sequence
  Synthetic
atagttagttaattaaaaaatgggacaaatcatcatgtctcgtaaggctccatgcaaatatgaagtgcggggcaa

SEQ ID NO: 248348 - DNA, 75 bp, Artificial Sequence
  Synthetic
actaacatttttcacagtaacaatcactataaattacataaaagtagaaaacaatctgcaaatatgccagtcaaa

SEQ ID NO: 248349 - DNA, 75 bp, Artificial Sequence
  Synthetic
ttcaatcacaattactggagttggcctgatagatatttattgttaagatcaaattatctcttaaatcagctttta

SEQ ID NO: 248350 - DNA, 75 bp, Artificial Sequence
  Synthetic
ggtaggctgatatgttgtcaaatctctaggactttaagagagacatcatggaacaatatggaaatagttggagta

SEQ ID NO: 248351 - DNA, 75 bp, Artificial Sequence
  Synthetic
taattgtttgattatgcgattacatgatagttaattaaaaaattcaattaaaaatcaaaagttaaaatttaaaac

SEQ ID NO: 248352 - DNA, 75 bp, Artificial Sequence
  Synthetic
aacacagtattttaaaagattgattcaaaggtatacagattctgtaataaacaaggacacatgctggaaaataag

SEQ ID NO: 248353 - DNA, 75 bp, Artificial Sequence
  Synthetic
gatggtgtcaaaatttgtgagttcagccaaatcagttggcaaaaagacacatgatctaattgcactgtgtgactt

SEQ ID NO: 248354 - DNA, 75 bp, Artificial Sequence
  Synthetic
ggtacattgatgataatcaaggaataaccaaggctgcagcttgctatagtctacacaacataatcaagcaactac

SEQ ID NO: 248355 - DNA, 75 bp, Artificial Sequence
  Synthetic
acatataaatttttatgttttaaacctgaagactcaaaaatcaacagttgtgatagactgacagatttatgcaga

SEQ ID NO: 248356 - DNA, 75 bp, Artificial Sequence
  Synthetic
agacaacaagctttctgatagcaaacatgtggcgctccacaacttgatattatcatatatggagatgagcaaaac

SEQ ID NO: 248357 - DNA, 75 bp, Artificial Sequence
  Synthetic
agccactgttgaagctgcaataagcagtgaggccgaccaagcattaacacaagccaaaattgcaccctatgcagg

SEQ ID NO: 248358 - DNA, 75 bp, Artificial Sequence
  Synthetic
aatcccagacaatctagatttgttctaggagcaatagcactcggtgttgcaacagcagctgcagttacagcaggt

SEQ ID NO: 248359 - DNA, 75 bp, Artificial Sequence
  Synthetic
aattctccaaagggcgaattaaattatgatttttttgaagcattagagaacacttaccctaatatgattaaacta

SEQ ID NO: 248360 - DNA, 75 bp, Artificial Sequence
  Synthetic
gatctgtcttgggagtttaggcattagttacaaatgtgtaaaacctttattacctaggtttatgagtgtaaattt

SEQ ID NO: 248361 - DNA, 75 bp, Artificial Sequence
  Synthetic
aagaaactaccaaaggaaaaactgaagaaattagcaagattaataattgatttatcagcaggaactgacaatgac

SEQ ID NO: 248362 - DNA, 75 bp, Artificial Sequence
  Synthetic
tatatacacaatcgaatggaagtgctatcattattcaatagataagacccaatcttgaatgttaaaactagatta

SEQ ID NO: 248363 - DNA, 75 bp, Artificial Sequence
  Synthetic
atagtttagttatttaaaaatattttgaaaacaggtatgcttctatgacacttcacagcaataggttataattaa

SEQ ID NO: 248364 - DNA, 75 bp, Artificial Sequence
  Synthetic
gtccgcagaaccaccactctccacacaagcagcataagaaaaagaccgcccacagcatcagcccaaccagacagc

SEQ ID NO: 248365 - DNA, 75 bp, Artificial Sequence
  Synthetic
tgtactaaaatccagataaaaataactgtcctaatcaataattgcttatataatcctaaagatcaatgagcttat

SEQ ID NO: 248366 - DNA, 75 bp, Artificial Sequence
  Synthetic
ggaagagttgcaaatgttagatatacatggagtggaaaagagttgggtagaagaaatagacaaagaggcaagaaa

SEQ ID NO: 248367 - DNA, 75 bp, Artificial Sequence
  Synthetic
taatcctaaagatcaatgagcttattattatagttatataaaaataatttagaactaggaaggtattaatagaaa

SEQ ID NO: 248368 - DNA, 75 bp, Artificial Sequence
  Synthetic
aaagaattaaaagaaacactatctgatgggatagtaaaatcacacaccaatatttatagttgttacttagaaaac

SEQ ID NO: 248369 - DNA, 75 bp, Artificial Sequence
  Synthetic
agaactaggaaggtattaatagaaagcgggacaagtgaaaatgtcttggaaagtgatgattatcatttcgttact

SEQ ID NO: 248370 - DNA, 75 bp, Artificial Sequence
  Synthetic
cttacacgattaattaggaagaaattgatgtgtgataatgcactcttcaatccaagttcatcaccaatgtttagt

SEQ ID NO: 248371 - DNA, 75 bp, Artificial Sequence
  Synthetic
cacaacatctgccagatccagaaacaatgccacaactcaaagcagcgaccaaacaacccagacagcagacccaag

SEQ ID NO: 248372 - DNA, 75 bp, Artificial Sequence
  Synthetic
cataacacctcagcacggactaaaagaaagttatttagaagaatcatgtagtactataactgaaggatatctcag

SEQ ID NO: 248373 - DNA, 75 bp, Artificial Sequence
  Synthetic
aagcaccttggccaagagctactaactctatctcatagattataaagtcaccattctagttatataaaaatcaag

SEQ ID NO: 248374 - DNA, 75 bp, Artificial Sequence
  Synthetic
atctgatcataaactacacaatacaaaaaaccacatctgaatcagaacaccacactagctcaccacccacagaat

SEQ ID NO: 248375 - DNA, 75 bp, Artificial Sequence
  Synthetic
cattagatgtcataaaaagtgatggatcctcagaaacgtgtaatcaactcaaaaaaacaataaaaaaacactcgg

SEQ ID NO: 248376 - DNA, 75 bp, Artificial Sequence
  Synthetic
aagagagctacttagaagagtcatgtagcactataactgaaggatatctcagtgttctgaggacaggttggtata

SEQ ID NO: 248377 - DNA, 75 bp, Artificial Sequence
  Synthetic
gagaactcaaaacagtttctgctgatcagttagcgagagaagaacaaattgaaaatcccagacaatcaaggtttg

SEQ ID NO: 248378 - DNA, 75 bp, Artificial Sequence
  Synthetic
gctaaggtggggtgtcattgccagatcatccaacaacataatgctagggcatgtatctgtgcaagctgaattgaa

SEQ ID NO: 248379 - DNA, 75 bp, Artificial Sequence
  Synthetic
actttgtcataaaagacagtgacacttgttggagaatacacaagaatcaatgtgcaaatataaaaatatacaagt

SEQ ID NO: 248380 - DNA, 75 bp, Artificial Sequence
  Synthetic
tccacaaaaaaaacatctcaagcacagtctctagaacacagtctccaccacggacaacagcgaaggcggtcccca

SEQ ID NO: 248381 - DNA, 75 bp, Artificial Sequence
  Synthetic
cacaggagaaagaccaaccacaacaccagtccagcctgacagcagcaccacaacacaaaatcatgaagaaacagg

SEQ ID NO: 248382 - DNA, 75 bp, Artificial Sequence
  Synthetic
tgggacttgatacacagaataagtaaagatgctttattgataacattgtgtgatgcagaattcaaaaacagagat

SEQ ID NO: 248383 - DNA, 75 bp, Artificial Sequence
  Synthetic
ccagtccagcctgacagcagcaccacaacacaaaatcatgaagaaacaggctcagcaaacccacaggcatctgca

SEQ ID NO: 248384 - DNA, 75 bp, Artificial Sequence
  Synthetic
aaaccatggtagaaaaacatagaagagcagagtgtcactgtctacatataaccgagtgggggtgctattatcttt

SEQ ID NO: 248385 - DNA, 75 bp, Artificial Sequence
  Synthetic
ccttggattgtcaatgccgaaggtgatttggttgagatcaagtcaattaaaatctatttgcaactgatagaacaa

SEQ ID NO: 248386 - DNA, 75 bp, Artificial Sequence
  Synthetic
gagctgtatcatacatgccaacatctgcaggacagataaaactaatgttagagaaccgtgcaatggtgaggagaa

SEQ ID NO: 248387 - DNA, 75 bp, Artificial Sequence
  Synthetic
acaggagaaagaccaaccacaacatcagtccagtctgacagcagcaccacagcccgaaatcatgaagaaacaggt

SEQ ID NO: 248388 - DNA, 75 bp, Artificial Sequence
  Synthetic
tagatacaccttgttggataatcaaggcagctccctcttgttcagaaaaagatggaaattatgcttgcctcctaa

SEQ ID NO: 248389 - DNA, 75 bp, Artificial Sequence
  Synthetic
agacatgttcaaagcaaagataaagaaccgtataagaagcagcaggtgctatagaaatgctacactgatccttat

SEQ ID NO: 248390 - DNA, 75 bp, Artificial Sequence
  Synthetic
tacaaatataaaaatatacaagttcttatgcttcgggttcataaattcaacaggtacagattgtgaggaactaac

SEQ ID NO: 248391 - DNA, 75 bp, Artificial Sequence
  Synthetic
cttaatattttcctgatcattgatcatgcaacactaagaaacatgatcaaaacagaaaactgtgctaacatgccg

SEQ ID NO: 248392 - DNA, 75 bp, Artificial Sequence
  Synthetic
atagaaatgctacactgatccttattggactaacagcactaagcatggcacttaatattttcctgatcattgatc

SEQ ID NO: 248393 - DNA, 75 bp, Artificial Sequence
  Synthetic
aatgggataaatgacaatgaaaacattagatgtcataaaaagtgatggatcctcagaaacgtgtaatcaactcaa

SEQ ID NO: 248394 - DNA, 75 bp, Artificial Sequence
  Synthetic
caattctaaaatgaaaatatcagattacaaggtagtagaaccagtaaacatgcaacatgaaataatgaagaatgt

SEQ ID NO: 248395 - DNA, 75 bp, Artificial Sequence
  Synthetic
tgaaatcagaacaaattctactcaggtttattaatacagtgtcttagttatttaaaaaccggatactgtctaggt

SEQ ID NO: 248396 - DNA, 75 bp, Artificial Sequence
  Synthetic
gcttgagagtgaagttacagcaattaagaatgcccttaaaaagactaatgaagcagtgtctacattggggaatgg

SEQ ID NO: 248397 - DNA, 75 bp, Artificial Sequence
  Synthetic
ctcagacaatgaggaagaagacgcagagtcctcaatcctaacctttgaagagagagacacatcatcactaagcat

SEQ ID NO: 248398 - DNA, 75 bp, Artificial Sequence
  Synthetic
tcagcacaggaagacaccctatcagcatggttgcactatcacctctcggtgctttggtggcttgctacaaagggg

SEQ ID NO: 248399 - DNA, 75 bp, Artificial Sequence
  Synthetic
accaaaatcaaccaatgaacggatcactcagacaaccacagagaaaaagacaaccagagcaacaacccaaagaag

SEQ ID NO: 248400 - DNA, 75 bp, Artificial Sequence
  Synthetic
acattagcactctcaaattaaatatgatatgtgattggctgcaattaaaatctacatcagatgatacctcaatcc

SEQ ID NO: 248401 - DNA, 75 bp, Artificial Sequence
  Synthetic
aaacaaccaacaccaccaaccaaatcagaaatgcaagtgagacaatcacaacatccgacagacccagaactgaca

SEQ ID NO: 248402 - DNA, 75 bp, Artificial Sequence
  Synthetic
ataaattaaattacaaaaaaatatgggacaagtgaaaatgtctcttcaagggattcacctgagtgatctatcata

SEQ ID NO: 248403 - DNA, 75 bp, Artificial Sequence
  Synthetic
tgttaacatggaaagatgtgatgttaagtcgattcaatgcgaatttttgtatatgggtgagcaacagtctgaatg

SEQ ID NO: 248404 - DNA, 75 bp, Artificial Sequence
  Synthetic
acagctctagggtcagagagagtacagcagattctaagaaactcaggcagtgaagtccaagcggttttaaccaga

SEQ ID NO: 248405 - DNA, 75 bp, Artificial Sequence
  Synthetic
acccagaaaaacatagacactatatggagggtttgggcatatgcaccaatgagatggcatctgttcatgtatcaa

SEQ ID NO: 248406 - DNA, 75 bp, Artificial Sequence
  Synthetic
aaaacgggacaaataaaaatgtctcttcaagggattcacctaagtgatctgtcatataaacatgctatattaaaa

SEQ ID NO: 248407 - DNA, 75 bp, Artificial Sequence
  Synthetic
ggcagcaaccccagagggccatccatacacagagacaacccaaacaccagacacaacagctctccagcaaaccac

SEQ ID NO: 248408 - DNA, 75 bp, Artificial Sequence
  Synthetic
agacaaacacacagcactgccaaaaccaaccagtgaacagatcacccagacgaccacagagaaaaagacaatcag

SEQ ID NO: 248409 - DNA, 75 bp, Artificial Sequence
  Synthetic
ccaaccagtgaacagatcacccagacgaccacagagaaaaagacaatcagagcaacagcccaaaaaaagaaaaaa

SEQ ID NO: 248410 - DNA, 75 bp, Artificial Sequence
  Synthetic
tggtgtcacaaacaatggcttcataccacataattagttaattaaaaataaagtaaattaaaataaaataaaatt

SEQ ID NO: 248411 - DNA, 75 bp, Artificial Sequence
  Synthetic
gcaagtgagacaatcacaacatccgacagacccagaattgacaccaccacccaaagcagtgaacagacaacccgg

SEQ ID NO: 248412 - DNA, 75 bp, Artificial Sequence
  Synthetic
tagagaccacagtcagaagagctaaccgtgtactaagtgatgcactcaaaagataccctagaatggacataccaa

SEQ ID NO: 248413 - DNA, 75 bp, Artificial Sequence
  Synthetic
acaatgataacattggatgtcattaaaaatgatgggtcttcaaaaacatgtactcacctcaaaaaaataatcaaa

SEQ ID NO: 248414 - DNA, 75 bp, Artificial Sequence
  Synthetic
accaagacatactctttagggaaaggtaaaaatagtaaaggggaagagttgcaaatgttagatatacatggagtg

SEQ ID NO: 248415 - DNA, 75 bp, Artificial Sequence
  Synthetic
gatcaaattatttattaaatcaacttttaaggaacactgatagagctgatggcttatcaataatatcaggagcag

SEQ ID NO: 248416 - DNA, 75 bp, Artificial Sequence
  Synthetic
atttgaacaaaaagtgtatcacagaagtttgttcattgagtatggcaaagcattaggctcatcctctacaggcag

SEQ ID NO: 248417 - DNA, 75 bp, Artificial Sequence
  Synthetic
gttggagagcttgacagaactaagaggggcattcatattaaggattatcaaaggatttgtggacaacaacaaaag

SEQ ID NO: 248418 - DNA, 75 bp, Artificial Sequence
  Synthetic
agagataataagctttctgacagcaaacatgtggcacttcacaacttgatattatcctatatggagatgagcaaa

SEQ ID NO: 248419 - DNA, 75 bp, Artificial Sequence
  Synthetic
cagtagtcttctatagatctttctatagaaggacccctgattttttaactgaagcaatcagtcatgtagatattc

SEQ ID NO: 248420 - DNA, 75 bp, Artificial Sequence
  Synthetic
ggcagcaaccctagagggccatccatacacagggacaactcaaacaccagacacaacagctccccagcaaaccac

SEQ ID NO: 248421 - DNA, 75 bp, Artificial Sequence
  Synthetic
acaacagaaccaagctccccaccgtaccatgcacggagaagtgcagggcccaggcgaacgtaacacataggtatc

SEQ ID NO: 248422 - DNA, 75 bp, Artificial Sequence
  Synthetic
caggcgaacgtaacacataggtatcccatccaagtagttaacaaaaaaccacaaaatacccttaaaaaccaaaaa

SEQ ID NO: 248423 - DNA, 75 bp, Artificial Sequence
  Synthetic
ttggactagagactacagttagaagagctaacagagtgctaagtgatgcgctcaaaagataccctagggtagata

SEQ ID NO: 248424 - DNA, 75 bp, Artificial Sequence
  Synthetic
ccaaagcagcgaacagacaacccgggcaacagaaccaggctcctcaccataccatgcacggagaagtgcaggacc

SEQ ID NO: 248425 - DNA, 75 bp, Artificial Sequence
  Synthetic
ctatgacctagtgcgagaaatgggccctgaatctgggctcctacatttaaggcaaagcccaaaagctggactgtt

SEQ ID NO: 248426 - DNA, 75 bp, Artificial Sequence
  Synthetic
aaaaaccaatcttgagatggtattaaatgacaaagctatatcacctcctaaaagattaatatggtctgtgtatcc

SEQ ID NO: 248427 - DNA, 75 bp, Artificial Sequence
  Synthetic
caggtgaacacaacacagaggtatctcatccaagtagttaacaaaaaaaccacaaaataaccttgaaaactaaaa

SEQ ID NO: 248428 - DNA, 75 bp, Artificial Sequence
  Synthetic
taataagaactggttcaattttatgtagatcactaggcaagttagtttttattgtatcatcttatggatgtgtag

SEQ ID NO: 248429 - DNA, 75 bp, Artificial Sequence
  Synthetic
cagcaccaagtatggcactcaacacccttttaatcattgatcatgcaacatcaaaaaacatgaccaaagtggaac

SEQ ID NO: 248430 - DNA, 75 bp, Artificial Sequence
  Synthetic
acagatgaagaaaaagaggctgcagagcacttcctaaatgtgagtgacgacagtcaaaatgattatgagtaatta

SEQ ID NO: 248431 - DNA, 75 bp, Artificial Sequence
  Synthetic
agaatatttaaatgataaggaacacattgtctcgttaactggaaaagaaagagaattaagtgtaggtagaatgtt

SEQ ID NO: 248432 - DNA, 75 bp, Artificial Sequence
  Synthetic
gcttacttaagttagtaaaaacacatcagagtgggataaatgacaatgataacattagatgtcattaaaaatgat

SEQ ID NO: 248433 - DNA, 75 bp, Artificial Sequence
  Synthetic
gagttcttggaactatattagaaaacaataattaccctatgtatgaagtagtacttaaattattaggggacacct

SEQ ID NO: 248434 - DNA, 75 bp, Artificial Sequence
  Synthetic
ggtgatctagatcttcagagaataatggaaatcaaatcggaactttcttctattaaaaccagaagaaatgacagt

SEQ ID NO: 248435 - DNA, 75 bp, Artificial Sequence
  Synthetic
acctactatcagtagacctaccaaaccaaccatattgtcagagccgaagttagcatggacagacaaaggtggggc

SEQ ID NO: 248436 - DNA, 75 bp, Artificial Sequence
  Synthetic
tataataattacattgcaagagcatccatagtaactgatttaagcaagttcaaccaagcctttagatatgaaact

SEQ ID NO: 248437 - DNA, 75 bp, Artificial Sequence
  Synthetic
caaccaagcctttagatatgaaactacagcaatctgtgcagatgtagcagacgaattacatggaacacaaagctt

SEQ ID NO: 248438 - DNA, 75 bp, Artificial Sequence
  Synthetic
acaaaaaaaacatctcaagtacagtttctagaacacagtccccaccacggacaacagcgaaggtgatccccagag

SEQ ID NO: 248439 - DNA, 75 bp, Artificial Sequence
  Synthetic
gcaacctggccaagaactaccaactctattctatagactaaaaagtcgccattttagttatataaaaatcaagtt

SEQ ID NO: 248440 - DNA, 75 bp, Artificial Sequence
  Synthetic
ccgttggagagtacacacgaatcaatgcacaaatataaaaatatacaagttcttatgttttgggtctatgaattc

SEQ ID NO: 248441 - DNA, 75 bp, Artificial Sequence
  Synthetic
taaaagtttgattcaaaggtatacaaactctgcaataaacagagacacatgctggaaaataagcagaaatcaatg

SEQ ID NO: 248442 - DNA, 75 bp, Artificial Sequence
  Synthetic
atttacaccgaatgaaccaggaaaatatacaaagttggagaaagatgctctagacttgctttcagacaatgaaga

SEQ ID NO: 248443 - DNA, 75 bp, Artificial Sequence
  Synthetic
atcaacagacagaccacccaaacaaccacagagaaaaagccaaccggagcaacaaccaataaagaaaaagaaacc

SEQ ID NO: 248444 - DNA, 75 bp, Artificial Sequence
  Synthetic
acaactcgaaccacaagcacagctgcaacccaaacactcaacaccaccaaccaaaccagcaatggaagagaggca

SEQ ID NO: 248445 - DNA, 75 bp, Artificial Sequence
  Synthetic
caataatcaatggtcaaaccactgttgcaaactcacctataatataatcacttagtaatacaaaacaagaaaatg

SEQ ID NO: 248446 - DNA, 75 bp, Artificial Sequence
  Synthetic
taacactaggttaggatccatccaagtctgttagttcaacaatttagttatttaaaaatattttgaaaacaagta

SEQ ID NO: 248447 - DNA, 75 bp, Artificial Sequence
  Synthetic
tggagaacattcgggcaattgacatgttcaaagcaaagatgaaaaaccgcataagaagcagcaagtgccatagaa

SEQ ID NO: 248448 - DNA, 75 bp, Artificial Sequence
  Synthetic
ggatttggaatcttgataggggtctacggaagctccgtgatttacatggtccagctgccgatctttggtgtcata

SEQ ID NO: 248449 - DNA, 75 bp, Artificial Sequence
  Synthetic
agtatctaaatgacaaagaccacattgtctcgttaactgggaaagaaagagaattaagtgtaggtaggatgtttg

SEQ ID NO: 248450 - DNA, 75 bp, Artificial Sequence
  Synthetic
gaaccaagcaagaagaccccaatgacctctgcagtagacccaaacaccaaacccaatccacagcgggcaacacag

SEQ ID NO: 248451 - DNA, 75 bp, Artificial Sequence
  Synthetic
agcatgatattaggactgcttcgtacacttaacattgcaacagcaggaccaacagctgcaagagatggaatcaga

SEQ ID NO: 248452 - DNA, 75 bp, Artificial Sequence
  Synthetic
catcaacaacaccatcactattcaagaaataagaagaaactaaaattcaagggataaataacaatggatccattt

SEQ ID NO: 248453 - DNA, 75 bp, Artificial Sequence
  Synthetic
gaattagaatttaggggagaaagcataatagttagtctgatattaagaaatttctggctgtataacttatacatg

SEQ ID NO: 248454 - DNA, 75 bp, Artificial Sequence
  Synthetic
ctgaccacagaggattcaacacctccagcagcaaccccagaggaccatccacacacagggacaaccccaacacca

SEQ ID NO: 248455 - DNA, 75 bp, Artificial Sequence
  Synthetic
actagaatcaatagaagagaagctaagcatgatattaggactgcttcgtacacttaacattgcaacagcaggacc

SEQ ID NO: 248456 - DNA, 75 bp, Artificial Sequence
  Synthetic
gaattaagtgtaggtaggatgtttgcaatgcaaccaggaaaacaaagacaaatacagatattagctgagaaactt

SEQ ID NO: 248457 - DNA, 75 bp, Artificial Sequence
  Synthetic
aatatctttcagtgaaaccaatgcaattggctcatgccttttgaaaagaccctatctaaaaaaggataacactgc

SEQ ID NO: 248458 - DNA, 75 bp, Artificial Sequence
  Synthetic
cataccaatgcaatttggaggaggagatccagtagtcttctatagatctttctatagaaggactcctgatttttt

SEQ ID NO: 248459 - DNA, 75 bp, Artificial Sequence
  Synthetic
atcctattgaagaagaagagtctactgagaaaaaggtgctgccctctagtgatgggaaaactcctgcagaaaaga

SEQ ID NO: 248460 - DNA, 75 bp, Artificial Sequence
  Synthetic
aataaaattgttgaagacgagagcacaagcggtgaatcagaagaagaagaagaaccaaaagaaactcaggataac

SEQ ID NO: 248461 - DNA, 75 bp, Artificial Sequence
  Synthetic
atttcaaagctaaaagttaccctagccaacttgagctaagtgtacaagattttttagaacttgctgcagtacaat

SEQ ID NO: 248462 - DNA, 75 bp, Artificial Sequence
  Synthetic
gtttcaggccaatacaccaccagcagttctgcttgatcagctaaagactctgacaataactactctgtatgctgc

SEQ ID NO: 248463 - DNA, 75 bp, Artificial Sequence
  Synthetic
tagttttttacagatctttttacagaaggactcctgatttcctaactgaagcaatcagccatgtggatttactgt

SEQ ID NO: 248464 - DNA, 75 bp, Artificial Sequence
  Synthetic
aagctcaccagagacagaaccaacatcaacaccagacacaacaagccgcccgcccttcgtcgacacacacacaac

SEQ ID NO: 248465 - DNA, 75 bp, Artificial Sequence
  Synthetic
gacgaatatagcaaattagaatttgacaaacttacagtctgtgaggtaaaaacagtttacttaacaaccatgaaa

SEQ ID NO: 248466 - DNA, 75 bp, Artificial Sequence
  Synthetic
acaagtccggcagtccacacaaaaaacaacccaaggataagctccagaacacattccccaccatgggcaatgaca

SEQ ID NO: 248467 - DNA, 75 bp, Artificial Sequence
  Synthetic
acaaccgcagagaaaaagccaaccagagcaacaaccaaaaaagaaaccacaactcgaaccacaagcacagctgca

SEQ ID NO: 248468 - DNA, 75 bp, Artificial Sequence
  Synthetic
aaacaacccagacagcagacccaagctcccaatcacaacacacacagaaaagcacaacaacaacatacaacacag

SEQ ID NO: 248469 - DNA, 75 bp, Artificial Sequence
  Synthetic
aaattaagcatgatactagggctattaagaacactcaacattgctacagcaggacccacagcagcaagagatggg

SEQ ID NO: 248470 - DNA, 75 bp, Artificial Sequence
  Synthetic
aggacggtccgtagaaccaccactctccgcacaagcagcataagaaaaagatcgtctacagcatcagtccaacct

SEQ ID NO: 248471 - DNA, 75 bp, Artificial Sequence
  Synthetic
ctctattaaacggagacaatcagtcaatagatgttagtaaaccagtaaaattgtctgaaggtgtagatgaagtaa

SEQ ID NO: 248472 - DNA, 75 bp, Artificial Sequence
  Synthetic
aatagatgttagtaaaccagtaaaattgtctgaaggtgtagatgaagtaaaagcagactatagcttagcaattag

SEQ ID NO: 248473 - DNA, 75 bp, Artificial Sequence
  Synthetic
aatgccacaactcaaagcagcgaccaaacaacccagacagcagacccaagctcccaatcacaacacacacagaaa

SEQ ID NO: 248474 - DNA, 75 bp, Artificial Sequence
  Synthetic
tatccactacaaattacccatgcaaagtcagcacaggaagacatcctatcagtatggttgcactgtctcctcttg

SEQ ID NO: 248475 - DNA, 75 bp, Artificial Sequence
  Synthetic
agagttttatatgaatcattaccctttcacaaagctgaaaaagttgtaaacatgatatcagggacaaaatctata

SEQ ID NO: 248476 - DNA, 75 bp, Artificial Sequence
  Synthetic
tgttaaaacagtttatttgacaaccatgaaaccatatgggatggtgtcaaaatttgtgagttcagccaaatcagt

SEQ ID NO: 248477 - DNA, 75 bp, Artificial Sequence
  Synthetic
ctaggattattgtctagaatattgtcagtagttgttgatagtatagaaattccaaccaaatctaatggtaggctg

SEQ ID NO: 248478 - DNA, 75 bp, Artificial Sequence
  Synthetic
tcacaatctccccaaaaaggcaacaacaccatattagctctgcttaaatctccctggaaaaaacactcgcccata

SEQ ID NO: 248479 - DNA, 75 bp, Artificial Sequence
  Synthetic
acaccatattagctctgcttaaatctccctggaaaaaacactcgcccatataccaactataccacaatcatccca

SEQ ID NO: 248480 - DNA, 75 bp, Artificial Sequence
  Synthetic
tggctcatgccttttgaaaagaccctatctaaaaaaagataacactgctaaagttgctgtagaaaaccctgttgt

SEQ ID NO: 248481 - DNA, 75 bp, Artificial Sequence
  Synthetic
gtcatgaccaaaatgaagatatcagattataaagtggttgaaccaattaatatgcagcatgaaataatgaaaaat

SEQ ID NO: 248482 - DNA, 75 bp, Artificial Sequence
  Synthetic
ctaccaactctattctatagactaaaaagtcaccgttttagttatataaaaatcaaattagagtaagaattaaat

SEQ ID NO: 248483 - DNA, 75 bp, Artificial Sequence
  Synthetic
attataaagtggttgaaccaattaatatgcagcatgaaataatgaaaaatatacacagttgtgagctcacattat

SEQ ID NO: 248484 - DNA, 75 bp, Artificial Sequence
  Synthetic
tatatgcaactagttctcatttgaaggggataattattgaaaagttcagcactgacagaactacaaggggtcaaa

SEQ ID NO: 248485 - DNA, 75 bp, Artificial Sequence
  Synthetic
actataaaatgcaaaaaaacacatctgaatcagaacatcacaccagctcatcacccatggaatccagcagagaaa

SEQ ID NO: 248486 - DNA, 75 bp, Artificial Sequence
  Synthetic
aaacattagctctctaaaattaagtatgatatgtgattggttacagttaaaatccacctcagataacacatcaat

SEQ ID NO: 248487 - DNA, 75 bp, Artificial Sequence
  Synthetic
ctagatgatattaaaaccagtgcagaatcaatagggagtctatgtcaagaactagaattcagaggagagagtata

SEQ ID NO: 248488 - DNA, 75 bp, Artificial Sequence
  Synthetic
gatctagagttcttggcactatattagaaaacaatgattaccctatgtatgaggtagtacttaaattattagggg

SEQ ID NO: 248489 - DNA, 75 bp, Artificial Sequence
  Synthetic
aatcatgtagcactataactgagggatatctcagtgttctgaggacaggttggtataccaacgtttttacattag

SEQ ID NO: 248490 - DNA, 75 bp, Artificial Sequence
  Synthetic
aatgcagtcaattctaagatgaaaatatcagattacaagatagtagagccagtaaacatgcaacatgaaattatg

SEQ ID NO: 248491 - DNA, 75 bp, Artificial Sequence
  Synthetic
acgggagcacctccagagctgagtggtgtcacaaacaatggcttcataccacacagttagttaattaaaaataaa

SEQ ID NO: 248492 - DNA, 75 bp, Artificial Sequence
  Synthetic
tccagtagttttttacagatctttttacagaaggactcccgatttcctaactgaagcaatcagccatgtggattt

SEQ ID NO: 248493 - DNA, 75 bp, Artificial Sequence
  Synthetic
tgtgtaaaacctttattacctagatttatgagtgtaaatttcttacatagattatctgtcagtagtagacctatg

SEQ ID NO: 248494 - DNA, 75 bp, Artificial Sequence
  Synthetic
caacaagttgattctggaattcaggaaagaagaagtaataagaactggttcaatcttgtgtaggtcattgggtaa

SEQ ID NO: 248495 - DNA, 75 bp, Artificial Sequence
  Synthetic
atcagctcttctgtgatagtgctatacattatagtagaaatgaagaagaagttgggatcattgcagacaacataa

SEQ ID NO: 248496 - DNA, 75 bp, Artificial Sequence
  Synthetic
tttgtgagcaagaatttaactcgtgcaatcaacaaaaacaagtgcgacattgatgacctaaaaatggccgttagc

SEQ ID NO: 248497 - DNA, 75 bp, Artificial Sequence
  Synthetic
tgatatcaggcacaaagtctatcactaatctattacaaagaacatctgctataaatggtgaagatattgatagag

SEQ ID NO: 248498 - DNA, 75 bp, Artificial Sequence
  Synthetic
tctagagttcttggcactatattagaaaacaatgattaccccatgtatgaagtagtacttaaattattaggggac

SEQ ID NO: 248499 - DNA, 75 bp, Artificial Sequence
  Synthetic
ttaaataagagagagaattatttccatggaaacaatcttattgagtctttatcagcagcattagcatgtcattgg

SEQ ID NO: 248500 - DNA, 75 bp, Artificial Sequence
  Synthetic
gataggggtctacgggagctccgtaatttacatggtgcagctgccaatctttggcgttatagacacgccttgctg

SEQ ID NO: 248501 - DNA, 75 bp, Artificial Sequence
  Synthetic
agttaattaaaaactaaaaatcaaaagttaaaaactaacaactgtcattaagtttattaaaaataagaaattata

SEQ ID NO: 248502 - DNA, 75 bp, Artificial Sequence
  Synthetic
cgacaagctaaggtaacaagtgatataaatagaacagcagttactagcatactaagtctatctcctaatcagctc

SEQ ID NO: 248503 - DNA, 75 bp, Artificial Sequence
  Synthetic
tgacaagaccacaagaggtcagaggggaccaaaaagcccctgggtaggatcaagcactcaagagaaaaaattggt

SEQ ID NO: 248504 - DNA, 75 bp, Artificial Sequence
  Synthetic
tttggacaccctatggtagatgagagggaagcaatggatgctgttaaattaaataatgagattacaaaaattctt

SEQ ID NO: 248505 - DNA, 75 bp, Artificial Sequence
  Synthetic
cgaacccgcaggcatctgcaaacacaatgcaaaaatagcacaccaacattgcaaaaccaaattagttaacaaaaa

SEQ ID NO: 248506 - DNA, 75 bp, Artificial Sequence
  Synthetic
ccgatccaactgtagtacatcatttgaaaaggctgattcagagacacaccaactctgtcacaaaagacagcgata

SEQ ID NO: 248507 - DNA, 75 bp, Artificial Sequence
  Synthetic
atgggtggtattgaaggatggtgtcaaaaactctggacaatggaagctatatctttattggatgttgtatctgta

SEQ ID NO: 248508 - DNA, 75 bp, Artificial Sequence
  Synthetic
aatctagtgttccaaaatgcaatcagctgcggaattagtataatgagtgttgtagaacagttaactggtagaagc

SEQ ID NO: 248509 - DNA, 75 bp, Artificial Sequence
  Synthetic
aatctcacacaactgagaaaatgatcatctaacagtttaattgaccattagttaattaaaaattataaattagta

SEQ ID NO: 248510 - DNA, 75 bp, Artificial Sequence
  Synthetic
catctaacagtttaattgaccattagttaattaaaaattataaattagtaactaattgataaaaaataagaaatt

SEQ ID NO: 248511 - DNA, 75 bp, Artificial Sequence
  Synthetic
aaatagcagcgtgtaatgatttttatgctgcaaaaaaacttgacaataaatcaattgaagccaactgtaaatcac

SEQ ID NO: 248512 - DNA, 75 bp, Artificial Sequence
  Synthetic
tttgcaatgcaacctggcaaacaaagacaaatacagatactagctgagaaacttttagctgataatattgtaccc

SEQ ID NO: 248513 - DNA, 75 bp, Artificial Sequence
  Synthetic
aatcaaacagaatcctaagcagtgcagagaaagggaacactggcttcatcattgtgataattctaattgctgtcc

SEQ ID NO: 248514 - DNA, 75 bp, Artificial Sequence
  Synthetic
tttttcccagaaactttaacaaagtatggtgacttggatctccaaagaattatggaaatgaaatcagaactttct

SEQ ID NO: 248515 - DNA, 75 bp, Artificial Sequence
  Synthetic
aatcaaacaactacctaaaggctgctcatacataactaaccaggacgcagacactgtaacaattgacaacactgt

SEQ ID NO: 248516 - DNA, 75 bp, Artificial Sequence
  Synthetic
aaggtcaaaaaactgatcagttcttaaataagagagaaaactattttcatggaaataatttaattgaatctttat

SEQ ID NO: 248517 - DNA, 75 bp, Artificial Sequence
  Synthetic
tgtttgattatgcgattacatgatagttaattaaaaaatttcaattaaaaatcaaaagttaaaatttaaaaccta

SEQ ID NO: 248518 - DNA, 75 bp, Artificial Sequence
  Synthetic
gttacaacaattatattgcaagagcctccatagtaacagacctaagtaaattcaatcaagcctttagatatgaaa

SEQ ID NO: 248519 - DNA, 75 bp, Artificial Sequence
  Synthetic
aaaagaaagagaattaagtgtaggtagaatgtttgctatgcaaccaggaaaacagcgacaaatacaaatattggc

SEQ ID NO: 248520 - DNA, 75 bp, Artificial Sequence
  Synthetic
ctccatagtaacagacctaagtaaattcaatcaagcctttagatatgaaaccacagctatctgtgcagatgtagc

SEQ ID NO: 248521 - DNA, 75 bp, Artificial Sequence
  Synthetic
agcttaattataattaaaacattatttaaaaccgtaactatttaatttacaaagtaaaaacaaaaatatgggaca

SEQ ID NO: 248522 - DNA, 75 bp, Artificial Sequence
  Synthetic
ttcttatgctctgggttcacaaattcaaaaggtacagattgtgaggaaccaacagccctatgcgacaaaaagtta

SEQ ID NO: 248523 - DNA, 75 bp, Artificial Sequence
  Synthetic
taatcatttgattatgcaattatgtaatagttaattaaaaactaaaaatcaaaagttagaaactaacaactgtca

SEQ ID NO: 248524 - DNA, 75 bp, Artificial Sequence
  Synthetic
gatgaatccattgacaaattattaagaattgacaacaccttttggagaatgttcagcaaagtcatgtttgaatca

SEQ ID NO: 248525 - DNA, 75 bp, Artificial Sequence
  Synthetic
tggtgtcagaagttatggacaatggaggcgatatccttgttagatgtagtatctgttaagactcgttgtcagatg

SEQ ID NO: 248526 - DNA, 75 bp, Artificial Sequence
  Synthetic
tccagagctgaatggtgttaccaacggcggttttataccgcatagttagttaattaaaaaatgggacaaatcatc

SEQ ID NO: 248527 - DNA, 75 bp, Artificial Sequence
  Synthetic
atgatgtgaaattcctatcattagtaggttatataggatttaaaaactggtttatagaacagttaagagtggtag

SEQ ID NO: 248528 - DNA, 75 bp, Artificial Sequence
  Synthetic
taagatggtaattctatggagaaaacatgtattatcatgcagaatttgcactacttatgggacagacctctattt

SEQ ID NO: 248529 - DNA, 75 bp, Artificial Sequence
  Synthetic
acagaaaagcacaacaacaacatacaacacagacacatcttctccaagtagttaacaaaaaaactataaaataac

SEQ ID NO: 248530 - DNA, 75 bp, Artificial Sequence
  Synthetic
attcgcaaagtatcatgctaaagactgcaatgtaaaattacctttttttgtgagatcagttgctacttttattat

SEQ ID NO: 248531 - DNA, 75 bp, Artificial Sequence
  Synthetic
aatattaaaaatgaggctaagatacgattctttaaagccttattatctatagaaaagaatgaacgtgctacatta

SEQ ID NO: 248532 - DNA, 75 bp, Artificial Sequence
  Synthetic
tgcctataaaaacattggccataaactcaaagaaggtgaaacatatatatcaagagatctccaatttataagtaa

SEQ ID NO: 248533 - DNA, 75 bp, Artificial Sequence
  Synthetic
gcagcatcagcgagcccatcagaaacagaaccagcatcaacaccagacacaacaaaccgcctgtcctccgtagac

SEQ ID NO: 248534 - DNA, 75 bp, Artificial Sequence
  Synthetic
actaatgtggttcaagggtacattgatgacaatcaaggaataacaaaggctgcagcttgctatagtctacataac

SEQ ID NO: 248535 - DNA, 75 bp, Artificial Sequence
  Synthetic
aatttctggctgtataacttatacatgcatgagtcaaaacagcatccgttagctggaaaacaactgtttaaacaa

SEQ ID NO: 248536 - DNA, 75 bp, Artificial Sequence
  Synthetic
tggcaacacgtaaacaggtacaattttgtctttagttctacaggttgtaaaatcagtttgaagacatgcatcggg

SEQ ID NO: 248537 - DNA, 75 bp, Artificial Sequence
  Synthetic
tgaggagaaattaagcatgatactagggctattaagaacactcaacattgctacagcaggacccacagcagcaag

SEQ ID NO: 248538 - DNA, 75 bp, Artificial Sequence
  Synthetic
agaggccttcagcaccagacacacccataatcttattatgtgtaggtgccttaatatttaccaaactagcatcaa

SEQ ID NO: 248539 - DNA, 75 bp, Artificial Sequence
  Synthetic
gccttgcaagacagtgaaagcactaatcaagtgcagtaagcatggtcccaaattcattaccatagaggcagatga

SEQ ID NO: 248540 - DNA, 75 bp, Artificial Sequence
  Synthetic
ggatacatgcttgtaagtaaaaaatgaaaaatgatgaagatgataaaatagatgacaacttcataccattctaaa

SEQ ID NO: 248541 - DNA, 75 bp, Artificial Sequence
  Synthetic
ccttgatcaccattacccattagaatatcaaagggtaataggtgatctaaatagggtgatagatagtggtgaagg

SEQ ID NO: 248542 - DNA, 75 bp, Artificial Sequence
  Synthetic
tttttacagaaggactcctgatttcctgactgaagcaatcagccatgtggatttactgttaaaagtttcaaacaa

SEQ ID NO: 248543 - DNA, 75 bp, Artificial Sequence
  Synthetic
gaaagcataagtaaaatatgcaagacttggagccatcaagggacaagatatgtgctgaagtccagataacagcca

SEQ ID NO: 248544 - DNA, 75 bp, Artificial Sequence
  Synthetic
ccgaatcagctcttttgtgatagtgctatacactatagcagaaatgaagaagaagtagggatcattgcagacaac

SEQ ID NO: 248545 - DNA, 75 bp, Artificial Sequence
  Synthetic
aagacccaatcctgaatgttaaaactagattaggatccgtctaagactattagttcaatagtctagttatttaaa

SEQ ID NO: 248546 - DNA, 75 bp, Artificial Sequence
  Synthetic
aagatttacagatgttagacatacatggagtagaaaaaagctgggtggaagagatagacaaagaagcaagaaaaa

SEQ ID NO: 248547 - DNA, 75 bp, Artificial Sequence
  Synthetic
aatcctcataggaataactactctgagtatagccctcaatatctatctgatcataaactacacaatacaaaaaac

SEQ ID NO: 248548 - DNA, 75 bp, Artificial Sequence
  Synthetic
tctatcaggattgagaatacctataaacaaaaaggagttgaatagacaaaagaaattgttaacactacaaagtaa

SEQ ID NO: 248549 - DNA, 75 bp, Artificial Sequence
  Synthetic
atggtattaaatgataaagcaatatctcctccaaaaaagttaatatggtcggtatatccaaaaaattatctacct

SEQ ID NO: 248550 - DNA, 75 bp, Artificial Sequence
  Synthetic
aaagacagagatacctgttggagagtacacacgaatcaatgcacaaatataaaaatatacaagttcttatgtttt

SEQ ID NO: 248551 - DNA, 75 bp, Artificial Sequence
  Synthetic
gttgtaaatatgatatcaggaacaaaatccataaccaacttattacagagaacatctgctattaatggtgaagat

SEQ ID NO: 248552 - DNA, 75 bp, Artificial Sequence
  Synthetic
ggttaaagaataaagcaagtacaataattgattggttagagcatattttgaattctccaaaaggtgaattaaact

SEQ ID NO: 248553 - DNA, 75 bp, Artificial Sequence
  Synthetic
ccttctatgacttatttgaacaaaaagtgtatcacagaagtttgttcattgagtatggcaaagcattaggctcat

SEQ ID NO: 248554 - DNA, 75 bp, Artificial Sequence
  Synthetic
agtgtatcacagaagtttgttcattgagtatggcaaagcattaggctcatcctctacaggcagcaaagcagaaag

SEQ ID NO: 248555 - DNA, 75 bp, Artificial Sequence
  Synthetic
acaatcctaaaggcatattcaagaagcttggagctgggactcaagttatagtagaactaggagcatatgtccagg

SEQ ID NO: 248556 - DNA, 75 bp, Artificial Sequence
  Synthetic
taataataataatgattaaccataatctcacacaactgagaaaataatcgtctaacagtttagttgatcattagt

SEQ ID NO: 248557 - DNA, 75 bp, Artificial Sequence
  Synthetic
acagcgaaggcggtccccagaaccaccgcctttcgcacaagcagcacaggagaaagaccaaccacaacatcagtc

SEQ ID NO: 248558 - DNA, 75 bp, Artificial Sequence
  Synthetic
aaaacaagaaaatgggacaagtggccatggaagtaagagtggagaacattcgggcaattgacatgttcaaagcaa

SEQ ID NO: 248559 - DNA, 75 bp, Artificial Sequence
  Synthetic
acaaattctttcaaaacaacaaagagaacagctagaagcaattggaaaaatgagatgggtatataaagggacacc

SEQ ID NO: 248560 - DNA, 75 bp, Artificial Sequence
  Synthetic
cattgattatgcaacatcaaaaaacatgaccaaagtggaacactgtgttaatatgccgccggtagaaccaagcaa

SEQ ID NO: 248561 - DNA, 75 bp, Artificial Sequence
  Synthetic
atgaccaaagtggaacactgtgttaatatgccgccggtagaaccaagcaagaagaccccaatgacctctgcagta

SEQ ID NO: 248562 - DNA, 75 bp, Artificial Sequence
  Synthetic
taataggtatgtatcgagggagagtgccaaacacagaactattttcagcagcagaaagctatgccaagagtttga

SEQ ID NO: 248563 - DNA, 75 bp, Artificial Sequence
  Synthetic
cccaccacggacaacagcgaaggcggtccccagaaccaccgcctttcgcacgagcagcacaggagaaagaccaac

SEQ ID NO: 248564 - DNA, 75 bp, Artificial Sequence
  Synthetic
atcagaaagagtacaacagattttgagaaactcaggtagtgaagttcaggtggttctaaccaaaacatactcctt

SEQ ID NO: 248565 - DNA, 75 bp, Artificial Sequence
  Synthetic
ccaatcctgaatgttaaaaatagattaggatccgtttaagactatcagtttaatagtctagttatttaaaaatat

SEQ ID NO: 248566 - DNA, 75 bp, Artificial Sequence
  Synthetic
ccaatatgatcaagcttatagataatctgggaaatgcagaaataaagaaactaatcaaggtcactgggtatatgc

SEQ ID NO: 248567 - DNA, 75 bp, Artificial Sequence
  Synthetic
atcttgaatgttaaaactagactaggatccgtctaagactatcagttcaatagtttagttatttaaaaatatttg

SEQ ID NO: 248568 - DNA, 75 bp, Artificial Sequence
  Synthetic
tcaaagcaagagtgaaaaatcgtgtggcacgcagcagatgctttaaaaatgcttctttaatcctcataggaataa

SEQ ID NO: 248569 - DNA, 75 bp, Artificial Sequence
  Synthetic
tcagagccgaagttagcatggacagacaaaggtggggcaatcaaaactgaagtaaagcaaacaatcaaaattatg

SEQ ID NO: 248570 - DNA, 75 bp, Artificial Sequence
  Synthetic
ctaggatattgtcagtaataattaatagtatagaaataccaatcaagtccaatggcagattgatatgctgtcaaa

SEQ ID NO: 248571 - DNA, 75 bp, Artificial Sequence
  Synthetic
atcagttcttgaacaagagagagaattatttccatgggaacaatcttattgagtctttgtcagcagcgttagcat

SEQ ID NO: 248572 - DNA, 75 bp, Artificial Sequence
  Synthetic
aaataaccatgaaaaccaaaaaactagaaaagttaatttgaactcagaaaagaacacaaacactatatgaattgt

SEQ ID NO: 248573 - DNA, 75 bp, Artificial Sequence
  Synthetic
atcgggaaattgataaaggacttaaaccctaaagttctttactttattggagaaggagcaggtaactggatggca

SEQ ID NO: 248574 - DNA, 75 bp, Artificial Sequence
  Synthetic
aaacagaaccagcatcaacaccaggcataacaaaccgcctgtcccttgtagacagatccacaacacaatcaagtg

SEQ ID NO: 248575 - DNA, 75 bp, Artificial Sequence
  Synthetic
atcattatttaagaattaagaagaagctaaaattcaagggacaaataacaatggatccgttttgtgaatccactg

SEQ ID NO: 248576 - DNA, 75 bp, Artificial Sequence
  Synthetic
ttgcagttaatagaacaaagtctatctttaagaataactgttttgaattatacagacatggcacatgctcttaca

SEQ ID NO: 248577 - DNA, 75 bp, Artificial Sequence
  Synthetic
ttaagaacactcaacattgctacagcaggacccacagcagcaagagatgggatcagagatgcaatgattggcata

SEQ ID NO: 248578 - DNA, 75 bp, Artificial Sequence
  Synthetic
agtccagtccgacagcagcaccacaacccaaaatcacgaagaaacaggttcagcgaacccacaggcatctgcaag

SEQ ID NO: 248579 - DNA, 75 bp, Artificial Sequence
  Synthetic
ggttcagcgaacccacaggcatctgcaagcacaatgtaaacccagcacaccaacattgtaaaaccaaattagtta

SEQ ID NO: 248580 - DNA, 75 bp, Artificial Sequence
  Synthetic
cagcgaacccacaggcatctgcaagcacaatgcaaaaccagcacaccaacaatataaaatcaaattagttaacaa

SEQ ID NO: 248581 - DNA, 75 bp, Artificial Sequence
  Synthetic
tagactattttcctaaggtaatatttgaaaggttaaaaagttatgacaccagttcggactacaacaaagggaagt

SEQ ID NO: 248582 - DNA, 75 bp, Artificial Sequence
  Synthetic
ctgttccagcttacaggacaacaaattaccattttgacactagtccaatcaaccaagcattaagtgagaggttcg

SEQ ID NO: 248583 - DNA, 75 bp, Artificial Sequence
  Synthetic
tttgtaaggtctgtagctacttttattatgcaaggaagcaaattgtcagggtcagaatgttacatacttttaaca

SEQ ID NO: 248584 - DNA, 75 bp, Artificial Sequence
  Synthetic
acaaaaaatatgaaatagctctaaagtaaaacatgtaggtgctaacaatcaagaaatcaaaagataactaataat

SEQ ID NO: 248585 - DNA, 75 bp, Artificial Sequence
  Synthetic
ttaggtcatcacaataatctgccatgtcatggagaaatacaaaattccaaaatgagaatagcagtgtgtaatgat

SEQ ID NO: 248586 - DNA, 75 bp, Artificial Sequence
  Synthetic
ttccagaaatcactaaaaaaatcaggtcacaagagaactcaatctattgtaggggaaaaagtaaacactatatca

SEQ ID NO: 248587 - DNA, 75 bp, Artificial Sequence
  Synthetic
atggagtcctatctggtagacacctatcagggcatcccttacacagcagctgttcaagttgatctagtagaaaag

SEQ ID NO: 248588 - DNA, 75 bp, Artificial Sequence
  Synthetic
atggatgaatataccaatgcagtttggagggggagacccagtagttttttacagatctttttacagaaggactcc

SEQ ID NO: 248589 - DNA, 75 bp, Artificial Sequence
  Synthetic
agaatatcaaagggtaataggtgatttaaatagagtgatagatggtggtgaaggattatcaatggagaccacaga

SEQ ID NO: 248590 - DNA, 75 bp, Artificial Sequence
  Synthetic
cagaaaaaccagcaaccaaaacaacagatcctgttgaagaagaggaactcaatgaaaagaaagtattgccttcca

SEQ ID NO: 248591 - DNA, 75 bp, Artificial Sequence
  Synthetic
tactttattaaatggattaacagatcaattaacaaaattaaaaaataaaaacaggctcagagttcatggtaccgt

SEQ ID NO: 248592 - DNA, 75 bp, Artificial Sequence
  Synthetic
ttaaaaatatcagctaacataaaaaatgaaacgaaaataagttttttcaaagccttactatcaatagaaaaaaat

SEQ ID NO: 248593 - DNA, 75 bp, Artificial Sequence
  Synthetic
aaaatcaaagttttcaaccagtgtaaaaaagaaagtttcctttacatcaaatgaaccagggaaatataccaaact

SEQ ID NO: 248594 - DNA, 75 bp, Artificial Sequence
  Synthetic
taaaagatgaccttgatcatcattatcctttggaataccagagagtgataggagaattaagcaggataatagata

SEQ ID NO: 248595 - DNA, 75 bp, Artificial Sequence
  Synthetic
actgcaatataaaattaccattttttgtaaggtctgtagctacttttattatgcaaggaagcaaattgtcaggat

SEQ ID NO: 248596 - DNA, 75 bp, Artificial Sequence
  Synthetic
ctcttctatcaggattaagaataccaataaacaaaaaagagttaaatagacaaaagaaactgttaacactacaaa

SEQ ID NO: 248597 - DNA, 75 bp, Artificial Sequence
  Synthetic
taatatttgaaaggttaaaaagttatgataccagttcagactacaacaaagggaagttaacaagaaattacatga

SEQ ID NO: 248598 - DNA, 75 bp, Artificial Sequence
  Synthetic
gcttatagataacctgggaaatgcagagataaaaaaactaatcaaagttaccgggtatatgcttgtgagtaagaa

SEQ ID NO: 248599 - DNA, 75 bp, Artificial Sequence
  Synthetic
gagataaaaaaactaatcaaagttaccgggtatatgcttgtgagtaagaagtaataataataataataatcaacc

SEQ ID NO: 248600 - DNA, 75 bp, Artificial Sequence
  Synthetic
ttattggagaaggagcaggtaactggatggcaagaacagcatgtgaatatcctgatataaaatttgtatatagga

SEQ ID NO: 248601 - DNA, 75 bp, Artificial Sequence
  Synthetic
tcagctaaaaaccttgacaataacaactctgtatgctgcatcacagaatggtccaatactcaaggtaaatgcatc

SEQ ID NO: 248602 - DNA, 75 bp, Artificial Sequence
  Synthetic
cattaaaaatgatgggtcttcaaaaacatgtacccaccttaaaaaaataatcaaagaccactctggtaaagtgct

SEQ ID NO: 248603 - DNA, 75 bp, Artificial Sequence
  Synthetic
aaagtatggtgatctagatcttcagagaataatggaaatcaaatcggaactttcttctattaaaaccagaagaaa

SEQ ID NO: 248604 - DNA, 75 bp, Artificial Sequence
  Synthetic
attggcaagagaggaacaaattgagaatcccagacaatctagatttgttctaggagcaatagcactcggtgttgc

SEQ ID NO: 248605 - DNA, 75 bp, Artificial Sequence
  Synthetic
tttggagaaaacatgtattatcttgtagaatctgtacagcttatggaacagatctttacttatttgcaaagtatc

SEQ ID NO: 248606 - DNA, 75 bp, Artificial Sequence
  Synthetic
ggacctagagaaaaatatacctgtgacaataccagcattcataaagtcagtttcaatcaaagagagtgagtcagc

SEQ ID NO: 248607 - DNA, 75 bp, Artificial Sequence
  Synthetic
gaatgcccttaaaaagactaatgaagcagtgtctacattggggaatggagttcgagtgttagcaactgcagtgag

SEQ ID NO: 248608 - DNA, 75 bp, Artificial Sequence
  Synthetic
aatcaagaaaacaaagaaaccaacaggagcacctccagagctgagtggtgtcacaaacaatggcttcataccaca

SEQ ID NO: 248609 - DNA, 75 bp, Artificial Sequence
  Synthetic
atggtacgcaaagcttattttgttggttacatcttattgttcccatgaccacaatgatatgtgcatacagacatg

SEQ ID NO: 248610 - DNA, 75 bp, Artificial Sequence
  Synthetic
attacaaatatgctgcagagatagggatacaatatatttgcacagctctaggatcagaaagagtacaacagattt

SEQ ID NO: 248611 - DNA, 75 bp, Artificial Sequence
  Synthetic
aacaccccagcacgggctaaaggagagttatttggaagaatcatgcagtactataactgagggatacctcagtgt

SEQ ID NO: 248612 - DNA, 75 bp, Artificial Sequence
  Synthetic
cacaaagcaaaaacaaaaacatgggacaagtagctatggaggtgaaagtagagaacactcgagcaacagacatgc

SEQ ID NO: 248613 - DNA, 75 bp, Artificial Sequence
  Synthetic
aaacggagacaatcaatcaatagatgtcagtaaaccagtaaaattgtctgaaggtatagatgaagtaaaagcaga

SEQ ID NO: 248614 - DNA, 75 bp, Artificial Sequence
  Synthetic
acaagtagctatggaggtgaaagtagagaacactcgagcaacagacatgctcaaagcaagagcgaaaaatcgtgt

SEQ ID NO: 248615 - DNA, 75 bp, Artificial Sequence
  Synthetic
gaaagcataatagttagtctgatattaagaaatttctggctgtataacttatacatgcatgaatcaaagcaacat

SEQ ID NO: 248616 - DNA, 75 bp, Artificial Sequence
  Synthetic
atggttgcactgtcccctctcggggctctggttgcctgttacaaaggagtaagctgttccattggcagcaataga

SEQ ID NO: 248617 - DNA, 75 bp, Artificial Sequence
  Synthetic
ccctggataaatacaatactagatgacattaaaaccagtgcagaatcaatagggagtctgtgtcaagaactagag

SEQ ID NO: 248618 - DNA, 75 bp, Artificial Sequence
  Synthetic
ttgatgtgtgataatgcactctttaatccaagttcatcaccgatgtttagtctaactcaagttattgatcctaca

SEQ ID NO: 248619 - DNA, 75 bp, Artificial Sequence
  Synthetic
cataacaaaccgcctgtcctccgcagacagatccacaacacaaccaagcgaaagcagaacaaagacaaactcgac

SEQ ID NO: 248620 - DNA, 75 bp, Artificial Sequence
  Synthetic
tctatctcatagattataaagtcaccattctagttatataaaaatcaagttagaacaagaattaaatcaatcaag

SEQ ID NO: 248621 - DNA, 75 bp, Artificial Sequence
  Synthetic
gacagatccacaacacaaccaagcgaaagcagaacaaagacaaactcgacagtccacaaaaaaaccatctcaaac

SEQ ID NO: 248622 - DNA, 75 bp, Artificial Sequence
  Synthetic
atcctacccctataaaaaagatcttaagagtaggaccatggataaacacaatattagatgacattaaaactagtg

SEQ ID NO: 248623 - DNA, 75 bp, Artificial Sequence
  Synthetic
cacagctcaaaatcatgaggaaacaggctcagcgaacccacaggcatctgcaagcacaatgcaaacccagcacac

SEQ ID NO: 248624 - DNA, 75 bp, Artificial Sequence
  Synthetic
caagaatatttaaatgataaggaacacattgtctcattaactggaaaagaaagagaattaagtgtaggtagaatg

SEQ ID NO: 248625 - DNA, 75 bp, Artificial Sequence
  Synthetic
gggaattatgcttgcctcctaagagaggatcaagggtggtattgtaaaaatgcaggatccactgtttactaccca

SEQ ID NO: 248626 - DNA, 75 bp, Artificial Sequence
  Synthetic
ggtgtcacaaacaatggcttcataccacataattagttaattaaaaaataaagtaaattaaattaaaataaaata

SEQ ID NO: 248627 - DNA, 75 bp, Artificial Sequence
  Synthetic
aacagcaaaggcggtctccagaaccaccgctcttcgcatgagcagcacaggagaaagacctaccacaacatcagt

SEQ ID NO: 248628 - DNA, 75 bp, Artificial Sequence
  Synthetic
accgctcttcgcatgagcagcacaggagaaagacctaccacaacatcagtccagtccgacagcagcaccacagcc

SEQ ID NO: 248629 - DNA, 75 bp, Artificial Sequence
  Synthetic
cacagaaaaacaaacaaccaaaacaacagatcctgttgaagaagaggaactcaatgaaaagaaggtatcaccttc

SEQ ID NO: 248630 - DNA, 75 bp, Artificial Sequence
  Synthetic
cagtgatgggaagactcctgcagagaaaaaatcaaaatctccaaccaatgtaaaaaagaaagtttccttcacatc

SEQ ID NO: 248631 - DNA, 75 bp, Artificial Sequence
  Synthetic
ttagtaattggtacaatctcaataagttaattttagaattcaggagagaggaagtaataagaaccggttcaatct

SEQ ID NO: 248632 - DNA, 75 bp, Artificial Sequence
  Synthetic
ccacagcacaaccaagtgaaagcagaacaaagacaaaatcgacagtccacacaagaaacaacccaagcacagctt

SEQ ID NO: 248633 - DNA, 75 bp, Artificial Sequence
  Synthetic
gatccaatcaggtttcctgaggatcagttcaatgttgcgcttgatcaagtcttcgaaagcattgagaacagtcag

SEQ ID NO: 248634 - DNA, 75 bp, Artificial Sequence
  Synthetic
acaagaaacaacccaagcacagcttccagcacacaatctccaccacgggcaacagcgaaggcaaaccgcagagcc

SEQ ID NO: 248635 - DNA, 75 bp, Artificial Sequence
  Synthetic
tacatagattatctgtcagtagtagacctatggaattcccagcatcagttccagcttatagaacaacaaattacc

SEQ ID NO: 248636 - DNA, 75 bp, Artificial Sequence
  Synthetic
aaacagcaacaacatcatgtcaactttgctcaaatctccctgggagaaactttcgcccccatactgacaacatca

SEQ ID NO: 248637 - DNA, 75 bp, Artificial Sequence
  Synthetic
gggaaattcaattataaactagtagataagataacttctgatcaacatatcttcagtccggacaaaatagatatg

SEQ ID NO: 248638 - DNA, 75 bp, Artificial Sequence
  Synthetic
cttaagttaatattagctttactaacatttttcacagtaacaatcactataaattacataaaagtagaaaacaat

SEQ ID NO: 248639 - DNA, 75 bp, Artificial Sequence
  Synthetic
aaccaagcaagaagaccccaatgacctctgcagtagacctaaacaccaaacccaatccacagcgggcaacacagt

SEQ ID NO: 248640 - DNA, 75 bp, Artificial Sequence
  Synthetic
gtcaataatatcaggagcaggtagagaagatagaactcaagactttgttcttggttctactaatgtggttcaagg

SEQ ID NO: 248641 - DNA, 75 bp, Artificial Sequence
  Synthetic
cacacagggacaactccaacaccagatgcaacagtctctcagcaaaccacagacgagcacacaacactgctgaga

SEQ ID NO: 248642 - DNA, 75 bp, Artificial Sequence
  Synthetic
agcagcaaccctagaggaccatctacacacagggacaactccaacaccagatgcaacagtctctcagcaaaccac

SEQ ID NO: 248643 - DNA, 75 bp, Artificial Sequence
  Synthetic
gtatacagattctgtaataaacaaggacacatgctggaaaataagcagaaatcaatgcacaaatataacaacata

SEQ ID NO: 248644 - DNA, 75 bp, Artificial Sequence
  Synthetic
aagtgcttagcaaaagatggactatgtacttcaaagcaaaaagttaccccagtcaactcgaattaagtgaacaag

SEQ ID NO: 248645 - DNA, 75 bp, Artificial Sequence
  Synthetic
cttcatatgccttgcaagacagtgaaagcactaatcaagtgcagtaaacatggtcccaaattcattaccatagag

SEQ ID NO: 248646 - DNA, 75 bp, Artificial Sequence
  Synthetic
tgggttcatatcagatcatgccttcatggatttcaagatatttctatgtgtatttaaaaccaaacttttatgtag

SEQ ID NO: 248647 - DNA, 75 bp, Artificial Sequence
  Synthetic
taaaaaatcgatatctagaagaaactttcaatgcaagtgatagtctcaaaacaagaagagtactagagtactatt

SEQ ID NO: 248648 - DNA, 75 bp, Artificial Sequence
  Synthetic
cagaaataggttataattaatagcccaattataattaaaacattatttaaaaccataaatattcaatttacagag

SEQ ID NO: 248649 - DNA, 75 bp, Artificial Sequence
  Synthetic
aaaccaaaaccagctgttgaagtgtatcacatagtagaatgccattgtatatacacagttaaatggaagtgctat

SEQ ID NO: 248650 - DNA, 75 bp, Artificial Sequence
  Synthetic
tcattgggtaaattagtttttattgtatcatcatatggatgtatcgtcaagagcaacaaaagcaaaagagtgagc

SEQ ID NO: 248651 - DNA, 75 bp, Artificial Sequence
  Synthetic
aaaaaataataaaaaagcactcaggtaaactgcttattgcattaaaactgatattggccttattgacgtttttca

SEQ ID NO: 248652 - DNA, 75 bp, Artificial Sequence
  Synthetic
taaaagtagaaaacaatttgcaggcatgtcaatcaaaaaatgaatcagacaaaaaggtcacaaagttaaatacta

SEQ ID NO: 248653 - DNA, 75 bp, Artificial Sequence
  Synthetic
cctcgatgagcccctcagaaacagaaccagcatcaacaccaggcataacaaaccgcctgtcccttgtagatagat

SEQ ID NO: 248654 - DNA, 75 bp, Artificial Sequence
  Synthetic
acaaccctatgcgacaaaaagttaaaaaccatggtagaaaaacatagaaaggcggaatgtcagtgtctagatata

SEQ ID NO: 248655 - DNA, 75 bp, Artificial Sequence
  Synthetic
aatgtaaaattacctttttttgtgagatcagttgctactttcattatgcagggtagtaagctgtcaggttcagaa

SEQ ID NO: 248656 - DNA, 75 bp, Artificial Sequence
  Synthetic
attgaaatcagaacaaattctacccaggtttattaatacagtgtcttagttatttaaaaaccgaatattgtctag

SEQ ID NO: 248657 - DNA, 75 bp, Artificial Sequence
  Synthetic
aaaaaataataacacggctttcaacattgaaatcagaacaaattctacccaggtttattaatacagtgtcttagt

SEQ ID NO: 248658 - DNA, 75 bp, Artificial Sequence
  Synthetic
aggtttattaatacagtgtcttagttatttaaaaaccgaatattgtctaggctgcatgacacttcgcaataatat

SEQ ID NO: 248659 - DNA, 75 bp, Artificial Sequence
  Synthetic
accgcctttcgcacgagcagcacaggagaaagaccaactacaacatcagtccagtctgacagcagcaccacagcc

SEQ ID NO: 248660 - DNA, 75 bp, Artificial Sequence
  Synthetic
atgaagaaaaagaagctgcagaacacttcttaaacatgagtggtgacaatcaagatgattatgagtaattaaaaa

SEQ ID NO: 248661 - DNA, 75 bp, Artificial Sequence
  Synthetic
cagaacacattccccaccatgggcaatgacaaggacggtccgtggaaccaccactctccgcacaagcagcataag

SEQ ID NO: 248662 - DNA, 75 bp, Artificial Sequence
  Synthetic
caaaagataactaataatctctctaaaacagcaacaacatcatgtcaactttgctcaaatctccctgggagaacc

SEQ ID NO: 248663 - DNA, 75 bp, Artificial Sequence
  Synthetic
aggcagtatccacactaggaaatggagtgcgagtcctagccactgcagtaagagagctgaaagaatttgtgagca

SEQ ID NO: 248664 - DNA, 75 bp, Artificial Sequence
  Synthetic
aggccagcacatcaacaacatacaaccaaactagttaacaaaaaatacaaaataactctaagataaaccatgtag

SEQ ID NO: 248665 - DNA, 75 bp, Artificial Sequence
  Synthetic
gacaacttcatactattctaaattaattatttgattatgcaattatatgatagttaattaaaattaaaaattaaa

SEQ ID NO: 248666 - DNA, 75 bp, Artificial Sequence
  Synthetic
catacacagggacaactcaaacaccagacacaacagctccccagcaaaccacagacaaacacacagcactgccaa

SEQ ID NO: 248667 - DNA, 75 bp, Artificial Sequence
  Synthetic
ttagactcaaaaatgcagtcaattctaaaatgagaatatcagattacaaggtagtagaaccaataaacatgcaac

SEQ ID NO: 248668 - DNA, 75 bp, Artificial Sequence
  Synthetic
gacaaccacagagaaaaagacaaccagagcaacaacccaaaaaagggaaaaaagaaaagaaaacacaaaccaaac

SEQ ID NO: 248669 - DNA, 75 bp, Artificial Sequence
  Synthetic
cacaagtacagctgcaacccaaacaaccaacaccaccaaccaaaccagaaatgcaagtgagacaatcacaacatc

SEQ ID NO: 248670 - DNA, 75 bp, Artificial Sequence
  Synthetic
atagaagagaagttgagcatgatattaggactgcttcgtacacttaacattgcaacagcaggaccaacagctgca

SEQ ID NO: 248671 - DNA, 75 bp, Artificial Sequence
  Synthetic
ataccatgcacggagaggtgcaggacccaggtgaacgcaacacacaggtatctcatccaagtagttaacaaaaaa

SEQ ID NO: 248672 - DNA, 75 bp, Artificial Sequence
  Synthetic
ttcttcacatacaatcaactgttaacatggaaagatgtgatgttaagtcgatttaatgcgaatttttgtatatgg

SEQ ID NO: 248673 - DNA, 75 bp, Artificial Sequence
  Synthetic
ccaccattatttaaggaataagaagaggcaaaaattcaagggataaatgacaatggatcccttttgtgagtctac

SEQ ID NO: 248674 - DNA, 75 bp, Artificial Sequence
  Synthetic
caatcatctcaagaaaagaaactgggcaaaacatcaccaaagagacaaataacaatggatcctcttaatgaatcc

SEQ ID NO: 248675 - DNA, 75 bp, Artificial Sequence
  Synthetic
aacactggtttcattattgtaataattttgattgctgttcttgggttaaccatgatttcagtgagcatcatcatc

SEQ ID NO: 248676 - DNA, 75 bp, Artificial Sequence
  Synthetic
gtaaatgcaactgtagcacttgatgagtacagcaaacttgactttgacaagctgacggtttgcgatgttaaaaca

SEQ ID NO: 248677 - DNA, 75 bp, Artificial Sequence
  Synthetic
gatattggccttattgacctttcttacagtaacaatcactgtcaaccatataaaagtagaaaacaatctgcaggc

SEQ ID NO: 248678 - DNA, 75 bp, Artificial Sequence
  Synthetic
atgcatcaaattattaatcaataaaaacttagagaatgctgcagaattatactatatattcagaatttttggtca

SEQ ID NO: 248679 - DNA, 75 bp, Artificial Sequence
  Synthetic
tcgatatctagaagaaactttcaatgcaagtgatagtctcaaaacaagaagagtactagagtactatttgaaaga

SEQ ID NO: 248680 - DNA, 75 bp, Artificial Sequence
  Synthetic
atggaaagatgtgatgttaagtagattcaatgcaaacttttgtatatgggtaagtaacaacctgaacaaaaatca

SEQ ID NO: 248681 - DNA, 75 bp, Artificial Sequence
  Synthetic
gaacaatccaaaaggtatattcaagaaactaggagctggaacacaagtgatagtagagctgggggcatatgttca

SEQ ID NO: 248682 - DNA, 75 bp, Artificial Sequence
  Synthetic
taacaaaggctgcagcttgctatagtctacataacataataaaacagctacaagaaatagaagtaagacaggcta

SEQ ID NO: 248683 - DNA, 75 bp, Artificial Sequence
  Synthetic
aaagaaactaccaagagaaaaactgaagaaattagcgaaattaataattgatttatcagcaggaactgataatga

SEQ ID NO: 248684 - DNA, 75 bp, Artificial Sequence
  Synthetic
caaagcaagagtgaaaaatcgtgtggcacgtagcaaatgctttaaaaatgcttctttaatcctcataggaataac

SEQ ID NO: 248685 - DNA, 75 bp, Artificial Sequence
  Synthetic
aagaaattagcgaaattaataattgatttatcagcaggaactgataatgactcttcatatgccttgcaagacagt

SEQ ID NO: 248686 - DNA, 75 bp, Artificial Sequence
  Synthetic
ggttaactgaacaattatcagtgttgaaagctaagaacagatctagagttcttggaactatattagaaaacaata

SEQ ID NO: 248687 - DNA, 75 bp, Artificial Sequence
  Synthetic
cagtacacaatccccaccatgggcaacaacgaaggcaatccgcagagccaccaccttccacatgagcagcacagg

SEQ ID NO: 248688 - DNA, 75 bp, Artificial Sequence
  Synthetic
cctcggtgagcccatcagaaacagaaccagcatcaacaccaggcataacaaaccgcccgtcctctgtagacagat

SEQ ID NO: 248689 - DNA, 75 bp, Artificial Sequence
  Synthetic
gcaaaaccaaattagttaacaaaaaatataaaatagctctaaagtaaaacatataggtgctaacaatcaagaaat

SEQ ID NO: 248690 - DNA, 75 bp, Artificial Sequence
  Synthetic
taattattgaaaagttcagcactgacagaactacaagaggtcaaagaggtccaaaaagcccttgggtagggtcga

SEQ ID NO: 248691 - DNA, 75 bp, Artificial Sequence
  Synthetic
tcctcagaaacatgtaatcaactcaaaaaaataataaaaaaacactcaggtaaattgcttattgcattaaaactg

SEQ ID NO: 248692 - DNA, 75 bp, Artificial Sequence
  Synthetic
cagtaacaattactgttaactatataaaagtagaaaacaatttgcaggcatgtcaattaaaaaatgaatcagaca

SEQ ID NO: 248693 - DNA, 75 bp, Artificial Sequence
  Synthetic
acagcaacgacaccatgtcagctttgctcaaatctctctgggagaaacttttgcccacatactaacaacatcaca

SEQ ID NO: 248694 - DNA, 75 bp, Artificial Sequence
  Synthetic
gagcaaaaatctgactagtgcaatcaacaagaacaaatgtgacattgctgatctgaagatggctgtcagcttcag

SEQ ID NO: 248695 - DNA, 75 bp, Artificial Sequence
  Synthetic
ggacctaatgactgatgctgagttggccagagctgtatcatacatgccaacatctgcaggacagataaaactgat

SEQ ID NO: 248696 - DNA, 75 bp, Artificial Sequence
  Synthetic
cgcgtataaattagattccaaaaaaatatgggacaagtgaaaatgtctcttcaagggattcacctgagtgattta

SEQ ID NO: 248697 - DNA, 75 bp, Artificial Sequence
  Synthetic
aatctgaaggagtaatgcatcctacccctataaaaaagatcttaagagtaggaccatggataaacacaatattag

SEQ ID NO: 248698 - DNA, 75 bp, Artificial Sequence
  Synthetic
gcaaactcacccataatataatcactgagtaatacaaaacaagaaaatgggacaagtggccatggaagtaagagt

SEQ ID NO: 248699 - DNA, 75 bp, Artificial Sequence
  Synthetic
cagcatccaactcaacagtctacagaaagcctcacactctaccccgcatcctcgatgagcccctcagaaacagaa

SEQ ID NO: 248700 - DNA, 75 bp, Artificial Sequence
  Synthetic
aagagtctcagtacacaataaagagagatgtaggcacaacaaccgcagtgacaccctcatcattgcaacaagaaa

SEQ ID NO: 248701 - DNA, 75 bp, Artificial Sequence
  Synthetic
ggggaagagttgcagatgttagatatacatggagtggaaaagagttgggtagaagaaatagacaaagaggcaaga

SEQ ID NO: 248702 - DNA, 75 bp, Artificial Sequence
  Synthetic
gcaaagtcagcacaggaagacaccctataagtatggttgcactatcacctcttggtgctttggtggcttgctata

SEQ ID NO: 248703 - DNA, 75 bp, Artificial Sequence
  Synthetic
acaaagacaaactcgacagtccacaaaagaaacatctcaagtacaatttctagaacacagtccccaccacggaca

SEQ ID NO: 248704 - DNA, 75 bp, Artificial Sequence
  Synthetic
tagagcagttgagatcagctgaattgcatgaaataccttggattgtcaatgccgaaggtgatttggttgagatca

SEQ ID NO: 248705 - DNA, 75 bp, Artificial Sequence
  Synthetic
agttaaaaacaataaaggagaagatttacagatgttagacatacacggagtagaaaaaagctgggtggaagagat

SEQ ID NO: 248706 - DNA, 75 bp, Artificial Sequence
  Synthetic
aattgacaacaccgtgtatcaactaagcaaagttgaaggtgaacagcatgtaataaaagggagaccagtttcaag

SEQ ID NO: 248707 - DNA, 75 bp, Artificial Sequence
  Synthetic
gccctgaatctggacttctacatttaaggcaaagcccaaaagctggactgttatcactagccaactgtcccaact

SEQ ID NO: 248708 - DNA, 75 bp, Artificial Sequence
  Synthetic
gggagggattgaagggtggtgccaaaagttatggacaatggaagcaatatccttgttagatgtagtatctgtgaa

SEQ ID NO: 248709 - DNA, 75 bp, Artificial Sequence
  Synthetic
agaacaaatgtgacattgctgatctgaagatggctgtcagcttcagtcagttcaacagaagattcctaaatgttg

SEQ ID NO: 248710 - DNA, 75 bp, Artificial Sequence
  Synthetic
caaccacagagaaaaagccaaccggagcaacaaccaaaaaagaaaccacaactcgaactacaagcacagctgcaa

SEQ ID NO: 248711 - DNA, 75 bp, Artificial Sequence
  Synthetic
agcaacaaccaaaaaagaaaccacaactcgaactacaagcacagctgcaacccaaacactcaacactaccaacca

SEQ ID NO: 248712 - DNA, 75 bp, Artificial Sequence
  Synthetic
aaaaaggacacaaagctaaataccacatcaacaacaatcagacccattcctgatctaaatgcagtacagtacttg

SEQ ID NO: 248713 - DNA, 75 bp, Artificial Sequence
  Synthetic
cacgattaattaggaagaaattgatgtgtgataatgcactcttcaatccaagttcatcaccaatgtttagtctaa

SEQ ID NO: 248714 - DNA, 75 bp, Artificial Sequence
  Synthetic
acaacatccgccagatccagaaacagtgccacaactcaaagcagcgaccaaacaacccaggcagcagacccaagc

SEQ ID NO: 248715 - DNA, 75 bp, Artificial Sequence
  Synthetic
gaattaagtgaacaagattttctagagcttgctgcaatacaatttgaacaagagttttctgttcctgaaaaaacc

SEQ ID NO: 248716 - DNA, 75 bp, Artificial Sequence
  Synthetic
aaaatcagaacaaatcctatccagatctattaatataatattttagttatttaaaaactctaaatattgtctaga

SEQ ID NO: 248717 - DNA, 75 bp, Artificial Sequence
  Synthetic
tgatcatcattatcctttggaataccagagagtgataggtgaattaagcagaatcatagatagtggtgaagggct

SEQ ID NO: 248718 - DNA, 75 bp, Artificial Sequence
  Synthetic
tagttaattaaaaattataaattagtaactaattgataaaaaataagaaattgaaattgaatgtatacggttttt

SEQ ID NO: 248719 - DNA, 75 bp, Artificial Sequence
  Synthetic
ggacaagtggccatggaagtaagagtggagaacattcgggcaatagacatgttcaaagcaaagatgaaaaaccgt

SEQ ID NO: 248720 - DNA, 75 bp, Artificial Sequence
  Synthetic
gatatttagaagaaactttcaatgcaagtgatagtctcaaaacaagaagagtactagagtattatttaaaagata

SEQ ID NO: 248721 - DNA, 75 bp, Artificial Sequence
  Synthetic
actagagaaagatgccctagatttgctctcagacaatgaggaagaagacgcagaatcctcaatcctaacctttga

SEQ ID NO: 248722 - DNA, 75 bp, Artificial Sequence
  Synthetic
cctctgcagtagacttaaacaccaaactcaatccacagcaggcaacacagctgaccacagaggattcaacatctc

SEQ ID NO: 248723 - DNA, 75 bp, Artificial Sequence
  Synthetic
gaattacctactatcagtagacctgcaaaaccaaccatactgtcagaaccaaagttagcatggactgataaaggt

SEQ ID NO: 248724 - DNA, 75 bp, Artificial Sequence
  Synthetic
aatagcagacataataaaggaagctaaagggaaagcagcagaaatgatggaagaggaaatgagtcaacgatcaaa

SEQ ID NO: 248725 - DNA, 75 bp, Artificial Sequence
  Synthetic
ttaatcttagagtttagaagagaggaagtaataagaactggttcaattttatgtagatcactaggcaagttagtt

SEQ ID NO: 248726 - DNA, 75 bp, Artificial Sequence
  Synthetic
tggtgaagatattgatagagcagtgtctatgatgttagagaacttagggttgttatctaggatattgtcagtaat

SEQ ID NO: 248727 - DNA, 75 bp, Artificial Sequence
  Synthetic
aagtccaatggcagattgatatgctgtcaaatttccaagaccttgagagaaaaatcatggaacaatatggaaata

SEQ ID NO: 248728 - DNA, 75 bp, Artificial Sequence
  Synthetic
ccttacacagcagctgttcaagttgatctaatagaaaaggacctgttacctgcaagcctaacaatatggttccct

SEQ ID NO: 248729 - DNA, 75 bp, Artificial Sequence
  Synthetic
gataacctagggaatgcagagattaaaaaactgatcaaagtaacaggatacatgcttgtaagtaaaaaatgaaaa

SEQ ID NO: 248730 - DNA, 75 bp, Artificial Sequence
  Synthetic
aacactcaacattgctacagcaggacccacagcagcaagagatgggatcagagatgcaatgattggcataaggga

SEQ ID NO: 248731 - DNA, 75 bp, Artificial Sequence
  Synthetic
aaggaactccagggctaagaagattgctcaacaagatttgcataggaagtttaggtattagctataaatgtgtaa

SEQ ID NO: 248732 - DNA, 75 bp, Artificial Sequence
  Synthetic
gcttatggtgctggtcaaacaatgctgaggtggggggttatcgccaggtcatctaacaatataatgttagggcat

SEQ ID NO: 248733 - DNA, 75 bp, Artificial Sequence
  Synthetic
actgcagtgacaccctcatcattgcaacaagaaataacgctgttgtgtggagaaattctgtatgctaaacatgct

SEQ ID NO: 248734 - DNA, 75 bp, Artificial Sequence
  Synthetic
cacaagtggtgaatccgaagaagaagaagaaccaaaagacacacaggaaaataatcaagaagatgacatttacca

SEQ ID NO: 248735 - DNA, 75 bp, Artificial Sequence
  Synthetic
ttaagaaaaggataatgttatatgatgtaaaattcctatcactagtaggttacatagggtttaagaactggttta

SEQ ID NO: 248736 - DNA, 75 bp, Artificial Sequence
  Synthetic
acattaaaatcagaacaaattctacccaggtctattaatacagtggtttagttatttaaaaactaaatattgtct

SEQ ID NO: 248737 - DNA, 75 bp, Artificial Sequence
  Synthetic
agagctgggggcatatgttcaggctgagagcatcagcaggatctgcaagagctggagtcaccaaggaacaagata

SEQ ID NO: 248738 - DNA, 75 bp, Artificial Sequence
  Synthetic
aacagttaactggtagaagcccaaaacaattagtcttaatccctcaattagaagagatagatattatgcctcctc

SEQ ID NO: 248739 - DNA, 75 bp, Artificial Sequence
  Synthetic
ataactgttttgaactatacagatatggcacatgctctcacacgattaatcagaaagaagttgatgtgtgataat

SEQ ID NO: 248740 - DNA, 75 bp, Artificial Sequence
  Synthetic
gatcaacacatcttcagtcctgacaaaatagacatattaacactagggaagatgcttatgcctaccataaaaggt

SEQ ID NO: 248741 - DNA, 75 bp, Artificial Sequence
  Synthetic
tacaaaaaaaatatgggacaagtgaaaatgtctcttcaagggattcacctgagtgatctatcatacaagcatgct

SEQ ID NO: 248742 - DNA, 75 bp, Artificial Sequence
  Synthetic
agagctcaacaaaattgttgaagatgaaagcacaagtggagaatctgaagaagaagaagaaccaaaagacataca

SEQ ID NO: 248743 - DNA, 75 bp, Artificial Sequence
  Synthetic
tgtcctccacagcaggcccaaacaccaaacccgatccacagcaagcaacacagtggaccacagagaactcaacat

SEQ ID NO: 248744 - DNA, 75 bp, Artificial Sequence
  Synthetic
taatttaattgaatctttatctgcagcacttgcatgccactggtgtggaatattaacagaacagtgtatagaaaa

SEQ ID NO: 248745 - DNA, 75 bp, Artificial Sequence
  Synthetic
aattacatgatactgttgccatggcagcatgttaatagatataactttgtctttagttctactggatgtaaagtt

SEQ ID NO: 248746 - DNA, 75 bp, Artificial Sequence
  Synthetic
tttgtactttattggagaaggagcaggaaattggatggccagaacagcatgtgaatatcctgatattaagtttgt

SEQ ID NO: 248747 - DNA, 75 bp, Artificial Sequence
  Synthetic
gaaatcaaccaacgaacagatcacccagacaaccacagagaaaaagacaaccagagcagcaacccaaaaagggaa

SEQ ID NO: 248748 - DNA, 75 bp, Artificial Sequence
  Synthetic
taaaagatgaagatataatagatgaatccattgacaaattattaagaattgacaacaccttttggagaatgttca

SEQ ID NO: 248749 - DNA, 75 bp, Artificial Sequence
  Synthetic
ttacagatgttagacatacacggggttgagaagagctgggtagaagagatagacaaagaagcaaggaaaacaatg

SEQ ID NO: 248750 - DNA, 75 bp, Artificial Sequence
  Synthetic
gtaatatcccacaaaatcagaggccctcagcaccagacacacccataatcttattatgtgtaggtgccttaatat

SEQ ID NO: 248751 - DNA, 75 bp, Artificial Sequence
  Synthetic
agtaaaatatgcaagacttggagccatcaaggaacaagatatgtgctgaagtccaaataacagccaagcaacctg

SEQ ID NO: 248752 - DNA, 75 bp, Artificial Sequence
  Synthetic
ggcacatgctcttacacgattaattaggaaaaaattgatgtgtgataatgcactcttcaatccaagttcatcacc

SEQ ID NO: 248753 - DNA, 75 bp, Artificial Sequence
  Synthetic
aattaaatcaatcaagaacgggacaaataaaaatgtcttggaaagtggtgatcattttttcattgctaataacac

SEQ ID NO: 248754 - DNA, 75 bp, Artificial Sequence
  Synthetic
agaagagcaaagtgggctatacagatatcatatgggagggattgaagggtggtgtcagaagttatggacaatgga

SEQ ID NO: 248755 - DNA, 75 bp, Artificial Sequence
  Synthetic
tggagccggtcaaacaatgctaaggtggggggtcattgccaggtcatccaacaatataatgttaggacatgtatc

SEQ ID NO: 248756 - DNA, 75 bp, Artificial Sequence
  Synthetic
tggggggtcattgccaggtcatccaacaatataatgttaggacatgtatccgtccaggctgagctaaaacaggtc

SEQ ID NO: 248757 - DNA, 75 bp, Artificial Sequence
  Synthetic
tttgggacaaatcataatgtctcgtaaggctccatgcaaatatgaagtgcggggcaaatgcaatagaggaagtga

SEQ ID NO: 248758 - DNA, 75 bp, Artificial Sequence
  Synthetic
atagcactcggtgttgcaacagcagctgcagttacagcaggtgttgcaattgccaaaaccatccggcttgaaagt

SEQ ID NO: 248759 - DNA, 75 bp, Artificial Sequence
  Synthetic
tcaaagaaggtgaaacatatatatcaagagatctccaatttataagtaaggtgattcaatctgagggggtcatgc

SEQ ID NO: 248760 - DNA, 75 bp, Artificial Sequence
  Synthetic
gcacaaatataaaaatatataagttcttatgttttgggtttatgaattcaacaaatacagactgtgaagaactaa

SEQ ID NO: 248761 - DNA, 75 bp, Artificial Sequence
  Synthetic
acacagaattattttcagcagcagaaagttatgccaaaagtttgaaagaaagcaataaaatcaatttctcttcat

SEQ ID NO: 248762 - DNA, 75 bp, Artificial Sequence
  Synthetic
tagttaattaaaatttaaattaaaaatcaaaaattaaaatttaaaacctatcattaagtttattaaaaataagaa

SEQ ID NO: 248763 - DNA, 75 bp, Artificial Sequence
  Synthetic
aaagatctcaatctattataggagaaaaagtgaatactgtatcagaaacattggaattacctactatcagtagac

SEQ ID NO: 248764 - DNA, 75 bp, Artificial Sequence
  Synthetic
ccgtaatttacatggtgcaactgccaatctttggggttatagacacgccttgctggatagtaaaagcagcccctt

SEQ ID NO: 248765 - DNA, 75 bp, Artificial Sequence
  Synthetic
accaaagttagcatggactgataaaggtggggcaatcaaaactgaaataaagcaagcaatcaaagtcatggatcc

SEQ ID NO: 248766 - DNA, 75 bp, Artificial Sequence
  Synthetic
aagaaggtgctgccctccagtgatgggaaaacccctgcagaaaagaaactgaaaccatcaactaacaccaaaaag

SEQ ID NO: 248767 - DNA, 75 bp, Artificial Sequence
  Synthetic
gaaaccatcaactaacaccaaaaagaaggtttcatttacacaaaatgaaccaggaaaatatacaaagttggaaaa

SEQ ID NO: 248768 - DNA, 75 bp, Artificial Sequence
  Synthetic
gcagagaaaggaaacactggcttcatcattgtaataattctaattgctgtccttggctctaccatgatcctagtg

SEQ ID NO: 248769 - DNA, 75 bp, Artificial Sequence
  Synthetic
agatgctctagatttgctctcagataatgaagaagaagatgcagaatcttcaatcttaacctttgaagaaaggga

SEQ ID NO: 248770 - DNA, 75 bp, Artificial Sequence
  Synthetic
agaatttagaaaatgctgcagaattatattatatattcagaatttttggacaccctatggtagatgagagagaag

SEQ ID NO: 248771 - DNA, 75 bp, Artificial Sequence
  Synthetic
attggttagagcatattttgaattctccaaaaggtgaattaaactatgatttctttgaagcattagagaacacat

SEQ ID NO: 248772 - DNA, 75 bp, Artificial Sequence
  Synthetic
gagagtgctctatgaatcactaccttttcataaggctgaaaaggttgtcaatatgatatcaggtacaaagtctat

SEQ ID NO: 248773 - DNA, 75 bp, Artificial Sequence
  Synthetic
tcagtagacctaccaaaccgaccatattgtcagagccgaagttagcatggacagacaaaggtggggcaatcagaa

SEQ ID NO: 248774 - DNA, 75 bp, Artificial Sequence
  Synthetic
tacttcatcgttaagcattgaggccagattggaatcaatagaggagaaattaagcatgatattagggctattaag

SEQ ID NO: 248775 - DNA, 75 bp, Artificial Sequence
  Synthetic
gatcatcaagcagctgaacaaaggttgctcctatataaccaaccaagatgcagacacagtgacaatagacaacac

SEQ ID NO: 248776 - DNA, 75 bp, Artificial Sequence
  Synthetic
gaacagcatgttataaaaggaaggccagtgtcaagcagctttgatccagtcaagtttcctgaagatcaattcaat

SEQ ID NO: 248777 - DNA, 75 bp, Artificial Sequence
  Synthetic
tcaatatttagaagaggctttcaatgcaagtgacagtcaaagaacaaggagagtcttagaattttacttaaaaga

SEQ ID NO: 248778 - DNA, 75 bp, Artificial Sequence
  Synthetic
tgcaagtgacagccaaagaacaaggagagtcttagaattttacttaaaagattgtaattttgatcaaaaagaact

SEQ ID NO: 248779 - DNA, 75 bp, Artificial Sequence
  Synthetic
ctcggcaatgcctcaggcttaggcataataggtatgtatcgcgggagagtgccaaacacagaactattttcagca

SEQ ID NO: 248780 - DNA, 75 bp, Artificial Sequence
  Synthetic
acagatactagctgagaaacttctagctgataatattgtaccttttttcccagaaactttaacaaagtatggtga

SEQ ID NO: 248781 - DNA, 75 bp, Artificial Sequence
  Synthetic
gctgataatattgtaccttttttcccagaaactttaacaaagtatggtgacttagatctccaaagaattatggaa

SEQ ID NO: 248782 - DNA, 75 bp, Artificial Sequence
  Synthetic
tatgctgcatcacaaaatggtccaatactcaaagtgaatgcatcagcccaaggtgcagcaatgtctgtacttccc

SEQ ID NO: 248783 - DNA, 75 bp, Artificial Sequence
  Synthetic
atgtgagtgacgacagtcaaaatgattatgagtaattaaaaaagcgggacaagtcaaaatgtcattccctgaagg

SEQ ID NO: 248784 - DNA, 75 bp, Artificial Sequence
  Synthetic
tagcactcgatgaatatagcaaattggaatttgacaaactcacagtctgtgaagtaaaaacagtttacttaacaa

SEQ ID NO: 248785 - DNA, 75 bp, Artificial Sequence
  Synthetic
aacatttacaattgttatttagaaaacatagaaattatatatgtcaaggcttacttaagttagtaaaaacacatc

SEQ ID NO: 248786 - DNA, 75 bp, Artificial Sequence
  Synthetic
acccagacatcaatccaaactcacagcatccaactcaacagtccacagaaagcctcacactctaccccgcatcct

SEQ ID NO: 248787 - DNA, 75 bp, Artificial Sequence
  Synthetic
gatgtagagaaccttacatgtgctgatggacctagcttaataaaaacagaattagacctgaccaaaagtgcacta

SEQ ID NO: 248788 - DNA, 75 bp, Artificial Sequence
  Synthetic
tcaaagagagtgagtcagctactgttgaagctgctataagcagtgaagcagaccaagctctaacacaggccaaaa

SEQ ID NO: 248789 - DNA, 75 bp, Artificial Sequence
  Synthetic
ttgcaccttatgcgggattgattatgatcatgactatgaacaatcccaaaggcatattcaaaaagcttggagctg

SEQ ID NO: 248790 - DNA, 75 bp, Artificial Sequence
  Synthetic
ggctgtataacttgtacatgtatgagtcaaaacagcacccgctagctggaaagcaactatttaagcaattgaaca

SEQ ID NO: 248791 - DNA, 75 bp, Artificial Sequence
  Synthetic
tatctgcagcacttgcatgccactggtgtggaatattaacagaacagtgtgtagaaaacaatatctttaggaaag

SEQ ID NO: 248792 - DNA, 75 bp, Artificial Sequence
  Synthetic
atcaagtgcagtgagcatggtcctgttttcattactatagaggttgatgacatgatatggactcataaggactta

SEQ ID NO: 248793 - DNA, 75 bp, Artificial Sequence
  Synthetic
tgttcttggcaatgcttcaggtctaggcataatcggaatgtacagagggagagtaccaaacacagagctattttc

SEQ ID NO: 248794 - DNA, 75 bp, Artificial Sequence
  Synthetic
gagtaccaaacacagagctattttctgcagcagaaagttatgccagaagcttaaaagagagcaataaaatcaatt

SEQ ID NO: 248795 - DNA, 75 bp, Artificial Sequence
  Synthetic
aaaccaaattagttaacaaaaaatatgaaatagctctaaagtaaaacatgtaggtgctaacaatcaagaaatcaa

SEQ ID NO: 248796 - DNA, 75 bp, Artificial Sequence
  Synthetic
agcccgaaatcatgaagaaacaggttcagcgaacccacaggcatctgcaagcacaatgcaaacccaacacaccaa

SEQ ID NO: 248797 - DNA, 75 bp, Artificial Sequence
  Synthetic
tgatattggccttactgacatttttcacagcaacaatcactgtcaactatataaaagtagaaaacaatttgcagg

SEQ ID NO: 248798 - DNA, 75 bp, Artificial Sequence
  Synthetic
gcttaataaaaacggaattagacctgaccaaaagtgcactaagagagctcagaacagtttctgctgatcaactgg

SEQ ID NO: 248799 - DNA, 75 bp, Artificial Sequence
  Synthetic
cacagcaacaatcactgtcaactatataaaagtagaaaacaatttgcaggcatgtcaaccaaaaaatgaatcaga

SEQ ID NO: 248800 - DNA, 75 bp, Artificial Sequence
  Synthetic
tcagcaaacccgcacgatcatctacactgctggaaccaaaattggcatgggcagacaacagcggaatcaccaaaa

SEQ ID NO: 248801 - DNA, 75 bp, Artificial Sequence
  Synthetic
acatcaacaacaatcagacccacacccgatccaactgtagtacatcatttgaaaaggctgattcagagacacacc

SEQ ID NO: 248802 - DNA, 75 bp, Artificial Sequence
  Synthetic
tcacagaaaaaccagcaaccaaaacaacagatcctgttgaagaagaggaattcaatgaaaagaaagtattgcctt

SEQ ID NO: 248803 - DNA, 75 bp, Artificial Sequence
  Synthetic
tgataatgcactcttcaatccaagttcatcaccaatgtttagtctaactcaagttatcgatcctacaacacagct

SEQ ID NO: 248804 - DNA, 75 bp, Artificial Sequence
  Synthetic
aaaaatcgtgtggcacgcagcaaatgctttaaaaatgcctctttggtcctcataggaataactacattgagtatt

SEQ ID NO: 248805 - DNA, 75 bp, Artificial Sequence
  Synthetic
ttttgaaaagaccctatctaaaaaatgataacactgctaaagttgctgtagaaaaccctgttgttgaacatgtca

SEQ ID NO: 248806 - DNA, 75 bp, Artificial Sequence
  Synthetic
agaggagaccatgtcttttgcgacacagcagcaggaatcaatgtcgctgagcagtcaaaggagtgcaacatcaac

SEQ ID NO: 248807 - DNA, 75 bp, Artificial Sequence
  Synthetic
gaaaaccctgttgttgaacatgtcaggcttagaaatgcagtcatgaccaaaatgaagatatcagattataaagtg

SEQ ID NO: 248808 - DNA, 75 bp, Artificial Sequence
  Synthetic
tgaaagattttgtgagcaagaatctaacacgtgcaatcaacaaaaacaagtgcgacattgatgacctgaagatgg

SEQ ID NO: 248809 - DNA, 75 bp, Artificial Sequence
  Synthetic
caaaaatatgggacaagtagttatggaggtgaaagtagagaacattcgagcaatagacatgctcaaagcaagagt

SEQ ID NO: 248810 - DNA, 75 bp, Artificial Sequence
  Synthetic
ccatggcagcacgtaaacaggtataattttgtctttagttcaacaggatgtaaaatcagcttgaagacatgcatc

SEQ ID NO: 248811 - DNA, 75 bp, Artificial Sequence
  Synthetic
atatagcaaattagaatttgacaaacttacagtctgtgaagtaaaaacagtttacttaacaaccatgaaaccata

SEQ ID NO: 248812 - DNA, 75 bp, Artificial Sequence
  Synthetic
gtgatataaatagaacagcagttaccagcatactgagtctatctcctaatcagctcttctgtgatagtgctatac

SEQ ID NO: 248813 - DNA, 75 bp, Artificial Sequence
  Synthetic
acgtacaaatataaaaatatacaagttcttatgctctgggttcacaaattcaaaaggtacagattgtgaggaacc

SEQ ID NO: 248814 - DNA, 75 bp, Artificial Sequence
  Synthetic
tgggatggtatcaaagtttgtgagctcggccaaatcagttggcaaaaaaacacatgatctaatcgcattatgtga

SEQ ID NO: 248815 - DNA, 75 bp, Artificial Sequence
  Synthetic
actgcttcgtacacttaacattgcaacagcaggaccaacagctgcacgagatggaatcagagatgcaatgattgg

SEQ ID NO: 248816 - DNA, 75 bp, Artificial Sequence
  Synthetic
tccaacatgccaacatctgcaggacaaataaaactgatgttggagaaccgtgcaatggtaagaagaaaggggttc

SEQ ID NO: 248817 - DNA, 75 bp, Artificial Sequence
  Synthetic
aagcagaatgtcactgtctacatacaaccgagtgggggtgccttcatccctaaaataacacggctttcaacatta

SEQ ID NO: 248818 - DNA, 75 bp, Artificial Sequence
  Synthetic
aaatcagaacaacctccacccaggtctatcaatacagtggtttagccatttaaaaaccgaatattatctaggctg

SEQ ID NO: 248819 - DNA, 75 bp, Artificial Sequence
  Synthetic
ataattaaggaagccaagggaaaagcagctgaaatgatggaagaagagatgaatcaaagatctaaaataggaaat

SEQ ID NO: 248820 - DNA, 75 bp, Artificial Sequence
  Synthetic
agaacattcgagcgatagacatgttcaaagcaaagataaaaaaccgtataagaagcagcaggtgctatagaaatg

SEQ ID NO: 248821 - DNA, 75 bp, Artificial Sequence
  Synthetic
tccgcacaagcagcacaagaaagagaccgtccacagcatcagtccaacctgacatcagcgcaacaacccacaaaa

SEQ ID NO: 248822 - DNA, 75 bp, Artificial Sequence
  Synthetic
gacatcagcgcaacaacccacaaaaacgaagaagcaagtccagcgagcccacaaacatctgcaagcacaacaaga

SEQ ID NO: 248823 - DNA, 75 bp, Artificial Sequence
  Synthetic
acaagtccggcagtccacacaaaaaacaacccaaggacaagctctagaacacattctccaccacgggcaacgaca

SEQ ID NO: 248824 - DNA, 75 bp, Artificial Sequence
  Synthetic
taagaaacatgatcaaaacagaaaactgtgctaacatgccgtcggcagaaccaagcaaaaagaccccaatgacct

SEQ ID NO: 248825 - DNA, 75 bp, Artificial Sequence
  Synthetic
caagctcacagtatccaactcaacagtccacagaaggctccacactctactttgcagcctcagcaagctcaccag

SEQ ID NO: 248826 - DNA, 75 bp, Artificial Sequence
  Synthetic
caggaagacatcctatcagtatggttgcactgtctcctcttggggctttagttgcttgctacaagggagtgagct

SEQ ID NO: 248827 - DNA, 75 bp, Artificial Sequence
  Synthetic
atggagaaatacaaaattccaaaatgagaatagcagtgtgtaatgatttccatgcctcaaaaaaactagacaaca

SEQ ID NO: 248828 - DNA, 75 bp, Artificial Sequence
  Synthetic
gatcatcaagcaactgaacaaaggctgctcttatataaccaaccaagacgcagacacagtgacaatagacaacac

SEQ ID NO: 248829 - DNA, 75 bp, Artificial Sequence
  Synthetic
aagtgagacaatcacaacatccgacagacccagaactgacaccacaacccaaagcagcgaacagacaacccgggc

SEQ ID NO: 248830 - DNA, 75 bp, Artificial Sequence
  Synthetic
agacccagaactgacaccacaacccaaagcagcgaacagacaacccgggcaacagacccaagctccccaccacac

SEQ ID NO: 248831 - DNA, 75 bp, Artificial Sequence
  Synthetic
tgatgataaccaaagcataacaaaagctgcagcctgttacagtctacataatataatcaaacaactacaagaagt

SEQ ID NO: 248832 - DNA, 75 bp, Artificial Sequence
  Synthetic
actatgatttctttgaagcattagagaacacataccccaatatgatcaagcttatagataacctgggaaatgcag

SEQ ID NO: 248833 - DNA, 75 bp, Artificial Sequence
  Synthetic
aatgagcacaacacacaaacatcccatccaagtagttaacaaaaaaccacaaaataaccttgaaaaccaaaaaac

SEQ ID NO: 248834 - DNA, 75 bp, Artificial Sequence
  Synthetic
gcaattaagaatgccctcaaaacgaccaatgaagcagtatctacattggggaatggagttcgagtgttggcaact

SEQ ID NO: 248835 - DNA, 75 bp, Artificial Sequence
  Synthetic
tcaatcctaagttttatagatgtagaatttatacctagctgggtaagcaattggtttagtaattggtacaatctc

SEQ ID NO: 248836 - DNA, 75 bp, Artificial Sequence
  Synthetic
tgccgagagagaaactgaaaaaattagcaaagcttataattgacttatcagcaggtgctgaaaatgactcttcat

SEQ ID NO: 248837 - DNA, 75 bp, Artificial Sequence
  Synthetic
aacatagacaccatatggaaggttctagcatatgcaccaatgagatggcatctgttcatgtatcaatagcaccac

SEQ ID NO: 248838 - DNA, 75 bp, Artificial Sequence
  Synthetic
tgagcaagaatttaactcgtgcaatcaacaaaaataagtgcgacattgatgacctaaaaatggctgttagcttca

SEQ ID NO: 248839 - DNA, 75 bp, Artificial Sequence
  Synthetic
gggcaaaacaacacccaagagacaaataacaatggatcctctcaatgaatccactgttaatgtctatcttcccga

SEQ ID NO: 248840 - DNA, 75 bp, Artificial Sequence
  Synthetic
tgttgtgcggcaattttcagacaatgctggaataacaccagcaatatctttggacttaatgacagatgctgaact

SEQ ID NO: 248841 - DNA, 75 bp, Artificial Sequence
  Synthetic
attaaagaccactctggtaaagtgcttattgtacttaagttaatattagctttactaacatttctcacagtgaca

SEQ ID NO: 248842 - DNA, 75 bp, Artificial Sequence
  Synthetic
aaaacaatctgcaaatatgccagtcaaaaactgaatcagacaaaaaggactcatcatcaaataccacatcagtca

SEQ ID NO: 248843 - DNA, 75 bp, Artificial Sequence
  Synthetic
cgaaagatcgacagatccatgcagaaacaaatcaaaatcagcagccgaagcacatcacacagtagaatgccattg

SEQ ID NO: 248844 - DNA, 75 bp, Artificial Sequence
  Synthetic
aacaaatcaaaatcagcagccgaagcacatcacacagtagaatgccattgcacacacacaactgagtggaagtgc

SEQ ID NO: 248845 - DNA, 75 bp, Artificial Sequence
  Synthetic
aatcttgaatgccaaaaccagactaggatccgtccaagaccatcagctcaatagtctagccatttaaaaatattt

SEQ ID NO: 248846 - DNA, 75 bp, Artificial Sequence
  Synthetic
ggatccgtccaagaccatcagctcaatagtctagccatttaaaaatatttgagaacaggcaagtctccatggcac

SEQ ID NO: 248847 - DNA, 75 bp, Artificial Sequence
  Synthetic
aatctgaagacacaaaaaccaacaattgtgataaactgacagatttatgcagaaacaaaccaaaaccagctgttg

SEQ ID NO: 248848 - DNA, 75 bp, Artificial Sequence
  Synthetic
ttgtgataaactgacagatttatgcagaaacaaaccaaaaccagctgttgaagtgtatcacatagtagaatgcca

SEQ ID NO: 248849 - DNA, 75 bp, Artificial Sequence
  Synthetic
gagcatgctcagttcagtactaggtttaggaatactttattgaatgggttaactgaacaattatcagtgttgaaa

SEQ ID NO: 248850 - DNA, 75 bp, Artificial Sequence
  Synthetic
agcccaactacaatcaaaacatcacttaaaaccgcaaccatttaacttacaaagcaaaaacaaaaacatgggaca

SEQ ID NO: 248851 - DNA, 75 bp, Artificial Sequence
  Synthetic
ctcaatcccaaatgttaacactagattaggatctatccaagtctgttagttcaacagtttagttatttaaaaata

SEQ ID NO: 248852 - DNA, 75 bp, Artificial Sequence
  Synthetic
ttcaacagaagatttctaaatgttgtgcggcagttttcagacaatgcagggataacaccagcaatatcattggac

SEQ ID NO: 248853 - DNA, 75 bp, Artificial Sequence
  Synthetic
agtagctatggaggtgaaagcagagaacactcgagcaatagacatgcccaaagcaagagtgaaaaatcgtgtggc

SEQ ID NO: 248854 - DNA, 75 bp, Artificial Sequence
  Synthetic
atacttcataatgataagtaataattaattgcttaatcatcatcacaacattattcgaaaccataactattcaat

SEQ ID NO: 248855 - DNA, 75 bp, Artificial Sequence
  Synthetic
taattgcttaatcatcatcacaacattattcgaaaccataactattcaatttaagaagtaaaaacaataatatgg

SEQ ID NO: 248856 - DNA, 75 bp, Artificial Sequence
  Synthetic
ctaaaaatcaaaagttagaaactaacaactgtcattaagtttattaaaaataagaaattataattggatgtatac

SEQ ID NO: 248857 - DNA, 75 bp, Artificial Sequence
  Synthetic
gacaagtagttatggaggtgaaagtggagaacattcgaacaatagatatgctcaaagcaagagtgaaaaaccgtg

SEQ ID NO: 248858 - DNA, 75 bp, Artificial Sequence
  Synthetic
ggagaacattcgaacaatagatatgctcaaagcaagagtgaaaaaccgtgtggcacgcagcaaatgctttaaaaa

SEQ ID NO: 248859 - DNA, 75 bp, Artificial Sequence
  Synthetic
ctcaaagcaagagtgaaaaaccgtgtggcacgcagcaaatgctttaaaaatgcctctttgatcctaataggaata

SEQ ID NO: 248860 - DNA, 75 bp, Artificial Sequence
  Synthetic
aacaaaccgcctgtcctccgtagacaggtccacagcacaaccaagtgaaaacagaacaaagacaaaactgacagt

SEQ ID NO: 248861 - DNA, 75 bp, Artificial Sequence
  Synthetic
gcaagaaaacacatccgaatcagaacatcacaccagctcatcacccatggaatccagcagggaaactccaacggt

SEQ ID NO: 248862 - DNA, 75 bp, Artificial Sequence
  Synthetic
cagtccagtccgacagcagcaccacaacccaaaatcatgaagaaacaggttcagcgaacccacaggcatctgcaa

SEQ ID NO: 248863 - DNA, 75 bp, Artificial Sequence
  Synthetic
tctccaaagaattatggaaataaaatcagaactttcttccattaaaactagaaagaatgatagctacaacaatta

SEQ ID NO: 248864 - DNA, 75 bp, Artificial Sequence
  Synthetic
tccaccaatgtggttcaaggttatattgatgataaccaaagcataacaaaagctgcagcctgctacagtctacac

SEQ ID NO: 248865 - DNA, 75 bp, Artificial Sequence
  Synthetic
acaatatggttccctttgtttcaggccaacacaccaccagcagtgctgctcgatcagctgaaaaccctaacaata

SEQ ID NO: 248866 - DNA, 75 bp, Artificial Sequence
  Synthetic
tatgccctgcaagacagtgaaagcattaatcaagtgcagtgagcatggtcctgttttcattactatagaggttga

SEQ ID NO: 248867 - DNA, 75 bp, Artificial Sequence
  Synthetic
aaaatacaaaataactccaagataaaccatgtagacaccaacaattgagaggccaaaaggcaattcacaatctcc

SEQ ID NO: 248868 - DNA, 75 bp, Artificial Sequence
  Synthetic
ccatgatttcagtgagcatcatcatcataatcaagaaaacaaggaagcccacaggagcacctccagagctgaatg

SEQ ID NO: 248869 - DNA, 75 bp, Artificial Sequence
  Synthetic
taacatctgtgcagagattttttgaactgaagaaagaaaatgatgtggttgacctatggatgaatataccaatgc

SEQ ID NO: 248870 - DNA, 75 bp, Artificial Sequence
  Synthetic
ccaaaaaggcaacaacaccatattagctctgcttaaatctccctgaaaaaaactcgcccatataccaactatacc

SEQ ID NO: 248871 - DNA, 75 bp, Artificial Sequence
  Synthetic
gacaagctaaggtaacaagtgatataaatagaacagcagttaccagcatactgagtctatctccgaatcagctct

SEQ ID NO: 248872 - DNA, 75 bp, Artificial Sequence
  Synthetic
ctcaccatcaaataccacatccgtcacaaccaagactactctagaccatgatataacacagtattttaaaagatt

SEQ ID NO: 248873 - DNA, 75 bp, Artificial Sequence
  Synthetic
ttacactaaacacactgattacaaatatgctgctgagataggaatgcaatatatttgcacagctctaggatcaga

SEQ ID NO: 248874 - DNA, 75 bp, Artificial Sequence
  Synthetic
acaacccagacatcacttcaaactcacagcatccaactcaacagtccacagaaagcctcacactccaccccgcat

SEQ ID NO: 248875 - DNA, 75 bp, Artificial Sequence
  Synthetic
atatttgcacagctctaggatcagaaagagtacaacagattttgagaaactcaggtagtgaagttcaggtggttc

SEQ ID NO: 248876 - DNA, 75 bp, Artificial Sequence
  Synthetic
accagcatcaacactaggcacaacaaaccgcctgtcctttgtagacagatccacaacacaatcaagtgaaagcag

SEQ ID NO: 248877 - DNA, 75 bp, Artificial Sequence
  Synthetic
aaccgcctgtcctttgtagacagatccacaacacaatcaagtgaaagcagaacaaagacaaactcgacagtccac

SEQ ID NO: 248878 - DNA, 75 bp, Artificial Sequence
  Synthetic
taagtttcttcaaagccttactgtcaatagaaaaaaatgaacgtgctacactgacaacactaatgagagatcctc

SEQ ID NO: 248879 - DNA, 75 bp, Artificial Sequence
  Synthetic
accgcttttcgcacgagcagcacaggagaaagaccaaccacaacatcagtccagtctgacagcagcaccacagcc

SEQ ID NO: 248880 - DNA, 75 bp, Artificial Sequence
  Synthetic
ttcaatagtttagttatttaaaaatatttgagaacaggtaagtttctatggcacttcatagcaataggtaataat

SEQ ID NO: 248881 - DNA, 75 bp, Artificial Sequence
  Synthetic
ttcagcaccagacacaccaataattttattatgtgtaggtgccctaatattcactaaactagcatcaacaataga

SEQ ID NO: 248882 - DNA, 75 bp, Artificial Sequence
  Synthetic
aaacttagagaatgctgctgaattatactatatatttagaatattcggtcacccaatggtagatgaaagagatgc

SEQ ID NO: 248883 - DNA, 75 bp, Artificial Sequence
  Synthetic
atttgagaacaggtaagtttctatggcacttcatagcaataggtaataattaatagcttaattataattaaaaca

SEQ ID NO: 248884 - DNA, 75 bp, Artificial Sequence
  Synthetic
ccagtctgacagcagcaccacagcccgaaatcacgaagaaacaggttcagcgaacccacaggcatccacaagcac

SEQ ID NO: 248885 - DNA, 75 bp, Artificial Sequence
  Synthetic
atctgacagcaaacatgtagcacttcacaacttagtcctatcttatatggagatgagcaaaactcctgcatcttt

SEQ ID NO: 248886 - DNA, 75 bp, Artificial Sequence
  Synthetic
tctatctgatcataaactacacaatacaaaaaaccacatctgaatcagaacaccacaccagctcaccacccacag

SEQ ID NO: 248887 - DNA, 75 bp, Artificial Sequence
  Synthetic
acagaggtttatgacttggtgagagaaatgggtcctgaatctgggcttttacatctaagacaaagtccaaaggca

SEQ ID NO: 248888 - DNA, 75 bp, Artificial Sequence
  Synthetic
tagtagataagataacttctgatcaacatatcttcagtccggacaaaatagatatgttaacactagggaaaatgc

SEQ ID NO: 248889 - DNA, 75 bp, Artificial Sequence
  Synthetic
atacaacaaaccgcctgtcctccgtagacaggtccacgacacaaccaagtgaaaacagaacaaagacaaaactga

SEQ ID NO: 248890 - DNA, 75 bp, Artificial Sequence
  Synthetic
tgttagctgataacattgtacctttcttcccagaaaccttaacaaagtatggtgatctagatcttcagagaataa

SEQ ID NO: 248891 - DNA, 75 bp, Artificial Sequence
  Synthetic
aaaagttatgtggttaaacaagaatatttaaatgataaggatcatattgtctcgctaactggaaaggaaagagaa

SEQ ID NO: 248892 - DNA, 75 bp, Artificial Sequence
  Synthetic
ttgagtgtgggtagaatgtttgctatgcaaccaggaaaacagcgacaaatacaaatattggctgaaaaattgtta

SEQ ID NO: 248893 - DNA, 75 bp, Artificial Sequence
  Synthetic
ggattattatctagaatattgtcagtagttgttgatagtatagaaattccaaccaaatctaatggtaggctgata

SEQ ID NO: 248894 - DNA, 75 bp, Artificial Sequence
  Synthetic
ccacaacccaaaatcacgaagaaacaggttctgcgaacccacaggcatctgcaagcacaatgcaaaccagcacac

SEQ ID NO: 248895 - DNA, 75 bp, Artificial Sequence
  Synthetic
ttcccaaaaaattcgaagtaaatgcaactgtggcacttgatgaatacagcaaacttgactttgacaagttaacgg

SEQ ID NO: 248896 - DNA, 75 bp, Artificial Sequence
  Synthetic
aggctgcacgacacttcgcaataatatgcaataatcaatagtcaaaccactgctgcaaactcatccataatataa

SEQ ID NO: 248897 - DNA, 75 bp, Artificial Sequence
  Synthetic
caacaatataaaaccaaattagttaacaaaaaatacgagatagctctaaagcaaaacatgtaggtaccaacaatc

SEQ ID NO: 248898 - DNA, 75 bp, Artificial Sequence
  Synthetic
aaaattccaaaatgagaatagcagtgtgtaatgatttctatgcctcaaagaaactggacaacaaatcaattgaag

SEQ ID NO: 248899 - DNA, 75 bp, Artificial Sequence
  Synthetic
aatgagtgtagtagaacaattaactggtaggagtccaaaacagttagttttaatacctcaattagaagaaataga

SEQ ID NO: 248900 - DNA, 75 bp, Artificial Sequence
  Synthetic
tatagcaacagttggcggcagtaagattatagaatccaaatggttaaagaataaagcaagtacaataattgattg

SEQ ID NO: 248901 - DNA, 75 bp, Artificial Sequence
  Synthetic
gcatcagcaggatctgcaagagctggagtcaccaaggaacaagatacgtactaaaatccagataaaaataactgt

SEQ ID NO: 248902 - DNA, 75 bp, Artificial Sequence
  Synthetic
gaacaacaaattaccattttgacactagtcctattaatcaagcactaagtgagagatttgggaatgaagatatta

SEQ ID NO: 248903 - DNA, 75 bp, Artificial Sequence
  Synthetic
agacacgatgtcaaatgacatctttattaaacggtgacaaccaatcaatagatgtaagtaaaccagtcaagttat

SEQ ID NO: 248904 - DNA, 75 bp, Artificial Sequence
  Synthetic
cagattatagcttggctataaaaatgctaaaagaaataagagatgcatacagaaatataggccataaacttaaag

SEQ ID NO: 248905 - DNA, 75 bp, Artificial Sequence
  Synthetic
atcataaactataaaatgcaagaaaacacatccgaatcagaacatcacaccagctcatcacccatggaatccagc

SEQ ID NO: 248906 - DNA, 75 bp, Artificial Sequence
  Synthetic
gtttgattatgcaattatttgatagttaattaaaatttaaattaaaaatcaaaagttaaaatttaaaacctatca

SEQ ID NO: 248907 - DNA, 75 bp, Artificial Sequence
  Synthetic
cattatcctctggaataccagagagtgataggtgaattaagcagaatcatagatagtggtgaagggctttcaatg

SEQ ID NO: 248908 - DNA, 75 bp, Artificial Sequence
  Synthetic
aaaatttaaattaaaaatcaaaagttaaaatttaaaacctatcattaagtttattaaaaataagaaattataatt

SEQ ID NO: 248909 - DNA, 75 bp, Artificial Sequence
  Synthetic
acagtatccaactcaacagtccacagaaggctccacactccactctgcagcctcagcaagctcaccagagacaga

SEQ ID NO: 248910 - DNA, 75 bp, Artificial Sequence
  Synthetic
ttaattaaaatttaaattaaaaatcaaaagttaaaatttaaaacctatcattaagtttattaaaaataagaaatt

SEQ ID NO: 248911 - DNA, 75 bp, Artificial Sequence
  Synthetic
attaaaagagtctcagtacacaataaaaagagatgtaggaacaacaacagcagtgacaccctcatcattgcaaca

SEQ ID NO: 248912 - DNA, 75 bp, Artificial Sequence
  Synthetic
cagtgacaccctcatcattgcaacaagaaataacactgttgtgtggagaaattctatatgctaagcatactgatt

SEQ ID NO: 248913 - DNA, 75 bp, Artificial Sequence
  Synthetic
tgaaaatcaggaagggctagggttgagaagtaatctgcaaggtatgttaactaataaactatatgaaactgtaga

SEQ ID NO: 248914 - DNA, 75 bp, Artificial Sequence
  Synthetic
agtggtcttctatagatctttctatagaaggactcctgattttttaactgaagcaatcagtcatgtggatattct

SEQ ID NO: 248915 - DNA, 75 bp, Artificial Sequence
  Synthetic
taactcaagttattgatcctacagaacaattagcttatttccctaagataacatttgaaaggctaaaaaattatg

SEQ ID NO: 248916 - DNA, 75 bp, Artificial Sequence
  Synthetic
gaaggtttctcacttgtgaaagagttcgaaggttttattatgagtgaaatccttaggattactgaacatgctcaa

SEQ ID NO: 248917 - DNA, 75 bp, Artificial Sequence
  Synthetic
ccaacccgacagcagcgcaacaacccacaaacacgaagaagcaagcccagtgagcccacaaacatctgcaagcac

SEQ ID NO: 248918 - DNA, 75 bp, Artificial Sequence
  Synthetic
ctgttgccatggcaacatgttaatagatataactttgtctttagttctactggatgtaaagttagtctaaaaaca

SEQ ID NO: 248919 - DNA, 75 bp, Artificial Sequence
  Synthetic
cagagcgacaagcaaaagtaacaagtgatatcaatagaacagcagttaccagcatcttaagtctttctccaaatc

SEQ ID NO: 248920 - DNA, 75 bp, Artificial Sequence
  Synthetic
agttgtacttaaattattaggagatactttgagatgtatcaaattattaatcaataaaaacttagagaatgctgc

SEQ ID NO: 248921 - DNA, 75 bp, Artificial Sequence
  Synthetic
ctacagtagaaatgaagaagaggtcggaatcattgctgacaacataacacctgtttatcctcatggactgagagt

SEQ ID NO: 248922 - DNA, 75 bp, Artificial Sequence
  Synthetic
atgaagatgataaaatagatgacaacttcataccattctaaagtaattgtttgattatgcaattatatgatagtt

SEQ ID NO: 248923 - DNA, 75 bp, Artificial Sequence
  Synthetic
aacactacaaagcaatcattcttctgtagcaacagttggcggcagcaagatcatagagtctaaatggttaacaaa

SEQ ID NO: 248924 - DNA, 75 bp, Artificial Sequence
  Synthetic
acaacacccaagagacaaataacaatggatcctcttaatgaatccactgttaatgtctatcttcccgactcatat

SEQ ID NO: 248925 - DNA, 75 bp, Artificial Sequence
  Synthetic
aagcaacaaaagtaaaagagtgagttttttcacctataaccaactgttaacatggaaagatgtgatgttaagtag

SEQ ID NO: 248926 - DNA, 75 bp, Artificial Sequence
  Synthetic
taatcattgaaaagttcagcactgacagaactacaagaggtcaaagaggtccaaagagcccttgggtagggtcga

SEQ ID NO: 248927 - DNA, 75 bp, Artificial Sequence
  Synthetic
gaataaccacactgagcatagctctcaacatttatctgatcataaactacacaatacaaaaaaccacatctgaat

SEQ ID NO: 248928 - DNA, 75 bp, Artificial Sequence
  Synthetic
cttagaggagtaatttcttttagtgaaaccaatgcaattggttcatgtctcttaaaaagaccctacttaaaaaat

SEQ ID NO: 248929 - DNA, 75 bp, Artificial Sequence
  Synthetic
gtgctaagtgatgcactcaaaagataccctagggtagatataccaaagattgctagatctttttatgaactattt

SEQ ID NO: 248930 - DNA, 75 bp, Artificial Sequence
  Synthetic
aaacacaataattgattggttagaacatattttaaattctccaaaaggtgaattaaattatgatttttttgaagc

SEQ ID NO: 248931 - DNA, 75 bp, Artificial Sequence
  Synthetic
tacatttaaggcaaagcccaaaagctggactgttatccctagccaattgtcccaactttgcaagtgttgttctcg

SEQ ID NO: 248932 - DNA, 75 bp, Artificial Sequence
  Synthetic
gtgttgttcttggtaatgcttcaggtctaggtataatcggaatgtacagaggaagagtgccaaacacagagctat

SEQ ID NO: 248933 - DNA, 75 bp, Artificial Sequence
  Synthetic
gtcaattaaaaaatgagtcagacaaaaaggacacaaagctaaatactacatcaacaacaatcagacccattcctg

SEQ ID NO: 248934 - DNA, 75 bp, Artificial Sequence
  Synthetic
ctatagaagtgggattagagaccacagtcagaagagctaaccgtgtactaagtgatgcactcaaaagatacccta

SEQ ID NO: 248935 - DNA, 75 bp, Artificial Sequence
  Synthetic
tgtgtctttaaaactaaacttttatgtagttggggatcccaagggaaaaacattaaagatgaagatatagtagat

SEQ ID NO: 248936 - DNA, 75 bp, Artificial Sequence
  Synthetic
actgggacaagtcaaaatgtcattccctgaaggaaaagatatcctgttcatgggtaatgaagcagcaaaaatagc

SEQ ID NO: 248937 - DNA, 75 bp, Artificial Sequence
  Synthetic
aaaaactctaaatattgtctagacttcacaacactttgcggtcatatgcaataatcaatggtcaaaccactgttg

SEQ ID NO: 248938 - DNA, 75 bp, Artificial Sequence
  Synthetic
cagcaaaattggcagaagctttccagaaatcattaagaaaacctagtcataaaagatctcaatctattataggag

SEQ ID NO: 248939 - DNA, 75 bp, Artificial Sequence
  Synthetic
cagcaaggttatgtttgaatcaaaggttaagaaaaggataatgttatatgatgtaaagtttctatcattagtagg

SEQ ID NO: 248940 - DNA, 75 bp, Artificial Sequence
  Synthetic
agagatggactatgtacttcaaagcaaaaagttaccccagtcaacttgaattaagtgaacaagattttttagagc

SEQ ID NO: 248941 - DNA, 75 bp, Artificial Sequence
  Synthetic
ggaactcaatgaaaagaaagtattgccttccagtgatgggaagactcccgcagagaaaaaatcaaagttttcaac

SEQ ID NO: 248942 - DNA, 75 bp, Artificial Sequence
  Synthetic
tttttttaatcattgattatgcaacattaaaaaacatgaccaaagtggaacactgtgttaatatgccaccggtag

SEQ ID NO: 248943 - DNA, 75 bp, Artificial Sequence
  Synthetic
aattatattgcaagagcctctatagtaacagacttaagtaagtttaatcaggcctttagatatgaaaccacagct

SEQ ID NO: 248944 - DNA, 75 bp, Artificial Sequence
  Synthetic
agcacaggaaaaagaccaaccacaacatcagtccagtccgacagcagtaccacaacccaaaatcacgaagaaaca

SEQ ID NO: 248945 - DNA, 75 bp, Artificial Sequence
  Synthetic
aataactgtgttgaactatacagatatggcacatgctctcacaagattaatcagaaagaagttgatgtgtgataa

SEQ ID NO: 248946 - DNA, 75 bp, Artificial Sequence
  Synthetic
taaccaaagcataacaaaagctgcagcctgctacagtctacacaacataatcaagcaactacaagaagttgaagt

SEQ ID NO: 248947 - DNA, 75 bp, Artificial Sequence
  Synthetic
cagagaaaaaatcaaaatctccaaccaatgtaaaaaagaaagtttccttcacatcaaatgaaccagggaaataca

SEQ ID NO: 248948 - DNA, 75 bp, Artificial Sequence
  Synthetic
tctgcagtagacctaaacaccaaacccaatccacagcgggcaacacagttgaccacagaggattcaacatctcta

SEQ ID NO: 248949 - DNA, 75 bp, Artificial Sequence
  Synthetic
gaatgctacatactcttaacactaggccaccacaacagtttaccttgccatggagaaatacaaaattctaagatg

SEQ ID NO: 248950 - DNA, 75 bp, Artificial Sequence
  Synthetic
ttgatcctacagaacaattagcttatttccctaagataacatttgaaaggctaaaaaattatgacactagttcaa

SEQ ID NO: 248951 - DNA, 75 bp, Artificial Sequence
  Synthetic
atattctgttaaaaatatcagctaacataaaaaatgaaacaaaagtaagtttcttcaaagccttactatcaatag

SEQ ID NO: 248952 - DNA, 75 bp, Artificial Sequence
  Synthetic
taggactgcttcgtacacttaacattgcaacagcaggaccaacggctgcaagagatggaatcagagatgcaatga

SEQ ID NO: 248953 - DNA, 75 bp, Artificial Sequence
  Synthetic
caaccaaaccagcaatggaagagaggcaaccacaacatccgccagatccagaaacggtgccacaactcaaaacag

SEQ ID NO: 248954 - DNA, 75 bp, Artificial Sequence
  Synthetic
ttctgtactttattggagaaggggcaggaaattggatggccagaacagcatgtgaatatcctgacatcaaatttg

SEQ ID NO: 248955 - DNA, 75 bp, Artificial Sequence
  Synthetic
aggcagaccagtgtcaagcagctttgatccagtcaagtttcctgaagatcaattcaatgttgcacttgaccaagt

SEQ ID NO: 248956 - DNA, 75 bp, Artificial Sequence
  Synthetic
accagcaatggaagagaggcaaccacaacatctgccagatccagaaacaatgccacaactcaaagcagcgaccaa

SEQ ID NO: 248957 - DNA, 75 bp, Artificial Sequence
  Synthetic
atcagaactttcttctattaaaaccagaagaaatgatagttataataattacattgcaagagcatccatagtaac

SEQ ID NO: 248958 - DNA, 75 bp, Artificial Sequence
  Synthetic
agatttaagtaagttcaaccaagcctttaggtatgaaactacagcgatctgtgcggatgtagcagatgaactaca

SEQ ID NO: 248959 - DNA, 75 bp, Artificial Sequence
  Synthetic
tgaaaaccaaaaaactagaaaagttaatttgaactcaaaaaaaccacaaacactatatgaattgtttgagcgtat

SEQ ID NO: 248960 - DNA, 75 bp, Artificial Sequence
  Synthetic
actcagaaaagaacacaaacactatatgaattgtttgagcgtatatactaatgaaatagcatctgtttgtgcatc

SEQ ID NO: 248961 - DNA, 75 bp, Artificial Sequence
  Synthetic
gtatgctgcatcacaaagtggtccaatactaaaagtgaatgcatcagcccaaggtgcagcaatgtctgtacttcc

SEQ ID NO: 248962 - DNA, 75 bp, Artificial Sequence
  Synthetic
gtagtaaactgtcaggctcagaatgctacatactcttaacactaggccaccacaacaatttaccctgtcatggag

SEQ ID NO: 248963 - DNA, 75 bp, Artificial Sequence
  Synthetic
ataactgtcttaatcaataattgcctatataactctagagattaataagcttattattatagttatataaaaata

SEQ ID NO: 248964 - DNA, 75 bp, Artificial Sequence
  Synthetic
aagaaggaattaaatagacagagaaggttattaacactacaaagtaaccattcttctgtagcaacagttggaggt

SEQ ID NO: 248965 - DNA, 75 bp, Artificial Sequence
  Synthetic
accagcatttatcaaatcagtttctatcaaagagagtgaatcagccactgttgaagctgcaataagcagtgaagc

SEQ ID NO: 248966 - DNA, 75 bp, Artificial Sequence
  Synthetic
tgattggttagaacatattttaaattctccaaaaggtgaactaaattatgatttttttgaagcattagaaaatac

SEQ ID NO: 248967 - DNA, 75 bp, Artificial Sequence
  Synthetic
ttactatagaggttgatgatatgatatggactcaaaaagaattaaaagaagctttgtccgatgggatagtgaagt

SEQ ID NO: 248968 - DNA, 75 bp, Artificial Sequence
  Synthetic
aaaaactgatcaaagtaactggatatatgcttgtaagtaaaaaatgaaaaatgataaaaatgataaaataggtga

SEQ ID NO: 248969 - DNA, 75 bp, Artificial Sequence
  Synthetic
aaccaataaattatatgaaactgttgattacatgctaagcctatgctgcaatgaaggattctctctggtgaaaga

SEQ ID NO: 248970 - DNA, 75 bp, Artificial Sequence
  Synthetic
caattaaaggtgctctcaaacaaactaatgaagcagtatccacattaggaaatggtgtgcgggtcctagccactg

SEQ ID NO: 248971 - DNA, 75 bp, Artificial Sequence
  Synthetic
gtgtagtagaacaattaacaggtagaagcccaaaacagttagttttaataccccaattagaagaaatagacatta

SEQ ID NO: 248972 - DNA, 75 bp, Artificial Sequence
  Synthetic
aagagctaatagagtgctaagtgatgcactcaaaagataccctagggtagatataccaaagattgctagatcttt

SEQ ID NO: 248973 - DNA, 75 bp, Artificial Sequence
  Synthetic
gttgcacttgaccaagttttcgagagcattgagaacagtcaggccttggtggatcaatcaaacagaatcctaagc

SEQ ID NO: 248974 - DNA, 75 bp, Artificial Sequence
  Synthetic
acagtctgaatgaaaatcaggaagggttagggttgagaagtaatctgcaaggcatattaactaataagctatatg

SEQ ID NO: 248975 - DNA, 75 bp, Artificial Sequence
  Synthetic
aagaggagcatttatactaagaattataaaagggtttgtagacaataataaaagatggcctaaaattaagaattt

SEQ ID NO: 248976 - DNA, 75 bp, Artificial Sequence
  Synthetic
cgtctaagactattagttcaatagtttagttatttaaaaatattttgaaaacaggtaagtttctatgacacttca

SEQ ID NO: 248977 - DNA, 75 bp, Artificial Sequence
  Synthetic
cgcacagtggatcctaggcattttgaactgcgctacaaaattggttcactgaaccagtttaacacttgtgtgagt

SEQ ID NO: 248978 - DNA, 75 bp, Artificial Sequence
  Synthetic
tcaagaacaatgggtcaaatagtgacattctttcaagaggtgcctcatataattgaggaagtgatgaacatagtg

SEQ ID NO: 248979 - DNA, 75 bp, Artificial Sequence
  Synthetic
ttaatcacactgtcgctcttggctatattgaagggcatttacaatgtgatgacatgtggactgattggactcctc

SEQ ID NO: 248980 - DNA, 75 bp, Artificial Sequence
  Synthetic
acctttctctttctttgtggaaaatcctgttctacaatttataaggacaactatcggctcatgcagctaaatttg

SEQ ID NO: 248981 - DNA, 75 bp, Artificial Sequence
  Synthetic
gacatgagtgggttgaatgcaacaatgccactctcttgctcaaaaaacaattctcaccactacatccaggtcttt

SEQ ID NO: 248982 - DNA, 75 bp, Artificial Sequence
  Synthetic
aacaccactggcctggaactaacactgacaaatgactcactaattggacataaatggtgcaacctttcagatgct

SEQ ID NO: 248983 - DNA, 75 bp, Artificial Sequence
  Synthetic
cacaagaaagacacttatgaccacacattaatgtctattatttcaacttttcacctaagcatcccaaatttcaat

SEQ ID NO: 248984 - DNA, 75 bp, Artificial Sequence
  Synthetic
cattatgaggctatggcttgtgatttcaatggtggcaaaatttccattcaatataatttatcccattcatcagag

SEQ ID NO: 248985 - DNA, 75 bp, Artificial Sequence
  Synthetic
acagatgccatgaaccactgtggcaccgtagctaacggtgttcttgaagtttttcgcaggatgacatggtgcacc

SEQ ID NO: 248986 - DNA, 75 bp, Artificial Sequence
  Synthetic
cactgtgacactccgctaggagcaagcatagctggcttcaactgtgtcagaacaagttacaagtacctaatcata

SEQ ID NO: 248987 - DNA, 75 bp, Artificial Sequence
  Synthetic
cagaatactacatgggaagaccactgcactatgtctagaccatcacctatgggttatttgtccctgctttctcag

SEQ ID NO: 248988 - DNA, 75 bp, Artificial Sequence
  Synthetic
agggcaagagaaatctacatttctagaaggctcatggggacatttacttggactctctcagattctgagggcaat

SEQ ID NO: 248989 - DNA, 75 bp, Artificial Sequence
  Synthetic
gatctaccaggtggttattgcctccagagatggatgctcatagaagccgaaatgaagtgctttggaaacactgct

SEQ ID NO: 248990 - DNA, 75 bp, Artificial Sequence
  Synthetic
gttgcgaaatgtaaccaacaacatgatgaggagttttgtgacatgcttcggctatttgactttaacaaggaagca

SEQ ID NO: 248991 - DNA, 75 bp, Artificial Sequence
  Synthetic
attcatagattaagagttgaggccgagaagagcattagcttgatcaacaaagctgtgaactcactaataaatgac

SEQ ID NO: 248992 - DNA, 75 bp, Artificial Sequence
  Synthetic
cagctaatcatgaggaatcatctgagggacattatgggaatcccttactgcaattactcaagattctggtatctg

SEQ ID NO: 248993 - DNA, 75 bp, Artificial Sequence
  Synthetic
aatgacactagaagtggtagaacctccttacctaaatgttggatggtgtcaaatgggtcctaccttaacgagaca

SEQ ID NO: 248994 - DNA, 75 bp, Artificial Sequence
  Synthetic
cacttttcttctgacatagaacaggaagccaacaatatgatcacagagatgttgagaaaagaatatgaaaggaga

SEQ ID NO: 248995 - DNA, 75 bp, Artificial Sequence
  Synthetic
caagggacgacacctttgggtttagttgacttgtttgtgttttccacatccttttacctgattagtgtgttctta

SEQ ID NO: 248996 - DNA, 75 bp, Artificial Sequence
  Synthetic
catttgattaaaattccaactcaccgtcacctggttggtaagccgtgcccaaagcctcatcgtctcaaccatatg

SEQ ID NO: 248997 - DNA, 75 bp, Artificial Sequence
  Synthetic
ggtgtgtgtagctgtggtctgtacaagcaaccagggttacccactaaatggaagagataatgccccaaaaggggg

SEQ ID NO: 248998 - DNA, 75 bp, Artificial Sequence
  Synthetic
gcccccgtgacccaccgccataaggcggtgggtcacgggggcatcctcttacaggatgaccttgggtgttgctga

SEQ ID NO: 248999 - DNA, 75 bp, Artificial Sequence
  Synthetic
cctgaagaccaggtccttgctgagcacaggtcttggtatgacaatgtccagactgttccttgtagtggcctcaaa

SEQ ID NO: 249000 - DNA, 75 bp, Artificial Sequence
  Synthetic
catgaggcagtccaaaagagcgcaatgtggagttatctcctccttcccacctcgtttcttcttttccactacaat

SEQ ID NO: 249001 - DNA, 75 bp, Artificial Sequence
  Synthetic
ccctgtgtgcatggagcacagatgtttgtactcgtcccaaatctgatgttcaaattttcttgcatcggccttttg

SEQ ID NO: 249002 - DNA, 75 bp, Artificial Sequence
  Synthetic
cattgagacatcaattagtttaatgtccttccttccttgagagtccagcagctttctgatatcttcgacaccttg

SEQ ID NO: 249003 - DNA, 75 bp, Artificial Sequence
  Synthetic
gcaagtcaggaccatgttctttggaaggttctccaacactgcactggtcaagcctggctgtgttgtgaaaagatc

SEQ ID NO: 249004 - DNA, 75 bp, Artificial Sequence
  Synthetic
ttgaacatcaataccatgtgaatacttggcatcctgtctgaactgcttaatgtcagttggctctctgtaaaaatg

SEQ ID NO: 249005 - DNA, 75 bp, Artificial Sequence
  Synthetic
aatgtaatgtccattggatggttgataaattgcaatttctactggatcatcagcacgaccctctatgtccaccca

SEQ ID NO: 249006 - DNA, 75 bp, Artificial Sequence
  Synthetic
agtttttgctgttgggtcaatctgtagcatggagtctttaagctccatcatttgggagtaagtcagtcctgcatt

SEQ ID NO: 249007 - DNA, 75 bp, Artificial Sequence
  Synthetic
aaatccagcagccccagctgttttgttactagtgggaggtcctttattgattgggtctttgttggtgccaagatc

SEQ ID NO: 249008 - DNA, 75 bp, Artificial Sequence
  Synthetic
gacctcagtgttgtcccaagctctccctgatatcgatgtcctacacgctatgtagggccagccatctcctgaaag

SEQ ID NO: 249009 - DNA, 75 bp, Artificial Sequence
  Synthetic
acaaattttgtaaaggatgttctcgtaggggttcctctcccctggtgtgtctgacacaaacatccccacagatct

SEQ ID NO: 249010 - DNA, 75 bp, Artificial Sequence
  Synthetic
cttgaccttcaagacacactttaaaatagtgtcaatgttttttggtgtgacctttatagtctccaacatgttgcc

SEQ ID NO: 249011 - DNA, 75 bp, Artificial Sequence
  Synthetic
tccatcaagtaagctggctcctgctttcacagctgcatttagactaaagttgtagcctgaaatattgatagcact

SEQ ID NO: 249012 - DNA, 75 bp, Artificial Sequence
  Synthetic
cttgttcccatcaatgagtcccaaaactgggtgagtgtgtgtcagcttgtccaaatctgaaagatttggatattt

SEQ ID NO: 249013 - DNA, 75 bp, Artificial Sequence
  Synthetic
tgcggtgtacactaggcctaaatctgtcaatgccttgacaacatcactaaggtcttcttggccttgtttgcaaag

SEQ ID NO: 249014 - DNA, 75 bp, Artificial Sequence
  Synthetic
acacgccagtgtcaaactcggcattgtcccaaactgattgtttagaagatcagggtttcgaacgtcccacactct

SEQ ID NO: 249015 - DNA, 75 bp, Artificial Sequence
  Synthetic
gacaatcccatccccacctcttggtggaactctactgccccccattccaacaagctgcaacaaaatctttctttg

SEQ ID NO: 249016 - DNA, 75 bp, Artificial Sequence
  Synthetic
gtctagctgttgttgtgtcaggttgcccatgtacacaccccctgtcaagggtctttctgatctattgactttagc

SEQ ID NO: 249017 - DNA, 75 bp, Artificial Sequence
  Synthetic
tttgagtctatcaagatcagctgctaggaccaaaagatcatctgaggtgagagcacccaccctcagtgtgttctt

SEQ ID NO: 249018 - DNA, 75 bp, Artificial Sequence
  Synthetic
ttgttgactggatttcagttcaacaagattgttgactgtctgattcaagtctctaagtcttttcaaatcagaatc

SEQ ID NO: 249019 - DNA, 75 bp, Artificial Sequence
  Synthetic
atccctcttttcctttctcattagtctctggatgttgctcacttcagagaagtctagaccatgaagcagggattg

SEQ ID NO: 249020 - DNA, 75 bp, Artificial Sequence
  Synthetic
tgcatctttaatcacctgcacacgagtgttggtacagaaacctgacaattctctcctaagagattgagtccaaag

SEQ ID NO: 249021 - DNA, 75 bp, Artificial Sequence
  Synthetic
gaatgacttgatttccttggagttgctcatcactgtggtttccaattagcgcaaccaattcgcctaggatccact

SEQ ID NO: 249022 - DNA, 75 bp, Artificial Sequence
  Synthetic
acttgatttccttggagttgctcatcactgtggtttccaattagcgcaaccaattcgcctaggatccactgtgcg

SEQ ID NO: 249023 - DNA, 75 bp, Artificial Sequence
  Synthetic
cgcaccggggatcctaggcaattttggaagtcaaaacctgagagtgacgtttcggagcatctcatcaacaccaca

SEQ ID NO: 249024 - DNA, 75 bp, Artificial Sequence
  Synthetic
tctccaatttcatcagcaacgaggcaagatcaccccttatcatgggacagaagccttccaagccaaaggcacctc

SEQ ID NO: 249025 - DNA, 75 bp, Artificial Sequence
  Synthetic
caaccacatatgagtcccccagatccagcctcactccagatgccactgggtttggcccagagttctgcaagagtt

SEQ ID NO: 249026 - DNA, 75 bp, Artificial Sequence
  Synthetic
gctggtttgagaggaaggggcttattaagtgccagaaccattatctgtgcatgacatgtctcacactcctcctca

SEQ ID NO: 249027 - DNA, 75 bp, Artificial Sequence
  Synthetic
ctgtctccaacagatgccccgtctgcaaataccccctgccaaccaagctcaggcttgagaagtctccaacagccc

SEQ ID NO: 249028 - DNA, 75 bp, Artificial Sequence
  Synthetic
ctcctccagaggcaacgaaccctccaccctacagcccctgaacaccggggcaacacactcccaacacctctcccc

SEQ ID NO: 249029 - DNA, 75 bp, Artificial Sequence
  Synthetic
ctccccccccggggggaccccccgccgggagcccccccggggggcccacgccagggatgagttcactcgatgtcc

SEQ ID NO: 249030 - DNA, 75 bp, Artificial Sequence
  Synthetic
tccacatgcacagggtcatcaaatagcttcctacataattttccttttaatctcaagttgccttctgaagtatga

SEQ ID NO: 249031 - DNA, 75 bp, Artificial Sequence
  Synthetic
atcattaaagtattctttgtcttactaaaacaaaggctatatcccttaaaaccagtccaggaatccaagacagac

SEQ ID NO: 249032 - DNA, 75 bp, Artificial Sequence
  Synthetic
aaggactctgttatgaaatccttataatttgtaggcatatttttggtcaagaccgccacaatatctaaactatgc

SEQ ID NO: 249033 - DNA, 75 bp, Artificial Sequence
  Synthetic
cactgcaaaccctgagaacccctaacagtgatcatcttctgaatcatatcttttaaaagttctttatcatcaata

SEQ ID NO: 249034 - DNA, 75 bp, Artificial Sequence
  Synthetic
cacaactctttcactaatatctcaaagtcttgatcatgaatgcttggattgaagggaactagtttcttatcacct

SEQ ID NO: 249035 - DNA, 75 bp, Artificial Sequence
  Synthetic
tcaaagatgtaaccatccttcacaaccaaaggcaccacatttacatcaggtcccactctttcaaagtcaagggta

SEQ ID NO: 249036 - DNA, 75 bp, Artificial Sequence
  Synthetic
tctaatctcagtgcatccctattaattatcacttcaattggaactacctcacccaccattgatccgtctttcagg

SEQ ID NO: 249037 - DNA, 75 bp, Artificial Sequence
  Synthetic
taatccttaatgttagccgtgttcagatgccagatgactttgtctcctagaaaatggctgttagtcagaataagc

SEQ ID NO: 249038 - DNA, 75 bp, Artificial Sequence
  Synthetic
ctccagcaatctagaactgcagacctgtttatggcaccactgtactgaaccccaatgttgttaaactcaaatttg

SEQ ID NO: 249039 - DNA, 75 bp, Artificial Sequence
  Synthetic
ccatccacatcaaagctcccatagaatttgcagtgaataaaaaacttttccctcagtgattctccttggctttta

SEQ ID NO: 249040 - DNA, 75 bp, Artificial Sequence
  Synthetic
acttgaaagttcacagtcaacgatatctcaatagaacctggcttcaagcttgacaacattgacataaattctgat

SEQ ID NO: 249041 - DNA, 75 bp, Artificial Sequence
  Synthetic
aagtcttcgaaatatctcatctcagttaggccgtattgaatcaatttgcttgaatttatatagaactctccaaaa

SEQ ID NO: 249042 - DNA, 75 bp, Artificial Sequence
  Synthetic
tcaaaatctaaccatgcgtagccactgaaaagatcatgtctatacattggtctttctattcctttgaagatgact

SEQ ID NO: 249043 - DNA, 75 bp, Artificial Sequence
  Synthetic
ttttcaataaaggttccaaatggtcccagagatgctaagccttccgactctggcaaagatgttttgtgtggaaac

SEQ ID NO: 249044 - DNA, 75 bp, Artificial Sequence
  Synthetic
cacgtgaatgagcccaaggtcctagatgttgcaacaaaaggcctagcaaaagactcaaagtaaatctgcctcaag

SEQ ID NO: 249045 - DNA, 75 bp, Artificial Sequence
  Synthetic
aagttctctgacacatcctctgtgctaactaccctttcatctgctagggattcatgtgacctatcatgagaaatt

SEQ ID NO: 249046 - DNA, 75 bp, Artificial Sequence
  Synthetic
gatagctcatcagatagaattacataatgttcctccctcttccatttaacaatgtgagagactaatgacatggct

SEQ ID NO: 249047 - DNA, 75 bp, Artificial Sequence
  Synthetic
tcacaatttacatccaacattacacataaatccagaaatttaactctaggtgaccacttcatcttagttgaagcc

SEQ ID NO: 249048 - DNA, 75 bp, Artificial Sequence
  Synthetic
aggtcgctcatgaatggaagtaagtgcttttcaaaaatatcagggtacaaccttctaaaagaatgaattatatga

SEQ ID NO: 249049 - DNA, 75 bp, Artificial Sequence
  Synthetic
ttaaagccaactttatcttccaacaaccttgtcacagatggtttcataggaaaataatcacatggcctaaacttc

SEQ ID NO: 249050 - DNA, 75 bp, Artificial Sequence
  Synthetic
atctgtggtaaagggcttttaagtttgggttcacctaagacccaagaaccaatctccaaagctgttgataatgct

SEQ ID NO: 249051 - DNA, 75 bp, Artificial Sequence
  Synthetic
atgcaaagataatcccagagtataggtctaaagtaattcccccatttctgttgagctctagaattatcaagaggg

SEQ ID NO: 249052 - DNA, 75 bp, Artificial Sequence
  Synthetic
tttctcaccctccaaacatcaacacccatcaccagctccctactcaccccctccatcatcatggattgattcata

SEQ ID NO: 249053 - DNA, 75 bp, Artificial Sequence
  Synthetic
atagacttgatgtaaaagttttctctctcaggtcctctgacacatttactacccaatgtcctacagaggccaaca

SEQ ID NO: 249054 - DNA, 75 bp, Artificial Sequence
  Synthetic
aagccagacgctatacaactctgaaaagcactcctattgatagcttcagataataatttttgagctcctcttgtg

SEQ ID NO: 249055 - DNA, 75 bp, Artificial Sequence
  Synthetic
aagttagatgataatttattttgcagagtctttacaattgttggtagtttttcctcctcaacattaactgcacct

SEQ ID NO: 249056 - DNA, 75 bp, Artificial Sequence
  Synthetic
gtatatataaccttttgtcgaagaaccattctcaaggggtaatatgcagataagttcaaccacgacaatcctagc

SEQ ID NO: 249057 - DNA, 75 bp, Artificial Sequence
  Synthetic
tcttcatcattaagtatttcagtgtcaaaaattttgctaagcttagcaagcgactgatacggatcgcctgacaaa

SEQ ID NO: 249058 - DNA, 75 bp, Artificial Sequence
  Synthetic
taggctgcagtgaactcttcatgaagaaggcccgttttgaggttgttgtacaaccttcttaagaaggaccttact

SEQ ID NO: 249059 - DNA, 75 bp, Artificial Sequence
  Synthetic
ttccttgttccattaggctctagcatttcaatgttcctcataattctatagcctctatttccgtctacccaatcc

SEQ ID NO: 249060 - DNA, 75 bp, Artificial Sequence
  Synthetic
ttgacatcagaggagcagaacatcaaaaaggggtctattggatactgagcatacctaaggagattcaaagtgcgt

SEQ ID NO: 249061 - DNA, 75 bp, Artificial Sequence
  Synthetic
tcctgaacaatgttacataatttcacaggtaccccattagcaacagcttgatcaattatcgtgtcaatagtttct

SEQ ID NO: 249062 - DNA, 75 bp, Artificial Sequence
  Synthetic
gctaactgatgcggctctttacacttgatattatgcaatgatgcagcaacaaactttgtcaataacgggacttca

SEQ ID NO: 249063 - DNA, 75 bp, Artificial Sequence
  Synthetic
tctccccaaacaaagaaccttgatttaaactcagcagcaaagttccccttcacacttttagggctgataaatttg

SEQ ID NO: 249064 - DNA, 75 bp, Artificial Sequence
  Synthetic
ttcagctgatcactcaaataattatggaactccaagatgtactcaaattcatcaggatctttctccagcaagtct

SEQ ID NO: 249065 - DNA, 75 bp, Artificial Sequence
  Synthetic
gacaaacttttgtcaaagagacttatttggtcatcactagaagtgaatgcatcaacatttccttcatataaacaa

SEQ ID NO: 249066 - DNA, 75 bp, Artificial Sequence
  Synthetic
ctaatacaataattgatgaacctctcagaaattaggccgtaaaaatcagatgtattttgcagaattccttgaccc

SEQ ID NO: 249067 - DNA, 75 bp, Artificial Sequence
  Synthetic
ttatccagaatagaactgatgtgtgatggcactttccccagcctaaagtgttcaaagaaaaatctctctgtcatg

SEQ ID NO: 249068 - DNA, 75 bp, Artificial Sequence
  Synthetic
gtctcagacagattctttttcaatcccaactttgacttgataaaggacttcatcatagccgtaacaacattaaag

SEQ ID NO: 249069 - DNA, 75 bp, Artificial Sequence
  Synthetic
ggaacctcaaccaacttatggatatgccatgacaacattgatgatacatagtctctgctcttagcatctgaaagt

SEQ ID NO: 249070 - DNA, 75 bp, Artificial Sequence
  Synthetic
gtgtctagagaaggccaattaatgttctgtaatgttgccaagaacaagaagggggtcatcataggcccccatttg

SEQ ID NO: 249071 - DNA, 75 bp, Artificial Sequence
  Synthetic
ctgtggtccaggctataagatagaaggcccagtgacacattgaacttcatagagaaaacggcgttctcaaactca

SEQ ID NO: 249072 - DNA, 75 bp, Artificial Sequence
  Synthetic
tgttcatcatttagacaacttcctttgaattggctggttaaagcctcaaagtagtcttcaattaatcttgtgaac

SEQ ID NO: 249073 - DNA, 75 bp, Artificial Sequence
  Synthetic
attttggttctcaggtctcctatgtacagctctctgttccctccaacttgttctttataagacaatgaaaatttg

SEQ ID NO: 249074 - DNA, 75 bp, Artificial Sequence
  Synthetic
agtctaccagtatctggcccctgtgaattgtaagactgaggggattcttgactataaaaacaaagattcttaagt

SEQ ID NO: 249075 - DNA, 75 bp, Artificial Sequence
  Synthetic
gccgcagtagtgcagttagttagacttagtgctttgctcaatgcttctgagttactctccctttcacttatcctg

SEQ ID NO: 249076 - DNA, 75 bp, Artificial Sequence
  Synthetic
gtctcattgaacaacctgtccctatctaacttgaaatttaaacatttgctcttgtaatggttaaatttcccagac

SEQ ID NO: 249077 - DNA, 75 bp, Artificial Sequence
  Synthetic
aatttgttagcattcatctgcagcaatagggacttaaagcactgaaagtattcctcatcatggaatgtccttgta

SEQ ID NO: 249078 - DNA, 75 bp, Artificial Sequence
  Synthetic
cagacagcctgggccatcttagttagaggacaagattccaatgattccaaatagaaatattttgatctaaggctt

SEQ ID NO: 249079 - DNA, 75 bp, Artificial Sequence
  Synthetic
gggtctgagtagacacttttacaaatctcttcataagtatcataagggagagtcattacatcaaaatcttcaacc

SEQ ID NO: 249080 - DNA, 75 bp, Artificial Sequence
  Synthetic
atatgacaagacagttcattcctgattagcctcagctgtgccttatcttgtagtgccaaactcaagtcatctata

SEQ ID NO: 249081 - DNA, 75 bp, Artificial Sequence
  Synthetic
gaacattcacttttaagggtggctgaagactctgaaccggaccatgaaaatttactcatcactgtatcaacagac

SEQ ID NO: 249082 - DNA, 75 bp, Artificial Sequence
  Synthetic
tgttttatactgtcaaaatagtcagctgctccgccctctatcagaacttcatcgacctcttcacaagaattcaac

SEQ ID NO: 249083 - DNA, 75 bp, Artificial Sequence
  Synthetic
cctatttctgacccatgtaattttgaccttccaatgaccaaatcactcattatttgttgtatcttgaaatcataa

SEQ ID NO: 249084 - DNA, 75 bp, Artificial Sequence
  Synthetic
tcttctttacttaatacatacttaccctttctcgagaaaacttcagacaactggcagacagccgttgcaaccaat

SEQ ID NO: 249085 - DNA, 75 bp, Artificial Sequence
  Synthetic
ttgtcataatcatattcaattattctgtctccgtctgtgtatttattgacaacaacactcttattgctggctaga

SEQ ID NO: 249086 - DNA, 75 bp, Artificial Sequence
  Synthetic
tctagtgcagtagcacacccactaaccaccagtgggtccttcacaccattctttaactctgcttgtttgaatagt

SEQ ID NO: 249087 - DNA, 75 bp, Artificial Sequence
  Synthetic
gagccattattgaaggatgaaaccatcatagaaaagatttttcttgagacaccaggcgttttgaataggattccc

SEQ ID NO: 249088 - DNA, 75 bp, Artificial Sequence
  Synthetic
tcatcaccaaaacaatctggtttgctcaaaaatttatcagcagacattaataaagacctcaactcctcttggtca

SEQ ID NO: 249089 - DNA, 75 bp, Artificial Sequence
  Synthetic
gctggttctaatggatttacattcacactgtcaaatttcatctttggttcaataaatttctcgaagcatttgatc

SEQ ID NO: 249090 - DNA, 75 bp, Artificial Sequence
  Synthetic
tgatctgtcaatctatcaggggtctctttggttatcaaatgacatagataggataaattaaggataaatttaaat

SEQ ID NO: 249091 - DNA, 75 bp, Artificial Sequence
  Synthetic
ctattagtaatcatggttgtaacattcacattaaaaacaatgttcagtattgatcttgtgattctatacaataga

SEQ ID NO: 249092 - DNA, 75 bp, Artificial Sequence
  Synthetic
aactcacagtttgttattagatcttctcttaacttttctaggagatccttgtgatggtattcagagacatatgcc

SEQ ID NO: 249093 - DNA, 75 bp, Artificial Sequence
  Synthetic
atggtgaagtatcttaagttctgcaaaaatttttgtattcttttagtagggttcgtcaagacaaccatcactacc

SEQ ID NO: 249094 - DNA, 75 bp, Artificial Sequence
  Synthetic
atctttaagagagactttatttctttaataaactccttcagctcagagcactccgttaaccagctgatcatggtg

SEQ ID NO: 249095 - DNA, 75 bp, Artificial Sequence
  Synthetic
tctatcatttcttgcaacacagagtccgaaaaaattgcaggaaaatacctctttgggtccgcataaaaggaacac

SEQ ID NO: 249096 - DNA, 75 bp, Artificial Sequence
  Synthetic
aactctcctacaaccgcatcgtttacagaataacactttgagcattccccagttttttgataaatcaacattaac

SEQ ID NO: 249097 - DNA, 75 bp, Artificial Sequence
  Synthetic
cgatgcccctcaataagaaaatcttggtaataggcctccttacatctaacacatttgtatctgagtttcccatgc

SEQ ID NO: 249098 - DNA, 75 bp, Artificial Sequence
  Synthetic
tcattttgtctgagtttaacagttgatgaagttttcatggagttaaccaatgccagtgaaatgcttgagagtctc

SEQ ID NO: 249099 - DNA, 75 bp, Artificial Sequence
  Synthetic
tttaaatctgattgattatcaggatccatcgcttgaatgttgtaactgaatctatcaatgggattcttttcataa

SEQ ID NO: 249100 - DNA, 75 bp, Artificial Sequence
  Synthetic
ttgattgttggctcaacaccgtttacttccaaagacatcatttctgtaaaactggattcagacaagatatcttca

SEQ ID NO: 249101 - DNA, 75 bp, Artificial Sequence
  Synthetic
tcaacattatagtccttgaacgttaggttgacaaggaggagtacctctttagccttattcagaacacgattaacc

SEQ ID NO: 249102 - DNA, 75 bp, Artificial Sequence
  Synthetic
atagtggagaagacttcataagcactctggctctggtgtgaatgtgacaatcgattcgttctcctttgtaaccaa

SEQ ID NO: 249103 - DNA, 75 bp, Artificial Sequence
  Synthetic
gtttttaagtctttctgagtagctggcagtgataccaacctatcattaacactgaggaatgatgaacccatccac

SEQ ID NO: 249104 - DNA, 75 bp, Artificial Sequence
  Synthetic
tcagattctaccaagtgaccattaacacttaaatccttcatgtgagcaagtagaagaattgagtcaaagatcaac

SEQ ID NO: 249105 - DNA, 75 bp, Artificial Sequence
  Synthetic
ataagctttcttctagtatttattagcctcaaacttttgactttgttaagcagtgatctccacccacgcacatga

SEQ ID NO: 249106 - DNA, 75 bp, Artificial Sequence
  Synthetic
ctaatatcactttggcaacttttaccgttaggtaactcacaatacaacattgtaatcaacggacaagagtgatag

SEQ ID NO: 249107 - DNA, 75 bp, Artificial Sequence
  Synthetic
taatcattcaataggctgtccaataactctggtttatccccaactcttagtgtgtacatctcgttaaatgcttta

SEQ ID NO: 249108 - DNA, 75 bp, Artificial Sequence
  Synthetic
attaattcttctctgttaaccctcaagaattgtctctctatcaccccattctgtagtttgttgcgaaatgcttga

SEQ ID NO: 249109 - DNA, 75 bp, Artificial Sequence
  Synthetic
aactcttgaattatttccctcttcacatccaagctgctcatatgattattgattcctacatggcacaacttcaac

SEQ ID NO: 249110 - DNA, 75 bp, Artificial Sequence
  Synthetic
aattcatcaaagtgttcacttctatgatccgataaaatatttatattttcaatgcctgatcttttacctcctgag

SEQ ID NO: 249111 - DNA, 75 bp, Artificial Sequence
  Synthetic
acatttaaagactcacacagtctcgaatattcagcttcttcaaacatcctacttgattcttgagaaaaggctaaa

SEQ ID NO: 249112 - DNA, 75 bp, Artificial Sequence
  Synthetic
agactgaacaacagggttctaaatctctcatttgcccactccggaagacggtctgtctgaaagttagttctaccg

SEQ ID NO: 249113 - DNA, 75 bp, Artificial Sequence
  Synthetic
tctattaatgggagcattgtaattccaaccgtcatgagatcctcttttaatgagttcagcttcaccaggtcttcc

SEQ ID NO: 249114 - DNA, 75 bp, Artificial Sequence
  Synthetic
cgatatttttgttcaaaattggctggtgaactcctaacaaaacactcaagaatcatcagtacattcccattcaat

SEQ ID NO: 249115 - DNA, 75 bp, Artificial Sequence
  Synthetic
ttgaaaccatctggaaccaccatcggcaatccaggacacaacactcgattttcactaaggaagttctcgacagaa

SEQ ID NO: 249116 - DNA, 75 bp, Artificial Sequence
  Synthetic
agttctttagtattatggtcacaaccatttgcttcacagctgtctatttcgatacagagagatagcaatttgagc

SEQ ID NO: 249117 - DNA, 75 bp, Artificial Sequence
  Synthetic
ccttcaattaataaaagttttggttctgattggaccagaaaggccagtttctgctttgccaatctgtcatcattt

SEQ ID NO: 249118 - DNA, 75 bp, Artificial Sequence
  Synthetic
gaaagatatttacttatgatgtccttgacttcacttatttgttcttccatggatcaacacaccggaattggtcag

SEQ ID NO: 249119 - DNA, 75 bp, Artificial Sequence
  Synthetic
aagtgtaattcaatttgagctgtggttgagttggtgggatcaacactacagcagattgccgatcctgcagaacac

SEQ ID NO: 249120 - DNA, 75 bp, Artificial Sequence
  Synthetic
gcagattgccgatcctgcagaacacaaaacaagatttccaaaaagatagccaaaatgcctaggatccccggtgcg

SEQ ID NO: 249121 - DNA, 75 bp, Artificial Sequence
  Synthetic
agttgatcctgccagcggtgggtcgctactgtttcgcgaaccagtcgttttgacagttggttgggatcaaatttg

SEQ ID NO: 249122 - DNA, 75 bp, Artificial Sequence
  Synthetic
ttctgtgcgcgtcacgccactttttgtggcgggaatgtgcgaaaataacaggaaaaagaaccctggaaagggttc

SEQ ID NO: 249123 - DNA, 75 bp, Artificial Sequence
  Synthetic
aaagaagaaaaagaatgctggaaggaatgggaaggaagtcccgggacttgctctggtgatgggcgtgatccatta

SEQ ID NO: 249124 - DNA, 75 bp, Artificial Sequence
  Synthetic
cgccagccatatagccttgggaatgaaagttaattcacggcttaaaaggttttggaagatgactccggccagcaa

SEQ ID NO: 249125 - DNA, 75 bp, Artificial Sequence
  Synthetic
acttgcaaaaacaataacaacattgattaacatacttagaaatttgctgtccttcactttgaaaagaaagactaa

SEQ ID NO: 249126 - DNA, 75 bp, Artificial Sequence
  Synthetic
gcaaagatcagctggatggaccatgggtgtgattttcatatggatgatgggaaccatattgtcaattgaagttgt

SEQ ID NO: 249127 - DNA, 75 bp, Artificial Sequence
  Synthetic
taaaaacaacgggggttggctcatgaaaccccgtcttcaagacactggatccacggtgcctgttggaaaaggatc

SEQ ID NO: 249128 - DNA, 75 bp, Artificial Sequence
  Synthetic
gtgcactttcacttccttggatgttggttacgagtgtgactacaaaataggctatgactgtgtgacgttaacaag

SEQ ID NO: 249129 - DNA, 75 bp, Artificial Sequence
  Synthetic
cactgaggatcccaatggaattgattgttattgcagaggtgttgacatggtccgtgtcgagtaccccttgtgcaa

SEQ ID NO: 249130 - DNA, 75 bp, Artificial Sequence
  Synthetic
gaaaggaagcaatcgagtgagaagagcagtgaatatcgcctcacatcctgaaattgtgcctctcaaaccagttac

SEQ ID NO: 249131 - DNA, 75 bp, Artificial Sequence
  Synthetic
atacatgccaactctgggtagtgtcaatgacagagtagggaagacagaagaatgggtaaccaataacatggttaa

SEQ ID NO: 249132 - DNA, 75 bp, Artificial Sequence
  Synthetic
aactcttctttttgtgttcattatgtttgcaatctttgggtttgattggaagaccgttgtggtgctttgtctggc

SEQ ID NO: 249133 - DNA, 75 bp, Artificial Sequence
  Synthetic
agctttggcactaccatcatttgcaaccaattgtgtgaccatatcacagagagaaattcttaaaggagtggaagg

SEQ ID NO: 249134 - DNA, 75 bp, Artificial Sequence
  Synthetic
agtcacatggttcgaggtgcttttggaaaagactagctgcattaccattgcagcacaaaacagaccatccattga

SEQ ID NO: 249135 - DNA, 75 bp, Artificial Sequence
  Synthetic
cctctggctagacgatgtgaaacaaagctcggtgatggccagcaaagaattctgcatgaaggtcgaagtgtcaga

SEQ ID NO: 249136 - DNA, 75 bp, Artificial Sequence
  Synthetic
aactcaaatagctgctaggtgccctactcaaggagatgcaactttgcctatggaagggaaggatgattatgtttg

SEQ ID NO: 249137 - DNA, 75 bp, Artificial Sequence
  Synthetic
caagaaaaccttcagtgacagaggatggggcaatggatgtgctctttttgggaaaggaagtattgtgggctgcgc

SEQ ID NO: 249138 - DNA, 75 bp, Artificial Sequence
  Synthetic
taaagtagcctgcaatactgctaatgttatgaaaactcatatctatgagcaacaagctgtccagtatgtggttgg

SEQ ID NO: 249139 - DNA, 75 bp, Artificial Sequence
  Synthetic
catagaggtacatagaggggaagtcatcaaagcaaatgtttcagacaaggtcatcaaagcctcattttcggctga

SEQ ID NO: 249140 - DNA, 75 bp, Artificial Sequence
  Synthetic
agcagaaaagcatacagttgagataccagactatggaagtcttgacttcacatgtcgggtggtggccagtgcgga

SEQ ID NO: 249141 - DNA, 75 bp, Artificial Sequence
  Synthetic
cctatcaaacattagactgttggaggtagatggccattactttaatgtgcatgaagactggctggatgatctccc

SEQ ID NO: 249142 - DNA, 75 bp, Artificial Sequence
  Synthetic
cttaccatggagaatcaacgctggaccctggagagggatggacaagctggtaaatttcagagaaccatatgccgt

SEQ ID NO: 249143 - DNA, 75 bp, Artificial Sequence
  Synthetic
gaaaatggtaatcatgggatatggagatcaaaggccggctgtgctaggggctcttgataaggctgaagaaataaa

SEQ ID NO: 249144 - DNA, 75 bp, Artificial Sequence
  Synthetic
gaaagtaggagacaactaccatctgaatggaggacatgtgagctgcaaagtttccgtggctaagttgaaattgaa

SEQ ID NO: 249145 - DNA, 75 bp, Artificial Sequence
  Synthetic
gggaatgacatatgttgtgtgtggtggaaagtttgcttgggccaaaaaaccaattgctacaaatcatgatacagt

SEQ ID NO: 249146 - DNA, 75 bp, Artificial Sequence
  Synthetic
ggcaatggaagtcacatatactggcaatgatacaccatgccgtgtgacagttaaaaatgtgaaggaaaattcaga

SEQ ID NO: 249147 - DNA, 75 bp, Artificial Sequence
  Synthetic
tgatcaaggaactctgatcactacaaatccatttgttgaaagcaatggagccactatcttcctggaacttgaacc

SEQ ID NO: 249148 - DNA, 75 bp, Artificial Sequence
  Synthetic
agtctatggattgtcaacaataaaagttggggacatcacataccaatggaatcagcaagggagtgtcattgggaa

SEQ ID NO: 249149 - DNA, 75 bp, Artificial Sequence
  Synthetic
ggctgtgagaaaaatcaccaacgacatccataaaacaattgtcgttgggagtgctttttggaattcagatcaaag

SEQ ID NO: 249150 - DNA, 75 bp, Artificial Sequence
  Synthetic
attctcagccattaatttgatggatctaattaggttgccctttgcttttttatttgggggacttggattcatgat

SEQ ID NO: 249151 - DNA, 75 bp, Artificial Sequence
  Synthetic
gaagatgatcatttccctggttttaatttggttttgcttgaataccagaaatttttcaatagcagtcacttctgg

SEQ ID NO: 249152 - DNA, 75 bp, Artificial Sequence
  Synthetic
aattgtgggttttggtcttctagctttcaccacaggagtgatgggagatcatggctgtgtccttgatgttgatag

SEQ ID NO: 249153 - DNA, 75 bp, Artificial Sequence
  Synthetic
aaaggaaatgaaatgtggggatggagtcatggtgtggaatgaagttaatgactggtatggggggtacatgtacta

SEQ ID NO: 249154 - DNA, 75 bp, Artificial Sequence
  Synthetic
cccagatgatccagagacattcatcgccagcttggtcaatgataagaaagagcattgtggtacttatccagcaaa

SEQ ID NO: 249155 - DNA, 75 bp, Artificial Sequence
  Synthetic
cgccttggaactagcaatgtggcagaagcttgaatctcagatcaatttgttgttgaaagagatgaaggttgaatg

SEQ ID NO: 249156 - DNA, 75 bp, Artificial Sequence
  Synthetic
gagaatcaaagtttctgaaaagcaagatggctttccaaaaggagatcacttgggctgggaaaagaaaactggccg

SEQ ID NO: 249157 - DNA, 75 bp, Artificial Sequence
  Synthetic
caatggtctttcctggcagaactgggcaaagtcatttgattacatggaatggatctttgagacagatgccggcaa

SEQ ID NO: 249158 - DNA, 75 bp, Artificial Sequence
  Synthetic
ctcaacatactatgtgggaaatgttggagagaaagaatgtcctgatcatgacagaagctggaatgtgttcaggtt

SEQ ID NO: 249159 - DNA, 75 bp, Artificial Sequence
  Synthetic
tgaagagtttggagttggccttctaacaactagggtgtttgttggtatcaatgaagaaccagaccaatactgtga

SEQ ID NO: 249160 - DNA, 75 bp, Artificial Sequence
  Synthetic
ccctggattgatgggtgctgccgcaaaagataggtacatggtgcacagctcaacttggatgtggatggaaagtta

SEQ ID NO: 249161 - DNA, 75 bp, Artificial Sequence
  Synthetic
tgaggttaatgatactctacagttgcagcggctccagtatgactattacgtggaatgcctgtggccgccaacaca

SEQ ID NO: 249162 - DNA, 75 bp, Artificial Sequence
  Synthetic
tacattagatgggcaaaatgtgcttgagtccctgctgatactaccaaagcaactgggagggccagtttcaaattt

SEQ ID NO: 249163 - DNA, 75 bp, Artificial Sequence
  Synthetic
gaatagagtgaaaggctatgcagagcaagacaagggcccatggaagaaaggaaggttgctggttgagaggggtta

SEQ ID NO: 249164 - DNA, 75 bp, Artificial Sequence
  Synthetic
ctgtgaaggcacaacggtggtggtcgatgagaactgtcaacaccgtggacctagtgtgagatctacgactgaagg

SEQ ID NO: 249165 - DNA, 75 bp, Artificial Sequence
  Synthetic
agggaatgtcattaaggaatggtgttgccgtcactgcaaactgcctccccttaaattcaccatggaggaagagtg

SEQ ID NO: 249166 - DNA, 75 bp, Artificial Sequence
  Synthetic
ctggtacgccatggaaatacgaccaacttccaaagttaatggtttggtgatggcatcagatggtgagaaaccact

SEQ ID NO: 249167 - DNA, 75 bp, Artificial Sequence
  Synthetic
gtttgaatggtgttcatttgctctcctgaccacaatttacctactgttcatggcgggaaaaaacaccacagcttt

SEQ ID NO: 249168 - DNA, 75 bp, Artificial Sequence
  Synthetic
gataccttttgtggcgtttctaggagcaattctgtatggatctggattcttgacagccaatcttgtcatgaagta

SEQ ID NO: 249169 - DNA, 75 bp, Artificial Sequence
  Synthetic
tgtagctgcattctatctgaacagtgttctggaaaagtctgaaccaatgctttgggcatatatgatggaagtggt

SEQ ID NO: 249170 - DNA, 75 bp, Artificial Sequence
  Synthetic
gtttgacttgagaccaggcatgctgcttggccttatgttgaacaagacatggaagtttgaaagacttgttgccat

SEQ ID NO: 249171 - DNA, 75 bp, Artificial Sequence
  Synthetic
gattggttgtctgtcattcttacaacaagccactattgaatggcggacagcctgggttctgctagattgcattgc

SEQ ID NO: 249172 - DNA, 75 bp, Artificial Sequence
  Synthetic
agttcttgtggtctttcaaagtcaaggctcaaaaatcaaaggacatcttctcaacattgtcttgctcaatttatc

SEQ ID NO: 249173 - DNA, 75 bp, Artificial Sequence
  Synthetic
atgggttacatctgaacacctgattatgatggtgaaactgactggatttttactactgctgtcagatagtggagt

SEQ ID NO: 249174 - DNA, 75 bp, Artificial Sequence
  Synthetic
gtttgaaagatcatcatggcaacaaaagaccaggactgtgttgacagccggaatgatgacgttaaacacacccta

SEQ ID NO: 249175 - DNA, 75 bp, Artificial Sequence
  Synthetic
ctcatttctagttgctgcatggccactccctaggcacattaggggagtggactacgtcgctatactaggaatttt

SEQ ID NO: 249176 - DNA, 75 bp, Artificial Sequence
  Synthetic
aatgggagtgggggcatctgtggcaaggaatggactggaatcagaattgtgggtaatgggtatcatggccctggt

SEQ ID NO: 249177 - DNA, 75 bp, Artificial Sequence
  Synthetic
gcttttggtctttgtcctccagctcacaactggggaactgttagctgaatgggactcacactactcatggaaaca

SEQ ID NO: 249178 - DNA, 75 bp, Artificial Sequence
  Synthetic
aaactgtgatcaggcctctgggtctgttgacttatcagtcaagaggctaccagatggaagactcgtaaacatcac

SEQ ID NO: 249179 - DNA, 75 bp, Artificial Sequence
  Synthetic
tgagaaagaagaaagtaggatggagactcttattcttggggtgggaatgatagcaacagaattccattgggtggg

SEQ ID NO: 249180 - DNA, 75 bp, Artificial Sequence
  Synthetic
tttacccctgacagttcttgtccttggcttgaggagatggattgtgaatggaaaagaacaaaggagtctgatagt

SEQ ID NO: 249181 - DNA, 75 bp, Artificial Sequence
  Synthetic
ctatggtggaagatcagagagtgccaatgatgaaactgagggagaccttcttgagggagtttatagaattacagc

SEQ ID NO: 249182 - DNA, 75 bp, Artificial Sequence
  Synthetic
agcctccatttttgggagaaagcaagttggaataggtgtcctcaaggaaggagtgttccataccatgtggcacgt

SEQ ID NO: 249183 - DNA, 75 bp, Artificial Sequence
  Synthetic
cactagaggaagtgctctgcgagtgagagggagagtgctcgccccagaatgggctagtgtggaggaggatcttgt

SEQ ID NO: 249184 - DNA, 75 bp, Artificial Sequence
  Synthetic
ggcgtataatggtacgtggaagctcaacaagaaatgggatggaggggaagtgcaactacatgcctacactccaga

SEQ ID NO: 249185 - DNA, 75 bp, Artificial Sequence
  Synthetic
cggcaagattatcaaaacccaggttctaccaggaaagatggaattggctggtggaggttcaatgggactgattcc

SEQ ID NO: 249186 - DNA, 75 bp, Artificial Sequence
  Synthetic
tctagactttcctcctggttcatctggttctccagtcatcaatgcaaatggagaggtggtcggcctgtatggcaa

SEQ ID NO: 249187 - DNA, 75 bp, Artificial Sequence
  Synthetic
tggagtcttgcatggcgatacctactgcagttctatagctcaaactaccaaggagctaccagtagacaaaccaaa

SEQ ID NO: 249188 - DNA, 75 bp, Artificial Sequence
  Synthetic
ggtggtgaaaggagatgggtggctgtcaaagggtcgcatatccattgttgatgctcatccgggtagtgggaaaac

SEQ ID NO: 249189 - DNA, 75 bp, Artificial Sequence
  Synthetic
tcacaggattcttcctgaacttgtaaggagagcactgagccgcaagttgagaaccttggtcttggcccccactag

SEQ ID NO: 249190 - DNA, 75 bp, Artificial Sequence
  Synthetic
aatagtggtcaaagagatggagtcagctctaagaggacttgatgtcagtttccactcatctgcagtcagccataa

SEQ ID NO: 249191 - DNA, 75 bp, Artificial Sequence
  Synthetic
gaatcctgggagtcttgccgatgtgatgtgccatgcgacttatgtaaacaggaaattaattcacatgccccagaa

SEQ ID NO: 249192 - DNA, 75 bp, Artificial Sequence
  Synthetic
aaactacgaggttatcatcatggatgaagcacactggacggatccaagcagcatagcagctagagggtttattac

SEQ ID NO: 249193 - DNA, 75 bp, Artificial Sequence
  Synthetic
tagcctttgtgaagctaagagatgtgctgtggttttgatgacggcaacgccacctggtgttgaagacccatgggc

SEQ ID NO: 249194 - DNA, 75 bp, Artificial Sequence
  Synthetic
tgaaagtaatgagaagatcaatgatgttgagaaagtgattcctgatggaccatggaaacagggacatgaatggat

SEQ ID NO: 249195 - DNA, 75 bp, Artificial Sequence
  Synthetic
aactgaatatgagggtagaacagcctggtttgtgccttctttaaacacagccaactcaatggcaaaagtccttag

SEQ ID NO: 249196 - DNA, 75 bp, Artificial Sequence
  Synthetic
aggtctaggaaagaaagttgtggtgcttacaagcaagaccttccatgataactatccgaagctcaatgatgagaa

SEQ ID NO: 249197 - DNA, 75 bp, Artificial Sequence
  Synthetic
gcctgattttattttgactactgatatctcagaaatgggtgctaacttggatgtggaaagagtcattgaccctag

SEQ ID NO: 249198 - DNA, 75 bp, Artificial Sequence
  Synthetic
aacaacattgaagcctgttgagaaaggaaatgcagttgaaatcagtggtgaaaggaagataactccagcctctgc

SEQ ID NO: 249199 - DNA, 75 bp, Artificial Sequence
  Synthetic
agcgcaacgacgcggcagggtcggaaggactaaaggaaagaaggctgattacatttaccaaggtgagacaaatgc

SEQ ID NO: 249200 - DNA, 75 bp, Artificial Sequence
  Synthetic
tgatgattcagaacttgtgtgctggaaggaagctcaaatgctcttggataacatggagagcaggcttggctcagc

SEQ ID NO: 249201 - DNA, 75 bp, Artificial Sequence
  Synthetic
ctctgtcttttatggacctgagcaagtgaaaatgactgaaatgccaggattttacaaattgaatgacgaaaaaag

SEQ ID NO: 249202 - DNA, 75 bp, Artificial Sequence
  Synthetic
gaaagtgtttaggcacctgcttgctcaatgtgactttacaccatggttggcttggaaagtggcttcagatggcaa

SEQ ID NO: 249203 - DNA, 75 bp, Artificial Sequence
  Synthetic
gagcattgagaaccgagagtggctcaagagtgggccaaaggaacacttggtgacagatgaaaactgtgaagcggt

SEQ ID NO: 249204 - DNA, 75 bp, Artificial Sequence
  Synthetic
tacatacaagactcctggtggaaaggttgaaagactccagccagtgtggatggatgctagaatgactagggagaa

SEQ ID NO: 249205 - DNA, 75 bp, Artificial Sequence
  Synthetic
aagggacttgctgaacctactggattatgcagaaatgcgtagaagcagtgtttggctgagtctgcctggggctct

SEQ ID NO: 249206 - DNA, 75 bp, Artificial Sequence
  Synthetic
gtacaatcagttcacggaagccatggacacgatctatgtctattatacggccaatccatcctccaagggattcag

SEQ ID NO: 249207 - DNA, 75 bp, Artificial Sequence
  Synthetic
gatggcccaagaatcaatgccaacagcccttcttactgtgatgcaagctctaataataggcactggattgatcat

SEQ ID NO: 249208 - DNA, 75 bp, Artificial Sequence
  Synthetic
gttcttggggtggatgtgttcgagtaggaaggtggacagaatgatgctgggcactctgttgatagtgggatgtag

SEQ ID NO: 249209 - DNA, 75 bp, Artificial Sequence
  Synthetic
tgtcacagcatggtgtggaggtgtgcccctgccattggtatccgccatggcgttggttacttttatactattgct

SEQ ID NO: 249210 - DNA, 75 bp, Artificial Sequence
  Synthetic
gtgcctggttcctgaggaagggcagcaaaggacccagattgacacaactctagccatgtttgtctattccatgct

SEQ ID NO: 249211 - DNA, 75 bp, Artificial Sequence
  Synthetic
gttgtttgttggtcttgtgattgctaatgaattgaggtggctggaaaacactaaagaagatatcaaacaactgtt

SEQ ID NO: 249212 - DNA, 75 bp, Artificial Sequence
  Synthetic
tggagaaaagatacatatgggcatttcatcaggaggtgacttttggaagtacatcgatctgaaacctttaagcat

SEQ ID NO: 249213 - DNA, 75 bp, Artificial Sequence
  Synthetic
ctggggcacctatgcaaccttggtgacttttatgcgaccacaaatgctccacaaccttagaatgttcacccagag

SEQ ID NO: 249214 - DNA, 75 bp, Artificial Sequence
  Synthetic
aattgttgctggtagtgtcagtggaaaactggacacattgaatggattgagaaatggatttgtgagcacctcgat

SEQ ID NO: 249215 - DNA, 75 bp, Artificial Sequence
  Synthetic
gtcattgggtgacttgtcgcttttcatctcattctgcagaaacatgagtcctctaactactgtgacagggctggt

SEQ ID NO: 249216 - DNA, 75 bp, Artificial Sequence
  Synthetic
tctagccgcaatacactggctttggttttatcctatgcatgaggctagcctaacctccaaggcccataagatggt

SEQ ID NO: 249217 - DNA, 75 bp, Artificial Sequence
  Synthetic
tgctcagagtactgcaaaaaatgttgcctttgatggagaaggaattatcgactttcacacggaagaggtggacac

SEQ ID NO: 249218 - DNA, 75 bp, Artificial Sequence
  Synthetic
atcttcagcggaaaggaagacatcatttggagtggctatcctcctagctgtcatcaatgtggttgttgtccgtga

SEQ ID NO: 249219 - DNA, 75 bp, Artificial Sequence
  Synthetic
accatgggcaatgcttgaagctggactagtgctcctcgctgcaattaagtttgcggctgatggggctaaagaaac

SEQ ID NO: 249220 - DNA, 75 bp, Artificial Sequence
  Synthetic
tttgataacgcttcctgtcctgagtgggattggtgctttgattagaggggattactttggagtggccccaatctt

SEQ ID NO: 249221 - DNA, 75 bp, Artificial Sequence
  Synthetic
gctcaatttgtatctgcagacaacatccaacaggaggggcatttgttcgagtgcccccacactgggggaaatctg

SEQ ID NO: 249222 - DNA, 75 bp, Artificial Sequence
  Synthetic
gaaaagaaagttaaaccagcttgatgctaaagagttcatggcctatagacgaaggtttgtggttgaagtcgacag

SEQ ID NO: 249223 - DNA, 75 bp, Artificial Sequence
  Synthetic
aaatgaagctagggaagcactggctaagggaaaaaccaacaccggccatgcggtctccagaggaacagcaaaact

SEQ ID NO: 249224 - DNA, 75 bp, Artificial Sequence
  Synthetic
agcctggattgatgagaggggtggagtggagttgaaaggaagtgtcgtggacctgggctgtggaagagggggctg

SEQ ID NO: 249225 - DNA, 75 bp, Artificial Sequence
  Synthetic
gagttactatgcggcttcgcaaccaaatgtgagagaagtgaaggcctacacgctaggaacttcaggtcatgagaa

SEQ ID NO: 249226 - DNA, 75 bp, Artificial Sequence
  Synthetic
gccaagacttgtggaaacttttggatggaacttgattacgtttaagtccaaagtcgatgtcagaaagatggaacc

SEQ ID NO: 249227 - DNA, 75 bp, Artificial Sequence
  Synthetic
ctttcaagctgatacagtgctatgtgacataggtgaaagcaatccaacagcagctgttgaagccagcagaacctt

SEQ ID NO: 249228 - DNA, 75 bp, Artificial Sequence
  Synthetic
aactgtgttaaacgtgatttcaagatggctggaatacaatcaaggctgtgggttttgcgtcaaagtcttaaatcc

SEQ ID NO: 249229 - DNA, 75 bp, Artificial Sequence
  Synthetic
atatagctgtgatgttcttgaggcactaatgaaaatgcaacgaagatttggagggggtctcattagagtccctct

SEQ ID NO: 249230 - DNA, 75 bp, Artificial Sequence
  Synthetic
atcaagaaattcaacacatgagatgtactttgtctcaggcataaagaacaatattatgggtaatgtaaccgctgt

SEQ ID NO: 249231 - DNA, 75 bp, Artificial Sequence
  Synthetic
atccaggcaactcctgaaaagaatggaggagcagggaggggaaagagtggttccagactataaattctctacagg

SEQ ID NO: 249232 - DNA, 75 bp, Artificial Sequence
  Synthetic
aacaagatccaatcttacccaaaagattgaggtgccagaagaagaagtccagatgagagtagacaaaatcaaggc

SEQ ID NO: 249233 - DNA, 75 bp, Artificial Sequence
  Synthetic
tgagaaatcaggcacctggtgttttgattctaatcacccttatcgcacgtggaactatcatggatcataccgtgt

SEQ ID NO: 249234 - DNA, 75 bp, Artificial Sequence
  Synthetic
gagggatgtgggaacaagagcttcagcagtcaatcatgttgtgaagttacttagttggccttggggtaagatgga

SEQ ID NO: 249235 - DNA, 75 bp, Artificial Sequence
  Synthetic
gaaagtactggcaatgtcaatgacagacaccacagcgtttggacagcaaagggtgtttaaacaaaaagtggacac

SEQ ID NO: 249236 - DNA, 75 bp, Artificial Sequence
  Synthetic
caaggccccagaaccaaatatccaggtgaaaaaagtgatgaggaaagtatttaaatggttgatcgaaagaattaa

SEQ ID NO: 249237 - DNA, 75 bp, Artificial Sequence
  Synthetic
aaccaaaggtgggaaagtgagaacatgcacaaaagaagagttcatccaaaaagtaagatctcatgctgctatcgg

SEQ ID NO: 249238 - DNA, 75 bp, Artificial Sequence
  Synthetic
ggcctggtcgtcagatatggaagggtggagctcagctgtggaggcagttgacgatcctaggttctggaacatggt

SEQ ID NO: 249239 - DNA, 75 bp, Artificial Sequence
  Synthetic
gcagaaagaaagagatttacacctacaagggaaatgtgagatgtgtgtgtacaacctcatgggaaaaagtgaaaa

SEQ ID NO: 249240 - DNA, 75 bp, Artificial Sequence
  Synthetic
gaaacctggggattttggagttgccaaggggagccgtaccatctggtacatgtggctcggcagtagattcctgga

SEQ ID NO: 249241 - DNA, 75 bp, Artificial Sequence
  Synthetic
atttgaaagttttggatttctgaatgaagaacattgggcttcacgggagttgagtgggggaggagtcgaagggat

SEQ ID NO: 249242 - DNA, 75 bp, Artificial Sequence
  Synthetic
tcccctaaattatttaggataccatctcagagaaatggcccaaaaaccaggagtgctatatgctgatgacacagc

SEQ ID NO: 249243 - DNA, 75 bp, Artificial Sequence
  Synthetic
tggatgggacacccgcattaccatggcagatctggaggatgaaggcatgctgcttgacatgatgagcggagaaca

SEQ ID NO: 249244 - DNA, 75 bp, Artificial Sequence
  Synthetic
caagaaactggcttcggcactattcagtaaagcttacaaagtgaaagtggccttgtgccccagacctggacccaa

SEQ ID NO: 249245 - DNA, 75 bp, Artificial Sequence
  Synthetic
aggaggaactctcatggatgtcatatccaggaccgaccaaagagggtctggccaagtagtgacttatgcactcaa

SEQ ID NO: 249246 - DNA, 75 bp, Artificial Sequence
  Synthetic
caccctgaccaacataaaagtgcagcttatcagaatggcagaagccgaaggagttcttggagcaacttttgagga

SEQ ID NO: 249247 - DNA, 75 bp, Artificial Sequence
  Synthetic
cttcgggattgacagatggttgcaggaacatggtgaagaccgagttgaaagaatgctggtcagtggtgatgactg

SEQ ID NO: 249248 - DNA, 75 bp, Artificial Sequence
  Synthetic
tgtagtcaatgctatagatgaaaggtttgggtcaagtctgaattggttgaatgccatggaaaaagtgaggaaaga

SEQ ID NO: 249249 - DNA, 75 bp, Artificial Sequence
  Synthetic
cattgacctatggaaaccatcaccctcatttagaaactgggaacgggttgaattctgctctaatcacttccatga

SEQ ID NO: 249250 - DNA, 75 bp, Artificial Sequence
  Synthetic
gatgacaatgaaagacgggagagtcattgtggcgccctgtcgtggccaaactgaattgatagcaagagggacagt

SEQ ID NO: 249251 - DNA, 75 bp, Artificial Sequence
  Synthetic
caaccaggggggatgtgttggagtggaatcaacaggctgtctagccaaggcgtatgcgcaaatgtggcttttgct

SEQ ID NO: 249252 - DNA, 75 bp, Artificial Sequence
  Synthetic
ttatttccacagaagagacctcagaacgctggctctagctgttatgtcagctgtgccaagcaattggattccaac

SEQ ID NO: 249253 - DNA, 75 bp, Artificial Sequence
  Synthetic
aggacgcaccacttggtccctcatggtgaaaggagaatggatgactgatgaagacatgttggctgtgtggaatag

SEQ ID NO: 249254 - DNA, 75 bp, Artificial Sequence
  Synthetic
ggtttggattgaagacaaccctttcatggaagacaagagagaggtggaaaggtggagtgaagtcccttaccttcc

SEQ ID NO: 249255 - DNA, 75 bp, Artificial Sequence
  Synthetic
aagaaaccaggacaagtcatgtggtagcctaattgggactactgctagggcagaatgggccaagttgcttccagg

SEQ ID NO: 249256 - DNA, 75 bp, Artificial Sequence
  Synthetic
agccgttgagaaggtgaggaacatctttgggaagcaaagattcagaaactaccttaggaacatgggtaggtatga

SEQ ID NO: 249257 - DNA, 75 bp, Artificial Sequence
  Synthetic
gtcacaagaagaagctccattttcaatgtattaaacaatgaaataattaaatgaaagagtgttgagggcaaccag

SEQ ID NO: 249258 - DNA, 75 bp, Artificial Sequence
  Synthetic
tgggctagccacatgggtatgacgcacccaccctctgcattcttgtaaatactttggccagtcattgtaaatagg

SEQ ID NO: 249259 - DNA, 75 bp, Artificial Sequence
  Synthetic
ttagggagccgggcccaacccagctagggatagcctttctggggtaaggactagaggttagtggagacccccggc

SEQ ID NO: 249260 - DNA, 75 bp, Artificial Sequence
  Synthetic
ttttgaagttagggcaacacagggagtggttcaattggccagaaccgctctggcgtttgcctcctgttattttcc

SEQ ID NO: 249261 - DNA, 75 bp, Artificial Sequence
  Synthetic
aaattcccgttaccgggggtggggtgattagccatggtcgcacagatcaagctcagattgcttacatgtaatctg

SEQ ID NO: 249262 - DNA, 75 bp, Artificial Sequence
  Synthetic
gattagccatggtcgcacagatcaagctcagattgcttacatgtaatctgtgtggtcatgaatatgacctccgct

SEQ ID NO: 249263 - DNA, 75 bp, Artificial Sequence
  Synthetic
aacaagggtgattatggatacgtgtaatacaacactaaatactacaaacttaggattcaggacacaatcaattgg

SEQ ID NO: 249264 - DNA, 75 bp, Artificial Sequence
  Synthetic
cttctgtgggtttaaattcaagtgttttttacctctggagctagataacgatttgagtatgtatatgaaggataa

SEQ ID NO: 249265 - DNA, 75 bp, Artificial Sequence
  Synthetic
tgcaggtcctggccacaactcagatcaaaagacaaaaaaacacagaaacccatcccaaaaaatgtattctactct

SEQ ID NO: 249266 - DNA, 75 bp, Artificial Sequence
  Synthetic
agctctatctcccgttaaaaatgaatgggattctgtctatccttatgagtcaatgtgctacaacccacccgcctc

SEQ ID NO: 249267 - DNA, 75 bp, Artificial Sequence
  Synthetic
caagcatgagactgagagatttagagaatatcaggccaatttgggaaggcaaggtaaacctcttgcatcaacagc

SEQ ID NO: 249268 - DNA, 75 bp, Artificial Sequence
  Synthetic
aaccacgtccagacgattagtcgatgtgtttgtaaatgatgctgagtttgacccctatgagataattgattatgt

SEQ ID NO: 249269 - DNA, 75 bp, Artificial Sequence
  Synthetic
aaccctaacgacaaagataattgtgtataacccctccaacaaaggccctgccttaagatgggaaattacaaaatt

SEQ ID NO: 249270 - DNA, 75 bp, Artificial Sequence
  Synthetic
actatctggcaggtacatcgatgatcctgaatttaacatatcatatagtcttaaggaaaaggaaacaaaacaagc

SEQ ID NO: 249271 - DNA, 75 bp, Artificial Sequence
  Synthetic
tgctatgaggttaatctggtcccctgcagcatcacactcagtgaaggtcggtgcagcactgacacttctgtctgc

SEQ ID NO: 249272 - DNA, 75 bp, Artificial Sequence
  Synthetic
aggacgcttgtttgctaagatgacctacaagatgagagcatgccaggtcgttgccgaatcattgattgcgaacgg

SEQ ID NO: 249273 - DNA, 75 bp, Artificial Sequence
  Synthetic
ccatgctgagaacccaggagcaatgattaggtcgttggtgaacgatcccgatattgaggtagtgattactgatat

SEQ ID NO: 249274 - DNA, 75 bp, Artificial Sequence
  Synthetic
tattggaaaatattttaaagagaatggaatggtcaaagatgagcacgaactgctcaagagcttgcatcaattatc

SEQ ID NO: 249275 - DNA, 75 bp, Artificial Sequence
  Synthetic
atcagaatttgatcacggagtgcctcgccttgaaagaagaggtgagaaagccgaacagcagatggaaagctacaa

SEQ ID NO: 249276 - DNA, 75 bp, Artificial Sequence
  Synthetic
tgcatcatccgttccgaagaatgagggctttaatgaggataactggaaaattagtaaacgccctttcaagagaat

SEQ ID NO: 249277 - DNA, 75 bp, Artificial Sequence
  Synthetic
aaggattctcaatagaactcctcaagagaatttgttttataatcctgagattgacgatcttgagattctggactc

SEQ ID NO: 249278 - DNA, 75 bp, Artificial Sequence
  Synthetic
tgagagcaaggattctttaagtaaggaaaataaaacattgttaaattctaaagtgatcacaaacaccataggtca

SEQ ID NO: 249279 - DNA, 75 bp, Artificial Sequence
  Synthetic
tgggacatttctctttgcaatagctactgttctagcccaagtttggatcctggttgcaaaggcagtgacagcccc

SEQ ID NO: 249280 - DNA, 75 bp, Artificial Sequence
  Synthetic
taacacttttaacactactctccaaaacaaacaaccgagaacaccgcgaataaatcctcaattaaacaaaaataa

SEQ ID NO: 249281 - DNA, 75 bp, Artificial Sequence
  Synthetic
tgacaccgccgaggacagtgaaaataagagatgggccaagtatgtacagcaaaagagagttaatcctgactacct

SEQ ID NO: 249282 - DNA, 75 bp, Artificial Sequence
  Synthetic
gaacagcttgcaagatacaatttctaattacatatccaaagactataccattcaagactatacaagtaaggcatt

SEQ ID NO: 249283 - DNA, 75 bp, Artificial Sequence
  Synthetic
tgtctctaaccgctggattactgctatgaggtcattgatttcaatggatttatcagttagaaaatatatggtaga

SEQ ID NO: 249284 - DNA, 75 bp, Artificial Sequence
  Synthetic
cgatagatccgatgacaagtacgatacaattagttcattcttaactacagatttgcagaagttttgtctgaattg

SEQ ID NO: 249285 - DNA, 75 bp, Artificial Sequence
  Synthetic
aattttgattgaagtaaagaagagcggtgtttctaggggaagactaaacgagatgattgcagacataggtaatta

SEQ ID NO: 249286 - DNA, 75 bp, Artificial Sequence
  Synthetic
gagatatgagtcgacagcattatttgcggaacgagtggatgagatttatgggttgcctggattctttaattggtt

SEQ ID NO: 249287 - DNA, 75 bp, Artificial Sequence
  Synthetic
tatcgaagagaccggcatggcaggattctttttgactatcaaatatgggctagaaatgaaattcccagtgatcgt

SEQ ID NO: 249288 - DNA, 75 bp, Artificial Sequence
  Synthetic
acataacaggctagaaaggtgtacattatacgtagcagatcctcattgtcctccacccttcacggatcacttaga

SEQ ID NO: 249289 - DNA, 75 bp, Artificial Sequence
  Synthetic
gatcaatgaatttcaggctgacctgctcacattgcagacactcatgaggacatatatggatctaggacctcgggc

SEQ ID NO: 249290 - DNA, 75 bp, Artificial Sequence
  Synthetic
attggatgaagttcctgatgagggaatattcattaggcatcctatgggtgggatagaaggctatagtcagaagct

SEQ ID NO: 249291 - DNA, 75 bp, Artificial Sequence
  Synthetic
accatatatggttcttcttgaagattcgatacagacaaagttcgccccgggtaactatccacttctatggagctt

SEQ ID NO: 249292 - DNA, 75 bp, Artificial Sequence
  Synthetic
ctggactattattaccattccttttctctttttgagtggtgtcgagaccaatacaagggtggctgctgttgtaca

SEQ ID NO: 249293 - DNA, 75 bp, Artificial Sequence
  Synthetic
tgcaatgggggtaggcacaacactggatagatcaatgggtgcactcaacatcaatagatcctacctagagcctat

SEQ ID NO: 249294 - DNA, 75 bp, Artificial Sequence
  Synthetic
aggtgacaaccaatccattgcaatcacacacaaagttcaccccaatatgtcatacatagcaaagaaagatgttag

SEQ ID NO: 249295 - DNA, 75 bp, Artificial Sequence
  Synthetic
ctatttcaaactgggtcaaaatgctgcgagaaagaatgcaggatctatagatagaaaattagccgaagaactagg

SEQ ID NO: 249296 - DNA, 75 bp, Artificial Sequence
  Synthetic
cgctgagaaagctaggatctactttgagagacttaggacaaaccttgatgctttaggtcataatcttaaattgac

SEQ ID NO: 249297 - DNA, 75 bp, Artificial Sequence
  Synthetic
catatcaccagaacaggcagatgagattaaagagatgatgcaagaagtcacaacacagagacatgagacaaatgt

SEQ ID NO: 249298 - DNA, 75 bp, Artificial Sequence
  Synthetic
tgaaactataattagtactcatttttttgtgtactctaaacgaatctattatgatggtatggtattatcgcaagg

SEQ ID NO: 249299 - DNA, 75 bp, Artificial Sequence
  Synthetic
tcaggctagggaagggaagttcaatattgcagttggcgggatagaatctctcctcacagacgaggatgatgacat

SEQ ID NO: 249300 - DNA, 75 bp, Artificial Sequence
  Synthetic
attaaagtcagtatcaaggtgtgttttctggtcagagacactggttgatgagacgagatcagcgtgtagtaatat

SEQ ID NO: 249301 - DNA, 75 bp, Artificial Sequence
  Synthetic
cacaaactcaagatatatgtcagaaacgaccgacaccatgtttaatctggtaagacctacgagggattatgaatc

SEQ ID NO: 249302 - DNA, 75 bp, Artificial Sequence
  Synthetic
tagtacgtctatagccaaggctattgagaatggtctatctaaagatatagggtactctcttaatgtccttaaaac

SEQ ID NO: 249303 - DNA, 75 bp, Artificial Sequence
  Synthetic
ctctaaagtgagcccaaaggaaagcaacaaaaacaagtccgacatgtctgtcagagaccgtcttttgatgaacct

SEQ ID NO: 249304 - DNA, 75 bp, Artificial Sequence
  Synthetic
tatacaacaaatcattgtatcactcaaattttctattaatgagacaatgacacctgatgtcaccaatcccttgat

SEQ ID NO: 249305 - DNA, 75 bp, Artificial Sequence
  Synthetic
gagggaagaggaggcaagaaaatctgaggcacagatgcttggaatcatggatttagcattcaagaagacatctgc

SEQ ID NO: 249306 - DNA, 75 bp, Artificial Sequence
  Synthetic
tcaaaatattaactggctacttactgcatgcttaatgccggcatctttaggaggatttaattatttgaacttgtc

SEQ ID NO: 249307 - DNA, 75 bp, Artificial Sequence
  Synthetic
aggacagactcctacctctagtactgcagcaacagcacaagcagactcatctgttgacatctcagctagtaacat

SEQ ID NO: 249308 - DNA, 75 bp, Artificial Sequence
  Synthetic
cagattatatgttagaaatataggagatcctattacggcatctttagcagacttgaagagaatgattaattctgg

SEQ ID NO: 249309 - DNA, 75 bp, Artificial Sequence
  Synthetic
tgttaatgatttggatgccctcgataattgaatatatcagtaattgtaattaggacgtacatttgtagaatatca

SEQ ID NO: 249310 - DNA, 75 bp, Artificial Sequence
  Synthetic
cttaatgacagaaagggttcttcatcaagttatgacacagacaccaggagatgcatcctttctcgattgggcaag

SEQ ID NO: 249311 - DNA, 75 bp, Artificial Sequence
  Synthetic
acactgcatatatgttggactccaaatctcaactttggaaagtttgtacttaatatataaagtgtatataattaa

SEQ ID NO: 249312 - DNA, 75 bp, Artificial Sequence
  Synthetic
tgatccatactcagccaacctacccagttcacaaagcataacgaagacaatcaagaatgtgactgcaagattggt

SEQ ID NO: 249313 - DNA, 75 bp, Artificial Sequence
  Synthetic
atggtgtgtcaataatttaaactacctattgaatattaaacaaaacttaggatccaagagacaaatgtccgcgca

SEQ ID NO: 249314 - DNA, 75 bp, Artificial Sequence
  Synthetic
cttgtcaaatgccaaaaatcctatactaaaggggctgtttcataacagttatcacgaagaagacaaaagcttggc

SEQ ID NO: 249315 - DNA, 75 bp, Artificial Sequence
  Synthetic
atcgacacaaaccacaccaaggatcagccagaacaacaccacccaaaccacaacaaaccaaaaagccctccaacc

SEQ ID NO: 249316 - DNA, 75 bp, Artificial Sequence
  Synthetic
tgaatttttgatggatagaaacattattatgcctcgagcagcacacgaaatactggataactctataacaggagc

SEQ ID NO: 249317 - DNA, 75 bp, Artificial Sequence
  Synthetic
acaaaaaaacaaaagaaagttatcaactcctacaaaactcaccctaaccaacttggacaccctgtctcaaatctc

SEQ ID NO: 249318 - DNA, 75 bp, Artificial Sequence
  Synthetic
aagggaagagatatcaggtatgttagatacaacaaaaggcttgattagaactggattgtcaaaaggaggaataca

SEQ ID NO: 249319 - DNA, 75 bp, Artificial Sequence
  Synthetic
agagggtcagggttcaacagaacctgtaaacaacgaggttccattcatcgatttgaccacaacaggtcagggagt

SEQ ID NO: 249320 - DNA, 75 bp, Artificial Sequence
  Synthetic
gccaagacttgtgtccagattatcacactacgactatgaacagtttcgtgtttttaacaatttgatgagaaacaa

SEQ ID NO: 249321 - DNA, 75 bp, Artificial Sequence
  Synthetic
caacaatttacaatgtcgtatgaagacagaatcaaacagattcagaatggcctccagattgttgacctggtcaag

SEQ ID NO: 249322 - DNA, 75 bp, Artificial Sequence
  Synthetic
aaacatgagtccttatataaaacccacaatttgctctgtggaacttgcaaggtacttaagatcacacatgtggag

SEQ ID NO: 249323 - DNA, 75 bp, Artificial Sequence
  Synthetic
aaagttaggcaggaatcgatcgaaaagccaacatacgggcgaagtgcaattggccttccaacaaccaaagatcga

SEQ ID NO: 249324 - DNA, 75 bp, Artificial Sequence
  Synthetic
aaggttatctcagggacgattaatttacggcctagaagtccctgatcctatcgaatcgatgcagggaaccattat

SEQ ID NO: 249325 - DNA, 75 bp, Artificial Sequence
  Synthetic
gcagcagcctgggagctgttccataaatcttcacttgatgaagccggacctgaagaactgcctcttaaagaagga

SEQ ID NO: 249326 - DNA, 75 bp, Artificial Sequence
  Synthetic
cagaggaagcgaagaatgtagcctctgtgcatctgaaaaatctccttattgctggttttttataccaaaagacat

SEQ ID NO: 249327 - DNA, 75 bp, Artificial Sequence
  Synthetic
gatgacccagctgacactagagatggagtgggcattccagagcctcttcataatgttgacagtggaggaagccga

SEQ ID NO: 249328 - DNA, 75 bp, Artificial Sequence
  Synthetic
ggatttagacaaagtccataagcctaccaatagtatcagagtcccgtatataggatcatcgacagatgagagatc

SEQ ID NO: 249329 - DNA, 75 bp, Artificial Sequence
  Synthetic
acatacaaagaggcaaactgggatgagggagacgaaccaatactcgaaaatcagttggttacaaacattcaaccg

SEQ ID NO: 249330 - DNA, 75 bp, Artificial Sequence
  Synthetic
agaaatcaaacttggacatgttaagtcatccagtcgtgccctcaagtcagctataaggatagctacagtttatac

SEQ ID NO: 249331 - DNA, 75 bp, Artificial Sequence
  Synthetic
aatgatccaggaaggaagactgcctacgggaaatctgatcacacgtatgctgacagcacaaataatagaaccaaa

SEQ ID NO: 249332 - DNA, 75 bp, Artificial Sequence
  Synthetic
ctgggccttcggagatgatgatgagtcatggttagaagcctggtatctagcctcacagagggttaatatcgactt

SEQ ID NO: 249333 - DNA, 75 bp, Artificial Sequence
  Synthetic
ggaggtgagtggagcaatggatgttcttcgcctaataaggttgatgtgtccggcatattccagggcgatgtacct

SEQ ID NO: 249334 - DNA, 75 bp, Artificial Sequence
  Synthetic
agaagttttaagagcaataactcctatctcaacatcaaacaacttagcacatagattaagagacagagctactca

SEQ ID NO: 249335 - DNA, 75 bp, Artificial Sequence
  Synthetic
aaggacacagatgctgaaggacctagtgagaaacccaagtcatcattcagaatgaatcccaatgctcaagagtac

SEQ ID NO: 249336 - DNA, 75 bp, Artificial Sequence
  Synthetic
agtcaaattcaatggttcctctttaaacagggtttcaaggtatgtcacaataagcaatgataggttagaattcat

SEQ ID NO: 249337 - DNA, 75 bp, Artificial Sequence
  Synthetic
attccacgagatttgactccattgacagtaataattgattcttgtccttttgatcacaatcatgctgatgatgac

SEQ ID NO: 249338 - DNA, 75 bp, Artificial Sequence
  Synthetic
aattaatgatcaaaaggtggatactaatctcatatttcagcaggttatgctcttaggactatctgctatagaaca

SEQ ID NO: 249339 - DNA, 75 bp, Artificial Sequence
  Synthetic
tcagaagatcaaacagaagactctgcatatgtatttgaggcaggcctgaacaaaccagcagtcaaacctcgaatg

SEQ ID NO: 249340 - DNA, 75 bp, Artificial Sequence
  Synthetic
aaggtaccgatacaagacttgcactggcaaagagaatgttatataccatctgcatgcaagagagaactgctgtgt

SEQ ID NO: 249341 - DNA, 75 bp, Artificial Sequence
  Synthetic
atcaaggcagcacaaaaggagacactagtagatcaggacggagaggtaatgaatttgtcaatacttcctaagcag

SEQ ID NO: 249342 - DNA, 75 bp, Artificial Sequence
  Synthetic
tatagaaatgtcatcaactgggaatgtcccatcattgttagaaccaccattctacaaagagatcagagaaaatcg

SEQ ID NO: 249343 - DNA, 75 bp, Artificial Sequence
  Synthetic
agaaagtccatcctcaacaagcccattggtgcagaggatgcaattcccaaaaagcaagccagacctagtctagta

SEQ ID NO: 249344 - DNA, 75 bp, Artificial Sequence
  Synthetic
attaatttatgacgataaccctattatagataaagacttgagaaaattaaggacgcaggcttggtatgcatcaga

SEQ ID NO: 249345 - DNA, 75 bp, Artificial Sequence
  Synthetic
gtcatagaagaagatgatgaagatcagaagagcgaaccgatagaaaatatagacaaaagtgatgcaggatcagat

SEQ ID NO: 249346 - DNA, 75 bp, Artificial Sequence
  Synthetic
tgttgacttctccaactggaaatcgtcagatttacattgtgttcttgcgcaatctctggcacataccataattga

SEQ ID NO: 249347 - DNA, 75 bp, Artificial Sequence
  Synthetic
attactatatttgacatagctgataaggctacagatcatctgcgaaggaatcaaatggccgtgaaagcaatcgga

SEQ ID NO: 249348 - DNA, 75 bp, Artificial Sequence
  Synthetic
ttcaatctctaaaagtgataatgatgtgctgaaacaatttgttaccataagctctgacgataatattaacagctt

SEQ ID NO: 249349 - DNA, 75 bp, Artificial Sequence
  Synthetic
aatataattgagacgtcagcaggagtcccgatcattcaggaagaagtcatatatttgtctgatagacctactcaa

SEQ ID NO: 249350 - DNA, 75 bp, Artificial Sequence
  Synthetic
aataactgaatttttactggttgatgttaacctgcttagtgtatatctaggacaagcctgctcaaacaagtgggc

SEQ ID NO: 249351 - DNA, 75 bp, Artificial Sequence
  Synthetic
ccagcaccagagaaaataccagcaaaggaaagccgaaaattgagagctcttgagaaaactgagtcagggaaaggg

SEQ ID NO: 249352 - DNA, 75 bp, Artificial Sequence
  Synthetic
ttttgatatccatttcaagaggccacaaggtaaatggcaaatgatagagctattgacggatttattatcagacac

SEQ ID NO: 249353 - DNA, 75 bp, Artificial Sequence
  Synthetic
gagagtgatagtggactgagattggttaaaaaaggcatcgaagagaatacagtctctgttgggatggatcagaaa

SEQ ID NO: 249354 - DNA, 75 bp, Artificial Sequence
  Synthetic
atctgttcacgtattcagggtgttaactaatgcattatcacatcctagagtctttaagaaattttgggactcagg

SEQ ID NO: 249355 - DNA, 75 bp, Artificial Sequence
  Synthetic
tcaaggtcgaagaatggtgcaatccgatctgctccaaggttaaatcagaaccatcaagggaaaagtgtacctgta

SEQ ID NO: 249356 - DNA, 75 bp, Artificial Sequence
  Synthetic
cctattgtcacctcactatggaccttatttctataatcaggataccacaaaattggctattgatcttataatttc

SEQ ID NO: 249357 - DNA, 75 bp, Artificial Sequence
  Synthetic
agcaatgtccaatcatgtgccaagacgagcactgtaccaaaattgaatatgaatgaacaacaatctgggcatgac

SEQ ID NO: 249358 - DNA, 75 bp, Artificial Sequence
  Synthetic
ttcctacacgatgtacttaactatttggttagaggggagaactgttagcttccttatggcagaacagtctgttga

SEQ ID NO: 249359 - DNA, 75 bp, Artificial Sequence
  Synthetic
ttggggtatacctctgaggaatcaactccatcgtcaatgaatataagcttcgaagaatattttgatggattagta

SEQ ID NO: 249360 - DNA, 75 bp, Artificial Sequence
  Synthetic
tgcagtagatataagatcccagacagtacaggcaaaacatctatgtatgctgtgtgatttatactgcaatgaaca

SEQ ID NO: 249361 - DNA, 75 bp, Artificial Sequence
  Synthetic
acacaattgaccaaggatgatatagttagagaggtatacaggaaccaattagtaatcctcagtaaagtcgaggag

SEQ ID NO: 249362 - DNA, 75 bp, Artificial Sequence
  Synthetic
aggaccaccacatattagggacttgatgcctcatcaaaaaatagatatactgtcagatttcattaagaagacaag

SEQ ID NO: 249363 - DNA, 75 bp, Artificial Sequence
  Synthetic
aacaatgcaactgctgatttgttaaagttgttggcaaacaatcagaaagctatgcttgcaaaattagatgcacta

SEQ ID NO: 249364 - DNA, 75 bp, Artificial Sequence
  Synthetic
actaaatatagtaggctctgattcttggaatatccataatctgcacatcaatgtttaccctgcttctcttacata

SEQ ID NO: 249365 - DNA, 75 bp, Artificial Sequence
  Synthetic
gataggaatgtcagccgactgggcctagctgtttcttccatggaacagatgcttgcatctatgagaatcatgatc

SEQ ID NO: 249366 - DNA, 75 bp, Artificial Sequence
  Synthetic
tctaaggcgtggtgttatcaaacagttgagaatcagacaagacataggtgaaatgtttgatattatagagatgga

SEQ ID NO: 249367 - DNA, 75 bp, Artificial Sequence
  Synthetic
ccagggaagcccccggaaaatggtgagaagcagaagaaccccttacttaaacctgtgataggtcgtgcaaatatg

SEQ ID NO: 249368 - DNA, 75 bp, Artificial Sequence
  Synthetic
caggaagtatcataagtttatggtggaaacagctattaattacaagcctcgatctagttgtactgttttaaatct

SEQ ID NO: 249369 - DNA, 75 bp, Artificial Sequence
  Synthetic
aaagtagaagaggttattgatgtcaacccagatataggagtagggaagaacaattttcatagcgcgaagaaagag

SEQ ID NO: 249370 - DNA, 75 bp, Artificial Sequence
  Synthetic
caatgatatagacaggccacttaattccacattgtacatagatttggaagattctgtacctgtaaatggctggga

SEQ ID NO: 249371 - DNA, 75 bp, Artificial Sequence
  Synthetic
ttgtttattgaacctctagatccagccaagaccaacgccaccaggttcataccagaaaatgatgccattacatct

SEQ ID NO: 249372 - DNA, 75 bp, Artificial Sequence
  Synthetic
atcacacaagtataggcgtgtcgggattaactcaacatctggttataaagccctagaactgtactctataataga

SEQ ID NO: 249373 - DNA, 75 bp, Artificial Sequence
  Synthetic
caaacacttagagcgatagtcataaatagaataaaagatcaagaacttaaagacgcctttctagcaaagataagc

SEQ ID NO: 249374 - DNA, 75 bp, Artificial Sequence
  Synthetic
aagatactacactcccaactctccacgtttatttgtgggagaaggttcaggggcaatgatgagtgtatacttcaa

SEQ ID NO: 249375 - DNA, 75 bp, Artificial Sequence
  Synthetic
aatgacttagattatacacagctgaagattactcatgatcagataaaggaagcattacaagctggattatagcca

SEQ ID NO: 249376 - DNA, 75 bp, Artificial Sequence
  Synthetic
attactagggaaggcaattaactactataactcagggattagtgagttggaagttgtagggcagagagagctaag

SEQ ID NO: 249377 - DNA, 75 bp, Artificial Sequence
  Synthetic
ttgaagttctgcagtgctaataataagcgtaaggtattaattaacagtattctttgctctttattatttgaatca

SEQ ID NO: 249378 - DNA, 75 bp, Artificial Sequence
  Synthetic
gttgtaccctgcagaggcttgtatagtggatcataacatgggagaagagtatggccttcttcaatccatcatacc

SEQ ID NO: 249379 - DNA, 75 bp, Artificial Sequence
  Synthetic
ctatatggttacacagctcattgtgcaatgcttcatgaaccgcacccctatatatatcataaaaaacttaggagt

SEQ ID NO: 249380 - DNA, 75 bp, Artificial Sequence
  Synthetic
attattcaatggaagacctgaaacaacttggataggcaacatggattgctttgtccatatcatgagaatgattaa

SEQ ID NO: 249381 - DNA, 75 bp, Artificial Sequence
  Synthetic
caagaaatgatcagcaacagaattcgacaaaaagacgaccatcatggaggctacttctgatttcaaggacgcaac

SEQ ID NO: 249382 - DNA, 75 bp, Artificial Sequence
  Synthetic
gagtcatagtcttgggttagtgcatagtgacatggagagtggtttggacaaggaaagtataactatacttaatga

SEQ ID NO: 249383 - DNA, 75 bp, Artificial Sequence
  Synthetic
atggcaggatggaggattgttaaaatcgattgatgccgagttagatgaacaaggatatatgattcctaaatacag

SEQ ID NO: 249384 - DNA, 75 bp, Artificial Sequence
  Synthetic
gcatagtcatctactctctcttgcaatcaacctgttgagattcgatggcatacttgtgtctaagattaatccctc

SEQ ID NO: 249385 - DNA, 75 bp, Artificial Sequence
  Synthetic
ggtgatcaatccaggagggaacgagaggaagacaatgggatatatgtacctgattgcttatggatttgtcgagga

SEQ ID NO: 249386 - DNA, 75 bp, Artificial Sequence
  Synthetic
atcatcattccctttaactgcattgttcaacatgtataaggcttgtttcgtagatattaaaattgcattacccaa

SEQ ID NO: 249387 - DNA, 75 bp, Artificial Sequence
  Synthetic
tgtccttaatgatcataaaactcaacaaaagccgaagattaggactgtagcagcatacccctttggtgtgggctc

SEQ ID NO: 249388 - DNA, 75 bp, Artificial Sequence
  Synthetic
atatagtaatcctaattctactgaatgttatttaatttgcacacagcctcggatcttgactgttgttaccccgga

SEQ ID NO: 249389 - DNA, 75 bp, Artificial Sequence
  Synthetic
atcagattcatcaccagaagacctgttgaagagtgcctgtgctctagatgtctctgtgagaaggacagcaggggc

SEQ ID NO: 249390 - DNA, 75 bp, Artificial Sequence
  Synthetic
aattattttagaacacagcatagacaaacccgaagattgcaataaatcagtcctcaattatatcttgatactcaa

SEQ ID NO: 249391 - DNA, 75 bp, Artificial Sequence
  Synthetic
aacagaaaagatagtcatgggtgctaggggtacgctaggttgcttggcaccttggtcatctgttctcaacaatgg

SEQ ID NO: 249392 - DNA, 75 bp, Artificial Sequence
  Synthetic
atttagaataggtatatccttcgaagatagagggagaagtgtttgcgacgggaagattgtcggagatatgtctca

SEQ ID NO: 249393 - DNA, 75 bp, Artificial Sequence
  Synthetic
tgccatattcaatgcatcgaagatttgcaacaatgtggatttaatccaattaggtacacctcagagattaaggat

SEQ ID NO: 249394 - DNA, 75 bp, Artificial Sequence
  Synthetic
tgggatagtagaatacaagagatccggatcagacagaattgaactaacagggcaagtaaaggccaacatttgtga

SEQ ID NO: 249395 - DNA, 75 bp, Artificial Sequence
  Synthetic
cttcttcttatcaattacattattgactgataaggggatctacaaaatacctaaaactgtgctcgagtttcgcga

SEQ ID NO: 249396 - DNA, 75 bp, Artificial Sequence
  Synthetic
ctctgataacattactcttataaaccttattcaaggtcttactgaggatgacaagatattattatcttgtggttt

SEQ ID NO: 249397 - DNA, 75 bp, Artificial Sequence
  Synthetic
gagtaatgccgtggcatttaacctattggtgtctctgagaatagacacagatcttacccgagccggaatgaaggg

SEQ ID NO: 249398 - DNA, 75 bp, Artificial Sequence
  Synthetic
atctctcaatggccctaccatttgtcaaaaattattaggatacgatgtgagtggtccgctagaaacaatcctcga

SEQ ID NO: 249399 - DNA, 75 bp, Artificial Sequence
  Synthetic
gattgttgacaaagaggggaggaggttggcaacattcatgctacacatcgggaattttgtgagaaggggaagaaa

SEQ ID NO: 249400 - DNA, 75 bp, Artificial Sequence
  Synthetic
atcatcatttttactcctcaatgaagcattgaatatttacgatggtaatagaatgccttccagtttttttgaacc

SEQ ID NO: 249401 - DNA, 75 bp, Artificial Sequence
  Synthetic
gccctattctatagaatactgtaaaaagaaagtcgaaaacatggccttgatattctcacttggcgctgtcggggg

SEQ ID NO: 249402 - DNA, 75 bp, Artificial Sequence
  Synthetic
atatcctatactggagtccacaagattgacgaggtatatgcacaagtttgtcagaaagatcataggttacaccta

SEQ ID NO: 249403 - DNA, 75 bp, Artificial Sequence
  Synthetic
tcttagccttcatgttagattcactgggaagttgagtaagagactgattgcatctatgaggtttcacagaaacat

SEQ ID NO: 249404 - DNA, 75 bp, Artificial Sequence
  Synthetic
cctcaaatacaacacattggacctgtcattagtcaatcaacatatttcaaacctgaaaaggagatatttgatatt

SEQ ID NO: 249405 - DNA, 75 bp, Artificial Sequence
  Synthetic
atgcttctccctcatggatataaaccctggtttaaataaacttacatggaaccatgagtgtgaaatacagaaaat

SEQ ID NO: 249406 - DNA, 75 bp, Artificial Sequence
  Synthetic
tgatttcaacacttataaacatacaaagattatcccaaattattattacaagcggatcaataaagggaaattcaa

SEQ ID NO: 249407 - DNA, 75 bp, Artificial Sequence
  Synthetic
cacagctgtttttcaaccttcaatacctaaggattttaaaatatatgatgatgtcttaatcgataatacaggtaa

SEQ ID NO: 249408 - DNA, 75 bp, Artificial Sequence
  Synthetic
acagaattggatgataagtttgactaccaaagaaataaagttatggtggaagttaatctcttatgtaccaatatt

SEQ ID NO: 249409 - DNA, 75 bp, Artificial Sequence
  Synthetic
gatattgaaaaattaatagtaatgaaggtcgagataactataaaggtcaattttattctcagtagtaacataccg

SEQ ID NO: 249410 - DNA, 75 bp, Artificial Sequence
  Synthetic
caataagactacataattaatcataccagaaccaaatccaagttatgctaaccctattaataaaaacttaagatc

SEQ ID NO: 249411 - DNA, 75 bp, Artificial Sequence
  Synthetic
atgttactttactttataatctatcttgaaaggatttatcagattagggatcctgtggcagttaaatgcaaccaa

SEQ ID NO: 249412 - DNA, 75 bp, Artificial Sequence
  Synthetic
ccaaatccaagttatgctaaccctattaataaaaacttaagatcaagatttcaattgttgaatccatatattttc

SEQ ID NO: 249413 - DNA, 75 bp, Artificial Sequence
  Synthetic
tgggcataggggcaataaaaatgtgatccataagtatatcaaagtaattgaataatcccatcctttcaattaagt

SEQ ID NO: 249414 - DNA, 75 bp, Artificial Sequence
  Synthetic
taacattgtatatatgattatcccgtcctgtctacagaatcacgatatacctcgtaattgctattccgatcatgg

SEQ ID NO: 249415 - DNA, 75 bp, Artificial Sequence
  Synthetic
gtgctaatagattcttcacttaatggtatgcgggttttaattgaattaatcaaatcagaagacgctgtcattgtt

SEQ ID NO: 249416 - DNA, 75 bp, Artificial Sequence
  Synthetic
gtgatccgatcgataataatgtgatgtactgtattatgctgcttatgtataggtataaattaacatgtgattgtt

SEQ ID NO: 249417 - DNA, 75 bp, Artificial Sequence
  Synthetic
tgtcaaacccaatataaaaaacttaggtgtcaggactatgccattcagcatttacgagactccctacactgcagg

SEQ ID NO: 249418 - DNA, 75 bp, Artificial Sequence
  Synthetic
tagctccactaggtctctcagccatttgcctaggaagaaagtggattataagtgcatcattattgtgtccttatt

SEQ ID NO: 249419 - DNA, 75 bp, Artificial Sequence
  Synthetic
attcatacttggactaacgatcacactaggtttctcatccagttggttgacattggttttcaagaaccctggata

SEQ ID NO: 249420 - DNA, 75 bp, Artificial Sequence
  Synthetic
cgctactgattctaacccacgagatctaccgcctcagacaagaattgacccgactcaaagaatactcattcgaaa

SEQ ID NO: 249421 - DNA, 75 bp, Artificial Sequence
  Synthetic
accagacagataccctttcagaccagggatacctggaagaagcaattgtgagagtagaacagtaccgccatatcc

SEQ ID NO: 249422 - DNA, 75 bp, Artificial Sequence
  Synthetic
gtagtactttgactgacttagaagctgaaccacttaaaacactgataatttttctcgatcaaaccgtactaatac

SEQ ID NO: 249423 - DNA, 75 bp, Artificial Sequence
  Synthetic
ttatctcaactttttggaagaaatacaaagaaactgtcttagagaaatatcctgcctatatatgcatctgttagt

SEQ ID NO: 249424 - DNA, 75 bp, Artificial Sequence
  Synthetic
ctaaatattagagtggtctttacactattggttgtgcttatggactacaggttgattctctttgttctcttggtc

SEQ ID NO: 249425 - DNA, 75 bp, Artificial Sequence
  Synthetic
ttaataacctttcttgtactttattacagctactatttcctagatctacaactggaaagctacccggagcaagta

SEQ ID NO: 249426 - DNA, 75 bp, Artificial Sequence
  Synthetic
actgtttgatagccacacgggggctaattttctgtttaagagataggagatatagtggacccatctgtggttact

SEQ ID NO: 249427 - DNA, 75 bp, Artificial Sequence
  Synthetic
taatttctagattactcttgatatgataagaacaataaattgtatacttttagttataatcatcatattgtatat

SEQ ID NO: 249428 - DNA, 75 bp, Artificial Sequence
  Synthetic
taaacttgtgatattcattgtacttgctctacgaggaatcaattgcatctctctcttaacgggtgagcaatagat

SEQ ID NO: 249429 - DNA, 75 bp, Artificial Sequence
  Synthetic
attgcagcaagccgtactagacaatccagattcacttttagaatagaactatcaggagattcagagaacatacga

SEQ ID NO: 249430 - DNA, 75 bp, Artificial Sequence
  Synthetic
catggcactaaataaaaatatgttcagttcactgttccttggttatctattagtgtacgctacgactgttcagtc

SEQ ID NO: 249431 - DNA, 75 bp, Artificial Sequence
  Synthetic
tagtatacactatgactccttatctaaggtcggtgtcattaagggtctgacatacaactataagatcaagggttc

SEQ ID NO: 249432 - DNA, 75 bp, Artificial Sequence
  Synthetic
gccatctacaaagctaatggtggtcaaattgatacctaacattgatagtgttaaaaactgtactcagaaacagta

SEQ ID NO: 249433 - DNA, 75 bp, Artificial Sequence
  Synthetic
tgatgaatacaagaacttagtaaggaaagccttagaaccggtcaaaatggctattgacaccatgctcaataatgt

SEQ ID NO: 249434 - DNA, 75 bp, Artificial Sequence
  Synthetic
taagtcgggtaataacaagtacagatttgcaggtgcaattatggctggagttgccctcggtgttgcaacagcagc

SEQ ID NO: 249435 - DNA, 75 bp, Artificial Sequence
  Synthetic
cactgttacagcagggatagctctccatagatcaaatgaaaatgcacaggcaattgcaaacatgaagagtgctat

SEQ ID NO: 249436 - DNA, 75 bp, Artificial Sequence
  Synthetic
tcaaaatacaaatgaggcagtaaagcaattgcaattggccaataaacaaacactagctgtgattgacaccataag

SEQ ID NO: 249437 - DNA, 75 bp, Artificial Sequence
  Synthetic
aggagagatcaataacaatataatacccgttataaatcaattgagctgtgacacaattgggctcagtgtaggtat

SEQ ID NO: 249438 - DNA, 75 bp, Artificial Sequence
  Synthetic
aagactcactcagtactactctgaaataataactgcatttgggccagctttgcagaatccagtaaatacaaggat

SEQ ID NO: 249439 - DNA, 75 bp, Artificial Sequence
  Synthetic
taccattcaagcaatatctagtgtgtttaatggcaactttgatgaactgctgaagattatggggtatacaagtgg

SEQ ID NO: 249440 - DNA, 75 bp, Artificial Sequence
  Synthetic
tgatctttatgaaattctacatagtgaattaattagaggcaacattatagacgttgatgtagatgcaggatacat

SEQ ID NO: 249441 - DNA, 75 bp, Artificial Sequence
  Synthetic
agctctagaaatagaattccccaatctaacattggtacctaatgctgtagtacaggagttaatgcctatcagtta

SEQ ID NO: 249442 - DNA, 75 bp, Artificial Sequence
  Synthetic
taacatagacggggatgagtgggtcacacttgtgccaaggtttgtacttacaaggactacactgttatcaaatat

SEQ ID NO: 249443 - DNA, 75 bp, Artificial Sequence
  Synthetic
tgatacgagtagatgtacaatcacagatagtagtgtcatatgtgacaacgactacgccttgcctatgtcacacga

SEQ ID NO: 249444 - DNA, 75 bp, Artificial Sequence
  Synthetic
gcttattggctgcttacagggagatacatctaagtgtgctagagagaaggtagtctcaagttatgtccctaaatt

SEQ ID NO: 249445 - DNA, 75 bp, Artificial Sequence
  Synthetic
tgcgttgtctgatgggttagtgtatgcaaattgcctcaatactatctgccgatgtatggatacagatactccaat

SEQ ID NO: 249446 - DNA, 75 bp, Artificial Sequence
  Synthetic
ctcacaaagtctcggagccactgtatcattactagacaacaagaggtgttcagtatatcaggtaggagatgtctt

SEQ ID NO: 249447 - DNA, 75 bp, Artificial Sequence
  Synthetic
gatttctgtcggatcatatctaggagatggagaatataatgctgataatgtagagcttggcccacctatagttat

SEQ ID NO: 249448 - DNA, 75 bp, Artificial Sequence
  Synthetic
agataagattgacataggaaatcagctggcaggtattaatcaaaccttacaagaggcagaagattacattgagaa

SEQ ID NO: 249449 - DNA, 75 bp, Artificial Sequence
  Synthetic
gtcagaagagttcttaaaaggggttaacccttcaattatcactcttggttccatggttgtcctttatatatttat

SEQ ID NO: 249450 - DNA, 75 bp, Artificial Sequence
  Synthetic
gatattaatagccattgtgtcagtaatagcactagtattgtcaattaaattaacagtaaaaggtaacgtggtaag

SEQ ID NO: 249451 - DNA, 75 bp, Artificial Sequence
  Synthetic
gcagcagttcacgtatactcagcatgttcctagcatggagaatatcaattatgtaagtcattaaagatacagtga

SEQ ID NO: 249452 - DNA, 75 bp, Artificial Sequence
  Synthetic
aacaatctctaagatgattataaatgctctagatcatgttttaatcttatattagattaagttcttgaggtacaa

SEQ ID NO: 249453 - DNA, 75 bp, Artificial Sequence
  Synthetic
tcacactgggtaatgagttaagatactataatcttctagtttagcataattttagatgggcaatatgcgtatgcc

SEQ ID NO: 249454 - DNA, 75 bp, Artificial Sequence
  Synthetic
tattaataaaaacttaggagtcagggtactcaaggacagaccagacccaactcccagcaggatcaactgactctt

SEQ ID NO: 249455 - DNA, 75 bp, Artificial Sequence
  Synthetic
ctcaatcctcaagcaggaaagcaagtagaaaaaaggaaaaggcaccaaggccccaacaaatatggcaacgaatag

SEQ ID NO: 249456 - DNA, 75 bp, Artificial Sequence
  Synthetic
agacaataccatcacatcagcagaggtctcccaagaagataaggttaaaaaatattatggagtggaaactgctga

SEQ ID NO: 249457 - DNA, 75 bp, Artificial Sequence
  Synthetic
gaaggttgccgacagcataagtggtaataaggtattcatattgatgaatacacttctgatactgacaggtgctat

SEQ ID NO: 249458 - DNA, 75 bp, Artificial Sequence
  Synthetic
tattacaataacactaaatatcaccaacctgacagcggctaaaagtcaacagaatatgctgaaaataatccaaga

SEQ ID NO: 249459 - DNA, 75 bp, Artificial Sequence
  Synthetic
tgacgtgaatgccaaattagaaatgttcgtgaatcttgatcaattggtgaagggtgaaattaagccaaaagtgtc

SEQ ID NO: 249460 - DNA, 75 bp, Artificial Sequence
  Synthetic
actcataaatacagcagtgagcgtcagcatacccggtcagatctcaaacctccagaccaaattcctgcaaaaata

SEQ ID NO: 249461 - DNA, 75 bp, Artificial Sequence
  Synthetic
tgtttacttagaagaatctattactaagcagtgcacttgcaaccctttatctgggatatttccaacatcaggccc

SEQ ID NO: 249462 - DNA, 75 bp, Artificial Sequence
  Synthetic
aacctaccctccaactgataaaccagacgatgataccacagatgatgacaaagtggacaccacgattaagcctat

SEQ ID NO: 249463 - DNA, 75 bp, Artificial Sequence
  Synthetic
tgagtaccccaagccggatgggtgcaatagaactggcgaccatttcacgatggagcccggagctaacttttatac

SEQ ID NO: 249464 - DNA, 75 bp, Artificial Sequence
  Synthetic
tgtccctaacctaggaccggcaagttctaattctgacgagtgttacacaaacccctctttttcaattgggtcctc

SEQ ID NO: 249465 - DNA, 75 bp, Artificial Sequence
  Synthetic
catctatatgttttctcaagagattagaaaaacggactgcacagcaggagagatattatcaattcagatcgtctt

SEQ ID NO: 249466 - DNA, 75 bp, Artificial Sequence
  Synthetic
aggccgaatagtagacaagggtcagcagggtcctcaagcatcacccttattagtatgggccgtcccaaatccaaa

SEQ ID NO: 249467 - DNA, 75 bp, Artificial Sequence
  Synthetic
gatcataaactcgtgtgctgtcgcagctggagacgagatgggatgggtgttatgctcagtgacattaactgcagc

SEQ ID NO: 249468 - DNA, 75 bp, Artificial Sequence
  Synthetic
atcaggggagcccatacctcacatgtttgatgggttctggttgtataagttagaacctgacaccgaagttgtatc

SEQ ID NO: 249469 - DNA, 75 bp, Artificial Sequence
  Synthetic
ctatagaatcacaggctatgcttatctcttagataaacaatatgactctgtctttataggtaagggcggtggtat

SEQ ID NO: 249470 - DNA, 75 bp, Artificial Sequence
  Synthetic
tcagaaaggtaacgatctatactttcagatgtatggattgtccagaaataggcaaagttttaaggcactgtgtga

SEQ ID NO: 249471 - DNA, 75 bp, Artificial Sequence
  Synthetic
acatggatcatgcctcggcactggaggtggagggtatcaagtgttgtgtgacagggctgtgatgtctttcgggag

SEQ ID NO: 249472 - DNA, 75 bp, Artificial Sequence
  Synthetic
tgaagaatcactaattacaaatgcatatctgaaggtgaatgatctggcaagtgggaaacctgtgataataggaca

SEQ ID NO: 249473 - DNA, 75 bp, Artificial Sequence
  Synthetic
gacatttccgccctcagattcttataaaggctcaaatggtcggatgtacactataggtgataaatatggtctgta

SEQ ID NO: 249474 - DNA, 75 bp, Artificial Sequence
  Synthetic
tcttgctccgtcatcctggaacagatatcttagatttgggataacaccagatatttctgtaagatcaacaacctg

SEQ ID NO: 249475 - DNA, 75 bp, Artificial Sequence
  Synthetic
gttgaaaagtcaagatccgataatgaagattttgtcaacatgcacgaacactgatagagatatgtgtcctgaaat

SEQ ID NO: 249476 - DNA, 75 bp, Artificial Sequence
  Synthetic
ttgcaatactagaggttatcaagatatttttccattgtcggaggattcagagtattatacatacataggcataac

SEQ ID NO: 249477 - DNA, 75 bp, Artificial Sequence
  Synthetic
tcctaataatggtggaactaaaaactttgtggccgtacgtgactcagatggtcatatagcatccattgatatttt

SEQ ID NO: 249478 - DNA, 75 bp, Artificial Sequence
  Synthetic
acaaaattattatagtatcacctcagctactataagctgcttcatgtacaaagatgagatttggtgtattgcaat

SEQ ID NO: 249479 - DNA, 75 bp, Artificial Sequence
  Synthetic
cacagaagggaaaaaacagaaagacaatcctcaacggatatatgcacattcttacaaaattaggcaaatgtgtta

SEQ ID NO: 249480 - DNA, 75 bp, Artificial Sequence
  Synthetic
taatatgaagtctgccacagtgactgtgggtaatgccaaaaatatcacaatcaggaggtattaaagtttaatgat

SEQ ID NO: 249481 - DNA, 75 bp, Artificial Sequence
  Synthetic
ttaagttaaattatcaaaaggcctcagggatgttcatcttgttaattagttgtctaggaatcgagtcacctataa

SEQ ID NO: 249482 - DNA, 75 bp, Artificial Sequence
  Synthetic
tgagatcatgcaaatacgattatcataatacttgagacaagagattctgtgaagacaaaataaggcgactcaatc

SEQ ID NO: 249483 - DNA, 75 bp, Artificial Sequence
  Synthetic
agtgctgcttaaattcatctctctgatgttcagagaagtataggagcaagactaatgtgactattatgtgcaagg

SEQ ID NO: 249484 - DNA, 75 bp, Artificial Sequence
  Synthetic
actcacaagtagtctcattattgttccacaaagataatatttcctaatcatttttgacctgttgatacctctatt

SEQ ID NO: 249485 - DNA, 75 bp, Artificial Sequence
  Synthetic
ggtcttagtgataatatgacattacggatcagtttgggattaataaatgtcatgatcaagagtagatctcagatt

SEQ ID NO: 249486 - DNA, 75 bp, Artificial Sequence
  Synthetic
aattcatggtatcaggtggtggttgtagggtgcttagtcatgaatcagggtcatatattcagattttaggtgcac

SEQ ID NO: 249487 - DNA, 75 bp, Artificial Sequence
  Synthetic
ataatgtttgctacatatagcaatcggtgtcttcatttaaactaattaatctactttaatggtatatttaggtta

SEQ ID NO: 249488 - DNA, 75 bp, Artificial Sequence
  Synthetic
caaaaaacttaggattcacggatccaacagatatcacatcgttcaccgatgccagcctgcatccatagcatcaaa

SEQ ID NO: 249489 - DNA, 75 bp, Artificial Sequence
  Synthetic
acaagagtagaggagaggggagagaacccacgaaacacgaaacccgagctagaggagacaaccccatgatcagac

SEQ ID NO: 249490 - DNA, 75 bp, Artificial Sequence
  Synthetic
cacgacgagctaggttcttagattgacacgacctgattcgggattggggcagtacaaaacaccactgaagaaact

SEQ ID NO: 249491 - DNA, 75 bp, Artificial Sequence
  Synthetic
aatcataatgaacttcagtgatgtttcggtctctgacatactctaccccgaatgtcatcttaatagtcctattgt

SEQ ID NO: 249492 - DNA, 75 bp, Artificial Sequence
  Synthetic
gacagggaaaatcgttcaagtagtcagatttagtgatattccatgtaaccaaattcttattgaccctactctgaa

SEQ ID NO: 249493 - DNA, 75 bp, Artificial Sequence
  Synthetic
cgagataattgatattaagctgaagtcaaataaaccaggcctaatcaggcggagacaaaaggagtatggtatcct

SEQ ID NO: 249494 - DNA, 75 bp, Artificial Sequence
  Synthetic
attgaagcaagtggcaggggacattacatcttaccagcatatcccatatccagaatgcaataccagattattcta

SEQ ID NO: 249495 - DNA, 75 bp, Artificial Sequence
  Synthetic
tatatccgattcgagtttggtttgttgtctttcagagattatgactcatgctaaccagtgctatttgaaaatatc

SEQ ID NO: 249496 - DNA, 75 bp, Artificial Sequence
  Synthetic
ttctaaaatactagatcttcttgataaaaccgaatgtaacttaacaggaattggatcacgagatgatgatgaaac

SEQ ID NO: 249497 - DNA, 75 bp, Artificial Sequence
  Synthetic
aaggattatatataataatgtggagaccttacctaagatcatggctcagagtaaatggtataagcctttcttatt

SEQ ID NO: 249498 - DNA, 75 bp, Artificial Sequence
  Synthetic
ttggttcactgtcaaaactgagatgaggaacaatatcaaggagaataaaaagtattcaagacacaatcgtcccca

SEQ ID NO: 249499 - DNA, 75 bp, Artificial Sequence
  Synthetic
tataactcaattgagtggcaaacttatatatgtacaactaaatatgaacctaatatcaataatcgaatgggagaa

SEQ ID NO: 249500 - DNA, 75 bp, Artificial Sequence
  Synthetic
aaaatgtatataccatctcacacctgaattagtactgatgtactgtgatgtcatagaaggaagactaatgattga

SEQ ID NO: 249501 - DNA, 75 bp, Artificial Sequence
  Synthetic
tactgtgatgaaagctgacaccagatatcatccactctacaatcgagctcatcaactgtgggacttattagattt

SEQ ID NO: 249502 - DNA, 75 bp, Artificial Sequence
  Synthetic
gatgtttgaggagattggaaataacatgtacaacattatttcattgattgagcctttgacattaggaatattgca

SEQ ID NO: 249503 - DNA, 75 bp, Artificial Sequence
  Synthetic
actacaggataaagcagttgctttggtagggagttttttgtcattttgtatcagtgaaattcgaagtgagttggt

SEQ ID NO: 249504 - DNA, 75 bp, Artificial Sequence
  Synthetic
gaagaatgggttccatgatgaacaagatattgaagattttacaagtcgtataatcaacatcatgtctcttccaga

SEQ ID NO: 249505 - DNA, 75 bp, Artificial Sequence
  Synthetic
tattcatcttgtagctgagtttttctccttcttcagaacatttggacacccaacattagaagctcttactgctgc

SEQ ID NO: 249506 - DNA, 75 bp, Artificial Sequence
  Synthetic
agaaaaagttagaactcatatgcagaagcctaaaatacttgattttcttcctatcatgaaagcccatgctatctt

SEQ ID NO: 249507 - DNA, 75 bp, Artificial Sequence
  Synthetic
ctgtggaatcataataaatggataccgagaccggcacgggggggcatggccacctgtaatattccctgaacacgt

SEQ ID NO: 249508 - DNA, 75 bp, Artificial Sequence
  Synthetic
ttctgtcctgatcaagaggttgcacaatagtagtgaagctttaacacatgaaatttgctgccaggagtggaaatc

SEQ ID NO: 249509 - DNA, 75 bp, Artificial Sequence
  Synthetic
acgcttaacaacaaaatcaaagaagacacagacagtatcagtgacctaaacaaaatgtaacactcctacaatgga

SEQ ID NO: 249510 - DNA, 75 bp, Artificial Sequence
  Synthetic
gagcattcagattcaaactgagctaactgttccatctagttcagacaatgagggtctgcgagatccccggtgtat

SEQ ID NO: 249511 - DNA, 75 bp, Artificial Sequence
  Synthetic
caaaatgtaacactcctacaatggagtctgacaagattgtgttcaaggtgaataaccaagttgtttctttgaagc

SEQ ID NO: 249512 - DNA, 75 bp, Artificial Sequence
  Synthetic
gcatgagcaaaaggataagaaaggccacactactgatcaagatggggtctcagatattgagtcagctcctgacaa

SEQ ID NO: 249513 - DNA, 75 bp, Artificial Sequence
  Synthetic
cagaggtcatatcggatcaatatgagtacaaatatcccgccattttagatggaaagaaaccagggataactttag

SEQ ID NO: 249514 - DNA, 75 bp, Artificial Sequence
  Synthetic
ggaagagattcgtgatatagagggagaagttgcccatcaggtcgcggaaagcttttcaaagaaatacaaattccc

SEQ ID NO: 249515 - DNA, 75 bp, Artificial Sequence
  Synthetic
ggaaaacgcctgatctgaacactgcatacaagtccatcctgtcaggtatgaaagccgcgaagcttgacccagatg

SEQ ID NO: 249516 - DNA, 75 bp, Artificial Sequence
  Synthetic
ttctagatcctcgggaatattcttatggaacttcgagcagctcaagatgaatttggatgatattgtgaaggcggc

SEQ ID NO: 249517 - DNA, 75 bp, Artificial Sequence
  Synthetic
atgtttgctcttacttggcagccgctatgcatctcttcgagggggtttgccccgaggactgggtcagttatggaa

SEQ ID NO: 249518 - DNA, 75 bp, Artificial Sequence
  Synthetic
catgaatgtgcctggtgttgagaagatagccgagaagggaggcaagcttcccttgagatgtattttgggatttgt

SEQ ID NO: 249519 - DNA, 75 bp, Artificial Sequence
  Synthetic
ttgtcattgcaaagaagggggagaaaatcaaccctagcgtgattgttgatatagttcgaaccaatgttgagggga

SEQ ID NO: 249520 - DNA, 75 bp, Artificial Sequence
  Synthetic
ggcattagactcctcaaagagatttaggcttcttgccaacaacgacaaagtggccagactcatacaagatgatat

SEQ ID NO: 249521 - DNA, 75 bp, Artificial Sequence
  Synthetic
attgggctcaagctggaggaatggatgtgatcagagaccctacaacagcagagcatgcgtcattggttggactgc

SEQ ID NO: 249522 - DNA, 75 bp, Artificial Sequence
  Synthetic
caacagttacatggcccggcttgaggatgcagaatagaagctgtccggactagtgtagtccagtcttgaaatgaa

SEQ ID NO: 249523 - DNA, 75 bp, Artificial Sequence
  Synthetic
tgctatgtctttatcgattgagcaagatagtcggccagaacacagcaaactataaaactaatgtggctgacagaa

SEQ ID NO: 249524 - DNA, 75 bp, Artificial Sequence
  Synthetic
aaaaacatgtaacatccctaaaaagatgaatttcctaaagaagatggtcagaagctgcaaggatgaagagaccca

SEQ ID NO: 249525 - DNA, 75 bp, Artificial Sequence
  Synthetic
tggagcaaatatttgagactgctccttttgcaaaggtggtggaacatcatacattgatgactactcataaaatgt

SEQ ID NO: 249526 - DNA, 75 bp, Artificial Sequence
  Synthetic
gaagtatccatcagcaacggcacctccagacgatgatgacctttggatgcctccgccggagtatgtccctttaac

SEQ ID NO: 249527 - DNA, 75 bp, Artificial Sequence
  Synthetic
gtgctaactggagcactatacccaacttcagattcttggtaggtacatatgatatgttttttgcaagggtcgaac

SEQ ID NO: 249528 - DNA, 75 bp, Artificial Sequence
  Synthetic
tcaggttaaaggcaaagccagcttaaggaacttttgcatcagtggggaagtcaagatatgtagtccaaacggata

SEQ ID NO: 249529 - DNA, 75 bp, Artificial Sequence
  Synthetic
atatatattctgctctcagagttggaacagtggtgacagcatatgaggattgctctgggttggtctccttcaccg

SEQ ID NO: 249530 - DNA, 75 bp, Artificial Sequence
  Synthetic
ctcctttaagatactcaggcatattttaaagtcttttgacaacgtttactccgggaacaggaggatgatagggtt

SEQ ID NO: 249531 - DNA, 75 bp, Artificial Sequence
  Synthetic
ggtttatcaaacagatcaatctatctcctcgagatgcactgctctacttcttccataaaaactttgaaggagaga

SEQ ID NO: 249532 - DNA, 75 bp, Artificial Sequence
  Synthetic
agtcaaggtagtcatagggcttgtgctttcagggtccctagtcccagagggaatgaactgggtttataaactgcg

SEQ ID NO: 249533 - DNA, 75 bp, Artificial Sequence
  Synthetic
taaagaggatgttcgagccagggcaagaaactgcagttccccattcatacttcattcattttagagcgcttggct

SEQ ID NO: 249534 - DNA, 75 bp, Artificial Sequence
  Synthetic
tagaaccttaatatttcagtgggcagagtcgtatggaccattggaaggggaagaacttgagtactcacaagaaat

SEQ ID NO: 249535 - DNA, 75 bp, Artificial Sequence
  Synthetic
tgagtggcaaatccccatactcttccaatgctgtagggcacacttttaatctaattcactttgtaggatgctata

SEQ ID NO: 249536 - DNA, 75 bp, Artificial Sequence
  Synthetic
tacatgggatgatgaggcagagtttgtaggcctgcaaatcagagtgagcgccagacaatgtcacatccagggtcg

SEQ ID NO: 249537 - DNA, 75 bp, Artificial Sequence
  Synthetic
tgggtcagatcaggtctctaaacgcaacagtgattcaaacatgtgcacctcatgaaatgtcagtcctggggggat

SEQ ID NO: 249538 - DNA, 75 bp, Artificial Sequence
  Synthetic
cctctggtgcataaacatgaactcaagggcgtgtcagttatgggcagatatgattttaaagacccaacaatcacc

SEQ ID NO: 249539 - DNA, 75 bp, Artificial Sequence
  Synthetic
atctgggagaagaattctttgggaagggcaccttcgaaaggaggtttttcagagacgaaaaagagatgcaagatt

SEQ ID NO: 249540 - DNA, 75 bp, Artificial Sequence
  Synthetic
ggacgatgaaaacacctcacttttattggaataaactctagcctgtagctttgtctctcagctgttacctctgtt

SEQ ID NO: 249541 - DNA, 75 bp, Artificial Sequence
  Synthetic
atacagagttggaggaggccagagtagaagcttcactcgctgatgatggaactgtagactccgatgaggaagatt

SEQ ID NO: 249542 - DNA, 75 bp, Artificial Sequence
  Synthetic
tgcagtagagaaaaaccgcgagcaatagaacaattaccgcaatggtgcccgctttcagcacaataaatataaccc

SEQ ID NO: 249543 - DNA, 75 bp, Artificial Sequence
  Synthetic
tcttctctggagagactaggagtcctgaggcagtttatagtaggataatgatgaatggtggcaagttgaagaaag

SEQ ID NO: 249544 - DNA, 75 bp, Artificial Sequence
  Synthetic
accaacaagtttgtcttcctattcagggttgagcaaagacgtgaaaaaaactacatgaaaaggcacaacagccct

SEQ ID NO: 249545 - DNA, 75 bp, Artificial Sequence
  Synthetic
ttcatatacgtaggtatattgcagtgagctctaatcatcaagctagaccgaactcttttgccgaattcttaaaca

SEQ ID NO: 249546 - DNA, 75 bp, Artificial Sequence
  Synthetic
ctcactgccatcatgaacctaccctgtctgactgtgatcctcattttattcactaaatattccctgggagaattt

SEQ ID NO: 249547 - DNA, 75 bp, Artificial Sequence
  Synthetic
aggtgtatgcagatgggtcataatccgagggcttcttggaaaacgagggtctacagatgagtagggttgtgggac

SEQ ID NO: 249548 - DNA, 75 bp, Artificial Sequence
  Synthetic
cccttgtacacaattccggaaaagatagagaaatggacccctatagacatgatccacctaagttgccctaacaac

SEQ ID NO: 249549 - DNA, 75 bp, Artificial Sequence
  Synthetic
agattccaagaaaaaaacttaacaccactctttgattcgtggtgtcaaaatgagcaaagatttggttcatcctag

SEQ ID NO: 249550 - DNA, 75 bp, Artificial Sequence
  Synthetic
ctgctgtctcaagaagagggctgcaatgcagagacgcccttcacttacttcgagctcaagagtggttacttagct

SEQ ID NO: 249551 - DNA, 75 bp, Artificial Sequence
  Synthetic
tcttatcagggcagggatagtggaactcgaaatggcagaagagaccactgatctgatcaacaggaccatagagag

SEQ ID NO: 249552 - DNA, 75 bp, Artificial Sequence
  Synthetic
catcagaaagtacagggattcacgtgtaccggggttgtgaatgaggcagagacatacacaaactttgtcggatat

SEQ ID NO: 249553 - DNA, 75 bp, Artificial Sequence
  Synthetic
caatcaagctcacctccagggcgagccattttatgttgattcattgcctgaagatatgagcaagttgagaataga

SEQ ID NO: 249554 - DNA, 75 bp, Artificial Sequence
  Synthetic
gtcaccacaaccttcaagagaaagcactttaggcctacagttgctgcatgtcgtgatgcatacaactggaaagtg

SEQ ID NO: 249555 - DNA, 75 bp, Artificial Sequence
  Synthetic
ggaccaatctggtaggactaaaacagaagaaggcgagggagatgaagatagctctgaggaggatgactatctgtt

SEQ ID NO: 249556 - DNA, 75 bp, Artificial Sequence
  Synthetic
tccggagaccccaggtatgaggaatcactacacacaccgtaccctgacagtagctggttaagaactgtgaccaca

SEQ ID NO: 249557 - DNA, 75 bp, Artificial Sequence
  Synthetic
tgagggacaagacccgttaattctctttcagaatttccttgacgaaattggggccaaagcagtaaagaagttaaa

SEQ ID NO: 249558 - DNA, 75 bp, Artificial Sequence
  Synthetic
accaaagaatcccttcttataatatcacccagcatcgtggaaatggatatatacggcaggactctacattctccc

SEQ ID NO: 249559 - DNA, 75 bp, Artificial Sequence
  Synthetic
gactggtgagggattcttcagggtgtggtctgctctgtcagatgacatcaaggggtatgtatctacccatataat

SEQ ID NO: 249560 - DNA, 75 bp, Artificial Sequence
  Synthetic
atgtttccgtcagggacatgttcaaagctctatccctctgtcccatcatgtaagactaatcatgattatacttta

SEQ ID NO: 249561 - DNA, 75 bp, Artificial Sequence
  Synthetic
gacacatagggcgaaaaatactaagagtatacaaattcaaacagaaccagcggcatcatctagccctggaggtgc

SEQ ID NO: 249562 - DNA, 75 bp, Artificial Sequence
  Synthetic
tggttgccggaagatcctagtctgagtttgatctgtgatatcttcacctcaagcaacggacagaaggccatgaac

SEQ ID NO: 249563 - DNA, 75 bp, Artificial Sequence
  Synthetic
ggttctgcaggattccaggagcaaggatgacccaaatgacaaaaaagatcataccgccgatcatgatgtggtctc

SEQ ID NO: 249564 - DNA, 75 bp, Artificial Sequence
  Synthetic
gggtctcgcatctgcggattcaaggatgaaaggggattttacagatctttgaaaggtgcttgcaagctgacgttg

SEQ ID NO: 249565 - DNA, 75 bp, Artificial Sequence
  Synthetic
agatgttgagtcagctattgacaaagacgagagccgagatatagagggagaagtcgctcatcaagttgcggaaag

SEQ ID NO: 249566 - DNA, 75 bp, Artificial Sequence
  Synthetic
tgtgggaaaccaggaatcagactgttcgacggaacctgggtctcctttgcaaggccggatgttcatgtatggtgt

SEQ ID NO: 249567 - DNA, 75 bp, Artificial Sequence
  Synthetic
cttttcaaagaaatacaaattcccttctagatcttcgggaatcttcctatggaactttgagcagctcaaaatgaa

SEQ ID NO: 249568 - DNA, 75 bp, Artificial Sequence
  Synthetic
actcctaaccaattggtgaatatccacaatgacagactagatgagattgaacacctaattgtggaagatatcatc

SEQ ID NO: 249569 - DNA, 75 bp, Artificial Sequence
  Synthetic
tctggatgatattgtgaaagcggccatgaatgtgccaggggttgaaaagatagcagaaaagggagggaagctccc

SEQ ID NO: 249570 - DNA, 75 bp, Artificial Sequence
  Synthetic
aagagaagagaagaatgtttagacactctggagacaatactcatgtctcaatcaattagctttagacgattgagc

SEQ ID NO: 249571 - DNA, 75 bp, Artificial Sequence
  Synthetic
tttgagatgtattttgggatttgtggcattagactcttcaaaaagatttagacttcttgcaaacaacgacaaggt

SEQ ID NO: 249572 - DNA, 75 bp, Artificial Sequence
  Synthetic
catttcagaaagttagttccaggatatggaaaagcctacaccgttttgaacggcagcttgatggaaacgaatgtc

SEQ ID NO: 249573 - DNA, 75 bp, Artificial Sequence
  Synthetic
agcaagactcatacaagatgatatcaacagttacatggcccggcttgaggaggcggaatgaaggatgtaatgacc

SEQ ID NO: 249574 - DNA, 75 bp, Artificial Sequence
  Synthetic
tactacaagagggtagacaagtggactgacattttgccttctaaagggtgtctaaaggtaggacagcaatgcatg

SEQ ID NO: 249575 - DNA, 75 bp, Artificial Sequence
  Synthetic
cacaaaaatccatgaattgggcagccctgtcttgaagtgaaaaaaacatgtaacatccctaaaaagatgaacttc

SEQ ID NO: 249576 - DNA, 75 bp, Artificial Sequence
  Synthetic
gaccctgtcaaaggagtcttcttcaacggaattatcaagggtcctgatggccagatactaattccagagatgcaa

SEQ ID NO: 249577 - DNA, 75 bp, Artificial Sequence
  Synthetic
ctcaagaggatggtcaaaagctgcaaagatgaggagacccagaagtatccaccagcatcggcgcctccagacgat

SEQ ID NO: 249578 - DNA, 75 bp, Artificial Sequence
  Synthetic
tccgagcagctcaaacagcatatggacttgttaaaagcagctgtgtttcctcttcgccaccctttaatcgacaga

SEQ ID NO: 249579 - DNA, 75 bp, Artificial Sequence
  Synthetic
gatgacctttggatgcctccgcctgagtatgtccctttaactcaggttaagggcaaggctagtataagaaacttt

SEQ ID NO: 249580 - DNA, 75 bp, Artificial Sequence
  Synthetic
ggagcggtatttaaaaaggacggagatgcagatgattttgtggacctccacatgcctgacgttcacaaatccgtg

SEQ ID NO: 249581 - DNA, 75 bp, Artificial Sequence
  Synthetic
tgcatcagtggggaggttaagatatgtagtcctaacgggtactctttcaagatactcaggcatattctgaagtct

SEQ ID NO: 249582 - DNA, 75 bp, Artificial Sequence
  Synthetic
tcagatgttgatctgggcttgcctcactgggggctctggctgatgatcggggcggcagtagtggcatttatggtc

SEQ ID NO: 249583 - DNA, 75 bp, Artificial Sequence
  Synthetic
tttgacaacatttactctgggaacagaaggatgatcggattagtcaaggtggttatagggctcgtgctttcagga

SEQ ID NO: 249584 - DNA, 75 bp, Artificial Sequence
  Synthetic
ctaatctgcctgctccgtgtatgttgtaaaagagtgggaagaagaagatcaccacatgcgactcaggagatcccc

SEQ ID NO: 249585 - DNA, 75 bp, Artificial Sequence
  Synthetic
tccccaatcccagagggcatgaactgggtttataaacttcgtagaaccctaatctttcagtgggtcgagtcatat

SEQ ID NO: 249586 - DNA, 75 bp, Artificial Sequence
  Synthetic
ctcagtgtttcctctgcccctgtccctcgagccaaagtggtgtcatcatgggagtcatacaaagggctccctggt

SEQ ID NO: 249587 - DNA, 75 bp, Artificial Sequence
  Synthetic
ggacccttggaaggggaagagctggagtactcacaagaaattacatgggatgatgaggcagagtttgtaggccta

SEQ ID NO: 249588 - DNA, 75 bp, Artificial Sequence
  Synthetic
acatgatacttctatcagattgcctgatacatagctcacaacctggttacctgcctcggcacgataacaatcaat

SEQ ID NO: 249589 - DNA, 75 bp, Artificial Sequence
  Synthetic
caaatcagagtgagcgccagacagtgtcacatccagggtcgtctctggtgcataaacatgaactcaagagcatgc

SEQ ID NO: 249590 - DNA, 75 bp, Artificial Sequence
  Synthetic
cacatggtgtcaagtcttcgttcataccctccactgtataatgattcatggagggctgcttgtcaatcggggatg

SEQ ID NO: 249591 - DNA, 75 bp, Artificial Sequence
  Synthetic
cagttatgggccgatatgatcttgaagacccaacagtccccggatgatgaaaacacctcacttttattagaataa

SEQ ID NO: 249592 - DNA, 75 bp, Artificial Sequence
  Synthetic
gtgttctctcatgcactccgttacccatgatttagaacccttccttcctcatcttctcactatctctgaatacaa

SEQ ID NO: 249593 - DNA, 75 bp, Artificial Sequence
  Synthetic
agacccaacagtccccggatgatgaaaacacctcacttttattagaataaaatctagcctgcagcttcgtctctc

SEQ ID NO: 249594 - DNA, 75 bp, Artificial Sequence
  Synthetic
aattgttacctctgtttggagtagagaaaaaccgcgagcaatagaacaattactgcaacggtgcccgctttcagc

SEQ ID NO: 249595 - DNA, 75 bp, Artificial Sequence
  Synthetic
tcaatagacgactgggtcttcgggttcctataaagagttgccttctaacatggggtggttcaaatagtattctat

SEQ ID NO: 249596 - DNA, 75 bp, Artificial Sequence
  Synthetic
acaatacatataacctaacaaccagtttgtcttcctcttcaggtttgagcaaaaaagtgaaaaaaactacatgaa

SEQ ID NO: 249597 - DNA, 75 bp, Artificial Sequence
  Synthetic
tgagcctttaataattctgaggtgcggcaatagtcgtttgaactaacctcaaggtctaaatgctcctgttctcca

SEQ ID NO: 249598 - DNA, 75 bp, Artificial Sequence
  Synthetic
aaggtacaacagccctctcactgccatcatgagtacactgtgccttgttgtgatcctcagcttagccactacaca

SEQ ID NO: 249599 - DNA, 75 bp, Artificial Sequence
  Synthetic
ataatgtcacaggggtgtctcattgttctgtataataacaggacgcaatattatgtctgtttgtatcatagagtt

SEQ ID NO: 249600 - DNA, 75 bp, Artificial Sequence
  Synthetic
ttcccttggagactttcccttgtacacaattcccgagaagatagagaaatggactcctatagacttgattcatct

SEQ ID NO: 249601 - DNA, 75 bp, Artificial Sequence
  Synthetic
ttgatttgttatattggagccctagactgtcccgtatgagattatcaatgtgaaaaaaactgcccctaattcaaa

SEQ ID NO: 249602 - DNA, 75 bp, Artificial Sequence
  Synthetic
aagttgccctaacaacctcctgtctgaggaggaaggatgcaatacagagtcatccttcacttactttgagctcaa

SEQ ID NO: 249603 - DNA, 75 bp, Artificial Sequence
  Synthetic
atctacacttcaacacccctcctatttcgtctacaatcatgatggatgtcacggaggtgtatgacgacccgattg

SEQ ID NO: 249604 - DNA, 75 bp, Artificial Sequence
  Synthetic
gagtggttacttagctcatcaaaaggttccagggttcacatgtacaggggtggtgaatgaggcagagacatacac

SEQ ID NO: 249605 - DNA, 75 bp, Artificial Sequence
  Synthetic
accctgtcgaaccagagggagagtggaactgtagtcctgtagtccctaacattttgaggaattctgactacaacc

SEQ ID NO: 249606 - DNA, 75 bp, Artificial Sequence
  Synthetic
aaactttgtggggtatgtcaccacaaccttcaaaaggaagcactttaggcctacagtagccgcttgtcgggatgc

SEQ ID NO: 249607 - DNA, 75 bp, Artificial Sequence
  Synthetic
taaactcccccttgctagaagatcctgccagcctgatgattcaatggctaacatctgggaacagaccctcgagaa

SEQ ID NO: 249608 - DNA, 75 bp, Artificial Sequence
  Synthetic
ctacaactggaaagtgtcaggagaccccaggtacgaagagtcactacacaccccatatcctgacaacagctggtt

SEQ ID NO: 249609 - DNA, 75 bp, Artificial Sequence
  Synthetic
tgaacgtcacagagaacacggctaggtcttacaaagtcttgagagcatttttcaaaggaatggatgttgcaacag

SEQ ID NO: 249610 - DNA, 75 bp, Artificial Sequence
  Synthetic
gaggactgttaccacaaccaaagagtcccttcttatcatatcgcccagcattgtggaaatggatgtgtatagcag

SEQ ID NO: 249611 - DNA, 75 bp, Artificial Sequence
  Synthetic
taaaaatagggggtgtaggggcccaggcaatgatggggttgtgggtcttggggtctcactcagaatcttcccgaa

SEQ ID NO: 249612 - DNA, 75 bp, Artificial Sequence
  Synthetic
gactctccattcacccatgtttccgtcaggaacatgttctaagttatatccctctgtcccttcgtgtaagaccaa

SEQ ID NO: 249613 - DNA, 75 bp, Artificial Sequence
  Synthetic
gcaggaagtgtttagctgacttgtctgccttttatagaaggaccctgcctatagagtctattttaaaccacactt

SEQ ID NO: 249614 - DNA, 75 bp, Artificial Sequence
  Synthetic
tcatgattacacattgtggttgccagaagatcctaatctgagtttggtctgtgatatcttcacttctagtaacgg

SEQ ID NO: 249615 - DNA, 75 bp, Artificial Sequence
  Synthetic
tgatgaacagaggattgcagactcctaaagagggagtgttatctggattaaatagggtcagttatgatcagtctt

SEQ ID NO: 249616 - DNA, 75 bp, Artificial Sequence
  Synthetic
aaagaaagctatgaacgggtcccgcatttgtggattcaaggatgaaagaggattttacagatctttgaagggcgc

SEQ ID NO: 249617 - DNA, 75 bp, Artificial Sequence
  Synthetic
tcggacggtatttaggcaatttgtactcctcttatctcttatttcatgttatcatattatatatgaatgctttgg

SEQ ID NO: 249618 - DNA, 75 bp, Artificial Sequence
  Synthetic
ttgcaagctgacattgtgcgggaaacctggaatcaggctgtttgacggaacttgggtctcttttgtgaagccgga

SEQ ID NO: 249619 - DNA, 75 bp, Artificial Sequence
  Synthetic
attgggaagaagagaagaccattttggctctgtggagagatataacatctatagatgtcagaaatgaccgagtat

SEQ ID NO: 249620 - DNA, 75 bp, Artificial Sequence
  Synthetic
tgttcatgtgtggtgcactcccaaccaattagtcaatatacataatgacagactagacgaggtagaacacttgat

SEQ ID NO: 249621 - DNA, 75 bp, Artificial Sequence
  Synthetic
ccttcaaggaccccttgtgggggaagctattagtgacgaaagattttgtctatgcacacaatagcaactgtttat

SEQ ID NO: 249622 - DNA, 75 bp, Artificial Sequence
  Synthetic
cgtggaggacatcatcaagaaaagagaagagtgcttagacactctagaaacaatactcatgtctcaatcaattag

SEQ ID NO: 249623 - DNA, 75 bp, Artificial Sequence
  Synthetic
tcgacaaaaattatacactgatgctaaaagacttattcttgtcaagattcaactctttgctcatactcgtatccc

SEQ ID NO: 249624 - DNA, 75 bp, Artificial Sequence
  Synthetic
ttttagacgattgagccatttcaggaaactagttccaggatatgggaaggcctatactcttttaaatggcagcct

SEQ ID NO: 249625 - DNA, 75 bp, Artificial Sequence
  Synthetic
cgccagattctcgctactcagatgatctggccgctaatctgtgtagactttacatctcaggtgataagcttcttt

SEQ ID NO: 249626 - DNA, 75 bp, Artificial Sequence
  Synthetic
gatggaaacaaatgtctactacaatagggttgacaagtgggctgacattctgccatccaaagggtgtcttaaagt

SEQ ID NO: 249627 - DNA, 75 bp, Artificial Sequence
  Synthetic
ctgtttgcgggaatgcggggtatgatgtgatcaagatgctggagccttgcgtggtagatctcttagttcaaagag

SEQ ID NO: 249628 - DNA, 75 bp, Artificial Sequence
  Synthetic
cgggcaacaatgcatgaagcctgttaaaggagtcctcttcaatggaattatcaagggccctgatggccagattct

SEQ ID NO: 249629 - DNA, 75 bp, Artificial Sequence
  Synthetic
ccgagacattccgtccattaattcactctcttggggagttccctgccttcataagagataaaacgactcaactaa

SEQ ID NO: 249630 - DNA, 75 bp, Artificial Sequence
  Synthetic
gattcctgagatgcagtcagagcaactcaagcaacatatggacttgttaaaagcagctgtgttccctctccgaca

SEQ ID NO: 249631 - DNA, 75 bp, Artificial Sequence
  Synthetic
taggaacttttggaccatgcgcatcacaattcttctcgatgctccaacaatttgacaatattcatgatttggtat

SEQ ID NO: 249632 - DNA, 75 bp, Artificial Sequence
  Synthetic
ccctttaatcagtggagatgcagtctttaagaaggacggagatgcagatgactttgtggaccttcatatgcctga

SEQ ID NO: 249633 - DNA, 75 bp, Artificial Sequence
  Synthetic
ttgtttacggatgttaccggcactgggggcacccctacatagactatcgaaaagggctttccaagcttttcgatc

SEQ ID NO: 249634 - DNA, 75 bp, Artificial Sequence
  Synthetic
tgtccacaaatctgtatccgatgtcgacctaggcctgccccattgggggttctggctgttgatcggggcaactgt

SEQ ID NO: 249635 - DNA, 75 bp, Artificial Sequence
  Synthetic
aagtccacatgagaaagactatagataaacagtatcaagagcgcctggctagcgatctagcgaggaagatcctgc

SEQ ID NO: 249636 - DNA, 75 bp, Artificial Sequence
  Synthetic
agtagcatttgtggtcttggtatgcttactccgtgtatgttgtaggcgagtgaggatgagaagatcagtacgtga

SEQ ID NO: 249637 - DNA, 75 bp, Artificial Sequence
  Synthetic
gttggggatttgacaagtactccaagtggtatcttgatacaggtgtcattcccaaagaacaccccctcgcccctt

SEQ ID NO: 249638 - DNA, 75 bp, Artificial Sequence
  Synthetic
gactcaagagatccccctaagcatttcatctgcctctgcccctcgagctagagttgtgtcttcatgggagtccta

SEQ ID NO: 249639 - DNA, 75 bp, Artificial Sequence
  Synthetic
atatagccacacaaacatggccacccaagcaagtagtggatctcctaggagactcttggcacactctcccgatga

SEQ ID NO: 249640 - DNA, 75 bp, Artificial Sequence
  Synthetic
taaagggctcccgggtacatgagacctccatcagaatgcctgacatataactcacaaccggattacctgcctcgg

SEQ ID NO: 249641 - DNA, 75 bp, Artificial Sequence
  Synthetic
cacaaatttttgaggttcctgaatctatggacccctctgagattttggatgacaaatctcactcctttaccagga

SEQ ID NO: 249642 - DNA, 75 bp, Artificial Sequence
  Synthetic
cacgacacaactcagcaacatggtatcaaatctcctttcatgccctcccacgtataatgattagcggagggttgc

SEQ ID NO: 249643 - DNA, 75 bp, Artificial Sequence
  Synthetic
caaagctatcaagttggctgtcagaacacagaggaggacctgtaccaagtgagaaagtgataataactgctctgt

SEQ ID NO: 249644 - DNA, 75 bp, Artificial Sequence
  Synthetic
ttgccaatcgggggtggtgtcctctcacacattccgttactcgttcgttgaaatccctccttcttcactgtctaa

SEQ ID NO: 249645 - DNA, 75 bp, Artificial Sequence
  Synthetic
ccaaacccccagtaaaccccagagagttcctcaagtctatagatagagaggggttgccagacgatgatcttatta

SEQ ID NO: 249646 - DNA, 75 bp, Artificial Sequence
  Synthetic
atatctctgaatgcaatcaacagatgattgggtcttctgatttttataaagagtggccttctaacatgggttggt

SEQ ID NO: 249647 - DNA, 75 bp, Artificial Sequence
  Synthetic
taggactcaaaccaaaagaaagggagttaaagatagatgggcgattctttgctctgatgtcctggaatctgaggt

SEQ ID NO: 249648 - DNA, 75 bp, Artificial Sequence
  Synthetic
tcaaacaataatctattgagtcttcaatcattctgaggtgcggcaatattagcttgaactaacctcaaggtctaa

SEQ ID NO: 249649 - DNA, 75 bp, Artificial Sequence
  Synthetic
tgtactttgtgattaccgagaagctattggctaatcacatcatccctcttttcgattcactcacaatgacagaca

SEQ ID NO: 249650 - DNA, 75 bp, Artificial Sequence
  Synthetic
gtgctcctgttttctaataatatcacaggagcgtctagctgttctgtatgataacaggacgccatatgatgtttc

SEQ ID NO: 249651 - DNA, 75 bp, Artificial Sequence
  Synthetic
atctcaataaagtgtttaaaaagctgatagacagagtcaccggtcaagggcttaaagactactctcgcgtcacct

SEQ ID NO: 249652 - DNA, 75 bp, Artificial Sequence
  Synthetic
tttgtattgtaggatgttgattcgtcagattgtggccctagaccgtctcatgtgatgttgtcaatgtgaaaaaaa

SEQ ID NO: 249653 - DNA, 75 bp, Artificial Sequence
  Synthetic
atgcattccatttagactatgagaaatggaacaaccaccagagattagagtcaacaagggatgtattctctgttc

SEQ ID NO: 249654 - DNA, 75 bp, Artificial Sequence
  Synthetic
catgcccccttgtcaaagtcaacacatcaacactcctcctatctcagtggtaaccatgatggatgttactgaggt

SEQ ID NO: 249655 - DNA, 75 bp, Artificial Sequence
  Synthetic
tcgacagggcgttcggactgaagaaggtattctctaggacacatgagtttttccaaaagtcctggatatattact

SEQ ID NO: 249656 - DNA, 75 bp, Artificial Sequence
  Synthetic
gtatgacgacccgatagaccctgtcgaaccagaaggagagtggaacaacagtcccgtagtcccgaacattctgcg

SEQ ID NO: 249657 - DNA, 75 bp, Artificial Sequence
  Synthetic
cagacagatcagatcttatagggatttggaaggaccagatctattgtctagacatgactgaaggccctatttgct

SEQ ID NO: 249658 - DNA, 75 bp, Artificial Sequence
  Synthetic
aaactctgactacaacctaaactctcctttgctagaagaccccgcaaacctgatgattcagtggctaacatccga

SEQ ID NO: 249659 - DNA, 75 bp, Artificial Sequence
  Synthetic
ggaatggtcaagacggaggtttggagggtctacggcaaaaaggatggagcttggtgagccttctaatgattgaga

SEQ ID NO: 249660 - DNA, 75 bp, Artificial Sequence
  Synthetic
gaacaggccctatagaatgaatgtcacagagaacacaaccaggtcttacaaagtcttgaaggcattctttaaggg

SEQ ID NO: 249661 - DNA, 75 bp, Artificial Sequence
  Synthetic
gggagtcaaaaaccaggaacaccagaactaagattctagcccagggagacaatcaggtgctttgtcccacttata

SEQ ID NO: 249662 - DNA, 75 bp, Artificial Sequence
  Synthetic
aatggatatcgcagcagtaaagatcggaggtgtaggggcccaggcaatgatggggttgtgggtcttggggtctca

SEQ ID NO: 249663 - DNA, 75 bp, Artificial Sequence
  Synthetic
tgctgtcttctggtctcaacaatgaagggcttatgtatgaactggagaacatttccaagaacgcaatgtccattt

SEQ ID NO: 249664 - DNA, 75 bp, Artificial Sequence
  Synthetic
ttcagagtcatccagaagcagaaagtgcttagctgatttgtctgccttttatcgaaggaccctacctatcgagtc

SEQ ID NO: 249665 - DNA, 75 bp, Artificial Sequence
  Synthetic
atcgtgcgattgaagaaggggcctccaagctagggctgataataaaaaaggaagagacaatgtgcagctttgact

SEQ ID NO: 249666 - DNA, 75 bp, Artificial Sequence
  Synthetic
aattttaaaccacaccttgatgaacagagggttgcaaacccctaaagaaggagtcttatctggattgaacagagt

SEQ ID NO: 249667 - DNA, 75 bp, Artificial Sequence
  Synthetic
ttctgatatacggaaagacgcctctattcagaggcaacatattagttcctgaatctaaacggtgggctagggttt

SEQ ID NO: 249668 - DNA, 75 bp, Artificial Sequence
  Synthetic
cagctatgatcagtcatttggccggtatttgggcaacctgtactcttcttatctcctatttcatgtcatcatctt

SEQ ID NO: 249669 - DNA, 75 bp, Artificial Sequence
  Synthetic
cgtgtatctctaatgaccagattgtaaatttggccaacatcatgtcaaccgtttctacaaacgccttgactgttg

SEQ ID NO: 249670 - DNA, 75 bp, Artificial Sequence
  Synthetic
gtacatgaatgcgttggactgggaagaggagaagaccattctagccctgtggagagacatagcatctatagatgt

SEQ ID NO: 249671 - DNA, 75 bp, Artificial Sequence
  Synthetic
ctcaacattctcaatcccttgtgaagccaatgcgagactttcttctgatgtcggttcaagcaatttatcattact

SEQ ID NO: 249672 - DNA, 75 bp, Artificial Sequence
  Synthetic
caaaaatgaccgagtctcttttaaggaccctttgtgggggaaactcttagtgacaaaagattttgtctatgcaca

SEQ ID NO: 249673 - DNA, 75 bp, Artificial Sequence
  Synthetic
tgctgttcagccccattataaaggatcgggtttataaggtgctgaactcaaaggatgatgactttcttctggcca

SEQ ID NO: 249674 - DNA, 75 bp, Artificial Sequence
  Synthetic
caatagcaactgcttatttgataaaaattatacactgatgctcaaggacttgttcttgtctagattcaactcttt

SEQ ID NO: 249675 - DNA, 75 bp, Artificial Sequence
  Synthetic
tgtcaaggatcatatatttggatccctctctgggtggtgtctcagggatgtctctgggaagatttcacatcagac

SEQ ID NO: 249676 - DNA, 75 bp, Artificial Sequence
  Synthetic
gctcatacttgtgtccccgcctgactcccgttactcagatgatctggctgccaacctgtgtcgactttacatttc

SEQ ID NO: 249677 - DNA, 75 bp, Artificial Sequence
  Synthetic
aattctcagaccctgtatcggagggactaaccttttggaaggaaatatggctgagttcatccgagaactgggttc

SEQ ID NO: 249678 - DNA, 75 bp, Artificial Sequence
  Synthetic
aggtgacaggctgctctccacttgtgggaatgcgggatatgatgtaattaaaatgttagagccttgtgtagtaga

SEQ ID NO: 249679 - DNA, 75 bp, Artificial Sequence
  Synthetic
atcatctttgtcaagaggctgggaaccccgacttgggggatagaagtctagagagttttacacgtctcttggaag

SEQ ID NO: 249680 - DNA, 75 bp, Artificial Sequence
  Synthetic
tatcctagttcgaagagctgagacgttccgtccgttaattcactccttgggggagttccctgctttcataaggga

SEQ ID NO: 249681 - DNA, 75 bp, Artificial Sequence
  Synthetic
accccactacattgaatataaggggaggggccagtccaactatcctattgaaggaggctatcaggaaagctctgt

SEQ ID NO: 249682 - DNA, 75 bp, Artificial Sequence
  Synthetic
taaaacaactcaactgataggaacttttggaccaagcgcatcacaattcttcttgatgctccaacaattcgacaa

SEQ ID NO: 249683 - DNA, 75 bp, Artificial Sequence
  Synthetic
atgatgaagtagacagggtggagaattctgaatttagagaggccatcatcttgtctaagactcacagagacaact

SEQ ID NO: 249684 - DNA, 75 bp, Artificial Sequence
  Synthetic
tattcatgatttggtatttatttatggatgttaccggcactggggtcatccctacatcgactataggaaagggct

SEQ ID NO: 249685 - DNA, 75 bp, Artificial Sequence
  Synthetic
tcatattgtttttgaagtctatagagcccctcttccctcgattcttaagtgagctgttcagctcttccttcctag

SEQ ID NO: 249686 - DNA, 75 bp, Artificial Sequence
  Synthetic
taccaagctttttgaccaagtccatatgaaaaagactatagatcagctgtaccaagagcgtctggctagcgattt

SEQ ID NO: 249687 - DNA, 75 bp, Artificial Sequence
  Synthetic
gtattcctgaatcaataatcggactcatacaaaactctagaactgtcaggagacagtttagaaggagcctctcaa

SEQ ID NO: 249688 - DNA, 75 bp, Artificial Sequence
  Synthetic
agccagaaagatcctgcgttgggggtttgacaagtactctaaatggtatctagatatatgtgccattcctaagaa

SEQ ID NO: 249689 - DNA, 75 bp, Artificial Sequence
  Synthetic
agactttggaagaatctttccttcactctgagatccatggtattgacaggatgacacagacccctcagcgactcg

SEQ ID NO: 249690 - DNA, 75 bp, Artificial Sequence
  Synthetic
ccatcctctagccccttatattgcaacacaaacatggcccccgaagcatgtggtggatctcctaggagattcttg

SEQ ID NO: 249691 - DNA, 75 bp, Artificial Sequence
  Synthetic
ggagagtatgggcatgctctgctgagagggcagatcagttaagagagatatcatggggaaggagagtggttggta

SEQ ID NO: 249692 - DNA, 75 bp, Artificial Sequence
  Synthetic
acacaaacatggcccccgaagcatgtggtggatctcctaggagattcttggcacactctcccaataactcaaatt

SEQ ID NO: 249693 - DNA, 75 bp, Artificial Sequence
  Synthetic
cgacagttccccatccttctgagatgctgaatttgatccccaaatcctcggtgtcttgtggatgttatacaaggg

SEQ ID NO: 249694 - DNA, 75 bp, Artificial Sequence
  Synthetic
tttgaggttccggaatctatggacccttctgagattctagatgacaaatctcactcatttacccggacaaagctg

SEQ ID NO: 249695 - DNA, 75 bp, Artificial Sequence
  Synthetic
gtgtcttgtggatgttatacaagggagattggaaacccccggatttctgtttcagtgttgccttcttttgaccct

SEQ ID NO: 249696 - DNA, 75 bp, Artificial Sequence
  Synthetic
tcaagctggttatctgaacacagaggaggaccagtaccaagtgagaaagttatcataactgctctgtccaggccc

SEQ ID NO: 249697 - DNA, 75 bp, Artificial Sequence
  Synthetic
ccggtaaatcccagagaatttctcaagtcaatagatcgagagggtctgccagacgatgaccttattataggactc

SEQ ID NO: 249698 - DNA, 75 bp, Artificial Sequence
  Synthetic
tatgtccactcagttgttccactcatgggagaaggtcacaaatgttcatgtggttaagagggccctatctctcaa

SEQ ID NO: 249699 - DNA, 75 bp, Artificial Sequence
  Synthetic
aaaccgaaagagagagagttaaagatagatgggcggttctttgcgctgatgtcttggaacctgagattgtacttt

SEQ ID NO: 249700 - DNA, 75 bp, Artificial Sequence
  Synthetic
ggagtctatcaactggtttgtgtctcgggagtctaacctggcaaagactttgataagaaacatactgtccctaac

SEQ ID NO: 249701 - DNA, 75 bp, Artificial Sequence
  Synthetic
gtgattaccgaaaagctattggccaatcacatcatccctcttttcgacgcactcacgatgacagataatcttaac

SEQ ID NO: 249702 - DNA, 75 bp, Artificial Sequence
  Synthetic
aggaccctcttttcccattgaagaggcaccagttttcaagaggactggctcagccttacatcgatttaaatcagc

SEQ ID NO: 249703 - DNA, 75 bp, Artificial Sequence
  Synthetic
aaagtattcaagaaactgatagacagggtgactggtcaaggacttaaagactactctcgtgtcacctatgcattc

SEQ ID NO: 249704 - DNA, 75 bp, Artificial Sequence
  Synthetic
tagatatagtgaagggggttattcggctgtgtgtcccaacctgctatctcacatatcagtcagcactgataccat

SEQ ID NO: 249705 - DNA, 75 bp, Artificial Sequence
  Synthetic
catctggactatgaaaagtggaacaaccaccagagactcgagtcaacgaaggatgtattctctgttctcgacagg

SEQ ID NO: 249706 - DNA, 75 bp, Artificial Sequence
  Synthetic
gtctgatctaacacaggatgggaccaattttgacttcatgtttcagcccctaatgttatatgcacagacttggac

SEQ ID NO: 249707 - DNA, 75 bp, Artificial Sequence
  Synthetic
gcgttcggaatgaagaaggtattctctaggacacatgagttctttcaaaagtcctggatatattactcagacaga

SEQ ID NO: 249708 - DNA, 75 bp, Artificial Sequence
  Synthetic
ctcggagctggtccagaaggaccttaggttggcagattctacttttcattggcatttacggtgtcaaaagtgtat

SEQ ID NO: 249709 - DNA, 75 bp, Artificial Sequence
  Synthetic
tcagatctcatagggatttggaaagaccagatctattgtcttgacatgaccgaaggcccaacttgctggaatggt

SEQ ID NO: 249710 - DNA, 75 bp, Artificial Sequence
  Synthetic
caggcccatagaggaagttaatctagatgcacctcaactcttttcgtttccagacatatcttctagaatctcaag

SEQ ID NO: 249711 - DNA, 75 bp, Artificial Sequence
  Synthetic
caagacggggggttggagggtctaagacaaaaaggatggagtttagtaagcctcctgatgattgagagggagtca

SEQ ID NO: 249712 - DNA, 75 bp, Artificial Sequence
  Synthetic
gatggtgtcgggagcagttccgcaattccgaaagctgccggaggtcgggcttaaggctggagacttgatggcctt

SEQ ID NO: 249713 - DNA, 75 bp, Artificial Sequence
  Synthetic
aaaaccaggaataccagaactaagattttagctcagggagataaccaagtgctgtgtcccacttatatgctgtct

SEQ ID NO: 249714 - DNA, 75 bp, Artificial Sequence
  Synthetic
aaacaacagcgagaggtcttatcatatagggactgctcaaggattgctatactccatcctggtggcagtccatga

SEQ ID NO: 249715 - DNA, 75 bp, Artificial Sequence
  Synthetic
tctggcctcaacaatgaaggactcatgtacgaactggagaacatctccaagaatgcaatgtccatatatcgtgct

SEQ ID NO: 249716 - DNA, 75 bp, Artificial Sequence
  Synthetic
cccaggttataacgacaattctctattccctgtgaacatctatggcaaagtgtcagcgagaggttatttgagagg

SEQ ID NO: 249717 - DNA, 75 bp, Artificial Sequence
  Synthetic
attgaagaaggggcctccaagctcgggctgataataaagaaggaagaaacaatgtgtagtttcgactttctgata

SEQ ID NO: 249718 - DNA, 75 bp, Artificial Sequence
  Synthetic
gctcgcgagaggaattctgataggatcctctctatgtttcttgacaagaatgaccaacatcaacattaatcgccc

SEQ ID NO: 249719 - DNA, 75 bp, Artificial Sequence
  Synthetic
tatggaaagacccctctttttagaggtaacatattagtccctgagtccaaacggtgggctagagtctcgtgtatc

SEQ ID NO: 249720 - DNA, 75 bp, Artificial Sequence
  Synthetic
cctagagttaatttctggggtgatttcttacattctgcttaagctagacaaccatccctctctttacattatgct

SEQ ID NO: 249721 - DNA, 75 bp, Artificial Sequence
  Synthetic
tccaatgaccagattgtgaatctggcaaatatcatgtcaaccgtgtccactaatgccttgactgtagctcaacac

SEQ ID NO: 249722 - DNA, 75 bp, Artificial Sequence
  Synthetic
gaaagaacccgagttaagggcagagatattttcaattcctcagaaagtgcctgctgcctacccgaccaccatgga

SEQ ID NO: 249723 - DNA, 75 bp, Artificial Sequence
  Synthetic
tctcaatcccttgtaaagcctatgcgggacttcctcctcatgtctgtccaggcaatttatcattatttgttgttc

SEQ ID NO: 249724 - DNA, 75 bp, Artificial Sequence
  Synthetic
agaaggcaatagatccgtcttatgttatcttcatcaggtccttaggtatgagagagacagtatgtcctttccccc

SEQ ID NO: 249725 - DNA, 75 bp, Artificial Sequence
  Synthetic
agccccatcataaaagatcgagtttacaaagttctgaactcaagggatgatgattttcttctagccatgtcaaga

SEQ ID NO: 249726 - DNA, 75 bp, Artificial Sequence
  Synthetic
agggaacgacatcttgtggatattttctgactttaggagcataaaaatgacttacctgacactgataacctttca

SEQ ID NO: 249727 - DNA, 75 bp, Artificial Sequence
  Synthetic
atcatatatctggatccttctcttggtggtgtctcagggatgtccctagggagatttcacatcagacaattttca

SEQ ID NO: 249728 - DNA, 75 bp, Artificial Sequence
  Synthetic
ggcatacctatggctgcagagggtagagagaagcttgtcaaagcaagtgagagttagattgcggcagctgaattc

SEQ ID NO: 249729 - DNA, 75 bp, Artificial Sequence
  Synthetic
gaccctgtgtcggagggactaaccttctggaaggagatatggctgagtacatccgagacttgggtccatcatctc

SEQ ID NO: 249730 - DNA, 75 bp, Artificial Sequence
  Synthetic
tctcatgagacaggtcttgggtggtcacggagaagatactattgattcagatgacgagatattgtctcttctaaa

SEQ ID NO: 249731 - DNA, 75 bp, Artificial Sequence
  Synthetic
tgtcaagaggccgggaaccctgatctgggggatagaagtctagagagctttacacgtctcttggaagaccctact

SEQ ID NO: 249732 - DNA, 75 bp, Artificial Sequence
  Synthetic
ggaatccctgagaagaacaagatgggtagatcaggaggtccgccatgcagcaaagtcaatgactccagacctcaa

SEQ ID NO: 249733 - DNA, 75 bp, Artificial Sequence
  Synthetic
acactgaatatcagggggggagctagtcctactgtccttttgaaagaagccatcaggaaagctctgtatgatgag

SEQ ID NO: 249734 - DNA, 75 bp, Artificial Sequence
  Synthetic
tcctgttccgaagatctctcgtcgaatggggtcttctgagtggatatgctctgcacagcaaatagctatttctac

SEQ ID NO: 249735 - DNA, 75 bp, Artificial Sequence
  Synthetic
gtagacagggtggagaattctgaatttagagaggccatcatcctatccaagactcaccgagacaacttcatactg

SEQ ID NO: 249736 - DNA, 75 bp, Artificial Sequence
  Synthetic
ttcgctgaatccagcatctgcctctgatattgacttgagatctttgtcacgtcaatatcagaatcctctcatatc

SEQ ID NO: 249737 - DNA, 75 bp, Artificial Sequence
  Synthetic
tttttgaagtctatagaacccttgttccctcgtttcctgagtgagctctttagctcttctttcctgggtattcct

SEQ ID NO: 249738 - DNA, 75 bp, Artificial Sequence
  Synthetic
tggcttaagagtggtgcaatgggccaccggtgctcattacaaaatcaagccaatcttgaatgactcggatgtatg

SEQ ID NO: 249739 - DNA, 75 bp, Artificial Sequence
  Synthetic
gaatctataatcggactcatacagaactcaaggactgtcaggagacagtttaggaggagcctctcaaaaaccttg

SEQ ID NO: 249740 - DNA, 75 bp, Artificial Sequence
  Synthetic
cccttgtctatccctggttataggagatggatcggggggaatttccagggtcgttttgagcatgttcccagattc

SEQ ID NO: 249741 - DNA, 75 bp, Artificial Sequence
  Synthetic
gaggagtctttccttaactctgaaatccatgggattaacagggtgacacaaacccctcaacggctcgggagagta

SEQ ID NO: 249742 - DNA, 75 bp, Artificial Sequence
  Synthetic
caaacttgtgttcaacagtctgttggaggtgaacgatctaatggcatccggcactcacccgttaccgccgtcagc

SEQ ID NO: 249743 - DNA, 75 bp, Artificial Sequence
  Synthetic
tgggcatgctctgctgagaaggcggatcagttgagagagatatcatggggaaggaaggtcgttggcacaacagtt

SEQ ID NO: 249744 - DNA, 75 bp, Artificial Sequence
  Synthetic
ccttatgagagggggtgatgatattacatccagagtgatcgacttcgaatcaatctgggaaaagccgtctgatct

SEQ ID NO: 249745 - DNA, 75 bp, Artificial Sequence
  Synthetic
cctcacccttctgagatgttgaccttgatacctaaatcctcggtggcgtgtggatgttataccagggaggttgga

SEQ ID NO: 249746 - DNA, 75 bp, Artificial Sequence
  Synthetic
gaggaacccgctcacttggaagtatttccactcaatacaatccaagctgagagcacagtttgacttgatagtctg

SEQ ID NO: 249747 - DNA, 75 bp, Artificial Sequence
  Synthetic
aaccctcgaatatctgtctctgtgttgccctcttttgacccttctttcctctcaaggggccctcttaaggggtat

SEQ ID NO: 249748 - DNA, 75 bp, Artificial Sequence
  Synthetic
tgatgctgaggtgactgacatagaatcagtcaacaagatcacattgttgctgtctgacttctcaatgtcaattaa

SEQ ID NO: 249749 - DNA, 75 bp, Artificial Sequence
  Synthetic
ttaggatcgtccacatctatgtccactcagttgtttcactcttgggagaaagtcacaaatgttcatgtggttaag

SEQ ID NO: 249750 - DNA, 75 bp, Artificial Sequence
  Synthetic
gggcccattatgtttaatctttaagacctacgggaccatgctcgtgaacccagattacaaagcaatccaccatct

SEQ ID NO: 249751 - DNA, 75 bp, Artificial Sequence
  Synthetic
agggctttatctctcaaggagtccatcaactggtttgtgtctcgggagtctaacttggcaaagactcttataggg

SEQ ID NO: 249752 - DNA, 75 bp, Artificial Sequence
  Synthetic
atccagggcattcccaaatgtaactgggtttgtcactcaaatgacatcatctttttcctccgagatctaccttag

SEQ ID NO: 249753 - DNA, 75 bp, Artificial Sequence
  Synthetic
aacatattgtctctaacagggccctcttttcccatagaggaggctcctgtcttcaagaggacgggctcagcctta

SEQ ID NO: 249754 - DNA, 75 bp, Artificial Sequence
  Synthetic
attttcaaaaacaggatacttcttcagagaccatgagttgctgaccgcatctacaatccgagagatgagtctagt

SEQ ID NO: 249755 - DNA, 75 bp, Artificial Sequence
  Synthetic
catagattcaaatcagcgaggtatagtgaaggcggttactcagccgtgtgtcccaacctgttgtctcacatatca

SEQ ID NO: 249756 - DNA, 75 bp, Artificial Sequence
  Synthetic
attgttcaattgcagcaacccgaaaagcgagatgctgagggctaggaccttgaattatcaagacttgataagagg

SEQ ID NO: 249757 - DNA, 75 bp, Artificial Sequence
  Synthetic
gtcagcactgacaccatgtctgatttgacacaggatggaaccaactttgacttcatgttccagcccttaatgtta

SEQ ID NO: 249758 - DNA, 75 bp, Artificial Sequence
  Synthetic
ttttccccctgagatcatctccaatccgtacaatgagatgattatcaccttgattgatagtgatgtggagtcctt

SEQ ID NO: 249759 - DNA, 75 bp, Artificial Sequence
  Synthetic
tatgctcaaacctggacatcagaattggttcaaaaggacttcaggttggcggattctacttttcactggcattta

SEQ ID NO: 249760 - DNA, 75 bp, Artificial Sequence
  Synthetic
cttagttcacagggtggttgatgatttggagctcaagagaggacccccgtccaagatggccatcataatcaccat

SEQ ID NO: 249761 - DNA, 75 bp, Artificial Sequence
  Synthetic
aggtgtcaaaaatgtatcagacccatagaagaagtcactctggatgcccctcaactttttaccttcccagacata

SEQ ID NO: 249762 - DNA, 75 bp, Artificial Sequence
  Synthetic
tgccatcctattctctaacagtgttttcaatgtgtccaagtcactggatgaaccaaaattcttccctccctcgga

SEQ ID NO: 249763 - DNA, 75 bp, Artificial Sequence
  Synthetic
tcgtctagaatatcaagaatggtctcgggggcagttcctcaattcagaaagctgcccgaggttgggctcaaggct

SEQ ID NO: 249764 - DNA, 75 bp, Artificial Sequence
  Synthetic
tccaaaattgttgaggcacttcaacatatgctctagtacacttttgttcctttctactgcaatgggagatttgtc

SEQ ID NO: 249765 - DNA, 75 bp, Artificial Sequence
  Synthetic
ggagacctgatggctctaagcagcagcgagaggtcctatcatatcgggaccgctcaaggactgctatactccatc

SEQ ID NO: 249766 - DNA, 75 bp, Artificial Sequence
  Synthetic
gaacttcacaaggcttcatgagctctacaactccccagtgacttattatttcggaaagcagaccgttaaggggag

SEQ ID NO: 249767 - DNA, 75 bp, Artificial Sequence
  Synthetic
ctggtggcagtccacgaccccgggtacaatgacaactccctgttccctgtgaacatctatggcaaggtgtcggct

SEQ ID NO: 249768 - DNA, 75 bp, Artificial Sequence
  Synthetic
gaggtttctgtcttggagctgggctaactcgagcccaatcttcaaaaaggtagcatgcaactcttctatcagtct

SEQ ID NO: 249769 - DNA, 75 bp, Artificial Sequence
  Synthetic
agaggttatttgagagggctcgcgagaggaattcttatagggtcttctatatgtttcctgacgagaatgactaac

SEQ ID NO: 249770 - DNA, 75 bp, Artificial Sequence
  Synthetic
atcctctcactggatcaggttgatatacaagatagttaaaaccacccgcctggattgttctcctagggacatgtt

SEQ ID NO: 249771 - DNA, 75 bp, Artificial Sequence
  Synthetic
atcaacattaaccgcccacttgagttgatttctggggtgatctcctacatattgctaaagctggacaaccatcca

SEQ ID NO: 249772 - DNA, 75 bp, Artificial Sequence
  Synthetic
aagagagacagaagcttgtttgagaacttacaacaagtggatcaacataagggacgtacgatctagaacatctat

SEQ ID NO: 249773 - DNA, 75 bp, Artificial Sequence
  Synthetic
tctctctacatcatgctgaaagagcccgagttaagggcggagatcttctctatccctcagaaagtgcctgctgcc

SEQ ID NO: 249774 - DNA, 75 bp, Artificial Sequence
  Synthetic
cttagactactgttgtctctaatcaaatcaatataaatagactaaaaaagcatttttgaaaaaaacagataacag

SEQ ID NO: 249775 - DNA, 75 bp, Artificial Sequence
  Synthetic
taccctactaccatggaagaaggcaacaggtctgtcttatgttatcttcaacaagtcctcaggtatgagagagat

SEQ ID NO: 249776 - DNA, 75 bp, Artificial Sequence
  Synthetic
acgcttaacaacaaaaccgaagaagatatagacagtaccaatgacctagacaaaatgtaacactcctacaatgga

SEQ ID NO: 249777 - DNA, 75 bp, Artificial Sequence
  Synthetic
aaaaacagataacagataccttgggcattgtcctgtgattgtttttaatttttgtgtggtttttttgttaagcgt

SEQ ID NO: 249778 - DNA, 75 bp, Artificial Sequence
  Synthetic
agtatgtcttttcccccaggaaatgacatcttgtggatattctctgactttaggagtataaagatgacttacctg

SEQ ID NO: 249779 - DNA, 75 bp, Artificial Sequence
  Synthetic
gtctgataagattgtattcaaggtgaacaaccaagttgtttctttgaagcctgaggtcatatcagatcaatatga

SEQ ID NO: 249780 - DNA, 75 bp, Artificial Sequence
  Synthetic
accttgataacctttcaggcatacctatggctacagagggtagagaaaagcctgtcaaaacaagtaagagttaga

SEQ ID NO: 249781 - DNA, 75 bp, Artificial Sequence
  Synthetic
gtataagtatcctgccatcctagatgggaagaaaccagggataactttagggaaggcaccagatctgaatactgc

SEQ ID NO: 249782 - DNA, 75 bp, Artificial Sequence
  Synthetic
ttgcgacagctaaactctctcatgagacaagtcttgggtggccatggagaagatgttattgattcagatgatgag

SEQ ID NO: 249783 - DNA, 75 bp, Artificial Sequence
  Synthetic
ctataagtccatcttatcaggtatgaaagccgccaagctcgacccagacgatgtttgctcttacttggcagctgc

SEQ ID NO: 249784 - DNA, 75 bp, Artificial Sequence
  Synthetic
atattatccctccttaaagaatccctgaggaggacaagatgggtggatcaggaggtgcgccatgcagcaaagtca

SEQ ID NO: 249785 - DNA, 75 bp, Artificial Sequence
  Synthetic
catgcatctcttcgagggggtttgtcctgaagactgggtcagttatgggattgtcattgcaaagaaaggggagaa

SEQ ID NO: 249786 - DNA, 75 bp, Artificial Sequence
  Synthetic
atgactccggatctcaatcctatgcctaagatctctcgtagagtggggtcttcagagtggatttgctctgcacag

SEQ ID NO: 249787 - DNA, 75 bp, Artificial Sequence
  Synthetic
aatcaaccctagcgtgatcgttgacatagctcgaaccaacgtggaggggaattgggctcaagccggaggaacgga

SEQ ID NO: 249788 - DNA, 75 bp, Artificial Sequence
  Synthetic
caaatagctatttccacctctctaaatccggcatctgcttctgatatagaccttagatctttatcacgtcagtat

SEQ ID NO: 249789 - DNA, 75 bp, Artificial Sequence
  Synthetic
tgtaatcagagaccctacaattgcggagcatgcatcattggttggactgttgctgtgtctgtatcggttgagtaa

SEQ ID NO: 249790 - DNA, 75 bp, Artificial Sequence
  Synthetic
cagaatcctctcatatccggcttacgagtggtgcaatgggccactggggctcattacaagatcaagccaattcta

SEQ ID NO: 249791 - DNA, 75 bp, Artificial Sequence
  Synthetic
gatcgttggccagaacacagcaaactataaaactaatgtagctgataggatggagcaaatatttgagactgcccc

SEQ ID NO: 249792 - DNA, 75 bp, Artificial Sequence
  Synthetic
aatgacttagatgtgtgtccttgtctatccttggtcataggagatggatctggaggtatttcgagagtcgttctg

SEQ ID NO: 249793 - DNA, 75 bp, Artificial Sequence
  Synthetic
ttttgcgaaagtggtggaacatcacaccttgatgactgctcacaaaatgtgtgctaactggagcactatacccaa

SEQ ID NO: 249794 - DNA, 75 bp, Artificial Sequence
  Synthetic
agcatgtttccagactctaaacttgtgtttaacagtctgttggaagtgaatgacctgatggcatcgggcactcac

SEQ ID NO: 249795 - DNA, 75 bp, Artificial Sequence
  Synthetic
cttcagatttttggttggcacatacgacatgttttttgcaagagttgagcatatatactcggctctcagagtagg

SEQ ID NO: 249796 - DNA, 75 bp, Artificial Sequence
  Synthetic
cctttaccgccgtcagccctcatgagaggaggtgacgacatcacatctagagtgatagattttgagtcaatttgg

SEQ ID NO: 249797 - DNA, 75 bp, Artificial Sequence
  Synthetic
aacagtggtaacagcatatgaggattgttctgggttggtctccttcacagggtttatcaaacagatcaatctatc

SEQ ID NO: 249798 - DNA, 75 bp, Artificial Sequence
  Synthetic
gaaaaaccgtccgatttgaggaatccactcacttggaaatatttccactctatacaatccaagttgagatcacag

SEQ ID NO: 249799 - DNA, 75 bp, Artificial Sequence
  Synthetic
ccctagagacgcactgctatatttcttccacaaaaactttgagggagagatcaagagaatgtttgagccagggca

SEQ ID NO: 249800 - DNA, 75 bp, Artificial Sequence
  Synthetic
tttgacttaatagtctgtgatgcggaggtgacagacatagagtcagtcaacaagatcactttgttgttgtctgat

SEQ ID NO: 249801 - DNA, 75 bp, Artificial Sequence
  Synthetic
agaaacagcagtcccccactcatacttcattcatttcagggcacttggattgagtggcaaatctccttactcgtc

SEQ ID NO: 249802 - DNA, 75 bp, Artificial Sequence
  Synthetic
ttttcaatgtcgattaaggggcctttatatttaatctttaaaacctacgggaccatgctcgtgaatccagattat

SEQ ID NO: 249803 - DNA, 75 bp, Artificial Sequence
  Synthetic
caatgctgtaggtcacactttcaatctgattcattttgtgggatgctatatgggtcagatcaggtctctaaatgc

SEQ ID NO: 249804 - DNA, 75 bp, Artificial Sequence
  Synthetic
aaggcaatccaccatctatccagagcattccccaatgtaactggatttgtcactcaaatgacatcatcattctct

SEQ ID NO: 249805 - DNA, 75 bp, Artificial Sequence
  Synthetic
aacagttatccaaacctgtgcacctcatgagatgtcagtcttagggggatatcttggggaggaattctttgggaa

SEQ ID NO: 249806 - DNA, 75 bp, Artificial Sequence
  Synthetic
tccgagatctacctcagattctcaaaaacaggttatttctttagagaccatgagctgcttacagcatctacaatc

SEQ ID NO: 249807 - DNA, 75 bp, Artificial Sequence
  Synthetic
gggcaccttcgagaggaggttcttcagagatgaaaaagagatgcaggattatacagagctggagggggcaagagt

SEQ ID NO: 249808 - DNA, 75 bp, Artificial Sequence
  Synthetic
agggagatgagtctggtactgttcaattgcagcaatcctaagagcgagatgctgagggctcggaccttgaattac

SEQ ID NO: 249809 - DNA, 75 bp, Artificial Sequence
  Synthetic
ggatgcctcacttgctgatgacgggactgtagactcagatgaggatgatttcttttctggagaaactagaagtcc

SEQ ID NO: 249810 - DNA, 75 bp, Artificial Sequence
  Synthetic
caagacttgataagaggtttccctcatgagatcatctccaatccttataatgagatgattattaccctgattgac

SEQ ID NO: 249811 - DNA, 75 bp, Artificial Sequence
  Synthetic
tgaagcagtctacagtaggataatgatgaacggtggtaagttgaagaaagttcatatacgtagatatatagcggt

SEQ ID NO: 249812 - DNA, 75 bp, Artificial Sequence
  Synthetic
agtgaggtagagtccttcttagttcataaagtggtcgatgacttagagctcaagagaggatcccagtccaaaatg

SEQ ID NO: 249813 - DNA, 75 bp, Artificial Sequence
  Synthetic
gagctcaaaccaccaagctagaccaaactcttttgcagaattcttgaataaagtatatgcagacggatcataatc

SEQ ID NO: 249814 - DNA, 75 bp, Artificial Sequence
  Synthetic
gccataataattgccgtggccgtcttattctcaaacagtgtcttcaatgtatctaagtcactgaacgagccaaag

SEQ ID NO: 249815 - DNA, 75 bp, Artificial Sequence
  Synthetic
ctagagctcctttacaaaggaggatctacagatgattgagattgcaagatagattcaagaaaaaaacttaacacc

SEQ ID NO: 249816 - DNA, 75 bp, Artificial Sequence
  Synthetic
ttcttccccccatcggatccaaaactgttgaggcacttcaatatatgctctagcacacttctattcttgtctact

SEQ ID NO: 249817 - DNA, 75 bp, Artificial Sequence
  Synthetic
actacttgattcgtggtgtcaagatgagcaaagatttagtacatccgagcctcatccgagcagggatagtagact

SEQ ID NO: 249818 - DNA, 75 bp, Artificial Sequence
  Synthetic
gcgatgggagatctgtcgaacttcacaaggcttcatgagctttacaactctcctgtaacttattacttcggaaag

SEQ ID NO: 249819 - DNA, 75 bp, Artificial Sequence
  Synthetic
tggagatggccgaagagactactgatctaatcaatcgaaccatcgagggcaatcaagctcaccttcagggggagc

SEQ ID NO: 249820 - DNA, 75 bp, Artificial Sequence
  Synthetic
caaactgtcaaaggaaggaggtatttatcttggagttgggaccaatcaagcccaatcttcaaaaaggtagcatgc

SEQ ID NO: 249821 - DNA, 75 bp, Artificial Sequence
  Synthetic
ctttttatgttgattccttgccggaagatatgggcagattgaaaatagggggcgaatctgataaggctaaaacag

SEQ ID NO: 249822 - DNA, 75 bp, Artificial Sequence
  Synthetic
aactcctctatcagtctatcctctcactggatacggctgatatacaagatagtcaaaaccactcgcctgaactgt

SEQ ID NO: 249823 - DNA, 75 bp, Artificial Sequence
  Synthetic
aagaagaagagagagatgaggggagctctgaggaagatgactatctgtctgatagacaagacccattagtcttat

SEQ ID NO: 249824 - DNA, 75 bp, Artificial Sequence
  Synthetic
tctcctagggacatgttgagagagacagaagcttgcctgagaacttacaacaagtggatcaacataagggacata

SEQ ID NO: 249825 - DNA, 75 bp, Artificial Sequence
  Synthetic
ttcagaatttccttgacgaaatcggggccaaagcagtcaaaaagttaaagactggtgagggattcttcagagtgt

SEQ ID NO: 249826 - DNA, 75 bp, Artificial Sequence
  Synthetic
cgatccagaacatctatcttggattactgttgtctttagtctaattcatggtgatagatttagagagcattattg

SEQ ID NO: 249827 - DNA, 75 bp, Artificial Sequence
  Synthetic
ggtctgctctctcggatgatataaaggggtacgtgtcaacccacttaatgccatctaaggcgagaaagacaaaga

SEQ ID NO: 249828 - DNA, 75 bp, Artificial Sequence
  Synthetic
aaaaaaacaggtaacaaataccttatgcattgtcatgtgactgtttttaatttttatgtggtttttttgttaagc

SEQ ID NO: 249829 - DNA, 75 bp, Artificial Sequence
  Synthetic
gcatacaaattcaaacagaaccgactgcattatctagttttgcaagtgagagtcggccagattcctggtgtgtgc

SEQ ID NO: 249830 - DNA, 75 bp, Artificial Sequence
  Synthetic
acgcttaacaaccagatcaaagaagacacagatagtatcagtgacctaaacaaaatgtaacactcctacaatgga

SEQ ID NO: 249831 - DNA, 75 bp, Artificial Sequence
  Synthetic
aaaaacaggtaacaaataccttatgcattgtcatgtgactgtttttaatttttatgtggtttttttgttaagcgt

SEQ ID NO: 249832 - DNA, 75 bp, Artificial Sequence
  Synthetic
aagaccaaacggataagggagaccatgacactgatcacgatatggtctcggatgttgaatcagccactgagaaag

SEQ ID NO: 249833 - DNA, 75 bp, Artificial Sequence
  Synthetic
ctgaggtcatatcagatcaatatgagtataaatatcccgccattctagatgggaagaaaccagggatcaccttgg

SEQ ID NO: 249834 - DNA, 75 bp, Artificial Sequence
  Synthetic
aagagatcagagatatagagggagaggttgctcaccaggttgcagaaagcttctcaaagaagtacaaattccctt

SEQ ID NO: 249835 - DNA, 75 bp, Artificial Sequence
  Synthetic
ggaaggcacctgatctaaacactgcatacaaatccatcctatcaggtatgaaggctgcaaagcttgacccagacg

SEQ ID NO: 249836 - DNA, 75 bp, Artificial Sequence
  Synthetic
ctagatcctcaggaatatttttatggaacttcgagcagctcaaaatgaatttggacgacattgtgaaggcagcca

SEQ ID NO: 249837 - DNA, 75 bp, Artificial Sequence
  Synthetic
atgtttgctcttacttagcagctgctatgcatctattcgagggggtctgtcccgaggactgggttagttatggga

SEQ ID NO: 249838 - DNA, 75 bp, Artificial Sequence
  Synthetic
tgaatgtaccaggggttgacatgatcgccgaaaaaggagggaagctccccttaagatgcattttgggatttgtag

SEQ ID NO: 249839 - DNA, 75 bp, Artificial Sequence
  Synthetic
ttgtcattgcgaagaagggagagaaaatcaaccccagcgtgatcgtcgatatagttcgcactaacgttgagggga

SEQ ID NO: 249840 - DNA, 75 bp, Artificial Sequence
  Synthetic
cgttagactcttcaaaaagattcaggctccttgcaaacaacgacaaggtggccagactcatacaagatgatatca

SEQ ID NO: 249841 - DNA, 75 bp, Artificial Sequence
  Synthetic
attgggctcaagcgggaggaactgatgtgattagagatcctacaatggcagagcatgcttcattggtcggactgt

SEQ ID NO: 249842 - DNA, 75 bp, Artificial Sequence
  Synthetic
acagttacatggcccggctggaggaggccgattagaggttataaagacccataacacaatcaataactgggcagt

SEQ ID NO: 249843 - DNA, 75 bp, Artificial Sequence
  Synthetic
tattatgtctgtatcgattgagcaagatagtcggtcagaacacagcaaactataaaaccaatgtagcagacagaa

SEQ ID NO: 249844 - DNA, 75 bp, Artificial Sequence
  Synthetic
cttgtcttgaaatgaaaaaaacatgtaacacccctgaaaagatgaatttcctaaagagaatggttaaaagctgca

SEQ ID NO: 249845 - DNA, 75 bp, Artificial Sequence
  Synthetic
tggaacaaatatttgagactgctccttttgcgaaggtggtggaacatcacacattgatgactactcataagatgt

SEQ ID NO: 249846 - DNA, 75 bp, Artificial Sequence
  Synthetic
aagaggaagagtcccccaagtatccatcagcttctgcaccgccggacgacgatgacctttggatgcctcctcctg

SEQ ID NO: 249847 - DNA, 75 bp, Artificial Sequence
  Synthetic
gcgctaactggagcactatacctaacttcagattcctggtgggcacatatgatatgttctttgcaagagtcgagc

SEQ ID NO: 249848 - DNA, 75 bp, Artificial Sequence
  Synthetic
agtatgttcctttgacccaggttacaagcaaggccagagtaagaaatttttgtatcaatggggaggtcaagatat

SEQ ID NO: 249849 - DNA, 75 bp, Artificial Sequence
  Synthetic
atatatattcggctctcagagtcggaacagtcgtgacagcctacgaggattgctcaggcttggtctcctttaccg

SEQ ID NO: 249850 - DNA, 75 bp, Artificial Sequence
  Synthetic
gtagtccaaacgggtactccttcaagatactccggcatattctgaagtcattagacaatgcttactctggaaaca

SEQ ID NO: 249851 - DNA, 75 bp, Artificial Sequence
  Synthetic
ggtttatcaaacaaatcaatctatctcctagagatgcactgctatatttcttccataaaaactttgaaggggaga

SEQ ID NO: 249852 - DNA, 75 bp, Artificial Sequence
  Synthetic
ggaggatgatagggttagtcaaagtggtcatagggcttgtcctttcaggatctccaatcccggaaggcatgaact

SEQ ID NO: 249853 - DNA, 75 bp, Artificial Sequence
  Synthetic
ttaagagaatgtttgagccggggcaagaaacagcagttccccactcatacttcattcattttagagcacttggcc

SEQ ID NO: 249854 - DNA, 75 bp, Artificial Sequence
  Synthetic
gggtttataaacttcgcagaacattaatctttcagtgggcagagtcatatggaccattagaaggagaagagcttg

SEQ ID NO: 249855 - DNA, 75 bp, Artificial Sequence
  Synthetic
tgagtggcaagtccccgtactcgtccaatgctgtaggtcatactttcaatttaatccactttgtaggatgctata

SEQ ID NO: 249856 - DNA, 75 bp, Artificial Sequence
  Synthetic
agtactcccaggaaattacctgggatgatgaggcagaattcgtaggcttgcaaatccgagtgagtgcaagacaat

SEQ ID NO: 249857 - DNA, 75 bp, Artificial Sequence
  Synthetic
tgggtcagatcaggtctctaaatgcaactgtgatccaaacatgtgcacctcacgagatgtcagtactggggggat

SEQ ID NO: 249858 - DNA, 75 bp, Artificial Sequence
  Synthetic
gtcacatccagggtcgtctctggtgtataaatataaactcaagagcatgtcagctgtgggctgatatgaccttga

SEQ ID NO: 249859 - DNA, 75 bp, Artificial Sequence
  Synthetic
atcttggagaagagttctttgggaaaggcacctttgagaggaggttctttagggatgaaaaagagatgcaagatt

SEQ ID NO: 249860 - DNA, 75 bp, Artificial Sequence
  Synthetic
agacccaacagtccccggacgatgaaaacacctcactcctgctagagtagactctagcctgtagctgtgtatctc

SEQ ID NO: 249861 - DNA, 75 bp, Artificial Sequence
  Synthetic
atacagagcttgaggaggccagagtagaggcttcgctcgctgatgacgggactgtagactcagatgaggaggact

SEQ ID NO: 249862 - DNA, 75 bp, Artificial Sequence
  Synthetic
agttgttacctctgtttggagtagagtaaaactgcgagcaatagaacaatcaccgcaatggtgcccgctttcagc

SEQ ID NO: 249863 - DNA, 75 bp, Artificial Sequence
  Synthetic
tcttctctggagaaaccagaagtcctgaagcagtttacagtaggataatgatgaacaacggtaaattgaagaaag

SEQ ID NO: 249864 - DNA, 75 bp, Artificial Sequence
  Synthetic
acaatacatataacctaataaccggtttgtcttcctattcagggttgagcaaaaacgtgaaaaaaactcagggaa

SEQ ID NO: 249865 - DNA, 75 bp, Artificial Sequence
  Synthetic
ttcacatacgtaggtatattgcggtgagttctaatcatcaagcgaggccgaactcttttgcagaattcttaaaca

SEQ ID NO: 249866 - DNA, 75 bp, Artificial Sequence
  Synthetic
aaaggcacaacagccctctcactgccatcatgaatatacaatgccttgctgtgctccttagcttcaccactacct

SEQ ID NO: 249867 - DNA, 75 bp, Artificial Sequence
  Synthetic
aggtgtatgcagatggatcataatcagagagcttcttggaagacgatgatctatagaggggtattattgtgagac

SEQ ID NO: 249868 - DNA, 75 bp, Artificial Sequence
  Synthetic
attctctgggagaatttcctttgtacacaattcccgagaagatagagaaatggaccccaatagacatgatccatc

SEQ ID NO: 249869 - DNA, 75 bp, Artificial Sequence
  Synthetic
agattccagaaaaaaacttaacaccactcctcgattcgtggtgtcaaaatgagcaaagatttggtgcatcctagt

SEQ ID NO: 249870 - DNA, 75 bp, Artificial Sequence
  Synthetic
taagctgccccaacaacttattatccgaggaggaaggttgcaacacagagtcacccctcacctacttcgagctca

SEQ ID NO: 249871 - DNA, 75 bp, Artificial Sequence
  Synthetic
cttatcagggcagggatagtagaactggaaatggcagaagagactactgatctgattaacaggaccatagagagc

SEQ ID NO: 249872 - DNA, 75 bp, Artificial Sequence
  Synthetic
agattggttacttagctcatcagaaagttcctgggtttacatgtacaggggtggtgactgaggcggagacataca

SEQ ID NO: 249873 - DNA, 75 bp, Artificial Sequence
  Synthetic
aaccaagctcaccttcagggggagccgctttatgttgattcattgccggaagatatgagcagattgagaatagag

SEQ ID NO: 249874 - DNA, 75 bp, Artificial Sequence
  Synthetic
caaattttgtcgggtatgtcaccacaaccttcaaaagaaaacacttcaggccgacagtagccgcctgtcgtgatg

SEQ ID NO: 249875 - DNA, 75 bp, Artificial Sequence
  Synthetic
gacaaatctcgtaggactaaaacagaagaagaagaaagagatgaaggtagttctgaggaggataactatttgtct

SEQ ID NO: 249876 - DNA, 75 bp, Artificial Sequence
  Synthetic
catacaactggaaagtgtccggggaccccaggtatgaagagtcactgcacaccccttatccggacagcagctggt

SEQ ID NO: 249877 - DNA, 75 bp, Artificial Sequence
  Synthetic
gagggacaagatccattaatcccctttcagaatttccttgatgaaattggggccagagcggtcaagagattgaag

SEQ ID NO: 249878 - DNA, 75 bp, Artificial Sequence
  Synthetic
tgaggactgtaaccaccaccaaagaatcccttcttataatatcacctagcatcgtagagatggatgtatatggca

SEQ ID NO: 249879 - DNA, 75 bp, Artificial Sequence
  Synthetic
actggcgagggattcttcagggtgtggtctgctctgtcagatgacataaaggggtatgtatctaccaatataatg

SEQ ID NO: 249880 - DNA, 75 bp, Artificial Sequence
  Synthetic
ggactctccattcccccatgttcccttcagggatatgttccaagctctatccctctgttccatcttgtaaaacca

SEQ ID NO: 249881 - DNA, 75 bp, Artificial Sequence
  Synthetic
acatctggggagagagatactaagagcatacaaattcagacagaaccaaccgcttcagttagctctggaaacgag

SEQ ID NO: 249882 - DNA, 75 bp, Artificial Sequence
  Synthetic
accatgattacacattatggctgccagaagatcctagtttgagtttaatctgtgatatcttcacttctggcagcg

SEQ ID NO: 249883 - DNA, 75 bp, Artificial Sequence
  Synthetic
agtcggcatgattctgagagcatgcatgatccaaatgacaagaaagatcacacacccgatcacgatgtggtcccg

SEQ ID NO: 249884 - DNA, 75 bp, Artificial Sequence
  Synthetic
gaaggaaggccatgaatggatcccgcatctgcggattcaaagatgaaaggggattttacaggtctttaaaaggcg

SEQ ID NO: 249885 - DNA, 75 bp, Artificial Sequence
  Synthetic
gacattgagtcttctactgacaaaggagagattcgagatatagaaggagaagttgcccatcaggtagcagaaagc

SEQ ID NO: 249886 - DNA, 75 bp, Artificial Sequence
  Synthetic
cttgtaagttgaccttgtgcgggaagcctggaatcagattatttgacggaacttgggtctcttttacaaggccag

SEQ ID NO: 249887 - DNA, 75 bp, Artificial Sequence
  Synthetic
ttttcaaagaaatacaagttcccttctagatcctcgggaatattcttgtggaactttgagcagcttaaaatgaat

SEQ ID NO: 249888 - DNA, 75 bp, Artificial Sequence
  Synthetic
aagttcacgtgtggtgcactcccaaccaattggtcaacatacacaatgacagactagatgagattgagcacttga

SEQ ID NO: 249889 - DNA, 75 bp, Artificial Sequence
  Synthetic
ctagatgatattgtgaaagcagccatgaatgtaccaggggttgaaaggatcgccgaaaagggagggaagcttccc

SEQ ID NO: 249890 - DNA, 75 bp, Artificial Sequence
  Synthetic
tcgttgaagacattgtcaaaagaagagaggagtgtttagacactctggagacgatatttatgtctcaatcaatta

SEQ ID NO: 249891 - DNA, 75 bp, Artificial Sequence
  Synthetic
ctgagatgtattttggggtttgtggcattggactcttcaaagagatttagacttcttgcagacaatgacaaggtg

SEQ ID NO: 249892 - DNA, 75 bp, Artificial Sequence
  Synthetic
gttttaggaggttgagccactttcggaaattggttccaggatatgggaaagcttacaccattttaaatggtagct

SEQ ID NO: 249893 - DNA, 75 bp, Artificial Sequence
  Synthetic
gcaagactcatccaagaagatatcaacagttacatggcccggctcgaggaggcagagtaaaggctgagaggaccc

SEQ ID NO: 249894 - DNA, 75 bp, Artificial Sequence
  Synthetic
tgatggaggcaaatgtatactataaaagagttgacaagtgggcggacattttaccctctaagggatgtctgaaag

SEQ ID NO: 249895 - DNA, 75 bp, Artificial Sequence
  Synthetic
ataaaagaactcgaatttggcaatctggtcttgaaatggaaaaaacatgtaacatccctaaaaagatgaatttcc

SEQ ID NO: 249896 - DNA, 75 bp, Artificial Sequence
  Synthetic
tagggcaacaatgtatggaccctgtcaacggagtcttcttcaacggaattatcaaaagcccggatggccaaatct

SEQ ID NO: 249897 - DNA, 75 bp, Artificial Sequence
  Synthetic
tcaagaaaatgatcaagagctgtaaggatgaagagactcagaagtatccatcagcatctgcgcctccagacgatg

SEQ ID NO: 249898 - DNA, 75 bp, Artificial Sequence
  Synthetic
tgatccctgagatgcagtcagagcagctaaaacagcatatggacttattgaaagcagcagtgttccctctccgac

SEQ ID NO: 249899 - DNA, 75 bp, Artificial Sequence
  Synthetic
atgacatttggatgcccccgcctgagtatgtccccttaacccaggtcaagggcaaggccagtgtgagaaactttt

SEQ ID NO: 249900 - DNA, 75 bp, Artificial Sequence
  Synthetic
atcctttgatcagccaagaagcagtctttaagaaagacggggaggcagatgattttgtggacctccatatgccag

SEQ ID NO: 249901 - DNA, 75 bp, Artificial Sequence
  Synthetic
gcattagtggagaggtcaagatatgtagtccaaacgggtactccttcaagatactcaggcatattttgaagtcgt

SEQ ID NO: 249902 - DNA, 75 bp, Artificial Sequence
  Synthetic
acgtccacaaatctatatcagatgtagacttgggcttgcctcactgggggttctggctgttgatcggggtgacca

SEQ ID NO: 249903 - DNA, 75 bp, Artificial Sequence
  Synthetic
ttgataatgtttactctgggaacaggaggatgatcgggttagtcaaagtggttatcgggcttgtactttcaggat

SEQ ID NO: 249904 - DNA, 75 bp, Artificial Sequence
  Synthetic
tagtggcatttttggtcttggtgtgcttgctccgtgtctgttgtaggagagtgaggaggagaggttcgcgacgtg

SEQ ID NO: 249905 - DNA, 75 bp, Artificial Sequence
  Synthetic
ctccagtcccggagggcatgaactgggtttataaacttcgtaggaccttaatatttcagtgggcagagtctcatg

SEQ ID NO: 249906 - DNA, 75 bp, Artificial Sequence
  Synthetic
caactcaggagatccccctcagcgtttcctctgtccctgtccctcgagccacggtggtgtcatcatgggagtctt

SEQ ID NO: 249907 - DNA, 75 bp, Artificial Sequence
  Synthetic
ggtttataaacttcgtaggaccttaatatttcagtgggcagagtctcatggaccgttggaaggagaagagcttga

SEQ ID NO: 249908 - DNA, 75 bp, Artificial Sequence
  Synthetic
gtactcacaagaaattacatgggatgatgaggcagagtttgtaggcctccaaatcagagtgagcgccagacaatg

SEQ ID NO: 249909 - DNA, 75 bp, Artificial Sequence
  Synthetic
acaaagggctcccaggcacctgaagcttccaattgactgaaacaatactcacaaccggaacacctgcctcggcac

SEQ ID NO: 249910 - DNA, 75 bp, Artificial Sequence
  Synthetic
tcacatccagggtcgtctctggtgcattaacatgaactcaagagcatgtcaattatgggccgatatgatcttgca

SEQ ID NO: 249911 - DNA, 75 bp, Artificial Sequence
  Synthetic
aacaaaacccaaccacatggtgtcaaatctcggttcatgctctcccatgtataatgattagaggagggttgcttg

SEQ ID NO: 249912 - DNA, 75 bp, Artificial Sequence
  Synthetic
gacccaacagtccccggatgatgaaaacacctcacttttattagagtagactctagcctgtagctttgcctctta

SEQ ID NO: 249913 - DNA, 75 bp, Artificial Sequence
  Synthetic
tcaatcgaagggaatgctttctcacacattctgtcacctgtaagctataatccttcctttcccattgtctaaatc

SEQ ID NO: 249914 - DNA, 75 bp, Artificial Sequence
  Synthetic
tttctgaacacaatcaatatactactgggtcttcgggtttctataaagagttgccttctaacttggggttgttca

SEQ ID NO: 249915 - DNA, 75 bp, Artificial Sequence
  Synthetic
attgttacctctgtttggagtagagaaaaaccgcgagcaatagaacaattaccgcaacggtgcccgctttcagca

SEQ ID NO: 249916 - DNA, 75 bp, Artificial Sequence
  Synthetic
caatacatataacctaaccactggtttgtcttcctattcagggtcgagcgaaaacgtgaaaaaaactacataaaa

SEQ ID NO: 249917 - DNA, 75 bp, Artificial Sequence
  Synthetic
gttaatgcttgattgggccttcaatcattctgaggtgcggcaatattagcctgaactaacctcgaggtttaagtg

SEQ ID NO: 249918 - DNA, 75 bp, Artificial Sequence
  Synthetic
aggcacaacagccctctccctgccatcatgaatataccttgctttgttgtgattctcagcttagccactacacat

SEQ ID NO: 249919 - DNA, 75 bp, Artificial Sequence
  Synthetic
ctcctgtttcctaataatatcacaggagtatgtcattgttctgtgtgataacaggacacaatatgatgtttattc

SEQ ID NO: 249920 - DNA, 75 bp, Artificial Sequence
  Synthetic
tctctgggagaattccccttgtacacaattcctgagaagatagagaaatggactcccatagacatgatccatctg

SEQ ID NO: 249921 - DNA, 75 bp, Artificial Sequence
  Synthetic
gtattgtagagttatgatttgtcagattgtgaccctagaatgttccatgtattgatgtgaaaaaaacatgccact

SEQ ID NO: 249922 - DNA, 75 bp, Artificial Sequence
  Synthetic
agttgccccaacaacctattatctgaggaagaaggttgcaatgcagagtcatcctttacttactttgagctcaag

SEQ ID NO: 249923 - DNA, 75 bp, Artificial Sequence
  Synthetic
gggccaaagtccacacttcaacactcctcctattcgctttgcaatcatgatggacatcaatgaggtgtatgacga

SEQ ID NO: 249924 - DNA, 75 bp, Artificial Sequence
  Synthetic
atcctttacttactttgagctcaagagtggttacctagctcatcagaaggttccagggtttacctgtaccggggt

SEQ ID NO: 249925 - DNA, 75 bp, Artificial Sequence
  Synthetic
cccgatagatcctgttgaaccggaaggagagtggaacagcagccccgtggtccccaatattctgcgaaactctga

SEQ ID NO: 249926 - DNA, 75 bp, Artificial Sequence
  Synthetic
agtggttacctagctcatcagaaggttccagggtttacctgtaccggggtcgtgaacgaggcagagacatataca

SEQ ID NO: 249927 - DNA, 75 bp, Artificial Sequence
  Synthetic
aacttcgtcgggtacgtcaccacaaccttcaaaaggaagcactttaggcctacagtagccgcctgtcgtgatgcc

SEQ ID NO: 249928 - DNA, 75 bp, Artificial Sequence
  Synthetic
ctataacctaaattctcctttgctggaagactctgccaatttgatgattcaatggataacatcaggaaacagacc

SEQ ID NO: 249929 - DNA, 75 bp, Artificial Sequence
  Synthetic
tacaactggaaagtgtcaggagaccccaggtacgaagagtcactccacactccttatcctgacagcagttggttg

SEQ ID NO: 249930 - DNA, 75 bp, Artificial Sequence
  Synthetic
ctcgagaatgaatgtcacagagaacacaaccaggtactacaaagttctgaaagcacttttcaaggggacagatgt

SEQ ID NO: 249931 - DNA, 75 bp, Artificial Sequence
  Synthetic
aggactgtgactacaaccaaagaatcacttctcataatatcgcccagcatcgtggaaatggatatttacggcagg

SEQ ID NO: 249932 - DNA, 75 bp, Artificial Sequence
  Synthetic
agcatcagtgagaatagggggtgtcggggctcaggcaatgatgagtttgtgggtcttggggtctcactcggaatc

SEQ ID NO: 249933 - DNA, 75 bp, Artificial Sequence
  Synthetic
cacttctcataatatcgcccagcatcgtggaaatggatatttacggcaggactctccattcccccatgtttcctt

SEQ ID NO: 249934 - DNA, 75 bp, Artificial Sequence
  Synthetic
atctagaagtagaaagtgtttagctgacttgtctgccttttatcaaaggacactgcctatagagtcgatactgaa

SEQ ID NO: 249935 - DNA, 75 bp, Artificial Sequence
  Synthetic
cgtggaaatggatatttacggcaggactctccattcccccatgtttccttcaggagtatgttccaacgtatatcc

SEQ ID NO: 249936 - DNA, 75 bp, Artificial Sequence
  Synthetic
ctctgtcccatcctgtgagactaatcatgattacacattatggctgcctgaagatcctagtttgagtttggtctg

SEQ ID NO: 249937 - DNA, 75 bp, Artificial Sequence
  Synthetic
ccacacattaatgaacagaggattacagaccccaaaagagggagtgttatctggattgaatagagtcagctatga

SEQ ID NO: 249938 - DNA, 75 bp, Artificial Sequence
  Synthetic
tgatatctttacttccagcaacggaaagaaggccatgaacgggtcacgcatctgcggattcaaggatgaaagggg

SEQ ID NO: 249939 - DNA, 75 bp, Artificial Sequence
  Synthetic
tcagtctttcggaaggtatttgggtaatttgtattcctcctatcttctctttcatgtcataatattgtacatgaa

SEQ ID NO: 249940 - DNA, 75 bp, Artificial Sequence
  Synthetic
attctacagatctttaaagggcgcttgcaagctgacattgtgtggaagacctggaattaggttattcgacggaac

SEQ ID NO: 249941 - DNA, 75 bp, Artificial Sequence
  Synthetic
tgcgctggactgggacgaagagaaaaccattctagctttgtggaaagacataacatctatagatgtcaaaagtga

SEQ ID NO: 249942 - DNA, 75 bp, Artificial Sequence
  Synthetic
ttgggtctcttttacaaagccggacgtgcacgtatggtgcactcccaaccaattgatcaatatacacaatgacag

SEQ ID NO: 249943 - DNA, 75 bp, Artificial Sequence
  Synthetic
cagagtctctttcagagaccccttgtggggaaagctctcagtgacaaaggattttgtctatgcacacaataacaa

SEQ ID NO: 249944 - DNA, 75 bp, Artificial Sequence
  Synthetic
actagatgagatagaacacctgatcgtggaagacatcataaagaaaagagaagagtgcttagacaccctggaaac

SEQ ID NO: 249945 - DNA, 75 bp, Artificial Sequence
  Synthetic
ctgtttgttcgacaaaaactacacactgatgttaaaggacttgtttctgtcaagattcaattccttgctcatact

SEQ ID NO: 249946 - DNA, 75 bp, Artificial Sequence
  Synthetic
aatacttatgtctcaatctgttagctttagaaggttgagccatttccgaaagttagttccaggatatgggaaggc

SEQ ID NO: 249947 - DNA, 75 bp, Artificial Sequence
  Synthetic
tgtgtccccgccagactctcgttactcggacgatctggccgccaacctgtgtcgactttacatctctggtgatag

SEQ ID NO: 249948 - DNA, 75 bp, Artificial Sequence
  Synthetic
ctacactattttaaacggcagcctgatggaaacaaatgtctactacaaaagggtcgacaagtgggctgacatctt

SEQ ID NO: 249949 - DNA, 75 bp, Artificial Sequence
  Synthetic
gcttctctccaattgtggtaatgctggatatgatgtgatcaaaatgttggaaccttgtgtggtggatctcctagt

SEQ ID NO: 249950 - DNA, 75 bp, Artificial Sequence
  Synthetic
accctctaagggatgtctgaaagtcgggcaacaatgcatggaacctgtcaaaggagtcctcttcaatgggattat

SEQ ID NO: 249951 - DNA, 75 bp, Artificial Sequence
  Synthetic
gaaaagggctgagacattccgtccgttaattcactctctcggggagttccctgccttcataaaggacaaaacaaa

SEQ ID NO: 249952 - DNA, 75 bp, Artificial Sequence
  Synthetic
caagggcccggatggccaaattttgatccccgagatgcagtcagagcagctaaagcagcatatggacctgttgaa

SEQ ID NO: 249953 - DNA, 75 bp, Artificial Sequence
  Synthetic
tcagctgataggagtcttcggaccatgcgcatcacaattcttcctaatgctccaccaattcgacaatattcacga

SEQ ID NO: 249954 - DNA, 75 bp, Artificial Sequence
  Synthetic
ggcggctgtgtttcctctccgacaccctttaatcagccgggaggcagtctttaagaaagacggggatgccgatga

SEQ ID NO: 249955 - DNA, 75 bp, Artificial Sequence
  Synthetic
tttggtgtttatttacggatgttacaggcactggggtcatccttacatagactatagaaaaggacttaccaagct

SEQ ID NO: 249956 - DNA, 75 bp, Artificial Sequence
  Synthetic
ttttgtggatctccatatgcctgatgtccacaagtctgtgtcagatgtcgacctgggtctgcctcattggggttt

SEQ ID NO: 249957 - DNA, 75 bp, Artificial Sequence
  Synthetic
tttcgatcaagttcacatgaagaagactatagatcatcagtatcaagaacgtttggccagcgatttagccaggaa

SEQ ID NO: 249958 - DNA, 75 bp, Artificial Sequence
  Synthetic
ctggatgttgatcggggcaacaatagtagcatttgtggtcttggtatgtttactccgtgtatgttgtaagagagt

SEQ ID NO: 249959 - DNA, 75 bp, Artificial Sequence
  Synthetic
gattcttcgttggggatttgataagtactccaaatggtatctagatacaggtgtcattcctaaagaccatccctt

SEQ ID NO: 249960 - DNA, 75 bp, Artificial Sequence
  Synthetic
gaggaggagaagatcaggacgtgcaactcaggagatccccctgagctttccctctgcccctgttcctcgagccaa

SEQ ID NO: 249961 - DNA, 75 bp, Artificial Sequence
  Synthetic
ggccccttatatcgcaacacaaacatggccccctaaacatgtagtagaccttctgggggactcttggcacactct

SEQ ID NO: 249962 - DNA, 75 bp, Artificial Sequence
  Synthetic
agtggtgtcatcttgggagtcctataaagggcttccaggtacatgaaaccttcatcagattgcctaacatatccc

SEQ ID NO: 249963 - DNA, 75 bp, Artificial Sequence
  Synthetic
cccgatgactcaaatttttgagattcccgagtctatggacccttctgagatcctagacgacaaatctcactcatt

SEQ ID NO: 249964 - DNA, 75 bp, Artificial Sequence
  Synthetic
ccacaaccggattacctgcctcggcaagacacaacttgatcacatggtgtcaaatctcctttcaaaccctccagt

SEQ ID NO: 249965 - DNA, 75 bp, Artificial Sequence
  Synthetic
tacccggaccaaactgtcaagctggttgtctgaacacaggggaggacctgtaccaagtgagaaagtgatcataac

SEQ ID NO: 249966 - DNA, 75 bp, Artificial Sequence
  Synthetic
gtataatgattagaggagggttgcttgtcaatcagggggtggtgttgtctcatacattccgttactcgtaagttg

SEQ ID NO: 249967 - DNA, 75 bp, Artificial Sequence
  Synthetic
ggctctatccagacccccagtaaatccccgagaatttctcaagtcaatagatcaaggagggttgcctgatgatga

SEQ ID NO: 249968 - DNA, 75 bp, Artificial Sequence
  Synthetic
aaatctctcctttctcattgtctaaatacttctgaacacaatctctcaacgattaggtcttctggtttttataaa

SEQ ID NO: 249969 - DNA, 75 bp, Artificial Sequence
  Synthetic
tcttattatcggactcaaaccaaaagaaagagagttgaagatagacgggcgattttttgctctgatgtcctggaa

SEQ ID NO: 249970 - DNA, 75 bp, Artificial Sequence
  Synthetic
gagttgccttctaaaatgggcactctatagagccttcaatctttttgaggtgcggcaatattagcttgaaataac

SEQ ID NO: 249971 - DNA, 75 bp, Artificial Sequence
  Synthetic
cctgagactatactttgtaatcaccgagaagctgttagccaatcacatcatccctcttttcgatgcacttacaat

SEQ ID NO: 249972 - DNA, 75 bp, Artificial Sequence
  Synthetic
cttaaggtctaatttctcctgtttcccaataatatcacaggagtatctaattgttctgtgtgatgacaggacgca

SEQ ID NO: 249973 - DNA, 75 bp, Artificial Sequence
  Synthetic
gacagacaatcttaacaaggtgttcaagaagcttatagacagagtgaccggacaaggactcaaagactattctcg

SEQ ID NO: 249974 - DNA, 75 bp, Artificial Sequence
  Synthetic
atatgatgtctcttcttcttgtagagtgttgattcgtcagattgtcaccctagactgtcacatatgagattattg

SEQ ID NO: 249975 - DNA, 75 bp, Artificial Sequence
  Synthetic
cgtcacctatgcattccacctagactatgaaaaatggaacaaccaccaaagactagagtcgacaaaggacgtgtt

SEQ ID NO: 249976 - DNA, 75 bp, Artificial Sequence
  Synthetic
atgtgaaaaaaacatgccccttggtcaaagtcaacgcctcaacactcctcctacttcagttgcaaccatgatgga

SEQ ID NO: 249977 - DNA, 75 bp, Artificial Sequence
  Synthetic
ctctgttctcgacagagcattcggaatgaagagagtgttctccaggacacatgagttttttcagaaatcctggat

SEQ ID NO: 249978 - DNA, 75 bp, Artificial Sequence
  Synthetic
cgttacggaggtgtatgacgacccgatagaccctgttgagccagaaggagaatggaatagcagtcccgtagttcc

SEQ ID NO: 249979 - DNA, 75 bp, Artificial Sequence
  Synthetic
atattactcagatagatcagaccttatagggatttggaacgaccagatttattgtcttgacatgaccgacggccc

SEQ ID NO: 249980 - DNA, 75 bp, Artificial Sequence
  Synthetic
aaatattttgcggaactctgactacaacctgaactctcctttgctagaagaccccgcaaatctaatgattcagtg

SEQ ID NO: 249981 - DNA, 75 bp, Artificial Sequence
  Synthetic
cacttgctggaatgggcaagacggaggtttggagggtctacgacaaaaaggatggagtttagtgagcctcttgat

SEQ ID NO: 249982 - DNA, 75 bp, Artificial Sequence
  Synthetic
aacctgaactctcctttgctagaagaccccgcaaatctaatgattcagtggctaacatccgggaatagaccctcg

SEQ ID NO: 249983 - DNA, 75 bp, Artificial Sequence
  Synthetic
agaatgaatgtcacagagaacacaaccaggtcttacaaagtcttgagagcacttttcaagggagtggatatagca

SEQ ID NO: 249984 - DNA, 75 bp, Artificial Sequence
  Synthetic
gattgagagggagtcaaaaactaggaatactcgaaccaagatcttagctcagggagacaatcaagtgctgtgtcc

SEQ ID NO: 249985 - DNA, 75 bp, Artificial Sequence
  Synthetic
acaataaaaatagggggtgtgggagctcaggcaatgatggggctgtgggtcttggggtctcactcagaatcgtct

SEQ ID NO: 249986 - DNA, 75 bp, Artificial Sequence
  Synthetic
cacttacatgttgtcttctggtctcaacaacgaagggctcttgtatgaattggaaaacatctccaagaatgctat

SEQ ID NO: 249987 - DNA, 75 bp, Artificial Sequence
  Synthetic
cgaagcagaaagtgtctagctgacttgtctgcattttatcagaggaccctacctatagagtccatcttgaaccac

SEQ ID NO: 249988 - DNA, 75 bp, Artificial Sequence
  Synthetic
gtctatatatcgtgcaattgaagagggagcctccaagctcgggctgataataaagaaggaagaaacaatgtgtag

SEQ ID NO: 249989 - DNA, 75 bp, Artificial Sequence
  Synthetic
accttaatgaacagaggactacagacccctagagaaggagttttatccggattgaatagagttagctatgatcag

SEQ ID NO: 249990 - DNA, 75 bp, Artificial Sequence
  Synthetic
ctttgactttttgatatacggaaagacacctctttttagaggtaacatattggtccctgaatcgaagcgttgggc

SEQ ID NO: 249991 - DNA, 75 bp, Artificial Sequence
  Synthetic
tcctttggccggtatttaggcaatttgtactcctcttatctcctctttcacgtcatcatattgtacatgaatgcg

SEQ ID NO: 249992 - DNA, 75 bp, Artificial Sequence
  Synthetic
tagagtttcatgtatctccaatgatcagattgtgaacctggccaatattatgtcaacggtctctaccaatgcttt

SEQ ID NO: 249993 - DNA, 75 bp, Artificial Sequence
  Synthetic
ttggattgggaagaggagaagaccattctggccctgtggagagacataacatctatagatatcaaaaatgaccga

SEQ ID NO: 249994 - DNA, 75 bp, Artificial Sequence
  Synthetic
gactgttgcccaacactctcaatccctggtgaagcccatgcgagacttccttttaatgtctgtccaggcaatcta

SEQ ID NO: 249995 - DNA, 75 bp, Artificial Sequence
  Synthetic
ttctggccctgtggagagacataacatctatagatatcaaaaatgaccgagtctactttaaggaccctttgtggg

SEQ ID NO: 249996 - DNA, 75 bp, Artificial Sequence
  Synthetic
tcattatctgttgttcagccccattataaaagatcgcgtttacaaggtgctgaactccaggaatgaagattttct

SEQ ID NO: 249997 - DNA, 75 bp, Artificial Sequence
  Synthetic
ggaaactcttagtaacaaaagattttgtatatgcacacaatagcaactgtttatttgacaaaaattacacactga

SEQ ID NO: 249998 - DNA, 75 bp, Artificial Sequence
  Synthetic
tctagccatgtcgcgaatcatatatctagatccttcccttggtggagtatctgggatgtctttaggaagatttca

SEQ ID NO: 249999 - DNA, 75 bp, Artificial Sequence
  Synthetic
tgctaaaagacttgttcctgtcaagattcaactcattgctcatacttgtgtccccgccggactcccgttactcag

SEQ ID NO: 250000 - DNA, 75 bp, Artificial Sequence
  Synthetic
cataagacagttctcagatcctgtctcagagggactaaccttttggaaggagatatggctgagtacatccgagac

SEQ ID NO: 250001 - DNA, 75 bp, Artificial Sequence
  Synthetic
atgatctggctgccaacctgtgtcgactttacatctcaggggataggcttctctccagttgtgggaatgcaggat

SEQ ID NO: 250002 - DNA, 75 bp, Artificial Sequence
  Synthetic
ttggattcatcatctatgtcaagaagctggaaacccagatttgggggatagaagtctagagagctttacacgtct

SEQ ID NO: 250003 - DNA, 75 bp, Artificial Sequence
  Synthetic
atgatgtcatcaaaatgttagagccttgtgtggtggatctactggttcaaagagctgagacgttccgtcctttaa

SEQ ID NO: 250004 - DNA, 75 bp, Artificial Sequence
  Synthetic
cttagaggatcccactacattgaacataagagggggagctagtcccactatcctcttgaaggaagccatcaggaa

SEQ ID NO: 250005 - DNA, 75 bp, Artificial Sequence
  Synthetic
ttcactcactgggggagttccctgctttcataaaagacaaaacaactcaactgataggcacttttggaccatgcg

SEQ ID NO: 250006 - DNA, 75 bp, Artificial Sequence
  Synthetic
agccttgtatgatgaagtagatagggtggagaattctgagttcagagaggctattatcctgtctaagactcaccg

SEQ ID NO: 250007 - DNA, 75 bp, Artificial Sequence
  Synthetic
catcacaattcttctcgatgctccagcaattcgacaatattcatgatttggtatttatttacggatgttaccggc

SEQ ID NO: 250008 - DNA, 75 bp, Artificial Sequence
  Synthetic
tgacaattttatactgtttttgaagtctatagagcctctcttcccccgtttcttaagtgaactctttagttcttc

SEQ ID NO: 250009 - DNA, 75 bp, Artificial Sequence
  Synthetic
actgggggcatccctacatagactatagaaaagggctttccaagctctttgatcaagtccatatgaagaagacta

SEQ ID NO: 250010 - DNA, 75 bp, Artificial Sequence
  Synthetic
ctttttaggtattccggaatccataattggactcatacagaactccagaactgtcagaagacagtttaggaagag

SEQ ID NO: 250011 - DNA, 75 bp, Artificial Sequence
  Synthetic
tagatcagcaatatcaagagcgtctggctagcgatctagccaggaagattctgcgttgggggttcgaaaagtact

SEQ ID NO: 250012 - DNA, 75 bp, Artificial Sequence
  Synthetic
cctctcgaaaaccttagaggagtctttccttcactctgagatccatggaattaatcgggtaacacaaacccctca

SEQ ID NO: 250013 - DNA, 75 bp, Artificial Sequence
  Synthetic
ccaaatggtatctagatacaggtgtcattcccaaagaccatcccctggctccttatattgcaacacagacatggc

SEQ ID NO: 250014 - DNA, 75 bp, Artificial Sequence
  Synthetic
acgactcgggagagtatgggcgtgctctgctgagagggcggatcagttaagagagatatcatggggaaggaaggt

SEQ ID NO: 250015 - DNA, 75 bp, Artificial Sequence
  Synthetic
ccccgaaacatgtggtggatctcctgggagattcttggcacactctcccgatgactcaaatttttgaggttcctg

SEQ ID NO: 250016 - DNA, 75 bp, Artificial Sequence
  Synthetic
ggtcggcacaacagttcctcatccttctgagatgttgaccctaatccccaagtcctcagtggcttgcggatgtta

SEQ ID NO: 250017 - DNA, 75 bp, Artificial Sequence
  Synthetic
aatctatggacccttctgagattctagatgacaaatctcactcatttacccggacaaagctgtcaagttggtcat

SEQ ID NO: 250018 - DNA, 75 bp, Artificial Sequence
  Synthetic
tacaagggaatctggaaaccctagaatttctgtctcagttttgccttcgtttgacccttctttcctatcaagggg

SEQ ID NO: 250019 - DNA, 75 bp, Artificial Sequence
  Synthetic
ctgaacacagagggggaccggtaccaagtgaaaaagtgattataacagctctgtccaggcccccagtaaatccca

SEQ ID NO: 250020 - DNA, 75 bp, Artificial Sequence
  Synthetic
ccctcttaaggggtatttgggatcttccacatccatgtccactcagttgttccattcatgggagaaggttacaaa

SEQ ID NO: 250021 - DNA, 75 bp, Artificial Sequence
  Synthetic
gagactttctcaagtcgatagatcaaggagggttgccagatgatgaccttattataggactcaaaccaaaagaaa

SEQ ID NO: 250022 - DNA, 75 bp, Artificial Sequence
  Synthetic
tgttcatgtagtcaagagggctctatctctcaaagagtccatcaactggtttgtttctcgggagtctaacttggc

SEQ ID NO: 250023 - DNA, 75 bp, Artificial Sequence
  Synthetic
gagagttaaagatagatgggcgattctttgcactgatgtcttggaacctgagactgtactttgtgattaccgaga

SEQ ID NO: 250024 - DNA, 75 bp, Artificial Sequence
  Synthetic
caagaccctgataggaaacatactgtccctaacagggccctcttttccgattgaagaagctccagtcttcaagag

SEQ ID NO: 250025 - DNA, 75 bp, Artificial Sequence
  Synthetic
agttactggccaatcacatcatccctcttttcgatgcactaacaatgacagataatcttaacaaagttttcaaga

SEQ ID NO: 250026 - DNA, 75 bp, Artificial Sequence
  Synthetic
gacaggctcagccttacatcgattcaaatcagctaggtatagtgaaggaggttattcagctgtttgtcccaacct

SEQ ID NO: 250027 - DNA, 75 bp, Artificial Sequence
  Synthetic
aactgatagacagagtgactggtcaagggctcaaagactactctcgcgtcacctatgcgttccatctagactatg

SEQ ID NO: 250028 - DNA, 75 bp, Artificial Sequence
  Synthetic
gctgtctcatatctcggtaagcacagatactatgtctgatttgacccaagacgggaccaatttcgacttcatgtt

SEQ ID NO: 250029 - DNA, 75 bp, Artificial Sequence
  Synthetic
aaaaatggaacaaccaccagagactcgagtcgacaaaggatgtgttttctgttcttgacagagcgttcggaatga

SEQ ID NO: 250030 - DNA, 75 bp, Artificial Sequence
  Synthetic
ccagcctctgatgttgtatgcacaaacctggacatcagagttggtccaaaaggaccttaggttggctgactctac

SEQ ID NO: 250031 - DNA, 75 bp, Artificial Sequence
  Synthetic
agaaggtattctctaggacacatgagttttttcaaaaatcctggatatattactcagatagatcagatctcatcg

SEQ ID NO: 250032 - DNA, 75 bp, Artificial Sequence
  Synthetic
ttttcattggcatttgaggtgtcaaaaatgtatccgggccatagaagaagtcactctggatgctcctcaactctt

SEQ ID NO: 250033 - DNA, 75 bp, Artificial Sequence
  Synthetic
ggatttggaaggaccagatctattgtcttgacatgactgaaggccctacttgctggaatggtcaggatggaggat

SEQ ID NO: 250034 - DNA, 75 bp, Artificial Sequence
  Synthetic
tgcattccccgacatatcttctagaatctccagaatggtctccggggcggtccctcaattcagaaagttgccgga

SEQ ID NO: 250035 - DNA, 75 bp, Artificial Sequence
  Synthetic
tagaaggtctaaggcaaaaaggatggagtttagtgagcctcctgatgattgagagggaatcaaaaaccaggaaca

SEQ ID NO: 250036 - DNA, 75 bp, Artificial Sequence
  Synthetic
ggttggacttaaggcaggagacttgatggccctaggtagcagcgagaggtcatatcatatcggaacagcccaagg

SEQ ID NO: 250037 - DNA, 75 bp, Artificial Sequence
  Synthetic
cccgaactaagattttagctcagggggacaaccaagtgttgtgtcccacttatatgctgtcttctggcctcaata

SEQ ID NO: 250038 - DNA, 75 bp, Artificial Sequence
  Synthetic
actgttatattccatcctggtagccgtccatgacccagggtacaatgataattccctcttccctgtgaacatcta

SEQ ID NO: 250039 - DNA, 75 bp, Artificial Sequence
  Synthetic
acgaaggactcaggtatgagctagaaaacatctctaagaatgcaatgtccatatatcgagctattgaagacggag

SEQ ID NO: 250040 - DNA, 75 bp, Artificial Sequence
  Synthetic
tagtaaagtgtcggctagaggttatctaagagggctcgcgagggggattctgataggatcctctatatgttttct

SEQ ID NO: 250041 - DNA, 75 bp, Artificial Sequence
  Synthetic
cctctaagctcgggctaatcataaagaaggaggaaacaatgtgtagctttgactttctgatatatggaaagacac

SEQ ID NO: 250042 - DNA, 75 bp, Artificial Sequence
  Synthetic
gacgagaatgaccaacatcaacattaatcgcccccttgagttgatttctggagtaatctcttacatattgctaaa

SEQ ID NO: 250043 - DNA, 75 bp, Artificial Sequence
  Synthetic
ctctctttagaggtaacatattggttcctgaatccaagcggtgggctagagtttcttgtatctccaatgaccaga

SEQ ID NO: 250044 - DNA, 75 bp, Artificial Sequence
  Synthetic
gcttgacaaccatccatctctttacattatgctgaaagaacctgagttaagggcagagatcttctccattcctca

SEQ ID NO: 250045 - DNA, 75 bp, Artificial Sequence
  Synthetic
ttgtgaatttggccaatatcatgtcaacagtgtcaactaatgccctgactgtagctcaacactctcaatcccttg

SEQ ID NO: 250046 - DNA, 75 bp, Artificial Sequence
  Synthetic
aaaagtgcccgcggcctaccctactaccatggaagaaggcaacagatctgtcttgtgttatctccaacaagtcct

SEQ ID NO: 250047 - DNA, 75 bp, Artificial Sequence
  Synthetic
tgaagcccatgcgagacttccttctaatgtcagtccaagcaatttatcattatctgctgttcagccctatcatca

SEQ ID NO: 250048 - DNA, 75 bp, Artificial Sequence
  Synthetic
caggtatgagagggacagtatgtcttttcctccaggaaatgacatcttgtggatcttctccgactttaggagtat

SEQ ID NO: 250049 - DNA, 75 bp, Artificial Sequence
  Synthetic
aggatcgagtttacaaggtgctgaactctaaggatgatgactttcttctagccatgtcacgaatcatatatttgg

SEQ ID NO: 250050 - DNA, 75 bp, Artificial Sequence
  Synthetic
ctctaaggatgatgactttcttctagccatgtcacgaatcatatatttggatccttctcttggtggtgtttctgg

SEQ ID NO: 250051 - DNA, 75 bp, Artificial Sequence
  Synthetic
aaaaatgacttacctgacactgataacctttcaggcatacttatggctacagagggtagaaagaagcttgcccaa

SEQ ID NO: 250052 - DNA, 75 bp, Artificial Sequence
  Synthetic
gccatgtcacgaatcatatatttggatccttctcttggtggtgtttctggaatgtccttaggaaggtttccaata

SEQ ID NO: 250053 - DNA, 75 bp, Artificial Sequence
  Synthetic
agacagttctctgacccggtgtctgagggactaaccttttggaaagagatctggctgagttcatctgagacttgg

SEQ ID NO: 250054 - DNA, 75 bp, Artificial Sequence
  Synthetic
acaggtgagagtcagactaagacagctgaactctctcatgagacaggtcttgggtggccatggagaagacaccat

SEQ ID NO: 250055 - DNA, 75 bp, Artificial Sequence
  Synthetic
atccatcatctttgtcaagaagcaggaaaccccgacttgggggatagaagtctggagagttttactcgtctctta

SEQ ID NO: 250056 - DNA, 75 bp, Artificial Sequence
  Synthetic
tgattcagatgatgaaatattatcccttcttaaagaagctctgagaaggacaagatgggtggatcaagaagtccg

SEQ ID NO: 250057 - DNA, 75 bp, Artificial Sequence
  Synthetic
gaagaccccactacattgaatatcagggggggggctagtcccactatcttactgaaagaagccatcaggaaggcc

SEQ ID NO: 250058 - DNA, 75 bp, Artificial Sequence
  Synthetic
ccatgcagcaaagtcaatgactccagatcccaatcctgttcctaagatatctcgtagaatagggtcttctgagtg

SEQ ID NO: 250059 - DNA, 75 bp, Artificial Sequence
  Synthetic
ttgtatgatgaggtagacagggtggagaattctgaatttagagaggccatcatcttgtccaagactcaccgggac

SEQ ID NO: 250060 - DNA, 75 bp, Artificial Sequence
  Synthetic
gatttgctctgcacaacaaatagctatctccacctctctgaatccagcctctgcttcggatatcgacatgagatc

SEQ ID NO: 250061 - DNA, 75 bp, Artificial Sequence
  Synthetic
aacttcatactgtttttaaagtctatagagcccctattccctcgtttcttgagtgagctcttcagctcttctttc

SEQ ID NO: 250062 - DNA, 75 bp, Artificial Sequence
  Synthetic
tctatcacgtcaatatcagaatcctctcatttctggcctaagggtggtgcaatgggccaccggagcccactacaa

SEQ ID NO: 250063 - DNA, 75 bp, Artificial Sequence
  Synthetic
ctgggtattcctgaatctataattgggcttatccagaactcaagaactgtcaggagacagtttagaaagagcctc

SEQ ID NO: 250064 - DNA, 75 bp, Artificial Sequence
  Synthetic
aatcaagccaatcctaaacgacttggatgtttgcccttgtttgtccctggtcataggagatggatcgggaggtat

SEQ ID NO: 250065 - DNA, 75 bp, Artificial Sequence
  Synthetic
tcaaaaacattagaggagtctttccttaattccgagatccatgggataaacagggtgacacaaacccctcaacga

SEQ ID NO: 250066 - DNA, 75 bp, Artificial Sequence
  Synthetic
ttcaagagttgttctgagcatgttcccggactctaaactggtgtttaacagcctgttggaggtgaacgaccttat

SEQ ID NO: 250067 - DNA, 75 bp, Artificial Sequence
  Synthetic
ctcgggagagtatggacatgctctgctgagagggcagatcagttgagagagatatcatggggaaggaaggttgtc

SEQ ID NO: 250068 - DNA, 75 bp, Artificial Sequence
  Synthetic
ggcatcaggcactcaccctttaccaccttcagcccttatgagagggggtgacgatatcacatccagggtgattga

SEQ ID NO: 250069 - DNA, 75 bp, Artificial Sequence
  Synthetic
ggcacaacagttcctaatccctctgagatgttgaccttggtccccaagtcctcagtggcttgtgggtgttatacc

SEQ ID NO: 250070 - DNA, 75 bp, Artificial Sequence
  Synthetic
tttcgattcaatatgggaaaagccgtctgatttgaggaatccactcacgtggaagtatttccactcaatacaatc

SEQ ID NO: 250071 - DNA, 75 bp, Artificial Sequence
  Synthetic
ctcagtggcttgtgggtgttataccagggaggttggaaacccccggatctctgtctcagtgttgccttcctttga

SEQ ID NO: 250072 - DNA, 75 bp, Artificial Sequence
  Synthetic
caagttgagatcacagtttgacttaatagtttgtgatgccgaggtgaaagacatagaatccgtcaacaagattac

SEQ ID NO: 250073 - DNA, 75 bp, Artificial Sequence
  Synthetic
cccttctttcctctcaaggggccctcttaaggggtacttaggatcttccacatctatgtccactcagttgttcca

SEQ ID NO: 250074 - DNA, 75 bp, Artificial Sequence
  Synthetic
cctgttgttgtctgatttctcgatgtcgattaaaggccccttatatttaatctttaagacctacgggaccatgct

SEQ ID NO: 250075 - DNA, 75 bp, Artificial Sequence
  Synthetic
ctcatgggagaaagtcacaaatgttcatgtggtcaagagggctctatcactcaaagagtccatcaactggtttgt

SEQ ID NO: 250076 - DNA, 75 bp, Artificial Sequence
  Synthetic
cgtgaatccagattataaggcaatacaccacctgtcgagagcattccccaatgtgaccgggtttgtcactcaaat

SEQ ID NO: 250077 - DNA, 75 bp, Artificial Sequence
  Synthetic
gtctcgggagtctaacttggcaaagactctgataggaaacatactgtccctaacaggaccatcttttcccataga

SEQ ID NO: 250078 - DNA, 75 bp, Artificial Sequence
  Synthetic
gacatcatctttctcctccgagatctaccttaggttctcaaaaacagggtacttcttcagagaccatgagctgct

SEQ ID NO: 250079 - DNA, 75 bp, Artificial Sequence
  Synthetic
ggaggctccggttttcaagaggaccggctcagctttacatcgattcaaatctgctaggtatagtgagggcggtta

SEQ ID NO: 250080 - DNA, 75 bp, Artificial Sequence
  Synthetic
gacagcatctacaatcagagagatgagtctagtgttattcaattgcagcaatcccaagagcgagatgctgagggc

SEQ ID NO: 250081 - DNA, 75 bp, Artificial Sequence
  Synthetic
ctcagccgtgtgtcccaacctactgtcccacatatcagtcagcactgataccatgtctgatttgacacaggacgg

SEQ ID NO: 250082 - DNA, 75 bp, Artificial Sequence
  Synthetic
caggactttaaattaccaagacttgataagaggttttccccctgagatcatctccaacccgtacaatgagatgat

SEQ ID NO: 250083 - DNA, 75 bp, Artificial Sequence
  Synthetic
aaccaatttcgacttcatgttccagcccttgatgttatatgctcagacctggacgtcagagctggtccaaaagga

SEQ ID NO: 250084 - DNA, 75 bp, Artificial Sequence
  Synthetic
tattaccctgattgacagtgaggtagaatcgttcctagtccacaaagtggttgatgacttggagctcaagagagg

SEQ ID NO: 250085 - DNA, 75 bp, Artificial Sequence
  Synthetic
ctttagattggcagattcgacttttcattggcatctaaggtgtcaaaaatgtatcaggcccatagaagaagtcac

SEQ ID NO: 250086 - DNA, 75 bp, Artificial Sequence
  Synthetic
atccccgtccaagatggctatcataatttccattgccattctattctctaacagtgtcttcaatgtttctaagtc

SEQ ID NO: 250087 - DNA, 75 bp, Artificial Sequence
  Synthetic
tctggatgcccctcaactttttgacttcccagacatatcttctagaatctcaagaatggtctcgggggcagttcc

SEQ ID NO: 250088 - DNA, 75 bp, Artificial Sequence
  Synthetic
attaaatgagcccaaattcttccccccatcagatccaaagttgttgaggcacttcaacatatgctcaagcacact

SEQ ID NO: 250089 - DNA, 75 bp, Artificial Sequence
  Synthetic
ccaatttagaaagttgccagaagttgggctcaaggccggagacctgacggcattaagtagcagcgagaggtccta

SEQ ID NO: 250090 - DNA, 75 bp, Artificial Sequence
  Synthetic
tttattcctgtctacagcaatgggagatttgtcaaatttcacaaggattcatgaactctacaactctcctgtgac

SEQ ID NO: 250091 - DNA, 75 bp, Artificial Sequence
  Synthetic
tcatatagggacagctcaaggattgctatactccatactagttgcagttcatgaccccgggtataacgacaactc

SEQ ID NO: 250092 - DNA, 75 bp, Artificial Sequence
  Synthetic
ttattactttggaaagcagacagtcaaagggaggagatatttgtcatggagctgggccactccaagtccaatctt

SEQ ID NO: 250093 - DNA, 75 bp, Artificial Sequence
  Synthetic
cctattccctgtgaacatctatggcaaagtgtctgccagaggttatttaagagggcttgcaagaggaattctaat

SEQ ID NO: 250094 - DNA, 75 bp, Artificial Sequence
  Synthetic
caaaaaggtggcatgtaactcctccatcagtctatcttcccactggatacgaatgatatataagatagtcaaaac

SEQ ID NO: 250095 - DNA, 75 bp, Artificial Sequence
  Synthetic
agggtcttctatatgttttctaacgagaatgaccaatatcaacattaatcgcccccttgagctgatttctggggt

SEQ ID NO: 250096 - DNA, 75 bp, Artificial Sequence
  Synthetic
cactcgcctgaactgctctcctagggaaatgttaagagagacagaagcttgtcttagaacctacaacaaatggat

SEQ ID NO: 250097 - DNA, 75 bp, Artificial Sequence
  Synthetic
aatttcttacatactgctaaagctagacaaccatccgtctctttacattatgctgaaagaacccgagttgagggc

SEQ ID NO: 250098 - DNA, 75 bp, Artificial Sequence
  Synthetic
aaacataagggacatacgatccagaacctccttactagaatactgctgtctttaatcccctcgatgttgacagac

SEQ ID NO: 250099 - DNA, 75 bp, Artificial Sequence
  Synthetic
agagatcttctccatccctcagaaagtgcctgcggcttacccgacgacaatggaagaagggaatagatctgtctt

SEQ ID NO: 250100 - DNA, 75 bp, Artificial Sequence
  Synthetic
tgggagctaagttttgaaaaaaacagataacaagtaccttatgcattgtcctgtgattgtttttaatttttttgt

SEQ ID NO: 250101 - DNA, 75 bp, Artificial Sequence
  Synthetic
aaaaacagataacaagtaccttatgcattgtcctgtgattgtttttaatttttttgtggtttttttgttaagcgt

SEQ ID NO: 250102 - DNA, 75 bp, Artificial Sequence
  Synthetic
atgttatcttcaacaagtcctcaggtatgagagagacagtatgtcttttcctccagggaatgacatcttgtggat

SEQ ID NO: 250103 - DNA, 75 bp, Artificial Sequence
  Synthetic
attttctgattttaggagtataaagatgacgtacttgacgctgataacctttcaggcatacctatggctgcagag

SEQ ID NO: 250104 - DNA, 75 bp, Artificial Sequence
  Synthetic
agtagagagaaacttgtctaaacaggtaagagtcagattgagacagctgaactctctcatgagacaggtcctggg

SEQ ID NO: 250105 - DNA, 75 bp, Artificial Sequence
  Synthetic
tggccacggagaagatactattgactctgatgatgagatattatcccttcttaaagaatccctgagaaggacaag

SEQ ID NO: 250106 - DNA, 75 bp, Artificial Sequence
  Synthetic
atgggtagatcaagaggtccgccatgcagctaagtcaatgacaccagatctcaatcctgtccctaagatctcacg

SEQ ID NO: 250107 - DNA, 75 bp, Artificial Sequence
  Synthetic
tagaatggggtcttcagagtggatttgctctgcacagcagatagctatctccacctctctaaatccagcatctgc

SEQ ID NO: 250108 - DNA, 75 bp, Artificial Sequence
  Synthetic
ttctgacattgacctcagatctttatcacgtcagtatcagaatcctctcatctctggcttgagagtggtacagtg

SEQ ID NO: 250109 - DNA, 75 bp, Artificial Sequence
  Synthetic
ggccactggggcccattacaagatcaagccaattctgaacgacttggatgtttgcccttgcctatcattggtcat

SEQ ID NO: 250110 - DNA, 75 bp, Artificial Sequence
  Synthetic
tggagatggatctggaggtatttcgagagtcgttttgagcatgttcccagattctaaacttgtgtttaacagcct

SEQ ID NO: 250111 - DNA, 75 bp, Artificial Sequence
  Synthetic
attagaagtgaacgacttgatggcatcaggcactcaccctttaccgccgtctgcccttatgagaggaggtgacga

SEQ ID NO: 250112 - DNA, 75 bp, Artificial Sequence
  Synthetic
cataacctctcgagtgatagacttcgagtctatttgggaaaaaccttctgatttgagaaatcccctcacttggaa

SEQ ID NO: 250113 - DNA, 75 bp, Artificial Sequence
  Synthetic
gtatttccattctatacaatccaagttgagatcacagtttgacttaatagtttgtgatgccgaagtgacagatat

SEQ ID NO: 250114 - DNA, 75 bp, Artificial Sequence
  Synthetic
agagtcagtcaacaagattaccttgttactatctgatttctcaatgtcgattaagggtcccttatatctaatctt

SEQ ID NO: 250115 - DNA, 75 bp, Artificial Sequence
  Synthetic
taagacctacgggactatgctcgtgaatccagattataaggcaatccaccatctatcccgagcattcccaaatgt

SEQ ID NO: 250116 - DNA, 75 bp, Artificial Sequence
  Synthetic
gacagggtttgttactcaaatgacatcatctttctcgtccgagatctaccttagattctccaaaacaggttattt

SEQ ID NO: 250117 - DNA, 75 bp, Artificial Sequence
  Synthetic
cttcagagaccatgagctgctgacggcatctacagtcagagaaatgagtctagtattattcaattgcagtaatcc

SEQ ID NO: 250118 - DNA, 75 bp, Artificial Sequence
  Synthetic
taagagtgagatgctgagagccagaaccctgaattaccaagacttgataagaggctttcctccggagattatctc

SEQ ID NO: 250119 - DNA, 75 bp, Artificial Sequence
  Synthetic
caatccttacaatgagatgataattaccctgatagacagtgaggtagagtccttcttagttcacaaggtggttga

SEQ ID NO: 250120 - DNA, 75 bp, Artificial Sequence
  Synthetic
tgatttggagcttaagagaggagccccgtccaagatggccattataatcgccgttgccattttgttctctaacag

SEQ ID NO: 250121 - DNA, 75 bp, Artificial Sequence
  Synthetic
tgtcctcaatgtgtctaagtcattgaatgagccaaagttcttccccccatctgatccaaagctgttgaggcactt

SEQ ID NO: 250122 - DNA, 75 bp, Artificial Sequence
  Synthetic
caacatatgctctagtacacttctattcctgtctacggcacttggagatttgtctaacttcacaagactccacga

SEQ ID NO: 250123 - DNA, 75 bp, Artificial Sequence
  Synthetic
gctctacaactctcctgtgacttattactttggaaagcagactatcaaagggaggaggtatctatcgtggagttg

SEQ ID NO: 250124 - DNA, 75 bp, Artificial Sequence
  Synthetic
ggccaactcaagtccaatcttcaaaaaggtggcatgcaactcctctatcagtctatcctctcactggataaggtt

SEQ ID NO: 250125 - DNA, 75 bp, Artificial Sequence
  Synthetic
gatatacaagatagtcaaaaccactcgcctgaattgctctcctagggacatgttaagagagacagaagcttgcct

SEQ ID NO: 250126 - DNA, 75 bp, Artificial Sequence
  Synthetic
tagaacctataacaagtggatcaacataagagacacaagatctagaacttcgatattggactactgctgtcttta

SEQ ID NO: 250127 - DNA, 75 bp, Artificial Sequence
  Synthetic
gtctaatcaatggtgatagacttggagagcatcattgaaaaaaacaggtagcaattaccttatgcattgtcctgt

SEQ ID NO: 250128 - DNA, 75 bp, Artificial Sequence
  Synthetic
aaaacaggtagcaattaccttatgcattgtcctgtgattatttttgatttttatatggtttttttgttaagcgtc

SEQ ID NO: 250129 - DNA, 75 bp, Artificial Sequence
  Synthetic
agtggttacctagctcatcagaaggttccagggtttacctgtaccggggtcgttaatgaggcagagacatataca

SEQ ID NO: 250130 - DNA, 75 bp, Artificial Sequence
  Synthetic
cgtggaaatggatatttacggcaggactctccattcccccatgtttccttcaggagtatgttccaagctatatcc

SEQ ID NO: 250131 - DNA, 75 bp, Artificial Sequence
  Synthetic
gccatgtcacgaatcatatatttggatccttctcttggtggtgtttctggaatgtccttaggaaggtttcacata

SEQ ID NO: 250132 - DNA, 75 bp, Artificial Sequence
  Synthetic
aaaaacaggtagcaattaccttatgcattgtcctgtgattatttttgatttttatatggtttttttgttaagcgt

SEQ ID NO: 250133 - DNA, 75 bp, Artificial Sequence
  Synthetic
acgcttaacaacaaaatcaaagaagacatagacagtatcagcgacctaaacaaaatgtaacactcctacaatgga

SEQ ID NO: 250134 - DNA, 75 bp, Artificial Sequence
  Synthetic
gtctgacaagattgtgttcaaggtgaacaaccaagtcgtttctttgaagcccgaggtcatatcggatcaatatga

SEQ ID NO: 250135 - DNA, 75 bp, Artificial Sequence
  Synthetic
gtataaatatcctgccatcctagatggaaagaaaccagggataactttaggaaaagcacctgatctaagcaccgc

SEQ ID NO: 250136 - DNA, 75 bp, Artificial Sequence
  Synthetic
ctacaagtccatcttatcaggtatgaagtctgcaaagctcgacccagacgatgtttgttcttacttggcagctgc

SEQ ID NO: 250137 - DNA, 75 bp, Artificial Sequence
  Synthetic
tatgcatctcttcgagggggtctgtcccgaggactgggtcagttatgggattgtcattgcaaagaagggggagaa

SEQ ID NO: 250138 - DNA, 75 bp, Artificial Sequence
  Synthetic
gattaaccctagtgtgatcgttgatataacccgcacaaatgttgagggaaattgggctcaagcgggaggaactga

SEQ ID NO: 250139 - DNA, 75 bp, Artificial Sequence
  Synthetic
agtgatcagagaccctaccacggcagagcatgcgtcattggttgggctgttactgtgtctgtataggttaagcaa

SEQ ID NO: 250140 - DNA, 75 bp, Artificial Sequence
  Synthetic
gatagttggccaaaacactgcaaactataagaccaatgtggctgacagaatggagcaaatattcgaaacggctcc

SEQ ID NO: 250141 - DNA, 75 bp, Artificial Sequence
  Synthetic
ttttgcgaaggtggtagaacatcacacattgatgactacccacaagatgtgtgccaattggagcactataccgaa

SEQ ID NO: 250142 - DNA, 75 bp, Artificial Sequence
  Synthetic
cttcagattcttggtaggtacatatgatatgttctttgcaagagttgagcacatatattctgctctcagagtcgg

SEQ ID NO: 250143 - DNA, 75 bp, Artificial Sequence
  Synthetic
aacagtggtgactgcatatgaggattgctctgggttggtctctttcaccgggttcatcaaacagatcaatctatc

SEQ ID NO: 250144 - DNA, 75 bp, Artificial Sequence
  Synthetic
tcctagggatgcgctgctatatttctttcataaaaactttgagggagagatcaagagaatgtttgaaccagggca

SEQ ID NO: 250145 - DNA, 75 bp, Artificial Sequence
  Synthetic
agagacagcagtcccccattcatacttcattcatttcagggcactcggattgagtggcaagtccccatattcttc

SEQ ID NO: 250146 - DNA, 75 bp, Artificial Sequence
  Synthetic
caatgctgtgggtcatactttcaatctaattcactttgttggatgctatatgggtcagatcaggtctctcaatgc

SEQ ID NO: 250147 - DNA, 75 bp, Artificial Sequence
  Synthetic
tacagtgatccaaacatgtgcaccccacgaaatgtcagtcctaggaggatatctcggagaagagttctttggtaa

SEQ ID NO: 250148 - DNA, 75 bp, Artificial Sequence
  Synthetic
aggcacattcgagaggaggtttttcagggatgagaaagaaatgcaagattatacagagttggagggggccagagt

SEQ ID NO: 250149 - DNA, 75 bp, Artificial Sequence
  Synthetic
ggaagcttcactggctgatgatgggactgtggactcagatgaggaagatttcttctctggagaaactagaagtcc

SEQ ID NO: 250150 - DNA, 75 bp, Artificial Sequence
  Synthetic
tgaagcagtctacagtcggataatgatgaataacggcaagctaaagaaagtccatatacgcaggtatatagcagt

SEQ ID NO: 250151 - DNA, 75 bp, Artificial Sequence
  Synthetic
gagctctaatcatcaagccagaccgaactcttttgccgaattcttgaacaaggtatatgcagatggttcttaatc

SEQ ID NO: 250152 - DNA, 75 bp, Artificial Sequence
  Synthetic
tgaaggtttcttgggagatggaaatctacagataagtaaggttgtgagacaggctccaagaaaaaaacttaacac

SEQ ID NO: 250153 - DNA, 75 bp, Artificial Sequence
  Synthetic
cactcctcgattcgtggtggcacaatgagcaaagacttggtacaccctagtctgatccgagcggggatagtggaa

SEQ ID NO: 250154 - DNA, 75 bp, Artificial Sequence
  Synthetic
ttggaaatggcagaagagaccactgatctgatcaacaggaccattgagagcaatcaagctcaccttcagggtgag

SEQ ID NO: 250155 - DNA, 75 bp, Artificial Sequence
  Synthetic
ccgttttatgttgattccttgccagaaaacatgggcagattgaaaatagaggacaaatctattaggaccaagacc

SEQ ID NO: 250156 - DNA, 75 bp, Artificial Sequence
  Synthetic
gaagaagaagagggagatgaatgcagctctgaagaggatgactatttgtctgagggacacgacccattagttctc

SEQ ID NO: 250157 - DNA, 75 bp, Artificial Sequence
  Synthetic
cttcaaaattttcttgacgaaattggggccaaagctgtcaagaagttgaagactggcgaggggttcttcagggtg

SEQ ID NO: 250158 - DNA, 75 bp, Artificial Sequence
  Synthetic
tggtcagctctgtcggatgacataaaggggtatgtatctactcatgtaataacatctggggctaggagcactaag

SEQ ID NO: 250159 - DNA, 75 bp, Artificial Sequence
  Synthetic
agcatacaaactcagacagaaccaactgcctcatataattcaggacacgagagtctgcgggacccctggtgcatg

SEQ ID NO: 250160 - DNA, 75 bp, Artificial Sequence
  Synthetic
catgaccagaaggataagaaagacagcgcaattgggcccgcaagggtctcagacgttgaatcggctgctgacaag

SEQ ID NO: 250161 - DNA, 75 bp, Artificial Sequence
  Synthetic
gaagagactcgagatatagaaggagaagtcgcccatcaggtcgcagaaagcttctcgaagaaatacaaatttcct

SEQ ID NO: 250162 - DNA, 75 bp, Artificial Sequence
  Synthetic
tctagatcttcgggaatattcttgtggaattttgaacagcttaagatgaatctggatgacattgtgaaggcagcc

SEQ ID NO: 250163 - DNA, 75 bp, Artificial Sequence
  Synthetic
atgaatgtacctggagttgataagatagctgagaaaggaggcaagcttcccctgagatgcattctaggatttgta

SEQ ID NO: 250164 - DNA, 75 bp, Artificial Sequence
  Synthetic
gctttagactcttcaaagagatttaggttgcttgcaaacaacgacaaggtggccagactcatccaagatgatatc

SEQ ID NO: 250165 - DNA, 75 bp, Artificial Sequence
  Synthetic
aacagttacatggcccggctagaggatgcagattagaggctataaggaaccataatgaaatccagaattaggcag

SEQ ID NO: 250166 - DNA, 75 bp, Artificial Sequence
  Synthetic
tccgattttgaaatgaaaaaaacgtgtaacatccctaaaaagatgaacttcctaaagaagatggtgagaagttgc

SEQ ID NO: 250167 - DNA, 75 bp, Artificial Sequence
  Synthetic
aaggatgaagagacccaaaagtatccgtcagcatcggcgcctccagatgatgacgacctttggatgcctccgcct

SEQ ID NO: 250168 - DNA, 75 bp, Artificial Sequence
  Synthetic
gagtatgtccctttaactcaggttaaggggaaggccagcatacgaaatttttgtatcaatggggaggtcaagata

SEQ ID NO: 250169 - DNA, 75 bp, Artificial Sequence
  Synthetic
tgtagtccaaacggttactcctttaagatactcaggcatatcctcaagtcttttgataacatttactctgggaac

SEQ ID NO: 250170 - DNA, 75 bp, Artificial Sequence
  Synthetic
cggaggatgatcgggttagtcaaagtggttatagggctggtactttcaggatctccagtcccggaaggaatgaac

SEQ ID NO: 250171 - DNA, 75 bp, Artificial Sequence
  Synthetic
tgggtttacaaactccgtaggaccttaatatttcagtgggcagagtcgtatggaccattggaaggagaagagctt

SEQ ID NO: 250172 - DNA, 75 bp, Artificial Sequence
  Synthetic
gagtactcacaggaaattacatgggatgacgaggcagagtttgtaggcctgcaaatcagagtgagtgccagacaa

SEQ ID NO: 250173 - DNA, 75 bp, Artificial Sequence
  Synthetic
tgtcacatccaggggcgtctctggtgcatcaacatgaactctagagcatgtcagttatgggccgatatgatcttg

SEQ ID NO: 250174 - DNA, 75 bp, Artificial Sequence
  Synthetic
aagacccaacaatctccggatgatgaaaacacctcacttttattagagtagactctagcccacagctttgtttct

SEQ ID NO: 250175 - DNA, 75 bp, Artificial Sequence
  Synthetic
cagttgttacctctgtccgcagtagagaaaatccgcgagcaatagaacaattaacgcactggtgcccgctttcag

SEQ ID NO: 250176 - DNA, 75 bp, Artificial Sequence
  Synthetic
cacaatacatataacctactaaccagtttgtcttccgattcaggttcgagcaaaaatgtgaaaaaaactgcatga

SEQ ID NO: 250177 - DNA, 75 bp, Artificial Sequence
  Synthetic
aaagactcaacagccctctaactgccatcatgaatataccttgctttgctgtgatcctcagcttagctactacac

SEQ ID NO: 250178 - DNA, 75 bp, Artificial Sequence
  Synthetic
attctctgggagaattccccttgtatacgattcccgagaaaatagagaaatggacccccatagacatgatccatc

SEQ ID NO: 250179 - DNA, 75 bp, Artificial Sequence
  Synthetic
ttagttgccctaataacctgctgtctgaggaagaaggttgcaatacagagtctcctttcacctacttcgagctca

SEQ ID NO: 250180 - DNA, 75 bp, Artificial Sequence
  Synthetic
agagtggttacctagcccatcagaaggtcccaggatttacatgcactggggttgtgaatgaggcagagacataca

SEQ ID NO: 250181 - DNA, 75 bp, Artificial Sequence
  Synthetic
caaactttgtcggatatgtcaccaccaccttcaaaaggaagcactttaaacctacagtggctgcttgtcgtgatg

SEQ ID NO: 250182 - DNA, 75 bp, Artificial Sequence
  Synthetic
cctacaactggaaagtatcaggggacccccgatatgaagaatctctacacaccccgtatcccgacagcagctggt

SEQ ID NO: 250183 - DNA, 75 bp, Artificial Sequence
  Synthetic
taaggactgtgaccacaaccaaagaagcccttcttataatatcgccaagcattgtagagatggacatatatggca

SEQ ID NO: 250184 - DNA, 75 bp, Artificial Sequence
  Synthetic
ggacccttcactctcccatgttcccttcggggaaatgttccaagctctatccttctgtcccctcttgtacaacca

SEQ ID NO: 250185 - DNA, 75 bp, Artificial Sequence
  Synthetic
accatgattacacattgtggttgccagaagattctagtctgagtttgatttgcgacatcttcacttccagcagtg

SEQ ID NO: 250186 - DNA, 75 bp, Artificial Sequence
  Synthetic
gacagaaggccatgaatgggtctcgcatctgcggattcaaggatgaaaggggattttacagatccttgaagggat

SEQ ID NO: 250187 - DNA, 75 bp, Artificial Sequence
  Synthetic
cctgtaagctgacattgtgcgggaaacctggaattaggctgttcgacggaacttgggtctcttttacaaagccgg

SEQ ID NO: 250188 - DNA, 75 bp, Artificial Sequence
  Synthetic
acgttcatgtgtggtgcactcccaaccagttagtcaatatacataacgacagactagatgaggttgaacatctga

SEQ ID NO: 250189 - DNA, 75 bp, Artificial Sequence
  Synthetic
tcgtggacgatatcatcaagaagagagaggagtgtttagacacgctggaaactatacttatgtctcaatcagtta

SEQ ID NO: 250190 - DNA, 75 bp, Artificial Sequence
  Synthetic
gttttagacggttgagccatttcagaaagttagttccaggatatggaaaagcttacactattttgaacggcagct

SEQ ID NO: 250191 - DNA, 75 bp, Artificial Sequence
  Synthetic
taatggaaacaaatgtctactacaaaagagttgacaggtgggcggacattttgccttctaggggatgtctgaaag

SEQ ID NO: 250192 - DNA, 75 bp, Artificial Sequence
  Synthetic
tcggacaacagtgcatggaccctgtcaaaggggtcctcttcaacggaattatcaagggtccggatggacaaatat

SEQ ID NO: 250193 - DNA, 75 bp, Artificial Sequence
  Synthetic
tgattccagagatgcagtcagagcagctcaaacagcatatggatctgttgaaagcagctatgtttcctctccgtc

SEQ ID NO: 250194 - DNA, 75 bp, Artificial Sequence
  Synthetic
atcctttaatcaacagagaggcagtcttcaagaaggatggaaatgccgatgattttgttgatctccatatgcctg

SEQ ID NO: 250195 - DNA, 75 bp, Artificial Sequence
  Synthetic
atgttcaaaaatctgtgtcggatgtcgacctgggcctgcctcattgggggttctggttgttagtcggggcaacag

SEQ ID NO: 250196 - DNA, 75 bp, Artificial Sequence
  Synthetic
tagtagcctttgtggtcttggcgtgcttgctccgtgtatgttgtaggagagtgagaaggagaaggtcactgcgtg

SEQ ID NO: 250197 - DNA, 75 bp, Artificial Sequence
  Synthetic
ccactcaggatatccccctcagcgttgcccctgcccctgtccctcgtgccaaagtggtgtcatcatgggagtctt

SEQ ID NO: 250198 - DNA, 75 bp, Artificial Sequence
  Synthetic
ataaagggctcccaggtacttgatgcctttatcatactgcctgacacatagatcacaacctgattacctgcctca

SEQ ID NO: 250199 - DNA, 75 bp, Artificial Sequence
  Synthetic
gcacaccagatctcacccacatgctgtcaaatctcagttcacaacctccaatcacgattaatagggggttgtctg

SEQ ID NO: 250200 - DNA, 75 bp, Artificial Sequence
  Synthetic
tctataagggggtggtgtcctctcacatattctgttgcctatacttaaaaacctttcctttttattgtctaaata

SEQ ID NO: 250201 - DNA, 75 bp, Artificial Sequence
  Synthetic
tctctgaacacaatcaatagacgactgggttttctggtttctataaagagttgccttctaacatggggtggttca

SEQ ID NO: 250202 - DNA, 75 bp, Artificial Sequence
  Synthetic
aatagtactctcttgagcctttaatcattctgaggtgcaacaaccttggcttgaactaacctcaaggtctaagcg

SEQ ID NO: 250203 - DNA, 75 bp, Artificial Sequence
  Synthetic
ctcctgtcttccaataatatcacaggagtatctcattgttctgtatgatgacaggacacaatatgatgtctctct

SEQ ID NO: 250204 - DNA, 75 bp, Artificial Sequence
  Synthetic
gtattgtagagtttgatctgtcagattgttgccctagactgtcccatataatattattgatgtgaaaaaaacgtg

SEQ ID NO: 250205 - DNA, 75 bp, Artificial Sequence
  Synthetic
cccttgggtcaaagtttacacttcaacactcctcctacttcattttgcaatcatgatggacgtcacggaggtgta

SEQ ID NO: 250206 - DNA, 75 bp, Artificial Sequence
  Synthetic
tgacgacccgatagaccctgttgaaccagagggagagtggaacaacagtccagtagtcccaaacatcctgcggaa

SEQ ID NO: 250207 - DNA, 75 bp, Artificial Sequence
  Synthetic
ctcagactacaatctcaactctcctttgctggaagaccccgccaacctgatgattcaatggctaacatctggtaa

SEQ ID NO: 250208 - DNA, 75 bp, Artificial Sequence
  Synthetic
caggccctccagaatgagtgtcacagagaacaccaccaggtcttacaaagttctaaagacatttttcaaaggatt

SEQ ID NO: 250209 - DNA, 75 bp, Artificial Sequence
  Synthetic
ggatgttgcaacggtgaaaatagggggtgtgggggcccaggcaatgatgggtttgtgggtcctggggtctcactc

SEQ ID NO: 250210 - DNA, 75 bp, Artificial Sequence
  Synthetic
agaatcatcccgaagcaggaaatgcttggctgacttgtctgccttttatcgaaggacccttcctatagagtctat

SEQ ID NO: 250211 - DNA, 75 bp, Artificial Sequence
  Synthetic
tttgaaccacaccctgttgaacaggggattacagacccctaaagaaggggttttgtctgggttaaatagagtcag

SEQ ID NO: 250212 - DNA, 75 bp, Artificial Sequence
  Synthetic
ctatgatcagtccttcggacgttacttgggcaatttgtactcctcttatctcctatttcatgtcatcatattata

SEQ ID NO: 250213 - DNA, 75 bp, Artificial Sequence
  Synthetic
catgaatgcgttggattgggaagaggagaagaccattctggccctgtggagagacataacagcgatagatgtcaa

SEQ ID NO: 250214 - DNA, 75 bp, Artificial Sequence
  Synthetic
aaatgaccgagtctcatttaaggaccccttgtgggggaagctcttggtgacaaaggactttgtctatgcacacaa

SEQ ID NO: 250215 - DNA, 75 bp, Artificial Sequence
  Synthetic
taggaactgtttattcgacaaaaactatacactgatgctaaaagatttgttcctatctagattcaactcattgct

SEQ ID NO: 250216 - DNA, 75 bp, Artificial Sequence
  Synthetic
tatactagtatccccaccagactcaaggtactcggacgatctggctgccaacctgtgccggctttacatttcagg

SEQ ID NO: 250217 - DNA, 75 bp, Artificial Sequence
  Synthetic
tgacaggcttctctccacttgcgggaatgcaggatatgatgtgatcaagatgctggagccttatgtggtggatct

SEQ ID NO: 250218 - DNA, 75 bp, Artificial Sequence
  Synthetic
cctagttagcagagctgagacattccgtccattaattcattcactcggggagttccctgctttcataaaggacaa

SEQ ID NO: 250219 - DNA, 75 bp, Artificial Sequence
  Synthetic
aaccacacaactgataggaacttttggaccaagcgcatcccaattcttcttgatgctccgacaatttgacaatat

SEQ ID NO: 250220 - DNA, 75 bp, Artificial Sequence
  Synthetic
tcatgatctagtatttatttacggatgttaccggcactgggggcatccatacatagactatcggaaggggcttac

SEQ ID NO: 250221 - DNA, 75 bp, Artificial Sequence
  Synthetic
caaactttttgaccaagttcatatgaagaagactatagatcagcaatatcaagagcgactggctagtgatttagc

SEQ ID NO: 250222 - DNA, 75 bp, Artificial Sequence
  Synthetic
cagaaagatcttgcgctggggatttgacaagtactccaaatggtatctagacacaggtgtcattcctaaagacca

SEQ ID NO: 250223 - DNA, 75 bp, Artificial Sequence
  Synthetic
ccccttaaccccttatatagccacacaaacatggcctcctaagcatgttgtggatctcttgggagattcttggca

SEQ ID NO: 250224 - DNA, 75 bp, Artificial Sequence
  Synthetic
cactctcccgataactcagatttttgaagttcctgaatctatggatccttccgaaattctagatgacaaatctca

SEQ ID NO: 250225 - DNA, 75 bp, Artificial Sequence
  Synthetic
ctcccttacccggacaaagctgtcaagttggttgtctgaacacagaggaggacctgtaccaagtgagaaagtgat

SEQ ID NO: 250226 - DNA, 75 bp, Artificial Sequence
  Synthetic
cataaccgctttatcccgacctccggtaaatcccagagaatttctcaagtcaatagaccaaggggggttgccaga

SEQ ID NO: 250227 - DNA, 75 bp, Artificial Sequence
  Synthetic
cgatgaccttattatagggcttaaaccaaaagaaagagagttaaagatagaaggtcgattctttgcgctgatgtc

SEQ ID NO: 250228 - DNA, 75 bp, Artificial Sequence
  Synthetic
ctggaacctgagactgtactttgtgattactgaaaagctgttggccaatcacatcatccctctgtttgatgcact

SEQ ID NO: 250229 - DNA, 75 bp, Artificial Sequence
  Synthetic
tacaatgacagacaatctcaacaaagtgttcaagaagctgatagacagagtgactggtcaagggctaaaagacta

SEQ ID NO: 250230 - DNA, 75 bp, Artificial Sequence
  Synthetic
ctctcgcgttacatatgcattccatctagactatgaaaaatggaacaatcaccagagattagagtcgacaaagga

SEQ ID NO: 250231 - DNA, 75 bp, Artificial Sequence
  Synthetic
tgtgttctccgttctcgacagagcattcggaatgaagaaggtattctctaggacacatgagtttttccaaaagtc

SEQ ID NO: 250232 - DNA, 75 bp, Artificial Sequence
  Synthetic
ctgggtgtactactcagacagatcggatctgatagggatttggaaggaccagatctattgtctcgacatgactga

SEQ ID NO: 250233 - DNA, 75 bp, Artificial Sequence
  Synthetic
aggccccacttgctggaatggtcaggatggaggtttagagggtttacggcaaaaagggtggagtttagttagcct

SEQ ID NO: 250234 - DNA, 75 bp, Artificial Sequence
  Synthetic
ccttatgattgagagagagtcaaaaaccaggaacactagaactaagattttggctcagggagataatcaagtgct

SEQ ID NO: 250235 - DNA, 75 bp, Artificial Sequence
  Synthetic
gtgtcccacctatatgctgtcttctggcctaaataacgaaggactcatgtatgaactggaaaacatctccaaaaa

SEQ ID NO: 250236 - DNA, 75 bp, Artificial Sequence
  Synthetic
tgcaatgtccatatatcgtgcgattgaagaaggtgcgtccaggcttgggctgataataaagaaagaggaaacaat

SEQ ID NO: 250237 - DNA, 75 bp, Artificial Sequence
  Synthetic
gtgtagtttcgactttctgatatatggaaagacgcctctcttcaggggcaacatattagttccggagtctaagcg

SEQ ID NO: 250238 - DNA, 75 bp, Artificial Sequence
  Synthetic
atgggctagagtctcgtgtatttccaatgaccagattgtgaacctggccaacatcatgtcaactgtctccactaa

SEQ ID NO: 250239 - DNA, 75 bp, Artificial Sequence
  Synthetic
cgccttgacagtagctcaacactctcaatctcttgtgaagcccatgcgagacttccttctaatgtcagtccaagc

SEQ ID NO: 250240 - DNA, 75 bp, Artificial Sequence
  Synthetic
aatctatcattatctgttattcagccctattataaaggatcgagtgtacaaggtgctgaactcgaaggatgatga

SEQ ID NO: 250241 - DNA, 75 bp, Artificial Sequence
  Synthetic
ctttcttctggccatgtcacgaattatatacttagatccttctcttggaggtgtatcagggatgtccctaggaag

SEQ ID NO: 250242 - DNA, 75 bp, Artificial Sequence
  Synthetic
atttcacatcaggcaattctcagaccctgtatcggaagggctaaccttctggagggagatatggctgagttcttc

SEQ ID NO: 250243 - DNA, 75 bp, Artificial Sequence
  Synthetic
cgagacttgggttcatcatctttgtcaagaggctgggaacccagacttaggagacaggagtttagagagttttac

SEQ ID NO: 250244 - DNA, 75 bp, Artificial Sequence
  Synthetic
acgtctcttagaagaccccactacattgaatataagagggggggccagtccgaccatcttattgaaggaggccat

SEQ ID NO: 250245 - DNA, 75 bp, Artificial Sequence
  Synthetic
caggaaagccttatatgatgaggtagacagagtagagaattctgaatttagagaggccatcatcttatctaagac

SEQ ID NO: 250246 - DNA, 75 bp, Artificial Sequence
  Synthetic
tcaccgagacaacttcatactttatttgaagtcgatagagcctctcttcccgcgtttcttgagtgagctcttcag

SEQ ID NO: 250247 - DNA, 75 bp, Artificial Sequence
  Synthetic
ctcttccttcctaggtattcctgagtcaataataggactcatacagaactcaaggactgtcaggagacagttcag

SEQ ID NO: 250248 - DNA, 75 bp, Artificial Sequence
  Synthetic
acggagcctctcaaaaaccttggaagagtctttccttcactctgagatccatgggattaacaggatgacacagac

SEQ ID NO: 250249 - DNA, 75 bp, Artificial Sequence
  Synthetic
tcctcagcgtctcgggagagtctgggcgtgctctgctgagagggcggatcagttgagagagatatcatggggaag

SEQ ID NO: 250250 - DNA, 75 bp, Artificial Sequence
  Synthetic
gaaagttgttgggacgacagttcctcatccctcagagatgttgaccttgatccccaaatcttccgtggcttgtgg

SEQ ID NO: 250251 - DNA, 75 bp, Artificial Sequence
  Synthetic
atgttacacaagggatgttggaaaccctcggatctctgtctccgtgttgccatcctttgacccttccttcctatc

SEQ ID NO: 250252 - DNA, 75 bp, Artificial Sequence
  Synthetic
cctcggatctctgtctccgtgttgccatcctttgacccttccttcctatcgaggggccctcttaaagggtattta

SEQ ID NO: 250253 - DNA, 75 bp, Artificial Sequence
  Synthetic
ggatcttccacatctatgtccactcagttgttccactcatgggagaaggttacaaatgttcatgtggttaagagg

SEQ ID NO: 250254 - DNA, 75 bp, Artificial Sequence
  Synthetic
gccttatcgctcaaggagtccatcaactggtttgtgtctcgagaatctaacttggcaaagactttgatagggaac

SEQ ID NO: 250255 - DNA, 75 bp, Artificial Sequence
  Synthetic
atactgtccctaacaggaccctcttttcccatagaagaggctcctgtcttcaaaaggacaggctcagccttacat

SEQ ID NO: 250256 - DNA, 75 bp, Artificial Sequence
  Synthetic
cgattcaaatcagcaaggtatagtgaaggcggttattcagctgtgtgtcccaaccttctgtctcacatatctgtc

SEQ ID NO: 250257 - DNA, 75 bp, Artificial Sequence
  Synthetic
agcactgataccatgtctgatttgacacaggatgggaccaacttcgacttcatgttccagcccctgatgttgtat

SEQ ID NO: 250258 - DNA, 75 bp, Artificial Sequence
  Synthetic
gcacaaacctggacatcggagctagtccagaaggaccttaggttggcagattccacttttcattggcatttaagg

SEQ ID NO: 250259 - DNA, 75 bp, Artificial Sequence
  Synthetic
tgtcaaaaatgtatcaggcccattgaggaggttactctagatgcacctcagctttttgcatttccagacatatct

SEQ ID NO: 250260 - DNA, 75 bp, Artificial Sequence
  Synthetic
tctagaatctcaagaatggtttccggggcagttcctcaattcagaaagctgcctgaggttgggcttaaggccgga

SEQ ID NO: 250261 - DNA, 75 bp, Artificial Sequence
  Synthetic
gacttgacggccctaagcagcagcgagagatcttatcatatagggacggcccaaggactgttatattccatcctg

SEQ ID NO: 250262 - DNA, 75 bp, Artificial Sequence
  Synthetic
gtggcagtccatgaccccgggtataacgacaattccctattccctgtgaacatttatggcaaagtgtccgccaga

SEQ ID NO: 250263 - DNA, 75 bp, Artificial Sequence
  Synthetic
gggtacttaagagggctcgcgagggggattctgataggatcttcgatatgtttcctgacaagaatgaccaacatc

SEQ ID NO: 250264 - DNA, 75 bp, Artificial Sequence
  Synthetic
aacattaatcgtccccttgagttgatttccggggtgatctcttacatattgctaaaactagacgaccatccgtcg

SEQ ID NO: 250265 - DNA, 75 bp, Artificial Sequence
  Synthetic
ctctacatcatgctaaaagaacccgaattaagggcagagatcttctccatccctcagaaagtgccagcggcttac

SEQ ID NO: 250266 - DNA, 75 bp, Artificial Sequence
  Synthetic
cccactaccatggaagaaggcaacaggtcggtcttgtgttatcttcaacaagtcctcaggtatgagagagacagc

SEQ ID NO: 250267 - DNA, 75 bp, Artificial Sequence
  Synthetic
atgtctttccccccgggaagtgacatcttgtggatcttttctgactttaggagtataaaaatgacttatctgaca

SEQ ID NO: 250268 - DNA, 75 bp, Artificial Sequence
  Synthetic
ctgataacctttcaggctttcctatggctgcagagagtagagagaagcttaccgaaacaggtaagagttagattg

SEQ ID NO: 250269 - DNA, 75 bp, Artificial Sequence
  Synthetic
cgacagttgaactctctcatgagacaggtcttgggtggtcatggagaagatacgattgattccgacgatgagata

SEQ ID NO: 250270 - DNA, 75 bp, Artificial Sequence
  Synthetic
ttgtcccttctaaaagaatctctgagaaggacaagatgggtggatcaagaggtccgccatgcggctaagtcaatg

SEQ ID NO: 250271 - DNA, 75 bp, Artificial Sequence
  Synthetic
actccggacctcaaccctgttcctaagatctctcgtaaaatcgggtcttcagaatggatttgctctgcacagcag

SEQ ID NO: 250272 - DNA, 75 bp, Artificial Sequence
  Synthetic
atagccatctttacttctctgaatcctgcatctgcttctgatattgacctgagatctctgtcacgccaatatcag

SEQ ID NO: 250273 - DNA, 75 bp, Artificial Sequence
  Synthetic
aatcctctcatatctggcctaagagtggtgcaatgggccaccggggctcattacaaaattaagcctattctgaac

SEQ ID NO: 250274 - DNA, 75 bp, Artificial Sequence
  Synthetic
gatttggatgcttgcccttgtttatccttggttataggagacggatcggggggcatttcaagagttgttctgagc

SEQ ID NO: 250275 - DNA, 75 bp, Artificial Sequence
  Synthetic
atgttcccagactctaagcttgttttcaacagtttgttggaagtgaatgatctgatggcgtcgggcacccaccct

SEQ ID NO: 250276 - DNA, 75 bp, Artificial Sequence
  Synthetic
ttaccaccgtcagcccttatgagagggggtgatgatatcacatctagagtaatagactttgactcgatatgggaa

SEQ ID NO: 250277 - DNA, 75 bp, Artificial Sequence
  Synthetic
aagccgtctgacttgaggaatccactcacttggaagtactttcactccatacaatccaagcaaagatcacagttt

SEQ ID NO: 250278 - DNA, 75 bp, Artificial Sequence
  Synthetic
gacttaatagtctgtgatgctgaggtgacagacatagaatcagtcaacaagatcacattgttgctgtcggacttc

SEQ ID NO: 250279 - DNA, 75 bp, Artificial Sequence
  Synthetic
tcaatgtcaatcaaaggccccttatgtttaatctttaaaacatatgggaccatgctcgtgaatccagactataag

SEQ ID NO: 250280 - DNA, 75 bp, Artificial Sequence
  Synthetic
gcaatccaccatctatcaagagcgttccccaatgtgaccgggtttgtcacccaaatgacatcttccttctcttct

SEQ ID NO: 250281 - DNA, 75 bp, Artificial Sequence
  Synthetic
gagatctatcttagattctcaaaaacaggatatttcttcagagatcatgagctattgactgcatcaacaatcaga

SEQ ID NO: 250282 - DNA, 75 bp, Artificial Sequence
  Synthetic
gagatgagtctagtactgttcaactgtagcaacccgaagagtgagatgctgagggcgaggaccttaaattaccag

SEQ ID NO: 250283 - DNA, 75 bp, Artificial Sequence
  Synthetic
gacttgataagaggctttccccctgagatcatctctaatccatacaatgagatgattattaccttgattgacagc

SEQ ID NO: 250284 - DNA, 75 bp, Artificial Sequence
  Synthetic
gaggtggagtccttcttggttcacaaggtggttgatgacttagagctcaaaagaggatccccgtccaagatggcc

SEQ ID NO: 250285 - DNA, 75 bp, Artificial Sequence
  Synthetic
atcataatcgccattgctgtcctcttctctaacagtgttttcaatgtgtctaaatctctgaatgagccaaaattc

SEQ ID NO: 250286 - DNA, 75 bp, Artificial Sequence
  Synthetic
ttccccccttcggatccaaagttgctgaggcacttcaacatatgttccagtacacttctattcttttctacagca

SEQ ID NO: 250287 - DNA, 75 bp, Artificial Sequence
  Synthetic
atgggagatctgtctaacttcacaaggctccacgagctctacaactctcctgtaacttattattttggaaagcag

SEQ ID NO: 250288 - DNA, 75 bp, Artificial Sequence
  Synthetic
accgttaaaggaagaaggtatttaacatggagctgggctaactcaagcccgatcttcaaaaaggtagcatgcaac

SEQ ID NO: 250289 - DNA, 75 bp, Artificial Sequence
  Synthetic
tcctccatcagtctatcctctcactggataaggctgatatacaagatagttaaaaccactcgcctgaactgttct

SEQ ID NO: 250290 - DNA, 75 bp, Artificial Sequence
  Synthetic
tctaaagacatgttgagggagacggaagcttgcctgagaacatacaacaaatggatcagcataagggacatacga

SEQ ID NO: 250291 - DNA, 75 bp, Artificial Sequence
  Synthetic
tcgaggacctctattctggactactgttgtctttaatccaatcaatatggataagctgtgagagcatcattgaaa

SEQ ID NO: 250292 - DNA, 75 bp, Artificial Sequence
  Synthetic
aaaaacaagtaacaattacattatgcatcatcatgtgattgtttttaatttttatatggtttttttgttaagcgt

SEQ ID NO: 250293 - DNA, 75 bp, Artificial Sequence
  Synthetic
acgcttaacaacaaaatcaaagaagacatagacagtagcagtgacctaaacaagatgtaacactcctacaatgga

SEQ ID NO: 250294 - DNA, 75 bp, Artificial Sequence
  Synthetic
gtctgacaagattgtgttcaaggtgaataatcaagttgtgtctttgaagcctgaggtcatatctgatcaatatga

SEQ ID NO: 250295 - DNA, 75 bp, Artificial Sequence
  Synthetic
gtataaatatcctgcaattctagatggaaagaaaccagggataaccttggggaaggcccccgatttaaatactgc

SEQ ID NO: 250296 - DNA, 75 bp, Artificial Sequence
  Synthetic
ttataagtctatcttgtcaggaatgaaggctgctaagcttgatccagacgatgtttgctcttacttggcagctgc

SEQ ID NO: 250297 - DNA, 75 bp, Artificial Sequence
  Synthetic
tatgcctctgttcgagggggtttgtcctgaggactgggtcagttatgggatcgtcattgcaaagaagggggagaa

SEQ ID NO: 250298 - DNA, 75 bp, Artificial Sequence
  Synthetic
aatcaaccctagcgtaatcgttgatatagctcgcacaaatgtagaagggaattgggctcaggccggaggaactga

SEQ ID NO: 250299 - DNA, 75 bp, Artificial Sequence
  Synthetic
tgtgatcagagaccccacaacggcagagcacgcgtcattggtgggattgttgttatgtctgtatcggttgagcaa

SEQ ID NO: 250300 - DNA, 75 bp, Artificial Sequence
  Synthetic
gatagttggtcagaatacggcaaattataaaactaatgtggctgacagaatggaacagatatttgaaactgcccc

SEQ ID NO: 250301 - DNA, 75 bp, Artificial Sequence
  Synthetic
ttttgcaaaggtggtagaacatcacacattgatgaccacccataaaatgtgcgctaactggagcactatacccaa

SEQ ID NO: 250302 - DNA, 75 bp, Artificial Sequence
  Synthetic
cttcaggttcttggtaggtacatatgatatgttctttgcaagggttgaacatatatattcagctctcagagtcgg

SEQ ID NO: 250303 - DNA, 75 bp, Artificial Sequence
  Synthetic
gacggtggtgacagcatatgaagattgctctggattagtctctttcacagggtttatcaaacagatcaatctatc

SEQ ID NO: 250304 - DNA, 75 bp, Artificial Sequence
  Synthetic
tcctagagatgcactgctatatttctttcataaaaactttgagggagagatcaagagaatgttcgagccaggaca

SEQ ID NO: 250305 - DNA, 75 bp, Artificial Sequence
  Synthetic
agaaactgctgttccccattcatacttcattcatttcaggtcacttggcttgagcggcaagtccccatactcctc

SEQ ID NO: 250306 - DNA, 75 bp, Artificial Sequence
  Synthetic
caatgcagtaggtcacaccttcaatttgattcattttgtgggatgctatatgggtcaaatcaggtcgctaaatgc

SEQ ID NO: 250307 - DNA, 75 bp, Artificial Sequence
  Synthetic
gacggtgatacaaacatgtgcacctcatgagatgtcagtcctaggaggatatctgggggaagaattcttcgggaa

SEQ ID NO: 250308 - DNA, 75 bp, Artificial Sequence
  Synthetic
aggcactttcgagaggaggttcttcagggatgaaaaagagatgcaggactatacagagctggaggaggccagagt

SEQ ID NO: 250309 - DNA, 75 bp, Artificial Sequence
  Synthetic
ggaagcttcacttgctgatgatgggactgtagactcagatgaggaggatttcttctcaggagaaaccagaagtcc

SEQ ID NO: 250310 - DNA, 75 bp, Artificial Sequence
  Synthetic
agaggcagtatacagccgaataatgatgaacggtggcaagttgaagaaagtccatatacgtaggtatatagcagt

SEQ ID NO: 250311 - DNA, 75 bp, Artificial Sequence
  Synthetic
gagctctaatcatcaggcgagacctaactcttttgccgaatttttgaacaaggtctatgccgatggatcataatc

SEQ ID NO: 250312 - DNA, 75 bp, Artificial Sequence
  Synthetic
agagggcttcttagaggatgacagtttgcagaagatcaaagttgtgagacggactccaagaaaaaaacttaacac

SEQ ID NO: 250313 - DNA, 75 bp, Artificial Sequence
  Synthetic
cactcttcaattcgtggtgaaaaaaatgagtaaggacttggtacatcctagtcttatcagagccgggatagtaga

SEQ ID NO: 250314 - DNA, 75 bp, Artificial Sequence
  Synthetic
actagagatggcagaggagaccactgatctgattaacaggaccatagagagcaatcaagcccaccttcagggaga

SEQ ID NO: 250315 - DNA, 75 bp, Artificial Sequence
  Synthetic
gccattttctgttgattccttgccagaagatatgagcagattgagaattagggacagttctggcgggaccaaaat

SEQ ID NO: 250316 - DNA, 75 bp, Artificial Sequence
  Synthetic
ggaggtggaggacagagaggaaggcagctcggaggaagatgactatatgtctgagggacaagacccattggtcct

SEQ ID NO: 250317 - DNA, 75 bp, Artificial Sequence
  Synthetic
ctttcagaatttcctcgacgagattggggccaaagcggtcaaaaagttgaaaactggtgagggattcttcagagt

SEQ ID NO: 250318 - DNA, 75 bp, Artificial Sequence
  Synthetic
gtggtcatccctttcagatgacataaaggggtatgtctctacccatataatgaaatccaaggcgacaaatactaa

SEQ ID NO: 250319 - DNA, 75 bp, Artificial Sequence
  Synthetic
aagtagacagactcaaacagaaccaaccacatcatctagttctggaaatgagagtctgtgggattctcggtgcat

SEQ ID NO: 250320 - DNA, 75 bp, Artificial Sequence
  Synthetic
gtctgatcaaaaggatgagaaagaccactctactgatcatgagatggtcttagatgttgattctgctacagacaa

SEQ ID NO: 250321 - DNA, 75 bp, Artificial Sequence
  Synthetic
agaagagattcgagatatagaaggagaagtcgctcaccaggtcgcggaaagcttttcaaagaaatacaaatttcc

SEQ ID NO: 250322 - DNA, 75 bp, Artificial Sequence
  Synthetic
ttctagatcttcgggaatattcttgtggaatttcgagcaactcaaaatgaatttagatgacattgtgaaggcagc

SEQ ID NO: 250323 - DNA, 75 bp, Artificial Sequence
  Synthetic
catgaatgtacccggagttgacaagatagcagaaaagggagggaagcttcccttgagatgcattttaggatttgt

SEQ ID NO: 250324 - DNA, 75 bp, Artificial Sequence
  Synthetic
agcttcagactcttcaaagagattccggcttcttgccaataatgacaaggtggcaagactcatacaagaagacat

SEQ ID NO: 250325 - DNA, 75 bp, Artificial Sequence
  Synthetic
caacagctacatggcccggcttgaggatgcagactagggactgttcaaccccctaataaaaccttgaattgggaa

SEQ ID NO: 250326 - DNA, 75 bp, Artificial Sequence
  Synthetic
tttcagtcatgacatgaaaaaaacatgtaacatccctaaaaagatgaatttcctaaagaagatggttagaagctg

SEQ ID NO: 250327 - DNA, 75 bp, Artificial Sequence
  Synthetic
caaggaggaagagattcagaagtgtccatcagcatcagcgcctccggacgatgatgacctttggatgcctccacc

SEQ ID NO: 250328 - DNA, 75 bp, Artificial Sequence
  Synthetic
agaatatgtccctttgactcaggttaaaggcaaagccagcgtaagaaacttttgtataagtggggaggtcaagat

SEQ ID NO: 250329 - DNA, 75 bp, Artificial Sequence
  Synthetic
atgcagtccaaacgggtattctttcaagatactcaggcatatcttgaagtcattcgacaacgtttactctgggaa

SEQ ID NO: 250330 - DNA, 75 bp, Artificial Sequence
  Synthetic
caggaggatgatagggttggtcaaggtggttatagggcttgtactttcaggatctccagtcccagagggaatgaa

SEQ ID NO: 250331 - DNA, 75 bp, Artificial Sequence
  Synthetic
ctgggtttacaaacttcgtaggacattaatattccagtgggcagagtcctacggaccactggaaggagaagagct

SEQ ID NO: 250332 - DNA, 75 bp, Artificial Sequence
  Synthetic
tgagtattcacaagagattacgtgggatgatgaggcagaatttgttggcttacagatcagcgtgagtgctagaca

SEQ ID NO: 250333 - DNA, 75 bp, Artificial Sequence
  Synthetic
gtgtcacatccagggtcgtctctggtgtataaacatgaactcaagagcatgtcagttgtgggctgatatgatctt

SEQ ID NO: 250334 - DNA, 75 bp, Artificial Sequence
  Synthetic
gaagacccaacagtccccagatgatgagaacacctcacttttattagagtagactttaattcacatctctgtctc

SEQ ID NO: 250335 - DNA, 75 bp, Artificial Sequence
  Synthetic
tcagttgttacctctgtttgcagtagagaataaccgcgagcaatagaacaattaccgcaatggtgcccgctttca

SEQ ID NO: 250336 - DNA, 75 bp, Artificial Sequence
  Synthetic
gcacaacacatataacctactaacctgtttgtcttcctattcagggttgagcaaaaatgtgaaaaaaactacata

SEQ ID NO: 250337 - DNA, 75 bp, Artificial Sequence
  Synthetic
aaaaggcacaacagccctctcacagccatcatgaatataccttgctttgctgttatcttcagtttagccattaca

SEQ ID NO: 250338 - DNA, 75 bp, Artificial Sequence
  Synthetic
tattccttgggagagttccccttgtacacgatccccgagaagatagaaaaatggactcccatagacatgatccat

SEQ ID NO: 250339 - DNA, 75 bp, Artificial Sequence
  Synthetic
ctgagttgccctaacaacctattgtcggaggaagagggctgcaacacagagtctcccttcacatactttgagctc

SEQ ID NO: 250340 - DNA, 75 bp, Artificial Sequence
  Synthetic
aagagtgggtacctcgcgcaccagaaggtcccagggtttacatgtactggggttgtaaatgaggcagagacatac

SEQ ID NO: 250341 - DNA, 75 bp, Artificial Sequence
  Synthetic
acaaacttcgtcgggtatgtcaccactacctttaaaaggaaacacttcatgcctaccgtggctgcctgtcgcgat

SEQ ID NO: 250342 - DNA, 75 bp, Artificial Sequence
  Synthetic
gcttacaactggaaggtgtctggagacccgaggtatgaggagtcactacacactccgtaccctgacagcagttgg

SEQ ID NO: 250343 - DNA, 75 bp, Artificial Sequence
  Synthetic
ttaagaactgtcaccacaaccaaagaatctcttctcataatatcgcctagtatcgtggagatggatgtctacggc

SEQ ID NO: 250344 - DNA, 75 bp, Artificial Sequence
  Synthetic
aggactcttcactcccccatgtttccatcaggtatttgttctaagctctatccttctgtcccgtcatgcaagacc

SEQ ID NO: 250345 - DNA, 75 bp, Artificial Sequence
  Synthetic
aaccatgattacacattgtggttgcccgaagatcctagcttgagtttgatctgtgatattttcacctccagcagt

SEQ ID NO: 250346 - DNA, 75 bp, Artificial Sequence
  Synthetic
ggacaaaaggtcatgaacgggtctcgcatctgcgggttcagagacgagcggggattttacagatccttgaagggc

SEQ ID NO: 250347 - DNA, 75 bp, Artificial Sequence
  Synthetic
gcttgtaagctgacgctgtgcgggagacctgggattagattgtttgacgggacttgggtatctttcacaaagcct

SEQ ID NO: 250348 - DNA, 75 bp, Artificial Sequence
  Synthetic
gacattcatgtgtggtgcacccccaatcaattagtcaatatacacaatgatagactggatgagattgagcactta

SEQ ID NO: 250349 - DNA, 75 bp, Artificial Sequence
  Synthetic
attgtggaagacattataaagaaaagggaagagtgtttagacactctggagacaatacttatgtctcagtcaatt

SEQ ID NO: 250350 - DNA, 75 bp, Artificial Sequence
  Synthetic
agttttagacggttgagccatttccgaaaattggttcctggatatggaaaagcttacactattttaaacggcagc

SEQ ID NO: 250351 - DNA, 75 bp, Artificial Sequence
  Synthetic
ttgatggaaacaaacgtctactacaaaagggttgacaagtggactgacattttgccttctaagggatgtctcaaa

SEQ ID NO: 250352 - DNA, 75 bp, Artificial Sequence
  Synthetic
gtcgggcagcaatgcatggagcccgtcaacggagtccttttcaacggaattattaagggccctgatggccagatc

SEQ ID NO: 250353 - DNA, 75 bp, Artificial Sequence
  Synthetic
ttgattccggagatgcagtcagagcagctcaagcaacacatggacttgttaaaggcagctgtgtttccacttcgt

SEQ ID NO: 250354 - DNA, 75 bp, Artificial Sequence
  Synthetic
catcctttaattaaaagagaatcagttttcaaaacggatggtgatgctgatgactttgtggatctccatatgccc

SEQ ID NO: 250355 - DNA, 75 bp, Artificial Sequence
  Synthetic
gatgttcacaaatctgtgtcaggtgtcgacctgggcctgcctcattgggggttttggctgttgatcggggcgacg

SEQ ID NO: 250356 - DNA, 75 bp, Artificial Sequence
  Synthetic
gcagtcgcatttgtggtcttggtgtgcttgcttcgtgtgtgctgtaggagaataagaaggagaagatctctacat

SEQ ID NO: 250357 - DNA, 75 bp, Artificial Sequence
  Synthetic
gcgactcaagagatccccctcagcgtttcctctgcctctgtcccaagagccaaagtggtgtcatcatgggagtct

SEQ ID NO: 250358 - DNA, 75 bp, Artificial Sequence
  Synthetic
tataaagggctcccaggtacttgatacttctatccaattgcctgacacataactcacaacctgactacctgcctc

SEQ ID NO: 250359 - DNA, 75 bp, Artificial Sequence
  Synthetic
ggcacgcccaagatcaaccatatggtgtcaaatctccgttcataccctccgatatgtgatgattggaggagggtt

SEQ ID NO: 250360 - DNA, 75 bp, Artificial Sequence
  Synthetic
gcctgttaattgggtggtggcatcccatcatacattccgttattcttaagttagagtctcttctttctcgttgtc

SEQ ID NO: 250361 - DNA, 75 bp, Artificial Sequence
  Synthetic
taaatagctctgaatataatcactagatgactaggtcttctgatctctacaaagatttgccttctaacatggggt

SEQ ID NO: 250362 - DNA, 75 bp, Artificial Sequence
  Synthetic
ggttcaaatagtactcttttgagcctttaatcatttcgaggtgcgttaatattagcttgaactaacctcaaggtc

SEQ ID NO: 250363 - DNA, 75 bp, Artificial Sequence
  Synthetic
taaatgctcctgtgattttcaataatctcacagaagcatcttattgttctgtatggtgacaggacacaatataat

SEQ ID NO: 250364 - DNA, 75 bp, Artificial Sequence
  Synthetic
gtctctttgtgtagtagaggtttgattcgtctgattgtatctctaataccgtcctatatgatcttggtgatgtga

SEQ ID NO: 250365 - DNA, 75 bp, Artificial Sequence
  Synthetic
aaaaaacttgcccttaggtcaaagtctacacatcaacaatcctcctgtctcatttccaaccatgatggatatcac

SEQ ID NO: 250366 - DNA, 75 bp, Artificial Sequence
  Synthetic
agaggtgtatgacgacccgatagatcctgttgaaccagaaggagagtggaacagcagccctgtagtccctaatat

SEQ ID NO: 250367 - DNA, 75 bp, Artificial Sequence
  Synthetic
tttgagaaactccgactacaacctaaactctcccttgcttgaagacccagctaatctgatgattcaatggctaac

SEQ ID NO: 250368 - DNA, 75 bp, Artificial Sequence
  Synthetic
ttcagggaacagacccatgagaatgaatgtcacggagaacacaaaccggtcttacagagttttgaaagcattctt

SEQ ID NO: 250369 - DNA, 75 bp, Artificial Sequence
  Synthetic
caaaggaatagatgttgcaacagtcaaaataggaggggcaggggctcaggcaatgatggggttgtgggtcttggg

SEQ ID NO: 250370 - DNA, 75 bp, Artificial Sequence
  Synthetic
atctaactctgaatcatctaggagtaggaggtgcctaactgacttgtctgccttttatcgccgaaccatgcctat

SEQ ID NO: 250371 - DNA, 75 bp, Artificial Sequence
  Synthetic
agaatctattttgaaccacaccttgatgaacagaggattgcagactcccaaggagggagtgttatcaggattaaa

SEQ ID NO: 250372 - DNA, 75 bp, Artificial Sequence
  Synthetic
tagagtcagctatgatcagtccttcggaaggtatttaggtaatttgtactcatcttacctcctatttcatgtcat

SEQ ID NO: 250373 - DNA, 75 bp, Artificial Sequence
  Synthetic
catactatacatgaacgcactggattgggaagaagagaagactatcctagccctatggagagacataacatctat

SEQ ID NO: 250374 - DNA, 75 bp, Artificial Sequence
  Synthetic
agatgtcaaaaatgaccgagtttcctttaaggaccctttatgggggaagctcttggtgacaaaagattttgtcta

SEQ ID NO: 250375 - DNA, 75 bp, Artificial Sequence
  Synthetic
tgcacacaataacaattgtttattcgacaaaaactatacactgatgctgaaggatctgttcttatctcgatttaa

SEQ ID NO: 250376 - DNA, 75 bp, Artificial Sequence
  Synthetic
ctcattgctcatacttgtttccccgccggactctcgttattcagacgatctggctgccaacctgtgtcgacttta

SEQ ID NO: 250377 - DNA, 75 bp, Artificial Sequence
  Synthetic
catctcaggtgatagacttctctccacttgcgggaatgcagggtatgatgtgatcaaaatgctagagccttgcgt

SEQ ID NO: 250378 - DNA, 75 bp, Artificial Sequence
  Synthetic
ggttgaccttctggtccgaagagctgagacattccgtccgctaattcattctctgggagaattccctgccttcat

SEQ ID NO: 250379 - DNA, 75 bp, Artificial Sequence
  Synthetic
aagagataaaaccattcaactgataggaacttttggaccatgtgcctcacaattcttctttatgctacagcagtt

SEQ ID NO: 250380 - DNA, 75 bp, Artificial Sequence
  Synthetic
cgacaatattcatgatttggtatttatatacgggtgttaccggcactgggggcatccctacatagactatagaaa

SEQ ID NO: 250381 - DNA, 75 bp, Artificial Sequence
  Synthetic
ggggctcaccaagctctttgatcaagtccatatgaagaaaactatagatcagcaatatcaagagcgtctagccag

SEQ ID NO: 250382 - DNA, 75 bp, Artificial Sequence
  Synthetic
cgatttagcccgaaagatcttgcgttgggggtttgataagtactccaaatggtatctagatacaggtgtcattcc

SEQ ID NO: 250383 - DNA, 75 bp, Artificial Sequence
  Synthetic
taaagatcatccactagctccctatattgccacacaaacatggccccctaagcatgtggtggatctcctgggaga

SEQ ID NO: 250384 - DNA, 75 bp, Artificial Sequence
  Synthetic
ttcttggcacaccctcccaatgactcaaatttttgaagtccccgaatctatggacccttccgagattctagatga

SEQ ID NO: 250385 - DNA, 75 bp, Artificial Sequence
  Synthetic
caaatctcactccttcacccggacaaagctgtccagttggttgtctgaacatcgaggaggtcctgtacccagtga

SEQ ID NO: 250386 - DNA, 75 bp, Artificial Sequence
  Synthetic
aaaagtgatcataactgctctgtccaggccccccgtcaaccccagagaattcctcaagtcaatagatcaaggggg

SEQ ID NO: 250387 - DNA, 75 bp, Artificial Sequence
  Synthetic
gttgccagacgatgacctaattataggacttaaaccaaaagaaagagagttaaagatagatgggcggttctttgc

SEQ ID NO: 250388 - DNA, 75 bp, Artificial Sequence
  Synthetic
actaatgtcttggaaccttagactgtactttgtgattactgagaagctgttggccaatcacattatccctctttt

SEQ ID NO: 250389 - DNA, 75 bp, Artificial Sequence
  Synthetic
cgatgcactcacaatgacagataatctcaacaaagtgttcaagaagctgatcgatagagtgactggtcaagggct

SEQ ID NO: 250390 - DNA, 75 bp, Artificial Sequence
  Synthetic
caaggactactctcgagtcacctatgccttccatttagattatgagaagtggaacaaccaccagagactcgagtc

SEQ ID NO: 250391 - DNA, 75 bp, Artificial Sequence
  Synthetic
aacaaaggatgtgttttctgttcttgacagagcgttcggaatgaggagggtattctctaggacgcatgagttttt

SEQ ID NO: 250392 - DNA, 75 bp, Artificial Sequence
  Synthetic
tcaaaagtcctggatatattactctgacagatcagatctcatagggatttggaaagatcagatctattgtcttga

SEQ ID NO: 250393 - DNA, 75 bp, Artificial Sequence
  Synthetic
catgactgaaggccctacttgctggaatggtcaggatgggggtttagagggtctacgacaaaaagggtggagttt

SEQ ID NO: 250394 - DNA, 75 bp, Artificial Sequence
  Synthetic
agttagcctcctgatgattgaaagggaatcaaaaactagaaataccagaactaagatcttagctcagggagacaa

SEQ ID NO: 250395 - DNA, 75 bp, Artificial Sequence
  Synthetic
tcaagtgctttgtcctacttatatgctgtcatctggcctcaacaatgagggactcatgtacgagctggaaaacat

SEQ ID NO: 250396 - DNA, 75 bp, Artificial Sequence
  Synthetic
ctccaaaaatgcaatgtccatataccgtgcgattgaagaaggggcctccaaactcgggctgataataaagaagga

SEQ ID NO: 250397 - DNA, 75 bp, Artificial Sequence
  Synthetic
ggagacaatgtgtagcttcgactttctgatatatggaaagacacctctttttagaggcaacatattggttcctga

SEQ ID NO: 250398 - DNA, 75 bp, Artificial Sequence
  Synthetic
gtctaagcggtgggctagggtctcgtgcatatccaacgatcagatcgtgaatttggccaacatcatgtcaacagt

SEQ ID NO: 250399 - DNA, 75 bp, Artificial Sequence
  Synthetic
ctctactaatgccttaactgtggctcagcactctcaatcccttgtgaagcccatgcgagatttccttttaatgtc

SEQ ID NO: 250400 - DNA, 75 bp, Artificial Sequence
  Synthetic
agttcaagccatctatcattatctgctgtttagccccatcataaaagatcgagtttacaaggtattgaactcaaa

SEQ ID NO: 250401 - DNA, 75 bp, Artificial Sequence
  Synthetic
ggatgatgactttcttctggccatgtcacgaatcatatatctagatccctctcttggcggtgtctccgggatgtc

SEQ ID NO: 250402 - DNA, 75 bp, Artificial Sequence
  Synthetic
cctaggaaggtttcacatcaggcaattctcagaccctgtatcggaagggctaactttttggaaggagatatggct

SEQ ID NO: 250403 - DNA, 75 bp, Artificial Sequence
  Synthetic
gagctcctccgaagcttgggttcatcacctttgtcaggaagcgggaaaccccgacttgggagatagaagtctgga

SEQ ID NO: 250404 - DNA, 75 bp, Artificial Sequence
  Synthetic
gagcttcacacgtctcttagaagaccccactacattgaatataagaggaggtgctagtccaactatcctattgaa

SEQ ID NO: 250405 - DNA, 75 bp, Artificial Sequence
  Synthetic
agaagctatcaggaaagccttgtatgatgaggttgacagggtggagaattctgaatttagagaagccatcatatt

SEQ ID NO: 250406 - DNA, 75 bp, Artificial Sequence
  Synthetic
gtctaagactcaccgagacaatttcatactgttcttaaaatctatagagcccttattccctcgttttttgagtga

SEQ ID NO: 250407 - DNA, 75 bp, Artificial Sequence
  Synthetic
gcttttcagctcttccttcctaggcattcctgaatcaataatcggacttatacaaaattcaagaacagtcaggag

SEQ ID NO: 250408 - DNA, 75 bp, Artificial Sequence
  Synthetic
acagttcagaaagagcctctctagaaccttggaggagtccttccttcagtctgagatccatgggattaatagggt

SEQ ID NO: 250409 - DNA, 75 bp, Artificial Sequence
  Synthetic
gacacagacccctcagaggctcgggagagtgtgggcatgctctgctgagagagctgatcagttaagagagatatc

SEQ ID NO: 250410 - DNA, 75 bp, Artificial Sequence
  Synthetic
ctggggaaggaaagtcattggtacaacagttcctcatccttcagaaatgttagctttaatcccgaagtcttcggt

SEQ ID NO: 250411 - DNA, 75 bp, Artificial Sequence
  Synthetic
agcttgcggatgttacacaagggaggcaggcaaccccaggatttccgtttcggtgttgccttcttttgacccttc

SEQ ID NO: 250412 - DNA, 75 bp, Artificial Sequence
  Synthetic
ttttctatcacggggcccccttaaggggtatctagggtcttctacatccatgtccactcagttgttccactcatg

SEQ ID NO: 250413 - DNA, 75 bp, Artificial Sequence
  Synthetic
ggagaaggtcacgaatgttcatgtggttaagagggctctatccctcaaagaatccatcaactggtttgtgtctag

SEQ ID NO: 250414 - DNA, 75 bp, Artificial Sequence
  Synthetic
agattccaacttggcgaagactctgatagggaacatattgtccttaactgggccctcttttcccatcgaagagac

SEQ ID NO: 250415 - DNA, 75 bp, Artificial Sequence
  Synthetic
tccagtcttcaagaggacaggctcagctttacaccgatttaaatcagctaggtatagtgaaggcggttattcagc

SEQ ID NO: 250416 - DNA, 75 bp, Artificial Sequence
  Synthetic
tgtgtgccctaatctactttctcacatatcagtcagcactgacacaatgtctgatttaacccaggacgggaccaa

SEQ ID NO: 250417 - DNA, 75 bp, Artificial Sequence
  Synthetic
ttttgactttatgttccagccactgatgttatatgcacaaacatggacatcagagttagtccaaaaagaccttcg

SEQ ID NO: 250418 - DNA, 75 bp, Artificial Sequence
  Synthetic
gttggcagattctacctttcattggcacttaagatgtcagaaatgcattagacccatagaggaggttactctgga

SEQ ID NO: 250419 - DNA, 75 bp, Artificial Sequence
  Synthetic
tgcacctcaactctttgcctttccagacatatcctctagaatctcaagaatggtttctggggcggttcctcaatt

SEQ ID NO: 250420 - DNA, 75 bp, Artificial Sequence
  Synthetic
cagaaaactacctgaagtagggctcaaggccggagacttaatggctctcagcagcagcgagaggtcttatcatat

SEQ ID NO: 250421 - DNA, 75 bp, Artificial Sequence
  Synthetic
agggacagctcaaggactactatactccatcttggtggcggtccatgaccctggttacaacgataattccttgtt

SEQ ID NO: 250422 - DNA, 75 bp, Artificial Sequence
  Synthetic
ccccgtgaacatctatggcaaagtgtcagctaggggttatttgcgggggcttgcaagagggatactgatagggtc

SEQ ID NO: 250423 - DNA, 75 bp, Artificial Sequence
  Synthetic
atctatatgttttctgaccaggatgaccaacatcaacattaatcgccctctggagctgatttctggggtgatctc

SEQ ID NO: 250424 - DNA, 75 bp, Artificial Sequence
  Synthetic
ttacatattgttaaagctggacaaccatccatctctctacattatgctaaaagaacccgaattaagagcagagat

SEQ ID NO: 250425 - DNA, 75 bp, Artificial Sequence
  Synthetic
tttctctattcctcagaaagtgccggcggcttatcctaccaccatggaggaaggcaatagatctgtgttatgtta

SEQ ID NO: 250426 - DNA, 75 bp, Artificial Sequence
  Synthetic
tcttcaacaagtcctcaggtatgagagagacagtatgtcatttcccccagggaatgacatattatggatcttctc

SEQ ID NO: 250427 - DNA, 75 bp, Artificial Sequence
  Synthetic
tgattttaggagtataaaaatgacttacctgactctgataacctttcaggcatacctctggctgcagagagtaga

SEQ ID NO: 250428 - DNA, 75 bp, Artificial Sequence
  Synthetic
gagaagcttgtcaaagcaggtgagaatcaaattgcgacagctgaattctctaatgaggcaggtcctgggtggtca

SEQ ID NO: 250429 - DNA, 75 bp, Artificial Sequence
  Synthetic
tggggaagatactattgattcagatgacgaaatattatcacttcttaaagaatccctaagacgaacaagatgggt

SEQ ID NO: 250430 - DNA, 75 bp, Artificial Sequence
  Synthetic
tgaccaagaggtccgccatgcagccaagtcaatgactccggacctaaatcctgttcccaagatttctcgcagaat

SEQ ID NO: 250431 - DNA, 75 bp, Artificial Sequence
  Synthetic
agggtcctctgagtggatatgctctgctcagcaaatagctatctccacatctctcaatccagcatctgcttctga

SEQ ID NO: 250432 - DNA, 75 bp, Artificial Sequence
  Synthetic
tattgatttacgatctctatcgcgtcaatatcagaatcctctcatatccgggttaagagtggtgcaatgggccac

SEQ ID NO: 250433 - DNA, 75 bp, Artificial Sequence
  Synthetic
tggggctcattacaaaatcaagccaattctgaatgacctagatgtttgtccttgtttatctttggttatagggga

SEQ ID NO: 250434 - DNA, 75 bp, Artificial Sequence
  Synthetic
tggatcggggggcatttctagagtcgttttgagcatgttcccagactctaagcttgtgttcaacagtctattgga

SEQ ID NO: 250435 - DNA, 75 bp, Artificial Sequence
  Synthetic
ggtgaatgatctgatggcatctggcactcaccctttaccgccatcagccctgatgaggggaggtgatgatattac

SEQ ID NO: 250436 - DNA, 75 bp, Artificial Sequence
  Synthetic
atctagagtgatagactttgactcaatatgggaaaaaccgtctgatttgaggaatccactcacttggaagtattt

SEQ ID NO: 250437 - DNA, 75 bp, Artificial Sequence
  Synthetic
tcactcaatacaatccaagttgaggtcacagtttgacttaatagtatgcgatgcagaggtgacagacatagaatc

SEQ ID NO: 250438 - DNA, 75 bp, Artificial Sequence
  Synthetic
agtcaacaagatcacattgctgttgtctgatttctcgatgtcgatcaagggccccctatgtttaatctttaaaac

SEQ ID NO: 250439 - DNA, 75 bp, Artificial Sequence
  Synthetic
ctacggaacaatgcttgtgaatccagattacaaggctatccaccatctatccagagcattccccaatgtgactgg

SEQ ID NO: 250440 - DNA, 75 bp, Artificial Sequence
  Synthetic
gtttgtcactcaaatgacgtcttctttttcctcagagatctaccttagattttcaaaaacaggatatttcttcag

SEQ ID NO: 250441 - DNA, 75 bp, Artificial Sequence
  Synthetic
agatcatgaactgctgacagcatctacgatcagagagatgagtctagtattgtttaattgcagcaatcccaagag

SEQ ID NO: 250442 - DNA, 75 bp, Artificial Sequence
  Synthetic
tgaaatgcttagagccaggactttaaattaccaggacctgataagaggtttccccccagagatcatctctaaccc

SEQ ID NO: 250443 - DNA, 75 bp, Artificial Sequence
  Synthetic
ctacaatgaaatgattatcaccctgattgacagcgaggttgagtcctttttagttcacaagatcgtagacgattt

SEQ ID NO: 250444 - DNA, 75 bp, Artificial Sequence
  Synthetic
ggagcttaagagaggatcctcgtctaagatggcaatcataatcgccattgccatcctcttctctaacagtgtttt

SEQ ID NO: 250445 - DNA, 75 bp, Artificial Sequence
  Synthetic
caatgtgtctaagtcattgagtgacccccaatttttccctccatcagatcccaagttgttgaggcacttcaacat

SEQ ID NO: 250446 - DNA, 75 bp, Artificial Sequence
  Synthetic
atgctctagtacactcctattcttgtctgcagcaatgggagatctgtctaacttcacaagacttcatgagctcta

SEQ ID NO: 250447 - DNA, 75 bp, Artificial Sequence
  Synthetic
caactctcctgtggcatattacttcgggaagcaaaccataagaggaaggaagtatctatcatggagttgggctaa

SEQ ID NO: 250448 - DNA, 75 bp, Artificial Sequence
  Synthetic
ctcaagccctatattcaagaaggtagcatgcaactcctccatcagcttatcctctcactggatcaggttgatata

SEQ ID NO: 250449 - DNA, 75 bp, Artificial Sequence
  Synthetic
caaaatagtcaaaaccactcgcctgaattgttctcctagggacatgttgagagagactgaagcatgtctgagaac

SEQ ID NO: 250450 - DNA, 75 bp, Artificial Sequence
  Synthetic
ctacaacaaatggatcagcataagggacataaggtctagaacttccatcatggactactgttgtctttaatcagt

SEQ ID NO: 250451 - DNA, 75 bp, Artificial Sequence
  Synthetic
tctattttgatagattaaaaagcattcgtgaaaaaaacgagtaacaagcacatcatgcattgtcctgtgattgtt

SEQ ID NO: 250452 - DNA, 75 bp, Artificial Sequence
  Synthetic
aaaaacgagtaacaagcacatcatgcattgtcctgtgattgtttttaatttttatgtggtttttttgttaagcgt

SEQ ID NO: 250453 - DNA, 75 bp, Artificial Sequence
  Synthetic
gtctgacaagattgtgttcagagtgaataatcaagttgtttctttgaaacccgaagtcatctcggatcaatatga

SEQ ID NO: 250454 - DNA, 75 bp, Artificial Sequence
  Synthetic
gtataaatatcctgccatcttagatggaaagaaaccagggataactttagggaaggcccctgacctgaacactgc

SEQ ID NO: 250455 - DNA, 75 bp, Artificial Sequence
  Synthetic
atacaagtccgtcttatcaggtatgaaagctgcaaagctcgacccagacgatgtttgctcttacttggcagctgc

SEQ ID NO: 250456 - DNA, 75 bp, Artificial Sequence
  Synthetic
tatgcatctcttcgagggagtctgccctgaggactgggtcagttatgggatcgtcattgcaaagaagggggagag

SEQ ID NO: 250457 - DNA, 75 bp, Artificial Sequence
  Synthetic
aatcaaccctagcgtaattgttgatatagctcgcacgaatgttgaagggaattgggctcaggccggaggaaccga

SEQ ID NO: 250458 - DNA, 75 bp, Artificial Sequence
  Synthetic
tgtgatcaaagaccccacaactgcagagcatgcatctttggtgggactgttattgtgcctttatcggttgagcaa

SEQ ID NO: 250459 - DNA, 75 bp, Artificial Sequence
  Synthetic
gatagttggccagaacacggcaaactataaaactaatgtggctgacagaatggagcaaatattcgaaactgcccc

SEQ ID NO: 250460 - DNA, 75 bp, Artificial Sequence
  Synthetic
ctttgctaaagttgtggaacatcacacattgatgaccactcacaaaatgtgcgccaactggagcactatacccaa

SEQ ID NO: 250461 - DNA, 75 bp, Artificial Sequence
  Synthetic
cttcagattcctggtaggtacatatgatatgttttttgcaagagttgagcacatatattcggccctcagagtcgg

SEQ ID NO: 250462 - DNA, 75 bp, Artificial Sequence
  Synthetic
aacggtggtgacagcatatgaggactgctctgggttggtctccttcaccggattcctcaaacagattaatttatc

SEQ ID NO: 250463 - DNA, 75 bp, Artificial Sequence
  Synthetic
tcctagagatgcactgttatatttctttcataaaaactttgagggagagatcaagagaatgtttgagccagggca

SEQ ID NO: 250464 - DNA, 75 bp, Artificial Sequence
  Synthetic
agaaacagccgttcctcattcatacttcattcatttcagagctctcggcctgagtggtaagtccccttattcgtc

SEQ ID NO: 250465 - DNA, 75 bp, Artificial Sequence
  Synthetic
caatgctgtaggtcatacttttaatctgattcactttgtagggtgttatatgggtcagatcaggtctttaaatgc

SEQ ID NO: 250466 - DNA, 75 bp, Artificial Sequence
  Synthetic
aacggtgattcaaacatgtgcacctcatgagatgtcagtcctaggaggatatcttggggaagaattctttgggaa

SEQ ID NO: 250467 - DNA, 75 bp, Artificial Sequence
  Synthetic
gggcaccttcgagaggcggttcttcagggatgaaaaagaaatgcaagattatacagagcttgagggggctagagt

SEQ ID NO: 250468 - DNA, 75 bp, Artificial Sequence
  Synthetic
ggaagcttcactagccgatgacggtacggtagactcagatgaggaagacttcttctctggggaaaccagaagtcc

SEQ ID NO: 250469 - DNA, 75 bp, Artificial Sequence
  Synthetic
tgaagcggtttacagtcggataatgatgaatggtggcaagttgaagaaggttcatatacgccggtacatagcagt

SEQ ID NO: 250470 - DNA, 75 bp, Artificial Sequence
  Synthetic
gagctctaatcatcaggctagacctaactcttttgctgaattcttaaacaaagtatatgcagatggatcataact

SEQ ID NO: 250471 - DNA, 75 bp, Artificial Sequence
  Synthetic
tgttggcctctcgaaaaatgataatctacgggtagatgaggttgtgagacagatctaaaagaaaaaaacttaaca

SEQ ID NO: 250472 - DNA, 75 bp, Artificial Sequence
  Synthetic
ccactcttcaattcgtggtgtcaaaatgagcaaggaccttgtgcatcccagtcttatcaggtcagggatagtaga

SEQ ID NO: 250473 - DNA, 75 bp, Artificial Sequence
  Synthetic
attggaaatggcagaagaaaccatggatctgatcaatagaaccatagaaagcaatcaggctcaccttcagggcga

SEQ ID NO: 250474 - DNA, 75 bp, Artificial Sequence
  Synthetic
gccattttatgttgattctttgccagaaaatatgagcagattgaggataggagagaaatcgggtcagaccaagac

SEQ ID NO: 250475 - DNA, 75 bp, Artificial Sequence
  Synthetic
agaaggagatgagaaggatgaggacagctctgaggaagatgactatttatctggggaacaagaccccttagttcc

SEQ ID NO: 250476 - DNA, 75 bp, Artificial Sequence
  Synthetic
ctttcagaatttcctcgacgaaattggagccaaagcggtcaagaagttgaagacaggagagggattcttcagggt

SEQ ID NO: 250477 - DNA, 75 bp, Artificial Sequence
  Synthetic
gtggtcatccctgtcagatgacatcaaagggtatgtgtctacccacatcatgattcccaggccgaggaaccttaa

SEQ ID NO: 250478 - DNA, 75 bp, Artificial Sequence
  Synthetic
gtgtctagaaaaaaatgtgtgacccacgaccgtaggaaactctagagggtaagaaaaatcaatcgtttatagaga

SEQ ID NO: 250479 - DNA, 75 bp, Artificial Sequence
  Synthetic
aagaaaaatcaatcgtttatagagaccatcagaaagaggtttaatatttttgtgagacccatcgaagagagaaag

SEQ ID NO: 250480 - DNA, 75 bp, Artificial Sequence
  Synthetic
ccatcagaaagaggtttaatatttttgtgagacccatcgaagagagaaaggataaaaactttttacgactccatc

SEQ ID NO: 250481 - DNA, 75 bp, Artificial Sequence
  Synthetic
tgtgagacccatcgaagagagaaaggataaaaactttttacgactccatcagaaagaggtttaatatttttgtga

SEQ ID NO: 250482 - DNA, 75 bp, Artificial Sequence
  Synthetic
tatttgtaacttcgtcatacagcgttagatcaatagaataaacaatcgtgtgacgcaacttttttacgatctagt

SEQ ID NO: 250483 - DNA, 75 bp, Artificial Sequence
  Synthetic
gacccatcgaagagagaaaggataaaaactttttacgactccatcagaaagaggtttaatatttttgtgagaccc

SEQ ID NO: 250484 - DNA, 75 bp, Artificial Sequence
  Synthetic
gttagaaattctaaatctatagtattatctattacagcgtaaaacacattcaatattgtattgttatttttatat

SEQ ID NO: 250485 - DNA, 75 bp, Artificial Sequence
  Synthetic
tatctattacagcgtaaaacacattcaatattgtattgttatttttatattatttacacaattaacaatgtatta

SEQ ID NO: 250486 - DNA, 75 bp, Artificial Sequence
  Synthetic
gagaataattggaacacaagttgataaaatattgatagctaaatatacaatagatgcaatgtatcgcataagacc

SEQ ID NO: 250487 - DNA, 75 bp, Artificial Sequence
  Synthetic
tgctatgataatcagatcattagccgatagtggtaacgctatcgaaacaacatcgccagaaattacaaacgctac

SEQ ID NO: 250488 - DNA, 75 bp, Artificial Sequence
  Synthetic
cgagagaaagagatggttagtcaagatatttttcttagtacaaaagtcaatgttttaaaatatatggacgagaat

SEQ ID NO: 250489 - DNA, 75 bp, Artificial Sequence
  Synthetic
tgttttaaaatatatggacgagaattaatttgtctgtataaaaacttgtgtgaaattatgtactagagaaaaaac

SEQ ID NO: 250490 - DNA, 75 bp, Artificial Sequence
  Synthetic
taatttgtctgtataaaaacttgtgtgaaattatgtactagagaaaaaacgtgagcagtgtcccctacatggatt

SEQ ID NO: 250491 - DNA, 75 bp, Artificial Sequence
  Synthetic
tattaactatatacgtttattatatgatgttaacgtgtaaattataaacattattttatgatgcaattgtctgac

SEQ ID NO: 250492 - DNA, 75 bp, Artificial Sequence
  Synthetic
cgttatcgtttacgaaatagttgagacatcagaaagaggtttaatatttttgtgagaccatcgaagagagaaaga

SEQ ID NO: 250493 - DNA, 75 bp, Artificial Sequence
  Synthetic
gaataaaaatatttttttgtaaaacttttttatgagacaagagagaaagagaatacgaatagtgatcatatcgta

SEQ ID NO: 250494 - DNA, 75 bp, Artificial Sequence
  Synthetic
gaatacgaatagtgatcatatcgtatcacatattgaaacagaaagaagaagtaacgagaggtaactttttgtgaa

SEQ ID NO: 250495 - DNA, 75 bp, Artificial Sequence
  Synthetic
gaatcgtttgattaacccaactcatccattttcagatgaatagagttatcgattcagacacatgctttgagtttt

SEQ ID NO: 250496 - DNA, 75 bp, Artificial Sequence
  Synthetic
tatgctatattcctgttatcatcattagttaatgaaaataactctcgtgcttcagaaaagtcaaatattgtatcc

SEQ ID NO: 250497 - DNA, 75 bp, Artificial Sequence
  Synthetic
ccattttcagatgaatagagttatcgattcagacacatgctttgagttttgttgaatcgatgagtgaagtatcat

SEQ ID NO: 250498 - DNA, 75 bp, Artificial Sequence
  Synthetic
atacatctccaaaactatcacttatacgtttatctttaacgaacatatacctgatggttatttactaacagacat

SEQ ID NO: 250499 - DNA, 75 bp, Artificial Sequence
  Synthetic
gtcgacatacttgaatccatccttgacttcaagttcagatgattcctcacacatgtctccgatacgtacgctaaa

SEQ ID NO: 250500 - DNA, 75 bp, Artificial Sequence
  Synthetic
acttcaagttcagatgattcctcacacatgtctccgatacgtacgctaaactctaggttcttaacacattttgta

SEQ ID NO: 250501 - DNA, 75 bp, Artificial Sequence
  Synthetic
atcaacgtcgttgtagtgaatagtagtcattgatctattatatgaaacggatatgtctagttaatattttctttg

SEQ ID NO: 250502 - DNA, 75 bp, Artificial Sequence
  Synthetic
ctttgtaactcactttcttatgtgagatgttagacccaagtactggatgggtcttgatgtcgctgtctttctctt

SEQ ID NO: 250503 - DNA, 75 bp, Artificial Sequence
  Synthetic
gatgttagacccaagtactggatgggtcttgatgtcgctgtctttctcttcttcgctacatctgatgtcgataga

SEQ ID NO: 250504 - DNA, 75 bp, Artificial Sequence
  Synthetic
agagcttcttcacgcgtgatcgcgggagagtccttaccttgtcctggtgacacgctggacaatctagtattcaca

SEQ ID NO: 250505 - DNA, 75 bp, Artificial Sequence
  Synthetic
gagagtccttaccttgtcctggtgacacgctggacaatctagtattcacagtgtttccatcagaggattcggaga

SEQ ID NO: 250506 - DNA, 75 bp, Artificial Sequence
  Synthetic
gaatccaaagttcatgttaagacccgcgccgacgatagtgtaataagtggtgggatctccttttacaacttcttc

SEQ ID NO: 250507 - DNA, 75 bp, Artificial Sequence
  Synthetic
tcatcatcttcggtctctgtaacttccgttacggattgacaaatcttatcattggtcggtgtttggtcttgcttt

SEQ ID NO: 250508 - DNA, 75 bp, Artificial Sequence
  Synthetic
attggtcggtgtttggtcttgctttgtgactttgataataacatcgattcccatatgatgtttgttttcttcttc

SEQ ID NO: 250509 - DNA, 75 bp, Artificial Sequence
  Synthetic
gtgactttgataataacatcgattcccatatgatgtttgttttcttcttcagtacacgaggatgaggattgttga

SEQ ID NO: 250510 - DNA, 75 bp, Artificial Sequence
  Synthetic
ctaggcacatgcatgccaggacaatatattgtttcatgattgctattgattgattactgttctagatgattctac

SEQ ID NO: 250511 - DNA, 75 bp, Artificial Sequence
  Synthetic
tgattactgttctagatgattctactttcttaccatataataaattagaatatattttctacttttacgagaaat

SEQ ID NO: 250512 - DNA, 75 bp, Artificial Sequence
  Synthetic
tttatgtatatcacaactagcgggcatatggctattgacatcgagaacattacccatatgataagagattgtatc

SEQ ID NO: 250513 - DNA, 75 bp, Artificial Sequence
  Synthetic
cgtttcgtagtcttgagtattggtattactatatagtatgtagatgtcgacgctagatagacagtcgcccactag

SEQ ID NO: 250514 - DNA, 75 bp, Artificial Sequence
  Synthetic
ttactatatagtatgtagatgtcgacgctagatagacagtcgcccactagagttaccgtctctgaatgcggcatg

SEQ ID NO: 250515 - DNA, 75 bp, Artificial Sequence
  Synthetic
cgctagatagacagtcgcccactagagttaccgtctctgaatgcggcatgatagtatcattctttgttttcgtta

SEQ ID NO: 250516 - DNA, 75 bp, Artificial Sequence
  Synthetic
gttacatttaatctcgaaattcagagtacatatctttgaagtattctgatatctattttctcctgtaaagaatcc

SEQ ID NO: 250517 - DNA, 75 bp, Artificial Sequence
  Synthetic
gtacatatctttgaagtattctgatatctattttctcctgtaaagaatcctgaagttgctacattattaaggaca

SEQ ID NO: 250518 - DNA, 75 bp, Artificial Sequence
  Synthetic
gatcacaatctttatgattcatggtaatagttagttccgacgttgagatggattcgctgagaccggtagtggtcg

SEQ ID NO: 250519 - DNA, 75 bp, Artificial Sequence
  Synthetic
tggatatagaaaacacgtaatacgatctataaaaataagtattaaatactttttatttacggtactcttgtagtg

SEQ ID NO: 250520 - DNA, 75 bp, Artificial Sequence
  Synthetic
gattcgctgagaccggtagtggtcgtccgagtacacgatgtgtcgttgactggatacaggttaatttccacatcg

SEQ ID NO: 250521 - DNA, 75 bp, Artificial Sequence
  Synthetic
cgggttcgcatttatctgtggaagagacggtgtgagaatatgttccgggaccacacggagaacagatgacgtctc

SEQ ID NO: 250522 - DNA, 75 bp, Artificial Sequence
  Synthetic
ccacacggagaacagatgacgtctccggtagacgtgtatccggatactccgtatcctattccacactttgtttta

SEQ ID NO: 250523 - DNA, 75 bp, Artificial Sequence
  Synthetic
atcctttgagaagacaataatatcctggagagcattcacagattctattgtgagtcgtgttacacgatcgcgtct

SEQ ID NO: 250524 - DNA, 75 bp, Artificial Sequence
  Synthetic
tggagagcattcacagattctattgtgagtcgtgttacacgatcgcgtctctacctgattactatcacatcttcc

SEQ ID NO: 250525 - DNA, 75 bp, Artificial Sequence
  Synthetic
gatcattttgaagacgatgatttgtctacatgttctgccgtaaccgatagggaaacggatgtataattttttttt

SEQ ID NO: 250526 - DNA, 75 bp, Artificial Sequence
  Synthetic
tgattattgtgagatgtaaaggtatccgaaccacacggcgtacattgtgtattagtcttgctatcacataatctg

SEQ ID NO: 250527 - DNA, 75 bp, Artificial Sequence
  Synthetic
ccgaaccacacggcgtacattgtgtattagtcttgctatcacataatctggaagcgtaagttcccggaggacacg

SEQ ID NO: 250528 - DNA, 75 bp, Artificial Sequence
  Synthetic
gtattcgttgtctttacattttccattggatggtgcatgtggtgctatatctcttccgtttattattatacatga

SEQ ID NO: 250529 - DNA, 75 bp, Artificial Sequence
  Synthetic
ttggatggtgcatgtggtgctatatctcttccgtttattattatacatgagagaaacaatatatacgagtataat

SEQ ID NO: 250530 - DNA, 75 bp, Artificial Sequence
  Synthetic
gtaatcgtcgtcttgttactgtttgtttcctacttctccaatcatatagattattttttaaatattttctttcta

SEQ ID NO: 250531 - DNA, 75 bp, Artificial Sequence
  Synthetic
tttcctacttctccaatcatatagattattttttaaatattttctttctatcatggataatatttgtaatggttc

SEQ ID NO: 250532 - DNA, 75 bp, Artificial Sequence
  Synthetic
ggtagtcgcttagcttggttatgatattgcgcataatttccggaggcaaatacgatagtctagattgactatcga

SEQ ID NO: 250533 - DNA, 75 bp, Artificial Sequence
  Synthetic
attgcgcataatttccggaggcaaatacgatagtctagattgactatcgatggtagactctaatttattgagtgc

SEQ ID NO: 250534 - DNA, 75 bp, Artificial Sequence
  Synthetic
tccatcgatagatgacactgttctatgagatcgtcgtacatgggaaatgaaatgcgtttgtctgaatgtatggct

SEQ ID NO: 250535 - DNA, 75 bp, Artificial Sequence
  Synthetic
tgagatcgtcgtacatgggaaatgaaatgcgtttgtctgaatgtatggcttcgagataggtgtgataccggatgt

SEQ ID NO: 250536 - DNA, 75 bp, Artificial Sequence
  Synthetic
aaatgtttttgttaaccgctgcatgatgtacagatttcggaatcgcaaaccacttgtggttttattttatccttg

SEQ ID NO: 250537 - DNA, 75 bp, Artificial Sequence
  Synthetic
gttggtgtctgagattcgaatctctttgaggagacttatgtcacgactacatttttcgatgatggaatctatctt

SEQ ID NO: 250538 - DNA, 75 bp, Artificial Sequence
  Synthetic
ttgaggagacttatgtcacgactacatttttcgatgatggaatctatcttatcgaatgatatatttttcataaat

SEQ ID NO: 250539 - DNA, 75 bp, Artificial Sequence
  Synthetic
agaatttagtatgtagttccgcaaatgactcgtcccttaataggcagtaggctattatcttctttacgtagtgat

SEQ ID NO: 250540 - DNA, 75 bp, Artificial Sequence
  Synthetic
tgactcgtcccttaataggcagtaggctattatcttctttacgtagtgatcgtcgtagggagagaactccgacat

SEQ ID NO: 250541 - DNA, 75 bp, Artificial Sequence
  Synthetic
ggtagagatactttcagtctgtggtggatgatgtcattaacgacatccgccttgtatatgatgtttctgttttca

SEQ ID NO: 250542 - DNA, 75 bp, Artificial Sequence
  Synthetic
ttggaatctatacatcatctgtggtctgtagtgtatgatcatcttaatgttgtgaatggcgaagaacgatgctat

SEQ ID NO: 250543 - DNA, 75 bp, Artificial Sequence
  Synthetic
ggatgatgtcattaacgacatccgccttgtatatgatgtttctgttttcaaacaccaagtcgaatactgtcttat

SEQ ID NO: 250544 - DNA, 75 bp, Artificial Sequence
  Synthetic
gtatccgatgtatacgaggtatgaggcaacattgttattgcaattctggaaggcggtatgaagaggagtcattgt

SEQ ID NO: 250545 - DNA, 75 bp, Artificial Sequence
  Synthetic
gcaacattgttattgcaattctggaaggcggtatgaagaggagtcattgtattatagtattcgtctttctgaatg

SEQ ID NO: 250546 - DNA, 75 bp, Artificial Sequence
  Synthetic
gtatattgagagagcgacttccatatccttgattatgttttatgaatagataaagtagatgttgtccttcttcct

SEQ ID NO: 250547 - DNA, 75 bp, Artificial Sequence
  Synthetic
tccttgattatgttttatgaatagataaagtagatgttgtccttcttccttttgtaatttcccgtatttttgttc

SEQ ID NO: 250548 - DNA, 75 bp, Artificial Sequence
  Synthetic
atatgacctgttgcacaatcgttctttatgtattccatgatgggtgtacaatcaagattattacgtatcctcgta

SEQ ID NO: 250549 - DNA, 75 bp, Artificial Sequence
  Synthetic
ttatgtattccatgatgggtgtacaatcaagattattacgtatcctcgtatcggctcctcgagataaaagagcat

SEQ ID NO: 250550 - DNA, 75 bp, Artificial Sequence
  Synthetic
atactgttgaaggtaagtgtgtaacggcgtatttccgattttcgtaaccgcgttaatgtttgctccatgatctat

SEQ ID NO: 250551 - DNA, 75 bp, Artificial Sequence
  Synthetic
tatcgcgtagatgaatcgcttctcagctcgcatcttagtgtgactctttgacttgtaataattgctttcgtggaa

SEQ ID NO: 250552 - DNA, 75 bp, Artificial Sequence
  Synthetic
tgaagagaagtgagtccatcctcatcgacgcaattagggtcagatcctttagtcaataatttgtacagaacgtaa

SEQ ID NO: 250553 - DNA, 75 bp, Artificial Sequence
  Synthetic
cgacgcaattagggtcagatcctttagtcaataatttgtacagaacgtaatagtttaagctcccattgaatttat

SEQ ID NO: 250554 - DNA, 75 bp, Artificial Sequence
  Synthetic
ggatgatttactaaagtcatcaatggggtccgttagtatatcaaagatcttgttatcgattgatagtgaatgaat

SEQ ID NO: 250555 - DNA, 75 bp, Artificial Sequence
  Synthetic
cagatagtggtgtagaggaatatgtccttttttatccttgctatcaaagttacgcatgccgtggcgtaacaatat

SEQ ID NO: 250556 - DNA, 75 bp, Artificial Sequence
  Synthetic
tacgcatgccgtggcgtaacaatatctttaatacagatggattaaatcgtgtattcatcgtatagcaatgtaatg

SEQ ID NO: 250557 - DNA, 75 bp, Artificial Sequence
  Synthetic
ctttaatacagatggattaaatcgtgtattcatcgtatagcaatgtaatggagagttaccacattttagtcgttt

SEQ ID NO: 250558 - DNA, 75 bp, Artificial Sequence
  Synthetic
aatttaaacagatgagatgatatatccacatcaaagaatgcgagatacatatgacagacattattgacagaaatg

SEQ ID NO: 250559 - DNA, 75 bp, Artificial Sequence
  Synthetic
tgaccttcattatcaccgtcgtccataaatgcgttaggtacgtaccacatactatcgttaacgatgcgcacaatc

SEQ ID NO: 250560 - DNA, 75 bp, Artificial Sequence
  Synthetic
atgatttactttttcataattagagaaaaagatcaaggtataaaaattagaagtgttagactataaactaactta

SEQ ID NO: 250561 - DNA, 75 bp, Artificial Sequence
  Synthetic
cttatgactattaactcatttcaagaaaggtgggtggagagaactctatatgacagcttgtgaaacaattagatc

SEQ ID NO: 250562 - DNA, 75 bp, Artificial Sequence
  Synthetic
tgacagcttgtgaaacaattagatccctaatttctaatggaagttttgataggagattgtcatcagttgatacat

SEQ ID NO: 250563 - DNA, 75 bp, Artificial Sequence
  Synthetic
cctaatttctaatggaagttttgataggagattgtcatcagttgatacattgtttattatctcatctattagagc

SEQ ID NO: 250564 - DNA, 75 bp, Artificial Sequence
  Synthetic
tgctcggttacttctgtgtaaatcttgaatcctttagtgatacactgtgtcaaaactggatgtttagaataccta

SEQ ID NO: 250565 - DNA, 75 bp, Artificial Sequence
  Synthetic
tgaatcctttagtgatacactgtgtcaaaactggatgtttagaatacctatgtagaatatgggaagcatgcttgt

SEQ ID NO: 250566 - DNA, 75 bp, Artificial Sequence
  Synthetic
atacatggttgtattatgaattttcatctgcctaatgtactccaattcttgtttacaatcaattatataatcaaa

SEQ ID NO: 250567 - DNA, 75 bp, Artificial Sequence
  Synthetic
atctgcctaatgtactccaattcttgtttacaatcaattatataatcaaagagtgatgatgcatacacattacaa

SEQ ID NO: 250568 - DNA, 75 bp, Artificial Sequence
  Synthetic
acttgatacagagctttatcacatcatggttttcaattgtattattaagtatagctaattttatacagtcaatag

SEQ ID NO: 250569 - DNA, 75 bp, Artificial Sequence
  Synthetic
atggttttcaattgtattattaagtatagctaattttatacagtcaatagacaatggttctctaagcaatatttc

SEQ ID NO: 250570 - DNA, 75 bp, Artificial Sequence
  Synthetic
cgggcgatgacagatcccctatccacggccacgtcaagacatgtatatccattactcattactgcgttgacattt

SEQ ID NO: 250571 - DNA, 75 bp, Artificial Sequence
  Synthetic
cggccacgtcaagacatgtatatccattactcattactgcgttgacatttgctccattttctaatagccatgata

SEQ ID NO: 250572 - DNA, 75 bp, Artificial Sequence
  Synthetic
agcgcgataaagcaaggtccttccaccagcatctagttgattgatatcttcaatatatgggatacaaagcttata

SEQ ID NO: 250573 - DNA, 75 bp, Artificial Sequence
  Synthetic
ccagcatctagttgattgatatcttcaatatatgggatacaaagcttataaatttctaatactgtgggttcatct

SEQ ID NO: 250574 - DNA, 75 bp, Artificial Sequence
  Synthetic
ttattttatatagatctaatttaacatcattttcatctgggataccacaattcaaaataaactcaacaacactac

SEQ ID NO: 250575 - DNA, 75 bp, Artificial Sequence
  Synthetic
ataggcattcaagcattctattttatatattacagccccatgatctaccataaaatcaacaatgtctatttctac

SEQ ID NO: 250576 - DNA, 75 bp, Artificial Sequence
  Synthetic
aagagatcttgtacagaattacaattcttaataattatagagaaaatatcttccatataattctttgacactaat

SEQ ID NO: 250577 - DNA, 75 bp, Artificial Sequence
  Synthetic
gtgagttaatattcatgttgaacataaaaaatatcattttatttcaaaattatttaccattccattccatcccat

SEQ ID NO: 250578 - DNA, 75 bp, Artificial Sequence
  Synthetic
tcttaataattatagagaaaatatcttccatataattctttgacactaatgcagatataatatctttatatgtaa

SEQ ID NO: 250579 - DNA, 75 bp, Artificial Sequence
  Synthetic
atactgatcaatattatctctatgaatcctaaaataatcatacagaacatctacaggatcacaaattggttcaag

SEQ ID NO: 250580 - DNA, 75 bp, Artificial Sequence
  Synthetic
atcctaaaataatcatacagaacatctacaggatcacaaattggttcaaggagaaatctatcaaatattttcctg

SEQ ID NO: 250581 - DNA, 75 bp, Artificial Sequence
  Synthetic
agtcaacacctaatccatgttttttatagtcatctaccaaagataatgaccaaagatcgaggtcgtcgtgaaact

SEQ ID NO: 250582 - DNA, 75 bp, Artificial Sequence
  Synthetic
tcttattcgccattgattttcattttttataattatgtacatgttttccttctattctcaagagtctacaaaaat

SEQ ID NO: 250583 - DNA, 75 bp, Artificial Sequence
  Synthetic
tctattctcaagagtctacaaaaatatattttttttcgatatctaagtactaagtttttttactgtttttgttac

SEQ ID NO: 250584 - DNA, 75 bp, Artificial Sequence
  Synthetic
tgtcttccattcttctaactaaagatctgagataaattatacaatcttcgctatcgaaccatttttgtagtctaa

SEQ ID NO: 250585 - DNA, 75 bp, Artificial Sequence
  Synthetic
attatcattattatcatagtctattaaacacaaatcatctacgtttataacaacattctcattattaattagttc

SEQ ID NO: 250586 - DNA, 75 bp, Artificial Sequence
  Synthetic
atcgagtagtaacttctaataaagacttgatatcattatcatatgtttgatcgtcatagttaatagtgtggctaa

SEQ ID NO: 250587 - DNA, 75 bp, Artificial Sequence
  Synthetic
cttgatatcattatcatatgtttgatcgtcatagttaatagtgtggctaaatggtactgttaataagtttataga

SEQ ID NO: 250588 - DNA, 75 bp, Artificial Sequence
  Synthetic
aattagattatttttttaaatactgatcctcacaattccgtgatgtagcagtagttggtgcatggtctatatcgt

SEQ ID NO: 250589 - DNA, 75 bp, Artificial Sequence
  Synthetic
tctaataccataataaaaattatcattatgtataatcatcactgtcgctatcattattgcgtttgtgtagttctg

SEQ ID NO: 250590 - DNA, 75 bp, Artificial Sequence
  Synthetic
ctcactatatcttctaaaattacaaacaactggatattcgataacagcatttgtgtagtttttgtcttttacagt

SEQ ID NO: 250591 - DNA, 75 bp, Artificial Sequence
  Synthetic
acaactggatattcgataacagcatttgtgtagtttttgtcttttacagtatatacgttattgtcaaaatctaaa

SEQ ID NO: 250592 - DNA, 75 bp, Artificial Sequence
  Synthetic
tcatacagcgttagatcaatagaataaacaatcgtgtgacgcaacttttttacgatctagttgtatgagtttatc

SEQ ID NO: 250593 - DNA, 75 bp, Artificial Sequence
  Synthetic
aaacaatcgtgtgacgcaacttttttacgatctagttgtatgagtttatcgtttacataagcaattaacggcttt

SEQ ID NO: 250594 - DNA, 75 bp, Artificial Sequence
  Synthetic
cctctgttatacgtttaatgttcacggtcttagtatttttagatatcaattgtgatttacaccatattcgactcc

SEQ ID NO: 250595 - DNA, 75 bp, Artificial Sequence
  Synthetic
acaatgtattattagtttatattactgaattaataatataaaattcccaatcttgtcataaacacaaaatccatt

SEQ ID NO: 250596 - DNA, 75 bp, Artificial Sequence
  Synthetic
gatcattagccgatagtggtaacgctatcgaaacaacatcgccagaaattacaaacgctacaacagatattccag

SEQ ID NO: 250597 - DNA, 75 bp, Artificial Sequence
  Synthetic
acaaacgctacaacagatattccagctatcagattatgtggtccagagggagatggatattgtttacacggtgac

SEQ ID NO: 250598 - DNA, 75 bp, Artificial Sequence
  Synthetic
gtatgtattgtagatgctctcatggttatacaggcattagatgtcagcatgtagtattagtagactatcaacgtt

SEQ ID NO: 250599 - DNA, 75 bp, Artificial Sequence
  Synthetic
gtagtattagtagactatcaacgttcaggaaaaccagacactacaacatcatatatcccatctctaggtattgtg

SEQ ID NO: 250600 - DNA, 75 bp, Artificial Sequence
  Synthetic
cttgtattagtaggcattattattacgtgttgtctattatctgtttataggttcactcgaagaactaaactacct

SEQ ID NO: 250601 - DNA, 75 bp, Artificial Sequence
  Synthetic
gttcactcgaagaactaaactacctatacaagatatggttgtgttatattttttataaaatttttttatgagtat

SEQ ID NO: 250602 - DNA, 75 bp, Artificial Sequence
  Synthetic
aaaatactaagtatgcgatgtatcctgtattatttgtatttatctaaacaatacttctgcctctagatgggatac

SEQ ID NO: 250603 - DNA, 75 bp, Artificial Sequence
  Synthetic
tgtattatttgtatttatctaaacaatacttctgcctctagatgggatacaaaaattttttatttcagcatatta

SEQ ID NO: 250604 - DNA, 75 bp, Artificial Sequence
  Synthetic
tgaatacagtgggtggttccgtatcaccagtaagaacataatagtcgaatacagtatccgattgagattttgcat

SEQ ID NO: 250605 - DNA, 75 bp, Artificial Sequence
  Synthetic
taatatggatgtcgtggcaatttcctaatacggaaataagacataaacacgcaataaatctaattgcggacatgt

SEQ ID NO: 250606 - DNA, 75 bp, Artificial Sequence
  Synthetic
acatcaaccaagtaatgatcatctattgttatataacaataacataactcttttccatttttatcagtatatata

SEQ ID NO: 250607 - DNA, 75 bp, Artificial Sequence
  Synthetic
agctcgttctcatcatcagaataaatcaatatctctgtttttttattatacagatgtattacagcctcatatatt

SEQ ID NO: 250608 - DNA, 75 bp, Artificial Sequence
  Synthetic
ttaatattttctttgatttaaagtctagagtctttacaaacataatatccttatccgactttatatttcctgtag

SEQ ID NO: 250609 - DNA, 75 bp, Artificial Sequence
  Synthetic
ggtggcataattttattctgcctccacaatcagtgtttccaaatatattactagacaatattccatatggttatt

SEQ ID NO: 250610 - DNA, 75 bp, Artificial Sequence
  Synthetic
acaatcagtgtttccaaatatattactagacaatattccatatggttattagttaagggacccgattagaacacg

SEQ ID NO: 250611 - DNA, 75 bp, Artificial Sequence
  Synthetic
tacgcgcttattcatcatttggatcgtatttcataaaagttattatgttatcgatgtcaacacattctacatttt

SEQ ID NO: 250612 - DNA, 75 bp, Artificial Sequence
  Synthetic
ttaatcgtctatatagtatttttctgatattttctataatatcagaattgtcttccataggaagttgtatactat

SEQ ID NO: 250613 - DNA, 75 bp, Artificial Sequence
  Synthetic
cggaatcagttacatgtttaaataattctctgatgtcattccttatacaatcaaattcattattaaacagtttaa

SEQ ID NO: 250614 - DNA, 75 bp, Artificial Sequence
  Synthetic
gttattaattaattacatgttgttttatatatcgctacgaatttaaacagagaaatcagttaggaagaaaaaatt

SEQ ID NO: 250615 - DNA, 75 bp, Artificial Sequence
  Synthetic
tcaaattcattattaaacagtttaatagtctgtagacctttatcgtcgtacatatccattgtcttattagttacg

SEQ ID NO: 250616 - DNA, 75 bp, Artificial Sequence
  Synthetic
tttattatattttataagaatgattgtttgacaatgtcgtagtatagatatattattagaggaggtataattata

SEQ ID NO: 250617 - DNA, 75 bp, Artificial Sequence
  Synthetic
tattattagaggaggtataattataaaaagtttctgagtacgatgttataagaggagagaggacacattaacaat

SEQ ID NO: 250618 - DNA, 75 bp, Artificial Sequence
  Synthetic
aacattgtaatcaaaagaattgcaattttgatgtataacaactgtcaatggaattgtatattacaaattacggta

SEQ ID NO: 250619 - DNA, 75 bp, Artificial Sequence
  Synthetic
attaattatatatctattacaccggccttgtatcataataaagttgtggtagtatgatctccatatttataattt

SEQ ID NO: 250620 - DNA, 75 bp, Artificial Sequence
  Synthetic
tttcactgtttagtcgcggatatggaattcgatcctgtcaaaatcaatacatcatctatagatcatgtaacaata

SEQ ID NO: 250621 - DNA, 75 bp, Artificial Sequence
  Synthetic
aattcgatcctgtcaaaatcaatacatcatctatagatcatgtaacaatattacaatacatagatgaaccaaatg

SEQ ID NO: 250622 - DNA, 75 bp, Artificial Sequence
  Synthetic
ccgaaatattaataacattacatattatatcaatatcacaaaaataaatccacatttggctaatcgatttcgggc

SEQ ID NO: 250623 - DNA, 75 bp, Artificial Sequence
  Synthetic
tatatcaatatcacaaaaataaatccacatttggctaatcgatttcgggcttggaaaaaacgtatcgccggaagg

SEQ ID NO: 250624 - DNA, 75 bp, Artificial Sequence
  Synthetic
aaaaaaatgaattgatgatataagtgtcttcataacgcattattacgttagcattctattatccagtgttaaaaa

SEQ ID NO: 250625 - DNA, 75 bp, Artificial Sequence
  Synthetic
atacaggaatacaacaatcaaaacttactgaaactatacgtaactgtcaaaaaaataaaaacatatatggtctat

SEQ ID NO: 250626 - DNA, 75 bp, Artificial Sequence
  Synthetic
tactgaaactatacgtaactgtcaaaaaaataaaaacatatatggtctatatatacactacaatttagttattaa

SEQ ID NO: 250627 - DNA, 75 bp, Artificial Sequence
  Synthetic
gagggctattgggtatgaaaatccgaaatattaaaccagaaaccccatataattttatagctaagaatgccgcga

SEQ ID NO: 250628 - DNA, 75 bp, Artificial Sequence
  Synthetic
gtgattgttcaatcaatattaagagggttggtaaattggtacatagctaataatacatatactccaaatacaccc

SEQ ID NO: 250629 - DNA, 75 bp, Artificial Sequence
  Synthetic
ggttggtaaattggtacatagctaataatacatatactccaaatacacccaataatactacaaccatttctgagt

SEQ ID NO: 250630 - DNA, 75 bp, Artificial Sequence
  Synthetic
atacgaggacatgtatagagtaagtaaagaaaaagaatgtggaatttgctatgaagttgtttactcaaaacgatt

SEQ ID NO: 250631 - DNA, 75 bp, Artificial Sequence
  Synthetic
aaagaaaaagaatgtggaatttgctatgaagttgtttactcaaaacgattagaaaacgatagatactttggttta

SEQ ID NO: 250632 - DNA, 75 bp, Artificial Sequence
  Synthetic
gcataacatgtatcaatatatggcatagaacacgaagagaaaccggtgcgttagataattgtcctatatgccgta

SEQ ID NO: 250633 - DNA, 75 bp, Artificial Sequence
  Synthetic
caagttctataagctagttaactaataaataaaaagtttaattatcgacgatatatgtcgttatttttctctcat

SEQ ID NO: 250634 - DNA, 75 bp, Artificial Sequence
  Synthetic
taaataaaaagtttaattatcgacgatatatgtcgttatttttctctcatatgaaagattaatttgattctaata

SEQ ID NO: 250635 - DNA, 75 bp, Artificial Sequence
  Synthetic
atgaaagattaatttgattctaatataatcttcagtattggatgaatctcaattcaaattaattccattagatta

SEQ ID NO: 250636 - DNA, 75 bp, Artificial Sequence
  Synthetic
atatgatggatattatgatggatatgatggatatgatggatattatgatggatatgatatatgatggatattatg

SEQ ID NO: 250637 - DNA, 75 bp, Artificial Sequence
  Synthetic
gatggatatgatggatattatgatggatatgatatatgatggatattatgatggatatgatggatatgatggata

SEQ ID NO: 250638 - DNA, 75 bp, Artificial Sequence
  Synthetic
gattagattagattagattagattagattagattagattagattagattagattagattagattagattagatta

SEQ ID NO: 250639 - DNA, 75 bp, Artificial Sequence
  Synthetic
atggatatgatggatatgatggatatgatggatatgatggatatgatggatatgatggatatgatggatatgatg

SEQ ID NO: 250640 - DNA, 75 bp, Artificial Sequence
  Synthetic
cactacttcagccaaatattcttttttgaaacgccatctagcgtaatgagaacacaagtgaacctataatgagca

SEQ ID NO: 250641 - DNA, 75 bp, Artificial Sequence
  Synthetic
ttgaaacgccatctagcgtaatgagaacacaagtgaacctataatgagcaaatttattagtatcggttacatgaa

SEQ ID NO: 250642 - DNA, 75 bp, Artificial Sequence
  Synthetic
aacacaagtgaacctataatgagcaaatttattagtatcggttacatgaaggactttacgtagagtggtgattcc

SEQ ID NO: 250643 - DNA, 75 bp, Artificial Sequence
  Synthetic
tcttctttgatgccatcacccagatgttctataaacttggtatcctcgtccgatttcatatcatttgccaaccaa

SEQ ID NO: 250644 - DNA, 75 bp, Artificial Sequence
  Synthetic
gttctataaacttggtatcctcgtccgatttcatatcatttgccaaccaatacatatagctaaacccaggcatac

SEQ ID NO: 250645 - DNA, 75 bp, Artificial Sequence
  Synthetic
ttctccagaagatgttacaatggctagatttggacatttggtttcaaccgcgttaacatatgagtgaacacaccc

SEQ ID NO: 250646 - DNA, 75 bp, Artificial Sequence
  Synthetic
cgttaacatatgagtgaacacacccatacatgaaagcgatgagaaataggattctcatcttgccaaaatatcact

SEQ ID NO: 250647 - DNA, 75 bp, Artificial Sequence
  Synthetic
ataaaaaatttatttatcaattttaaaggtataaaaaaatacttattgttgctcgaatattttgtatttgatggt

SEQ ID NO: 250648 - DNA, 75 bp, Artificial Sequence
  Synthetic
ttttatgaattttattatgcttcactattgcatcggaaataatatcatatgcttccacgtatattttattttgtt

SEQ ID NO: 250649 - DNA, 75 bp, Artificial Sequence
  Synthetic
tggattattgacatatcgatgaataattttagctccatgctcagtaaatattaatgagaacatagtgttgcctcc

SEQ ID NO: 250650 - DNA, 75 bp, Artificial Sequence
  Synthetic
aattcttgattgcagagatctatataatcattatagcgttgacttatggactctggaatcttagacgatgtacag

SEQ ID NO: 250651 - DNA, 75 bp, Artificial Sequence
  Synthetic
aatcattatagcgttgacttatggactctggaatcttagacgatgtacagtcatctataatcatggtatatttaa

SEQ ID NO: 250652 - DNA, 75 bp, Artificial Sequence
  Synthetic
ttttatgtttattagtgtacacattttggaagtaagttccggctgccatgtatttcctggagagcaagtagatga

SEQ ID NO: 250653 - DNA, 75 bp, Artificial Sequence
  Synthetic
atctacgatattagatacttcactcaatgaatcaatcacacaatctaatgtaggtttatgacataatagcatttt

SEQ ID NO: 250654 - DNA, 75 bp, Artificial Sequence
  Synthetic
aatgaatcaatcacacaatctaatgtaggtttatgacataatagcattttcagcagttcaatgtttctagattcg

SEQ ID NO: 250655 - DNA, 75 bp, Artificial Sequence
  Synthetic
atccgttatttgatctaatgttgacatctgaaccggattctagcagtaaagatactagagattgtttattatatc

SEQ ID NO: 250656 - DNA, 75 bp, Artificial Sequence
  Synthetic
taacagccttgtgaagaagtgtttctcctcgtttgtcaatcatgttaatgtctttaagataaggtaggcaaatgt

SEQ ID NO: 250657 - DNA, 75 bp, Artificial Sequence
  Synthetic
ataagacatgtcacaaagaccctttttgtatgtataagtgtagaaattataacatccatagttggattcacatag

SEQ ID NO: 250658 - DNA, 75 bp, Artificial Sequence
  Synthetic
ttgtatgtataagtgtagaaattataacatccatagttggattcacataggtgtccaatcgggatctctccatca

SEQ ID NO: 250659 - DNA, 75 bp, Artificial Sequence
  Synthetic
cttccttttttagtagatatttcatcgtgtaagaatcaatattaatatttctaaagtatctgtgtatagcctctt

SEQ ID NO: 250660 - DNA, 75 bp, Artificial Sequence
  Synthetic
cgtgtaagaatcaatattaatatttctaaagtatctgtgtatagcctctttatttaccacagctccatattccaa

SEQ ID NO: 250661 - DNA, 75 bp, Artificial Sequence; identical to SEQ ID NO: 45702
  Synthetic

SEQ ID NO: 250662 - DNA, 75 bp, Artificial Sequence; identical to SEQ ID NO: 45703
  Synthetic

SEQ ID NO: 250663 - DNA, 75 bp, Artificial Sequence
  Synthetic
gtgcggctttccattctccaaaaacaattttaccaaatctaaatctacatctttattgtatctataatcactatt

SEQ ID NO: 250664 - DNA, 75 bp, Artificial Sequence
  Synthetic
aattttaccaaatctaaatctacatctttattgtatctataatcactatttagataatcagccataattcctcga

SEQ ID NO: 250665 - DNA, 75 bp, Artificial Sequence
  Synthetic
taatattaatattagactatctctatcgcgctacacgaccaatatcgattactatggatatctttagggaaatcg

SEQ ID NO: 250666 - DNA, 75 bp, Artificial Sequence
  Synthetic
ataaataagccgtgttatctattcctttcattaacaatttaacgatgtctatatctatatgagatgacttaatat

SEQ ID NO: 250667 - DNA, 75 bp, Artificial Sequence
  Synthetic
tttcattaacaatttaacgatgtctatatctatatgagatgacttaatataatattgaagagctgtacaatagtt

SEQ ID NO: 250668 - DNA, 75 bp, Artificial Sequence
  Synthetic
ccgtgattaattagacatttaacaacttccggacgcacatatgctctcgtatccgactctgaatacagatgagag

SEQ ID NO: 250669 - DNA, 75 bp, Artificial Sequence
  Synthetic
atccgactctgaatacagatgagagatgatatacagatgcaatacggtaccgcaatttcgtggttgataatcatc

SEQ ID NO: 250670 - DNA, 75 bp, Artificial Sequence
  Synthetic
tcataaagaacactgcagccattttctatgaacaaatcaataatttcaggaacaggatcatctgtcattacataa

SEQ ID NO: 250671 - DNA, 75 bp, Artificial Sequence
  Synthetic
ttttctataactgaacgatggttttcacatttaacactcaagtcaaatccatgttctaccaacacctttatcaag

SEQ ID NO: 250672 - DNA, 75 bp, Artificial Sequence
  Synthetic
tatagctgaatatattaaagtcatttatgttgctatatccagtagcttctagtagagccatcgctatatccttat

SEQ ID NO: 250673 - DNA, 75 bp, Artificial Sequence
  Synthetic
ttgtggaattaatattatgaatcatggtttttacacatagatctactacaggcggaacatcaattattatggcag

SEQ ID NO: 250674 - DNA, 75 bp, Artificial Sequence
  Synthetic
agtagagccatcgctatatccttattgactttaacatgtctactatttgtgtattcttctattggggtaaactgt

SEQ ID NO: 250675 - DNA, 75 bp, Artificial Sequence
  Synthetic
tgccactgtctagtagtagtttgacgacctcaacattattacaatgctcattgaaaaggtatgcgtgtaaagcat

SEQ ID NO: 250676 - DNA, 75 bp, Artificial Sequence
  Synthetic
gacctcaacattattacaatgctcattgaaaaggtatgcgtgtaaagcattattcttgaattggttcctggtatc

SEQ ID NO: 250677 - DNA, 75 bp, Artificial Sequence
  Synthetic
aaagaaatactaaaaaatgtagaaattgaaaataataaaaacattaacaagaatcatcccagtgaatatattaga

SEQ ID NO: 250678 - DNA, 75 bp, Artificial Sequence
  Synthetic
tgtttaagttcatcgagaaccacctcctcattttccagatagtcaaacattttgactgaatagaagtgaatgagc

SEQ ID NO: 250679 - DNA, 75 bp, Artificial Sequence
  Synthetic
tttgactgaatagaagtgaatgagctactgtgaactctatacacccgcacaactaatgtcattaaatatcatttt

SEQ ID NO: 250680 - DNA, 75 bp, Artificial Sequence
  Synthetic
aactaatgtcattaaatatcatttttgaatgtatttataccatgtcaaaaacttgtacaattattaataaaaata

SEQ ID NO: 250681 - DNA, 75 bp, Artificial Sequence
  Synthetic
acttgtacaattattaataaaaataattagtgtttaaattttaccagttccagattttacacctccgttaacacc

SEQ ID NO: 250682 - DNA, 75 bp, Artificial Sequence
  Synthetic
attagtgtttaaattttaccagttccagattttacacctccgttaacacctccattaaccccactttttacacca

SEQ ID NO: 250683 - DNA, 75 bp, Artificial Sequence
  Synthetic
cactgccaccagatgtataagttttagatcctttattactaccatcatgtccatggataaagacactccacatgc

SEQ ID NO: 250684 - DNA, 75 bp, Artificial Sequence
  Synthetic
ccatggataaagacactccacatgccgccactactaccccctttagaagacatattaataagacaagtttaacaa

SEQ ID NO: 250685 - DNA, 75 bp, Artificial Sequence
  Synthetic
taccaacctacactatatatgattatagtttctatttttataggaacgcgtacgagaaaatcaaatgtctaagtt

SEQ ID NO: 250686 - DNA, 75 bp, Artificial Sequence
  Synthetic
tagtttctatttttataggaacgcgtacgagaaaatcaaatgtctaagttctaacggtagtgttgataaacgatt

SEQ ID NO: 250687 - DNA, 75 bp, Artificial Sequence
  Synthetic
tacgagaaaatcaaatgtctaagttctaacggtagtgttgataaacgattgttatccgcggatacctcatctatc

SEQ ID NO: 250688 - DNA, 75 bp, Artificial Sequence
  Synthetic
ctattaacctattagcattatatattatttgattataaaacttatattgcttattagcccaatctgtaaatatcg

SEQ ID NO: 250689 - DNA, 75 bp, Artificial Sequence
  Synthetic
tatttgattataaaacttatattgcttattagcccaatctgtaaatatcggattattaacatatcgtttctttgt

SEQ ID NO: 250690 - DNA, 75 bp, Artificial Sequence
  Synthetic
gtaagcatgtccgtaccatttattttaatttgacacatatcagcaatttctttttcgcagtcggttatatattct

SEQ ID NO: 250691 - DNA, 75 bp, Artificial Sequence
  Synthetic
taatttgacacatatcagcaatttctttttcgcagtcggttatatattctatataagatggatacgtatcacata

SEQ ID NO: 250692 - DNA, 75 bp, Artificial Sequence
  Synthetic
gtacttaatacatattttcagtaacgatttagccttattacctattaataagtgcctgtcgttggataggtaatc

SEQ ID NO: 250693 - DNA, 75 bp, Artificial Sequence
  Synthetic
gatttagccttattacctattaataagtgcctgtcgttggataggtaatcaactgttttcttaatacattcgatg

SEQ ID NO: 250694 - DNA, 75 bp, Artificial Sequence
  Synthetic
ccaatatcttaatatatatttctgctatttctggtatacatgcatgtgccattataacacaaataccaatacatg

SEQ ID NO: 250695 - DNA, 75 bp, Artificial Sequence
  Synthetic
attataacacaaataccaatacatgtagacccatatgttgttgttatattaatatctgcgccattatctattaac

SEQ ID NO: 250696 - DNA, 75 bp, Artificial Sequence
  Synthetic
actcgatacaataataaagtatactacgtccatgtttatctattttgtttatatcatcgatatacggcttacaaa

SEQ ID NO: 250697 - DNA, 75 bp, Artificial Sequence
  Synthetic
acgtccatgtttatctattttgtttatatcatcgatatacggcttacaaatttttagtatcgataacacttctga

SEQ ID NO: 250698 - DNA, 75 bp, Artificial Sequence
  Synthetic
aacggcataatatttattatgttatcatcattaacaactacgtttccattttttaaaatatactctacaacttta

SEQ ID NO: 250699 - DNA, 75 bp, Artificial Sequence
  Synthetic
catcattaacaactacgtttccattttttaaaatatactctacaactttaggatccctattgtcaaatcttttaa

SEQ ID NO: 250700 - DNA, 75 bp, Artificial Sequence
  Synthetic
atataatatagctccttccctaatcatacatttgataacattgatgtacactgtatgataagatacatattctga

SEQ ID NO: 250701 - DNA, 75 bp, Artificial Sequence
  Synthetic
tatcaatatagcaacagtaattcttgctcctccttgattttagcatcctcttcattattttcttctacgtacata

SEQ ID NO: 250702 - DNA, 75 bp, Artificial Sequence
  Synthetic
atacatttgataacattgatgtacactgtatgataagatacatattctgacaatagatcttgtatagaatctgta

SEQ ID NO: 250703 - DNA, 75 bp, Artificial Sequence
  Synthetic
tgacattattacgtaaactattacacaattctaaaatataaaacgtatcatgggcagataatagtttatccacta

SEQ ID NO: 250704 - DNA, 75 bp, Artificial Sequence
  Synthetic
caattctaaaatataaaacgtatcatgggcagataatagtttatccactatataattatctattttatgattttt

SEQ ID NO: 250705 - DNA, 75 bp, Artificial Sequence
  Synthetic
atagatagaatatgcattagttcattaccgctatagttactatcgaataacacgtcaaatatttcccgtttaata

SEQ ID NO: 250706 - DNA, 75 bp, Artificial Sequence
  Synthetic
gcgcatgttgatgtgtctgtttatacaatcaattatactaggatccataccactacattcgggtaaaattgtagc

SEQ ID NO: 250707 - DNA, 75 bp, Artificial Sequence
  Synthetic
taccgctatagttactatcgaataacacgtcaaatatttcccgtttaatatcgcatttgtcaacataataataga

SEQ ID NO: 250708 - DNA, 75 bp, Artificial Sequence
  Synthetic
atgacacatttcgttttcgtgcgaaattaaatagtttatcacgtccaaagatgtcacataaccatcttgtgacct

SEQ ID NO: 250709 - DNA, 75 bp, Artificial Sequence
  Synthetic
attaaatagtttatcacgtccaaagatgtcacataaccatcttgtgacctagtaataatataataatagagaact

SEQ ID NO: 250710 - DNA, 75 bp, Artificial Sequence
  Synthetic
cagtggtgtagtcataatctaaataatcaaactcgtcatcccaattaaaataaatataatcagtacattgaatgg

SEQ ID NO: 250711 - DNA, 75 bp, Artificial Sequence
  Synthetic
atcaaactcgtcatcccaattaaaataaatataatcagtacattgaatgggtatgatattgtacccatactgtat

SEQ ID NO: 250712 - DNA, 75 bp, Artificial Sequence
  Synthetic
tccaataatagtttaaatacatctatattaggatttgatgttgtcgcgtatttctctacaatattaataccattt

SEQ ID NO: 250713 - DNA, 75 bp, Artificial Sequence
  Synthetic
tattaggatttgatgttgtcgcgtatttctctacaatattaataccatttttgatactatttatttctatacctt

SEQ ID NO: 250714 - DNA, 75 bp, Artificial Sequence
  Synthetic
tatatcgatgttatcagaacatagatattcaaatatatcaaaatcattgatatttttatagtcgactgacgacaa

SEQ ID NO: 250715 - DNA, 75 bp, Artificial Sequence
  Synthetic
tattcaaatatatcaaaatcattgatatttttatagtcgactgacgacaataacaaaatcacaacatcgtttttg

SEQ ID NO: 250716 - DNA, 75 bp, Artificial Sequence
  Synthetic
atgcctttaatggagtttcaccatcatactcatataatggatttgcaccactttctattaatgattgtgcactac

SEQ ID NO: 250717 - DNA, 75 bp, Artificial Sequence
  Synthetic
atactcatataatggatttgcaccactttctattaatgattgtgcactactggcatcgatgttaaatgttttaca

SEQ ID NO: 250718 - DNA, 75 bp, Artificial Sequence
  Synthetic
accatgattggttgttgacgttatcacattttttggtttctttcatttcagttatgtatggatttagcacgtttg

SEQ ID NO: 250719 - DNA, 75 bp, Artificial Sequence
  Synthetic
acattttttggtttctttcatttcagttatgtatggatttagcacgtttgggaagcatgagctcatatgatttca

SEQ ID NO: 250720 - DNA, 75 bp, Artificial Sequence
  Synthetic
ttcgatcagatcaatgtctagatctatagaatcaaaacacgataggtcagaagataatgaatatctgtacgcttc

SEQ ID NO: 250721 - DNA, 75 bp, Artificial Sequence
  Synthetic
aagataatgaatatctgtacgcttcttcttgtactgtaacttctggttttgttagatggttgcatcgtgctttaa

SEQ ID NO: 250722 - DNA, 75 bp, Artificial Sequence
  Synthetic
ttcttgtactgtaacttctggttttgttagatggttgcatcgtgctttaacgtcaatggtacaaattttatcctc

SEQ ID NO: 250723 - DNA, 75 bp, Artificial Sequence
  Synthetic
gtataaaattctatattcaaattatcatgcgatgtgtatacgctaacggtatcaataaacggagcacagcattta

SEQ ID NO: 250724 - DNA, 75 bp, Artificial Sequence
  Synthetic
aagtatatcttaacgaaagaagttgtcatcgttagagtgtggtaaatcattgtctacggtactagatcctcataa

SEQ ID NO: 250725 - DNA, 75 bp, Artificial Sequence
  Synthetic
atttatcaaatggttgataatatggatgtcgtggcaatttcctaatacggaaataagacataaacacgcaataaa

SEQ ID NO: 250726 - DNA, 75 bp, Artificial Sequence
  Synthetic
cttttagtaagtgtcatttaacactatactcatattaatccatggactcataatctctatacgggattaacggat

SEQ ID NO: 250727 - DNA, 75 bp, Artificial Sequence
  Synthetic
atactcatattaatccatggactcataatctctatacgggattaacggatgttctatatacggggatgagtagtt

SEQ ID NO: 250728 - DNA, 75 bp, Artificial Sequence
  Synthetic
agagatagataatactcgaccgacataatgttgtgttgtccattatagtataaaaattaatatttctatttctat

SEQ ID NO: 250729 - DNA, 75 bp, Artificial Sequence
  Synthetic
ctaatcatatttagactgatgtatgggtaatagtgtttgaagagctcgttctcatcatcagaataaatcaatatc

SEQ ID NO: 250730 - DNA, 75 bp, Artificial Sequence
  Synthetic
ttcaccgcatagttgtttgcaaatacggttaatcctttgacctcgtcgatttccgaccaatctgggcgtataacg

SEQ ID NO: 250731 - DNA, 75 bp, Artificial Sequence
  Synthetic
cggttaatcctttgacctcgtcgatttccgaccaatctgggcgtataacgaatcttaactttaatttcttgtaat

SEQ ID NO: 250732 - DNA, 75 bp, Artificial Sequence
  Synthetic
tccgtagttatctcctctatgtaactgtaaatttctcaacgcgatatctccattaataatgatgtcgaattcgtg

SEQ ID NO: 250733 - DNA, 75 bp, Artificial Sequence
  Synthetic
acttggtaatagttttactatcataagtttataaattccacaagctactatggaatataccaaccatcttagtat

SEQ ID NO: 250734 - DNA, 75 bp, Artificial Sequence
  Synthetic
tcatctattggataacgtctctgtattctacgatagagtgctattttaagatgtgacagatccgtgtcatcaaat

SEQ ID NO: 250735 - DNA, 75 bp, Artificial Sequence
  Synthetic
ttctacgatagagtgctattttaagatgtgacagatccgtgtcatcaaatatatactccattaaaatgattattc

SEQ ID NO: 250736 - DNA, 75 bp, Artificial Sequence
  Synthetic
atcacgacctttgttaatatccacgacaatagacagcaatcccatggttccataaacagtgagtttatctttctt

SEQ ID NO: 250737 - DNA, 75 bp, Artificial Sequence
  Synthetic
acaatagacagcaatcccatggttccataaacagtgagtttatctttctttgaagtgatattttgtagagatctt

SEQ ID NO: 250738 - DNA, 75 bp, Artificial Sequence
  Synthetic
ttatatctttagctaaatcatatatgttaccatcataatatctaacagcatctatcttaaacgtttccatcgctg

SEQ ID NO: 250739 - DNA, 75 bp, Artificial Sequence
  Synthetic
gttaccatcataatatctaacagcatctatcttaaacgtttccatcgctgtaaagacgtttccgatagatggtct

SEQ ID NO: 250740 - DNA, 75 bp, Artificial Sequence
  Synthetic
caaatgtaatcgtgtataacatctttgatagaatcagactctaaagaaaaggaatcggctttattatacacattc

SEQ ID NO: 250741 - DNA, 75 bp, Artificial Sequence
  Synthetic
tgatagaatcagactctaaagaaaaggaatcggctttattatacacattcatgataaacttaatgaaaaatgttt

SEQ ID NO: 250742 - DNA, 75 bp, Artificial Sequence
  Synthetic
tatgtcttaataattgttattatttcactaattaatatttagtaacgagtacactctataaaaacgagaatgaca

SEQ ID NO: 250743 - DNA, 75 bp, Artificial Sequence
  Synthetic
cactaattaatatttagtaacgagtacactctataaaaacgagaatgacataactaatcataactagttatcaaa

SEQ ID NO: 250744 - DNA, 75 bp, Artificial Sequence
  Synthetic
atggtatagatcctgtaagcgttgtctgtattctggagctattttctctatcgcattagtgagttcagaatatgt

SEQ ID NO: 250745 - DNA, 75 bp, Artificial Sequence
  Synthetic
ctgtattctggagctattttctctatcgcattagtgagttcagaatatgttataaatttaaatcgaataacgaac

SEQ ID NO: 250746 - DNA, 75 bp, Artificial Sequence
  Synthetic
taactcttttattttctagccatcgtaataccatgtttaagatagtatattctctagttactacgatctcatcgt

SEQ ID NO: 250747 - DNA, 75 bp, Artificial Sequence
  Synthetic
tctctagttactacgatctcatcgttgtctagaatatcgcatactgaatctacatccaattttagaaattggtct

SEQ ID NO: 250748 - DNA, 75 bp, Artificial Sequence
  Synthetic
tgttgatatattgtcgtagaaaactattacgtagaccattttctttataaaacgaatatatagtactccaattat

SEQ ID NO: 250749 - DNA, 75 bp, Artificial Sequence
  Synthetic
attacgtagaccattttctttataaaacgaatatatagtactccaattatctttaccgatatatttgcatacata

SEQ ID NO: 250750 - DNA, 75 bp, Artificial Sequence
  Synthetic
tcaatgctccagcgttcaacaacgtacatactagacgcacgttattatcagctattgcataatacaagacactat

SEQ ID NO: 250751 - DNA, 75 bp, Artificial Sequence
  Synthetic
ttaagagtttggttgttaagatatttggctaaactatataattctattagatcatcaacagaatcagtatatatt

SEQ ID NO: 250752 - DNA, 75 bp, Artificial Sequence
  Synthetic
tggctaaactatataattctattagatcatcaacagaatcagtatatatttttctagatccaaagatgaactctt

SEQ ID NO: 250753 - DNA, 75 bp, Artificial Sequence
  Synthetic
aaagatattttcgtgttttagtttatcaagatctaacctgttcatatccatgattaacgacgtcatataaccaca

SEQ ID NO: 250754 - DNA, 75 bp, Artificial Sequence
  Synthetic
tcaagatctaacctgttcatatccatgattaacgacgtcatataaccacataaaataaaaatccattttcatttt

SEQ ID NO: 250755 - DNA, 75 bp, Artificial Sequence
  Synthetic
attgatgtaatattttgttactttgaacgtaaagacagtacacgggtccgtatctccaacaagcacgtagtaatc

SEQ ID NO: 250756 - DNA, 75 bp, Artificial Sequence
  Synthetic
tatctccaacaagcacgtagtaatcaaatttggtgttgttaaacttcgcaatattcatcaatttagatagaaact

SEQ ID NO: 250757 - DNA, 75 bp, Artificial Sequence
  Synthetic
ttcttttgtattcggtagttcaaatatatgatccatgcatatatcgacaaagctattgtagatgtgatttttcct

SEQ ID NO: 250758 - DNA, 75 bp, Artificial Sequence
  Synthetic
atatgatccatgcatatatcgacaaagctattgtagatgtgatttttcctaaatctaatataaaactcgtttact

SEQ ID NO: 250759 - DNA, 75 bp, Artificial Sequence
  Synthetic
ccaagacacacatggtttctaaatctatcaagtggtggggatccatagttataacgcagtaacatagattattac

SEQ ID NO: 250760 - DNA, 75 bp, Artificial Sequence
  Synthetic
tatcaagtggtggggatccatagttataacgcagtaacatagattattaccttcttgactgtcgctaatatctat

SEQ ID NO: 250761 - DNA, 75 bp, Artificial Sequence
  Synthetic
ctacatatagatggcttgtatatcaaagatatagaacacataaccaatttatattctcgctttgtattttcgaat

SEQ ID NO: 250762 - DNA, 75 bp, Artificial Sequence
  Synthetic
aagatatagaacacataaccaatttatattctcgctttgtattttcgaatctaaagttaagagatttagaaaaca

SEQ ID NO: 250763 - DNA, 75 bp, Artificial Sequence
  Synthetic
tgtttccagagtaggatatattaaagtctttaaagattttgtccgattcaaataaatcactaaataatatcccat

SEQ ID NO: 250764 - DNA, 75 bp, Artificial Sequence
  Synthetic
gtctttaaagattttgtccgattcaaataaatcactaaataatatcccatattatcatctgttatagtcatgtca

SEQ ID NO: 250765 - DNA, 75 bp, Artificial Sequence
  Synthetic
atatatcactgctcacctctatatttcgtacatttttaaactgtttgtataatatctctctaatacaatcagata

SEQ ID NO: 250766 - DNA, 75 bp, Artificial Sequence
  Synthetic
tcgtacatttttaaactgtttgtataatatctctctaatacaatcagatatatctattgtgtcggtagacgatac

SEQ ID NO: 250767 - DNA, 75 bp, Artificial Sequence
  Synthetic
cattttacaacttttaacaagttgaccaattcatttctaatagtatcaaactctccatgattaaatattttaata

SEQ ID NO: 250768 - DNA, 75 bp, Artificial Sequence
  Synthetic
tattaaaacattttacttatgactggagttagaatttatagacgacacatttcgtttatcattgttactattact

SEQ ID NO: 250769 - DNA, 75 bp, Artificial Sequence
  Synthetic
ccagatagtttatatccatacttgcacttaaagtctacattgtagttgtatgagtgtatgatcttttaagccgct

SEQ ID NO: 250770 - DNA, 75 bp, Artificial Sequence
  Synthetic
tgagtgtatgatcttttaagccgctagaagttttccgtttgatataggatgtggacatttaacaatctgacacgt

SEQ ID NO: 250771 - DNA, 75 bp, Artificial Sequence
  Synthetic
agaagttttccgtttgatataggatgtggacatttaacaatctgacacgtgggtggattggaccattctcctcct

SEQ ID NO: 250772 - DNA, 75 bp, Artificial Sequence
  Synthetic
tcaacgaatatccactattgcaactataagttacaatgctcccatcgatataaaaatcctcgtatccgttatgtc

SEQ ID NO: 250773 - DNA, 75 bp, Artificial Sequence
  Synthetic
ttggcatttaacagattcgcaaataggtgcctcaggattccataccatagatccagtagatcctaattcacaata

SEQ ID NO: 250774 - DNA, 75 bp, Artificial Sequence
  Synthetic
ggtgcctcaggattccataccatagatccagtagatcctaattcacaatacgatttagattcaccgatcaaatga

SEQ ID NO: 250775 - DNA, 75 bp, Artificial Sequence
  Synthetic
atccagtagatcctaattcacaatacgatttagattcaccgatcaaatgatatccgctattacaagagtacgtta

SEQ ID NO: 250776 - DNA, 75 bp, Artificial Sequence
  Synthetic
aatatcaagttggccattatcgatatctcgaggcgatgggcatctccgtttaatacattgattaaagagtgtcca

SEQ ID NO: 250777 - DNA, 75 bp, Artificial Sequence
  Synthetic
tctcgaggcgatgggcatctccgtttaatacattgattaaagagtgtccatccggtaccggtacatttagcatat

SEQ ID NO: 250778 - DNA, 75 bp, Artificial Sequence
  Synthetic
atccaggtagacatagatattctatagtgtctcctatgttgtaattagcatcagtctctacactattcttaaatt

SEQ ID NO: 250779 - DNA, 75 bp, Artificial Sequence
  Synthetic
tcatattaatggggcgtgacggaatagtacagtatgatagaacacatcctattcccaacaatgtcaggaacgtca

SEQ ID NO: 250780 - DNA, 75 bp, Artificial Sequence
  Synthetic
tccgtaaaatgttatcctggacatcgtacaaataataaaaagcccatatatatgttcgctattgtagaaattgtt

SEQ ID NO: 250781 - DNA, 75 bp, Artificial Sequence
  Synthetic
gtacaaataataaaaagcccatatatatgttcgctattgtagaaattgtttttcacagttgctcaaaaacaatgg

SEQ ID NO: 250782 - DNA, 75 bp, Artificial Sequence
  Synthetic
ttggagtctcatctttagtaaacatatcataatattcgatattacgagttgacatatcgaacaaattccaagtat

SEQ ID NO: 250783 - DNA, 75 bp, Artificial Sequence
  Synthetic
atcataatattcgatattacgagttgacatatcgaacaaattccaagtatttgattttggataatattcgtattt

SEQ ID NO: 250784 - DNA, 75 bp, Artificial Sequence
  Synthetic
tcaccacaagaacacacgaacgtctttcctacatggttaaagtacatgtacaattctatccatttgtcttcctta

SEQ ID NO: 250785 - DNA, 75 bp, Artificial Sequence
  Synthetic
caagtatctagttagcaattttcctcaacatgttattactaaggatgtattagctaataccaatttttttgtttt

SEQ ID NO: 250786 - DNA, 75 bp, Artificial Sequence
  Synthetic
ttcctacatggttaaagtacatgtacaattctatccatttgtcttccttaactatatatttgtatagataattac

SEQ ID NO: 250787 - DNA, 75 bp, Artificial Sequence
  Synthetic
tgcatagatgtcaccatcgtattctacagcataaactatactatgacgtctaggcatgggagacttttttatcca

SEQ ID NO: 250788 - DNA, 75 bp, Artificial Sequence
  Synthetic
acagcataaactatactatgacgtctaggcatgggagacttttttatccaacgatttttagtgaaacattccaca

SEQ ID NO: 250789 - DNA, 75 bp, Artificial Sequence
  Synthetic
agtggtataaactccacccattacatatatatcatcgtttacgaatactgatgcgcctgaatatctaggagtgat

SEQ ID NO: 250790 - DNA, 75 bp, Artificial Sequence
  Synthetic
tatatatcatcgtttacgaatactgatgcgcctgaatatctaggagtgattaagtttggaagtcttttccatttc

SEQ ID NO: 250791 - DNA, 75 bp, Artificial Sequence
  Synthetic
ctatacccgttgaaatagaaaattctaatcctcctattacatataactttccatcgttaacacaagtactaactt

SEQ ID NO: 250792 - DNA, 75 bp, Artificial Sequence
  Synthetic
aagatctacccgcgatacggaataaacatgtctattgttaatcatgccgccaataatgtatagacaattatgtaa

SEQ ID NO: 250793 - DNA, 75 bp, Artificial Sequence
  Synthetic
acatgtctattgttaatcatgccgccaataatgtatagacaattatgtaaaacatttgcatcatagaattgtcta

SEQ ID NO: 250794 - DNA, 75 bp, Artificial Sequence
  Synthetic
attctgttctaggagagtaatgggttattgtggatatataatcagagtttttaatgactactatattatgtttta

SEQ ID NO: 250795 - DNA, 75 bp, Artificial Sequence
  Synthetic
tattgtggatatataatcagagtttttaatgactactatattatgttttataccatttcgtgtcacagctttgta

SEQ ID NO: 250796 - DNA, 75 bp, Artificial Sequence
  Synthetic
atgctatagcattgcatatagcattagtcataaacttgggatgtaaaatgttgatgatatctacatcgtttggat

SEQ ID NO: 250797 - DNA, 75 bp, Artificial Sequence
  Synthetic
gatgatttgtctacatgttctgccgtaaccgatagggaaacggatgtataattttttttatagtatgaaggatat

SEQ ID NO: 250798 - DNA, 75 bp, Artificial Sequence
  Synthetic
tgacatcgacgcattatatagttttttaattccatatcttttagaaaagttaaacatccttatacaatttgtgga

SEQ ID NO: 250799 - DNA, 75 bp, Artificial Sequence
  Synthetic
atgtttatcttcttccagcgcatatagtctaatatcgattcaaacgcgtgatagtttataccattcaatataatc

SEQ ID NO: 250800 - DNA, 75 bp, Artificial Sequence
  Synthetic
agtctaatatcgattcaaacgcgtgatagtttataccattcaatataatcgcttcatcctttagatggtgatcct

SEQ ID NO: 250801 - DNA, 75 bp, Artificial Sequence
  Synthetic
ttcgacattaattcctttttaaatttccgtctatcatctatagaaacatattctatgaatttataaaatgctttt

SEQ ID NO: 250802 - DNA, 75 bp, Artificial Sequence
  Synthetic
gacgacttcaactatgacagctcggtggcgtctgccagcgtgcacatacgaatggcatttctaagaaaagtctac

SEQ ID NO: 250803 - DNA, 75 bp, Artificial Sequence
  Synthetic
ccgctaaaaagcctatcgaatttctacaaaagaatctgttatatggtatagggagagtataaaacattaaatgtc

SEQ ID NO: 250804 - DNA, 75 bp, Artificial Sequence
  Synthetic
acaaaagaatctgttatatggtatagggagagtataaaacattaaatgtccgtacttattaaagtattcagtagc

SEQ ID NO: 250805 - DNA, 75 bp, Artificial Sequence
  Synthetic
gggagagtataaaacattaaatgtccgtacttattaaagtattcagtagccaatcctaactctttcgaataatta

SEQ ID NO: 250806 - DNA, 75 bp, Artificial Sequence
  Synthetic
ctatttttttgaacaatggacctagtggtatatcttgttctatgtatctaaaataatgtctgactagatccgtta

SEQ ID NO: 250807 - DNA, 75 bp, Artificial Sequence
  Synthetic
tggtatatcttgttctatgtatctaaaataatgtctgactagatccgttagtttaatatccgcagtcatcttgtc

SEQ ID NO: 250808 - DNA, 75 bp, Artificial Sequence
  Synthetic
ttaggcgtaggcgttagtttagtttctatatctacatctatgtctttatctaacaccaaaaatataatagctaat

SEQ ID NO: 250809 - DNA, 75 bp, Artificial Sequence
  Synthetic
ctatatctacatctatgtctttatctaacaccaaaaatataatagctaatattttattacaatcatccggatatt

SEQ ID NO: 250810 - DNA, 75 bp, Artificial Sequence
  Synthetic
ttctttggttatactagtatagtcacgatcagacaaataaagaaaatcagatgatcgatgaataatacatttaaa

SEQ ID NO: 250811 - DNA, 75 bp, Artificial Sequence
  Synthetic
tgtctcattaaaatattattagtgtcagttctcattatcatatattgacagcagctattacacttattttatttt

SEQ ID NO: 250812 - DNA, 75 bp, Artificial Sequence
  Synthetic
atagatcagtcattagatcatcaaaatacttttcaatcatcctaaagagtatggtgaacgaatcttcccatctaa

SEQ ID NO: 250813 - DNA, 75 bp, Artificial Sequence
  Synthetic
atacttttcaatcatcctaaagagtatggtgaacgaatcttcccatctaatttctgaacgtctaccaatgtctct

SEQ ID NO: 250814 - DNA, 75 bp, Artificial Sequence
  Synthetic
attcgcttaacatcttctacattattaactggttgattcaatctatctagcaatggaccgtcggatagcgtcatt

SEQ ID NO: 250815 - DNA, 75 bp, Artificial Sequence
  Synthetic
taactggttgattcaatctatctagcaatggaccgtcggatagcgtcattctcatgttcttaatcaatgtacata

SEQ ID NO: 250816 - DNA, 75 bp, Artificial Sequence
  Synthetic
aaacaatataagctttttaaaatcatcattataataggatggatcgccgtcatttctccaaagaatatatctaat

SEQ ID NO: 250817 - DNA, 75 bp, Artificial Sequence
  Synthetic
tcattataataggatggatcgccgtcatttctccaaagaatatatctaataagtagagtcctcatgcttagtaat

SEQ ID NO: 250818 - DNA, 75 bp, Artificial Sequence
  Synthetic
ttttatgttaaatcaattagtaacaccgctatgtttaatacttattcatattttagttttaggatcgagaatcaa

SEQ ID NO: 250819 - DNA, 75 bp, Artificial Sequence
  Synthetic
ccgctatgtttaatacttattcatattttagttttaggatcgagaatcaatacaaaaattaatacatcaattttg

SEQ ID NO: 250820 - DNA, 75 bp, Artificial Sequence
  Synthetic
atgaaacatttgagctcatcgtaaaggacgttctcgtacaggacgtaactataaattggtttatatttgttcaag

SEQ ID NO: 250821 - DNA, 75 bp, Artificial Sequence
  Synthetic
ggacgttctcgtacaggacgtaactataaattggtttatatttgttcaagatagatacaaatccgataacttttt

SEQ ID NO: 250822 - DNA, 75 bp, Artificial Sequence
  Synthetic
aaaagtgtcataccgggttctttttattcttttaaacagatcgattgtgtgatgttgattaggtcttttacgaat

SEQ ID NO: 250823 - DNA, 75 bp, Artificial Sequence
  Synthetic
attcttttaaacagatcgattgtgtgatgttgattaggtcttttacgaatttgatacagaatagcgtttacatat

SEQ ID NO: 250824 - DNA, 75 bp, Artificial Sequence
  Synthetic
gttcgtatgtcataaattctttaattatatgacactgtgtattatttagttcgtccttgttcatcattaggaatc

SEQ ID NO: 250825 - DNA, 75 bp, Artificial Sequence
  Synthetic
tatatgacactgtgtattatttagttcgtccttgttcatcattaggaatctatccaatatggcaattatattaga

SEQ ID NO: 250826 - DNA, 75 bp, Artificial Sequence
  Synthetic
aatcatcaaatacttcgtaagatactccttcatgaacataatcagttacaaaacgtttatatgaagtaaagtatc

SEQ ID NO: 250827 - DNA, 75 bp, Artificial Sequence
  Synthetic
tccttcatgaacataatcagttacaaaacgtttatatgaagtaaagtatctacgatttttacaaaagtcaggatg

SEQ ID NO: 250828 - DNA, 75 bp, Artificial Sequence
  Synthetic
ggaataataatagatttatctagtttatctttttctatctctttcatagttatatacatggtctcagaagtcgga

SEQ ID NO: 250829 - DNA, 75 bp, Artificial Sequence
  Synthetic
tatctttttctatctctttcatagttatatacatggtctcagaagtcggattatgtaacatcagcttcgataaaa

SEQ ID NO: 250830 - DNA, 75 bp, Artificial Sequence
  Synthetic
ttcgctcatacatgtatgaccgttaactatagagtctacactaaaatgattgaataatagatagtctaccattgt

SEQ ID NO: 250831 - DNA, 75 bp, Artificial Sequence
  Synthetic
actatagagtctacactaaaatgattgaataatagatagtctaccattgtttcgtattcagatagtacagcgtag

SEQ ID NO: 250832 - DNA, 75 bp, Artificial Sequence
  Synthetic
tcggcaatctttctcaacatttcatccccatgccttttcattcctcgagtctattgtcgtcgaaatatcgttcca

SEQ ID NO: 250833 - DNA, 75 bp, Artificial Sequence
  Synthetic
cattatctaatagatatttgacgcatcttatggatcccacttcaacagccatcttaaaatcggtagaatcatatt

SEQ ID NO: 250834 - DNA, 75 bp, Artificial Sequence
  Synthetic
tcttatggatcccacttcaacagccatcttaaaatcggtagaatcatattgctttcctttatcgttaataatttc

SEQ ID NO: 250835 - DNA, 75 bp, Artificial Sequence
  Synthetic
ccccatgccttttcattcctcgagtctattgtcgtcgaaatatcgttccagctccttttcgacctcaataacttt

SEQ ID NO: 250836 - DNA, 75 bp, Artificial Sequence
  Synthetic
atacaaatattaactgtttgatcagtaataacattgctagtcgatatcaatttgttaataagatgcgctgggctc

SEQ ID NO: 250837 - DNA, 75 bp, Artificial Sequence
  Synthetic
taataacattgctagtcgatatcaatttgttaataagatgcgctgggctcaatgtcttaataagaagtgtaagag

SEQ ID NO: 250838 - DNA, 75 bp, Artificial Sequence
  Synthetic
attaacatccgttgatggaagtaaaagatttataatgtctacatacttgactgttttagagcatacaatatggag

SEQ ID NO: 250839 - DNA, 75 bp, Artificial Sequence
  Synthetic
agatttataatgtctacatacttgactgttttagagcatacaatatggagaggcgtatttccatcatgatctggt

SEQ ID NO: 250840 - DNA, 75 bp, Artificial Sequence
  Synthetic
gtcgttcgagatcagaaatacgtgttttcttggaatggatttcgtcgatgtacttgtcatgattggcatcgaaac

SEQ ID NO: 250841 - DNA, 75 bp, Artificial Sequence
  Synthetic
tcatccatgagattgtagaagcttttggattgtctgacataagatgtctatgaatatgatttttgccaaatttat

SEQ ID NO: 250842 - DNA, 75 bp, Artificial Sequence
  Synthetic
tggattgtctgacataagatgtctatgaatatgatttttgccaaatttatccactatcctggcttcgaatccgat

SEQ ID NO: 250843 - DNA, 75 bp, Artificial Sequence
  Synthetic
tacttgtcatgattggcatcgaaacacttattaagttctttttttcaattctacgattttatttctttcgcgagt

SEQ ID NO: 250844 - DNA, 75 bp, Artificial Sequence
  Synthetic
tctgaaggatctgtatacgccaacaacggaccacatccttcttcatcaaccgagttgttaatcttggctccatac

SEQ ID NO: 250845 - DNA, 75 bp, Artificial Sequence
  Synthetic
gttttgtcagattcacgctctctacgtagactttcttgcaagttactaatttgttccctggcattaccgagttca

SEQ ID NO: 250846 - DNA, 75 bp, Artificial Sequence
  Synthetic
gtagactttcttgcaagttactaatttgttccctggcattaccgagttcagttttatatgccgaatagagttctg

SEQ ID NO: 250847 - DNA, 75 bp, Artificial Sequence
  Synthetic
tgacttcatcatctgttcccgagagataatatagaggtgttttattatgtttatcacatgcgtttggatctgcgc

SEQ ID NO: 250848 - DNA, 75 bp, Artificial Sequence
  Synthetic
tgatagatcgaaaaaagccactaataaaaacagttggttaattacttcaggctttagactacaaaaatggttcga

SEQ ID NO: 250849 - DNA, 75 bp, Artificial Sequence
  Synthetic
tctattattattaattttagaagctatatgcaatggataatttccatcatcatccgtctcatttggagagtatcc

SEQ ID NO: 250850 - DNA, 75 bp, Artificial Sequence
  Synthetic
atatgcaatggataatttccatcatcatccgtctcatttggagagtatcctctatgaagaagttcttctataaat

SEQ ID NO: 250851 - DNA, 75 bp, Artificial Sequence
  Synthetic
gcattgatttcattattacgtccgcagtcgttcaactgtatttcaagatctgagattctagattgtaatctctgt

SEQ ID NO: 250852 - DNA, 75 bp, Artificial Sequence
  Synthetic
atcgttaagatgtctatcaagatccatgattctatctcttttccatatcagcattgatttcattattacgtccgc

SEQ ID NO: 250853 - DNA, 75 bp, Artificial Sequence
  Synthetic
aatacgcatgtagaatgtgataatttccagagggttcgataacttgtagcatattcctaaatacatctaaatttt

SEQ ID NO: 250854 - DNA, 75 bp, Artificial Sequence
  Synthetic
taacaaatatcataacttagttcttttatgtcaagaaggcactggtttaattcatctataaatgtcacgccataa

SEQ ID NO: 250855 - DNA, 75 bp, Artificial Sequence
  Synthetic
ttatgtcaagaaggcactggtttaattcatctataaatgtcacgccataactaccacgcatactatactcagaat

SEQ ID NO: 250856 - DNA, 75 bp, Artificial Sequence
  Synthetic
gtgtaagtaatggggattaatctttgttggatcagtctctaagttaacacatgtcacacatgatccatttatagt

SEQ ID NO: 250857 - DNA, 75 bp, Artificial Sequence
  Synthetic
gttggatcagtctctaagttaacacatgtcacacatgatccatttatagttatatcacacgatgatgatttatga

SEQ ID NO: 250858 - DNA, 75 bp, Artificial Sequence
  Synthetic
attttgtagttccacaattcatttccatacatgttattgtcacactaatattatgatgaactttatctagccgct

SEQ ID NO: 250859 - DNA, 75 bp, Artificial Sequence
  Synthetic
catacatgttattgtcacactaatattatgatgaactttatctagccgctgagtggtaaacaacagaacagatag

SEQ ID NO: 250860 - DNA, 75 bp, Artificial Sequence
  Synthetic
gccgctgccacaaatctctgatccgtatccatgatggtcatgtttatttttagtccgtatccagtcaacactatg

SEQ ID NO: 250861 - DNA, 75 bp, Artificial Sequence
  Synthetic
tatccatgatggtcatgtttatttttagtccgtatccagtcaacactatgttagcatttctgtcgatatagcttt

SEQ ID NO: 250862 - DNA, 75 bp, Artificial Sequence
  Synthetic
tgtagaattaatgtcgtaatttacaccaatagtgagttcggcgacaaagtaccagtaccggtaatcttgtcgagg

SEQ ID NO: 250863 - DNA, 75 bp, Artificial Sequence
  Synthetic
aaaagagtaagactaatttgtaaaccatcttactcaaaatatgcgacaatagtacgatgcaatgagtaagacaat

SEQ ID NO: 250864 - DNA, 75 bp, Artificial Sequence
  Synthetic
tattctatcaattttaccaattagttagtgtaatgttaacaaaaatgtgggataatttaatagtttttccttaca

SEQ ID NO: 250865 - DNA, 75 bp, Artificial Sequence
  Synthetic
cctcgtttttgctaattatttcgtccaatttattattcttgacatcgtcaagatcttttgtataggagtcagact

SEQ ID NO: 250866 - DNA, 75 bp, Artificial Sequence
  Synthetic
caatttattattcttgacatcgtcaagatcttttgtataggagtcagacttgtattcaacatgtttttctataat

SEQ ID NO: 250867 - DNA, 75 bp, Artificial Sequence
  Synthetic
agatcttttgtataggagtcagacttgtattcaacatgtttttctataatcatcttagctatttcggcatcatcc

SEQ ID NO: 250868 - DNA, 75 bp, Artificial Sequence
  Synthetic
gtgtaatattattaatggatatatagataacgcaatagggactaatagtattgtaaaagatataatcgactattt

SEQ ID NO: 250869 - DNA, 75 bp, Artificial Sequence
  Synthetic
aatagatattaatgtcgtatttgaacagagcctgtaacatctcaatgtctttattatctatagccaatttgatgt

SEQ ID NO: 250870 - DNA, 75 bp, Artificial Sequence
  Synthetic
cagagcctgtaacatctcaatgtctttattatctatagccaatttgatgtccggaatgaagagaagggaattggt

SEQ ID NO: 250871 - DNA, 75 bp, Artificial Sequence
  Synthetic
aagagaatcatcatatccacgtgtccattttttatagtggtgtgaatacaactaaggagaatagctagatcaaaa

SEQ ID NO: 250872 - DNA, 75 bp, Artificial Sequence
  Synthetic
cattttttatagtggtgtgaatacaactaaggagaatagctagatcaaaaggagatggtatctctgaaagaaagt

SEQ ID NO: 250873 - DNA, 75 bp, Artificial Sequence
  Synthetic
catgacagcatgataaaatgaagttttccatccagttttcccatagaacatcagtctccaatttttcttaacaaa

SEQ ID NO: 250874 - DNA, 75 bp, Artificial Sequence
  Synthetic
ttccatccagttttcccatagaacatcagtctccaatttttcttaacaaacagttttaccgtttgcatgttacca

SEQ ID NO: 250875 - DNA, 75 bp, Artificial Sequence
  Synthetic
tgtttcctttgtcatcaaattgtgaatcatccattccactgaatagcaaaatctttactattttggtatcttcta

SEQ ID NO: 250876 - DNA, 75 bp, Artificial Sequence
  Synthetic
atcatccattccactgaatagcaaaatctttactattttggtatcttctaatgtggctgcctgatgtaatggaaa

SEQ ID NO: 250877 - DNA, 75 bp, Artificial Sequence
  Synthetic
ctagacgcacgttattatcagctattgcataatacaagacactatgaccgttgatatccgccttaaatgcatctt

SEQ ID NO: 250878 - DNA, 75 bp, Artificial Sequence
  Synthetic
ttccaccttacccataaacaatataaatccagtaatatcatgtctaatgatgaacacaaatggtgtattaaattc

SEQ ID NO: 250879 - DNA, 75 bp, Artificial Sequence
  Synthetic
aatccagtaatatcatgtctaatgatgaacacaaatggtgtattaaattccagttcttcaggagatgatctcgcc

SEQ ID NO: 250880 - DNA, 75 bp, Artificial Sequence
  Synthetic
ccgctacagttccttgttcgtctacatctatctttacattctgaaacattttataaatatataatgggtccctag

SEQ ID NO: 250881 - DNA, 75 bp, Artificial Sequence
  Synthetic
atctatctttacattctgaaacattttataaatatataatgggtccctagtcatatgtttaaacgacgccttatc

SEQ ID NO: 250882 - DNA, 75 bp, Artificial Sequence
  Synthetic
atttcggctatcgacttaatatccctcttgttttcgatagaaaatctagggagtttaagattgtacattttattc

SEQ ID NO: 250883 - DNA, 75 bp, Artificial Sequence
  Synthetic
tcttgttttcgatagaaaatctagggagtttaagattgtacattttattccctaattgagatgaccaatattcta

SEQ ID NO: 250884 - DNA, 75 bp, Artificial Sequence
  Synthetic
gaaatgggtcatattatcacctattgccaggtacatactaatattagcatccttatacagaaggcgcaccatatc

SEQ ID NO: 250885 - DNA, 75 bp, Artificial Sequence
  Synthetic
gccaggtacatactaatattagcatccttatacagaaggcgcaccatatcatattcttcgtcatcgattgtgatt

SEQ ID NO: 250886 - DNA, 75 bp, Artificial Sequence
  Synthetic
cgttcatcatgggaaccgttttcgtaccgtacttattagtaaaactagcattgtgtgttttagtgatatcaaacg

SEQ ID NO: 250887 - DNA, 75 bp, Artificial Sequence
  Synthetic
accgtacttattagtaaaactagcattgtgtgttttagtgatatcaaacggatattgccacgtacctttaaaata

SEQ ID NO: 250888 - DNA, 75 bp, Artificial Sequence
  Synthetic
gtattatcgtcgagcatagtagaatcaactacattagacataccagatctacgttctactatagaattaatttta

SEQ ID NO: 250889 - DNA, 75 bp, Artificial Sequence
  Synthetic
caactacattagacataccagatctacgttctactatagaattaattttattaaccgcatctcgtctaaagttta

SEQ ID NO: 250890 - DNA, 75 bp, Artificial Sequence
  Synthetic
ttgttgataatacgacggtttaatacacacagtactatcgacgaaactttgatacgttagatcggtgtacgtata

SEQ ID NO: 250891 - DNA, 75 bp, Artificial Sequence
  Synthetic
cacacagtactatcgacgaaactttgatacgttagatcggtgtacgtatatttagatgttttcatcttagctaat

SEQ ID NO: 250892 - DNA, 75 bp, Artificial Sequence
  Synthetic
gacccagatctctttttctcaaattcatagtattcaataattctactctagtattacctgatgcagacaatagcg

SEQ ID NO: 250893 - DNA, 75 bp, Artificial Sequence
  Synthetic
gtattacctgatgcagacaatagcgacataaacatagaaaacgaatacccaaacggtgagaagacaatattatca

SEQ ID NO: 250894 - DNA, 75 bp, Artificial Sequence
  Synthetic
tatttttatacgctaatataccggcattgataaatccctgcagacgatatgcggatactgaacacgctaatgata

SEQ ID NO: 250895 - DNA, 75 bp, Artificial Sequence
  Synthetic
gtatcaataacgcaatcatgatttttatggtattaataattaaccttatttttatgtttggtataaaatttattg

SEQ ID NO: 250896 - DNA, 75 bp, Artificial Sequence
  Synthetic
taactctaatcactttaacttttacagttttccctacaagtttatccctatattcaacatatctatccatatgca

SEQ ID NO: 250897 - DNA, 75 bp, Artificial Sequence
  Synthetic
agttttccctacaagtttatccctatattcaacatatctatccatatgcatctcttaacactctgccaagatagc

SEQ ID NO: 250898 - DNA, 75 bp, Artificial Sequence
  Synthetic
taaatatatagagtataatcattctcgtatactctgccctttattacatcgcccgcattgggcaacgaataacaa

SEQ ID NO: 250899 - DNA, 75 bp, Artificial Sequence
  Synthetic
cgtaaattgggataaaattatgtttttattgtttatctattttattcaagagaatattcaggaagttccttttcc

SEQ ID NO: 250900 - DNA, 75 bp, Artificial Sequence
  Synthetic
ttattgtttatctattttattcaagagaatattcaggaagttccttttccggttgtatctcgtcgcagtatatat

SEQ ID NO: 250901 - DNA, 75 bp, Artificial Sequence
  Synthetic
agaatattcaggaagttccttttccggttgtatctcgtcgcagtatatatcatttgtacattgtttcatattttt

SEQ ID NO: 250902 - DNA, 75 bp, Artificial Sequence
  Synthetic
ctagtatcgtacaattcatagctgtattttgaattccaatcacgtataaaaatatcttccaattgttgacgaaga

SEQ ID NO: 250903 - DNA, 75 bp, Artificial Sequence
  Synthetic
attttgaattccaatcacgtataaaaatatcttccaattgttgacgaagacctaatccatcatccggtgtaatat

SEQ ID NO: 250904 - DNA, 75 bp, Artificial Sequence
  Synthetic
aaagtaatttcctgtccaatttgatgtacctatatacgccgttttatcggttaccatatattttgcatggtttac

SEQ ID NO: 250905 - DNA, 75 bp, Artificial Sequence
  Synthetic
gtacctatatacgccgttttatcggttaccatatattttgcatggtttaccctagaatacggaatgggaggatca

SEQ ID NO: 250906 - DNA, 75 bp, Artificial Sequence
  Synthetic
cttctatatctatgtttttagattttagcatagctatagatcttaaaaagtttctcatgataaacgaagatcgtt

SEQ ID NO: 250907 - DNA, 75 bp, Artificial Sequence
  Synthetic
tagcatagctatagatcttaaaaagtttctcatgataaacgaagatcgttgccagcaactaatcaatagcttaac

SEQ ID NO: 250908 - DNA, 75 bp, Artificial Sequence
  Synthetic
cttcttaattcatcttctatataaggccaaaacaaaattttacccgcctttgaataaataataggaataaagttc

SEQ ID NO: 250909 - DNA, 75 bp, Artificial Sequence
  Synthetic
gccaaaacaaaattttacccgcctttgaataaataataggaataaagttcataacagatacataaacgaatttac

SEQ ID NO: 250910 - DNA, 75 bp, Artificial Sequence
  Synthetic
agcggttaaatcattggttctttccatagtacataattgttgtggtgcagaagcaataaatacagagtgtggaac

SEQ ID NO: 250911 - DNA, 75 bp, Artificial Sequence
  Synthetic
atagtacataattgttgtggtgcagaagcaataaatacagagtgtggaacaccgcttacgttaatactaagagga

SEQ ID NO: 250912 - DNA, 75 bp, Artificial Sequence
  Synthetic
aaaagtttttccaattatatggtagattgttaactccaagataccagtatacctcaaaaatttgagtgagatccg

SEQ ID NO: 250913 - DNA, 75 bp, Artificial Sequence
  Synthetic
attgttaactccaagataccagtatacctcaaaaatttgagtgagatccgctgccaagttcctattattgaagat

SEQ ID NO: 250914 - DNA, 75 bp, Artificial Sequence
  Synthetic
gttagtgatctccaatccatgttagcgcttcctaaataaatatgtgtattatcagatatccaaaattttgtatga

SEQ ID NO: 250915 - DNA, 75 bp, Artificial Sequence
  Synthetic
cgcttcctaaataaatatgtgtattatcagatatccaaaattttgtatgaagaactcctcctaggatatttgtaa

SEQ ID NO: 250916 - DNA, 75 bp, Artificial Sequence
  Synthetic
ggccatttgtagtctttcaacatcctttaatggtttgttggatttattgacggctactctaactcttactcctct

SEQ ID NO: 250917 - DNA, 75 bp, Artificial Sequence
  Synthetic
tttaatggtttgttggatttattgacggctactctaactcttactcctcttttgggtaattgtacaatctcgttt

SEQ ID NO: 250918 - DNA, 75 bp, Artificial Sequence
  Synthetic
ccacttcatccgataaactccaataaaaagatgatatatctagtgtttttatggtattggatagaatttccctcc

SEQ ID NO: 250919 - DNA, 75 bp, Artificial Sequence
  Synthetic
tttatcaaattgcatacctataggaatagtctctgtaatcactgcgattgtattatccggattcattttatttgt

SEQ ID NO: 250920 - DNA, 75 bp, Artificial Sequence
  Synthetic
actctattaaaaatccaagtttctatttctttcatgactgattttttaacttcatccgtttccttatgaagatga

SEQ ID NO: 250921 - DNA, 75 bp, Artificial Sequence
  Synthetic
tttctttcatgactgattttttaacttcatccgtttccttatgaagatgatgtttggcaccttcataaattttta

SEQ ID NO: 250922 - DNA, 75 bp, Artificial Sequence
  Synthetic
catgaaataatatgcacctgaaacatcgctaatctcattgtttgttccctggagtatgagagtcggggtgttaat

SEQ ID NO: 250923 - DNA, 75 bp, Artificial Sequence
  Synthetic
tcgctaatctcattgtttgttccctggagtatgagagtcggggtgttaatcttgggaattatttttctaaccttg

SEQ ID NO: 250924 - DNA, 75 bp, Artificial Sequence
  Synthetic
caaatccagccttaattttttcatgattgactaatggatcgtattggtatttataaacttcatccatatctctag

SEQ ID NO: 250925 - DNA, 75 bp, Artificial Sequence
  Synthetic
attgactaatggatcgtattggtatttataaacttcatccatatctctagatactgattctggacatagctttcc

SEQ ID NO: 250926 - DNA, 75 bp, Artificial Sequence
  Synthetic
cccataagttttgcagctagcagattcagtcttggaacagcgtctgcattaactagaggagacattagaatcatt

SEQ ID NO: 250927 - DNA, 75 bp, Artificial Sequence
  Synthetic
tcagtcttggaacagcgtctgcattaactagaggagacattagaatcattgctgtaaacaagtttggattatcgc

SEQ ID NO: 250928 - DNA, 75 bp, Artificial Sequence
  Synthetic
tcccatggaatgacccaataagaagactggaactcctggataagtagatttaatagtcactacgtgctgtaccac

SEQ ID NO: 250929 - DNA, 75 bp, Artificial Sequence
  Synthetic
actggaactcctggataagtagatttaatagtcactacgtgctgtaccacatctctaacatacttaccaaagtca

SEQ ID NO: 250930 - DNA, 75 bp, Artificial Sequence
  Synthetic
ttcttccatggccaatatgatcatgtgagaatactaaaattcctaacgatgatatgttttcagctagttcgtcat

SEQ ID NO: 250931 - DNA, 75 bp, Artificial Sequence
  Synthetic
tgagaatactaaaattcctaacgatgatatgttttcagctagttcgtcataacgtccagaatgttcaccagctcc

SEQ ID NO: 250932 - DNA, 75 bp, Artificial Sequence
  Synthetic
ggatatgtaataggtttccaatatttacaatatatgtaatcattgtccagattgaacatacagtttgcactcatg

SEQ ID NO: 250933 - DNA, 75 bp, Artificial Sequence
  Synthetic
tacaatatatgtaatcattgtccagattgaacatacagtttgcactcatgattcactatataactatcaatatta

SEQ ID NO: 250934 - DNA, 75 bp, Artificial Sequence
  Synthetic
ttttatgttttattgataattgtaaaaatatacaattaaatcaatatagaggaaggagacggtactgtattttgt

SEQ ID NO: 250935 - DNA, 75 bp, Artificial Sequence
  Synthetic
aaatatacaattaaatcaatatagaggaaggagacggtactgtattttgtgagatagtcatggagactaaatcag

SEQ ID NO: 250936 - DNA, 75 bp, Artificial Sequence
  Synthetic
tgtggatgatgatgaaatatgtagtcgcgactccatcattgatctaatagatgaatatatcacgtggagaaatca

SEQ ID NO: 250937 - DNA, 75 bp, Artificial Sequence
  Synthetic
atgaatatatcacgtggagaaatcatgttatagtgtttaataaagatattaccagttgtggaagactgtacaagg

SEQ ID NO: 250938 - DNA, 75 bp, Artificial Sequence
  Synthetic
tatacggtactatggtattgataaaattaatgagattgtcgaggctatgagtgaaggagaccactacatcaatct

SEQ ID NO: 250939 - DNA, 75 bp, Artificial Sequence
  Synthetic
attaatgagattgtcgaggctatgagtgaaggagaccactacatcaatcttacagaagtccatgatcaggaaagt

SEQ ID NO: 250940 - DNA, 75 bp, Artificial Sequence
  Synthetic
ctaaaatcgctgaacattggggatacaaaaagatttcagaatctaaattccaatcattgggaaacattacagatc

SEQ ID NO: 250941 - DNA, 75 bp, Artificial Sequence
  Synthetic
caaaaagatttcagaatctaaattccaatcattgggaaacattacagatctgatgaccgacgataatataaacat

SEQ ID NO: 250942 - DNA, 75 bp, Artificial Sequence
  Synthetic
tattatcctatcatgtatttgagagtcttatatgtagcaaacatgataactgcaatacccataatctttagatat

SEQ ID NO: 250943 - DNA, 75 bp, Artificial Sequence
  Synthetic
tcttatatgtagcaaacatgataactgcaatacccataatctttagatattcacgcgtgctatggatggcattat

SEQ ID NO: 250944 - DNA, 75 bp, Artificial Sequence
  Synthetic
ataatctacaaaataatcatcgcatatagtatgagatagtagagtaaacatttttatcgtttctactgggttcat

SEQ ID NO: 250945 - DNA, 75 bp, Artificial Sequence
  Synthetic
atagtatgagatagtagagtaaacatttttatcgtttctactgggttcatacatcgtctacccaattcggtaatg

SEQ ID NO: 250946 - DNA, 75 bp, Artificial Sequence
  Synthetic
ccaaacccttgttgttcattagtatagtattaacttcattatttatgtcataaactgtaaatgattctgtagatg

SEQ ID NO: 250947 - DNA, 75 bp, Artificial Sequence
  Synthetic
agtattaacttcattatttatgtcataaactgtaaatgattctgtagatgccatatcacacatgatattcatgtc

SEQ ID NO: 250948 - DNA, 75 bp, Artificial Sequence
  Synthetic
tcacaatacgtgttgataatatctacatatgatctagtttttgtgggtaattgcctatacaagtcgtctaaacgt

SEQ ID NO: 250949 - DNA, 75 bp, Artificial Sequence
  Synthetic
catatgatctagtttttgtgggtaattgcctatacaagtcgtctaaacgttgtttactcatatagtattgaacag

SEQ ID NO: 250950 - DNA, 75 bp, Artificial Sequence
  Synthetic
tgatagataatcgagtatgttagtagacttgtcaaatctatataccatattttctggaagcggatatacatagtc

SEQ ID NO: 250951 - DNA, 75 bp, Artificial Sequence
  Synthetic
gacttgtcaaatctatataccatattttctggaagcggatatacatagtcgcgatcatcattatcactagcctca

SEQ ID NO: 250952 - DNA, 75 bp, Artificial Sequence
  Synthetic
aatctatgatattattatacataaacatcgacaacatactattgtctattatctaagtcctgttgatccaaaccc

SEQ ID NO: 250953 - DNA, 75 bp, Artificial Sequence
  Synthetic
catcgacaacatactattgtctattatctaagtcctgttgatccaaacccttgatctcctctatctgtactatct

SEQ ID NO: 250954 - DNA, 75 bp, Artificial Sequence
  Synthetic
gataatatatacgttgatagattagctgagctattctatctccagtatttacattaaacgtacattttccattat

SEQ ID NO: 250955 - DNA, 75 bp, Artificial Sequence
  Synthetic
ctgagctattctatctccagtatttacattaaacgtacattttccattattaataagaatgactcctatgtttcc

SEQ ID NO: 250956 - DNA, 75 bp, Artificial Sequence
  Synthetic
cctcctatatcaatgccttttagggacagaccagacctaggagctattctaccatagcagaacttaggcatggac

SEQ ID NO: 250957 - DNA, 75 bp, Artificial Sequence
  Synthetic
acagaccagacctaggagctattctaccatagcagaacttaggcatggacatactaatatctgtcttaattaact

SEQ ID NO: 250958 - DNA, 75 bp, Artificial Sequence
  Synthetic
atcgtaagcgctatacaaatcatatccggcagcacccggcgattgcctagtaggcgatttagctctgttagtttc

SEQ ID NO: 250959 - DNA, 75 bp, Artificial Sequence
  Synthetic
atatattccatgaataagtgcgattattgtacacttctatagtatctatatacgatccacgataaaatcctccta

SEQ ID NO: 250960 - DNA, 75 bp, Artificial Sequence
  Synthetic
attgtacacttctatagtatctatatacgatccacgataaaatcctcctatcaatagcagtttattatccactat

SEQ ID NO: 250961 - DNA, 75 bp, Artificial Sequence
  Synthetic
taaataggatcatctatcagagtccatgtattactggattcacaataaaattccgcatttctaccaaccaagaat

SEQ ID NO: 250962 - DNA, 75 bp, Artificial Sequence
  Synthetic
gtattacccgggtacgtggatatcatatatggtattggtccattatcagtaatggctccataaactgatacggcg

SEQ ID NO: 250963 - DNA, 75 bp, Artificial Sequence
  Synthetic
ttccgcatttctaccaaccaagaataaccttctaccaaacactaacgcacatgatttataatgaggataataagt

SEQ ID NO: 250964 - DNA, 75 bp, Artificial Sequence
  Synthetic
tgattgggtagcaaatattctgtagttgtatcagtttcagaatgtcctcccattacgtatataacattgtttatg

SEQ ID NO: 250965 - DNA, 75 bp, Artificial Sequence
  Synthetic
ttgtatcagtttcagaatgtcctcccattacgtatataacattgtttatggatgccactgctggattacatctag

SEQ ID NO: 250966 - DNA, 75 bp, Artificial Sequence
  Synthetic
ccaagcagcatccccgtggaaccaacgctcaacagatgtgggatttggtagacctcctactacgtataatttatt

SEQ ID NO: 250967 - DNA, 75 bp, Artificial Sequence
  Synthetic
cgctcaacagatgtgggatttggtagacctcctactacgtataatttattgttagcgggtatcccgctagcatac

SEQ ID NO: 250968 - DNA, 75 bp, Artificial Sequence
  Synthetic
ttggaatccaattgtttgatatataatttaccgctatagcattgttatgtatttcattgttcatccatccaccga

SEQ ID NO: 250969 - DNA, 75 bp, Artificial Sequence
  Synthetic
atttaccgctatagcattgttatgtatttcattgttcatccatccaccgatgagatatactacttctccaacatg

SEQ ID NO: 250970 - DNA, 75 bp, Artificial Sequence
  Synthetic
tctataatttgatccatgttcataggatactctatgaatggatacttgtatgatttgcgtggttgtttatcacaa

SEQ ID NO: 250971 - DNA, 75 bp, Artificial Sequence
  Synthetic
gatactctatgaatggatacttgtatgatttgcgtggttgtttatcacaatgaaatattttgttacagtctagta

SEQ ID NO: 250972 - DNA, 75 bp, Artificial Sequence
  Synthetic
gggagaaagataatttgacctgattacatttttgataagaagtagcagatttcctaatctatttcttcgcctcat

SEQ ID NO: 250973 - DNA, 75 bp, Artificial Sequence
  Synthetic
ataccacttaatgacaaaatcaactacataatcctcatctggaacatttagttcgtcgctttctagaataagttt

SEQ ID NO: 250974 - DNA, 75 bp, Artificial Sequence
  Synthetic
tggtggtctaggatgaggatccggtatcggagtgggttttggattataatcatcatcatcatcatcatcatcatc

SEQ ID NO: 250975 - DNA, 75 bp, Artificial Sequence
  Synthetic
atgatgtcatcttctagttccaaaaagtgtttggtaataaagtctttagtatgacataagagattggatagtccg

SEQ ID NO: 250976 - DNA, 75 bp, Artificial Sequence
  Synthetic
agtgtttggtaataaagtctttagtatgacataagagattggatagtccgtattctatacccatcatgtaacact

SEQ ID NO: 250977 - DNA, 75 bp, Artificial Sequence
  Synthetic
tcgtaggataaagtttatacaagtgtagatgataaattctacagatgttaatatagaagcacgtaataaattgac

SEQ ID NO: 250978 - DNA, 75 bp, Artificial Sequence
  Synthetic
tagatgataaattctacagatgttaatatagaagcacgtaataaattgacgacgttatgactatctatatatacc

SEQ ID NO: 250979 - DNA, 75 bp, Artificial Sequence
  Synthetic
tagaagttagactgtgaatgtcaaggtctagacaaaccctcgtaactggatctttattttttgtgtatttttgac

SEQ ID NO: 250980 - DNA, 75 bp, Artificial Sequence
  Synthetic
caataattgttttgaatttcttagtcgtatacaatgctaatatattcttacagtacacagtattgacaaatatcg

SEQ ID NO: 250981 - DNA, 75 bp, Artificial Sequence
  Synthetic
cgtatacaatgctaatatattcttacagtacacagtattgacaaatatcggcatttatgtttctttaaaagtcaa

SEQ ID NO: 250982 - DNA, 75 bp, Artificial Sequence
  Synthetic
ttgagacataactcccattttttggtattcacccacacgtttttcgaaaaaattagtttttccttccaatgatat

SEQ ID NO: 250983 - DNA, 75 bp, Artificial Sequence
  Synthetic
tattcacccacacgtttttcgaaaaaattagtttttccttccaatgatatattttccatgaaatcaaacggattg

SEQ ID NO: 250984 - DNA, 75 bp, Artificial Sequence
  Synthetic
ccaattcagaaatcaatctatctgcgacgaattctatatatgttttcatcatttcacaattcattcctatgagtt

SEQ ID NO: 250985 - DNA, 75 bp, Artificial Sequence
  Synthetic
gacgaattctatatatgttttcatcatttcacaattcattcctatgagtttaactggaagagccacagtaagaaa

SEQ ID NO: 250986 - DNA, 75 bp, Artificial Sequence
  Synthetic
gttataataaatctaacggtttcttcactcggtggatgtaataaatgtttaaacatcaaacatgcgaaatcgcag

SEQ ID NO: 250987 - DNA, 75 bp, Artificial Sequence
  Synthetic
cactcggtggatgtaataaatgtttaaacatcaaacatgcgaaatcgcagtgcagaccctcgtctctactaatta

SEQ ID NO: 250988 - DNA, 75 bp, Artificial Sequence
  Synthetic
cattaggccacgctttttaagccaaaatatggaagcgaatgatccggaaaagaagattccttctactgcagcaaa

SEQ ID NO: 250989 - DNA, 75 bp, Artificial Sequence
  Synthetic
atccgtttaggagagcacatagtgacgattatcttaataagcaacaagatcatgaacacgatgatatagaatcat

SEQ ID NO: 250990 - DNA, 75 bp, Artificial Sequence
  Synthetic
gcgctgtcatgtatccacttttgagcccaatcggccttcttttttacacaaggcatcgtttctatggcattaaag

SEQ ID NO: 250991 - DNA, 75 bp, Artificial Sequence
  Synthetic
cccaatcggccttcttttttacacaaggcatcgtttctatggcattaaagagatagtttttttcattactatctt

SEQ ID NO: 250992 - DNA, 75 bp, Artificial Sequence
  Synthetic
aggcatcgtttctatggcattaaagagatagtttttttcattactatctttaacataagtatcgatcaaaagact

SEQ ID NO: 250993 - DNA, 75 bp, Artificial Sequence
  Synthetic
atggccatctgaaatccgtagaaacatctagcctcggtaatctgcacttctgtacaaaatcgttctgctaaattt

SEQ ID NO: 250994 - DNA, 75 bp, Artificial Sequence
  Synthetic
atctagcctcggtaatctgcacttctgtacaaaatcgttctgctaaattttcattcactattccatcactggctg

SEQ ID NO: 250995 - DNA, 75 bp, Artificial Sequence
  Synthetic
aaaatatttttcgtctggtgttagtttattccagtcattgatatctttagatatatccacttcttccactgtcca

SEQ ID NO: 250996 - DNA, 75 bp, Artificial Sequence
  Synthetic
ttattccagtcattgatatctttagatatatccacttcttccactgtccaaaatgatgcctctgcctttttatac

SEQ ID NO: 250997 - DNA, 75 bp, Artificial Sequence
  Synthetic
ttgggaaaataacaaatctatttggatttggtgcaaggataggttccataactaaattaacaatagtagtaattt

SEQ ID NO: 250998 - DNA, 75 bp, Artificial Sequence
  Synthetic
tttttcagttatctgtatgactgtacttggatcttttgtatatcgctatcgccgcaatcactacaataattacaa

SEQ ID NO: 250999 - DNA, 75 bp, Artificial Sequence
  Synthetic
gccgcaatcactacaataattacaagtattattgatagcattgttattactactatcataattaaattatcgaca

SEQ ID NO: 251000 - DNA, 75 bp, Artificial Sequence
  Synthetic
gtattattgatagcattgttattactactatcataattaaattatcgacattcatgggtgttgaataatcgttat

SEQ ID NO: 251001 - DNA, 75 bp, Artificial Sequence
  Synthetic
actagataaatcatttgtgagattgttgtgggaagcgggcacggaagatgcattatcattattatttaacgcctc

SEQ ID NO: 251002 - DNA, 75 bp, Artificial Sequence
  Synthetic
agaattttcgattaatgagttcatggtaaggaagggcaaatgtctgtatataatatacataagttaatagttttt

SEQ ID NO: 251003 - DNA, 75 bp, Artificial Sequence
  Synthetic
acgttcaacgttttatggaaactataattttgtgaaaacagataacaagaaaactcgtcatcgttcaaattttta

SEQ ID NO: 251004 - DNA, 75 bp, Artificial Sequence
  Synthetic
agctaatttctaacgctagcgactctgttggatatgggtttccagatatatatcttttcagttcccctacgtatc

SEQ ID NO: 251005 - DNA, 75 bp, Artificial Sequence
  Synthetic
tgttggatatgggtttccagatatatatcttttcagttcccctacgtatctataatcatctgtaggaaatggaag

SEQ ID NO: 251006 - DNA, 75 bp, Artificial Sequence
  Synthetic
aatatcatatgcggtggtgtagaaccattaagcgcgaaagatgttatttcgcatcgtattttaacttcgcaataa

SEQ ID NO: 251007 - DNA, 75 bp, Artificial Sequence
  Synthetic
tttctggttagataacgcactctaccagtcaagtcaatgatattagcctttacagatatattcatagtagtcgta

SEQ ID NO: 251008 - DNA, 75 bp, Artificial Sequence
  Synthetic
atactcctttgtatgtaccagaatcttcgtacctcaaactcgatatatttaaacaagttaatgatatattaacgc

SEQ ID NO: 251009 - DNA, 75 bp, Artificial Sequence
  Synthetic
ttcgtacctcaaactcgatatatttaaacaagttaatgatatattaacgcgttttatgaatgatgatatataacc

SEQ ID NO: 251010 - DNA, 75 bp, Artificial Sequence
  Synthetic
gctataaccttatcattataataccaactagtgtaattaatatgtgacacgacagtgtgggtacaaatatgtaca

SEQ ID NO: 251011 - DNA, 75 bp, Artificial Sequence
  Synthetic
aaaaagattcggttttatactgttcgatattctcattgcttatattctcatctatcatctccacacagtcaaatc

SEQ ID NO: 251012 - DNA, 75 bp, Artificial Sequence
  Synthetic
gatattctcattgcttatattctcatctatcatctccacacagtcaaatccatggttaacatgtacctcatcaac

SEQ ID NO: 251013 - DNA, 75 bp, Artificial Sequence
  Synthetic
aatgtaacgcgtctgttttatacattttttagttatctgatgaaagataaactaaatatataagtataatcccat

SEQ ID NO: 251014 - DNA, 75 bp, Artificial Sequence
  Synthetic
atcatcataactcgagaatatttaatttggtggtcattattaatcaagtcaattatcttatttttaacaaacgta

SEQ ID NO: 251015 - DNA, 75 bp, Artificial Sequence
  Synthetic
taatactttaacctgatgtattattacctgcatcttattagaatattaacctaactaaaagacataaaaagcggg

SEQ ID NO: 251016 - DNA, 75 bp, Artificial Sequence
  Synthetic
acttttagaaatatacagactctatcgtgtgtctatatcttctttttatatccaatgtatttatgtctgattttt

SEQ ID NO: 251017 - DNA, 75 bp, Artificial Sequence
  Synthetic
cgtgtgtctatatcttctttttatatccaatgtatttatgtctgatttttcttcatttatcatatataatggtcc

SEQ ID NO: 251018 - DNA, 75 bp, Artificial Sequence
  Synthetic
tccaatgtatttatgtctgatttttcttcatttatcatatataatggtccaaattctacacgtgcttcggattca

SEQ ID NO: 251019 - DNA, 75 bp, Artificial Sequence
  Synthetic
cgcaacatccttctcttccatcttctacatcttccttcttattcttagcgtcacagaatctaccacagcaggatc

SEQ ID NO: 251020 - DNA, 75 bp, Artificial Sequence
  Synthetic
tacatcttccttcttattcttagcgtcacagaatctaccacagcaggatcccatgacgagcgtcacattaaacta

SEQ ID NO: 251021 - DNA, 75 bp, Artificial Sequence
  Synthetic
attagtaatgaccattaaaataaaaatattcttcataaccggtaagaaagtaaaaagttcacattgaaactatgt

SEQ ID NO: 251022 - DNA, 75 bp, Artificial Sequence
  Synthetic
atattcttcataaccggtaagaaagtaaaaagttcacattgaaactatgtcagtagttatacatcatgagatgat

SEQ ID NO: 251023 - DNA, 75 bp, Artificial Sequence
  Synthetic
atgatataattcgtggataatcattcttaagacacatttcttcattcgtaaatcttttcacattaaatgagtgtc

SEQ ID NO: 251024 - DNA, 75 bp, Artificial Sequence
  Synthetic
aatcttttcacattaaatgagtgtccatattttgcaatttcttcatatgatggcggtgtacgtggacgaggctgc

SEQ ID NO: 251025 - DNA, 75 bp, Artificial Sequence
  Synthetic
cgtgtttgcgtttagatccctccattatcgcgattgcgtagtgagtactatttataccttgtaattaaatttttt

SEQ ID NO: 251026 - DNA, 75 bp, Artificial Sequence
  Synthetic
tatcgcgattgcgtagtgagtactatttataccttgtaattaaatttttttattaattaaacgtataaaaacgtt

SEQ ID NO: 251027 - DNA, 75 bp, Artificial Sequence
  Synthetic
ttcgtctaatagaacaaatagctacagtaaaaataactagaataatcgctacacccactagaaaccacggatcgt

SEQ ID NO: 251028 - DNA, 75 bp, Artificial Sequence
  Synthetic
agtaaaaataactagaataatcgctacacccactagaaaccacggatcgtaatacggcaatcggttttcgataat

SEQ ID NO: 251029 - DNA, 75 bp, Artificial Sequence
  Synthetic
gacttaacaattgtctgtaaaccacaatttgcttccgccgatcctgtattaactatctgtaaaagcatatgttgg

SEQ ID NO: 251030 - DNA, 75 bp, Artificial Sequence
  Synthetic
ccgggcggagccgaacattctccgatattcaatttttgtatatctataatgttattaacctccgcatacgcatta

SEQ ID NO: 251031 - DNA, 75 bp, Artificial Sequence
  Synthetic
gttattaacctccgcatacgcattacagttcttttctagcttggatactacactaggtacatcatctaaatctat

SEQ ID NO: 251032 - DNA, 75 bp, Artificial Sequence
  Synthetic
cagttcttttctagcttggatactacactaggtacatcatctaaatctattcctatttcctcagcgatagctctt

SEQ ID NO: 251033 - DNA, 75 bp, Artificial Sequence
  Synthetic
tcacttcaataaatgattcaaccatgagtgtgaaactaagtcgagaattactcatgcatttgttagttattcgga

SEQ ID NO: 251034 - DNA, 75 bp, Artificial Sequence
  Synthetic
gagtgtgaaactaagtcgagaattactcatgcatttgttagttattcggagcgcgcaatttttaaactgtcctat

SEQ ID NO: 251035 - DNA, 75 bp, Artificial Sequence
  Synthetic
gtgacattagtagggatagaatgttgagctaatttttgtaaataactatctataaaaagattatacaaagtttta

SEQ ID NO: 251036 - DNA, 75 bp, Artificial Sequence
  Synthetic
gagctaatttttgtaaataactatctataaaaagattatacaaagttttaaactctttagtttccgccatttatc

SEQ ID NO: 251037 - DNA, 75 bp, Artificial Sequence
  Synthetic
taaatttttccaagaaactaattgggtgaagaatggaaacctttaatctatatttatcacagtctgttttggtac

SEQ ID NO: 251038 - DNA, 75 bp, Artificial Sequence
  Synthetic
gtgaagaatggaaacctttaatctatatttatcacagtctgttttggtacacatgatgaattcttctaatgctgt

SEQ ID NO: 251039 - DNA, 75 bp, Artificial Sequence
  Synthetic
tctggatatgtttttaataaagtatgaacaaagaaatggaaatcgtaataccagttatgttcaactttgaaattg

SEQ ID NO: 251040 - DNA, 75 bp, Artificial Sequence
  Synthetic
gaacaaagaaatggaaatcgtaataccagttatgttcaactttgaaattgttttttattttcttgttaatgattc

SEQ ID NO: 251041 - DNA, 75 bp, Artificial Sequence
  Synthetic
gtttaatgccgatttaatacgttcattaaaaacaaactttttattctttagatgaattattattggttcattgga

SEQ ID NO: 251042 - DNA, 75 bp, Artificial Sequence
  Synthetic
ttaaaaacaaactttttattctttagatgaattattattggttcattggaatcaaaaagtaagatattatcgggt

SEQ ID NO: 251043 - DNA, 75 bp, Artificial Sequence
  Synthetic
cacaacagggtagttcgtagattttaatgtataacagagacatctgtaaaaagataaactttatgtattgtacca

SEQ ID NO: 251044 - DNA, 75 bp, Artificial Sequence
  Synthetic
aatgtataacagagacatctgtaaaaagataaactttatgtattgtaccaaagatttaaatcctaatttgatagc

SEQ ID NO: 251045 - DNA, 75 bp, Artificial Sequence
  Synthetic
gaatacagtgctaggggaaaaattataatatttcctctttcgtattcgtaattagttctcttttcatgttcgaaa

SEQ ID NO: 251046 - DNA, 75 bp, Artificial Sequence
  Synthetic
taatatttcctctttcgtattcgtaattagttctcttttcatgttcgaaaaagtgaaacatgcggttaaaatagt

SEQ ID NO: 251047 - DNA, 75 bp, Artificial Sequence
  Synthetic
aactgcaggataaaagtgggatagtaatttcacgaatttgatactgtcctttctctcgttaaacgcctttagaaa

SEQ ID NO: 251048 - DNA, 75 bp, Artificial Sequence
  Synthetic
aatttcacgaatttgatactgtcctttctctcgttaaacgcctttagaaaaactttagaagaatatctcaatgag

SEQ ID NO: 251049 - DNA, 75 bp, Artificial Sequence
  Synthetic
tcaataatagcaacatatgaagaacccgcttatacagagtatgtaaaaatgttaatttatagtttaatcccatgg

SEQ ID NO: 251050 - DNA, 75 bp, Artificial Sequence
  Synthetic
gttaatttatagtttaatcccatggcccacgcacacacgattaattttttttcatctccctttagattgttgtat

SEQ ID NO: 251051 - DNA, 75 bp, Artificial Sequence
  Synthetic
ccgtagtttccatgggactatataattttgtggcctcgaatacaaattttactacatagttatctatcttaaaga

SEQ ID NO: 251052 - DNA, 75 bp, Artificial Sequence
  Synthetic
ttttgtggcctcgaatacaaattttactacatagttatctatcttaaagactataccatatcctcctgtagatat

SEQ ID NO: 251053 - DNA, 75 bp, Artificial Sequence
  Synthetic
taaaatcgtttatctttttgttggaaaaaggatgaattaatgtaatcattctcttctatctttagtagtgtttcc

SEQ ID NO: 251054 - DNA, 75 bp, Artificial Sequence
  Synthetic
aaaaggatgaattaatgtaatcattctcttctatctttagtagtgtttccttattaaaattcttaaaataattta

SEQ ID NO: 251055 - DNA, 75 bp, Artificial Sequence
  Synthetic
ttggtgtaaatctaattgggacattatgttgttaaaatataaacagtctcctaatataacagtatctgataatct

SEQ ID NO: 251056 - DNA, 75 bp, Artificial Sequence
  Synthetic
atgttgttaaaatataaacagtctcctaatataacagtatctgataatctatggggagacatccattgatattca

SEQ ID NO: 251057 - DNA, 75 bp, Artificial Sequence
  Synthetic
tttattgtacaaaaagccccaatttacaaacgaaagtccaggtttgatagagacaaactattaactattttgtct

SEQ ID NO: 251058 - DNA, 75 bp, Artificial Sequence
  Synthetic
acaaacgaaagtccaggtttgatagagacaaactattaactattttgtctctgtttttaacacctccacagtttt

SEQ ID NO: 251059 - DNA, 75 bp, Artificial Sequence
  Synthetic
cacaatatcagtatcttctttatctaccagagattttactaacttgataaccttggctgtctcattcaatagggt

SEQ ID NO: 251060 - DNA, 75 bp, Artificial Sequence
  Synthetic
accagagattttactaacttgataaccttggctgtctcattcaatagggtagtgatatttgtatgtatgatattg

SEQ ID NO: 251061 - DNA, 75 bp, Artificial Sequence
  Synthetic
gaagtgattctttgatggtatcagcatacgaattacaataatgcagaaactcagttaacatgcaggaattatagt

SEQ ID NO: 251062 - DNA, 75 bp, Artificial Sequence
  Synthetic
atacgaattacaataatgcagaaactcagttaacatgcaggaattatagtaagccaattccaattgttgcctgta

SEQ ID NO: 251063 - DNA, 75 bp, Artificial Sequence
  Synthetic
atgatgtccttgcgtttctctgatagaatgcgagcagcgattttggcgttatcatttgacgatatttctggaata

SEQ ID NO: 251064 - DNA, 75 bp, Artificial Sequence
  Synthetic
atgatagtgagagatctagcaactagagtaaatatacagatgttcgataaagatgccgtcaaaaatattgtacag

SEQ ID NO: 251065 - DNA, 75 bp, Artificial Sequence
  Synthetic
gaatgcgagcagcgattttggcgttatcatttgacgatatttctggaataacgaatcctgtttctactaacttct

SEQ ID NO: 251066 - DNA, 75 bp, Artificial Sequence
  Synthetic
gaaaatagcttctcctcctatttgtggaagaaattgaactcctctagatgatctactgacgatagtatctccttg

SEQ ID NO: 251067 - DNA, 75 bp, Artificial Sequence
  Synthetic
ggaagaaattgaactcctctagatgatctactgacgatagtatctccttgacagatattggaccgaactacggaa

SEQ ID NO: 251068 - DNA, 75 bp, Artificial Sequence
  Synthetic
ccccctcattttttaagcagattgttgccgtaaatcctgcactatgcccaagatagagagctcctttggtgaatc

SEQ ID NO: 251069 - DNA, 75 bp, Artificial Sequence
  Synthetic
ttttttatgcttgtattattaatggtatgtaatatgatttaattgattgtgtacacgataccaatttgtcgagta

SEQ ID NO: 251070 - DNA, 75 bp, Artificial Sequence
  Synthetic
tgccgtaaatcctgcactatgcccaagatagagagctcctttggtgaatccatcactatgtttcagtttaaccaa

SEQ ID NO: 251071 - DNA, 75 bp, Artificial Sequence
  Synthetic
ccatctctatctaatacagaatccaacttgatgtcagggactatgaccggtttaatgttatatgtaacattgagt

SEQ ID NO: 251072 - DNA, 75 bp, Artificial Sequence
  Synthetic
acttgatgtcagggactatgaccggtttaatgttatatgtaacattgagtaaatccttaagttcataatcatcgt

SEQ ID NO: 251073 - DNA, 75 bp, Artificial Sequence
  Synthetic
caatgtttctaccggcatggtggatacgaagatgctatccatcagaatgtttccctgattagtattttctatata

SEQ ID NO: 251074 - DNA, 75 bp, Artificial Sequence
  Synthetic
acgaagatgctatccatcagaatgtttccctgattagtattttctatatagctattcttctttaaacgattttcc

SEQ ID NO: 251075 - DNA, 75 bp, Artificial Sequence
  Synthetic
taggagtaggacgtctagccagtatggaagaggattttctagatactctcttcaacatctttgatctcaatggaa

SEQ ID NO: 251076 - DNA, 75 bp, Artificial Sequence
  Synthetic
ggaagaggattttctagatactctcttcaacatctttgatctcaatggaatgcaaaaccccatggtgtaacaacc

SEQ ID NO: 251077 - DNA, 75 bp, Artificial Sequence
  Synthetic
cactttttataattttaccatctgactcatggattcattaatatctttataagagctactaacgtataattcttt

SEQ ID NO: 251078 - DNA, 75 bp, Artificial Sequence
  Synthetic
ctcatggattcattaatatctttataagagctactaacgtataattctttataactgaactgagatatatacacc

SEQ ID NO: 251079 - DNA, 75 bp, Artificial Sequence
  Synthetic
aaatgaatgctcggcaataactaatggcaaatgtatagaacaacgaaattatactagagttgttaaagttaatat

SEQ ID NO: 251080 - DNA, 75 bp, Artificial Sequence
  Synthetic
ggcaaatgtatagaacaacgaaattatactagagttgttaaagttaatattttctatgagttgttccaataaatt

SEQ ID NO: 251081 - DNA, 75 bp, Artificial Sequence
  Synthetic
taaattatcttgatactatccagtaaacagtctttaagttctggaatattatcatcccattgtaaagcccctagt

SEQ ID NO: 251082 - DNA, 75 bp, Artificial Sequence
  Synthetic
aacagtctttaagttctggaatattatcatcccattgtaaagcccctagttcgactatcgaatatcctgctctga

SEQ ID NO: 251083 - DNA, 75 bp, Artificial Sequence
  Synthetic
caatactgtaataaaggtggtagtattgtcatcatcgtgataaactacgggaatatggtcgttagtaggtaccgt

SEQ ID NO: 251084 - DNA, 75 bp, Artificial Sequence
  Synthetic
ttgtcatcatcgtgataaactacgggaatatggtcgttagtaggtaccgtgactttacacaacgcgatatataac

SEQ ID NO: 251085 - DNA, 75 bp, Artificial Sequence
  Synthetic
agttgggacgtcctgcagggtattgttttgaagaaatgatatcgagaacagatttgatacgatatttgttggatt

SEQ ID NO: 251086 - DNA, 75 bp, Artificial Sequence
  Synthetic
ttttgaagaaatgatatcgagaacagatttgatacgatatttgttggattcctgattattcactataatataatc

SEQ ID NO: 251087 - DNA, 75 bp, Artificial Sequence
  Synthetic
agagaaggtatatcgttggtaggataatacatccccattccagtattctcggatactctattgatgacactagtt

SEQ ID NO: 251088 - DNA, 75 bp, Artificial Sequence
  Synthetic
aatacatccccattccagtattctcggatactctattgatgacactagttaagaacatgtcttctattctagaaa

SEQ ID NO: 251089 - DNA, 75 bp, Artificial Sequence
  Synthetic
taaaacttctaacgctcctgattgtgtttcgaatgcctcgtacaaggatttcaaggatgccatagattctttgac

SEQ ID NO: 251090 - DNA, 75 bp, Artificial Sequence
  Synthetic
gtttcgaatgcctcgtacaaggatttcaaggatgccatagattctttgaccaacgatttagtattgcgtttagca

SEQ ID NO: 251091 - DNA, 75 bp, Artificial Sequence
  Synthetic
gtcggctctctggtttactaccccaatgataacaatagtcttgtaaagataaaccgcaagaaaatttatacgcat

SEQ ID NO: 251092 - DNA, 75 bp, Artificial Sequence
  Synthetic
atgataacaatagtcttgtaaagataaaccgcaagaaaatttatacgcatccatccaaataaccctagcaccgtc

SEQ ID NO: 251093 - DNA, 75 bp, Artificial Sequence
  Synthetic
aataactaacaatttgtgtatcatatagacaattaattaggtaactgttatctctttttaactaactaactaact

SEQ ID NO: 251094 - DNA, 75 bp, Artificial Sequence
  Synthetic
attttccatccacagttattgggccagtatactgttagcaacggtatatcgaatagattactcatgtaacctact

SEQ ID NO: 251095 - DNA, 75 bp, Artificial Sequence
  Synthetic
gctccttagtccaatgtttttaataaccgcacacaatctctgtgtcagaacgctcgtcaatatagatcgtagaaa

SEQ ID NO: 251096 - DNA, 75 bp, Artificial Sequence
  Synthetic
agtatactgttagcaacggtatatcgaatagattactcatgtaacctactagaatgatagttcgtgtactagtca

SEQ ID NO: 251097 - DNA, 75 bp, Artificial Sequence
  Synthetic
atctaaaattagatcttttacactattaaagttaacaaaggtattacccgggtacgtggatatcatatatggtat

SEQ ID NO: 251098 - DNA, 75 bp, Artificial Sequence
  Synthetic
tgttctgccgtaaccgatagggaaacggatgtataatttttttttatagtatgaaggatatgatggatatgatgg

SEQ ID NO: 251099 - DNA, 75 bp, Artificial Sequence
  Synthetic
aattcgcgcccacaattcatctctagatatgcatttaatatcgaacggtaacacatcaatctcgggacgcgtata

SEQ ID NO: 251100 - DNA, 75 bp, Artificial Sequence
  Synthetic
gatatgcatttaatatcgaacggtaacacatcaatctcgggacgcgtatatgtttctaaattcttaatccaaata

SEQ ID NO: 251101 - DNA, 75 bp, Artificial Sequence
  Synthetic
tcatactgtcaactatagtatacctagagaactttcgatacatctgctgtttcctgtaatcgttaaattttacaa

SEQ ID NO: 251102 - DNA, 75 bp, Artificial Sequence
  Synthetic
agagaactttcgatacatctgctgtttcctgtaatcgttaaattttacaaatctataacatgctaaaccttttga

SEQ ID NO: 251103 - DNA, 75 bp, Artificial Sequence
  Synthetic
atggaatctgtattctcaataccgtatcgttctaaagccagtgctatatctccctgttcgtgggaacgctttcgt

SEQ ID NO: 251104 - DNA, 75 bp, Artificial Sequence
  Synthetic
atcgttctaaagccagtgctatatctccctgttcgtgggaacgctttcgtataatatcgatcaatggataatatg

SEQ ID NO: 251105 - DNA, 75 bp, Artificial Sequence
  Synthetic
atgatctatttcgtccataaacaatctagacataggaattggaggcgatgatcttaattttgtgcaatgggtcaa

SEQ ID NO: 251106 - DNA, 75 bp, Artificial Sequence
  Synthetic
caagtttaacaataaaattaatcacgagtaccctactccaaccactattatatgattatagtttctatttttaca

SEQ ID NO: 251107 - DNA, 75 bp, Artificial Sequence
  Synthetic
ctagacataggaattggaggcgatgatcttaattttgtgcaatgggtcaatcctataacttctaatattgtaata

SEQ ID NO: 251108 - DNA, 75 bp, Artificial Sequence
  Synthetic
tgttatcatcgtatattagtataccacgaccttcttcatttcgtgccaaaatgatatacagtcttaaataattac

SEQ ID NO: 251109 - DNA, 75 bp, Artificial Sequence
  Synthetic
gagtccaaatcctcctctccgtaatccacttcctcaacatgatgattattatcctccacaagtacacagacctcc

SEQ ID NO: 251110 - DNA, 75 bp, Artificial Sequence
  Synthetic
gcaatatctcaatagtttcataattgttagctgttttcatcaaggtttgtatcctgtttaacatgatggcgttct

SEQ ID NO: 251111 - DNA, 75 bp, Artificial Sequence
  Synthetic
attttttaaatttttaacgatttactgtggctagatacccaatctctctcaaatatttttttagcctcgcttaca

SEQ ID NO: 251112 - DNA, 75 bp, Artificial Sequence
  Synthetic
tgtggctagatacccaatctctctcaaatatttttttagcctcgcttacaagctgtttatctatactattaaaac

SEQ ID NO: 251113 - DNA, 75 bp, Artificial Sequence
  Synthetic
ggttccgtcgaaatttgccgaagtgatatgaacatattcgtcgtcgactatcaacaattttgtattattctgaat

SEQ ID NO: 251114 - DNA, 75 bp, Artificial Sequence
  Synthetic
atatgaacatattcgtcgtcgactatcaacaattttgtattattctgaatagtgaaaaccttcacagatagatca

SEQ ID NO: 251115 - DNA, 75 bp, Artificial Sequence
  Synthetic
ttctggcggttgccatagaatatacgtcgttcttatcccaattaccaactagaagtctgatcttaactcctctat

SEQ ID NO: 251116 - DNA, 75 bp, Artificial Sequence
  Synthetic
gtcgttcttatcccaattaccaactagaagtctgatcttaactcctctattaatggctgcttctataatggagtt

SEQ ID NO: 251117 - DNA, 75 bp, Artificial Sequence
  Synthetic
ttaccgtcgacacgtgtagtgggaactatggccaaatgttcaatatctatactagtcttagccgacttgagttta

SEQ ID NO: 251118 - DNA, 75 bp, Artificial Sequence
  Synthetic
ctatggccaaatgttcaatatctatactagtcttagccgacttgagtttatcaataactacatcagtgtctagat

SEQ ID NO: 251119 - DNA, 75 bp, Artificial Sequence
  Synthetic
tggagaatcagtaaagaacactccacctataggattcttaatatgatacgcagtgctaactggcagacaacaagc

SEQ ID NO: 251120 - DNA, 75 bp, Artificial Sequence
  Synthetic
cctataggattcttaatatgatacgcagtgctaactggcagacaacaagccgcagagcataaattcaaccatgaa

SEQ ID NO: 251121 - DNA, 75 bp, Artificial Sequence
  Synthetic
aagtatcaaatcttctacgaagatctgtggccagcggaggataatcagaatatacgcctaacgttttaatcgtat

SEQ ID NO: 251122 - DNA, 75 bp, Artificial Sequence
  Synthetic
tgtggccagcggaggataatcagaatatacgcctaacgttttaatcgtatgtatagatcctccagtaaatgacgc

SEQ ID NO: 251123 - DNA, 75 bp, Artificial Sequence
  Synthetic
tcagacacccaaaaacaaccgagtagtagtcccacattattttttttatctatattaacggttataaaatttata

SEQ ID NO: 251124 - DNA, 75 bp, Artificial Sequence
  Synthetic
gtagtcccacattattttttttatctatattaacggttataaaatttatatccggggagtgactttgtagctctc

SEQ ID NO: 251125 - DNA, 75 bp, Artificial Sequence
  Synthetic
tagcaaaactattattttaatccctttttcagatacctcttttagtttatcaaaaataagcgctcccctagtagt

SEQ ID NO: 251126 - DNA, 75 bp, Artificial Sequence
  Synthetic
ttttcagatacctcttttagtttatcaaaaataagcgctcccctagtagtactcagaggattacaacaaaaagat

SEQ ID NO: 251127 - DNA, 75 bp, Artificial Sequence
  Synthetic
gagtgataatttcgttaaaacattcaaatgttgtcaaatgatcggatctaaaatccatattttctggtagtgttt

SEQ ID NO: 251128 - DNA, 75 bp, Artificial Sequence
  Synthetic
aaatgttgtcaaatgatcggatctaaaatccatattttctggtagtgtttctaccagcctacattttgctcccgc

SEQ ID NO: 251129 - DNA, 75 bp, Artificial Sequence
  Synthetic
tagttaacataaaaacttatatatcctgttctatcaacgattctagaatatcatcggctatatcgctaaaatttt

SEQ ID NO: 251130 - DNA, 75 bp, Artificial Sequence
  Synthetic
ctgttctatcaacgattctagaatatcatcggctatatcgctaaaattttcatcaaagtcgacatcacaacctaa

SEQ ID NO: 251131 - DNA, 75 bp, Artificial Sequence
  Synthetic
atgatgtcatcttcgtctatttctatatccgtatccattgtagattgttgaccgattatcgagtttaaatcatta

SEQ ID NO: 251132 - DNA, 75 bp, Artificial Sequence
  Synthetic
tatccgtatccattgtagattgttgaccgattatcgagtttaaatcattactaatactcaatccttcagaataca

SEQ ID NO: 251133 - DNA, 75 bp, Artificial Sequence
  Synthetic
ggcggtgtatttaagttggtagattttcaattatgtatcaatatagcaacagtaattcttgctcctccttgattt

SEQ ID NO: 251134 - DNA, 75 bp, Artificial Sequence
  Synthetic
ccgccacagacacgaatatgactagaccgatgaccatttaaaaaatactctctagctttaacttaaactgtatcg

SEQ ID NO: 251135 - DNA, 75 bp, Artificial Sequence
  Synthetic
accgatgaccatttaaaaaatactctctagctttaacttaaactgtatcgatcattcttttagcacatgtataat

SEQ ID NO: 251136 - DNA, 75 bp, Artificial Sequence
  Synthetic
gaattattaccatagaagatgttagaaaaaatgatgctggttattatacatgtgttttagaatatatatatatat

SEQ ID NO: 251137 - DNA, 75 bp, Artificial Sequence
  Synthetic
aatttaggcttccaaaaatttttcatccgtaaaccgataataatatatatagacttgttaatagtcggaataaat

SEQ ID NO: 251138 - DNA, 75 bp, Artificial Sequence
  Synthetic
tccgtaaaccgataataatatatatagacttgttaatagtcggaataaatatattaatgcttaaactatcatcat

SEQ ID NO: 251139 - DNA, 75 bp, Artificial Sequence
  Synthetic
acattctttttgctgtttcgaaactttatcaatacacgttaatacaaacccaggaaggagatattgaaactgagg

SEQ ID NO: 251140 - DNA, 75 bp, Artificial Sequence
  Synthetic
ttatcaatacacgttaatacaaacccaggaaggagatattgaaactgaggctgttgaaaatgaaacggtgaatac

SEQ ID NO: 251141 - DNA, 75 bp, Artificial Sequence
  Synthetic
gattccgtattctgatgatattagaactgctaatggatgtcgatggtatgtatctaggagtatctattttaacaa

SEQ ID NO: 251142 - DNA, 75 bp, Artificial Sequence
  Synthetic
actgctaatggatgtcgatggtatgtatctaggagtatctattttaacaaagcatcgatttgctaatatacaatt

SEQ ID NO: 251143 - DNA, 75 bp, Artificial Sequence
  Synthetic
ttcatattcttaaaaggtttcatatttatcaattcttctacattaaaaatttccatttttaatttatctagcccc

SEQ ID NO: 251144 - DNA, 75 bp, Artificial Sequence
  Synthetic
ttatcaattcttctacattaaaaatttccatttttaatttatctagccccgcaatactcctcattacgtttcatt

SEQ ID NO: 251145 - DNA, 75 bp, Artificial Sequence
  Synthetic
catcttggtacatagattatccaattgagaagcgcatttagtagttttgtacattttaagtttattaacgaatcg

SEQ ID NO: 251146 - DNA, 75 bp, Artificial Sequence
  Synthetic
tgagaagcgcatttagtagttttgtacattttaagtttattaacgaatcgtcgaaaactagttatagttaacatt

SEQ ID NO: 251147 - DNA, 75 bp, Artificial Sequence
  Synthetic
tacccctgccgttactattatttataactgatgtaacccacgtaacattggaattaattatcgatagtaatgcat

SEQ ID NO: 251148 - DNA, 75 bp, Artificial Sequence
  Synthetic
aactgatgtaacccacgtaacattggaattaattatcgatagtaatgcatcgacacttccaaaattgtctattat

SEQ ID NO: 251149 - DNA, 75 bp, Artificial Sequence
  Synthetic
catgttttcatattcattaggattatcaaatctttaatcttattacgattgtatgcgttgatattacaagacgtc

SEQ ID NO: 251150 - DNA, 75 bp, Artificial Sequence
  Synthetic
tcaaatctttaatcttattacgattgtatgcgttgatattacaagacgtcattctaaaagacggaggatttccat

SEQ ID NO: 251151 - DNA, 75 bp, Artificial Sequence
  Synthetic
gtacatggaaataggttttgttctattacgcatcatagattcatataaaacacccgtagaaatactaatttgttt

SEQ ID NO: 251152 - DNA, 75 bp, Artificial Sequence
  Synthetic
ttacgcatcatagattcatataaaacacccgtagaaatactaatttgttttactctataaaatactattgcatct

SEQ ID NO: 251153 - DNA, 75 bp, Artificial Sequence
  Synthetic
tccaagtgtcaaattctaattttttttcattgatagtaccaaattcttctatctctttaactacttgcatagata

SEQ ID NO: 251154 - DNA, 75 bp, Artificial Sequence
  Synthetic
ttcattgatagtaccaaattcttctatctctttaactacttgcatagataggtaattacagtgatgcctacatgc

SEQ ID NO: 251155 - DNA, 75 bp, Artificial Sequence
  Synthetic
tctagaagcgatgctacgctagtcacgatcaccactttcatatttagaatatatgtatgtaaaaatatagtagaa

SEQ ID NO: 251156 - DNA, 75 bp, Artificial Sequence
  Synthetic
aaatgaattctcattttgtatctgcacatactccgttttatatcaataccaaagaaggaagatatctggttctaa

SEQ ID NO: 251157 - DNA, 75 bp, Artificial Sequence
  Synthetic
acatactccgttttatatcaataccaaagaaggaagatatctggttctaaaagccgttaaagtatgcgatgttag

SEQ ID NO: 251158 - DNA, 75 bp, Artificial Sequence
  Synthetic
gtagtatgataatatcaaaaagatggatataaagaatttactgactacatgtactattttacattactacattgg

SEQ ID NO: 251159 - DNA, 75 bp, Artificial Sequence
  Synthetic
aactgtagaatgcgaaggaagtaaagcttcctgcgtactcaaagtagataaaccctcatcacccacgtgtgagag

SEQ ID NO: 251160 - DNA, 75 bp, Artificial Sequence
  Synthetic
atcatcatcatcatcttcgatatttattttgctatcttgataatgtcctgtatcagttgcattttcagcactcga

SEQ ID NO: 251161 - DNA, 75 bp, Artificial Sequence
  Synthetic
ttccacacgctccagtaaacgggtgtcatgtgacgagggagaatcttgataagaggcataatcaatgttgtaatc

SEQ ID NO: 251162 - DNA, 75 bp, Artificial Sequence
  Synthetic
gagagaatgaataaccctggaaaacaagtcccgtttatgagaacggacatgttacaaaatatgtttgctgctaat

SEQ ID NO: 251163 - DNA, 75 bp, Artificial Sequence
  Synthetic
aagtcccgtttatgagaacggacatgttacaaaatatgtttgctgctaatcgcgacaacgtaacgtcaagacttt

SEQ ID NO: 251164 - DNA, 75 bp, Artificial Sequence
  Synthetic
tcatgtgacgagggagaatcttgataagaggcataatcaatgttgtaatccggtgtccacctggagaatttgcca

SEQ ID NO: 251165 - DNA, 75 bp, Artificial Sequence
  Synthetic
acacaaaatgtgaacactgcccacctcatacatataccgcaatccccaattattctaatagatgtcatcaatgta

SEQ ID NO: 251166 - DNA, 75 bp, Artificial Sequence
  Synthetic
ttcgatattaataaatccgtgtctcccgggttttttatctctttcagtatgtgaatagataggtattttatctct

SEQ ID NO: 251167 - DNA, 75 bp, Artificial Sequence
  Synthetic
ccgggttttttatctctttcagtatgtgaatagataggtattttatctctattcatcatcgaatttaagagatcc

SEQ ID NO: 251168 - DNA, 75 bp, Artificial Sequence
  Synthetic
atgtcagcatctgatacaacaatatatgtgcacataaacctctggcacttatttcatgtaccttccccttatcac

SEQ ID NO: 251169 - DNA, 75 bp, Artificial Sequence
  Synthetic
actgaagattgtcgagatttgtgtaccaaaaaaggagatgtccatgcggatactttggtggaatagatgaaggaa

SEQ ID NO: 251170 - DNA, 75 bp, Artificial Sequence
  Synthetic
atgtgcacataaacctctggcacttatttcatgtaccttccccttatcactaaggagaatagtatttgagaaata

SEQ ID NO: 251171 - DNA, 75 bp, Artificial Sequence
  Synthetic
ccaaaaaaggagatgtccatgcggatactttggtggaatagatgaaggaaatcctatttgtaaatcgtgttgtgt

SEQ ID NO: 251172 - DNA, 75 bp, Artificial Sequence
  Synthetic
ggtatacgctactgattcttcacagactgaagattgtcgagatttgtgtaccaaaaaaggagatgtccatgcgga

SEQ ID NO: 251173 - DNA, 75 bp, Artificial Sequence
  Synthetic
agatatacagaatttgtaacactctcgaaatcacacgatgtgtcggcgttaagatctaatatatcactcgataac

SEQ ID NO: 251174 - DNA, 75 bp, Artificial Sequence
  Synthetic
aattatagacttgatccatttcctccatgcaacctatctatctaaatgtaattaattatgattttgatgataatg

SEQ ID NO: 251175 - DNA, 75 bp, Artificial Sequence
  Synthetic
agccaggaacatattcagatcatcgatgtgataaatacagcgataccatctgtggacattgtccaagtgacacat

SEQ ID NO: 251176 - DNA, 75 bp, Artificial Sequence
  Synthetic
cgaaatcacacgatgtgtcggcgttaagatctaatatatcactcgataacacattttcatctagatacactagac

SEQ ID NO: 251177 - DNA, 75 bp, Artificial Sequence
  Synthetic
agtagtaacagtaactatgcgattattttcatcgatgatacatttcatcggcatattattacgcgtaccatcaaa

SEQ ID NO: 251178 - DNA, 75 bp, Artificial Sequence
  Synthetic
agacctattaataattacttatcttttgacgatcttgttataattataatataaaaatacttatgacatagtaac

SEQ ID NO: 251179 - DNA, 75 bp, Artificial Sequence
  Synthetic
ttttcatcgatgatacatttcatcggcatattattacgcgtaccatcaaagactataccatgtgtatatctaacg

SEQ ID NO: 251180 - DNA, 75 bp, Artificial Sequence
  Synthetic
gttagtgtgtattattcagtatggaagacctattaataattacttatcttttgacgatcttgttataattataat

SEQ ID NO: 251181 - DNA, 75 bp, Artificial Sequence
  Synthetic
agtaactcataattgctgacgcgataaattcgtaataatctgttttgttcaaatttttataaggaatctacaggc

SEQ ID NO: 251182 - DNA, 75 bp, Artificial Sequence
  Synthetic
cattaaacttttcaggatctttggatagatcttccaatctatctatttgagaaaacatttttatcatgttcaata

SEQ ID NO: 251183 - DNA, 75 bp, Artificial Sequence
  Synthetic
aaatttttataaggaatctacaggcataaaaataaaaatataatctataatatactcttacaacgccatcatgaa

SEQ ID NO: 251184 - DNA, 75 bp, Artificial Sequence
  Synthetic
tagatcttccaatctatctatttgagaaaacatttttatcatgttcaatagttgaaacgtcggatccactatata

SEQ ID NO: 251185 - DNA, 75 bp, Artificial Sequence
  Synthetic
tagcagtgaattaattgctgttattatggatttagaaatagtggacgattttgtgatattaatatagttattaat

SEQ ID NO: 251186 - DNA, 75 bp, Artificial Sequence
  Synthetic
actatgttcatggtatcctggcgaatattaaaactatcaatgatatgattatcgttttcatcttttatcaccata

SEQ ID NO: 251187 - DNA, 75 bp, Artificial Sequence
  Synthetic
tattaaaactatcaatgatatgattatcgttttcatcttttatcaccatatagtttctaagatatgggattttac

SEQ ID NO: 251188 - DNA, 75 bp, Artificial Sequence
  Synthetic
tcatcctatctggagcctccgaatattttttccattctgttttccaataattttatcgattctaatgaatacgaa

SEQ ID NO: 251189 - DNA, 75 bp, Artificial Sequence
  Synthetic
aaattttattagaaatgccaaatctataagaaaagtcctagaattagtctgaagaatatctatatcaccgtaccg

SEQ ID NO: 251190 - DNA, 75 bp, Artificial Sequence
  Synthetic
ataagaaaagtcctagaattagtctgaagaatatctatatcaccgtaccgtatatttggattaattagatataga

SEQ ID NO: 251191 - DNA, 75 bp, Artificial Sequence
  Synthetic
aaagtgttaactatttgatcgattacatttatgggatacctttgagcctaactaacgataacgtgaaatatattc

SEQ ID NO: 251192 - DNA, 75 bp, Artificial Sequence
  Synthetic
ttttattatgacgtctaagatattcttccatcaacttattaacatttttgactagggaagatacattatgacgtc

SEQ ID NO: 251193 - DNA, 75 bp, Artificial Sequence
  Synthetic
ttggatctgccattactgagtgcgaaaaatacatacttaaaaatctttgttttagaaactgtatcgatttctaca

SEQ ID NO: 251194 - DNA, 75 bp, Artificial Sequence
  Synthetic
ttccatcaacttattaacatttttgactagggaagatacattatgacgtcccattacttttgccttgtctattac

SEQ ID NO: 251195 - DNA, 75 bp, Artificial Sequence
  Synthetic
tctcttgccaattcttccattgatgttacattataagaaattttagatgaaattacatttggagctttaatagta

SEQ ID NO: 251196 - DNA, 75 bp, Artificial Sequence
  Synthetic
ttacattataagaaattttagatgaaattacatttggagctttaatagtaagaactcctaatatatccgtgtatg

SEQ ID NO: 251197 - DNA, 75 bp, Artificial Sequence
  Synthetic
tatatataaaaaatgaggatttcaccccactgattctcattaaatggttagagagtacaccaaccatgtaccgtc

SEQ ID NO: 251198 - DNA, 75 bp, Artificial Sequence
  Synthetic
tataatcgtaaataatttacctatattatatgtttgagtttgtttagaaaagtagctaagtatacgatcttttat

SEQ ID NO: 251199 - DNA, 75 bp, Artificial Sequence
  Synthetic
ttatatgtttgagtttgtttagaaaagtagctaagtatacgatcttttatttctgatgccgatgtatcaacatcg

SEQ ID NO: 251200 - DNA, 75 bp, Artificial Sequence
  Synthetic
cccactgattctcattaaatggttagagagtacaccaaccatgtaccgtcgagttacttagatgcctcagaatat

SEQ ID NO: 251201 - DNA, 75 bp, Artificial Sequence
  Synthetic
atcactttatagtcatcgactggttagttcaatctacgaatgtataacattcttaaacaatatagcattcttgga

SEQ ID NO: 251202 - DNA, 75 bp, Artificial Sequence
  Synthetic
ttactaacgatacgaatatgtctttgttaaaaacagttattttctgaatatttctagcttgtaattttaacatat

SEQ ID NO: 251203 - DNA, 75 bp, Artificial Sequence
  Synthetic
gttaaaaacagttattttctgaatatttctagcttgtaattttaacatatgatattcgttcacactaggtactct

SEQ ID NO: 251204 - DNA, 75 bp, Artificial Sequence
  Synthetic
agttcaatctacgaatgtataacattcttaaacaatatagcattcttggataaatcatttcctagataccatatc

SEQ ID NO: 251205 - DNA, 75 bp, Artificial Sequence
  Synthetic
gtaattcacatgataagatttccataaactgctacaatcataaaaaaattcatgggaaatgatatcttcacgtag

SEQ ID NO: 251206 - DNA, 75 bp, Artificial Sequence
  Synthetic
aatgtaatattaggaagagtattctgatcaggattcctattcattttgaggatttaaaactctgattattgtcta

SEQ ID NO: 251207 - DNA, 75 bp, Artificial Sequence
  Synthetic
gatcaggattcctattcattttgaggatttaaaactctgattattgtctaatatggtctcaacacaaactttttc

SEQ ID NO: 251208 - DNA, 75 bp, Artificial Sequence
  Synthetic
ctggataatattatctatatgatgggtggatatgatcagtccctgtatagaagttcaaaggttatagcgtacaat

SEQ ID NO: 251209 - DNA, 75 bp, Artificial Sequence
  Synthetic
gtggatatgatcagtccctgtatagaagttcaaaggttatagcgtacaatacatgtactaattcttggatatatg

SEQ ID NO: 251210 - DNA, 75 bp, Artificial Sequence
  Synthetic
tcgtttttcttaagaaatataaaactactgtctccagagctcgctctatcttttattttatctaattcgatacaa

SEQ ID NO: 251211 - DNA, 75 bp, Artificial Sequence
  Synthetic
tactgtctccagagctcgctctatcttttattttatctaattcgatacaaactcctgatactggttcagaaagta

SEQ ID NO: 251212 - DNA, 75 bp, Artificial Sequence
  Synthetic
aagttcaaaggttatagcgtacaatacatgtactaattcttggatatatgatataccagagctaaaatatcctcg

SEQ ID NO: 251213 - DNA, 75 bp, Artificial Sequence
  Synthetic
gacgaatacatttattgtataggcggtatacgcgatcaggagtcatcgttgatatctagtatcgatagatggaag

SEQ ID NO: 251214 - DNA, 75 bp, Artificial Sequence
  Synthetic
gaagatatttaatatagataatacaaaatcttcagttcttgatatcgatctgattgatcctagaactagatatat

SEQ ID NO: 251215 - DNA, 75 bp, Artificial Sequence
  Synthetic
aaatcttcagttcttgatatcgatctgattgatcctagaactagatatattaataacgtgctcattaggcagttt

SEQ ID NO: 251216 - DNA, 75 bp, Artificial Sequence
  Synthetic
atgctaaaatgtgcgaaccaaaatgtgatatggggttgcgattttaaacggattaatatatgtcataggtggagt

SEQ ID NO: 251217 - DNA, 75 bp, Artificial Sequence
  Synthetic
tatattccagttcatatttattagataccgcattgcccagattttgatattctatgaattcctctgaaaataaat

SEQ ID NO: 251218 - DNA, 75 bp, Artificial Sequence
  Synthetic
taccgcattgcccagattttgatattctatgaattcctctgaaaataaatccaaaataactagacattctatttt

SEQ ID NO: 251219 - DNA, 75 bp, Artificial Sequence
  Synthetic
acgcactagagagtttatcagaagatggatggatgaatcatcaacgtcttccaataaaaatgtccaatatgtcga

SEQ ID NO: 251220 - DNA, 75 bp, Artificial Sequence
  Synthetic
tggatggatgaatcatcaacgtcttccaataaaaatgtccaatatgtcgacgattgttcatgctggaaagattta

SEQ ID NO: 251221 - DNA, 75 bp, Artificial Sequence
  Synthetic
tctatcatgttcactactggtgtccacaatgataaatatctagagggaatataatatagtccatatgatgccaat

SEQ ID NO: 251222 - DNA, 75 bp, Artificial Sequence
  Synthetic
acaatgataaatatctagagggaatataatatagtccatatgatgccaatctagcaatgtcgaataactgtaatt

SEQ ID NO: 251223 - DNA, 75 bp, Artificial Sequence
  Synthetic
agtgtagttaatgtaatatcgaatctagagtccttagctataatccgatatatgatgaatggaccaaattatcat

SEQ ID NO: 251224 - DNA, 75 bp, Artificial Sequence
  Synthetic
tgaatcttgaggtataaacctaacacaaattatatcattagacttttcgtatgtaatgtctttcatgttataagt

SEQ ID NO: 251225 - DNA, 75 bp, Artificial Sequence
  Synthetic
caaattatatcattagacttttcgtatgtaatgtctttcatgttataagtttttaatcctggaatagaatctatt

SEQ ID NO: 251226 - DNA, 75 bp, Artificial Sequence
  Synthetic
tcaggagtcttgaggataaagtttaaaatagaattaataaagaacatataggtcatttttttaaacatggataga

SEQ ID NO: 251227 - DNA, 75 bp, Artificial Sequence
  Synthetic
tctccaacgagtcaaagcataatactctgttggttttcttatattcaatattacgattttcttctttgaatggaa

SEQ ID NO: 251228 - DNA, 75 bp, Artificial Sequence
  Synthetic
tctgttggttttcttatattcaatattacgattttcttctttgaatggaataggtttttgaattagtttataatt

SEQ ID NO: 251229 - DNA, 75 bp, Artificial Sequence
  Synthetic
taaatagtacgcggaaaaaacataatagctcccctgttttcatccatggttttaagtaaatgatcactggcttct

SEQ ID NO: 251230 - DNA, 75 bp, Artificial Sequence
  Synthetic
tagctcccctgttttcatccatggttttaagtaaatgatcactggcttctttagtcaatggatattcgaacatta

SEQ ID NO: 251231 - DNA, 75 bp, Artificial Sequence
  Synthetic
tccatatttcttaatgtaaagagtgatcaaatcattgtgtttattgtaccatcttgttgtaaatgtgtattcggt

SEQ ID NO: 251232 - DNA, 75 bp, Artificial Sequence
  Synthetic
atcaaatcattgtgtttattgtaccatcttgttgtaaatgtgtattcggttatcggatctgctcctttttctatt

SEQ ID NO: 251233 - DNA, 75 bp, Artificial Sequence
  Synthetic
agaattcaactatatcgacatatttcatttgtatacacataaccattactaacgtagaatgtataggaagagatg

SEQ ID NO: 251234 - DNA, 75 bp, Artificial Sequence
  Synthetic
catttgtatacacataaccattactaacgtagaatgtataggaagagatgtaacgggaacagggtttgttgattc

SEQ ID NO: 251235 - DNA, 75 bp, Artificial Sequence
  Synthetic
tctgttaatacgtcttgcacgtaatctattatagatgccaagatatctatataattattttgtaagatgatatta

SEQ ID NO: 251236 - DNA, 75 bp, Artificial Sequence
  Synthetic
actatgtgatctatataagtagtgtaataattcatgtatttcgatatatgttccaactctgtctttgtgatgtct

SEQ ID NO: 251237 - DNA, 75 bp, Artificial Sequence
  Synthetic
ttccaactctgtctttgtgatgtctagtttcgtaatatctatagcgtcctcaaaaaatatattcgcatatattcc

SEQ ID NO: 251238 - DNA, 75 bp, Artificial Sequence
  Synthetic
agtttcgtaatatctatagcgtcctcaaaaaatatattcgcatatattcccaagtcttcagttctatcttctaaa

SEQ ID NO: 251239 - DNA, 75 bp, Artificial Sequence
  Synthetic
aatctattttacctcttctgatgtcattaatgatatagtttttgacactattttccgtcaattgattcttattca

SEQ ID NO: 251240 - DNA, 75 bp, Artificial Sequence
  Synthetic
attaatgatatagtttttgacactattttccgtcaattgattcttattcactatgtctaaaaaccggatagcgtc

SEQ ID NO: 251241 - DNA, 75 bp, Artificial Sequence
  Synthetic
atctctattatagcttctggacataaatcatctattataccagaattaatgggaactattccgtatctatctaac

SEQ ID NO: 251242 - DNA, 75 bp, Artificial Sequence
  Synthetic
aatcatctattataccagaattaatgggaactattccgtatctatctaacatagttttaagaaagtcagaatcta

SEQ ID NO: 251243 - DNA, 75 bp, Artificial Sequence
  Synthetic
atacatgaaatgatctctattgatgatagtgactatttcattctctgaaaattggtaactcattctatacacgct

SEQ ID NO: 251244 - DNA, 75 bp, Artificial Sequence
  Synthetic
atagtgactatttcattctctgaaaattggtaactcattctatacacgctttccttgttgataaaggatagtata

SEQ ID NO: 251245 - DNA, 75 bp, Artificial Sequence
  Synthetic
actgttctcttatgaatcgtatatcatcatctgaaatgatcatgtaaggcatacatttaacaatgagagacttgt

SEQ ID NO: 251246 - DNA, 75 bp, Artificial Sequence
  Synthetic
atcatctgaaatgatcatgtaaggcatacatttaacaatgagagacttgtctcctgttatcaatatactattctt

SEQ ID NO: 251247 - DNA, 75 bp, Artificial Sequence
  Synthetic
attgagaggaccatctggttcaggaaagacagccataaccaaaagactgttaaaagactatgtgaatatatttgg

SEQ ID NO: 251248 - DNA, 75 bp, Artificial Sequence
  Synthetic
ttgtccacgttctttaattttgttatagtagatatcaaatccaatggagatacagttcttggcttaaacagatat

SEQ ID NO: 251249 - DNA, 75 bp, Artificial Sequence
  Synthetic
atttgtggtgtcccataccactagatttcctcgtcctatggaacgagaaggtgttgattaccttacgttaacaga

SEQ ID NO: 251250 - DNA, 75 bp, Artificial Sequence
  Synthetic
tagtagatatcaaatccaatggagatacagttcttggcttaaacagatatagtttttctggaacgaattctacaa

SEQ ID NO: 251251 - DNA, 75 bp, Artificial Sequence
  Synthetic
ataagtgggatgaaatcctattttaattaatgcgatagccttgtcctcgtgcagatatccaaacgcttttgtgat

SEQ ID NO: 251252 - DNA, 75 bp, Artificial Sequence
  Synthetic
attaatgcgatagccttgtcctcgtgcagatatccaaacgcttttgtgatagtatggcattcattgtctagaaac

SEQ ID NO: 251253 - DNA, 75 bp, Artificial Sequence
  Synthetic
tcatctttagagaatactagtcgcgttaatagtactaaaatttgtattttttaatctatctcaataaaaaattaa

SEQ ID NO: 251254 - DNA, 75 bp, Artificial Sequence
  Synthetic
actactaactgttattgataactagaatcagaatctaatgatgacataactaagaagtttatctacagccaattt

SEQ ID NO: 251255 - DNA, 75 bp, Artificial Sequence
  Synthetic
aatcagaatctaatgatgacataactaagaagtttatctacagccaatttagctgcattatttttagcatctcgt

SEQ ID NO: 251256 - DNA, 75 bp, Artificial Sequence
  Synthetic
taagaagtttatctacagccaatttagctgcattatttttagcatctcgtttagattttccatctgccttatcga

SEQ ID NO: 251257 - DNA, 75 bp, Artificial Sequence
  Synthetic
ggcataaaatgtaggagagttactaggccccactgattcaatacgaaaagaccaatctctcctagttatttggca

SEQ ID NO: 251258 - DNA, 75 bp, Artificial Sequence
  Synthetic
ggccccactgattcaatacgaaaagaccaatctctcctagttatttggcagtactcattaataacggtgacaggg

SEQ ID NO: 251259 - DNA, 75 bp, Artificial Sequence
  Synthetic
ttttaaccggaataacatcatcaaaagacttattatcctctctcattgatttttcgcgggatacatcatctatta

SEQ ID NO: 251260 - DNA, 75 bp, Artificial Sequence
  Synthetic
agacttattatcctctctcattgatttttcgcgggatacatcatctattatagcatcagcatcagaatctgtagg

SEQ ID NO: 251261 - DNA, 75 bp, Artificial Sequence
  Synthetic
gaccaacgaggaggagtatcgtcggaactgtacaccatagtactacgttgaagatcatacagagctttattaact

SEQ ID NO: 251262 - DNA, 75 bp, Artificial Sequence
  Synthetic
aacattatttatttatgatatacattatatacattatatacattatatacattatatacattatatacattatat

SEQ ID NO: 251263 - DNA, 75 bp, Artificial Sequence
  Synthetic
caatctctgtgtcagaacgctcgtcaatatagatcgtagaaattttttagagagaactaacacaactagcaataa

SEQ ID NO: 251264 - DNA, 75 bp, Artificial Sequence
  Synthetic
tacaagggagtcctgttctaatattggcatcaatgtaaacgagaccatctatcggaaacgtctttacagcgatgg

SEQ ID NO: 251265 - DNA, 75 bp, Artificial Sequence
  Synthetic
tattcatcatcctctggtggttcgtcgttcctatcgaatgtagctctgattaacccgtcatctataggtgatgct

SEQ ID NO: 251266 - DNA, 75 bp, Artificial Sequence
  Synthetic
gcagaactcaacaataaatttagtgataataatccgtttaggagagcacatagtgacgattatcttaataagcaa

SEQ ID NO: 251267 - DNA, 75 bp, Artificial Sequence
  Synthetic
cgttcctatcgaatgtagctctgattaacccgtcatctataggtgatgctggttctggagattctggaggagatg

SEQ ID NO: 251268 - DNA, 75 bp, Artificial Sequence
  Synthetic
caaactttactcttccagcatccgtttctaaaaaaatattaacgagttccatttatatcatccaatattattgaa

SEQ ID NO: 251269 - DNA, 75 bp, Artificial Sequence
  Synthetic
aagtcataagttagttaagtcataagttagttttataagtaagttagttaagtcataagttagttttataagtaa

SEQ ID NO: 251270 - DNA, 75 bp, Artificial Sequence
  Synthetic
tatttccttgttttcatgtatcgattgcgttgtaacattaagattgcgaaatgctctaaatttgggaggcttaaa

SEQ ID NO: 251271 - DNA, 75 bp, Artificial Sequence
  Synthetic
tgcgttgtaacattaagattgcgaaatgctctaaatttgggaggcttaaagtgttgtttacaatctctacacgcg

SEQ ID NO: 251272 - DNA, 75 bp, Artificial Sequence
  Synthetic
atattatgatggtaacatatatgatttagctaaagatataaatacgatgtcattcgacagttttataagatctct

SEQ ID NO: 251273 - DNA, 75 bp, Artificial Sequence
  Synthetic
gattgctgtctattgtcgtggatattaacaaaggtcgtgatgtatccaatatcaagttcgctgccggaataatca

SEQ ID NO: 251274 - DNA, 75 bp, Artificial Sequence
  Synthetic
ttagctaaagatataaatacgatgtcattcgacagttttataagatctctacaaaatatcacttcaaagaaagat

SEQ ID NO: 251275 - DNA, 75 bp, Artificial Sequence
  Synthetic
cggctctagtttgaatcatcatcggtgtagtattcctacttttacagttaggacacggtgtattgtatttctcgt

SEQ ID NO: 251276 - DNA, 75 bp, Artificial Sequence
  Synthetic
tgtagtattcctacttttacagttaggacacggtgtattgtatttctcgtcgagaacgttaaaataatcgttgta

SEQ ID NO: 251277 - DNA, 75 bp, Artificial Sequence
  Synthetic
taacaaaggtcgtgatgtatccaatatcaagttcgctgccggaataatcattttaatggagtatatatttgatga

SEQ ID NO: 251278 - DNA, 75 bp, Artificial Sequence
  Synthetic
gcactctatcgtagaatacagagacgttatccaatagatgatgatagataattttttcttcctaactgatttctc

SEQ ID NO: 251279 - DNA, 75 bp, Artificial Sequence
  Synthetic
gttatccaatagatgatgatagataattttttcttcctaactgatttctctgtttaaattcgtagcgatatataa

SEQ ID NO: 251280 - DNA, 75 bp, Artificial Sequence
  Synthetic
ttgtattctactcctttcttaatgcattttataccgaacaagagatagcgaaggaattctttttcggtaccgcta

SEQ ID NO: 251281 - DNA, 75 bp, Artificial Sequence
  Synthetic
attttataccgaacaagagatagcgaaggaattctttttcggtaccgctagtacccttaatcatatcacatagtg

SEQ ID NO: 251282 - DNA, 75 bp, Artificial Sequence
  Synthetic
ttaagacatgtgttctatactaagatggttggtatattccatagtagcttgtggaatttataaacttatgatagt

SEQ ID NO: 251283 - DNA, 75 bp, Artificial Sequence
  Synthetic
tggttggtatattccatagtagcttgtggaatttataaacttatgatagtaaaactattaccaagtatgtaaaga

SEQ ID NO: 251284 - DNA, 75 bp, Artificial Sequence
  Synthetic
ggacggtttatttctatacgatagtttgtttctggaatcctttgagtattctataccaatattattctttgattc

SEQ ID NO: 251285 - DNA, 75 bp, Artificial Sequence
  Synthetic
ttgtttctggaatcctttgagtattctataccaatattattctttgattcgaatttagtttcttcgatattagat

SEQ ID NO: 251286 - DNA, 75 bp, Artificial Sequence
  Synthetic
caccgtcggtattcgttcatcaattcagtatgggtatacaacacgaattcgacatcattattaatggagatatcg

SEQ ID NO: 251287 - DNA, 75 bp, Artificial Sequence
  Synthetic
cagtatgggtatacaacacgaattcgacatcattattaatggagatatcgcgttgagaaatttacagttacatag

SEQ ID NO: 251288 - DNA, 75 bp, Artificial Sequence
  Synthetic
agtactttgatgatttttccatggcccattctattaagttttccaagttggcatcatccacatattgtgatagta

SEQ ID NO: 251289 - DNA, 75 bp, Artificial Sequence
  Synthetic
ccattctattaagttttccaagttggcatcatccacatattgtgatagtaattctcggatatcagtagtgactac

SEQ ID NO: 251290 - DNA, 75 bp, Artificial Sequence
  Synthetic
aaaattatttcgaatgattacaagaaattaaagttaagattcgttatacgcccagattggtcggaaatcgacgag

SEQ ID NO: 251291 - DNA, 75 bp, Artificial Sequence
  Synthetic
aattaaagttaagattcgttatacgcccagattggtcggaaatcgacgaggtcaaaggattaaccgtatttgcaa

SEQ ID NO: 251292 - DNA, 75 bp, Artificial Sequence
  Synthetic
gagtaactactaatgtatacattttccatttataacacttatgtattaactttgtttatttatattttttcatta

SEQ ID NO: 251293 - DNA, 75 bp, Artificial Sequence
  Synthetic
ttatgttgatattaataatcgtattgtggttatatggctacaatttcataatgagttgaagtcagtgtcctatga

SEQ ID NO: 251294 - DNA, 75 bp, Artificial Sequence
  Synthetic
ggtagattacacgttatattacgtaatatatgaggctgtaatacatctgtataataaaaaaacagagatattgat

SEQ ID NO: 251295 - DNA, 75 bp, Artificial Sequence
  Synthetic
atatatgaggctgtaatacatctgtataataaaaaaacagagatattgatttattctgatgatgagaacgagctc

SEQ ID NO: 251296 - DNA, 75 bp, Artificial Sequence
  Synthetic
agaaagtatcaaatcgatagtgcagagtcaacaatgaaaatggataagacgatgacaaagtttcagaatagagtc

SEQ ID NO: 251297 - DNA, 75 bp, Artificial Sequence
  Synthetic
gtctaaatatgattagtaaaaagtataaaattaaagaagagaactactcatccccgtatatagaacatccgttaa

SEQ ID NO: 251298 - DNA, 75 bp, Artificial Sequence
  Synthetic
taaaattaaagaagagaactactcatccccgtatatagaacatccgttaatcccgtatagagattatgagtccat

SEQ ID NO: 251299 - DNA, 75 bp, Artificial Sequence
  Synthetic
tgacacttactaaaagccaaagtttttattcgtatttttaaggagtgtaacatgtccgcaattagatttattgcg

SEQ ID NO: 251300 - DNA, 75 bp, Artificial Sequence
  Synthetic
ttattcgtatttttaaggagtgtaacatgtccgcaattagatttattgcgtgtttatgtcttatttccgtattag

SEQ ID NO: 251301 - DNA, 75 bp, Artificial Sequence
  Synthetic
ttattccaaataatcagaaaacttataaactattctcggacatttcagtcattggcaaagcatcacagaatccga

SEQ ID NO: 251302 - DNA, 75 bp, Artificial Sequence
  Synthetic
taaactattctcggacatttcagtcattggcaaagcatcacagaatccgagtaagatgatatatgctcgctgctt

SEQ ID NO: 251303 - DNA, 75 bp, Artificial Sequence
  Synthetic
aattaggtaactgttatctctttttaactaactaactaactaactaactcttatatactattaataatacatcta

SEQ ID NO: 251304 - DNA, 75 bp, Artificial Sequence
  Synthetic
gtaagatgatatatgctcgctgctttacatgtttcccaatttgtttggagatgaccatagattcatttgttatag

SEQ ID NO: 251305 - DNA, 75 bp, Artificial Sequence
  Synthetic
caaccatttgataaattaaatattactctagatatatacacttatgaggatctagtaccgtagacaatgatttac

SEQ ID NO: 251306 - DNA, 75 bp, Artificial Sequence
  Synthetic
ctctagatatatacacttatgaggatctagtaccgtagacaatgatttaccacactctaacgatgacaacttctt

SEQ ID NO: 251307 - DNA, 75 bp, Artificial Sequence
  Synthetic
aatgcatccaatgagtaaaatcaaacacaaaatcttcgttcaaacttaatcttattagaatattagtggaagaaa

SEQ ID NO: 251308 - DNA, 75 bp, Artificial Sequence
  Synthetic
attggcaaagcatcacagaatccgagtaagatgatatatgctcgctgctttacatgtttcccaatttgtttggag

SEQ ID NO: 251309 - DNA, 75 bp, Artificial Sequence
  Synthetic
ttggattactgttgactaaatgctgtgctccgtttattgataccgttagcgtatacacatcgcatgataatttga

SEQ ID NO: 251310 - DNA, 75 bp, Artificial Sequence
  Synthetic
tgctccgtttattgataccgttagcgtatacacatcgcatgataatttgaatatagaattttatactagagacga

SEQ ID NO: 251311 - DNA, 75 bp, Artificial Sequence
  Synthetic
atgacaagataagacttactcgcatctactggatagacataaatatcctcctcgtaataatgaaatataatataa

SEQ ID NO: 251312 - DNA, 75 bp, Artificial Sequence
  Synthetic
cagtacagatacaatgatgatgtagaaaatggattcattggattggataaactaaaattaaacattgttcatgat

SEQ ID NO: 251313 - DNA, 75 bp, Artificial Sequence
  Synthetic
atttgtaccattgacgttaaagcacgatgcaaccatctaacaaaaccagaagttacagtacaagaagaagcgtac

SEQ ID NO: 251314 - DNA, 75 bp, Artificial Sequence
  Synthetic
gatgcaaccatctaacaaaaccagaagttacagtacaagaagaagcgtacagatattcattatcttctgacctat

SEQ ID NO: 251315 - DNA, 75 bp, Artificial Sequence
  Synthetic
atagttgaatcatgtatacctgttcgtatgcctgtggctaagatactgtgtaaagaaatggtaaataaatacttt

SEQ ID NO: 251316 - DNA, 75 bp, Artificial Sequence
  Synthetic
gtatgcctgtggctaagatactgtgtaaagaaatggtaaataaatactttgagaatctttaagagtgtattgact

SEQ ID NO: 251317 - DNA, 75 bp, Artificial Sequence
  Synthetic
cattgatctgatcgaaactaatagtactgacactacagtactgaaatcatatgagctcatgcttcccaaacgtgc

SEQ ID NO: 251318 - DNA, 75 bp, Artificial Sequence
  Synthetic
actgacactacagtactgaaatcatatgagctcatgcttcccaaacgtgctaaatccatacataactgaaatgaa

SEQ ID NO: 251319 - DNA, 75 bp, Artificial Sequence
  Synthetic
ttctccaatactaattcaaattgttaaattaataatggaatagtataaatagttattagtgataagatagtaaaa

SEQ ID NO: 251320 - DNA, 75 bp, Artificial Sequence
  Synthetic
aacaaccaatcatggttaacgataagatactctatgatagttgtaaaacatttaacatcgatgccagtagtgcac

SEQ ID NO: 251321 - DNA, 75 bp, Artificial Sequence
  Synthetic
gatactctatgatagttgtaaaacatttaacatcgatgccagtagtgcacaatcattaatagaaagtggtgcaaa

SEQ ID NO: 251322 - DNA, 75 bp, Artificial Sequence
  Synthetic
atagataactctcttctataaaaaatggattttattcgtagaaagtatcttatatacacagtagaaaataatata

SEQ ID NO: 251323 - DNA, 75 bp, Artificial Sequence
  Synthetic
tggattttattcgtagaaagtatcttatatacacagtagaaaataatatagattttttaaaggatgatacattaa

SEQ ID NO: 251324 - DNA, 75 bp, Artificial Sequence
  Synthetic
ttatattttatattttattttatattttgtagtaagaatagaatgctaatgtcaagtttattcgaatagatgtct

SEQ ID NO: 251325 - DNA, 75 bp, Artificial Sequence
  Synthetic
actccattaaaggcatacgttaccaaaaaaaataataatatcaaaaacgatgttgtgattttgttattgtcgtca

SEQ ID NO: 251326 - DNA, 75 bp, Artificial Sequence
  Synthetic
aaaaaaataataatatcaaaaacgatgttgtgattttgttattgtcgtcagtcgactataaaaatatcaatgatt

SEQ ID NO: 251327 - DNA, 75 bp, Artificial Sequence
  Synthetic
tgataacatcgatatagacttattgaaattactaatttcgaaaggtatagaaataaatagtatcaaaaatggtat

SEQ ID NO: 251328 - DNA, 75 bp, Artificial Sequence
  Synthetic
aaattactaatttcgaaaggtatagaaataaatagtatcaaaaatggtattaatattgtagagaaatacgcgaca

SEQ ID NO: 251329 - DNA, 75 bp, Artificial Sequence
  Synthetic
acccacgttgtacgttaaagcattgactaagaattatttatcgtttagtaacacaatacagtcgtacaaggaaac

SEQ ID NO: 251330 - DNA, 75 bp, Artificial Sequence
  Synthetic
actaagaattatttatcgtttagtaacacaatacagtcgtacaaggaaaccgtgcataaactaacacaagatgaa

SEQ ID NO: 251331 - DNA, 75 bp, Artificial Sequence
  Synthetic
ttaaactattattggataaaggaatacctacatgtagcaacatacagtatgggtacaatatcatacccattcaat

SEQ ID NO: 251332 - DNA, 75 bp, Artificial Sequence
  Synthetic
acctacatgtagcaacatacagtatgggtacaatatcatacccattcaatgtactgattatatttattttaattg

SEQ ID NO: 251333 - DNA, 75 bp, Artificial Sequence
  Synthetic
tggacgaattaggagaacttataggcgtaaattatgacttagttcttaatccattatttcacggaggggaaccca

SEQ ID NO: 251334 - DNA, 75 bp, Artificial Sequence
  Synthetic
cgtaaattatgacttagttcttaatccattatttcacggaggggaacccatcaaagatatggaaatcattttttt

SEQ ID NO: 251335 - DNA, 75 bp, Artificial Sequence
  Synthetic
tatgactacaccactgattatgataatagaatgggtaaaacagttctctattattatattattactaggtcacaa

SEQ ID NO: 251336 - DNA, 75 bp, Artificial Sequence
  Synthetic
atagaatgggtaaaacagttctctattattatattattactaggtcacaagatggttatgtgacatctttggacg

SEQ ID NO: 251337 - DNA, 75 bp, Artificial Sequence
  Synthetic
aaagttgttaaaaaattaagtgttataagattacttatttgggcatacctaagcaagaaagatacaggcatagag

SEQ ID NO: 251338 - DNA, 75 bp, Artificial Sequence
  Synthetic
taagattacttatttgggcatacctaagcaagaaagatacaggcatagagtttgcggataatgatagacaagata

SEQ ID NO: 251339 - DNA, 75 bp, Artificial Sequence
  Synthetic
aaacgaaatgtgtcattatacttatcgtgaacgtaccatactctattattatgttgacaaatgcgatattaaacg

SEQ ID NO: 251340 - DNA, 75 bp, Artificial Sequence
  Synthetic
cgtgaacgtaccatactctattattatgttgacaaatgcgatattaaacgggaaatatttgacgtgttattcgat

SEQ ID NO: 251341 - DNA, 75 bp, Artificial Sequence
  Synthetic
tagaatagtccatagcaatctaacagaaacgtttagggattatatctttcccggagataagactagctattgggt

SEQ ID NO: 251342 - DNA, 75 bp, Artificial Sequence
  Synthetic
gaaacgtttagggattatatctttcccggagataagactagctattgggtgtggttaaacgaaagtatagctaat

SEQ ID NO: 251343 - DNA, 75 bp, Artificial Sequence
  Synthetic
tgcatattctatctatctatttacgtaaacaatataggaagaaaaatcataaaatagataattatatagtggata

SEQ ID NO: 251344 - DNA, 75 bp, Artificial Sequence
  Synthetic
taaacaatataggaagaaaaatcataaaatagataattatatagtggataaactattatctgcccatgatacgtt

SEQ ID NO: 251345 - DNA, 75 bp, Artificial Sequence
  Synthetic
ccgccattaccatgtatgataaaattcttagttatatatactctgagataaaacagggacgcgttaataaaaaca

SEQ ID NO: 251346 - DNA, 75 bp, Artificial Sequence
  Synthetic
aaataccgatcggtaattgtctctgtcgctgtaatagaattaattatatatctattacaccggccttgtatcata

SEQ ID NO: 251347 - DNA, 75 bp, Artificial Sequence
  Synthetic
tcttagttatatatactctgagataaaacagggacgcgttaataaaaacatgcttaagttagtttatatctttga

SEQ ID NO: 251348 - DNA, 75 bp, Artificial Sequence
  Synthetic
ataaagttgtggtagtatgatctccatatttataatttagtactttgtatttagtatttttggaatcataaaaaa

SEQ ID NO: 251349 - DNA, 75 bp, Artificial Sequence
  Synthetic
ttacgtaataatgtcataatatcctcaattcttaaaagatatacagattctatacaagatctattgtcagaatat

SEQ ID NO: 251350 - DNA, 75 bp, Artificial Sequence
  Synthetic
ctgctagaaatcatatatgatattcctggagatatcctatctattattgatgcaaaaaacgatgattggaaaaaa

SEQ ID NO: 251351 - DNA, 75 bp, Artificial Sequence
  Synthetic
ctggagatatcctatctattattgatgcaaaaaacgatgattggaaaaaatattttattagtttttacaaagcta

SEQ ID NO: 251352 - DNA, 75 bp, Artificial Sequence
  Synthetic
aggagctatattatatagatttaagcatataaataaatattttaaaagatttgacaatagggatcctaaagttgt

SEQ ID NO: 251353 - DNA, 75 bp, Artificial Sequence
  Synthetic
caattcttaaaagatatacagattctatacaagatctattgtcagaatatgtatcttatcatacagtgtacatca

SEQ ID NO: 251354 - DNA, 75 bp, Artificial Sequence
  Synthetic
catataaataaatattttaaaagatttgacaatagggatcctaaagttgtagagtatattttaaaaaatggaaac

SEQ ID NO: 251355 - DNA, 75 bp, Artificial Sequence
  Synthetic
tagtgatagaacgtttaacgaggacttattcagagttgttgttcaaatagatcccgaatatttcgataatgaacg

SEQ ID NO: 251356 - DNA, 75 bp, Artificial Sequence
  Synthetic
ttattcagagttgttgttcaaatagatcccgaatatttcgataatgaacgaattatgtctttattctatacgagt

SEQ ID NO: 251357 - DNA, 75 bp, Artificial Sequence
  Synthetic
taaatattatgccgttattccctaccttatttattcacgagtcagaagtgttatcgatactaaaaatttgtaagc

SEQ ID NO: 251358 - DNA, 75 bp, Artificial Sequence
  Synthetic
cttatttattcacgagtcagaagtgttatcgatactaaaaatttgtaagccgtatatcgatgatataaacaaaat

SEQ ID NO: 251359 - DNA, 75 bp, Artificial Sequence
  Synthetic
agttagatattaataacagttatatatctaatataatttatgaggtgaacgatatcacattagatacaatggatg

SEQ ID NO: 251360 - DNA, 75 bp, Artificial Sequence
  Synthetic
atctaatataatttatgaggtgaacgatatcacattagatacaatggatgatatgaagaagtgtcaaatctttaa

SEQ ID NO: 251361 - DNA, 75 bp, Artificial Sequence
  Synthetic
tattattgtatcgagtcgcatagtgttgcactagtagaatggttaatagataatggcgcagatattaatataaca

SEQ ID NO: 251362 - DNA, 75 bp, Artificial Sequence
  Synthetic
ttgcactagtagaatggttaatagataatggcgcagatattaatataacaacaacatatgggtctacatgtattg

SEQ ID NO: 251363 - DNA, 75 bp, Artificial Sequence
  Synthetic
gaatacaatacatacctgtttttgcacgagtcggatcccatggtcatagagaacggaatactaaagaaactgtca

SEQ ID NO: 251364 - DNA, 75 bp, Artificial Sequence
  Synthetic
acgagtcggatcccatggtcatagagaacggaatactaaagaaactgtcatctataaaatccaagagtagacggc

SEQ ID NO: 251365 - DNA, 75 bp, Artificial Sequence
  Synthetic
atgtataccagaaatagcagaaatatatattaagatattggaaattattttgagtaaattaccaaccatcgaatg

SEQ ID NO: 251366 - DNA, 75 bp, Artificial Sequence
  Synthetic
tatattaagatattggaaattattttgagtaaattaccaaccatcgaatgtattaagaaaacagttgattaccta

SEQ ID NO: 251367 - DNA, 75 bp, Artificial Sequence
  Synthetic
aaaatattatttagacggacaattggctcgtctaggtcttgtgttagatgattataaaggagacttattagttaa

SEQ ID NO: 251368 - DNA, 75 bp, Artificial Sequence
  Synthetic
gctcgtctaggtcttgtgttagatgattataaaggagacttattagttaaaatgataaaccatctcaaatctgtg

SEQ ID NO: 251369 - DNA, 75 bp, Artificial Sequence
  Synthetic
gtaataaggctaaatcgttactgaaaatatgtattaagtacttcatattagtagactataagtacatatgtgata

SEQ ID NO: 251370 - DNA, 75 bp, Artificial Sequence
  Synthetic
aatatgtattaagtacttcatattagtagactataagtacatatgtgatacgtatccatcttatatagaatatat

SEQ ID NO: 251371 - DNA, 75 bp, Artificial Sequence
  Synthetic
tctctacagataaaaaccctagtattcttccatcgctaatcaaaactattttagctagttataatatttccatca

SEQ ID NO: 251372 - DNA, 75 bp, Artificial Sequence
  Synthetic
tcttccatcgctaatcaaaactattttagctagttataatatttccatcatcgtcttatttcaaaggtttttaag

SEQ ID NO: 251373 - DNA, 75 bp, Artificial Sequence
  Synthetic
gatatgtgtcaaattaaaataaatggtacggacatgcttacagtgatgtacaagttaaataaacctacaaagaaa

SEQ ID NO: 251374 - DNA, 75 bp, Artificial Sequence
  Synthetic
gtacggacatgcttacagtgatgtacaagttaaataaacctacaaagaaacgatatgttaataatccgatattta

SEQ ID NO: 251375 - DNA, 75 bp, Artificial Sequence
  Synthetic
ttcttggataaaagcatccatctaaccaagactgataagaaatatatacttcaattgataaggcacggtagatca

SEQ ID NO: 251376 - DNA, 75 bp, Artificial Sequence
  Synthetic
gttttataatcaaataatatataatgctaataggttaatagaacaaagtaagaaaatagacaacatgatagatga

SEQ ID NO: 251377 - DNA, 75 bp, Artificial Sequence
  Synthetic
tcaattgataaggcacggtagatcatagaacaaaccaaatatattattaataatttgtatatacatagatataat

SEQ ID NO: 251378 - DNA, 75 bp, Artificial Sequence
  Synthetic
gctaataggttaatagaacaaagtaagaaaatagacaacatgatagatgaggtatccgcggataacaatcgttta

SEQ ID NO: 251379 - DNA, 75 bp, Artificial Sequence
  Synthetic
ttttgataaatggaaactgttgcaacaattcagactcccaccaaattaatgaataaagaaaatgcagaaatgatt

SEQ ID NO: 251380 - DNA, 75 bp, Artificial Sequence
  Synthetic
caattcagactcccaccaaattaatgaataaagaaaatgcagaaatgattttggaaaaaattgttaatcatatag

SEQ ID NO: 251381 - DNA, 75 bp, Artificial Sequence
  Synthetic
atttgattttctcgtacgcgttcctataaaaatagaaactataatcatatatagtgtaggttggtagtattgatc

SEQ ID NO: 251382 - DNA, 75 bp, Artificial Sequence
  Synthetic
ataaaaatagaaactataatcatatatagtgtaggttggtagtattgatcttgtgactagagactttagtcaagg

SEQ ID NO: 251383 - DNA, 75 bp, Artificial Sequence
  Synthetic
atattcagaaaataatcctgaatatattgattttcgtaacagatacggagactatagatctctcattataaaaag

SEQ ID NO: 251384 - DNA, 75 bp, Artificial Sequence
  Synthetic
attgattttcgtaacagatacggagactatagatctctcattataaaaagtgatcacgagtttgtaaagctatgt

SEQ ID NO: 251385 - DNA, 75 bp, Artificial Sequence
  Synthetic
atataatagtggttggagtagggtactcgtgattaattttattgttaaacttgtcttattaatatgtcttctaaa

SEQ ID NO: 251386 - DNA, 75 bp, Artificial Sequence
  Synthetic
ctcgtgattaattttattgttaaacttgtcttattaatatgtcttctaaagggggtagtagtggcggcatgtgga

SEQ ID NO: 251387 - DNA, 75 bp, Artificial Sequence
  Synthetic
cagaaacgcaacaaatgattatcaaacacatatacgaacaatatcttattccagtatctgaagtactattaaaac

SEQ ID NO: 251388 - DNA, 75 bp, Artificial Sequence
  Synthetic
acacatatacgaacaatatcttattccagtatctgaagtactattaaaacctataatgtccatgggtgacatatt

SEQ ID NO: 251389 - DNA, 75 bp, Artificial Sequence
  Synthetic
tagtaataaaggatctaaaacttatacatctggtggcagtggaatgtggggaggaggatcgtccagtggtgtaaa

SEQ ID NO: 251390 - DNA, 75 bp, Artificial Sequence
  Synthetic
acatctggtggcagtggaatgtggggaggaggatcgtccagtggtgtaaaaagtggggttaatggaggtgttaac

SEQ ID NO: 251391 - DNA, 75 bp, Artificial Sequence
  Synthetic
gaatggatgctagaacaactctctaccctaaactttaacaatctctacacatggaactcatgtagcataggcaat

SEQ ID NO: 251392 - DNA, 75 bp, Artificial Sequence
  Synthetic
aaatttaaacactaattatttttattaataattgtacaagtttttgacatggtataaatacattcaaaaatgata

SEQ ID NO: 251393 - DNA, 75 bp, Artificial Sequence
  Synthetic
taataattgtacaagtttttgacatggtataaatacattcaaaaatgatatttaatgacattagttgtgcgggtg

SEQ ID NO: 251394 - DNA, 75 bp, Artificial Sequence
  Synthetic
tctattcagtcaaaatgtttgactatctggaaaatgaggaggtggttctcgatgaacttaaacagatgttgagag

SEQ ID NO: 251395 - DNA, 75 bp, Artificial Sequence
  Synthetic
tctggaaaatgaggaggtggttctcgatgaacttaaacagatgttgagagacagagatcctaatgataccaggaa

SEQ ID NO: 251396 - DNA, 75 bp, Artificial Sequence
  Synthetic
gcataccttttcaatgagcattgtaataatgttgaggtcgtcaaactactactagacagtggcactaatccatta

SEQ ID NO: 251397 - DNA, 75 bp, Artificial Sequence
  Synthetic
ataatgttgaggtcgtcaaactactactagacagtggcactaatccattacacaaaaattggagacagtttaccc

SEQ ID NO: 251398 - DNA, 75 bp, Artificial Sequence
  Synthetic
gtagaccgttaatgaaaaacacatatctatttgataattacgcgtatggatggataccagaaactgcaatttgga

SEQ ID NO: 251399 - DNA, 75 bp, Artificial Sequence
  Synthetic
tctatttgataattacgcgtatggatggataccagaaactgcaatttggagtagtagatacgcaaacctagatgc

SEQ ID NO: 251400 - DNA, 75 bp, Artificial Sequence
  Synthetic
acatgttaaagtcaataaggatatagcgatggctctactagaagctactggatatagcaacataaatgactttaa

SEQ ID NO: 251401 - DNA, 75 bp, Artificial Sequence
  Synthetic
gcgatggctctactagaagctactggatatagcaacataaatgactttaatatattcagctatattaaatcaaaa

SEQ ID NO: 251402 - DNA, 75 bp, Artificial Sequence
  Synthetic
ggattacttaaaaagtttgaatttctcatgtctctatataaaggtcctattcccgtatatgaagaaaaagtaaat

SEQ ID NO: 251403 - DNA, 75 bp, Artificial Sequence
  Synthetic
tcatgtctctatataaaggtcctattcccgtatatgaagaaaaagtaaatactgaattcattgctaatggatctt

SEQ ID NO: 251404 - DNA, 75 bp, Artificial Sequence
  Synthetic
tgttggtagaacatggatttgacttgagtgttaaatgtgaaaaccatcgttcagttatagaaaattatgtaatga

SEQ ID NO: 251405 - DNA, 75 bp, Artificial Sequence
  Synthetic
gagtgttaaatgtgaaaaccatcgttcagttatagaaaattatgtaatgacagatgatcctgttcctgaaattat

SEQ ID NO: 251406 - DNA, 75 bp, Artificial Sequence
  Synthetic
tagaaagttttctgcccttccaacaaacgagtttattagttttttattattgacctccatccctatctataatat

SEQ ID NO: 251407 - DNA, 75 bp, Artificial Sequence
  Synthetic
aacgagtttattagttttttattattgacctccatccctatctataatatcttattctggtttaaaaacacacag

SEQ ID NO: 251408 - DNA, 75 bp, Artificial Sequence
  Synthetic
agtgttctttatgaggatgacgagtacggatacgcgtatgatgattatcaaccacgaaattgcggtaccgtattg

SEQ ID NO: 251409 - DNA, 75 bp, Artificial Sequence
  Synthetic
acggatacgcgtatgatgattatcaaccacgaaattgcggtaccgtattgcatctgtatatcatctctcatctgt

SEQ ID NO: 251410 - DNA, 75 bp, Artificial Sequence
  Synthetic
tcagatacgtctatacagataataccaaacaccttgcgttggctaggtatatacatcaaacaggagactataagc

SEQ ID NO: 251411 - DNA, 75 bp, Artificial Sequence
  Synthetic
caaacaccttgcgttggctaggtatatacatcaaacaggagactataagcctttgtttagtcgtctcaaagagaa

SEQ ID NO: 251412 - DNA, 75 bp, Artificial Sequence
  Synthetic
tgtgcgtccggaagttgttaaatgtctaattaatcacggaatcaagccgtcttctatagataaaaactattgtac

SEQ ID NO: 251413 - DNA, 75 bp, Artificial Sequence
  Synthetic
aaaaatgtttttgttaaccgctgcatgatgtacagatttcggaatcgcaaaccacttgtggatttattttatcct

SEQ ID NO: 251414 - DNA, 75 bp, Artificial Sequence
  Synthetic
aaaaatgtttttgttaaccgctgcatgatgtacagatttcggaatcgcaaaccacttgtggattttttttatcct

SEQ ID NO: 251415 - DNA, 75 bp, Artificial Sequence
  Synthetic
aaaaatgtttttgttaaccgctgcatgatgtacagatttcggaatcgcaaaccacttgtggatttcttttatcct

SEQ ID NO: 251416 - DNA, 75 bp, Artificial Sequence
  Synthetic
aaaaatgtttttgttaaccgctgcatgatgtacagatttcggaatcgcaaaccacttgtggatttgttttatcct

SEQ ID NO: 251417 - DNA, 75 bp, Artificial Sequence
  Synthetic
aaaaatgtttttgttaaccgctgcatgatgtacagatttcggaatcgcaaaccacttgtggttttattttatcct

SEQ ID NO: 251418 - DNA, 75 bp, Artificial Sequence
  Synthetic
aaaaatgtttttgttaaccgctgcatgatgtacagatttcggaatcgcaaaccacttgtggtttttttttatcct

SEQ ID NO: 251419 - DNA, 75 bp, Artificial Sequence
  Synthetic
aaaaatgtttttgttaaccgctgcatgatgtacagatttcggaatcgcaaaccacttgtggttttcttttatcct

SEQ ID NO: 251420 - DNA, 75 bp, Artificial Sequence
  Synthetic
aaaaatgtttttgttaaccgctgcatgatgtacagatttcggaatcgcaaaccacttgtggttttgttttatcct

SEQ ID NO: 251421 - DNA, 75 bp, Artificial Sequence
  Synthetic
aaaaatgtttttgttaaccgctgcatgatgtacagatttcggaatcgcaaaccacttgtggctttattttatcct

SEQ ID NO: 251422 - DNA, 75 bp, Artificial Sequence
  Synthetic
aaaaatgtttttgttaaccgctgcatgatgtacagatttcggaatcgcaaaccacttgtggcttttttttatcct

SEQ ID NO: 251423 - DNA, 75 bp, Artificial Sequence
  Synthetic
aaaaatgtttttgttaaccgctgcatgatgtacagatttcggaatcgcaaaccacttgtggctttcttttatcct

SEQ ID NO: 251424 - DNA, 75 bp, Artificial Sequence
  Synthetic
aaaaatgtttttgttaaccgctgcatgatgtacagatttcggaatcgcaaaccacttgtggctttgttttatcct

SEQ ID NO: 251425 - DNA, 75 bp, Artificial Sequence
  Synthetic
aaaaatgtttttgttaaccgctgcatgatgtacagatttcggaatcgcaaaccacttgtgggtttattttatcct

SEQ ID NO: 251426 - DNA, 75 bp, Artificial Sequence
  Synthetic
aaaaatgtttttgttaaccgctgcatgatgtacagatttcggaatcgcaaaccacttgtgggttttttttatcct

SEQ ID NO: 251427 - DNA, 75 bp, Artificial Sequence
  Synthetic
aaaaatgtttttgttaaccgctgcatgatgtacagatttcggaatcgcaaaccacttgtgggtttcttttatcct

SEQ ID NO: 251428 - DNA, 75 bp, Artificial Sequence
  Synthetic
aaaaatgtttttgttaaccgctgcatgatgtacagatttcggaatcgcaaaccacttgtgggtttgttttatcct

SEQ ID NO: 251429 - DNA, 75 bp, Artificial Sequence
  Synthetic
ctaattaatcacggaatcaagccgtcttctatagataaaaactattgtacagctcttcaatattatattaagtca

SEQ ID NO: 251430 - DNA, 75 bp, Artificial Sequence
  Synthetic
ataggtatcaaagatatagattaccctaatcttagtagagcaagaagtccatccgattatgagacattagctaat

SEQ ID NO: 251431 - DNA, 75 bp, Artificial Sequence
  Synthetic
ctaatcttagtagagcaagaagtccatccgattatgagacattagctaatattagtactatattgtactttacca

SEQ ID NO: 251432 - DNA, 75 bp, Artificial Sequence
  Synthetic
aattgttaatgaaaggaatagataacacggcttatttatatatagacgatctaacatgttgcactcgaggaatta

SEQ ID NO: 251433 - DNA, 75 bp, Artificial Sequence
  Synthetic
cacggcttatttatatatagacgatctaacatgttgcactcgaggaattatggctgattatctaaatagtgatta

SEQ ID NO: 251434 - DNA, 75 bp, Artificial Sequence
  Synthetic
attgttttacgtacctgggtattcaattactacaaaaattactccagccgtagaatatctaatggataaactgaa

SEQ ID NO: 251435 - DNA, 75 bp, Artificial Sequence
  Synthetic
attactacaaaaattactccagccgtagaatatctaatggataaactgaatctaacaaagagcgacgtacaactg

SEQ ID NO: 251436 - DNA, 75 bp, Artificial Sequence
  Synthetic
gatttggtaaaattgtttttggagaatggaaagccgcacggaataatgcgtagtattgtaccactatggagaaat

SEQ ID NO: 251437 - DNA, 75 bp, Artificial Sequence
  Synthetic
atggaaagccgcacggaataatgcgtagtattgtaccactatggagaaatgataaggaaaccatctctttgatat

SEQ ID NO: 251438 - DNA, 75 bp, Artificial Sequence
  Synthetic
aaatgtaggtcttgaaccaaacattctttgaaaaaatgagatgcataaaactttattatccaatagattaactat

SEQ ID NO: 251439 - DNA, 75 bp, Artificial Sequence
  Synthetic
ctttgaaaaaatgagatgcataaaactttattatccaatagattaactatttcagacgtcaatcgtttaaagtaa

SEQ ID NO: 251440 - DNA, 75 bp, Artificial Sequence
  Synthetic
ccaacatatactaattgagtatatgacattcggcgatatcgatatccctctagtggaatgcatgttggaatatgg

SEQ ID NO: 251441 - DNA, 75 bp, Artificial Sequence
  Synthetic
acattcggcgatatcgatatccctctagtggaatgcatgttggaatatggagctgtggtaaataaagaggctata

SEQ ID NO: 251442 - DNA, 75 bp, Artificial Sequence
  Synthetic
tgccgagtttaaaacttctatcgataattgtttcatatgttttaatatttacaagttttttggtccatggtacat

SEQ ID NO: 251443 - DNA, 75 bp, Artificial Sequence
  Synthetic
aattgtttcatatgttttaatatttacaagttttttggtccatggtacattagctggacagatatatgcaaaata

SEQ ID NO: 251444 - DNA, 75 bp, Artificial Sequence
  Synthetic
ttgattcttacacgatgaaatatctactaaaaaaggaagggggagatgccgtcaatcatctcgatgatggagaga

SEQ ID NO: 251445 - DNA, 75 bp, Artificial Sequence
  Synthetic
actaaaaaaggaagggggagatgccgtcaatcatctcgatgatggagagatcccgattggacacctatgtgaatc

SEQ ID NO: 251446 - DNA, 75 bp, Artificial Sequence
  Synthetic
tctggattgtttttattatattcagtaaccaaatacatattagggttatctgcggatttataatttgagtgatgc

SEQ ID NO: 251447 - DNA, 75 bp, Artificial Sequence
  Synthetic
taaccaaatacatattagggttatctgcggatttataatttgagtgatgcattcgactcaacataaataattcta

SEQ ID NO: 251448 - DNA, 75 bp, Artificial Sequence
  Synthetic
acttatacatacaaaaagggtctttgtgacatgtcttatacttgcccaattcttagtactataaacatttgccta

SEQ ID NO: 251449 - DNA, 75 bp, Artificial Sequence
  Synthetic
gtgacatgtcttatacttgcccaattcttagtactataaacatttgcctaccttatcttaaagacattaacatga

SEQ ID NO: 251450 - DNA, 75 bp, Artificial Sequence
  Synthetic
ggatcgtaaatctgtttctaaagaacggagaatatctatacatacctgattagaattcatccgtccttcagacaa

SEQ ID NO: 251451 - DNA, 75 bp, Artificial Sequence
  Synthetic
cggagaatatctatacatacctgattagaattcatccgtccttcagacaacatctcagatagtctggtcttgtat

SEQ ID NO: 251452 - DNA, 75 bp, Artificial Sequence
  Synthetic
tcacaaggctgttagatataataaacaatctctagtatctttactgctagaatccggttcagatgtcaacattag

SEQ ID NO: 251453 - DNA, 75 bp, Artificial Sequence
  Synthetic
caatctctagtatctttactgctagaatccggttcagatgtcaacattagatcaaataacggatatacatgtata

SEQ ID NO: 251454 - DNA, 75 bp, Artificial Sequence
  Synthetic
tggaaacatctcttctagtttcactagtacctttattaattctctcaggtacagattttgaattcgacgatgccg

SEQ ID NO: 251455 - DNA, 75 bp, Artificial Sequence
  Synthetic
agtacctttattaattctctcaggtacagattttgaattcgacgatgccgagtatttcatcgttgtatatttctt

SEQ ID NO: 251456 - DNA, 75 bp, Artificial Sequence
  Synthetic
acattgaactgctgaaaatgctattatgtcataaacctacattagattgtgtgattgattcattgagtgaagtat

SEQ ID NO: 251457 - DNA, 75 bp, Artificial Sequence
  Synthetic
atgtcataaacctacattagattgtgtgattgattcattgagtgaagtatctaatatcgtagataatgcctatgc

SEQ ID NO: 251458 - DNA, 75 bp, Artificial Sequence
  Synthetic
tataccgcctcaaactctattttaaaattattaaacaatactctactattaatcagtcgttctaactcctttgct

SEQ ID NO: 251459 - DNA, 75 bp, Artificial Sequence
  Synthetic
aattattaaacaatactctactattaatcagtcgttctaactcctttgctatttctatggacttatctacatctt

SEQ ID NO: 251460 - DNA, 75 bp, Artificial Sequence
  Synthetic
atgattatagatgactgtacatcgtctaagattccagagtccataagtcaacgctataatgattatatagatctc

SEQ ID NO: 251461 - DNA, 75 bp, Artificial Sequence
  Synthetic
ctaagattccagagtccataagtcaacgctataatgattatatagatctctgcaatcaagaattgaatgagatga

SEQ ID NO: 251462 - DNA, 75 bp, Artificial Sequence
  Synthetic
gtcggtatctccatacacgctacgaaaacgaaatctataatctataggcaacgatgttttcacaatcggattaat

SEQ ID NO: 251463 - DNA, 75 bp, Artificial Sequence
  Synthetic
aaacgaaatctataatctataggcaacgatgttttcacaatcggattaatatctctatcgtccatataaaatgga

SEQ ID NO: 251464 - DNA, 75 bp, Artificial Sequence
  Synthetic
tatgttctcattaatatttactgagcatggagctaaaattattcatcgatatgccaataatccagaaatacgtgc

SEQ ID NO: 251465 - DNA, 75 bp, Artificial Sequence
  Synthetic
taaaccattagataaagttgatcttaaaccgtcttttctggtataatattgtttagtagatactcatcaagatta

SEQ ID NO: 251466 - DNA, 75 bp, Artificial Sequence
  Synthetic
catggagctaaaattattcatcgatatgccaataatccagaaatacgtgcgtattatgagtcaaaacaaaataaa

SEQ ID NO: 251467 - DNA, 75 bp, Artificial Sequence
  Synthetic
acataccgttggataactctgctccatttagtaccgattctagatacaagatcattctacgtcctatggatgtgc

SEQ ID NO: 251468 - DNA, 75 bp, Artificial Sequence; identical to SEQ ID NO: 46688
  Synthetic

SEQ ID NO: 251469 - DNA, 75 bp, Artificial Sequence
  Synthetic
tttccgatgcaatagtgaagcataataaaattcataaaaccatcatagaatcagttgatgataatacctacattt

SEQ ID NO: 251470 - DNA, 75 bp, Artificial Sequence
  Synthetic
taaaattcataaaaccatcatagaatcagttgatgataatacctacatttctaatcttccgtataccatcaaata

SEQ ID NO: 251471 - DNA, 75 bp, Artificial Sequence
  Synthetic
agaccatatactgagttggctactatcttgtacgtatattgcatggaatcatagatggccttttcagttgaactg

SEQ ID NO: 251472 - DNA, 75 bp, Artificial Sequence
  Synthetic
tcttgtacgtatattgcatggaatcatagatggccttttcagttgaactggtagcctgttttaacatctttttat

SEQ ID NO: 251473 - DNA, 75 bp, Artificial Sequence
  Synthetic
tttttttatacctttaaaattgataaataaattttttatagtgatattttggcaagatgagaatcctatttctca

SEQ ID NO: 251474 - DNA, 75 bp, Artificial Sequence
  Synthetic
aataaattttttatagtgatattttggcaagatgagaatcctatttctcatcgctttcatgtatgggtgtgttca

SEQ ID NO: 251475 - DNA, 75 bp, Artificial Sequence
  Synthetic
tggttaacgcccttggctctaaccattttcaagatgaggtccctgattatagtccttctgttcccctctatcatc

SEQ ID NO: 251476 - DNA, 75 bp, Artificial Sequence
  Synthetic
tcttaatagtctaggaatggttccttctattgatctatcgaaaattgctatttcagagatgaggttcggtagtct

SEQ ID NO: 251477 - DNA, 75 bp, Artificial Sequence
  Synthetic
tctattgatctatcgaaaattgctatttcagagatgaggttcggtagtctaggttcacaatgaaccgtaatatat

SEQ ID NO: 251478 - DNA, 75 bp, Artificial Sequence
  Synthetic
aaatgtccaaatctagccattgtaacatcttctggagaatttcattgttccggatgtgtggaacgtatgcctggg

SEQ ID NO: 251479 - DNA, 75 bp, Artificial Sequence
  Synthetic
catcttctggagaatttcattgttccggatgtgtggaacgtatgcctgggtttagctatatgtattggttggcaa

SEQ ID NO: 251480 - DNA, 75 bp, Artificial Sequence
  Synthetic
agagctgattatttatttcttcttccaatctattggtactaacaacgacaccgactaatgtttccggagatagat

SEQ ID NO: 251481 - DNA, 75 bp, Artificial Sequence
  Synthetic
caatctattggtactaacaacgacaccgactaatgtttccggagatagatttccaaagatacacacattaggata

SEQ ID NO: 251482 - DNA, 75 bp, Artificial Sequence
  Synthetic
caagtttatagaacatctgggtgatggcatcaaagaagatgaaaccgttcgtaccacagatggaggaatcaccac

SEQ ID NO: 251483 - DNA, 75 bp, Artificial Sequence
  Synthetic
acattattactaaacattttttgttttggagcaaataccttaccgccttcataaggaaacttttgttttgtttct

SEQ ID NO: 251484 - DNA, 75 bp, Artificial Sequence
  Synthetic
gatactaataaatttgctcattataggttcacttgtgttctcattacgctagatggcgtttcaaaaaagaatatt

SEQ ID NO: 251485 - DNA, 75 bp, Artificial Sequence; identical to SEQ ID NO: 46700
  Synthetic

SEQ ID NO: 251486 - DNA, 75 bp, Artificial Sequence
  Synthetic
catagatttccgaagtttagcttctaggacggcgattcttttttttctttcgaattcacggggtacaaccgtttc

SEQ ID NO: 251487 - DNA, 75 bp, Artificial Sequence
  Synthetic
aatctaatctaatctaatctaatctaatctaatctaatctaatctaatctaatctaatctaatctaatctaatct

SEQ ID NO: 251488 - DNA, 75 bp, Artificial Sequence
  Synthetic
aatctaatctaatctaatctaatctaatctaatctaatctaatctaatctaatggaattaatttgaattgagatt

SEQ ID NO: 251489 - DNA, 75 bp, Artificial Sequence
  Synthetic
ttttgtttctactccataatactcccacaaatactgacacaaacaagcatcatgaatacagtatctagccatatc

SEQ ID NO: 251490 - DNA, 75 bp, Artificial Sequence
  Synthetic
cacaaatactgacacaaacaagcatcatgaatacagtatctagccatatctaaagctatgtttagattataatcc

SEQ ID NO: 251491 - DNA, 75 bp, Artificial Sequence
  Synthetic
gaatgaatgtattcgaagaattacaacatgggatagagaatcatgcgtcagaattgatacacagactataaataa

SEQ ID NO: 251492 - DNA, 75 bp, Artificial Sequence
  Synthetic
aatcaaattaatctttcatatgagagaaaaataacgacatatatcgtcgataattaaactttttatttattagtt

SEQ ID NO: 251493 - DNA, 75 bp, Artificial Sequence
  Synthetic
gaaaaataacgacatatatcgtcgataattaaactttttatttattagttaactagcttatagaacttgctcatt

SEQ ID NO: 251494 - DNA, 75 bp, Artificial Sequence
  Synthetic
catcctttccgaaagataatttatatgtatcattaggtaaagtaggacatgatagtacgactttaaatccatttt

SEQ ID NO: 251495 - DNA, 75 bp, Artificial Sequence
  Synthetic
gatagtacgactttaaatccattttcccaaatatctttacgaattactttacatataatatcctcatcaacagtc

SEQ ID NO: 251496 - DNA, 75 bp, Artificial Sequence
  Synthetic
atataggacaattatctaacgcaccggtttctcttcgtgttctatgccatatattgatacatgttatgcaaaata

SEQ ID NO: 251497 - DNA, 75 bp, Artificial Sequence
  Synthetic
ggtttctcttcgtgttctatgccatatattgatacatgttatgcaaaatatatgattacacgaatccaataaacc

SEQ ID NO: 251498 - DNA, 75 bp, Artificial Sequence
  Synthetic
ttgcaaatgtatcggctttgcctttcgcgtccgtagtatcgtcaccgatgaacgtcatttctctaactcctctat

SEQ ID NO: 251499 - DNA, 75 bp, Artificial Sequence
  Synthetic
cgcgtccgtagtatcgtcaccgatgaacgtcatttctctaactcctctatttaatactttacccatgcaactgaa

SEQ ID NO: 251500 - DNA, 75 bp, Artificial Sequence
  Synthetic
tttgagtaaacaacttcatagcaaattccacattctttttctttacttactctatacatgtcctcgtatttatcc

SEQ ID NO: 251501 - DNA, 75 bp, Artificial Sequence
  Synthetic
ttccacattctttttctttacttactctatacatgtcctcgtatttatccagtattttgatgatatccaactcag

SEQ ID NO: 251502 - DNA, 75 bp, Artificial Sequence
  Synthetic
ttgtacgaatccaatttttcagatttttgaatgaatgaatatagatcgaaaaatatagttccattattgttatta

SEQ ID NO: 251503 - DNA, 75 bp, Artificial Sequence
  Synthetic
tttgaatgaatgaatatagatcgaaaaatatagttccattattgttattaacgtgaaacgtagtattggccatgc

SEQ ID NO: 251504 - DNA, 75 bp, Artificial Sequence
  Synthetic
atttggagtatatgtattattagctatgtaccaatttaccaaccctcttaatattgattgaacaatcacatcggt

SEQ ID NO: 251505 - DNA, 75 bp, Artificial Sequence
  Synthetic
atgtaccaatttaccaaccctcttaatattgattgaacaatcacatcggttatccaatcaataaccacattaata

SEQ ID NO: 251506 - DNA, 75 bp, Artificial Sequence
  Synthetic
atttctctcataaatacagagatgtacagcttcctttttgtctggagatctaaagataatcttctctcctgttaa

SEQ ID NO: 251507 - DNA, 75 bp, Artificial Sequence
  Synthetic
acagcttcctttttgtctggagatctaaagataatcttctctcctgttaataactctagacgattagtaatatat

SEQ ID NO: 251508 - DNA, 75 bp, Artificial Sequence
  Synthetic
catatatgtttttatttttttgacagttacgtatagtttcagtaagttttgattgttgtattcctgtatctctag

SEQ ID NO: 251509 - DNA, 75 bp, Artificial Sequence
  Synthetic
gttacgtatagtttcagtaagttttgattgttgtattcctgtatctctagataagttagtcatatagtcccttcc

SEQ ID NO: 251510 - DNA, 75 bp, Artificial Sequence; identical to SEQ ID NO: 47342
  Synthetic

SEQ ID NO: 251511 - DNA, 75 bp, Artificial Sequence
  Synthetic
tctctagcgatcgttcaagatccctgattctagtctttagcctatttacctcctcagaagatgctccgttaccgt

SEQ ID NO: 251512 - DNA, 75 bp, Artificial Sequence
  Synthetic
ttccaacaattgtttagctattcgtaacaaaactatttcagaacatagaactagttctcgttcgtaatccatttc

SEQ ID NO: 251513 - DNA, 75 bp, Artificial Sequence
  Synthetic
aatcgattagccaaatgtggatttatttttgtgatattgatataatatgtaatgttattaatatttcggataatg

SEQ ID NO: 251514 - DNA, 75 bp, Artificial Sequence
  Synthetic
tttttgtgatattgatataatatgtaatgttattaatatttcggataatgcatactgttagtcttatatcatttg

SEQ ID NO: 251515 - DNA, 75 bp, Artificial Sequence
  Synthetic
cctctatcgacggcttcttgtatttcctgttccgttaacatctcttcattaatgagcgtaaacagtaatcgttta

SEQ ID NO: 251516 - DNA, 75 bp, Artificial Sequence
  Synthetic
atcacctaaatgtttttaacgaagataatgtggtaaagattatatacacttatatatcttccgatatctacaagg

SEQ ID NO: 251517 - DNA, 75 bp, Artificial Sequence
  Synthetic
cctgttccgttaacatctcttcattaatgagcgtaaacagtaatcgtttaccacttaaatcgatataacagtaac

SEQ ID NO: 251518 - DNA, 75 bp, Artificial Sequence
  Synthetic
tacatgatctatagatgatgtattgattttgacaggatcgaattccatatccgcgactaaacagtgaaaaaaatg

SEQ ID NO: 251519 - DNA, 75 bp, Artificial Sequence
  Synthetic
attttgacaggatcgaattccatatccgcgactaaacagtgaaaaaaatgtaaatactttttaaattttaaatta

SEQ ID NO: 251520 - DNA, 75 bp, Artificial Sequence
  Synthetic
tacagaaggaaacttcttatcgaagtgacactctatatctagaaataagtacgatcttgggatatcgaatctagg

SEQ ID NO: 251521 - DNA, 75 bp, Artificial Sequence; identical to SEQ ID NO: 46722
  Synthetic

SEQ ID NO: 251522 - DNA, 75 bp, Artificial Sequence
  Synthetic
atactaaatacaaagtactaaattataaatatggagatcatactaccacaactttattatgatacaaggccggtg

SEQ ID NO: 251523 - DNA, 75 bp, Artificial Sequence
  Synthetic
taaatatggagatcatactaccacaactttattatgatacaaggccggtgtaatagatatataattaattctatt

SEQ ID NO: 251524 - DNA, 75 bp, Artificial Sequence; identical to SEQ ID NO: 46724
  Synthetic

SEQ ID NO: 251525 - DNA, 75 bp, Artificial Sequence
  Synthetic
gtccaacgagtaacatccgtctggagatatcccgttagaaatataaaaccaactaatattgagaaattcatccat

SEQ ID NO: 251526 - DNA, 75 bp, Artificial Sequence
  Synthetic
gtctatggaaattattgataatcggtactaataaaatagtttaactcttttagaaccagtttggtactgtaattt

SEQ ID NO: 251527 - DNA, 75 bp, Artificial Sequence
  Synthetic
acagatacagatacagatacagatgttacaaatgtagaagatatcatgaatgaaatagatagagagaaagaaata

SEQ ID NO: 251528 - DNA, 75 bp, Artificial Sequence
  Synthetic
ggtatttgtcgttacaacataccgtaatttgtaatatacaattccattgacagttgttatacatcaaaattgcaa

SEQ ID NO: 251529 - DNA, 75 bp, Artificial Sequence; identical to SEQ ID NO: 46728
  Synthetic

SEQ ID NO: 251530 - DNA, 75 bp, Artificial Sequence
  Synthetic
ctgcgacggagcattttctatctttaatatctagattataacttattgtctcgtcaatgtctatagttctcatct

SEQ ID NO: 251531 - DNA, 75 bp, Artificial Sequence
  Synthetic
aatgtgtcctctcctcttataacatcgtactcagaaactttttataattatacctcctctaataatatatctata

SEQ ID NO: 251532 - DNA, 75 bp, Artificial Sequence
  Synthetic
aatttgtaatatacaattccattgacagttgttatacatcaaaattgcaattcttttgattacaatgttataaga

SEQ ID NO: 251533 - DNA, 75 bp, Artificial Sequence
  Synthetic
cgtactcagaaactttttataattatacctcctctaataatatatctatactacgacattgtcaaacaatcattc

SEQ ID NO: 251534 - DNA, 75 bp, Artificial Sequence
  Synthetic
aggaggagataatgactgatatatttcgtccgtcactacgtaataaaagtaatgaggaaatcgtataaatactgt

SEQ ID NO: 251535 - DNA, 75 bp, Artificial Sequence
  Synthetic
tcgtccgtcactacgtaataaaagtaatgaggaaatcgtataaatactgtctcgccatttcgacatctggatttc

SEQ ID NO: 251536 - DNA, 75 bp, Artificial Sequence
  Synthetic
aaacccataaaaataagcgtaactaataagacaatggatatgtacgacgataaaggtctacagactattaaactg

SEQ ID NO: 251537 - DNA, 75 bp, Artificial Sequence
  Synthetic
ataagacaatggatatgtacgacgataaaggtctacagactattaaactgtttaataatgaatttgattgtataa

SEQ ID NO: 251538 - DNA, 75 bp, Artificial Sequence
  Synthetic
gactttcaaaccaattaatacacctaacatccatttctagaatttagaaatatattttcatttaaatgaatccca

SEQ ID NO: 251539 - DNA, 75 bp, Artificial Sequence
  Synthetic
aacatccatttctagaatttagaaatatattttcatttaaatgaatcccaaacattggggaagagccatatggac

SEQ ID NO: 251540 - DNA, 75 bp, Artificial Sequence
  Synthetic
acatgtaactgattcctatagtatacaacttcctatggaagacaattctgatattatagaaaatatcagaaaaat

SEQ ID NO: 251541 - DNA, 75 bp, Artificial Sequence
  Synthetic
aactttaactttttctttctcagcatctagttgatattccgacctcttcacgtttcacatgggttacctccgcag

SEQ ID NO: 251542 - DNA, 75 bp, Artificial Sequence
  Synthetic
caacttcctatggaagacaattctgatattatagaaaatatcagaaaaatactatatagacgattaaaaaatgta

SEQ ID NO: 251543 - DNA, 75 bp, Artificial Sequence
  Synthetic
gcgggtttagacggcaacatagaagcgtgtaaacgaaaactatatactatagtcagcactcttccatgtcctgca

SEQ ID NO: 251544 - DNA, 75 bp, Artificial Sequence
  Synthetic
cgtgtaaacgaaaactatatactatagtcagcactcttccatgtcctgcatgtagacgacacgcgactatcgcta

SEQ ID NO: 251545 - DNA, 75 bp, Artificial Sequence
  Synthetic
taacttttatgaaatacgatccaaatgatgaataagcgcgtacgtgttctaatcgggtcccttaactaataacca

SEQ ID NO: 251546 - DNA, 75 bp, Artificial Sequence
  Synthetic
tgatgaataagcgcgtacgtgttctaatcgggtcccttaactaataaccatatggaatattgtctagtaatatat

SEQ ID NO: 251547 - DNA, 75 bp, Artificial Sequence
  Synthetic
cgatgatctgaattatatttattattttttcatcagattatttaacaatttggcatttgatcccaaatacgcaat

SEQ ID NO: 251548 - DNA, 75 bp, Artificial Sequence
  Synthetic
tttttcatcagattatttaacaatttggcatttgatcccaaatacgcaatcgatgtgtcaaaggttaaaccttta

SEQ ID NO: 251549 - DNA, 75 bp, Artificial Sequence
  Synthetic
aataaaattatgccaccctacaggaaatataaagtcggataaggatattatgtttgtaaagactctagactttaa

SEQ ID NO: 251550 - DNA, 75 bp, Artificial Sequence
  Synthetic
aatataaagtcggataaggatattatgtttgtaaagactctagactttaaatcaaagaaaatattaactagacat

SEQ ID NO: 251551 - DNA, 75 bp, Artificial Sequence
  Synthetic
tgattagtcacgactgaaataaccgcgtgattattttttggtataattctacacggcatggtttctgtgactatg

SEQ ID NO: 251552 - DNA, 75 bp, Artificial Sequence
  Synthetic
cgtgattattttttggtataattctacacggcatggtttctgtgactatgaattcaacacctgttatcttagtga

SEQ ID NO: 251553 - DNA, 75 bp, Artificial Sequence
  Synthetic
actactattcactacaacgacgttgatatatatatatactgataaaaatggaaaagagttatgttattgttatat

SEQ ID NO: 251554 - DNA, 75 bp, Artificial Sequence
  Synthetic
atatatatatatactgataaaaatggaaaagagttatgttattgttatataacaatagatgatcattacttggtt

SEQ ID NO: 251555 - DNA, 75 bp, Artificial Sequence
  Synthetic
gtcaaagacataaaactcattgtttacgatcgaaatagaccccctatcacacttaaaataaaaaatatccttatc

SEQ ID NO: 251556 - DNA, 75 bp, Artificial Sequence
  Synthetic
taaactaacttatgacttaactaacttatgacttaactaacttatgacttaactaacttatgacttaactaactt

SEQ ID NO: 251557 - DNA, 75 bp, Artificial Sequence
  Synthetic
acgatcgaaatagaccccctatcacacttaaaataaaaaatatccttatcctttaccaccaaataaaattctgat

SEQ ID NO: 251558 - DNA, 75 bp, Artificial Sequence
  Synthetic
tcaatagatcttgaaaaatgtctgttagtaaataaccatcaggtatatgttcgttaaagataaacgtataagtga

SEQ ID NO: 251559 - DNA, 75 bp, Artificial Sequence
  Synthetic
tagtaaataaccatcaggtatatgttcgttaaagataaacgtataagtgatagttttggagatgtatggatacaa

SEQ ID NO: 251560 - DNA, 75 bp, Artificial Sequence
  Synthetic
acagttccacaaatttatttattaactccgaggcacatacatcgtcggtattttttatgacaaactttactcttc

SEQ ID NO: 251561 - DNA, 75 bp, Artificial Sequence
  Synthetic
gttattttcattaactaatgatgataacaggaatatagcataggacactgataaactagacgatgatacagatat

SEQ ID NO: 251562 - DNA, 75 bp, Artificial Sequence
  Synthetic
aacaggaatatagcataggacactgataaactagacgatgatacagatatatggactcctgtcacagaagatgat

SEQ ID NO: 251563 - DNA, 75 bp, Artificial Sequence
  Synthetic
tacctttgtccaccatctcctccaattcatactctattttgtcattaactttaatgtgtgaaaacagtacgccac

SEQ ID NO: 251564 - DNA, 75 bp, Artificial Sequence
  Synthetic
tgtttatacaagattgaaattatattctttttttatagagtgtggggtagtgttacggatatctaatattaatat

SEQ ID NO: 251565 - DNA, 75 bp, Artificial Sequence
  Synthetic
ttcatactctattttgtcattaactttaatgtgtgaaaacagtacgccacatgcttccatgacagtgtgtaacac

SEQ ID NO: 251566 - DNA, 75 bp, Artificial Sequence
  Synthetic
tgtatgcaaaatctcaatcggatactgtattcgactattatgttcttactggtgatacggaaccacccactgtat

SEQ ID NO: 251567 - DNA, 75 bp, Artificial Sequence
  Synthetic
tgtattcgactattatgttcttactggtgatacggaaccacccactgtattcattttcaaggtaactagatttta

SEQ ID NO: 251568 - DNA, 75 bp, Artificial Sequence
  Synthetic
gtataattgtccaagactgtcaatctataatagatagtagctataatatattctatgatggtattgaagaagatg

SEQ ID NO: 251569 - DNA, 75 bp, Artificial Sequence
  Synthetic
tataatagatagtagctataatatattctatgatggtattgaagaagatgacaaccttggcatattgatcattta

SEQ ID NO: 251570 - DNA, 75 bp, Artificial Sequence
  Synthetic
tttgtatcccatctagaggcagaagtattgtttagataaatacaaataatacaggatacatcgcatacttagtat

SEQ ID NO: 251571 - DNA, 75 bp, Artificial Sequence
  Synthetic
tattgtttagataaatacaaataatacaggatacatcgcatacttagtatttttttatacatatacatttttgta

SEQ ID NO: 251572 - DNA, 75 bp, Artificial Sequence
  Synthetic
cttaaatgaaagagaatcagtaattggaataagcgtcttctcgatgtagtgtccgtataccaacatgtctgatat

SEQ ID NO: 251573 - DNA, 75 bp, Artificial Sequence
  Synthetic
ggaataagcgtcttctcgatgtagtgtccgtataccaacatgtctgatattttgatgtattccattaaattattt

SEQ ID NO: 251574 - DNA, 75 bp, Artificial Sequence
  Synthetic
aaaaatataacacaaccatatcttgtataggtagtttagttcttcgagtgaacctataaacagataatagacaac

SEQ ID NO: 251575 - DNA, 75 bp, Artificial Sequence
  Synthetic
tataggtagtttagttcttcgagtgaacctataaacagataatagacaacacgtaataataatgcctactaatac

SEQ ID NO: 251576 - DNA, 75 bp, Artificial Sequence
  Synthetic
acagaatttctgtcaatggaccccaacatcgttgacctattaagttttgattgatttttccgtgtaaggcgtatc

SEQ ID NO: 251577 - DNA, 75 bp, Artificial Sequence
  Synthetic
acatcgttgacctattaagttttgattgatttttccgtgtaaggcgtatctagtcagatcgtatagcctatccaa

SEQ ID NO: 251578 - DNA, 75 bp, Artificial Sequence
  Synthetic
tatgatgttgtagtgtctggttttcctgaacgttgatagtctactaatactacatgctgacatctaatgcctgta

SEQ ID NO: 251579 - DNA, 75 bp, Artificial Sequence
  Synthetic
ctgaacgttgatagtctactaatactacatgctgacatctaatgcctgtataaccatgagagcatctacaataca

SEQ ID NO: 251580 - DNA, 75 bp, Artificial Sequence
  Synthetic
catcgtacactttttaattttctatagaagagtgacagacatctggagcaattacagacagcaatttctttattc

SEQ ID NO: 251581 - DNA, 75 bp, Artificial Sequence
  Synthetic
agaagagtgacagacatctggagcaattacagacagcaatttctttattctctacagatgtaagatacttgaaga

SEQ ID NO: 251582 - DNA, 75 bp, Artificial Sequence
  Synthetic
tcggacatttatacaagggagtcctgttctaatattggcatcaatgttcggatctataggcttgattttcgcatt

SEQ ID NO: 251583 - DNA, 75 bp, Artificial Sequence
  Synthetic
gtaactcaaagacatcatatatagaatggtaacgcgtcgttaactcgtcggttaactctttcttttgatcgagtt

SEQ ID NO: 251584 - DNA, 75 bp, Artificial Sequence
  Synthetic
acagtcaccgtgtaaacaatatccatctccctctggaccacataatctgatagctggaatatctgttgtagcgtt

SEQ ID NO: 251585 - DNA, 75 bp, Artificial Sequence
  Synthetic
ggataacacggtattgatggtatctgttaccataattcctttgactgatagtgtcaaagtacaagatttccaatc

SEQ ID NO: 251586 - DNA, 75 bp, Artificial Sequence
  Synthetic
gttaccataattcctttgactgatagtgtcaaagtacaagatttccaatcttttgcaattttcagtaccattatc

SEQ ID NO: 251587 - DNA, 75 bp, Artificial Sequence
  Synthetic
atctgattatcatagcagcgaacaacaacatcagatattttatcgacatttttaatggattttgtgtttatgaca

SEQ ID NO: 251588 - DNA, 75 bp, Artificial Sequence
  Synthetic
tctccctctggaccacataatctgatagctggaatatctgttgtagcgtttgtaatttctggcgatgttgtttcg

SEQ ID NO: 251589 - DNA, 75 bp, Artificial Sequence
  Synthetic
caacatcagatattttatcgacatttttaatggattttgtgtttatgacaagattgggaattttatattattaat

SEQ ID NO: 251590 - DNA, 75 bp, Artificial Sequence
  Synthetic
gcatggtacgtctgacaacacagggattaagacggaaagatgaaatgattctctcaacatcttcaatagatacct

SEQ ID NO: 251591 - DNA, 75 bp, Artificial Sequence
  Synthetic
attaagacggaaagatgaaatgattctctcaacatcttcaatagataccttgctattttttttggcattatctat

SEQ ID NO: 251592 - DNA, 75 bp, Artificial Sequence
  Synthetic
tgttaattgtgtaaataatataaaaataacaatacaatattgaatgtgttttacgctgtaatagataatactata

SEQ ID NO: 251593 - DNA, 75 bp, Artificial Sequence
  Synthetic
ataacaatacaatattgaatgtgttttacgctgtaatagataatactatagatttagaatttctaacgttgcaca

SEQ ID NO: 251594 - DNA, 75 bp, Artificial Sequence
  Synthetic
tcagtatcctttttgatgatagtggatctcaatgacatgggacgtctaaaccttcttattctatcaccagattgc

SEQ ID NO: 251595 - DNA, 75 bp, Artificial Sequence
  Synthetic
atctcaatgacatgggacgtctaaaccttcttattctatcaccagattgcatggtgatttgtcttctttctttta

SEQ ID NO: 251596 - DNA, 75 bp, Artificial Sequence
  Synthetic
acaattgatatctaaaaatactaagaccgtgaacattaaacgtataacagaggtatattattactcagatcatct

SEQ ID NO: 251597 - DNA, 75 bp, Artificial Sequence
  Synthetic
accgtgaacattaaacgtataacagaggtatattattactcagatcatctgttaaagccgttaattgcttatgta

SEQ ID NO: 251598 - DNA, 75 bp, Artificial Sequence
  Synthetic
ggcaaattgtctatatctaaaatcataatatgagatgtttacctctacaaatatctgttcgtccaatgttagagt

SEQ ID NO: 251599 - DNA, 75 bp, Artificial Sequence
  Synthetic
taatatgagatgtttacctctacaaatatctgttcgtccaatgttagagtatctatatcagttttgtattccaaa

SEQ ID NO: 251600 - DNA, 75 bp, Artificial Sequence
  Synthetic
gtaaaaaagttgcgtcacacgattgtttattctattgatctaacgctgtatgacgaagttacaaatatacatggc

SEQ ID NO: 251601 - DNA, 75 bp, Artificial Sequence
  Synthetic
tttattctattgatctaacgctgtatgacgaagttacaaatatacatggctagtatgctcgaacatggatcctga

SEQ ID NO: 251602 - DNA, 75 bp, Artificial Sequence
  Synthetic
tatattcctctattaagtcctcgtcgataataacagaatgtagataatcatttaatccatcgtacatggttggaa

SEQ ID NO: 251603 - DNA, 75 bp, Artificial Sequence
  Synthetic
gataataacagaatgtagataatcatttaatccatcgtacatggttggaagatgctcgttgacaaaatctttaat

SEQ ID NO: 251604 - DNA, 75 bp, Artificial Sequence
  Synthetic
ttgtttagattttgacaataacgtatatactgtaaaagacaaaaactacacaaatgctgttatcgaatatccagt

SEQ ID NO: 251605 - DNA, 75 bp, Artificial Sequence
  Synthetic
tatactgtaaaagacaaaaactacacaaatgctgttatcgaatatccagttgtttgtaattttagaagatatagt

SEQ ID NO: 251606 - DNA, 75 bp, Artificial Sequence
  Synthetic
ctaacatcttgattaataaaatttataacattgtccataggatactttgtaactagttttatacacatctcttca

SEQ ID NO: 251607 - DNA, 75 bp, Artificial Sequence
  Synthetic
gggcagaactacacaaacgcaataatgatagcgacagtgatgattatacataatgataatttttattatggtatt

SEQ ID NO: 251608 - DNA, 75 bp, Artificial Sequence
  Synthetic
tgatagcgacagtgatgattatacataatgataatttttattatggtattagaaaatatgataaaaaactattaa

SEQ ID NO: 251609 - DNA, 75 bp, Artificial Sequence
  Synthetic
gaacaggtggtatattatattcatcagatatacgaagaataatgtccaaatctatattgtttaatatattatata

SEQ ID NO: 251610 - DNA, 75 bp, Artificial Sequence
  Synthetic
agatatacgaagaataatgtccaaatctatattgtttaatatattatatagatgtagtgtagctcctacaggaat

SEQ ID NO: 251611 - DNA, 75 bp, Artificial Sequence
  Synthetic
tctatattgtttaatatattatatagatgtagtgtagctcctacaggaatatctttaactaagtcaatgatttca

SEQ ID NO: 251612 - DNA, 75 bp, Artificial Sequence
  Synthetic
tgcccttccttaccatgaactcattaatcgaaaattctgtactccacgtcagaaaactattatatatgatacatt

SEQ ID NO: 251613 - DNA, 75 bp, Artificial Sequence
  Synthetic
aatcgaaaattctgtactccacgtcagaaaactattatatatgatacattttaacgatatagaccatgcaccaac

SEQ ID NO: 251614 - DNA, 75 bp, Artificial Sequence
  Synthetic
taatcatataggcattgatttttaaaaggtatgtagccttgactacattctcattaattaaccattccaagtcac

SEQ ID NO: 251615 - DNA, 75 bp, Artificial Sequence
  Synthetic
aaggtatgtagccttgactacattctcattaattaaccattccaagtcactgtgtgtaagaagattatattctat

SEQ ID NO: 251616 - DNA, 75 bp, Artificial Sequence
  Synthetic
gatcagtatttaaaaaaataatctaattctggaaagaaaatactatgatattgtctataaacttattaacagtac

SEQ ID NO: 251617 - DNA, 75 bp, Artificial Sequence
  Synthetic
attctggaaagaaaatactatgatattgtctataaacttattaacagtaccatttagccacactattaactatga

SEQ ID NO: 251618 - DNA, 75 bp, Artificial Sequence
  Synthetic
gataccattaaagaattcttatgatataaggaaacagcttttaggtactcatctactctacaagaattttggaga

SEQ ID NO: 251619 - DNA, 75 bp, Artificial Sequence
  Synthetic
ataaggaaacagcttttaggtactcatctactctacaagaattttggagagccttaacgatatcagtgacgttta

SEQ ID NO: 251620 - DNA, 75 bp, Artificial Sequence
  Synthetic
aagtatttattagaagttactactcgatttcatcgtcattaccataactagtttaagtcttaaaaaagaaatcat

SEQ ID NO: 251621 - DNA, 75 bp, Artificial Sequence
  Synthetic
tagccaaattattaaagatattactacagaactaattaataatgagaatgttgttataaacgtagatgatttgtg

SEQ ID NO: 251622 - DNA, 75 bp, Artificial Sequence
  Synthetic
attgagaatatctgaattaatagcttccagatacagtgattttggcaatagtccgtgtaatccataatccagtaa

SEQ ID NO: 251623 - DNA, 75 bp, Artificial Sequence
  Synthetic
tttcctccctcttcttctacctttcccagaaacaaacttttttacccactataaaataaaatgagtatactacct

SEQ ID NO: 251624 - DNA, 75 bp, Artificial Sequence
  Synthetic
tccagatacagtgattttggcaatagtccgtgtaatccataatccagtaacacgagctggtgcttgctagacacc

SEQ ID NO: 251625 - DNA, 75 bp, Artificial Sequence
  Synthetic
acagaactaattaataatgagaatgttgttataaacgtagatgatttgtgtttaatagactatgataataatgat

SEQ ID NO: 251626 - DNA, 75 bp, Artificial Sequence
  Synthetic
taagctttgataaagccttcctcgcaaattccggatacatgaacatgtcgccaacatgattaagtattgtttttc

SEQ ID NO: 251627 - DNA, 75 bp, Artificial Sequence
  Synthetic
aaattccggatacatgaacatgtcgccaacatgattaagtattgtttttcattatttttatattttctcaacaag

SEQ ID NO: 251628 - DNA, 75 bp, Artificial Sequence
  Synthetic
aatatcacccaatgcgtccatgttgtctatttccaacaggtcgctatatccaccaatagaagttttcccaaaaaa

SEQ ID NO: 251629 - DNA, 75 bp, Artificial Sequence
  Synthetic
tctatttccaacaggtcgctatatccaccaatagaagttttcccaaaaaagattctaggaacagttctaccacca

SEQ ID NO: 251630 - DNA, 75 bp, Artificial Sequence
  Synthetic
attcattttcgggtttaaattctttaatatctacaatttcatacgctcctcttttgaaactaaacttatttagaa

SEQ ID NO: 251631 - DNA, 75 bp, Artificial Sequence
  Synthetic
aatatctacaatttcatacgctcctcttttgaaactaaacttatttagaatatccagtgcgtttctacaaaaagg

SEQ ID NO: 251632 - DNA, 75 bp, Artificial Sequence
  Synthetic
acaaatagtaaatgagagatctactggtaaaatggtatgtcccaatattaatgcatttatttctagtaacgtaaa

SEQ ID NO: 251633 - DNA, 75 bp, Artificial Sequence
  Synthetic
atatacataagttaatagttttttatcatattttctaataccataataaaaattatcattattgcgtttggtagt

SEQ ID NO: 251634 - DNA, 75 bp, Artificial Sequence
  Synthetic
actttgttattggccaacctttgttgtacaaattcctcggccatttttaatatttaagtgatacaaaactatctc

SEQ ID NO: 251635 - DNA, 75 bp, Artificial Sequence
  Synthetic
gtacaaattcctcggccatttttaatatttaagtgatacaaaactatctcgacttatttaactctttagtcgaga

SEQ ID NO: 251636 - DNA, 75 bp, Artificial Sequence
  Synthetic
taaccaactacagaagacaaacgctataaaaaacataattacaacgagcatatttataaatatttttattcagta

SEQ ID NO: 251637 - DNA, 75 bp, Artificial Sequence
  Synthetic
ataaaaaacataattacaacgagcatatttataaatatttttattcagtattacttgatatagtaatattaggca

SEQ ID NO: 251638 - DNA, 75 bp, Artificial Sequence
  Synthetic
tacattaactctctcattttctttaacaaattctgcaatatcttcgtaaaaagattcttgaaactttttagaata

SEQ ID NO: 251639 - DNA, 75 bp, Artificial Sequence
  Synthetic
acaaattctgcaatatcttcgtaaaaagattcttgaaactttttagaatatctatcgactctagatgaaatagcg

SEQ ID NO: 251640 - DNA, 75 bp, Artificial Sequence
  Synthetic
acataaaggcgcccattttaacagtttctagtgacaaaatgctagcgatcctaggatcctttagaatcacataga

SEQ ID NO: 251641 - DNA, 75 bp, Artificial Sequence
  Synthetic
ttctagtgacaaaatgctagcgatcctaggatcctttagaatcacatagattgacgattcgtctctcttagtaac

SEQ ID NO: 251642 - DNA, 75 bp, Artificial Sequence
  Synthetic
gtacgcgaaataatattatccttgacttgaggagatctaaacaatctagttttgagaacatcgataagttcatcg

SEQ ID NO: 251643 - DNA, 75 bp, Artificial Sequence
  Synthetic
cttgaggagatctaaacaatctagttttgagaacatcgataagttcatcgggaatgacatacatactatctttaa

SEQ ID NO: 251644 - DNA, 75 bp, Artificial Sequence
  Synthetic
ggattcgtccttaaccaactgattaatgagatcttctattttatcattttccagatgatatgtatgtccattaaa

SEQ ID NO: 251645 - DNA, 75 bp, Artificial Sequence
  Synthetic
atgagatcttctattttatcattttccagatgatatgtatgtccattaaagttaaattgtgtagcgcttcttttt

SEQ ID NO: 251646 - DNA, 75 bp, Artificial Sequence
  Synthetic
cactaatatcgatatacaaaggagatgatttatcgatggtattaagaattcgtttttcgacatccgtcaaaacca

SEQ ID NO: 251647 - DNA, 75 bp, Artificial Sequence
  Synthetic
tgatttatcgatggtattaagaattcgtttttcgacatccgtcaaaaccaattcctttttgcctgtatcatccag

SEQ ID NO: 251648 - DNA, 75 bp, Artificial Sequence
  Synthetic
ttttctactagactattaataagactgataaggattcctccataattgcacaatccaaactttttcacaaaacta

SEQ ID NO: 251649 - DNA, 75 bp, Artificial Sequence
  Synthetic
tgataaggattcctccataattgcacaatccaaactttttcacaaaactagactttacgagatctacaggaatgc

SEQ ID NO: 251650 - DNA, 75 bp, Artificial Sequence
  Synthetic
ttttttcttttgcggacattttctagtgaccaactcatctaccatttcattgattttagcagtgaaataagcttt

SEQ ID NO: 251651 - DNA, 75 bp, Artificial Sequence
  Synthetic
gtgaccaactcatctaccatttcattgattttagcagtgaaataagctttcaatgcacgggcactgatactattg

SEQ ID NO: 251652 - DNA, 75 bp, Artificial Sequence
  Synthetic
ccatttaagttcaccaaacaacttttaaatacaaatatatcaatagtagtagaataagaactataaaaaaaataa

SEQ ID NO: 251653 - DNA, 75 bp, Artificial Sequence
  Synthetic
taaatacaaatatatcaatagtagtagaataagaactataaaaaaaataataattaaccaataccaaccccaaca

SEQ ID NO: 251654 - DNA, 75 bp, Artificial Sequence
  Synthetic
gttttctcatcacttagaacagatttaacaatttctataaagtctgtcaaatcatcttcctgagaacccataaat

SEQ ID NO: 251655 - DNA, 75 bp, Artificial Sequence
  Synthetic
taacaatttctataaagtctgtcaaatcatcttcctgagaacccataaatacaccaaatatagcagcgtacaact

SEQ ID NO: 251656 - DNA, 75 bp, Artificial Sequence
  Synthetic
cttttctttatcgctatcttcatcatattcatcatcaatatcgacaagtcccagattacgaaccagatcttcttc

SEQ ID NO: 251657 - DNA, 75 bp, Artificial Sequence
  Synthetic
tattcatcatcaatatcgacaagtcccagattacgaaccagatcttcttctacattttcagtcattgatacgcgt

SEQ ID NO: 251658 - DNA, 75 bp, Artificial Sequence
  Synthetic
cgttagccaccacttctctatcaatgattagtttcttgagcgcgaatgtaatttttgtttccgttccggatctat

SEQ ID NO: 251659 - DNA, 75 bp, Artificial Sequence
  Synthetic
gattagtttcttgagcgcgaatgtaatttttgtttccgttccggatctatagaaaactacaggtgtgataattgc

SEQ ID NO: 251660 - DNA, 75 bp, Artificial Sequence
  Synthetic
ctgagtgattctagttcaccttctatagatctgagaatggatgattctccagtcgaaacatattctaccatggct

SEQ ID NO: 251661 - DNA, 75 bp, Artificial Sequence
  Synthetic
tagatctgagaatggatgattctccagtcgaaacatattctaccatggctccgtttaatttgttgatgaagatgg

SEQ ID NO: 251662 - DNA, 75 bp, Artificial Sequence
  Synthetic
aatagtttccgccgaaagactatgcaaagaatttggaatgcgttccttgtgcgtaatgtttccatagacagcttc

SEQ ID NO: 251663 - DNA, 75 bp, Artificial Sequence
  Synthetic
aaagaatttggaatgcgttccttgtgcgtaatgtttccatagacagcttctagaagttgatacaacataggacta

SEQ ID NO: 251664 - DNA, 75 bp, Artificial Sequence
  Synthetic
agtatccatcgcttctatcttgtttagatttatttttataaagtttagtctctccttccaacataataaaagtgg

SEQ ID NO: 251665 - DNA, 75 bp, Artificial Sequence
  Synthetic
agatttatttttataaagtttagtctctccttccaacataataaaagtggaagtcatctgactagataaactatc

SEQ ID NO: 251666 - DNA, 75 bp, Artificial Sequence
  Synthetic
tggaatcataaaaaaagttttactaatttaaaatttaaaaagtatttacatttttcactgtttagtcgcggatat

SEQ ID NO: 251667 - DNA, 75 bp, Artificial Sequence
  Synthetic
caattagcgtattgagaagcatttagtgtaacgtattcgatacattttgcattagatttactaatcgattttgca

SEQ ID NO: 251668 - DNA, 75 bp, Artificial Sequence
  Synthetic
gtgtaacgtattcgatacattttgcattagatttactaatcgattttgcatactctataacacccgcacaagtct

SEQ ID NO: 251669 - DNA, 75 bp, Artificial Sequence
  Synthetic
tcttggtgaagtttcaactctcttcttgattaccttactcatgattaaacctaaataattgtactttgcaatata

SEQ ID NO: 251670 - DNA, 75 bp, Artificial Sequence
  Synthetic
ttactaggattagagaagataaaacgtggaaagaatctactcatctaaacgatttagtaaacttgactaaatctt

SEQ ID NO: 251671 - DNA, 75 bp, Artificial Sequence
  Synthetic
acgtagatagtacattcccgtttttagaccgagactccatccgtaaaaatgcatactcgttagtttggaataact

SEQ ID NO: 251672 - DNA, 75 bp, Artificial Sequence
  Synthetic
agaccgagactccatccgtaaaaatgcatactcgttagtttggaataactcggatctgctatatggatattcata

SEQ ID NO: 251673 - DNA, 75 bp, Artificial Sequence
  Synthetic
ccctgtctgcagccatttttatgatcgtcttttgtggaatttcccaaatagttttataaactcgcttaatatctt

SEQ ID NO: 251674 - DNA, 75 bp, Artificial Sequence
  Synthetic
cgtcttttgtggaatttcccaaatagttttataaactcgcttaatatcttctggaaggtttgtattctgaatgga

SEQ ID NO: 251675 - DNA, 75 bp, Artificial Sequence
  Synthetic
ttgatctcatcattccataattttctctcggttaaaactctaaggagatgcgggttaactacttggaattctcca

SEQ ID NO: 251676 - DNA, 75 bp, Artificial Sequence
  Synthetic
tctcggttaaaactctaaggagatgcgggttaactacttggaattctccagacaatactctccgagtgtaaatat

SEQ ID NO: 251677 - DNA, 75 bp, Artificial Sequence
  Synthetic
attatttcccaaaatttgagcagttgatgcagtcggcataggtgccaccaataaactatttctaagaccgtatgt

SEQ ID NO: 251678 - DNA, 75 bp, Artificial Sequence
  Synthetic
gatgcagtcggcataggtgccaccaataaactatttctaagaccgtatgttctgattttatcttttagatgttcc

SEQ ID NO: 251679 - DNA, 75 bp, Artificial Sequence
  Synthetic
cattccaaagatcatattgtagaataccgttactggcgtacgatcctacatatgtatcatatggtccttccttct

SEQ ID NO: 251680 - DNA, 75 bp, Artificial Sequence
  Synthetic
accgttactggcgtacgatcctacatatgtatcatatggtccttccttctcagctagtttacaactcgcctctaa

SEQ ID NO: 251681 - DNA, 75 bp, Artificial Sequence
  Synthetic
atcttcttatttagatcttgtgcttccgggctatcaaatggataatttaagagaataaacgcgtccgctaatcct

SEQ ID NO: 251682 - DNA, 75 bp, Artificial Sequence
  Synthetic
ccgggctatcaaatggataatttaagagaataaacgcgtccgctaatccttgaacaccaataccgataggtctat

SEQ ID NO: 251683 - DNA, 75 bp, Artificial Sequence
  Synthetic
tggaataggataataattaatatctataattttattgagatttctgacaattactttgaccacatccttcagttt

SEQ ID NO: 251684 - DNA, 75 bp, Artificial Sequence
  Synthetic
ataattttattgagatttctgacaattactttgaccacatccttcagtttgagaaaatcaaatcgcccatctatt

SEQ ID NO: 251685 - DNA, 75 bp, Artificial Sequence
  Synthetic
ccagattacacacggctacctcattagcatccgcatattgtattatctcagtgcaaagattactacacttgatag

SEQ ID NO: 251686 - DNA, 75 bp, Artificial Sequence
  Synthetic
agcatccgcatattgtattatctcagtgcaaagattactacacttgatagttcctaaattttgttgattactctt

SEQ ID NO: 251687 - DNA, 75 bp, Artificial Sequence
  Synthetic
atgaatggagtaccagtttcaatctgagattctataatcgctttccagacgactcgagcctttattatagatttg

SEQ ID NO: 251688 - DNA, 75 bp, Artificial Sequence
  Synthetic
gagattctataatcgctttccagacgactcgagcctttattatagatttgtatctcctttctctttcgtatagtg

SEQ ID NO: 251689 - DNA, 75 bp, Artificial Sequence
  Synthetic
ccaaacattgtccaatccaggacattcatccggacacatcaacgaccactctccgtcatccttcactcgtttcat

SEQ ID NO: 251690 - DNA, 75 bp, Artificial Sequence
  Synthetic
tcatccggacacatcaacgaccactctccgtcatccttcactcgtttcataaagagatcaggaatccaaagagct

SEQ ID NO: 251691 - DNA, 75 bp, Artificial Sequence
  Synthetic
cctcgtttcctgtattctttttaagatcgaggaacgccataatatcagaatgccacggttccaagtatatggcca

SEQ ID NO: 251692 - DNA, 75 bp, Artificial Sequence
  Synthetic
ctgatctatgtatctagcggtgttattataaactctcaacattggaataataccgtttgatataccattggtacc

SEQ ID NO: 251693 - DNA, 75 bp, Artificial Sequence
  Synthetic
ttataaactctcaacattggaataataccgtttgatataccattggtaccggagatatagcttccactggcacga

SEQ ID NO: 251694 - DNA, 75 bp, Artificial Sequence
  Synthetic
taccgtttgatataccattggtaccggagatatagcttccactggcacgaatattactaattgatagacctattc

SEQ ID NO: 251695 - DNA, 75 bp, Artificial Sequence
  Synthetic
gcatcgttttaacgtgtcatagatgccttctatgctatcatcgatcatgttaagtagaaaacagctagacatttg

SEQ ID NO: 251696 - DNA, 75 bp, Artificial Sequence
  Synthetic
ccttctatgctatcatcgatcatgttaagtagaaaacagctagacatttggtgacgagtagttcccgcattaaat

SEQ ID NO: 251697 - DNA, 75 bp, Artificial Sequence
  Synthetic
atttttcagaaagtagattgtacgtctcaatagctgagtctatatcccattgatgaattcctactgcgacacgca

SEQ ID NO: 251698 - DNA, 75 bp, Artificial Sequence
  Synthetic
ctcaatagctgagtctatatcccattgatgaattcctactgcgacacgcattaacatgtgctgaggtctttcaac

SEQ ID NO: 251699 - DNA, 75 bp, Artificial Sequence
  Synthetic
taggatttttccaaagttttaaaaccaaaatagttgtatgaaaagtctcgttcgtaaataataaccgaattgagc

SEQ ID NO: 251700 - DNA, 75 bp, Artificial Sequence
  Synthetic
caaaatagttgtatgaaaagtctcgttcgtaaataataaccgaattgagcttatccttatatttgttaactatat

SEQ ID NO: 251701 - DNA, 75 bp, Artificial Sequence
  Synthetic
agaatgtttcccatttttaggattaacatagttgaataaatcctccatcacttcactaaatagtttttttgtttc

SEQ ID NO: 251702 - DNA, 75 bp, Artificial Sequence
  Synthetic
acatagttgaataaatcctccatcacttcactaaatagtttttttgtttccttgtgtagatttgatatggctatt

SEQ ID NO: 251703 - DNA, 75 bp, Artificial Sequence
  Synthetic
gatgttgtgtagtacaagtggctgctatttcggctgccagagtgtccaattctaccgttgttactccattatata

SEQ ID NO: 251704 - DNA, 75 bp, Artificial Sequence
  Synthetic
tatttcggctgccagagtgtccaattctaccgttgttactccattatatattccttgaataaccttcatagctat

SEQ ID NO: 251705 - DNA, 75 bp, Artificial Sequence
  Synthetic
tttaagccatagcacaattttctaatacgagacgtgattttatcaaacatgacattttccttgtatccatttcgt

SEQ ID NO: 251706 - DNA, 75 bp, Artificial Sequence
  Synthetic
tacgagacgtgattttatcaaacatgacattttccttgtatccatttcgtttaatgacaaacatttttgttggtg

SEQ ID NO: 251707 - DNA, 75 bp, Artificial Sequence
  Synthetic
tcattaatagggatttgacgtatgtagcgtacaaaattatcgttcctggtatatagataaagagtcctatatatt

SEQ ID NO: 251708 - DNA, 75 bp, Artificial Sequence
  Synthetic
agcgtacaaaattatcgttcctggtatatagataaagagtcctatatatttgaaaatcgttacggttcgattaaa

SEQ ID NO: 251709 - DNA, 75 bp, Artificial Sequence
  Synthetic
atggtagcaatatgctaattctgaacccgacacaatcagacgctggtatttatgtatgcattaccacgaacgaaa

SEQ ID NO: 251710 - DNA, 75 bp, Artificial Sequence
  Synthetic
tcattaggatttaactccttgactatcatggcggtgccagaaattaccatcaaaagcattaatacagttatacag

SEQ ID NO: 251711 - DNA, 75 bp, Artificial Sequence
  Synthetic
tcatggcggtgccagaaattaccatcaaaagcattaatacagttatacagatcgcagttagaacggttatagcat

SEQ ID NO: 251712 - DNA, 75 bp, Artificial Sequence
  Synthetic
tcaaagaatatgtgacaacgtcctagttgtatactgagaattgacgaaacaatgtttcttacatatttttttctt

SEQ ID NO: 251713 - DNA, 75 bp, Artificial Sequence
  Synthetic
gttgtatactgagaattgacgaaacaatgtttcttacatatttttttcttattagtaaccgacttaatagtagga

SEQ ID NO: 251714 - DNA, 75 bp, Artificial Sequence
  Synthetic
tataagtatagatacccttccaaataatgttctctttgataaaagttccagaaaatgtagaattttttaaaaagt

SEQ ID NO: 251715 - DNA, 75 bp, Artificial Sequence
  Synthetic
aatgttctctttgataaaagttccagaaaatgtagaattttttaaaaagttatcttttgctattactaatatcgt

SEQ ID NO: 251716 - DNA, 75 bp, Artificial Sequence
  Synthetic
agtatcgttgagacttcccacaacggacaccgacgtcttttggataagtaatggtatgtattacgaagaagaaga

SEQ ID NO: 251717 - DNA, 75 bp, Artificial Sequence
  Synthetic
gtgatgaaatccacaccgcttctagatatcgcttttatttccacattagatggtaaatccaatagtgaaactatc

SEQ ID NO: 251718 - DNA, 75 bp, Artificial Sequence
  Synthetic
tggtaaatccaatagtgaaactatctttttaggaatgtatggacttgcgtttagaggagtgaacgtcttcggagt

SEQ ID NO: 251719 - DNA, 75 bp, Artificial Sequence
  Synthetic
agtaaaggatgattcgtcaaatgaataaacaatttcacaaatggatgttaatgtattagtaggaaattttttgac

SEQ ID NO: 251720 - DNA, 75 bp, Artificial Sequence
  Synthetic
taaacaatttcacaaatggatgttaatgtattagtaggaaattttttgacgctagtggaattgaagattctaatg

SEQ ID NO: 251721 - DNA, 75 bp, Artificial Sequence
  Synthetic
ataacatgttaatttccaacaccaacggttttaatatttcgatgatatacggtagtctctctttcggacttatat

SEQ ID NO: 251722 - DNA, 75 bp, Artificial Sequence
  Synthetic
cggttttaatatttcgatgatatacggtagtctctctttcggacttatatagcttattccacaatacgagtcatt

SEQ ID NO: 251723 - DNA, 75 bp, Artificial Sequence
  Synthetic
caagtacacagacctccgccacttcctcctaaaccagtccaaaatccgccacaacttccccctagaccagtaggt

SEQ ID NO: 251724 - DNA, 75 bp, Artificial Sequence
  Synthetic
agtataaaatctgtatcgaatgggaaaaacgaaattatcgatataggtatagaatccggaacattgaacgtatta

SEQ ID NO: 251725 - DNA, 75 bp, Artificial Sequence
  Synthetic
aaaacgaaattatcgatataggtatagaatccggaacattgaacgtattaatacttaattctttttcagtggtaa

SEQ ID NO: 251726 - DNA, 75 bp, Artificial Sequence
  Synthetic
tggttttaaatattctataacttgagacttgatagatattaatgacgaattgaaaattatttttatcaccacgtg

SEQ ID NO: 251727 - DNA, 75 bp, Artificial Sequence
  Synthetic
gacttgatagatattaatgacgaattgaaaattatttttatcaccacgtgtgtttcaggatcatcgtcgacgcca

SEQ ID NO: 251728 - DNA, 75 bp, Artificial Sequence
  Synthetic
gagtatgaatacggagtacaaacataaactgaagtttaacattatatacattatatacattatatacattatata

SEQ ID NO: 251729 - DNA, 75 bp, Artificial Sequence
  Synthetic
aaatatcattaatatatgctctagatattagtatttttattaatcctttgattatcatcttctcgtacgcgaatg

SEQ ID NO: 251730 - DNA, 75 bp, Artificial Sequence
  Synthetic
tattagtatttttattaatcctttgattatcatcttctcgtacgcgaatgattccatgatcaagagtgatttgag

SEQ ID NO: 251731 - DNA, 75 bp, Artificial Sequence
  Synthetic
ttagtaaacagtccatcgttgcaataataaaagttgtccaagttaaaggatattatgcattcgtttaaagatatc

SEQ ID NO: 251732 - DNA, 75 bp, Artificial Sequence
  Synthetic
aataaaagttgtccaagttaaaggatattatgcattcgtttaaagatatcacctcatctaacggagacaattttt

SEQ ID NO: 251733 - DNA, 75 bp, Artificial Sequence
  Synthetic
tacttgtttaacaaagttattcatcgtcgtctactattctatttaattttgtagttaatttatcacatatcacat

SEQ ID NO: 251734 - DNA, 75 bp, Artificial Sequence; identical to SEQ ID NO: 46911
  Synthetic

SEQ ID NO: 251735 - DNA, 75 bp, Artificial Sequence
  Synthetic
gcgttatccgtttccgttatatacagggatagatcttgcaagttaaatagaatgctcttaaataatgtcattttt

SEQ ID NO: 251736 - DNA, 75 bp, Artificial Sequence
  Synthetic
gggatagatcttgcaagttaaatagaatgctcttaaataatgtcatttttttatccgctaaaaatttaaagaatg

SEQ ID NO: 251737 - DNA, 75 bp, Artificial Sequence
  Synthetic
acttttaggtggagttctggtacacaatatcataaacaaactaataaacatcccacattcagattccaacaattg

SEQ ID NO: 251738 - DNA, 75 bp, Artificial Sequence
  Synthetic
aatatcataaacaaactaataaacatcccacattcagattccaacaattgattaacttccacattaatacagcct

SEQ ID NO: 251739 - DNA, 75 bp, Artificial Sequence
  Synthetic
aaaatctgaataaaacatcaatatcgcaatttgtattatccaatacagaatgtctgtgattcgtgttaaaaccat

SEQ ID NO: 251740 - DNA, 75 bp, Artificial Sequence
  Synthetic
gcaatttgtattatccaatacagaatgtctgtgattcgtgttaaaaccatcggaaaaagaatagaaataaaaatt

SEQ ID NO: 251741 - DNA, 75 bp, Artificial Sequence; identical to SEQ ID NO: 46920
  Synthetic

SEQ ID NO: 251742 - DNA, 75 bp, Artificial Sequence
  Synthetic
atactaaacattgttttttatcataaattacacatttccaatgagacaaataacaaaatccaaacattacaaatc

SEQ ID NO: 251743 - DNA, 75 bp, Artificial Sequence
  Synthetic
tttaagtatatacgataagatatgtttattcataaacgcgtcaaatttttcatgaatagctaaggagtttaagaa

SEQ ID NO: 251744 - DNA, 75 bp, Artificial Sequence
  Synthetic
ttattcataaacgcgtcaaatttttcatgaatagctaaggagtttaagaatctcatgtcaaattgtcctatataa

SEQ ID NO: 251745 - DNA, 75 bp, Artificial Sequence
  Synthetic
gagagactaagttcttaatacttcgattgctcatccaggctcctctctcaggctctattttcatcttgacgacct

SEQ ID NO: 251746 - DNA, 75 bp, Artificial Sequence
  Synthetic
attgctcatccaggctcctctctcaggctctattttcatcttgacgacctttggattttcaccagtatgtattcc

SEQ ID NO: 251747 - DNA, 75 bp, Artificial Sequence
  Synthetic
aaatccatttgtgagaagtctatcgccttagatactttttcccgtagttgaggtttaaagaaatacgctaacggt

SEQ ID NO: 251748 - DNA, 75 bp, Artificial Sequence
  Synthetic
tagttccaacatcataccgataggaatacaagacactttgccagcggttgtagatttatcatatttctccaccac

SEQ ID NO: 251749 - DNA, 75 bp, Artificial Sequence
  Synthetic
atacaagacactttgccagcggttgtagatttatcatatttctccaccacatatccgttacaatttgttaagaat

SEQ ID NO: 251750 - DNA, 75 bp, Artificial Sequence
  Synthetic
ctaacttatgacttaactaacttatgactattaactcatttcaagaaaggtgggtggagagaactctatatgaca

SEQ ID NO: 251751 - DNA, 75 bp, Artificial Sequence
  Synthetic
atccagctagtgaatatatatgacataataaattggtaaatcctagttctggtattttactaattactaaatctg

SEQ ID NO: 251752 - DNA, 75 bp, Artificial Sequence
  Synthetic
taataaattggtaaatcctagttctggtattttactaattactaaatctgtatatctttccatttatcatggaaa

SEQ ID NO: 251753 - DNA, 75 bp, Artificial Sequence
  Synthetic
tccaaactgcgttaatgtattctcttacaaatattcacaagatgaattcagtaatatgagtaaaacggaacgtga

SEQ ID NO: 251754 - DNA, 75 bp, Artificial Sequence
  Synthetic
tacaaatattcacaagatgaattcagtaatatgagtaaaacggaacgtgataatttctcattggctgtgtttcca

SEQ ID NO: 251755 - DNA, 75 bp, Artificial Sequence
  Synthetic
cacacgttgtaaaacataaaggaatatacaaagttagtacagaagcacgtggaaaaaaagtatctcctccatcac

SEQ ID NO: 251756 - DNA, 75 bp, Artificial Sequence
  Synthetic
atacaaagttagtacagaagcacgtggaaaaaaagtatctcctccatcactaggaaaacccgcacatataaacct

SEQ ID NO: 251757 - DNA, 75 bp, Artificial Sequence
  Synthetic
gagtatgcaataagctttgaatgttatagttttctaaaatgtataacaaatacagaaatcaattcgttcgatgag

SEQ ID NO: 251758 - DNA, 75 bp, Artificial Sequence
  Synthetic
atagttttctaaaatgtataacaaatacagaaatcaattcgttcgatgagtatatattaagaggactattagaag

SEQ ID NO: 251759 - DNA, 75 bp, Artificial Sequence
  Synthetic
caattccgtaggtaaacgaatagatactataggtgtactagggaataagtatccatttagcaaaattccattggc

SEQ ID NO: 251760 - DNA, 75 bp, Artificial Sequence
  Synthetic
actataggtgtactagggaataagtatccatttagcaaaattccattggcctcattaactcctaaagcacaacga

SEQ ID NO: 251761 - DNA, 75 bp, Artificial Sequence
  Synthetic
atagacctgtagttttaactggaggaaccggagtgggtaagacgtcacaggtacccaagttattgctttggttta

SEQ ID NO: 251762 - DNA, 75 bp, Artificial Sequence
  Synthetic
aaccggagtgggtaagacgtcacaggtacccaagttattgctttggtttaattatttatttggtggattctctac

SEQ ID NO: 251763 - DNA, 75 bp, Artificial Sequence
  Synthetic
gaaagaccagtcattctatctcttcctaggatagctttagttagattgcatagcaataccattttaaaatcattg

SEQ ID NO: 251764 - DNA, 75 bp, Artificial Sequence
  Synthetic
ctaggatagctttagttagattgcatagcaataccattttaaaatcattgggatttaaggtactagatggatctc

SEQ ID NO: 251765 - DNA, 75 bp, Artificial Sequence
  Synthetic
accggaagaattaataaacaaacaaccaaaaaaatatggaattgtattttctacccataagttatctctaacaaa

SEQ ID NO: 251766 - DNA, 75 bp, Artificial Sequence
  Synthetic
ccaaaaaaatatggaattgtattttctacccataagttatctctaacaaaactatttagttatggcactattatt

SEQ ID NO: 251767 - DNA, 75 bp, Artificial Sequence
  Synthetic
aaataggagatattattatagcagtagcgagaaagcatcatacgaaaatagattctatgtttttaatgactgcca

SEQ ID NO: 251768 - DNA, 75 bp, Artificial Sequence
  Synthetic
agcgagaaagcatcatacgaaaatagattctatgtttttaatgactgccacgttagaggatgacagggaacgtct

SEQ ID NO: 251769 - DNA, 75 bp, Artificial Sequence
  Synthetic
tttatacatattcctggagatacactgtttaaaattagcgaggtatttattcataataagataaatccatcttcc

SEQ ID NO: 251770 - DNA, 75 bp, Artificial Sequence
  Synthetic
tgtttaaaattagcgaggtatttattcataataagataaatccatcttccagaatggcatatatagaagaagaaa

SEQ ID NO: 251771 - DNA, 75 bp, Artificial Sequence
  Synthetic
gatgtatactcctcctgatggatcatccggtatagtctttgtggcatccgttgcacagtgtcacgaatataaatc

SEQ ID NO: 251772 - DNA, 75 bp, Artificial Sequence
  Synthetic
tccggtatagtctttgtggcatccgttgcacagtgtcacgaatataaatcatatttagaaaaaagattaccgtat

SEQ ID NO: 251773 - DNA, 75 bp, Artificial Sequence
  Synthetic
tcttagatatagacgaaatattagaaaaagtgtattcatcacctaatgtatcgataattatttctactccttatt

SEQ ID NO: 251774 - DNA, 75 bp, Artificial Sequence
  Synthetic
ttttttcgatatctaagtactaagtttttttactgtttttgttactgtcttccattcttctaactaaagatctga

SEQ ID NO: 251775 - DNA, 75 bp, Artificial Sequence; identical to SEQ ID NO: 46953
  Synthetic

SEQ ID NO: 251776 - DNA, 75 bp, Artificial Sequence
  Synthetic
agagtttttgtccccgctccttttggaggatcacaacaatttatttctaaatctatgagagatcaacgaaaagga

SEQ ID NO: 251777 - DNA, 75 bp, Artificial Sequence
  Synthetic
gaggatcacaacaatttatttctaaatctatgagagatcaacgaaaaggaagagtaggaagagttaatcctggaa

SEQ ID NO: 251778 - DNA, 75 bp, Artificial Sequence
  Synthetic
actttccaacttatcattatcccaggctatgtttcgcccatcatcgttgcacagagtgaataattcttttgtatt

SEQ ID NO: 251779 - DNA, 75 bp, Artificial Sequence
  Synthetic
ttatatgaagtctatacagcgaatagattcagaatttctacataattatatattgtacgctaataagtttaatct

SEQ ID NO: 251780 - DNA, 75 bp, Artificial Sequence
  Synthetic
gattcagaatttctacataattatatattgtacgctaataagtttaatctaacactccccgaagatttgtttata

SEQ ID NO: 251781 - DNA, 75 bp, Artificial Sequence; identical to SEQ ID NO: 46958
  Synthetic

SEQ ID NO: 251782 - DNA, 75 bp, Artificial Sequence
  Synthetic
gttcgatattagtacagaaacatggaataaattattatccaattattatatgaagatgatagagtatgctaaact

SEQ ID NO: 251783 - DNA, 75 bp, Artificial Sequence
  Synthetic
gaggagttggataactttgagaggacgggagaattaactagtattgtacaagaagccattttatctctaaattta

SEQ ID NO: 251784 - DNA, 75 bp, Artificial Sequence
  Synthetic
cgggagaattaactagtattgtacaagaagccattttatctctaaatttacgaattaagattttaaaatttaaac

SEQ ID NO: 251785 - DNA, 75 bp, Artificial Sequence
  Synthetic
cttttgtagaatattattcggcgtctataacggaacaaacgctactatatattatcatagacctctaacgggata

SEQ ID NO: 251786 - DNA, 75 bp, Artificial Sequence
  Synthetic
attatcatagacctctaacgggatatatgaatatgatttcagatactatatttgttcctgtagataataactaaa

SEQ ID NO: 251787 - DNA, 75 bp, Artificial Sequence; identical to SEQ ID NO: 46967
  Synthetic

SEQ ID NO: 251788 - DNA, 75 bp, Artificial Sequence
  Synthetic
atctccttttgtagacacgactaaacattttgcagaaaaaagtttattattatttagataatcgtatacttcatc

SEQ ID NO: 251789 - DNA, 75 bp, Artificial Sequence; identical to SEQ ID NO: 46968
  Synthetic

SEQ ID NO: 251790 - DNA, 75 bp, Artificial Sequence; identical to SEQ ID NO: 46969
  Synthetic

SEQ ID NO: 251791 - DNA, 75 bp, Artificial Sequence
  Synthetic
tacaaaactagattttgcagtgatgtcgtacctggtattcctaccaaacaaaattttacttttagttcttttaga

SEQ ID NO: 251792 - DNA, 75 bp, Artificial Sequence; identical to SEQ ID NO: 46972
  Synthetic

SEQ ID NO: 251793 - DNA, 75 bp, Artificial Sequence
  Synthetic
cactagcaaaaaatgatagaaatatatattgatacatcgcagctggttttgatctactatactttaaaaacgaat

SEQ ID NO: 251794 - DNA, 75 bp, Artificial Sequence
  Synthetic
atattgatacatcgcagctggttttgatctactatactttaaaaacgaatcagattccataattgcctgtatatc

SEQ ID NO: 251795 - DNA, 75 bp, Artificial Sequence; identical to SEQ ID NO: 46975
  Synthetic

SEQ ID NO: 251796 - DNA, 75 bp, Artificial Sequence
  Synthetic
atgatatatcttgtttagacaatgataaagttatcatgtccatgagagacgcgtctccgtatcgtataaatattt

SEQ ID NO: 251797 - DNA, 75 bp, Artificial Sequence
  Synthetic
gggtatacttctataaggtttcttaattagtccatcattggttgcgtcaagaactactatctgatgttgttgggt

SEQ ID NO: 251798 - DNA, 75 bp, Artificial Sequence
  Synthetic
attagtccatcattggttgcgtcaagaactactatctgatgttgttgggtatctctagtgttacacatggcctta

SEQ ID NO: 251799 - DNA, 75 bp, Artificial Sequence
  Synthetic
ccccattgatagaaaatatcacgctttccattttcttgaagtactaaaagtaattataatataatgtaaaggttt

SEQ ID NO: 251800 - DNA, 75 bp, Artificial Sequence
  Synthetic
tatctctattaattatagatgcatatatttcattcgtcaaggatattaatatcgacttactatcgtcattaatac

SEQ ID NO: 251801 - DNA, 75 bp, Artificial Sequence
  Synthetic
tatttcattcgtcaaggatattaatatcgacttactatcgtcattaatacgtgtaatataatcatataaatcatg

SEQ ID NO: 251802 - DNA, 75 bp, Artificial Sequence; identical to SEQ ID NO: 46984
  Synthetic

SEQ ID NO: 251803 - DNA, 75 bp, Artificial Sequence
  Synthetic
aattcatattaatactttgacattgactaatttgtaatatagcctcgccacgaagaaagctctcgtattcagttt

SEQ ID NO: 251804 - DNA, 75 bp, Artificial Sequence
  Synthetic
taactggttgccgatagtctcatagtctattaagtggtaagtttcgtacaaatacagaatccctaaaatattatc

SEQ ID NO: 251805 - DNA, 75 bp, Artificial Sequence
  Synthetic
tctattaagtggtaagtttcgtacaaatacagaatccctaaaatattatctaatgtgggattaatccttaccata

SEQ ID NO: 251806 - DNA, 75 bp, Artificial Sequence
  Synthetic
taactattttaccgtttgtacttactggaatagatgaaggaataatctccggacatgatggtaaagacccaaatg

SEQ ID NO: 251807 - DNA, 75 bp, Artificial Sequence
  Synthetic
tgttatcgtaattggaaaattggtattcaagtgagctggattatgtgagtattggattgtatattttattttatt

SEQ ID NO: 251808 - DNA, 75 bp, Artificial Sequence
  Synthetic
tggaatagatgaaggaataatctccggacatgatggtaaagacccaaatgtctgtttgaagaaatccaatgttcc

SEQ ID NO: 251809 - DNA, 75 bp, Artificial Sequence
  Synthetic
acgatattcgatcccgatatcctttgcattctatttaccagcatatcacgaactatattaagattatctatcatg

SEQ ID NO: 251810 - DNA, 75 bp, Artificial Sequence
  Synthetic
gcattctatttaccagcatatcacgaactatattaagattatctatcatgtctattctcccaccgttatataaat

SEQ ID NO: 251811 - DNA, 75 bp, Artificial Sequence
  Synthetic
atccatacaatggaatacttcatttctaaaatagtattcgttttctaattctttaatgtgaaatcgtatactaga

SEQ ID NO: 251812 - DNA, 75 bp, Artificial Sequence; identical to SEQ ID NO: 46993
  Synthetic

SEQ ID NO: 251813 - DNA, 75 bp, Artificial Sequence
  Synthetic
atgttctgattgcgtctgtctccgtcgctgaattaatagatttacaccaaaaactcatataacttctagatgtag

SEQ ID NO: 251814 - DNA, 75 bp, Artificial Sequence
  Synthetic
cgctgaattaatagatttacaccaaaaactcatataacttctagatgtagaagcattcgctaaaaaattagtaga

SEQ ID NO: 251815 - DNA, 75 bp, Artificial Sequence
  Synthetic
aacaagtgagcaattcccaagatttcatctatatcattctcgaatccgaaattagaaattcccaagtagatatcc

SEQ ID NO: 251816 - DNA, 75 bp, Artificial Sequence
  Synthetic
catctatatcattctcgaatccgaaattagaaattcccaagtagatatcctttttcatccgatcattgatgaaaa

SEQ ID NO: 251817 - DNA, 75 bp, Artificial Sequence
  Synthetic
catttactaaggagtaaaataggaagtaacgttcgtatatcgttatcgtcgtataaattaaaggtgtgttttttg

SEQ ID NO: 251818 - DNA, 75 bp, Artificial Sequence
  Synthetic
gtaacgttcgtatatcgttatcgtcgtataaattaaaggtgtgttttttgccattaagagacattataattttac

SEQ ID NO: 251819 - DNA, 75 bp, Artificial Sequence
  Synthetic
tatttgagcactagaaacggtcgatgcatcggtaaatatagctgtatctaatgttctagtcggtatttcttcatt

SEQ ID NO: 251820 - DNA, 75 bp, Artificial Sequence
  Synthetic
gcatcggtaaatatagctgtatctaatgttctagtcggtatttcttcatttcgctgtctaatgatagcgttttct

SEQ ID NO: 251821 - DNA, 75 bp, Artificial Sequence
  Synthetic
gaagtttattggtcgggtaatatgtaaaataataagaaatacatacgaataacaaaaataaaataagatataata

SEQ ID NO: 251822 - DNA, 75 bp, Artificial Sequence
  Synthetic
aaaataataagaaatacatacgaataacaaaaataaaataagatataataaagatgccatttagagatctaattt

SEQ ID NO: 251823 - DNA, 75 bp, Artificial Sequence
  Synthetic
tacagaagatgaggaatcgttggagatagtatcttccttatgtagaggatttgaaatatcttacgatgacttaat

SEQ ID NO: 251824 - DNA, 75 bp, Artificial Sequence
  Synthetic
atagtatcttccttatgtagaggatttgaaatatcttacgatgacttaatatcgtactttccagataggaaatac

SEQ ID NO: 251825 - DNA, 75 bp, Artificial Sequence
  Synthetic
tgtcgtagtatagatatattattagaggaggtataattataaaaagtttctgagtacgatgttataagaggagag

SEQ ID NO: 251826 - DNA, 75 bp, Artificial Sequence
  Synthetic
aacatgtagatttatcggaggaattaagtatggaattccatgatacaactctgagagatttagtatatcttagat

SEQ ID NO: 251827 - DNA, 75 bp, Artificial Sequence
  Synthetic
aagtatggaattccatgatacaactctgagagatttagtatatcttagattgtacaagtattccaagtatatacg

SEQ ID NO: 251828 - DNA, 75 bp, Artificial Sequence
  Synthetic
ctaaaaggtatagttgttataaaggacagaaatatatatattagagaagcaaatgatgacttgatagaatatctc

SEQ ID NO: 251829 - DNA, 75 bp, Artificial Sequence
  Synthetic
acagaaatatatatattagagaagcaaatgatgacttgatagaatatctcctcaaggaatacactcctcagattt

SEQ ID NO: 251830 - DNA, 75 bp, Artificial Sequence
  Synthetic
catagctggttcaaaattaattctttgtggattttctcaagttacatttatggcgtatacaacgtcgcatataac

SEQ ID NO: 251831 - DNA, 75 bp, Artificial Sequence
  Synthetic
tgtggattttctcaagttacatttatggcgtatacaacgtcgcatataacaacaaataaaaaggtagatgttctc

SEQ ID NO: 251832 - DNA, 75 bp, Artificial Sequence; identical to SEQ ID NO: 47018
  Synthetic

SEQ ID NO: 251833 - DNA, 75 bp, Artificial Sequence
  Synthetic
acttcaaaatttatttgataaaggaagcggaacaataaacaaaatactcaggaagatattttattcggtaacagg

SEQ ID NO: 251834 - DNA, 75 bp, Artificial Sequence; identical to SEQ ID NO: 47022
  Synthetic

SEQ ID NO: 251835 - DNA, 75 bp, Artificial Sequence
  Synthetic
aattcaccagcgatttatcggttttggtgaaatccaaggatttattaatgtccacaaatgccatttgttttgtct

SEQ ID NO: 251836 - DNA, 75 bp, Artificial Sequence
  Synthetic
gatgtagttagatagatgcgctgcgaagtttcctattagggttccgcgcttcacgtcacccaacatacttgaatc

SEQ ID NO: 251837 - DNA, 75 bp, Artificial Sequence; identical to SEQ ID NO: 47028
  Synthetic

SEQ ID NO: 251838 - DNA, 75 bp, Artificial Sequence
  Synthetic
cgttcttcatttatgggtatcaaaaacttaaaatcgttactgttggaaaataaatcactgacgatattagatgat

SEQ ID NO: 251839 - DNA, 75 bp, Artificial Sequence
  Synthetic
acttaaaatcgttactgttggaaaataaatcactgacgatattagatgataatttatacaaagtatacaatggaa

SEQ ID NO: 251840 - DNA, 75 bp, Artificial Sequence
  Synthetic
tatagccgtcgccaattgtgtcagaaacttagaagagttaactacggtattcataaaatacgtaaacggatgggt

SEQ ID NO: 251841 - DNA, 75 bp, Artificial Sequence
  Synthetic
aacttagaagagttaactacggtattcataaaatacgtaaacggatgggtaaaaaagggaggacatgtaaccctt

SEQ ID NO: 251842 - DNA, 75 bp, Artificial Sequence
  Synthetic
ttaaacaagacgttagagacaagagacgtaaatattctaaattaaccaaggacagaaaaatgttagaattagaaa

SEQ ID NO: 251843 - DNA, 75 bp, Artificial Sequence
  Synthetic
acgtaaatattctaaattaaccaaggacagaaaaatgttagaattagaaaagtgtacatccgaaatacaaaatgt

SEQ ID NO: 251844 - DNA, 75 bp, Artificial Sequence
  Synthetic
aaggcagaaatgcaattaaaaatcgataaactcacatttcaaatatatttatctgattatgataacataaaaata

SEQ ID NO: 251845 - DNA, 75 bp, Artificial Sequence
  Synthetic
ataaactcacatttcaaatatatttatctgattatgataacataaaaatatcattgaatgagatactaacacatt

SEQ ID NO: 251846 - DNA, 75 bp, Artificial Sequence
  Synthetic
attttattgtgatgaacgagacgcagaattcgttatgtgtctagaggctaaaacacagttctctaccacaggaga

SEQ ID NO: 251847 - DNA, 75 bp, Artificial Sequence
  Synthetic
gaattcgttatgtgtctagaggctaaaacacagttctctaccacaggagaatggccgttaataataagtaccgat

SEQ ID NO: 251848 - DNA, 75 bp, Artificial Sequence
  Synthetic
ctgataatcatcctaagatgataaaaaacttaactcaactgtttaaatttgttccctcggcagaggataactatt

SEQ ID NO: 251849 - DNA, 75 bp, Artificial Sequence
  Synthetic
aaacttaactcaactgtttaaatttgttccctcggcagaggataactatttagcaaaattaactgcattagtgaa

SEQ ID NO: 251850 - DNA, 75 bp, Artificial Sequence
  Synthetic
tatggggcatctataacacccaacaacttaaacaaaatacaattgtttagtgattttacaatcgataatatagtc

SEQ ID NO: 251851 - DNA, 75 bp, Artificial Sequence; identical to SEQ ID NO: 47043
  Synthetic

SEQ ID NO: 251852 - DNA, 75 bp, Artificial Sequence
  Synthetic
cgtgcgtaatattgttacgtttataaacgattacgctaatttagaagatgtctactcgtatattcctccttgtca

SEQ ID NO: 251853 - DNA, 75 bp, Artificial Sequence
  Synthetic
aacgattacgctaatttagaagatgtctactcgtatattcctccttgtcaatgcactgttcaagaatttatattc

SEQ ID NO: 251854 - DNA, 75 bp, Artificial Sequence
  Synthetic
aatttaaatcatcttatttagagagcgtgccgttaccctgccaattaatgtacgcattagaaccacgtaaggaga

SEQ ID NO: 251855 - DNA, 75 bp, Artificial Sequence
  Synthetic
cgtgccgttaccctgccaattaatgtacgcattagaaccacgtaaggagattgatgtttcagaagttaaaacttt

SEQ ID NO: 251856 - DNA, 75 bp, Artificial Sequence
  Synthetic
actaaatcagatatcgatgttataaaatctatatcctcgatttttggatattctaatgaaaactgtaacaccata

SEQ ID NO: 251857 - DNA, 75 bp, Artificial Sequence
  Synthetic
aatctatatcctcgatttttggatattctaatgaaaactgtaacaccatagtgttcggcatctataaggataatt

SEQ ID NO: 251858 - DNA, 75 bp, Artificial Sequence; identical to SEQ ID NO: 47051
  Synthetic

SEQ ID NO: 251859 - DNA, 75 bp, Artificial Sequence
  Synthetic
atggtgttccagctcgtgtgttctacgtgcggcaaagatatttctcacgaacgatataaattgattatacgaaaa

SEQ ID NO: 251860 - DNA, 75 bp, Artificial Sequence
  Synthetic
acgatataaattgattatacgaaaaaaatcattaaaggatgtactagtcagtgtaaagaacgaatgttgtaggtt

SEQ ID NO: 251861 - DNA, 75 bp, Artificial Sequence
  Synthetic
aaatcattaaaggatgtactagtcagtgtaaagaacgaatgttgtaggttaaaattatctacacaaatagaacct

SEQ ID NO: 251862 - DNA, 75 bp, Artificial Sequence
  Synthetic
tattggatataaactaatggatccggttaattttatcaagacatatgcgcctagaggttctattatttttattaa

SEQ ID NO: 251863 - DNA, 75 bp, Artificial Sequence
  Synthetic
gttaattttatcaagacatatgcgcctagaggttctattatttttattaattatgccatgtcattaactagtcat

SEQ ID NO: 251864 - DNA, 75 bp, Artificial Sequence
  Synthetic
tgggtatttattatggtacgttattatcggaacacttggtagttgaatctacctatagaaaaggagttagaataa

SEQ ID NO: 251865 - DNA, 75 bp, Artificial Sequence
  Synthetic
atcggaacacttggtagttgaatctacctatagaaaaggagttagaataatcccattggatagattttttgaagg

SEQ ID NO: 251866 - DNA, 75 bp, Artificial Sequence
  Synthetic
ttagagaatattcaagttatgaaaatagcagctgatatgtcgttaactttactaggtattccatatggatttggt

SEQ ID NO: 251867 - DNA, 75 bp, Artificial Sequence
  Synthetic
tagcagctgatatgtcgttaactttactaggtattccatatggatttggtcatgatagaatgtattgttttaaat

SEQ ID NO: 251868 - DNA, 75 bp, Artificial Sequence
  Synthetic
acactgaagcggacgacgaatctcatcgtcgcgtgatgttggcaaaaaacggatatggatgaggtcaacgaagca

SEQ ID NO: 251869 - DNA, 75 bp, Artificial Sequence
  Synthetic
cggtattgatacatcgtctaaacgaatattaggtaaagatatttttctgagccaaaactttacagatgataatag

SEQ ID NO: 251870 - DNA, 75 bp, Artificial Sequence
  Synthetic
atattaggtaaagatatttttctgagccaaaactttacagatgataatagatggataaagatatatgattctaat

SEQ ID NO: 251871 - DNA, 75 bp, Artificial Sequence
  Synthetic
accttaaagggtgagttaatatgcataactactcctccgttgttttttccctcgttctttttcttaacgttgttt

SEQ ID NO: 251872 - DNA, 75 bp, Artificial Sequence
  Synthetic
taactactcctccgttgttttttccctcgttctttttcttaacgttgtttgccatcactctcataatgtaaagat

SEQ ID NO: 251873 - DNA, 75 bp, Artificial Sequence
  Synthetic
tgaaatgtgaacaaggtgtctcatattataatgcacaagaattaaagtgttgtaaactatctagccaggaacata

SEQ ID NO: 251874 - DNA, 75 bp, Artificial Sequence
  Synthetic
tgtttagaaaaatgctaatattaaaatagctaacgctagtaatccaatcggaagccatttgatatctataatagg

SEQ ID NO: 251875 - DNA, 75 bp, Artificial Sequence
  Synthetic
atcggatgcagaaattggtataaatgttgtaattgtattatttcccgtcaatggactagtcacagctccatcagt

SEQ ID NO: 251876 - DNA, 75 bp, Artificial Sequence
  Synthetic
gttgtaattgtattatttcccgtcaatggactagtcacagctccatcagttttatatcctttagagtatttctca

SEQ ID NO: 251877 - DNA, 75 bp, Artificial Sequence
  Synthetic
ccatgatttgtttatcgttgatattggccggaaagatagattttttattttttattatattactattggcaattg

SEQ ID NO: 251878 - DNA, 75 bp, Artificial Sequence
  Synthetic
tttattatattactattggcaattgtagatataacttctggtaaatatttttctaccttttcattctcttctatt

SEQ ID NO: 251879 - DNA, 75 bp, Artificial Sequence
  Synthetic
tattgttgctagtatcaataccttttctggctaagaagtcatatgtggtattcactatatcagttttaactggta

SEQ ID NO: 251880 - DNA, 75 bp, Artificial Sequence
  Synthetic
tctggctaagaagtcatatgtggtattcactatatcagttttaactggtagttccattagcctttccacttctgc

SEQ ID NO: 251881 - DNA, 75 bp, Artificial Sequence
  Synthetic
catggatcctgatcttatagatagatgtattatgctaatatttgtttagattttgacaataacgtatatactgta

SEQ ID NO: 251882 - DNA, 75 bp, Artificial Sequence
  Synthetic
ccagaaaatccagctactataataggctcaccgatgatcattggcaaaatcctatattgtaccagattaatgaga

SEQ ID NO: 251883 - DNA, 75 bp, Artificial Sequence
  Synthetic
gctcaccgatgatcattggcaaaatcctatattgtaccagattaatgagagcatatttcatttccaataattctg

SEQ ID NO: 251884 - DNA, 75 bp, Artificial Sequence
  Synthetic
tgatgaatctatttggttctctagatactctaccatttctgccgcatacaataacttgttagataaaatcagggt

SEQ ID NO: 251885 - DNA, 75 bp, Artificial Sequence
  Synthetic
tactctaccatttctgccgcatacaataacttgttagataaaatcagggttatcaaagtgtttagtgtggctaga

SEQ ID NO: 251886 - DNA, 75 bp, Artificial Sequence
  Synthetic
atgctgtagtatgagtaaaccgttttaacgaattatatagtctccagaaatctgtggcgttgcatacatgaactg

SEQ ID NO: 251887 - DNA, 75 bp, Artificial Sequence
  Synthetic
taacgaattatatagtctccagaaatctgtggcgttgcatacatgaactgaatgacatcgaagattgtccaatat

SEQ ID NO: 251888 - DNA, 75 bp, Artificial Sequence
  Synthetic
atttctatatttgactcgcaacaattgtagataccattaatcactgattcctttttcgatgccggacaatagcac

SEQ ID NO: 251889 - DNA, 75 bp, Artificial Sequence
  Synthetic
caagctttcatgttgactactgcagtgtttcttgctctgactacatatactctacaatcaaagagagatttcagt

SEQ ID NO: 251890 - DNA, 75 bp, Artificial Sequence
  Synthetic
attcagaattaatagatatatctctcaatacagattgcactatacattttgaaactatgtcaaaaattgtagaac

SEQ ID NO: 251891 - DNA, 75 bp, Artificial Sequence
  Synthetic
ttaaataatttacaaaaatttaaaatgagcatccgtataaaaatcgataaattgcgccaaattgtggcatatttt

SEQ ID NO: 251892 - DNA, 75 bp, Artificial Sequence
  Synthetic
aacaatagtagtgtagttaatgtaatatcgaatctagagtccttagctataatccgatatatgatgaatggacca

SEQ ID NO: 251893 - DNA, 75 bp, Artificial Sequence
  Synthetic
attgcgccaaattgtggcatatttttcagagttcagcgaagaagtgtctataaatgtagactcgacggatgagtt

SEQ ID NO: 251894 - DNA, 75 bp, Artificial Sequence
  Synthetic
ggatctgtaaacatttgggccattatacctctcagtgcatcagtgttctaccgcggagccgaaaatattgtgttt

SEQ ID NO: 251895 - DNA, 75 bp, Artificial Sequence
  Synthetic
tacctctcagtgcatcagtgttctaccgcggagccgaaaatattgtgtttaaccttccagtgtccaaggtaaaat

SEQ ID NO: 251896 - DNA, 75 bp, Artificial Sequence
  Synthetic
tgctatcatagatatagaacctgatctggaaaataatctagtaaaactttctagttatcatgtagtaagtgtcga

SEQ ID NO: 251897 - DNA, 75 bp, Artificial Sequence
  Synthetic
ctggaaaataatctagtaaaactttctagttatcatgtagtaagtgtcgattgtaacaaggaactgatgcctatt

SEQ ID NO: 251898 - DNA, 75 bp, Artificial Sequence
  Synthetic
gtatagatcaaaagaaatcttacgtatttaattttcacaagtatgaagaaaaatgttgtggtagaaccgtcattc

SEQ ID NO: 251899 - DNA, 75 bp, Artificial Sequence
  Synthetic
atttaattttcacaagtatgaagaaaaatgttgtggtagaaccgtcattcatctagaatggttgttgggctttat

SEQ ID NO: 251900 - DNA, 75 bp, Artificial Sequence
  Synthetic
ttggctattatgtttaaagatgacaatattattatgaagactcctggtaatactgatgcgttttccagggaatat

SEQ ID NO: 251901 - DNA, 75 bp, Artificial Sequence
  Synthetic
atattattatgaagactcctggtaatactgatgcgttttccagggaatattctatgactgaatgttctcaagaac

SEQ ID NO: 251902 - DNA, 75 bp, Artificial Sequence
  Synthetic
tatctcgtctctcaacaaactacgaggattcaaaaagagagtcaatgtttttgaaactagaatcgtaatggataa

SEQ ID NO: 251903 - DNA, 75 bp, Artificial Sequence
  Synthetic
ggattcaaaaagagagtcaatgtttttgaaactagaatcgtaatggataatgacgataacattctaggaatgttg

SEQ ID NO: 251904 - DNA, 75 bp, Artificial Sequence
  Synthetic
agattaacatctttatggcgtttttagactaatactttcaatgagataaatatgggtggcggagtaagtgttgag

SEQ ID NO: 251905 - DNA, 75 bp, Artificial Sequence
  Synthetic
gagtacccactgatgagatgttattaaacgtggataaaatgcatgacgtgatagctcccgctaagcttttagaat

SEQ ID NO: 251906 - DNA, 75 bp, Artificial Sequence
  Synthetic
aaacgtggataaaatgcatgacgtgatagctcccgctaagcttttagaatatgtgcatataggaccactaacaaa

SEQ ID NO: 251907 - DNA, 75 bp, Artificial Sequence
  Synthetic
atgtgcatataggaccactaacaaaagataaagaggataaagtaaagaaaagatatccagagtttagattagtca

SEQ ID NO: 251908 - DNA, 75 bp, Artificial Sequence
  Synthetic
attattaagacaatcatataatggaaccgcacccaattgctgtcgcacttttaatcgtactcattattggaagaa

SEQ ID NO: 251909 - DNA, 75 bp, Artificial Sequence
  Synthetic
accgcacccaattgctgtcgcacttttaatcgtactcattattggaagaaggatggaaagatatcagataagtat

SEQ ID NO: 251910 - DNA, 75 bp, Artificial Sequence
  Synthetic
gttggcccgacgtccacgacactggaaaatgcgatgttgatttattcgactggtgtcagggggatacgttcgata

SEQ ID NO: 251911 - DNA, 75 bp, Artificial Sequence
  Synthetic
tacatatccagatatctatattcctactagtttgctgcgtagttgcatcattgatatgcatgatttatcaggatt

SEQ ID NO: 251912 - DNA, 75 bp, Artificial Sequence
  Synthetic
aaaatgcgatgttgatttattcgactggtgtcagggggatacgttcgatatgaacatatgccatcagtggatcgg

SEQ ID NO: 251913 - DNA, 75 bp, Artificial Sequence
  Synthetic
actgtagagggtcgacaatcgttaataaatctgtataataagatgcaaacattatgtagtaaagatgctagtgta

SEQ ID NO: 251914 - DNA, 75 bp, Artificial Sequence
  Synthetic
taaatctgtataataagatgcaaacattatgtagtaaagatgctagtgtaccaatatgtgaattatttttgcatc

SEQ ID NO: 251915 - DNA, 75 bp, Artificial Sequence
  Synthetic
tagcaaagagatgatcgattatattctaagacaacagtcggcggactttaaacagaaatatatgagatgtagtta

SEQ ID NO: 251916 - DNA, 75 bp, Artificial Sequence
  Synthetic
ctaagacaacagtcggcggactttaaacagaaatatatgagatgtagttatcccactagagataagttagaagag

SEQ ID NO: 251917 - DNA, 75 bp, Artificial Sequence
  Synthetic
aatgttgggatccagagtgttcgaatgccaatgttaatttcttactaacacgtaattataataatttaggacttt

SEQ ID NO: 251918 - DNA, 75 bp, Artificial Sequence
  Synthetic
tgccaatgttaatttcttactaacacgtaattataataatttaggactttgcaatattgtacgatgtaatacgag

SEQ ID NO: 251919 - DNA, 75 bp, Artificial Sequence
  Synthetic
actattaataatacatctattaatcattgattagtttattgctttaattgtttttgtaaactaacactgttcatt

SEQ ID NO: 251920 - DNA, 75 bp, Artificial Sequence
  Synthetic
acttcctcattaagattatcatgtggattaagcaatagtgatagattttctactgttcccgtcaatagagcaaaa

SEQ ID NO: 251921 - DNA, 75 bp, Artificial Sequence
  Synthetic
gattaagcaatagtgatagattttctactgttcccgtcaatagagcaaaagtagttcaacataatattaaacatt

SEQ ID NO: 251922 - DNA, 75 bp, Artificial Sequence
  Synthetic
cagtttattatctctcttggtaatatggatactaattgtagctatttaaatgggtgccgcagcaagcatacagac

SEQ ID NO: 251923 - DNA, 75 bp, Artificial Sequence
  Synthetic
tggatactaattgtagctatttaaatgggtgccgcagcaagcatacagacgactgtgaatacactcagtgaacgt

SEQ ID NO: 251924 - DNA, 75 bp, Artificial Sequence
  Synthetic
cgaacgctagtgctcaaacaaaatgtgatatagaaatcggaaatttttatatccgacaaaaccatggatgtaaca

SEQ ID NO: 251925 - DNA, 75 bp, Artificial Sequence
  Synthetic
tgatatagaaatcggaaatttttatatccgacaaaaccatggatgtaacatcactgttaaaaatatgtgctctgc

SEQ ID NO: 251926 - DNA, 75 bp, Artificial Sequence
  Synthetic
gtgttatcagccgctacagaaacatatagtggattaacaccggaacaaaaagcatacgtaccagctatgtttact

SEQ ID NO: 251927 - DNA, 75 bp, Artificial Sequence
  Synthetic
ttgaggaacccaattacgacgagtttcgtcgagtattaatgaatggagttatgaaaaatttttgttgataaaaaa

SEQ ID NO: 251928 - DNA, 75 bp, Artificial Sequence
  Synthetic
atagtggattaacaccggaacaaaaagcatacgtaccagctatgtttactgctgcgttaaacattcagacgagtg

SEQ ID NO: 251929 - DNA, 75 bp, Artificial Sequence
  Synthetic
aaattatgtgaaacagacttgtaattctagcgctgttgtcgataacaaattaaagatacaaaacgtaattataga

SEQ ID NO: 251930 - DNA, 75 bp, Artificial Sequence
  Synthetic
tctagcgctgttgtcgataacaaattaaagatacaaaacgtaattatagatgaatgttacggagccccaggatct

SEQ ID NO: 251931 - DNA, 75 bp, Artificial Sequence
  Synthetic
caggatctagcaaaggaaattgtgccattaaggcgttgatgcaattgactactaaggccactactcaaatagcac

SEQ ID NO: 251932 - DNA, 75 bp, Artificial Sequence
  Synthetic
cattaaggcgttgatgcaattgactactaaggccactactcaaatagcacctagacaagttgctggtacaggagt

SEQ ID NO: 251933 - DNA, 75 bp, Artificial Sequence
  Synthetic
gttataatattggcagcgttgtttatgtactatgccaagcgtatgctgttcacatccaccaatgataaaatcaaa

SEQ ID NO: 251934 - DNA, 75 bp, Artificial Sequence
  Synthetic
tgtactatgccaagcgtatgctgttcacatccaccaatgataaaatcaaacttattttagccaataaggaaaacg

SEQ ID NO: 251935 - DNA, 75 bp, Artificial Sequence
  Synthetic
attctttagaacttctccgatgattattgctaccacggatatacaaaactgaaaatatattgataatattttaat

SEQ ID NO: 251936 - DNA, 75 bp, Artificial Sequence
  Synthetic
attgctaccacggatatacaaaactgaaaatatattgataatattttaatagattaacatggaagttatcgctga

SEQ ID NO: 251937 - DNA, 75 bp, Artificial Sequence
  Synthetic
aatatagcggatgaaaaatttgtagattttgttatacacggtctagagcatcaatgtcctgctatacttcgacca

SEQ ID NO: 251938 - DNA, 75 bp, Artificial Sequence
  Synthetic
attttgttatacacggtctagagcatcaatgtcctgctatacttcgaccattaattaggttgtttattgatatac

SEQ ID NO: 251939 - DNA, 75 bp, Artificial Sequence
  Synthetic
ttttacggtacgtctagtaagtagaaattatcaaatgttgttggtgttggtggcgctagtcatcacattaactat

SEQ ID NO: 251940 - DNA, 75 bp, Artificial Sequence
  Synthetic
aattatcaaatgttgttggtgttggtggcgctagtcatcacattaactatttttttattactttatactataata

SEQ ID NO: 251941 - DNA, 75 bp, Artificial Sequence
  Synthetic
tctcacctgccataaataaatgcttgatattaaagtcttctatttctaacactattccatctgtggaaaataata

SEQ ID NO: 251942 - DNA, 75 bp, Artificial Sequence
  Synthetic
gatattaaagtcttctatttctaacactattccatctgtggaaaataatactctgacattatcgctaattgatac

SEQ ID NO: 251943 - DNA, 75 bp, Artificial Sequence
  Synthetic
taataatcttctttgggcacatataccagtgtaccaggttctaacaacctatttactggtgctcctgtagcatac

SEQ ID NO: 251944 - DNA, 75 bp, Artificial Sequence
  Synthetic
ccagtgtaccaggttctaacaacctatttactggtgctcctgtagcatactttttttttaccttgagaatatcca

SEQ ID NO: 251945 - DNA, 75 bp, Artificial Sequence
  Synthetic
gtgattttttatcaaccactcaaaaaagtaattggagtgttcatatcctctacgggctattgtctcatggccgtg

SEQ ID NO: 251946 - DNA, 75 bp, Artificial Sequence
  Synthetic
aagtaattggagtgttcatatcctctacgggctattgtctcatggccgtgtatgaaatttaagtaacacgactgt

SEQ ID NO: 251947 - DNA, 75 bp, Artificial Sequence
  Synthetic
tgccgcaaatagatagaactaccaatatgtctgtacaaatgttaaacattaattgattaacagaaaaaacaatgt

SEQ ID NO: 251948 - DNA, 75 bp, Artificial Sequence
  Synthetic
cattagaaattagggatctaattgtttcacaagctgtcatatagagttctatccacccacctttcttgaaatgag

SEQ ID NO: 251949 - DNA, 75 bp, Artificial Sequence
  Synthetic
tatgtctgtacaaatgttaaacattaattgattaacagaaaaaacaatgttcgttctgggaatagaaaccagatt

SEQ ID NO: 251950 - DNA, 75 bp, Artificial Sequence
  Synthetic
ccacgtttatacatggaatataaaataactacagtttgaaaaataacagtatcatttaaacatttaacttgcggg

SEQ ID NO: 251951 - DNA, 75 bp, Artificial Sequence
  Synthetic
taactacagtttgaaaaataacagtatcatttaaacatttaacttgcggggttaatctcacaactttactgtttt

SEQ ID NO: 251952 - DNA, 75 bp, Artificial Sequence
  Synthetic
tccatgagaaatacgtttagccgcctttaatagaggaaatccaaccgcctttctggatctcaccaacgacgatag

SEQ ID NO: 251953 - DNA, 75 bp, Artificial Sequence
  Synthetic
tttaatagaggaaatccaaccgcctttctggatctcaccaacgacgatagttctgaccagcaactcatttcttca

SEQ ID NO: 251954 - DNA, 75 bp, Artificial Sequence
  Synthetic
aggcaggagatagatatccgtcattgcaatattccttctcgtaggcacacaatctaatattgataaaatctccat

SEQ ID NO: 251955 - DNA, 75 bp, Artificial Sequence
  Synthetic
gcaatattccttctcgtaggcacacaatctaatattgataaaatctccattctcttctctgtatttattatcttg

SEQ ID NO: 251956 - DNA, 75 bp, Artificial Sequence
  Synthetic
ctatcgttgttgaatctattttggtcattaaatctttcatttcttcctggtatatttctatcacctcgtttggtt

SEQ ID NO: 251957 - DNA, 75 bp, Artificial Sequence
  Synthetic
cattaaatctttcatttcttcctggtatatttctatcacctcgtttggttggatttttgtctatattatcgtttg

SEQ ID NO: 251958 - DNA, 75 bp, Artificial Sequence
  Synthetic
tcacaaaaaaaacttctctaaatgagtctactgctagaaaacctcatcgaagaagataccatattttttgcagga

SEQ ID NO: 251959 - DNA, 75 bp, Artificial Sequence
  Synthetic
gtctactgctagaaaacctcatcgaagaagataccatattttttgcaggaagtatatctgagtatgatgatttac

SEQ ID NO: 251960 - DNA, 75 bp, Artificial Sequence
  Synthetic
caaatttccaagatctatgctttctatttttaatatagtacctagaacgatgtcaaaatatgagttggagttgat

SEQ ID NO: 251961 - DNA, 75 bp, Artificial Sequence
  Synthetic
atttttaatatagtacctagaacgatgtcaaaatatgagttggagttgattcataacgagaatatcacaggggca

SEQ ID NO: 251962 - DNA, 75 bp, Artificial Sequence
  Synthetic
gaaacaatttgggtctaggcgatgataaactaactattgaagccattgaaaactatttcttggatcctaacaatg

SEQ ID NO: 251963 - DNA, 75 bp, Artificial Sequence
  Synthetic
taaactaactattgaagccattgaaaactatttcttggatcctaacaatgaggttatgcctcttatcattaataa

SEQ ID NO: 251964 - DNA, 75 bp, Artificial Sequence
  Synthetic
cctatagttttattgcttactactaacatggatacagatacagatacagatacagatacagatacagatacagat

SEQ ID NO: 251965 - DNA, 75 bp, Artificial Sequence
  Synthetic
tcgtatttgatacatccgcattcagccaacaaatataaaattacaaaaactctaacgacgttcgtacacatcttg

SEQ ID NO: 251966 - DNA, 75 bp, Artificial Sequence
  Synthetic
aaaaaaagtggtaggagaaagaataagaacatggttatcttccgtcaaggatcatcacctatcttgtgtattttc

SEQ ID NO: 251967 - DNA, 75 bp, Artificial Sequence
  Synthetic
catcatcatcatcatcatcatcatcatcatcatcatcatcatcatcatcatcatctatgatatcatcatcatcat

SEQ ID NO: 251968 - DNA, 75 bp, Artificial Sequence
  Synthetic
agaacatggttatcttccgtcaaggatcatcacctatcttgtgtattttcgaaactcgtaaaaagattaatattt

SEQ ID NO: 251969 - DNA, 75 bp, Artificial Sequence
  Synthetic
gactgagtatacacctatcggagacaacaaggctttgatatctaaatatgcgggaattaatatcctgaatgtgta

SEQ ID NO: 251970 - DNA, 75 bp, Artificial Sequence
  Synthetic
aacaaggctttgatatctaaatatgcgggaattaatatcctgaatgtgtattctccttccacgtccatgagattg

SEQ ID NO: 251971 - DNA, 75 bp, Artificial Sequence
  Synthetic
aaaataaactagagaaacttagtactaataaggaactagaatcgtatagttctagccctcttcaagaacccatta

SEQ ID NO: 251972 - DNA, 75 bp, Artificial Sequence
  Synthetic
taataaggaactagaatcgtatagttctagccctcttcaagaacccattaggttaaatgattttctgggactatt

SEQ ID NO: 251973 - DNA, 75 bp, Artificial Sequence
  Synthetic
ctaacagatattccgacaaaggattgattactataaatggagaatgttcctaatgtatactttaatcctgtgttt

SEQ ID NO: 251974 - DNA, 75 bp, Artificial Sequence
  Synthetic
gattactataaatggagaatgttcctaatgtatactttaatcctgtgtttatagagcccacgtttaaacattctt

SEQ ID NO: 251975 - DNA, 75 bp, Artificial Sequence
  Synthetic
aatagttttatttgaagtattcgttgtattcattctaatatatgtattttttagatctgaattaaatatgttctt

SEQ ID NO: 251976 - DNA, 75 bp, Artificial Sequence
  Synthetic
gtattcattctaatatatgtattttttagatctgaattaaatatgttcttcatgcctaaacgaaaaatacccgat

SEQ ID NO: 251977 - DNA, 75 bp, Artificial Sequence
  Synthetic
atctagcgtgtgaagacgataaattaatgatctatggattaccatggataacaactcaaacatctgcgttatcaa

SEQ ID NO: 251978 - DNA, 75 bp, Artificial Sequence
  Synthetic
aatgatctatggattaccatggataacaactcaaacatctgcgttatcaataaatagtaaaccgatagtgtataa

SEQ ID NO: 251979 - DNA, 75 bp, Artificial Sequence
  Synthetic
ataaatggatcacaaccagtatctcttaacgatgttcttcgcagatgatgattcattttttaagtattttgctag

SEQ ID NO: 251980 - DNA, 75 bp, Artificial Sequence
  Synthetic
ttaacgatgttcttcgcagatgatgattcattttttaagtattttgctagtcaagatgatgaatcttcattatct

SEQ ID NO: 251981 - DNA, 75 bp, Artificial Sequence
  Synthetic
tagactttctgttattattattgatccaatcaaaaaataaattagaagctgtgggtcattgttatgaatctcttt

SEQ ID NO: 251982 - DNA, 75 bp, Artificial Sequence
  Synthetic
ccaatcaaaaaataaattagaagctgtgggtcattgttatgaatctctttcagaggaatacagacaattgacaaa

SEQ ID NO: 251983 - DNA, 75 bp, Artificial Sequence
  Synthetic
aaactgtttaacaaggtccctattgttacagatggaagggtcaaacttaataaaggatatttgttcgactttgtg

SEQ ID NO: 251984 - DNA, 75 bp, Artificial Sequence
  Synthetic
ttacagatggaagggtcaaacttaataaaggatatttgttcgactttgtgattagtttgatgcgattcaaaaaag

SEQ ID NO: 251985 - DNA, 75 bp, Artificial Sequence
  Synthetic
agatcctgttagatacatagatcctcgtcgtgatatcgcattttctaacgtgatggatatattaaagtcgaataa

SEQ ID NO: 251986 - DNA, 75 bp, Artificial Sequence
  Synthetic
cgtcgtgatatcgcattttctaacgtgatggatatattaaagtcgaataaagttgaacaataattaattctttat

SEQ ID NO: 251987 - DNA, 75 bp, Artificial Sequence
  Synthetic
cagttgataatcggccccatgttttcaggtaaaagtacagaattaattagacgagttagacgttatcaaatagct

SEQ ID NO: 251988 - DNA, 75 bp, Artificial Sequence
  Synthetic
caggtaaaagtacagaattaattagacgagttagacgttatcaaatagctcaatataaatgtgtgactataaaat

SEQ ID NO: 251989 - DNA, 75 bp, Artificial Sequence
  Synthetic
gggactatggacgcatgataagaataattttgcagcattggaagtaactaaactatgtgatgtcttggaagcaat

SEQ ID NO: 251990 - DNA, 75 bp, Artificial Sequence
  Synthetic
aattttgcagcattggaagtaactaaactatgtgatgtcttggaagcaattacagatttctccgtgataggtatc

SEQ ID NO: 251991 - DNA, 75 bp, Artificial Sequence
  Synthetic
ttgttgaattctgtgagcgtatggcaaacgaaggaaaaatagttatagtagccgcgctcgatgggacatttcaac

SEQ ID NO: 251992 - DNA, 75 bp, Artificial Sequence
  Synthetic
aaacgaaggaaaaatagttatagtagccgcgctcgatgggacatttcaacgtagaccgtttaataatattttgaa

SEQ ID NO: 251993 - DNA, 75 bp, Artificial Sequence
  Synthetic
gtaaaactaactgcagtgtgtatgaaatgctttaaggaggcttccttttctaaacgattaggtgcagaaaccgag

SEQ ID NO: 251994 - DNA, 75 bp, Artificial Sequence
  Synthetic
aatgctttaaggaggcttccttttctaaacgattaggtgcagaaaccgagatagaaataataggaggtaatgata

SEQ ID NO: 251995 - DNA, 75 bp, Artificial Sequence
  Synthetic
tctagtgggcgactgtctatctagcgtcgacatctacatactatatagtaataccaatactcaagactacgaaac

SEQ ID NO: 251996 - DNA, 75 bp, Artificial Sequence
  Synthetic
ttacatcgactcataatattatattttttatctaaaaaactaaaaataaacattgattaaattttaatataatac

SEQ ID NO: 251997 - DNA, 75 bp, Artificial Sequence
  Synthetic
ttttatctaaaaaactaaaaataaacattgattaaattttaatataatacttaaaaatggatgttgtgtcgttag

SEQ ID NO: 251998 - DNA, 75 bp, Artificial Sequence
  Synthetic
aattgataatgagttagattacgaaccagaaagtgcaaatgaggtcgcaaaaaaactgccgtatcaaggacagtt

SEQ ID NO: 251999 - DNA, 75 bp, Artificial Sequence
  Synthetic
ccagaaagtgcaaatgaggtcgcaaaaaaactgccgtatcaaggacagttaaaactattactaggagaattattt

SEQ ID NO: 252000 - DNA, 75 bp, Artificial Sequence
  Synthetic
gtatattagatggtgccaccgtagtgtatataggatctgctccaggtacacatatacgttatttgagagatcatt

SEQ ID NO: 252001 - DNA, 75 bp, Artificial Sequence
  Synthetic
gtatataggatctgctccaggtacacatatacgttatttgagagatcatttctataatttaggagtgatcatcaa

SEQ ID NO: 252002 - DNA, 75 bp, Artificial Sequence
  Synthetic
catgatcctattctaaatggattgcgtgatgtgactctagtgactcggtttgttgatgaggaatatctacgatcc

SEQ ID NO: 252003 - DNA, 75 bp, Artificial Sequence
  Synthetic
gtgatgtgactctagtgactcggtttgttgatgaggaatatctacgatccatcaaaaaacaactacatccttcta

SEQ ID NO: 252004 - DNA, 75 bp, Artificial Sequence
  Synthetic
atccaaacgaggaggaaatgaacctagtactgcggatttactaagtaattatgctctacaaaatgtcatgattag

SEQ ID NO: 252005 - DNA, 75 bp, Artificial Sequence
  Synthetic
agtactgcggatttactaagtaattatgctctacaaaatgtcatgattagtattttaaaccccgtggcgtctagt

SEQ ID NO: 252006 - DNA, 75 bp, Artificial Sequence
  Synthetic
atcaatggatcaaggacttttatatcccacacggtaataaaatgttacaaccttttgctccttcatattcagctg

SEQ ID NO: 252007 - DNA, 75 bp, Artificial Sequence
  Synthetic
cccacacggtaataaaatgttacaaccttttgctccttcatattcagctgaaatgagattattaagtatttatac

SEQ ID NO: 252008 - DNA, 75 bp, Artificial Sequence
  Synthetic
gttaccaaatcagacgctgtaaattatgaaaaaaagatgtattaccttaataagatagtccgcaacaaagtagtt

SEQ ID NO: 252009 - DNA, 75 bp, Artificial Sequence
  Synthetic
atgaaaaaaagatgtattaccttaataagatagtccgcaacaaagtagttgttaactttgattatcctaatcagg

SEQ ID NO: 252010 - DNA, 75 bp, Artificial Sequence
  Synthetic
tatgttgaggaccgtatactgcaataaaacatttcctactactaaagcaaagatactatttctacaacaatctat

SEQ ID NO: 252011 - DNA, 75 bp, Artificial Sequence
  Synthetic
aaaacatttcctactactaaagcaaagatactatttctacaacaatctatatttcgtttcttaaatattccaacg

SEQ ID NO: 252012 - DNA, 75 bp, Artificial Sequence
  Synthetic
aaccaatacaacgtaaaatatctagcaaagattctatgtctaaaaacagaaatagcaagagatccgtacgcggta

SEQ ID NO: 252013 - DNA, 75 bp, Artificial Sequence
  Synthetic
caaagattctatgtctaaaaacagaaatagcaagagatccgtacgcggtaataaatagaaacgtactactgagat

SEQ ID NO: 252014 - DNA, 75 bp, Artificial Sequence
  Synthetic
ttacttcttctttctgtttcaatatgtgatacgatatgatcactattcgtattctcttggtctcataaaaaagtt

SEQ ID NO: 252015 - DNA, 75 bp, Artificial Sequence
  Synthetic
tttagttactttaataaccgttagacataaaattgattctatgaaaactgtgtttcaggtatttaacgaatcatc

SEQ ID NO: 252016 - DNA, 75 bp, Artificial Sequence
  Synthetic
cataaaattgattctatgaaaactgtgtttcaggtatttaacgaatcatccataaattatactccggttgatgat

SEQ ID NO: 252017 - DNA, 75 bp, Artificial Sequence
  Synthetic
catcgtatcttcaaaaaggtcataacaagtttcctgtaaattttctatacatagatgtggtaatatctgacttat

SEQ ID NO: 252018 - DNA, 75 bp, Artificial Sequence
  Synthetic
caagtttcctgtaaattttctatacatagatgtggtaatatctgacttatttcctagctttgttagactagatac

SEQ ID NO: 252019 - DNA, 75 bp, Artificial Sequence
  Synthetic
gtactacaaacaggcgatggtaaaaagactcttcgtcttcctaaaatgttagagacggaaatagttgtcaagatt

SEQ ID NO: 252020 - DNA, 75 bp, Artificial Sequence
  Synthetic
agactcttcgtcttcctaaaatgttagagacggaaatagttgtcaagattctctatcgtcctaatataccattaa

SEQ ID NO: 252021 - DNA, 75 bp, Artificial Sequence
  Synthetic
catggtaactggagtagagatagccgatagatctgttatttcagtcgctgattaatcaattagtagagatgagat

SEQ ID NO: 252022 - DNA, 75 bp, Artificial Sequence
  Synthetic
ctaatattaaaatagctaacgctagtaatccaatcggaagccatttgatatctataatagggtatctaatttcct

SEQ ID NO: 252023 - DNA, 75 bp, Artificial Sequence
  Synthetic
taatccaatcggaagccatttgatatctataatagggtatctaatttcctgattcagatagcgtacggctatatt

SEQ ID NO: 252024 - DNA, 75 bp, Artificial Sequence
  Synthetic
caaacattatttacatctaatttactatctgtaatggaaacgtttcccaatgaaatggtacaatcagatacatta

SEQ ID NO: 252025 - DNA, 75 bp, Artificial Sequence
  Synthetic
tatctgtaatggaaacgtttcccaatgaaatggtacaatcagatacattacatcttgatatatttttttttaaag

SEQ ID NO: 252026 - DNA, 75 bp, Artificial Sequence
  Synthetic
tttacatggctcgtaccaacaataatagggtaatcttgtatctattcctatccgtactatacttttatcaggata

SEQ ID NO: 252027 - DNA, 75 bp, Artificial Sequence
  Synthetic
tagggtaatcttgtatctattcctatccgtactatacttttatcaggataaatacatttacatcgtatatcgtct

SEQ ID NO: 252028 - DNA, 75 bp, Artificial Sequence
  Synthetic
tttgttcgtccgtcatgataaaaatttaaagtgtaaatataactattatttttatagttgtaataaaaagggaaa

SEQ ID NO: 252029 - DNA, 75 bp, Artificial Sequence
  Synthetic
gaatatattgttggacgttatcgtttacgaaatagttgagacatcagaaagaggtttaatatttttgtgagacca

SEQ ID NO: 252030 - DNA, 75 bp, Artificial Sequence
  Synthetic
aaaagaaactgacttgataaaaatggctgtaatctctaaggttacgtatagtctatacgatcaaaaagagattaa

SEQ ID NO: 252031 - DNA, 75 bp, Artificial Sequence
  Synthetic
gctgtaatctctaaggttacgtatagtctatacgatcaaaaagagattaatgctacagatattatcattagtcat

SEQ ID NO: 252032 - DNA, 75 bp, Artificial Sequence
  Synthetic
gtctatacgatcaaaaagagattaatgctacagatattatcattagtcatattaaaaatgacgacgatatcggta

SEQ ID NO: 252033 - DNA, 75 bp, Artificial Sequence
  Synthetic
tatggatggggcattatgtaagacttgtgggaaaacggaattggaatgtttcggtcactggggtaaagtaagtat

SEQ ID NO: 252034 - DNA, 75 bp, Artificial Sequence
  Synthetic
tgtgggaaaacggaattggaatgtttcggtcactggggtaaagtaagtatttataaaactcatatagttaagcct

SEQ ID NO: 252035 - DNA, 75 bp, Artificial Sequence
  Synthetic
tactgaatcatatatgtattcattgcggattattgcgttcacgagaaccgtattccgacgatattaacctaaaag

SEQ ID NO: 252036 - DNA, 75 bp, Artificial Sequence
  Synthetic
cggattattgcgttcacgagaaccgtattccgacgatattaacctaaaagagttatcgggacacgctcttaggag

SEQ ID NO: 252037 - DNA, 75 bp, Artificial Sequence
  Synthetic
aaaaagtcatgttggaacagcgaatgtatgcaaccgtatcaaaaaattactttttcaaagaaaaaggtttgtttc

SEQ ID NO: 252038 - DNA, 75 bp, Artificial Sequence
  Synthetic
gtatgcaaccgtatcaaaaaattactttttcaaagaaaaaggtttgtttcgtcaacaagttggatgatattaacg

SEQ ID NO: 252039 - DNA, 75 bp, Artificial Sequence
  Synthetic
gttaatttctattcatgaaaagttttggccattattagaaattcatcaatatccagctaacttattttatacaga

SEQ ID NO: 252040 - DNA, 75 bp, Artificial Sequence
  Synthetic
tggccattattagaaattcatcaatatccagctaacttattttatacagactactttcccatccctccgttgatt

SEQ ID NO: 252041 - DNA, 75 bp, Artificial Sequence
  Synthetic
tagatagtatacccaaagagacaaatgaattaacttacttattaggtatgatcgttaagaattgtaacttgaatg

SEQ ID NO: 252042 - DNA, 75 bp, Artificial Sequence
  Synthetic
tgaattaacttacttattaggtatgatcgttaagaattgtaacttgaatgctgatgaacaggttatccagaaggc

SEQ ID NO: 252043 - DNA, 75 bp, Artificial Sequence
  Synthetic
attatttctaataacactaccagtatcaatttatcatatatcacatccggcaaaaataatatgattagaagttat

SEQ ID NO: 252044 - DNA, 75 bp, Artificial Sequence
  Synthetic
ccgctagatctgtaattggtcccagtacatctatcaccgttaatgaggtaggaatgcccacatatattagaaata

SEQ ID NO: 252045 - DNA, 75 bp, Artificial Sequence
  Synthetic
tacatctatcaccgttaatgaggtaggaatgcccacatatattagaaatacacttacagaaaagatatttgttaa

SEQ ID NO: 252046 - DNA, 75 bp, Artificial Sequence
  Synthetic
ggaatgcccacatatattagaaatacacttacagaaaagatatttgttaatgcctttacagtggataaagttaaa

SEQ ID NO: 252047 - DNA, 75 bp, Artificial Sequence
  Synthetic
aattttactttaataaacgattaaaccaattaacaagaatacgtcaaggaaagtttatcaaaaataaaatacatt

SEQ ID NO: 252048 - DNA, 75 bp, Artificial Sequence
  Synthetic
ccaattaacaagaatacgtcaaggaaagtttatcaaaaataaaatacatttattgcctggtgattgggtagaagt

SEQ ID NO: 252049 - DNA, 75 bp, Artificial Sequence
  Synthetic
atttttggaagacaaccgtctctacatagatacaacgtcatcgcttcatctatcagagctaccgaaggagatact

SEQ ID NO: 252050 - DNA, 75 bp, Artificial Sequence
  Synthetic
cttactataagtgggtgggattctgggaattagtgatcagtttatgtatatcgcaactagcgggcatatggctat

SEQ ID NO: 252051 - DNA, 75 bp, Artificial Sequence
  Synthetic
atagatacaacgtcatcgcttcatctatcagagctaccgaaggagatactatcaaaatatctcccggaattgcca

SEQ ID NO: 252052 - DNA, 75 bp, Artificial Sequence
  Synthetic
agatgaagaatggatgatattggagcaaaatcctaaagccgtagttgaacaaagtattcttatgtatccgacgac

SEQ ID NO: 252053 - DNA, 75 bp, Artificial Sequence
  Synthetic
caaaatcctaaagccgtagttgaacaaagtattcttatgtatccgacgacgttactcaaacacgatattcatgga

SEQ ID NO: 252054 - DNA, 75 bp, Artificial Sequence
  Synthetic
atgaaatcgtagcagcgtattcattgtttaggatacaagatctttgtttagatgaagtattgaacatcttgggga

SEQ ID NO: 252055 - DNA, 75 bp, Artificial Sequence
  Synthetic
gtttaggatacaagatctttgtttagatgaagtattgaacatcttggggaaatatggaagagagttcgatcctaa

SEQ ID NO: 252056 - DNA, 75 bp, Artificial Sequence
  Synthetic
gagacattgaaactaggatatataaaatttaagggaatgattaggactactactctagaagatatagcaccatct

SEQ ID NO: 252057 - DNA, 75 bp, Artificial Sequence
  Synthetic
gatatctatacttacttgataggtgaaaagattaattatccgggtctcttaaaggatggcgaaattattgcaaac

SEQ ID NO: 252058 - DNA, 75 bp, Artificial Sequence
  Synthetic
aaaagattaattatccgggtctcttaaaggatggcgaaattattgcaaacgacgtagatagtaattttgttgtag

SEQ ID NO: 252059 - DNA, 75 bp, Artificial Sequence
  Synthetic
actcttatccgatcataaatcgaacgtggaaggtatcaactttattatcaagtcatcttatgtttttaagagata

SEQ ID NO: 252060 - DNA, 75 bp, Artificial Sequence
  Synthetic
gtggaaggtatcaactttattatcaagtcatcttatgtttttaagagatatctatctatttacggttttggggtg

SEQ ID NO: 252061 - DNA, 75 bp, Artificial Sequence
  Synthetic
cgacgttcactaataaattggaggctatcaacgtagaaaaaatagaacttatcaaagaagcatacgccaaatatc

SEQ ID NO: 252062 - DNA, 75 bp, Artificial Sequence
  Synthetic
tatcaacgtagaaaaaatagaacttatcaaagaagcatacgccaaatatctcaaagatgtaagagacgggaaaat

SEQ ID NO: 252063 - DNA, 75 bp, Artificial Sequence
  Synthetic
gcggactacttggaatccatgttatccaacttgacaaatcttaatatcagagagatagaagaacatatgagacaa

SEQ ID NO: 252064 - DNA, 75 bp, Artificial Sequence
  Synthetic
ccaacttgacaaatcttaatatcagagagatagaagaacatatgagacaaacgctgatagatgatccagataata

SEQ ID NO: 252065 - DNA, 75 bp, Artificial Sequence
  Synthetic
catcatataccatttctagtactttaggttcattgttatccattgcagaggacgtcatgatcgaatccaaaaaaa

SEQ ID NO: 252066 - DNA, 75 bp, Artificial Sequence
  Synthetic
ttataaagtaaatcccacagaactaatgtatattctaggtacttatggacaacagaggatagatggcgaaccagc

SEQ ID NO: 252067 - DNA, 75 bp, Artificial Sequence
  Synthetic
atgtatattctaggtacttatggacaacagaggatagatggcgaaccagcagagactcgagtattgggtagagtc

SEQ ID NO: 252068 - DNA, 75 bp, Artificial Sequence
  Synthetic
aggatccagaaggaagaggttatattcttaattctttaacaaaaggattaacgggttctcaatattacttttcga

SEQ ID NO: 252069 - DNA, 75 bp, Artificial Sequence
  Synthetic
tcttaattctttaacaaaaggattaacgggttctcaatattacttttcgatgctggttgcaagatctcaatctac

SEQ ID NO: 252070 - DNA, 75 bp, Artificial Sequence
  Synthetic
accggaacactggctagaaaaatcattaaaaagatggaggatatggtggtcgacggatacggacaagtagttata

SEQ ID NO: 252071 - DNA, 75 bp, Artificial Sequence
  Synthetic
ttaaaaagatggaggatatggtggtcgacggatacggacaagtagttataggtaatacgctcatcaagtacgcag

SEQ ID NO: 252072 - DNA, 75 bp, Artificial Sequence
  Synthetic
agtatgtaaacctgtagatcttatctatccagatgagtccatgacttggtatttggaaattagtgctttgtggaa

SEQ ID NO: 252073 - DNA, 75 bp, Artificial Sequence
  Synthetic
tatccagatgagtccatgacttggtatttggaaattagtgctttgtggaataaaataaaacagggattcgtttac

SEQ ID NO: 252074 - DNA, 75 bp, Artificial Sequence
  Synthetic
agacattggcgccgtttaatttcctagtattcgtcaaacccaccactgaggataatgctattaaggttaaggatc

SEQ ID NO: 252075 - DNA, 75 bp, Artificial Sequence
  Synthetic
agtattcgtcaaacccaccactgaggataatgctattaaggttaaggatctgtacgatatgattcataacgtcat

SEQ ID NO: 252076 - DNA, 75 bp, Artificial Sequence
  Synthetic
tttacggtatctaatatagattttatggagtatatattcttgacgcatcttaatccttctagaattagaattaca

SEQ ID NO: 252077 - DNA, 75 bp, Artificial Sequence
  Synthetic
ggatataaatattatggccgcaaccgttccgcgttttgacgatgtgtacaaaaatgcacaaagaagaattctaga

SEQ ID NO: 252078 - DNA, 75 bp, Artificial Sequence
  Synthetic
tggagtatatattcttgacgcatcttaatccttctagaattagaattacaaaagaaacggctatcactatctttg

SEQ ID NO: 252079 - DNA, 75 bp, Artificial Sequence
  Synthetic
tactctaggtggtggaactcctattggaattatttctgcacaggtattgtctgagaagtttacacaacaagccct

SEQ ID NO: 252080 - DNA, 75 bp, Artificial Sequence
  Synthetic
gtccagttttcacactactgaaaagagtggtgctgtaaaacaaaaacttggtttcaacgagtttaataacttgac

SEQ ID NO: 252081 - DNA, 75 bp, Artificial Sequence
  Synthetic
attatcactctggtatccgatgatatctctaaacttcaatctgttaagattaatttcgaatttgtatgtttggga

SEQ ID NO: 252082 - DNA, 75 bp, Artificial Sequence
  Synthetic
tctctaaacttcaatctgttaagattaatttcgaatttgtatgtttgggagaattaaatccagacatcactcttc

SEQ ID NO: 252083 - DNA, 75 bp, Artificial Sequence
  Synthetic
agacataatagtcaatagattatacatcaagagagcagaaataaccgaattagtcgtcgaatatatgattgaacg

SEQ ID NO: 252084 - DNA, 75 bp, Artificial Sequence
  Synthetic
atcaagagagcagaaataaccgaattagtcgtcgaatatatgattgaacgatttatctcctttagcgtcattgta

SEQ ID NO: 252085 - DNA, 75 bp, Artificial Sequence
  Synthetic
ttgaggacgaggataatattagatttactgtctacctaaatttcgttgaaccggaggaattgaatcttagtaagt

SEQ ID NO: 252086 - DNA, 75 bp, Artificial Sequence
  Synthetic
ttatgatggttcttccgggtgccgccaacaagggcaagattagtaaattcaagattcctatctctgactatacgg

SEQ ID NO: 252087 - DNA, 75 bp, Artificial Sequence
  Synthetic
aagattcctatctctgactatacgggatataacgacttcaatcaaacaaaaaagctcaataagatgactgtagaa

SEQ ID NO: 252088 - DNA, 75 bp, Artificial Sequence
  Synthetic
gatataacgacttcaatcaaacaaaaaagctcaataagatgactgtagaactcatgaatctaaaagaattgggtt

SEQ ID NO: 252089 - DNA, 75 bp, Artificial Sequence
  Synthetic
gtatcctggagtatggaatacatacgatatcttcggtattgaggccgctcgtggatacttgtgcgaagccatgtt

SEQ ID NO: 252090 - DNA, 75 bp, Artificial Sequence
  Synthetic
gatatcttcggtattgaggccgctcgtggatacttgtgcgaagccatgttaaacacctatggagaaggtttcgat

SEQ ID NO: 252091 - DNA, 75 bp, Artificial Sequence
  Synthetic
tcgctagtttactatgtgctagttacgaaccagaatcagttaataaattcaagttcggtgcagctagtactctta

SEQ ID NO: 252092 - DNA, 75 bp, Artificial Sequence
  Synthetic
cgaaccagaatcagttaataaattcaagttcggtgcagctagtactcttaagagagctacgttcggagataataa

SEQ ID NO: 252093 - DNA, 75 bp, Artificial Sequence
  Synthetic
aaaaagtcagaacctattaacgataatagtagctgccacttttttagcaaggtccctaatataggaactggatat

SEQ ID NO: 252094 - DNA, 75 bp, Artificial Sequence
  Synthetic
atagtagctgccacttttttagcaaggtccctaatataggaactggatattacaaatactttatcgacttgggtc

SEQ ID NO: 252095 - DNA, 75 bp, Artificial Sequence
  Synthetic
atctgataagatatcttctcaaaagatcaaggagatagaagaaacagaagacttttaattcttatcaataacata

SEQ ID NO: 252096 - DNA, 75 bp, Artificial Sequence
  Synthetic
acttttaattcttatcaataacatatttttctatgatctgtcttttaaacgatggattttccacaaatgcgcctc

SEQ ID NO: 252097 - DNA, 75 bp, Artificial Sequence
  Synthetic
gataaggatacgctattaaaacattttacttatgactggagttagaatttatagacgactcatttcgtttatcat

SEQ ID NO: 252098 - DNA, 75 bp, Artificial Sequence
  Synthetic
gtataaaaaatatagcataggtgatgactccttatttttagacattagatatgccaaaatcatagccccgcttct

SEQ ID NO: 252099 - DNA, 75 bp, Artificial Sequence
  Synthetic
gactccttatttttagacattagatatgccaaaatcatagccccgcttctatttactcccgcaacacaatgaacc

SEQ ID NO: 252100 - DNA, 75 bp, Artificial Sequence
  Synthetic
atttagataagaaggcggtcacgtcgtcaaaatatttactaatatcagtagttgtatcatctaccaacggtatat

SEQ ID NO: 252101 - DNA, 75 bp, Artificial Sequence
  Synthetic
gtcaaaatatttactaatatcagtagttgtatcatctaccaacggtatatgaataatattaatattagagttagg

SEQ ID NO: 252102 - DNA, 75 bp, Artificial Sequence
  Synthetic
tttaaaacatatttgaacttaacttcagatgatggtgcatccatagcatttttataatttcccaaatacacatta

SEQ ID NO: 252103 - DNA, 75 bp, Artificial Sequence
  Synthetic
cagatgatggtgcatccatagcatttttataatttcccaaatacacattatttgttactcttgtcattatagtgg

SEQ ID NO: 252104 - DNA, 75 bp, Artificial Sequence
  Synthetic
agttgaacgtagtagtaagtatttatacaaacttttcttatccatttataacgtacaaatggataaaactacttt

SEQ ID NO: 252105 - DNA, 75 bp, Artificial Sequence
  Synthetic
tacaaacttttcttatccatttataacgtacaaatggataaaactactttatcagtaaacgcatgcaatttagaa

SEQ ID NO: 252106 - DNA, 75 bp, Artificial Sequence
  Synthetic
gcgtacaagcagccaagacatcaacacttatattttttgttattatattggcaattagtgcgctattactctggt

SEQ ID NO: 252107 - DNA, 75 bp, Artificial Sequence
  Synthetic
acttatattttttgttattatattggcaattagtgcgctattactctggtttcagacgtctgataatccagtctt

SEQ ID NO: 252108 - DNA, 75 bp, Artificial Sequence
  Synthetic
attaaaaatacggttaacgattggaaatcattaacggatagcaaaacaaaattagaaagtgatagaggtagactt

SEQ ID NO: 252109 - DNA, 75 bp, Artificial Sequence
  Synthetic
aatcattaacggatagcaaaacaaaattagaaagtgatagaggtagacttctagccgctggtaaggatgatatat

SEQ ID NO: 252110 - DNA, 75 bp, Artificial Sequence
  Synthetic
cgcctattttatagctatgcgattggataagaaaacatatctgccgcaagctattaggcgaggtactggagacgc

SEQ ID NO: 252111 - DNA, 75 bp, Artificial Sequence
  Synthetic
gataagaaaacatatctgccgcaagctattaggcgaggtactggagacgcgtggatggttaaaaaggcggcaaaa

SEQ ID NO: 252112 - DNA, 75 bp, Artificial Sequence
  Synthetic
gtcagtatttgataaaacacaagtctaataatgttattacttgtggtaatgagatgttaaatgaattaggttata

SEQ ID NO: 252113 - DNA, 75 bp, Artificial Sequence
  Synthetic
taataatgttattacttgtggtaatgagatgttaaatgaattaggttatagcggttattttatgtcaccgcattg

SEQ ID NO: 252114 - DNA, 75 bp, Artificial Sequence
  Synthetic
taagtgttagataaatgcggtaacaaatgttcctgtaaggaaccataacagtttagatttaacattaaagatgag

SEQ ID NO: 252115 - DNA, 75 bp, Artificial Sequence
  Synthetic
gtttagatttaacattaaagatgagcataaacataataaacaaaattacaatcaaacctataacattaatatcaa

SEQ ID NO: 252116 - DNA, 75 bp, Artificial Sequence
  Synthetic
agtagtaaacgtgtacatgactcctggataacgtttagcagctaccgttcctattctagaccaaaaatttggttt

SEQ ID NO: 252117 - DNA, 75 bp, Artificial Sequence
  Synthetic
aacaacatatacacatttaataaaaataatattcattaagaagattcagattccactgtacccatcaatataaat

SEQ ID NO: 252118 - DNA, 75 bp, Artificial Sequence
  Synthetic
ctattctagaccaaaaatttggtttcatggtttcgaagcggtgttctgcaacaagacgaggatcgtgttctacat

SEQ ID NO: 252119 - DNA, 75 bp, Artificial Sequence
  Synthetic
cctgttaatcttcatttcgttttcgattctggctatttcaaaataaaatcccgatgatagacctccagactttat

SEQ ID NO: 252120 - DNA, 75 bp, Artificial Sequence
  Synthetic
attctggctatttcaaaataaaatcccgatgatagacctccagactttataatttcatctacgatgttcagcgcc

SEQ ID NO: 252121 - DNA, 75 bp, Artificial Sequence
  Synthetic
ataagctaacatcataccctcctgtatatgtgaatatggcatgatctttgtctattacaagctcggttttaactt

SEQ ID NO: 252122 - DNA, 75 bp, Artificial Sequence
  Synthetic
atatgtgaatatggcatgatctttgtctattacaagctcggttttaactttatttcctgtaataatttctctcat

SEQ ID NO: 252123 - DNA, 75 bp, Artificial Sequence
  Synthetic
tgtattgccttcaagacgggacgaagaaacgtaatatcctcaataacgttatcgttttctataataactacatat

SEQ ID NO: 252124 - DNA, 75 bp, Artificial Sequence
  Synthetic
gaaacgtaatatcctcaataacgttatcgttttctataataactacatattctacatttttattttctagctcga

SEQ ID NO: 252125 - DNA, 75 bp, Artificial Sequence
  Synthetic
taaatgtctagcgatatttcttttcgtttcctctgtacacatagtgttacaaaaccctgaaaagaagtgagtata

SEQ ID NO: 252126 - DNA, 75 bp, Artificial Sequence
  Synthetic
gtttcctctgtacacatagtgttacaaaaccctgaaaagaagtgagtatacttgtcatcatctctaatatttcct

SEQ ID NO: 252127 - DNA, 75 bp, Artificial Sequence
  Synthetic
ccttgtaatgatctggatcatcattgactatcacaacatctcttttttcttgcataacttcattgtccttcacat

SEQ ID NO: 252128 - DNA, 75 bp, Artificial Sequence
  Synthetic
gactatcacaacatctcttttttcttgcataacttcattgtccttcacatcatcgaacttctgatcattaatatg

SEQ ID NO: 252129 - DNA, 75 bp, Artificial Sequence
  Synthetic
gatggaggtctatcaataactggcacaacaataacaggagttttcgccgccgccatttagttattgaaattaatc

SEQ ID NO: 252130 - DNA, 75 bp, Artificial Sequence
  Synthetic
caacaataacaggagttttcgccgccgccatttagttattgaaattaatcatatacaactctctaatacgagtta

SEQ ID NO: 252131 - DNA, 75 bp, Artificial Sequence
  Synthetic
attgacatacttcgacaaaaagatataaaatgcgtattccaatgcttctctgtttaatgaattactaaaatatac

SEQ ID NO: 252132 - DNA, 75 bp, Artificial Sequence
  Synthetic
taaaatgcgtattccaatgcttctctgtttaatgaattactaaaatatacaaacacgtcactgtctggtaataaa

SEQ ID NO: 252133 - DNA, 75 bp, Artificial Sequence
  Synthetic
ttattttgtattgcacatgttcgtgatctatgagttcttcttcgaatggcataggatctccgaatctgaaaacgt

SEQ ID NO: 252134 - DNA, 75 bp, Artificial Sequence
  Synthetic
atctatgagttcttcttcgaatggcataggatctccgaatctgaaaacgtataaataggagttagaataataata

SEQ ID NO: 252135 - DNA, 75 bp, Artificial Sequence
  Synthetic
ctctttagcggtataattagtttttttctctcgatttctatttttagatgtgatggaaaaatgactaattttgta

SEQ ID NO: 252136 - DNA, 75 bp, Artificial Sequence
  Synthetic
ttctctcgatttctatttttagatgtgatggaaaaatgactaattttgtagcattagtatcatgaactctaatca

SEQ ID NO: 252137 - DNA, 75 bp, Artificial Sequence
  Synthetic
tagctctttgaagtttttaagagatgcatcagttggttttacagatggagtaggtgtaacaattttttgtttaat

SEQ ID NO: 252138 - DNA, 75 bp, Artificial Sequence
  Synthetic
gcatgtatgtattggagccattgtcttaactataatggtgcttgtatcgaaaaactttaatgcggataacggaag

SEQ ID NO: 252139 - DNA, 75 bp, Artificial Sequence
  Synthetic
aaaactttaatgcggataacggaagctcttcgccgcgactttctacgtcgtaattgggttctaatgccgatctct

SEQ ID NO: 252140 - DNA, 75 bp, Artificial Sequence
  Synthetic
ctcttcgccgcgactttctacgtcgtaattgggttctaatgccgatctctgaatggatactagttttctaagttc

SEQ ID NO: 252141 - DNA, 75 bp, Artificial Sequence
  Synthetic
tccaattcctccggcattatagatgtgtatacatcggtaaataaaactatagtatccaacgatcccttctcgcaa

SEQ ID NO: 252142 - DNA, 75 bp, Artificial Sequence
  Synthetic
tgtatacatcggtaaataaaactatagtatccaacgatcccttctcgcaaattctagtcttaaccaagaaatcgt

SEQ ID NO: 252143 - DNA, 75 bp, Artificial Sequence
  Synthetic
aagagtggattcttctaccgttttgttcttggatttcatataagaaactataaagtccgcactactgttaagaat

SEQ ID NO: 252144 - DNA, 75 bp, Artificial Sequence
  Synthetic
ttcttggatttcatataagaaactataaagtccgcactactgttaagaatgatcactaacgcaactatatagttc

SEQ ID NO: 252145 - DNA, 75 bp, Artificial Sequence
  Synthetic
ataactctgtagatgatacttgactttcgaataagtttgcagacaaacgaagaaagaacagacctctcttaattt

SEQ ID NO: 252146 - DNA, 75 bp, Artificial Sequence
  Synthetic
ttcgaataagtttgcagacaaacgaagaaagaacagacctctcttaatttcagaagaaaactttttttcgtattc

SEQ ID NO: 252147 - DNA, 75 bp, Artificial Sequence
  Synthetic
agaaagttaagaattagtcggttaatgttgtatttcattacccaagtttgagatttcataatattgtcaaaagac

SEQ ID NO: 252148 - DNA, 75 bp, Artificial Sequence
  Synthetic
tgttgtatttcattacccaagtttgagatttcataatattgtcaaaagacatgataatattaaagataaagcgct

SEQ ID NO: 252149 - DNA, 75 bp, Artificial Sequence
  Synthetic
ttcgctcaagaatatagtcttgttaaacgtggaaacgataactgtatttttaatcacgtcagcggcatctaaatt

SEQ ID NO: 252150 - DNA, 75 bp, Artificial Sequence
  Synthetic
aacgtggaaacgataactgtatttttaatcacgtcagcggcatctaaattaaatataggtatatttattccacac

SEQ ID NO: 252151 - DNA, 75 bp, Artificial Sequence
  Synthetic
atagcactacgttgaagatcatacagagctttattaacttctcgcttctccatattaagttgtttagttagttgt

SEQ ID NO: 252152 - DNA, 75 bp, Artificial Sequence
  Synthetic
cataataaataaattcgttagcaaaattattaattttagtgaaatagttagcgtcaactttcatagcttccttca

SEQ ID NO: 252153 - DNA, 75 bp, Artificial Sequence
  Synthetic
attattaattttagtgaaatagttagcgtcaactttcatagcttccttcaatctaatttgatgctcacatggcgc

SEQ ID NO: 252154 - DNA, 75 bp, Artificial Sequence
  Synthetic
catgcctcaggttcatcgatctctataatatctagtttcttgcgtttcacaaacacaggctcgtctctcgcgatg

SEQ ID NO: 252155 - DNA, 75 bp, Artificial Sequence
  Synthetic
taatatctagtttcttgcgtttcacaaacacaggctcgtctctcgcgatgagatctgtatagtaactatgtaaat

SEQ ID NO: 252156 - DNA, 75 bp, Artificial Sequence
  Synthetic
atatagatgacgatcctttaagagaggtataataactttaccccaatcagatagactgttgttatggtcttcgga

SEQ ID NO: 252157 - DNA, 75 bp, Artificial Sequence
  Synthetic
ggtataataactttaccccaatcagatagactgttgttatggtcttcggaaaaagaatttttataaatttttcca

SEQ ID NO: 252158 - DNA, 75 bp, Artificial Sequence
  Synthetic
tatctaagaaatccttaatgataataggaatggataatccgtctattttataaagaaatacatatcgcatattat

SEQ ID NO: 252159 - DNA, 75 bp, Artificial Sequence
  Synthetic
aggaatggataatccgtctattttataaagaaatacatatcgcatattatacttttttttggaaattggaatacc

SEQ ID NO: 252160 - DNA, 75 bp, Artificial Sequence
  Synthetic
tctaaatattttttagagaatcttagttggtccaaattcttttccaagtacggtaatagatttttcatattgaac

SEQ ID NO: 252161 - DNA, 75 bp, Artificial Sequence
  Synthetic
gttggtccaaattcttttccaagtacggtaatagatttttcatattgaacggtatcttcttgatctctggttcta

SEQ ID NO: 252162 - DNA, 75 bp, Artificial Sequence
  Synthetic
gtcactatttttataactaacgattacatcacctctaacatcatcatttaccaggatactgatcttcttttgtcg

SEQ ID NO: 252163 - DNA, 75 bp, Artificial Sequence
  Synthetic
gtaatacgatctataaaaataaggtattaaatactttttatttacggtactcttgtagtggtgataccactaatc

SEQ ID NO: 252164 - DNA, 75 bp, Artificial Sequence
  Synthetic
acatcacctctaacatcatcatttaccaggatactgatcttcttttgtcgtaaatacatgtctaatgtgttaaaa

SEQ ID NO: 252165 - DNA, 75 bp, Artificial Sequence
  Synthetic
tttcatctgtagtattcttgtcattgaaggataaactcgtactaatctcttctttaacagtctgttcaaatttat

SEQ ID NO: 252166 - DNA, 75 bp, Artificial Sequence
  Synthetic
gaaggataaactcgtactaatctcttctttaacagtctgttcaaatttatatcctatatacgaaaaaatagcaac

SEQ ID NO: 252167 - DNA, 75 bp, Artificial Sequence
  Synthetic
ttctgttctatcgtagtgtatagcaatcttatatcttcttctgtgatagtcgatacgttataaaggttgataacg

SEQ ID NO: 252168 - DNA, 75 bp, Artificial Sequence
  Synthetic
atcttatatcttcttctgtgatagtcgatacgttataaaggttgataacgaaaatatttttatttcgtgaaataa

SEQ ID NO: 252169 - DNA, 75 bp, Artificial Sequence
  Synthetic
attcgtgtctagtagatatgattttatttttggaatgatctcaattaaaatagtctctttagagtccatttaaag

SEQ ID NO: 252170 - DNA, 75 bp, Artificial Sequence
  Synthetic
atttttggaatgatctcaattaaaatagtctctttagagtccatttaaagttacaaacaactaggaaattggttt

SEQ ID NO: 252171 - DNA, 75 bp, Artificial Sequence
  Synthetic
atagattctttattctatacttaaaaaatgaaaataaatacaaaggttcttgagggttgtgttaattgaaagcga

SEQ ID NO: 252172 - DNA, 75 bp, Artificial Sequence
  Synthetic
aaatgaaaataaatacaaaggttcttgagggttgtgttaattgaaagcgagaaataatcataaattatttcatta

SEQ ID NO: 252173 - DNA, 75 bp, Artificial Sequence
  Synthetic
taaaatagtaaaattaaattaattataaaattatgtatataatttactaactttagttagataaattaataatac

SEQ ID NO: 252174 - DNA, 75 bp, Artificial Sequence
  Synthetic
gtaatggcgtggtcaattacgaataaagcggatactagtagtttcacaaagatggctgaaatcagagctcatcta

SEQ ID NO: 252175 - DNA, 75 bp, Artificial Sequence
  Synthetic
tttacgacacgcatttgatgcacccacgttgtacgttaaagcattgactaagaattatttatcgtttagtaacac

SEQ ID NO: 252176 - DNA, 75 bp, Artificial Sequence
  Synthetic
aagcggatactagtagtttcacaaagatggctgaaatcagagctcatctaagaaatagcgctgaaaataaagata

SEQ ID NO: 252177 - DNA, 75 bp, Artificial Sequence
  Synthetic
tgtaataattccatctactaagcccaaaaccaaacgaaccactactcctcgtaaaccagcggctactaaaagatc

SEQ ID NO: 252178 - DNA, 75 bp, Artificial Sequence
  Synthetic
aaaaccaaacgaaccactactcctcgtaaaccagcggctactaaaagatcaaccaaaaaggataaagaaaaggag

SEQ ID NO: 252179 - DNA, 75 bp, Artificial Sequence
  Synthetic
ttatagaggaatatcatcaaacaactgaagaaaattctccacctccgtcatcatctcctggagtcggcgacattg

SEQ ID NO: 252180 - DNA, 75 bp, Artificial Sequence
  Synthetic
tgaagaaaattctccacctccgtcatcatctcctggagtcggcgacattgtagaaagcgtggccgctgtagagct

SEQ ID NO: 252181 - DNA, 75 bp, Artificial Sequence
  Synthetic
cctatggtacaagttgaagctggtaaagtaaatcatagtgctagaagcgatctctctgacctaaaggtggctacc

SEQ ID NO: 252182 - DNA, 75 bp, Artificial Sequence
  Synthetic
aagtaaatcatagtgctagaagcgatctctctgacctaaaggtggctaccgacaatatcgttaaagatcttaaga

SEQ ID NO: 252183 - DNA, 75 bp, Artificial Sequence
  Synthetic
atcgactgttctagaggatgttcaagcagctggtatctctagacaatttacttctatgactaaagctattacaac

SEQ ID NO: 252184 - DNA, 75 bp, Artificial Sequence
  Synthetic
gcagctggtatctctagacaatttacttctatgactaaagctattacaacactatctgatctagtcaccgaggga

SEQ ID NO: 252185 - DNA, 75 bp, Artificial Sequence
  Synthetic
ttaaaacttgtaagaagtaaatgcgtgcacttttttataaagatggtaaactgtttaccgataataattttttaa

SEQ ID NO: 252186 - DNA, 75 bp, Artificial Sequence
  Synthetic
tgcacttttttataaagatggtaaactgtttaccgataataattttttaaatcctgtatcagacgataatccagc

SEQ ID NO: 252187 - DNA, 75 bp, Artificial Sequence
  Synthetic
attcctactcatttaacagatgtagtagtatatgaacaaacgtgggaagaggcattaactagattaatttttgtg

SEQ ID NO: 252188 - DNA, 75 bp, Artificial Sequence
  Synthetic
tagtatatgaacaaacgtgggaagaggcattaactagattaatttttgtgggaagtgattcaaaaggacgtagac

SEQ ID NO: 252189 - DNA, 75 bp, Artificial Sequence
  Synthetic
acagaatcgcaatgctaaaagagatcgtatttttgttagagtatataacgttatgaaacgaattaattgttttat

SEQ ID NO: 252190 - DNA, 75 bp, Artificial Sequence
  Synthetic
cgtatttttgttagagtatataacgttatgaaacgaattaattgttttataaacaaaaatataaagaaatcgtcc

SEQ ID NO: 252191 - DNA, 75 bp, Artificial Sequence
  Synthetic
tttttatgttaatggaaactatgttttttattagatttggtaaaatgaaatatcttaaggagaatgaaacagtag

SEQ ID NO: 252192 - DNA, 75 bp, Artificial Sequence
  Synthetic
ttttattagatttggtaaaatgaaatatcttaaggagaatgaaacagtagggttattaacactaaaaaataaaca

SEQ ID NO: 252193 - DNA, 75 bp, Artificial Sequence
  Synthetic
gttatcaagtttgtaggaaaggacaaagtttcacatgaatttgttgttcataagtctaatagactatataaaccg

SEQ ID NO: 252194 - DNA, 75 bp, Artificial Sequence
  Synthetic
aagtttcacatgaatttgttgttcataagtctaatagactatataaaccgttattgaaactgactgatgattcta

SEQ ID NO: 252195 - DNA, 75 bp, Artificial Sequence
  Synthetic
actaagtgaacgaaaggtatacgaatgtatcaaacagtttggtattagaatcaaggatctccgaacgtatggagt

SEQ ID NO: 252196 - DNA, 75 bp, Artificial Sequence
  Synthetic
tgtatcaaacagtttggtattagaatcaaggatctccgaacgtatggagtcaattatacgtttttatataatttt

SEQ ID NO: 252197 - DNA, 75 bp, Artificial Sequence
  Synthetic
ctcttccatcaccaaaaaagttgatagcgttaactatcaaacaaactgctgaagtggtaggtcatactccatcaa

SEQ ID NO: 252198 - DNA, 75 bp, Artificial Sequence
  Synthetic
agcgttaactatcaaacaaactgctgaagtggtaggtcatactccatcaatttcaaaaagagcttatatggcaac

SEQ ID NO: 252199 - DNA, 75 bp, Artificial Sequence
  Synthetic
aaaaattttttagacgtagtatctaaaactacgttcgatgaattcctatctatagtcgtagatcacgttaaatca

SEQ ID NO: 252200 - DNA, 75 bp, Artificial Sequence
  Synthetic
acgatacaatctatgtaagtatctacgcggacacaccgatagcatagaggatgaatttgatcattttgaagacga

SEQ ID NO: 252201 - DNA, 75 bp, Artificial Sequence
  Synthetic
tatagtcgtagatcacgttaaatcatctacggatggatgataatagatctttacacaaataattacaagaccgat

SEQ ID NO: 252202 - DNA, 75 bp, Artificial Sequence
  Synthetic
atctctcgctatgacagctttcttcggagagctaaacacgttagatattatggcattgataatgtctatatttaa

SEQ ID NO: 252203 - DNA, 75 bp, Artificial Sequence
  Synthetic
accgacagggaaacggatgtataatttttttatagtgtgatggatatgatggatatgatatatgatggatattat

SEQ ID NO: 252204 - DNA, 75 bp, Artificial Sequence
  Synthetic
ggagagctaaacacgttagatattatggcattgataatgtctatatttaaacgccatccaaacaataccattttt

SEQ ID NO: 252205 - DNA, 75 bp, Artificial Sequence
  Synthetic
gatatgatggatatgatggatatgatggatatgataaatatgataaaaatataattgttgtatatgatggatatg

SEQ ID NO: 252206 - DNA, 75 bp, Artificial Sequence
  Synthetic
tgattgatttcgaatacgataattataaggcttctcaatatttggatctgaccctcactccgatatctggaaatg

SEQ ID NO: 252207 - DNA, 75 bp, Artificial Sequence
  Synthetic
taaggcttctcaatatttggatctgaccctcactccgatatctggaaatgaatgcaagactcacgcatcgagtat

SEQ ID NO: 252208 - DNA, 75 bp, Artificial Sequence
  Synthetic
attattaaagaggatattagcgaatatatcaaaactactccccgtcttaaacgatttataaaaaaataccgcaat

SEQ ID NO: 252209 - DNA, 75 bp, Artificial Sequence
  Synthetic
atatcaaaactactccccgtcttaaacgatttataaaaaaataccgcaatagatcatatactcgtatcagtcgag

SEQ ID NO: 252210 - DNA, 75 bp, Artificial Sequence
  Synthetic
agctaaaggcatagattacgaatatataaaagacgcttgttaataagtaaatgaaaaaaaactagtcgtttataa

SEQ ID NO: 252211 - DNA, 75 bp, Artificial Sequence
  Synthetic
ataaaagacgcttgttaataagtaaatgaaaaaaaactagtcgtttataataaaacacgatatggatgccaacat

SEQ ID NO: 252212 - DNA, 75 bp, Artificial Sequence
  Synthetic
tatatagacgctttagcgaagaatgcttcagaattagaacagaggtctaccgcatacgaaataaataatgaattg

SEQ ID NO: 252213 - DNA, 75 bp, Artificial Sequence
  Synthetic
cttcagaattagaacagaggtctaccgcatacgaaataaataatgaattggaactagtatttattaaaccgccat

SEQ ID NO: 252214 - DNA, 75 bp, Artificial Sequence
  Synthetic
tatctccacgattcaggaatcgtttattcgatttaccgttactaataaggaaggtatcaaaattagaactaagat

SEQ ID NO: 252215 - DNA, 75 bp, Artificial Sequence
  Synthetic
attcgatttaccgttactaataaggaaggtatcaaaattagaactaagattccattatctaaggtacatggtcta

SEQ ID NO: 252216 - DNA, 75 bp, Artificial Sequence
  Synthetic
tgaaaaaaaacataactattaagcgctattgcgctattgtgcttaattattttgctctataaactgaatatatag

SEQ ID NO: 252217 - DNA, 75 bp, Artificial Sequence
  Synthetic
atgctatagataacatagtttgggaaaagaaatcattagtgacggaaaatcgtcttcacaaagaatgcttgttga

SEQ ID NO: 252218 - DNA, 75 bp, Artificial Sequence
  Synthetic
aaagaaatcattagtgacggaaaatcgtcttcacaaagaatgcttgttgagactatcgacagaggaacgtcatat

SEQ ID NO: 252219 - DNA, 75 bp, Artificial Sequence
  Synthetic
tcctctatccgactagaattagtcaatcttattcaagcaaaaacaaaaaactttacgatagactttaagctaaaa

SEQ ID NO: 252220 - DNA, 75 bp, Artificial Sequence
  Synthetic
atcttattcaagcaaaaacaaaaaactttacgatagactttaagctaaaatattttctaggatctggtgctcaat

SEQ ID NO: 252221 - DNA, 75 bp, Artificial Sequence
  Synthetic
taatcatccaaagtcaaggcctaatacatctctggaaatagaatttacacctagagacaatgaaacagttccata

SEQ ID NO: 252222 - DNA, 75 bp, Artificial Sequence
  Synthetic
acatctctggaaatagaatttacacctagagacaatgaaacagttccatatgatgaactaataaaggaattgacg

SEQ ID NO: 252223 - DNA, 75 bp, Artificial Sequence
  Synthetic
cttctccagagaatgtaattctttctccacctattaacgcacctataaagacttttatgttgcctaaacaagata

SEQ ID NO: 252224 - DNA, 75 bp, Artificial Sequence
  Synthetic
tccacctattaacgcacctataaagacttttatgttgcctaaacaagatatagtaggtctggatctggaaaatct

SEQ ID NO: 252225 - DNA, 75 bp, Artificial Sequence
  Synthetic
attcctataactatcagagttacatcaaaagggttgtattgttattttacacatcttggttatattattagatat

SEQ ID NO: 252226 - DNA, 75 bp, Artificial Sequence
  Synthetic
caaaagggttgtattgttattttacacatcttggttatattattagatatccagttaagagaacaatagattccg

SEQ ID NO: 252227 - DNA, 75 bp, Artificial Sequence
  Synthetic
taaggataagaactggaccgtatatctcattaagctaatagagcccgtaaatgcaatcagtgatagactagaaga

SEQ ID NO: 252228 - DNA, 75 bp, Artificial Sequence
  Synthetic
ctcattaagctaatagagcccgtaaatgcaatcagtgatagactagaagaaagtaagtatgttgaatctaaacta

SEQ ID NO: 252229 - DNA, 75 bp, Artificial Sequence
  Synthetic
tcaagtcaaagaaatacgaaggtccgtttactacaactagtgaagtcgtcgatatgttatctacatatttaccaa

SEQ ID NO: 252230 - DNA, 75 bp, Artificial Sequence
  Synthetic
gtttactacaactagtgaagtcgtcgatatgttatctacatatttaccaaagcaaccagaaggtgttattctgtt

SEQ ID NO: 252231 - DNA, 75 bp, Artificial Sequence
  Synthetic
attgattttaaaatcaaaaaggagaatactatagaccaaactgcaaatgtagtatttaggtacatgtccagtgaa

SEQ ID NO: 252232 - DNA, 75 bp, Artificial Sequence
  Synthetic
atactatagaccaaactgcaaatgtagtatttaggtacatgtccagtgaaccaattatctttggagagtcgtcta

SEQ ID NO: 252233 - DNA, 75 bp, Artificial Sequence
  Synthetic
caacgataaaggctttcctaaagaatatggttctggtaagattgtgttatataacggcgttaattatctaaataa

SEQ ID NO: 252234 - DNA, 75 bp, Artificial Sequence
  Synthetic
tatggttctggtaagattgtgttatataacggcgttaattatctaaataatatctattgtttggaatatattaat

SEQ ID NO: 252235 - DNA, 75 bp, Artificial Sequence
  Synthetic
ccgttgttgtacctattaagtttatagcagaattcttagtcaatggagaaatacttaaacctagaatcgataaaa

SEQ ID NO: 252236 - DNA, 75 bp, Artificial Sequence
  Synthetic
agcagaattcttagtcaatggagaaatacttaaacctagaatcgataaaaccatgaaatatattaactcagaaga

SEQ ID NO: 252237 - DNA, 75 bp, Artificial Sequence
  Synthetic
atagtcgaacatttaagagatcaaagcatcaaaataggagatgtctttaacgaggataaactatcggatattgga

SEQ ID NO: 252238 - DNA, 75 bp, Artificial Sequence
  Synthetic
aatttagattaaatccagaagttagttattttactaataaacgaactagagggccgttgggaattttatcaaact

SEQ ID NO: 252239 - DNA, 75 bp, Artificial Sequence
  Synthetic
ttattttactaataaacgaactagagggccgttgggaattttatcaaactacgtcaagactcttcttatttctat

SEQ ID NO: 252240 - DNA, 75 bp, Artificial Sequence
  Synthetic
gggccgttgggaattttatcaaactacgtcaagactcttcttatttctatgtattgttccaaaacatttttagac

SEQ ID NO: 252241 - DNA, 75 bp, Artificial Sequence
  Synthetic
cgattgattttggaaacggtgctgacctggaaaaatacttttatggagagattgcgttattggtagcgacggatc

SEQ ID NO: 252242 - DNA, 75 bp, Artificial Sequence
  Synthetic
cctggaaaaatacttttatggagagattgcgttattggtagcgacggatccggatgctgatgctatagctagagg

SEQ ID NO: 252243 - DNA, 75 bp, Artificial Sequence
  Synthetic
tctggaattaaaaccaagtactacaaatttgactacattcaggaaactattcgatccgatacatttgtctctagt

SEQ ID NO: 252244 - DNA, 75 bp, Artificial Sequence
  Synthetic
aatttgactacattcaggaaactattcgatccgatacatttgtctctagtgtcagagaagtattctattttggaa

SEQ ID NO: 252245 - DNA, 75 bp, Artificial Sequence
  Synthetic
cgctattcattattcttttcatccaagacattatgctacagtcatgaataacttatccgaactaactgcttctgg

SEQ ID NO: 252246 - DNA, 75 bp, Artificial Sequence
  Synthetic
agacattatgctacagtcatgaataacttatccgaactaactgcttctggaggcaaggtattaattactaccatg

SEQ ID NO: 252247 - DNA, 75 bp, Artificial Sequence
  Synthetic
ccgataaaaagacttttataattcataagaatctacctagtagcgaaaactatatgtctgtagaaaaaatagctg

SEQ ID NO: 252248 - DNA, 75 bp, Artificial Sequence
  Synthetic
taagaatctacctagtagcgaaaactatatgtctgtagaaaaaatagctgatgatagaatagtggtatataatcc

SEQ ID NO: 252249 - DNA, 75 bp, Artificial Sequence
  Synthetic
gaatacattatcaaaaagaacgatatagtcagagtgtttaatgaatacggatttgttcttgtagataatgttgat

SEQ ID NO: 252250 - DNA, 75 bp, Artificial Sequence
  Synthetic
tagtcagagtgtttaatgaatacggatttgttcttgtagataatgttgatttcgctacaattatagaacgaagta

SEQ ID NO: 252251 - DNA, 75 bp, Artificial Sequence
  Synthetic
aatggaagatagaccgtctacaagaaactttttcgaactaaatagaggagccattaaatgtgaaggtttagatgt

SEQ ID NO: 252252 - DNA, 75 bp, Artificial Sequence
  Synthetic
aactttttcgaactaaatagaggagccattaaatgtgaaggtttagatgtcgaagacttacttagttactatgtt

SEQ ID NO: 252253 - DNA, 75 bp, Artificial Sequence
  Synthetic
taataatatggtatgggttctgatatccccgttctaaatgcattaaataattccaatagagcgatttttgttcct

SEQ ID NO: 252254 - DNA, 75 bp, Artificial Sequence
  Synthetic
tccccgttctaaatgcattaaataattccaatagagcgatttttgttcctataggaccttccaactgtggatact

SEQ ID NO: 252255 - DNA, 75 bp, Artificial Sequence
  Synthetic
acttttgtagggtaacagaggttctacgtcttctaaaaataaaagttttataacatctggcctgttcataaataa

SEQ ID NO: 252256 - DNA, 75 bp, Artificial Sequence
  Synthetic
acgtcttctaaaaataaaagttttataacatctggcctgttcataaataaaaacttggcgattctatatatactc

SEQ ID NO: 252257 - DNA, 75 bp, Artificial Sequence
  Synthetic
tatagatgtgagctactgtaggtgtaccatttgattttctttctaatactatatatttctctcgaagaagttctt

SEQ ID NO: 252258 - DNA, 75 bp, Artificial Sequence
  Synthetic
accatttgattttctttctaatactatatatttctctcgaagaagttcttgcagatcatctgggaataaaatact

SEQ ID NO: 252259 - DNA, 75 bp, Artificial Sequence
  Synthetic
tttatatcgatattgatggacatttttatagttaaggataataagtatcccaaagtagataacgacgataacgaa

SEQ ID NO: 252260 - DNA, 75 bp, Artificial Sequence
  Synthetic
ttatagttaaggataataagtatcccaaagtagataacgacgataacgaagtatttatacttttaggaaatcaca

SEQ ID NO: 252261 - DNA, 75 bp, Artificial Sequence
  Synthetic
aaaattaaaggagcatgtatttttttctgaatatattgtgactccagatacatatggatctttatgcgtcgaatt

SEQ ID NO: 252262 - DNA, 75 bp, Artificial Sequence
  Synthetic
tctgaatatattgtgactccagatacatatggatctttatgcgtcgaattaaatgggtctagttttcagcacggt

SEQ ID NO: 252263 - DNA, 75 bp, Artificial Sequence
  Synthetic
ttatagatgctggaagacaagttagatggtgttctacatccaatcatatatctgaagatatacacactgataaat

SEQ ID NO: 252264 - DNA, 75 bp, Artificial Sequence
  Synthetic
atggtgttctacatccaatcatatatctgaagatatacacactgataaatttgtcatttatgatatttatacgtt

SEQ ID NO: 252265 - DNA, 75 bp, Artificial Sequence
  Synthetic
gtatttgtacaggtgcctccatcattaggagatgatagctatttaactaatccgttattgtctccgtattatcgt

SEQ ID NO: 252266 - DNA, 75 bp, Artificial Sequence
  Synthetic
taggagatgatagctatttaactaatccgttattgtctccgtattatcgtaattcagtagccagacaaatggtca

SEQ ID NO: 252267 - DNA, 75 bp, Artificial Sequence
  Synthetic
atttttaaaatatttattagaacatctgattagaagccactatagagtttctaaacatataacaatagttagata

SEQ ID NO: 252268 - DNA, 75 bp, Artificial Sequence
  Synthetic
ctgattagaagccactatagagtttctaaacatataacaatagttagatacaaggataccgaagaattaaatcta

SEQ ID NO: 252269 - DNA, 75 bp, Artificial Sequence
  Synthetic
agtttaaggcatttgtattcgcttggtttaacggcgtttcggaaaatgaaaaggtactagatacgtataaaaagg

SEQ ID NO: 252270 - DNA, 75 bp, Artificial Sequence
  Synthetic
gtttaacggcgtttcggaaaatgaaaaggtactagatacgtataaaaaggtatctgatttgatataatgaattca

SEQ ID NO: 252271 - DNA, 75 bp, Artificial Sequence
  Synthetic
ctattacttatcacgatgattgggaaccagtaatgagtcaattggtagagttttataacgaagtagccagttggc

SEQ ID NO: 252272 - DNA, 75 bp, Artificial Sequence
  Synthetic
tgctacgagacgagacgtcgcctattcctgataagttctttatacaattgaaacagccgcttagaaataaacgag

SEQ ID NO: 252273 - DNA, 75 bp, Artificial Sequence
  Synthetic
aaacagccgcttagaaataaacgagtatgtgtgtgtggtatagatccgtatccaaaagatggaactggtgtaccg

SEQ ID NO: 252274 - DNA, 75 bp, Artificial Sequence
  Synthetic
tatgtgtgtgtggtatagatccgtatccaaaagatggaactggtgtaccgttcgaatcaccaaattttacaaaaa

SEQ ID NO: 252275 - DNA, 75 bp, Artificial Sequence
  Synthetic
tatatctagattaaccggagtaattgattataaaggttataaccttaatataatagacggggttataccctggaa

SEQ ID NO: 252276 - DNA, 75 bp, Artificial Sequence
  Synthetic
gattataaaggttataaccttaatataatagacggggttataccctggaattattacttaagttgtaaattagga

SEQ ID NO: 252277 - DNA, 75 bp, Artificial Sequence
  Synthetic
gggataagatttccaagttactgctgcagcatataactaaacacgttagtgttctttattgtttgggtaaaacag

SEQ ID NO: 252278 - DNA, 75 bp, Artificial Sequence
  Synthetic
gcagcatataactaaacacgttagtgttctttattgtttgggtaaaacagatttctcgaatatacgggcaaagtt

SEQ ID NO: 252279 - DNA, 75 bp, Artificial Sequence
  Synthetic
ggatatcatccagcggccagagaccaccaattcgagaaagatcgatcatttgaaattatcaacgttttactggaa

SEQ ID NO: 252280 - DNA, 75 bp, Artificial Sequence
  Synthetic
accaattcgagaaagatcgatcatttgaaattatcaacgttttactggaattagacaacaagacacctataaatt

SEQ ID NO: 252281 - DNA, 75 bp, Artificial Sequence
  Synthetic
ctttagtgaaattttaacttgtgttctaaatggatgcggctattagaggtaatgatgttatctttgttcttaaga

SEQ ID NO: 252282 - DNA, 75 bp, Artificial Sequence
  Synthetic
ctaaatggatgcggctattagaggtaatgatgttatctttgttcttaagactataggtgtcccgtcagcatgcag

SEQ ID NO: 252283 - DNA, 75 bp, Artificial Sequence
  Synthetic
gaagcatttaaatgcgacgagttagaaagatatattgataataatccagaatgtacactattcgaaagtcttagg

SEQ ID NO: 252284 - DNA, 75 bp, Artificial Sequence
  Synthetic
aaagatatattgataataatccagaatgtacactattcgaaagtcttagggatgaggaagcatactctatagtca

SEQ ID NO: 252285 - DNA, 75 bp, Artificial Sequence
  Synthetic
cgcgtgtctagacgaaatagattatttaacggctattcaagattttattatcgaggtgtcaaactgtgtagctag

SEQ ID NO: 252286 - DNA, 75 bp, Artificial Sequence
  Synthetic
ttaacggctattcaagattttattatcgaggtgtcaaactgtgtagctagattcgcatttacagaatgcggtgcc

SEQ ID NO: 252287 - DNA, 75 bp, Artificial Sequence
  Synthetic
tgagatctaatttttcattgactaagtctacaaatagagataaaacaagttttcatattatctttttagacacgt

SEQ ID NO: 252288 - DNA, 75 bp, Artificial Sequence
  Synthetic
gtctacaaatagagataaaacaagttttcatattatctttttagacacgtataccactatggatacattgatagc

SEQ ID NO: 252289 - DNA, 75 bp, Artificial Sequence
  Synthetic
agtagatcatctgaaaatccactaacaagatcgatagacactgccgtatataggagaaaaacaactcttcgggtt

SEQ ID NO: 252290 - DNA, 75 bp, Artificial Sequence
  Synthetic
caagatcgatagacactgccgtatataggagaaaaacaactcttcgggttgtaggtactaggaaaaatccaaatt

SEQ ID NO: 252291 - DNA, 75 bp, Artificial Sequence
  Synthetic
acctcatgataatatagaagattacctattcacttacgtggatatgaacaacaatagttattacttttctctaca

SEQ ID NO: 252292 - DNA, 75 bp, Artificial Sequence
  Synthetic
ctattcacttacgtggatatgaacaacaatagttattacttttctctacaacgacgattggaggatttagttcct

SEQ ID NO: 252293 - DNA, 75 bp, Artificial Sequence
  Synthetic
tttcgttcgaagacgctataaaaagagtttcaaaaatattcattaattctataataaactttaatgatctcgatg

SEQ ID NO: 252294 - DNA, 75 bp, Artificial Sequence
  Synthetic
agtttcaaaaatattcattaattctataataaactttaatgatctcgatgaaaataattttacaacggtaccact

SEQ ID NO: 252295 - DNA, 75 bp, Artificial Sequence
  Synthetic
gcattatgtaaaaaacgatcgcataaacatccgcatcaactatcgttggaaaatggtgctattagaatttacaaa

SEQ ID NO: 252296 - DNA, 75 bp, Artificial Sequence
  Synthetic
aacatccgcatcaactatcgttggaaaatggtgctattagaatttacaaaactggtaatccacatagttgtaaag

SEQ ID NO: 252297 - DNA, 75 bp, Artificial Sequence
  Synthetic
cgcgatatctccattaataatgatgtcgaattcgtgttgtatacccatactgaattgatgaacgaataccgacgg

SEQ ID NO: 252298 - DNA, 75 bp, Artificial Sequence
  Synthetic
taaactgtttaatattgcacaaagaattttagacactaactctgttttattaaccgaacgaggagaccatatagt

SEQ ID NO: 252299 - DNA, 75 bp, Artificial Sequence
  Synthetic
attttagacactaactctgttttattaaccgaacgaggagaccatatagtttggattaataattcatggaaattt

SEQ ID NO: 252300 - DNA, 75 bp, Artificial Sequence
  Synthetic
aactaattctatcaataagacatcaactacctaaggaatattcaagcgaattactctgtccgaggaaacgaaaga

SEQ ID NO: 252301 - DNA, 75 bp, Artificial Sequence
  Synthetic
actacctaaggaatattcaagcgaattactctgtccgaggaaacgaaagactgtagaagctaacatacgagacat

SEQ ID NO: 252302 - DNA, 75 bp, Artificial Sequence
  Synthetic
acctatccggataaacttccgtttaaaaatggtgtattggacctggtagacggaatgttttactctggagatgat

SEQ ID NO: 252303 - DNA, 75 bp, Artificial Sequence
  Synthetic
aaaatggtgtattggacctggtagacggaatgttttactctggagatgatgctaaaaaatatacgtgtactgtat

SEQ ID NO: 252304 - DNA, 75 bp, Artificial Sequence
  Synthetic
aaaattcgtcgaaaacagtccagaaatggaagagttaatgaatatcattaacgatatccaaccattaacggatga

SEQ ID NO: 252305 - DNA, 75 bp, Artificial Sequence
  Synthetic
atggaagagttaatgaatatcattaacgatatccaaccattaacggatgaaaataagaaaaatagagagctgtat

SEQ ID NO: 252306 - DNA, 75 bp, Artificial Sequence
  Synthetic
gtggtgctaccaaaggatgtttaacattcttttttggagaaaccgcaactggaaagtcgacaaccaaacgtttgt

SEQ ID NO: 252307 - DNA, 75 bp, Artificial Sequence
  Synthetic
attcttttttggagaaaccgcaactggaaagtcgacaaccaaacgtttgttaaagtctgctatcggtgacctgtt

SEQ ID NO: 252308 - DNA, 75 bp, Artificial Sequence
  Synthetic
acagatgtattggataaaggacctaatccatttatcgctaatatgcatttaaaaagatctgtattctgtagcgaa

SEQ ID NO: 252309 - DNA, 75 bp, Artificial Sequence
  Synthetic
atccatttatcgctaatatgcatttaaaaagatctgtattctgtagcgaactacctgattttgcatgtagtggat

SEQ ID NO: 252310 - DNA, 75 bp, Artificial Sequence
  Synthetic
taaaaagttgacagaaccttgtgtcattggaagaccgtgtttctccaataaaattaataatagaaaccatgcgac

SEQ ID NO: 252311 - DNA, 75 bp, Artificial Sequence
  Synthetic
attggaagaccgtgtttctccaataaaattaataatagaaaccatgcgacaatcattatcgatactaattacaaa

SEQ ID NO: 252312 - DNA, 75 bp, Artificial Sequence
  Synthetic
cattaatgagaagaattgccgtcgtgcgattcagaacacacttttctcaaccttctggtagagaggctgctgaaa

SEQ ID NO: 252313 - DNA, 75 bp, Artificial Sequence
  Synthetic
gcgattcagaacacacttttctcaaccttctggtagagaggctgctgaaaataatgacgcgtacgataaagtcaa

SEQ ID NO: 252314 - DNA, 75 bp, Artificial Sequence
  Synthetic
aaaatacagaataatagatatagattcgcatttctatacttgttggttaaatggtacaaaaaatatcatattcct

SEQ ID NO: 252315 - DNA, 75 bp, Artificial Sequence
  Synthetic
tcgcatttctatacttgttggttaaatggtacaaaaaatatcatattcctattatgaaactatatcctacaccgg

SEQ ID NO: 252316 - DNA, 75 bp, Artificial Sequence
  Synthetic
tctcaaaataggtactctgttggtatctagctctgtaaagcatattccattaatgacagacctctccaaaaaggg

SEQ ID NO: 252317 - DNA, 75 bp, Artificial Sequence
  Synthetic
tctagctctgtaaagcatattccattaatgacagacctctccaaaaagggatatatattgtacgataatgtggtt

SEQ ID NO: 252318 - DNA, 75 bp, Artificial Sequence
  Synthetic
agaaaatatccaagtattttaattctagactatttggacacgatatagagagcttcatcaatagacataagaaat

SEQ ID NO: 252319 - DNA, 75 bp, Artificial Sequence
  Synthetic
tagactatttggacacgatatagagagcttcatcaatagacataagaaatttgccaatgttagtgatgaatatct

SEQ ID NO: 252320 - DNA, 75 bp, Artificial Sequence
  Synthetic
tcatctccgtaaatatatgccatatatttatagaagatatcacatatctaaatgaataccggaatcatagattta

SEQ ID NO: 252321 - DNA, 75 bp, Artificial Sequence
  Synthetic
caactatattacctcatcagttagctactttagattatctagttagaactatcatagatgagaacagaagcgtgt

SEQ ID NO: 252322 - DNA, 75 bp, Artificial Sequence
  Synthetic
tactttagattatctagttagaactatcatagatgagaacagaagcgtgttattgttccatattatgggatcggg

SEQ ID NO: 252323 - DNA, 75 bp, Artificial Sequence
  Synthetic
atcatagatgagaacagaagcgtgttattgttccatattatgggatcgggtaaaacaataatcgctttgttgttc

SEQ ID NO: 252324 - DNA, 75 bp, Artificial Sequence
  Synthetic
taaacttcgcaatattcatcaatttagatagaaacttatactcatcatctgttttaggaatccatgtattattac

SEQ ID NO: 252325 - DNA, 75 bp, Artificial Sequence
  Synthetic
aggtttacattttagtaccgaacatcaacatcttaaaaattttcaattataatatgggtgtagctatgaacttgt

SEQ ID NO: 252326 - DNA, 75 bp, Artificial Sequence
  Synthetic
caacatcttaaaaattttcaattataatatgggtgtagctatgaacttgtttaatgacgaattcatagctgagaa

SEQ ID NO: 252327 - DNA, 75 bp, Artificial Sequence
  Synthetic
ttttattctcttaattataacgataacgtcattaattataacggattaagtcgctacaataactctatttttatc

SEQ ID NO: 252328 - DNA, 75 bp, Artificial Sequence
  Synthetic
acgtcattaattataacggattaagtcgctacaataactctatttttatcgttgatgaggcgcataatatttttg

SEQ ID NO: 252329 - DNA, 75 bp, Artificial Sequence
  Synthetic
cgtgataaaaaataaaaacaagattccttttctactattgtctggatctcccattactaacacacctaatacgct

SEQ ID NO: 252330 - DNA, 75 bp, Artificial Sequence
  Synthetic
ccttttctactattgtctggatctcccattactaacacacctaatacgctgggtcatattatagatttaatgtcc

SEQ ID NO: 252331 - DNA, 75 bp, Artificial Sequence
  Synthetic
acggatatggatgaggtcaacgaagcaggtctattcgacactattattattgaagatgatgtgaatttagcatat

SEQ ID NO: 252332 - DNA, 75 bp, Artificial Sequence
  Synthetic
ttattagtcgtggtaagaaagtaattcagacacttcttaacgaacgcggagtgaatgtactcaaggatttgctta

SEQ ID NO: 252333 - DNA, 75 bp, Artificial Sequence
  Synthetic
tcagacacttcttaacgaacgcggagtgaatgtactcaaggatttgcttaaaggaagaatatcatattacgaaat

SEQ ID NO: 252334 - DNA, 75 bp, Artificial Sequence
  Synthetic
agatatcacggacgtaaatttctagatactcgagtagtatattgtcacatgtctaaacttcaagagagagattat

SEQ ID NO: 252335 - DNA, 75 bp, Artificial Sequence
  Synthetic
atcatgaaatgtttgataaaaatatgtataacgtgtcaatggcagtattgggacaacttaatctgatgaataatt

SEQ ID NO: 252336 - DNA, 75 bp, Artificial Sequence
  Synthetic
gtataacgtgtcaatggcagtattgggacaacttaatctgatgaataatttagatacgttatttcaggaacagga

SEQ ID NO: 252337 - DNA, 75 bp, Artificial Sequence
  Synthetic
ggacaacttaatctgatgaataatttagatacgttatttcaggaacaggataaggaattgtacccaaatctgaaa

SEQ ID NO: 252338 - DNA, 75 bp, Artificial Sequence; identical to SEQ ID NO: 45174
  Synthetic

SEQ ID NO: 252339 - DNA, 75 bp, Artificial Sequence
  Synthetic
ttccaaatttaagtactttatcaatcggatacagacactcaagggaaaacactttatatacttctctaattctac

SEQ ID NO: 252340 - DNA, 75 bp, Artificial Sequence
  Synthetic
atcatgctcagtaatggatattctgaatataatggttctcagggaactaatccacatatgataaacggcaaacca

SEQ ID NO: 252341 - DNA, 75 bp, Artificial Sequence
  Synthetic
aatataatggttctcagggaactaatccacatatgataaacggcaaaccaaaaacatttgctatcgttactagta

SEQ ID NO: 252342 - DNA, 75 bp, Artificial Sequence
  Synthetic
attagatgtgtataattctcctgaaaacgatgatggcagtcaattgatgtttttgttttcgtcaaacattatgtc

SEQ ID NO: 252343 - DNA, 75 bp, Artificial Sequence
  Synthetic
aacgatgatggcagtcaattgatgtttttgttttcgtcaaacattatgtctgaatcctatactctgaaagaggta

SEQ ID NO: 252344 - DNA, 75 bp, Artificial Sequence
  Synthetic
cggatactttttctcaatacaaccaaattcttggacgatctattagaaaattctcttacgccgatatttctgaac

SEQ ID NO: 252345 - DNA, 75 bp, Artificial Sequence
  Synthetic
aattcttggacgatctattagaaaattctcttacgccgatatttctgaacccgttaatgtatatcttttagcagc

SEQ ID NO: 252346 - DNA, 75 bp, Artificial Sequence
  Synthetic
gtgacgtcattaaacgattatacacaggatgaattgattaatgttttaccctttgacatcaaaaagctgttgtat

SEQ ID NO: 252347 - DNA, 75 bp, Artificial Sequence
  Synthetic
aggatgaattgattaatgttttaccctttgacatcaaaaagctgttgtatctaaaatttaagactaaagaaacga

SEQ ID NO: 252348 - DNA, 75 bp, Artificial Sequence
  Synthetic
atagttggttgtagcggttgggaaggctgtctgctggcgaccatcatattatctctagctagttgttctcgcaac

SEQ ID NO: 252349 - DNA, 75 bp, Artificial Sequence
  Synthetic
atagttggttgtagcggttgggtaggctgtctgctggcgaccatcatattatctctagctagttgttctcgcaac

SEQ ID NO: 252350 - DNA, 75 bp, Artificial Sequence
  Synthetic
atagttggttgtagcggttgggcaggctgtctgctggcgaccatcatattatctctagctagttgttctcgcaac

SEQ ID NO: 252351 - DNA, 75 bp, Artificial Sequence
  Synthetic
atagttggttgtagcggttggggaggctgtctgctggcgaccatcatattatctctagctagttgttctcgcaac

SEQ ID NO: 252352 - DNA, 75 bp, Artificial Sequence
  Synthetic
gatgtctgaaacgtattctcttccaccacatccatcaattgtaaaagttttattgggagaattggtcagacaatt

SEQ ID NO: 252353 - DNA, 75 bp, Artificial Sequence
  Synthetic
ccacatccatcaattgtaaaagttttattgggagaattggtcagacaatttttttataataattctcgtattaag

SEQ ID NO: 252354 - DNA, 75 bp, Artificial Sequence
  Synthetic
tggttacatcagttataaaaaataaagaagacgctaggaattacatagatgatattgtaaacggtcacttctttg

SEQ ID NO: 252355 - DNA, 75 bp, Artificial Sequence
  Synthetic
agaagacgctaggaattacatagatgatattgtaaacggtcacttctttgtatcgaataaagtatttgataaatc

SEQ ID NO: 252356 - DNA, 75 bp, Artificial Sequence
  Synthetic
attattacagtaccgtttagactttcctacgaaccatttgtttggggagttaactttcgtaaagaatataacgtg

SEQ ID NO: 252357 - DNA, 75 bp, Artificial Sequence
  Synthetic
cctacgaaccatttgtttggggagttaactttcgtaaagaatataacgtggtatcttctccataaaactgatgag

SEQ ID NO: 252358 - DNA, 75 bp, Artificial Sequence
  Synthetic
tttgttaccaatggatatcttccagttacattggaaccacatgagttgacattagacataaaaactaatattagg

SEQ ID NO: 252359 - DNA, 75 bp, Artificial Sequence
  Synthetic
ttacattggaaccacatgagttgacattagacataaaaactaatattaggaatgccgtatataaggcgtatctcc

SEQ ID NO: 252360 - DNA, 75 bp, Artificial Sequence
  Synthetic
caagaaaatagaaattcgtgaagacgtggaattacctctcggcgaaatagttaataattctgtagttataaacgt

SEQ ID NO: 252361 - DNA, 75 bp, Artificial Sequence
  Synthetic
gtggaattacctctcggcgaaatagttaataattctgtagttataaacgttccgtgtgtaataacctacgcatat

SEQ ID NO: 252362 - DNA, 75 bp, Artificial Sequence
  Synthetic
gaacattaaacatcgaagatgaatcaaatgtaactattcaatgtggagatttaatctgtaaactaagtagagatt

SEQ ID NO: 252363 - DNA, 75 bp, Artificial Sequence
  Synthetic
aaatgtaactattcaatgtggagatttaatctgtaaactaagtagagattcgggtactgtatcatttagcgattc

SEQ ID NO: 252364 - DNA, 75 bp, Artificial Sequence
  Synthetic
aatgcgtatgataacggcatcgaagtctccgccgttctaatggaggctcaacaaggtaccgaatctagttttgtt

SEQ ID NO: 252365 - DNA, 75 bp, Artificial Sequence
  Synthetic
tctccgccgttctaatggaggctcaacaaggtaccgaatctagttttgtttttctcgcgaatatcgttgactcat

SEQ ID NO: 252366 - DNA, 75 bp, Artificial Sequence
  Synthetic
aatacgaatactatggcaataattgcgaatgttttattcccttcgatatatttttgataatatgaaaaacatgcc

SEQ ID NO: 252367 - DNA, 75 bp, Artificial Sequence
  Synthetic
cgaatgttttattcccttcgatatatttttgataatatgaaaaacatgcctctctcaaatcagacaaccatttca

SEQ ID NO: 252368 - DNA, 75 bp, Artificial Sequence
  Synthetic
atagaaaattctaatcctcctattacatataactttccatcgttaacacaagtactaacttctgattttaacgac

SEQ ID NO: 252369 - DNA, 75 bp, Artificial Sequence
  Synthetic
ggtggttgcagctcgtataatctccccagaataatatacttgcgtgtcgtcgttcaatttatacggatttctata

SEQ ID NO: 252370 - DNA, 75 bp, Artificial Sequence
  Synthetic
ccagaataatatacttgcgtgtcgtcgttcaatttatacggatttctataattctctgttatataatgaggttta

SEQ ID NO: 252371 - DNA, 75 bp, Artificial Sequence
  Synthetic
gtgttctgaatttagatagttgatcagaatgaatgtttattggtgttggaaaaattatccatgctgcgtctgcag

SEQ ID NO: 252372 - DNA, 75 bp, Artificial Sequence
  Synthetic
agaatgaatgtttattggtgttggaaaaattatccatgctgcgtctgcagagtggttgatagttgttcctagata

SEQ ID NO: 252373 - DNA, 75 bp, Artificial Sequence
  Synthetic
agcaaattgtctagataaaatactgaatcaaatggcgcagacatattagcggatctaatggaatccaattgattg

SEQ ID NO: 252374 - DNA, 75 bp, Artificial Sequence
  Synthetic
aatcaaatggcgcagacatattagcggatctaatggaatccaattgattgactatcttttgaaaatatacatttt

SEQ ID NO: 252375 - DNA, 75 bp, Artificial Sequence
  Synthetic
agcaataatgataattccatcatcgtgtttttttgcctcttcataagaactatattttttcttattccaatgaac

SEQ ID NO: 252376 - DNA, 75 bp, Artificial Sequence
  Synthetic
ctcatgatttacgttaacgttttcgtgtgataagatagtggtcagttcatcctttgataattttccaaattctgg

SEQ ID NO: 252377 - DNA, 75 bp, Artificial Sequence
  Synthetic
tgtttttttgcctcttcataagaactatattttttcttattccaatgaaccagattaatctctccagagtatttg

SEQ ID NO: 252378 - DNA, 75 bp, Artificial Sequence
  Synthetic
cataatcgtcttccttcccccaatatatatgtattgttgataacacatattcattggggagaaaccctccactta

SEQ ID NO: 252379 - DNA, 75 bp, Artificial Sequence
  Synthetic
tatatgtattgttgataacacatattcattggggagaaaccctccacttatatatcctcctttaaaattaatcct

SEQ ID NO: 252380 - DNA, 75 bp, Artificial Sequence
  Synthetic
gtggttggtttcgactcattataatgtatgtctaacgtcttcaatcgcgtgtcagaaattgcttttttagtttct

SEQ ID NO: 252381 - DNA, 75 bp, Artificial Sequence
  Synthetic
gtatgtctaacgtcttcaatcgcgtgtcagaaattgcttttttagtttctatattaataggagatagttgttgag

SEQ ID NO: 252382 - DNA, 75 bp, Artificial Sequence
  Synthetic
gtctagaaatagctcttagtatgggatttacaatggatgaggaagtgatatttgaaactcctagagaattaatat

SEQ ID NO: 252383 - DNA, 75 bp, Artificial Sequence
  Synthetic
atttacaatggatgaggaagtgatatttgaaactcctagagaattaatatctattaaacgaataaaagatattcc

SEQ ID NO: 252384 - DNA, 75 bp, Artificial Sequence
  Synthetic
gctgcgtgtataacaagtgacggatatccgttaataggagctagaagaacttcattcgcattccaggcgatatta

SEQ ID NO: 252385 - DNA, 75 bp, Artificial Sequence
  Synthetic
atccgttaataggagctagaagaacttcattcgcattccaggcgatattatctcaacaaaattcagattctatct

SEQ ID NO: 252386 - DNA, 75 bp, Artificial Sequence
  Synthetic
gtttatgtactacaatgaactaagagaaatctttagacggttgagaaaaggttctatcaacaatatcgatcctca

SEQ ID NO: 252387 - DNA, 75 bp, Artificial Sequence
  Synthetic
gaaatctttagacggttgagaaaaggttctatcaacaatatcgatcctcacttcgaagagttaatattattgggt

SEQ ID NO: 252388 - DNA, 75 bp, Artificial Sequence
  Synthetic
ttaaagattgtttaagaagagaattaaaagaggaaagtgatgaacatataacagtaaaagaattcggaaatgtaa

SEQ ID NO: 252389 - DNA, 75 bp, Artificial Sequence
  Synthetic
aaaagaggaaagtgatgaacatataacagtaaaagaattcggaaatgtaattctaaaacttacaacgagtgataa

SEQ ID NO: 252390 - DNA, 75 bp, Artificial Sequence
  Synthetic
tattgcatggcatgttttattaatcaatcgttggaggatttatcacatactagtatttacaatgtagaaattaga

SEQ ID NO: 252391 - DNA, 75 bp, Artificial Sequence
  Synthetic
aatcgttggaggatttatcacatactagtatttacaatgtagaaattagaaagattaaatcgttaaatgattgta

SEQ ID NO: 252392 - DNA, 75 bp, Artificial Sequence
  Synthetic
gtcttatatttataatatactaattaatagtaaatgagcttttacagatctagtataattagtcagattattaag

SEQ ID NO: 252393 - DNA, 75 bp, Artificial Sequence
  Synthetic
aatagtaaatgagcttttacagatctagtataattagtcagattattaagtataatagacgactagctaagtcta

SEQ ID NO: 252394 - DNA, 75 bp, Artificial Sequence
  Synthetic
catatctttttcaacactcgacatgagatccttaagggtcatatcgtctagattttgttgagatgctgctcctgg

SEQ ID NO: 252395 - DNA, 75 bp, Artificial Sequence
  Synthetic
tattacactcacggcattcgttaaccaatgcctatggtgtcataaacgagtatccgtgtccgctattttattaac

SEQ ID NO: 252396 - DNA, 75 bp, Artificial Sequence
  Synthetic
caatgcctatggtgtcataaacgagtatccgtgtccgctattttattaactactgataacaaaatattagtatgt

SEQ ID NO: 252397 - DNA, 75 bp, Artificial Sequence
  Synthetic
ctgaaataattagaactagaaacatgtatagaaagaaacgattatttctgaattattccaattatttgaacaaac

SEQ ID NO: 252398 - DNA, 75 bp, Artificial Sequence
  Synthetic
gtatagaaagaaacgattatttctgaattattccaattatttgaacaaacaggaaagaagtatactatcgtcatt

SEQ ID NO: 252399 - DNA, 75 bp, Artificial Sequence
  Synthetic
gataatgatagaataaacgctatttatccgggtggtatacccaaaaggggtgagaacgttccagagtgtttatcc

SEQ ID NO: 252400 - DNA, 75 bp, Artificial Sequence
  Synthetic
atccgggtggtatacccaaaaggggtgagaacgttccagagtgtttatccagggaaatcaaagaagaagttaata

SEQ ID NO: 252401 - DNA, 75 bp, Artificial Sequence
  Synthetic
cactcgtttttttattcatggtatcatagaagataccattattaacaaattttttgaggtaattttctttgttgg

SEQ ID NO: 252402 - DNA, 75 bp, Artificial Sequence
  Synthetic
atagaagataccattattaacaaattttttgaggtaattttctttgttggaagaatatctctaacgagtgatcaa

SEQ ID NO: 252403 - DNA, 75 bp, Artificial Sequence
  Synthetic
atgaaataaaggatctaatatttttagatccgaattcaggtaatggactccaatacgaaattgcaaaatatgctc

SEQ ID NO: 252404 - DNA, 75 bp, Artificial Sequence
  Synthetic
agatccgaattcaggtaatggactccaatacgaaattgcaaaatatgctctagatactgcaaaacttaaatgtta

SEQ ID NO: 252405 - DNA, 75 bp, Artificial Sequence
  Synthetic
tcattaaaaaaattaactgaggatgattgattagaaaatataaattaatttaccatcgtgtatttttataacggg

SEQ ID NO: 252406 - DNA, 75 bp, Artificial Sequence
  Synthetic
attgattagaaaatataaattaatttaccatcgtgtatttttataacgggattgtctggcatatcatgtagatag

SEQ ID NO: 252407 - DNA, 75 bp, Artificial Sequence
  Synthetic
catctacgcctttaaatcctctatttattgatattaatctattagaattggaataccaaatattagtaccctcaa

SEQ ID NO: 252408 - DNA, 75 bp, Artificial Sequence
  Synthetic
ttagtttattggtaatattttttttagacgatagatcgatggctcttgaaaccaaggttttccaaccggactcat

SEQ ID NO: 252409 - DNA, 75 bp, Artificial Sequence
  Synthetic
attagcatgaatccattctaatgatgtatgtttaaacactctaaacaattgtacaaattcttttgatttgttttg

SEQ ID NO: 252410 - DNA, 75 bp, Artificial Sequence
  Synthetic
gtatgtttaaacactctaaacaattgtacaaattcttttgatttgttttgaatgatttcaaataggtcttcgtct

SEQ ID NO: 252411 - DNA, 75 bp, Artificial Sequence
  Synthetic
tagccattataaagtgcacgtttacatatctacgttctggaggagtaagaacgtgactattgagacgaatggctc

SEQ ID NO: 252412 - DNA, 75 bp, Artificial Sequence
  Synthetic
atatctacgttctggaggagtaagaacgtgactattgagacgaatggctcttcctactatctgacgaagagacgc

SEQ ID NO: 252413 - DNA, 75 bp, Artificial Sequence
  Synthetic
aagatatcattgattgagaagaaactaataccctcgcctccgctagaagagaatacgcatgttttaatgtattct

SEQ ID NO: 252414 - DNA, 75 bp, Artificial Sequence
  Synthetic
taataccctcgcctccgctagaagagaatacgcatgttttaatgtattctccgttagtgtttgattcttggttaa

SEQ ID NO: 252415 - DNA, 75 bp, Artificial Sequence
  Synthetic
atcttttgttctagatgagaactctatattagagataccaaagactttgaaatatagtaataagatttctattcc

SEQ ID NO: 252416 - DNA, 75 bp, Artificial Sequence
  Synthetic
atattagagataccaaagactttgaaatatagtaataagatttctattcctgactgattaacaaatggttcaaag

SEQ ID NO: 252417 - DNA, 75 bp, Artificial Sequence
  Synthetic
atattcccaaacatacatctataaatttgacgcttttctcttttaattcagtaaatagagagatatcagccgcaa

SEQ ID NO: 252418 - DNA, 75 bp, Artificial Sequence
  Synthetic
tttgacgcttttctcttttaattcagtaaatagagagatatcagccgcaatagcatcccctcccaatagttctcc

SEQ ID NO: 252419 - DNA, 75 bp, Artificial Sequence
  Synthetic
ttagaaaattctctatctcttaatgaatttttaaaatcattatatagggttgctatctcttgtgtgtattctccc

SEQ ID NO: 252420 - DNA, 75 bp, Artificial Sequence
  Synthetic
aatttttaaaatcattatatagggttgctatctcttgtgtgtattctcccggatcacgattttgtctttcaggaa

SEQ ID NO: 252421 - DNA, 75 bp, Artificial Sequence
  Synthetic
catacgtctcagaattctaaatgatgatataccagtttttatttctgcgagtttagccttttgataaatctcttc

SEQ ID NO: 252422 - DNA, 75 bp, Artificial Sequence
  Synthetic
gatataccagtttttatttctgcgagtttagccttttgataaatctcttcttgcttttttgacatattaacgtat

SEQ ID NO: 252423 - DNA, 75 bp, Artificial Sequence
  Synthetic
tgtcctgtatcagttgcattttcagcactcgactgaatattagtacattcattgtctattattaacgtatttcta

SEQ ID NO: 252424 - DNA, 75 bp, Artificial Sequence
  Synthetic
atgatgcagacccttccacatcatcaaaaatagaaaactcgttattaactatgtacgaacataggcctcctagtt

SEQ ID NO: 252425 - DNA, 75 bp, Artificial Sequence
  Synthetic
aaaaatagaaaactcgttattaactatgtacgaacataggcctcctagtttggagactaattctttttcatcgac

SEQ ID NO: 252426 - DNA, 75 bp, Artificial Sequence
  Synthetic
tggtgttgtaaggatcctggtcgcagtaagttaaccaacatggtgaattcttgcacactattaacgataggtgta

SEQ ID NO: 252427 - DNA, 75 bp, Artificial Sequence
  Synthetic
gtaagttaaccaacatggtgaattcttgcacactattaacgataggtgtagccgataaacaaatcatcttatggt

SEQ ID NO: 252428 - DNA, 75 bp, Artificial Sequence
  Synthetic
aaaattatatactgaccgagtaggacggatcttaccatcttctttgattaatgatttagaaatgaagttatgaca

SEQ ID NO: 252429 - DNA, 75 bp, Artificial Sequence
  Synthetic
cggatcttaccatcttctttgattaatgatttagaaatgaagttatgacattcatcaatgatgacgcatattcta

SEQ ID NO: 252430 - DNA, 75 bp, Artificial Sequence
  Synthetic
tagtaaaaaatttatttctaaaattttgatcatcgtaattaataaaaatacaatccttcgttatctctggagcgt

SEQ ID NO: 252431 - DNA, 75 bp, Artificial Sequence
  Synthetic
ttgatcatcgtaattaataaaaatacaatccttcgttatctctggagcgtatctgagtatagtgtttatccaagg

SEQ ID NO: 252432 - DNA, 75 bp, Artificial Sequence
  Synthetic
aataagataattgcccaatttgtataaatatccttaagatgtttgagaatatatacagtagtcattgttttaccg

SEQ ID NO: 252433 - DNA, 75 bp, Artificial Sequence
  Synthetic
aaatatccttaagatgtttgagaatatatacagtagtcattgttttaccgacacctgtttcatggaacaataaaa

SEQ ID NO: 252434 - DNA, 75 bp, Artificial Sequence
  Synthetic
gaaaactcttgctacaaaatgttgataatccttgaggcgtactacgtctgaccccatcatttcaacgggcatatt

SEQ ID NO: 252435 - DNA, 75 bp, Artificial Sequence
  Synthetic
taatccttgaggcgtactacgtctgaccccatcatttcaacgggcatattagtagttctgcgtaaggcataatcg

SEQ ID NO: 252436 - DNA, 75 bp, Artificial Sequence
  Synthetic
tttatgagtgataagtaataactatgttttaaaaatcacagcagtagtttaactagtcttctctgatgtttgttt

SEQ ID NO: 252437 - DNA, 75 bp, Artificial Sequence
  Synthetic
gttttaaaaatcacagcagtagtttaactagtcttctctgatgtttgttttcgatactttttgaatcagaagtca

SEQ ID NO: 252438 - DNA, 75 bp, Artificial Sequence
  Synthetic
gtaatagagagcttcgtatactctattcgaaaactctaagaacttattaatgaattccgtatccactggatcgtt

SEQ ID NO: 252439 - DNA, 75 bp, Artificial Sequence
  Synthetic
ttcgaaaactctaagaacttattaatgaattccgtatccactggatcgtttaaaatactaaattgaacagtgttc

SEQ ID NO: 252440 - DNA, 75 bp, Artificial Sequence
  Synthetic
tgacggacttaacatgagacataaataaatccaaattttttttataaacatcactagccaccataatggcgctat

SEQ ID NO: 252441 - DNA, 75 bp, Artificial Sequence
  Synthetic
taaatccaaattttttttataaacatcactagccaccataatggcgctatctttcaaccaactatcgcttacgca

SEQ ID NO: 252442 - DNA, 75 bp, Artificial Sequence
  Synthetic
agactacaatatattctcatagtatcgattacacctctaccgaatagagtgggaagtttaataatacaatatttt

SEQ ID NO: 252443 - DNA, 75 bp, Artificial Sequence
  Synthetic
cgattacacctctaccgaatagagtgggaagtttaataatacaatatttttcgtttacaaaatcaaataatggtc

SEQ ID NO: 252444 - DNA, 75 bp, Artificial Sequence
  Synthetic
ataatcgctaatgtatagattgttttcagtgagatgattattagatttaatagcatctcgttcacgtttgaacag

SEQ ID NO: 252445 - DNA, 75 bp, Artificial Sequence
  Synthetic
tcagtgagatgattattagatttaatagcatctcgttcacgtttgaacagtttattgcgtgcgctgaggtcggca

SEQ ID NO: 252446 - DNA, 75 bp, Artificial Sequence
  Synthetic
tcccataatactttacgctattaatctttaaaatttcatagactttatctagatcgctttctggtaacatgatat

SEQ ID NO: 252447 - DNA, 75 bp, Artificial Sequence
  Synthetic
ctttaaaatttcatagactttatctagatcgctttctggtaacatgatatcatgtgtaaaaagttttaacatgtc

SEQ ID NO: 252448 - DNA, 75 bp, Artificial Sequence
  Synthetic
actctagaaatctgaagaaagtaattagctccatattccagactaggtaatgggcttttacctaaagacaagtta

SEQ ID NO: 252449 - DNA, 75 bp, Artificial Sequence
  Synthetic
tagctccatattccagactaggtaatgggcttttacctaaagacaagttaagttctggcaatgtttcataaaatg

SEQ ID NO: 252450 - DNA, 75 bp, Artificial Sequence
  Synthetic
gatattttttacaatttcatccatttacaactctatagtttgttttcattattattagttattatctcccataat

SEQ ID NO: 252451 - DNA, 75 bp, Artificial Sequence
  Synthetic
tacaactctatagtttgttttcattattattagttattatctcccataatcttggtaatacttacaccttgatca

SEQ ID NO: 252452 - DNA, 75 bp, Artificial Sequence
  Synthetic
atacaactaccaattgtttttgtacataatagattggatgattgacatccatggtggaataaactactcgaacag

SEQ ID NO: 252453 - DNA, 75 bp, Artificial Sequence
  Synthetic
ataatagattggatgattgacatccatggtggaataaactactcgaacagatagtttatctttccccctagatac

SEQ ID NO: 252454 - DNA, 75 bp, Artificial Sequence
  Synthetic
aagaatatctttggtgtaaagttaaaagttagggttcttgttccattattgctttttgtcagtagttcgttataa

SEQ ID NO: 252455 - DNA, 75 bp, Artificial Sequence
  Synthetic
aagttagggttcttgttccattattgctttttgtcagtagttcgttataaattctcgagatgggcccgttctctg

SEQ ID NO: 252456 - DNA, 75 bp, Artificial Sequence
  Synthetic
taaaattatgtatataatttactaactttagttagataaattaataatacataagttttagtacattaatattat

SEQ ID NO: 252457 - DNA, 75 bp, Artificial Sequence
  Synthetic
aacttctagtctagaaataatatcggtcttatttttaaaatctattcccttgatgaatggatcgttaataaacaa

SEQ ID NO: 252458 - DNA, 75 bp, Artificial Sequence
  Synthetic
gtcttatttttaaaatctattcccttgatgaatggatcgttaataaacaaatccttggcctttgattcggctgat

SEQ ID NO: 252459 - DNA, 75 bp, Artificial Sequence
  Synthetic
gttgactagtccaaagacttacaggaatagatgtatcgatgatgttgatagtatgtgatatgtgagcaaagactg

SEQ ID NO: 252460 - DNA, 75 bp, Artificial Sequence
  Synthetic
aatagatgtatcgatgatgttgatagtatgtgatatgtgagcaaagactgttctcttggtggcgtcgctatatgt

SEQ ID NO: 252461 - DNA, 75 bp, Artificial Sequence
  Synthetic
gaaatgttatatataaaagaattttttcgggttccaaacattaacagattagtatgaagataaacactcatatta

SEQ ID NO: 252462 - DNA, 75 bp, Artificial Sequence
  Synthetic
ttcgggttccaaacattaacagattagtatgaagataaacactcatattatcaggaacattatcaatttttacat

SEQ ID NO: 252463 - DNA, 75 bp, Artificial Sequence
  Synthetic
cttttcagttgcttagacttccaagtattaattcgtgacagatccatgtctgaaacgagacgctaattagtgtat

SEQ ID NO: 252464 - DNA, 75 bp, Artificial Sequence
  Synthetic
aacaccatcttctggaacctctacgatctcggcagattccggataaccagtcggtggaccatcactaacaataac

SEQ ID NO: 252465 - DNA, 75 bp, Artificial Sequence
  Synthetic
atctcggcagattccggataaccagtcggtggaccatcactaacaataactagatcatccaacaatctactcaca

SEQ ID NO: 252466 - DNA, 75 bp, Artificial Sequence
  Synthetic
cttgtgagtaccctggatacgaaataaatttgttatccgtatttccataataaggtttagtataaacagagagag

SEQ ID NO: 252467 - DNA, 75 bp, Artificial Sequence
  Synthetic
aaatttgttatccgtatttccataataaggtttagtataaacagagagagatgttgctgcatgaacttcggttac

SEQ ID NO: 252468 - DNA, 75 bp, Artificial Sequence
  Synthetic
cctattactctcctaggtttctctataaatgatggtttaatttgtacattcttaaccatatatccaataaagctc

SEQ ID NO: 252469 - DNA, 75 bp, Artificial Sequence
  Synthetic
taaatgatggtttaatttgtacattcttaaccatatatccaataaagctcaattcaggaacataaacaaattctt

SEQ ID NO: 252470 - DNA, 75 bp, Artificial Sequence
  Synthetic
agagtcacgaataacgatatcggatactggattgaaggtcaccgttaccgtaatttttgaatcggatagtttaag

SEQ ID NO: 252471 - DNA, 75 bp, Artificial Sequence
  Synthetic
actggattgaaggtcaccgttaccgtaatttttgaatcggatagtttaagactactgaatgtatcttccacatca

SEQ ID NO: 252472 - DNA, 75 bp, Artificial Sequence
  Synthetic
ctgtagatggttctttaatagtgtcattaggagttagaccaatagaaatatcattaagttcactagaatatccag

SEQ ID NO: 252473 - DNA, 75 bp, Artificial Sequence
  Synthetic
tcattaagttcactagaatatccagaatgtttcaaagcaattgtattattgatacaattattatataattcttcg

SEQ ID NO: 252474 - DNA, 75 bp, Artificial Sequence
  Synthetic
tacacgaagagacagatacatgattaatacatttatatccaacatatggtacgtaaccgaatcttcccatacctt

SEQ ID NO: 252475 - DNA, 75 bp, Artificial Sequence
  Synthetic
aatacatttatatccaacatatggtacgtaaccgaatcttcccatacctttaacttctggaagttccaaactcag

SEQ ID NO: 252476 - DNA, 75 bp, Artificial Sequence
  Synthetic
tactgatccctaatttcgaagctagcgatagcctgattgtcgggcccatcgtttgtcataactccggatagagaa

SEQ ID NO: 252477 - DNA, 75 bp, Artificial Sequence
  Synthetic
cgatagcctgattgtcgggcccatcgtttgtcataactccggatagagaaatatattgcggcatatataaagttg

SEQ ID NO: 252478 - DNA, 75 bp, Artificial Sequence
  Synthetic
attagaccgtttaataaagtcatccccaccgatcaaagaattaatgatagtattattcattttctatttaaaatg

SEQ ID NO: 252479 - DNA, 75 bp, Artificial Sequence
  Synthetic
tgggatcgtctatcgatagactttctctaaataggactattgttacaaaagttaataacaattataacaattata

SEQ ID NO: 252480 - DNA, 75 bp, Artificial Sequence
  Synthetic
gaaaaaagcttacaataaactccgtagagaaatatctataatttgtgagttttccttaaagtaacagcttccgta

SEQ ID NO: 252481 - DNA, 75 bp, Artificial Sequence
  Synthetic
tttccttaaagtaacagcttccgtaaacaccgtctttatctcttaataagtttattgtatttatgaccttttcct

SEQ ID NO: 252482 - DNA, 75 bp, Artificial Sequence
  Synthetic
aacaccgtctttatctcttaataagtttattgtatttatgaccttttccttatcttcatagaatactaaaggcaa

SEQ ID NO: 252483 - DNA, 75 bp, Artificial Sequence
  Synthetic
agagctacgtgagacttaaccatagacgccaacgaatccctacatattttagaacagaaatacccaacttcacca

SEQ ID NO: 252484 - DNA, 75 bp, Artificial Sequence
  Synthetic
acgccaacgaatccctacatattttagaacagaaatacccaacttcaccacccttgaatgtctcaatactaatag

SEQ ID NO: 252485 - DNA, 75 bp, Artificial Sequence
  Synthetic
aaaccaacacttatcaattacactatttgtcttaatagacatatctgccatagatttataatactttggtagtat

SEQ ID NO: 252486 - DNA, 75 bp, Artificial Sequence
  Synthetic
ggcttaaagactgctttaggtgctgaaataaccacatctggaagacttactcgcttagccatttaattacggaac

SEQ ID NO: 252487 - DNA, 75 bp, Artificial Sequence
  Synthetic
agtagaaaacctctcatctacaaaaacatactcgtgtccataatcctctaccatagtaacacgttttttagatct

SEQ ID NO: 252488 - DNA, 75 bp, Artificial Sequence
  Synthetic
acatactcgtgtccataatcctctaccatagtaacacgttttttagatctcatatgtgctaaaaagttttcccat

SEQ ID NO: 252489 - DNA, 75 bp, Artificial Sequence
  Synthetic
tataatttttaacagtttgaggttttagatttttagttacagaagtgatatcgaatattttatccaaaaagaatg

SEQ ID NO: 252490 - DNA, 75 bp, Artificial Sequence
  Synthetic
tagatttttagttacagaagtgatatcgaatattttatccaaaaagaatgagtaattaattgtcttagaaggagt

SEQ ID NO: 252491 - DNA, 75 bp, Artificial Sequence
  Synthetic
tgcttaaatatttctactacttcattaatcttttctgtactcagattcagtttctcatcttttacttgattgatt

SEQ ID NO: 252492 - DNA, 75 bp, Artificial Sequence
  Synthetic
taatcttttctgtactcagattcagtttctcatcttttacttgattgattatttcaaagactaacttataatcct

SEQ ID NO: 252493 - DNA, 75 bp, Artificial Sequence
  Synthetic
aagaaaactagatacaaaatttgcatctacatcatccgtggatatttgatttttttccatgatatccaatagttc

SEQ ID NO: 252494 - DNA, 75 bp, Artificial Sequence
  Synthetic
tctacatcatccgtggatatttgatttttttccatgatatccaatagttccgagataatttctccagaacattga

SEQ ID NO: 252495 - DNA, 75 bp, Artificial Sequence
  Synthetic
ttctcaaatgaataagtttattagacacgtggaagtttgactttttttgtacctttgtacatttttgaaatacag

SEQ ID NO: 252496 - DNA, 75 bp, Artificial Sequence
  Synthetic
cacgtggaagtttgactttttttgtacctttgtacatttttgaaatacagactcgcaaaaaatacaatattcata

SEQ ID NO: 252497 - DNA, 75 bp, Artificial Sequence
  Synthetic
tgtctacaacagctacataatcgtagattcatgttaacactctacgtatctcgtcgtccaatattttatataaaa

SEQ ID NO: 252498 - DNA, 75 bp, Artificial Sequence
  Synthetic
gattcatgttaacactctacgtatctcgtcgtccaatattttatataaaaacattttatttctagacgttgtcag

SEQ ID NO: 252499 - DNA, 75 bp, Artificial Sequence
  Synthetic
tttggttgtgaataaagtatcgccctaataatattggtaccgtcttccgacaatatagtagttaaattatccgag

SEQ ID NO: 252500 - DNA, 75 bp, Artificial Sequence
  Synthetic
taataatattggtaccgtcttccgacaatatagtagttaaattatccgagcatgtagaagaacaccgcttaggcg

SEQ ID NO: 252501 - DNA, 75 bp, Artificial Sequence
  Synthetic
gtaccaactcatttaaatatcataatctaaaatagttctgtaatatgtctagcgctaatatattgatcataatcc

SEQ ID NO: 252502 - DNA, 75 bp, Artificial Sequence
  Synthetic
tctaaaatagttctgtaatatgtctagcgctaatatattgatcataatcctgtgcataaattaagatacaacaat

SEQ ID NO: 252503 - DNA, 75 bp, Artificial Sequence
  Synthetic
ttccatagttagaagatcatcgtcaaagttagcaacgtgattcatcaacatttgctgttttgaggcagcaaatac

SEQ ID NO: 252504 - DNA, 75 bp, Artificial Sequence
  Synthetic
aagttagcaacgtgattcatcaacatttgctgttttgaggcagcaaatactgaaccatcaccattcaaccattca

SEQ ID NO: 252505 - DNA, 75 bp, Artificial Sequence
  Synthetic
ataatttcttgtactggtttttgagagctcgcatcaatctagcatttctagctcccggattgaaaacagaaagag

SEQ ID NO: 252506 - DNA, 75 bp, Artificial Sequence
  Synthetic
agctcgcatcaatctagcatttctagctcccggattgaaaacagaaagaggatcgtacatccagggtccattttc

SEQ ID NO: 252507 - DNA, 75 bp, Artificial Sequence
  Synthetic
ttcaagaagatatcagacgatccacaatcaaagaattggtctccgagtttgtaacagactgcggactttaaccta

SEQ ID NO: 252508 - DNA, 75 bp, Artificial Sequence
  Synthetic
aatcaaagaattggtctccgagtttgtaacagactgcggactttaacctatacatgataccgtttagcatgattt

SEQ ID NO: 252509 - DNA, 75 bp, Artificial Sequence
  Synthetic
atctattagagatctaaagccggtgtaacattctccaccaaacatattcttattctgacgtcgttctacataaaa

SEQ ID NO: 252510 - DNA, 75 bp, Artificial Sequence
  Synthetic
taacattctccaccaaacatattcttattctgacgtcgttctacataaaacatcattgctccattaacgataaca

SEQ ID NO: 252511 - DNA, 75 bp, Artificial Sequence
  Synthetic
cattagttcccaatggatcaatgtgtgtaactccagaacatcttccatagcctatgttaggaggagcgaacacca

SEQ ID NO: 252512 - DNA, 75 bp, Artificial Sequence
  Synthetic
cctatgttaggaggagcgaacaccactcttccactattgccatcgaatgccatagaataaatatccttggaattg

SEQ ID NO: 252513 - DNA, 75 bp, Artificial Sequence
  Synthetic
ttatcatcttcataggattaacaacgatgtatggtgcagcctgaagtttcatatcataactgatgccgttcatag

SEQ ID NO: 252514 - DNA, 75 bp, Artificial Sequence
  Synthetic
gatgtatggtgcagcctgaagtttcatatcataactgatgccgttcataggtctagccacagaaaccaacgtagg

SEQ ID NO: 252515 - DNA, 75 bp, Artificial Sequence
  Synthetic
gaagctaatatctgttcctcatctgtcataacttgagagcatccagtatgaataatcttcattagatggggatct

SEQ ID NO: 252516 - DNA, 75 bp, Artificial Sequence
  Synthetic
tcataacttgagagcatccagtatgaataatcttcattagatggggatctaccgcatcatcatcgttacaataaa

SEQ ID NO: 252517 - DNA, 75 bp, Artificial Sequence
  Synthetic
tgcttttctaatcatggtatgaatgtttgctctctgaatctctgtggaaattagatctgatacacctgtaatcac

SEQ ID NO: 252518 - DNA, 75 bp, Artificial Sequence
  Synthetic
tttgctctctgaatctctgtggaaattagatctgatacacctgtaatcactatcggattatcctccgtaagacga

SEQ ID NO: 252519 - DNA, 75 bp, Artificial Sequence
  Synthetic
actttactcttctaaattcataaagttgctggattagactatatgtgtctccatgtacatacgcgttctcgagcg

SEQ ID NO: 252520 - DNA, 75 bp, Artificial Sequence
  Synthetic
ttgctggattagactatatgtgtctccatgtacatacgcgttctcgagcgcaggaagtttaataccgaatagtgc

SEQ ID NO: 252521 - DNA, 75 bp, Artificial Sequence
  Synthetic
ttagtttctggttttctataaataaaagacaaatcttgtgaactagacatatcggtaaaatgcatggattggaat

SEQ ID NO: 252522 - DNA, 75 bp, Artificial Sequence
  Synthetic
aagacaaatcttgtgaactagacatatcggtaaaatgcatggattggaatcgtgtagtcgacagaagaatatgat

SEQ ID NO: 252523 - DNA, 75 bp, Artificial Sequence
  Synthetic
taactctttgagttggtcaccgattctaggactagctcgagaatgaataagtactaagggatgagtacatttcac

SEQ ID NO: 252524 - DNA, 75 bp, Artificial Sequence
  Synthetic
ctaggactagctcgagaatgaataagtactaagggatgagtacatttcacagaaacactggcgttgttcaacgta

SEQ ID NO: 252525 - DNA, 75 bp, Artificial Sequence
  Synthetic
atagctcgtttctatttgtcctgacaatatttagtttattcataatattaagcatatcctgaatagtaaagttag

SEQ ID NO: 252526 - DNA, 75 bp, Artificial Sequence
  Synthetic
aatatttagtttattcataatattaagcatatcctgaatagtaaagttagatgtgtcatacttgttagtagttag

SEQ ID NO: 252527 - DNA, 75 bp, Artificial Sequence
  Synthetic
tttctcaatctcgtactccaatcatgtgtggatgctacttcgtcgatggaaaccatacaatcctttttgataggc

SEQ ID NO: 252528 - DNA, 75 bp, Artificial Sequence
  Synthetic
cgtcgtgaaactgctcatcgacagccatgaaatctaccgactccatggcgcgaatcgcactgtcttattcgccat

SEQ ID NO: 252529 - DNA, 75 bp, Artificial Sequence
  Synthetic
gtgtggatgctacttcgtcgatggaaaccatacaatcctttttgataggctgttgagattgatcatttcctgtac

SEQ ID NO: 252530 - DNA, 75 bp, Artificial Sequence
  Synthetic
agcccctgcggatataaagtcatcgtctacaatttgggataatgaattacatacactacaagacaaagatttatc

SEQ ID NO: 252531 - DNA, 75 bp, Artificial Sequence
  Synthetic
tctacaatttgggataatgaattacatacactacaagacaaagatttatcagaagtgtgaatatgatcttcatct

SEQ ID NO: 252532 - DNA, 75 bp, Artificial Sequence
  Synthetic
aactagattttagtcccgcgttagatgttaaaaaaacatcgctattgaccacggcttccattatttatattcgta

SEQ ID NO: 252533 - DNA, 75 bp, Artificial Sequence
  Synthetic
tgttaaaaaaacatcgctattgaccacggcttccattatttatattcgtagtttttactcgaaagcgtgatttta

SEQ ID NO: 252534 - DNA, 75 bp, Artificial Sequence
  Synthetic
tcgttcaaaacctttgactagttgtataatttgatctattgccctacgcgtatactcccttgcatcatatacgtt

SEQ ID NO: 252535 - DNA, 75 bp, Artificial Sequence
  Synthetic
agtaggtgtgggagtacatacagtggccacaataggaggttgaagaggtgtaaccgttggagtagtacaagaaat

SEQ ID NO: 252536 - DNA, 75 bp, Artificial Sequence
  Synthetic
gccacaataggaggttgaagaggtgtaaccgttggagtagtacaagaaatacttccatccgattgttgtgtacat

SEQ ID NO: 252537 - DNA, 75 bp, Artificial Sequence
  Synthetic
gttgggtagatggcggtgtcgtcatcttttgatctttattaaatttagagataatatcctgaacagtattgctcg

SEQ ID NO: 252538 - DNA, 75 bp, Artificial Sequence
  Synthetic
ataatatcctgaacagtattgctcggcgtcaacgctggaaggagtgtactcgccggcgcatcagtatctgcagac

SEQ ID NO: 252539 - DNA, 75 bp, Artificial Sequence
  Synthetic
cagatgatgtattagtttgttgtcgtggttttagtacaggagcagtactactaggtagaagaataggagccggtg

SEQ ID NO: 252540 - DNA, 75 bp, Artificial Sequence
  Synthetic
ctaggtagaagaataggagccggtgtaggtgtcggaaccggctgtggagttatatgaatagttggttgtagcggt

SEQ ID NO: 252541 - DNA, 75 bp, Artificial Sequence
  Synthetic
tcatattatctctagctagttgttctcgcaactgtctttgataatacgactcttgagactttagtcctatttcaa

SEQ ID NO: 252542 - DNA, 75 bp, Artificial Sequence
  Synthetic
tcgcaactgtctttgataatacgactcttgagactttagtcctatttcaatcgcttcatcctttttcgtatccgg

SEQ ID NO: 252543 - DNA, 75 bp, Artificial Sequence
  Synthetic
aagttagtttatagtctaacacttctaatttttataccttgatctttttctctaattatgaaaaagtaaatcatt

SEQ ID NO: 252544 - DNA, 75 bp, Artificial Sequence
  Synthetic
gacgactttggtgtagaggattctgccagcccctgtgagaacttgttaaagaagtccatttaaggctttaaaatt

SEQ ID NO: 252545 - DNA, 75 bp, Artificial Sequence
  Synthetic
tcgagtattaacatataagttatttttaaaccccttttgggttccgtcctaaacggcgtttcggtctgtgtcgcc

SEQ ID NO: 252546 - DNA, 75 bp, Artificial Sequence
  Synthetic
ccagcccctgtgagaacttgttaaagaagtccatttaaggctttaaaattgaattgcgattataagattaaatgg

SEQ ID NO: 252547 - DNA, 75 bp, Artificial Sequence
  Synthetic
tgaatccgatgatctcaccgaatacgaggatgatgaagaagatggagagtcactagaaactagtgatatagatcc

SEQ ID NO: 252548 - DNA, 75 bp, Artificial Sequence
  Synthetic
gaggatgatgaagaagatggagagtcactagaaactagtgatatagatcccaaatcttcttataagattgtagaa

SEQ ID NO: 252549 - DNA, 75 bp, Artificial Sequence
  Synthetic
cgcattccaatcttaaacatatagggaatcatatatctgctcttaaacgacgctatactagacgtataagtctat

SEQ ID NO: 252550 - DNA, 75 bp, Artificial Sequence
  Synthetic
gaatcatatatctgctcttaaacgacgctatactagacgtataagtctatttgaaatagcgggtataatagcaga

SEQ ID NO: 252551 - DNA, 75 bp, Artificial Sequence
  Synthetic
aggttacctctagtttcagaattttctgacgaaacgatgaagcaaaatatgctacatgtaattatacaagagata

SEQ ID NO: 252552 - DNA, 75 bp, Artificial Sequence
  Synthetic
ctgacgaaacgatgaagcaaaatatgctacatgtaattatacaagagatagaggagggttcttgtcctatagtca

SEQ ID NO: 252553 - DNA, 75 bp, Artificial Sequence
  Synthetic
ggtaaacgattttgataaagatggtctaaaattccatctagactatattatcaaaatttggaaacttcaaaaacg

SEQ ID NO: 252554 - DNA, 75 bp, Artificial Sequence
  Synthetic
ctaaaattccatctagactatattatcaaaatttggaaacttcaaaaacgatattagaatttatacgaatatcgt

SEQ ID NO: 252555 - DNA, 75 bp, Artificial Sequence
  Synthetic
tcatattcagcagtttattgtcgtactttatatcgtgttcattaacgatattttgcaaaatagtaatgattctat

SEQ ID NO: 252556 - DNA, 75 bp, Artificial Sequence
  Synthetic
ctttatatcgtgttcattaacgatattttgcaaaatagtaatgattctatcttccttcgatagatattcttcaga

SEQ ID NO: 252557 - DNA, 75 bp, Artificial Sequence
  Synthetic
ttatccgatatgaatttgataagactttgaacattattaatacccgtctgtttaattttttctatagatatttta

SEQ ID NO: 252558 - DNA, 75 bp, Artificial Sequence
  Synthetic
tttgaacattattaatacccgtctgtttaattttttctatagatattttagttttggtagattctatggtgtctg

SEQ ID NO: 252559 - DNA, 75 bp, Artificial Sequence
  Synthetic
cgacgtcaattgtctataaatcagagtataaattttagaaataacattagcaaattgttgtgcgttgatgtcgtt

SEQ ID NO: 252560 - DNA, 75 bp, Artificial Sequence; identical to SEQ ID NO: 47890
  Synthetic

SEQ ID NO: 252561 - DNA, 75 bp, Artificial Sequence
  Synthetic
atttattgttactcagttgaacagatgatatatccagattactaacgcatctgattccatataccaaactttcag

SEQ ID NO: 252562 - DNA, 75 bp, Artificial Sequence
  Synthetic
tgatatatccagattactaacgcatctgattccatataccaaactttcagaagaaatggtgtacaattgtttgta

SEQ ID NO: 252563 - DNA, 75 bp, Artificial Sequence
  Synthetic
attagtttagagtcgaatactgcaataattttcaagagatagttttcatcagataagattttatttagtgtagat

SEQ ID NO: 252564 - DNA, 75 bp, Artificial Sequence
  Synthetic
taattttcaagagatagttttcatcagataagattttatttagtgtagatatgataaaactattgttttgttgga

SEQ ID NO: 252565 - DNA, 75 bp, Artificial Sequence
  Synthetic
agtcgacgctctcaaatgggaaacaatctctattatttttttggaatcggatactatatcttcggtatcttgacg

SEQ ID NO: 252566 - DNA, 75 bp, Artificial Sequence
  Synthetic
atctctattatttttttggaatcggatactatatcttcggtatcttgacgcagtctagtatacatagagttaaga

SEQ ID NO: 252567 - DNA, 75 bp, Artificial Sequence
  Synthetic
acatgtctctaaatgtggctacaaacttttctttttccacatcatctagtttattatataccgatttcacaacgg

SEQ ID NO: 252568 - DNA, 75 bp, Artificial Sequence
  Synthetic
cttttctttttccacatcatctagtttattatataccgatttcacaacggcaccagatttaaggaaccagaatga

SEQ ID NO: 252569 - DNA, 75 bp, Artificial Sequence
  Synthetic
atcatagttacgattttatcatcttctatagttggtgtgataacacatacctttttctccaagactggaaccaac

SEQ ID NO: 252570 - DNA, 75 bp, Artificial Sequence
  Synthetic
ctatagttggtgtgataacacatacctttttctccaagactggaaccaacgtcataaaaatgtttaaatcaaaat

SEQ ID NO: 252571 - DNA, 75 bp, Artificial Sequence
  Synthetic
accagtctcgcgttcaagattatctttactaatggtgacgaactcatcgtatagaactctaagtttgtccattat

SEQ ID NO: 252572 - DNA, 75 bp, Artificial Sequence
  Synthetic
ttactaatggtgacgaactcatcgtatagaactctaagtttgtccattatttatttacagatttagttgtttaat

SEQ ID NO: 252573 - DNA, 75 bp, Artificial Sequence
  Synthetic
atagtatttttctaacgtcggtattatattattaggatctacgttcatatgtatcataatattaatcatccacgt

SEQ ID NO: 252574 - DNA, 75 bp, Artificial Sequence
  Synthetic
atattattaggatctacgttcatatgtatcataatattaatcatccacgttttgataaatctatctttagcttct

SEQ ID NO: 252575 - DNA, 75 bp, Artificial Sequence
  Synthetic
atgttacactatataacaattacaatacatttttatcataacactacttcggttagatgttttagaaaaaaataa

SEQ ID NO: 252576 - DNA, 75 bp, Artificial Sequence
  Synthetic
aaaaatatttagttacggcatcagacgcaataacattttttgtaaatgtaacgtatttagacgacagatcttcgt

SEQ ID NO: 252577 - DNA, 75 bp, Artificial Sequence
  Synthetic
cgcaataacattttttgtaaatgtaacgtatttagacgacagatcttcgttaaaaagttttccatctatgtagaa

SEQ ID NO: 252578 - DNA, 75 bp, Artificial Sequence
  Synthetic
gcgtcagagtgaataggagtttgaatagtttgttttggaaatagatccttcaataacttatagttgggtggggaa

SEQ ID NO: 252579 - DNA, 75 bp, Artificial Sequence
  Synthetic
aaatcaattttatcactagactctttcttttttactatcattacctcatgaactatttcttgaatgagtatatgt

SEQ ID NO: 252580 - DNA, 75 bp, Artificial Sequence
  Synthetic
aactatttcttgaatgagtatatgtattttctttcctatatcggtcgcgttcattggaaaatatatcatgtcgtt

SEQ ID NO: 252581 - DNA, 75 bp, Artificial Sequence
  Synthetic
gaaatcctttgttttatccacttcacattttaaataaatgtcaactatacattcttctgttaattttactagatc

SEQ ID NO: 252582 - DNA, 75 bp, Artificial Sequence
  Synthetic
attttctttcctatatcggtcgcgttcattggaaaatatatcatgtcgttaactataagaatatttttatcctcg

SEQ ID NO: 252583 - DNA, 75 bp, Artificial Sequence
  Synthetic
tagttcgtaaacgaactatatcatcaccagcacaacatctaactatatgatatccactagtttcctttagccgtt

SEQ ID NO: 252584 - DNA, 75 bp, Artificial Sequence
  Synthetic
accagcacaacatctaactatatgatatccactagtttcctttagccgtttattatcttgttccatattagcagt

SEQ ID NO: 252585 - DNA, 75 bp, Artificial Sequence
  Synthetic
aagataatagggagaaatgacattttggattctgttacgactttaccaaaattaaggatatacggacttactatc

SEQ ID NO: 252586 - DNA, 75 bp, Artificial Sequence
  Synthetic
tggattctgttacgactttaccaaaattaaggatatacggacttactatctttttctcaacgtcgatttgatgaa

SEQ ID NO: 252587 - DNA, 75 bp, Artificial Sequence
  Synthetic
agattgatcatgtagaaaacaacaagggatacaatatttccgcatatcatgaaatatattaagaaatcccacttt

SEQ ID NO: 252588 - DNA, 75 bp, Artificial Sequence
  Synthetic
gggatacaatatttccgcatatcatgaaatatattaagaaatcccactttattatatttccccaaaggatcaatg

SEQ ID NO: 252589 - DNA, 75 bp, Artificial Sequence
  Synthetic
taataaagacttctttctcatcggatctgtaaaagttgttactgatttttttcattccaggatctagataattaa

SEQ ID NO: 252590 - DNA, 75 bp, Artificial Sequence
  Synthetic
tctgtaaaagttgttactgatttttttcattccaggatctagataattaataataatgggttttctattcttatt

SEQ ID NO: 252591 - DNA, 75 bp, Artificial Sequence
  Synthetic
cagtaaacagtttccactttggtaaaatcagaagacttttgaacgctattaaacatggcattaatggcaataact

SEQ ID NO: 252592 - DNA, 75 bp, Artificial Sequence
  Synthetic
aatcagaagacttttgaacgctattaaacatggcattaatggcaataactaaaaatgtaaaatatttttctatgt

SEQ ID NO: 252593 - DNA, 75 bp, Artificial Sequence
  Synthetic
aagaacaattcggtactatagaagaactcaagcagaagcttagattaaattctgaagagggagcagataattttt

SEQ ID NO: 252594 - DNA, 75 bp, Artificial Sequence
  Synthetic
agatatatggttttttgccaaaatgatagatatttttttatccgatgatagcaaaatattattagtcgccgtctc

SEQ ID NO: 252595 - DNA, 75 bp, Artificial Sequence
  Synthetic
atagatatttttttatccgatgatagcaaaatattattagtcgccgtctctataaaaatgaagctagtctcgata

SEQ ID NO: 252596 - DNA, 75 bp, Artificial Sequence
  Synthetic
gagtcgccaaatgtaccttatacgttatatctcccttgatgcgttccatttgtgtatctatatcggacacaagat

SEQ ID NO: 252597 - DNA, 75 bp, Artificial Sequence
  Synthetic
tatatctcccttgatgcgttccatttgtgtatctatatcggacacaagatctgtaaatagttttacgttattaat

SEQ ID NO: 252598 - DNA, 75 bp, Artificial Sequence
  Synthetic
aatgctaatgtactatccaagtcccaaatggagagatttaactgttcatcgtttagaataaaatgattacctgtc

SEQ ID NO: 252599 - DNA, 75 bp, Artificial Sequence
  Synthetic
aaatggagagatttaactgttcatcgtttagaataaaatgattacctgtcatattaataaagtgttcatcgtatc

SEQ ID NO: 252600 - DNA, 75 bp, Artificial Sequence
  Synthetic
gtccaagtcttgaactcgctgaatgatcttttttaacccagttagttttagattggtacgaaatatattgttaaa

SEQ ID NO: 252601 - DNA, 75 bp, Artificial Sequence
  Synthetic
atcttttttaacccagttagttttagattggtacgaaatatattgttaaactttgattctacagtaatgtccaaa

SEQ ID NO: 252602 - DNA, 75 bp, Artificial Sequence
  Synthetic
taaaaaaatacttattgttgctcgaatattttgtatttgatggtatacggaagattagaaatgtaggtattatca

SEQ ID NO: 252603 - DNA, 75 bp, Artificial Sequence
  Synthetic
acattgtttcaaacttgataatattattatctacatcttcgtacgatccaaattccggaatagatgtatcgcacg

SEQ ID NO: 252604 - DNA, 75 bp, Artificial Sequence
  Synthetic
attatctacatcttcgtacgatccaaattccggaatagatgtatcgcacgctctggccacccagataaccaaaaa

SEQ ID NO: 252605 - DNA, 75 bp, Artificial Sequence
  Synthetic
tataaaaagctatcgttttttagtagtgtttttttctgagtatatacgaaaggattaaaaatagtattatcaacg

SEQ ID NO: 252606 - DNA, 75 bp, Artificial Sequence
  Synthetic
gtgtttttttctgagtatatacgaaaggattaaaaatagtattatcaacgtaactatattccaaattattcttat

SEQ ID NO: 252607 - DNA, 75 bp, Artificial Sequence
  Synthetic
aatatctaacaaatttcctaaatatccctttaattgagtcattcgaagcgttaataaaatatgtctcttaactat

SEQ ID NO: 252608 - DNA, 75 bp, Artificial Sequence
  Synthetic
ccctttaattgagtcattcgaagcgttaataaaatatgtctcttaactatttccggccgttgtatatttaaatga

SEQ ID NO: 252609 - DNA, 75 bp, Artificial Sequence
  Synthetic
acttctcatctatgtaatcatatggagtgagatatagggctcgttctacctcctgccccttacccacctgtaata

SEQ ID NO: 252610 - DNA, 75 bp, Artificial Sequence
  Synthetic
agtgagatatagggctcgttctacctcctgccccttacccacctgtaataccaattgtggactcactatatatcg

SEQ ID NO: 252611 - DNA, 75 bp, Artificial Sequence
  Synthetic
tccataaatttctccaacgctttgattgtttccatagatttccgaagtttagcttctaggacggcgattcttttt

SEQ ID NO: 252612 - DNA, 75 bp, Artificial Sequence
  Synthetic
ataactctattcatctgaaaatggatgagttgggttaatcgaacgattcagacaccgcaccacgaattaaaaaag

SEQ ID NO: 252613 - DNA, 75 bp, Artificial Sequence
  Synthetic
aaaatctactaccgatgatgtaagtcttacaatgttcgaaccagtaccagatcttaatttggaggcctccgtaga

SEQ ID NO: 252614 - DNA, 75 bp, Artificial Sequence
  Synthetic
actaggggaggtaaatatagatcaaacaacacctatgataaaggagaatagcggttttatatcccgtagtagacg

SEQ ID NO: 252615 - DNA, 75 bp, Artificial Sequence
  Synthetic
caagatttttagcgtattatcctccgatgatgtgttattttttaactgctacacctagaccagctaaccgaattt

SEQ ID NO: 252616 - DNA, 75 bp, Artificial Sequence
  Synthetic
gatgagagaaaactagcattacgattctttttacaaagactttattttttagatcatagagagattcattatttg

SEQ ID NO: 252617 - DNA, 75 bp, Artificial Sequence
  Synthetic
tctttttacaaagactttattttttagatcatagagagattcattatttgttcagatgcgtcgacgctgtaaaag

SEQ ID NO: 252618 - DNA, 75 bp, Artificial Sequence
  Synthetic
cattatcgtggcgccttatatagcacttttaactatcgcatcaaaaggatgcaaacttacagaaacaatgattga

SEQ ID NO: 252619 - DNA, 75 bp, Artificial Sequence
  Synthetic
cttttaactatcgcatcaaaaggatgcaaacttacagaaacaatgattgaagcattctttccagaactatataat

SEQ ID NO: 252620 - DNA, 75 bp, Artificial Sequence
  Synthetic
actctcaagtatccatcatccaagaaaaactcggataccagtctggaaactatcacgtttatgattttgaaccgt

SEQ ID NO: 252621 - DNA, 75 bp, Artificial Sequence
  Synthetic
aaaactcggataccagtctggaaactatcacgtttatgattttgaaccgtattactctacagtagctctggctat

SEQ ID NO: 252622 - DNA, 75 bp, Artificial Sequence
  Synthetic
tttaatatccgtcaagagagttatcttgtaagttcattatctgaaataacatatagattttatctaattaatcta

SEQ ID NO: 252623 - DNA, 75 bp, Artificial Sequence
  Synthetic
ttgtaagttcattatctgaaataacatatagattttatctaattaatctaaaatctgatcttgttcaatggagtg

SEQ ID NO: 252624 - DNA, 75 bp, Artificial Sequence
  Synthetic
aatggtaaatactgtattgattacagtgtatgacaaattacaactggccatagaaaatgattcacaatttacatg

SEQ ID NO: 252625 - DNA, 75 bp, Artificial Sequence
  Synthetic
gtgtatgacaaattacaactggccatagaaaatgattcacaatttacatgttcattggctgtggaatcagaactt

SEQ ID NO: 252626 - DNA, 75 bp, Artificial Sequence
  Synthetic
atgaattatttacaaaattcattaacgagttaaaaaagaccagttcattcaagataagcaaacgcgataaggata

SEQ ID NO: 252627 - DNA, 75 bp, Artificial Sequence
  Synthetic
tgggaaatggtggtctaggatgaggatcaggtatcggagtgggttttggattataatcatcatcatcatcatcat

SEQ ID NO: 252628 - DNA, 75 bp, Artificial Sequence
  Synthetic
actatcattattagtattcttcttgtcatcttgttcagaaatatacagcaatgctatacctaataccaaatacat

SEQ ID NO: 252629 - DNA, 75 bp, Artificial Sequence
  Synthetic
tcatcttgttcagaaatatacagcaatgctatacctaataccaaatacattatcatgcttgcaatggctctaaca

SEQ ID NO: 252630 - DNA, 75 bp, Artificial Sequence
  Synthetic
gtagcttttgttcacaaaaatacataaagaaatgtctacataaatctatggcgccattggctacttgaaatagcg

SEQ ID NO: 252631 - DNA, 75 bp, Artificial Sequence
  Synthetic
aaagaaatgtctacataaatctatggcgccattggctacttgaaatagcgccagtcctcctacagattttaatat

SEQ ID NO: 252632 - DNA, 75 bp, Artificial Sequence
  Synthetic
tcatcaaaagagacagagtcaccatctgtcatatttagattttttttcatgtgttcaaagtatcctctactcatt

SEQ ID NO: 252633 - DNA, 75 bp, Artificial Sequence
  Synthetic
ctgtcatatttagattttttttcatgtgttcaaagtatcctctactcatttcattataatagtttatcatactta

SEQ ID NO: 252634 - DNA, 75 bp, Artificial Sequence
  Synthetic
agatttgactagatcgtcagtagtaatttgtgcatcatctattctgcatccgcttcgtcgaataatgtatagcat

SEQ ID NO: 252635 - DNA, 75 bp, Artificial Sequence
  Synthetic
atttgtgcatcatctattctgcatccgcttcgtcgaataatgtatagcatcgctttgagattctccatagctatc

SEQ ID NO: 252636 - DNA, 75 bp, Artificial Sequence
  Synthetic
tatctgtgaatgctttatacttctccaacatcgatgccttaacatcatcacatactttagcattgaaaatacgtt

SEQ ID NO: 252637 - DNA, 75 bp, Artificial Sequence
  Synthetic
caacatcgatgccttaacatcatcacatactttagcattgaaaatacgttctattgtgtagatggatgtagcaag

SEQ ID NO: 252638 - DNA, 75 bp, Artificial Sequence
  Synthetic
catgatgattgtctcaagtctccaatcgtttgtttagaacgattagctacagagtccaatgcttggctaactagc

SEQ ID NO: 252639 - DNA, 75 bp, Artificial Sequence
  Synthetic
tcgtttgtttagaacgattagctacagagtccaatgcttggctaactagcatattattatctttagaaattgtat

SEQ ID NO: 252640 - DNA, 75 bp, Artificial Sequence
  Synthetic
tgtgatttcgttagtcatattacagtctgactgggttgtaatgttatccaacatatcacctatggatacggtaca

SEQ ID NO: 252641 - DNA, 75 bp, Artificial Sequence
  Synthetic
tctgactgggttgtaatgttatccaacatatcacctatggatacggtacacgtaccagcatttgtaataatccta

SEQ ID NO: 252642 - DNA, 75 bp, Artificial Sequence
  Synthetic
agaaaatatcttctcctgtaatatctccactctcgataaatctactcagattattcttaaatgccttattctctg

SEQ ID NO: 252643 - DNA, 75 bp, Artificial Sequence
  Synthetic
tccactctcgataaatctactcagattattcttaaatgccttattctctggagaaaagatatcagtgtccatcat

SEQ ID NO: 252644 - DNA, 75 bp, Artificial Sequence
  Synthetic
ataccacgagtatcaattctatccaagatacttatcggttccgagtcacagataatggtttcctctccttcggga

SEQ ID NO: 252645 - DNA, 75 bp, Artificial Sequence
  Synthetic
agatacttatcggttccgagtcacagataatggtttcctctccttcgggagatcctgcatagaaatatctaggac

SEQ ID NO: 252646 - DNA, 75 bp, Artificial Sequence
  Synthetic
ctgataatctctaaagtcactaactgataccatgaaattgagaagatcaaacgctgaagtaatcaatttttctgc

SEQ ID NO: 252647 - DNA, 75 bp, Artificial Sequence
  Synthetic
gataccatgaaattgagaagatcaaacgctgaagtaatcaatttttctgcctcgtttttactacaactagttttc

SEQ ID NO: 252648 - DNA, 75 bp, Artificial Sequence
  Synthetic
tagttactcttggtctaatactgatgatagagatattattgcttcccataatggatcttctagtagtcaccttaa

SEQ ID NO: 252649 - DNA, 75 bp, Artificial Sequence
  Synthetic
gatagagatattattgcttcccataatggatcttctagtagtcaccttaaagcccattgatgcgaatagcagata

SEQ ID NO: 252650 - DNA, 75 bp, Artificial Sequence
  Synthetic
ctaatatagtacggactacctttgtcacccaactttatacccacataagccataacaacctctttaatagccgtt

SEQ ID NO: 252651 - DNA, 75 bp, Artificial Sequence
  Synthetic
cacccaactttatacccacataagccataacaacctctttaatagccgtttcatgaggtttatcagccatgagcc

SEQ ID NO: 252652 - DNA, 75 bp, Artificial Sequence
  Synthetic
tcccgtctcagaaagtcctatatgcatgatagatttatctttcctgggaaactctcgtatagttatagatgaaat

SEQ ID NO: 252653 - DNA, 75 bp, Artificial Sequence
  Synthetic
atgatagatttatctttcctgggaaactctcgtatagttatagatgaaatactcttcaaagtttctgaaataaga

SEQ ID NO: 252654 - DNA, 75 bp, Artificial Sequence
  Synthetic
ctctgggtaacaaacatactctaataggtgttttctctgcggagataatatcagaaaggatagagcaataagtag

SEQ ID NO: 252655 - DNA, 75 bp, Artificial Sequence
  Synthetic
aggtgttttctctgcggagataatatcagaaaggatagagcaataagtagtattattgtgattataaagaccgaa

SEQ ID NO: 252656 - DNA, 75 bp, Artificial Sequence
  Synthetic
atcatgtcctgaagggttttagacttgtattcctcgtaatctataccgtcccaaaacatggatttggtaactttg

SEQ ID NO: 252657 - DNA, 75 bp, Artificial Sequence
  Synthetic
tgtattcctcgtaatctataccgtcccaaaacatggatttggtaactttgatagccgtagatctttgttccttcg

SEQ ID NO: 252658 - DNA, 75 bp, Artificial Sequence
  Synthetic
gaatttgttgtttctatttatgtccacaaattgcacgtttggaagcgccacggttacattcactgcagcattttg

SEQ ID NO: 252659 - DNA, 75 bp, Artificial Sequence
  Synthetic
acaaattgcacgtttggaagcgccacggttacattcactgcagcattttgaggatcgcgagtatgaagtacaatg

SEQ ID NO: 252660 - DNA, 75 bp, Artificial Sequence
  Synthetic
agaaatctaccagtctaggaataagagattgatatcgcatagaaatagtaaagtttataatctcatcattgtaga

SEQ ID NO: 252661 - DNA, 75 bp, Artificial Sequence
  Synthetic
agattgatatcgcatagaaatagtaaagtttataatctcatcattgtagattactctgttaccattgtaataaat

SEQ ID NO: 252662 - DNA, 75 bp, Artificial Sequence
  Synthetic
aagtactgttcatacatgatgagatgtttatatgttggcatagtagtgagatcgacgtttggtaatggcaatgta

SEQ ID NO: 252663 - DNA, 75 bp, Artificial Sequence
  Synthetic
gtttatatgttggcatagtagtgagatcgacgtttggtaatggcaatgtattaagattaactccataatgtctag

SEQ ID NO: 252664 - DNA, 75 bp, Artificial Sequence
  Synthetic
gtcaaagcggggttgatcttgtgctgttatatattgtctaacacctataagattatcaaaatcttgtctgcttaa

SEQ ID NO: 252665 - DNA, 75 bp, Artificial Sequence
  Synthetic
gttatatattgtctaacacctataagattatcaaaatcttgtctgcttaatacaccgttaacaatttttgccttg

SEQ ID NO: 252666 - DNA, 75 bp, Artificial Sequence
  Synthetic
catccttatagaggatgttaaacaaataagtattatcaaagttaagatctgggtatttcttttctgctagaacat

SEQ ID NO: 252667 - DNA, 75 bp, Artificial Sequence
  Synthetic
ataagtattatcaaagttaagatctgggtatttcttttctgctagaacatccattgagtcggagccatctggttt

SEQ ID NO: 252668 - DNA, 75 bp, Artificial Sequence
  Synthetic
ctgtattctgtatccgtcaatctaatattaagaaggtgttgagtgaaaggtggaagatcgtaaaagctgtgagta

SEQ ID NO: 252669 - DNA, 75 bp, Artificial Sequence
  Synthetic
tattaagaaggtgttgagtgaaaggtggaagatcgtaaaagctgtgagtattaataatagggttagtttccgaac

SEQ ID NO: 252670 - DNA, 75 bp, Artificial Sequence
  Synthetic
atctatatttccagcgttaagtgtaacattaaacagttttaattcacgtgacgtggtatcaattaaataattaat

SEQ ID NO: 252671 - DNA, 75 bp, Artificial Sequence
  Synthetic
acattaaacagttttaattcacgtgacgtggtatcaattaaataattaatgcccaatttggatatagtagcctga

SEQ ID NO: 252672 - DNA, 75 bp, Artificial Sequence
  Synthetic
ctaatgagttattaagaaatacatcgaacggatgaacgaaggttgttttaagttgatcacatactttgtaatcta

SEQ ID NO: 252673 - DNA, 75 bp, Artificial Sequence
  Synthetic
gaacggatgaacgaaggttgttttaagttgatcacatactttgtaatctagacatagatgtggaagaacggtaga

SEQ ID NO: 252674 - DNA, 75 bp, Artificial Sequence
  Synthetic
tcctctaattgatcaagagtaactattgacttaataggcatcatttatttagtattaaatgacgaccgtaccagt

SEQ ID NO: 252675 - DNA, 75 bp, Artificial Sequence
  Synthetic
ttgacttaataggcatcatttatttagtattaaatgacgaccgtaccagtgacagatatacaaaacgacttaatt

SEQ ID NO: 252676 - DNA, 75 bp, Artificial Sequence
  Synthetic
catctaacaaaaattatgaaataactcttcgccaaatgtctattctaactcacgttaacaacgtggtagatagag

SEQ ID NO: 252677 - DNA, 75 bp, Artificial Sequence
  Synthetic
tcttcgccaaatgtctattctaactcacgttaacaacgtggtagatagagaacataatgccgccgtagtgtcatc

SEQ ID NO: 252678 - DNA, 75 bp, Artificial Sequence
  Synthetic
aatgaagatctatttccagatgatgattcaccggccactattatcgaacgagtacaacctcatactactattatt

SEQ ID NO: 252679 - DNA, 75 bp, Artificial Sequence
  Synthetic
attcaccggccactattatcgaacgagtacaacctcatactactattattgacgatacgccacctcctacttttc

SEQ ID NO: 252680 - DNA, 75 bp, Artificial Sequence
  Synthetic
acgtcaacaacgagaaaaaagatttaatattacagtatcaaaaaattctgaagcaataatggaatctagatctat

SEQ ID NO: 252681 - DNA, 75 bp, Artificial Sequence
  Synthetic
aatattacagtatcaaaaaattctgaagcaataatggaatctagatctatgataacttctatgccaacacaaaca

SEQ ID NO: 252682 - DNA, 75 bp, Artificial Sequence
  Synthetic
aagataaaagaattcagatgctagaggatgaagtggttaatcttagaaatcaacgatctaatacaaaatcatctg

SEQ ID NO: 252683 - DNA, 75 bp, Artificial Sequence
  Synthetic
ggatgaagtggttaatcttagaaatcaacgatctaatacaaaatcatctgataatttagataattttaccagaat

SEQ ID NO: 252684 - DNA, 75 bp, Artificial Sequence
  Synthetic
tcaacagaagttaataagcgtatagccatcgttaattatgcaaatttgaacgggtcccccttatcagtcgaggac

SEQ ID NO: 252685 - DNA, 75 bp, Artificial Sequence
  Synthetic
ccatcgttaattatgcaaatttgaacgggtcccccttatcagtcgaggacttggatgtttgttcggaggatgaaa

SEQ ID NO: 252686 - DNA, 75 bp, Artificial Sequence
  Synthetic
ttctctagtacataatttcacacaagtttttatacagacaaattaattctcgtccatatattttaaaacattgac

SEQ ID NO: 252687 - DNA, 75 bp, Artificial Sequence
  Synthetic
acaatatcacgaaagtagaaaacgaaaaattatcgtcactaacgtgattattattgtcataaacattatcgagca

SEQ ID NO: 252688 - DNA, 75 bp, Artificial Sequence
  Synthetic
aaaattatcgtcactaacgtgattattattgtcataaacattatcgagcaggcattgctaaaactcggatttgaa

SEQ ID NO: 252689 - DNA, 75 bp, Artificial Sequence
  Synthetic
tcacttcagaaattatcgatgtggagatcggagatgactgcgatgctgtagcatcaaaactaggaatcggtaaca

SEQ ID NO: 252690 - DNA, 75 bp, Artificial Sequence
  Synthetic
gatcggagatgactgcgatgctgtagcatcaaaactaggaatcggtaacagtccggttcttaatattgtattgtt

SEQ ID NO: 252691 - DNA, 75 bp, Artificial Sequence
  Synthetic
attaaaattatttaatttaatacattcccatatccagacaacaatcgtctggattaatctgttcctgtcgtctca

SEQ ID NO: 252692 - DNA, 75 bp, Artificial Sequence
  Synthetic
tgcagctgttgccgttgttaaaggaaattgtagaaaggataccgtagacttttcttagaaatgccattcgtatgt

SEQ ID NO: 252693 - DNA, 75 bp, Artificial Sequence
  Synthetic
tcccatatccagacaacaatcgtctggattaatctgttcctgtcgtctcataccggacgacatattaatcttttt

SEQ ID NO: 252694 - DNA, 75 bp, Artificial Sequence
  Synthetic
aattgtagaaaggataccgtagacttttcttagaaatgccattcgtatgtacacgctggcagacgccaccgagct

SEQ ID NO: 252695 - DNA, 75 bp, Artificial Sequence
  Synthetic
ttctttttcccagcattaactgattcgatacctagaagatcgtgattgatttctccgaccattccacgaacttct

SEQ ID NO: 252696 - DNA, 75 bp, Artificial Sequence
  Synthetic
cgatacctagaagatcgtgattgatttctccgaccattccacgaacttctaattggccgtctctaacggtaccat

SEQ ID NO: 252697 - DNA, 75 bp, Artificial Sequence
  Synthetic
agcttggacaatctgaccatccattgcgttgaatgatgtagttgctgttgttctacgtctaggagcaccagaggt

SEQ ID NO: 252698 - DNA, 75 bp, Artificial Sequence
  Synthetic
gcgttgaatgatgtagttgctgttgttctacgtctaggagcaccagaggtatttttagagctcttggatgttgat

SEQ ID NO: 252699 - DNA, 75 bp, Artificial Sequence
  Synthetic
gtttacatgtaatacattttgaactctttgattttgtatcacatgcgccggcagtcacatctgtttgagaattaa

SEQ ID NO: 252700 - DNA, 75 bp, Artificial Sequence
  Synthetic
ctttgattttgtatcacatgcgccggcagtcacatctgtttgagaattaagattattgttgcctcctttgacggc

SEQ ID NO: 252701 - DNA, 75 bp, Artificial Sequence
  Synthetic
agatttttaagctgtggtgtaatcttattaactgtttcgatataatcatcgtaactacttctaacggctaaattt

SEQ ID NO: 252702 - DNA, 75 bp, Artificial Sequence
  Synthetic
tattaactgtttcgatataatcatcgtaactacttctaacggctaaattttttttatccgccatttagaagctaa

SEQ ID NO: 252703 - DNA, 75 bp, Artificial Sequence
  Synthetic
ttaactagattatacaatgaactaatatgatccttttctagattatttacgaacttggtatttcttgtttctgga

SEQ ID NO: 252704 - DNA, 75 bp, Artificial Sequence
  Synthetic
tatgatccttttctagattatttacgaacttggtatttcttgtttctggaggaggagaatttaaattcggacttg

SEQ ID NO: 252705 - DNA, 75 bp, Artificial Sequence
  Synthetic
cttattatacagcgtgtataggatggcgacggtaactgctacacaaataccgatcaacagaagaataccaatcat

SEQ ID NO: 252706 - DNA, 75 bp, Artificial Sequence
  Synthetic
gcgacggtaactgctacacaaataccgatcaacagaagaataccaatcatttattgacaataacttcactatgat

SEQ ID NO: 252707 - DNA, 75 bp, Artificial Sequence
  Synthetic
ctaagtaagtagtaataatgattcaacaatgacaagatatatggacgataataatttagttcatggaaatatcgc

SEQ ID NO: 252708 - DNA, 75 bp, Artificial Sequence
  Synthetic
acaatgacaagatatatggacgataataatttagttcatggaaatatcgctatgattggtgtgaatgactccgct

SEQ ID NO: 252709 - DNA, 75 bp, Artificial Sequence
  Synthetic
gtatccgattgagattttgcatacaatactagtctagaaagaaatttgtaatcatcttctgtgacaggagtccat

SEQ ID NO: 252710 - DNA, 75 bp, Artificial Sequence
  Synthetic
atcatcttctgtgacaggagtccatatatctgtatcatcgtctagtttttatcagtgtcctatgctatattcctg

SEQ ID NO: 252711 - DNA, 75 bp, Artificial Sequence
  Synthetic
ccccacatagaataaattagcattccgactgtgataataataccaagtataaacgccataatactcaatactttc

SEQ ID NO: 252712 - DNA, 75 bp, Artificial Sequence
  Synthetic
cgactgtgataataataccaagtataaacgccataatactcaatactttccatgtacgagtgggactggtagact

SEQ ID NO: 252713 - DNA, 75 bp, Artificial Sequence
  Synthetic
acacgaaagaatcaaaagaatgattccagcgattagcacgccggaaaaataatttccaatcataagcatcatgtc

SEQ ID NO: 252714 - DNA, 75 bp, Artificial Sequence
  Synthetic
ccagcgattagcacgccggaaaaataatttccaatcataagcatcatgtccatttaactaataaaaattttaaat

SEQ ID NO: 252715 - DNA, 75 bp, Artificial Sequence
  Synthetic
aaccatataaaaacaatagtttgtactgcaaaaataatatctatttttgttttcgaagatatggtaaaattaaat

SEQ ID NO: 252716 - DNA, 75 bp, Artificial Sequence
  Synthetic
ctgcaaaaataatatctatttttgttttcgaagatatggtaaaattaaatagtagtacacagcatgttataacta

SEQ ID NO: 252717 - DNA, 75 bp, Artificial Sequence
  Synthetic
tatcatttactagacgaaaaggtggtgggatattttcttgctcaaataatacgaatatatcacccatccatttta

SEQ ID NO: 252718 - DNA, 75 bp, Artificial Sequence
  Synthetic
tgggatattttcttgctcaaataatacgaatatatcacccatccattttatacgatgtttatatactctaatctt

SEQ ID NO: 252719 - DNA, 75 bp, Artificial Sequence
  Synthetic
caaatatattactagacaatattccatatagttattagttaagggacccaattagaacacatacgcgcttattca

SEQ ID NO: 252720 - DNA, 75 bp, Artificial Sequence
  Synthetic
accaacaatatagattttatcgattcatctaatttaaacccttccttaaacgtgaatgatctattatctggcata

SEQ ID NO: 252721 - DNA, 75 bp, Artificial Sequence
  Synthetic
catctaatttaaacccttccttaaacgtgaatgatctattatctggcataatgatgaccctacctgatgaatctg

SEQ ID NO: 252722 - DNA, 75 bp, Artificial Sequence
  Synthetic
actattttagttggtggtcgccatggatggtgttatcgtatactgtctaaatgcgttagtaaaacatggcgagga

SEQ ID NO: 252723 - DNA, 75 bp, Artificial Sequence
  Synthetic
aattatcaacgaattatcgtctacgaacatttatatcatttgttttaattttaggacgtgaataaatagatataa

SEQ ID NO: 252724 - DNA, 75 bp, Artificial Sequence
  Synthetic
aaaaaaaacataactattaagcgctattgcgctattgtgcttaattattttgctctataaactgaatatatatag

SEQ ID NO: 252725 - DNA, 75 bp, Artificial Sequence
  Synthetic
ttaggacgtgaataaatagatataaaatagaaaataacagatattacaaccagtgttatggacgcacccaaccat

SEQ ID NO: 252726 - DNA, 75 bp, Artificial Sequence
  Synthetic
ctacaggttctcctggatgtacgtcaccaactgcagacgtagttctagtacaattagacgtaagttccgcttggg

SEQ ID NO: 252727 - DNA, 75 bp, Artificial Sequence
  Synthetic
caattagacgtaagttccgcttgggaattttttaacgctaaagagttaacgttaatcgtacacccaacgtattta

SEQ ID NO: 252728 - DNA, 75 bp, Artificial Sequence
  Synthetic
catctagttctttgaacatcttgattataatataaccattttctatctctagattcgtcagtgcactcatgtaac

SEQ ID NO: 252729 - DNA, 75 bp, Artificial Sequence
  Synthetic
tataatataaccattttctatctctagattcgtcagtgcactcatgtaaccaacataccctaggtcctaaatatt

SEQ ID NO: 252730 - DNA, 75 bp, Artificial Sequence
  Synthetic
attcgcgcaccaacaatttctatttcctttatggtcgttacaaaagacgtataatgccgtatccccaaaagtaaa

SEQ ID NO: 252731 - DNA, 75 bp, Artificial Sequence
  Synthetic
cctttatggtcgttacaaaagacgtataatgccgtatccccaaaagtaaaataatcaggacgaataattctaata

SEQ ID NO: 252732 - DNA, 75 bp, Artificial Sequence
  Synthetic
tatgtttggagcaaatatcggaataagtagacatagccggtttccgttttacacgtaaccattctaaacaattgg

SEQ ID NO: 252733 - DNA, 75 bp, Artificial Sequence
  Synthetic
agtagacatagccggtttccgttttacacgtaaccattctaaacaattggggtttccaggatcgtttctacaaaa

SEQ ID NO: 252734 - DNA, 75 bp, Artificial Sequence
  Synthetic
tctgtcttgtaattattattaaatatttttggacagtgtttggtatttgtcttagaacaacattttgccacgcta

SEQ ID NO: 252735 - DNA, 75 bp, Artificial Sequence
  Synthetic
tttttggacagtgtttggtatttgtcttagaacaacattttgccacgctatcactatcacccaggagataatcct

SEQ ID NO: 252736 - DNA, 75 bp, Artificial Sequence
  Synthetic
atttcaaaatgttaaatcgcgtgccagtctattggcggaaaaaaaaatgcctagagtacctattactgctaccga

SEQ ID NO: 252737 - DNA, 75 bp, Artificial Sequence
  Synthetic
atttcaaaatgttaaatcgcgtgccagtctattggcggaaaaaataatgcctagagtacctattactgctaccga

SEQ ID NO: 252738 - DNA, 75 bp, Artificial Sequence
  Synthetic
atttcaaaatgttaaatcgcgtgccagtctattggcggaaaaaacaatgcctagagtacctattactgctaccga

SEQ ID NO: 252739 - DNA, 75 bp, Artificial Sequence
  Synthetic
atttcaaaatgttaaatcgcgtgccagtctattggcggaaaaaagaatgcctagagtacctattactgctaccga

SEQ ID NO: 252740 - DNA, 75 bp, Artificial Sequence
  Synthetic
atgttgatagaagttattttaacagccgcatattctactaagccgtacaacaataagggaaaaaaccgacctgtc

SEQ ID NO: 252741 - DNA, 75 bp, Artificial Sequence
  Synthetic
atgttgatagaagttattttaacagccgcatattctactaagccgtacaacaataagggaaaaatccgacctgtc

SEQ ID NO: 252742 - DNA, 75 bp, Artificial Sequence
  Synthetic
atgttgatagaagttattttaacagccgcatattctactaagccgtacaacaataagggaaaaacccgacctgtc

SEQ ID NO: 252743 - DNA, 75 bp, Artificial Sequence
  Synthetic
atgttgatagaagttattttaacagccgcatattctactaagccgtacaacaataagggaaaaagccgacctgtc

SEQ ID NO: 252744 - DNA, 75 bp, Artificial Sequence
  Synthetic
atgttgatagaagttattttaacagccgcatattctactaagccgtacaacaataagggataaaaccgacctgtc

SEQ ID NO: 252745 - DNA, 75 bp, Artificial Sequence
  Synthetic
atgttgatagaagttattttaacagccgcatattctactaagccgtacaacaataagggataaatccgacctgtc

SEQ ID NO: 252746 - DNA, 75 bp, Artificial Sequence
  Synthetic
atgttgatagaagttattttaacagccgcatattctactaagccgtacaacaataagggataaacccgacctgtc

SEQ ID NO: 252747 - DNA, 75 bp, Artificial Sequence
  Synthetic
atgttgatagaagttattttaacagccgcatattctactaagccgtacaacaataagggataaagccgacctgtc

SEQ ID NO: 252748 - DNA, 75 bp, Artificial Sequence
  Synthetic
atgttgatagaagttattttaacagccgcatattctactaagccgtacaacaataagggacaaaaccgacctgtc

SEQ ID NO: 252749 - DNA, 75 bp, Artificial Sequence
  Synthetic
atgttgatagaagttattttaacagccgcatattctactaagccgtacaacaataagggacaaatccgacctgtc

SEQ ID NO: 252750 - DNA, 75 bp, Artificial Sequence
  Synthetic
atgttgatagaagttattttaacagccgcatattctactaagccgtacaacaataagggacaaacccgacctgtc

SEQ ID NO: 252751 - DNA, 75 bp, Artificial Sequence
  Synthetic
atgttgatagaagttattttaacagccgcatattctactaagccgtacaacaataagggacaaagccgacctgtc

SEQ ID NO: 252752 - DNA, 75 bp, Artificial Sequence
  Synthetic
atgttgatagaagttattttaacagccgcatattctactaagccgtacaacaataagggagaaaaccgacctgtc

SEQ ID NO: 252753 - DNA, 75 bp, Artificial Sequence
  Synthetic
atgttgatagaagttattttaacagccgcatattctactaagccgtacaacaataagggagaaatccgacctgtc

SEQ ID NO: 252754 - DNA, 75 bp, Artificial Sequence
  Synthetic
atgttgatagaagttattttaacagccgcatattctactaagccgtacaacaataagggagaaacccgacctgtc

SEQ ID NO: 252755 - DNA, 75 bp, Artificial Sequence
  Synthetic
atgttgatagaagttattttaacagccgcatattctactaagccgtacaacaataagggagaaagccgacctgtc

SEQ ID NO: 252756 - DNA, 75 bp, Artificial Sequence
  Synthetic
ggatgctatataatcagtagcatattttaaatccttaatatattcaggagttacctcgttctgataatagattaa

SEQ ID NO: 252757 - DNA, 75 bp, Artificial Sequence
  Synthetic
tttaaatccttaatatattcaggagttacctcgttctgataatagattaatgatccaggacgaaatttgaaagaa

SEQ ID NO: 252758 - DNA, 75 bp, Artificial Sequence
  Synthetic
catattgtttagcaaattcaggaactataaaactactacaatgatctatcgacataccatctatcaaacaaaatt

SEQ ID NO: 252759 - DNA, 75 bp, Artificial Sequence
  Synthetic
tataaaactactacaatgatctatcgacataccatctatcaaacaaaatttgggtttaatttctcctggagacgt

SEQ ID NO: 252760 - DNA, 75 bp, Artificial Sequence
  Synthetic
tcggcaaacctaacagctctattatattcaggataattaaaatctaataccatatatttgtctcgtatatctgct

SEQ ID NO: 252761 - DNA, 75 bp, Artificial Sequence
  Synthetic
attcaggataattaaaatctaataccatatatttgtctcgtatatctgctattcctgtctctattttgattctat

SEQ ID NO: 252762 - DNA, 75 bp, Artificial Sequence
  Synthetic
taataatcatcagtatttaaactgttaaatgttggtatatcaacatctatcttatttcccgcaatataaggtttg

SEQ ID NO: 252763 - DNA, 75 bp, Artificial Sequence
  Synthetic
taaatgttggtatatcaacatctatcttatttcccgcaatataaggtttgttgcaggtatactgttcaggaatgg

SEQ ID NO: 252764 - DNA, 75 bp, Artificial Sequence
  Synthetic
ctgtctttcgatgttcatcacaaatgcaaagaacagaataaacaaaataatgtaagaaataatattaaatatctg

SEQ ID NO: 252765 - DNA, 75 bp, Artificial Sequence
  Synthetic
gcaaagaacagaataaacaaaataatgtaagaaataatattaaatatctgtgaattcgtaaatacattgattgcc

SEQ ID NO: 252766 - DNA, 75 bp, Artificial Sequence
  Synthetic
tttatagattatataaaggtacaaaaacaggatatcgtcaaacttactgtatacgattgcatatatctatgatag

SEQ ID NO: 252767 - DNA, 75 bp, Artificial Sequence
  Synthetic
acacaatagacattcccacagtgttgccattacctccacgatacatttgagttactaagcaataggtaataacta

SEQ ID NO: 252768 - DNA, 75 bp, Artificial Sequence
  Synthetic
gttactaagcaataggtaataactaagctagtaagaggcaatagaaaagatgagataaatatcatcaatatagag

SEQ ID NO: 252769 - DNA, 75 bp, Artificial Sequence
  Synthetic
tagaatagactagtgtatgtggaaatgtcatagaaagttaaaagttaatgagagcaaaaatatataaggttgtat

SEQ ID NO: 252770 - DNA, 75 bp, Artificial Sequence
  Synthetic
agacgaacaaaatcaaaccgagtaacgttctaacatcattatttttgaagattcccaaataatcattcattattc

SEQ ID NO: 252771 - DNA, 75 bp, Artificial Sequence
  Synthetic
cgttctaacatcattatttttgaagattcccaaataatcattcattattcctccataatcgttttgcatcatacc

SEQ ID NO: 252772 - DNA, 75 bp, Artificial Sequence
  Synthetic
gggatactgaaggatatttcagagagttgtggatgttcgggttcgacatccaccgatggtgtcacgccactaatc

SEQ ID NO: 252773 - DNA, 75 bp, Artificial Sequence
  Synthetic
gggatactgaaggatatttcagagagttgtggatgttcgggttcgacatcctccgatggtgtcacgccactaatc

SEQ ID NO: 252774 - DNA, 75 bp, Artificial Sequence
  Synthetic
gggatactgaaggatatttcagagagttgtggatgttcgggttcgacatcccccgatggtgtcacgccactaatc

SEQ ID NO: 252775 - DNA, 75 bp, Artificial Sequence
  Synthetic
gggatactgaaggatatttcagagagttgtggatgttcgggttcgacatccgccgatggtgtcacgccactaatc

SEQ ID NO: 252776 - DNA, 75 bp, Artificial Sequence
  Synthetic
gggatactgaaggatatttcagagagttgtggttgttcgggttcgacatccaccgatggtgtcacgccactaatc

SEQ ID NO: 252777 - DNA, 75 bp, Artificial Sequence
  Synthetic
gggatactgaaggatatttcagagagttgtggttgttcgggttcgacatcctccgatggtgtcacgccactaatc

SEQ ID NO: 252778 - DNA, 75 bp, Artificial Sequence
  Synthetic
gggatactgaaggatatttcagagagttgtggttgttcgggttcgacatcccccgatggtgtcacgccactaatc

SEQ ID NO: 252779 - DNA, 75 bp, Artificial Sequence
  Synthetic
gggatactgaaggatatttcagagagttgtggttgttcgggttcgacatccgccgatggtgtcacgccactaatc

SEQ ID NO: 252780 - DNA, 75 bp, Artificial Sequence
  Synthetic
gggatactgaaggatatttcagagagttgtggctgttcgggttcgacatccaccgatggtgtcacgccactaatc

SEQ ID NO: 252781 - DNA, 75 bp, Artificial Sequence
  Synthetic
gggatactgaaggatatttcagagagttgtggctgttcgggttcgacatcctccgatggtgtcacgccactaatc

SEQ ID NO: 252782 - DNA, 75 bp, Artificial Sequence
  Synthetic
gggatactgaaggatatttcagagagttgtggctgttcgggttcgacatcccccgatggtgtcacgccactaatc

SEQ ID NO: 252783 - DNA, 75 bp, Artificial Sequence
  Synthetic
gggatactgaaggatatttcagagagttgtggctgttcgggttcgacatccgccgatggtgtcacgccactaatc

SEQ ID NO: 252784 - DNA, 75 bp, Artificial Sequence
  Synthetic
gggatactgaaggatatttcagagagttgtgggtgttcgggttcgacatccaccgatggtgtcacgccactaatc

SEQ ID NO: 252785 - DNA, 75 bp, Artificial Sequence
  Synthetic
gggatactgaaggatatttcagagagttgtgggtgttcgggttcgacatcctccgatggtgtcacgccactaatc

SEQ ID NO: 252786 - DNA, 75 bp, Artificial Sequence
  Synthetic
gggatactgaaggatatttcagagagttgtgggtgttcgggttcgacatcccccgatggtgtcacgccactaatc

SEQ ID NO: 252787 - DNA, 75 bp, Artificial Sequence
  Synthetic
gggatactgaaggatatttcagagagttgtgggtgttcgggttcgacatccgccgatggtgtcacgccactaatc

SEQ ID NO: 252788 - DNA, 75 bp, Artificial Sequence
  Synthetic
tgctgttcctctgtaaataaatctttatcaagcactccagcacccgcagagaagtcatcaagcatattgtaatat

SEQ ID NO: 252789 - DNA, 75 bp, Artificial Sequence
  Synthetic
tatcaagcactccagcacccgcagagaagtcatcaagcatattgtaatatcttaaataactcatttatatattaa

SEQ ID NO: 252790 - DNA, 75 bp, Artificial Sequence
  Synthetic
ataatctttatgccgaactaaaaaaaatgacttgtggtcagaccataagtctttttaatgaagacggcgatttcg

SEQ ID NO: 252791 - DNA, 75 bp, Artificial Sequence
  Synthetic
aatgacttgtggtcagaccataagtctttttaatgaagacggcgatttcgtagaagttgaaccaggatcatcctt

SEQ ID NO: 252792 - DNA, 75 bp, Artificial Sequence
  Synthetic
tactcctctccttgtgtaaagacgagtctagtattcgagacattaacaacgaccgataataaaattactagtatc

SEQ ID NO: 252793 - DNA, 75 bp, Artificial Sequence
  Synthetic
gtctagtattcgagacattaacaacgaccgataataaaattactagtatcaatccaacaaatgcgccaaagttat

SEQ ID NO: 252794 - DNA, 75 bp, Artificial Sequence
  Synthetic
tgaagtagtttctaatatgaggaaaatgatcgaattaaaacgtcctctatacatcactcttcacttggcatgtgg

SEQ ID NO: 252795 - DNA, 75 bp, Artificial Sequence
  Synthetic
atgatcgaattaaaacgtcctctatacatcactcttcacttggcatgtggatttggtaagactattaccacgtgt

SEQ ID NO: 252796 - DNA, 75 bp, Artificial Sequence
  Synthetic
aaaccatcatttgcgtacccaataaaatgttaatacatcaatggaagacacaggtagaggcagtcggattggaac

SEQ ID NO: 252797 - DNA, 75 bp, Artificial Sequence
  Synthetic
aatgttaatacatcaatggaagacacaggtagaggcagtcggattggaacataagatatctatagatggagttag

SEQ ID NO: 252798 - DNA, 75 bp, Artificial Sequence
  Synthetic
caaagtccggatgtattaatcgtagtcagtagacatctgacaaacgatgcattttgtaaatatatcaataagcat

SEQ ID NO: 252799 - DNA, 75 bp, Artificial Sequence
  Synthetic
tcagtagacatctgacaaacgatgcattttgtaaatatatcaataagcattatgatttgtttatcttggatgaat

SEQ ID NO: 252800 - DNA, 75 bp, Artificial Sequence
  Synthetic
tacagcagttacaagatttttagcgtattatcctccgatgatgtgttattttttaactgctacacctagaccagc

SEQ ID NO: 252801 - DNA, 75 bp, Artificial Sequence
  Synthetic
taaaaaaaactatctatacagtagatagtttttttgagccatattccacagacaatattagaaatatggtaaaac

SEQ ID NO: 252802 - DNA, 75 bp, Artificial Sequence
  Synthetic
tagtttttttgagccatattccacagacaatattagaaatatggtaaaacgactagatggaccatctaataaata

SEQ ID NO: 252803 - DNA, 75 bp, Artificial Sequence
  Synthetic
tctgtagacgagcctagaaaccaacttattcttgataccctggtagaagaattcaagtcaggaactattaataga

SEQ ID NO: 252804 - DNA, 75 bp, Artificial Sequence
  Synthetic
ttattcttgataccctggtagaagaattcaagtcaggaactattaatagaattttagttattactaaactacgtg

SEQ ID NO: 252805 - DNA, 75 bp, Artificial Sequence
  Synthetic
tcgtatccgactctgaatacagatgagcgatgatatacagatgcaatacggtaccacaatttcgtggttgataat

SEQ ID NO: 252806 - DNA, 75 bp, Artificial Sequence
  Synthetic
attattagatcttttcggaccagaggttgtatttataggagacgcccaaaatagacgtactccagatatggtcaa

SEQ ID NO: 252807 - DNA, 75 bp, Artificial Sequence
  Synthetic
gttgtatttataggagacgcccaaaatagacgtactccagatatggtcaaatcaattaaggaactaaatagattt

SEQ ID NO: 252808 - DNA, 75 bp, Artificial Sequence
  Synthetic
ccggcactggtttagatattccgagtttggattctttgttcatttgctcggcagtaatcaacaatatgcaaatag

SEQ ID NO: 252809 - DNA, 75 bp, Artificial Sequence
  Synthetic
tttggattctttgttcatttgctcggcagtaatcaacaatatgcaaatagagcaattactagggagggtatgtcg

SEQ ID NO: 252810 - DNA, 75 bp, Artificial Sequence
  Synthetic
gtatatgtatttcctaacacatccatcaaagaaataaagtacatgataggaaatttcgtgcaacgaattattagt

SEQ ID NO: 252811 - DNA, 75 bp, Artificial Sequence
  Synthetic
tcaaagaaataaagtacatgataggaaatttcgtgcaacgaattattagtctgtctgtagataaactcggattta

SEQ ID NO: 252812 - DNA, 75 bp, Artificial Sequence
  Synthetic
ttctcgttgacaagatccatctacttttccatccctaatagtatccagttccttttctagttctgaccgcatttc

SEQ ID NO: 252813 - DNA, 75 bp, Artificial Sequence
  Synthetic
ggaatctgaacccgcttccgtgccaacatcctccagagaagaacgtgtattaaatagaatatttaactcgcaaaa

SEQ ID NO: 252814 - DNA, 75 bp, Artificial Sequence
  Synthetic
acatcctccagagaagaacgtgtattaaatagaatatttaactcgcaaaatcgttaagaagtttaagagacgatc

SEQ ID NO: 252815 - DNA, 75 bp, Artificial Sequence
  Synthetic
acccctcatagtattaatataatccaatgatacttttgtgatgtcggaaatcttaaccaatttagactgacaggc

SEQ ID NO: 252816 - DNA, 75 bp, Artificial Sequence
  Synthetic
tcttaaccaatttagactgacaggcagaacacgtcatgcaatcatcatcgtcatcgataactgtagtcttgggct

SEQ ID NO: 252817 - DNA, 75 bp, Artificial Sequence
  Synthetic
tctttttgcgactcttcattccggaacgcatattggtgctatccatttaggtagtaaaaaataagtcagaatatg

SEQ ID NO: 252818 - DNA, 75 bp, Artificial Sequence
  Synthetic
acgcatattggtgctatccatttaggtagtaaaaaataagtcagaatatgccctataacacgatcgtgcaaaacc

SEQ ID NO: 252819 - DNA, 75 bp, Artificial Sequence
  Synthetic
caatatagtgtatcaacatctttattattgacctcgtttatcttggaacatggaatgggaacatttttgttaacg

SEQ ID NO: 252820 - DNA, 75 bp, Artificial Sequence
  Synthetic
tattgacctcgtttatcttggaacatggaatgggaacatttttgttaacggccacctttgccttaattccagatg

SEQ ID NO: 252821 - DNA, 75 bp, Artificial Sequence
  Synthetic
atcatcgacacaaatgaaattcttgtttagacgtttgtagtttacgtatgcggctcgttctcgtctcattttttc

SEQ ID NO: 252822 - DNA, 75 bp, Artificial Sequence
  Synthetic
tttagacgtttgtagtttacgtatgcggctcgttctcgtctcattttttcagatattgcaggtactataatatta

SEQ ID NO: 252823 - DNA, 75 bp, Artificial Sequence
  Synthetic
ttaaaaataaagttatcatgacttctagtgctgatttaactaacttaaaagaattacttagtctgtacaaaagtt

SEQ ID NO: 252824 - DNA, 75 bp, Artificial Sequence
  Synthetic
tagtgctgatttaactaacttaaaagaattacttagtctgtacaaaagtttgagattttcagattctgtggctat

SEQ ID NO: 252825 - DNA, 75 bp, Artificial Sequence
  Synthetic
tggggaacatctacttactggaaaataggcgtacaaaaggtaactaatgtcgagacgtccatatctgattattat

SEQ ID NO: 252826 - DNA, 75 bp, Artificial Sequence
  Synthetic
taggcgtacaaaaggtaactaatgtcgagacgtccatatctgattattatgatgaggtaaaaaataaaccgttta

SEQ ID NO: 252827 - DNA, 75 bp, Artificial Sequence
  Synthetic
cttaccagtatattttggaagcgtctttatttattcgaagggtaaaaatatggtagaacttggatctggaaactc

SEQ ID NO: 252828 - DNA, 75 bp, Artificial Sequence
  Synthetic
tttatttattcgaagggtaaaaatatggtagaacttggatctggaaactcttttcaaataccggatgagattcga

SEQ ID NO: 252829 - DNA, 75 bp, Artificial Sequence
  Synthetic
gtgataacggaatagactttctgagatttgttttgttaaacaatagatggataatggaagacgctatatcaaaat

SEQ ID NO: 252830 - DNA, 75 bp, Artificial Sequence
  Synthetic
atttgttttgttaaacaatagatggataatggaagacgctatatcaaaataccagtctccagttaatatatttaa

SEQ ID NO: 252831 - DNA, 75 bp, Artificial Sequence
  Synthetic
atacccaactatttagaaattgaaatagaggaagacacattatttgacgatgagttatactctattatggaacgc

SEQ ID NO: 252832 - DNA, 75 bp, Artificial Sequence
  Synthetic
tagaggaagacacattatttgacgatgagttatactctattatggaacgctctttcgatgatacatttccaaaaa

SEQ ID NO: 252833 - DNA, 75 bp, Artificial Sequence
  Synthetic
agaacttaaacggcaagttgtagactttttcaaattctcattcatgtatattgagtcaatcaaggtagatcgtat

SEQ ID NO: 252834 - DNA, 75 bp, Artificial Sequence
  Synthetic
tttttcaaattctcattcatgtatattgagtcaatcaaggtagatcgtataggagataatatttttattcctagc

SEQ ID NO: 252835 - DNA, 75 bp, Artificial Sequence
  Synthetic
tattagtaaaagatgtagaccatttaatacgatccaaggttagagaacatacatttgtaaaagtaaaaaagaaaa

SEQ ID NO: 252836 - DNA, 75 bp, Artificial Sequence
  Synthetic
aatacgatccaaggttagagaacatacatttgtaaaagtaaaaaagaaaaacacattttccattttatacgacta

SEQ ID NO: 252837 - DNA, 75 bp, Artificial Sequence
  Synthetic
ggagaagtaataaaacgaattatagacactataggacgagactattatgttaatggaaagtatttctctaaggtt

SEQ ID NO: 252838 - DNA, 75 bp, Artificial Sequence
  Synthetic
acactataggacgagactattatgttaatggaaagtatttctctaaggttggtagtgcaggcttaaagcaattga

SEQ ID NO: 252839 - DNA, 75 bp, Artificial Sequence
  Synthetic
gaaaacatgtacataattataaaaaatgaaaatcaatggcgaataagacagtgcgattcgcgccatggagtcggc

SEQ ID NO: 252840 - DNA, 75 bp, Artificial Sequence
  Synthetic
cgcaactgtcgatgagttagttgatgagattaataaatccggaactgtaaaacgaaaaataaaaaaccaatcagt

SEQ ID NO: 252841 - DNA, 75 bp, Artificial Sequence
  Synthetic
gagattaataaatccggaactgtaaaacgaaaaataaaaaaccaatcagtatttgatttaagcagagaatgtttg

SEQ ID NO: 252842 - DNA, 75 bp, Artificial Sequence
  Synthetic
cgttagttaataacatgcggttcaaaatagaaaattgtaaggtcgtaaatttcaatattgaaaatactaattgtt

SEQ ID NO: 252843 - DNA, 75 bp, Artificial Sequence
  Synthetic
aatagaaaattgtaaggtcgtaaatttcaatattgaaaatactaattgtttaaataacccgagtattgaaactat

SEQ ID NO: 252844 - DNA, 75 bp, Artificial Sequence
  Synthetic
ttgacaggatcaggctcttctacaggaagaagtttcggcctcttatgatagtcatgtctgggaaatggtggtcta

SEQ ID NO: 252845 - DNA, 75 bp, Artificial Sequence
  Synthetic
tcaatctttaataccgttaccgatgtcaaaaaaagattattcgagtgaaataatatgcgcctttgatataggtgc

SEQ ID NO: 252846 - DNA, 75 bp, Artificial Sequence
  Synthetic
tcaaaaaaagattattcgagtgaaataatatgcgcctttgatataggtgcaaaaaatcctgccagaactgtttta

SEQ ID NO: 252847 - DNA, 75 bp, Artificial Sequence
  Synthetic
tattggatatatcaaaattagactggagttctgattgggaaaggcgcatagctcaagatttgtcacaatatgaat

SEQ ID NO: 252848 - DNA, 75 bp, Artificial Sequence
  Synthetic
gagttctgattgggaaaggcgcatagctcaagatttgtcacaatatgaatacactacagttcttctagaacgtca

SEQ ID NO: 252849 - DNA, 75 bp, Artificial Sequence
  Synthetic
tttatctattttattaaaggctttttatatcatacatctgctgccaaagttatttgcgtctcacctgtcatgtct

SEQ ID NO: 252850 - DNA, 75 bp, Artificial Sequence
  Synthetic
tatatcatacatctgctgccaaagttatttgcgtctcacctgtcatgtctggtaattcatatagagatcgaaaaa

SEQ ID NO: 252851 - DNA, 75 bp, Artificial Sequence
  Synthetic
ttggatggacacattcggattgcgagactccgttccggatagacgcaaattagacgatgtagcggatagtttcaa

SEQ ID NO: 252852 - DNA, 75 bp, Artificial Sequence
  Synthetic
ttccatatcatcattgtgtaaactaaataacgttttctatggcatttaataaggacattggatatgtggaaaaga

SEQ ID NO: 252853 - DNA, 75 bp, Artificial Sequence
  Synthetic
ctaacggtatcgaatggcataagtttgaaacgagtgaagaaataatttctacttacttaatagatgatgtggtaa

SEQ ID NO: 252854 - DNA, 75 bp, Artificial Sequence
  Synthetic
gactccgttccggatagacgcaaattagacgatgtagcggatagtttcaatttggctatgagatacgtattagat

SEQ ID NO: 252855 - DNA, 75 bp, Artificial Sequence
  Synthetic
tccattgttaccacgtctgtactcgacgagctcacgtttaagagattcaatttccagtttgtatcggtccatgtc

SEQ ID NO: 252856 - DNA, 75 bp, Artificial Sequence
  Synthetic
ataataggtgtaaatatagaaattacataaaaaaaatgtaataacgttagtaacgccattatggataatctattt

SEQ ID NO: 252857 - DNA, 75 bp, Artificial Sequence
  Synthetic
cataaaaaaaatgtaataacgttagtaacgccattatggataatctatttacctttctacatgaaatagaagata

SEQ ID NO: 252858 - DNA, 75 bp, Artificial Sequence
  Synthetic
tcatctaataagttgcgatgaaataggagatatatatggtcttatgaaagaacgcatttcctcagaggatatgtt

SEQ ID NO: 252859 - DNA, 75 bp, Artificial Sequence
  Synthetic
ggagatatatatggtcttatgaaagaacgcatttcctcagaggatatgtttgacaatatagtatataataaagat

SEQ ID NO: 252860 - DNA, 75 bp, Artificial Sequence
  Synthetic
tttattgcgacatccaacttactaaacatattattaatcagaatacgtatccggtatttaacgattcttcacaag

SEQ ID NO: 252861 - DNA, 75 bp, Artificial Sequence
  Synthetic
acatattattaatcagaatacgtatccggtatttaacgattcttcacaagtgaaatgttgtcattatttcgatat

SEQ ID NO: 252862 - DNA, 75 bp, Artificial Sequence
  Synthetic
gtgaatcagtcaaatttggtaattctattaatgttaaacatacatctgtttcagctaagcaactaagaacacgta

SEQ ID NO: 252863 - DNA, 75 bp, Artificial Sequence
  Synthetic
tctcgtacagtagagatatttgagagtgaaaagtcatctcttgtatcatatattaaaactaccaataagaagaga

SEQ ID NO: 252864 - DNA, 75 bp, Artificial Sequence
  Synthetic
gtgaaaagtcatctcttgtatcatatattaaaactaccaataagaagagaaaggtcaattacggcgaaataaaga

SEQ ID NO: 252865 - DNA, 75 bp, Artificial Sequence
  Synthetic
aaattacttttccggtaaaaagtctgatgagtatctgagcactacagtcaggtccaacattaatcaaccttggat

SEQ ID NO: 252866 - DNA, 75 bp, Artificial Sequence
  Synthetic
gatgagtatctgagcactacagtcaggtccaacattaatcaaccttggatcaaaaccatttctaagagaatgaga

SEQ ID NO: 252867 - DNA, 75 bp, Artificial Sequence
  Synthetic
taacgcgtggaaaaagctctatattacaaactatagaaattatttttactaatagaacatgtgtgaaaatattca

SEQ ID NO: 252868 - DNA, 75 bp, Artificial Sequence
  Synthetic
acaaactatagaaattatttttactaatagaacatgtgtgaaaatattcaaggattctactatgcacattattct

SEQ ID NO: 252869 - DNA, 75 bp, Artificial Sequence
  Synthetic
tgtataaacatgattgataaattattctatgtatattataatttatttctgttgttcgaggatatcatccaaaac

SEQ ID NO: 252870 - DNA, 75 bp, Artificial Sequence
  Synthetic
tctatgtatattataatttatttctgttgttcgaggatatcatccaaaacgagtactttaaagaagtagctaatg

SEQ ID NO: 252871 - DNA, 75 bp, Artificial Sequence
  Synthetic
ggcattagatgagaaattattcctaattaagaaaatggctgaacacgatgtttatggagttagcaatttcaaaat

SEQ ID NO: 252872 - DNA, 75 bp, Artificial Sequence
  Synthetic
attaagaaaatggctgaacacgatgtttatggagttagcaatttcaaaatagggatgtttaacctgacatttatt

SEQ ID NO: 252873 - DNA, 75 bp, Artificial Sequence
  Synthetic
cctctctgttagatgaggatagcaaaataaagttttttaaggggaaaaagctcaatattgtagcattacgatctc

SEQ ID NO: 252874 - DNA, 75 bp, Artificial Sequence
  Synthetic
aataaagttttttaaggggaaaaagctcaatattgtagcattacgatctctggaggattgtacaaattacgtgac

SEQ ID NO: 252875 - DNA, 75 bp, Artificial Sequence
  Synthetic
atgaaggaaagatcgactattttaaatagcatagatatagaaacggaatcggtagatcgtctaaaagaattgctt

SEQ ID NO: 252876 - DNA, 75 bp, Artificial Sequence
  Synthetic
atagcatagatatagaaacggaatcggtagatcgtctaaaagaattgcttctaaaatgaaaaaaaacactgtttc

SEQ ID NO: 252877 - DNA, 75 bp, Artificial Sequence
  Synthetic
aagtttttggtgcctgatcctaaagccggagttttttatagaccgttacatttccaatatgtatcgtattctaat

SEQ ID NO: 252878 - DNA, 75 bp, Artificial Sequence
  Synthetic
ccggagttttttatagaccgttacatttccaatatgtatcgtattctaattttatattgcatcgattgcatgaaa

SEQ ID NO: 252879 - DNA, 75 bp, Artificial Sequence
  Synthetic
atcgtttaagaataatacagaacgaattatgatagaaattagcaatgttaaagtgactcctccagattactcacc

SEQ ID NO: 252880 - DNA, 75 bp, Artificial Sequence
  Synthetic
tatattttatattttatattttattttatattttgtagtaagaatagaatgctaaatgtcaagtttattcgaata

SEQ ID NO: 252881 - DNA, 75 bp, Artificial Sequence
  Synthetic
attatgatagaaattagcaatgttaaagtgactcctccagattactcacctataattgcgagtattaaaggtaag

SEQ ID NO: 252882 - DNA, 75 bp, Artificial Sequence
  Synthetic
ctgtaaatatctttaaagaggtaatgaccaaagagggtatatccatcactaaaataagtagttatgagggaaaag

SEQ ID NO: 252883 - DNA, 75 bp, Artificial Sequence
  Synthetic
gaccaaagagggtatatccatcactaaaataagtagttatgagggaaaagattctcatttgataaaaattccgct

SEQ ID NO: 252884 - DNA, 75 bp, Artificial Sequence
  Synthetic
agagacataatgtagacatagttattatatccttcttagataagtgttacgctactggaaagtttccatcgttat

SEQ ID NO: 252885 - DNA, 75 bp, Artificial Sequence
  Synthetic
acattggctacggtatatacctacttcgtcacttccacacgctccagtaaacgggtgtcatgtgacgagggagaa

SEQ ID NO: 252886 - DNA, 75 bp, Artificial Sequence
  Synthetic
ccacttgatacagccaagtatcttgttcctaatgtcataggtggagtctttatcaataaacaatctgtcgaaaaa

SEQ ID NO: 252887 - DNA, 75 bp, Artificial Sequence
  Synthetic
ttcctaatgtcataggtggagtctttatcaataaacaatctgtcgaaaaagtaggaattaatctagtagaaaaga

SEQ ID NO: 252888 - DNA, 75 bp, Artificial Sequence
  Synthetic
tgttaagccaaactcattcactttctcgttttcctccgtatcccctcctaatgtattaccgacaagatatcgcca

SEQ ID NO: 252889 - DNA, 75 bp, Artificial Sequence
  Synthetic
tcgttttcctccgtatcccctcctaatgtattaccgacaagatatcgccattacaagatatctctggatatatca

SEQ ID NO: 252890 - DNA, 75 bp, Artificial Sequence
  Synthetic
cgacaaagacatttataacggtcaatattgttttgctgtctcaatatttatctagagtgagtctagaattcatta

SEQ ID NO: 252891 - DNA, 75 bp, Artificial Sequence
  Synthetic
gacgtagtttatcatacgatatgcctccagaagttgtctatctagtaaacgcgataatagatagtgctaaacgac

SEQ ID NO: 252892 - DNA, 75 bp, Artificial Sequence
  Synthetic
tattgatacatacattaatgacctggtggaagctgaacacattaaacaaaaatctcagttaacgattaacgagtt

SEQ ID NO: 252893 - DNA, 75 bp, Artificial Sequence
  Synthetic
gtggaagctgaacacattaaacaaaaatctcagttaacgattaacgagtttaaatatgaaatgctgcataacttt

SEQ ID NO: 252894 - DNA, 75 bp, Artificial Sequence
  Synthetic
atcaactaaagggattttatatgatatctttactaagaaagtttctctactgtatctaccacacttctagatatc

SEQ ID NO: 252895 - DNA, 75 bp, Artificial Sequence
  Synthetic
atctttactaagaaagtttctctactgtatctaccacacttctagatatccagatagagattcgatggtttgtca

SEQ ID NO: 252896 - DNA, 75 bp, Artificial Sequence
  Synthetic
tttgagacgttggcacatgatgaattagagaattacataggtaacatccgaaacgatatcatgaacaatcacaag

SEQ ID NO: 252897 - DNA, 75 bp, Artificial Sequence
  Synthetic
tagagaattacataggtaacatccgaaacgatatcatgaacaatcacaagaacagaggcacttacgcagtaaaca

SEQ ID NO: 252898 - DNA, 75 bp, Artificial Sequence
  Synthetic
taatcatgcattttctagtctattgagtggaaagttcaaaaagtcagacggtagttatcgaacacatcctcacta

SEQ ID NO: 252899 - DNA, 75 bp, Artificial Sequence
  Synthetic
agtggaaagttcaaaaagtcagacggtagttatcgaacacatcctcactattcatggatgcagaatatttctatt

SEQ ID NO: 252900 - DNA, 75 bp, Artificial Sequence
  Synthetic
atcaagtaaagatttcaaagatgttttctgtcagaaaataccatccaagccaatatctttacttttgttcatcag

SEQ ID NO: 252901 - DNA, 75 bp, Artificial Sequence
  Synthetic
ttctgtcagaaaataccatccaagccaatatctttacttttgttcatcagacgttccggaaagaggtcctcaggt

SEQ ID NO: 252902 - DNA, 75 bp, Artificial Sequence
  Synthetic
ttgagttccattacaaatatactaacgtctgagtatttggatttggaaaagaaaatttgtgagtatatcagatca

SEQ ID NO: 252903 - DNA, 75 bp, Artificial Sequence
  Synthetic
cgtctgagtatttggatttggaaaagaaaatttgtgagtatatcagatcatattataaagatgatataagttact

SEQ ID NO: 252904 - DNA, 75 bp, Artificial Sequence
  Synthetic
agaaaatgctctagtcgcatctcttaatccaaatatgatatgtgattttgtaactgactttagacgtagaaaacg

SEQ ID NO: 252905 - DNA, 75 bp, Artificial Sequence
  Synthetic
aatccaaatatgatatgtgattttgtaactgactttagacgtagaaaacggatgggattcttcggtaacttggag

SEQ ID NO: 252906 - DNA, 75 bp, Artificial Sequence
  Synthetic
acatgaatgaaattcgcattaatattggagcaggaagattagtcagaccattcttggttgtggataacggagagc

SEQ ID NO: 252907 - DNA, 75 bp, Artificial Sequence
  Synthetic
tggagcaggaagattagtcagaccattcttggttgtggataacggagagctcatgatggatgtgtgtccggagtt

SEQ ID NO: 252908 - DNA, 75 bp, Artificial Sequence
  Synthetic
tatcacgttttccattttcttgaagtactataagtaattataatataatgaatgtaaaaaggtttatatattcaa

SEQ ID NO: 252909 - DNA, 75 bp, Artificial Sequence
  Synthetic
ttctctgacattcagaaagagtttccacatgtcatcgaaatggtagatatagaacaatttacttttagtaacgta

SEQ ID NO: 252910 - DNA, 75 bp, Artificial Sequence
  Synthetic
cacatgtcatcgaaatggtagatatagaacaatttacttttagtaacgtatgtgaatcggttcaaaaatttagaa

SEQ ID NO: 252911 - DNA, 75 bp, Artificial Sequence
  Synthetic
atacgatttatgtgactttcctgccgaatttagagatggatatgtagcatcttcactagtgggaatcaatcacaa

SEQ ID NO: 252912 - DNA, 75 bp, Artificial Sequence
  Synthetic
gaatttagagatggatatgtagcatcttcactagtgggaatcaatcacaattctggacccagagctattcttgga

SEQ ID NO: 252913 - DNA, 75 bp, Artificial Sequence
  Synthetic
cttgtctgagttcggatatacgaaataaaatagacaatggaattcatttgatgtatccagagaggccaattgtga

SEQ ID NO: 252914 - DNA, 75 bp, Artificial Sequence
  Synthetic
taaaatagacaatggaattcatttgatgtatccagagaggccaattgtgattagtaaggctttagaaacttcaaa

SEQ ID NO: 252915 - DNA, 75 bp, Artificial Sequence
  Synthetic
catgttactatagcattaatgtcgtacaaaggtatcaatcaagaggatggaattatcatcaaaaaacaatttatt

SEQ ID NO: 252916 - DNA, 75 bp, Artificial Sequence
  Synthetic
acaaaggtatcaatcaagaggatggaattatcatcaaaaaacaatttattcagagaggcggtctcgatattgtta

SEQ ID NO: 252917 - DNA, 75 bp, Artificial Sequence
  Synthetic
tccattggaaaactttaataacaaagaaagagataggtctaacgcctattcgaaattagaaagtaatggattagt

SEQ ID NO: 252918 - DNA, 75 bp, Artificial Sequence
  Synthetic
gaaagagataggtctaacgcctattcgaaattagaaagtaatggattagttagactgaatgctttcttggaatcc

SEQ ID NO: 252919 - DNA, 75 bp, Artificial Sequence
  Synthetic
cacacataaaaaaaaaaaaaaaaaaaaaaaaaaaaaaaaaaaattaattataaaattatgtatataatttactaa

SEQ ID NO: 252920 - DNA, 75 bp, Artificial Sequence
  Synthetic
catcaagaactcttgaagatgattttgctagagataatcagattagctttgatgtttccgagaaatatacagata

SEQ ID NO: 252921 - DNA, 75 bp, Artificial Sequence
  Synthetic
tgctagagataatcagattagctttgatgtttccgagaaatatacagatatgtacaaatctcgcgttgaacgagt

SEQ ID NO: 252922 - DNA, 75 bp, Artificial Sequence
  Synthetic
taatcatcatcatcatcatcatcatcatcatcatcatcatcatcatcatcatcatcatcatcatcatcatctatg

SEQ ID NO: 252923 - DNA, 75 bp, Artificial Sequence
  Synthetic
aaggtgcgagtattaaccatgaaagaaagaagacccattctaggagacaaatttactactagaacgagtcaaaag

SEQ ID NO: 252924 - DNA, 75 bp, Artificial Sequence
  Synthetic
aaagaagacccattctaggagacaaatttactactagaacgagtcaaaagggaacagtcgcgtatatcgcagatg

SEQ ID NO: 252925 - DNA, 75 bp, Artificial Sequence
  Synthetic
tggtatcacaccagatgtcattattaattctacatccatcttctctagaaaaactatatctatgttgatagaagt

SEQ ID NO: 252926 - DNA, 75 bp, Artificial Sequence
  Synthetic
tattttaacagccgcatattctactaagccgtacaacaataagggagaaaaccgacctgtctgttttcctagtag

SEQ ID NO: 252927 - DNA, 75 bp, Artificial Sequence
  Synthetic
atgcaattcgctaaacaatgttatgagtattcaaatccgaaattgtccgaggaagaattatcggataaaatcttt

SEQ ID NO: 252928 - DNA, 75 bp, Artificial Sequence
  Synthetic
agtattcaaatccgaaattgtccgaggaagaattatcggataaaatcttttgtgaaaagattctctatgatcctg

SEQ ID NO: 252929 - DNA, 75 bp, Artificial Sequence
  Synthetic
agtattttttggaccaatttattacttgcgtctgagacatttaactcaggacaaggcaaccgttagatgtagagg

SEQ ID NO: 252930 - DNA, 75 bp, Artificial Sequence
  Synthetic
ttgcgtctgagacatttaactcaggacaaggcaaccgttagatgtagaggtaaaaagacgaagctcattagacaa

SEQ ID NO: 252931 - DNA, 75 bp, Artificial Sequence
  Synthetic
gaggtatcaagtttggagaaatggagagagactgtttaatagcacatggcgcagccaatactattacagaagttt

SEQ ID NO: 252932 - DNA, 75 bp, Artificial Sequence
  Synthetic
gagagactgtttaatagcacatggcgcagccaatactattacagaagttttaaaagactcagaagaggattatca

SEQ ID NO: 252933 - DNA, 75 bp, Artificial Sequence
  Synthetic
ggagacatagcagcacaaatcaaaagtattaatacatgtcttagatgttcaaaacttaatctctctcctctctta

SEQ ID NO: 252934 - DNA, 75 bp, Artificial Sequence
  Synthetic
gtattaatacatgtcttagatgttcaaaacttaatctctctcctctcttaacaaaaattgataccacacacgtat

SEQ ID NO: 252935 - DNA, 75 bp, Artificial Sequence
  Synthetic
cgccagaggcgtaaaagttaaattagatttcgaacgaaggcctccttcgttttataaaccattagataaagttga

SEQ ID NO: 252936 - DNA, 75 bp, Artificial Sequence
  Synthetic
catcaatataaataaaataattattccttacatcgtacccatcaatataaataaaataattattccttacatcgt

SEQ ID NO: 252937 - DNA, 75 bp, Artificial Sequence
  Synthetic
tcttaaaccgtcttttctggtataatattgtttagtagatactcatcaagattatcaagataagctaattcacta

SEQ ID NO: 252938 - DNA, 75 bp, Artificial Sequence
  Synthetic
tactcgagaatagagttcgttatgctcctgatattcggaaatctgtggagtttcaggttttggtggaagtgtaac

SEQ ID NO: 252939 - DNA, 75 bp, Artificial Sequence
  Synthetic
acaatatattaagtagattccaccttacccataaacaatataaatccagtaatatcatgtctaatgatgaacaca

SEQ ID NO: 252940 - DNA, 75 bp, Artificial Sequence
  Synthetic
tatttcagagagttgtggatgttcgggttcgacatccaccgatggtgtcacgccactaatcggttcggtaacgtc

SEQ ID NO: 252941 - DNA, 75 bp, Artificial Sequence
  Synthetic
gaacctgtagcctcagttgtcaacggagatacatcttcaatgcgcggaaatgtataatttggtaatggtttctca

SEQ ID NO: 252942 - DNA, 75 bp, Artificial Sequence
  Synthetic
tgtataatttggtaatggtttctcatgtggatcttaagaagaagaggtaagatatctacgaaagataccgatcac

SEQ ID NO: 252943 - DNA, 75 bp, Artificial Sequence
  Synthetic
gatatctacgaaagataccgatcacgttctagttctcttttgtagaactttaactttttctttctcagcatctag

SEQ ID NO: 252944 - DNA, 75 bp, Artificial Sequence
  Synthetic
cacatgggttacctccgcagtttttacaagcgatttcacgttccagatcacgttcagccttcatacgtctctccc

SEQ ID NO: 252945 - DNA, 75 bp, Artificial Sequence
  Synthetic
acaagcgatttcacgttccagatcacgttcagccttcatacgtctctccctctctctatcgagtttatcagagca

SEQ ID NO: 252946 - DNA, 75 bp, Artificial Sequence
  Synthetic
ttcgaattcacggggtacaaccgtttccattaccaccatctctacgtttcttttctagatcggcaatctttctca

SEQ ID NO: 252947 - DNA, 75 bp, Artificial Sequence
  Synthetic
tccattaccaccatctctacgtttcttttctagatcggcaatctttctcaacatttcatccccatgccttttcat

SEQ ID NO: 252948 - DNA, 75 bp, Artificial Sequence
  Synthetic
aagctctctcttgtagtactatcatttttatctgattccctggcacgtttaagatcttcatgtaattgagtcagc

SEQ ID NO: 252949 - DNA, 75 bp, Artificial Sequence
  Synthetic
gttaccacgtctgtactcggcgagctcacgtttaagagattcaatttccagtttgtacattgatttcattattac

SEQ ID NO: 252950 - DNA, 75 bp, Artificial Sequence
  Synthetic
aagatctgagattctagattgtaatctctgtagcatttccacggcattcactcagttgtctttcaagatctgaga

SEQ ID NO: 252951 - DNA, 75 bp, Artificial Sequence
  Synthetic
ctcagttgtctttcaagatctgagattctagattggagtctgctaatctctgtaagatttcctcctccgctctcg

SEQ ID NO: 252952 - DNA, 75 bp, Artificial Sequence
  Synthetic
gttctctaatacgtgaacgcagtgcatcaacttcttgtgtgtcttcttgattgcgtgtgcattcatcgagtctag

SEQ ID NO: 252953 - DNA, 75 bp, Artificial Sequence
  Synthetic
atcaacttcttgtgtgtcttcttgattgcgtgtgcattcatcgagtctagattcgagatctctaacgtgtcgtcg

SEQ ID NO: 252954 - DNA, 75 bp, Artificial Sequence
  Synthetic
acagaaagcgtgtccctatcttgttgatatttagcaatttctgattctagagtactgattctactcacgtatgta

SEQ ID NO: 252955 - DNA, 75 bp, Artificial Sequence
  Synthetic
agtactgattctactcacgtatgtactaatagttgtcttatccttatcaagatcctccttgtatttgtcacattc

SEQ ID NO: 252956 - DNA, 75 bp, Artificial Sequence
  Synthetic
cttgatatccatacgaagtctggacagttcccattcgacattacgacgtttatcgatttcagctcggagatcgtc

SEQ ID NO: 252957 - DNA, 75 bp, Artificial Sequence
  Synthetic
atgatgcgatatatagggttatacagttttaacaattatataatagagatagaaagtacaaaagatgtagaatca

SEQ ID NO: 252958 - DNA, 75 bp, Artificial Sequence
  Synthetic
atccatctacttttccatccctaatagtatccagttccttttctagttctgaccgcatttctcgttccatatcaa

SEQ ID NO: 252959 - DNA, 75 bp, Artificial Sequence
  Synthetic
agtatccagttccttttctagttctgaccgcatttctcgttccatatcaagagattctctcaattctcgtatagt

SEQ ID NO: 252960 - DNA, 75 bp, Artificial Sequence
  Synthetic
gaaccatcatctgtcccattttgttgcatatccctgagttctttgatctctgttgtaagtctgtcgattctttcg

SEQ ID NO: 252961 - DNA, 75 bp, Artificial Sequence
  Synthetic
gcatatccctgagttctttgatctctgttgtaagtctgtcgattctttcggttttataaacagaatccctttcca

SEQ ID NO: 252962 - DNA, 75 bp, Artificial Sequence
  Synthetic
actaagttcttcattcaattcagtgagttttctcttggcttcttccaagtctgttttaaactctccatcatttcc

SEQ ID NO: 252963 - DNA, 75 bp, Artificial Sequence
  Synthetic
agttttctcttggcttcttccaagtctgttttaaactctccatcatttccgcattcttcctcgcatttatctaac

SEQ ID NO: 252964 - DNA, 75 bp, Artificial Sequence
  Synthetic
gttggtaatcagcgattcctatagccgttcttgtatttgtgggaacataattaggatcttctaatggattgtatg

SEQ ID NO: 252965 - DNA, 75 bp, Artificial Sequence
  Synthetic
cgttcttgtatttgtgggaacataattaggatcttctaatggattgtatggcttgatagcatcatctttatcatt

SEQ ID NO: 252966 - DNA, 75 bp, Artificial Sequence
  Synthetic
attggttggtcctccttatctcctccagtagcatgtggttcttcaataccagtattagtaataggcttagacaaa

SEQ ID NO: 252967 - DNA, 75 bp, Artificial Sequence
  Synthetic
cagtagcatgtggttcttcaataccagtattagtaataggcttagacaaatgcttgtcgtacgcgggcacttcct

SEQ ID NO: 252968 - DNA, 75 bp, Artificial Sequence
  Synthetic
ttctgtttcagaatattcttttctaagagacgcgacttcaggagttagtagaagaactctgtttctgtatctatc

SEQ ID NO: 252969 - DNA, 75 bp, Artificial Sequence
  Synthetic
agagacgcgacttcaggagttagtagaagaactctgtttctgtatctatcaacgctggaatcgatactcaagtta

SEQ ID NO: 252970 - DNA, 75 bp, Artificial Sequence
  Synthetic
catccgtatcttctgaaacgccatcatatgacatttcatgaagtctaacgtattgataaacagaatcagatttag

SEQ ID NO: 252971 - DNA, 75 bp, Artificial Sequence
  Synthetic
atatgacatttcatgaagtctaacgtattgataaacagaatcagatttagtattaaacagatccttgaccttttt

SEQ ID NO: 252972 - DNA, 75 bp, Artificial Sequence
  Synthetic
tctccagatttcataatatgatcgcatgccttaaatgtcaatgcttccatgatatagtctggaacactaatgggt

SEQ ID NO: 252973 - DNA, 75 bp, Artificial Sequence
  Synthetic
atgccttaaatgtcaatgcttccatgatatagtctggaacactaatgggtgacgaaaaagatacagcaccatatg

SEQ ID NO: 252974 - DNA, 75 bp, Artificial Sequence
  Synthetic
actaagtagataatgattaatgttaaggaagaggaaatattcagtatatagatatgccttagcatcatatcttgt

SEQ ID NO: 252975 - DNA, 75 bp, Artificial Sequence
  Synthetic
aggaagaggaaatattcagtatatagatatgccttagcatcatatcttgtactaaacacgctaaacagtttattg

SEQ ID NO: 252976 - DNA, 75 bp, Artificial Sequence
  Synthetic
ttagagcggcaggaataccaacaaacatattaccacatccgtattttctatgaatatcacatatcatgttaaaaa

SEQ ID NO: 252977 - DNA, 75 bp, Artificial Sequence
  Synthetic
catattaccacatccgtattttctatgaatatcacatatcatgttaaaaaatcttgatagaagagcgaatatctc

SEQ ID NO: 252978 - DNA, 75 bp, Artificial Sequence
  Synthetic
gcagcataagtcataactgtaaatagaacatactttcctgtagtgttgattctagactccacatcaacaccatta

SEQ ID NO: 252979 - DNA, 75 bp, Artificial Sequence
  Synthetic
gaacatactttcctgtagtgttgattctagactccacatcaacaccattattaaaaatagttttatatacatctt

SEQ ID NO: 252980 - DNA, 75 bp, Artificial Sequence
  Synthetic
acgttctagtatacggaaacactttgatttcttatctgtagttaatgacttagtgatatcacgaagaatattacg

SEQ ID NO: 252981 - DNA, 75 bp, Artificial Sequence
  Synthetic
gatttcttatctgtagttaatgacttagtgatatcacgaagaatattacgaattacatttcttgtttttcttgtg

SEQ ID NO: 252982 - DNA, 75 bp, Artificial Sequence
  Synthetic
cattccatagtttttctacctcagtggcgaaatctttggagtgtttggtacattttttaataaggttcgtgacct

SEQ ID NO: 252983 - DNA, 75 bp, Artificial Sequence
  Synthetic
ggcgaaatctttggagtgtttggtacattttttaataaggttcgtgacctccatttattataaaaaatttttatt

SEQ ID NO: 252984 - DNA, 75 bp, Artificial Sequence
  Synthetic
tataagatcgtagatctcccatgtggtggaatactaccatctatcgcatgtggatggacagtaggtaatggccat

SEQ ID NO: 252985 - DNA, 75 bp, Artificial Sequence
  Synthetic
gtggaatactaccatctatcgcatgtggatggacagtaggtaatggccatgggaacagtaatgtttgcatattta

SEQ ID NO: 252986 - DNA, 75 bp, Artificial Sequence
  Synthetic
ttgtcccaatgtttcaatgtgatgttctaacctatcaactgccactgtatcacaacaataatgtccgatggaatt

SEQ ID NO: 252987 - DNA, 75 bp, Artificial Sequence
  Synthetic
tctaacctatcaactgccactgtatcacaacaataatgtccgatggaattaagattatgatccaatgtgtttaat

SEQ ID NO: 252988 - DNA, 75 bp, Artificial Sequence
  Synthetic
tgctatcttgatgatgtcctgtatcagttgcattttcagcactcgactgaatattagtacattcattgtctatta

SEQ ID NO: 252989 - DNA, 75 bp, Artificial Sequence
  Synthetic
agttgcattttcagcactcgactgaatattagtacattcattgtctattattaacgtatttctaaacccaaaatg

SEQ ID NO: 252990 - DNA, 75 bp, Artificial Sequence
  Synthetic
tatgtgttgaacatcactactatagttgatgagtcttatagcatgaattcgcttatcgttatcgggtttatcttc

SEQ ID NO: 252991 - DNA, 75 bp, Artificial Sequence
  Synthetic
ttaaactctgcataatcataaccatttctattgtttgttctaatataaacgagtatagcatcattgctaaatttt

SEQ ID NO: 252992 - DNA, 75 bp, Artificial Sequence
  Synthetic
ctaaaccatataatatatattcaggaacactcaaactaaatgtccaggattctcctaaatacgtaaactttaata

SEQ ID NO: 252993 - DNA, 75 bp, Artificial Sequence
  Synthetic
aacactcaaactaaatgtccaggattctcctaaatacgtaaactttaatagtgctaaatcattcaaaaatctacc

SEQ ID NO: 252994 - DNA, 75 bp, Artificial Sequence
  Synthetic
tctcctaaatacgtaaactttaatagtgctaaatcattcaaaaatctaccgcttatagatagatagtacatgaat

SEQ ID NO: 252995 - DNA, 75 bp, Artificial Sequence
  Synthetic
tattatgaaaaccgacattacgatcatatatttcgtgatatacatgtgacccgtttacgttaaaccataaataca

SEQ ID NO: 252996 - DNA, 75 bp, Artificial Sequence
  Synthetic
atatatttcgtgatatacatgtgacccgtttacgttaaaccataaatacatgggtgatcctataaacatgaattt

SEQ ID NO: 252997 - DNA, 75 bp, Artificial Sequence
  Synthetic
aattgaccgtgtaatatttgtttacatgcatacttgatacgatcattaataagatttttatcattgctcgttatt

SEQ ID NO: 252998 - DNA, 75 bp, Artificial Sequence
  Synthetic
atgcatacttgatacgatcattaataagatttttatcattgctcgttatttcagaatcgtatatataaggagtac

SEQ ID NO: 252999 - DNA, 75 bp, Artificial Sequence
  Synthetic
acaaaatactatatataaaatatattgacccacgttagtaatcatgtaaatgtttaatgttttaaattttgtatt

SEQ ID NO: 253000 - DNA, 75 bp, Artificial Sequence
  Synthetic
ttttaaaaaatagaaaaaacatgtggtattagtgcaggtcgttattcttccaattgcaattggtaagatgacggc

SEQ ID NO: 253001 - DNA, 75 bp, Artificial Sequence
  Synthetic
tgacccacgttagtaatcatgtaaatgtttaatgttttaaattttgtatttaatgatccatcatcatacgctagc

SEQ ID NO: 253002 - DNA, 75 bp, Artificial Sequence
  Synthetic
aaatataatattgtgttagccattgcattggagctcctaatggagattttctattctcgtccattttaggatatg

SEQ ID NO: 253003 - DNA, 75 bp, Artificial Sequence
  Synthetic
cattggagctcctaatggagattttctattctcgtccattttaggatatgctttcataaagtccctaataacttc

SEQ ID NO: 253004 - DNA, 75 bp, Artificial Sequence
  Synthetic
ctgatgcatgtatttgcttcgatttttttatcccatgtttcatctatcatagatttaaacgcagtaatgctcgca

SEQ ID NO: 253005 - DNA, 75 bp, Artificial Sequence
  Synthetic
ttttatcccatgtttcatctatcatagatttaaacgcagtaatgctcgcaacattaacatcttgaaccgttggta

SEQ ID NO: 253006 - DNA, 75 bp, Artificial Sequence
  Synthetic
gttcgccatttatataactcattttttgaatatacttttaattgaacaaaagagttaagttactcatatggacgc

SEQ ID NO: 253007 - DNA, 75 bp, Artificial Sequence
  Synthetic
ttgaatatacttttaattgaacaaaagagttaagttactcatatggacgccgtccagtctgtacatcaatctttt

SEQ ID NO: 253008 - DNA, 75 bp, Artificial Sequence
  Synthetic
tagagtttcagcgtgattttccaacctaaatagaacttcatcgttgtgtttacaacacttttctatttgttcaaa

SEQ ID NO: 253009 - DNA, 75 bp, Artificial Sequence
  Synthetic
ctaaatagaacttcatcgttgtgtttacaacacttttctatttgttcaaactttgttgttatattagtaatcttt

SEQ ID NO: 253010 - DNA, 75 bp, Artificial Sequence
  Synthetic
tgagagtttcctcattgtcgtctccataggctttaacaattgcttcgcgtttagtctctggatttttagcagcct

SEQ ID NO: 253011 - DNA, 75 bp, Artificial Sequence
  Synthetic
ataggctttaacaattgcttcgcgtttagtctctggatttttagcagcctttgtagagaaaaattcagttgctgg

SEQ ID NO: 253012 - DNA, 75 bp, Artificial Sequence
  Synthetic
aaaagagttccgtccatttaaagtacagattttagaaactgacactctgtgttatttatatttggcgcaatacat

SEQ ID NO: 253013 - DNA, 75 bp, Artificial Sequence
  Synthetic
cagattttagaaactgacactctgtgttatttatatttggcgcaatacatggattataaatatcgatgttaataa

SEQ ID NO: 253014 - DNA, 75 bp, Artificial Sequence
  Synthetic
ttgtcgcatcgtgttaaattttctaatggatctagtattattgggtccaacttctgcctgaaatccaaatatgga

SEQ ID NO: 253015 - DNA, 75 bp, Artificial Sequence
  Synthetic
taaaccacacatctccacttttgctttacatcagaaattgtgtcattgacatcttgaactctcctatctaatgcc

SEQ ID NO: 253016 - DNA, 75 bp, Artificial Sequence
  Synthetic
ttacatcagaaattgtgtcattgacatcttgaactctcctatctaatgccggtgttccacctatagattttgaat

SEQ ID NO: 253017 - DNA, 75 bp, Artificial Sequence
  Synthetic
atcttgaactctcctatctaatgccggtgttccacctatagattttgaatactcgaatgctgcatgagtagcatt

SEQ ID NO: 253018 - DNA, 75 bp, Artificial Sequence
  Synthetic
tcatatattgagtaactctggataaaaagtaaacacaccgcagccgtcgctactacaataaaaaaaattgataga

SEQ ID NO: 253019 - DNA, 75 bp, Artificial Sequence
  Synthetic
aaagtaaacacaccgcagccgtcgctactacaataaaaaaaattgatagagagttcatttataatctattagaag

SEQ ID NO: 253020 - DNA, 75 bp, Artificial Sequence
  Synthetic
agacaatgctttaataaatagttcaacatctacttttgtcatatcgaaccgatggtatgattctaacctagaatt

SEQ ID NO: 253021 - DNA, 75 bp, Artificial Sequence
  Synthetic
acatctacttttgtcatatcgaaccgatggtatgattctaacctagaattacatccgaaaaagttgaccatgttc

SEQ ID NO: 253022 - DNA, 75 bp, Artificial Sequence
  Synthetic
tacatattaccatatcatccattatataatcgatgatgcatgtattaaaatactttccgaataagtcttctaaat

SEQ ID NO: 253023 - DNA, 75 bp, Artificial Sequence
  Synthetic
acattccagactctggattataagacgatactgtttcgtcacaatcacccaccttaatcatgtgattatgaatat

SEQ ID NO: 253024 - DNA, 75 bp, Artificial Sequence
  Synthetic
cgttgagacttcccacaacggacgctgacgtcttttggataagtaatggtatgtattacgaagaagaagacgagg

SEQ ID NO: 253025 - DNA, 75 bp, Artificial Sequence
  Synthetic
cgatactgtttcgtcacaatcacccaccttaatcatgtgattatgaatattggctattagagcaccttctaagaa

SEQ ID NO: 253026 - DNA, 75 bp, Artificial Sequence
  Synthetic
ttaaaatcaaaccacgaatatacttctacgaagaaagttagtttacccataggagatataactataaatggagat

SEQ ID NO: 253027 - DNA, 75 bp, Artificial Sequence
  Synthetic
ctacgaagaaagttagtttacccataggagatataactataaatggagatctagatacaaaatccggatctatga

SEQ ID NO: 253028 - DNA, 75 bp, Artificial Sequence
  Synthetic
attaaatacctccacatctaaaaatgttaattttgaaactatgtcttcgtttattaccgtacctgaactaaacgc

SEQ ID NO: 253029 - DNA, 75 bp, Artificial Sequence
  Synthetic
gttaattttgaaactatgtcttcgtttattaccgtacctgaactaaacgctataagctctattgtttgagaactc

SEQ ID NO: 253030 - DNA, 75 bp, Artificial Sequence
  Synthetic
gtaacaaagtttcctttaactcggtcggtttatctaccatagttacagaatttgtatccttatctataatataat

SEQ ID NO: 253031 - DNA, 75 bp, Artificial Sequence
  Synthetic
cggtttatctaccatagttacagaatttgtatccttatctataatataataatcaaaatcgtataaagttatata

SEQ ID NO: 253032 - DNA, 75 bp, Artificial Sequence
  Synthetic
ttcaaatagactaaaaaccccatttctctagtaagtatcttatgtatatgtttgtaaaatatcttcatggtggga

SEQ ID NO: 253033 - DNA, 75 bp, Artificial Sequence
  Synthetic
ctctagtaagtatcttatgtatatgtttgtaaaatatcttcatggtgggaatatgctctacagcagttagccatt

SEQ ID NO: 253034 - DNA, 75 bp, Artificial Sequence
  Synthetic
gatctttattttttgtgtatttttgacgtaaatgtgtgcgaaagtatggagataactttttcaatatcgtagaat

SEQ ID NO: 253035 - DNA, 75 bp, Artificial Sequence
  Synthetic
agacaaaactactccaatgtttaacaagggccattttacgagattattaaatccttgtttgataaatgtagccaa

SEQ ID NO: 253036 - DNA, 75 bp, Artificial Sequence
  Synthetic
atccttgtttgataaatgtagccaatgcgggttcgagttcaacgacgattgaattctcttcccgtggatgctgca

SEQ ID NO: 253037 - DNA, 75 bp, Artificial Sequence
  Synthetic
ttgatttggaattctttttcgactttttgtttatattaaatattttaaaatttatggctgatagtaattcatgta

SEQ ID NO: 253038 - DNA, 75 bp, Artificial Sequence
  Synthetic
tttgtttatattaaatattttaaaatttatggctgatagtaattcatgtactacggataatgtagacgtgtattg

SEQ ID NO: 253039 - DNA, 75 bp, Artificial Sequence
  Synthetic
aaatttatcaataaatgtgagaagtttgcctcgttaaggtcttccatttaaatattatataaatatttgtgtttg

SEQ ID NO: 253040 - DNA, 75 bp, Artificial Sequence
  Synthetic
gtttttaactagtaaagctgtaattacatactttgtccgtaaaacataaatataaatacccgcttttatcaaacg

SEQ ID NO: 253041 - DNA, 75 bp, Artificial Sequence
  Synthetic
acatactttgtccgtaaaacataaatataaatacccgcttttatcaaacgttccaaaaagtcggcagctgacatt

SEQ ID NO: 253042 - DNA, 75 bp, Artificial Sequence
  Synthetic
tataaatacccgcttttatcaaacgttccaaaaagtcggcagctgacatttttaacatggcatctattttaaata

SEQ ID NO: 253043 - DNA, 75 bp, Artificial Sequence
  Synthetic
attttataattgtaacgattcaataactaaagaaaagattaagattaaacataagggaatgtcatttgtatttta

SEQ ID NO: 253044 - DNA, 75 bp, Artificial Sequence
  Synthetic
actaaagaaaagattaagattaaacataagggaatgtcatttgtattttataagccaaagcattctaccgttgtt

SEQ ID NO: 253045 - DNA, 75 bp, Artificial Sequence
  Synthetic
atcatgatgatttggttgtattggggaaggtaacaattaatgatctaaagatgatgctattttacatggatttat

SEQ ID NO: 253046 - DNA, 75 bp, Artificial Sequence
  Synthetic
attgttataattatgatgatacattttttgacgatgatgattgatcactattacacaattttgtttttgtacttt

SEQ ID NO: 253047 - DNA, 75 bp, Artificial Sequence
  Synthetic
ttttgacgatgatgattgatcactattacacaattttgtttttgtactttctaatatagtgtttaggttcttttt

SEQ ID NO: 253048 - DNA, 75 bp, Artificial Sequence
  Synthetic
atatctatgtttaacttttgttctataacgtccttatcggcggtatcggtacatatacgtaattcaccttcacaa

SEQ ID NO: 253049 - DNA, 75 bp, Artificial Sequence
  Synthetic
acatatacgtaattcaccttcacaaaatactgagtcttcgataataatagccaatcgattattggatctagctgt

SEQ ID NO: 253050 - DNA, 75 bp, Artificial Sequence
  Synthetic
ctgtatcatattcaacatgtttaatatatcctttcgtttcccctttacaggcatcgatcgtagcatattttccgc

SEQ ID NO: 253051 - DNA, 75 bp, Artificial Sequence
  Synthetic
atatcctttcgtttcccctttacaggcatcgatcgtagcatattttccgcgtctgagatggaaatgttaaaactg

SEQ ID NO: 253052 - DNA, 75 bp, Artificial Sequence
  Synthetic
ctaatattggtacgtgtctataagtttggcatagtagaataatagacgtgtttaaatgccttccaaagtttaaga

SEQ ID NO: 253053 - DNA, 75 bp, Artificial Sequence
  Synthetic
ttggcatagtagaataatagacgtgtttaaatgccttccaaagtttaagaattctattagagtattacattttga

SEQ ID NO: 253054 - DNA, 75 bp, Artificial Sequence
  Synthetic
ataagtaaaaagtgtgctgattttttatgattttgtgcgacagcaatacatttttctatgttacttttagttcgt

SEQ ID NO: 253055 - DNA, 75 bp, Artificial Sequence
  Synthetic
tatgattttgtgcgacagcaatacatttttctatgttacttttagttcgtatcagattatattctagagcttcct

SEQ ID NO: 253056 - DNA, 75 bp, Artificial Sequence
  Synthetic
tggccaaatgtatccatcataatctgggttataaacgggtgtaaacaagaatatatgtttatattttttaactag

SEQ ID NO: 253057 - DNA, 75 bp, Artificial Sequence
  Synthetic
gggttataaacgggtgtaaacaagaatatatgtttatattttttaactagtgtagaaaacagagatagtaaatag

SEQ ID NO: 253058 - DNA, 75 bp, Artificial Sequence
  Synthetic
ctgttaaaaccattctaaacggcatttttaataaattttctcttgaaaattgtttttcttgaaaacaattcataa

SEQ ID NO: 253059 - DNA, 75 bp, Artificial Sequence
  Synthetic
atgatggatatgatggatatgatggatatgatggatatgataaaaaaatataattgttgtatccattcccattca

SEQ ID NO: 253060 - DNA, 75 bp, Artificial Sequence
  Synthetic
ttatatttacagttactaaattaatttgataataaatcaaaatatggaaaactaaggtcgttagtagggaggaga

SEQ ID NO: 253061 - DNA, 75 bp, Artificial Sequence
  Synthetic
ataacatttattatcatgatgacaccagaaaacgacgaagagcagacatctgtgttctccgctactgtttacgga

SEQ ID NO: 253062 - DNA, 75 bp, Artificial Sequence
  Synthetic
cagaaaacgacgaagagcagacatctgtgttctccgctactgtttacggagacaaaattcagggaaagaataaac

SEQ ID NO: 253063 - DNA, 75 bp, Artificial Sequence
  Synthetic
ctttgaagaatttatataaatcatctcacgagatattgctctctgtcatattcatacacctgcataaactttcta

SEQ ID NO: 253064 - DNA, 75 bp, Artificial Sequence
  Synthetic
tagaatatctatggttatttcactactatctatgattaccatgtccgcgtttctcatagtgcgcctaaatcaatg

SEQ ID NO: 253065 - DNA, 75 bp, Artificial Sequence
  Synthetic
ctatctatgattaccatgtccgcgtttctcatagtgcgcctaaatcaatgcatgtctgctaacgaggctgctatt

SEQ ID NO: 253066 - DNA, 75 bp, Artificial Sequence
  Synthetic
cggcatcatctactcatagaaaggttgcgtctagcactacacaatatgatcacaaagaaagctgtaatggtttat

SEQ ID NO: 253067 - DNA, 75 bp, Artificial Sequence
  Synthetic
tgcgtctagcactacacaatatgatcacaaagaaagctgtaatggtttatattaccagggttcttgttatatatt

SEQ ID NO: 253068 - DNA, 75 bp, Artificial Sequence
  Synthetic
gatgctaaagcaaactgcgctgcggaatcatcaacgctacccaataaatccgatgtcttgactacctggctcatt

SEQ ID NO: 253069 - DNA, 75 bp, Artificial Sequence
  Synthetic
aatcatcaacgctacccaataaatccgatgtcttgactacctggctcattgattatgttgaggatacatggggat

SEQ ID NO: 253070 - DNA, 75 bp, Artificial Sequence
  Synthetic
tacatccgattatcaagattctgatgtatcacaagaagttagaaagtatttttgtacataaataaatgaaatcgc

SEQ ID NO: 253071 - DNA, 75 bp, Artificial Sequence
  Synthetic
gtatcacaagaagttagaaagtatttttgtacataaataaatgaaatcgcttaatagacaaactgtaagtaggtt

SEQ ID NO: 253072 - DNA, 75 bp, Artificial Sequence
  Synthetic
ataatgatgttactctcaaccattattagcggcataggaacatttctacattacagagaagaactgatgcctagt

SEQ ID NO: 253073 - DNA, 75 bp, Artificial Sequence
  Synthetic
ttagcggcataggaacatttctacattacagagaagaactgatgcctagtgcttgcgccaatggatggatacaat

SEQ ID NO: 253074 - DNA, 75 bp, Artificial Sequence
  Synthetic
caacattaaaatgtctacggataatgcagtttatcagtgtcgcaaattacgagctagattgcctagacctgatac

SEQ ID NO: 253075 - DNA, 75 bp, Artificial Sequence
  Synthetic
tatgatggatatgatggatatgataaatatgataaaaatataattgttgtatccattcccattcaaatcacctta

SEQ ID NO: 253076 - DNA, 75 bp, Artificial Sequence
  Synthetic
gcagtttatcagtgtcgcaaattacgagctagattgcctagacctgatactagacatctgagagtattgtttagt

SEQ ID NO: 253077 - DNA, 75 bp, Artificial Sequence
  Synthetic
gtttaaaaaagaccaatgataaatggttagatattaataatgataaagatatagatattagtaaattaacaaatt

SEQ ID NO: 253078 - DNA, 75 bp, Artificial Sequence
  Synthetic
gttagatattaataatgataaagatatagatattagtaaattaacaaattttaagcaactaaacagcacaacgga

SEQ ID NO: 253079 - DNA, 75 bp, Artificial Sequence
  Synthetic
tctggaaaactggttaaaacagtatgtaaaagtactcaatctgtactatgcgttaaaagattctacaagtgataa

SEQ ID NO: 253080 - DNA, 75 bp, Artificial Sequence
  Synthetic
gtaaaagtactcaatctgtactatgcgttaaaagattctacaagtgataacaaaaaatgaattaatagtaagtcg

SEQ ID NO: 253081 - DNA, 75 bp, Artificial Sequence
  Synthetic
cgtttgttattactccaatgggtgtgttgactataacagatacattgtatgatgatctcgatatctcaatcatgg

SEQ ID NO: 253082 - DNA, 75 bp, Artificial Sequence
  Synthetic
gatgatctcgatatctcaatcatggactttataggaccatacattataggtaacataaaaattgtccaaatagat

SEQ ID NO: 253083 - DNA, 75 bp, Artificial Sequence
  Synthetic
tgcaaaaatgctactttagctataagggtaaaatagttcctcaggattctaatgatttggctagattcaacattt

SEQ ID NO: 253084 - DNA, 75 bp, Artificial Sequence
  Synthetic
gggtaaaatagttcctcaggattctaatgatttggctagattcaacatttatagtatttgtaccgcatacagatc

SEQ ID NO: 253085 - DNA, 75 bp, Artificial Sequence
  Synthetic
gactatgatatcatgttagatatagaaggtaaacatcaaccattttatctattcccatctattgatgtttttaac

SEQ ID NO: 253086 - DNA, 75 bp, Artificial Sequence
  Synthetic
aaggtaaacatcaaccattttatctattcccatctattgatgtttttaacgctacaatcatagaagcgtataatc

SEQ ID NO: 253087 - DNA, 75 bp, Artificial Sequence
  Synthetic
gatcatcaatccttcagataatctgaaaatgaaattgtcgtttaattcttcattttgtatatcagacggcaatgg

SEQ ID NO: 253088 - DNA, 75 bp, Artificial Sequence
  Synthetic
cattttgtatatcagacggcaatggatggattataattgatgggaaatgtaatagtaattttttatcataaaagt

SEQ ID NO: 253089 - DNA, 75 bp, Artificial Sequence
  Synthetic
tattgaactagtagtatgttgtatattgagcaatcagagatgatgctggtacctcttatcacggtgaccgtagtt

SEQ ID NO: 253090 - DNA, 75 bp, Artificial Sequence
  Synthetic
ttgagcaatcagagatgatgctggtacctcttatcacggtgaccgtagttgcgggaacaatattagtatgttata

SEQ ID NO: 253091 - DNA, 75 bp, Artificial Sequence
  Synthetic
acgtactgtctataatgacaataaaattatcatgacaaaattaaaaaagataaagagtcctaattccagcaaatc

SEQ ID NO: 253092 - DNA, 75 bp, Artificial Sequence
  Synthetic
attatcatgacaaaattaaaaaagataaagagtcctaattccagcaaatctagtaaatcaactgatagcgaatca

SEQ ID NO: 253093 - DNA, 75 bp, Artificial Sequence
  Synthetic
tggaacaaaacaatgacgtagataatatttctagaaatgagatattgaacgatgatagcttcgctggtagtttaa

SEQ ID NO: 253094 - DNA, 75 bp, Artificial Sequence
  Synthetic
tatttctagaaatgagatattgaacgatgatagcttcgctggtagtttaatatgggataacgaatccaatgtcat

SEQ ID NO: 253095 - DNA, 75 bp, Artificial Sequence
  Synthetic
gatagtgttgctggaagcacgctgctaataaataatgatcgtaatgaacagactatttatcagaatactacagta

SEQ ID NO: 253096 - DNA, 75 bp, Artificial Sequence
  Synthetic
taataaataatgatcgtaatgaacagactatttatcagaatactacagtagtaattaatgatacagagactgttg

SEQ ID NO: 253097 - DNA, 75 bp, Artificial Sequence
  Synthetic
gattcctagctattcttccaatcctttcgtaaattataataaaaccagtatttgtagcaagtcaaatccgttcat

SEQ ID NO: 253098 - DNA, 75 bp, Artificial Sequence
  Synthetic
cttgtattctaccgaatacccgagagatgcgatacaaaagagtaagactaatttgtaaaccatcttactcaaaat

SEQ ID NO: 253099 - DNA, 75 bp, Artificial Sequence
  Synthetic
ataacaagatcatgaacacgatgatatagaatcatcggttgtatcattgtctgattagtttcctttttataaaat

SEQ ID NO: 253100 - DNA, 75 bp, Artificial Sequence
  Synthetic
ctgattagtttcctttttataaaattgaagtaatatttagtattaattaccgccgatgcattatacaaatatgga

SEQ ID NO: 253101 - DNA, 75 bp, Artificial Sequence
  Synthetic
tgaagtaatatttagtattaattaccgccgatgcattatacaaatatggagatattccctgtattcggcatttct

SEQ ID NO: 253102 - DNA, 75 bp, Artificial Sequence
  Synthetic
atgactgtagatattatatagatgtagagcatcaaaaaattatatctgatgagatcaatagacagatggatgaaa

SEQ ID NO: 253103 - DNA, 75 bp, Artificial Sequence
  Synthetic
agagcatcaaaaaattatatctgatgagatcaatagacagatggatgaaacggtacttcttaccaacatcttaag

SEQ ID NO: 253104 - DNA, 75 bp, Artificial Sequence
  Synthetic
atgtaccatcttattccccatagactatcgacgattatactctgtattagttctgttggaggatgtgttatctct

SEQ ID NO: 253105 - DNA, 75 bp, Artificial Sequence
  Synthetic
tatcgacgattatactctgtattagttctgttggaggatgtgttatctctatagataatgacgtcaatgacaaaa

SEQ ID NO: 253106 - DNA, 75 bp, Artificial Sequence
  Synthetic
tgctgtaatcatatccccactgagtaaatgtgtcgtagttagcaagggccctacaaccatactggttgttaaagc

SEQ ID NO: 253107 - DNA, 75 bp, Artificial Sequence
  Synthetic
acatcgtttacaaacgacatactgtatgtaaacaatctatcactgattaattatttaccgttgtctgtattcatt

SEQ ID NO: 253108 - DNA, 75 bp, Artificial Sequence
  Synthetic
atagacacatatgcgatcagatatttgctaataataagtggtattccattataactatcgacgataagcaatatc

SEQ ID NO: 253109 - DNA, 75 bp, Artificial Sequence
  Synthetic
tgctaataataagtggtattccattataactatcgacgataagcaatatcctattccatcaaattgtataggtat

SEQ ID NO: 253110 - DNA, 75 bp, Artificial Sequence
  Synthetic
agcatcgagcaagatattttgatccatgtttgtaacctcgagcatccattcgactcagtctacaaaaaaatgcag

SEQ ID NO: 253111 - DNA, 75 bp, Artificial Sequence
  Synthetic
aacaaatattgtatggtagaattgataatataaatatgagcattagtatttcggtggattaatagatttctctag

SEQ ID NO: 253112 - DNA, 75 bp, Artificial Sequence
  Synthetic
tacatcataaaaaagctattatcaaatactgtactgaatggattcattcttttctctttttatgaaactctgttg

SEQ ID NO: 253113 - DNA, 75 bp, Artificial Sequence
  Synthetic
atactgtactgaatggattcattcttttctctttttatgaaactctgttgtatatctacggataaaactagaagc

SEQ ID NO: 253114 - DNA, 75 bp, Artificial Sequence
  Synthetic
attatatggaggaacacgattattataaaataacaatagttcctggttcctcttccacgtctactagctcgtggt

SEQ ID NO: 253115 - DNA, 75 bp, Artificial Sequence
  Synthetic
taaaataacaatagttcctggttcctcttccacgtctactagctcgtggtattatacacatgcctagtaatagtc

SEQ ID NO: 253116 - DNA, 75 bp, Artificial Sequence
  Synthetic
agaaataacaggccaaaatgttcagacaccataatagttcccaacccagataataacagagttccatcaacacat

SEQ ID NO: 253117 - DNA, 75 bp, Artificial Sequence
  Synthetic
acaccataatagttcccaacccagataataacagagttccatcaacacattcctttaaactcaatcccaaaccca

SEQ ID NO: 253118 - DNA, 75 bp, Artificial Sequence
  Synthetic
ttgataatagataatgaggtgtacagcacatgataatttacacagtaaccaaaatgaaaacactttagtaattat

SEQ ID NO: 253119 - DNA, 75 bp, Artificial Sequence
  Synthetic
gcacatgataatttacacagtaaccaaaatgaaaacactttagtaattataagaaatatagacggtaatgtcatc

SEQ ID NO: 253120 - DNA, 75 bp, Artificial Sequence
  Synthetic
gagtaaacattgacggataaaacaaaaatgccccgcataactctatcatggcaataacgcaaccaaacacttgta

SEQ ID NO: 253121 - DNA, 75 bp, Artificial Sequence
  Synthetic
aaatgccccgcataactctatcatggcaataacgcaaccaaacacttgtaaaattcctaaattagtagaaaatac

SEQ ID NO: 253122 - DNA, 75 bp, Artificial Sequence
  Synthetic
tcgaggaataataagaacaaagtaattcccgtaaagataaacatcaacattgtttggtaatcattaaaccaatta

SEQ ID NO: 253123 - DNA, 75 bp, Artificial Sequence
  Synthetic
ttcccgtaaagataaacatcaacattgtttggtaatcattaaaccaattagtatgacgttgaactaatttcacag

SEQ ID NO: 253124 - DNA, 75 bp, Artificial Sequence
  Synthetic
gcatgtatacgtacctggtaagatatctttatattccataatcaatgagacatcactatccgataacgaatgaag

SEQ ID NO: 253125 - DNA, 75 bp, Artificial Sequence
  Synthetic
tctttatattccataatcaatgagacatcactatccgataacgaatgaagtctagcactagtatgccatttactt

SEQ ID NO: 253126 - DNA, 75 bp, Artificial Sequence
  Synthetic
atgccatggatatctttaaagaactaatcttaaaacatacggatgaaaatgttttgatttctccagtttccattt

SEQ ID NO: 253127 - DNA, 75 bp, Artificial Sequence
  Synthetic
tataagttaaaatatcatgattgtccaatttccatctaatatactttgtcggattatctataatacatggaataa

SEQ ID NO: 253128 - DNA, 75 bp, Artificial Sequence
  Synthetic
caatttccatctaatatactttgtcggattatctataatacatggaataatgatggtatcattacatgctgtata

SEQ ID NO: 253129 - DNA, 75 bp, Artificial Sequence
  Synthetic
accacaaaagtacagaggtatatcaacaatattctaactcttaacatttttatttatttaaaatgatacctttgt

SEQ ID NO: 253130 - DNA, 75 bp, Artificial Sequence
  Synthetic
attttcaaataatgaactaaacaaaactgggttaactaataacaataattatatcacaacatctataaaagtaga

SEQ ID NO: 253131 - DNA, 75 bp, Artificial Sequence
  Synthetic
actgggttaactaataacaataattatatcacaacatctataaaagtagaggataatgatacattagtagtatgc

SEQ ID NO: 253132 - DNA, 75 bp, Artificial Sequence
  Synthetic
gttggaaaatagacggttcatactacccaaaacatataggtagaggatacgatcatcaaaatagcaaagtaacga

SEQ ID NO: 253133 - DNA, 75 bp, Artificial Sequence
  Synthetic
cccaaaacatataggtagaggatacgatcatcaaaatagcaaagtaacgataatcagtcacaatgaatgtgtact

SEQ ID NO: 253134 - DNA, 75 bp, Artificial Sequence
  Synthetic
ggaattaaacgatggagaagatttgacggaccatgtggttatgattaaacgagttaagttttttaagaagcctta

SEQ ID NO: 253135 - DNA, 75 bp, Artificial Sequence
  Synthetic
atatttgtagcacaacgaataactcccaaactgcattcatgttacactatataacaattacaatacatttttatc

SEQ ID NO: 253136 - DNA, 75 bp, Artificial Sequence
  Synthetic
aacaattatcaatttttttctttaatattttacgtggttgaccattcttggtggtaaaataatctcttagtgttg

SEQ ID NO: 253137 - DNA, 75 bp, Artificial Sequence
  Synthetic
tattttacgtggttgaccattcttggtggtaaaataatctcttagtgttggaatggaatgctgtttaatgtttcc

SEQ ID NO: 253138 - DNA, 75 bp, Artificial Sequence
  Synthetic
gcagtcacatcgtttacgcaatagtcagactgtagttctatcatgcttcctacgttagaaggaggaacagtttta

SEQ ID NO: 253139 - DNA, 75 bp, Artificial Sequence
  Synthetic
ggatccaaactagcaaacttcgcgtatacagtatcgcgattagtgtatacaccaactgtatgaaaattaagaaaa

SEQ ID NO: 253140 - DNA, 75 bp, Artificial Sequence
  Synthetic
atacagtatcgcgattagtgtatacaccaactgtatgaaaattaagaaaacagtttaataaatctacagaaatat

SEQ ID NO: 253141 - DNA, 75 bp, Artificial Sequence
  Synthetic
gccatatttatggatttcggattcacacgttgtttgtctaagtggttcgtctagtgttgcttctacatagacttc

SEQ ID NO: 253142 - DNA, 75 bp, Artificial Sequence
  Synthetic
cacgttgtttgtctaagtggttcgtctagtgttgcttctacatagacttcgattcccatatattctttattgtca

SEQ ID NO: 253143 - DNA, 75 bp, Artificial Sequence
  Synthetic
ctggttcacttgtttgaaaactaaatggtagtagatacatcaaaataataaataataagtacattctgcaatatt

SEQ ID NO: 253144 - DNA, 75 bp, Artificial Sequence
  Synthetic
ataacaatggctgaatggcataaaattatcgaggatatctcaaaaaataataagttcgaggatgccgccatcgtt

SEQ ID NO: 253145 - DNA, 75 bp, Artificial Sequence
  Synthetic
ttatcgaggatatctcaaaaaataataagttcgaggatgccgccatcgttgattacaagactacaaagaatgttc

SEQ ID NO: 253146 - DNA, 75 bp, Artificial Sequence
  Synthetic
tgcaaagattaatccgggtgaagttattcccctcatcactaatcataatattctaaaacctcttattggtcagaa

SEQ ID NO: 253147 - DNA, 75 bp, Artificial Sequence
  Synthetic
attcccctcatcactaatcataatattctaaaacctcttattggtcagaaattttgtattgtatatactaactct

SEQ ID NO: 253148 - DNA, 75 bp, Artificial Sequence
  Synthetic
tggagttgcttactgggtacgcccctgtatctccgatcgttatagcgagaactcataccgcacttatatttttga

SEQ ID NO: 253149 - DNA, 75 bp, Artificial Sequence
  Synthetic
tgtatctccgatcgttatagcgagaactcataccgcacttatatttttgatgggtaagccaacaacatccagacg

SEQ ID NO: 253150 - DNA, 75 bp, Artificial Sequence
  Synthetic
cacgctacccgtgtacgtgcaactggtaattaaaataaaaagtaatattcatatgtagtgtcaattttaaatgat

SEQ ID NO: 253151 - DNA, 75 bp, Artificial Sequence
  Synthetic
atatccatattgacgatgtcaataatgccggtattgacatacagttcatcgatttttagatttcattcagaggat

SEQ ID NO: 253152 - DNA, 75 bp, Artificial Sequence
  Synthetic
gatttttagatttcattcagaggatattgaattatgttatgggaatttgtattttgataggatctataataatgt

SEQ ID NO: 253153 - DNA, 75 bp, Artificial Sequence
  Synthetic
attgaattatgttatgggaatttgtattttgataggatctataataatgtagtaaatataaaatatattcctgag

SEQ ID NO: 253154 - DNA, 75 bp, Artificial Sequence
  Synthetic
gagtcagctcttgacgcaatctcttaactaacttcctctcttgcttcttcgtcatagtacttacaatcactatgg

SEQ ID NO: 253155 - DNA, 75 bp, Artificial Sequence
  Synthetic
ttaatcgtacgttctccgtagatgaactagatgataatgtcttttttacacatggttattttttaaaacacaaat

SEQ ID NO: 253156 - DNA, 75 bp, Artificial Sequence
  Synthetic
gtcatagtacttacaatcactatgggatccattgttaccacgtctgtactcgacgagctcacgtttaagagattc

SEQ ID NO: 253157 - DNA, 75 bp, Artificial Sequence
  Synthetic
aatggtcacttggtaccacataattatataatgtataaatgcgaaccggttaaacatagatatccattggaaaaa

SEQ ID NO: 253158 - DNA, 75 bp, Artificial Sequence
  Synthetic
aatggtcacttggtaccacataattatataatgtataaatgcgaaccggttaaacatagatatccattggtaaaa

SEQ ID NO: 253159 - DNA, 75 bp, Artificial Sequence
  Synthetic
aatggtcacttggtaccacataattatataatgtataaatgcgaaccggttaaacatagatatccattggcaaaa

SEQ ID NO: 253160 - DNA, 75 bp, Artificial Sequence
  Synthetic
aatggtcacttggtaccacataattatataatgtataaatgcgaaccggttaaacatagatatccattgggaaaa

SEQ ID NO: 253161 - DNA, 75 bp, Artificial Sequence
  Synthetic
gattgtctcattatcaggaaacttaaaatataatgatatacaatgctcagtaaatgtatcatgtctcattaaaaa

SEQ ID NO: 253162 - DNA, 75 bp, Artificial Sequence
  Synthetic
ttaacatctaaacataagacttattctctatatcggtccacgtgtattgctataataggatacgattctattata

SEQ ID NO: 253163 - DNA, 75 bp, Artificial Sequence
  Synthetic
ataatgacatctatgattttactgcaatatgtatgctaatagcgtctacattgatagtgatcatatacgtgttta

SEQ ID NO: 253164 - DNA, 75 bp, Artificial Sequence
  Synthetic
aatatgtatgctaatagcgtctacattgatagtgatcatatacgtgtttaaaaaaataaaaatgaactcttaatt

SEQ ID NO: 253165 - DNA, 75 bp, Artificial Sequence
  Synthetic
aatcaaaattacgattgattcaaaaattggtaatgttgttaccatatcgtataacttggaaaagataactattga

SEQ ID NO: 253166 - DNA, 75 bp, Artificial Sequence
  Synthetic
ctcgtccatatattttaaaacattgacttttgtactaagaaaaatatcttgactaaccatctctttctctcgtcg

SEQ ID NO: 253167 - DNA, 75 bp, Artificial Sequence
  Synthetic
aaggatgtattattagcgcaatcagttgctgtcgaagaggcaaaagatgtcaaggtggaagaaaaaaatattatc

SEQ ID NO: 253168 - DNA, 75 bp, Artificial Sequence
  Synthetic
tttaaaaaaatacttattctgattcttctagccatttccgtgttcgttcgaatgccacatcgacgtcaaagatag

SEQ ID NO: 253169 - DNA, 75 bp, Artificial Sequence
  Synthetic
ttctagccatttccgtgttcgttcgaatgccacatcgacgtcaaagataggggagtagttgaaatctagttctgc

SEQ ID NO: 253170 - DNA, 75 bp, Artificial Sequence
  Synthetic
aatgccacatcgacgtcaaagataggggagtagttgaaatctagttctgcattgttggtacgcacctcaaatgta

SEQ ID NO: 253171 - DNA, 75 bp, Artificial Sequence
  Synthetic
ataatattaatgtactaaaacttatgtattattaatttatctaactaaagttagtaaattatatacataatttta

SEQ ID NO: 253172 - DNA, 75 bp, Artificial Sequence
  Synthetic
tgttgagtattgatggttttctaaatagaattctcttcatatcattcttgcacgcgtacatttttagcatccatc

SEQ ID NO: 253173 - DNA, 75 bp, Artificial Sequence
  Synthetic
tagaattctcttcatatcattcttgcacgcgtacatttttagcatccatcttggaatcctagatccttgttctat

SEQ ID NO: 253174 - DNA, 75 bp, Artificial Sequence
  Synthetic
taattaatttaattttactattttatttagtgtctagaaaaaaatgtgtgacccacgaccgtaggaaactctaga

SEQ ID NO: 253175 - DNA, 75 bp, Artificial Sequence
  Synthetic
ttaaacatatcgtaagaacacgatggagagtaatcgtagcaaaagtaagcatttcctttaatcgcagatcccgga

SEQ ID NO: 253176 - DNA, 75 bp, Artificial Sequence
  Synthetic
gagagtaatcgtagcaaaagtaagcatttcctttaatcgcagatcccggatactggatatattttgcagccaaca

SEQ ID NO: 253177 - DNA, 75 bp, Artificial Sequence
  Synthetic
atatacccggctatgcacagcgtcatcatcgactgtacgatacataatgttaccgtgttgcttacattgctcgta

SEQ ID NO: 253178 - DNA, 75 bp, Artificial Sequence
  Synthetic
tcatcgactgtacgatacataatgttaccgtgttgcttacattgctcgtaaaagactttcgtcaatttgtctcct

SEQ ID NO: 253179 - DNA, 75 bp, Artificial Sequence
  Synthetic
ggcaacaagtatacaattttgcgccattcatgattacggaattattggctttcataaccagttgctcggccatac

SEQ ID NO: 253180 - DNA, 75 bp, Artificial Sequence
  Synthetic
attcatgattacggaattattggctttcataaccagttgctcggccatacgtttactttttgcgtatacatgtcc

SEQ ID NO: 253181 - DNA, 75 bp, Artificial Sequence
  Synthetic
tcatgaccgatgaatggattaccgtgtttatttggtcctattgcttccatgctactagtatagatcaaatacttg

SEQ ID NO: 253182 - DNA, 75 bp, Artificial Sequence
  Synthetic
gtttatttggtcctattgcttccatgctactagtatagatcaaatacttgattcctaggtccacacaagctgcca

SEQ ID NO: 253183 - DNA, 75 bp, Artificial Sequence
  Synthetic
tactttcatgatttcattatcagtgtattttccaaatacatccactagagcagccgtatgaataatcagatttac

SEQ ID NO: 253184 - DNA, 75 bp, Artificial Sequence
  Synthetic
tattttccaaatacatccactagagcagccgtatgaataatcagatttaccccatctagcgcttctctcacctta

SEQ ID NO: 253185 - DNA, 75 bp, Artificial Sequence
  Synthetic
tatagtttataaccttaactttcgaggttattggttgtggatcttctacaatatctatgactcttatttcttgaa

SEQ ID NO: 253186 - DNA, 75 bp, Artificial Sequence
  Synthetic
ggttattggttgtggatcttctacaatatctatgactcttatttcttgaacatcatctgcgctaattaaaagttt

SEQ ID NO: 253187 - DNA, 75 bp, Artificial Sequence
  Synthetic
gcaccgccagtaaccgcgtacacggccattgctgccactcataatatcagactacttattctattttactaaata

SEQ ID NO: 253188 - DNA, 75 bp, Artificial Sequence
  Synthetic
ccattgctgccactcataatatcagactacttattctattttactaaataatggctgtttgtataatagaccacg

SEQ ID NO: 253189 - DNA, 75 bp, Artificial Sequence
  Synthetic
tgaacaagtccatggaaaagataaagttttaggatcagttattggattaaaatccggaacgtatagtttgataat

SEQ ID NO: 253190 - DNA, 75 bp, Artificial Sequence
  Synthetic
gttttaggatcagttattggattaaaatccggaacgtatagtttgataattcatcgttacggagatattagtcga

SEQ ID NO: 253191 - DNA, 75 bp, Artificial Sequence
  Synthetic
aaatatttatcggtaacatctttgtaaacagatatggtgtagcatatgtttatttagatacagatgtaaatatat

SEQ ID NO: 253192 - DNA, 75 bp, Artificial Sequence
  Synthetic
tatttagatacagatgtaaatatatctacaattattggaaaggcgttatctatttcaaaaaatgatcagagatta

SEQ ID NO: 253193 - DNA, 75 bp, Artificial Sequence
  Synthetic
acataaatgaaaagataatacattttcttacaattaacgagaatggcgtttgatatatcagttaatgcgtctaaa

SEQ ID NO: 253194 - DNA, 75 bp, Artificial Sequence
  Synthetic
tcttacaattaacgagaatggcgtttgatatatcagttaatgcgtctaaaacaataaatgcattagtttactttt

SEQ ID NO: 253195 - DNA, 75 bp, Artificial Sequence
  Synthetic
acgtaatgaagttaatgatatacactacactgtcgaatttgatagggacaaagtagttgatacgtttatttcata

SEQ ID NO: 253196 - DNA, 75 bp, Artificial Sequence
  Synthetic
tacactgtcgaatttgatagggacaaagtagttgatacgtttatttcatataatagacataatgactccatagag

SEQ ID NO: 253197 - DNA, 75 bp, Artificial Sequence
  Synthetic
ctaatattggtcgcgtggttaatacgccggttagtatgacttacttgtataataagtatagttttaaaccgattt

SEQ ID NO: 253198 - DNA, 75 bp, Artificial Sequence
  Synthetic
aataagtatagttttaaaccgattttagcagaatatataagacacagaaatactatatccggcaatatttattcg

SEQ ID NO: 253199 - DNA, 75 bp, Artificial Sequence
  Synthetic
ttattaaacagtatggagacattgatctattatttaatgagaaacttaaagtagactccgattcgggactatttg

SEQ ID NO: 253200 - DNA, 75 bp, Artificial Sequence
  Synthetic
tctattatttaatgagaaacttaaagtagactccgattcgggactatttgactttgtcaactttgtaaaggatat

SEQ ID NO: 253201 - DNA, 75 bp, Artificial Sequence
  Synthetic
gtagctctatctagtctagtatctaaacattgggaattgacaaataaaaagtataggtgtatggcattagccgaa

SEQ ID NO: 253202 - DNA, 75 bp, Artificial Sequence
  Synthetic
aacattgggaattgacaaataaaaagtataggtgtatggcattagccgaacatatagctgatagtattccaatat

SEQ ID NO: 253203 - DNA, 75 bp, Artificial Sequence
  Synthetic
atatgatggatatgatggatatgatggatatgatggatatgatggatatgataaatatgataaaaatataattgt

SEQ ID NO: 253204 - DNA, 75 bp, Artificial Sequence
  Synthetic
tgtatccattcccattcaaatcaccttatatgattctgtaacacaatgaaggagtctcatagatatatagaggtc

SEQ ID NO: 253205 - DNA, 75 bp, Artificial Sequence
  Synthetic
ttatatgattctgtaacacaatgaaggagtctcatagatatatagaggtcagatactggtttgataaacttttta

SEQ ID NO: 253206 - DNA, 75 bp, Artificial Sequence
  Synthetic
ggttagacacgcatactttaacaaatcactgaaaattggagttaggtattcctctcagaatcagttgccgttctg

SEQ ID NO: 253207 - DNA, 75 bp, Artificial Sequence
  Synthetic
tcactgaaaattggagttaggtattcctctcagaatcagttgccgttctggaacattaaatgtattttttatgat

SEQ ID NO: 253208 - DNA, 75 bp, Artificial Sequence
  Synthetic
tacaacaagtcattaataatgagtatttccaagagttttagttgtctagtatttaacaagagaagagatttcatc

SEQ ID NO: 253209 - DNA, 75 bp, Artificial Sequence
  Synthetic
atttaacaagagaagagatttcatcagactgtttatgaactcgaataccgcctcattgtcgcttatattgatgac

SEQ ID NO: 253210 - DNA, 75 bp, Artificial Sequence
  Synthetic
agtgatgagtagctcaatcttgttatcgggatccaatttctaaagatgtcattaaaccctcgatcgtgaatggat

SEQ ID NO: 253211 - DNA, 75 bp, Artificial Sequence
  Synthetic
tcgggatccaatttctaaagatgtcattaaaccctcgatcgtgaatggatttatcatcatcgtttttatattgga

SEQ ID NO: 253212 - DNA, 75 bp, Artificial Sequence
  Synthetic
tctatatacgatgatttctgaattatttcatatatctctcgttaactccaggaacttgtcagggatctaacttta

SEQ ID NO: 253213 - DNA, 75 bp, Artificial Sequence
  Synthetic
ggaacttgtcagggatctaactttaatatgttctcgtctaagagatgaaaatctttggatggtggcatgtgactt

SEQ ID NO: 253214 - DNA, 75 bp, Artificial Sequence
  Synthetic
taaatacagcgataccatctgtggacattgtccaagtgacacattcacgtcaatatataatcgttctcctcggtg

SEQ ID NO: 253215 - DNA, 75 bp, Artificial Sequence
  Synthetic
tcctctcttaaatgaatccatcttatccttggacaagatggacagtctattttccttagatggtttaatattttt

SEQ ID NO: 253216 - DNA, 75 bp, Artificial Sequence
  Synthetic
tttccttagatggtttaatattttttacccatgatctataaaggtagacagacctaatcgtctcggatgaccata

SEQ ID NO: 253217 - DNA, 75 bp, Artificial Sequence
  Synthetic
ataaattgtaaaaaatatgttaggtttacgaaaatgtctcgtggggcattaatcgtttttgaaggattggacaaa

SEQ ID NO: 253218 - DNA, 75 bp, Artificial Sequence
  Synthetic
ttacgaaaatgtctcgtggggcattaatcgtttttgaaggattggacaaatctggaaaaacaacacaatgtatga

SEQ ID NO: 253219 - DNA, 75 bp, Artificial Sequence
  Synthetic
cacgataaaatatcttaactttcctcagcgatccacagtcactggaaagatgatagatgactatctaactcgtaa

SEQ ID NO: 253220 - DNA, 75 bp, Artificial Sequence
  Synthetic
cagcgatccacagtcactggaaagatgatagatgactatctaactcgtaaaaaaacctataatgatcatatagtt

SEQ ID NO: 253221 - DNA, 75 bp, Artificial Sequence
  Synthetic
gggagtttgcatcttttatacaagaacaactagaacagggaattactttaatagttgacagatacgcgttctctg

SEQ ID NO: 253222 - DNA, 75 bp, Artificial Sequence
  Synthetic
acaactagaacagggaattactttaatagttgacagatacgcgttctctggagtagcgtatgccaccgctaaagg

SEQ ID NO: 253223 - DNA, 75 bp, Artificial Sequence
  Synthetic
tatgaatctggattgcctaaacccgacttagttatattcttggaatctggtagcaaagaaattaatagaaacgtc

SEQ ID NO: 253224 - DNA, 75 bp, Artificial Sequence
  Synthetic
acttagttatattcttggaatctggtagcaaagaaattaatagaaacgtcggcgaggaaatttatgaagatgttg

SEQ ID NO: 253225 - DNA, 75 bp, Artificial Sequence
  Synthetic
atataaaaaaatgattgaagaaggagatattcattggcaaattatttcttctgaattcgaggaagatgtaaagaa

SEQ ID NO: 253226 - DNA, 75 bp, Artificial Sequence
  Synthetic
ctgaattcgaggaagatgtaaagaaggagttgattaagaatatagttatagaggctatacacacggttactggac

SEQ ID NO: 253227 - DNA, 75 bp, Artificial Sequence
  Synthetic
aaatgaaattacatttttataaatagatattagtacagtgttataaatggatgaagcatattactctggcaactt

SEQ ID NO: 253228 - DNA, 75 bp, Artificial Sequence
  Synthetic
atgaagcatattactctggcaacttggaatcagtactcggggatacgtgtccgatatgcataccgaactcgcatc

SEQ ID NO: 253229 - DNA, 75 bp, Artificial Sequence
  Synthetic
gaaactatagataatgattattaaacaaggacattgtaaattttatcatatgtagatcaaacttggataatccat

SEQ ID NO: 253230 - DNA, 75 bp, Artificial Sequence
  Synthetic
caaggacattgtaaattttatcatatgtagatcaaacttggataatccatttatctctttcctagatactgcata

SEQ ID NO: 253231 - DNA, 75 bp, Artificial Sequence
  Synthetic
cagaacgagttgattaattcattagacgataatgaaattatcgattgtatagttaacaagtttatgagcttttat

SEQ ID NO: 253232 - DNA, 75 bp, Artificial Sequence
  Synthetic
agaccaacgaggaggagtatcgttggagctgtaaaccatagcactacgttgaagatcatacagagctttattaac

SEQ ID NO: 253233 - DNA, 75 bp, Artificial Sequence
  Synthetic
acgataatgaaattatcgattgtatagttaacaagtttatgagcttttataaggataacctagaaaatatggtag

SEQ ID NO: 253234 - DNA, 75 bp, Artificial Sequence
  Synthetic
taattaataatccagattttaaaactacgtatgtggaagtactcggttccagaatagctgatatagatattaaac

SEQ ID NO: 253235 - DNA, 75 bp, Artificial Sequence
  Synthetic
agaatagctgatatagatattaaacaagtgatacgtaagaatataatacaattgtctaatgatccgcgaacgata

SEQ ID NO: 253236 - DNA, 75 bp, Artificial Sequence
  Synthetic
cacacaatctctgtgtcagaacgctcgtcaatatagatcttagaaatttttttagagagaactaacgcaactagc

SEQ ID NO: 253237 - DNA, 75 bp, Artificial Sequence
  Synthetic
tttagagagaactaacgcaactagcaataaaactgatcttattttatcattttttttattcatcatcctctggtg

SEQ ID NO: 253238 - DNA, 75 bp, Artificial Sequence
  Synthetic
ctttttttattaaatgacgtctcttcgcgaatttagaaaattatgctgtgatatatatcacgcatcaggatataa

SEQ ID NO: 253239 - DNA, 75 bp, Artificial Sequence
  Synthetic
cgcgaatttagaaaattatgctgtgatatatatcacgcatcaggatataaagaaaaatctaaattaattagagac

SEQ ID NO: 253240 - DNA, 75 bp, Artificial Sequence
  Synthetic
atacatatttgatcattaagctattgcttcccggattagacgatagaatgtataacatgaacgataaacaaatta

SEQ ID NO: 253241 - DNA, 75 bp, Artificial Sequence
  Synthetic
gcttcccggattagacgatagaatgtataacatgaacgataaacaaattataaaattatatagtataatatttaa

SEQ ID NO: 253242 - DNA, 75 bp, Artificial Sequence
  Synthetic
gatttaggatacggatatataggagacactattaggacattcttcaaagagaacacggaaatccgtccacgagat

SEQ ID NO: 253243 - DNA, 75 bp, Artificial Sequence
  Synthetic
acactattaggacattcttcaaagagaacacggaaatccgtccacgagataaaagcattttaactttagaagaag

SEQ ID NO: 253244 - DNA, 75 bp, Artificial Sequence
  Synthetic
atatataaaatttaagggaatgattaggactactactctagaagatatagcaccatctattccaaataatcagaa

SEQ ID NO: 253245 - DNA, 75 bp, Artificial Sequence
  Synthetic
atcagtaactaaagaatcacatcaaataaaattattgactgatatagcatctgtttgtacatgtaatgatttaaa

SEQ ID NO: 253246 - DNA, 75 bp, Artificial Sequence
  Synthetic
ataaaattattgactgatatagcatctgtttgtacatgtaatgatttaaaatgtgtagtcatgcttattgataaa

SEQ ID NO: 253247 - DNA, 75 bp, Artificial Sequence
  Synthetic
ggtacgtgcttaacgctattagtcctcatgcctatgatgtttttagaaaatctaataacttgaaagagataatag

SEQ ID NO: 253248 - DNA, 75 bp, Artificial Sequence
  Synthetic
tcatgcctatgatgtttttagaaaatctaataacttgaaagagataatagaaaatgcagctaaacaaaatctaga

SEQ ID NO: 253249 - DNA, 75 bp, Artificial Sequence
  Synthetic
ccaattaatcccatgttagcggaatcatgtgattctgtcaataaggcgtttaaaaaatttccatcaggaatgttt

SEQ ID NO: 253250 - DNA, 75 bp, Artificial Sequence
  Synthetic
catgtgattctgtcaataaggcgtttaaaaaatttccatcaggaatgtttgcggaagtcaaatacgatggtgaaa

SEQ ID NO: 253251 - DNA, 75 bp, Artificial Sequence
  Synthetic
cgagtttgcattctttagtagaaacatgaaaccagtactctctcataaagtggattatctcaaagaatacatacc

SEQ ID NO: 253252 - DNA, 75 bp, Artificial Sequence
  Synthetic
atgaaaccagtactctctcataaagtggattatctcaaagaatacataccgaaagcatttaaaaaagctacgtct

SEQ ID NO: 253253 - DNA, 75 bp, Artificial Sequence
  Synthetic
taatttccccattgatagaaaatatcacgcgttccattctcttgaagtactataagtaattataatataatgtaa

SEQ ID NO: 253254 - DNA, 75 bp, Artificial Sequence
  Synthetic
ttgtagacgaacataatgtaccgctaccgtttggaagtttaggtatacacaaaaagaaagaatataaaaactcta

SEQ ID NO: 253255 - DNA, 75 bp, Artificial Sequence
  Synthetic
accgtttggaagtttaggtatacacaaaaagaaagaatataaaaactctaacatgtgtttgttcgtgtttgactg

SEQ ID NO: 253256 - DNA, 75 bp, Artificial Sequence
  Synthetic
acagacattccattgtatgaacgaagatcttttctcaaagatgttatggtcgaaatacccaatagaatagtattc

SEQ ID NO: 253257 - DNA, 75 bp, Artificial Sequence
  Synthetic
gatcttttctcaaagatgttatggtcgaaatacccaatagaatagtattctcagagttgacgaatattagtaacg

SEQ ID NO: 253258 - DNA, 75 bp, Artificial Sequence
  Synthetic
tgatgcactaacgagaaaattagaaggattggtcttaaaagatattaatggcgtatacgaaccgggaaagagaag

SEQ ID NO: 253259 - DNA, 75 bp, Artificial Sequence
  Synthetic
ggattggtcttaaaagatattaatggcgtatacgaaccgggaaagagaagatggttaaaaataaagcgagactat

SEQ ID NO: 253260 - DNA, 75 bp, Artificial Sequence
  Synthetic
ctgccgatttagtagtactaggtgcctactatggtaaaggaggaaagggtggtatcatggcagtctttctaatgg

SEQ ID NO: 253261 - DNA, 75 bp, Artificial Sequence
  Synthetic
ctactatggtaaaggaggaaagggtggtatcatggcagtctttctaatgggttgttacgacgatgaatccggtaa

SEQ ID NO: 253262 - DNA, 75 bp, Artificial Sequence
  Synthetic
ggtcacgatgataatacgttaagggttttgcaagaccaattaacgatggttaaaattaacaaggatcccaaaaaa

SEQ ID NO: 253263 - DNA, 75 bp, Artificial Sequence
  Synthetic
ttttgcaagaccaattaacgatggttaaaattaacaaggatcccaaaaaaattccagagtggttggtagttaata

SEQ ID NO: 253264 - DNA, 75 bp, Artificial Sequence
  Synthetic
agatgatccgaaacaatctcagatatgggaaatttcaggagcagagtttacatcttccaagtcacatacagcgaa

SEQ ID NO: 253265 - DNA, 75 bp, Artificial Sequence
  Synthetic
tttagttagaagaatggaagacagtaacaaaaacagtaaaaaacttagtacttagatatcgaaaaaaaatatatt

SEQ ID NO: 253266 - DNA, 75 bp, Artificial Sequence
  Synthetic
ctaaagcctgaagtaattaaccaactgtttttattagtggcttttttcgatctatcaatttcagtatattcttcg

SEQ ID NO: 253267 - DNA, 75 bp, Artificial Sequence; identical to SEQ ID NO: 45497
  Synthetic

SEQ ID NO: 253268 - DNA, 75 bp, Artificial Sequence
  Synthetic
gtcgccatggatggtgttatcgtatactgtctaaatgcgttagtaaaacatggcgaggaaataaatcatataaaa

SEQ ID NO: 253269 - DNA, 75 bp, Artificial Sequence
  Synthetic
actgtctaaatgcgttagtaaaacatggcgaggaaataaatcatataaaaaatgatttcatgattaaaccatgtt

SEQ ID NO: 253270 - DNA, 75 bp, Artificial Sequence
  Synthetic
acatgaataataatattctaattcctcgtattgactacttacagatactcgaaatagtctgaaaaattcttcaaa

SEQ ID NO: 253271 - DNA, 75 bp, Artificial Sequence
  Synthetic
agtttattaccgaccatgaacgagatagatggataaatatcctttccatcaaaggtcataattggataattgtcc

SEQ ID NO: 253272 - DNA, 75 bp, Artificial Sequence
  Synthetic
gaacgttcacatcggcggacaatctaaaaacaatacagtgattgcagatttgccatatctggataatgctgtatc

SEQ ID NO: 253273 - DNA, 75 bp, Artificial Sequence; identical to SEQ ID NO: 45502
  Synthetic

SEQ ID NO: 253274 - DNA, 75 bp, Artificial Sequence
  Synthetic
tgccatatctggataatgctgtatcagatgtatgcaaatcaatatataaaaagaatgtatcaagaatatccagat

SEQ ID NO: 253275 - DNA, 75 bp, Artificial Sequence
  Synthetic
gaagtaatgtactagtttgtgacaattaacaagatacaaaagagatgccgatactaatacgtaaatagctatacg

SEQ ID NO: 253276 - DNA, 75 bp, Artificial Sequence
  Synthetic
ttaacaagatacaaaagagatgccgatactaatacgtaaatagctatacgcgaatccattgttacctttttttat

SEQ ID NO: 253277 - DNA, 75 bp, Artificial Sequence
  Synthetic
cgatgacaagactcctaccggtgtatataattattttaaacctaaagatgctattcctgttattatatccatagg

SEQ ID NO: 253278 - DNA, 75 bp, Artificial Sequence
  Synthetic
tataattattttaaacctaaagatgctattcctgttattatatccataggaaaggataaagatgtctgtgaacta

SEQ ID NO: 253279 - DNA, 75 bp, Artificial Sequence
  Synthetic
gtattacttaagactagaaaaatcaaaagtaagtttttgatatttgattcttacttattgtgggattgtagttta

SEQ ID NO: 253280 - DNA, 75 bp, Artificial Sequence
  Synthetic
aaagtaagtttttgatatttgattcttacttattgtgggattgtagtttacttagtaattcatctctgaatcctg

SEQ ID NO: 253281 - DNA, 75 bp, Artificial Sequence
  Synthetic
cgtgtataaagttaaatttatataaagtagccattcttcccatggatgtttccttttttaccaaaggaaatgcat

SEQ ID NO: 253282 - DNA, 75 bp, Artificial Sequence
  Synthetic
agtagccattcttcccatggatgtttccttttttaccaaaggaaatgcatcattgattattctcctgtttgattt

SEQ ID NO: 253283 - DNA, 75 bp, Artificial Sequence
  Synthetic
actacgcagcaaactagtaggaatatagatatctggatatgtacgtaaatagtcgattatatcttttacaatact

SEQ ID NO: 253284 - DNA, 75 bp, Artificial Sequence
  Synthetic
agaagtgtaaccgataataatgttattatatctagacaccagcgtctacatgacgagcttccgagttccaattgg

SEQ ID NO: 253285 - DNA, 75 bp, Artificial Sequence
  Synthetic
attagtccctattgcgttatctatatatccattaataatattacacagtggatacttatgagaaatatacctctt

SEQ ID NO: 253286 - DNA, 75 bp, Artificial Sequence
  Synthetic
ttatatctagacaccagcgtctacatgacgagcttccgagttccaattggttcaagttttacataagtataaagt

SEQ ID NO: 253287 - DNA, 75 bp, Artificial Sequence
  Synthetic
ggttgttgatggatctatgatgtatgcgatagctgataatagaactcacgcaattattagcaaaaatatattaga

SEQ ID NO: 253288 - DNA, 75 bp, Artificial Sequence
  Synthetic
agaaagatatgtgtgtagtactgtattacctaaattatcagtctcattcaaatattgcatgactattatcgagaa

SEQ ID NO: 253289 - DNA, 75 bp, Artificial Sequence
  Synthetic
gcgatagctgataatagaactcacgcaattattagcaaaaatatattagacaatactacgattaacgatgagtgt

SEQ ID NO: 253290 - DNA, 75 bp, Artificial Sequence
  Synthetic
ttacctaaattatcagtctcattcaaatattgcatgactattatcgagaattgctatatccctctatactcgatg

SEQ ID NO: 253291 - DNA, 75 bp, Artificial Sequence
  Synthetic
ttaggattcttgatagagatgagatgctcaatggatcatcgtgttatatgaacagacattgtattatgatgaatt

SEQ ID NO: 253292 - DNA, 75 bp, Artificial Sequence
  Synthetic
ctaacataagagccaatctcaatgttggtttaattatatcatcttcatgtaataataacgatggaaactttccag

SEQ ID NO: 253293 - DNA, 75 bp, Artificial Sequence
  Synthetic
gctcaatggatcatcgtgttatatgaacagacattgtattatgatgaatttacctgatgtaggcgaatttggatc

SEQ ID NO: 253294 - DNA, 75 bp, Artificial Sequence
  Synthetic
tggtttaattatatcatcttcatgtaataataacgatggaaactttccagtagcgtaacacttatctaagaagga

SEQ ID NO: 253295 - DNA, 75 bp, Artificial Sequence
  Synthetic
gacatgattaagattgctctttcggtggctggtaatttaataagaaatcgagactacattcccgggagacgaggc

SEQ ID NO: 253296 - DNA, 75 bp, Artificial Sequence
  Synthetic
ctcttatcgagaatattcttaacgagatatccatagctattctggtgctaattattcctatattatattccacga

SEQ ID NO: 253297 - DNA, 75 bp, Artificial Sequence
  Synthetic
cctctagataatttttttaagcacgaaataaaaacataattttaaacaatctatttcatactattttgtgtgatc

SEQ ID NO: 253298 - DNA, 75 bp, Artificial Sequence
  Synthetic
gagtattagtgagagagcatgaaggagatttagtatttagcagtgaggatatgatccaagagggtgagatagtcg

SEQ ID NO: 253299 - DNA, 75 bp, Artificial Sequence
  Synthetic
agatgataaaaagtgtagtgagtaagagtattagtgagagagcatgaaggagatttagtatttagcagtgaggat

SEQ ID NO: 253300 - DNA, 75 bp, Artificial Sequence
  Synthetic
agatttagtatttagcagtgaggatatgatccaagagggtgagatagtcgttctcgttcagaatctttcgcagca

SEQ ID NO: 253301 - DNA, 75 bp, Artificial Sequence
  Synthetic
tgatatattagtatttctggtgataaatttacggcgactgctaggagggaaaatgaagaaagaaaaaatatctac

SEQ ID NO: 253302 - DNA, 75 bp, Artificial Sequence
  Synthetic
aatttacggcgactgctaggagggaaaatgaagaaagaaaaaatatctacctctccaaaaagaaaaactactgat

SEQ ID NO: 253303 - DNA, 75 bp, Artificial Sequence
  Synthetic
attgaagactcttccggtgacaatagctgattgagtacaaagtccaattattgcacaaagttctttggcggtttt

SEQ ID NO: 253304 - DNA, 75 bp, Artificial Sequence
  Synthetic
gctgattgagtacaaagtccaattattgcacaaagttctttggcggttttcatggagtcatttctgatgaaacat

SEQ ID NO: 253305 - DNA, 75 bp, Artificial Sequence
  Synthetic
acaatgaattgttagatagagatgagatgtctactattctagaggaatattaggccttagaataaaatatggacg

SEQ ID NO: 253306 - DNA, 75 bp, Artificial Sequence
  Synthetic
tattgtcccacggaagtgaatccgagaactccttcaactcgctaccaaatagctccattgcatcaattctgaaag

SEQ ID NO: 253307 - DNA, 75 bp, Artificial Sequence
  Synthetic
gaactccttcaactcgctaccaaatagctccattgcatcaattctgaaagagatgagaagcctgtagagaggccc

SEQ ID NO: 253308 - DNA, 75 bp, Artificial Sequence
  Synthetic
gataaactaaatatataagtataatcccattctaatactttaacctgatgtattattacctgcatcttattagaa

SEQ ID NO: 253309 - DNA, 75 bp, Artificial Sequence
  Synthetic
tgagaaacccacaggatgtattcagtcagacaatgtctgacatcagtcacggtattcagggagtccttagtagcg

SEQ ID NO: 253310 - DNA, 75 bp, Artificial Sequence
  Synthetic
tcagacaatgtctgacatcagtcacggtattcagggagtccttagtagcgtggcaatgacagggactgaactggg

SEQ ID NO: 253311 - DNA, 75 bp, Artificial Sequence
  Synthetic
ggtagatgtttggagaaatgagaaactgttttctagatggaaatattggttacaagcgattaaactgtttattga

SEQ ID NO: 253312 - DNA, 75 bp, Artificial Sequence
  Synthetic
agacgaaggtaacctgatggtagacctgtagccgtctgtgcttaatagagggctttaatttccatttttaatggt

SEQ ID NO: 253313 - DNA, 75 bp, Artificial Sequence
  Synthetic
tctcgtccttggtttacatggatcagagtgagaaaaaatatcttgtatattattaactaacaaccttggtttcta

SEQ ID NO: 253314 - DNA, 75 bp, Artificial Sequence
  Synthetic
aagttaatgagagcaaaaatatataaggttgtattccatatttgttatttttttctgtaatagttagaaaataca

SEQ ID NO: 253315 - DNA, 75 bp, Artificial Sequence
  Synthetic
ttcgatggtctatctaccagattattatgtgttataaggtacttttctcataataaactagagtatgagtaagat

SEQ ID NO: 253316 - DNA, 75 bp, Artificial Sequence
  Synthetic
gttctttattaattctattttaaactttatcctcaagactcctgacaaaattaaaatccagaaagcagcaaacaa

SEQ ID NO: 253317 - DNA, 75 bp, Artificial Sequence
  Synthetic
tttatcctcaagactcctgacaaaattaaaatccagaaagcagcaaacaatcctgttacaagtttactgaaatct

SEQ ID NO: 253318 - DNA, 75 bp, Artificial Sequence
  Synthetic
aaaattgatggatgagatatacagctattaatttcgaaaatatattttaatctgataactttaaacatggatttt

SEQ ID NO: 253319 - DNA, 75 bp, Artificial Sequence
  Synthetic
tcagagcaagaaacactgcagtagtcaacatgaaagcttgcataacgatacgtgcatcatagaaagtaacaacag

SEQ ID NO: 253320 - DNA, 75 bp, Artificial Sequence
  Synthetic
caacatgaaagcttgcataacgatacgtgcatcatagaaagtaacaacagaggccagcgttagagattctaacag

SEQ ID NO: 253321 - DNA, 75 bp, Artificial Sequence
  Synthetic
agattttgttattgtagtatgataatatcaaaaagatggatataaagaattggtcagtgtataataaattatatg

SEQ ID NO: 253322 - DNA, 75 bp, Artificial Sequence
  Synthetic
tggtcagtgtataataaattatatgtaggaggaggaatatctgatgatgttcaaactaatacatctgaaacatac

SEQ ID NO: 253323 - DNA, 75 bp, Artificial Sequence
  Synthetic
ttcaggggatgttcatgtctgtgtaaagtcaatgcgaaaatcaagcctatagatccgaacattgatgccaatatt

SEQ ID NO: 253324 - DNA, 75 bp, Artificial Sequence
  Synthetic
tcatcacattaactatttttttattactttatactataatagtactagactgacttctaacaaacatctcacctg

SEQ ID NO: 253325 - DNA, 75 bp, Artificial Sequence
  Synthetic
aacgaataactcccaaactgcattcatgttacactatataacactacttcggttagatgttttagaaaaaataaa

SEQ ID NO: 253326 - DNA, 75 bp, Artificial Sequence
  Synthetic
taggaggaggaatatctgatgatgttcaaactaatacatctgaaacatacgataaagaaaaagattgttggacat

SEQ ID NO: 253327 - DNA, 75 bp, Artificial Sequence
  Synthetic
gtgacaaaaataatgaccaatataagttccataaattgctaccgtgaatataaatccgttaaaataattaataat

SEQ ID NO: 253328 - DNA, 75 bp, Artificial Sequence
  Synthetic
aaaaaacacagtacacgaatgattttctaaagtatttggaaagttttataggtagttgatagaacaaaatacata

SEQ ID NO: 253329 - DNA, 75 bp, Artificial Sequence
  Synthetic
ggtagttgatagaacaaaatacataattttgtaaaaataaatcactttttatactaatatgacacaattaccaat

SEQ ID NO: 253330 - DNA, 75 bp, Artificial Sequence
  Synthetic
tagtttttgtcttttacagtatatacgttattgtcaaaatctaaacaaatattagcataatacatctatctataa

SEQ ID NO: 253331 - DNA, 75 bp, Artificial Sequence
  Synthetic
attttgtaaaaataaatcactttttatactaatatgacacaattaccaatacttttgttactaatatcattagta

SEQ ID NO: 253332 - DNA, 75 bp, Artificial Sequence
  Synthetic
ctaaaaaaataggtgatgatgcaactatatcatgtagtcgaaataatacaaattactacgttgttatgagtgctt

SEQ ID NO: 253333 - DNA, 75 bp, Artificial Sequence
  Synthetic
tatatcatgtagtcgaaataatacaaattactacgttgttatgagtgcttggtataaggagcccaattccattat

SEQ ID NO: 253334 - DNA, 75 bp, Artificial Sequence
  Synthetic
ttgtattttgataattataccaaggataaaatatcttacgactctccatacgatgatctagttacaactatcaca

SEQ ID NO: 253335 - DNA, 75 bp, Artificial Sequence
  Synthetic
ataaaatatcttacgactctccatacgatgatctagttacaactatcacaattaaatcattgactgctggagatg

SEQ ID NO: 253336 - DNA, 75 bp, Artificial Sequence
  Synthetic
tatgacatcgactacaaatgatactgataaagtagattatgaagaatactccatagagttgattgtaaatacaga

SEQ ID NO: 253337 - DNA, 75 bp, Artificial Sequence
  Synthetic
gataaagtagattatgaagaatactccatagagttgattgtaaatacagatagtgaatcgactatagacataata

SEQ ID NO: 253338 - DNA, 75 bp, Artificial Sequence
  Synthetic
tttctgagaaaccagaggatatagataattctaattgctcgtctgtattcgaaatcgcgactccggaaccaatta

SEQ ID NO: 253339 - DNA, 75 bp, Artificial Sequence
  Synthetic
ctgataatgtagaagaccatacagacaccgtcacatacactagtgatagcattaatacagtaaatgcatcatctg

SEQ ID NO: 253340 - DNA, 75 bp, Artificial Sequence
  Synthetic
ggaaccaattactgataaagaagaagatcatacagtaacagacactgtctcatacactacagtaagtacatcatc

SEQ ID NO: 253341 - DNA, 75 bp, Artificial Sequence
  Synthetic
accgatgatgcggatctttatgatacatacaatgataatgatacagtaccgccaactactgtaggtggtagtaca

SEQ ID NO: 253342 - DNA, 75 bp, Artificial Sequence
  Synthetic
catacaatgataatgatacagtaccgccaactactgtaggtggtagtacaacctctattagcaattataaaacca

SEQ ID NO: 253343 - DNA, 75 bp, Artificial Sequence
  Synthetic
gccaactactgtaggtggtagtacaacctctattagcaattataaaaccaaggactttgtagaaatatttggtat

SEQ ID NO: 253344 - DNA, 75 bp, Artificial Sequence
  Synthetic
gtggcgattttctgtattacgtattatatatgtaataaacacccacgtaaatacaaaacagagaacaaagtctag

SEQ ID NO: 253345 - DNA, 75 bp, Artificial Sequence
  Synthetic
atatatgtaataaacacccacgtaaatacaaaacagagaacaaagtctagatttttgacttacataaatatctgg

SEQ ID NO: 253346 - DNA, 75 bp, Artificial Sequence
  Synthetic
tctcactcacatgtaatcttaaaaaatgatatgatagttcttacaagtagagattgagttttaaatggattctat

SEQ ID NO: 253347 - DNA, 75 bp, Artificial Sequence
  Synthetic
gtgtcccataccactagatttcctcgtcctatggaacgacgagaaggtgttgattaccattacttaacagagagg

SEQ ID NO: 253348 - DNA, 75 bp, Artificial Sequence
  Synthetic
aaactttctagaacatactgagtttttaggaaatatttacggaacttctaaaacagctgtaaatacagcggctat

SEQ ID NO: 253349 - DNA, 75 bp, Artificial Sequence
  Synthetic
ttaggaaatatttacggaacttctaaaacagctgtaaatacagcggctattaataatcgtatttgcgcgatggat

SEQ ID NO: 253350 - DNA, 75 bp, Artificial Sequence
  Synthetic
taataatcgtatttgcgcgatggatttaaacatcaacggtgttagaagtcttaaaaatacttacctaatgcatta

SEQ ID NO: 253351 - DNA, 75 bp, Artificial Sequence
  Synthetic
gcatatagtaagtgttaattcagatactacaggaccgtattagaatgtattttaacactaattagagacttaaga

SEQ ID NO: 253352 - DNA, 75 bp, Artificial Sequence
  Synthetic
cattgtgtaaactaaataacgttttctatggcatttaataagacattggatatgtggaaaagatgatggtgtatg

SEQ ID NO: 253353 - DNA, 75 bp, Artificial Sequence
  Synthetic
cattgtgtaaactaaataacgttttctatggcatttaataagtcattggatatgtggaaaagatgatggtgtatg

SEQ ID NO: 253354 - DNA, 75 bp, Artificial Sequence
  Synthetic
cattgtgtaaactaaataacgttttctatggcatttaataagccattggatatgtggaaaagatgatggtgtatg

SEQ ID NO: 253355 - DNA, 75 bp, Artificial Sequence
  Synthetic
cattgtgtaaactaaataacgttttctatggcatttaataaggcattggatatgtggaaaagatgatggtgtatg

SEQ ID NO: 253356 - DNA, 75 bp, Artificial Sequence
  Synthetic
tttgacttaaaacttgataattaataatataactcgtttttatatgtggctatttcaacgtctaatgtattagtt

SEQ ID NO: 253357 - DNA, 75 bp, Artificial Sequence
  Synthetic
tatttcaacgtctaatgtattagttaaatattaaaacttaccacgtaaaacttaaaatttaaaatggtatttcat

SEQ ID NO: 253358 - DNA, 75 bp, Artificial Sequence
  Synthetic
aaatattaaaacttaccacgtaaaacttaaaatttaaaatggtatttcattgacagatcatacattatgaagttt

SEQ ID NO: 253359 - DNA, 75 bp, Artificial Sequence
  Synthetic
gcaaaaatcaatgggtcgttggaccattaataggaaaaggtggattcggtagtatttatactactaatgacaata

SEQ ID NO: 253360 - DNA, 75 bp, Artificial Sequence
  Synthetic
attaataggaaaaggtggattcggtagtatttatactactaatgacaataattatgtagtaaaaatagagcccaa

SEQ ID NO: 253361 - DNA, 75 bp, Artificial Sequence
  Synthetic
caggcattttatactagagtacttaaaccatccgttatcgaagaatggaaaaaatctcacaatataaagcacgta

SEQ ID NO: 253362 - DNA, 75 bp, Artificial Sequence
  Synthetic
aaccatccgttatcgaagaatggaaaaaatctcacaatataaagcacgtaggtcttatcacgtgcaaggcatttg

SEQ ID NO: 253363 - DNA, 75 bp, Artificial Sequence
  Synthetic
aatgttctcgatgtcaatagccatatgcccgctagttgcgatatacataaactgatcactaattcccagaatccc

SEQ ID NO: 253364 - DNA, 75 bp, Artificial Sequence
  Synthetic
atatcgattcttggtaattaatagattaggtgcagatctagatgcggtgatcagagccaataataatagactacc

SEQ ID NO: 253365 - DNA, 75 bp, Artificial Sequence
  Synthetic
ttaggtgcagatctagatgcggtgatcagagccaataataatagactaccagaaaggtcggtgatgttgatcgga

SEQ ID NO: 253366 - DNA, 75 bp, Artificial Sequence
  Synthetic
ttatgcacgagcaaggatattctcacggagatattaaagcgagtaatatagtcttggatcaaatagataagaata

SEQ ID NO: 253367 - DNA, 75 bp, Artificial Sequence
  Synthetic
cggagatattaaagcgagtaatatagtcttggatcaaatagataagaataaattatatctagtggattacggatt

SEQ ID NO: 253368 - DNA, 75 bp, Artificial Sequence
  Synthetic
gaacatgttccatttataagaaatccaaataaaatggataacggtactctagaatttacacctatagattcgcat

SEQ ID NO: 253369 - DNA, 75 bp, Artificial Sequence
  Synthetic
caaataaaatggataacggtactctagaatttacacctatagattcgcataaaggatacgttgtatctagacgtg

SEQ ID NO: 253370 - DNA, 75 bp, Artificial Sequence
  Synthetic
tatgattagatggttgggaggtatcttgccatggactaagatatctgaaacaaagaattctgcattagtaagtgc

SEQ ID NO: 253371 - DNA, 75 bp, Artificial Sequence
  Synthetic
ttgccatggactaagatatctgaaacaaagaattctgcattagtaagtgctgcaaaacagaaatatgttaacaat

SEQ ID NO: 253372 - DNA, 75 bp, Artificial Sequence
  Synthetic
tgcaatatgcacctagagaattgctgcaatatattaccatggtaaactctttgacatattttgaggaacccaatt

SEQ ID NO: 253373 - DNA, 75 bp, Artificial Sequence
  Synthetic
aatagaaacacggcgatgttttacgcacacgctttcggtgggtacgacgagaaccttcatgcatttcctggaata

SEQ ID NO: 253374 - DNA, 75 bp, Artificial Sequence
  Synthetic
cacacgctttcggtgggtacgacgagaaccttcatgcatttcctggaatatcatcgacggttgccaatgatgtca

SEQ ID NO: 253375 - DNA, 75 bp, Artificial Sequence
  Synthetic
gttctgccgtaaccgatagggaaacggatgtataattttttttatagtatgaaggatatgatggatatgatgata

SEQ ID NO: 253376 - DNA, 75 bp, Artificial Sequence
  Synthetic
taataaaaagtataacattgtaaaaaacaaatatatgtggtgtaacagtcaagtgaacaagagatatattggagc

SEQ ID NO: 253377 - DNA, 75 bp, Artificial Sequence
  Synthetic
aacaaatatatgtggtgtaacagtcaagtgaacaagagatatattggagcactactgcctatgtttgagtgcaat

SEQ ID NO: 253378 - DNA, 75 bp, Artificial Sequence
  Synthetic
tccatgatctagaaggaaatcaaatctctattgtcacatatcgccacaaaaactactatgctctaagtggaattg

SEQ ID NO: 253379 - DNA, 75 bp, Artificial Sequence
  Synthetic
ctctattgtcacatatcgccacaaaaactactatgctctaagtggaattgggtacgagagtctagacttgtgttt

SEQ ID NO: 253380 - DNA, 75 bp, Artificial Sequence
  Synthetic
gtacttgaaacaggaaacgcggtatatggaaaagttcaacatgagtattctactatcaaagagaaggccaaagaa

SEQ ID NO: 253381 - DNA, 75 bp, Artificial Sequence
  Synthetic
atggaaaagttcaacatgagtattctactatcaaagagaaggccaaagaaatgaatgcactcaaaccaggaccta

SEQ ID NO: 253382 - DNA, 75 bp, Artificial Sequence
  Synthetic
agattgtgtctgccaagttactactgtagacgtgcatggaaaggaaattatgagaatgagattcaaaaggggtgc

SEQ ID NO: 253383 - DNA, 75 bp, Artificial Sequence
  Synthetic
gtagacgtgcatggaaaggaaattatgagaatgagattcaaaaggggtgcggtgcttccgattccaaatctggta

SEQ ID NO: 253384 - DNA, 75 bp, Artificial Sequence
  Synthetic
gattagattagattagattagatcataaataaaaatagtagcacgcactacttcagccaaatattcttttttgaa

SEQ ID NO: 253385 - DNA, 75 bp, Artificial Sequence
  Synthetic
atacaataaatctttccacttccatatcagctctcctgaattccggtggcggcaccatcgaggtaacatctaagg

SEQ ID NO: 253386 - DNA, 75 bp, Artificial Sequence
  Synthetic
taaaaacaaatttgtatatgaagactatgggagcatgtcttcaaatggactccatggaagctctagagtatctta

SEQ ID NO: 253387 - DNA, 75 bp, Artificial Sequence
  Synthetic
tatgggagcatgtcttcaaatggactccatggaagctctagagtatcttagtgaactgaaggaatcaggtgggcg

SEQ ID NO: 253388 - DNA, 75 bp, Artificial Sequence
  Synthetic
ctctcttcgatgggtctcacaaaaatattaaacctctttctgatggtctctataaacgattgatttttcttaccc

SEQ ID NO: 253389 - DNA, 75 bp, Artificial Sequence
  Synthetic
gggaaacggatgtataatttttttatagtgtgatggatatgatggatatgatggatatgatatatgatggatatt

SEQ ID NO: 253390 - DNA, 75 bp, Artificial Sequence
  Synthetic
tttgaatatccagatggagtgaaagacactgaatcaattgagagattggcagaggagttcttcaatagatcagaa

SEQ ID NO: 253391 - DNA, 75 bp, Artificial Sequence
  Synthetic
cttctatactctcatcttttgccaacacaaagggtggatatttgttcattggagttgataataatacacacaaag

SEQ ID NO: 253392 - DNA, 75 bp, Artificial Sequence
  Synthetic
cacaaagggtggatatttgttcattggagttgataataatacacacaaagtaattggattcacggtgggtcacga

SEQ ID NO: 253393 - DNA, 75 bp, Artificial Sequence
  Synthetic
atagaaaagtatatccaaaaacttcctgttgtgcatttctgcaagaaaaaagaggacatcaagtacgcatgtaga

SEQ ID NO: 253394 - DNA, 75 bp, Artificial Sequence
  Synthetic
ctgttgtgcatttctgcaagaaaaaagaggacatcaagtacgcatgtagattcatcaaggtgtataaacctggtg

SEQ ID NO: 253395 - DNA, 75 bp, Artificial Sequence
  Synthetic
cgcaatcaaagtggaaagatgctgctgtgctgtgtttgcggattggccagaatcatggtacatggatactagtgg

SEQ ID NO: 253396 - DNA, 75 bp, Artificial Sequence
  Synthetic
tgtgctgtgtttgcggattggccagaatcatggtacatggatactagtggtagtatgaagaagtattctccagat

SEQ ID NO: 253397 - DNA, 75 bp, Artificial Sequence
  Synthetic
aattagggtaaggtaaaactatatataataactaacaatttgtgtatcatatagacaattaattaggtaactgtt

SEQ ID NO: 253398 - DNA, 75 bp, Artificial Sequence
  Synthetic
tttcccagaaacaaactttttttacctactataaaataaaatgagtatactacctgttatatttcttcctatatt

SEQ ID NO: 253399 - DNA, 75 bp, Artificial Sequence
  Synthetic
tttaattgtttttgtaaactaacactgttcattgaaaagggataacatgttacagaatataaattatatatggat

SEQ ID NO: 253400 - DNA, 75 bp, Artificial Sequence
  Synthetic
atgaatttacagaaattatctctggctatatatcttacggtgacatgttcgtggtgttatgaaacatgtatgaga

SEQ ID NO: 253401 - DNA, 75 bp, Artificial Sequence
  Synthetic
tacagaatataaattatatatggatttttttaaaaaggaaatacttgactggagtatatatttatttcttcatta

SEQ ID NO: 253402 - DNA, 75 bp, Artificial Sequence
  Synthetic
tccaattcttccacatctcatataatacaggaatataatcttgttcgaaaatacgagaaagtggataaaacaata

SEQ ID NO: 253403 - DNA, 75 bp, Artificial Sequence
  Synthetic
tacaggaatataatcttgttcgaaaatacgagaaagtggataaaacaatagttgattttttatctaggtggccaa

SEQ ID NO: 253404 - DNA, 75 bp, Artificial Sequence
  Synthetic
ggaaaatattctacatatttattttatagatgctgctaatacgaatattatgattttttttctagatagagtatt

SEQ ID NO: 253405 - DNA, 75 bp, Artificial Sequence
  Synthetic
atagatgctgctaatacgaatattatgattttttttctagatagagtattaaatattaataagaaccgtgggtca

SEQ ID NO: 253406 - DNA, 75 bp, Artificial Sequence
  Synthetic
ccattaatataaaagaatatgtatatcaattagttaataatgatcatctagataatagtataagactaatgcttg

SEQ ID NO: 253407 - DNA, 75 bp, Artificial Sequence
  Synthetic
tcaattagttaataatgatcatctagataatagtataagactaatgcttgaaaatggacgtagaacaagacattt

SEQ ID NO: 253408 - DNA, 75 bp, Artificial Sequence
  Synthetic
aatatctatataagtattttaataaatcatagattttatatagatgccgaagacagttacggttgtacattatta

SEQ ID NO: 253409 - DNA, 75 bp, Artificial Sequence
  Synthetic
agacagttacggttgtacattattacatagatgtatatataactataggaaatcagaatcagaatcatataatga

SEQ ID NO: 253410 - DNA, 75 bp, Artificial Sequence
  Synthetic
attaattaagatattgttaaataatggatcagatgtagataaaaaagatacgtacggaaacacaccgtttatcct

SEQ ID NO: 253411 - DNA, 75 bp, Artificial Sequence
  Synthetic
ggatcagatgtagataaaaaagatacgtacggaaacacaccgtttatcctattatgtaaacacgatatcgacaac

SEQ ID NO: 253412 - DNA, 75 bp, Artificial Sequence
  Synthetic
agaatgctaatatagactctgtagactttaatggatatacacctcttcattatgtctcatgtcgtaataaatatg

SEQ ID NO: 253413 - DNA, 75 bp, Artificial Sequence
  Synthetic
ctttaatggatatacacctcttcattatgtctcatgtcgtaataaatatgattttgtaaagttattaatttctaa

SEQ ID NO: 253414 - DNA, 75 bp, Artificial Sequence
  Synthetic
ataaaatctatatgactgataagagacgtgttattacatcctggttaaacattaatcctgtcaaggaagaagatg

SEQ ID NO: 253415 - DNA, 75 bp, Artificial Sequence
  Synthetic
agattcggaactactccattttattgtggaattatacacggtatctcgcttataaaactatatttggaatcagac

SEQ ID NO: 253416 - DNA, 75 bp, Artificial Sequence
  Synthetic
gtggaattatacacggtatctcgcttataaaactatatttggaatcagacacagagttagaaatagataatgaac

SEQ ID NO: 253417 - DNA, 75 bp, Artificial Sequence
  Synthetic
tgatgctgttgaatctttagattatctattgtccagaggagttattgatattaactatcgtactatatacaacga

SEQ ID NO: 253418 - DNA, 75 bp, Artificial Sequence
  Synthetic
ctattgtccagaggagttattgatattaactatcgtactatatacaacgaaacatctatttacgacgctgtcagt

SEQ ID NO: 253419 - DNA, 75 bp, Artificial Sequence
  Synthetic
atctattaaacagaaatggtgattttgagacgattactactagtggatgtacatgtatttcggaagcagtcgcga

SEQ ID NO: 253420 - DNA, 75 bp, Artificial Sequence
  Synthetic
tgagacgattactactagtggatgtacatgtatttcggaagcagtcgcgaacaacaacaaaataataatggatat

SEQ ID NO: 253421 - DNA, 75 bp, Artificial Sequence
  Synthetic
aaaattatgataccatctatgatagcaattactaaacataaacaacataatgcagatttattgaaaatgtgtata

SEQ ID NO: 253422 - DNA, 75 bp, Artificial Sequence
  Synthetic
caattactaaacataaacaacataatgcagatttattgaaaatgtgtataaaatatactgcgtgtatgaccgatt

SEQ ID NO: 253423 - DNA, 75 bp, Artificial Sequence
  Synthetic
gctacatcaatataaatggtatattttaaaatgttttgatgaaatagatatcatgaagagatgttatataaaaaa

SEQ ID NO: 253424 - DNA, 75 bp, Artificial Sequence
  Synthetic
tgtatcaaagacattaatactttaatgagatacggtagacatccttctttcgtgaaatgtaatattctcgacgta

SEQ ID NO: 253425 - DNA, 75 bp, Artificial Sequence
  Synthetic
tagcatctattagatatcgtcagagattaattagtctattatccaagaagctggatgctggagataaatggtcgt

SEQ ID NO: 253426 - DNA, 75 bp, Artificial Sequence
  Synthetic
aatattggaaaactttaacgataacgaactgaccacatatctaaaaatcttataaacactattaaaatataaaat

SEQ ID NO: 253427 - DNA, 75 bp, Artificial Sequence
  Synthetic
tcattgtttccttttagtgctcgacagtgtatactatttttaacactcataaataaaaatgaaaacgatttccgt

SEQ ID NO: 253428 - DNA, 75 bp, Artificial Sequence
  Synthetic
agtgtatactatttttaacactcataaataaaaatgaaaacgatttccgttgttacgttgttatgcgtactacct

SEQ ID NO: 253429 - DNA, 75 bp, Artificial Sequence
  Synthetic
tacccactatgaataacgctaaattaacgtctaccgaaacatcgtttaatgataaacagaaagttacgtttacat

SEQ ID NO: 253430 - DNA, 75 bp, Artificial Sequence
  Synthetic
aacgtctaccgaaacatcgtttaatgataaacagaaagttacgtttacatgtgattcaggatatcattctttgga

SEQ ID NO: 253431 - DNA, 75 bp, Artificial Sequence
  Synthetic
aaatggaaatacgaaaatccatgcaagaaaatgtgcacagtttctgattatgtctctgaactatatgataagcca

SEQ ID NO: 253432 - DNA, 75 bp, Artificial Sequence
  Synthetic
agaaaatgtgcacagtttctgattatgtctctgaactatatgataagccattatacgaagtgaattccaccatga

SEQ ID NO: 253433 - DNA, 75 bp, Artificial Sequence
  Synthetic
atattttcgttgtgaagaaaaaaatggaaatacttcttggaatgatactgtcacgtgtcctaatgcggaatgtca

SEQ ID NO: 253434 - DNA, 75 bp, Artificial Sequence
  Synthetic
ggaaatacttcttggaatgatactgtcacgtgtcctaatgcggaatgtcaacctcttcaattagaacacggatcg

SEQ ID NO: 253435 - DNA, 75 bp, Artificial Sequence
  Synthetic
catttggggaatatatgactatcaactgtgatgttggatatgaggttattggtgtttcgtatataagttgtacgg

SEQ ID NO: 253436 - DNA, 75 bp, Artificial Sequence
  Synthetic
ggtgtttcgtatataagttgtacggctaattcttggaatgttattccatcatgtcaacaaaaatgtgatataccg

SEQ ID NO: 253437 - DNA, 75 bp, Artificial Sequence
  Synthetic
gatctacattttctatcggtggcgttatacatcttagttgtaaaagtggttttacactaacggggtctccatcat

SEQ ID NO: 253438 - DNA, 75 bp, Artificial Sequence
  Synthetic
tatacatcttagttgtaaaagtggttttacactaacggggtctccatcatccacatgtatcgacggtaaatggaa

SEQ ID NO: 253439 - DNA, 75 bp, Artificial Sequence
  Synthetic
tctaacgaagaatttgatccagtggatgatggtcccgacgatgagacagatctgagcaaactctcgaaagacgtt

SEQ ID NO: 253440 - DNA, 75 bp, Artificial Sequence
  Synthetic
atgatggtcccgacgatgagacagatctgagcaaactctcgaaagacgttgtacaatatgaacaagaaatagaat

SEQ ID NO: 253441 - DNA, 75 bp, Artificial Sequence
  Synthetic
cataatggcgttgacaattatgggtgtcatatttctaatctctattatagtattagtttgttcctgtgacaaaaa

SEQ ID NO: 253442 - DNA, 75 bp, Artificial Sequence
  Synthetic
taattaataacgaacaagtatcaaaagattaaagaattagctagaatcaattagatgtcttcttcagtggatgtt

SEQ ID NO: 253443 - DNA, 75 bp, Artificial Sequence
  Synthetic
ttagatgtcttcttcagtggatgttgatatctacgatgctgttagagcatttttactcaggcactattatgacaa

SEQ ID NO: 253444 - DNA, 75 bp, Artificial Sequence
  Synthetic
gatatctacgatgctgttagagcatttttactcaggcactattatgacaagagatttattgtgtatggaagaagt

SEQ ID NO: 253445 - DNA, 75 bp, Artificial Sequence
  Synthetic
ggctatttacaagatgcaccgttatacagttcgatgatatagtacgtactatgccaaatgaatcacgtgttaaac

SEQ ID NO: 253446 - DNA, 75 bp, Artificial Sequence
  Synthetic
acagttcgatgatatagtacgtactatgccaaatgaatcacgtgttaaacaatgggtgatggatacacttaatgg

SEQ ID NO: 253447 - DNA, 75 bp, Artificial Sequence
  Synthetic
gtatgtgtgggtaccggactacgattcatggaaatgtttttcgattacaataaaaataatcccaaaaatagcatc

SEQ ID NO: 253448 - DNA, 75 bp, Artificial Sequence
  Synthetic
tcatggaaatgtttttcgattacaataaaaataatcccaaaaatagcatcaacaatcaaataatgtatgatataa

SEQ ID NO: 253449 - DNA, 75 bp, Artificial Sequence
  Synthetic
taatgagagatatagaagcgcgtttaacgacgatagaatatacatccgtagaactatgatggacaaattgtacga

SEQ ID NO: 253450 - DNA, 75 bp, Artificial Sequence
  Synthetic
acgatcactggaggtgtttgttattatctgttgatgcatctagttagtttgtataaataattatttcgatatact

SEQ ID NO: 253451 - DNA, 75 bp, Artificial Sequence
  Synthetic
ataaaaaactaataacgtttttatttgtaataggtgcagttgcatcctattcgaataatgagtacactccgttta

SEQ ID NO: 253452 - DNA, 75 bp, Artificial Sequence
  Synthetic
tgtaataggtgcagttgcatcctattcgaataatgagtacactccgtttaataaactgagtgtaaaactctatat

SEQ ID NO: 253453 - DNA, 75 bp, Artificial Sequence
  Synthetic
tcatatactgatgataataatgaattggtgttaaattttaaagagtacacaatttctattattacagagtcatgc

SEQ ID NO: 253454 - DNA, 75 bp, Artificial Sequence
  Synthetic
tggtgttaaattttaaagagtacacaatttctattattacagagtcatgcgacgtcggatttgattccatagata

SEQ ID NO: 253455 - DNA, 75 bp, Artificial Sequence
  Synthetic
tattgatatgtataccattgactcgtctactattcaacgcagagaacatacgtgtagaatatctaccaaattatc

SEQ ID NO: 253456 - DNA, 75 bp, Artificial Sequence
  Synthetic
tctactattcaacgcagagaacatacgtgtagaatatctaccaaattatcatgccattatgataagtacccttat

SEQ ID NO: 253457 - DNA, 75 bp, Artificial Sequence
  Synthetic
gacaatattctattactgcagagggaaaatgctataaaggaataaaatatgaaataagtatgatgaacgatgata

SEQ ID NO: 253458 - DNA, 75 bp, Artificial Sequence
  Synthetic
aaaatgctataaaggaataaaatatgaaataagtatgatgaacgatgatactctattgagaaaacatactcttaa

SEQ ID NO: 253459 - DNA, 75 bp, Artificial Sequence
  Synthetic
tgatggtggtttaagtttaaaaaagattttgttattgtagtatgataatatcaaaaagatggatataaagaattt

SEQ ID NO: 253460 - DNA, 75 bp, Artificial Sequence
  Synthetic
cgtcatgggcatagtaatacatattattcaaaatatgatttttaaaaatttaaaatatattatcacttcagtgac

SEQ ID NO: 253461 - DNA, 75 bp, Artificial Sequence
  Synthetic
tgagatatattataattctcgcagttttgttcattaatagtatacatgctaaaataactagttataagtttgaat

SEQ ID NO: 253462 - DNA, 75 bp, Artificial Sequence
  Synthetic
atggactggggatggtctatacaatatatcccttaaaaattatggcatcaagacgtggcaaacaatgtatacaaa

SEQ ID NO: 253463 - DNA, 75 bp, Artificial Sequence
  Synthetic
atatcccttaaaaattatggcatcaagacgtggcaaacaatgtatacaaatgtaccagaaggaacatacgacata

SEQ ID NO: 253464 - DNA, 75 bp, Artificial Sequence
  Synthetic
gatgtcatcaatgtagaaaatgcccaacaggatcatttgataaggtaaagtgtaccggaacacagaacaaatgtt

SEQ ID NO: 253465 - DNA, 75 bp, Artificial Sequence
  Synthetic
tatctttctgggttaaatttgaacaaggcgactataaagtggaagagtattgtacgggactatgtgtcgaagtaa

SEQ ID NO: 253466 - DNA, 75 bp, Artificial Sequence
  Synthetic
gactgaatatgacgatcatatcaatttgttcatcgagcatccgtatgctactagaggtagcaagaagattcctat

SEQ ID NO: 253467 - DNA, 75 bp, Artificial Sequence
  Synthetic
atctacttgttgtatacggctaacttcacattcggagattctgaagaaccagtaacatatgatatcgatgactac

SEQ ID NO: 253468 - DNA, 75 bp, Artificial Sequence
  Synthetic
tagactttgccacaacagaaaaagtgtgtgtgacagcacagggagccacagaagggtttctcgaaaaaattactc

SEQ ID NO: 253469 - DNA, 75 bp, Artificial Sequence
  Synthetic
acctaaaaagaatgtatatacgtgcgcaattagatctaaagaagatgttcccaatttcaaggacaaaatagccag

SEQ ID NO: 253470 - DNA, 75 bp, Artificial Sequence
  Synthetic
gcaattagatctaaagaagatgttcccaatttcaaggacaaaatagccagagttatcacgagaaaatttaataaa

SEQ ID NO: 253471 - DNA, 75 bp, Artificial Sequence
  Synthetic
ttctcggtagcacatcgaatgatgttacaacttttcttagcattcttgactaaatattcataactaatttttatt

SEQ ID NO: 253472 - DNA, 75 bp, Artificial Sequence
  Synthetic
taaatattcataactaatttttattaatgatacaaaaatgaaataaaactgcatattatacactggttaacgccc

SEQ ID NO: 253473 - DNA, 75 bp, Artificial Sequence
  Synthetic
aggtccctgattatagtccttctgttcccctctatcatctactccatgtctattagacgatgcgagaagactgaa

SEQ ID NO: 253474 - DNA, 75 bp, Artificial Sequence
  Synthetic
tattagacgatgcgagaagactgaagaggaaacatggggattaaaaatagggttgtgtataattgccaaagattt

SEQ ID NO: 253475 - DNA, 75 bp, Artificial Sequence
  Synthetic
ctatcccgaaagaactgattgcagtgttcatcgcccaactgcaagtggaggattgataactgaaggcaatggatt

SEQ ID NO: 253476 - DNA, 75 bp, Artificial Sequence
  Synthetic
acagaaccacatgactttattatcaccgatactcaacaaacacgtcttggatcatctcatacatatattaaattc

SEQ ID NO: 253477 - DNA, 75 bp, Artificial Sequence
  Synthetic
ccgatactcaacaaacacgtcttggatcatctcatacatatattaaattcagtaacatgaatacaggtgtcccat

SEQ ID NO: 253478 - DNA, 75 bp, Artificial Sequence
  Synthetic
atcatctcatacatatattaaattcagtaacatgaatacaggtgtcccatctagtattccaaaatgttccagaac

SEQ ID NO: 253479 - DNA, 75 bp, Artificial Sequence
  Synthetic
caagaggcgggagacataaaatttgaggagtatactcaagaatcaagtgatatcagtattagagttaagtatgat

SEQ ID NO: 253480 - DNA, 75 bp, Artificial Sequence
  Synthetic
aggagtatactcaagaatcaagtgatatcagtattagagttaagtatgattcatcatgtattgattatctgggta

SEQ ID NO: 253481 - DNA, 75 bp, Artificial Sequence
  Synthetic
agagaatcatgtgtcagaattgatacacagactataaataaatatcttaagtcttgcaccaacacaaaattcgac

SEQ ID NO: 253482 - DNA, 75 bp, Artificial Sequence
  Synthetic
tgaagagtaaagcactccatgctaaaacagagttgtaatagatataaaatactttttataataattaggctagaa

SEQ ID NO: 253483 - DNA, 75 bp, Artificial Sequence
  Synthetic
aaaaatgatatgatagttcttacaagtagagattgagttttaaatggattctattaattaccggggaacttaaca

SEQ ID NO: 253484 - DNA, 75 bp, Artificial Sequence
  Synthetic
attcgttctgatctacagacattggttaataaatcatcttattttgccgatatattaaaatgtggaaactccact

SEQ ID NO: 253485 - DNA, 75 bp, Artificial Sequence
  Synthetic
aatagtagtgtagttaatgtaatatcgaatctagtccttagctataatccgatatatgatgaatggaccaaatta

SEQ ID NO: 253486 - DNA, 75 bp, Artificial Sequence
  Synthetic
tatattaaaatgtggaaactccactaataatattacattgtgtgactttcaagatgatgcgatatatagggttat

SEQ ID NO: 253487 - DNA, 75 bp, Artificial Sequence
  Synthetic
gatagaaagtacaaaagatgtataatcaatgatatggcacgctaaacagttgggtgtggaatcattgctaaaaga

SEQ ID NO: 253488 - DNA, 75 bp, Artificial Sequence
  Synthetic
tgggtgtggaatcattgctaaaagaatgtcaaaattatttgcttagaatattacgtatataattgtttagaaatt

SEQ ID NO: 253489 - DNA, 75 bp, Artificial Sequence
  Synthetic
tatcgtatatctacaacgatgtaagaaacttcatattggataatattactattaatatataaggatccagatttt

SEQ ID NO: 253490 - DNA, 75 bp, Artificial Sequence
  Synthetic
aaacttcatattggataatattactattaatatataaggatccagattttatatatttgcctaaatacattatta

SEQ ID NO: 253491 - DNA, 75 bp, Artificial Sequence
  Synthetic
cttctccttattgattgaaaatgaaaatataaatagtttttatatatagcggtatctaccctatagttttattgc

SEQ ID NO: 253492 - DNA, 75 bp, Artificial Sequence
  Synthetic
atatcgttattgtttggtctatgccatggatatctttaaagaactaatcttaaaacatacggatgaaaatgtttt

SEQ ID NO: 253493 - DNA, 75 bp, Artificial Sequence
  Synthetic
atacagatacagatacagatacagatacagatacagatacagatacagatacagatacagatacagatacagata

SEQ ID NO: 253494 - DNA, 75 bp, Artificial Sequence
  Synthetic
cagatacagatacagatacagatacagatacagatacagatgtagaagatatcatgaacgaaatagatagagaga

SEQ ID NO: 253495 - DNA, 75 bp, Artificial Sequence
  Synthetic
actttatctattctgaatcatggagtagctggttctacagctgaacaactatcaaaatatatagagaatatgaat

SEQ ID NO: 253496 - DNA, 75 bp, Artificial Sequence
  Synthetic
atgcattacttgggtatataagacctacctctcttaaaatggttgagaccaatcttcgtcgtagaaacactgaag

SEQ ID NO: 253497 - DNA, 75 bp, Artificial Sequence
  Synthetic
aattgaaaataataaaaacattaacaagaatcatcccagtgaatatattagagaagcacttgttattaataccag

SEQ ID NO: 253498 - DNA, 75 bp, Artificial Sequence
  Synthetic
tagtaatagtgattccattgataaagaagttatagaatatatcagtcacgatgtaggaatatagatcatatctac

SEQ ID NO: 253499 - DNA, 75 bp, Artificial Sequence
  Synthetic
taaaaacaactcgttattacatagcaggcatggaatccttcaagtattgttttgataacgatggtaagaaatgga

SEQ ID NO: 253500 - DNA, 75 bp, Artificial Sequence
  Synthetic
aggcatggaatccttcaagtattgttttgataacgatggtaagaaatggattatcggaaatactttatattctgg

SEQ ID NO: 253501 - DNA, 75 bp, Artificial Sequence
  Synthetic
aaaaatttcactagttcgttctacaattacgtaatgaagatagatcataaatcacacaagccattgttgtccgaa

SEQ ID NO: 253502 - DNA, 75 bp, Artificial Sequence
  Synthetic
attacgtaatgaagatagatcataaatcacacaagccattgttgtccgaaatacgattctatatatctgtattgg

SEQ ID NO: 253503 - DNA, 75 bp, Artificial Sequence
  Synthetic
acgggaacgtggtataaagtatttggctattccagatctgtatggaattggagaaaccgatgattatatgttctt

SEQ ID NO: 253504 - DNA, 75 bp, Artificial Sequence
  Synthetic
gctattccagatctgtatggaattggagaaaccgatgattatatgttcttcgttataaagaatttgggaagagta

SEQ ID NO: 253505 - DNA, 75 bp, Artificial Sequence
  Synthetic
ttttcgaagcatgtgtcactatgataaacacgttagagtttatacactctcgaggatttactcatggaaaaatag

SEQ ID NO: 253506 - DNA, 75 bp, Artificial Sequence
  Synthetic
aaacacgttagagtttatacactctcgaggatttactcatggaaaaatagaaccgatgaatatactgattagaaa

SEQ ID NO: 253507 - DNA, 75 bp, Artificial Sequence
  Synthetic
tctagaactaacaaactatacaaaagtggaacacatatagattacaacgaggacatgataacttcaggaaatatc

SEQ ID NO: 253508 - DNA, 75 bp, Artificial Sequence
  Synthetic
gtggaacacatatagattacaacgaggacatgataacttcaggaaatatcaattatatgtgtgtagacaatcatc

SEQ ID NO: 253509 - DNA, 75 bp, Artificial Sequence
  Synthetic
agatttagaaatgttgggatattgcatgatagaatggttcggtggtaaacttccatggaaaaacgaaagtagtat

SEQ ID NO: 253510 - DNA, 75 bp, Artificial Sequence
  Synthetic
atgatagaatggttcggtggtaaacttccatggaaaaacgaaagtagtataaaagtaataaaacaaaaaaaagaa

SEQ ID NO: 253511 - DNA, 75 bp, Artificial Sequence
  Synthetic
ttgaggactgttttcctgaaggaaatgaacctctggaattagttagatatatagaattagtatacatgttagatt

SEQ ID NO: 253512 - DNA, 75 bp, Artificial Sequence
  Synthetic
tagtatagcataaactaaagtcgatacatacattaaaacttaaaaaataatgtaatttacaattaatagtataaa

SEQ ID NO: 253513 - DNA, 75 bp, Artificial Sequence
  Synthetic
attctcaaactcctaattatgacagactacgtagactgtttatacaagattgaaattatattcttttttttatag

SEQ ID NO: 253514 - DNA, 75 bp, Artificial Sequence
  Synthetic
tgaaattatattcttttttttatagagtgtggggtagtgttacggatatctgatatctaatattaatattagact

SEQ ID NO: 253515 - DNA, 75 bp, Artificial Sequence
  Synthetic
gtataaaaatactgcagctgttgccgttgttaaaggaaattgtagaaagaataccgtagacttttcttagaaatg

SEQ ID NO: 253516 - DNA, 75 bp, Artificial Sequence
  Synthetic
atcgattactatggatatctttagggaaatcgcatcttctatgaaaggaaagaatgtattcatttctccagcgtc

SEQ ID NO: 253517 - DNA, 75 bp, Artificial Sequence
  Synthetic
gaaatcgcatcttctatgaaaggaaagaatgtattcatttctccagcgtcaatctcgtcagtattgacaatactg

SEQ ID NO: 253518 - DNA, 75 bp, Artificial Sequence
  Synthetic
ctgaacagctatcaaaatatgtagaaaaggaggagaacatggataaggttagcgctcagaatatctcattcaaat

SEQ ID NO: 253519 - DNA, 75 bp, Artificial Sequence
  Synthetic
aaaggaggagaacatggataaggttagcgctcagaatatctcattcaaatccatgaataaagtatatgggcgata

SEQ ID NO: 253520 - DNA, 75 bp, Artificial Sequence
  Synthetic
ttgggaaaaattggcgataagtttcaaactgttgacttcactgattgtcgcactatagatgcaatcaataagtgt

SEQ ID NO: 253521 - DNA, 75 bp, Artificial Sequence
  Synthetic
aaactgttgacttcactgattgtcgcactatagatgcaatcaataagtgtgtagatatctttactgagggaaaaa

SEQ ID NO: 253522 - DNA, 75 bp, Artificial Sequence
  Synthetic
gtctcctgatacctgtctcctagcaattagtgccgtatactttaaagcaaaatggttgatgccattcgaaaagga

SEQ ID NO: 253523 - DNA, 75 bp, Artificial Sequence
  Synthetic
attagtgccgtatactttaaagcaaaatggttgatgccattcgaaaaggaatttaccagtgattatcccttttac

SEQ ID NO: 253524 - DNA, 75 bp, Artificial Sequence
  Synthetic
taagtatgatgtctatttacggcgagccatttaatcacgcatctgtaaaagaatcattcggtaacttttcaatca

SEQ ID NO: 253525 - DNA, 75 bp, Artificial Sequence
  Synthetic
gccatttaatcacgcatctgtaaaagaatcattcggtaacttttcaatcatagaactgccatatgttggagatac

SEQ ID NO: 253526 - DNA, 75 bp, Artificial Sequence
  Synthetic
aagattgatggattagaatccatagaacaaaatctaacagatacaaattttaagaaatggtgtaactctctggaa

SEQ ID NO: 253527 - DNA, 75 bp, Artificial Sequence
  Synthetic
aacaaaatctaacagatacaaattttaagaaatggtgtaactctctggaagctacgtttatcgatgtgcacattc

SEQ ID NO: 253528 - DNA, 75 bp, Artificial Sequence
  Synthetic
taatcttgtggatacgctaataaagttgggactgacagatgtgttctattcaactggtgattatatcaatatgtg

SEQ ID NO: 253529 - DNA, 75 bp, Artificial Sequence
  Synthetic
ttgggactgacagatgtgttctattcaactggtgattatatcaatatgtgtaattcagatgtgagtgttgacgct

SEQ ID NO: 253530 - DNA, 75 bp, Artificial Sequence
  Synthetic
tcaatgaagagtatacagaagcagctgcagcaacttctgtactagtggcagactgtgcatcaacagttacaaatg

SEQ ID NO: 253531 - DNA, 75 bp, Artificial Sequence
  Synthetic
tgcagcaacttctgtactagtggcagactgtgcatcaacagttacaaatgagttctgtgcagatcatccgttcat

SEQ ID NO: 253532 - DNA, 75 bp, Artificial Sequence
  Synthetic
atacatctccaaaactatcacttatacgtttatctttaacgaacatatacctagatggttatttactaacagaca

SEQ ID NO: 253533 - DNA, 75 bp, Artificial Sequence
  Synthetic
aaaattcttttcgttggtagatattgctctccaacaactaattaagcacattcttaatattagaatattatatag

SEQ ID NO: 253534 - DNA, 75 bp, Artificial Sequence
  Synthetic
tgtggtattagtgcaggtcgttattcttccaattgcaattggtaagatgacggccaactttagtacccacgtctt

SEQ ID NO: 253535 - DNA, 75 bp, Artificial Sequence
  Synthetic
cttccaattgcaattggtaagatgacggccaactttagtacccacgtcttttcaccacagcactgtggatgtgac

SEQ ID NO: 253536 - DNA, 75 bp, Artificial Sequence
  Synthetic
gacaatgtttgactgaatatatttattggtcgtcgtatgcataccgcaacaggcaatgcgctggacaactgtatg

SEQ ID NO: 253537 - DNA, 75 bp, Artificial Sequence
  Synthetic
tgcggaatcagtgttcatcgacgttcgtgagctggtaaaaaatatgccgtgggataatgttaaggattgtacaga

SEQ ID NO: 253538 - DNA, 75 bp, Artificial Sequence
  Synthetic
gagcaaaaaaccatcagagagatttcggccatcattggactttgtgcatatgctgctacttactggggaggtgaa

SEQ ID NO: 253539 - DNA, 75 bp, Artificial Sequence
  Synthetic
cggccatcattggactttgtgcatatgctgctacttactggggaggtgaagaccatcccactagtaacagtctga

SEQ ID NO: 253540 - DNA, 75 bp, Artificial Sequence
  Synthetic
gctcaattacatggattataccatcatattctggcgtatgaattgatgagttacagcttgacatttcttctttcc

SEQ ID NO: 253541 - DNA, 75 bp, Artificial Sequence
  Synthetic
tccattcgttcagacttttaacgtgcctgaatgtatcgacaaagggcaatattttgcatcattcatggagttaga

SEQ ID NO: 253542 - DNA, 75 bp, Artificial Sequence
  Synthetic
attttgcatcattcatggagttagaaaacgagccagtaatcttaccatgtcctcaaataaatacgctatcatccg

SEQ ID NO: 253543 - DNA, 75 bp, Artificial Sequence
  Synthetic
ggaaaaacgaggagcggataatgatagaattatacagatagataatggtagcaatatgctaattctgaacccgac

SEQ ID NO: 253544 - DNA, 75 bp, Artificial Sequence
  Synthetic
gcaatatgctaattctgaacccgacacaatcagactctggtatttatatatgcattaccacgaacgaaacctact

SEQ ID NO: 253545 - DNA, 75 bp, Artificial Sequence
  Synthetic
aatcgtgtctgtctcagaatcaaatatagatcttatctcgtatccacaaatagtaaatgagagatctactggtga

SEQ ID NO: 253546 - DNA, 75 bp, Artificial Sequence
  Synthetic
ccttagaaataagagacttaaacaacggacacctggaattattaccatagaagatgttagaaaaaatgatgctgg

SEQ ID NO: 253547 - DNA, 75 bp, Artificial Sequence
  Synthetic
ttttttttaagcacgaaataaaaacataattttaaacaatctatttcatactattttgtgtgctcaccatgaaca

SEQ ID NO: 253548 - DNA, 75 bp, Artificial Sequence
  Synthetic
taaccagaattataaaattagaggtacgtgatagaataatacctcctactatgaaattaccagaaggagtagtaa

SEQ ID NO: 253549 - DNA, 75 bp, Artificial Sequence
  Synthetic
atatgactgataagagacgtgttattacatcctggttaaacattaatcctgtcaaggaagaagatgctacaacgt

SEQ ID NO: 253550 - DNA, 75 bp, Artificial Sequence
  Synthetic
agtataacgtgaatgtatgttgttacatttccatatcaattgagtttataagaatttttatacattatcttccaa

SEQ ID NO: 253551 - DNA, 75 bp, Artificial Sequence
  Synthetic
catttccatatcaattgagtttataagaatttttatacattatcttccaacaaacaattgacgaacgtattgcta

SEQ ID NO: 253552 - DNA, 75 bp, Artificial Sequence
  Synthetic
tattattaatcattaacttgcagactatacctagtagtgctattttgacatactcatgttcttgtgtaattgcag

SEQ ID NO: 253553 - DNA, 75 bp, Artificial Sequence
  Synthetic
tatacctagtagtgctattttgacatactcatgttcttgtgtaattgcagtatctatattattaaagtacgtaaa

SEQ ID NO: 253554 - DNA, 75 bp, Artificial Sequence
  Synthetic
tttagataatatactgtctccgtatttttaaaaaattgccacatcctttattaaatcatgaatgggaatttctgt

SEQ ID NO: 253555 - DNA, 75 bp, Artificial Sequence
  Synthetic
ttttaaaaaattgccacatcctttattaaatcatgaatgggaatttctgtgtcatcgttagtatattgtgaacaa

SEQ ID NO: 253556 - DNA, 75 bp, Artificial Sequence
  Synthetic
gtggaatgcgatacattgatctatgtagttttaaaacataagcgaactttgaagaatttatataaatcatctcac

SEQ ID NO: 253557 - DNA, 75 bp, Artificial Sequence
  Synthetic
tactgtaaaaacaaatttgtatatgaagactatgggagcatgtcttcaaatggactccatggaagctctagagta

SEQ ID NO: 253558 - DNA, 75 bp, Artificial Sequence
  Synthetic
atatttacatatttactggtatatcaaagatgttagattagttaatgggaatcgtctataataatgaatattaaa

SEQ ID NO: 253559 - DNA, 75 bp, Artificial Sequence
  Synthetic
aaagatgttagattagttaatgggaatcgtctataataatgaatattaaacaattataggaggaatttataccta

SEQ ID NO: 253560 - DNA, 75 bp, Artificial Sequence
  Synthetic
cgtccgatttatgttttaaatatactaacattactaccttcagaaattatatacgaaatattatacatgctgaca

SEQ ID NO: 253561 - DNA, 75 bp, Artificial Sequence
  Synthetic
taacattactaccttcagaaattatatacgaaatattatacatgctgacaattaacgatctttataatatatagt

SEQ ID NO: 253562 - DNA, 75 bp, Artificial Sequence
  Synthetic
ttttttctcatgtgatgtgtgtaaaaaactgatattatataattatcttagtacctatgatgaagatgaagatga

SEQ ID NO: 253563 - DNA, 75 bp, Artificial Sequence
  Synthetic
tggtccgtatatattttgtatcattatcgttattgctattccatagttacgccatagacatcgaaaatgaaatca

SEQ ID NO: 253564 - DNA, 75 bp, Artificial Sequence
  Synthetic
gccatagacatcgaaaatgaaatcaccgaattcttcaataaaatgagagatactctaccagctaaagactctaaa

SEQ ID NO: 253565 - DNA, 75 bp, Artificial Sequence
  Synthetic
ccgaattcttcaataaaatgagagatactctaccagctaaagactctaaatggttgaatccagtatgtatgtttg

SEQ ID NO: 253566 - DNA, 75 bp, Artificial Sequence
  Synthetic
tctaggagagccattcagtgcaaagtgtcctcctattgaagacagtcttttatcgcatagatataaagactatgt

SEQ ID NO: 253567 - DNA, 75 bp, Artificial Sequence
  Synthetic
tgtcctcctattgaagacagtcttttatcgcatagatataaagactatgtggttaaatgggaaaggctagaaaag

SEQ ID NO: 253568 - DNA, 75 bp, Artificial Sequence
  Synthetic
aacgtgtcaaacatggtgatttatggatagccaactatacatctaaattcagtaaccgtaggtatttatgtaccg

SEQ ID NO: 253569 - DNA, 75 bp, Artificial Sequence
  Synthetic
gatagccaactatacatctaaattcagtaaccgtaggtatttatgtaccgtaaccacaaagaatggtgactgtgt

SEQ ID NO: 253570 - DNA, 75 bp, Artificial Sequence
  Synthetic
tggaaaccttcttcatgcattccaaaaacatatgaactaggtacttatgataagtatggcatagacttatactgt

SEQ ID NO: 253571 - DNA, 75 bp, Artificial Sequence
  Synthetic
aaacatatgaactaggtacttatgataagtatggcatagacttatactgtggaattctttatgcgaaacattata

SEQ ID NO: 253572 - DNA, 75 bp, Artificial Sequence
  Synthetic
taaggaaattaatatcgacgattttaagtattcacaagcgggaaaggaattaattattcataatccagagttaga

SEQ ID NO: 253573 - DNA, 75 bp, Artificial Sequence
  Synthetic
attagcatcgtttaacacaatattacgaaatattttgagactcatcaacaatgaaaactttaaatacttaacaga

SEQ ID NO: 253574 - DNA, 75 bp, Artificial Sequence
  Synthetic
aagtattcacaagcgggaaaggaattaattattcataatccagagttagaagatagtggaagatacgactgttac

SEQ ID NO: 253575 - DNA, 75 bp, Artificial Sequence
  Synthetic
agaatgatatcgtagtatcaagatgtaaaatacttacggttataccgtcacaagaccacaggtttaaactaatac

SEQ ID NO: 253576 - DNA, 75 bp, Artificial Sequence
  Synthetic
taaaatacttacggttataccgtcacaagaccacaggtttaaactaatactagatccgaaaatcaacgtaacgat

SEQ ID NO: 253577 - DNA, 75 bp, Artificial Sequence
  Synthetic
agtgctgtgtcaacgtcattatttgtcgacgatgtactgattgaatgggaaaatccatccggatggattatagga

SEQ ID NO: 253578 - DNA, 75 bp, Artificial Sequence
  Synthetic
tcgacgatgtactgattgaatgggaaaatccatccggatggattataggattagattttggtgtatactctattt

SEQ ID NO: 253579 - DNA, 75 bp, Artificial Sequence
  Synthetic
ggcgactttgtattttgaaaatgttactgaagaatatataggcaatacatatacatgtcgtggacacaactatta

SEQ ID NO: 253580 - DNA, 75 bp, Artificial Sequence
  Synthetic
atacatgtcgtggacacaactattattttgataaaactcttacaactacagtagtattggagtaaatacacaatg

SEQ ID NO: 253581 - DNA, 75 bp, Artificial Sequence
  Synthetic
ttattattaattatatcgtatttgtgctatagaatggatgaagatacgcgactatctaggtatttgtatctcacc

SEQ ID NO: 253582 - DNA, 75 bp, Artificial Sequence
  Synthetic
gctatagaatggatgaagatacgcgactatctaggtatttgtatctcaccgatagagaacatataaatgtagact

SEQ ID NO: 253583 - DNA, 75 bp, Artificial Sequence
  Synthetic
agatcctaatgcatgttatagatgtggatgtacggctttacatgagtacttttataattatagatcagtcaacgg

SEQ ID NO: 253584 - DNA, 75 bp, Artificial Sequence
  Synthetic
tttataattatagatcagtcaacggaaaatacaagtatagatacaacggttactatcaatattattcatctagcg

SEQ ID NO: 253585 - DNA, 75 bp, Artificial Sequence
  Synthetic
ttatgatgattatgatagaactggtatgaacagtgagagtgataatatatcaatcaaaacagaatatgagaatga

SEQ ID NO: 253586 - DNA, 75 bp, Artificial Sequence
  Synthetic
atgaacagtgagagtgataatatatcaatcaaaacagaatatgagaatgaatatgaattctatgatgaaacacaa

SEQ ID NO: 253587 - DNA, 75 bp, Artificial Sequence
  Synthetic
acgacattaaactcaaaaccaatgaggatgattttgttgatgaattctatggttatgatagatcagtgggtgtcc

SEQ ID NO: 253588 - DNA, 75 bp, Artificial Sequence
  Synthetic
ggatgattttgttgatgaattctatggttatgatagatcagtgggtgtccatgattatatagatgtatcaattaa

SEQ ID NO: 253589 - DNA, 75 bp, Artificial Sequence
  Synthetic
cacgtaagatggcgggatatatggcaagaacataatgatggcgtatacagtataggaaaggagtgcatagataat

SEQ ID NO: 253590 - DNA, 75 bp, Artificial Sequence
  Synthetic
aagaacataatgatggcgtatacagtataggaaaggagtgcatagataatatatacgaagacagacataccgtag

SEQ ID NO: 253591 - DNA, 75 bp, Artificial Sequence
  Synthetic
atagcgaagattgtataatttatctcagatctttagttagaagaatggaagacagtaacaaaaacagtaaaaaaa

SEQ ID NO: 253592 - DNA, 75 bp, Artificial Sequence
  Synthetic
atcagatgtagatgacgcagaacatatatctcagataactaatgatgtatctacacaaacatgggaaaagaaatc

SEQ ID NO: 253593 - DNA, 75 bp, Artificial Sequence
  Synthetic
atatctcagataactaatgatgtatctacacaaacatgggaaaagaaatcagagttagatagatacatggaaatg

SEQ ID NO: 253594 - DNA, 75 bp, Artificial Sequence
  Synthetic
attctgtctttaagggattttctgacaaagttagaaaaaatgatttagacatgaatgtggtaaaagaattacttt

SEQ ID NO: 253595 - DNA, 75 bp, Artificial Sequence
  Synthetic
caaagttagaaaaaatgatttagacatgaatgtggtaaaagaattactttctaacggtgcatctctaacaatcaa

SEQ ID NO: 253596 - DNA, 75 bp, Artificial Sequence
  Synthetic
gctgtttattttagaagaacaataatgaatttagaaatgattgatatcattaacaaacatacaactatctatgaa

SEQ ID NO: 253597 - DNA, 75 bp, Artificial Sequence
  Synthetic
taaaaaattatagaaatttcgattatccatttttcagaaagttagttttgactaataaacattgtctcaataatt

SEQ ID NO: 253598 - DNA, 75 bp, Artificial Sequence
  Synthetic
agtatatcttaacgaaagaagttgtcatcgttagtgtggtaaatcattgtctacggtactagatcctcataagtg

SEQ ID NO: 253599 - DNA, 75 bp, Artificial Sequence
  Synthetic
tggaacaccactacatatattagcatctaataaaaaaataataactcctaattacatgaagttattagtgtataa

SEQ ID NO: 253600 - DNA, 75 bp, Artificial Sequence
  Synthetic
tctaataaaaaaataataactcctaattacatgaagttattagtgtataacggaaatgatataaacgcacgaggt

SEQ ID NO: 253601 - DNA, 75 bp, Artificial Sequence
  Synthetic
tacacaaatatttgtgtaaatttgtatatcataatattgaatatggtatccgatactataatgaaaagattatag

SEQ ID NO: 253602 - DNA, 75 bp, Artificial Sequence
  Synthetic
atatcataatattgaatatggtatccgatactataatgaaaagattatagacgcatttatagagttaggagccga

SEQ ID NO: 253603 - DNA, 75 bp, Artificial Sequence
  Synthetic
atgataccagtagtttactgtatacactcaaatgccgaatatggttataacaatattactaacataaagataata

SEQ ID NO: 253604 - DNA, 75 bp, Artificial Sequence
  Synthetic
actcaaatgccgaatatggttataacaatattactaacataaagataatacgtaaactacttaatcttagtagac

SEQ ID NO: 253605 - DNA, 75 bp, Artificial Sequence
  Synthetic
tcgagtcatgcacgattatataagtaatacatatattgatcttgagtgtttagatatcattagatcactggatgg

SEQ ID NO: 253606 - DNA, 75 bp, Artificial Sequence
  Synthetic
aatacatatattgatcttgagtgtttagatatcattagatcactggatgggtacgatattaattgttactttgaa

SEQ ID NO: 253607 - DNA, 75 bp, Artificial Sequence
  Synthetic
tacaatataacttcactcagattgctgagtacttattagatcgaggagctgatatatcattaaagacagacgatg

SEQ ID NO: 253608 - DNA, 75 bp, Artificial Sequence
  Synthetic
tgagtacttattagatcgaggagctgatatatcattaaagacagacgatggtaaaactgtatttgatttatcgtt

SEQ ID NO: 253609 - DNA, 75 bp, Artificial Sequence
  Synthetic
actagctttttgattagtcgtctaccgcctaaaagtgtcatatgctcactgactaaccatataatagattatgtt

SEQ ID NO: 253610 - DNA, 75 bp, Artificial Sequence
  Synthetic
cgcctaaaagtgtcatatgctcactgactaaccatataatagattatgttcttacgaacaatagacgtattattt

SEQ ID NO: 253611 - DNA, 75 bp, Artificial Sequence
  Synthetic
cgtactgttactggacccatccttttattatagattcagaaatgctatcgaaaacaaattagaccaatacaataa

SEQ ID NO: 253612 - DNA, 75 bp, Artificial Sequence
  Synthetic
tattatagattcagaaatgctatcgaaaacaaattagaccaatacaataatcgttataatatgttcgaacacgat

SEQ ID NO: 253613 - DNA, 75 bp, Artificial Sequence
  Synthetic
aagtcttacatgacctcgatacatatatcaaggatgtacaagtattaaaatctacttccatcactaataatataa

SEQ ID NO: 253614 - DNA, 75 bp, Artificial Sequence
  Synthetic
tatcaaggatgtacaagtattaaaatctacttccatcactaataatataacactatacgacactattataaataa

SEQ ID NO: 253615 - DNA, 75 bp, Artificial Sequence
  Synthetic
gcaaacgacaaacaattaattaatctcataaaatccaatacatatcataatcttatcgaaaaagttattaaaaat

SEQ ID NO: 253616 - DNA, 75 bp, Artificial Sequence
  Synthetic
tcttatcgaaaaagttattaaaaatacattagagaaatatactttaactaatatagtcctcgagtatatgatctc

SEQ ID NO: 253617 - DNA, 75 bp, Artificial Sequence
  Synthetic
tatttgagtcgtattcctaatgagatattactcgaaatattatataaactcgacatgtacgatttacgtaatcta

SEQ ID NO: 253618 - DNA, 75 bp, Artificial Sequence
  Synthetic
tatacaagatatatgagagagaatgatatcacagagtatcatatagagaatacgaggtctgtttctacacagaca

SEQ ID NO: 253619 - DNA, 75 bp, Artificial Sequence
  Synthetic
ttttttttaatcttagatataacactaattacatcaagattatatattgaaatcgtaatttgagttgtctgatca

SEQ ID NO: 253620 - DNA, 75 bp, Artificial Sequence
  Synthetic
taattacatcaagattatatattgaaatcgtaatttgagttgtctgatcatcatggatatcgaaaatgatatacg

SEQ ID NO: 253621 - DNA, 75 bp, Artificial Sequence
  Synthetic
attgatatattattatgcgatgtaatcataactatcggagatgtagaaattaaagcgcataaaactattttggct

SEQ ID NO: 253622 - DNA, 75 bp, Artificial Sequence
  Synthetic
cctgaatgtgtttaaaaaattatacggagacgccgtaataatttccccattgatagaaaatatcacgctttccat

SEQ ID NO: 253623 - DNA, 75 bp, Artificial Sequence
  Synthetic
gccggatctacgtattttaaaacaatgttcacaacacctatgatagcgagagatctagcaactagagtaaatcta

SEQ ID NO: 253624 - DNA, 75 bp, Artificial Sequence
  Synthetic
tcatattataatacacaagaattaaagtgttgtaaactatctaagccaggaacatattcagatcatcgatgtgat

SEQ ID NO: 253625 - DNA, 75 bp, Artificial Sequence
  Synthetic
aaatattgtacagtacttatacaataggtatataagttctatgaatgtgatagacgtattaaaatgcaccgacta

SEQ ID NO: 253626 - DNA, 75 bp, Artificial Sequence
  Synthetic
agaacgtagaacgaactatagaatgttatacaatgggtgatgataagtagaagatgttacccgatatacccatag

SEQ ID NO: 253627 - DNA, 75 bp, Artificial Sequence
  Synthetic
ttagatcaatacatatacattataggcggtcgtacccaacactgattatacatcggtacatacagtaaatagcat

SEQ ID NO: 253628 - DNA, 75 bp, Artificial Sequence
  Synthetic
agatatggaggaggatacaaatatttcaaataaagttatgagatacgcactgtcaataatatatggaagacatta

SEQ ID NO: 253629 - DNA, 75 bp, Artificial Sequence
  Synthetic
atccaggctcttgcataaagatgaatatatatgttgtatgcgacatcaaagatgaaaaaatgttaagacttatat

SEQ ID NO: 253630 - DNA, 75 bp, Artificial Sequence
  Synthetic
tatatatgttgtatgcgacatcaaagatgaaaaaatgttaagacttatatatttagatataacacgaatatgtat

SEQ ID NO: 253631 - DNA, 75 bp, Artificial Sequence
  Synthetic
cagaaagcagattgtcagctctgcatactattcttcatgacaataccataatgatgttacattgttatgaaacgt

SEQ ID NO: 253632 - DNA, 75 bp, Artificial Sequence
  Synthetic
tactattcttcatgacaataccataatgatgttacattgttatgaaacgtatatgttacaagatacatttaatgt

SEQ ID NO: 253633 - DNA, 75 bp, Artificial Sequence
  Synthetic
ttggcatcaatgttcggatctataggcttgattttcgcattgactttacacagacataaacatcccctgaatctg

SEQ ID NO: 253634 - DNA, 75 bp, Artificial Sequence
  Synthetic
tacattatatacattatatacattatatacattatatacattatatacattatatacattatatacattatatac

SEQ ID NO: 253635 - DNA, 75 bp, Artificial Sequence
  Synthetic
aaacctctttctgatggtctctataaacgattgatttttcttaccctctagagtttcctacggtcgtgggtcaca

SEQ ID NO: 253636 - DNA, 75 bp, Artificial Sequence
  Synthetic
tacagctgaacaactatcaaaatatatagagaatatgaatgagaatacacccgatgataagaaggatgacaataa

SEQ ID NO: 253637 - DNA, 75 bp, Artificial Sequence
  Synthetic
atagagaatatgaatgagaatacacccgatgataagaaggatgacaataatgacatggacgtagatattccgtat

SEQ ID NO: 253638 - DNA, 75 bp, Artificial Sequence
  Synthetic
aaatatacggtagtgatagtatcgagttccatgcctccttcctacaaaaaataaaagacgattttcaaactgtaa

SEQ ID NO: 253639 - DNA, 75 bp, Artificial Sequence
  Synthetic
ataaaagacgattttcaaactgtaaactttaataatgctaaccaaacaaaggaactaatcaacgaatgggttaag

SEQ ID NO: 253640 - DNA, 75 bp, Artificial Sequence
  Synthetic
ttcacaatggcctttccttgtgcccagttcagtccctgtcattgccacgctactaaggactccctgaataccgtg

SEQ ID NO: 253641 - DNA, 75 bp, Artificial Sequence
  Synthetic
acaatgacaaatggtaaaattaattccttattgactagtccgctatccattaatactcgtatgacagttattagc

SEQ ID NO: 253642 - DNA, 75 bp, Artificial Sequence
  Synthetic
ttacagatctgatgaccgacgataatataaacatcttgatactttttctagaaaaaaaaatgaattgatgatata

SEQ ID NO: 253643 - DNA, 75 bp, Artificial Sequence
  Synthetic
ccttattgactagtccgctatccattaatactcgtatgacagttattagcgccgtccattttaaagcaatgtgga

SEQ ID NO: 253644 - DNA, 75 bp, Artificial Sequence
  Synthetic
tatatatatatatatatatatatatatgggcaaaacatataacgtaaccagaattataaaattagaggtacggga

SEQ ID NO: 253645 - DNA, 75 bp, Artificial Sequence
  Synthetic
atatacagacaagttttatatttctaagaatatagttaccagtgttgatatgatggtgggtaccgagaatgactt

SEQ ID NO: 253646 - DNA, 75 bp, Artificial Sequence
  Synthetic
aagaatatagttaccagtgttgatatgatggtgggtaccgagaatgacttgcaatatgtacatattaatgaatta

SEQ ID NO: 253647 - DNA, 75 bp, Artificial Sequence
  Synthetic
tagagtatcgttgagacttcccacaacggacaccgacgtcttttggataagtaatggtatatgtattacgaagaa

SEQ ID NO: 253648 - DNA, 75 bp, Artificial Sequence
  Synthetic
ttccatacgagggaaactctagtatggtgattatactgccggacgacatagaaggtatatataacatagaaaaaa

SEQ ID NO: 253649 - DNA, 75 bp, Artificial Sequence
  Synthetic
ggtgattatactgccggacgacatagaaggtatatataacatagaaaaaaatataacagatgaaaaatttaaaaa

SEQ ID NO: 253650 - DNA, 75 bp, Artificial Sequence
  Synthetic
ctatctcaccctcttggatcatatcctcactgctaaatactaaatctccttcatgctctctcactaatactctta

SEQ ID NO: 253651 - DNA, 75 bp, Artificial Sequence
  Synthetic
agtatagacttgtatatgccaaagtttaaagtggaaatgacggaaccgtataatctggtaccgattctagaaaat

SEQ ID NO: 253652 - DNA, 75 bp, Artificial Sequence
  Synthetic
ccatatcaattgagtttataagaattttttatacattatcttccaacaaacaattgacgaacgtattgctatgat

SEQ ID NO: 253653 - DNA, 75 bp, Artificial Sequence
  Synthetic
attatgcagattttagtaagatgtgtaatgaaactatcactgtagaaaaatttctacatacggcgtttatagatg

SEQ ID NO: 253654 - DNA, 75 bp, Artificial Sequence
  Synthetic
ggccgttacaggagtattcatgactaacttttcgatggtatatcgtatgaaggtctacataaaccatccattcat

SEQ ID NO: 253655 - DNA, 75 bp, Artificial Sequence
  Synthetic
aacttttcgatggtatatcgtatgaaggtctacataaaccatccattcatatacatgattaaagataacaccgga

SEQ ID NO: 253656 - DNA, 75 bp, Artificial Sequence
  Synthetic
gctatccgcaataaatataaacaatagacttttatcacgttatctcatgtataaaatattacaaatagtatagca

SEQ ID NO: 253657 - DNA, 75 bp, Artificial Sequence
  Synthetic
ttataagtaatatcaaaatgacgatatacggattaatagcgtatcttgtattcgtgacttcatccatcgctagtc

SEQ ID NO: 253658 - DNA, 75 bp, Artificial Sequence
  Synthetic
ttcgtgacttcatccatcgctagtccattttacattcccgttattccgcccatttcggaagataaatcgttcaat

SEQ ID NO: 253659 - DNA, 75 bp, Artificial Sequence
  Synthetic
agtgtagaggtattagtttctttgtttcccgatgaccaaaaagactatacagtaacttctcagttcaataactac

SEQ ID NO: 253660 - DNA, 75 bp, Artificial Sequence
  Synthetic
ttcccgatgaccaaaaagactatacagtaacttctcagttcaataactacactatcggtaccaaagactggacta

SEQ ID NO: 253661 - DNA, 75 bp, Artificial Sequence
  Synthetic
tctggacataccattgactaatataacttattggtcacggtttactataggtcgtgcattgttcaaatcagagtc

SEQ ID NO: 253662 - DNA, 75 bp, Artificial Sequence
  Synthetic
acttattggtcacggtttactataggtcgtgcattgttcaaatcagagtctgaggatattttccaaaagaaaatg

SEQ ID NO: 253663 - DNA, 75 bp, Artificial Sequence
  Synthetic
gtaagaagccgtcgacattacttacttttttaaccgtgcgtaaaatgactcgagtatttaatagatttccagata

SEQ ID NO: 253664 - DNA, 75 bp, Artificial Sequence
  Synthetic
aactaatacagcagatatattgctggacaattatccaattatgacctttgatggaaaggatatttatccatctat

SEQ ID NO: 253665 - DNA, 75 bp, Artificial Sequence
  Synthetic
ttttttaaccgtgcgtaaaatgactcgagtatttaatagatttccagatatggcttattatcgaggagactgtct

SEQ ID NO: 253666 - DNA, 75 bp, Artificial Sequence
  Synthetic
tataaaaatactaaaactggagagactgattacacgtacctctctaatggggggttgcctgcatactatcgtaat

SEQ ID NO: 253667 - DNA, 75 bp, Artificial Sequence
  Synthetic
ctgattacacgtacctctctaatggggggttgcctgcatactatcgtaatggggtcgatggttgattattgatta

SEQ ID NO: 253668 - DNA, 75 bp, Artificial Sequence
  Synthetic
cacaaaaagaacatttttataaacatgaaaccactgtctaaatgtaattatgatcttgatttatagatgatgatc

SEQ ID NO: 253669 - DNA, 75 bp, Artificial Sequence
  Synthetic
gaatttacagaaattatctctggctatatatcttacggtgacatgttcgtggtgttatgaaacatgtatgagaaa

SEQ ID NO: 253670 - DNA, 75 bp, Artificial Sequence
  Synthetic
atatatcttacggtgacatgttcgtggtgttatgaaacatgtatgagaaaaactgcgttgtatcatgacattcaa

SEQ ID NO: 253671 - DNA, 75 bp, Artificial Sequence
  Synthetic
atagtgtagcatcgctaccgtacaagtatctacaagtagtcaaacaaagagaacgtagtagattgttggctacat

SEQ ID NO: 253672 - DNA, 75 bp, Artificial Sequence
  Synthetic
gtatctacaagtagtcaaacaaagagaacgtagtagattgttggctacatttaattggacggatatagctgaggg

SEQ ID NO: 253673 - DNA, 75 bp, Artificial Sequence
  Synthetic
tgtgatatcaacggaacatatctatataattatactattgatgttagtataattattgattccacggaagaacta

SEQ ID NO: 253674 - DNA, 75 bp, Artificial Sequence
  Synthetic
ataattatactattgatgttagtataattattgattccacggaagaactaccaacagttactccaattacaacat

SEQ ID NO: 253675 - DNA, 75 bp, Artificial Sequence
  Synthetic
atgaaaatccgaaatattaaaccagacaaccccatataattttatagctaagaatgccgcgaagaatggaactaa

SEQ ID NO: 253676 - DNA, 75 bp, Artificial Sequence
  Synthetic
tatcgattatagcactgttattactactgaagaactacaagtgactccaacatatgcgcctgtaacaactcctct

SEQ ID NO: 253677 - DNA, 75 bp, Artificial Sequence
  Synthetic
actgaagaactacaagtgactccaacatatgcgcctgtaacaactcctcttccaacatcagcagttccttatgat

SEQ ID NO: 253678 - DNA, 75 bp, Artificial Sequence
  Synthetic
ctatatctattcagatactgagtaaaatattgggagtcaatgaaacagaattaactaattatcttattatgcata

SEQ ID NO: 253679 - DNA, 75 bp, Artificial Sequence
  Synthetic
ttaactaattatcttattatgcataaaaatgacactgttgacaataacaccatggttgatgatgagacatctgac

SEQ ID NO: 253680 - DNA, 75 bp, Artificial Sequence
  Synthetic
gatttttggaaataaataattgttacaatgtttctgtgtcagatgctagttttagaataacattagtaaacgata

SEQ ID NO: 253681 - DNA, 75 bp, Artificial Sequence
  Synthetic
caatgtttctgtgtcagatgctagttttagaataacattagtaaacgatacttctgaagaaattttgctaatgct

SEQ ID NO: 253682 - DNA, 75 bp, Artificial Sequence
  Synthetic
ttcatatcttccaccaatatcactgaatgtttgaaaacattaatcaataatgtgtcgattaatgatgtacttata

SEQ ID NO: 253683 - DNA, 75 bp, Artificial Sequence
  Synthetic
aatgtttgaaaacattaatcaataatgtgtcgattaatgatgtacttataacacaaaatatgaatgtaacatcta

SEQ ID NO: 253684 - DNA, 75 bp, Artificial Sequence
  Synthetic
gatggcatccgttattcctgcagttaatgaatttaacaatacgttgatgaaaattggtgtaaaagatgatgaaaa

SEQ ID NO: 253685 - DNA, 75 bp, Artificial Sequence
  Synthetic
tgtaaactaactacaaattctacatgtgatgagttaatcaatttagatgaagtcattaacaacataactctgaca

SEQ ID NO: 253686 - DNA, 75 bp, Artificial Sequence
  Synthetic
gtgatgagttaatcaatttagatgaagtcattaacaacataactctgacaaatattatacgcaatagtgtttcga

SEQ ID NO: 253687 - DNA, 75 bp, Artificial Sequence
  Synthetic
agtcattaacaacataactctgacaaatattatacgcaatagtgtttcgacaactaacagcagaaaaagacgaga

SEQ ID NO: 253688 - DNA, 75 bp, Artificial Sequence
  Synthetic
acttccaaggaattagattgtctttacgaatcatatggtgtaaacgatgatataagtcattgttttgcatcacct

SEQ ID NO: 253689 - DNA, 75 bp, Artificial Sequence
  Synthetic
tagactgtttatacaagattgaaattatattcttttttttatagagtgtggggtagtgttacggatatctgatat

SEQ ID NO: 253690 - DNA, 75 bp, Artificial Sequence
  Synthetic
acgaatcatatggtgtaaacgatgatataagtcattgttttgcatcacctagacgtagacgatctgacgacaaaa

SEQ ID NO: 253691 - DNA, 75 bp, Artificial Sequence
  Synthetic
cgaccacgcgaaaaaagatttaggaatagacagtgttattcctagaggtacaacccatttccaagtaggtgcatc

SEQ ID NO: 253692 - DNA, 75 bp, Artificial Sequence
  Synthetic
aaaaataatgcctagagtacctattactgctaccgaagctgatctatatgcaactgtaaatagacaacccaagtt

SEQ ID NO: 253693 - DNA, 75 bp, Artificial Sequence
  Synthetic
actgctaccgaagctgatctatatgcaactgtaaatagacaacccaagttaccagcaggtgttaaaagtactccg

SEQ ID NO: 253694 - DNA, 75 bp, Artificial Sequence
  Synthetic
taaaccaaaagctttctaatgttagagaggtaacttatgcttcgctcaatctgccaggatcaagtggctatgttc

SEQ ID NO: 253695 - DNA, 75 bp, Artificial Sequence
  Synthetic
agaggtaacttatgcttcgctcaatctgccaggatcaagtggctatgttcatagaccatctgattctgttattta

SEQ ID NO: 253696 - DNA, 75 bp, Artificial Sequence
  Synthetic
cctagtgatagcgatagtgattatgaggatatacaaactgttgttaaggaatataatgaaagatatggtagatca

SEQ ID NO: 253697 - DNA, 75 bp, Artificial Sequence
  Synthetic
aggatatacaaactgttgttaaggaatataatgaaagatatggtagatcagtcagtagaacacagtcatcaagta

SEQ ID NO: 253698 - DNA, 75 bp, Artificial Sequence
  Synthetic
tactgttgttagggaatatagacaaaaatatggcaatgcaatggcaaaaggacgtagtagttcccctaaacctga

SEQ ID NO: 253699 - DNA, 75 bp, Artificial Sequence
  Synthetic
acaactaaaagtctatctactggtgtagacatagttacaaaacaatcagactattctctattacctgacgttaat

SEQ ID NO: 253700 - DNA, 75 bp, Artificial Sequence
  Synthetic
tcaccagaaaaggagctactagacgacgacctagacgccctacaaatgatggtctacagagtccaaatcctcctc

SEQ ID NO: 253701 - DNA, 75 bp, Artificial Sequence
  Synthetic
cctcctatagatcaaccagataaaggatttagtaagtttgtatcacctagacggtgtagaagagcaagctctgga

SEQ ID NO: 253702 - DNA, 75 bp, Artificial Sequence
  Synthetic
acggtgtagaagagcaagctctggagtcatatgtggtatgatacaatcaaaaccaaacgatgatacctattcact

SEQ ID NO: 253703 - DNA, 75 bp, Artificial Sequence
  Synthetic
gaatatgcggaggttggtaatggtatacccaagaacaatgttcctgtaataggtaataaacatagtaaaaaatat

SEQ ID NO: 253704 - DNA, 75 bp, Artificial Sequence
  Synthetic
tacccaagaacaatgttcctgtaataggtaataaacatagtaaaaaatatacatcgacgatgtcaaaaatatcaa

SEQ ID NO: 253705 - DNA, 75 bp, Artificial Sequence
  Synthetic
tggagcagcaatgttactaactggtcagcaggccattagccaacagactagatcaactacgttgagtagaaaaga

SEQ ID NO: 253706 - DNA, 75 bp, Artificial Sequence
  Synthetic
cagcaggccattagccaacagactagatcaactacgttgagtagaaaagatcagatgagcaaggaagaaaagata

SEQ ID NO: 253707 - DNA, 75 bp, Artificial Sequence
  Synthetic
taccacataattatataatgtataaatgcgaaccggttaaacatagatatccattggaaaaaacacagtacacga

SEQ ID NO: 253708 - DNA, 75 bp, Artificial Sequence
  Synthetic
caactataggttcaacgttgacgtctgcaggtatgacgggtggtccaaaactaatgattgcaggaatggctataa

SEQ ID NO: 253709 - DNA, 75 bp, Artificial Sequence
  Synthetic
tgcaggtatgacgggtggtccaaaactaatgattgcaggaatggctataacggctataactggtataatagatac

SEQ ID NO: 253710 - DNA, 75 bp, Artificial Sequence
  Synthetic
tcaggacaggagaggccagtagatcctgttattaaattatttaataagtacgctggcttaatgtccgataataat

SEQ ID NO: 253711 - DNA, 75 bp, Artificial Sequence
  Synthetic
ctgttattaaattatttaataagtacgctggcttaatgtccgataataataaaatgggtgtaagaaaatgtttga

SEQ ID NO: 253712 - DNA, 75 bp, Artificial Sequence
  Synthetic
tatcgcatacagaaacgataccagttttaaacagaatacggatgcgatggctttgtatttcttagatgttatcga

SEQ ID NO: 253713 - DNA, 75 bp, Artificial Sequence
  Synthetic
tttaaacagaatacggatgcgatggctttgtatttcttagatgttatcgactcagagatcctatatctaaacaca

SEQ ID NO: 253714 - DNA, 75 bp, Artificial Sequence
  Synthetic
taaaggtggcttgccccataggaacattaagatctgtagatgtggacataactgcgtatacaatattatatgata

SEQ ID NO: 253715 - DNA, 75 bp, Artificial Sequence
  Synthetic
attaagatctgtagatgtggacataactgcgtatacaatattatatgatacagcggataatattaagaaatacaa

SEQ ID NO: 253716 - DNA, 75 bp, Artificial Sequence
  Synthetic
tccaaacatccagttattagattgacatgtggtttagcagcaacattggtgattaaaccgtacgaggtacccatc

SEQ ID NO: 253717 - DNA, 75 bp, Artificial Sequence
  Synthetic
catgtggtttagcagcaacattggtgattaaaccgtacgaggtacccatcagtgatatgcaactactaaaaatgg

SEQ ID NO: 253718 - DNA, 75 bp, Artificial Sequence
  Synthetic
taaatctataccatccgatgtctgtgataggtatcctctaaagaaattctatcttttagctggtggttgtcccta

SEQ ID NO: 253719 - DNA, 75 bp, Artificial Sequence
  Synthetic
gataggtatcctctaaagaaattctatcttttagctggtggttgtccctatgatacatctcaaacttttattgta

SEQ ID NO: 253720 - DNA, 75 bp, Artificial Sequence
  Synthetic
gaacagctacacgggatcagtttagaaacagatgggtgttacaaaatccatttagacaagaagggacatataagc

SEQ ID NO: 253721 - DNA, 75 bp, Artificial Sequence
  Synthetic
aaacagatgggtgttacaaaatccatttagacaagaagggacatataagcaactgtttacctttagcaaatacga

SEQ ID NO: 253722 - DNA, 75 bp, Artificial Sequence
  Synthetic
aatggtgtggtgggtcatgctagcttttgtaccaatagaagcagcaaccaatgtttctggtccgaacctatgata

SEQ ID NO: 253723 - DNA, 75 bp, Artificial Sequence
  Synthetic
cctggaattattaccatagaagatgttagaaaaaatgatgctggttattatacatgtgttttagaatatatatat

SEQ ID NO: 253724 - DNA, 75 bp, Artificial Sequence
  Synthetic
tttgtaccaatagaagcagcaaccaatgtttctggtccgaacctatgatattggaagatgtatcatcgtgtagtt

SEQ ID NO: 253725 - DNA, 75 bp, Artificial Sequence
  Synthetic
actgggaatatttaatgccgaaggttttaatagttttgtactaaattgtccaactgggtctacacctacatacat

SEQ ID NO: 253726 - DNA, 75 bp, Artificial Sequence
  Synthetic
tttaatagttttgtactaaattgtccaactgggtctacacctacatacatcaaacataaaaatgcggacagtaac

SEQ ID NO: 253727 - DNA, 75 bp, Artificial Sequence
  Synthetic
gtgattacggcacagccaaattgtattcagcaacaaaaccatcgaggatagctgtgttctgcacacataactatg

SEQ ID NO: 253728 - DNA, 75 bp, Artificial Sequence
  Synthetic
ttcagcaacaaaaccatcgaggatagctgtgttctgcacacataactatgataaacgattcaaatcagatattat

SEQ ID NO: 253729 - DNA, 75 bp, Artificial Sequence
  Synthetic
ggtattccattttggagcatgtacacaggaagtgtaactagtaaaaatagaatgtttaccacattggctagagga

SEQ ID NO: 253730 - DNA, 75 bp, Artificial Sequence
  Synthetic
gaagaagatgctacaacgtttacgtgtatggcgtttactattcctagcatcagcaaaacagttactgttagtata

SEQ ID NO: 253731 - DNA, 75 bp, Artificial Sequence
  Synthetic
caggaagtgtaactagtaaaaatagaatgtttaccacattggctagaggaatgccgtttagatcaacgtattgcg

SEQ ID NO: 253732 - DNA, 75 bp, Artificial Sequence
  Synthetic
attttttataattatgtacatgttttccttctcaagagtctacaaaaatatattttttttcgatatctaagtact

SEQ ID NO: 253733 - DNA, 75 bp, Artificial Sequence
  Synthetic
ttatgcaggaataccatttcatgaagatagtgtagaaacagatatacattatggaccagaaataatgttaaagga

SEQ ID NO: 253734 - DNA, 75 bp, Artificial Sequence
  Synthetic
atcgaaccatttttgtagtctaaagcctgaagtaattaaccaactgtttttattagtggcttttttcgatctatc

SEQ ID NO: 253735 - DNA, 75 bp, Artificial Sequence
  Synthetic
gatagtgtagaaacagatatacattatggaccagaaataatgttaaaggaaacatatgacataaacagtattgac

SEQ ID NO: 253736 - DNA, 75 bp, Artificial Sequence
  Synthetic
cccattttcctgctccattgagtgtaaaattcatggttgacaatttaggaaatggatatgacaaccctaattcat

SEQ ID NO: 253737 - DNA, 75 bp, Artificial Sequence
  Synthetic
aaaattcatggttgacaatttaggaaatggatatgacaaccctaattcattttgggaagatgctaaaactaagaa

SEQ ID NO: 253738 - DNA, 75 bp, Artificial Sequence
  Synthetic
aaagtcctaccatgtacagtgagaaataaaaatatagactttggatataactatggagatattatttctaatatg

SEQ ID NO: 253739 - DNA, 75 bp, Artificial Sequence
  Synthetic
ataaaaatatagactttggatataactatggagatattatttctaatatggtttatctacaatctactagtcagg

SEQ ID NO: 253740 - DNA, 75 bp, Artificial Sequence
  Synthetic
atttaaatccgtaactagatcagatcatgagtgtgaatctagcttagatctgacgtctaaggaagtaactgtgac

SEQ ID NO: 253741 - DNA, 75 bp, Artificial Sequence
  Synthetic
catgagtgtgaatctagcttagatctgacgtctaaggaagtaactgtgacatgtcctgcgtttagtataccaaga

SEQ ID NO: 253742 - DNA, 75 bp, Artificial Sequence
  Synthetic
gctttagtgttactacatctaaagatcattgtgctacaggtattggttggttaaaatctagtggctatgggaagg

SEQ ID NO: 253743 - DNA, 75 bp, Artificial Sequence
  Synthetic
tcattgtgctacaggtattggttggttaaaatctagtggctatgggaaggaagatgctgataaaccacgtgcttg

SEQ ID NO: 253744 - DNA, 75 bp, Artificial Sequence
  Synthetic
ctgtcgttggattattactgttcatacgaagatatttggagaagcacctggcctgactatgatccatgtaagtca

SEQ ID NO: 253745 - DNA, 75 bp, Artificial Sequence
  Synthetic
acgaagatatttggagaagcacctggcctgactatgatccatgtaagtcatatatccatatagagtatagagata

SEQ ID NO: 253746 - DNA, 75 bp, Artificial Sequence
  Synthetic
gcaacctccttacacattcgaattcattcatgacaattctaacgaatatgtggataaagaaattagtaacaaatt

SEQ ID NO: 253747 - DNA, 75 bp, Artificial Sequence
  Synthetic
attcatgacaattctaacgaatatgtggataaagaaattagtaacaaattaaatgatctgtacaatgaatacaag

SEQ ID NO: 253748 - DNA, 75 bp, Artificial Sequence
  Synthetic
cattgccggcgtctataaacagattagcaaaggcattgacttcagagggtagagaaatagcaagtgttaatatag

SEQ ID NO: 253749 - DNA, 75 bp, Artificial Sequence
  Synthetic
agcaaaggcattgacttcagagggtagagaaatagcaagtgttaatatagatggtaatctgttagatatcgcata

SEQ ID NO: 253750 - DNA, 75 bp, Artificial Sequence
  Synthetic
gacatacagacaagaataaatgatattattagagatttgtttatacacactctatcagacaaagatataaaagac

SEQ ID NO: 253751 - DNA, 75 bp, Artificial Sequence
  Synthetic
tctatcagacaaagatataaaagacattatagaatccgaagaaggtaagagatgttgtataatagatgttaagaa

SEQ ID NO: 253752 - DNA, 75 bp, Artificial Sequence
  Synthetic
attgataattatctatgtggtactttagatgattatatatacacctctgtagaatataacaaatcctatgtgtta

SEQ ID NO: 253753 - DNA, 75 bp, Artificial Sequence
  Synthetic
tagatgattatatatacacctctgtagaatataacaaatcctatgtgttagtaaacgatacttatatgagctatg

SEQ ID NO: 253754 - DNA, 75 bp, Artificial Sequence
  Synthetic
tgttctatcatgttatgaaatgactataatctccttggatacaaaagacgccaaagatgctatagaagatgtgat

SEQ ID NO: 253755 - DNA, 75 bp, Artificial Sequence
  Synthetic
ataatctccttggatacaaaagacgccaaagatgctatagaagatgtgatagtagcaagtgcggtagccgaagca

SEQ ID NO: 253756 - DNA, 75 bp, Artificial Sequence
  Synthetic
ataaaaacgtaagtgctattataataaaagaagaagataattatctaaacagttcgcccgatatctaccatataa

SEQ ID NO: 253757 - DNA, 75 bp, Artificial Sequence
  Synthetic
aaaagaagaagataattatctaaacagttcgcccgatatctaccatataatatatatcataggtggcactattct

SEQ ID NO: 253758 - DNA, 75 bp, Artificial Sequence
  Synthetic
ttggcaatttatatagcgcgcaataaatacataaccaggaaatatgaaataatgaaatatgacaatatgagcatt

SEQ ID NO: 253759 - DNA, 75 bp, Artificial Sequence
  Synthetic
taatcggtactaataaaatagtttaactcttttagaaccagtttggtactgtaatttcagttcattactcgttga

SEQ ID NO: 253760 - DNA, 75 bp, Artificial Sequence
  Synthetic
gaatattgatgattttttttaaaatgagtatcggtagttacatattaccatatcatccattatataatcgatgat

SEQ ID NO: 253761 - DNA, 75 bp, Artificial Sequence
  Synthetic
gagtatcggtagttacatattaccatatcatccattatataatcgatgatgcatgtattaaaatactttccgaat

SEQ ID NO: 253762 - DNA, 75 bp, Artificial Sequence
  Synthetic
attcaaagatgtttaatgatacgatactagattttatctctagcgagattgtttagaatcatttatcataactat

SEQ ID NO: 253763 - DNA, 75 bp, Artificial Sequence
  Synthetic
cgataaagacctcttgtaattcgagtataggaagcagtattaccatatcaacttccgagttaacaattactctaa

SEQ ID NO: 253764 - DNA, 75 bp, Artificial Sequence
  Synthetic
tattggagattactattcagtcgttgataaactagtaacctcaggtttctttacaaacgataaagtacaacatca

SEQ ID NO: 253765 - DNA, 75 bp, Artificial Sequence
  Synthetic
agtttcctacggtcgtgggacacaaaaaaaaaaaaaaaaaaaaaaaaaaaaaaaaaaaaaaaattaattataaaa

SEQ ID NO: 253766 - DNA, 75 bp, Artificial Sequence
  Synthetic
aatctagaaatcaaatgtaattatggaggagaatctagacaactaacacccacggcgaagtatactttatgcctc

SEQ ID NO: 253767 - DNA, 75 bp, Artificial Sequence
  Synthetic
gaggagaatctagacaactaacacccacggcgaagtatactttatgcctcattcagaaacggtaactgtagtagg

SEQ ID NO: 253768 - DNA, 75 bp, Artificial Sequence
  Synthetic
cacggcgaagtatactttatgcctcattcagaaacggtaactgtagtaggagactgtctctctaatctcgatgta

SEQ ID NO: 253769 - DNA, 75 bp, Artificial Sequence
  Synthetic
aatgatatccgctattacaagagtacgttatactagagccaaagtctactccgccaatatcaagttggccattat

SEQ ID NO: 253770 - DNA, 75 bp, Artificial Sequence
  Synthetic
ggaaccagatagtttatatccatacttgcacttaaagtctacattgtagttgtatgagagtatgatctttctaga

SEQ ID NO: 253771 - DNA, 75 bp, Artificial Sequence
  Synthetic
cacgctctccaccttagaatttatttatccgtaaaatgttatcctggacatcgtacaaataataaaaagcccata

SEQ ID NO: 253772 - DNA, 75 bp, Artificial Sequence
  Synthetic
cgatatattccgacatgaatggcgtcgcttatcatatgttatatcctaaatgttgatcatattccacaaatgatt

SEQ ID NO: 253773 - DNA, 75 bp, Artificial Sequence
  Synthetic
aacagacgataagagcagcacaaactcattgagacattgaaactaggatatataaaatttaagtgaatgattagg

SEQ ID NO: 253774 - DNA, 75 bp, Artificial Sequence
  Synthetic
atcagacgataagagcagcacaaactcattgagacattgaaactaggatatataaaatttaagtgaatgattagg

SEQ ID NO: 253775 - DNA, 75 bp, Artificial Sequence
  Synthetic
accagacgataagagcagcacaaactcattgagacattgaaactaggatatataaaatttaagtgaatgattagg

SEQ ID NO: 253776 - DNA, 75 bp, Artificial Sequence
  Synthetic
agcagacgataagagcagcacaaactcattgagacattgaaactaggatatataaaatttaagtgaatgattagg

SEQ ID NO: 253777 - DNA, 75 bp, Artificial Sequence
  Synthetic
cgcttatcatatgttatatcctaaatgttgatcatattccacaaatgattgtgaacgagattaaatcatctaaca

SEQ ID NO: 253778 - DNA, 75 bp, Artificial Sequence; identical to SEQ ID NO: 45878
  Synthetic

SEQ ID NO: 253779 - DNA, 75 bp, Artificial Sequence
  Synthetic
atataataaataaattaatcattattgacttaacgatgacgaaagttatcatcatcttaggattcttgattatta

SEQ ID NO: 253780 - DNA, 75 bp, Artificial Sequence
  Synthetic
gatattatgatggatatgatggatatgataaatatgatagatatgataaatatgataaaaatataattgttgtat

SEQ ID NO: 253781 - DNA, 75 bp, Artificial Sequence
  Synthetic
tatcagaattgtcttccataggaagttgtatactatcggaatcagttacatgtttaaataattctctgatgtcat

SEQ ID NO: 253782 - DNA, 75 bp, Artificial Sequence
  Synthetic
gaggtcacaccttgtacacctaccacaaatagaatctgtcattgtgactcgaatagttatcgtctccttaaagct

SEQ ID NO: 253783 - DNA, 75 bp, Artificial Sequence
  Synthetic
caaatagaatctgtcattgtgactcgaatagttatcgtctccttaaagcttctgatggtaactgtgttacatgtg

SEQ ID NO: 253784 - DNA, 75 bp, Artificial Sequence
  Synthetic
gtacggaaagaaaggagaaaatgatatggaataccatttgtaagaaatgtcggaagggtacttattcagatattg

SEQ ID NO: 253785 - DNA, 75 bp, Artificial Sequence
  Synthetic
atatacactaattattaatatcaatcgagtattaacatataagttatttttaaaccccttttgggttccgtccta

SEQ ID NO: 253786 - DNA, 75 bp, Artificial Sequence
  Synthetic
catcccctgaatctgtacctactttgtggatttacactgttagaatctctaacgctggcctctgttgttactttc

SEQ ID NO: 253787 - DNA, 75 bp, Artificial Sequence
  Synthetic
caatcaaagagagatttcagtaaacttgtaacaggattgtttgctgctttctggattttaattttgtcaggagtc

SEQ ID NO: 253788 - DNA, 75 bp, Artificial Sequence
  Synthetic
ttgaggataaagtttaaaatagaattaataaagaacatataggtcattttttaaacatggatagaaaccaaggtt

SEQ ID NO: 253789 - DNA, 75 bp, Artificial Sequence
  Synthetic
ttttctcactctgatccatgtaaaccaaggacgagagacactctcattcctcattcacgacaccattaaaaatgg

SEQ ID NO: 253790 - DNA, 75 bp, Artificial Sequence
  Synthetic
ctgtcattgccacgctactaaggactccctgaataccgtgactgacgtcagacattgtctgactgaatacatcct

SEQ ID NO: 253791 - DNA, 75 bp, Artificial Sequence
  Synthetic
tccctgaataccgtgactgacgtcagacattgtctgactgaatacatcctgtgggtttctcatagatggacccat

SEQ ID NO: 253792 - DNA, 75 bp, Artificial Sequence
  Synthetic
ggcttctcatctctttcagaattgatgcaatggagctatttggtagcgagttgaaggagttctcggattcacttc

SEQ ID NO: 253793 - DNA, 75 bp, Artificial Sequence
  Synthetic
tgcaatggagctatttggtagcgagttgaaggagttctcggattcacttccgtgggacaatatcgacaattgcgt

SEQ ID NO: 253794 - DNA, 75 bp, Artificial Sequence
  Synthetic
ccaaccactattatatgattacagtaccttgactaaagtctctagtcacaagatcaatactaccaacctacgcta

SEQ ID NO: 253795 - DNA, 75 bp, Artificial Sequence
  Synthetic
aatgactccatgaaaaccgccaaagaactttgtgcaataattggactttgtactcaatcagctattgtcactgga

SEQ ID NO: 253796 - DNA, 75 bp, Artificial Sequence
  Synthetic
aactttgtgcaataattggactttgtactcaatcagctattgtcactggaagagtcttcaatgataagtatatcg

SEQ ID NO: 253797 - DNA, 75 bp, Artificial Sequence
  Synthetic
aatactaaatctccttcatgctctctcactaatactcttactcactacactttttatcatcttatgatgaatgat

SEQ ID NO: 253798 - DNA, 75 bp, Artificial Sequence
  Synthetic
tgccttcatcatttttcgtggaatataatataggaataattagcaccagaatagctatggatatctcgttaagaa

SEQ ID NO: 253799 - DNA, 75 bp, Artificial Sequence
  Synthetic
taatataggaataattagcaccagaatagctatggatatctcgttaagaatattctcgataagagacataatgta

SEQ ID NO: 253800 - DNA, 75 bp, Artificial Sequence
  Synthetic
gatgacgaaagttatcattatcttaggattcttgattattaatacaaattcgttgtgtctatgaaatgtgaacaa

SEQ ID NO: 253801 - DNA, 75 bp, Artificial Sequence
  Synthetic
gatatcattaaaccaacattgagattggctcttatgttagctggattgaattactgtaataaatgcatcgagtat

SEQ ID NO: 253802 - DNA, 75 bp, Artificial Sequence
  Synthetic
agagggatatagcaattctcgataatagtcatgcaatatttgaatgagactgataatttaggtaatacagtacta

SEQ ID NO: 253803 - DNA, 75 bp, Artificial Sequence
  Synthetic
tatcgttaaaaatctgtaagaggtatatttctcataagtatccactgtgtaatattattaatggatatatagata

SEQ ID NO: 253804 - DNA, 75 bp, Artificial Sequence
  Synthetic
aaaagatataatcgactatttgtacatatccagatatctatattcctactagtttgctgcgtagttgcatcattg

SEQ ID NO: 253805 - DNA, 75 bp, Artificial Sequence
  Synthetic
agatgaattactaagtaaactacaatcccacaataagtaagaatcaaatatcaaaaactcacttttgatttttct

SEQ ID NO: 253806 - DNA, 75 bp, Artificial Sequence
  Synthetic
tcccacaataagtaagaatcaaatatcaaaaactcacttttgatttttctagtcttaagtaatacatatatttat

SEQ ID NO: 253807 - DNA, 75 bp, Artificial Sequence
  Synthetic
taacaatggattcgcgtatagctatttacgtattagtatcggcatctcttttgtatcttgttaattgtcacaaac

SEQ ID NO: 253808 - DNA, 75 bp, Artificial Sequence
  Synthetic
caacggcaacagctgcagtatttttatactttgaatgcatcggacatttatacaagggagtcctgttctaatatt

SEQ ID NO: 253809 - DNA, 75 bp, Artificial Sequence
  Synthetic
caattatgacctttgatggaaaggatatttatccatctatcgcgttcatggtcggtaataaacttttcctagatc

SEQ ID NO: 253810 - DNA, 75 bp, Artificial Sequence
  Synthetic
gtcggtaataaacttttcctagatctttataaaaatatctttgtagaatttttcagactatttcgagtatctgta

SEQ ID NO: 253811 - DNA, 75 bp, Artificial Sequence
  Synthetic
agtagtcaatacgaggaattagaatattattattcatgtgattatactaacaaccgtcctacaattaaacaacat

SEQ ID NO: 253812 - DNA, 75 bp, Artificial Sequence
  Synthetic
cactaataaaaacagttggttaattacttcaggctttagactacaaaaatggttcgatagcgaagattgtataat

SEQ ID NO: 253813 - DNA, 75 bp, Artificial Sequence
  Synthetic
ttatctcagatctttagttagaagaatggaagacagtaacaaaaacagtaaaaaaacttagtacttagatatcga

SEQ ID NO: 253814 - DNA, 75 bp, Artificial Sequence
  Synthetic
aaaaaaatatatttttgtagactcttgagaatagaaggaaaacatgtacataattataaaaaatgaaaatcaatg

SEQ ID NO: 253815 - DNA, 75 bp, Artificial Sequence
  Synthetic
catggagtcggcagatttcatggctgtcgatgagcagtttcacgacgacctcgatctttggtcattatctttggt

SEQ ID NO: 253816 - DNA, 75 bp, Artificial Sequence
  Synthetic
gtcgatgagcagtttcacgacgacctcgatctttggtcattatctttggtagatgactataaaaaacatggatta

SEQ ID NO: 253817 - DNA, 75 bp, Artificial Sequence
  Synthetic
atatgaaaaaaacataactattaagcgctattgcgctattgtgcttaattattttgctctataaactgaatatat

SEQ ID NO: 253818 - DNA, 75 bp, Artificial Sequence
  Synthetic
cagttgttgacaggaaaatatttgatagatttctccttgaaccaatttgtgatcctgtagatgttctgtatgatt

SEQ ID NO: 253819 - DNA, 75 bp, Artificial Sequence
  Synthetic
tagatttctccttgaaccaatttgtgatcctgtagatgttctgtatgattattttaggattcatagagataatat

SEQ ID NO: 253820 - DNA, 75 bp, Artificial Sequence
  Synthetic
tttgcatatattacatataaagatattatatctgcattagtgtcaaagaattatatggaagatattttctctata

SEQ ID NO: 253821 - DNA, 75 bp, Artificial Sequence
  Synthetic
ttatatggaagatattttctctataattattaagaattgtaattctgtacaagatctcttactttactatctatc

SEQ ID NO: 253822 - DNA, 75 bp, Artificial Sequence
  Synthetic
gttgattttatggtagatcatggggctgtaatatataaaatagaatgcttgaatgcctattttaggggaatatgt

SEQ ID NO: 253823 - DNA, 75 bp, Artificial Sequence
  Synthetic
ctgtaatatataaaatagaatgcttgaatgcctattttaggggaatatgtaaaaaggaaagtagtgttgttgagt

SEQ ID NO: 253824 - DNA, 75 bp, Artificial Sequence
  Synthetic
tgaaaatgatgttaaattagatctatataaaataattcagtatactaggggattccttgtagatgaacccacagt

SEQ ID NO: 253825 - DNA, 75 bp, Artificial Sequence
  Synthetic
tataaaataattcagtatactaggggattccttgtagatgaacccacagtattagaaatttataagctttgtatc

SEQ ID NO: 253826 - DNA, 75 bp, Artificial Sequence
  Synthetic
tagatgctggtggaaggaccttgctttatcgcgctatctatgcaggttatatagatttagtatcatggctattag

SEQ ID NO: 253827 - DNA, 75 bp, Artificial Sequence
  Synthetic
ttatcgcgctatctatgcaggttatatagatttagtatcatggctattagaaaatggagcaaatgtcaacgcagt

SEQ ID NO: 253828 - DNA, 75 bp, Artificial Sequence
  Synthetic
gacgtggccgtggataggggatctgtcatcgcccgtagggaagcacatcttaaaatattagaaatattgcttaga

SEQ ID NO: 253829 - DNA, 75 bp, Artificial Sequence
  Synthetic
tcatcgcccgtagggaagcacatcttaaaatattagaaatattgcttagagaaccattgtctattgactgtataa

SEQ ID NO: 253830 - DNA, 75 bp, Artificial Sequence
  Synthetic
agaatagagtcaaaatggtaaaagaaataaatcagacgataagagcagcacaaactcattacgagacattgaaac

SEQ ID NO: 253831 - DNA, 75 bp, Artificial Sequence
  Synthetic
tgaaaaccatgatgtgataaagctctgtatcaagtattttatgatggtagattattcactttgtaatgtgtatgc

SEQ ID NO: 253832 - DNA, 75 bp, Artificial Sequence
  Synthetic
tgtatcaagtattttatgatggtagattattcactttgtaatgtgtatgcatcatcactctttgattatataatt

SEQ ID NO: 253833 - DNA, 75 bp, Artificial Sequence
  Synthetic
ttaggcagatgaaaattcataatacaaccatgtatgagttaatctataatagagacaaaaacaagcatgcttccc

SEQ ID NO: 253834 - DNA, 75 bp, Artificial Sequence
  Synthetic
aaccatgtatgagttaatctataatagagacaaaaacaagcatgcttcccatattctacataggtattctaaaca

SEQ ID NO: 253835 - DNA, 75 bp, Artificial Sequence
  Synthetic
aaaggattcaagatttacacagaagtaaccgagcaggtcactaaagctctaaacagacgtgctctaatagatgag

SEQ ID NO: 253836 - DNA, 75 bp, Artificial Sequence
  Synthetic
taaccgagcaggtcactaaagctctaaacagacgtgctctaatagatgagataataaacaatgtatcaactgatg

SEQ ID NO: 253837 - DNA, 75 bp, Artificial Sequence
  Synthetic
tagtcataagttagttaagtcataagttagttttataagttagtttatagtctaacacttctaatttttatacct

SEQ ID NO: 253838 - DNA, 75 bp, Artificial Sequence
  Synthetic
taacgatagtatgtggtacgtacctaacgcatttatggacgacggtgataatgaaggtcacatttctgtcaataa

SEQ ID NO: 253839 - DNA, 75 bp, Artificial Sequence
  Synthetic
aacgcatttatggacgacggtgataatgaaggtcacatttctgtcaataatgtctgtcatatgtatctcgcattc

SEQ ID NO: 253840 - DNA, 75 bp, Artificial Sequence
  Synthetic
tgtttaaattagttattaaacactgcgatctgaataaacgactaaaatgtggtaactctccattacattgctata

SEQ ID NO: 253841 - DNA, 75 bp, Artificial Sequence
  Synthetic
cgatctgaataaacgactaaaatgtggtaactctccattacattgctatacgatgaatacacgatttaatccatc

SEQ ID NO: 253842 - DNA, 75 bp, Artificial Sequence
  Synthetic
ggcatgcgtaactttgatagcaaggataaaaaaggacatattcctctacaccactatctgattcattcactatca

SEQ ID NO: 253843 - DNA, 75 bp, Artificial Sequence
  Synthetic
ataaaaaaggacatattcctctacaccactatctgattcattcactatcaatcgataacaagatctttgatatac

SEQ ID NO: 253844 - DNA, 75 bp, Artificial Sequence
  Synthetic
taaatcatccgatctattgctgtgttatcttagatataaattcaatgggagcttaaactattacgttctgtacaa

SEQ ID NO: 253845 - DNA, 75 bp, Artificial Sequence
  Synthetic
tatcttagatataaattcaatgggagcttaaactattacgttctgtacaaattattgactaaaggatctgaccct

SEQ ID NO: 253846 - DNA, 75 bp, Artificial Sequence
  Synthetic
taagttagttaagtcataagttagttaagtcataagttagttaagtcataagttagttaagtcataagttagtta

SEQ ID NO: 253847 - DNA, 75 bp, Artificial Sequence
  Synthetic
cttctcttcattactactgtaaacacatatccgtgttccacgaaagcaattattacaagtcaaagagtcacacta

SEQ ID NO: 253848 - DNA, 75 bp, Artificial Sequence
  Synthetic
catatccgtgttccacgaaagcaattattacaagtcaaagagtcacactaagatgcgagctgagaagcgattcat

SEQ ID NO: 253849 - DNA, 75 bp, Artificial Sequence
  Synthetic
aacattaacgcggttacgaaaatcggaaatacgccgttacacacttaccttcaacagtataccaaacatagtcct

SEQ ID NO: 253850 - DNA, 75 bp, Artificial Sequence
  Synthetic
gaaatacgccgttacacacttaccttcaacagtataccaaacatagtcctcgtgtggtgtatgctcttttatctc

SEQ ID NO: 253851 - DNA, 75 bp, Artificial Sequence
  Synthetic
taatcttgattgtacacccatcatggaatacataaagaacgattgtgcaacaggtcatattctcataatgttact

SEQ ID NO: 253852 - DNA, 75 bp, Artificial Sequence
  Synthetic
gaatacataaagaacgattgtgcaacaggtcatattctcataatgttactcaattggcacgaacaaaaatacggg

SEQ ID NO: 253853 - DNA, 75 bp, Artificial Sequence
  Synthetic
atctactttatctattcataaaacataatcaaggatatggaagtcgctctctcaatatactacggtatctactag

SEQ ID NO: 253854 - DNA, 75 bp, Artificial Sequence
  Synthetic
taatcaaggatatggaagtcgctctctcaatatactacggtatctactagatagattcgacattcagaaagacga

SEQ ID NO: 253855 - DNA, 75 bp, Artificial Sequence
  Synthetic
tttctagtactttaggttcattgttatccattgcagaggacgtcatgatcgaataccaaaaaaaaatatattatt

SEQ ID NO: 253856 - DNA, 75 bp, Artificial Sequence
  Synthetic
cataccgccttccagaattgcaataacaatgttgcctcatacctcgtatacatcggatacgacatcaaccttccg

SEQ ID NO: 253857 - DNA, 75 bp, Artificial Sequence
  Synthetic
acaatgttgcctcatacctcgtatacatcggatacgacatcaaccttccgactaaagacgataagacagtattcg

SEQ ID NO: 253858 - DNA, 75 bp, Artificial Sequence
  Synthetic
catatacaaggcggatgtcgttaatgacatcatccaccacagactgaaagtatctctacctatgattaaatcgtt

SEQ ID NO: 253859 - DNA, 75 bp, Artificial Sequence
  Synthetic
gacatcatccaccacagactgaaagtatctctacctatgattaaatcgttgttctacaagatgtcggagttctct

SEQ ID NO: 253860 - DNA, 75 bp, Artificial Sequence
  Synthetic
agataatagcctactgcctattaagggacgagtcatttgcggaactacatactaaattctgtttaaacgaggact

SEQ ID NO: 253861 - DNA, 75 bp, Artificial Sequence
  Synthetic
ggacgagtcatttgcggaactacatactaaattctgtttaaacgaggactataaaagtgtatttatgaaaaatat

SEQ ID NO: 253862 - DNA, 75 bp, Artificial Sequence
  Synthetic
atcgaaaaatgtagtcgtgacataagtctcctcaaagagattcgaatctcagacaccaacttgtatacggtattg

SEQ ID NO: 253863 - DNA, 75 bp, Artificial Sequence
  Synthetic
gtctcctcaaagagattcgaatctcagacaccaacttgtatacggtattgagaacagaagacatccggtatcaca

SEQ ID NO: 253864 - DNA, 75 bp, Artificial Sequence
  Synthetic
caaacgcatttcatttcccatgtacgacgatctcatagaacagtgtcatctatcgatggagcataaaagtaaact

SEQ ID NO: 253865 - DNA, 75 bp, Artificial Sequence
  Synthetic
gacgatctcatagaacagtgtcatctatcgatggagcataaaagtaaactcgtcgacaaagcactcaataaatta

SEQ ID NO: 253866 - DNA, 75 bp, Artificial Sequence
  Synthetic
gactatcgtatttgcctccggaaattatgcgcaatatcataaccaagctaagcgactaccatctaaacagtatgt

SEQ ID NO: 253867 - DNA, 75 bp, Artificial Sequence
  Synthetic
ttatccatgatagaaagaaaatatttaaaaaataatctatatgattggagaagtaggaaacaaacagtaacaaga

SEQ ID NO: 253868 - DNA, 75 bp, Artificial Sequence
  Synthetic
tgaggtccgtattatactcgtatatattgtttctctcatgtataataataaacggaagagatatagcaccacatg

SEQ ID NO: 253869 - DNA, 75 bp, Artificial Sequence
  Synthetic
attgtttctctcatgtataataataaacggaagagatatagcaccacatgcaccatccaatggaaaatgtaaaga

SEQ ID NO: 253870 - DNA, 75 bp, Artificial Sequence
  Synthetic
tgttgtctatcgtgtcctccgggaacttacgcttccagattatgtgatagcaagactaatacacaatgtacgccg

SEQ ID NO: 253871 - DNA, 75 bp, Artificial Sequence
  Synthetic
cttacgcttccagattatgtgatagcaagactaatacacaatgtacgccgtgtggttcggatacctttacatctc

SEQ ID NO: 253872 - DNA, 75 bp, Artificial Sequence
  Synthetic
aagttgtaacggaagatgtgatagtaatcaggtagagacgcgatcgtgtaacacgactcacaatagaatctgtga

SEQ ID NO: 253873 - DNA, 75 bp, Artificial Sequence
  Synthetic
aatcaggtagagacgcgatcgtgtaacacgactcacaatagaatctgtgaatgctctccaggatattattgtctt

SEQ ID NO: 253874 - DNA, 75 bp, Artificial Sequence
  Synthetic
catgtatttctaaaacaaagtgtggaataggatacggagtatccggatacacgtctaccggagacgtcatctgtt

SEQ ID NO: 253875 - DNA, 75 bp, Artificial Sequence
  Synthetic
acgtctaccggagacgtcatctgttctccgtgtggtcccggaacatattctcacaccgtctcttccacagataaa

SEQ ID NO: 253876 - DNA, 75 bp, Artificial Sequence
  Synthetic
ctataagatcaggatccatgttcgagcatactagccatgtatatttgtaacttcgtcatacagcgttagatcaat

SEQ ID NO: 253877 - DNA, 75 bp, Artificial Sequence
  Synthetic
ttaactatatcgatgtggaaattaacctgtatccagtcaacgacacatcgtgtactcggacgaccactaccggtc

SEQ ID NO: 253878 - DNA, 75 bp, Artificial Sequence
  Synthetic
cctgtatccagtcaacgacacatcgtgtactcggacgaccactaccggtctcagcgaatccatctcaacgtcgga

SEQ ID NO: 253879 - DNA, 75 bp, Artificial Sequence
  Synthetic
gattgtgatcccgtctttcgtgcagaatacttctctgtccttaataatgtagcaacttcaggattctttacagga

SEQ ID NO: 253880 - DNA, 75 bp, Artificial Sequence
  Synthetic
aatacttctctgtccttaataatgtagcaacttcaggattctttacaggagaaaatagatatcagaatacttcaa

SEQ ID NO: 253881 - DNA, 75 bp, Artificial Sequence
  Synthetic
taaatgtaacaacaaagattcatcttccaaacagttaacgaaaacaaagaatgatactatcatgccgcattcaga

SEQ ID NO: 253882 - DNA, 75 bp, Artificial Sequence
  Synthetic
atagccatatgcccgctagttgtgatatacataaactgatcactaattcccagaatcccacccacttatagtaag

SEQ ID NO: 253883 - DNA, 75 bp, Artificial Sequence
  Synthetic
ttttttttacccataaataataaatacaataattaatttctcgtaaaagtagaaaatatattctaatttattata

SEQ ID NO: 253884 - DNA, 75 bp, Artificial Sequence
  Synthetic
agaaaatatattctaatttattatatggtaagaaagtagaatcatctagaacagtaatcaatcaatagcaatcat

SEQ ID NO: 253885 - DNA, 75 bp, Artificial Sequence
  Synthetic
tggtaagaaagtagaatcatctagaacagtaatcaatcaatagcaatcatgaaacaatatattgtcctggcatgc

SEQ ID NO: 253886 - DNA, 75 bp, Artificial Sequence
  Synthetic
ctactagtcttcaacaatcctcatcctcgtgtactgaagaagaaaacaaacatcatatgggaatcgatgttatta

SEQ ID NO: 253887 - DNA, 75 bp, Artificial Sequence
  Synthetic
tcaaagtcacaaagcaagaccaaacaccgaccaatgataagatttgtcaatccgtaacggaagttacagagaccg

SEQ ID NO: 253888 - DNA, 75 bp, Artificial Sequence
  Synthetic
tgaggtatccgaagaagttgtaaaaggagatcccaccacttattacactatcgtcggcgcgggtcttaacatgaa

SEQ ID NO: 253889 - DNA, 75 bp, Artificial Sequence
  Synthetic
ggagatcccaccacttattacactatcgtcggcgcgggtcttaacatgaactttggattcaccaaatgcccaaag

SEQ ID NO: 253890 - DNA, 75 bp, Artificial Sequence
  Synthetic
atggaaacactgtgaatactagattgtccagcgtgtcaccaggacaaggtaaggactctcccgcgatcacgcgtg

SEQ ID NO: 253891 - DNA, 75 bp, Artificial Sequence
  Synthetic
gtccagcgtgtcaccaggacaaggtaaggactctcccgcgatcacgcgtgaagaagctctggctatgatcaaaga

SEQ ID NO: 253892 - DNA, 75 bp, Artificial Sequence
  Synthetic
tgtagcgaagaagagaaagacagcgacatcaagacccatccagtacttgggtctaacatctcacataagaaagtg

SEQ ID NO: 253893 - DNA, 75 bp, Artificial Sequence
  Synthetic
acatcaagacccatccagtacttgggtctaacatctcacataagaaagtgagttacaaagatatcatcggttcaa

SEQ ID NO: 253894 - DNA, 75 bp, Artificial Sequence
  Synthetic
gaacctagagtttagcgtacgtatcggagacatgtgtgaggaatcatctgaacttgaagtcaaggatggattcaa

SEQ ID NO: 253895 - DNA, 75 bp, Artificial Sequence
  Synthetic
ggagacatgtgtgaggaatcatctgaacttgaagtcaaggatggattcaagtatgtcgacggatcggcatctgaa

SEQ ID NO: 253896 - DNA, 75 bp, Artificial Sequence
  Synthetic
tcgattcaacaaaactcaaagcatgtgtctgaatcgataactctattcatctgaaaatggatgagttgggttaat

SEQ ID NO: 253897 - DNA, 75 bp, Artificial Sequence
  Synthetic
tttaactacattcacaaaaagttacctctcgttacttcttctttctgtttcaatatgtgatacgatatgatcact

SEQ ID NO: 253898 - DNA, 75 bp, Artificial Sequence
  Synthetic
caatatgtgatacgatatgatcactattcgtattctctttctctcttgtctcataaaaaagttttacaaaaaaat

SEQ ID NO: 253899 - DNA, 75 bp, Artificial Sequence
  Synthetic
tggtctcacaaaaatattaaacctctttctgatgtctcaactatttcgtaaacgataacgtccaacaatatattc

SEQ ID NO: 253900 - DNA, 75 bp, Artificial Sequence
  Synthetic
tttctgatgtctcaactatttcgtaaacgataacgtccaacaatatattctcgtagagcttatcaatatccttat

SEQ ID NO: 253901 - DNA, 75 bp, Artificial Sequence
  Synthetic
cataaaataatgtttataatttacacgttaacatcatataataaacgtatatagttaatatttttggaatataaa

SEQ ID NO: 253902 - DNA, 75 bp, Artificial Sequence
  Synthetic
cataatttcacacaagtttttatacagacaaattaattctcgtccatatattttaaaacattgacttttgtacta

SEQ ID NO: 253903 - DNA, 75 bp, Artificial Sequence
  Synthetic
agaaaaatatcttgactaaccatctctttctctcgtcgatgggtctcacaaaaatattaaacctctttctgatgg

SEQ ID NO: 253904 - DNA, 75 bp, Artificial Sequence
  Synthetic
aaaatattaaacctctttctgatggagtcgtaaaaagtttttatcctttctctcttcgatgggtctcacaaaaat

SEQ ID NO: 253905 - DNA, 75 bp, Artificial Sequence
  Synthetic
tcgatgggtctcacaaaaatattaaacctctttctgatggagtcgtaaaaagtttttatcctttctctcttcgat

SEQ ID NO: 253906 - DNA, 75 bp, Artificial Sequence
  Synthetic
aaaaaaaaatatttttattctctttctctcttcgatggtctcacaaaaatattaaacctctttctgatgtctcaa

SEQ ID NO: 253907 - DNA, 75 bp, Artificial Sequence
  Synthetic
agttgagacatcagaaagaggtttaatatttttgtgagaccatcgaagagagaaagagaataaaaatattttttt

SEQ ID NO: 253908 - DNA, 75 bp, Artificial Sequence
  Synthetic
aaacagaaagaagaagtaacgagaggtaactttttgtgaatgtagttaaatatttttgttttgcaaaccggaata

SEQ ID NO: 253909 - DNA, 75 bp, Artificial Sequence
  Synthetic
tttcattttttataattttgtcatattgtaccagaattaataatatctctaatagatctgattagtagatacatg

SEQ ID NO: 253910 - DNA, 75 bp, Artificial Sequence
  Synthetic
ttttatatcactacggacataaaccattgtataatttttatgtttattagtgtacacattttggaagtaagttcc

SEQ ID NO: 253911 - DNA, 75 bp, Artificial Sequence
  Synthetic
tgcagtatttttatactttgaatgcattcggacatttatacaagggagtcctgttctaatattggcatcaatgtt

SEQ ID NO: 253912 - DNA, 75 bp, Artificial Sequence
  Synthetic
tcacgacaccattaaaaatggaaattaaagccctctattaagcacagacggctacaggtctaccatcaggttaac

SEQ ID NO: 253913 - DNA, 75 bp, Artificial Sequence
  Synthetic
actaacttatgacttaactaacttacttataaaactaacttatgacttaactaacttatgacttaactaacttat

SEQ ID NO: 253914 - DNA, 75 bp, Artificial Sequence
  Synthetic
taaaaagtttttatcctttctctcgtcgatgggtctcacaaaaatattaaacctctttctgatggtctctataaa

SEQ ID NO: 253915 - DNA, 75 bp, Artificial Sequence
  Synthetic
attgattttcattttttataattatgtacatgttttccttctattctcaagagtctacaaaaatatatttttttt

SEQ ID NO: 253916 - DNA, 75 bp, Artificial Sequence
  Synthetic
ctttaataatttggctatacatctgttcaatactatctattgatgatttcttttttaagacttaaactagttatg

SEQ ID NO: 253917 - DNA, 75 bp, Artificial Sequence
  Synthetic
tcagaaaagtcaaatattgtatccatacatctccaaaactatcacttatacgtttatctttaacgaacatatacc

SEQ ID NO: 253918 - DNA, 75 bp, Artificial Sequence
  Synthetic
tgatggttatttactaacagacatttttcaagatctattgacaataactcctatagtttccacatcaaccaagta

SEQ ID NO: 253919 - DNA, 75 bp, Artificial Sequence
  Synthetic
agttggttttgccggctacaacgatcctccgtaggaagcgttggtgtcttggacattgccgagttgaaaccttgg

SEQ ID NO: 253920 - DNA, 75 bp, Artificial Sequence
  Synthetic
tttccggctggaaaccacgtcgctcttcgtcaaatgacgaaaggcaaaatgaaaaacgcgaataaaaagaaagca

SEQ ID NO: 253921 - DNA, 75 bp, Artificial Sequence
  Synthetic
aaaaactctaagaccaatcctggtcgaagtggcagaagtaatggaatggatttggttatgggaatcatgcacttt

SEQ ID NO: 253922 - DNA, 75 bp, Artificial Sequence
  Synthetic
gccactcatattgcaatgggaatgaaggtcaacaagagactgaaaaccttttggaaggtgacgcccccaggtaga

SEQ ID NO: 253923 - DNA, 75 bp, Artificial Sequence
  Synthetic
ttggctaagggaataacaaggctgatcaacatcctaaaaactcttctgaatgcagtattgggtagaaagaaacaa

SEQ ID NO: 253924 - DNA, 75 bp, Artificial Sequence
  Synthetic
aggtctgccaagacggtgtgggttctcttcagcatgttggctttgatggtggccatggagattgagcaacagggc

SEQ ID NO: 253925 - DNA, 75 bp, Artificial Sequence
  Synthetic
acgtcattagtcattaagcctcaaaggagtgatgttggacggccagttcgagttagcacaggctactgcatgttc

SEQ ID NO: 253926 - DNA, 75 bp, Artificial Sequence
  Synthetic
tccgctatggacattgggataacgtgtgagaaaaccatacagtatgagtgtgttactttaaccacatctgaagag

SEQ ID NO: 253927 - DNA, 75 bp, Artificial Sequence
  Synthetic
ccgtttgatgttgattgttactgtaggaatgtcacaaatgtgttggttgagtattcaacgtgcaatccaacagtg

SEQ ID NO: 253928 - DNA, 75 bp, Artificial Sequence
  Synthetic
gaacgtgcaaaaaggtctctggtgatccaagatcacccacactctgaaactgtggctaaaccaacactgtggctg

SEQ ID NO: 253929 - DNA, 75 bp, Artificial Sequence
  Synthetic
aaatggaatacagttaatgatcgagtgggcatgactgaggaatgggtgatgagaaatacctggaaggcaacaatt

SEQ ID NO: 253930 - DNA, 75 bp, Artificial Sequence
  Synthetic
cttaccctggctattatagctgtcactggactcaactggaaaggagtcctcttattggtagttgccttgatgttt

SEQ ID NO: 253931 - DNA, 75 bp, Artificial Sequence
  Synthetic
gccccaaatttggctaccaattgtgtttctatccagaagagggacatcctaagaggatcaggctctacaacgtgg

SEQ ID NO: 253932 - DNA, 75 bp, Artificial Sequence
  Synthetic
tttgacgttcttcttgaaaaggggtcatgtgtgaccatagtggctgatgacagaccaacagttgacatctggctt

SEQ ID NO: 253933 - DNA, 75 bp, Artificial Sequence
  Synthetic
gacagaatcactcatgaatctccgattgctggaagggaatactgcatgagagttgacatttcaggattgaaaatt

SEQ ID NO: 253934 - DNA, 75 bp, Artificial Sequence
  Synthetic
gcaactcgctgtccaacgttaggtgaggcgtacctgagtgaagaacacacagaagattacgtgtgcaagagaggt

SEQ ID NO: 253935 - DNA, 75 bp, Artificial Sequence
  Synthetic
ttcagtgataggggatggggtaatggctgtggcttgtttggcaaaggaagtatcgtgggctgtgtgaaaacaaca

SEQ ID NO: 253936 - DNA, 75 bp, Artificial Sequence
  Synthetic
tgcaagagctcaggaatagccaagagttattcatatgacattcccaaagtgaaatatgtgatttccactgaagtc

SEQ ID NO: 253937 - DNA, 75 bp, Artificial Sequence
  Synthetic
cataagggtgaattgatttcaggaaatgtctcagccagtgtcgtgagtgctacattctcttctgaggctgaaaag

SEQ ID NO: 253938 - DNA, 75 bp, Artificial Sequence
  Synthetic
cacagcatggaactggaagattatggaagattggaatttacttgccgagttgtttcaggaagcaatcttggcagt

SEQ ID NO: 253939 - DNA, 75 bp, Artificial Sequence
  Synthetic
gtgagaattcttgagattgacaaccattatttcaatgtccatgaagattggctattagatctgcctcttccttgg

SEQ ID NO: 253940 - DNA, 75 bp, Artificial Sequence
  Synthetic
agaatacctgatggacactggcatgatttgggaaaactcatagccttcaaagaacctcatgcggtaaagatggtt

SEQ ID NO: 253941 - DNA, 75 bp, Artificial Sequence
  Synthetic
gtgcaagcttatggtgatcagagagcctcacttcttaaatctttggtaaaggctgaagaaattgcaaaatccggt

SEQ ID NO: 253942 - DNA, 75 bp, Artificial Sequence
  Synthetic
aacagttattacctccctggagggcatgttgattgccgagttagcctagtgaacctgaagctaaagggaacaact

SEQ ID NO: 253943 - DNA, 75 bp, Artificial Sequence
  Synthetic
tacccttattgtggtgactcattcgtttggaagcggcgccctacggctacccatcatggtacagttgcaatggaa

SEQ ID NO: 253944 - DNA, 75 bp, Artificial Sequence
  Synthetic
gtcacctaccaaggaactgatgttccgtgcaaggtatctgttatcgtggaaaaagatggacagaacggaggtaat

SEQ ID NO: 253945 - DNA, 75 bp, Artificial Sequence
  Synthetic
gcaggaagtttgattacatcaaatccaatcatcacagcacaagggtcatcagtgttcttagaactggaggttcca

SEQ ID NO: 253946 - DNA, 75 bp, Artificial Sequence
  Synthetic
ctgggtttttccactattaaggttggtgcagcaaaacagcaatggagacaggatggcagttcaataggaaaagct

SEQ ID NO: 253947 - DNA, 75 bp, Artificial Sequence
  Synthetic
atggctagagcctcaagagcttttgagcaaacattgatgacagctgggtcctattggcagtcaacggatacagtg

SEQ ID NO: 253948 - DNA, 75 bp, Artificial Sequence
  Synthetic
acttcatttagtctgatgagaatgatcagagcaccacttgccatgctctttggagatgttggtttcatgggaaaa

SEQ ID NO: 253949 - DNA, 75 bp, Artificial Sequence
  Synthetic
atgatcatttccatagtgtgtatctggtttgctatgaactcaagaaacatgactttgagtttggttctgggagtg

SEQ ID NO: 253950 - DNA, 75 bp, Artificial Sequence
  Synthetic
ctggggtttggtctcctagcgttcacaactggagtaatgggagatcaaggctgtgttttagacatctcaaggaaa

SEQ ID NO: 253951 - DNA, 75 bp, Artificial Sequence
  Synthetic
gagatgaaatgtggtgatggcttgatgatttggaatgaaatcaatgacttcaagcatggttacaagtattatcct

SEQ ID NO: 253952 - DNA, 75 bp, Artificial Sequence
  Synthetic
gaggacccagaaacattcctggcaagtttggttcaagacggtgaaaaacactgtgggtatcaaccttcaaacctg

SEQ ID NO: 253953 - DNA, 75 bp, Artificial Sequence
  Synthetic
atagagttgcgaatgtggcagtctctagaaaaggaattgaacctttacttggaagaccagaaaatagggtggaac

SEQ ID NO: 253954 - DNA, 75 bp, Artificial Sequence
  Synthetic
atcaaggtagcagaagagatgaaacattttccaaaaaccattaatgtgggttgggaaaggaggcaaggaaggaca

SEQ ID NO: 253955 - DNA, 75 bp, Artificial Sequence
  Synthetic
ggcctcacttggacaaactggatgaaatcaatgcctggaatacaccatttcatgaacaaaaacactgacttaaca

SEQ ID NO: 253956 - DNA, 75 bp, Artificial Sequence
  Synthetic
ggaacctattttgttggaagcattgggttggacgagtgcccagcatccaaccgaagctggaatgcatttaaagtg

SEQ ID NO: 253957 - DNA, 75 bp, Artificial Sequence
  Synthetic
gctgagtttggcgtgggcctggttcatacaagagcttttattgacattaggaatcaaccatccttaacctgtgac

SEQ ID NO: 253958 - DNA, 75 bp, Artificial Sequence
  Synthetic
ctaggtttgataggttcagcagcaaaagacagaatgattgtgcatggctctccttggatgtggatggagagctat

SEQ ID NO: 253959 - DNA, 75 bp, Artificial Sequence
  Synthetic
gaagtgaatggaactgtgcaactacaaaagttgactctcacccacacagttgaatgtctctggccaattacacac

SEQ ID NO: 253960 - DNA, 75 bp, Artificial Sequence
  Synthetic
actcttggaaacagaatggttttggactccaaattgatattgccaaaagaaatgggaggtccagcttctatcttg

SEQ ID NO: 253961 - DNA, 75 bp, Artificial Sequence
  Synthetic
aatatggttgaaggctattcagaacaaaacaagtgtccctggaatcaaggtcctgtgacagtggaaagaggttat

SEQ ID NO: 253962 - DNA, 75 bp, Artificial Sequence
  Synthetic
tgtgaagggactgaagttgagatatccgaagactgtgaagaaaggggaccttgtacgaggtcaaaaacccaagga

SEQ ID NO: 253963 - DNA, 75 bp, Artificial Sequence
  Synthetic
ggaacaaccataccacactggtgctgccgtgaatgtaagctccctcctttgaaatttacaaatcctgatggttgc

SEQ ID NO: 253964 - DNA, 75 bp, Artificial Sequence
  Synthetic
tggtatgcaatggaaattagacctgttaaagctcatgtgggtctagtgtcagcacagaatgaaatgtctcccctg

SEQ ID NO: 253965 - DNA, 75 bp, Artificial Sequence
  Synthetic
gatgcccgatgctggggtgtgttttccattctggttctttactacctaggcattctaacaaagattgaaaaaggg

SEQ ID NO: 253966 - DNA, 75 bp, Artificial Sequence
  Synthetic
aattggggaccttccttgattgtcacaatctccatcatgatgtggttacatatcatcgatgtaactgaattgttg

SEQ ID NO: 253967 - DNA, 75 bp, Artificial Sequence
  Synthetic
cattacttgttggctgttggttacacatttgtctggcaaacatctgagcccatgctgtggattgtggccatgcaa

SEQ ID NO: 253968 - DNA, 75 bp, Artificial Sequence
  Synthetic
gctatttttcagttgagacctgggtttgctgtagggttcgccctgtgcaaaacctggaggtttgaacggattgtc

SEQ ID NO: 253969 - DNA, 75 bp, Artificial Sequence
  Synthetic
ggcatggttgcttgcatgtggacaattcaagagttaacaactccatatgaagccttttggagatttatggatgca

SEQ ID NO: 253970 - DNA, 75 bp, Artificial Sequence
  Synthetic
ctgggcttgcttgtgtatgcttactcagcctcccactcaacacgacagagttatctctatgtcgtcttgatgcta
